United States Patent 7,691,997 (FUNCTIONAL AND HYPERFUNCTIONAL SIRNA) - sequence listing, part 36

SEQ ID NO: 1461101 - RNA, 19 nt, Homo sapiens
gcaagugacagugaagcua

SEQ ID NO: 1461102 - RNA, 19 nt, Homo sapiens
uuacacagaagaugccaua

SEQ ID NO: 1461103 - RNA, 19 nt, Homo sapiens
cauagcaagugacagugaa

SEQ ID NO: 1461104 - RNA, 19 nt, Homo sapiens
guacuugugugauguuuug

SEQ ID NO: 1461105 - RNA, 19 nt, Homo sapiens
aaauauacccaaagcaaug

SEQ ID NO: 1461106 - RNA, 19 nt, Homo sapiens
auaacucgcuucauagcaa

SEQ ID NO: 1461107 - RNA, 19 nt, Homo sapiens
guggcugucuucauucuau

SEQ ID NO: 1461108 - RNA, 19 nt, Homo sapiens
ccacugggaggucuuaaug

SEQ ID NO: 1461109 - RNA, 19 nt, Homo sapiens
uugaagauguuuagugcaa

SEQ ID NO: 1461110 - RNA, 19 nt, Homo sapiens
ugguauuucugccuuaauu

SEQ ID NO: 1461111 - RNA, 19 nt, Homo sapiens
cgagguaccaauauaguug

SEQ ID NO: 1461112 - RNA, 19 nt, Homo sapiens
ccaggaagcggugaagaaa

SEQ ID NO: 1461113 - RNA, 19 nt, Homo sapiens
guaccaauauaguuguucu

SEQ ID NO: 1461114 - RNA, 19 nt, Homo sapiens
ugccugagguuguuuagug

SEQ ID NO: 1461115 - RNA, 19 nt, Homo sapiens
gaaaauuugugcccuugau

SEQ ID NO: 1461116 - RNA, 19 nt, Homo sapiens
ucucaaguauguccagugu

SEQ ID NO: 1461117 - RNA, 19 nt, Homo sapiens
ccagaucuguggcugucuu

SEQ ID NO: 1461118 - RNA, 19 nt, Homo sapiens
caagugacagugaagcuau

SEQ ID NO: 1461119 - RNA, 19 nt, Homo sapiens
aauucgagguaccaauaua

SEQ ID NO: 1461120 - RNA, 19 nt, Homo sapiens
gaauacauaacucgcuuca

SEQ ID NO: 1461121 - RNA, 19 nt, Homo sapiens
gaauucgagguaccaauau

SEQ ID NO: 1461122 - RNA, 19 nt, Homo sapiens
ucuauaauuuguccagugu

SEQ ID NO: 1461123 - RNA, 19 nt, Homo sapiens
acugggaggucuuaauguu

SEQ ID NO: 1461124 - RNA, 19 nt, Homo sapiens
acagugaagcuaucaaguu

SEQ ID NO: 1461125 - RNA, 19 nt, Homo sapiens
gcaauggacgaagaccuuu

SEQ ID NO: 1461126 - RNA, 19 nt, Homo sapiens
uagcaacuuuaaagcagaa

SEQ ID NO: 1461127 - RNA, 19 nt, Homo sapiens
acaagaggaaugugcuuaa

SEQ ID NO: 1461128 - RNA, 19 nt, Homo sapiens
guguucgguuuguuacaua

SEQ ID NO: 1461129 - RNA, 19 nt, Homo sapiens
gaaagaacugugaggaaaa

SEQ ID NO: 1461130 - RNA, 19 nt, Homo sapiens
uaacaggaugcuacaugaa

SEQ ID NO: 1461131 - RNA, 19 nt, Homo sapiens
cacauaagccugagacucu

SEQ ID NO: 1461132 - RNA, 19 nt, Homo sapiens
ggacuuacugcugaugcua

SEQ ID NO: 1461133 - RNA, 19 nt, Homo sapiens
aagaugccauagcaaguga

SEQ ID NO: 1461134 - RNA, 19 nt, Homo sapiens
gaaauaucugaguguguau

SEQ ID NO: 1461135 - RNA, 19 nt, Homo sapiens
gacaaaagcauccuuauac

SEQ ID NO: 1461136 - RNA, 19 nt, Homo sapiens
ugacaaaagcauccuuaua

SEQ ID NO: 1461137 - RNA, 19 nt, Homo sapiens
cugagacucuauaauuugu

SEQ ID NO: 1461138 - RNA, 19 nt, Homo sapiens
agccugagacucuauaauu

SEQ ID NO: 1461139 - RNA, 19 nt, Homo sapiens
gccugagguuguuuaguga

SEQ ID NO: 1461140 - RNA, 19 nt, Homo sapiens
ugaagauguuuagugcaaa

SEQ ID NO: 1461141 - RNA, 19 nt, Homo sapiens
ugaugaugaugguaucuca

SEQ ID NO: 1461142 - RNA, 19 nt, Homo sapiens
gcuagaguaguaauaaaca

SEQ ID NO: 1461143 - RNA, 19 nt, Homo sapiens
uauuauggaaggcuuauug

SEQ ID NO: 1461144 - RNA, 19 nt, Homo sapiens
uauaauuuguccagugucu

SEQ ID NO: 1461145 - RNA, 19 nt, Homo sapiens
ccugagacucuauaauuug

SEQ ID NO: 1461146 - RNA, 19 nt, Homo sapiens
agucauaauuccacauaag

SEQ ID NO: 1461147 - RNA, 19 nt, Homo sapiens
cuucauagcaacuuuaaag

SEQ ID NO: 1461148 - RNA, 19 nt, Homo sapiens
guuaaggacauagcuauuc

SEQ ID NO: 1461149 - RNA, 19 nt, Homo sapiens
gaacugugaggaaaauuug

SEQ ID NO: 1461150 - RNA, 19 nt, Homo sapiens
caagauuguaucagacaga

SEQ ID NO: 1461151 - RNA, 19 nt, Homo sapiens
aaaagcauccuuauacuga

SEQ ID NO: 1461152 - RNA, 19 nt, Homo sapiens
acauaagccugagacucua

SEQ ID NO: 1461153 - RNA, 19 nt, Homo sapiens
caaccuuugaagauguuua

SEQ ID NO: 1461154 - RNA, 19 nt, Homo sapiens
uaauccaaaugguccacaa

SEQ ID NO: 1461155 - RNA, 19 nt, Homo sapiens
aagggcaucuuaacaggau

SEQ ID NO: 1461156 - RNA, 19 nt, Homo sapiens
auauugagcugcauuucuc

SEQ ID NO: 1461157 - RNA, 19 nt, Homo sapiens
cuacagagccuuuaacuua

SEQ ID NO: 1461158 - RNA, 19 nt, Homo sapiens
ggaccgcacugauuacaaa

SEQ ID NO: 1461159 - RNA, 19 nt, Homo sapiens
gaauuggaccgcacugauu

SEQ ID NO: 1461160 - RNA, 19 nt, Homo sapiens
gagccaaagcuguccauuu

SEQ ID NO: 1461161 - RNA, 19 nt, Homo sapiens
agauaaggauguguucaua

SEQ ID NO: 1461162 - RNA, 19 nt, Homo sapiens
ugacugggccauugaauug

SEQ ID NO: 1461163 - RNA, 19 nt, Homo sapiens
uguaugagccuuaaagcua

SEQ ID NO: 1461164 - RNA, 19 nt, Homo sapiens
gaucuuaucacgcuuucuu

SEQ ID NO: 1461165 - RNA, 19 nt, Homo sapiens
ccuuaaagcuaccaacaug

SEQ ID NO: 1461166 - RNA, 19 nt, Homo sapiens
uaacagugccgucuagugu

SEQ ID NO: 1461167 - RNA, 19 nt, Homo sapiens
ccaguggaaucucuauuuc

SEQ ID NO: 1461168 - RNA, 19 nt, Homo sapiens
gaaacaccagcuucuaugu

SEQ ID NO: 1461169 - RNA, 19 nt, Homo sapiens
gcuucuaugugacuuaaug

SEQ ID NO: 1461170 - RNA, 19 nt, Homo sapiens
gaaucucuauuuccuggau

SEQ ID NO: 1461171 - RNA, 19 nt, Homo sapiens
aaacacuuccaucagaaua

SEQ ID NO: 1461172 - RNA, 19 nt, Homo sapiens
cagcuucuaugugacuuaa

SEQ ID NO: 1461173 - RNA, 19 nt, Homo sapiens
acaagugacugggccauug

SEQ ID NO: 1461174 - RNA, 19 nt, Homo sapiens
aacaccagcuucuauguga

SEQ ID NO: 1461175 - RNA, 19 nt, Homo sapiens
acacuuccaucagaauauu

SEQ ID NO: 1461176 - RNA, 19 nt, Homo sapiens
ggcagaagaugacaaaaga

SEQ ID NO: 1461177 - RNA, 19 nt, Homo sapiens
auaaggauguguucauaca

SEQ ID NO: 1461178 - RNA, 19 nt, Homo sapiens
caaaacacuuccaucagaa

SEQ ID NO: 1461179 - RNA, 19 nt, Homo sapiens
acagagccuuuaacuuaga

SEQ ID NO: 1461180 - RNA, 19 nt, Homo sapiens
acaaaacacuuccaucaga

SEQ ID NO: 1461181 - RNA, 19 nt, Homo sapiens
ggucaguguaugagccuua

SEQ ID NO: 1461182 - RNA, 19 nt, Homo sapiens
agccaaagcuguccauuuu

SEQ ID NO: 1461183 - RNA, 19 nt, Homo sapiens
cacgcuuucuuucugguua

SEQ ID NO: 1461184 - RNA, 19 nt, Homo sapiens
ccaggucuuugcagggaaa

SEQ ID NO: 1461185 - RNA, 19 nt, Homo sapiens
gaucguguucuacuucaug

SEQ ID NO: 1461186 - RNA, 19 nt, Homo sapiens
aauuggaccgcacugauua

SEQ ID NO: 1461187 - RNA, 19 nt, Homo sapiens
ugaaacaccagcuucuaug

SEQ ID NO: 1461188 - RNA, 19 nt, Homo sapiens
uacagagccuuuaacuuag

SEQ ID NO: 1461189 - RNA, 19 nt, Homo sapiens
aaacuucuacagagccuuu

SEQ ID NO: 1461190 - RNA, 19 nt, Homo sapiens
caagugacugggccauuga

SEQ ID NO: 1461191 - RNA, 19 nt, Homo sapiens
gagccuuuaacuuagauaa

SEQ ID NO: 1461192 - RNA, 19 nt, Homo sapiens
gcacugcuccaggucuuug

SEQ ID NO: 1461193 - RNA, 19 nt, Homo sapiens
cuguauggaucguguucua

SEQ ID NO: 1461194 - RNA, 19 nt, Homo sapiens
uuaagcugcugacccugaa

SEQ ID NO: 1461195 - RNA, 19 nt, Homo sapiens
ccagagaaagagagccaaa

SEQ ID NO: 1461196 - RNA, 19 nt, Homo sapiens
guucaauagccacaaguga

SEQ ID NO: 1461197 - RNA, 19 nt, Homo sapiens
guuagcaggucaguguaug

SEQ ID NO: 1461198 - RNA, 19 nt, Homo sapiens
ccuuauaaacuucuacaga

SEQ ID NO: 1461199 - RNA, 19 nt, Homo sapiens
gauaaggauguguucauac

SEQ ID NO: 1461200 - RNA, 19 nt, Homo sapiens
gugacugggccauugaauu

SEQ ID NO: 1461201 - RNA, 19 nt, Homo sapiens
gucaguguaugagccuuaa

SEQ ID NO: 1461202 - RNA, 19 nt, Homo sapiens
ggaugugaacuacuugaag

SEQ ID NO: 1461203 - RNA, 19 nt, Homo sapiens
aucagaauauuccauccua

SEQ ID NO: 1461204 - RNA, 19 nt, Homo sapiens
ggacagaggggacccacaa

SEQ ID NO: 1461205 - RNA, 19 nt, Homo sapiens
aaacaccagcuucuaugug

SEQ ID NO: 1461206 - RNA, 19 nt, Homo sapiens
ccacaacacagcucacacu

SEQ ID NO: 1461207 - RNA, 19 nt, Homo sapiens
gugacuuaauggaucuuau

SEQ ID NO: 1461208 - RNA, 19 nt, Homo sapiens
uauggaucguguucuacuu

SEQ ID NO: 1461209 - RNA, 19 nt, Homo sapiens
ugacuuaauggaucuuauc

SEQ ID NO: 1461210 - RNA, 19 nt, Homo sapiens
ggccaaccacccacuaaca

SEQ ID NO: 1461211 - RNA, 19 nt, Homo sapiens
gccaagggaaacauccaaa

SEQ ID NO: 1461212 - RNA, 19 nt, Homo sapiens
caaugaaacaccagcuucu

SEQ ID NO: 1461213 - RNA, 19 nt, Homo sapiens
gagaaagagagccaaagcu

SEQ ID NO: 1461214 - RNA, 19 nt, Homo sapiens
ugaauuggaccgcacugau

SEQ ID NO: 1461215 - RNA, 19 nt, Homo sapiens
uuaucacgcuuucuuucug

SEQ ID NO: 1461216 - RNA, 19 nt, Homo sapiens
uagauaaggauguguucau

SEQ ID NO: 1461217 - RNA, 19 nt, Homo sapiens
gaagaugacaaaagaccuu

SEQ ID NO: 1461218 - RNA, 19 nt, Homo sapiens
guguggugaugggugauaa

SEQ ID NO: 1461219 - RNA, 19 nt, Homo sapiens
gacuuaauggaucuuauca

SEQ ID NO: 1461220 - RNA, 19 nt, Homo sapiens
ggaagacaguauucagaaa

SEQ ID NO: 1461221 - RNA, 19 nt, Homo sapiens
cuagguaacuugacaauca

SEQ ID NO: 1461222 - RNA, 19 nt, Homo sapiens
ucaugaagcuggccuguga

SEQ ID NO: 1461223 - RNA, 19 nt, Homo sapiens
gcacuugcgucucucaugu

SEQ ID NO: 1461224 - RNA, 19 nt, Homo sapiens
uaauaggccucccugguuu

SEQ ID NO: 1461225 - RNA, 19 nt, Homo sapiens
ccacuaccauccaguuuga

SEQ ID NO: 1461226 - RNA, 19 nt, Homo sapiens
caguucagcuucuucauga

SEQ ID NO: 1461227 - RNA, 19 nt, Homo sapiens
gaggaagacuggacaaagg

SEQ ID NO: 1461228 - RNA, 19 nt, Homo sapiens
ccaauauccuuucccauuc

SEQ ID NO: 1461229 - RNA, 19 nt, Homo sapiens
ucucauaucugcuuauucu

SEQ ID NO: 1461230 - RNA, 19 nt, Homo sapiens
gcuacauacuucauccuaa

SEQ ID NO: 1461231 - RNA, 19 nt, Homo sapiens
ggcaaugaauccagugcua

SEQ ID NO: 1461232 - RNA, 19 nt, Homo sapiens
ccaauugucuauggaguga

SEQ ID NO: 1461233 - RNA, 19 nt, Homo sapiens
cuacauacuucauccuaau

SEQ ID NO: 1461234 - RNA, 19 nt, Homo sapiens
gaugauauccgggucaaug

SEQ ID NO: 1461235 - RNA, 19 nt, Homo sapiens
ucaagcagcugcccuucug

SEQ ID NO: 1461236 - RNA, 19 nt, Homo sapiens
cagcgcauccuucgacuuu

SEQ ID NO: 1461237 - RNA, 19 nt, Homo sapiens
cuauguaccuuucauugga

SEQ ID NO: 1461238 - RNA, 19 nt, Homo sapiens
gaagcuggccugugaugau

SEQ ID NO: 1461239 - RNA, 19 nt, Homo sapiens
ggccuggacucacuucuca

SEQ ID NO: 1461240 - RNA, 19 nt, Homo sapiens
aagcuggccugugaugaua

SEQ ID NO: 1461241 - RNA, 19 nt, Homo sapiens
ucagugaucaaacuucuuu

SEQ ID NO: 1461242 - RNA, 19 nt, Homo sapiens
caauaucuaucugcugguu

SEQ ID NO: 1461243 - RNA, 19 nt, Homo sapiens
caucuuggccaauaucuau

SEQ ID NO: 1461244 - RNA, 19 nt, Homo sapiens
gagcccauguauauauuuc

SEQ ID NO: 1461245 - RNA, 19 nt, Homo sapiens
acaccaagaugucaugaag

SEQ ID NO: 1461246 - RNA, 19 nt, Homo sapiens
ucuauggagugaagacaaa

SEQ ID NO: 1461247 - RNA, 19 nt, Homo sapiens
ggucacacauuccuuccau

SEQ ID NO: 1461248 - RNA, 19 nt, Homo sapiens
cuaauaggccucccugguu

SEQ ID NO: 1461249 - RNA, 19 nt, Homo sapiens
caacccaauugucuaugga

SEQ ID NO: 1461250 - RNA, 19 nt, Homo sapiens
gcauugacauccucaucuc

SEQ ID NO: 1461251 - RNA, 19 nt, Homo sapiens
gcccauguauauauuucuu

SEQ ID NO: 1461252 - RNA, 19 nt, Homo sapiens
cagagaggcuguauuucag

SEQ ID NO: 1461253 - RNA, 19 nt, Homo sapiens
gccaucuucugguucaauu

SEQ ID NO: 1461254 - RNA, 19 nt, Homo sapiens
gcucaacccaauugucuau

SEQ ID NO: 1461255 - RNA, 19 nt, Homo sapiens
ucucaucuccuucucauau

SEQ ID NO: 1461256 - RNA, 19 nt, Homo sapiens
ggucacaguucagcuucuu

SEQ ID NO: 1461257 - RNA, 19 nt, Homo sapiens
gugcuguguucauauucua

SEQ ID NO: 1461258 - RNA, 19 nt, Homo sapiens
cuccuuaucuggcauggaa

SEQ ID NO: 1461259 - RNA, 19 nt, Homo sapiens
guuugaugcuugucugcua

SEQ ID NO: 1461260 - RNA, 19 nt, Homo sapiens
gaagacaguauucagaaaa

SEQ ID NO: 1461261 - RNA, 19 nt, Homo sapiens
ugugugugcuguguucaua

SEQ ID NO: 1461262 - RNA, 19 nt, Homo sapiens
uccaauauccuuucccauu

SEQ ID NO: 1461263 - RNA, 19 nt, Homo sapiens
ggaggaagacuggacaaag

SEQ ID NO: 1461264 - RNA, 19 nt, Homo sapiens
ugugugcuguguucauauu

SEQ ID NO: 1461265 - RNA, 19 nt, Homo sapiens
ccaaaaugcuggccaucuu

SEQ ID NO: 1461266 - RNA, 19 nt, Homo sapiens
uuauugcugugcuagguaa

SEQ ID NO: 1461267 - RNA, 19 nt, Homo sapiens
gucaucaucuccgccauug

SEQ ID NO: 1461268 - RNA, 19 nt, Homo sapiens
ggaucccaauggcaaugaa

SEQ ID NO: 1461269 - RNA, 19 nt, Homo sapiens
gaucaaacuucuuuuccau

SEQ ID NO: 1461270 - RNA, 19 nt, Homo sapiens
ugaauccagugcuacauac

SEQ ID NO: 1461271 - RNA, 19 nt, Homo sapiens
cccgucaucuuggccaaua

SEQ ID NO: 1461272 - RNA, 19 nt, Homo sapiens
ucaugugugugcuguguuc

SEQ ID NO: 1461273 - RNA, 19 nt, Homo sapiens
ccgggucaaugucgucuau

SEQ ID NO: 1461274 - RNA, 19 nt, Homo sapiens
guaacuugacaaucaucua

SEQ ID NO: 1461275 - RNA, 19 nt, Homo sapiens
aggccucccugguuuagaa

SEQ ID NO: 1461276 - RNA, 19 nt, Homo sapiens
uggaagacaguauucagaa

SEQ ID NO: 1461277 - RNA, 19 nt, Homo sapiens
ucaacccaauugucuaugg

SEQ ID NO: 1461278 - RNA, 19 nt, Homo sapiens
gggucaaugucgucuaugg

SEQ ID NO: 1461279 - RNA, 19 nt, Homo sapiens
uaacuugacaaucaucuac

SEQ ID NO: 1461280 - RNA, 19 nt, Homo sapiens
gaagacaaaggagauucga

SEQ ID NO: 1461281 - RNA, 19 nt, Homo sapiens
uugcgucucucaugugugu

SEQ ID NO: 1461282 - RNA, 19 nt, Homo sapiens
cuucucauaucugcuuauu

SEQ ID NO: 1461283 - RNA, 19 nt, Homo sapiens
gucacacauuccuuccaua

SEQ ID NO: 1461284 - RNA, 19 nt, Homo sapiens
ccuacugccuacaccaaga

SEQ ID NO: 1461285 - RNA, 19 nt, Homo sapiens
gcuauguggccaucuguca

SEQ ID NO: 1461286 - RNA, 19 nt, Homo sapiens
gccauccacuccuuaucug

SEQ ID NO: 1461287 - RNA, 19 nt, Homo sapiens
gagugaagacaaaggagau

SEQ ID NO: 1461288 - RNA, 19 nt, Homo sapiens
caaugaauccagugcuaca

SEQ ID NO: 1461289 - RNA, 19 nt, Homo sapiens
cgccaugccacaguacuua

SEQ ID NO: 1461290 - RNA, 19 nt, Homo sapiens
ucaaacuucuuuuccauuc

SEQ ID NO: 1461291 - RNA, 19 nt, Homo sapiens
ggccuuaucgucaucaucu

SEQ ID NO: 1461292 - RNA, 19 nt, Homo sapiens
gugaugauauccgggucaa

SEQ ID NO: 1461293 - RNA, 19 nt, Homo sapiens
guucagcuucuucaugaug

SEQ ID NO: 1461294 - RNA, 19 nt, Homo sapiens
ccauuggccuggacucacu

SEQ ID NO: 1461295 - RNA, 19 nt, Homo sapiens
gcuggccugugaugauauc

SEQ ID NO: 1461296 - RNA, 19 nt, Homo sapiens
ugucagugaucaaacuucu

SEQ ID NO: 1461297 - RNA, 19 nt, Homo sapiens
ucacaguucagcuucuuca

SEQ ID NO: 1461298 - RNA, 19 nt, Homo sapiens
ugucgucuauggccuuauc

SEQ ID NO: 1461299 - RNA, 19 nt, Homo sapiens
aaugucgucuauggccuua

SEQ ID NO: 1461300 - RNA, 19 nt, Homo sapiens
uagguaacuugacaaucau

SEQ ID NO: 1461301 - RNA, 19 nt, Homo sapiens
ucacacauuccuuccauac

SEQ ID NO: 1461302 - RNA, 19 nt, Homo sapiens
gugcucaacccaauugucu

SEQ ID NO: 1461303 - RNA, 19 nt, Homo sapiens
ucucaugugugugcugugu

SEQ ID NO: 1461304 - RNA, 19 nt, Homo sapiens
caauauccuuucccauucc

SEQ ID NO: 1461305 - RNA, 19 nt, Homo sapiens
aauaggccucccugguuua

SEQ ID NO: 1461306 - RNA, 19 nt, Homo sapiens
uauguaccuuucauuggau

SEQ ID NO: 1461307 - RNA, 19 nt, Homo sapiens
cugguuggccuucccauug

SEQ ID NO: 1461308 - RNA, 19 nt, Homo sapiens
ucuauggccuuaucgucau

SEQ ID NO: 1461309 - RNA, 19 nt, Homo sapiens
cuaccuuauugcugugcua

SEQ ID NO: 1461310 - RNA, 19 nt, Homo sapiens
ugugcucccucuaccuuau

SEQ ID NO: 1461311 - RNA, 19 nt, Homo sapiens
ggucagaacuauguugaua

SEQ ID NO: 1461312 - RNA, 19 nt, Homo sapiens
gcaaacagauggauucucu

SEQ ID NO: 1461313 - RNA, 19 nt, Homo sapiens
gagaaguccuggaauaaga

SEQ ID NO: 1461314 - RNA, 19 nt, Homo sapiens
cuaaguagcuccagacaga

SEQ ID NO: 1461315 - RNA, 19 nt, Homo sapiens
gcugaaacaucugucaaua

SEQ ID NO: 1461316 - RNA, 19 nt, Homo sapiens
gaaccaccaugccaaucua

SEQ ID NO: 1461317 - RNA, 19 nt, Homo sapiens
uauaauagcucuggugguu

SEQ ID NO: 1461318 - RNA, 19 nt, Homo sapiens
gcacaauaccugagacaaa

SEQ ID NO: 1461319 - RNA, 19 nt, Homo sapiens
caacccgagucaucuauaa

SEQ ID NO: 1461320 - RNA, 19 nt, Homo sapiens
uaaaauggcuacacucaaa

SEQ ID NO: 1461321 - RNA, 19 nt, Homo sapiens
ggacagaaacaccaaagga

SEQ ID NO: 1461322 - RNA, 19 nt, Homo sapiens
cagcucagauuauguuguu

SEQ ID NO: 1461323 - RNA, 19 nt, Homo sapiens
ccaggaaccuugcuaugau

SEQ ID NO: 1461324 - RNA, 19 nt, Homo sapiens
caaugugucuuguacugaa

SEQ ID NO: 1461325 - RNA, 19 nt, Homo sapiens
caaccaaugugucuuguac

SEQ ID NO: 1461326 - RNA, 19 nt, Homo sapiens
uaaagcauuccaagcaaua

SEQ ID NO: 1461327 - RNA, 19 nt, Homo sapiens
cagcagaacccagaaguuu

SEQ ID NO: 1461328 - RNA, 19 nt, Homo sapiens
uaagaguuaucaaccaaug

SEQ ID NO: 1461329 - RNA, 19 nt, Homo sapiens
uaaccaccaugccuacuug

SEQ ID NO: 1461330 - RNA, 19 nt, Homo sapiens
ucaaacaccucagccaaug

SEQ ID NO: 1461331 - RNA, 19 nt, Homo sapiens
uaauagcucuggugguuuc

SEQ ID NO: 1461332 - RNA, 19 nt, Homo sapiens
ccagaucucuagcccauuc

SEQ ID NO: 1461333 - RNA, 19 nt, Homo sapiens
gaccaucucauuugccuuu

SEQ ID NO: 1461334 - RNA, 19 nt, Homo sapiens
caagagaucccagagauuc

SEQ ID NO: 1461335 - RNA, 19 nt, Homo sapiens
ggacaccaaugcugcuauc

SEQ ID NO: 1461336 - RNA, 19 nt, Homo sapiens
ggaugccacuguuucucua

SEQ ID NO: 1461337 - RNA, 19 nt, Homo sapiens
gcuaugauccaagagauaa

SEQ ID NO: 1461338 - RNA, 19 nt, Homo sapiens
ccaaugacacccuuaacaa

SEQ ID NO: 1461339 - RNA, 19 nt, Homo sapiens
uagaacaaguccagucuuc

SEQ ID NO: 1461340 - RNA, 19 nt, Homo sapiens
gacaagugcuagaacaagu

SEQ ID NO: 1461341 - RNA, 19 nt, Homo sapiens
ucagaacuauguugauauc

SEQ ID NO: 1461342 - RNA, 19 nt, Homo sapiens
gaaccuugcuaugauccaa

SEQ ID NO: 1461343 - RNA, 19 nt, Homo sapiens
ucugcaagcuccugagauu

SEQ ID NO: 1461344 - RNA, 19 nt, Homo sapiens
ggaacuggcccacuuugug

SEQ ID NO: 1461345 - RNA, 19 nt, Homo sapiens
ccaccaugccuacuuguuu

SEQ ID NO: 1461346 - RNA, 19 nt, Homo sapiens
gacagaaacaccaaaggaa

SEQ ID NO: 1461347 - RNA, 19 nt, Homo sapiens
gcacagaugcuggagaauc

SEQ ID NO: 1461348 - RNA, 19 nt, Homo sapiens
caccaugccuacuuguuug

SEQ ID NO: 1461349 - RNA, 19 nt, Homo sapiens
auacaaggaugccacuguu

SEQ ID NO: 1461350 - RNA, 19 nt, Homo sapiens
cacaauaccugagacaaag

SEQ ID NO: 1461351 - RNA, 19 nt, Homo sapiens
gccacuguuucucuaagua

SEQ ID NO: 1461352 - RNA, 19 nt, Homo sapiens
agacaaaggccagcagaaa

SEQ ID NO: 1461353 - RNA, 19 nt, Homo sapiens
ccuaaagcauuccaagcaa

SEQ ID NO: 1461354 - RNA, 19 nt, Homo sapiens
agccaacacugcuaugauu

SEQ ID NO: 1461355 - RNA, 19 nt, Homo sapiens
gcaacccgagucaucuaua

SEQ ID NO: 1461356 - RNA, 19 nt, Homo sapiens
ccagauggaccaacuagug

SEQ ID NO: 1461357 - RNA, 19 nt, Homo sapiens
gcaagcuccugagauuugu

SEQ ID NO: 1461358 - RNA, 19 nt, Homo sapiens
gcagcuauccugacacagu

SEQ ID NO: 1461359 - RNA, 19 nt, Homo sapiens
uaucugggcuuagagacaa

SEQ ID NO: 1461360 - RNA, 19 nt, Homo sapiens
gccaggaaccuugcuauga

SEQ ID NO: 1461361 - RNA, 19 nt, Homo sapiens
uaaggcaguucaaggagau

SEQ ID NO: 1461362 - RNA, 19 nt, Homo sapiens
ccaccugaccaucucauuu

SEQ ID NO: 1461363 - RNA, 19 nt, Homo sapiens
acagaaacaccaaaggaaa

SEQ ID NO: 1461364 - RNA, 19 nt, Homo sapiens
uggguugccuucucaaaga

SEQ ID NO: 1461365 - RNA, 19 nt, Homo sapiens
cuaaagcauuccaagcaau

SEQ ID NO: 1461366 - RNA, 19 nt, Homo sapiens
uuaccuagcauagagcuua

SEQ ID NO: 1461367 - RNA, 19 nt, Homo sapiens
ucaagaagaauacaaggau

SEQ ID NO: 1461368 - RNA, 19 nt, Homo sapiens
ggagaaguccuggaauaag

SEQ ID NO: 1461369 - RNA, 19 nt, Homo sapiens
cuacaggcacucauugcua

SEQ ID NO: 1461370 - RNA, 19 nt, Homo sapiens
gaacaaguccagucuucac

SEQ ID NO: 1461371 - RNA, 19 nt, Homo sapiens
caggacaagugcuagaaca

SEQ ID NO: 1461372 - RNA, 19 nt, Homo sapiens
gauaaugcagauccaacaa

SEQ ID NO: 1461373 - RNA, 19 nt, Homo sapiens
ugaugcaguugcuuaugaa

SEQ ID NO: 1461374 - RNA, 19 nt, Homo sapiens
ugauaauucugagauccua

SEQ ID NO: 1461375 - RNA, 19 nt, Homo sapiens
gcagcagaacccagaaguu

SEQ ID NO: 1461376 - RNA, 19 nt, Homo sapiens
cugaaacaucugucaauaa

SEQ ID NO: 1461377 - RNA, 19 nt, Homo sapiens
ggacaagugcuagaacaag

SEQ ID NO: 1461378 - RNA, 19 nt, Homo sapiens
gcagggcuccagaucucua

SEQ ID NO: 1461379 - RNA, 19 nt, Homo sapiens
caccugaccaucucauuug

SEQ ID NO: 1461380 - RNA, 19 nt, Homo sapiens
ggaaccaccaugccaaucu

SEQ ID NO: 1461381 - RNA, 19 nt, Homo sapiens
ugcaguugcuuaugaacaa

SEQ ID NO: 1461382 - RNA, 19 nt, Homo sapiens
gcuccagacagacauuaaa

SEQ ID NO: 1461383 - RNA, 19 nt, Homo sapiens
ucaaugaucaaaugcugaa

SEQ ID NO: 1461384 - RNA, 19 nt, Homo sapiens
gcagauccaacaaccuuca

SEQ ID NO: 1461385 - RNA, 19 nt, Homo sapiens
aacaauugaugcagcagaa

SEQ ID NO: 1461386 - RNA, 19 nt, Homo sapiens
gaguucauguggcaguuca

SEQ ID NO: 1461387 - RNA, 19 nt, Homo sapiens
gagagcacaauaccugaga

SEQ ID NO: 1461388 - RNA, 19 nt, Homo sapiens
cucaagagaucccagagau

SEQ ID NO: 1461389 - RNA, 19 nt, Homo sapiens
aggcaacccuaaagcauuc

SEQ ID NO: 1461390 - RNA, 19 nt, Homo sapiens
augaugcaguugcuuauga

SEQ ID NO: 1461391 - RNA, 19 nt, Homo sapiens
uccaagagauaaugcagau

SEQ ID NO: 1461392 - RNA, 19 nt, Homo sapiens
aagcagggcuccagaucuc

SEQ ID NO: 1461393 - RNA, 19 nt, Homo sapiens
ucaaagaccaugacacacu

SEQ ID NO: 1461394 - RNA, 19 nt, Homo sapiens
ucucaaagaccaugacaca

SEQ ID NO: 1461395 - RNA, 19 nt, Homo sapiens
ccuggaauguuucagauac

SEQ ID NO: 1461396 - RNA, 19 nt, Homo sapiens
ccaaagccaacacugcuau

SEQ ID NO: 1461397 - RNA, 19 nt, Homo sapiens
ggucaaccacacuuccaaa

SEQ ID NO: 1461398 - RNA, 19 nt, Homo sapiens
uaucaaccaaugugucuug

SEQ ID NO: 1461399 - RNA, 19 nt, Homo sapiens
acaaaggccagcagaaaca

SEQ ID NO: 1461400 - RNA, 19 nt, Homo sapiens
gagacaaaggccagcagaa

SEQ ID NO: 1461401 - RNA, 19 nt, Homo sapiens
cugaucugcuuagugcuua

SEQ ID NO: 1461402 - RNA, 19 nt, Homo sapiens
gcucagauuauguuguuca

SEQ ID NO: 1461403 - RNA, 19 nt, Homo sapiens
ccuggcagcucagauuaug

SEQ ID NO: 1461404 - RNA, 19 nt, Homo sapiens
gccaaugacacccuuaaca

SEQ ID NO: 1461405 - RNA, 19 nt, Homo sapiens
gagaucccagagauucuaa

SEQ ID NO: 1461406 - RNA, 19 nt, Homo sapiens
gcucaagagaucccagaga

SEQ ID NO: 1461407 - RNA, 19 nt, Homo sapiens
gccaacacugcuaugauuu

SEQ ID NO: 1461408 - RNA, 19 nt, Homo sapiens
caaugacacccuuaacaag

SEQ ID NO: 1461409 - RNA, 19 nt, Homo sapiens
ucuagacacgcaacaauug

SEQ ID NO: 1461410 - RNA, 19 nt, Homo sapiens
gacaaaggccagcagaaac

SEQ ID NO: 1461411 - RNA, 19 nt, Homo sapiens
uaacagauuucuccaguaa

SEQ ID NO: 1461412 - RNA, 19 nt, Homo sapiens
ggacaacugugauauuuca

SEQ ID NO: 1461413 - RNA, 19 nt, Homo sapiens
caaagaagccuacaauguu

SEQ ID NO: 1461414 - RNA, 19 nt, Homo sapiens
cgacagaaaugaaccaguu

SEQ ID NO: 1461415 - RNA, 19 nt, Homo sapiens
guauagaacuaacagcaaa

SEQ ID NO: 1461416 - RNA, 19 nt, Homo sapiens
ucacuggguuuaucccuua

SEQ ID NO: 1461417 - RNA, 19 nt, Homo sapiens
gaaccaaguggauggcuua

SEQ ID NO: 1461418 - RNA, 19 nt, Homo sapiens
caacaacagccacggaaua

SEQ ID NO: 1461419 - RNA, 19 nt, Homo sapiens
caggacaacugugauauuu

SEQ ID NO: 1461420 - RNA, 19 nt, Homo sapiens
aaagaagccuacaauguug

SEQ ID NO: 1461421 - RNA, 19 nt, Homo sapiens
gcagaaauguagacaggau

SEQ ID NO: 1461422 - RNA, 19 nt, Homo sapiens
ccacaucaagggauuguua

SEQ ID NO: 1461423 - RNA, 19 nt, Homo sapiens
ccugauaacaguuccauua

SEQ ID NO: 1461424 - RNA, 19 nt, Homo sapiens
ccaaagaagccuacaaugu

SEQ ID NO: 1461425 - RNA, 19 nt, Homo sapiens
aaacccacaucuaccauuu

SEQ ID NO: 1461426 - RNA, 19 nt, Homo sapiens
gauuguaaauaccuccuaa

SEQ ID NO: 1461427 - RNA, 19 nt, Homo sapiens
guuuaucccuuaucaagaa

SEQ ID NO: 1461428 - RNA, 19 nt, Homo sapiens
gauaacaguuccauuacag

SEQ ID NO: 1461429 - RNA, 19 nt, Homo sapiens
gagcuucaguuucuucauc

SEQ ID NO: 1461430 - RNA, 19 nt, Homo sapiens
gaaccaacuucuccaucug

SEQ ID NO: 1461431 - RNA, 19 nt, Homo sapiens
gaaugcaccuauagcagau

SEQ ID NO: 1461432 - RNA, 19 nt, Homo sapiens
ugacauaccuccacuucgu

SEQ ID NO: 1461433 - RNA, 19 nt, Homo sapiens
aaacuucacuuggucuuug

SEQ ID NO: 1461434 - RNA, 19 nt, Homo sapiens
acaaugcaccggaaccuua

SEQ ID NO: 1461435 - RNA, 19 nt, Homo sapiens
cuacuacaauccaacuuug

SEQ ID NO: 1461436 - RNA, 19 nt, Homo sapiens
caacagccacggaauaaca

SEQ ID NO: 1461437 - RNA, 19 nt, Homo sapiens
gacauaaacacaacacaga

SEQ ID NO: 1461438 - RNA, 19 nt, Homo sapiens
ggaauucuagcuacuacaa

SEQ ID NO: 1461439 - RNA, 19 nt, Homo sapiens
cugggugucucauugcuua

SEQ ID NO: 1461440 - RNA, 19 nt, Homo sapiens
ggagaccaguagcagaaau

SEQ ID NO: 1461441 - RNA, 19 nt, Homo sapiens
ccaaguggauggcuuacca

SEQ ID NO: 1461442 - RNA, 19 nt, Homo sapiens
cagcaagugucaucuacau

SEQ ID NO: 1461443 - RNA, 19 nt, Homo sapiens
ccauagcuuuguuucuaaa

SEQ ID NO: 1461444 - RNA, 19 nt, Homo sapiens
acagaacauugcagaaguu

SEQ ID NO: 1461445 - RNA, 19 nt, Homo sapiens
gcaaacuuaaacucagaua

SEQ ID NO: 1461446 - RNA, 19 nt, Homo sapiens
gcuacuacaauccaacuuu

SEQ ID NO: 1461447 - RNA, 19 nt, Homo sapiens
uaacaguuccauuacaguu

SEQ ID NO: 1461448 - RNA, 19 nt, Homo sapiens
ucucauugcuuacucuugu

SEQ ID NO: 1461449 - RNA, 19 nt, Homo sapiens
ccacaaacagugauagcuu

SEQ ID NO: 1461450 - RNA, 19 nt, Homo sapiens
aaacacaacacagaacauu

SEQ ID NO: 1461451 - RNA, 19 nt, Homo sapiens
gaugacauaccuccacuuc

SEQ ID NO: 1461452 - RNA, 19 nt, Homo sapiens
gaaaacuccugauaacagu

SEQ ID NO: 1461453 - RNA, 19 nt, Homo sapiens
uaaagugccuuggaaugca

SEQ ID NO: 1461454 - RNA, 19 nt, Homo sapiens
aagcaaacuuaaacucaga

SEQ ID NO: 1461455 - RNA, 19 nt, Homo sapiens
gaaauguagacaggaugua

SEQ ID NO: 1461456 - RNA, 19 nt, Homo sapiens
aaacagcaagugucaucua

SEQ ID NO: 1461457 - RNA, 19 nt, Homo sapiens
gcacgacagauuccuuuca

SEQ ID NO: 1461458 - RNA, 19 nt, Homo sapiens
guucugcgauuagacaaug

SEQ ID NO: 1461459 - RNA, 19 nt, Homo sapiens
auccauagcuuuguuucua

SEQ ID NO: 1461460 - RNA, 19 nt, Homo sapiens
gcaccggaaccuuaugaug

SEQ ID NO: 1461461 - RNA, 19 nt, Homo sapiens
ugauaacaguuccauuaca

SEQ ID NO: 1461462 - RNA, 19 nt, Homo sapiens
caucuaccauuuccacaag

SEQ ID NO: 1461463 - RNA, 19 nt, Homo sapiens
gccacggaauaacagauuu

SEQ ID NO: 1461464 - RNA, 19 nt, Homo sapiens
cacagaacauugcagaagu

SEQ ID NO: 1461465 - RNA, 19 nt, Homo sapiens
auaaccaccucaaaucuca

SEQ ID NO: 1461466 - RNA, 19 nt, Homo sapiens
ugaagcaaacuuaaacuca

SEQ ID NO: 1461467 - RNA, 19 nt, Homo sapiens
gggauuguuauuccuuuaa

SEQ ID NO: 1461468 - RNA, 19 nt, Homo sapiens
ccugaggcauuuacuaagu

SEQ ID NO: 1461469 - RNA, 19 nt, Homo sapiens
caggagaccaguagcagaa

SEQ ID NO: 1461470 - RNA, 19 nt, Homo sapiens
acaauccaacuuugaauga

SEQ ID NO: 1461471 - RNA, 19 nt, Homo sapiens
uuucuaaagugccuuggaa

SEQ ID NO: 1461472 - RNA, 19 nt, Homo sapiens
gugauggcauuccuaugga

SEQ ID NO: 1461473 - RNA, 19 nt, Homo sapiens
gcacgugauggcauuccua

SEQ ID NO: 1461474 - RNA, 19 nt, Homo sapiens
caccggaaccuuaugaugu

SEQ ID NO: 1461475 - RNA, 19 nt, Homo sapiens
gccugaagcuucuguuacu

SEQ ID NO: 1461476 - RNA, 19 nt, Homo sapiens
gccuuggaaugcaccuaua

SEQ ID NO: 1461477 - RNA, 19 nt, Homo sapiens
uccauagcuuuguuucuaa

SEQ ID NO: 1461478 - RNA, 19 nt, Homo sapiens
acagauuucuccaguaacu

SEQ ID NO: 1461479 - RNA, 19 nt, Homo sapiens
gaaaauauaaccaccucaa

SEQ ID NO: 1461480 - RNA, 19 nt, Homo sapiens
ccacuucguacuucuguau

SEQ ID NO: 1461481 - RNA, 19 nt, Homo sapiens
gacauaccuccacuucgua

SEQ ID NO: 1461482 - RNA, 19 nt, Homo sapiens
aauauaaccaccucaaauc

SEQ ID NO: 1461483 - RNA, 19 nt, Homo sapiens
auaacagauuucuccagua

SEQ ID NO: 1461484 - RNA, 19 nt, Homo sapiens
caucaagggauuguuauuc

SEQ ID NO: 1461485 - RNA, 19 nt, Homo sapiens
ggaaccuuaugaugugagu

SEQ ID NO: 1461486 - RNA, 19 nt, Homo sapiens
gcgacuuuaugacgacaga

SEQ ID NO: 1461487 - RNA, 19 nt, Homo sapiens
cauccucucuucagaacca

SEQ ID NO: 1461488 - RNA, 19 nt, Homo sapiens
gaccaguagcagaaaugua

SEQ ID NO: 1461489 - RNA, 19 nt, Homo sapiens
aaucuauucuugccacauc

SEQ ID NO: 1461490 - RNA, 19 nt, Homo sapiens
gccagaaagugaagaaaau

SEQ ID NO: 1461491 - RNA, 19 nt, Homo sapiens
caauccaacuuugaaugau

SEQ ID NO: 1461492 - RNA, 19 nt, Homo sapiens
gaugugaguuuugggaauu

SEQ ID NO: 1461493 - RNA, 19 nt, Homo sapiens
cagccuaccuuaaaauuca

SEQ ID NO: 1461494 - RNA, 19 nt, Homo sapiens
uagcuucacuggguuuauc

SEQ ID NO: 1461495 - RNA, 19 nt, Homo sapiens
acaguuccauuacaguuag

SEQ ID NO: 1461496 - RNA, 19 nt, Homo sapiens
cgucagcagagcauucuuu

SEQ ID NO: 1461497 - RNA, 19 nt, Homo sapiens
aacaacagccacggaauaa

SEQ ID NO: 1461498 - RNA, 19 nt, Homo sapiens
caaaaugggcauaauacaa

SEQ ID NO: 1461499 - RNA, 19 nt, Homo sapiens
uauucugggugucucauug

SEQ ID NO: 1461500 - RNA, 19 nt, Homo sapiens
ggguuuaucccuuaucaag

SEQ ID NO: 1461501 - RNA, 19 nt, Homo sapiens
uaccaaagaagccuacaau

SEQ ID NO: 1461502 - RNA, 19 nt, Homo sapiens
gagaccaguagcagaaaug

SEQ ID NO: 1461503 - RNA, 19 nt, Homo sapiens
aaauuacugucacguggau

SEQ ID NO: 1461504 - RNA, 19 nt, Homo sapiens
gcauuccuauggaugacau

SEQ ID NO: 1461505 - RNA, 19 nt, Homo sapiens
agggauuguuauuccuuua

SEQ ID NO: 1461506 - RNA, 19 nt, Homo sapiens
ucagaaaacuucacuuggu

SEQ ID NO: 1461507 - RNA, 19 nt, Homo sapiens
auugugagcuucaguuucu

SEQ ID NO: 1461508 - RNA, 19 nt, Homo sapiens
caucuacauccuagccuuu

SEQ ID NO: 1461509 - RNA, 19 nt, Homo sapiens
gacuuuaugacgacagaaa

SEQ ID NO: 1461510 - RNA, 19 nt, Homo sapiens
ccugaagcuucuguuacua

SEQ ID NO: 1461511 - RNA, 19 nt, Homo sapiens
gaagaaagguugauggaaa

SEQ ID NO: 1461512 - RNA, 19 nt, Homo sapiens
gaaugaaacuccaaagaaa

SEQ ID NO: 1461513 - RNA, 19 nt, Homo sapiens
ggagauagguguauguaau

SEQ ID NO: 1461514 - RNA, 19 nt, Homo sapiens
gaucagaauuucaacaaga

SEQ ID NO: 1461515 - RNA, 19 nt, Homo sapiens
caaagaaacuguggaacaa

SEQ ID NO: 1461516 - RNA, 19 nt, Homo sapiens
uaaauccucugcaacaauu

SEQ ID NO: 1461517 - RNA, 19 nt, Homo sapiens
aaagguugauggaaaguua

SEQ ID NO: 1461518 - RNA, 19 nt, Homo sapiens
uaagucaacugaaagaaga

SEQ ID NO: 1461519 - RNA, 19 nt, Homo sapiens
gucaguagcucuauaaauc

SEQ ID NO: 1461520 - RNA, 19 nt, Homo sapiens
ucaaacaggucgcagcauu

SEQ ID NO: 1461521 - RNA, 19 nt, Homo sapiens
aaacagagaacuacucaaa

SEQ ID NO: 1461522 - RNA, 19 nt, Homo sapiens
gagcaaaacuaacacaauu

SEQ ID NO: 1461523 - RNA, 19 nt, Homo sapiens
caaaggauccaauauuuca

SEQ ID NO: 1461524 - RNA, 19 nt, Homo sapiens
uaagguaauuugccaguug

SEQ ID NO: 1461525 - RNA, 19 nt, Homo sapiens
ggaaacagagccauaaauc

SEQ ID NO: 1461526 - RNA, 19 nt, Homo sapiens
gaaagaagaagugauguca

SEQ ID NO: 1461527 - RNA, 19 nt, Homo sapiens
ugucaguacuguaacauaa

SEQ ID NO: 1461528 - RNA, 19 nt, Homo sapiens
caaacaggucgcagcauua

SEQ ID NO: 1461529 - RNA, 19 nt, Homo sapiens
caaucuaaguccagaagaa

SEQ ID NO: 1461530 - RNA, 19 nt, Homo sapiens
gaucuucacauucaaauuc

SEQ ID NO: 1461531 - RNA, 19 nt, Homo sapiens
gauugcacauccuauugua

SEQ ID NO: 1461532 - RNA, 19 nt, Homo sapiens
acagagaacuacucaaaca

SEQ ID NO: 1461533 - RNA, 19 nt, Homo sapiens
guaccaagagucaaauuug

SEQ ID NO: 1461534 - RNA, 19 nt, Homo sapiens
gcagagagaccagaccauu

SEQ ID NO: 1461535 - RNA, 19 nt, Homo sapiens
ccuuauaagucaacugaaa

SEQ ID NO: 1461536 - RNA, 19 nt, Homo sapiens
gaaucuaagccaucuaaug

SEQ ID NO: 1461537 - RNA, 19 nt, Homo sapiens
ugucagcguugcacaaauu

SEQ ID NO: 1461538 - RNA, 19 nt, Homo sapiens
gaaggaggaaggaagaaga

SEQ ID NO: 1461539 - RNA, 19 nt, Homo sapiens
auaaaucagucagcagaua

SEQ ID NO: 1461540 - RNA, 19 nt, Homo sapiens
ccaaguguacccagcguua

SEQ ID NO: 1461541 - RNA, 19 nt, Homo sapiens
agaaugaaacuccaaagaa

SEQ ID NO: 1461542 - RNA, 19 nt, Homo sapiens
guacccagcguuauccuuu

SEQ ID NO: 1461543 - RNA, 19 nt, Homo sapiens
gaacagugcaaacagcaau

SEQ ID NO: 1461544 - RNA, 19 nt, Homo sapiens
ggaacaacuucaggccaaa

SEQ ID NO: 1461545 - RNA, 19 nt, Homo sapiens
ccugggaucuucacauuca

SEQ ID NO: 1461546 - RNA, 19 nt, Homo sapiens
uguaagaagugugcucaaa

SEQ ID NO: 1461547 - RNA, 19 nt, Homo sapiens
ccgcacagcuaaacagcaa

SEQ ID NO: 1461548 - RNA, 19 nt, Homo sapiens
guaacauaauugcagcauu

SEQ ID NO: 1461549 - RNA, 19 nt, Homo sapiens
gagauagguguauguaaug

SEQ ID NO: 1461550 - RNA, 19 nt, Homo sapiens
gauggaaaguuauuaugcu

SEQ ID NO: 1461551 - RNA, 19 nt, Homo sapiens
ggaaggaagaagaaagguu

SEQ ID NO: 1461552 - RNA, 19 nt, Homo sapiens
cauaaauccucugcaacaa

SEQ ID NO: 1461553 - RNA, 19 nt, Homo sapiens
gaagugugcucaaaaugug

SEQ ID NO: 1461554 - RNA, 19 nt, Homo sapiens
gagaaagaccagcaucauc

SEQ ID NO: 1461555 - RNA, 19 nt, Homo sapiens
ccauaaauccucugcaaca

SEQ ID NO: 1461556 - RNA, 19 nt, Homo sapiens
uaugcuggcucuguacuuu

SEQ ID NO: 1461557 - RNA, 19 nt, Homo sapiens
cagagagaccagaccauuu

SEQ ID NO: 1461558 - RNA, 19 nt, Homo sapiens
ggaagaagaaagguugaug

SEQ ID NO: 1461559 - RNA, 19 nt, Homo sapiens
acaaagaaacuguggaaca

SEQ ID NO: 1461560 - RNA, 19 nt, Homo sapiens
guaagguaauuugccaguu

SEQ ID NO: 1461561 - RNA, 19 nt, Homo sapiens
cagaaugaaacuccaaaga

SEQ ID NO: 1461562 - RNA, 19 nt, Homo sapiens
caaauucaucuucuucauc

SEQ ID NO: 1461563 - RNA, 19 nt, Homo sapiens
uuauuaugcuggcucugua

SEQ ID NO: 1461564 - RNA, 19 nt, Homo sapiens
uuacugcagaucagaauuu

SEQ ID NO: 1461565 - RNA, 19 nt, Homo sapiens
uaagaagugugcucaaaau

SEQ ID NO: 1461566 - RNA, 19 nt, Homo sapiens
ucaaaggauccaauauuuc

SEQ ID NO: 1461567 - RNA, 19 nt, Homo sapiens
caaggaaugucggauugca

SEQ ID NO: 1461568 - RNA, 19 nt, Homo sapiens
caacugaaagaagaaguga

SEQ ID NO: 1461569 - RNA, 19 nt, Homo sapiens
gaaagguugauggaaaguu

SEQ ID NO: 1461570 - RNA, 19 nt, Homo sapiens
aagaaagguugauggaaag

SEQ ID NO: 1461571 - RNA, 19 nt, Homo sapiens
ugcaaggaaugucggauug

SEQ ID NO: 1461572 - RNA, 19 nt, Homo sapiens
gagcagggacuguggaaac

SEQ ID NO: 1461573 - RNA, 19 nt, Homo sapiens
cagaucagaauuucaacaa

SEQ ID NO: 1461574 - RNA, 19 nt, Homo sapiens
ggucgcagcauuaucaaag

SEQ ID NO: 1461575 - RNA, 19 nt, Homo sapiens
gaaacuguggaacaacuuc

SEQ ID NO: 1461576 - RNA, 19 nt, Homo sapiens
gaccagaccauuuuagaaa

SEQ ID NO: 1461577 - RNA, 19 nt, Homo sapiens
aaacaggucgcagcauuau

SEQ ID NO: 1461578 - RNA, 19 nt, Homo sapiens
gcauccauuucugucagua

SEQ ID NO: 1461579 - RNA, 19 nt, Homo sapiens
ccaguugcauccauuucug

SEQ ID NO: 1461580 - RNA, 19 nt, Homo sapiens
gaaacagagccauaaaucc

SEQ ID NO: 1461581 - RNA, 19 nt, Homo sapiens
gaagacgaaagaacaaagg

SEQ ID NO: 1461582 - RNA, 19 nt, Homo sapiens
ggaggaaggaagaagaaag

SEQ ID NO: 1461583 - RNA, 19 nt, Homo sapiens
gaccaccucagaccuguga

SEQ ID NO: 1461584 - RNA, 19 nt, Homo sapiens
uaauggagauagguguaug

SEQ ID NO: 1461585 - RNA, 19 nt, Homo sapiens
aaacagagccauaaauccu

SEQ ID NO: 1461586 - RNA, 19 nt, Homo sapiens
ucaucuucuucaucucuua

SEQ ID NO: 1461587 - RNA, 19 nt, Homo sapiens
acaggucgcagcauuauca

SEQ ID NO: 1461588 - RNA, 19 nt, Homo sapiens
gaggaaggaagaagaaagg

SEQ ID NO: 1461589 - RNA, 19 nt, Homo sapiens
gagaacaaaaugaacagua

SEQ ID NO: 1461590 - RNA, 19 nt, Homo sapiens
uaaaucagucagcagauag

SEQ ID NO: 1461591 - RNA, 19 nt, Homo sapiens
uggaaucuaagccaucuaa

SEQ ID NO: 1461592 - RNA, 19 nt, Homo sapiens
gcagaucagaauuucaaca

SEQ ID NO: 1461593 - RNA, 19 nt, Homo sapiens
caagagagcaaaacuaaca

SEQ ID NO: 1461594 - RNA, 19 nt, Homo sapiens
auagguguauguaaugugu

SEQ ID NO: 1461595 - RNA, 19 nt, Homo sapiens
agccauaaauccucugcaa

SEQ ID NO: 1461596 - RNA, 19 nt, Homo sapiens
gaagaagagcagggacugu

SEQ ID NO: 1461597 - RNA, 19 nt, Homo sapiens
cacaaaaucagcaaucuaa

SEQ ID NO: 1461598 - RNA, 19 nt, Homo sapiens
cagcaguagccaucacaaa

SEQ ID NO: 1461599 - RNA, 19 nt, Homo sapiens
gaaagaccagcaucaucca

SEQ ID NO: 1461600 - RNA, 19 nt, Homo sapiens
agccugggaucuucacauu

SEQ ID NO: 1461601 - RNA, 19 nt, Homo sapiens
caacaagagagcaaaacua

SEQ ID NO: 1461602 - RNA, 19 nt, Homo sapiens
uugcacauccuauuguaaa

SEQ ID NO: 1461603 - RNA, 19 nt, Homo sapiens
caucaucaccaccaucauc

SEQ ID NO: 1461604 - RNA, 19 nt, Homo sapiens
aagaaacuguggaacaacu

SEQ ID NO: 1461605 - RNA, 19 nt, Homo sapiens
guccuuauaagucaacuga

SEQ ID NO: 1461606 - RNA, 19 nt, Homo sapiens
ucaguagcucuauaaauca

SEQ ID NO: 1461607 - RNA, 19 nt, Homo sapiens
uacagaagacgaaagaaca

SEQ ID NO: 1461608 - RNA, 19 nt, Homo sapiens
cugcagaucagaauuucaa

SEQ ID NO: 1461609 - RNA, 19 nt, Homo sapiens
guaagaagugugcucaaaa

SEQ ID NO: 1461610 - RNA, 19 nt, Homo sapiens
gcaaucuaaguccagaaga

SEQ ID NO: 1461611 - RNA, 19 nt, Homo sapiens
gaaagaagccugaagguuu

SEQ ID NO: 1461612 - RNA, 19 nt, Homo sapiens
aaagaagccugaagguuua

SEQ ID NO: 1461613 - RNA, 19 nt, Homo sapiens
ucacacaggucaugaguuu

SEQ ID NO: 1461614 - RNA, 19 nt, Homo sapiens
gcacuacuuugcauuguuu

SEQ ID NO: 1461615 - RNA, 19 nt, Homo sapiens
gaccuuggcugaucacaaa

SEQ ID NO: 1461616 - RNA, 19 nt, Homo sapiens
gcgcagagcuuuauuuaac

SEQ ID NO: 1461617 - RNA, 19 nt, Homo sapiens
gaggaugacaugauuauaa

SEQ ID NO: 1461618 - RNA, 19 nt, Homo sapiens
gaaggaaguuguccaagca

SEQ ID NO: 1461619 - RNA, 19 nt, Homo sapiens
ggaugaacguacuaacuuu

SEQ ID NO: 1461620 - RNA, 19 nt, Homo sapiens
gcagagcuuuauuuaacua

SEQ ID NO: 1461621 - RNA, 19 nt, Homo sapiens
gguaugaugacuaugauua

SEQ ID NO: 1461622 - RNA, 19 nt, Homo sapiens
ggaaagugcugcggaagga

SEQ ID NO: 1461623 - RNA, 19 nt, Homo sapiens
gaagaggcgucucaagaag

SEQ ID NO: 1461624 - RNA, 19 nt, Homo sapiens
ucugaugucucucgauaua

SEQ ID NO: 1461625 - RNA, 19 nt, Homo sapiens
gaagaaaugagcacucguu

SEQ ID NO: 1461626 - RNA, 19 nt, Homo sapiens
agagagagauccagaaauc

SEQ ID NO: 1461627 - RNA, 19 nt, Homo sapiens
gccugaagguuuacauuaa

SEQ ID NO: 1461628 - RNA, 19 nt, Homo sapiens
ggucuacaaucucacauau

SEQ ID NO: 1461629 - RNA, 19 nt, Homo sapiens
gaagagcauuugccaacau

SEQ ID NO: 1461630 - RNA, 19 nt, Homo sapiens
cauuugaccugaaguauca

SEQ ID NO: 1461631 - RNA, 19 nt, Homo sapiens
gaaaugagcacucguuuug

SEQ ID NO: 1461632 - RNA, 19 nt, Homo sapiens
cuagaggccuuaauggaaa

SEQ ID NO: 1461633 - RNA, 19 nt, Homo sapiens
gcuaauaucagucaacaau

SEQ ID NO: 1461634 - RNA, 19 nt, Homo sapiens
gcuguaaugugcaaugaug

SEQ ID NO: 1461635 - RNA, 19 nt, Homo sapiens
caucaguguucuuacuuaa

SEQ ID NO: 1461636 - RNA, 19 nt, Homo sapiens
aauaauggcugcagcuaga

SEQ ID NO: 1461637 - RNA, 19 nt, Homo sapiens
ucucuagugucaaaguuua

SEQ ID NO: 1461638 - RNA, 19 nt, Homo sapiens
ugacuaugauuauggagaa

SEQ ID NO: 1461639 - RNA, 19 nt, Homo sapiens
ugaugucucucgauauauu

SEQ ID NO: 1461640 - RNA, 19 nt, Homo sapiens
uuugugaucuugcuaauga

SEQ ID NO: 1461641 - RNA, 19 nt, Homo sapiens
ucaguucucuagugucaaa

SEQ ID NO: 1461642 - RNA, 19 nt, Homo sapiens
gcuagaggccuuaauggaa

SEQ ID NO: 1461643 - RNA, 19 nt, Homo sapiens
gaacguacuaacuuucuug

SEQ ID NO: 1461644 - RNA, 19 nt, Homo sapiens
ccaacuaccugcucuguac

SEQ ID NO: 1461645 - RNA, 19 nt, Homo sapiens
gauuguggauucucuaagu

SEQ ID NO: 1461646 - RNA, 19 nt, Homo sapiens
gaacuucuuuaugcucuuc

SEQ ID NO: 1461647 - RNA, 19 nt, Homo sapiens
ugaaugguuuggaauaugu

SEQ ID NO: 1461648 - RNA, 19 nt, Homo sapiens
uauguucacuguauguuug

SEQ ID NO: 1461649 - RNA, 19 nt, Homo sapiens
caaaagagcacauucagaa

SEQ ID NO: 1461650 - RNA, 19 nt, Homo sapiens
cucaguaccuggagucuuu

SEQ ID NO: 1461651 - RNA, 19 nt, Homo sapiens
aagcugaacuucuuuaugc

SEQ ID NO: 1461652 - RNA, 19 nt, Homo sapiens
gcugagugguugaaugguu

SEQ ID NO: 1461653 - RNA, 19 nt, Homo sapiens
ggaccaagugccuuuauuc

SEQ ID NO: 1461654 - RNA, 19 nt, Homo sapiens
gaccugcuauccugagaga

SEQ ID NO: 1461655 - RNA, 19 nt, Homo sapiens
ugaagaggcgucucaagaa

SEQ ID NO: 1461656 - RNA, 19 nt, Homo sapiens
ugucaaaguuuagccguuu

SEQ ID NO: 1461657 - RNA, 19 nt, Homo sapiens
caacauagagaaugcaucu

SEQ ID NO: 1461658 - RNA, 19 nt, Homo sapiens
acaucaguguucuuacuua

SEQ ID NO: 1461659 - RNA, 19 nt, Homo sapiens
aaugugcaaugauguguuu

SEQ ID NO: 1461660 - RNA, 19 nt, Homo sapiens
uaacuauguucacuguaug

SEQ ID NO: 1461661 - RNA, 19 nt, Homo sapiens
uuuaaagacuggagguauu

SEQ ID NO: 1461662 - RNA, 19 nt, Homo sapiens
ugaaguaucacccaaggaa

SEQ ID NO: 1461663 - RNA, 19 nt, Homo sapiens
gaggagcacuacuuugcau

SEQ ID NO: 1461664 - RNA, 19 nt, Homo sapiens
guucaugucaaucuacuuu

SEQ ID NO: 1461665 - RNA, 19 nt, Homo sapiens
uuaagacagugaccugcua

SEQ ID NO: 1461666 - RNA, 19 nt, Homo sapiens
ccagagagagauccagaaa

SEQ ID NO: 1461667 - RNA, 19 nt, Homo sapiens
ggucaugaguuuacacacu

SEQ ID NO: 1461668 - RNA, 19 nt, Homo sapiens
gaaguaucacccaaggaaa

SEQ ID NO: 1461669 - RNA, 19 nt, Homo sapiens
ggcagcaacuuugggauug

SEQ ID NO: 1461670 - RNA, 19 nt, Homo sapiens
gucaacaauuucugcguuu

SEQ ID NO: 1461671 - RNA, 19 nt, Homo sapiens
cuagacaucaguguucuua

SEQ ID NO: 1461672 - RNA, 19 nt, Homo sapiens
gcaauaauggcugcagcua

SEQ ID NO: 1461673 - RNA, 19 nt, Homo sapiens
gagcacuacuuugcauugu

SEQ ID NO: 1461674 - RNA, 19 nt, Homo sapiens
aaugcaagcugaacuucuu

SEQ ID NO: 1461675 - RNA, 19 nt, Homo sapiens
ucagguaugaugacuauga

SEQ ID NO: 1461676 - RNA, 19 nt, Homo sapiens
agaggcgucucaagaagaa

SEQ ID NO: 1461677 - RNA, 19 nt, Homo sapiens
guugaaugguuuggaauau

SEQ ID NO: 1461678 - RNA, 19 nt, Homo sapiens
aaacgcauguaugauaguu

SEQ ID NO: 1461679 - RNA, 19 nt, Homo sapiens
ccauacaggcacuauauug

SEQ ID NO: 1461680 - RNA, 19 nt, Homo sapiens
ggagcacuacuuugcauug

SEQ ID NO: 1461681 - RNA, 19 nt, Homo sapiens
gacauuggacaucuucuug

SEQ ID NO: 1461682 - RNA, 19 nt, Homo sapiens
ugucaaaacuggagaaaau

SEQ ID NO: 1461683 - RNA, 19 nt, Homo sapiens
gagcacauucagaaacuug

SEQ ID NO: 1461684 - RNA, 19 nt, Homo sapiens
gguugaaugguuuggaaua

SEQ ID NO: 1461685 - RNA, 19 nt, Homo sapiens
caacaucacacaggucaug

SEQ ID NO: 1461686 - RNA, 19 nt, Homo sapiens
cauugaagcuauuugugau

SEQ ID NO: 1461687 - RNA, 19 nt, Homo sapiens
gaagaaagggaagaugaag

SEQ ID NO: 1461688 - RNA, 19 nt, Homo sapiens
gaaguuguccaagcaaaca

SEQ ID NO: 1461689 - RNA, 19 nt, Homo sapiens
gcaguucaaacacucagaa

SEQ ID NO: 1461690 - RNA, 19 nt, Homo sapiens
acaaaacgcauguaugaua

SEQ ID NO: 1461691 - RNA, 19 nt, Homo sapiens
ccaugaggauguugacaca

SEQ ID NO: 1461692 - RNA, 19 nt, Homo sapiens
gauucaggcuaauaucagu

SEQ ID NO: 1461693 - RNA, 19 nt, Homo sapiens
guaccuggagucuuucuug

SEQ ID NO: 1461694 - RNA, 19 nt, Homo sapiens
gcaagcugaacuucuuuau

SEQ ID NO: 1461695 - RNA, 19 nt, Homo sapiens
cggauggucuacaaucuca

SEQ ID NO: 1461696 - RNA, 19 nt, Homo sapiens
aagaagaaagggaagauga

SEQ ID NO: 1461697 - RNA, 19 nt, Homo sapiens
gugguugaaugguuuggaa

SEQ ID NO: 1461698 - RNA, 19 nt, Homo sapiens
ugaaagaagccugaagguu

SEQ ID NO: 1461699 - RNA, 19 nt, Homo sapiens
gcuaaugacaacaacauag

SEQ ID NO: 1461700 - RNA, 19 nt, Homo sapiens
cugagugguugaaugguuu

SEQ ID NO: 1461701 - RNA, 19 nt, Homo sapiens
agacaucaguguucuuacu

SEQ ID NO: 1461702 - RNA, 19 nt, Homo sapiens
gauaaaagaaucagagugu

SEQ ID NO: 1461703 - RNA, 19 nt, Homo sapiens
aagagcauuugccaacauu

SEQ ID NO: 1461704 - RNA, 19 nt, Homo sapiens
gcagcaacuuugggauugu

SEQ ID NO: 1461705 - RNA, 19 nt, Homo sapiens
cuaaugacaacaacauaga

SEQ ID NO: 1461706 - RNA, 19 nt, Homo sapiens
gcagcuagacaucaguguu

SEQ ID NO: 1461707 - RNA, 19 nt, Homo sapiens
caaaacgcauguaugauag

SEQ ID NO: 1461708 - RNA, 19 nt, Homo sapiens
cugcgcagagcuuuauuua

SEQ ID NO: 1461709 - RNA, 19 nt, Homo sapiens
gaaaaggagaagaaagaaa

SEQ ID NO: 1461710 - RNA, 19 nt, Homo sapiens
aaagugcugcggaaggaua

SEQ ID NO: 1461711 - RNA, 19 nt, Homo sapiens
gcagauugcuugaaaguuu

SEQ ID NO: 1461712 - RNA, 19 nt, Homo sapiens
ggacggaacuucuauaauc

SEQ ID NO: 1461713 - RNA, 19 nt, Homo sapiens
cgacagaacugaauauguu

SEQ ID NO: 1461714 - RNA, 19 nt, Homo sapiens
gaagagaaaugacaacagu

SEQ ID NO: 1461715 - RNA, 19 nt, Homo sapiens
gcacaaagcauucauaaag

SEQ ID NO: 1461716 - RNA, 19 nt, Homo sapiens
gaacuggcuuguccuguuu

SEQ ID NO: 1461717 - RNA, 19 nt, Homo sapiens
cagaagaccuauuaugauu

SEQ ID NO: 1461718 - RNA, 19 nt, Homo sapiens
gcaccgagaucaccuaugu

SEQ ID NO: 1461719 - RNA, 19 nt, Homo sapiens
aaacaggacuuuauggauu

SEQ ID NO: 1461720 - RNA, 19 nt, Homo sapiens
ucaaagaggugagacuaua

SEQ ID NO: 1461721 - RNA, 19 nt, Homo sapiens
gcagagacuuacauucaaa

SEQ ID NO: 1461722 - RNA, 19 nt, Homo sapiens
uaacagaaccuacuccauu

SEQ ID NO: 1461723 - RNA, 19 nt, Homo sapiens
gaaaugaaccgcacuguac

SEQ ID NO: 1461724 - RNA, 19 nt, Homo sapiens
gcugugggcuguggaaaua

SEQ ID NO: 1461725 - RNA, 19 nt, Homo sapiens
uugaauaccugguugauuu

SEQ ID NO: 1461726 - RNA, 19 nt, Homo sapiens
aaacauauccuaacugaga

SEQ ID NO: 1461727 - RNA, 19 nt, Homo sapiens
gaacuucuauaauccuuca

SEQ ID NO: 1461728 - RNA, 19 nt, Homo sapiens
ugacugauguugcagauug

SEQ ID NO: 1461729 - RNA, 19 nt, Homo sapiens
gaauaccaaugcucgcuuu

SEQ ID NO: 1461730 - RNA, 19 nt, Homo sapiens
gcaaggacgugaugguugu

SEQ ID NO: 1461731 - RNA, 19 nt, Homo sapiens
gaccauaugcagagacuua

SEQ ID NO: 1461732 - RNA, 19 nt, Homo sapiens
cagcacaaauuaucccuuu

SEQ ID NO: 1461733 - RNA, 19 nt, Homo sapiens
gcacaugugagaaauugua

SEQ ID NO: 1461734 - RNA, 19 nt, Homo sapiens
gcagaauccggcucaaaua

SEQ ID NO: 1461735 - RNA, 19 nt, Homo sapiens
ccauuucugugucauauuu

SEQ ID NO: 1461736 - RNA, 19 nt, Homo sapiens
ccacagaguuaaauaucuu

SEQ ID NO: 1461737 - RNA, 19 nt, Homo sapiens
ucaccuauguggauuacua

SEQ ID NO: 1461738 - RNA, 19 nt, Homo sapiens
gcauccaggucuucaauau

SEQ ID NO: 1461739 - RNA, 19 nt, Homo sapiens
gcucggaccuugaauaaac

SEQ ID NO: 1461740 - RNA, 19 nt, Homo sapiens
ccugagcucugcuuucuaa

SEQ ID NO: 1461741 - RNA, 19 nt, Homo sapiens
uaacgaaugguaugacuuu

SEQ ID NO: 1461742 - RNA, 19 nt, Homo sapiens
aaacagggcaugaugauga

SEQ ID NO: 1461743 - RNA, 19 nt, Homo sapiens
gaaccuacuccauugauga

SEQ ID NO: 1461744 - RNA, 19 nt, Homo sapiens
gacaacauccagaggaaua

SEQ ID NO: 1461745 - RNA, 19 nt, Homo sapiens
cacaaagcauucauaaaga

SEQ ID NO: 1461746 - RNA, 19 nt, Homo sapiens
gcacuguuguggauucaga

SEQ ID NO: 1461747 - RNA, 19 nt, Homo sapiens
gaaccgcacuguacagaac

SEQ ID NO: 1461748 - RNA, 19 nt, Homo sapiens
caagaucgcuaugcagaug

SEQ ID NO: 1461749 - RNA, 19 nt, Homo sapiens
gaagcauccucuagcaaug

SEQ ID NO: 1461750 - RNA, 19 nt, Homo sapiens
ccacgauucuuuaccgaaa

SEQ ID NO: 1461751 - RNA, 19 nt, Homo sapiens
caaaacauauccuaacuga

SEQ ID NO: 1461752 - RNA, 19 nt, Homo sapiens
gcugagaauugcuuuacuu

SEQ ID NO: 1461753 - RNA, 19 nt, Homo sapiens
gaugaaggcuguggcugaa

SEQ ID NO: 1461754 - RNA, 19 nt, Homo sapiens
gauaaacagagucuaauuc

SEQ ID NO: 1461755 - RNA, 19 nt, Homo sapiens
aagcagcaguaugauauua

SEQ ID NO: 1461756 - RNA, 19 nt, Homo sapiens
guagagugguuuaaauagu

SEQ ID NO: 1461757 - RNA, 19 nt, Homo sapiens
aauaaguguuugcgugaua

SEQ ID NO: 1461758 - RNA, 19 nt, Homo sapiens
gaauaaacagggcaugaug

SEQ ID NO: 1461759 - RNA, 19 nt, Homo sapiens
gaggugagacuauaaagau

SEQ ID NO: 1461760 - RNA, 19 nt, Homo sapiens
gaucucaaccaacgauaaa

SEQ ID NO: 1461761 - RNA, 19 nt, Homo sapiens
aaagaauuccacagaguua

SEQ ID NO: 1461762 - RNA, 19 nt, Homo sapiens
gugcaaaucugccauaagc

SEQ ID NO: 1461763 - RNA, 19 nt, Homo sapiens
guauugaugucuguaaaga

SEQ ID NO: 1461764 - RNA, 19 nt, Homo sapiens
uuagagcuauacagcaaua

SEQ ID NO: 1461765 - RNA, 19 nt, Homo sapiens
gaaauugguauacuuugug

SEQ ID NO: 1461766 - RNA, 19 nt, Homo sapiens
caaagaggugagacuauaa

SEQ ID NO: 1461767 - RNA, 19 nt, Homo sapiens
caaagaauuccacagaguu

SEQ ID NO: 1461768 - RNA, 19 nt, Homo sapiens
gacaauccaagaagaaauu

SEQ ID NO: 1461769 - RNA, 19 nt, Homo sapiens
gcucaagacugucggugau

SEQ ID NO: 1461770 - RNA, 19 nt, Homo sapiens
guuagucuguuaaagaaga

SEQ ID NO: 1461771 - RNA, 19 nt, Homo sapiens
cuacaaagaauuccacaga

SEQ ID NO: 1461772 - RNA, 19 nt, Homo sapiens
ggaauuagccaaccaucuc

SEQ ID NO: 1461773 - RNA, 19 nt, Homo sapiens
gccgagagcuuucugaacu

SEQ ID NO: 1461774 - RNA, 19 nt, Homo sapiens
aaucagcccaugcuuguua

SEQ ID NO: 1461775 - RNA, 19 nt, Homo sapiens
gagaucaccuauguggauu

SEQ ID NO: 1461776 - RNA, 19 nt, Homo sapiens
acaaaccucuuuaacuuag

SEQ ID NO: 1461777 - RNA, 19 nt, Homo sapiens
cagcacggauaauugugua

SEQ ID NO: 1461778 - RNA, 19 nt, Homo sapiens
acaaaguccuccggaauga

SEQ ID NO: 1461779 - RNA, 19 nt, Homo sapiens
cacaaaagcuagaagaaaa

SEQ ID NO: 1461780 - RNA, 19 nt, Homo sapiens
aaacaaacaggacuuuaug

SEQ ID NO: 1461781 - RNA, 19 nt, Homo sapiens
ggaacaagcaggaucucaa

SEQ ID NO: 1461782 - RNA, 19 nt, Homo sapiens
gaacuacuggcaucacuag

SEQ ID NO: 1461783 - RNA, 19 nt, Homo sapiens
cgaaaugaaccgcacugua

SEQ ID NO: 1461784 - RNA, 19 nt, Homo sapiens
gaagaccuauuaugauucc

SEQ ID NO: 1461785 - RNA, 19 nt, Homo sapiens
uaaaugcacagucuuugaa

SEQ ID NO: 1461786 - RNA, 19 nt, Homo sapiens
gauauucgaacuugcaaga

SEQ ID NO: 1461787 - RNA, 19 nt, Homo sapiens
ggucuucaauaucaucuuc

SEQ ID NO: 1461788 - RNA, 19 nt, Homo sapiens
agagggagcugccaucaag

SEQ ID NO: 1461789 - RNA, 19 nt, Homo sapiens
caagcaggaucucaaccaa

SEQ ID NO: 1461790 - RNA, 19 nt, Homo sapiens
acaaagaauuccacagagu

SEQ ID NO: 1461791 - RNA, 19 nt, Homo sapiens
caacacguaacgaauggua

SEQ ID NO: 1461792 - RNA, 19 nt, Homo sapiens
ggucagcuggaaacacuua

SEQ ID NO: 1461793 - RNA, 19 nt, Homo sapiens
gaccuauuaugauuccauu

SEQ ID NO: 1461794 - RNA, 19 nt, Homo sapiens
gcaauauguugauccugau

SEQ ID NO: 1461795 - RNA, 19 nt, Homo sapiens
gcugacugguccaaggaua

SEQ ID NO: 1461796 - RNA, 19 nt, Homo sapiens
uaccaaugcucgcuuugaa

SEQ ID NO: 1461797 - RNA, 19 nt, Homo sapiens
gcaaaacaacuuaaucuga

SEQ ID NO: 1461798 - RNA, 19 nt, Homo sapiens
gaacuguuaguccuaccua

SEQ ID NO: 1461799 - RNA, 19 nt, Homo sapiens
ccaccaagaucgcuaugca

SEQ ID NO: 1461800 - RNA, 19 nt, Homo sapiens
uauucgaacuugcaagauu

SEQ ID NO: 1461801 - RNA, 19 nt, Homo sapiens
ucuagaaggcugagaauug

SEQ ID NO: 1461802 - RNA, 19 nt, Homo sapiens
gugcaugccacgauucuuu

SEQ ID NO: 1461803 - RNA, 19 nt, Homo sapiens
gaauccggcucaaauacca

SEQ ID NO: 1461804 - RNA, 19 nt, Homo sapiens
agagaacaaugacugaugu

SEQ ID NO: 1461805 - RNA, 19 nt, Homo sapiens
guaaagaugcacucagcaa

SEQ ID NO: 1461806 - RNA, 19 nt, Homo sapiens
ccacacacaccuuucagaa

SEQ ID NO: 1461807 - RNA, 19 nt, Homo sapiens
agaacuggcuuguccuguu

SEQ ID NO: 1461808 - RNA, 19 nt, Homo sapiens
gaaugagacgguucuggaa

SEQ ID NO: 1461809 - RNA, 19 nt, Homo sapiens
aacaggacuuuauggauuu

SEQ ID NO: 1461810 - RNA, 19 nt, Homo sapiens
caacuuaaucugaaacagu

SEQ ID NO: 1461811 - RNA, 19 nt, Homo sapiens
cagcaaaguucuugaaauu

SEQ ID NO: 1461812 - RNA, 19 nt, Homo sapiens
cagaaccacugaugacuua

SEQ ID NO: 1461813 - RNA, 19 nt, Homo sapiens
caagacagaugcagaauca

SEQ ID NO: 1461814 - RNA, 19 nt, Homo sapiens
gaaaagagcuucugcuucu

SEQ ID NO: 1461815 - RNA, 19 nt, Homo sapiens
gcaggaagauaugauaguu

SEQ ID NO: 1461816 - RNA, 19 nt, Homo sapiens
uaaagcaucuggucaaagu

SEQ ID NO: 1461817 - RNA, 19 nt, Homo sapiens
gaagcaggguucaacuuug

SEQ ID NO: 1461818 - RNA, 19 nt, Homo sapiens
ccauagaccuagucaagaa

SEQ ID NO: 1461819 - RNA, 19 nt, Homo sapiens
gaagcaggaagauaugaua

SEQ ID NO: 1461820 - RNA, 19 nt, Homo sapiens
gauaacaagugggcugaaa

SEQ ID NO: 1461821 - RNA, 19 nt, Homo sapiens
ggcaguaucuucaugguau

SEQ ID NO: 1461822 - RNA, 19 nt, Homo sapiens
gagcuacaguggaucuauu

SEQ ID NO: 1461823 - RNA, 19 nt, Homo sapiens
gggcagcuauuucagagaa

SEQ ID NO: 1461824 - RNA, 19 nt, Homo sapiens
gaaaacaucucaggacaug

SEQ ID NO: 1461825 - RNA, 19 nt, Homo sapiens
ugaaucaaguuccagagaa

SEQ ID NO: 1461826 - RNA, 19 nt, Homo sapiens
gcugcuaugaugaauauua

SEQ ID NO: 1461827 - RNA, 19 nt, Homo sapiens
uacaguggaucuauucaaa

SEQ ID NO: 1461828 - RNA, 19 nt, Homo sapiens
gaaucaaguuccagagaag

SEQ ID NO: 1461829 - RNA, 19 nt, Homo sapiens
gguuaaaggcaacuuauga

SEQ ID NO: 1461830 - RNA, 19 nt, Homo sapiens
gcgcuaacauuuccugagu

SEQ ID NO: 1461831 - RNA, 19 nt, Homo sapiens
uaaugcgauuucucucuua

SEQ ID NO: 1461832 - RNA, 19 nt, Homo sapiens
cgagcaaucugccucucua

SEQ ID NO: 1461833 - RNA, 19 nt, Homo sapiens
ucucaugacugucucaaau

SEQ ID NO: 1461834 - RNA, 19 nt, Homo sapiens
caagagguaucaccauuuu

SEQ ID NO: 1461835 - RNA, 19 nt, Homo sapiens
aagcuuaacuucuguaggu

SEQ ID NO: 1461836 - RNA, 19 nt, Homo sapiens
aaauagcacuacaaaguca

SEQ ID NO: 1461837 - RNA, 19 nt, Homo sapiens
gacaauaagacgauaacaa

SEQ ID NO: 1461838 - RNA, 19 nt, Homo sapiens
gacacugccucaagcaaug

SEQ ID NO: 1461839 - RNA, 19 nt, Homo sapiens
caacuaguccugaaucaag

SEQ ID NO: 1461840 - RNA, 19 nt, Homo sapiens
ggagggauuccuuggauug

SEQ ID NO: 1461841 - RNA, 19 nt, Homo sapiens
caaaauagcacuacaaagu

SEQ ID NO: 1461842 - RNA, 19 nt, Homo sapiens
gaacugugggacaauaaga

SEQ ID NO: 1461843 - RNA, 19 nt, Homo sapiens
ggagcaauauuuucuaaug

SEQ ID NO: 1461844 - RNA, 19 nt, Homo sapiens
ucauugcuguuaaaucuga

SEQ ID NO: 1461845 - RNA, 19 nt, Homo sapiens
ugcgauuucucucuuauuu

SEQ ID NO: 1461846 - RNA, 19 nt, Homo sapiens
gguaacgaauaaaugcuau

SEQ ID NO: 1461847 - RNA, 19 nt, Homo sapiens
gagcuuuccuucccacaag

SEQ ID NO: 1461848 - RNA, 19 nt, Homo sapiens
gcucaguaguggcagcaaa

SEQ ID NO: 1461849 - RNA, 19 nt, Homo sapiens
auucaaagcuuaacuucug

SEQ ID NO: 1461850 - RNA, 19 nt, Homo sapiens
ucagcaaaguucuugaaau

SEQ ID NO: 1461851 - RNA, 19 nt, Homo sapiens
uggcugcuaugaugaauau

SEQ ID NO: 1461852 - RNA, 19 nt, Homo sapiens
cuaaugcgauuucucucuu

SEQ ID NO: 1461853 - RNA, 19 nt, Homo sapiens
gcacaaauugccggagaaa

SEQ ID NO: 1461854 - RNA, 19 nt, Homo sapiens
aacaagagguaucaccauu

SEQ ID NO: 1461855 - RNA, 19 nt, Homo sapiens
uauccaugguaacgaauaa

SEQ ID NO: 1461856 - RNA, 19 nt, Homo sapiens
gacaacuaguccugaauca

SEQ ID NO: 1461857 - RNA, 19 nt, Homo sapiens
uaauaaagcaucuggucaa

SEQ ID NO: 1461858 - RNA, 19 nt, Homo sapiens
acagagagaugcuggacau

SEQ ID NO: 1461859 - RNA, 19 nt, Homo sapiens
acaaguugcacaaagauuu

SEQ ID NO: 1461860 - RNA, 19 nt, Homo sapiens
gcagaaccacugaugacuu

SEQ ID NO: 1461861 - RNA, 19 nt, Homo sapiens
acucaugaauaccacauuu

SEQ ID NO: 1461862 - RNA, 19 nt, Homo sapiens
gaagauaugauaguucucu

SEQ ID NO: 1461863 - RNA, 19 nt, Homo sapiens
ucagcggccuggcucagua

SEQ ID NO: 1461864 - RNA, 19 nt, Homo sapiens
gaaaaugugcaggagauua

SEQ ID NO: 1461865 - RNA, 19 nt, Homo sapiens
aacaagagcuacaguggau

SEQ ID NO: 1461866 - RNA, 19 nt, Homo sapiens
gguggaggcuguacaugca

SEQ ID NO: 1461867 - RNA, 19 nt, Homo sapiens
ggauggcaguaucuucaug

SEQ ID NO: 1461868 - RNA, 19 nt, Homo sapiens
gaugguuaaaggcaacuua

SEQ ID NO: 1461869 - RNA, 19 nt, Homo sapiens
cuacuaagcaucagacauc

SEQ ID NO: 1461870 - RNA, 19 nt, Homo sapiens
gaagaaacuguggcugcua

SEQ ID NO: 1461871 - RNA, 19 nt, Homo sapiens
aauaaagcaucuggucaaa

SEQ ID NO: 1461872 - RNA, 19 nt, Homo sapiens
cuaacaccaugcagacuug

SEQ ID NO: 1461873 - RNA, 19 nt, Homo sapiens
agcaaaagcucaacuguuu

SEQ ID NO: 1461874 - RNA, 19 nt, Homo sapiens
ggagacacccaaagcuuca

SEQ ID NO: 1461875 - RNA, 19 nt, Homo sapiens
gaaggaaacaagagcuaca

SEQ ID NO: 1461876 - RNA, 19 nt, Homo sapiens
gaaacuguggcugcuauga

SEQ ID NO: 1461877 - RNA, 19 nt, Homo sapiens
ucacuacacagccaacaaa

SEQ ID NO: 1461878 - RNA, 19 nt, Homo sapiens
acaauaagacgauaacaag

SEQ ID NO: 1461879 - RNA, 19 nt, Homo sapiens
guuaaaggcaacuuaugaa

SEQ ID NO: 1461880 - RNA, 19 nt, Homo sapiens
agaugaaccugaaguacau

SEQ ID NO: 1461881 - RNA, 19 nt, Homo sapiens
agacaucguucguggagau

SEQ ID NO: 1461882 - RNA, 19 nt, Homo sapiens
guggaucuauucaaagcuu

SEQ ID NO: 1461883 - RNA, 19 nt, Homo sapiens
aagaaacuguggcugcuau

SEQ ID NO: 1461884 - RNA, 19 nt, Homo sapiens
uauguugucuuccucuaau

SEQ ID NO: 1461885 - RNA, 19 nt, Homo sapiens
ugcaggagauuaagacuag

SEQ ID NO: 1461886 - RNA, 19 nt, Homo sapiens
aagcaggguucaacuuugu

SEQ ID NO: 1461887 - RNA, 19 nt, Homo sapiens
gacccaagcauuccucuuc

SEQ ID NO: 1461888 - RNA, 19 nt, Homo sapiens
gcuguuaaaucugaugauc

SEQ ID NO: 1461889 - RNA, 19 nt, Homo sapiens
cuuacaaguugcacaaaga

SEQ ID NO: 1461890 - RNA, 19 nt, Homo sapiens
guaaagcagagcacaguca

SEQ ID NO: 1461891 - RNA, 19 nt, Homo sapiens
aaacaucucaggacaugga

SEQ ID NO: 1461892 - RNA, 19 nt, Homo sapiens
uaaauccccuccugauauu

SEQ ID NO: 1461893 - RNA, 19 nt, Homo sapiens
aaauguugguucaccuaaa

SEQ ID NO: 1461894 - RNA, 19 nt, Homo sapiens
gaacaaaauagcacuacaa

SEQ ID NO: 1461895 - RNA, 19 nt, Homo sapiens
ccagacagcacaccuaugg

SEQ ID NO: 1461896 - RNA, 19 nt, Homo sapiens
gguucaacuuugugagaaa

SEQ ID NO: 1461897 - RNA, 19 nt, Homo sapiens
gccauguacuccuguaaag

SEQ ID NO: 1461898 - RNA, 19 nt, Homo sapiens
gggauuccuuggauugcaa

SEQ ID NO: 1461899 - RNA, 19 nt, Homo sapiens
gucaaaguaucacuacaca

SEQ ID NO: 1461900 - RNA, 19 nt, Homo sapiens
aagcagagcacagucauga

SEQ ID NO: 1461901 - RNA, 19 nt, Homo sapiens
ucucauuccucugaacaaa

SEQ ID NO: 1461902 - RNA, 19 nt, Homo sapiens
uuaggacucuaccgaauag

SEQ ID NO: 1461903 - RNA, 19 nt, Homo sapiens
acccaaagcuucaccaaac

SEQ ID NO: 1461904 - RNA, 19 nt, Homo sapiens
agacagaugcagaaucaga

SEQ ID NO: 1461905 - RNA, 19 nt, Homo sapiens
ggguucaacuuugugagaa

SEQ ID NO: 1461906 - RNA, 19 nt, Homo sapiens
cauucaagcuguggaaaca

SEQ ID NO: 1461907 - RNA, 19 nt, Homo sapiens
gaaccacugaugacuuaca

SEQ ID NO: 1461908 - RNA, 19 nt, Homo sapiens
ccacaaggagcaauauuuu

SEQ ID NO: 1461909 - RNA, 19 nt, Homo sapiens
acaagagguaucaccauuu

SEQ ID NO: 1461910 - RNA, 19 nt, Homo sapiens
ggcaacuuaugaaggcaaa

SEQ ID NO: 1461911 - RNA, 19 nt, Homo sapiens
gaucuagucuuucgaguua

SEQ ID NO: 1461912 - RNA, 19 nt, Homo sapiens
ggaagaaguuucaccaaug

SEQ ID NO: 1461913 - RNA, 19 nt, Homo sapiens
gaaauaaucccgugucauc

SEQ ID NO: 1461914 - RNA, 19 nt, Homo sapiens
gaucaugcauuacacuuug

SEQ ID NO: 1461915 - RNA, 19 nt, Homo sapiens
caacgaagcacauguaaug

SEQ ID NO: 1461916 - RNA, 19 nt, Homo sapiens
gaaauguucuuccaguugu

SEQ ID NO: 1461917 - RNA, 19 nt, Homo sapiens
aauuaaagcuguaccagua

SEQ ID NO: 1461918 - RNA, 19 nt, Homo sapiens
gaaaugguacugaaaguug

SEQ ID NO: 1461919 - RNA, 19 nt, Homo sapiens
cagaugaaaucacagauga

SEQ ID NO: 1461920 - RNA, 19 nt, Homo sapiens
gaucagagguagagauuac

SEQ ID NO: 1461921 - RNA, 19 nt, Homo sapiens
aaaguacucuguccauaaa

SEQ ID NO: 1461922 - RNA, 19 nt, Homo sapiens
ggaauuggcuauggauaau

SEQ ID NO: 1461923 - RNA, 19 nt, Homo sapiens
agaaagagaugauggaagu

SEQ ID NO: 1461924 - RNA, 19 nt, Homo sapiens
gggaagaaguuucaccaau

SEQ ID NO: 1461925 - RNA, 19 nt, Homo sapiens
gaagcaagcacaugccaaa

SEQ ID NO: 1461926 - RNA, 19 nt, Homo sapiens
gaucaaaccuggugcuacu

SEQ ID NO: 1461927 - RNA, 19 nt, Homo sapiens
aaaaguaucugccucauuu

SEQ ID NO: 1461928 - RNA, 19 nt, Homo sapiens
gaagaaguuucaccaaugc

SEQ ID NO: 1461929 - RNA, 19 nt, Homo sapiens
gaaguguuaccauuacuaa

SEQ ID NO: 1461930 - RNA, 19 nt, Homo sapiens
uaaaguacucuguccauaa

SEQ ID NO: 1461931 - RNA, 19 nt, Homo sapiens
aaagugagauuacaucagu

SEQ ID NO: 1461932 - RNA, 19 nt, Homo sapiens
gaaagaaagagaugaugga

SEQ ID NO: 1461933 - RNA, 19 nt, Homo sapiens
ggaauuccaucugagaaga

SEQ ID NO: 1461934 - RNA, 19 nt, Homo sapiens
aaucagaggugagaauauu

SEQ ID NO: 1461935 - RNA, 19 nt, Homo sapiens
cauagacucugacacuuug

SEQ ID NO: 1461936 - RNA, 19 nt, Homo sapiens
caagaaccaugcauacauc

SEQ ID NO: 1461937 - RNA, 19 nt, Homo sapiens
aaagggaaauguugucgaa

SEQ ID NO: 1461938 - RNA, 19 nt, Homo sapiens
cgaagcacauguaauggaa

SEQ ID NO: 1461939 - RNA, 19 nt, Homo sapiens
uaugugaccuuuccaccua

SEQ ID NO: 1461940 - RNA, 19 nt, Homo sapiens
gauaucuguuagcccauua

SEQ ID NO: 1461941 - RNA, 19 nt, Homo sapiens
gauuaugccuauacuggaa

SEQ ID NO: 1461942 - RNA, 19 nt, Homo sapiens
ugaaaguuguccuuaguug

SEQ ID NO: 1461943 - RNA, 19 nt, Homo sapiens
gaagaaaugguacugaaag

SEQ ID NO: 1461944 - RNA, 19 nt, Homo sapiens
gccaggugauucaguuuaa

SEQ ID NO: 1461945 - RNA, 19 nt, Homo sapiens
uuacaauccucuuuccaaa

SEQ ID NO: 1461946 - RNA, 19 nt, Homo sapiens
gauguugaaucuuacaauc

SEQ ID NO: 1461947 - RNA, 19 nt, Homo sapiens
gaggaucccgggacauuaa

SEQ ID NO: 1461948 - RNA, 19 nt, Homo sapiens
guaucugccucauuugauu

SEQ ID NO: 1461949 - RNA, 19 nt, Homo sapiens
caucauuucuucaaguuuc

SEQ ID NO: 1461950 - RNA, 19 nt, Homo sapiens
aagaagaaaugguacugaa

SEQ ID NO: 1461951 - RNA, 19 nt, Homo sapiens
cagaugaagugcaggucua

SEQ ID NO: 1461952 - RNA, 19 nt, Homo sapiens
guacugaaaguuguccuua

SEQ ID NO: 1461953 - RNA, 19 nt, Homo sapiens
uagcagaguuugggcaauu

SEQ ID NO: 1461954 - RNA, 19 nt, Homo sapiens
uaaaucagaggugagaaua

SEQ ID NO: 1461955 - RNA, 19 nt, Homo sapiens
gauuuguacuguuuagaug

SEQ ID NO: 1461956 - RNA, 19 nt, Homo sapiens
uuaaaguacucuguccaua

SEQ ID NO: 1461957 - RNA, 19 nt, Homo sapiens
gaagaagaaaugguacuga

SEQ ID NO: 1461958 - RNA, 19 nt, Homo sapiens
auacagagacccaugguuu

SEQ ID NO: 1461959 - RNA, 19 nt, Homo sapiens
ggauaucuguuagcccauu

SEQ ID NO: 1461960 - RNA, 19 nt, Homo sapiens
gguggacucuucccugaug

SEQ ID NO: 1461961 - RNA, 19 nt, Homo sapiens
ggaaguguuaccauuacua

SEQ ID NO: 1461962 - RNA, 19 nt, Homo sapiens
cuaaggacauaaggaauug

SEQ ID NO: 1461963 - RNA, 19 nt, Homo sapiens
ccuagagccuuaacagaau

SEQ ID NO: 1461964 - RNA, 19 nt, Homo sapiens
aaucauggaugcaauuaag

SEQ ID NO: 1461965 - RNA, 19 nt, Homo sapiens
aaauguuccugaagaagaa

SEQ ID NO: 1461966 - RNA, 19 nt, Homo sapiens
cgaaggaucuuuugagugu

SEQ ID NO: 1461967 - RNA, 19 nt, Homo sapiens
gcaagcacaugccaaaaug

SEQ ID NO: 1461968 - RNA, 19 nt, Homo sapiens
uaaauguuccugaagaaga

SEQ ID NO: 1461969 - RNA, 19 nt, Homo sapiens
guaaaagcauuucucgauu

SEQ ID NO: 1461970 - RNA, 19 nt, Homo sapiens
gggcuauguuugaaguaaa

SEQ ID NO: 1461971 - RNA, 19 nt, Homo sapiens
ugaaaucacagaugaagug

SEQ ID NO: 1461972 - RNA, 19 nt, Homo sapiens
cauccacaacugagaaaua

SEQ ID NO: 1461973 - RNA, 19 nt, Homo sapiens
aagcacauguaauggaauu

SEQ ID NO: 1461974 - RNA, 19 nt, Homo sapiens
gccuagagccuuaacagaa

SEQ ID NO: 1461975 - RNA, 19 nt, Homo sapiens
uuaaagcuguaccaguaaa

SEQ ID NO: 1461976 - RNA, 19 nt, Homo sapiens
ucacaaaacugaggaaaau

SEQ ID NO: 1461977 - RNA, 19 nt, Homo sapiens
ccagugauuucuuagagau

SEQ ID NO: 1461978 - RNA, 19 nt, Homo sapiens
cauauacuauccagaagca

SEQ ID NO: 1461979 - RNA, 19 nt, Homo sapiens
cucgauagauuauuuguca

SEQ ID NO: 1461980 - RNA, 19 nt, Homo sapiens
uuauggcucucgauagauu

SEQ ID NO: 1461981 - RNA, 19 nt, Homo sapiens
aggacugucuguucaauga

SEQ ID NO: 1461982 - RNA, 19 nt, Homo sapiens
aaacagcuuccuuguauca

SEQ ID NO: 1461983 - RNA, 19 nt, Homo sapiens
caggugauucaguuuaaua

SEQ ID NO: 1461984 - RNA, 19 nt, Homo sapiens
accaaugccuagagccuua

SEQ ID NO: 1461985 - RNA, 19 nt, Homo sapiens
gaaccaugcauacaucagu

SEQ ID NO: 1461986 - RNA, 19 nt, Homo sapiens
ggagacacuucaggacugu

SEQ ID NO: 1461987 - RNA, 19 nt, Homo sapiens
uuacuaauuuguccuccaa

SEQ ID NO: 1461988 - RNA, 19 nt, Homo sapiens
cacaugaaacuacaaauca

SEQ ID NO: 1461989 - RNA, 19 nt, Homo sapiens
cagcuuccuuguaucagaa

SEQ ID NO: 1461990 - RNA, 19 nt, Homo sapiens
ccaaagaauggauaucugu

SEQ ID NO: 1461991 - RNA, 19 nt, Homo sapiens
ccaagaaccaugcauacau

SEQ ID NO: 1461992 - RNA, 19 nt, Homo sapiens
ggaaaauacugccgcaauc

SEQ ID NO: 1461993 - RNA, 19 nt, Homo sapiens
ucauagacucugacacuuu

SEQ ID NO: 1461994 - RNA, 19 nt, Homo sapiens
guucuaguaaccuaaagua

SEQ ID NO: 1461995 - RNA, 19 nt, Homo sapiens
uaaucuaugugcuugaaca

SEQ ID NO: 1461996 - RNA, 19 nt, Homo sapiens
guauauaugugaccuuucc

SEQ ID NO: 1461997 - RNA, 19 nt, Homo sapiens
guucuaaggacauaaggaa

SEQ ID NO: 1461998 - RNA, 19 nt, Homo sapiens
gcucgaccauccacaacug

SEQ ID NO: 1461999 - RNA, 19 nt, Homo sapiens
aagaauggauaucuguuag

SEQ ID NO: 1462000 - RNA, 19 nt, Homo sapiens
caaagaauggauaucuguu

SEQ ID NO: 1462001 - RNA, 19 nt, Homo sapiens
ggcucucgauagauuauuu

SEQ ID NO: 1462002 - RNA, 19 nt, Homo sapiens
ccaccaguuuguuugauca

SEQ ID NO: 1462003 - RNA, 19 nt, Homo sapiens
cacuguaucuuauaugaag

SEQ ID NO: 1462004 - RNA, 19 nt, Homo sapiens
cuagagccuuaacagaauu

SEQ ID NO: 1462005 - RNA, 19 nt, Homo sapiens
aaucaacgaagcacaugua

SEQ ID NO: 1462006 - RNA, 19 nt, Homo sapiens
aguuauggcucucgauaga

SEQ ID NO: 1462007 - RNA, 19 nt, Homo sapiens
ucaguuauggcucucgaua

SEQ ID NO: 1462008 - RNA, 19 nt, Homo sapiens
acaccaagaaccaugcaua

SEQ ID NO: 1462009 - RNA, 19 nt, Homo sapiens
cuucaggacugucuguuca

SEQ ID NO: 1462010 - RNA, 19 nt, Homo sapiens
gucaucauuucuucaaguu

SEQ ID NO: 1462011 - RNA, 19 nt, Homo sapiens
ggaauuagcugaacaacuu

SEQ ID NO: 1462012 - RNA, 19 nt, Homo sapiens
gguagaagaugguggauua

SEQ ID NO: 1462013 - RNA, 19 nt, Homo sapiens
caaauucccucauuacuuu

SEQ ID NO: 1462014 - RNA, 19 nt, Homo sapiens
gaacagugaagaaagauua

SEQ ID NO: 1462015 - RNA, 19 nt, Homo sapiens
gaaagucucuggaaucaca

SEQ ID NO: 1462016 - RNA, 19 nt, Homo sapiens
ggauuaagcuggcuaagga

SEQ ID NO: 1462017 - RNA, 19 nt, Homo sapiens
gcucagggcucuuugugua

SEQ ID NO: 1462018 - RNA, 19 nt, Homo sapiens
caauagguguuaagguuua

SEQ ID NO: 1462019 - RNA, 19 nt, Homo sapiens
gagaauggcaucuaaguuu

SEQ ID NO: 1462020 - RNA, 19 nt, Homo sapiens
ggaacaagcugagaaacaa

SEQ ID NO: 1462021 - RNA, 19 nt, Homo sapiens
caagaacagugaagaaaga

SEQ ID NO: 1462022 - RNA, 19 nt, Homo sapiens
gaagaacugucauuucaca

SEQ ID NO: 1462023 - RNA, 19 nt, Homo sapiens
ugauagaucucucuucaaa

SEQ ID NO: 1462024 - RNA, 19 nt, Homo sapiens
ggaagaguauggccuguga

SEQ ID NO: 1462025 - RNA, 19 nt, Homo sapiens
gaaacaguaucacaugguu

SEQ ID NO: 1462026 - RNA, 19 nt, Homo sapiens
gaugaagucuugagagaug

SEQ ID NO: 1462027 - RNA, 19 nt, Homo sapiens
gguaacaguucaagggaua

SEQ ID NO: 1462028 - RNA, 19 nt, Homo sapiens
aaagaugacacccaaauua

SEQ ID NO: 1462029 - RNA, 19 nt, Homo sapiens
caaagcagcugagagagaa

SEQ ID NO: 1462030 - RNA, 19 nt, Homo sapiens
aaacagauggagacuauua

SEQ ID NO: 1462031 - RNA, 19 nt, Homo sapiens
ggaggaaacccacauauuc

SEQ ID NO: 1462032 - RNA, 19 nt, Homo sapiens
gaugaagagugguccauga

SEQ ID NO: 1462033 - RNA, 19 nt, Homo sapiens
agaauggcaucuaaguuua

SEQ ID NO: 1462034 - RNA, 19 nt, Homo sapiens
ggauagauaugcuacaaca

SEQ ID NO: 1462035 - RNA, 19 nt, Homo sapiens
gaagagugguccaugaaca

SEQ ID NO: 1462036 - RNA, 19 nt, Homo sapiens
gaagaaacaguaucacaug

SEQ ID NO: 1462037 - RNA, 19 nt, Homo sapiens
gggaggagauccagauguu

SEQ ID NO: 1462038 - RNA, 19 nt, Homo sapiens
caucuaaguuuaugggaaa

SEQ ID NO: 1462039 - RNA, 19 nt, Homo sapiens
gagaaagggucagauacuu

SEQ ID NO: 1462040 - RNA, 19 nt, Homo sapiens
gaaguaauccuugucagaa

SEQ ID NO: 1462041 - RNA, 19 nt, Homo sapiens
gagagaacgucuuggugaa

SEQ ID NO: 1462042 - RNA, 19 nt, Homo sapiens
gaaaauagagcaagagaaa

SEQ ID NO: 1462043 - RNA, 19 nt, Homo sapiens
gauauagaaccaagacuuu

SEQ ID NO: 1462044 - RNA, 19 nt, Homo sapiens
gaacacacccggaaagucu

SEQ ID NO: 1462045 - RNA, 19 nt, Homo sapiens
cagcacaaauucccucauu

SEQ ID NO: 1462046 - RNA, 19 nt, Homo sapiens
ucaagaaaguagagaauca

SEQ ID NO: 1462047 - RNA, 19 nt, Homo sapiens
cgaaagauaugggucaaug

SEQ ID NO: 1462048 - RNA, 19 nt, Homo sapiens
gaaggaacaagcugagaaa

SEQ ID NO: 1462049 - RNA, 19 nt, Homo sapiens
gagaaagcuuugaggauca

SEQ ID NO: 1462050 - RNA, 19 nt, Homo sapiens
ggaaaccaguacugaugaa

SEQ ID NO: 1462051 - RNA, 19 nt, Homo sapiens
ucgaugaucugcucacauu

SEQ ID NO: 1462052 - RNA, 19 nt, Homo sapiens
uguagugugucaucgauua

SEQ ID NO: 1462053 - RNA, 19 nt, Homo sapiens
gaugauaaucuaagccuaa

SEQ ID NO: 1462054 - RNA, 19 nt, Homo sapiens
guugauagaucucucuuca

SEQ ID NO: 1462055 - RNA, 19 nt, Homo sapiens
gaaacuaauaugagcauga

SEQ ID NO: 1462056 - RNA, 19 nt, Homo sapiens
uagagcagcuacuuuguug

SEQ ID NO: 1462057 - RNA, 19 nt, Homo sapiens
uagagaaucagacuuagua

SEQ ID NO: 1462058 - RNA, 19 nt, Homo sapiens
gcaauagguguuaagguuu

SEQ ID NO: 1462059 - RNA, 19 nt, Homo sapiens
aaagagaaagggucagaua

SEQ ID NO: 1462060 - RNA, 19 nt, Homo sapiens
gaaugaagaccagcaagaa

SEQ ID NO: 1462061 - RNA, 19 nt, Homo sapiens
gaacaucuacgggauacaa

SEQ ID NO: 1462062 - RNA, 19 nt, Homo sapiens
gaaucuaacccaaggcaaa

SEQ ID NO: 1462063 - RNA, 19 nt, Homo sapiens
aaacccacauauucagaua

SEQ ID NO: 1462064 - RNA, 19 nt, Homo sapiens
ggaagagaaccaaaggaaa

SEQ ID NO: 1462065 - RNA, 19 nt, Homo sapiens
gauaaucuaagccuaaaug

SEQ ID NO: 1462066 - RNA, 19 nt, Homo sapiens
ggaagaagaaagagacaga

SEQ ID NO: 1462067 - RNA, 19 nt, Homo sapiens
gagccaagauuaucaaagc

SEQ ID NO: 1462068 - RNA, 19 nt, Homo sapiens
ggauacaaagucuacauuu

SEQ ID NO: 1462069 - RNA, 19 nt, Homo sapiens
uuugagagcuaaauucuug

SEQ ID NO: 1462070 - RNA, 19 nt, Homo sapiens
ccagaagacccaagagaaa

SEQ ID NO: 1462071 - RNA, 19 nt, Homo sapiens
ccaaacugauggaaagaga

SEQ ID NO: 1462072 - RNA, 19 nt, Homo sapiens
gaugacacccaaauuauca

SEQ ID NO: 1462073 - RNA, 19 nt, Homo sapiens
ugcaauagguguuaagguu

SEQ ID NO: 1462074 - RNA, 19 nt, Homo sapiens
gaagagaaccaaaggaaaa

SEQ ID NO: 1462075 - RNA, 19 nt, Homo sapiens
agaaagagacagaugguuu

SEQ ID NO: 1462076 - RNA, 19 nt, Homo sapiens
gaggaaacccacauauuca

SEQ ID NO: 1462077 - RNA, 19 nt, Homo sapiens
gaacaagcugagaaacaaa

SEQ ID NO: 1462078 - RNA, 19 nt, Homo sapiens
gcacaaauucccucauuac

SEQ ID NO: 1462079 - RNA, 19 nt, Homo sapiens
gaauauggaauuagcugaa

SEQ ID NO: 1462080 - RNA, 19 nt, Homo sapiens
ugucaucgauuacuaaagu

SEQ ID NO: 1462081 - RNA, 19 nt, Homo sapiens
ggaaaggcauccgagaaag

SEQ ID NO: 1462082 - RNA, 19 nt, Homo sapiens
gaagauaaaggauuagacu

SEQ ID NO: 1462083 - RNA, 19 nt, Homo sapiens
aacaagcucuuuaugagaa

SEQ ID NO: 1462084 - RNA, 19 nt, Homo sapiens
gagacccucugaugaugaa

SEQ ID NO: 1462085 - RNA, 19 nt, Homo sapiens
ggauauagaaccaagacuu

SEQ ID NO: 1462086 - RNA, 19 nt, Homo sapiens
gaacaagaaguugauagau

SEQ ID NO: 1462087 - RNA, 19 nt, Homo sapiens
ccuggaaagugaaagauga

SEQ ID NO: 1462088 - RNA, 19 nt, Homo sapiens
acaagaaguugauagaucu

SEQ ID NO: 1462089 - RNA, 19 nt, Homo sapiens
ugguaaagauguuugaaga

SEQ ID NO: 1462090 - RNA, 19 nt, Homo sapiens
gaaacuauaacacagauac

SEQ ID NO: 1462091 - RNA, 19 nt, Homo sapiens
gagaaucagacuuaguaaa

SEQ ID NO: 1462092 - RNA, 19 nt, Homo sapiens
guagaaacuuugaggacau

SEQ ID NO: 1462093 - RNA, 19 nt, Homo sapiens
aaaggaaacuaugaggaaa

SEQ ID NO: 1462094 - RNA, 19 nt, Homo sapiens
gaggaaaggcauccgagaa

SEQ ID NO: 1462095 - RNA, 19 nt, Homo sapiens
caauuucccaagcaucuua

SEQ ID NO: 1462096 - RNA, 19 nt, Homo sapiens
ucacaaggaggaagaagaa

SEQ ID NO: 1462097 - RNA, 19 nt, Homo sapiens
agauaugggucaauggaaa

SEQ ID NO: 1462098 - RNA, 19 nt, Homo sapiens
uacuaaaguuucaguggua

SEQ ID NO: 1462099 - RNA, 19 nt, Homo sapiens
aguaucacaugguuuauga

SEQ ID NO: 1462100 - RNA, 19 nt, Homo sapiens
cagcuacuuuguuggauga

SEQ ID NO: 1462101 - RNA, 19 nt, Homo sapiens
ccauagagcagcuacuuug

SEQ ID NO: 1462102 - RNA, 19 nt, Homo sapiens
cacccuggaugacauguuu

SEQ ID NO: 1462103 - RNA, 19 nt, Homo sapiens
cggaaagucucuggaauca

SEQ ID NO: 1462104 - RNA, 19 nt, Homo sapiens
gaauuagcugaacaacuua

SEQ ID NO: 1462105 - RNA, 19 nt, Homo sapiens
gacaagaaacauucaaauc

SEQ ID NO: 1462106 - RNA, 19 nt, Homo sapiens
gagacaagaaacauucaaa

SEQ ID NO: 1462107 - RNA, 19 nt, Homo sapiens
gaaaguagagaaucagacu

SEQ ID NO: 1462108 - RNA, 19 nt, Homo sapiens
cauuguagccgaaagauau

SEQ ID NO: 1462109 - RNA, 19 nt, Homo sapiens
ggaaauguccccaaaguau

SEQ ID NO: 1462110 - RNA, 19 nt, Homo sapiens
gagucuugcugcacaaaug

SEQ ID NO: 1462111 - RNA, 19 nt, Homo sapiens
caaaugaucuccucucuau

SEQ ID NO: 1462112 - RNA, 19 nt, Homo sapiens
gaggugccauuguucauua

SEQ ID NO: 1462113 - RNA, 19 nt, Homo sapiens
gaagauagagguccuuuau

SEQ ID NO: 1462114 - RNA, 19 nt, Homo sapiens
guacagcuguccaaagaaa

SEQ ID NO: 1462115 - RNA, 19 nt, Homo sapiens
agagagagcuuucuucaga

SEQ ID NO: 1462116 - RNA, 19 nt, Homo sapiens
gcuacuagaugcaggaauu

SEQ ID NO: 1462117 - RNA, 19 nt, Homo sapiens
guaugaaacugucgaugaa

SEQ ID NO: 1462118 - RNA, 19 nt, Homo sapiens
ggagaucuuuagggaaaua

SEQ ID NO: 1462119 - RNA, 19 nt, Homo sapiens
ugagagaggugccauuguu

SEQ ID NO: 1462120 - RNA, 19 nt, Homo sapiens
cgaaguacgugauggaaug

SEQ ID NO: 1462121 - RNA, 19 nt, Homo sapiens
gaccguggcugcuuacaga

SEQ ID NO: 1462122 - RNA, 19 nt, Homo sapiens
gaagcauuauguuccaauu

SEQ ID NO: 1462123 - RNA, 19 nt, Homo sapiens
gcaucaaucuccagcaaau

SEQ ID NO: 1462124 - RNA, 19 nt, Homo sapiens
gaagaagccaagaagauug

SEQ ID NO: 1462125 - RNA, 19 nt, Homo sapiens
ccggagaucuuuagggaaa

SEQ ID NO: 1462126 - RNA, 19 nt, Homo sapiens
ggaaauacacagacuucaa

SEQ ID NO: 1462127 - RNA, 19 nt, Homo sapiens
gaugaaggccugaagauag

SEQ ID NO: 1462128 - RNA, 19 nt, Homo sapiens
ccaagaagauugcaaaaga

SEQ ID NO: 1462129 - RNA, 19 nt, Homo sapiens
ucucccagauuuagaauuu

SEQ ID NO: 1462130 - RNA, 19 nt, Homo sapiens
gaaauacacagacuucaag

SEQ ID NO: 1462131 - RNA, 19 nt, Homo sapiens
aagcaggacucgccauauu

SEQ ID NO: 1462132 - RNA, 19 nt, Homo sapiens
acacagacuucaagauguu

SEQ ID NO: 1462133 - RNA, 19 nt, Homo sapiens
gggccuuccuggaucaaua

SEQ ID NO: 1462134 - RNA, 19 nt, Homo sapiens
caaagaaaauccucagcua

SEQ ID NO: 1462135 - RNA, 19 nt, Homo sapiens
agauagagguccuuuaugg

SEQ ID NO: 1462136 - RNA, 19 nt, Homo sapiens
accaaguacugcagaaaua

SEQ ID NO: 1462137 - RNA, 19 nt, Homo sapiens
ucaagauguucucugauga

SEQ ID NO: 1462138 - RNA, 19 nt, Homo sapiens
cacacaggcuuuacugcua

SEQ ID NO: 1462139 - RNA, 19 nt, Homo sapiens
ggaauuacaggauauuucu

SEQ ID NO: 1462140 - RNA, 19 nt, Homo sapiens
gcaggacucgccauauuau

SEQ ID NO: 1462141 - RNA, 19 nt, Homo sapiens
uaaagcaggacucgccaua

SEQ ID NO: 1462142 - RNA, 19 nt, Homo sapiens
ccucaggccuggcagaaga

SEQ ID NO: 1462143 - RNA, 19 nt, Homo sapiens
ugaagaagccaagaagauu

SEQ ID NO: 1462144 - RNA, 19 nt, Homo sapiens
ggguuucuuugauuucuuu

SEQ ID NO: 1462145 - RNA, 19 nt, Homo sapiens
ugguacagcuguccaaaga

SEQ ID NO: 1462146 - RNA, 19 nt, Homo sapiens
cagcaucaaucuccagcaa

SEQ ID NO: 1462147 - RNA, 19 nt, Homo sapiens
uaaaagaaguccccaaaag

SEQ ID NO: 1462148 - RNA, 19 nt, Homo sapiens
guugauggguuucuuugau

SEQ ID NO: 1462149 - RNA, 19 nt, Homo sapiens
ugauggguuucuuugauuu

SEQ ID NO: 1462150 - RNA, 19 nt, Homo sapiens
gcucagucucccuauauuu

SEQ ID NO: 1462151 - RNA, 19 nt, Homo sapiens
aagccaaguugauggguuu

SEQ ID NO: 1462152 - RNA, 19 nt, Homo sapiens
gaugagagaggugccauug

SEQ ID NO: 1462153 - RNA, 19 nt, Homo sapiens
ccauaccuaucauuucaug

SEQ ID NO: 1462154 - RNA, 19 nt, Homo sapiens
caagaagauugcaaaagaa

SEQ ID NO: 1462155 - RNA, 19 nt, Homo sapiens
cgaugaaggccugaagaua

SEQ ID NO: 1462156 - RNA, 19 nt, Homo sapiens
gaaaggaccaguguaccau

SEQ ID NO: 1462157 - RNA, 19 nt, Homo sapiens
cuagaaccuuggaagcauu

SEQ ID NO: 1462158 - RNA, 19 nt, Homo sapiens
caaguugauggguuucuuu

SEQ ID NO: 1462159 - RNA, 19 nt, Homo sapiens
augcaggaauuacaggaua

SEQ ID NO: 1462160 - RNA, 19 nt, Homo sapiens
aaacagagagagcuuucuu

SEQ ID NO: 1462161 - RNA, 19 nt, Homo sapiens
gaugaagaagccaagaaga

SEQ ID NO: 1462162 - RNA, 19 nt, Homo sapiens
agagcuuucuucagaggua

SEQ ID NO: 1462163 - RNA, 19 nt, Homo sapiens
ggaccaguguaccaugagu

SEQ ID NO: 1462164 - RNA, 19 nt, Homo sapiens
aaugaucuccucucuauuc

SEQ ID NO: 1462165 - RNA, 19 nt, Homo sapiens
cagcaaacccgaaguacgu

SEQ ID NO: 1462166 - RNA, 19 nt, Homo sapiens
uucaagagauguuguccuu

SEQ ID NO: 1462167 - RNA, 19 nt, Homo sapiens
auacacagacuucaagaug

SEQ ID NO: 1462168 - RNA, 19 nt, Homo sapiens
augaaggccugaagauaga

SEQ ID NO: 1462169 - RNA, 19 nt, Homo sapiens
gugauggaauggaacuugu

SEQ ID NO: 1462170 - RNA, 19 nt, Homo sapiens
ggcuuuacugcuacuauua

SEQ ID NO: 1462171 - RNA, 19 nt, Homo sapiens
aaaguuaaaugggcuaagg

SEQ ID NO: 1462172 - RNA, 19 nt, Homo sapiens
uugauggguuucuuugauu

SEQ ID NO: 1462173 - RNA, 19 nt, Homo sapiens
uaaaugggcuaaggaaaau

SEQ ID NO: 1462174 - RNA, 19 nt, Homo sapiens
gguccuuuauggugaugaa

SEQ ID NO: 1462175 - RNA, 19 nt, Homo sapiens
ccaaguugauggguuucuu

SEQ ID NO: 1462176 - RNA, 19 nt, Homo sapiens
uucaagauguucucugaug

SEQ ID NO: 1462177 - RNA, 19 nt, Homo sapiens
cauuacacgauucucaaua

SEQ ID NO: 1462178 - RNA, 19 nt, Homo sapiens
gcgacagucugguuuuaaa

SEQ ID NO: 1462179 - RNA, 19 nt, Homo sapiens
gcaggaauuacaggauauu

SEQ ID NO: 1462180 - RNA, 19 nt, Homo sapiens
uacacagacuucaagaugu

SEQ ID NO: 1462181 - RNA, 19 nt, Homo sapiens
acacgauucucaauaacca

SEQ ID NO: 1462182 - RNA, 19 nt, Homo sapiens
caaguacugcagaaauaug

SEQ ID NO: 1462183 - RNA, 19 nt, Homo sapiens
ugaagauagagguccuuua

SEQ ID NO: 1462184 - RNA, 19 nt, Homo sapiens
ccaaguacugcagaaauau

SEQ ID NO: 1462185 - RNA, 19 nt, Homo sapiens
ggcucagucucccuauauu

SEQ ID NO: 1462186 - RNA, 19 nt, Homo sapiens
uagaaccuuggaagcauua

SEQ ID NO: 1462187 - RNA, 19 nt, Homo sapiens
guggcucagucucccuaua

SEQ ID NO: 1462188 - RNA, 19 nt, Homo sapiens
cguggcugcuuacagauau

SEQ ID NO: 1462189 - RNA, 19 nt, Homo sapiens
aaggaccaguguaccauga

SEQ ID NO: 1462190 - RNA, 19 nt, Homo sapiens
cuacuagaugcaggaauua

SEQ ID NO: 1462191 - RNA, 19 nt, Homo sapiens
gauucucaauaaccauguu

SEQ ID NO: 1462192 - RNA, 19 nt, Homo sapiens
gagagaggugccauuguuc

SEQ ID NO: 1462193 - RNA, 19 nt, Homo sapiens
gaccaguguaccaugagua

SEQ ID NO: 1462194 - RNA, 19 nt, Homo sapiens
gaaccuuggaagcauuaug

SEQ ID NO: 1462195 - RNA, 19 nt, Homo sapiens
acagagagagcuuucuuca

SEQ ID NO: 1462196 - RNA, 19 nt, Homo sapiens
ugguguggcucucuggauu

SEQ ID NO: 1462197 - RNA, 19 nt, Homo sapiens
acuucaagauguucucuga

SEQ ID NO: 1462198 - RNA, 19 nt, Homo sapiens
aggcuuuacugcuacuauu

SEQ ID NO: 1462199 - RNA, 19 nt, Homo sapiens
gggcgacagucugguuuua

SEQ ID NO: 1462200 - RNA, 19 nt, Homo sapiens
cugagugauuuauuagaga

SEQ ID NO: 1462201 - RNA, 19 nt, Homo sapiens
uacaaaugaucuccucucu

SEQ ID NO: 1462202 - RNA, 19 nt, Homo sapiens
gauagagguccuuuauggu

SEQ ID NO: 1462203 - RNA, 19 nt, Homo sapiens
ccaaggaaccacagauugc

SEQ ID NO: 1462204 - RNA, 19 nt, Homo sapiens
guuaaaugggcuaaggaaa

SEQ ID NO: 1462205 - RNA, 19 nt, Homo sapiens
ucugagugauuuauuagag

SEQ ID NO: 1462206 - RNA, 19 nt, Homo sapiens
agcaggacucgccauauua

SEQ ID NO: 1462207 - RNA, 19 nt, Homo sapiens
ggccuuccuggaucaauaa

SEQ ID NO: 1462208 - RNA, 19 nt, Homo sapiens
guccagcaaacccgaagua

SEQ ID NO: 1462209 - RNA, 19 nt, Homo sapiens
gcaaaagaaggacaguuga

SEQ ID NO: 1462210 - RNA, 19 nt, Homo sapiens
gaagauugcaaaagaagga

SEQ ID NO: 1462211 - RNA, 19 nt, Homo sapiens
ggaaagugaucuagaaauu

SEQ ID NO: 1462212 - RNA, 19 nt, Homo sapiens
ugacagagccauugaaaua

SEQ ID NO: 1462213 - RNA, 19 nt, Homo sapiens
gaaagaauagaacgaguua

SEQ ID NO: 1462214 - RNA, 19 nt, Homo sapiens
ccagaaagccauugacuua

SEQ ID NO: 1462215 - RNA, 19 nt, Homo sapiens
guaagaagguggaggaaga

SEQ ID NO: 1462216 - RNA, 19 nt, Homo sapiens
gaagguggaggaagacuua

SEQ ID NO: 1462217 - RNA, 19 nt, Homo sapiens
caaccuagaucaccuuaug

SEQ ID NO: 1462218 - RNA, 19 nt, Homo sapiens
gcucagaacccagcaaaua

SEQ ID NO: 1462219 - RNA, 19 nt, Homo sapiens
gaaagccauugacuuauuc

SEQ ID NO: 1462220 - RNA, 19 nt, Homo sapiens
uaaagaaggugugauugaa

SEQ ID NO: 1462221 - RNA, 19 nt, Homo sapiens
uaagaaggcucaagaagag

SEQ ID NO: 1462222 - RNA, 19 nt, Homo sapiens
gaauagaacgaguuaagaa

SEQ ID NO: 1462223 - RNA, 19 nt, Homo sapiens
cauaaugcccuucugauaa

SEQ ID NO: 1462224 - RNA, 19 nt, Homo sapiens
agaaagccauugacuuauu

SEQ ID NO: 1462225 - RNA, 19 nt, Homo sapiens
uaaagggucuguuaauucu

SEQ ID NO: 1462226 - RNA, 19 nt, Homo sapiens
ugaggaaagugaucuagaa

SEQ ID NO: 1462227 - RNA, 19 nt, Homo sapiens
gaucuugccuuugccugua

SEQ ID NO: 1462228 - RNA, 19 nt, Homo sapiens
gcagaacauuggagaaagu

SEQ ID NO: 1462229 - RNA, 19 nt, Homo sapiens
cuauugaaguccuaaauga

SEQ ID NO: 1462230 - RNA, 19 nt, Homo sapiens
uuacagugguuugccauua

SEQ ID NO: 1462231 - RNA, 19 nt, Homo sapiens
ggaagaagcagcccaugau

SEQ ID NO: 1462232 - RNA, 19 nt, Homo sapiens
gaaagugaucuagaaauug

SEQ ID NO: 1462233 - RNA, 19 nt, Homo sapiens
aagggucuguuaauucuua

SEQ ID NO: 1462234 - RNA, 19 nt, Homo sapiens
auaaugcccuucugauaaa

SEQ ID NO: 1462235 - RNA, 19 nt, Homo sapiens
ggacucaaugaaauucuua

SEQ ID NO: 1462236 - RNA, 19 nt, Homo sapiens
acagagccauugaaauaaa

SEQ ID NO: 1462237 - RNA, 19 nt, Homo sapiens
gaacgagcuucgggccuuu

SEQ ID NO: 1462238 - RNA, 19 nt, Homo sapiens
ccuuauggaugucgcaaua

SEQ ID NO: 1462239 - RNA, 19 nt, Homo sapiens
ggagaaaguaugagcgaaa

SEQ ID NO: 1462240 - RNA, 19 nt, Homo sapiens
gaaagcacacagacuucua

SEQ ID NO: 1462241 - RNA, 19 nt, Homo sapiens
gaacauuggagaaaguaug

SEQ ID NO: 1462242 - RNA, 19 nt, Homo sapiens
ccuguaaauuggauuauga

SEQ ID NO: 1462243 - RNA, 19 nt, Homo sapiens
uagaucaccuuauggaugu

SEQ ID NO: 1462244 - RNA, 19 nt, Homo sapiens
gaacccagcaaauauguca

SEQ ID NO: 1462245 - RNA, 19 nt, Homo sapiens
ccucugaccuucucaucaa

SEQ ID NO: 1462246 - RNA, 19 nt, Homo sapiens
auaaagcccugcugaagga

SEQ ID NO: 1462247 - RNA, 19 nt, Homo sapiens
gugcaaugcugaaagaagu

SEQ ID NO: 1462248 - RNA, 19 nt, Homo sapiens
cggaaugccuggacucaau

SEQ ID NO: 1462249 - RNA, 19 nt, Homo sapiens
ugaagaugcuagugcaaug

SEQ ID NO: 1462250 - RNA, 19 nt, Homo sapiens
gccaaaugcugccauccaa

SEQ ID NO: 1462251 - RNA, 19 nt, Homo sapiens
gaagaagccagacgacagu

SEQ ID NO: 1462252 - RNA, 19 nt, Homo sapiens
uaaauaaagcccugcugaa

SEQ ID NO: 1462253 - RNA, 19 nt, Homo sapiens
ggagauaacggaggagaug

SEQ ID NO: 1462254 - RNA, 19 nt, Homo sapiens
gagaguggguggagagcau

SEQ ID NO: 1462255 - RNA, 19 nt, Homo sapiens
cuagugcaaugcugaaaga

SEQ ID NO: 1462256 - RNA, 19 nt, Homo sapiens
aaaaguggcugcuauugaa

SEQ ID NO: 1462257 - RNA, 19 nt, Homo sapiens
gaggaaagugaucuagaaa

SEQ ID NO: 1462258 - RNA, 19 nt, Homo sapiens
caaaccaacguaccucuga

SEQ ID NO: 1462259 - RNA, 19 nt, Homo sapiens
gacagagccauugaaauaa

SEQ ID NO: 1462260 - RNA, 19 nt, Homo sapiens
caaaugcugccauccaaga

SEQ ID NO: 1462261 - RNA, 19 nt, Homo sapiens
caagaaaugggagaugaaa

SEQ ID NO: 1462262 - RNA, 19 nt, Homo sapiens
uuaagaaggcucaagaaga

SEQ ID NO: 1462263 - RNA, 19 nt, Homo sapiens
gagcuucgggccuuuguga

SEQ ID NO: 1462264 - RNA, 19 nt, Homo sapiens
ugauaaagaaggugugauu

SEQ ID NO: 1462265 - RNA, 19 nt, Homo sapiens
gggaagaagcagcccauga

SEQ ID NO: 1462266 - RNA, 19 nt, Homo sapiens
cagcucagccuuacaagug

SEQ ID NO: 1462267 - RNA, 19 nt, Homo sapiens
caugcaggauccagaaguu

SEQ ID NO: 1462268 - RNA, 19 nt, Homo sapiens
gagcgagagaucaaagaaa

SEQ ID NO: 1462269 - RNA, 19 nt, Homo sapiens
acccaaagguuaugaaucu

SEQ ID NO: 1462270 - RNA, 19 nt, Homo sapiens
gaagaagcagcccaugauc

SEQ ID NO: 1462271 - RNA, 19 nt, Homo sapiens
aauccucgcuuggccauuu

SEQ ID NO: 1462272 - RNA, 19 nt, Homo sapiens
gaaaauaccaaggaagaaa

SEQ ID NO: 1462273 - RNA, 19 nt, Homo sapiens
uaacggaggagaugaugga

SEQ ID NO: 1462274 - RNA, 19 nt, Homo sapiens
gggcagggaauauacuuau

SEQ ID NO: 1462275 - RNA, 19 nt, Homo sapiens
ccauuaggguauucauuca

SEQ ID NO: 1462276 - RNA, 19 nt, Homo sapiens
ggaugucgcaauaauacaa

SEQ ID NO: 1462277 - RNA, 19 nt, Homo sapiens
gaagagcgagagaucaaag

SEQ ID NO: 1462278 - RNA, 19 nt, Homo sapiens
gauaaagaaggugugauug

SEQ ID NO: 1462279 - RNA, 19 nt, Homo sapiens
guggaaugccugguaauuu

SEQ ID NO: 1462280 - RNA, 19 nt, Homo sapiens
caaagaaagaauagaacga

SEQ ID NO: 1462281 - RNA, 19 nt, Homo sapiens
auaaagaaggugugauuga

SEQ ID NO: 1462282 - RNA, 19 nt, Homo sapiens
uuacugcucuaauuugagu

SEQ ID NO: 1462283 - RNA, 19 nt, Homo sapiens
gccauuaggguauucauuc

SEQ ID NO: 1462284 - RNA, 19 nt, Homo sapiens
uggaaugccugguaauuuu

SEQ ID NO: 1462285 - RNA, 19 nt, Homo sapiens
gaguuaagaaggcucaaga

SEQ ID NO: 1462286 - RNA, 19 nt, Homo sapiens
cgagagaucaaagaaagaa

SEQ ID NO: 1462287 - RNA, 19 nt, Homo sapiens
gagaaaguaugagcgaaaa

SEQ ID NO: 1462288 - RNA, 19 nt, Homo sapiens
cagagccauugaaauaaau

SEQ ID NO: 1462289 - RNA, 19 nt, Homo sapiens
ucaaauuacagaagccaaa

SEQ ID NO: 1462290 - RNA, 19 nt, Homo sapiens
gcuauugaaguccuaaaug

SEQ ID NO: 1462291 - RNA, 19 nt, Homo sapiens
caucaacugaggaaaguga

SEQ ID NO: 1462292 - RNA, 19 nt, Homo sapiens
caagagagcuggggugcuu

SEQ ID NO: 1462293 - RNA, 19 nt, Homo sapiens
ucucaucaguaaauuguca

SEQ ID NO: 1462294 - RNA, 19 nt, Homo sapiens
gauaauguuuuccuacuag

SEQ ID NO: 1462295 - RNA, 19 nt, Homo sapiens
cagacgaaccaucaacuga

SEQ ID NO: 1462296 - RNA, 19 nt, Homo sapiens
gagaucaaagaaagaauag

SEQ ID NO: 1462297 - RNA, 19 nt, Homo sapiens
agaagcagcccaugaucuu

SEQ ID NO: 1462298 - RNA, 19 nt, Homo sapiens
ccauugacuuauucacaga

SEQ ID NO: 1462299 - RNA, 19 nt, Homo sapiens
ggguauucauucagauaau

SEQ ID NO: 1462300 - RNA, 19 nt, Homo sapiens
auuuggaggucaagcauaa

SEQ ID NO: 1462301 - RNA, 19 nt, Homo sapiens
gaaucucaucaguaaauug

SEQ ID NO: 1462302 - RNA, 19 nt, Homo sapiens
gcaaauaugucaaaauacc

SEQ ID NO: 1462303 - RNA, 19 nt, Homo sapiens
acacugaugcuccucaaga

SEQ ID NO: 1462304 - RNA, 19 nt, Homo sapiens
ucagaacccagcaaauaug

SEQ ID NO: 1462305 - RNA, 19 nt, Homo sapiens
gguggaaugccugguaauu

SEQ ID NO: 1462306 - RNA, 19 nt, Homo sapiens
ugauugaaccagacacuga

SEQ ID NO: 1462307 - RNA, 19 nt, Homo sapiens
gcaggauccagaaguuaug

SEQ ID NO: 1462308 - RNA, 19 nt, Homo sapiens
agaaagaauagaacgaguu

SEQ ID NO: 1462309 - RNA, 19 nt, Homo sapiens
gaaaauugcagaacauugg

SEQ ID NO: 1462310 - RNA, 19 nt, Homo sapiens
gaagcagcccaugaucuug

SEQ ID NO: 1462311 - RNA, 19 nt, Homo sapiens
guaaagcccuggcagaaua

SEQ ID NO: 1462312 - RNA, 19 nt, Homo sapiens
ggacaaugcugagagcuaa

SEQ ID NO: 1462313 - RNA, 19 nt, Homo sapiens
caacugacuuaucaucuuu

SEQ ID NO: 1462314 - RNA, 19 nt, Homo sapiens
gcaaaggaaguauucguua

SEQ ID NO: 1462315 - RNA, 19 nt, Homo sapiens
guagagguguugcucauuu

SEQ ID NO: 1462316 - RNA, 19 nt, Homo sapiens
gaaaggaugaguuacguuu

SEQ ID NO: 1462317 - RNA, 19 nt, Homo sapiens
ucaaagaccuccuauccuu

SEQ ID NO: 1462318 - RNA, 19 nt, Homo sapiens
caaaggaaguauucguuau

SEQ ID NO: 1462319 - RNA, 19 nt, Homo sapiens
caagaaacuccacaucaua

SEQ ID NO: 1462320 - RNA, 19 nt, Homo sapiens
caggagcauuuguaacuua

SEQ ID NO: 1462321 - RNA, 19 nt, Homo sapiens
gggauuagauuggcugauu

SEQ ID NO: 1462322 - RNA, 19 nt, Homo sapiens
ccauuuaucuagcacuuaa

SEQ ID NO: 1462323 - RNA, 19 nt, Homo sapiens
uagauuggcugauucauuc

SEQ ID NO: 1462324 - RNA, 19 nt, Homo sapiens
uaaaagagccagccuaaua

SEQ ID NO: 1462325 - RNA, 19 nt, Homo sapiens
cacaugaggugcuuugauu

SEQ ID NO: 1462326 - RNA, 19 nt, Homo sapiens
gaccaucgcccucaacaaa

SEQ ID NO: 1462327 - RNA, 19 nt, Homo sapiens
caaguccaguagcuucuua

SEQ ID NO: 1462328 - RNA, 19 nt, Homo sapiens
ccaagaaacuccacaucau

SEQ ID NO: 1462329 - RNA, 19 nt, Homo sapiens
gaaagugccauguagaugu

SEQ ID NO: 1462330 - RNA, 19 nt, Homo sapiens
uuagugagcuggaugauca

SEQ ID NO: 1462331 - RNA, 19 nt, Homo sapiens
gaugaucaaucccuucuag

SEQ ID NO: 1462332 - RNA, 19 nt, Homo sapiens
gaacacagaccuaccuagu

SEQ ID NO: 1462333 - RNA, 19 nt, Homo sapiens
gagaaucugugcugagaag

SEQ ID NO: 1462334 - RNA, 19 nt, Homo sapiens
gguacugccugaggaauuu

SEQ ID NO: 1462335 - RNA, 19 nt, Homo sapiens
ugaaagagcaaaggaagua

SEQ ID NO: 1462336 - RNA, 19 nt, Homo sapiens
ucacagugcuuuccuccuu

SEQ ID NO: 1462337 - RNA, 19 nt, Homo sapiens
gggagaaucugugcugaga

SEQ ID NO: 1462338 - RNA, 19 nt, Homo sapiens
gcacaaaguugagggaaac

SEQ ID NO: 1462339 - RNA, 19 nt, Homo sapiens
caaagaccuccuauccuua

SEQ ID NO: 1462340 - RNA, 19 nt, Homo sapiens
gaacaaucucagucucuaa

SEQ ID NO: 1462341 - RNA, 19 nt, Homo sapiens
ucugaacccuggacacuaa

SEQ ID NO: 1462342 - RNA, 19 nt, Homo sapiens
gcugauucauucauuaguu

SEQ ID NO: 1462343 - RNA, 19 nt, Homo sapiens
gcagaggacaggccaagaa

SEQ ID NO: 1462344 - RNA, 19 nt, Homo sapiens
ccaaauuuguccuugaugu

SEQ ID NO: 1462345 - RNA, 19 nt, Homo sapiens
caacacacauacucacagu

SEQ ID NO: 1462346 - RNA, 19 nt, Homo sapiens
ccaaagcucaggucccaua

SEQ ID NO: 1462347 - RNA, 19 nt, Homo sapiens
uccaguagcuucuuagguu

SEQ ID NO: 1462348 - RNA, 19 nt, Homo sapiens
gagcauuuguaacuuaaca

SEQ ID NO: 1462349 - RNA, 19 nt, Homo sapiens
gcacucuucuuuaucaucu

SEQ ID NO: 1462350 - RNA, 19 nt, Homo sapiens
ggugcacucuucuuuauca

SEQ ID NO: 1462351 - RNA, 19 nt, Homo sapiens
gugaggaugugguuuagga

SEQ ID NO: 1462352 - RNA, 19 nt, Homo sapiens
gagccagccuaauaucaga

SEQ ID NO: 1462353 - RNA, 19 nt, Homo sapiens
guuguguacugucucauuu

SEQ ID NO: 1462354 - RNA, 19 nt, Homo sapiens
aaacugggcuuccuacacu

SEQ ID NO: 1462355 - RNA, 19 nt, Homo sapiens
caaauuuguccuugaugua

SEQ ID NO: 1462356 - RNA, 19 nt, Homo sapiens
ucaagugccugccuaucuu

SEQ ID NO: 1462357 - RNA, 19 nt, Homo sapiens
gaacgggaaaggaugaguu

SEQ ID NO: 1462358 - RNA, 19 nt, Homo sapiens
ggugaaccaugccaaagga

SEQ ID NO: 1462359 - RNA, 19 nt, Homo sapiens
guggaacacuacagacuga

SEQ ID NO: 1462360 - RNA, 19 nt, Homo sapiens
ccaucgcccucaacaaauu

SEQ ID NO: 1462361 - RNA, 19 nt, Homo sapiens
guggugcacucuucuuuau

SEQ ID NO: 1462362 - RNA, 19 nt, Homo sapiens
gaaggaauaaugagagaag

SEQ ID NO: 1462363 - RNA, 19 nt, Homo sapiens
gaagagugaaggacccaaa

SEQ ID NO: 1462364 - RNA, 19 nt, Homo sapiens
ugaacaaucucagucucua

SEQ ID NO: 1462365 - RNA, 19 nt, Homo sapiens
ugaggaauuugcaaguuug

SEQ ID NO: 1462366 - RNA, 19 nt, Homo sapiens
gaggugcuuugauuucuuc

SEQ ID NO: 1462367 - RNA, 19 nt, Homo sapiens
gugaaggaauaaugagaga

SEQ ID NO: 1462368 - RNA, 19 nt, Homo sapiens
ggauuagauuggcugauuc

SEQ ID NO: 1462369 - RNA, 19 nt, Homo sapiens
cugaggaauuugcaaguuu

SEQ ID NO: 1462370 - RNA, 19 nt, Homo sapiens
aagaaacuccacaucauaa

SEQ ID NO: 1462371 - RNA, 19 nt, Homo sapiens
gagaaggcaggcucaaaga

SEQ ID NO: 1462372 - RNA, 19 nt, Homo sapiens
gguagugaaggaauaauga

SEQ ID NO: 1462373 - RNA, 19 nt, Homo sapiens
uguguacugucucauuuaa

SEQ ID NO: 1462374 - RNA, 19 nt, Homo sapiens
acaacugacuuaucaucuu

SEQ ID NO: 1462375 - RNA, 19 nt, Homo sapiens
acaaugcccuaacccagaa

SEQ ID NO: 1462376 - RNA, 19 nt, Homo sapiens
ggagcaaugggauuagauu

SEQ ID NO: 1462377 - RNA, 19 nt, Homo sapiens
gaaacuccacaucauaaca

SEQ ID NO: 1462378 - RNA, 19 nt, Homo sapiens
gagcaaacugggcuuccua

SEQ ID NO: 1462379 - RNA, 19 nt, Homo sapiens
aaggaugaguuacguuuau

SEQ ID NO: 1462380 - RNA, 19 nt, Homo sapiens
ggaaagugccauguagaug

SEQ ID NO: 1462381 - RNA, 19 nt, Homo sapiens
gcugggagcaaugggauua

SEQ ID NO: 1462382 - RNA, 19 nt, Homo sapiens
ggaauuugcaaguuugugu

SEQ ID NO: 1462383 - RNA, 19 nt, Homo sapiens
ggugauggaugcuacaacu

SEQ ID NO: 1462384 - RNA, 19 nt, Homo sapiens
gaccuccuauccuuauuuc

SEQ ID NO: 1462385 - RNA, 19 nt, Homo sapiens
caagagcugccauuuaucu

SEQ ID NO: 1462386 - RNA, 19 nt, Homo sapiens
gagcaaggaugggacaacu

SEQ ID NO: 1462387 - RNA, 19 nt, Homo sapiens
gccaagaaacuccacauca

SEQ ID NO: 1462388 - RNA, 19 nt, Homo sapiens
uaccuagugugaagaaaug

SEQ ID NO: 1462389 - RNA, 19 nt, Homo sapiens
gagagaaggcaggcucaaa

SEQ ID NO: 1462390 - RNA, 19 nt, Homo sapiens
gggagccuguggaacacua

SEQ ID NO: 1462391 - RNA, 19 nt, Homo sapiens
ccaaacuggugccguucuu

SEQ ID NO: 1462392 - RNA, 19 nt, Homo sapiens
ugacuuaucaucuuugucu

SEQ ID NO: 1462393 - RNA, 19 nt, Homo sapiens
aaaggaugaguuacguuua

SEQ ID NO: 1462394 - RNA, 19 nt, Homo sapiens
gggaaaggaugaguuacgu

SEQ ID NO: 1462395 - RNA, 19 nt, Homo sapiens
cuuggucccugcuguauau

SEQ ID NO: 1462396 - RNA, 19 nt, Homo sapiens
aaagugccauguagaugug

SEQ ID NO: 1462397 - RNA, 19 nt, Homo sapiens
ucagcacccucaucaagug

SEQ ID NO: 1462398 - RNA, 19 nt, Homo sapiens
gcucaaagaccuccuaucc

SEQ ID NO: 1462399 - RNA, 19 nt, Homo sapiens
caaucucagucucuaagug

SEQ ID NO: 1462400 - RNA, 19 nt, Homo sapiens
cuucuauccuuguuacuug

SEQ ID NO: 1462401 - RNA, 19 nt, Homo sapiens
gggaaagugccauguagau

SEQ ID NO: 1462402 - RNA, 19 nt, Homo sapiens
ggucucaagaauucaagua

SEQ ID NO: 1462403 - RNA, 19 nt, Homo sapiens
gagggaaacgggagaaucu

SEQ ID NO: 1462404 - RNA, 19 nt, Homo sapiens
uaucauguccaccuacuau

SEQ ID NO: 1462405 - RNA, 19 nt, Homo sapiens
ggucagcacccucaucaag

SEQ ID NO: 1462406 - RNA, 19 nt, Homo sapiens
gaacagcugggagcaaugg

SEQ ID NO: 1462407 - RNA, 19 nt, Homo sapiens
ggugacgccuuccucaucu

SEQ ID NO: 1462408 - RNA, 19 nt, Homo sapiens
ccugggacccuuaaucuug

SEQ ID NO: 1462409 - RNA, 19 nt, Homo sapiens
gaaagagcaaaggaaguau

SEQ ID NO: 1462410 - RNA, 19 nt, Homo sapiens
ggaaaggaugaguuacguu

SEQ ID NO: 1462411 - RNA, 19 nt, Homo sapiens
ccagucagcuccaguauaa

SEQ ID NO: 1462412 - RNA, 19 nt, Homo sapiens
gcaugaaugugagauguua

SEQ ID NO: 1462413 - RNA, 19 nt, Homo sapiens
gaucaugggugcuggcauu

SEQ ID NO: 1462414 - RNA, 19 nt, Homo sapiens
uaagggagcuggaugcaau

SEQ ID NO: 1462415 - RNA, 19 nt, Homo sapiens
caucagagcuggaaagacu

SEQ ID NO: 1462416 - RNA, 19 nt, Homo sapiens
gaacauggaaauacuggaa

SEQ ID NO: 1462417 - RNA, 19 nt, Homo sapiens
ggagcuagcccagcaagua

SEQ ID NO: 1462418 - RNA, 19 nt, Homo sapiens
gaccgaggcucuagaacug

SEQ ID NO: 1462419 - RNA, 19 nt, Homo sapiens
cagccgaccugacugugua

SEQ ID NO: 1462420 - RNA, 19 nt, Homo sapiens
gcaagccagucucagaugu

SEQ ID NO: 1462421 - RNA, 19 nt, Homo sapiens
gaaacuacaggagauggua

SEQ ID NO: 1462422 - RNA, 19 nt, Homo sapiens
caaaggaggguccaugugu

SEQ ID NO: 1462423 - RNA, 19 nt, Homo sapiens
gcaaguacucuacaugcaa

SEQ ID NO: 1462424 - RNA, 19 nt, Homo sapiens
uugcagaccuggaaucaga

SEQ ID NO: 1462425 - RNA, 19 nt, Homo sapiens
gaaaucuugugcagagagu

SEQ ID NO: 1462426 - RNA, 19 nt, Homo sapiens
guauaaacgucuggagaug

SEQ ID NO: 1462427 - RNA, 19 nt, Homo sapiens
accaugcccuuuaaacaua

SEQ ID NO: 1462428 - RNA, 19 nt, Homo sapiens
gaaagcaucagagcuggaa

SEQ ID NO: 1462429 - RNA, 19 nt, Homo sapiens
acacacaccucagucuuug

SEQ ID NO: 1462430 - RNA, 19 nt, Homo sapiens
auaaacgucuggagaugaa

SEQ ID NO: 1462431 - RNA, 19 nt, Homo sapiens
cgaccuugauugccuguug

SEQ ID NO: 1462432 - RNA, 19 nt, Homo sapiens
gcaggaauguaagcacugu

SEQ ID NO: 1462433 - RNA, 19 nt, Homo sapiens
cagcaacccucugcacuuc

SEQ ID NO: 1462434 - RNA, 19 nt, Homo sapiens
ccagccaucuacugcaauu

SEQ ID NO: 1462435 - RNA, 19 nt, Homo sapiens
gaagccacgugagauuaau

SEQ ID NO: 1462436 - RNA, 19 nt, Homo sapiens
ucagaagccagccaaguuu

SEQ ID NO: 1462437 - RNA, 19 nt, Homo sapiens
gcuagguugugaacugcua

SEQ ID NO: 1462438 - RNA, 19 nt, Homo sapiens
caacagggaaagcaucaga

SEQ ID NO: 1462439 - RNA, 19 nt, Homo sapiens
uacaggagaugguauugug

SEQ ID NO: 1462440 - RNA, 19 nt, Homo sapiens
ggcagaaacuacaggagau

SEQ ID NO: 1462441 - RNA, 19 nt, Homo sapiens
gaucagagcccuagauacc

SEQ ID NO: 1462442 - RNA, 19 nt, Homo sapiens
uaaaggggcugaauguguu

SEQ ID NO: 1462443 - RNA, 19 nt, Homo sapiens
gaggcucggucuccaguca

SEQ ID NO: 1462444 - RNA, 19 nt, Homo sapiens
cuacaacgcgaccuugauu

SEQ ID NO: 1462445 - RNA, 19 nt, Homo sapiens
agagcuggcugcuucaguu

SEQ ID NO: 1462446 - RNA, 19 nt, Homo sapiens
cgugaugcaucugccuuua

SEQ ID NO: 1462447 - RNA, 19 nt, Homo sapiens
gcucuugcuggaacuguua

SEQ ID NO: 1462448 - RNA, 19 nt, Homo sapiens
ccaaaagccuggcaugaau

SEQ ID NO: 1462449 - RNA, 19 nt, Homo sapiens
agagagggcugcugcugau

SEQ ID NO: 1462450 - RNA, 19 nt, Homo sapiens
ggccagccaucuacugcaa

SEQ ID NO: 1462451 - RNA, 19 nt, Homo sapiens
ugaagccacgugagauuaa

SEQ ID NO: 1462452 - RNA, 19 nt, Homo sapiens
ggaaauacuggaagaacag

SEQ ID NO: 1462453 - RNA, 19 nt, Homo sapiens
ucacagagauuuucgucuu

SEQ ID NO: 1462454 - RNA, 19 nt, Homo sapiens
gaagcaacugcaggugaua

SEQ ID NO: 1462455 - RNA, 19 nt, Homo sapiens
gagucgcgcucucuugagu

SEQ ID NO: 1462456 - RNA, 19 nt, Homo sapiens
cagcugugggcaagucuua

SEQ ID NO: 1462457 - RNA, 19 nt, Homo sapiens
ggaaucagaacagcuuuua

SEQ ID NO: 1462458 - RNA, 19 nt, Homo sapiens
agaagcaacugcaggugau

SEQ ID NO: 1462459 - RNA, 19 nt, Homo sapiens
gcucccaccaugcccuuua

SEQ ID NO: 1462460 - RNA, 19 nt, Homo sapiens
ggacgcgagcagugaugua

SEQ ID NO: 1462461 - RNA, 19 nt, Homo sapiens
gggcaagucuuagcaaucc

SEQ ID NO: 1462462 - RNA, 19 nt, Homo sapiens
uaucccaggcuauguauga

SEQ ID NO: 1462463 - RNA, 19 nt, Homo sapiens
gucagaagccagccaaguu

SEQ ID NO: 1462464 - RNA, 19 nt, Homo sapiens
gugcagagaguauccugaa

SEQ ID NO: 1462465 - RNA, 19 nt, Homo sapiens
uggaaauacuggaagaaca

SEQ ID NO: 1462466 - RNA, 19 nt, Homo sapiens
gagcccgucuaccaaaaua

SEQ ID NO: 1462467 - RNA, 19 nt, Homo sapiens
gagcuggcugcuucaguuu

SEQ ID NO: 1462468 - RNA, 19 nt, Homo sapiens
cagagucuagugcuucuuu

SEQ ID NO: 1462469 - RNA, 19 nt, Homo sapiens
caugaagccacgugagauu

SEQ ID NO: 1462470 - RNA, 19 nt, Homo sapiens
cagaaccugcugccacuuu

SEQ ID NO: 1462471 - RNA, 19 nt, Homo sapiens
aagaucagagcccuagaua

SEQ ID NO: 1462472 - RNA, 19 nt, Homo sapiens
gaaauacuggaagaacaga

SEQ ID NO: 1462473 - RNA, 19 nt, Homo sapiens
uggcagacuucaccacuag

SEQ ID NO: 1462474 - RNA, 19 nt, Homo sapiens
gcugcgugcucauugugaa

SEQ ID NO: 1462475 - RNA, 19 nt, Homo sapiens
cgaugcugcuguuccagaa

SEQ ID NO: 1462476 - RNA, 19 nt, Homo sapiens
gcagagaguauccugaacu

SEQ ID NO: 1462477 - RNA, 19 nt, Homo sapiens
caugggugcuggcauugug

SEQ ID NO: 1462478 - RNA, 19 nt, Homo sapiens
gauugacaguguggagcua

SEQ ID NO: 1462479 - RNA, 19 nt, Homo sapiens
ccaccaugcccuuuaaaca

SEQ ID NO: 1462480 - RNA, 19 nt, Homo sapiens
guuagaagggcagaaacua

SEQ ID NO: 1462481 - RNA, 19 nt, Homo sapiens
gcaacccucugcacuucag

SEQ ID NO: 1462482 - RNA, 19 nt, Homo sapiens
ugacgaugcugcuguucca

SEQ ID NO: 1462483 - RNA, 19 nt, Homo sapiens
acauggaaauacuggaaga

SEQ ID NO: 1462484 - RNA, 19 nt, Homo sapiens
cacacacaccucagucuuu

SEQ ID NO: 1462485 - RNA, 19 nt, Homo sapiens
gaaagcaggaauguaagca

SEQ ID NO: 1462486 - RNA, 19 nt, Homo sapiens
gaaugugcccagcucgaau

SEQ ID NO: 1462487 - RNA, 19 nt, Homo sapiens
cggcagcucuauggaacaa

SEQ ID NO: 1462488 - RNA, 19 nt, Homo sapiens
uuucgucuuuggcuuauug

SEQ ID NO: 1462489 - RNA, 19 nt, Homo sapiens
ccacagcaagccagucuca

SEQ ID NO: 1462490 - RNA, 19 nt, Homo sapiens
gcagaaacuacaggagaug

SEQ ID NO: 1462491 - RNA, 19 nt, Homo sapiens
ccaaguuucugcggaacau

SEQ ID NO: 1462492 - RNA, 19 nt, Homo sapiens
uggcaggaccuaaagauca

SEQ ID NO: 1462493 - RNA, 19 nt, Homo sapiens
gaccagcugugggcaaguc

SEQ ID NO: 1462494 - RNA, 19 nt, Homo sapiens
ggacccagucucaguugug

SEQ ID NO: 1462495 - RNA, 19 nt, Homo sapiens
gcaagcaacagggaaagca

SEQ ID NO: 1462496 - RNA, 19 nt, Homo sapiens
uauaaacgucuggagauga

SEQ ID NO: 1462497 - RNA, 19 nt, Homo sapiens
ccacacacaccucagucuu

SEQ ID NO: 1462498 - RNA, 19 nt, Homo sapiens
cugauuagccucacacaag

SEQ ID NO: 1462499 - RNA, 19 nt, Homo sapiens
caccaugcccuuuaaacau

SEQ ID NO: 1462500 - RNA, 19 nt, Homo sapiens
ccagcugcgugcucauugu

SEQ ID NO: 1462501 - RNA, 19 nt, Homo sapiens
gucuggagaugaacagcaa

SEQ ID NO: 1462502 - RNA, 19 nt, Homo sapiens
acuguugguucguuacuug

SEQ ID NO: 1462503 - RNA, 19 nt, Homo sapiens
uggagucacugcaggaucu

SEQ ID NO: 1462504 - RNA, 19 nt, Homo sapiens
gagcuagcccagcaaguac

SEQ ID NO: 1462505 - RNA, 19 nt, Homo sapiens
ugugggaacccuccuauca

SEQ ID NO: 1462506 - RNA, 19 nt, Homo sapiens
ggaauguaagcacuguuca

SEQ ID NO: 1462507 - RNA, 19 nt, Homo sapiens
gcaugaagccacgugagau

SEQ ID NO: 1462508 - RNA, 19 nt, Homo sapiens
ggaauggccaugguaaagg

SEQ ID NO: 1462509 - RNA, 19 nt, Homo sapiens
uagaagggcagaaacuaca

SEQ ID NO: 1462510 - RNA, 19 nt, Homo sapiens
ggcaggaccuaaagaucag

SEQ ID NO: 1462511 - RNA, 19 nt, Homo sapiens
ggacagagguauaucauga

SEQ ID NO: 1462512 - RNA, 19 nt, Homo sapiens
gaagauaaauggaggugaa

SEQ ID NO: 1462513 - RNA, 19 nt, Homo sapiens
aaaccaggcuuuaaacuuu

SEQ ID NO: 1462514 - RNA, 19 nt, Homo sapiens
gaacucaacugcuguuuac

SEQ ID NO: 1462515 - RNA, 19 nt, Homo sapiens
gggauucgauggauucuuu

SEQ ID NO: 1462516 - RNA, 19 nt, Homo sapiens
gcacuaguguuugucauuu

SEQ ID NO: 1462517 - RNA, 19 nt, Homo sapiens
ggagagaagcaucggauua

SEQ ID NO: 1462518 - RNA, 19 nt, Homo sapiens
gggcugaucaugaagauua

SEQ ID NO: 1462519 - RNA, 19 nt, Homo sapiens
ccaaacagggucagauuua

SEQ ID NO: 1462520 - RNA, 19 nt, Homo sapiens
guaaagcacuaguguuugu

SEQ ID NO: 1462521 - RNA, 19 nt, Homo sapiens
ggugugauuucuccaauuu

SEQ ID NO: 1462522 - RNA, 19 nt, Homo sapiens
gagcagccauuguuugaug

SEQ ID NO: 1462523 - RNA, 19 nt, Homo sapiens
gaaagaagcacugggaaga

SEQ ID NO: 1462524 - RNA, 19 nt, Homo sapiens
ucaagagacucccgaagaa

SEQ ID NO: 1462525 - RNA, 19 nt, Homo sapiens
agaaugggcugaucaugaa

SEQ ID NO: 1462526 - RNA, 19 nt, Homo sapiens
gcagugugguuugaagaua

SEQ ID NO: 1462527 - RNA, 19 nt, Homo sapiens
gagagaagcaucggauuaa

SEQ ID NO: 1462528 - RNA, 19 nt, Homo sapiens
gcaggaaacuccagaagac

SEQ ID NO: 1462529 - RNA, 19 nt, Homo sapiens
gaaaccaggcuuuaaacuu

SEQ ID NO: 1462530 - RNA, 19 nt, Homo sapiens
gugagaagaugagcaauau

SEQ ID NO: 1462531 - RNA, 19 nt, Homo sapiens
gaaacacagugguaugaag

SEQ ID NO: 1462532 - RNA, 19 nt, Homo sapiens
ucagucagcucgaucaaga

SEQ ID NO: 1462533 - RNA, 19 nt, Homo sapiens
gcagaucaguguagacagu

SEQ ID NO: 1462534 - RNA, 19 nt, Homo sapiens
ucagagaaguuccacauca

SEQ ID NO: 1462535 - RNA, 19 nt, Homo sapiens
ccaaugagauggauauucg

SEQ ID NO: 1462536 - RNA, 19 nt, Homo sapiens
gaacaaguuuugccaguga

SEQ ID NO: 1462537 - RNA, 19 nt, Homo sapiens
gacaaugcccugaaucuug

SEQ ID NO: 1462538 - RNA, 19 nt, Homo sapiens
ccaaggccaucauuguauu

SEQ ID NO: 1462539 - RNA, 19 nt, Homo sapiens
aaaguaagaccgaguuaaa

SEQ ID NO: 1462540 - RNA, 19 nt, Homo sapiens
ggacagugcagccgaguug

SEQ ID NO: 1462541 - RNA, 19 nt, Homo sapiens
cagaagacccugaagaaug

SEQ ID NO: 1462542 - RNA, 19 nt, Homo sapiens
gaggugaaguugcaguguu

SEQ ID NO: 1462543 - RNA, 19 nt, Homo sapiens
gaugauuccugguguucuu

SEQ ID NO: 1462544 - RNA, 19 nt, Homo sapiens
gaacuaugacauugaaauc

SEQ ID NO: 1462545 - RNA, 19 nt, Homo sapiens
gcagagcauuuguuuaaaa

SEQ ID NO: 1462546 - RNA, 19 nt, Homo sapiens
ccagaaugcugaucucuac

SEQ ID NO: 1462547 - RNA, 19 nt, Homo sapiens
uaaagagucuaaguucaga

SEQ ID NO: 1462548 - RNA, 19 nt, Homo sapiens
gaugacacccuuucucgaa

SEQ ID NO: 1462549 - RNA, 19 nt, Homo sapiens
gacagucucuccucuuauc

SEQ ID NO: 1462550 - RNA, 19 nt, Homo sapiens
ugagaaaccaggcuuuaaa

SEQ ID NO: 1462551 - RNA, 19 nt, Homo sapiens
acagagauuugccuacuau

SEQ ID NO: 1462552 - RNA, 19 nt, Homo sapiens
ggaagaagaaggauauuuu

SEQ ID NO: 1462553 - RNA, 19 nt, Homo sapiens
gagucuaaguucagaguug

SEQ ID NO: 1462554 - RNA, 19 nt, Homo sapiens
ccgaagaaguguccgaaug

SEQ ID NO: 1462555 - RNA, 19 nt, Homo sapiens
gcuaacacugugcaucuua

SEQ ID NO: 1462556 - RNA, 19 nt, Homo sapiens
gagcaaaguguucgggauu

SEQ ID NO: 1462557 - RNA, 19 nt, Homo sapiens
agagguauaucaugaagga

SEQ ID NO: 1462558 - RNA, 19 nt, Homo sapiens
gcaugugacgagauaauuu

SEQ ID NO: 1462559 - RNA, 19 nt, Homo sapiens
gaaagucccgcuccgacaa

SEQ ID NO: 1462560 - RNA, 19 nt, Homo sapiens
gagaagaugagcaauaugg

SEQ ID NO: 1462561 - RNA, 19 nt, Homo sapiens
agaagacccugaagaaugg

SEQ ID NO: 1462562 - RNA, 19 nt, Homo sapiens
caaguuuccuggccucuca

SEQ ID NO: 1462563 - RNA, 19 nt, Homo sapiens
gggauuggauguugauuuu

SEQ ID NO: 1462564 - RNA, 19 nt, Homo sapiens
gcagaacccaggaaugaau

SEQ ID NO: 1462565 - RNA, 19 nt, Homo sapiens
ugacgcagcuccuccucaa

SEQ ID NO: 1462566 - RNA, 19 nt, Homo sapiens
gauaaauggaggugaaguu

SEQ ID NO: 1462567 - RNA, 19 nt, Homo sapiens
gaagagaagccaguacauc

SEQ ID NO: 1462568 - RNA, 19 nt, Homo sapiens
ccucaaguuuggugauaaa

SEQ ID NO: 1462569 - RNA, 19 nt, Homo sapiens
ccagguaaacauuguauug

SEQ ID NO: 1462570 - RNA, 19 nt, Homo sapiens
gaugaugauuccugguguu

SEQ ID NO: 1462571 - RNA, 19 nt, Homo sapiens
ggaacuaugacauugaaau

SEQ ID NO: 1462572 - RNA, 19 nt, Homo sapiens
gauggaaacagaagauugu

SEQ ID NO: 1462573 - RNA, 19 nt, Homo sapiens
gauggauucuuuggcauug

SEQ ID NO: 1462574 - RNA, 19 nt, Homo sapiens
gcgagcagccauuguuuga

SEQ ID NO: 1462575 - RNA, 19 nt, Homo sapiens
augcacagaugaccuauga

SEQ ID NO: 1462576 - RNA, 19 nt, Homo sapiens
cagugugguuugaagauaa

SEQ ID NO: 1462577 - RNA, 19 nt, Homo sapiens
gaggaacaauuaagcuucu

SEQ ID NO: 1462578 - RNA, 19 nt, Homo sapiens
gagauuugccuacuauaca

SEQ ID NO: 1462579 - RNA, 19 nt, Homo sapiens
ggagauggagcccaagaug

SEQ ID NO: 1462580 - RNA, 19 nt, Homo sapiens
gagauggagcccaagauga

SEQ ID NO: 1462581 - RNA, 19 nt, Homo sapiens
gaaaccagagcaaaguguu

SEQ ID NO: 1462582 - RNA, 19 nt, Homo sapiens
ccagagccuugcaaguaaa

SEQ ID NO: 1462583 - RNA, 19 nt, Homo sapiens
gauaaugagguacgguauu

SEQ ID NO: 1462584 - RNA, 19 nt, Homo sapiens
cacuaguguuugucauuua

SEQ ID NO: 1462585 - RNA, 19 nt, Homo sapiens
uguuuacagugucagauua

SEQ ID NO: 1462586 - RNA, 19 nt, Homo sapiens
ugagcaauaugggaacuuu

SEQ ID NO: 1462587 - RNA, 19 nt, Homo sapiens
uggucgaccucaucuauuu

SEQ ID NO: 1462588 - RNA, 19 nt, Homo sapiens
auaaugagguacgguauug

SEQ ID NO: 1462589 - RNA, 19 nt, Homo sapiens
agaguuguguccagagaaa

SEQ ID NO: 1462590 - RNA, 19 nt, Homo sapiens
aaccagagccuugcaagua

SEQ ID NO: 1462591 - RNA, 19 nt, Homo sapiens
caauuuacccucuuuggau

SEQ ID NO: 1462592 - RNA, 19 nt, Homo sapiens
gcugugcauuggaggagua

SEQ ID NO: 1462593 - RNA, 19 nt, Homo sapiens
cccgggagauccaagcaua

SEQ ID NO: 1462594 - RNA, 19 nt, Homo sapiens
gauguccugugacugagaa

SEQ ID NO: 1462595 - RNA, 19 nt, Homo sapiens
gaagauugugagaagauga

SEQ ID NO: 1462596 - RNA, 19 nt, Homo sapiens
cugggaagaggaacaauua

SEQ ID NO: 1462597 - RNA, 19 nt, Homo sapiens
gaacuccagccaccuuugu

SEQ ID NO: 1462598 - RNA, 19 nt, Homo sapiens
gccuuuggcugucagagaa

SEQ ID NO: 1462599 - RNA, 19 nt, Homo sapiens
guaggaaaguugugaaaau

SEQ ID NO: 1462600 - RNA, 19 nt, Homo sapiens
ccacagagauuugccuacu

SEQ ID NO: 1462601 - RNA, 19 nt, Homo sapiens
gaaaauacucucccaagga

SEQ ID NO: 1462602 - RNA, 19 nt, Homo sapiens
uugaggagauggaaacaga

SEQ ID NO: 1462603 - RNA, 19 nt, Homo sapiens
gcugaugaaugcacagaag

SEQ ID NO: 1462604 - RNA, 19 nt, Homo sapiens
uuaaccgucugaaucguuu

SEQ ID NO: 1462605 - RNA, 19 nt, Homo sapiens
aagaaugggcugaucauga

SEQ ID NO: 1462606 - RNA, 19 nt, Homo sapiens
ggucagauuuacugcucaa

SEQ ID NO: 1462607 - RNA, 19 nt, Homo sapiens
uacugaagaugcugacuga

SEQ ID NO: 1462608 - RNA, 19 nt, Homo sapiens
ucaagggaauacugaagau

SEQ ID NO: 1462609 - RNA, 19 nt, Homo sapiens
agugucagauuaacauuug

SEQ ID NO: 1462610 - RNA, 19 nt, Homo sapiens
ggagugcagaguccuuaaa

SEQ ID NO: 1462611 - RNA, 19 nt, Homo sapiens
gauauaggguuacagauua

SEQ ID NO: 1462612 - RNA, 19 nt, Homo sapiens
gggcaaagauggauuuaua

SEQ ID NO: 1462613 - RNA, 19 nt, Homo sapiens
gauguuagaugaaggagua

SEQ ID NO: 1462614 - RNA, 19 nt, Homo sapiens
gaugggagcauuugauuua

SEQ ID NO: 1462615 - RNA, 19 nt, Homo sapiens
ccaggaagauguuagauga

SEQ ID NO: 1462616 - RNA, 19 nt, Homo sapiens
gaauuaauguccucugaug

SEQ ID NO: 1462617 - RNA, 19 nt, Homo sapiens
uuacagcucucaauaaaug

SEQ ID NO: 1462618 - RNA, 19 nt, Homo sapiens
gaaauacacguggacaaua

SEQ ID NO: 1462619 - RNA, 19 nt, Homo sapiens
gaugaaggcugcugagcuu

SEQ ID NO: 1462620 - RNA, 19 nt, Homo sapiens
gaaggaacuuggcagaaau

SEQ ID NO: 1462621 - RNA, 19 nt, Homo sapiens
caagacacaucauuuauac

SEQ ID NO: 1462622 - RNA, 19 nt, Homo sapiens
cggaggccaucaugaauua

SEQ ID NO: 1462623 - RNA, 19 nt, Homo sapiens
cgaaagaaaucuaagugau

SEQ ID NO: 1462624 - RNA, 19 nt, Homo sapiens
ugaaggaacuuggcagaaa

SEQ ID NO: 1462625 - RNA, 19 nt, Homo sapiens
guucaagacacaucauuua

SEQ ID NO: 1462626 - RNA, 19 nt, Homo sapiens
gaacauugagggaucgaaa

SEQ ID NO: 1462627 - RNA, 19 nt, Homo sapiens
aaaguaggcuuggcuuaaa

SEQ ID NO: 1462628 - RNA, 19 nt, Homo sapiens
aaacagggagaucucauua

SEQ ID NO: 1462629 - RNA, 19 nt, Homo sapiens
ggagaucucauuaucauca

SEQ ID NO: 1462630 - RNA, 19 nt, Homo sapiens
aaauacacguggacaauau

SEQ ID NO: 1462631 - RNA, 19 nt, Homo sapiens
ggaggagggauccacuuua

SEQ ID NO: 1462632 - RNA, 19 nt, Homo sapiens
ccaccuacauggaaauuca

SEQ ID NO: 1462633 - RNA, 19 nt, Homo sapiens
cuagaugcuugucaaauga

SEQ ID NO: 1462634 - RNA, 19 nt, Homo sapiens
gaugaaggaguaauaguug

SEQ ID NO: 1462635 - RNA, 19 nt, Homo sapiens
gaggagggauccacuuuac

SEQ ID NO: 1462636 - RNA, 19 nt, Homo sapiens
ggaaauacacguggacaau

SEQ ID NO: 1462637 - RNA, 19 nt, Homo sapiens
gcacacacacauccaguau

SEQ ID NO: 1462638 - RNA, 19 nt, Homo sapiens
cacaugcauuugacauaua

SEQ ID NO: 1462639 - RNA, 19 nt, Homo sapiens
ggagccaccuacauggaaa

SEQ ID NO: 1462640 - RNA, 19 nt, Homo sapiens
aguaugggcuggugaaaga

SEQ ID NO: 1462641 - RNA, 19 nt, Homo sapiens
ucuagaugcuugucaaaug

SEQ ID NO: 1462642 - RNA, 19 nt, Homo sapiens
ucuaaggucuucucaaucu

SEQ ID NO: 1462643 - RNA, 19 nt, Homo sapiens
gcauuugauuuaccaguuc

SEQ ID NO: 1462644 - RNA, 19 nt, Homo sapiens
acacaugcauuugacauau

SEQ ID NO: 1462645 - RNA, 19 nt, Homo sapiens
acagggagaucucauuauc

SEQ ID NO: 1462646 - RNA, 19 nt, Homo sapiens
gaagauguuagaugaagga

SEQ ID NO: 1462647 - RNA, 19 nt, Homo sapiens
ugacugcucugggaaaugu

SEQ ID NO: 1462648 - RNA, 19 nt, Homo sapiens
ccaaguaguucauuuucua

SEQ ID NO: 1462649 - RNA, 19 nt, Homo sapiens
caauggagcuaaaauauag

SEQ ID NO: 1462650 - RNA, 19 nt, Homo sapiens
gaugaacuccacccgauga

SEQ ID NO: 1462651 - RNA, 19 nt, Homo sapiens
caacggcuccagugcauga

SEQ ID NO: 1462652 - RNA, 19 nt, Homo sapiens
acacacacauccaguaugg

SEQ ID NO: 1462653 - RNA, 19 nt, Homo sapiens
guauuucacaucucaguuu

SEQ ID NO: 1462654 - RNA, 19 nt, Homo sapiens
ccaagggauagauuuauuu

SEQ ID NO: 1462655 - RNA, 19 nt, Homo sapiens
ggaagaagugagugaugaa

SEQ ID NO: 1462656 - RNA, 19 nt, Homo sapiens
cccaagggauagauuuauu

SEQ ID NO: 1462657 - RNA, 19 nt, Homo sapiens
uggaagaagugagugauga

SEQ ID NO: 1462658 - RNA, 19 nt, Homo sapiens
ucaauaaccaccucccaaa

SEQ ID NO: 1462659 - RNA, 19 nt, Homo sapiens
ucacgaauuugcaaugaag

SEQ ID NO: 1462660 - RNA, 19 nt, Homo sapiens
guucacgaauuugcaauga

SEQ ID NO: 1462661 - RNA, 19 nt, Homo sapiens
uggaaaagauauaggguua

SEQ ID NO: 1462662 - RNA, 19 nt, Homo sapiens
uuucuaaggucuucucaau

SEQ ID NO: 1462663 - RNA, 19 nt, Homo sapiens
caaacagggagaucucauu

SEQ ID NO: 1462664 - RNA, 19 nt, Homo sapiens
aaagauauaggguuacaga

SEQ ID NO: 1462665 - RNA, 19 nt, Homo sapiens
cuacugaagcugcugauga

SEQ ID NO: 1462666 - RNA, 19 nt, Homo sapiens
ggcaaagauggauuuauaa

SEQ ID NO: 1462667 - RNA, 19 nt, Homo sapiens
ggagaaacuuuugaagaaa

SEQ ID NO: 1462668 - RNA, 19 nt, Homo sapiens
cagcagcguucaagacaca

SEQ ID NO: 1462669 - RNA, 19 nt, Homo sapiens
gguaaaccuauugugauua

SEQ ID NO: 1462670 - RNA, 19 nt, Homo sapiens
caccaucaaugcagcuuau

SEQ ID NO: 1462671 - RNA, 19 nt, Homo sapiens
guuagaugaaggaguaaua

SEQ ID NO: 1462672 - RNA, 19 nt, Homo sapiens
gaaaagauauaggguuaca

SEQ ID NO: 1462673 - RNA, 19 nt, Homo sapiens
gaucucgauuccaccagaa

SEQ ID NO: 1462674 - RNA, 19 nt, Homo sapiens
aauauagccuucuguuaag

SEQ ID NO: 1462675 - RNA, 19 nt, Homo sapiens
acaauugggugaaacacau

SEQ ID NO: 1462676 - RNA, 19 nt, Homo sapiens
gagaucucauuaucaucaa

SEQ ID NO: 1462677 - RNA, 19 nt, Homo sapiens
caucuggccuguguaaaca

SEQ ID NO: 1462678 - RNA, 19 nt, Homo sapiens
ggagaacgcgcagcaagug

SEQ ID NO: 1462679 - RNA, 19 nt, Homo sapiens
aaauguauccuaccagguu

SEQ ID NO: 1462680 - RNA, 19 nt, Homo sapiens
agauauaggguuacagauu

SEQ ID NO: 1462681 - RNA, 19 nt, Homo sapiens
ucccaaagcugaaggaacu

SEQ ID NO: 1462682 - RNA, 19 nt, Homo sapiens
gaaaaguaggcuuggcuua

SEQ ID NO: 1462683 - RNA, 19 nt, Homo sapiens
gaaagaguucacgaauuug

SEQ ID NO: 1462684 - RNA, 19 nt, Homo sapiens
guucggaggccaucaugaa

SEQ ID NO: 1462685 - RNA, 19 nt, Homo sapiens
gaucgaaagaaaucuaagu

SEQ ID NO: 1462686 - RNA, 19 nt, Homo sapiens
uggagaaacuuuugaagaa

SEQ ID NO: 1462687 - RNA, 19 nt, Homo sapiens
ggagaccgagcucaagaug

SEQ ID NO: 1462688 - RNA, 19 nt, Homo sapiens
auugagggaucgaaagaaa

SEQ ID NO: 1462689 - RNA, 19 nt, Homo sapiens
ucaugcaucuggccugugu

SEQ ID NO: 1462690 - RNA, 19 nt, Homo sapiens
caggugcucugccauccuu

SEQ ID NO: 1462691 - RNA, 19 nt, Homo sapiens
gggaucgaaagaaaucuaa

SEQ ID NO: 1462692 - RNA, 19 nt, Homo sapiens
ggcaggagccaccuacaug

SEQ ID NO: 1462693 - RNA, 19 nt, Homo sapiens
agggagaucucauuaucau

SEQ ID NO: 1462694 - RNA, 19 nt, Homo sapiens
cguggacaauauagacgua

SEQ ID NO: 1462695 - RNA, 19 nt, Homo sapiens
agaccgagcucaagaugcu

SEQ ID NO: 1462696 - RNA, 19 nt, Homo sapiens
caaaacauccaauuaguuc

SEQ ID NO: 1462697 - RNA, 19 nt, Homo sapiens
aaacccaagggauagauuu

SEQ ID NO: 1462698 - RNA, 19 nt, Homo sapiens
cugcugauguuauucaaag

SEQ ID NO: 1462699 - RNA, 19 nt, Homo sapiens
ccaauggagcuaaaauaua

SEQ ID NO: 1462700 - RNA, 19 nt, Homo sapiens
guucacaaauauugguuac

SEQ ID NO: 1462701 - RNA, 19 nt, Homo sapiens
gggagcauuugauuuacca

SEQ ID NO: 1462702 - RNA, 19 nt, Homo sapiens
gagccaggaagauguuaga

SEQ ID NO: 1462703 - RNA, 19 nt, Homo sapiens
gcacugggaaagucucaca

SEQ ID NO: 1462704 - RNA, 19 nt, Homo sapiens
agaugaaggaguaauaguu

SEQ ID NO: 1462705 - RNA, 19 nt, Homo sapiens
caaccucgagccaggaaga

SEQ ID NO: 1462706 - RNA, 19 nt, Homo sapiens
uggcagaaauggggaaaua

SEQ ID NO: 1462707 - RNA, 19 nt, Homo sapiens
caagaugcugcgcgugauu

SEQ ID NO: 1462708 - RNA, 19 nt, Homo sapiens
gacacaucauuuauacaca

SEQ ID NO: 1462709 - RNA, 19 nt, Homo sapiens
ggugggcaaagauggauuu

SEQ ID NO: 1462710 - RNA, 19 nt, Homo sapiens
gcaucuggccuguguaaac

SEQ ID NO: 1462711 - RNA, 19 nt, Homo sapiens
gcaaggaugucacaagaaa

SEQ ID NO: 1462712 - RNA, 19 nt, Homo sapiens
ucaaugcuguguucuauua

SEQ ID NO: 1462713 - RNA, 19 nt, Homo sapiens
cagaauagauggaguuuca

SEQ ID NO: 1462714 - RNA, 19 nt, Homo sapiens
caacaggaaucuucaagga

SEQ ID NO: 1462715 - RNA, 19 nt, Homo sapiens
gcucaugacuguuucuuug

SEQ ID NO: 1462716 - RNA, 19 nt, Homo sapiens
gaagaaggacucugcauau

SEQ ID NO: 1462717 - RNA, 19 nt, Homo sapiens
gaaggacucugcauaugau

SEQ ID NO: 1462718 - RNA, 19 nt, Homo sapiens
gggaugagcuuugucugua

SEQ ID NO: 1462719 - RNA, 19 nt, Homo sapiens
ggaagaaggacucugcaua

SEQ ID NO: 1462720 - RNA, 19 nt, Homo sapiens
gggcauaguuauuggaauu

SEQ ID NO: 1462721 - RNA, 19 nt, Homo sapiens
gaucaaugcuguguucuau

SEQ ID NO: 1462722 - RNA, 19 nt, Homo sapiens
ucacugacuucaagaauga

SEQ ID NO: 1462723 - RNA, 19 nt, Homo sapiens
gcagagagauggacaacag

SEQ ID NO: 1462724 - RNA, 19 nt, Homo sapiens
gaaccuaccuucauuucag

SEQ ID NO: 1462725 - RNA, 19 nt, Homo sapiens
ggacauccucuucugcuua

SEQ ID NO: 1462726 - RNA, 19 nt, Homo sapiens
gaaugcugcuacuugauuu

SEQ ID NO: 1462727 - RNA, 19 nt, Homo sapiens
ggagucaauuccuaggaua

SEQ ID NO: 1462728 - RNA, 19 nt, Homo sapiens
uaucuuauccucugguuua

SEQ ID NO: 1462729 - RNA, 19 nt, Homo sapiens
ggagagacuuuaucaggau

SEQ ID NO: 1462730 - RNA, 19 nt, Homo sapiens
gagagggagucaauuccua

SEQ ID NO: 1462731 - RNA, 19 nt, Homo sapiens
gcaguaccuugaagagaaa

SEQ ID NO: 1462732 - RNA, 19 nt, Homo sapiens
ggaggaagcaguaccuuga

SEQ ID NO: 1462733 - RNA, 19 nt, Homo sapiens
gugcagcccuuccauguug

SEQ ID NO: 1462734 - RNA, 19 nt, Homo sapiens
ggaggguguuuauguaaga

SEQ ID NO: 1462735 - RNA, 19 nt, Homo sapiens
cgacagcccaucaucauuu

SEQ ID NO: 1462736 - RNA, 19 nt, Homo sapiens
gugcaaggaugucacaaga

SEQ ID NO: 1462737 - RNA, 19 nt, Homo sapiens
aaucggcucuuuccaguuu

SEQ ID NO: 1462738 - RNA, 19 nt, Homo sapiens
gcucuacgcggcaaauuaa

SEQ ID NO: 1462739 - RNA, 19 nt, Homo sapiens
caacaagggagagacuuua

SEQ ID NO: 1462740 - RNA, 19 nt, Homo sapiens
ugacaacuuugccagcuuu

SEQ ID NO: 1462741 - RNA, 19 nt, Homo sapiens
gaugagcuuugucuguauu

SEQ ID NO: 1462742 - RNA, 19 nt, Homo sapiens
caugacuguuucuuuguua

SEQ ID NO: 1462743 - RNA, 19 nt, Homo sapiens
ggaagcagauacauaugag

SEQ ID NO: 1462744 - RNA, 19 nt, Homo sapiens
ccaggaagcagauacauau

SEQ ID NO: 1462745 - RNA, 19 nt, Homo sapiens
gcugcuacuugauuucuuu

SEQ ID NO: 1462746 - RNA, 19 nt, Homo sapiens
cccauucccugguuuauug

SEQ ID NO: 1462747 - RNA, 19 nt, Homo sapiens
gccggaggguguuuaugua

SEQ ID NO: 1462748 - RNA, 19 nt, Homo sapiens
uccaggagaugaaagauga

SEQ ID NO: 1462749 - RNA, 19 nt, Homo sapiens
ggaugagcuuugucuguau

SEQ ID NO: 1462750 - RNA, 19 nt, Homo sapiens
gaaagggcaggaagaagga

SEQ ID NO: 1462751 - RNA, 19 nt, Homo sapiens
gcuauggccggugcuauua

SEQ ID NO: 1462752 - RNA, 19 nt, Homo sapiens
caucacaguugcuacaauc

SEQ ID NO: 1462753 - RNA, 19 nt, Homo sapiens
cuuauccucugguuuaauu

SEQ ID NO: 1462754 - RNA, 19 nt, Homo sapiens
gcaucgagccugcuaagga

SEQ ID NO: 1462755 - RNA, 19 nt, Homo sapiens
ucacgaaucucugguccuu

SEQ ID NO: 1462756 - RNA, 19 nt, Homo sapiens
ggccaugugucuggaauug

SEQ ID NO: 1462757 - RNA, 19 nt, Homo sapiens
gcaguuuguuggaucuuca

SEQ ID NO: 1462758 - RNA, 19 nt, Homo sapiens
caagggagagacuuuauca

SEQ ID NO: 1462759 - RNA, 19 nt, Homo sapiens
guuccacgcucaugacugu

SEQ ID NO: 1462760 - RNA, 19 nt, Homo sapiens
ccucugguuuaauuacaua

SEQ ID NO: 1462761 - RNA, 19 nt, Homo sapiens
gaccaccaccaaugucuaa

SEQ ID NO: 1462762 - RNA, 19 nt, Homo sapiens
uagauggaguuucacaaug

SEQ ID NO: 1462763 - RNA, 19 nt, Homo sapiens
cuacuugauuucuuucuca

SEQ ID NO: 1462764 - RNA, 19 nt, Homo sapiens
ggaagcaguaccuugaaga

SEQ ID NO: 1462765 - RNA, 19 nt, Homo sapiens
cagcagcucucugggauca

SEQ ID NO: 1462766 - RNA, 19 nt, Homo sapiens
caucaucauuuccauugug

SEQ ID NO: 1462767 - RNA, 19 nt, Homo sapiens
ucugaaugcugcuacuuga

SEQ ID NO: 1462768 - RNA, 19 nt, Homo sapiens
gcagcucucugggaucaau

SEQ ID NO: 1462769 - RNA, 19 nt, Homo sapiens
gggagucaauuccuaggau

SEQ ID NO: 1462770 - RNA, 19 nt, Homo sapiens
gaucuuugccaucacaguu

SEQ ID NO: 1462771 - RNA, 19 nt, Homo sapiens
gacauccucuucugcuuag

SEQ ID NO: 1462772 - RNA, 19 nt, Homo sapiens
ugaaugcugcuacuugauu

SEQ ID NO: 1462773 - RNA, 19 nt, Homo sapiens
agaaggacucugcauauga

SEQ ID NO: 1462774 - RNA, 19 nt, Homo sapiens
ccucugcugcuuacuauuu

SEQ ID NO: 1462775 - RNA, 19 nt, Homo sapiens
gaugagagugcaaggaugu

SEQ ID NO: 1462776 - RNA, 19 nt, Homo sapiens
gacaacagacagaauagau

SEQ ID NO: 1462777 - RNA, 19 nt, Homo sapiens
gcaccuuccucacuuccau

SEQ ID NO: 1462778 - RNA, 19 nt, Homo sapiens
gaauagauggaguuucaca

SEQ ID NO: 1462779 - RNA, 19 nt, Homo sapiens
ggacaacagacagaauaga

SEQ ID NO: 1462780 - RNA, 19 nt, Homo sapiens
aagaaggacucugcauaug

SEQ ID NO: 1462781 - RNA, 19 nt, Homo sapiens
agcaguaccuugaagagaa

SEQ ID NO: 1462782 - RNA, 19 nt, Homo sapiens
ggaucaaugcuguguucua

SEQ ID NO: 1462783 - RNA, 19 nt, Homo sapiens
gacagcccaucaucauuuc

SEQ ID NO: 1462784 - RNA, 19 nt, Homo sapiens
gagacgaucauaaaggaau

SEQ ID NO: 1462785 - RNA, 19 nt, Homo sapiens
cugagacgaucauaaagga

SEQ ID NO: 1462786 - RNA, 19 nt, Homo sapiens
ucacuuccauacagcucua

SEQ ID NO: 1462787 - RNA, 19 nt, Homo sapiens
ggaagccggaggguguuua

SEQ ID NO: 1462788 - RNA, 19 nt, Homo sapiens
ucaugacuguuucuuuguu

SEQ ID NO: 1462789 - RNA, 19 nt, Homo sapiens
ucccuuggguucugauauu

SEQ ID NO: 1462790 - RNA, 19 nt, Homo sapiens
aagagcaccuuccucacuu

SEQ ID NO: 1462791 - RNA, 19 nt, Homo sapiens
ucaacaagggagagacuuu

SEQ ID NO: 1462792 - RNA, 19 nt, Homo sapiens
cuucaaggaugcagguguu

SEQ ID NO: 1462793 - RNA, 19 nt, Homo sapiens
ccagcuauccugcaaagug

SEQ ID NO: 1462794 - RNA, 19 nt, Homo sapiens
cagcugggcauaguuauug

SEQ ID NO: 1462795 - RNA, 19 nt, Homo sapiens
guccuugucuguggccaua

SEQ ID NO: 1462796 - RNA, 19 nt, Homo sapiens
gaaauuggagagggaguca

SEQ ID NO: 1462797 - RNA, 19 nt, Homo sapiens
cuaaggagaccaccaccaa

SEQ ID NO: 1462798 - RNA, 19 nt, Homo sapiens
ggagaugaaagaugagagu

SEQ ID NO: 1462799 - RNA, 19 nt, Homo sapiens
agacgaucauaaaggaauu

SEQ ID NO: 1462800 - RNA, 19 nt, Homo sapiens
cuuggcacaugacaacuuu

SEQ ID NO: 1462801 - RNA, 19 nt, Homo sapiens
agauggaguuucacaaugg

SEQ ID NO: 1462802 - RNA, 19 nt, Homo sapiens
ccaccaaugucuaagucau

SEQ ID NO: 1462803 - RNA, 19 nt, Homo sapiens
ccaacuuccuagucggauu

SEQ ID NO: 1462804 - RNA, 19 nt, Homo sapiens
gagauggacaacagacaga

SEQ ID NO: 1462805 - RNA, 19 nt, Homo sapiens
gaggauauaggagaggaaa

SEQ ID NO: 1462806 - RNA, 19 nt, Homo sapiens
gaugaacccaggacugcuu

SEQ ID NO: 1462807 - RNA, 19 nt, Homo sapiens
ggauaucacacgggccuuu

SEQ ID NO: 1462808 - RNA, 19 nt, Homo sapiens
caacuuccuagucggauug

SEQ ID NO: 1462809 - RNA, 19 nt, Homo sapiens
uauaaugggaugagcuuug

SEQ ID NO: 1462810 - RNA, 19 nt, Homo sapiens
gaggaagcaguaccuugaa

SEQ ID NO: 1462811 - RNA, 19 nt, Homo sapiens
gaucugagcuuucuucuug

SEQ ID NO: 1462812 - RNA, 19 nt, Homo sapiens
uaaaugaccugcuuucuuu

SEQ ID NO: 1462813 - RNA, 19 nt, Homo sapiens
ggucugagcuuucuucuug

SEQ ID NO: 1462814 - RNA, 19 nt, Homo sapiens
gacaauaguugaagaaaga

SEQ ID NO: 1462815 - RNA, 19 nt, Homo sapiens
gauaguaaaucccagguaa

SEQ ID NO: 1462816 - RNA, 19 nt, Homo sapiens
ggaaaguaauugucucuau

SEQ ID NO: 1462817 - RNA, 19 nt, Homo sapiens
gaacuacucuuugacuguu

SEQ ID NO: 1462818 - RNA, 19 nt, Homo sapiens
gaaaacacaucuaguaaga

SEQ ID NO: 1462819 - RNA, 19 nt, Homo sapiens
gaucuaaugugcuuauauc

SEQ ID NO: 1462820 - RNA, 19 nt, Homo sapiens
gcauauuucugcauaaugu

SEQ ID NO: 1462821 - RNA, 19 nt, Homo sapiens
gaagguugguacuauuuau

SEQ ID NO: 1462822 - RNA, 19 nt, Homo sapiens
gagcagacaguuucacuuu

SEQ ID NO: 1462823 - RNA, 19 nt, Homo sapiens
uaagaaggcaucuggauuu

SEQ ID NO: 1462824 - RNA, 19 nt, Homo sapiens
ugagauggguguccuaaga

SEQ ID NO: 1462825 - RNA, 19 nt, Homo sapiens
guaaaucccagguaaggua

SEQ ID NO: 1462826 - RNA, 19 nt, Homo sapiens
uaagauaggacaauaguug

SEQ ID NO: 1462827 - RNA, 19 nt, Homo sapiens
ggacaauaguugaagaaag

SEQ ID NO: 1462828 - RNA, 19 nt, Homo sapiens
uaaguacaauguucuccua

SEQ ID NO: 1462829 - RNA, 19 nt, Homo sapiens
ucugguagauugcaaauga

SEQ ID NO: 1462830 - RNA, 19 nt, Homo sapiens
ggaagguugguacuauuua

SEQ ID NO: 1462831 - RNA, 19 nt, Homo sapiens
guaaaucccaaguaaggua

SEQ ID NO: 1462832 - RNA, 19 nt, Homo sapiens
guaaaugaccugcuuucuu

SEQ ID NO: 1462833 - RNA, 19 nt, Homo sapiens
ugaaguuuguggaguguuu

SEQ ID NO: 1462834 - RNA, 19 nt, Homo sapiens
gccaagugaugaagacuga

SEQ ID NO: 1462835 - RNA, 19 nt, Homo sapiens
acaauguucuccuaccuaa

SEQ ID NO: 1462836 - RNA, 19 nt, Homo sapiens
cuaaugugcuuauaucauc

SEQ ID NO: 1462837 - RNA, 19 nt, Homo sapiens
cuacuucuguggacuuuga

SEQ ID NO: 1462838 - RNA, 19 nt, Homo sapiens
gagcagagcaaccuugugu

SEQ ID NO: 1462839 - RNA, 19 nt, Homo sapiens
acacuggaauucgcaauaa

SEQ ID NO: 1462840 - RNA, 19 nt, Homo sapiens
ugaaugcugugugaaguuu

SEQ ID NO: 1462841 - RNA, 19 nt, Homo sapiens
guagagaccauacaacugu

SEQ ID NO: 1462842 - RNA, 19 nt, Homo sapiens
ccaaccaugucauccauug

SEQ ID NO: 1462843 - RNA, 19 nt, Homo sapiens
caaagcaauuacuggaaga

SEQ ID NO: 1462844 - RNA, 19 nt, Homo sapiens
ggucuacgauuaguacgaa

SEQ ID NO: 1462845 - RNA, 19 nt, Homo sapiens
gggcagaucugagcuuucu

SEQ ID NO: 1462846 - RNA, 19 nt, Homo sapiens
gauuguaaaugaccugcuu

SEQ ID NO: 1462847 - RNA, 19 nt, Homo sapiens
uccgguagauuguaaauga

SEQ ID NO: 1462848 - RNA, 19 nt, Homo sapiens
gggaauauucugaaauguu

SEQ ID NO: 1462849 - RNA, 19 nt, Homo sapiens
gaaagaaaagucucuggua

SEQ ID NO: 1462850 - RNA, 19 nt, Homo sapiens
caggcauggucuacgauua

SEQ ID NO: 1462851 - RNA, 19 nt, Homo sapiens
gcagagcaaccuuguguuc

SEQ ID NO: 1462852 - RNA, 19 nt, Homo sapiens
aaacaagggccaagugaug

SEQ ID NO: 1462853 - RNA, 19 nt, Homo sapiens
ugaccugcuuucuuucuuu

SEQ ID NO: 1462854 - RNA, 19 nt, Homo sapiens
cugcaugaguaaucugaua

SEQ ID NO: 1462855 - RNA, 19 nt, Homo sapiens
ccaguauggugguuauaga

SEQ ID NO: 1462856 - RNA, 19 nt, Homo sapiens
cgagugagacaaagcaauu

SEQ ID NO: 1462857 - RNA, 19 nt, Homo sapiens
cgcaauaaauccaguaugg

SEQ ID NO: 1462858 - RNA, 19 nt, Homo sapiens
gaauaagauaggacaauag

SEQ ID NO: 1462859 - RNA, 19 nt, Homo sapiens
gcagugggcuaugguuucu

SEQ ID NO: 1462860 - RNA, 19 nt, Homo sapiens
gcagaucugagcuuucuuc

SEQ ID NO: 1462861 - RNA, 19 nt, Homo sapiens
cgauggaaguucuaagaca

SEQ ID NO: 1462862 - RNA, 19 nt, Homo sapiens
gaauucacagcuauauaug

SEQ ID NO: 1462863 - RNA, 19 nt, Homo sapiens
agagcaaccuuguguucaa

SEQ ID NO: 1462864 - RNA, 19 nt, Homo sapiens
guauggugguuauagaugu

SEQ ID NO: 1462865 - RNA, 19 nt, Homo sapiens
gaaggcaucuggauuuucu

SEQ ID NO: 1462866 - RNA, 19 nt, Homo sapiens
gcaucuggauuuucucuuu

SEQ ID NO: 1462867 - RNA, 19 nt, Homo sapiens
ccaggugggugcuaaggau

SEQ ID NO: 1462868 - RNA, 19 nt, Homo sapiens
guagcuguguacugcauga

SEQ ID NO: 1462869 - RNA, 19 nt, Homo sapiens
agacuuguguagcugugua

SEQ ID NO: 1462870 - RNA, 19 nt, Homo sapiens
guacuucauuagacuugug

SEQ ID NO: 1462871 - RNA, 19 nt, Homo sapiens
ugaauucugucucuaucau

SEQ ID NO: 1462872 - RNA, 19 nt, Homo sapiens
uauggugguuauagaugua

SEQ ID NO: 1462873 - RNA, 19 nt, Homo sapiens
gauugcaaaugaccugcuu

SEQ ID NO: 1462874 - RNA, 19 nt, Homo sapiens
ccucaaauacacuggaauu

SEQ ID NO: 1462875 - RNA, 19 nt, Homo sapiens
gacaaagcaauuacuggaa

SEQ ID NO: 1462876 - RNA, 19 nt, Homo sapiens
gagugagacaaagcaauua

SEQ ID NO: 1462877 - RNA, 19 nt, Homo sapiens
ccuggaagguugguacuau

SEQ ID NO: 1462878 - RNA, 19 nt, Homo sapiens
gaaaacaagggccaaguga

SEQ ID NO: 1462879 - RNA, 19 nt, Homo sapiens
cuaagaaggcaucuggauu

SEQ ID NO: 1462880 - RNA, 19 nt, Homo sapiens
ggcuggcucugguagauug

SEQ ID NO: 1462881 - RNA, 19 nt, Homo sapiens
uugaagagcuugaaaacaa

SEQ ID NO: 1462882 - RNA, 19 nt, Homo sapiens
ggaauucgcaauaaaucca

SEQ ID NO: 1462883 - RNA, 19 nt, Homo sapiens
gaaugaccauguucuuuuc

SEQ ID NO: 1462884 - RNA, 19 nt, Homo sapiens
ccuuggaaauaguaaagaa

SEQ ID NO: 1462885 - RNA, 19 nt, Homo sapiens
caagucuuauuuccuuauc

SEQ ID NO: 1462886 - RNA, 19 nt, Homo sapiens
gaauucugucucuaucauu

SEQ ID NO: 1462887 - RNA, 19 nt, Homo sapiens
ggauuuacuccaaccaugu

SEQ ID NO: 1462888 - RNA, 19 nt, Homo sapiens
acagugaaccucaaauaca

SEQ ID NO: 1462889 - RNA, 19 nt, Homo sapiens
uggcuccgguagauuguaa

SEQ ID NO: 1462890 - RNA, 19 nt, Homo sapiens
uuaaaucccagguggagaa

SEQ ID NO: 1462891 - RNA, 19 nt, Homo sapiens
ucuguggacuuugacuuaa

SEQ ID NO: 1462892 - RNA, 19 nt, Homo sapiens
guacaauguucuccuaccu

SEQ ID NO: 1462893 - RNA, 19 nt, Homo sapiens
gugggcagaucugagcuuu

SEQ ID NO: 1462894 - RNA, 19 nt, Homo sapiens
gcaggucugagcuuucuuc

SEQ ID NO: 1462895 - RNA, 19 nt, Homo sapiens
agucucugguacuucauua

SEQ ID NO: 1462896 - RNA, 19 nt, Homo sapiens
uaguucaguuuccgaguga

SEQ ID NO: 1462897 - RNA, 19 nt, Homo sapiens
gguugguacuauuuauuuc

SEQ ID NO: 1462898 - RNA, 19 nt, Homo sapiens
ggaccccugucgauuguaa

SEQ ID NO: 1462899 - RNA, 19 nt, Homo sapiens
cacuggaauucgcaauaaa

SEQ ID NO: 1462900 - RNA, 19 nt, Homo sapiens
gcaaugugaguccuaagag

SEQ ID NO: 1462901 - RNA, 19 nt, Homo sapiens
cuuguugaaugcuguguga

SEQ ID NO: 1462902 - RNA, 19 nt, Homo sapiens
aauguucuccuaccuaaga

SEQ ID NO: 1462903 - RNA, 19 nt, Homo sapiens
gcaugaguaaucugauaau

SEQ ID NO: 1462904 - RNA, 19 nt, Homo sapiens
ucauuagacuuguguagcu

SEQ ID NO: 1462905 - RNA, 19 nt, Homo sapiens
guugaaugcugugugaagu

SEQ ID NO: 1462906 - RNA, 19 nt, Homo sapiens
cuggaagguugguacuauu

SEQ ID NO: 1462907 - RNA, 19 nt, Homo sapiens
gagcaaccuuguguucaac

SEQ ID NO: 1462908 - RNA, 19 nt, Homo sapiens
uaaauccaguauggugguu

SEQ ID NO: 1462909 - RNA, 19 nt, Homo sapiens
gccuauauaugcauguuuu

SEQ ID NO: 1462910 - RNA, 19 nt, Homo sapiens
caugaguaaucugauaauc

SEQ ID NO: 1462911 - RNA, 19 nt, Homo sapiens
gcugaaaucuccaaauauu

SEQ ID NO: 1462912 - RNA, 19 nt, Homo sapiens
gaacagugcugcaauaaac

SEQ ID NO: 1462913 - RNA, 19 nt, Homo sapiens
gaacccaucaucuacauua

SEQ ID NO: 1462914 - RNA, 19 nt, Homo sapiens
gaucagaaugcuacuauua

SEQ ID NO: 1462915 - RNA, 19 nt, Homo sapiens
ggaccacucuuacaaaguu

SEQ ID NO: 1462916 - RNA, 19 nt, Homo sapiens
gagaagaccuuaugaacca

SEQ ID NO: 1462917 - RNA, 19 nt, Homo sapiens
aagcugaaaucuccaaaua

SEQ ID NO: 1462918 - RNA, 19 nt, Homo sapiens
ggagacuguucuaauuaua

SEQ ID NO: 1462919 - RNA, 19 nt, Homo sapiens
gaaagaaugagaacuaaca

SEQ ID NO: 1462920 - RNA, 19 nt, Homo sapiens
ggaauaugguaggagauaa

SEQ ID NO: 1462921 - RNA, 19 nt, Homo sapiens
gaaguuggcaugcagagaa

SEQ ID NO: 1462922 - RNA, 19 nt, Homo sapiens
aauaagcgauugaacacua

SEQ ID NO: 1462923 - RNA, 19 nt, Homo sapiens
gguaggagauaaauuugga

SEQ ID NO: 1462924 - RNA, 19 nt, Homo sapiens
gacuugggauguagcuuua

SEQ ID NO: 1462925 - RNA, 19 nt, Homo sapiens
guucaacucccacuuauga

SEQ ID NO: 1462926 - RNA, 19 nt, Homo sapiens
gaggaacacugacgagaag

SEQ ID NO: 1462927 - RNA, 19 nt, Homo sapiens
aaaguugguugugcuguua

SEQ ID NO: 1462928 - RNA, 19 nt, Homo sapiens
gcagccuguuugauaauaa

SEQ ID NO: 1462929 - RNA, 19 nt, Homo sapiens
caaaguugguugugcuguu

SEQ ID NO: 1462930 - RNA, 19 nt, Homo sapiens
ggacguagacuuuaucaac

SEQ ID NO: 1462931 - RNA, 19 nt, Homo sapiens
ccaaguauuugcuauugug

SEQ ID NO: 1462932 - RNA, 19 nt, Homo sapiens
gaauaugguaggagauaaa

SEQ ID NO: 1462933 - RNA, 19 nt, Homo sapiens
cauaauggauuggacaaga

SEQ ID NO: 1462934 - RNA, 19 nt, Homo sapiens
ugacacaguaucaucuuua

SEQ ID NO: 1462935 - RNA, 19 nt, Homo sapiens
ucagaaugcuacuauuaug

SEQ ID NO: 1462936 - RNA, 19 nt, Homo sapiens
cuacuggguucuaguuuga

SEQ ID NO: 1462937 - RNA, 19 nt, Homo sapiens
gcuacuggguucuaguuug

SEQ ID NO: 1462938 - RNA, 19 nt, Homo sapiens
ggaggaacacugacgagaa

SEQ ID NO: 1462939 - RNA, 19 nt, Homo sapiens
ucuggagacuguucuaauu

SEQ ID NO: 1462940 - RNA, 19 nt, Homo sapiens
ugugaacagugcugcaaua

SEQ ID NO: 1462941 - RNA, 19 nt, Homo sapiens
gauaguuugcugagaauga

SEQ ID NO: 1462942 - RNA, 19 nt, Homo sapiens
ugugauaguuugcugagaa

SEQ ID NO: 1462943 - RNA, 19 nt, Homo sapiens
cgaggaggacguagacuuu

SEQ ID NO: 1462944 - RNA, 19 nt, Homo sapiens
gaggaggacguagacuuua

SEQ ID NO: 1462945 - RNA, 19 nt, Homo sapiens
gagagaauauacuccaaaa

SEQ ID NO: 1462946 - RNA, 19 nt, Homo sapiens
ccaaacaugagagaauaua

SEQ ID NO: 1462947 - RNA, 19 nt, Homo sapiens
aaggaugguugacacagua

SEQ ID NO: 1462948 - RNA, 19 nt, Homo sapiens
cgugacaaaugcacagauu

SEQ ID NO: 1462949 - RNA, 19 nt, Homo sapiens
agauauuucuccuaagcua

SEQ ID NO: 1462950 - RNA, 19 nt, Homo sapiens
cuucaugacuugggaugua

SEQ ID NO: 1462951 - RNA, 19 nt, Homo sapiens
gcagguuuguuacauaggu

SEQ ID NO: 1462952 - RNA, 19 nt, Homo sapiens
uacaaugcuuagaggaaua

SEQ ID NO: 1462953 - RNA, 19 nt, Homo sapiens
uaacugcuuuaaaggauag

SEQ ID NO: 1462954 - RNA, 19 nt, Homo sapiens
aguauuccaugguguauau

SEQ ID NO: 1462955 - RNA, 19 nt, Homo sapiens
uaucuuaacccuauuccuu

SEQ ID NO: 1462956 - RNA, 19 nt, Homo sapiens
gacacaguaucaucuuuag

SEQ ID NO: 1462957 - RNA, 19 nt, Homo sapiens
acgugaaccuccacaauga

SEQ ID NO: 1462958 - RNA, 19 nt, Homo sapiens
uggagacuguucuaauuau

SEQ ID NO: 1462959 - RNA, 19 nt, Homo sapiens
gugcagguuuguuacauag

SEQ ID NO: 1462960 - RNA, 19 nt, Homo sapiens
guauugcuaucagaaguug

SEQ ID NO: 1462961 - RNA, 19 nt, Homo sapiens
gaaugaugguuugcagcuu

SEQ ID NO: 1462962 - RNA, 19 nt, Homo sapiens
cgugcagguuuguuacaua

SEQ ID NO: 1462963 - RNA, 19 nt, Homo sapiens
agaacgugcagguuuguua

SEQ ID NO: 1462964 - RNA, 19 nt, Homo sapiens
uuccaaacaugagagaaua

SEQ ID NO: 1462965 - RNA, 19 nt, Homo sapiens
ucagaaagaaagaaugaga

SEQ ID NO: 1462966 - RNA, 19 nt, Homo sapiens
uuucuaaacugcagagcuu

SEQ ID NO: 1462967 - RNA, 19 nt, Homo sapiens
ugacuugggauguagcuuu

SEQ ID NO: 1462968 - RNA, 19 nt, Homo sapiens
guccauguguucucauugu

SEQ ID NO: 1462969 - RNA, 19 nt, Homo sapiens
auaauggauuggacaagaa

SEQ ID NO: 1462970 - RNA, 19 nt, Homo sapiens
gaaccaggaauauuuugua

SEQ ID NO: 1462971 - RNA, 19 nt, Homo sapiens
gugccacacuuucuuuauc

SEQ ID NO: 1462972 - RNA, 19 nt, Homo sapiens
cauaguauuccauggugua

SEQ ID NO: 1462973 - RNA, 19 nt, Homo sapiens
gugcugcaauaaacauaug

SEQ ID NO: 1462974 - RNA, 19 nt, Homo sapiens
guacgugaaccuccacaau

SEQ ID NO: 1462975 - RNA, 19 nt, Homo sapiens
uagacuuuaucaacgagua

SEQ ID NO: 1462976 - RNA, 19 nt, Homo sapiens
cuggagacuguucuaauua

SEQ ID NO: 1462977 - RNA, 19 nt, Homo sapiens
cagaaagaaagaaugagaa

SEQ ID NO: 1462978 - RNA, 19 nt, Homo sapiens
uggcagacgugacaaaugc

SEQ ID NO: 1462979 - RNA, 19 nt, Homo sapiens
gacgagaagaccuuaugaa

SEQ ID NO: 1462980 - RNA, 19 nt, Homo sapiens
gugauaguuugcugagaau

SEQ ID NO: 1462981 - RNA, 19 nt, Homo sapiens
cauguguucucauuguuca

SEQ ID NO: 1462982 - RNA, 19 nt, Homo sapiens
gggucuaacuugcgcuuca

SEQ ID NO: 1462983 - RNA, 19 nt, Homo sapiens
gaacgugcagguuuguuac

SEQ ID NO: 1462984 - RNA, 19 nt, Homo sapiens
gagaauauacuccaaaagu

SEQ ID NO: 1462985 - RNA, 19 nt, Homo sapiens
ugucagaaagaaagaauga

SEQ ID NO: 1462986 - RNA, 19 nt, Homo sapiens
cagguuuguuacauaggua

SEQ ID NO: 1462987 - RNA, 19 nt, Homo sapiens
auacaaugcuuagaggaau

SEQ ID NO: 1462988 - RNA, 19 nt, Homo sapiens
aaaggaugguugacacagu

SEQ ID NO: 1462989 - RNA, 19 nt, Homo sapiens
ugaacagugcugcaauaaa

SEQ ID NO: 1462990 - RNA, 19 nt, Homo sapiens
gugaacagugcugcaauaa

SEQ ID NO: 1462991 - RNA, 19 nt, Homo sapiens
ugagagaauauacuccaaa

SEQ ID NO: 1462992 - RNA, 19 nt, Homo sapiens
ggucggcccugaaaaugaa

SEQ ID NO: 1462993 - RNA, 19 nt, Homo sapiens
uaucagaaguuggcaugca

SEQ ID NO: 1462994 - RNA, 19 nt, Homo sapiens
uauacaaugcuuagaggaa

SEQ ID NO: 1462995 - RNA, 19 nt, Homo sapiens
uaccagagugucagaaaga

SEQ ID NO: 1462996 - RNA, 19 nt, Homo sapiens
uguucuaucuuaacccuau

SEQ ID NO: 1462997 - RNA, 19 nt, Homo sapiens
aggaggacguagacuuuau

SEQ ID NO: 1462998 - RNA, 19 nt, Homo sapiens
gaugguugacacaguauca

SEQ ID NO: 1462999 - RNA, 19 nt, Homo sapiens
cagaaugcuacuauuaugu

SEQ ID NO: 1463000 - RNA, 19 nt, Homo sapiens
ugaucagaaugcuacuauu

SEQ ID NO: 1463001 - RNA, 19 nt, Homo sapiens
uaauggauuggacaagaaa

SEQ ID NO: 1463002 - RNA, 19 nt, Homo sapiens
gauuuucuaugcaguaaga

SEQ ID NO: 1463003 - RNA, 19 nt, Homo sapiens
ugacgagaagaccuuauga

SEQ ID NO: 1463004 - RNA, 19 nt, Homo sapiens
cauaccagagugucagaaa

SEQ ID NO: 1463005 - RNA, 19 nt, Homo sapiens
gaccacucuuacaaaguug

SEQ ID NO: 1463006 - RNA, 19 nt, Homo sapiens
ggaggacguagacuuuauc

SEQ ID NO: 1463007 - RNA, 19 nt, Homo sapiens
gauauuucuccuaagcuau

SEQ ID NO: 1463008 - RNA, 19 nt, Homo sapiens
gaaagaaagaaugagaacu

SEQ ID NO: 1463009 - RNA, 19 nt, Homo sapiens
uuccaaguauuugcuauug

SEQ ID NO: 1463010 - RNA, 19 nt, Homo sapiens
uuuauccagucuaucauug

SEQ ID NO: 1463011 - RNA, 19 nt, Homo sapiens
ggaaauagcugaauguaaa

SEQ ID NO: 1463012 - RNA, 19 nt, Homo sapiens
ggagacagaugauaaguaa

SEQ ID NO: 1463013 - RNA, 19 nt, Homo sapiens
gauaaggguuucuuucaua

SEQ ID NO: 1463014 - RNA, 19 nt, Homo sapiens
gagagaaggucuauaaaug

SEQ ID NO: 1463015 - RNA, 19 nt, Homo sapiens
ggaaaggccuucagucaga

SEQ ID NO: 1463016 - RNA, 19 nt, Homo sapiens
ggaaggggcuuuaguaaua

SEQ ID NO: 1463017 - RNA, 19 nt, Homo sapiens
gcaugaacgucuuuauuaa

SEQ ID NO: 1463018 - RNA, 19 nt, Homo sapiens
gggaugagcuggugcguuu

SEQ ID NO: 1463019 - RNA, 19 nt, Homo sapiens
gaaaucacgauaccaaaua

SEQ ID NO: 1463020 - RNA, 19 nt, Homo sapiens
ugaaauaggugaucagguu

SEQ ID NO: 1463021 - RNA, 19 nt, Homo sapiens
gaaggaaacccuguauaua

SEQ ID NO: 1463022 - RNA, 19 nt, Homo sapiens
gagagaagcccuuuaaaug

SEQ ID NO: 1463023 - RNA, 19 nt, Homo sapiens
gagguuaacacuugauuua

SEQ ID NO: 1463024 - RNA, 19 nt, Homo sapiens
gagaaacccuauaaauguu

SEQ ID NO: 1463025 - RNA, 19 nt, Homo sapiens
gagaagcccuuuaaaugug

SEQ ID NO: 1463026 - RNA, 19 nt, Homo sapiens
gagaaacccuauagauguu

SEQ ID NO: 1463027 - RNA, 19 nt, Homo sapiens
gagagaaacccuauaaaug

SEQ ID NO: 1463028 - RNA, 19 nt, Homo sapiens
gagaagcccuauaaauguu

SEQ ID NO: 1463029 - RNA, 19 nt, Homo sapiens
ggaaggaaacccuguauau

SEQ ID NO: 1463030 - RNA, 19 nt, Homo sapiens
ggcaugaacgucuuuauua

SEQ ID NO: 1463031 - RNA, 19 nt, Homo sapiens
ucacuuagccuaucagaaa

SEQ ID NO: 1463032 - RNA, 19 nt, Homo sapiens
acaauagcguggagcauua

SEQ ID NO: 1463033 - RNA, 19 nt, Homo sapiens
ggagagaaacccuauaaau

SEQ ID NO: 1463034 - RNA, 19 nt, Homo sapiens
ggagaagcccuauaaaugu

SEQ ID NO: 1463035 - RNA, 19 nt, Homo sapiens
gagaaggucuauaaaugug

SEQ ID NO: 1463036 - RNA, 19 nt, Homo sapiens
gcuuuaaaguccauaauug

SEQ ID NO: 1463037 - RNA, 19 nt, Homo sapiens
ggagagaagcccuuuaaau

SEQ ID NO: 1463038 - RNA, 19 nt, Homo sapiens
agagagggcuggcuuaguu

SEQ ID NO: 1463039 - RNA, 19 nt, Homo sapiens
gaaauaggugaucagguua

SEQ ID NO: 1463040 - RNA, 19 nt, Homo sapiens
gaacaaaagcaaccaauuu

SEQ ID NO: 1463041 - RNA, 19 nt, Homo sapiens
gagagaaacccuauagaug

SEQ ID NO: 1463042 - RNA, 19 nt, Homo sapiens
gagcucccaucuucaaauu

SEQ ID NO: 1463043 - RNA, 19 nt, Homo sapiens
gaauaccacugaugagaca

SEQ ID NO: 1463044 - RNA, 19 nt, Homo sapiens
guguaucaguucuuuguua

SEQ ID NO: 1463045 - RNA, 19 nt, Homo sapiens
gcucaucacugucucuguu

SEQ ID NO: 1463046 - RNA, 19 nt, Homo sapiens
uaacaagccuuugguaagu

SEQ ID NO: 1463047 - RNA, 19 nt, Homo sapiens
ccucugggcuccuuuggua

SEQ ID NO: 1463048 - RNA, 19 nt, Homo sapiens
ggaagaagcaagcaaagug

SEQ ID NO: 1463049 - RNA, 19 nt, Homo sapiens
gcacgaugccuccauaguu

SEQ ID NO: 1463050 - RNA, 19 nt, Homo sapiens
ggaauaugacuaacccuuu

SEQ ID NO: 1463051 - RNA, 19 nt, Homo sapiens
gguuugauuucuagcuuua

SEQ ID NO: 1463052 - RNA, 19 nt, Homo sapiens
ggaggagucacuaauguuu

SEQ ID NO: 1463053 - RNA, 19 nt, Homo sapiens
gaagaagcaagcaaaguga

SEQ ID NO: 1463054 - RNA, 19 nt, Homo sapiens
ggagagaaggucuauaaau

SEQ ID NO: 1463055 - RNA, 19 nt, Homo sapiens
ggaacacuaugcaggaaga

SEQ ID NO: 1463056 - RNA, 19 nt, Homo sapiens
ggccugaauuccacaagua

SEQ ID NO: 1463057 - RNA, 19 nt, Homo sapiens
uaaacuagggugaugauuu

SEQ ID NO: 1463058 - RNA, 19 nt, Homo sapiens
cugaauauauguccucaaa

SEQ ID NO: 1463059 - RNA, 19 nt, Homo sapiens
ccacuaagaucacguucug

SEQ ID NO: 1463060 - RNA, 19 nt, Homo sapiens
ugagucaccuucuaucuau

SEQ ID NO: 1463061 - RNA, 19 nt, Homo sapiens
ggagagaaacccuauagau

SEQ ID NO: 1463062 - RNA, 19 nt, Homo sapiens
caggagagaaggucuauaa

SEQ ID NO: 1463063 - RNA, 19 nt, Homo sapiens
gaaacccuguauauaccua

SEQ ID NO: 1463064 - RNA, 19 nt, Homo sapiens
ccauaaaugugacaagugu

SEQ ID NO: 1463065 - RNA, 19 nt, Homo sapiens
gcaauaaugcauaggaguu

SEQ ID NO: 1463066 - RNA, 19 nt, Homo sapiens
caccuucuaucuauacuuu

SEQ ID NO: 1463067 - RNA, 19 nt, Homo sapiens
gagacucuaugaaauaaca

SEQ ID NO: 1463068 - RNA, 19 nt, Homo sapiens
ggaacucaaggaauguuua

SEQ ID NO: 1463069 - RNA, 19 nt, Homo sapiens
cauaauucccauucacuua

SEQ ID NO: 1463070 - RNA, 19 nt, Homo sapiens
agagaaacccuauaaaugu

SEQ ID NO: 1463071 - RNA, 19 nt, Homo sapiens
gaaacuagagaugggauuu

SEQ ID NO: 1463072 - RNA, 19 nt, Homo sapiens
ggaaauuaaggaucuuuga

SEQ ID NO: 1463073 - RNA, 19 nt, Homo sapiens
ggaggcauaugugagauug

SEQ ID NO: 1463074 - RNA, 19 nt, Homo sapiens
gggaaggcguucagucaga

SEQ ID NO: 1463075 - RNA, 19 nt, Homo sapiens
ggcaaagccuucaauugga

SEQ ID NO: 1463076 - RNA, 19 nt, Homo sapiens
gaauaugacuaacccuuuu

SEQ ID NO: 1463077 - RNA, 19 nt, Homo sapiens
agacaucucugcuaacaag

SEQ ID NO: 1463078 - RNA, 19 nt, Homo sapiens
aaaaggagcacaugauuua

SEQ ID NO: 1463079 - RNA, 19 nt, Homo sapiens
caaggaauguuuagaagac

SEQ ID NO: 1463080 - RNA, 19 nt, Homo sapiens
ggaggaagaagcaagcaaa

SEQ ID NO: 1463081 - RNA, 19 nt, Homo sapiens
gauuuuaggugacucauaa

SEQ ID NO: 1463082 - RNA, 19 nt, Homo sapiens
gcauaugugagauugauuu

SEQ ID NO: 1463083 - RNA, 19 nt, Homo sapiens
gcucccaucuucaaauuca

SEQ ID NO: 1463084 - RNA, 19 nt, Homo sapiens
gcauaggaguucuugauac

SEQ ID NO: 1463085 - RNA, 19 nt, Homo sapiens
uauauguccuugaaccuuu

SEQ ID NO: 1463086 - RNA, 19 nt, Homo sapiens
caaugucacuuuauaaucg

SEQ ID NO: 1463087 - RNA, 19 nt, Homo sapiens
uuacagaauucacguggaa

SEQ ID NO: 1463088 - RNA, 19 nt, Homo sapiens
gcuaacaagccuuugguaa

SEQ ID NO: 1463089 - RNA, 19 nt, Homo sapiens
gaccaaaaguccccaauga

SEQ ID NO: 1463090 - RNA, 19 nt, Homo sapiens
ucuguaaucuugggcaaua

SEQ ID NO: 1463091 - RNA, 19 nt, Homo sapiens
gaaggucuauaaaugugau

SEQ ID NO: 1463092 - RNA, 19 nt, Homo sapiens
guucuguguuaaugaguua

SEQ ID NO: 1463093 - RNA, 19 nt, Homo sapiens
caaagagagggcuggcuua

SEQ ID NO: 1463094 - RNA, 19 nt, Homo sapiens
uggaggaacucaaggaaug

SEQ ID NO: 1463095 - RNA, 19 nt, Homo sapiens
uuucugagguuaacacuug

SEQ ID NO: 1463096 - RNA, 19 nt, Homo sapiens
ccagcacgaugccuccaua

SEQ ID NO: 1463097 - RNA, 19 nt, Homo sapiens
gagaaaccguaugucugua

SEQ ID NO: 1463098 - RNA, 19 nt, Homo sapiens
aaacuagggugaugauuuu

SEQ ID NO: 1463099 - RNA, 19 nt, Homo sapiens
guauugaacaccuccuaua

SEQ ID NO: 1463100 - RNA, 19 nt, Homo sapiens
aaauauccaucccuuccua

SEQ ID NO: 1463101 - RNA, 19 nt, Homo sapiens
cacgaugccuccauaguug

SEQ ID NO: 1463102 - RNA, 19 nt, Homo sapiens
guauauaccuacauugacu

SEQ ID NO: 1463103 - RNA, 19 nt, Homo sapiens
gaaaccaucucaaaauauc

SEQ ID NO: 1463104 - RNA, 19 nt, Homo sapiens
cuauaaauguuacgagugu

SEQ ID NO: 1463105 - RNA, 19 nt, Homo sapiens
uggagaagcccuauaaaug

SEQ ID NO: 1463106 - RNA, 19 nt, Homo sapiens
gagauagacugccaaaaug

SEQ ID NO: 1463107 - RNA, 19 nt, Homo sapiens
gaauucacguggaagucaa

SEQ ID NO: 1463108 - RNA, 19 nt, Homo sapiens
acaaaguucuguguuaaug

SEQ ID NO: 1463109 - RNA, 19 nt, Homo sapiens
gggcaaaucgcuuaaucuu

SEQ ID NO: 1463110 - RNA, 19 nt, Homo sapiens
caggagagaaacccuauaa

SEQ ID NO: 1463111 - RNA, 19 nt, Homo sapiens
cagcaagacugauaccuua

SEQ ID NO: 1463112 - RNA, 19 nt, Homo sapiens
uaacuugucucugcuauuu

SEQ ID NO: 1463113 - RNA, 19 nt, Homo sapiens
ucacaggauuucauacuua

SEQ ID NO: 1463114 - RNA, 19 nt, Homo sapiens
gcaaaguaaucaucauugu

SEQ ID NO: 1463115 - RNA, 19 nt, Homo sapiens
caagacugauaccuuauuu

SEQ ID NO: 1463116 - RNA, 19 nt, Homo sapiens
ccacuuccaucuaaugauu

SEQ ID NO: 1463117 - RNA, 19 nt, Homo sapiens
gaagcucacuuucaaaauu

SEQ ID NO: 1463118 - RNA, 19 nt, Homo sapiens
ggagaaacaugggcaaagu

SEQ ID NO: 1463119 - RNA, 19 nt, Homo sapiens
ggccagagaugacuuccuu

SEQ ID NO: 1463120 - RNA, 19 nt, Homo sapiens
gcaagacugauaccuuauu

SEQ ID NO: 1463121 - RNA, 19 nt, Homo sapiens
gaagagaaggagcaagaga

SEQ ID NO: 1463122 - RNA, 19 nt, Homo sapiens
gagaaacaugggcaaagua

SEQ ID NO: 1463123 - RNA, 19 nt, Homo sapiens
gcacgcguggcuucucuua

SEQ ID NO: 1463124 - RNA, 19 nt, Homo sapiens
caugggagauggccagaga

SEQ ID NO: 1463125 - RNA, 19 nt, Homo sapiens
ugagacagcaagacugaua

SEQ ID NO: 1463126 - RNA, 19 nt, Homo sapiens
gaugggauuucacuguguu

SEQ ID NO: 1463127 - RNA, 19 nt, Homo sapiens
ccaaagugcugggauuaca

SEQ ID NO: 1463128 - RNA, 19 nt, Homo sapiens
uuucaacacuggcugguuu

SEQ ID NO: 1463129 - RNA, 19 nt, Homo sapiens
gagcaaguguccacagcau

SEQ ID NO: 1463130 - RNA, 19 nt, Homo sapiens
ccaaguccgugucuguuuc

SEQ ID NO: 1463131 - RNA, 19 nt, Homo sapiens
ucuuuaggauucccaagua

SEQ ID NO: 1463132 - RNA, 19 nt, Homo sapiens
agaaggagcaagagaagaa

SEQ ID NO: 1463133 - RNA, 19 nt, Homo sapiens
ccuaguccauguugccuuu

SEQ ID NO: 1463134 - RNA, 19 nt, Homo sapiens
gggcaaaguaaucaucauu

SEQ ID NO: 1463135 - RNA, 19 nt, Homo sapiens
acccuucucuuucuucuuu

SEQ ID NO: 1463136 - RNA, 19 nt, Homo sapiens
cacuuugacuggcuucuuu

SEQ ID NO: 1463137 - RNA, 19 nt, Homo sapiens
aaacaugggcaaaguaauc

SEQ ID NO: 1463138 - RNA, 19 nt, Homo sapiens
agaaacaugggcaaaguaa

SEQ ID NO: 1463139 - RNA, 19 nt, Homo sapiens
gaucccucuuucuucuuua

SEQ ID NO: 1463140 - RNA, 19 nt, Homo sapiens
ugcaguagcuaagacuaua

SEQ ID NO: 1463141 - RNA, 19 nt, Homo sapiens
ucaaugacuggcugcuuua

SEQ ID NO: 1463142 - RNA, 19 nt, Homo sapiens
cucaaugacuggcugcuuu

SEQ ID NO: 1463143 - RNA, 19 nt, Homo sapiens
cacaggauuucauacuuau

SEQ ID NO: 1463144 - RNA, 19 nt, Homo sapiens
gcccagccgucacaggauu

SEQ ID NO: 1463145 - RNA, 19 nt, Homo sapiens
caguagagaugggauuuca

SEQ ID NO: 1463146 - RNA, 19 nt, Homo sapiens
gauauggacauugcauuug

SEQ ID NO: 1463147 - RNA, 19 nt, Homo sapiens
uagaagagaaggagcaaga

SEQ ID NO: 1463148 - RNA, 19 nt, Homo sapiens
gcaguagcuaagacuauaa

SEQ ID NO: 1463149 - RNA, 19 nt, Homo sapiens
cuacucaacaugaagauga

SEQ ID NO: 1463150 - RNA, 19 nt, Homo sapiens
ugauauggacauugcauuu

SEQ ID NO: 1463151 - RNA, 19 nt, Homo sapiens
uuucaagggucuccugcua

SEQ ID NO: 1463152 - RNA, 19 nt, Homo sapiens
uggccaaacuggucucgaa

SEQ ID NO: 1463153 - RNA, 19 nt, Homo sapiens
auauggacauugcauuuga

SEQ ID NO: 1463154 - RNA, 19 nt, Homo sapiens
acaugaagaugaugaggau

SEQ ID NO: 1463155 - RNA, 19 nt, Homo sapiens
caaaaugagccuuaugaaa

SEQ ID NO: 1463156 - RNA, 19 nt, Homo sapiens
uggcuucucuuacacacaa

SEQ ID NO: 1463157 - RNA, 19 nt, Homo sapiens
uagggcagcucuccaugga

SEQ ID NO: 1463158 - RNA, 19 nt, Homo sapiens
gucacaggauuucauacuu

SEQ ID NO: 1463159 - RNA, 19 nt, Homo sapiens
augacgaccuuuacgauga

SEQ ID NO: 1463160 - RNA, 19 nt, Homo sapiens
ggcaaaguaaucaucauug

SEQ ID NO: 1463161 - RNA, 19 nt, Homo sapiens
cuucuuggacuucaucuuu

SEQ ID NO: 1463162 - RNA, 19 nt, Homo sapiens
agaucccucuuucuucuuu

SEQ ID NO: 1463163 - RNA, 19 nt, Homo sapiens
gacaguagagaugggauuu

SEQ ID NO: 1463164 - RNA, 19 nt, Homo sapiens
gagaagcucacuuucaaaa

SEQ ID NO: 1463165 - RNA, 19 nt, Homo sapiens
augauccacuuccaucuaa

SEQ ID NO: 1463166 - RNA, 19 nt, Homo sapiens
gcugacacccuucucuuuc

SEQ ID NO: 1463167 - RNA, 19 nt, Homo sapiens
ccaaacuggucucgaacuc

SEQ ID NO: 1463168 - RNA, 19 nt, Homo sapiens
gaaacaugggcaaaguaau

SEQ ID NO: 1463169 - RNA, 19 nt, Homo sapiens
ggaugacgaccuuuacgau

SEQ ID NO: 1463170 - RNA, 19 nt, Homo sapiens
ugaugaggaugacgaccuu

SEQ ID NO: 1463171 - RNA, 19 nt, Homo sapiens
acgcguggcuucucuuaca

SEQ ID NO: 1463172 - RNA, 19 nt, Homo sapiens
ugacacccuucucuuucuu

SEQ ID NO: 1463173 - RNA, 19 nt, Homo sapiens
ccacugaggaacuccaaau

SEQ ID NO: 1463174 - RNA, 19 nt, Homo sapiens
ugacgagacaguagagaug

SEQ ID NO: 1463175 - RNA, 19 nt, Homo sapiens
gauccugccaccucagcua

SEQ ID NO: 1463176 - RNA, 19 nt, Homo sapiens
gauccacuuccaucuaaug

SEQ ID NO: 1463177 - RNA, 19 nt, Homo sapiens
ugacgaccuuuacgaugau

SEQ ID NO: 1463178 - RNA, 19 nt, Homo sapiens
ggagauggccagagaugac

SEQ ID NO: 1463179 - RNA, 19 nt, Homo sapiens
uugagucccugguucuuug

SEQ ID NO: 1463180 - RNA, 19 nt, Homo sapiens
gagaugacuuccuuuucuu

SEQ ID NO: 1463181 - RNA, 19 nt, Homo sapiens
cuuuaggauucccaaguaa

SEQ ID NO: 1463182 - RNA, 19 nt, Homo sapiens
aagagaaggagcaagagaa

SEQ ID NO: 1463183 - RNA, 19 nt, Homo sapiens
gaccacuuucuucuucuuu

SEQ ID NO: 1463184 - RNA, 19 nt, Homo sapiens
ugaccacuuucuucuucuu

SEQ ID NO: 1463185 - RNA, 19 nt, Homo sapiens
guagagaugggauuucacu

SEQ ID NO: 1463186 - RNA, 19 nt, Homo sapiens
gagaaggagcaagagaaga

SEQ ID NO: 1463187 - RNA, 19 nt, Homo sapiens
uuugaccacuuucuucuuc

SEQ ID NO: 1463188 - RNA, 19 nt, Homo sapiens
gaagaagaucucaaaauac

SEQ ID NO: 1463189 - RNA, 19 nt, Homo sapiens
ccugagacagcaagacuga

SEQ ID NO: 1463190 - RNA, 19 nt, Homo sapiens
gccgucacaggauuucaua

SEQ ID NO: 1463191 - RNA, 19 nt, Homo sapiens
ccuuuacgaugauccacuu

SEQ ID NO: 1463192 - RNA, 19 nt, Homo sapiens
guaacuugucucugcuauu

SEQ ID NO: 1463193 - RNA, 19 nt, Homo sapiens
ucacuguguuggccaaacu

SEQ ID NO: 1463194 - RNA, 19 nt, Homo sapiens
agagaugggauuucacugu

SEQ ID NO: 1463195 - RNA, 19 nt, Homo sapiens
gcauuugacgagacaguag

SEQ ID NO: 1463196 - RNA, 19 nt, Homo sapiens
cagcuaaggccugcaguag

SEQ ID NO: 1463197 - RNA, 19 nt, Homo sapiens
caaauuuucuuccacuucu

SEQ ID NO: 1463198 - RNA, 19 nt, Homo sapiens
gcuuuaccuucuucuugga

SEQ ID NO: 1463199 - RNA, 19 nt, Homo sapiens
gagcaagagaagaagaucu

SEQ ID NO: 1463200 - RNA, 19 nt, Homo sapiens
ucagcuaaggccugcagua

SEQ ID NO: 1463201 - RNA, 19 nt, Homo sapiens
acagcaagacugauaccuu

SEQ ID NO: 1463202 - RNA, 19 nt, Homo sapiens
ccagggcccaggucuacuu

SEQ ID NO: 1463203 - RNA, 19 nt, Homo sapiens
gaguauugagucccugguu

SEQ ID NO: 1463204 - RNA, 19 nt, Homo sapiens
guccauguugccuuucuuu

SEQ ID NO: 1463205 - RNA, 19 nt, Homo sapiens
ucucccuccugguggauuu

SEQ ID NO: 1463206 - RNA, 19 nt, Homo sapiens
gaaauaaccuacuccuaua

SEQ ID NO: 1463207 - RNA, 19 nt, Homo sapiens
gaaaugugguacaaucaua

SEQ ID NO: 1463208 - RNA, 19 nt, Homo sapiens
gaacaaauggccuuaaauu

SEQ ID NO: 1463209 - RNA, 19 nt, Homo sapiens
caacuuugcuccuguaauu

SEQ ID NO: 1463210 - RNA, 19 nt, Homo sapiens
gaagaaaugugguacaauc

SEQ ID NO: 1463211 - RNA, 19 nt, Homo sapiens
ggauggagaugauguaaga

SEQ ID NO: 1463212 - RNA, 19 nt, Homo sapiens
aaggauaucucacgaauuu

SEQ ID NO: 1463213 - RNA, 19 nt, Homo sapiens
uggaagaacugaaguaauu

SEQ ID NO: 1463214 - RNA, 19 nt, Homo sapiens
gaguuuggguucuaaauuu

SEQ ID NO: 1463215 - RNA, 19 nt, Homo sapiens
gaaaguuuauucuggacua

SEQ ID NO: 1463216 - RNA, 19 nt, Homo sapiens
gaaaucuucuugacagaga

SEQ ID NO: 1463217 - RNA, 19 nt, Homo sapiens
ggaaggauaucucacgaau

SEQ ID NO: 1463218 - RNA, 19 nt, Homo sapiens
guauggaugucuucucuaa

SEQ ID NO: 1463219 - RNA, 19 nt, Homo sapiens
ucugaaaucuguacaacua

SEQ ID NO: 1463220 - RNA, 19 nt, Homo sapiens
gaaaugcuaaugucaacua

SEQ ID NO: 1463221 - RNA, 19 nt, Homo sapiens
gcagaggaauuaaacuguu

SEQ ID NO: 1463222 - RNA, 19 nt, Homo sapiens
gaaacuacaucugcuuaau

SEQ ID NO: 1463223 - RNA, 19 nt, Homo sapiens
gcagaugugucuccugguu

SEQ ID NO: 1463224 - RNA, 19 nt, Homo sapiens
gaaagcagucucuguauca

SEQ ID NO: 1463225 - RNA, 19 nt, Homo sapiens
acaaggaguuggaaauaaa

SEQ ID NO: 1463226 - RNA, 19 nt, Homo sapiens
ccacauaucuaacaguauc

SEQ ID NO: 1463227 - RNA, 19 nt, Homo sapiens
gaucggaauuucuuguuau

SEQ ID NO: 1463228 - RNA, 19 nt, Homo sapiens
ggacaaacacaauugcaaa

SEQ ID NO: 1463229 - RNA, 19 nt, Homo sapiens
aaagagacauugugcaguu

SEQ ID NO: 1463230 - RNA, 19 nt, Homo sapiens
gcaaauaagggaagggaaa

SEQ ID NO: 1463231 - RNA, 19 nt, Homo sapiens
guuacagacucaaauauga

SEQ ID NO: 1463232 - RNA, 19 nt, Homo sapiens
ugacagaacaaucaaagua

SEQ ID NO: 1463233 - RNA, 19 nt, Homo sapiens
ugaaauaaccuacuccuau

SEQ ID NO: 1463234 - RNA, 19 nt, Homo sapiens
ggaaagcagucucuguauc

SEQ ID NO: 1463235 - RNA, 19 nt, Homo sapiens
guacaaggaguuggaaaua

SEQ ID NO: 1463236 - RNA, 19 nt, Homo sapiens
gauacuggcucucuugauc

SEQ ID NO: 1463237 - RNA, 19 nt, Homo sapiens
uaacuggauugucuuaaga

SEQ ID NO: 1463238 - RNA, 19 nt, Homo sapiens
uagaacaaauggccuuaaa

SEQ ID NO: 1463239 - RNA, 19 nt, Homo sapiens
caaauggccuuaaauucuc

SEQ ID NO: 1463240 - RNA, 19 nt, Homo sapiens
ggagaaauuguucaagauu

SEQ ID NO: 1463241 - RNA, 19 nt, Homo sapiens
cgaacaaauuggacaagaa

SEQ ID NO: 1463242 - RNA, 19 nt, Homo sapiens
gggaagaaaugugguacaa

SEQ ID NO: 1463243 - RNA, 19 nt, Homo sapiens
gugaaguugugucuaaauu

SEQ ID NO: 1463244 - RNA, 19 nt, Homo sapiens
cagcuaauuuccaauguau

SEQ ID NO: 1463245 - RNA, 19 nt, Homo sapiens
caguuucucuccuauauga

SEQ ID NO: 1463246 - RNA, 19 nt, Homo sapiens
ugagaucccugagcaguuu

SEQ ID NO: 1463247 - RNA, 19 nt, Homo sapiens
gggauuauauugacagaag

SEQ ID NO: 1463248 - RNA, 19 nt, Homo sapiens
gaucucagucagagcauua

SEQ ID NO: 1463249 - RNA, 19 nt, Homo sapiens
uggaaaugauugugaauug

SEQ ID NO: 1463250 - RNA, 19 nt, Homo sapiens
aaauaugguuguugcauga

SEQ ID NO: 1463251 - RNA, 19 nt, Homo sapiens
gaaaauaugcugaaagaga

SEQ ID NO: 1463252 - RNA, 19 nt, Homo sapiens
cgaauuggauggagaugau

SEQ ID NO: 1463253 - RNA, 19 nt, Homo sapiens
gaacaaauuggacaagaag

SEQ ID NO: 1463254 - RNA, 19 nt, Homo sapiens
gaagaacugaaguaauuga

SEQ ID NO: 1463255 - RNA, 19 nt, Homo sapiens
gggagaaauuguucaagau

SEQ ID NO: 1463256 - RNA, 19 nt, Homo sapiens
uuugugaaauucccaguua

SEQ ID NO: 1463257 - RNA, 19 nt, Homo sapiens
agucaaacauugugaucua

SEQ ID NO: 1463258 - RNA, 19 nt, Homo sapiens
guaaugaaccaggcaauga

SEQ ID NO: 1463259 - RNA, 19 nt, Homo sapiens
ucacgaauuugcuuugaau

SEQ ID NO: 1463260 - RNA, 19 nt, Homo sapiens
ugaucggaauuucuuguua

SEQ ID NO: 1463261 - RNA, 19 nt, Homo sapiens
guaacuggauugucuuaag

SEQ ID NO: 1463262 - RNA, 19 nt, Homo sapiens
gcaauaucucuuugaauga

SEQ ID NO: 1463263 - RNA, 19 nt, Homo sapiens
aaucaaaagugcugaguua

SEQ ID NO: 1463264 - RNA, 19 nt, Homo sapiens
ucacaguggcuauugauuu

SEQ ID NO: 1463265 - RNA, 19 nt, Homo sapiens
ggaagucuuuugugaaauu

SEQ ID NO: 1463266 - RNA, 19 nt, Homo sapiens
gcacaggcuggaagucuuu

SEQ ID NO: 1463267 - RNA, 19 nt, Homo sapiens
agcaauaucucuuugaaug

SEQ ID NO: 1463268 - RNA, 19 nt, Homo sapiens
ugaauccuuugucuucuaa

SEQ ID NO: 1463269 - RNA, 19 nt, Homo sapiens
gagauggaagucaugauuu

SEQ ID NO: 1463270 - RNA, 19 nt, Homo sapiens
ggaccgagauggaagucau

SEQ ID NO: 1463271 - RNA, 19 nt, Homo sapiens
uaaagaauggagagaguuu

SEQ ID NO: 1463272 - RNA, 19 nt, Homo sapiens
gcucugaaaugcuaauguc

SEQ ID NO: 1463273 - RNA, 19 nt, Homo sapiens
aaauaugacugugcucuga

SEQ ID NO: 1463274 - RNA, 19 nt, Homo sapiens
aaggauggcucccaguauu

SEQ ID NO: 1463275 - RNA, 19 nt, Homo sapiens
caacugaaugccuauggua

SEQ ID NO: 1463276 - RNA, 19 nt, Homo sapiens
uacaaggaguuggaaauaa

SEQ ID NO: 1463277 - RNA, 19 nt, Homo sapiens
ggaguuuggguucuaaauu

SEQ ID NO: 1463278 - RNA, 19 nt, Homo sapiens
caauuucucagcaauguuu

SEQ ID NO: 1463279 - RNA, 19 nt, Homo sapiens
caguuaaugugcuuucuug

SEQ ID NO: 1463280 - RNA, 19 nt, Homo sapiens
ugucuuauauguacaagga

SEQ ID NO: 1463281 - RNA, 19 nt, Homo sapiens
cagcagaauuugaugcaau

SEQ ID NO: 1463282 - RNA, 19 nt, Homo sapiens
uaaaggauggcucccagua

SEQ ID NO: 1463283 - RNA, 19 nt, Homo sapiens
gauggcaguuuuacaauuu

SEQ ID NO: 1463284 - RNA, 19 nt, Homo sapiens
gcgaacaaauuggacaaga

SEQ ID NO: 1463285 - RNA, 19 nt, Homo sapiens
gagagaaucuucguuuuga

SEQ ID NO: 1463286 - RNA, 19 nt, Homo sapiens
caagacuauuuaacuguga

SEQ ID NO: 1463287 - RNA, 19 nt, Homo sapiens
gcacagaaaauacuuugua

SEQ ID NO: 1463288 - RNA, 19 nt, Homo sapiens
ugcaauagcuauaaucaca

SEQ ID NO: 1463289 - RNA, 19 nt, Homo sapiens
ggagagaguuuggaagaac

SEQ ID NO: 1463290 - RNA, 19 nt, Homo sapiens
guuuccagcucuaggauuu

SEQ ID NO: 1463291 - RNA, 19 nt, Homo sapiens
ggagggacgcaaaucaauu

SEQ ID NO: 1463292 - RNA, 19 nt, Homo sapiens
cagaggaauuaaacuguug

SEQ ID NO: 1463293 - RNA, 19 nt, Homo sapiens
cuaaggaguccauaguuaa

SEQ ID NO: 1463294 - RNA, 19 nt, Homo sapiens
gcagucacaauucaacgua

SEQ ID NO: 1463295 - RNA, 19 nt, Homo sapiens
ucagauccuuuccuuguau

SEQ ID NO: 1463296 - RNA, 19 nt, Homo sapiens
acaaauggccuuaaauucu

SEQ ID NO: 1463297 - RNA, 19 nt, Homo sapiens
uaggaaagcagucucugua

SEQ ID NO: 1463298 - RNA, 19 nt, Homo sapiens
caaaagugcugaguuaaug

SEQ ID NO: 1463299 - RNA, 19 nt, Homo sapiens
ugggagaaauuguucaaga

SEQ ID NO: 1463300 - RNA, 19 nt, Homo sapiens
gaaauaaagaauggagaga

SEQ ID NO: 1463301 - RNA, 19 nt, Homo sapiens
agauaugcuucuucuguaa

SEQ ID NO: 1463302 - RNA, 19 nt, Homo sapiens
gaauggagagaguuuggaa

SEQ ID NO: 1463303 - RNA, 19 nt, Homo sapiens
gaagauggcaguuuuacaa

SEQ ID NO: 1463304 - RNA, 19 nt, Homo sapiens
guaaugaagauggcaguuu

SEQ ID NO: 1463305 - RNA, 19 nt, Homo sapiens
ugacuuguaugauguugau

SEQ ID NO: 1463306 - RNA, 19 nt, Homo sapiens
cgaaaucacugcagaaaua

SEQ ID NO: 1463307 - RNA, 19 nt, Homo sapiens
gcccagagccuuucaaaua

SEQ ID NO: 1463308 - RNA, 19 nt, Homo sapiens
gaaguuaccaggaauguuu

SEQ ID NO: 1463309 - RNA, 19 nt, Homo sapiens
cgucaaagguucagaaauu

SEQ ID NO: 1463310 - RNA, 19 nt, Homo sapiens
guacuuaccacaauugaua

SEQ ID NO: 1463311 - RNA, 19 nt, Homo sapiens
uaagacaucugcuauuguu

SEQ ID NO: 1463312 - RNA, 19 nt, Homo sapiens
gaaccagugugacucauau

SEQ ID NO: 1463313 - RNA, 19 nt, Homo sapiens
gaacucuuccugcuuauuu

SEQ ID NO: 1463314 - RNA, 19 nt, Homo sapiens
cauaagaacucuguccuuu

SEQ ID NO: 1463315 - RNA, 19 nt, Homo sapiens
gaucacacccugucuauug

SEQ ID NO: 1463316 - RNA, 19 nt, Homo sapiens
caggagagcuugaggagaa

SEQ ID NO: 1463317 - RNA, 19 nt, Homo sapiens
gaagagaagauugaugaua

SEQ ID NO: 1463318 - RNA, 19 nt, Homo sapiens
ggaggaaccuaauccaaau

SEQ ID NO: 1463319 - RNA, 19 nt, Homo sapiens
ccaaagagguagcaaguca

SEQ ID NO: 1463320 - RNA, 19 nt, Homo sapiens
gcuuugaggugcucgguua

SEQ ID NO: 1463321 - RNA, 19 nt, Homo sapiens
cauaagacaucugcuauug

SEQ ID NO: 1463322 - RNA, 19 nt, Homo sapiens
gaugcaaugucuuuagaaa

SEQ ID NO: 1463323 - RNA, 19 nt, Homo sapiens
aaacacgggcaauauauua

SEQ ID NO: 1463324 - RNA, 19 nt, Homo sapiens
caacuuaccagauuuccua

SEQ ID NO: 1463325 - RNA, 19 nt, Homo sapiens
ccagaaaggugucagaaca

SEQ ID NO: 1463326 - RNA, 19 nt, Homo sapiens
cuucagaucuuaccaguug

SEQ ID NO: 1463327 - RNA, 19 nt, Homo sapiens
gaccugagcacacaaauug

SEQ ID NO: 1463328 - RNA, 19 nt, Homo sapiens
agacacagauuacugauuc

SEQ ID NO: 1463329 - RNA, 19 nt, Homo sapiens
gcaaguuucuggugagcaa

SEQ ID NO: 1463330 - RNA, 19 nt, Homo sapiens
gaaauauucgcgacugaaa

SEQ ID NO: 1463331 - RNA, 19 nt, Homo sapiens
ugagacugcucguuacuaa

SEQ ID NO: 1463332 - RNA, 19 nt, Homo sapiens
gcauggccguuuccuauga

SEQ ID NO: 1463333 - RNA, 19 nt, Homo sapiens
caaauuuggugaauaugug

SEQ ID NO: 1463334 - RNA, 19 nt, Homo sapiens
gguagcaagucaaagcuuu

SEQ ID NO: 1463335 - RNA, 19 nt, Homo sapiens
ucaaucacaucaggaauuu

SEQ ID NO: 1463336 - RNA, 19 nt, Homo sapiens
cuagggagcugguggagaa

SEQ ID NO: 1463337 - RNA, 19 nt, Homo sapiens
gcuacuugguguuuauuaa

SEQ ID NO: 1463338 - RNA, 19 nt, Homo sapiens
ccaaguaucuggcaaccau

SEQ ID NO: 1463339 - RNA, 19 nt, Homo sapiens
agucaaagcuuuccuuaca

SEQ ID NO: 1463340 - RNA, 19 nt, Homo sapiens
aagaucaacuuaccagauu

SEQ ID NO: 1463341 - RNA, 19 nt, Homo sapiens
gaaagcuaaucgacaagau

SEQ ID NO: 1463342 - RNA, 19 nt, Homo sapiens
acagggagcuagaagacua

SEQ ID NO: 1463343 - RNA, 19 nt, Homo sapiens
ggaaaaggcuggagaaguc

SEQ ID NO: 1463344 - RNA, 19 nt, Homo sapiens
gacugaaauucuuggcuua

SEQ ID NO: 1463345 - RNA, 19 nt, Homo sapiens
ccagagccuuucaaauauu

SEQ ID NO: 1463346 - RNA, 19 nt, Homo sapiens
caaauacucucagccacaa

SEQ ID NO: 1463347 - RNA, 19 nt, Homo sapiens
ggacaagaaaggagaguau

SEQ ID NO: 1463348 - RNA, 19 nt, Homo sapiens
auucuuggcuuaaccauuu

SEQ ID NO: 1463349 - RNA, 19 nt, Homo sapiens
cagacaggcucuugauaga

SEQ ID NO: 1463350 - RNA, 19 nt, Homo sapiens
ggacagcaaugagccuaga

SEQ ID NO: 1463351 - RNA, 19 nt, Homo sapiens
ugaucaaaguguggaauua

SEQ ID NO: 1463352 - RNA, 19 nt, Homo sapiens
gaggguaucacgguacuua

SEQ ID NO: 1463353 - RNA, 19 nt, Homo sapiens
uaagagaccugagcacaca

SEQ ID NO: 1463354 - RNA, 19 nt, Homo sapiens
ucagugaaguuaccaggaa

SEQ ID NO: 1463355 - RNA, 19 nt, Homo sapiens
acacugcgaucaucuacaa

SEQ ID NO: 1463356 - RNA, 19 nt, Homo sapiens
gaacugggacaagaaagaa

SEQ ID NO: 1463357 - RNA, 19 nt, Homo sapiens
aaauuugccuugaagaaga

SEQ ID NO: 1463358 - RNA, 19 nt, Homo sapiens
gucaaagguucagaaauuu

SEQ ID NO: 1463359 - RNA, 19 nt, Homo sapiens
cuacaaagaccaccuggaa

SEQ ID NO: 1463360 - RNA, 19 nt, Homo sapiens
gcgaucaucuacaaugugu

SEQ ID NO: 1463361 - RNA, 19 nt, Homo sapiens
guucagaaauuugccuuga

SEQ ID NO: 1463362 - RNA, 19 nt, Homo sapiens
ccacauaagacaucugcua

SEQ ID NO: 1463363 - RNA, 19 nt, Homo sapiens
gcccaaggaugccauuugu

SEQ ID NO: 1463364 - RNA, 19 nt, Homo sapiens
cagaugagcuuuuaagaga

SEQ ID NO: 1463365 - RNA, 19 nt, Homo sapiens
ucaaagcuuuccuuacaau

SEQ ID NO: 1463366 - RNA, 19 nt, Homo sapiens
caagucaaagcuuuccuua

SEQ ID NO: 1463367 - RNA, 19 nt, Homo sapiens
ggaagaaaccacaguagag

SEQ ID NO: 1463368 - RNA, 19 nt, Homo sapiens
ccuccugacugcacuuuaa

SEQ ID NO: 1463369 - RNA, 19 nt, Homo sapiens
ggacgacucuggccuuuug

SEQ ID NO: 1463370 - RNA, 19 nt, Homo sapiens
aggaggagauguuggauug

SEQ ID NO: 1463371 - RNA, 19 nt, Homo sapiens
ccaccugcauggucuggua

SEQ ID NO: 1463372 - RNA, 19 nt, Homo sapiens
cccagagccuuucaaauau

SEQ ID NO: 1463373 - RNA, 19 nt, Homo sapiens
cagcaacuccuccuacuga

SEQ ID NO: 1463374 - RNA, 19 nt, Homo sapiens
agagaguucuucuguaugu

SEQ ID NO: 1463375 - RNA, 19 nt, Homo sapiens
guguaucccuugaccauga

SEQ ID NO: 1463376 - RNA, 19 nt, Homo sapiens
gcuuaaccauuucagaaga

SEQ ID NO: 1463377 - RNA, 19 nt, Homo sapiens
gaaauuugccuugaagaag

SEQ ID NO: 1463378 - RNA, 19 nt, Homo sapiens
caacaguggcuacaaagug

SEQ ID NO: 1463379 - RNA, 19 nt, Homo sapiens
ucccaugacucccaguaua

SEQ ID NO: 1463380 - RNA, 19 nt, Homo sapiens
cagcguccaugauccguuu

SEQ ID NO: 1463381 - RNA, 19 nt, Homo sapiens
gaucaaaguguggaauuau

SEQ ID NO: 1463382 - RNA, 19 nt, Homo sapiens
ugaagggaauggcaucaug

SEQ ID NO: 1463383 - RNA, 19 nt, Homo sapiens
cagacugccuggugauuau

SEQ ID NO: 1463384 - RNA, 19 nt, Homo sapiens
gaagucacagcguccauga

SEQ ID NO: 1463385 - RNA, 19 nt, Homo sapiens
caugagagcaauuggcuuu

SEQ ID NO: 1463386 - RNA, 19 nt, Homo sapiens
guugggacuucagaucuua

SEQ ID NO: 1463387 - RNA, 19 nt, Homo sapiens
acacaaguccucccaguga

SEQ ID NO: 1463388 - RNA, 19 nt, Homo sapiens
ggacagacaggcucuugau

SEQ ID NO: 1463389 - RNA, 19 nt, Homo sapiens
gaggaaaggcagagaguuc

SEQ ID NO: 1463390 - RNA, 19 nt, Homo sapiens
agaaacagaugagcuuuua

SEQ ID NO: 1463391 - RNA, 19 nt, Homo sapiens
caacaggaaucaaaagaug

SEQ ID NO: 1463392 - RNA, 19 nt, Homo sapiens
gaaaucacugcagaaauau

SEQ ID NO: 1463393 - RNA, 19 nt, Homo sapiens
uugcuuugcuucacuguuu

SEQ ID NO: 1463394 - RNA, 19 nt, Homo sapiens
ggguuuaccuggacagcaa

SEQ ID NO: 1463395 - RNA, 19 nt, Homo sapiens
gagaaacagaaaugaaaga

SEQ ID NO: 1463396 - RNA, 19 nt, Homo sapiens
ggaagaaacugaggaaaag

SEQ ID NO: 1463397 - RNA, 19 nt, Homo sapiens
ucagaaauuugccuugaag

SEQ ID NO: 1463398 - RNA, 19 nt, Homo sapiens
gauagaguaugaucuucuc

SEQ ID NO: 1463399 - RNA, 19 nt, Homo sapiens
cacaauugauagcuacauu

SEQ ID NO: 1463400 - RNA, 19 nt, Homo sapiens
gaacaaucaauaccaccuu

SEQ ID NO: 1463401 - RNA, 19 nt, Homo sapiens
gaucaucuacaauguguuc

SEQ ID NO: 1463402 - RNA, 19 nt, Homo sapiens
gaggacauucuguuucaaa

SEQ ID NO: 1463403 - RNA, 19 nt, Homo sapiens
gaaaauggagaaacagaaa

SEQ ID NO: 1463404 - RNA, 19 nt, Homo sapiens
ggagauguuggauugcuuu

SEQ ID NO: 1463405 - RNA, 19 nt, Homo sapiens
uauggcaacugcugauaga

SEQ ID NO: 1463406 - RNA, 19 nt, Homo sapiens
gaaguagccucaaauuaaa

SEQ ID NO: 1463407 - RNA, 19 nt, Homo sapiens
gaacugauguaaaugaaga

SEQ ID NO: 1463408 - RNA, 19 nt, Homo sapiens
gcacaugccucacgcacua

SEQ ID NO: 1463409 - RNA, 19 nt, Homo sapiens
caaagagacugguuaguga

SEQ ID NO: 1463410 - RNA, 19 nt, Homo sapiens
ggcaauggauuuagaagua

SEQ ID NO: 1463411 - RNA, 19 nt, Homo sapiens
gaauagcucugucucugaa

SEQ ID NO: 1463412 - RNA, 19 nt, Homo sapiens
agaaguagccucaaauuaa

SEQ ID NO: 1463413 - RNA, 19 nt, Homo sapiens
gggaauacgugagaaugua

SEQ ID NO: 1463414 - RNA, 19 nt, Homo sapiens
gggcagaguucuugaggaa

SEQ ID NO: 1463415 - RNA, 19 nt, Homo sapiens
gaaggaagcacugaagauu

SEQ ID NO: 1463416 - RNA, 19 nt, Homo sapiens
gguuagugauccugcauua

SEQ ID NO: 1463417 - RNA, 19 nt, Homo sapiens
gcaaagagacugguuagug

SEQ ID NO: 1463418 - RNA, 19 nt, Homo sapiens
gaagugaaagccaaaguga

SEQ ID NO: 1463419 - RNA, 19 nt, Homo sapiens
gcccaaggguuauggcuuu

SEQ ID NO: 1463420 - RNA, 19 nt, Homo sapiens
gagaacaacuagcuuggau

SEQ ID NO: 1463421 - RNA, 19 nt, Homo sapiens
ggaaagagacaccuaccaa

SEQ ID NO: 1463422 - RNA, 19 nt, Homo sapiens
ggagucaucuuugguggaa

SEQ ID NO: 1463423 - RNA, 19 nt, Homo sapiens
ccagugcaguucaaauaaa

SEQ ID NO: 1463424 - RNA, 19 nt, Homo sapiens
uaaagugugucaccauuag

SEQ ID NO: 1463425 - RNA, 19 nt, Homo sapiens
ccacugcauucaucccaua

SEQ ID NO: 1463426 - RNA, 19 nt, Homo sapiens
gaagauuccaccagcauug

SEQ ID NO: 1463427 - RNA, 19 nt, Homo sapiens
gguccaauguugucuuaga

SEQ ID NO: 1463428 - RNA, 19 nt, Homo sapiens
cagguccaauguugucuua

SEQ ID NO: 1463429 - RNA, 19 nt, Homo sapiens
gguuauggcuuucaugucu

SEQ ID NO: 1463430 - RNA, 19 nt, Homo sapiens
gcccagugcaguucaaaua

SEQ ID NO: 1463431 - RNA, 19 nt, Homo sapiens
aggaagcacugaagauuga

SEQ ID NO: 1463432 - RNA, 19 nt, Homo sapiens
gucugaaucuggaguaauu

SEQ ID NO: 1463433 - RNA, 19 nt, Homo sapiens
agagaugccucaagaagau

SEQ ID NO: 1463434 - RNA, 19 nt, Homo sapiens
gugggucgauccaguguuu

SEQ ID NO: 1463435 - RNA, 19 nt, Homo sapiens
ggagagaauuugauuaccu

SEQ ID NO: 1463436 - RNA, 19 nt, Homo sapiens
uccgaaagcuugaaucugu

SEQ ID NO: 1463437 - RNA, 19 nt, Homo sapiens
gaacaacuagcuuggaucu

SEQ ID NO: 1463438 - RNA, 19 nt, Homo sapiens
uaaaagaaguagccucaaa

SEQ ID NO: 1463439 - RNA, 19 nt, Homo sapiens
ucaccagccuccagccuuu

SEQ ID NO: 1463440 - RNA, 19 nt, Homo sapiens
gagagaugccucaagaaga

SEQ ID NO: 1463441 - RNA, 19 nt, Homo sapiens
aauaaagugugucaccauu

SEQ ID NO: 1463442 - RNA, 19 nt, Homo sapiens
aaacacugaucguccgaaa

SEQ ID NO: 1463443 - RNA, 19 nt, Homo sapiens
aagaaguagccucaaauua

SEQ ID NO: 1463444 - RNA, 19 nt, Homo sapiens
acuuucagcuuucauguuu

SEQ ID NO: 1463445 - RNA, 19 nt, Homo sapiens
ggagagaugccucaagaag

SEQ ID NO: 1463446 - RNA, 19 nt, Homo sapiens
gaaucuggaguaauuaaug

SEQ ID NO: 1463447 - RNA, 19 nt, Homo sapiens
ggaaggaagcacugaagau

SEQ ID NO: 1463448 - RNA, 19 nt, Homo sapiens
ggaagggaauacgugagaa

SEQ ID NO: 1463449 - RNA, 19 nt, Homo sapiens
gaaggcaugucagcugcaa

SEQ ID NO: 1463450 - RNA, 19 nt, Homo sapiens
cagagucaaugaaggaaau

SEQ ID NO: 1463451 - RNA, 19 nt, Homo sapiens
cugaugaugcugcuauuua

SEQ ID NO: 1463452 - RNA, 19 nt, Homo sapiens
cagauuugcugucgcuuuc

SEQ ID NO: 1463453 - RNA, 19 nt, Homo sapiens
gaggacugcucaacaaugc

SEQ ID NO: 1463454 - RNA, 19 nt, Homo sapiens
uaaacuccuuaaacucuga

SEQ ID NO: 1463455 - RNA, 19 nt, Homo sapiens
aaagaaguagccucaaauu

SEQ ID NO: 1463456 - RNA, 19 nt, Homo sapiens
cauggcagguggaaagaga

SEQ ID NO: 1463457 - RNA, 19 nt, Homo sapiens
guaauagaaucgcuuucca

SEQ ID NO: 1463458 - RNA, 19 nt, Homo sapiens
gaucucgugccguguaauu

SEQ ID NO: 1463459 - RNA, 19 nt, Homo sapiens
accaacagcucaucaggaa

SEQ ID NO: 1463460 - RNA, 19 nt, Homo sapiens
gcaauggauuuagaaguac

SEQ ID NO: 1463461 - RNA, 19 nt, Homo sapiens
gaucugaugaugcugcuau

SEQ ID NO: 1463462 - RNA, 19 nt, Homo sapiens
cugccuccaucauguaaua

SEQ ID NO: 1463463 - RNA, 19 nt, Homo sapiens
gaacuuucagcuuucaugu

SEQ ID NO: 1463464 - RNA, 19 nt, Homo sapiens
gaaccuccacugaauacug

SEQ ID NO: 1463465 - RNA, 19 nt, Homo sapiens
gaagggaauacgugagaau

SEQ ID NO: 1463466 - RNA, 19 nt, Homo sapiens
ggaagugaaagccaaagug

SEQ ID NO: 1463467 - RNA, 19 nt, Homo sapiens
ugucuuagaucugaugaug

SEQ ID NO: 1463468 - RNA, 19 nt, Homo sapiens
gccguguaauucaauguuu

SEQ ID NO: 1463469 - RNA, 19 nt, Homo sapiens
ugguggaacugauguaaau

SEQ ID NO: 1463470 - RNA, 19 nt, Homo sapiens
ggaauugaaaguugugcuu

SEQ ID NO: 1463471 - RNA, 19 nt, Homo sapiens
ucacagagucaaugaagga

SEQ ID NO: 1463472 - RNA, 19 nt, Homo sapiens
guaauuaaugccacccaaa

SEQ ID NO: 1463473 - RNA, 19 nt, Homo sapiens
ccucuuggcugaauuugag

SEQ ID NO: 1463474 - RNA, 19 nt, Homo sapiens
gcauucaucccauauccuu

SEQ ID NO: 1463475 - RNA, 19 nt, Homo sapiens
guggauuccuuacgacaau

SEQ ID NO: 1463476 - RNA, 19 nt, Homo sapiens
ggaaugcugccguggugaa

SEQ ID NO: 1463477 - RNA, 19 nt, Homo sapiens
uuggagagaugccucaaga

SEQ ID NO: 1463478 - RNA, 19 nt, Homo sapiens
aauguugucuuagaucuga

SEQ ID NO: 1463479 - RNA, 19 nt, Homo sapiens
agugaaagccaaagugaaa

SEQ ID NO: 1463480 - RNA, 19 nt, Homo sapiens
ccaauguugucuuagaucu

SEQ ID NO: 1463481 - RNA, 19 nt, Homo sapiens
uggcacaaccuacaucuug

SEQ ID NO: 1463482 - RNA, 19 nt, Homo sapiens
uuuaggaugucugaacuuu

SEQ ID NO: 1463483 - RNA, 19 nt, Homo sapiens
gcuuugguguggacaauag

SEQ ID NO: 1463484 - RNA, 19 nt, Homo sapiens
uuagugauccugcauuaga

SEQ ID NO: 1463485 - RNA, 19 nt, Homo sapiens
gagaaccuccacugaauac

SEQ ID NO: 1463486 - RNA, 19 nt, Homo sapiens
cagagccacugcauucauc

SEQ ID NO: 1463487 - RNA, 19 nt, Homo sapiens
aaagagacaccuaccaaca

SEQ ID NO: 1463488 - RNA, 19 nt, Homo sapiens
ggaugccuuugacuuugaa

SEQ ID NO: 1463489 - RNA, 19 nt, Homo sapiens
ggaggcaauggauuuagaa

SEQ ID NO: 1463490 - RNA, 19 nt, Homo sapiens
caugucagcugcaauuuug

SEQ ID NO: 1463491 - RNA, 19 nt, Homo sapiens
gaggauggccuggucugaa

SEQ ID NO: 1463492 - RNA, 19 nt, Homo sapiens
guuauggcuuucaugucua

SEQ ID NO: 1463493 - RNA, 19 nt, Homo sapiens
ccucaaauuaaacuccuua

SEQ ID NO: 1463494 - RNA, 19 nt, Homo sapiens
uggcugaauuugaguggaa

SEQ ID NO: 1463495 - RNA, 19 nt, Homo sapiens
uagaaagcgcugugaguga

SEQ ID NO: 1463496 - RNA, 19 nt, Homo sapiens
guagugaacggaagggaau

SEQ ID NO: 1463497 - RNA, 19 nt, Homo sapiens
ugaugcugcuauuuacaaa

SEQ ID NO: 1463498 - RNA, 19 nt, Homo sapiens
uggaacugauguaaaugaa

SEQ ID NO: 1463499 - RNA, 19 nt, Homo sapiens
uuugaaagccgaucugaga

SEQ ID NO: 1463500 - RNA, 19 nt, Homo sapiens
aaccuccacugaauacuga

SEQ ID NO: 1463501 - RNA, 19 nt, Homo sapiens
caucguugccaguuugaaa

SEQ ID NO: 1463502 - RNA, 19 nt, Homo sapiens
auaaagugugucaccauua

SEQ ID NO: 1463503 - RNA, 19 nt, Homo sapiens
ugaugaugcugcuauuuac

SEQ ID NO: 1463504 - RNA, 19 nt, Homo sapiens
gagaagauuccaccagcau

SEQ ID NO: 1463505 - RNA, 19 nt, Homo sapiens
ccacugaauacugaaauug

SEQ ID NO: 1463506 - RNA, 19 nt, Homo sapiens
gaaacuaacuggugcauug

SEQ ID NO: 1463507 - RNA, 19 nt, Homo sapiens
caacauggcuuucaucaga

SEQ ID NO: 1463508 - RNA, 19 nt, Homo sapiens
gaaagagucucauagauca

SEQ ID NO: 1463509 - RNA, 19 nt, Homo sapiens
gcacuuaccauuugucaua

SEQ ID NO: 1463510 - RNA, 19 nt, Homo sapiens
caucaaaggugucaacaaa

SEQ ID NO: 1463511 - RNA, 19 nt, Homo sapiens
ggagauggaucaccuaaug

SEQ ID NO: 1463512 - RNA, 19 nt, Homo sapiens
caacaaauccagccugaua

SEQ ID NO: 1463513 - RNA, 19 nt, Homo sapiens
ugacugaaaugaaucgaua

SEQ ID NO: 1463514 - RNA, 19 nt, Homo sapiens
cuaguaaucugucccauuu

SEQ ID NO: 1463515 - RNA, 19 nt, Homo sapiens
gaaugaagguagaaucaga

SEQ ID NO: 1463516 - RNA, 19 nt, Homo sapiens
caaggaaacagauaucaua

SEQ ID NO: 1463517 - RNA, 19 nt, Homo sapiens
gacaacagaugaaaggaaa

SEQ ID NO: 1463518 - RNA, 19 nt, Homo sapiens
ggaaacagauaucauagag

SEQ ID NO: 1463519 - RNA, 19 nt, Homo sapiens
gaagaagacccuggugaua

SEQ ID NO: 1463520 - RNA, 19 nt, Homo sapiens
ccaaaucuguugcuuaugu

SEQ ID NO: 1463521 - RNA, 19 nt, Homo sapiens
ucauagagcugaacaagga

SEQ ID NO: 1463522 - RNA, 19 nt, Homo sapiens
gagaagaugaugaugauuu

SEQ ID NO: 1463523 - RNA, 19 nt, Homo sapiens
caaaugcuauggaaccaaa

SEQ ID NO: 1463524 - RNA, 19 nt, Homo sapiens
caaggaaacugaggaauca

SEQ ID NO: 1463525 - RNA, 19 nt, Homo sapiens
gcauuaugauccugacuuu

SEQ ID NO: 1463526 - RNA, 19 nt, Homo sapiens
ucacaucuguuuaacuuga

SEQ ID NO: 1463527 - RNA, 19 nt, Homo sapiens
cacaugagcuuacccaaga

SEQ ID NO: 1463528 - RNA, 19 nt, Homo sapiens
ggaaagagucucauagauc

SEQ ID NO: 1463529 - RNA, 19 nt, Homo sapiens
ccacagugauuuagccaaa

SEQ ID NO: 1463530 - RNA, 19 nt, Homo sapiens
cuucugauaugcuguauuu

SEQ ID NO: 1463531 - RNA, 19 nt, Homo sapiens
gauggcacuugacuacaua

SEQ ID NO: 1463532 - RNA, 19 nt, Homo sapiens
guccagagcugcauaaugg

SEQ ID NO: 1463533 - RNA, 19 nt, Homo sapiens
ggagagcuguccaccauca

SEQ ID NO: 1463534 - RNA, 19 nt, Homo sapiens
uuggaaaucuugcaacuaa

SEQ ID NO: 1463535 - RNA, 19 nt, Homo sapiens
gccaagagaauaugaaauu

SEQ ID NO: 1463536 - RNA, 19 nt, Homo sapiens
ucaaaggugucaacaaauc

SEQ ID NO: 1463537 - RNA, 19 nt, Homo sapiens
gaacaaggaaacugaggaa

SEQ ID NO: 1463538 - RNA, 19 nt, Homo sapiens
ucucgagucucuucugaua

SEQ ID NO: 1463539 - RNA, 19 nt, Homo sapiens
aaacgaagccaagagaaua

SEQ ID NO: 1463540 - RNA, 19 nt, Homo sapiens
ggcaaagccuccuacagaa

SEQ ID NO: 1463541 - RNA, 19 nt, Homo sapiens
gaaccaaagaauaagauga

SEQ ID NO: 1463542 - RNA, 19 nt, Homo sapiens
gcuauggaaccaaagaaua

SEQ ID NO: 1463543 - RNA, 19 nt, Homo sapiens
gcuuaugucuugccaugaa

SEQ ID NO: 1463544 - RNA, 19 nt, Homo sapiens
gauaugcuguauuuaaugg

SEQ ID NO: 1463545 - RNA, 19 nt, Homo sapiens
acagaaacauccucagaga

SEQ ID NO: 1463546 - RNA, 19 nt, Homo sapiens
gaagguagaaucagagaca

SEQ ID NO: 1463547 - RNA, 19 nt, Homo sapiens
gaaacauccucagagauca

SEQ ID NO: 1463548 - RNA, 19 nt, Homo sapiens
caacuaaagcccggaauga

SEQ ID NO: 1463549 - RNA, 19 nt, Homo sapiens
caagucuccucaucugaaa

SEQ ID NO: 1463550 - RNA, 19 nt, Homo sapiens
agaauaagaugacucacau

SEQ ID NO: 1463551 - RNA, 19 nt, Homo sapiens
caaagaauaagaugacuca

SEQ ID NO: 1463552 - RNA, 19 nt, Homo sapiens
caucggcauuccaugauaa

SEQ ID NO: 1463553 - RNA, 19 nt, Homo sapiens
gggcagagaggacugguuu

SEQ ID NO: 1463554 - RNA, 19 nt, Homo sapiens
ccauucaucugguuuggaa

SEQ ID NO: 1463555 - RNA, 19 nt, Homo sapiens
cuacauauggcuuuagaaa

SEQ ID NO: 1463556 - RNA, 19 nt, Homo sapiens
acucacaucuguuuaacuu

SEQ ID NO: 1463557 - RNA, 19 nt, Homo sapiens
ugccaaaucuguugcuuau

SEQ ID NO: 1463558 - RNA, 19 nt, Homo sapiens
ugacagcuccauguucuua

SEQ ID NO: 1463559 - RNA, 19 nt, Homo sapiens
aggaguggcugugggauua

SEQ ID NO: 1463560 - RNA, 19 nt, Homo sapiens
cagaaucccugaguccaaa

SEQ ID NO: 1463561 - RNA, 19 nt, Homo sapiens
ugaggaaucacccaaauga

SEQ ID NO: 1463562 - RNA, 19 nt, Homo sapiens
gaaauccugcuucccagaa

SEQ ID NO: 1463563 - RNA, 19 nt, Homo sapiens
caacagaugaaaggaaauu

SEQ ID NO: 1463564 - RNA, 19 nt, Homo sapiens
gguggagucuuccgggauu

SEQ ID NO: 1463565 - RNA, 19 nt, Homo sapiens
gaaauuugcaggucucucu

SEQ ID NO: 1463566 - RNA, 19 nt, Homo sapiens
ucagugggaucaacauugu

SEQ ID NO: 1463567 - RNA, 19 nt, Homo sapiens
cuauggaaccaaagaauaa

SEQ ID NO: 1463568 - RNA, 19 nt, Homo sapiens
uggcaaagccuccuacaga

SEQ ID NO: 1463569 - RNA, 19 nt, Homo sapiens
gcucucgagucucuucuga

SEQ ID NO: 1463570 - RNA, 19 nt, Homo sapiens
agaugaagaaggacauuua

SEQ ID NO: 1463571 - RNA, 19 nt, Homo sapiens
gaaaugcacaugagcuuac

SEQ ID NO: 1463572 - RNA, 19 nt, Homo sapiens
gacuacauauggcuuuaga

SEQ ID NO: 1463573 - RNA, 19 nt, Homo sapiens
gaaaauguuuggcagaauc

SEQ ID NO: 1463574 - RNA, 19 nt, Homo sapiens
gcaaagccuccuacagaau

SEQ ID NO: 1463575 - RNA, 19 nt, Homo sapiens
aaagaaaggagauggauca

SEQ ID NO: 1463576 - RNA, 19 nt, Homo sapiens
gaucacagcagccgaagca

SEQ ID NO: 1463577 - RNA, 19 nt, Homo sapiens
cuccucaucugaaauauug

SEQ ID NO: 1463578 - RNA, 19 nt, Homo sapiens
cacgcaggguucucuauuu

SEQ ID NO: 1463579 - RNA, 19 nt, Homo sapiens
acacagaccacagugauuu

SEQ ID NO: 1463580 - RNA, 19 nt, Homo sapiens
ucacccaccuggaagaaau

SEQ ID NO: 1463581 - RNA, 19 nt, Homo sapiens
gaaauauuggguuccauuc

SEQ ID NO: 1463582 - RNA, 19 nt, Homo sapiens
gcauucacgucauccaaca

SEQ ID NO: 1463583 - RNA, 19 nt, Homo sapiens
ccugaaggcuggucgacuu

SEQ ID NO: 1463584 - RNA, 19 nt, Homo sapiens
ccaucggcauuccaugaua

SEQ ID NO: 1463585 - RNA, 19 nt, Homo sapiens
uggagaagaugaugaugau

SEQ ID NO: 1463586 - RNA, 19 nt, Homo sapiens
uagcagagcagcuuaucaa

SEQ ID NO: 1463587 - RNA, 19 nt, Homo sapiens
ggaaaucuugcaacuaaag

SEQ ID NO: 1463588 - RNA, 19 nt, Homo sapiens
cugcugcacuuaccauuug

SEQ ID NO: 1463589 - RNA, 19 nt, Homo sapiens
ucgagucucuucugauaug

SEQ ID NO: 1463590 - RNA, 19 nt, Homo sapiens
cagacaagcacuuuauaga

SEQ ID NO: 1463591 - RNA, 19 nt, Homo sapiens
gcugugggauuaugagaag

SEQ ID NO: 1463592 - RNA, 19 nt, Homo sapiens
gaucacacuguauaagcua

SEQ ID NO: 1463593 - RNA, 19 nt, Homo sapiens
caucuugagcucugaguuu

SEQ ID NO: 1463594 - RNA, 19 nt, Homo sapiens
aauauuuccucuugccaaa

SEQ ID NO: 1463595 - RNA, 19 nt, Homo sapiens
caacacaacauggcuuuca

SEQ ID NO: 1463596 - RNA, 19 nt, Homo sapiens
gaacuuugaagggcauuau

SEQ ID NO: 1463597 - RNA, 19 nt, Homo sapiens
gcagaaucccugaguccaa

SEQ ID NO: 1463598 - RNA, 19 nt, Homo sapiens
uacccaagaugaagaagga

SEQ ID NO: 1463599 - RNA, 19 nt, Homo sapiens
cgaaaugcacaugagcuua

SEQ ID NO: 1463600 - RNA, 19 nt, Homo sapiens
gcaccagaacacuuaauuc

SEQ ID NO: 1463601 - RNA, 19 nt, Homo sapiens
gaucaccuaaugccugaaa

SEQ ID NO: 1463602 - RNA, 19 nt, Homo sapiens
gcaggguucucuauuucuc

SEQ ID NO: 1463603 - RNA, 19 nt, Homo sapiens
uggaaagagucucauagau

SEQ ID NO: 1463604 - RNA, 19 nt, Homo sapiens
gcaacuaaagcccggaaug

SEQ ID NO: 1463605 - RNA, 19 nt, Homo sapiens
gcagagaggacugguuuua

SEQ ID NO: 1463606 - RNA, 19 nt, Homo sapiens
ggagagaaaugacuuaaga

SEQ ID NO: 1463607 - RNA, 19 nt, Homo sapiens
gaaaggaaauugcugaaag

SEQ ID NO: 1463608 - RNA, 19 nt, Homo sapiens
gguaagaguucacaagaaa

SEQ ID NO: 1463609 - RNA, 19 nt, Homo sapiens
gcacauggguguccagaga

SEQ ID NO: 1463610 - RNA, 19 nt, Homo sapiens
guagggaaaucacagauaa

SEQ ID NO: 1463611 - RNA, 19 nt, Homo sapiens
gagcuaggauuacaacuga

SEQ ID NO: 1463612 - RNA, 19 nt, Homo sapiens
gaaccacuguuaugucuga

SEQ ID NO: 1463613 - RNA, 19 nt, Homo sapiens
ggaggaggcuggucuggaa

SEQ ID NO: 1463614 - RNA, 19 nt, Homo sapiens
guagauugcuuuacuguuc

SEQ ID NO: 1463615 - RNA, 19 nt, Homo sapiens
gguagacacuugacacaaa

SEQ ID NO: 1463616 - RNA, 19 nt, Homo sapiens
uagagaaaguggaugauuu

SEQ ID NO: 1463617 - RNA, 19 nt, Homo sapiens
gcaggugucucuggaguuu

SEQ ID NO: 1463618 - RNA, 19 nt, Homo sapiens
gaaaugacuuaagaagcua

SEQ ID NO: 1463619 - RNA, 19 nt, Homo sapiens
gcaaauggccuuuuacuuu

SEQ ID NO: 1463620 - RNA, 19 nt, Homo sapiens
gagccgagaucaagccauu

SEQ ID NO: 1463621 - RNA, 19 nt, Homo sapiens
ggguagaguuuacuuagaa

SEQ ID NO: 1463622 - RNA, 19 nt, Homo sapiens
ggaggucacuggccuuuca

SEQ ID NO: 1463623 - RNA, 19 nt, Homo sapiens
gaaaggcagugguggucuu

SEQ ID NO: 1463624 - RNA, 19 nt, Homo sapiens
ucacaaaugagaacaauga

SEQ ID NO: 1463625 - RNA, 19 nt, Homo sapiens
agacaaagacggaaaguau

SEQ ID NO: 1463626 - RNA, 19 nt, Homo sapiens
caaauggccuuuuacuuuu

SEQ ID NO: 1463627 - RNA, 19 nt, Homo sapiens
uaaaccagccucuuucuga

SEQ ID NO: 1463628 - RNA, 19 nt, Homo sapiens
gcaucuguauauuccuuua

SEQ ID NO: 1463629 - RNA, 19 nt, Homo sapiens
gacaaagacggaaaguaua

SEQ ID NO: 1463630 - RNA, 19 nt, Homo sapiens
uaacaggaguagucacuuc

SEQ ID NO: 1463631 - RNA, 19 nt, Homo sapiens
ggaaugguagauugcuuua

SEQ ID NO: 1463632 - RNA, 19 nt, Homo sapiens
cagagccacuuguaauuga

SEQ ID NO: 1463633 - RNA, 19 nt, Homo sapiens
gaaaugagggguagaguuu

SEQ ID NO: 1463634 - RNA, 19 nt, Homo sapiens
gcacacacacagacaaaga

SEQ ID NO: 1463635 - RNA, 19 nt, Homo sapiens
ggagauacagccuagagaa

SEQ ID NO: 1463636 - RNA, 19 nt, Homo sapiens
gaagagguguagggaaauc

SEQ ID NO: 1463637 - RNA, 19 nt, Homo sapiens
cuucaaaggagaccaguua

SEQ ID NO: 1463638 - RNA, 19 nt, Homo sapiens
cacugaagcugcacucuga

SEQ ID NO: 1463639 - RNA, 19 nt, Homo sapiens
guagacacuugacacaaau

SEQ ID NO: 1463640 - RNA, 19 nt, Homo sapiens
aggaagagguguagggaaa

SEQ ID NO: 1463641 - RNA, 19 nt, Homo sapiens
agaaaugacuuaagaagcu

SEQ ID NO: 1463642 - RNA, 19 nt, Homo sapiens
gagauacagccuagagaaa

SEQ ID NO: 1463643 - RNA, 19 nt, Homo sapiens
gagcagacaaggaucauuc

SEQ ID NO: 1463644 - RNA, 19 nt, Homo sapiens
gcagcaggaugguaaacau

SEQ ID NO: 1463645 - RNA, 19 nt, Homo sapiens
cagcuaaaccagccucuuu

SEQ ID NO: 1463646 - RNA, 19 nt, Homo sapiens
gcugaaagccaaauaccaa

SEQ ID NO: 1463647 - RNA, 19 nt, Homo sapiens
gauacagccuagagaaagu

SEQ ID NO: 1463648 - RNA, 19 nt, Homo sapiens
ggaggcagagguugcagua

SEQ ID NO: 1463649 - RNA, 19 nt, Homo sapiens
aaaccagccucuuucugaa

SEQ ID NO: 1463650 - RNA, 19 nt, Homo sapiens
gcauauauugugccuuauu

SEQ ID NO: 1463651 - RNA, 19 nt, Homo sapiens
gauggcaaauggccuuuua

SEQ ID NO: 1463652 - RNA, 19 nt, Homo sapiens
cuuaguaugugcuuuaugu

SEQ ID NO: 1463653 - RNA, 19 nt, Homo sapiens
gaaacuuaguaugugcuuu

SEQ ID NO: 1463654 - RNA, 19 nt, Homo sapiens
ggacacaggaagccagcua

SEQ ID NO: 1463655 - RNA, 19 nt, Homo sapiens
ucacuggccuuucaugucu

SEQ ID NO: 1463656 - RNA, 19 nt, Homo sapiens
gcucagagacugugggaau

SEQ ID NO: 1463657 - RNA, 19 nt, Homo sapiens
gagcacacacacagacaaa

SEQ ID NO: 1463658 - RNA, 19 nt, Homo sapiens
gaaaccccaucucuacuaa

SEQ ID NO: 1463659 - RNA, 19 nt, Homo sapiens
ggaaucaggaagaggugua

SEQ ID NO: 1463660 - RNA, 19 nt, Homo sapiens
gcaggagaaucacuugaac

SEQ ID NO: 1463661 - RNA, 19 nt, Homo sapiens
uuucaugucugucaucuuc

SEQ ID NO: 1463662 - RNA, 19 nt, Homo sapiens
uaugcuacguggaauggua

SEQ ID NO: 1463663 - RNA, 19 nt, Homo sapiens
caucacaaaugagaacaau

SEQ ID NO: 1463664 - RNA, 19 nt, Homo sapiens
gcaggaugguaaacaugga

SEQ ID NO: 1463665 - RNA, 19 nt, Homo sapiens
uuagaggaaucaacccauu

SEQ ID NO: 1463666 - RNA, 19 nt, Homo sapiens
guaggagagaaaugacuua

SEQ ID NO: 1463667 - RNA, 19 nt, Homo sapiens
gcaggagaaucgcuugaac

SEQ ID NO: 1463668 - RNA, 19 nt, Homo sapiens
caauggcucaugccuguaa

SEQ ID NO: 1463669 - RNA, 19 nt, Homo sapiens
caggaguagucacuucauu

SEQ ID NO: 1463670 - RNA, 19 nt, Homo sapiens
gaauggcugcccuaugcua

SEQ ID NO: 1463671 - RNA, 19 nt, Homo sapiens
uggaauggcugcccuaugc

SEQ ID NO: 1463672 - RNA, 19 nt, Homo sapiens
agaagcagcaggaugguaa

SEQ ID NO: 1463673 - RNA, 19 nt, Homo sapiens
gaaaccccgucucuacuaa

SEQ ID NO: 1463674 - RNA, 19 nt, Homo sapiens
gugaaccacuguuaugucu

SEQ ID NO: 1463675 - RNA, 19 nt, Homo sapiens
gaaccugggaggcagaugu

SEQ ID NO: 1463676 - RNA, 19 nt, Homo sapiens
gagagaaaugacuuaagaa

SEQ ID NO: 1463677 - RNA, 19 nt, Homo sapiens
acaggaaacuuaguaugug

SEQ ID NO: 1463678 - RNA, 19 nt, Homo sapiens
gaaauugcugaaagccaaa

SEQ ID NO: 1463679 - RNA, 19 nt, Homo sapiens
gugguggucuucacugugu

SEQ ID NO: 1463680 - RNA, 19 nt, Homo sapiens
gcccagagccacuuguaau

SEQ ID NO: 1463681 - RNA, 19 nt, Homo sapiens
gcaagagcuaggauuacaa

SEQ ID NO: 1463682 - RNA, 19 nt, Homo sapiens
ccacuuguaauugauguuu

SEQ ID NO: 1463683 - RNA, 19 nt, Homo sapiens
ccagagccacuuguaauug

SEQ ID NO: 1463684 - RNA, 19 nt, Homo sapiens
uaccaaagcccagauuaug

SEQ ID NO: 1463685 - RNA, 19 nt, Homo sapiens
cagcaaguacucacaggaa

SEQ ID NO: 1463686 - RNA, 19 nt, Homo sapiens
ggaggcuggucuggaaaug

SEQ ID NO: 1463687 - RNA, 19 nt, Homo sapiens
cacaggaaacuuaguaugu

SEQ ID NO: 1463688 - RNA, 19 nt, Homo sapiens
aagcccagauuaugagguu

SEQ ID NO: 1463689 - RNA, 19 nt, Homo sapiens
gagaaggguaagaaaggaa

SEQ ID NO: 1463690 - RNA, 19 nt, Homo sapiens
gcagguaagaguucacaag

SEQ ID NO: 1463691 - RNA, 19 nt, Homo sapiens
ggaguagucacuucauuuu

SEQ ID NO: 1463692 - RNA, 19 nt, Homo sapiens
gauaacaggaguagucacu

SEQ ID NO: 1463693 - RNA, 19 nt, Homo sapiens
gaagcagcaggaugguaaa

SEQ ID NO: 1463694 - RNA, 19 nt, Homo sapiens
cagguaagaguucacaaga

SEQ ID NO: 1463695 - RNA, 19 nt, Homo sapiens
ggcaggagaaucacuugaa

SEQ ID NO: 1463696 - RNA, 19 nt, Homo sapiens
agaaccagcucugcagugu

SEQ ID NO: 1463697 - RNA, 19 nt, Homo sapiens
aaugguagauugcuuuacu

SEQ ID NO: 1463698 - RNA, 19 nt, Homo sapiens
aaaggaaauugcugaaagc

SEQ ID NO: 1463699 - RNA, 19 nt, Homo sapiens
acaaagacggaaaguauag

SEQ ID NO: 1463700 - RNA, 19 nt, Homo sapiens
gacagaaggaacagggauu

SEQ ID NO: 1463701 - RNA, 19 nt, Homo sapiens
agagaaggguaagaaagga

SEQ ID NO: 1463702 - RNA, 19 nt, Homo sapiens
aggcagagguugcaguaag

SEQ ID NO: 1463703 - RNA, 19 nt, Homo sapiens
gguggugcaugccuguaau

SEQ ID NO: 1463704 - RNA, 19 nt, Homo sapiens
cagcuacugcccacagaaa

SEQ ID NO: 1463705 - RNA, 19 nt, Homo sapiens
uagauugcuuuacuguuca

SEQ ID NO: 1463706 - RNA, 19 nt, Homo sapiens
acacacagaugacaaauua

SEQ ID NO: 1463707 - RNA, 19 nt, Homo sapiens
gaaaggagauacacuucuu

SEQ ID NO: 1463708 - RNA, 19 nt, Homo sapiens
gcacugagauuuaaaugca

SEQ ID NO: 1463709 - RNA, 19 nt, Homo sapiens
acaaauagaugaugguaug

SEQ ID NO: 1463710 - RNA, 19 nt, Homo sapiens
guacaagagucccuuugaa

SEQ ID NO: 1463711 - RNA, 19 nt, Homo sapiens
aaauuacccugaucugaua

SEQ ID NO: 1463712 - RNA, 19 nt, Homo sapiens
caagguagcucuaaguuuu

SEQ ID NO: 1463713 - RNA, 19 nt, Homo sapiens
gaagaggaaaugacucgua

SEQ ID NO: 1463714 - RNA, 19 nt, Homo sapiens
aaagagaccugcaauaaaa

SEQ ID NO: 1463715 - RNA, 19 nt, Homo sapiens
cagggaaccuagugcauuu

SEQ ID NO: 1463716 - RNA, 19 nt, Homo sapiens
guagucagguucaggaguu

SEQ ID NO: 1463717 - RNA, 19 nt, Homo sapiens
aaaccaacauccagaucua

SEQ ID NO: 1463718 - RNA, 19 nt, Homo sapiens
guucuugggugguuccuaa

SEQ ID NO: 1463719 - RNA, 19 nt, Homo sapiens
guauaugucuacacacaga

SEQ ID NO: 1463720 - RNA, 19 nt, Homo sapiens
cagaagagacugauccaaa

SEQ ID NO: 1463721 - RNA, 19 nt, Homo sapiens
ugugugggcuucugaguuu

SEQ ID NO: 1463722 - RNA, 19 nt, Homo sapiens
aaucuuggcucaguuugua

SEQ ID NO: 1463723 - RNA, 19 nt, Homo sapiens
gcagaguccuuauucuucu

SEQ ID NO: 1463724 - RNA, 19 nt, Homo sapiens
uaggagagauugggagaaa

SEQ ID NO: 1463725 - RNA, 19 nt, Homo sapiens
gacagugguucuuaugaug

SEQ ID NO: 1463726 - RNA, 19 nt, Homo sapiens
aagagucccuuugaagaua

SEQ ID NO: 1463727 - RNA, 19 nt, Homo sapiens
caucuucucucaucugauc

SEQ ID NO: 1463728 - RNA, 19 nt, Homo sapiens
gcagaacuccuccaaagca

SEQ ID NO: 1463729 - RNA, 19 nt, Homo sapiens
gaguuuauauucugaaagg

SEQ ID NO: 1463730 - RNA, 19 nt, Homo sapiens
uggaggauauucuacugua

SEQ ID NO: 1463731 - RNA, 19 nt, Homo sapiens
ggucauuucuuugcuuaug

SEQ ID NO: 1463732 - RNA, 19 nt, Homo sapiens
uuccuaaggucauuucuuu

SEQ ID NO: 1463733 - RNA, 19 nt, Homo sapiens
ucugguaucuuguuagaga

SEQ ID NO: 1463734 - RNA, 19 nt, Homo sapiens
gagauacacuucuuuugaa

SEQ ID NO: 1463735 - RNA, 19 nt, Homo sapiens
uaaaagagaccugcaauaa

SEQ ID NO: 1463736 - RNA, 19 nt, Homo sapiens
ggaaagggaagcacaugau

SEQ ID NO: 1463737 - RNA, 19 nt, Homo sapiens
gcagggaaccuagugcauu

SEQ ID NO: 1463738 - RNA, 19 nt, Homo sapiens
gaacuccuccaaagcaugu

SEQ ID NO: 1463739 - RNA, 19 nt, Homo sapiens
ucaguggaauuguacaaga

SEQ ID NO: 1463740 - RNA, 19 nt, Homo sapiens
gcauuuggcacugagauuu

SEQ ID NO: 1463741 - RNA, 19 nt, Homo sapiens
ggggauagguuuucugcua

SEQ ID NO: 1463742 - RNA, 19 nt, Homo sapiens
ggagaaaucauccuguuuu

SEQ ID NO: 1463743 - RNA, 19 nt, Homo sapiens
ggaaugauagcccagaaca

SEQ ID NO: 1463744 - RNA, 19 nt, Homo sapiens
gaugaugguaugauucuau

SEQ ID NO: 1463745 - RNA, 19 nt, Homo sapiens
gcccguauaugucuacaca

SEQ ID NO: 1463746 - RNA, 19 nt, Homo sapiens
ucucucaucugaucacuuc

SEQ ID NO: 1463747 - RNA, 19 nt, Homo sapiens
gaaagggaagcacaugauc

SEQ ID NO: 1463748 - RNA, 19 nt, Homo sapiens
ggagauacacuucuuuuga

SEQ ID NO: 1463749 - RNA, 19 nt, Homo sapiens
ugauagaaagcaaguguuu

SEQ ID NO: 1463750 - RNA, 19 nt, Homo sapiens
caaccagaauuguccucaa

SEQ ID NO: 1463751 - RNA, 19 nt, Homo sapiens
caucugaucacuucauguu

SEQ ID NO: 1463752 - RNA, 19 nt, Homo sapiens
gaaaccaacauccagaucu

SEQ ID NO: 1463753 - RNA, 19 nt, Homo sapiens
aaggucauuucuuugcuua

SEQ ID NO: 1463754 - RNA, 19 nt, Homo sapiens
aaugauagcccagaacaaa

SEQ ID NO: 1463755 - RNA, 19 nt, Homo sapiens
agacagugguucuuaugau

SEQ ID NO: 1463756 - RNA, 19 nt, Homo sapiens
cugcagaacuccuccaaag

SEQ ID NO: 1463757 - RNA, 19 nt, Homo sapiens
caagagucccuuugaagau

SEQ ID NO: 1463758 - RNA, 19 nt, Homo sapiens
uaaggucauuucuuugcuu

SEQ ID NO: 1463759 - RNA, 19 nt, Homo sapiens
cgucucaucuucucucauc

SEQ ID NO: 1463760 - RNA, 19 nt, Homo sapiens
ggagggaguguucaaaaua

SEQ ID NO: 1463761 - RNA, 19 nt, Homo sapiens
uuagagagcuuuucacugu

SEQ ID NO: 1463762 - RNA, 19 nt, Homo sapiens
ccucaaggcccagccauaa

SEQ ID NO: 1463763 - RNA, 19 nt, Homo sapiens
ggaugaggcacuucuguca

SEQ ID NO: 1463764 - RNA, 19 nt, Homo sapiens
gggagaaaucauccuguuu

SEQ ID NO: 1463765 - RNA, 19 nt, Homo sapiens
ccaagguagcucuaaguuu

SEQ ID NO: 1463766 - RNA, 19 nt, Homo sapiens
ggaguuaguggaguauuug

SEQ ID NO: 1463767 - RNA, 19 nt, Homo sapiens
uuaaaugcaaccagaauug

SEQ ID NO: 1463768 - RNA, 19 nt, Homo sapiens
aaucuugucuuaccacagu

SEQ ID NO: 1463769 - RNA, 19 nt, Homo sapiens
acaagagucccuuugaaga

SEQ ID NO: 1463770 - RNA, 19 nt, Homo sapiens
ucaggcccauuaccuagaa

SEQ ID NO: 1463771 - RNA, 19 nt, Homo sapiens
cauuuggcacugagauuua

SEQ ID NO: 1463772 - RNA, 19 nt, Homo sapiens
aggaguuaguggaguauuu

SEQ ID NO: 1463773 - RNA, 19 nt, Homo sapiens
auaauaaucuuggcucagu

SEQ ID NO: 1463774 - RNA, 19 nt, Homo sapiens
agaagagacugauccaaaa

SEQ ID NO: 1463775 - RNA, 19 nt, Homo sapiens
ugggagaaaucauccuguu

SEQ ID NO: 1463776 - RNA, 19 nt, Homo sapiens
gaggcacuucugucaauuu

SEQ ID NO: 1463777 - RNA, 19 nt, Homo sapiens
gggaaagggaagcacauga

SEQ ID NO: 1463778 - RNA, 19 nt, Homo sapiens
caucaagaauuagaagucu

SEQ ID NO: 1463779 - RNA, 19 nt, Homo sapiens
uagcagaguccuuauucuu

SEQ ID NO: 1463780 - RNA, 19 nt, Homo sapiens
gggcuucugaguuuauauu

SEQ ID NO: 1463781 - RNA, 19 nt, Homo sapiens
agagucccuuugaagauaa

SEQ ID NO: 1463782 - RNA, 19 nt, Homo sapiens
ggaggauauucuacuguac

SEQ ID NO: 1463783 - RNA, 19 nt, Homo sapiens
uaauaaucuuggcucaguu

SEQ ID NO: 1463784 - RNA, 19 nt, Homo sapiens
cucugagcaucaagaauua

SEQ ID NO: 1463785 - RNA, 19 nt, Homo sapiens
gcaucucccuucauuagcu

SEQ ID NO: 1463786 - RNA, 19 nt, Homo sapiens
gcugaugcuugaaguaacu

SEQ ID NO: 1463787 - RNA, 19 nt, Homo sapiens
cuuaugauguuuucccuua

SEQ ID NO: 1463788 - RNA, 19 nt, Homo sapiens
uauagcagaguccuuauuc

SEQ ID NO: 1463789 - RNA, 19 nt, Homo sapiens
aaaccuggguauguuccua

SEQ ID NO: 1463790 - RNA, 19 nt, Homo sapiens
ccguauaugucuacacaca

SEQ ID NO: 1463791 - RNA, 19 nt, Homo sapiens
cuucugguaucuuguuaga

SEQ ID NO: 1463792 - RNA, 19 nt, Homo sapiens
gaaugauagcccagaacaa

SEQ ID NO: 1463793 - RNA, 19 nt, Homo sapiens
uagaagucuuucaguggaa

SEQ ID NO: 1463794 - RNA, 19 nt, Homo sapiens
gaauuagaagucuuucagu

SEQ ID NO: 1463795 - RNA, 19 nt, Homo sapiens
gcaucaagaauuagaaguc

SEQ ID NO: 1463796 - RNA, 19 nt, Homo sapiens
cuacaaauagaugauggua

SEQ ID NO: 1463797 - RNA, 19 nt, Homo sapiens
uuucugcuagccaauauua

SEQ ID NO: 1463798 - RNA, 19 nt, Homo sapiens
cauugucucucucgaccuu

SEQ ID NO: 1463799 - RNA, 19 nt, Homo sapiens
cagugguucuuaugauguu

SEQ ID NO: 1463800 - RNA, 19 nt, Homo sapiens
cuucugaguuuauauucug

SEQ ID NO: 1463801 - RNA, 19 nt, Homo sapiens
ugacgcaggcaccuucuug

SEQ ID NO: 1463802 - RNA, 19 nt, Homo sapiens
gaucugauagaaagcaagu

SEQ ID NO: 1463803 - RNA, 19 nt, Homo sapiens
gucuuucaguggaauugua

SEQ ID NO: 1463804 - RNA, 19 nt, Homo sapiens
guauguuccuaaggucauu

SEQ ID NO: 1463805 - RNA, 19 nt, Homo sapiens
acccugaucugauagaaag

SEQ ID NO: 1463806 - RNA, 19 nt, Homo sapiens
gaagaaagccgaaguccuu

SEQ ID NO: 1463807 - RNA, 19 nt, Homo sapiens
gaagaagguugaauuugga

SEQ ID NO: 1463808 - RNA, 19 nt, Homo sapiens
gcaguaaugugaagaaugg

SEQ ID NO: 1463809 - RNA, 19 nt, Homo sapiens
ccacaaauaugaagaccuu

SEQ ID NO: 1463810 - RNA, 19 nt, Homo sapiens
gaagacaucagucacauug

SEQ ID NO: 1463811 - RNA, 19 nt, Homo sapiens
uaaaggcccugucuccaaa

SEQ ID NO: 1463812 - RNA, 19 nt, Homo sapiens
ggagggcaccaaucaguua

SEQ ID NO: 1463813 - RNA, 19 nt, Homo sapiens
ugaagaagguugaauuugg

SEQ ID NO: 1463814 - RNA, 19 nt, Homo sapiens
caugaacaaugacagcaua

SEQ ID NO: 1463815 - RNA, 19 nt, Homo sapiens
aaagaucauucuagcagua

SEQ ID NO: 1463816 - RNA, 19 nt, Homo sapiens
agccguagcucuuccaaua

SEQ ID NO: 1463817 - RNA, 19 nt, Homo sapiens
cugacacacuuaacauuua

SEQ ID NO: 1463818 - RNA, 19 nt, Homo sapiens
caagacagaagcauuuauu

SEQ ID NO: 1463819 - RNA, 19 nt, Homo sapiens
gaacaaugacagcauagug

SEQ ID NO: 1463820 - RNA, 19 nt, Homo sapiens
ucaccuugauuaccacuuu

SEQ ID NO: 1463821 - RNA, 19 nt, Homo sapiens
gaacugacacacuuaacau

SEQ ID NO: 1463822 - RNA, 19 nt, Homo sapiens
ccucugugauuaugcauuu

SEQ ID NO: 1463823 - RNA, 19 nt, Homo sapiens
acaauugugugguccauga

SEQ ID NO: 1463824 - RNA, 19 nt, Homo sapiens
ccaucaaggucuaugacua

SEQ ID NO: 1463825 - RNA, 19 nt, Homo sapiens
guuaacagauugguauuuc

SEQ ID NO: 1463826 - RNA, 19 nt, Homo sapiens
gcuccaacauacucauuug

SEQ ID NO: 1463827 - RNA, 19 nt, Homo sapiens
ggccuauccucugugauua

SEQ ID NO: 1463828 - RNA, 19 nt, Homo sapiens
gaacaggcaacaauucagu

SEQ ID NO: 1463829 - RNA, 19 nt, Homo sapiens
cagcaaccaucaaggucua

SEQ ID NO: 1463830 - RNA, 19 nt, Homo sapiens
ggugaagaagguugaauuu

SEQ ID NO: 1463831 - RNA, 19 nt, Homo sapiens
cgaaguccuugaaaccauu

SEQ ID NO: 1463832 - RNA, 19 nt, Homo sapiens
gaaagccgaaguccuugaa

SEQ ID NO: 1463833 - RNA, 19 nt, Homo sapiens
ucacuauucacaccaguua

SEQ ID NO: 1463834 - RNA, 19 nt, Homo sapiens
caaggucuaugacuacuac

SEQ ID NO: 1463835 - RNA, 19 nt, Homo sapiens
agacaucagucacauugga

SEQ ID NO: 1463836 - RNA, 19 nt, Homo sapiens
guguugagauacaauauuc

SEQ ID NO: 1463837 - RNA, 19 nt, Homo sapiens
caaugucccuggaauguac

SEQ ID NO: 1463838 - RNA, 19 nt, Homo sapiens
ugcagacgguguugagaua

SEQ ID NO: 1463839 - RNA, 19 nt, Homo sapiens
ggaguguuaacaacugaua

SEQ ID NO: 1463840 - RNA, 19 nt, Homo sapiens
acagaagcauuuauuccuu

SEQ ID NO: 1463841 - RNA, 19 nt, Homo sapiens
aggcaacaauucaguauuc

SEQ ID NO: 1463842 - RNA, 19 nt, Homo sapiens
ggaacugacacacuuaaca

SEQ ID NO: 1463843 - RNA, 19 nt, Homo sapiens
gaagaagaaagccgaaguc

SEQ ID NO: 1463844 - RNA, 19 nt, Homo sapiens
uacagucaguuaacagauu

SEQ ID NO: 1463845 - RNA, 19 nt, Homo sapiens
caacauacagucaguuaac

SEQ ID NO: 1463846 - RNA, 19 nt, Homo sapiens
caucagucacauuggauua

SEQ ID NO: 1463847 - RNA, 19 nt, Homo sapiens
gaugaacaggcaacaauuc

SEQ ID NO: 1463848 - RNA, 19 nt, Homo sapiens
caaccgacuucaccucgau

SEQ ID NO: 1463849 - RNA, 19 nt, Homo sapiens
gaugugagcaaccgacuuc

SEQ ID NO: 1463850 - RNA, 19 nt, Homo sapiens
ggccaaggcaggaggauug

SEQ ID NO: 1463851 - RNA, 19 nt, Homo sapiens
gcauuuauuccuucacuuc

SEQ ID NO: 1463852 - RNA, 19 nt, Homo sapiens
gaaaccagcaaccaucaag

SEQ ID NO: 1463853 - RNA, 19 nt, Homo sapiens
ggccagggcugugucuaug

SEQ ID NO: 1463854 - RNA, 19 nt, Homo sapiens
caccuugauuaccacuuua

SEQ ID NO: 1463855 - RNA, 19 nt, Homo sapiens
ugugguccaugaacaauga

SEQ ID NO: 1463856 - RNA, 19 nt, Homo sapiens
ucaguuaacagauugguau

SEQ ID NO: 1463857 - RNA, 19 nt, Homo sapiens
gaugcuaucuggguucagu

SEQ ID NO: 1463858 - RNA, 19 nt, Homo sapiens
gauuaugcauuuguaacug

SEQ ID NO: 1463859 - RNA, 19 nt, Homo sapiens
ucaguuacuucuccagcaa

SEQ ID NO: 1463860 - RNA, 19 nt, Homo sapiens
cagaugaacaggcaacaau

SEQ ID NO: 1463861 - RNA, 19 nt, Homo sapiens
ggucuaugacuacuaccua

SEQ ID NO: 1463862 - RNA, 19 nt, Homo sapiens
acagucaguuaacagauug

SEQ ID NO: 1463863 - RNA, 19 nt, Homo sapiens
gcaccaaucaguuacuucu

SEQ ID NO: 1463864 - RNA, 19 nt, Homo sapiens
ccguagcucuuccaauaug

SEQ ID NO: 1463865 - RNA, 19 nt, Homo sapiens
caaauaugaagaccuuuag

SEQ ID NO: 1463866 - RNA, 19 nt, Homo sapiens
uaacuguguucuuccucuu

SEQ ID NO: 1463867 - RNA, 19 nt, Homo sapiens
acuacuaccuaccagauga

SEQ ID NO: 1463868 - RNA, 19 nt, Homo sapiens
cugcauuucaccuugauua

SEQ ID NO: 1463869 - RNA, 19 nt, Homo sapiens
aggauacccugcccaaugu

SEQ ID NO: 1463870 - RNA, 19 nt, Homo sapiens
ugacacacuuaacauuuac

SEQ ID NO: 1463871 - RNA, 19 nt, Homo sapiens
gggcaccaaucaguuacuu

SEQ ID NO: 1463872 - RNA, 19 nt, Homo sapiens
ccagggcugugucuaugug

SEQ ID NO: 1463873 - RNA, 19 nt, Homo sapiens
gauccuugacucucacuau

SEQ ID NO: 1463874 - RNA, 19 nt, Homo sapiens
caacacagggagacucauc

SEQ ID NO: 1463875 - RNA, 19 nt, Homo sapiens
gagaucagccugggcaaca

SEQ ID NO: 1463876 - RNA, 19 nt, Homo sapiens
gaaguccuugaaaccauuu

SEQ ID NO: 1463877 - RNA, 19 nt, Homo sapiens
uuucaagacagaagcauuu

SEQ ID NO: 1463878 - RNA, 19 nt, Homo sapiens
ccucgauccuugacucuca

SEQ ID NO: 1463879 - RNA, 19 nt, Homo sapiens
ggcccugucuccaaauaca

SEQ ID NO: 1463880 - RNA, 19 nt, Homo sapiens
uuaaaggcccugucuccaa

SEQ ID NO: 1463881 - RNA, 19 nt, Homo sapiens
acaguuauccagguucuuu

SEQ ID NO: 1463882 - RNA, 19 nt, Homo sapiens
ccaaugucccuggaaugua

SEQ ID NO: 1463883 - RNA, 19 nt, Homo sapiens
ccuugacucucacuauuca

SEQ ID NO: 1463884 - RNA, 19 nt, Homo sapiens
ccuguaaucccagcacuuu

SEQ ID NO: 1463885 - RNA, 19 nt, Homo sapiens
uggauuagccacccuuaug

SEQ ID NO: 1463886 - RNA, 19 nt, Homo sapiens
gguguugagauacaauauu

SEQ ID NO: 1463887 - RNA, 19 nt, Homo sapiens
caaccaucaaggucuauga

SEQ ID NO: 1463888 - RNA, 19 nt, Homo sapiens
cacuuaacauuuacuugga

SEQ ID NO: 1463889 - RNA, 19 nt, Homo sapiens
gugaagaagguugaauuug

SEQ ID NO: 1463890 - RNA, 19 nt, Homo sapiens
cauuucaccuugauuacca

SEQ ID NO: 1463891 - RNA, 19 nt, Homo sapiens
ggauuagccacccuuaugg

SEQ ID NO: 1463892 - RNA, 19 nt, Homo sapiens
ggaaauaggaaaagcuaga

SEQ ID NO: 1463893 - RNA, 19 nt, Homo sapiens
uggccuauccucugugauu

SEQ ID NO: 1463894 - RNA, 19 nt, Homo sapiens
agaaugggguggagaagaa

SEQ ID NO: 1463895 - RNA, 19 nt, Homo sapiens
acacucagacuuacaccuu

SEQ ID NO: 1463896 - RNA, 19 nt, Homo sapiens
ccauggagggcaccaauca

SEQ ID NO: 1463897 - RNA, 19 nt, Homo sapiens
aaggcccugucuccaaaua

SEQ ID NO: 1463898 - RNA, 19 nt, Homo sapiens
ccgaaguccuugaaaccau

SEQ ID NO: 1463899 - RNA, 19 nt, Homo sapiens
caucaaggucuaugacuac

SEQ ID NO: 1463900 - RNA, 19 nt, Homo sapiens
acuuacaccuucaccauca

SEQ ID NO: 1463901 - RNA, 19 nt, Homo sapiens
acugacacacuuaacauuu

SEQ ID NO: 1463902 - RNA, 19 nt, Homo sapiens
caaggcaggaggauugcuu

SEQ ID NO: 1463903 - RNA, 19 nt, Homo sapiens
ccuauccucugugauuaug

SEQ ID NO: 1463904 - RNA, 19 nt, Homo sapiens
cagacgguguugagauaca

SEQ ID NO: 1463905 - RNA, 19 nt, Homo sapiens
gaagguugaauuuggaacu

SEQ ID NO: 1463906 - RNA, 19 nt, Homo sapiens
gaccuucacuucuagauua

SEQ ID NO: 1463907 - RNA, 19 nt, Homo sapiens
gaaccucacuuuaccauug

SEQ ID NO: 1463908 - RNA, 19 nt, Homo sapiens
gagagagacucccacuuua

SEQ ID NO: 1463909 - RNA, 19 nt, Homo sapiens
gcaaaugaauauggaguua

SEQ ID NO: 1463910 - RNA, 19 nt, Homo sapiens
guaaucaccucaguacuua

SEQ ID NO: 1463911 - RNA, 19 nt, Homo sapiens
gccaauguguccuuaauuu

SEQ ID NO: 1463912 - RNA, 19 nt, Homo sapiens
ccgcuucgcuuucuguuua

SEQ ID NO: 1463913 - RNA, 19 nt, Homo sapiens
gaucuacgguggucuguga

SEQ ID NO: 1463914 - RNA, 19 nt, Homo sapiens
guacacaccuaacugcauu

SEQ ID NO: 1463915 - RNA, 19 nt, Homo sapiens
gaauagaguuuacauccau

SEQ ID NO: 1463916 - RNA, 19 nt, Homo sapiens
gaauuaaguuuccaaagag

SEQ ID NO: 1463917 - RNA, 19 nt, Homo sapiens
ccacuucuaugaugacaaa

SEQ ID NO: 1463918 - RNA, 19 nt, Homo sapiens
ggaguuaguagauuuauga

SEQ ID NO: 1463919 - RNA, 19 nt, Homo sapiens
caugugggcuuucuucauu

SEQ ID NO: 1463920 - RNA, 19 nt, Homo sapiens
acacagaaguucaucaaug

SEQ ID NO: 1463921 - RNA, 19 nt, Homo sapiens
guggagaccuucacuucua

SEQ ID NO: 1463922 - RNA, 19 nt, Homo sapiens
gggaugagauauuaaaugg

SEQ ID NO: 1463923 - RNA, 19 nt, Homo sapiens
ucccaucucugguuaauuu

SEQ ID NO: 1463924 - RNA, 19 nt, Homo sapiens
caacauagccuacuuuuau

SEQ ID NO: 1463925 - RNA, 19 nt, Homo sapiens
ccucauggcagcuuuaaua

SEQ ID NO: 1463926 - RNA, 19 nt, Homo sapiens
caucugaucugaacagcuu

SEQ ID NO: 1463927 - RNA, 19 nt, Homo sapiens
ugagagagacucccacuuu

SEQ ID NO: 1463928 - RNA, 19 nt, Homo sapiens
ggaccaguauccagcugua

SEQ ID NO: 1463929 - RNA, 19 nt, Homo sapiens
gagagacucccacuuuauu

SEQ ID NO: 1463930 - RNA, 19 nt, Homo sapiens
ccaaggguguggaccagua

SEQ ID NO: 1463931 - RNA, 19 nt, Homo sapiens
gcugaaauguacauguuug

SEQ ID NO: 1463932 - RNA, 19 nt, Homo sapiens
acaccuaacugcauuuguu

SEQ ID NO: 1463933 - RNA, 19 nt, Homo sapiens
gaguuuacauccauucaug

SEQ ID NO: 1463934 - RNA, 19 nt, Homo sapiens
caugcugccuuauuucuuu

SEQ ID NO: 1463935 - RNA, 19 nt, Homo sapiens
auaaugagcugaagaaggu

SEQ ID NO: 1463936 - RNA, 19 nt, Homo sapiens
gaauauggaguuaguagau

SEQ ID NO: 1463937 - RNA, 19 nt, Homo sapiens
ucugaaaccuggauccaaa

SEQ ID NO: 1463938 - RNA, 19 nt, Homo sapiens
cgacaaggcuaaggacaau

SEQ ID NO: 1463939 - RNA, 19 nt, Homo sapiens
acaaacgacugcuucagaa

SEQ ID NO: 1463940 - RNA, 19 nt, Homo sapiens
gcacacagaaguucaucaa

SEQ ID NO: 1463941 - RNA, 19 nt, Homo sapiens
guucuuaauugcccuaaug

SEQ ID NO: 1463942 - RNA, 19 nt, Homo sapiens
ggauggagauagcagacuu

SEQ ID NO: 1463943 - RNA, 19 nt, Homo sapiens
guggaucagugaaggcaua

SEQ ID NO: 1463944 - RNA, 19 nt, Homo sapiens
cagcaaaguaguuucagua

SEQ ID NO: 1463945 - RNA, 19 nt, Homo sapiens
caaagaaaucugagagaga

SEQ ID NO: 1463946 - RNA, 19 nt, Homo sapiens
gaagagcucguuggccuuu

SEQ ID NO: 1463947 - RNA, 19 nt, Homo sapiens
gaaguagguggaucaguga

SEQ ID NO: 1463948 - RNA, 19 nt, Homo sapiens
caacugugcgcuugaaaga

SEQ ID NO: 1463949 - RNA, 19 nt, Homo sapiens
uaauagccauggguucuuu

SEQ ID NO: 1463950 - RNA, 19 nt, Homo sapiens
uaauugcccuaaugaucua

SEQ ID NO: 1463951 - RNA, 19 nt, Homo sapiens
cuuaagcacuucugaacuu

SEQ ID NO: 1463952 - RNA, 19 nt, Homo sapiens
gaaagugagucagauuggu

SEQ ID NO: 1463953 - RNA, 19 nt, Homo sapiens
gacaaauccucccuguguu

SEQ ID NO: 1463954 - RNA, 19 nt, Homo sapiens
gaugacaaaguucagagua

SEQ ID NO: 1463955 - RNA, 19 nt, Homo sapiens
agacaaauccucccugugu

SEQ ID NO: 1463956 - RNA, 19 nt, Homo sapiens
gacaaacgacugcuucaga

SEQ ID NO: 1463957 - RNA, 19 nt, Homo sapiens
gaacgagaggccaacaaga

SEQ ID NO: 1463958 - RNA, 19 nt, Homo sapiens
uagauacucaugcaacaua

SEQ ID NO: 1463959 - RNA, 19 nt, Homo sapiens
gaucagugaaggcauaaug

SEQ ID NO: 1463960 - RNA, 19 nt, Homo sapiens
caccaucuauacuucauug

SEQ ID NO: 1463961 - RNA, 19 nt, Homo sapiens
uaucuucucuuacgacaag

SEQ ID NO: 1463962 - RNA, 19 nt, Homo sapiens
cuucauaguugaguaauca

SEQ ID NO: 1463963 - RNA, 19 nt, Homo sapiens
cuacgguggucugugaaua

SEQ ID NO: 1463964 - RNA, 19 nt, Homo sapiens
ugacggaccgcacaucuga

SEQ ID NO: 1463965 - RNA, 19 nt, Homo sapiens
guacagcaaaguaguuuca

SEQ ID NO: 1463966 - RNA, 19 nt, Homo sapiens
cagcucugcuucuuuguuc

SEQ ID NO: 1463967 - RNA, 19 nt, Homo sapiens
ccaaagaguaaucuaggaa

SEQ ID NO: 1463968 - RNA, 19 nt, Homo sapiens
ggaaguugacguccugugu

SEQ ID NO: 1463969 - RNA, 19 nt, Homo sapiens
gcacaugcugccuuauuuc

SEQ ID NO: 1463970 - RNA, 19 nt, Homo sapiens
cugcugaaauguacauguu

SEQ ID NO: 1463971 - RNA, 19 nt, Homo sapiens
gaccgcacaucugaucuga

SEQ ID NO: 1463972 - RNA, 19 nt, Homo sapiens
guacuuaagcacuucugaa

SEQ ID NO: 1463973 - RNA, 19 nt, Homo sapiens
ccucaguacuuaagcacuu

SEQ ID NO: 1463974 - RNA, 19 nt, Homo sapiens
aaagugagucagauuggua

SEQ ID NO: 1463975 - RNA, 19 nt, Homo sapiens
ggccagaucuuugagaaac

SEQ ID NO: 1463976 - RNA, 19 nt, Homo sapiens
ggaagaguaauagggauga

SEQ ID NO: 1463977 - RNA, 19 nt, Homo sapiens
auucaugccucuuucagaa

SEQ ID NO: 1463978 - RNA, 19 nt, Homo sapiens
gcacuggcccaaugucauc

SEQ ID NO: 1463979 - RNA, 19 nt, Homo sapiens
guauccagcuguagugucu

SEQ ID NO: 1463980 - RNA, 19 nt, Homo sapiens
gcucuacuccuugguuauu

SEQ ID NO: 1463981 - RNA, 19 nt, Homo sapiens
cuucuaugaugacaaaguu

SEQ ID NO: 1463982 - RNA, 19 nt, Homo sapiens
cacagaaguucaucaaugc

SEQ ID NO: 1463983 - RNA, 19 nt, Homo sapiens
uggcucuacuccuugguua

SEQ ID NO: 1463984 - RNA, 19 nt, Homo sapiens
cagcauaagccaucaugug

SEQ ID NO: 1463985 - RNA, 19 nt, Homo sapiens
aaagaguaaucuaggaagu

SEQ ID NO: 1463986 - RNA, 19 nt, Homo sapiens
caaacgacugcuucagaaa

SEQ ID NO: 1463987 - RNA, 19 nt, Homo sapiens
caucuauacuucauugcau

SEQ ID NO: 1463988 - RNA, 19 nt, Homo sapiens
cauacgcuguacuugcuaa

SEQ ID NO: 1463989 - RNA, 19 nt, Homo sapiens
gaacagcuuggagaaagug

SEQ ID NO: 1463990 - RNA, 19 nt, Homo sapiens
ccgcacaucugaucugaac

SEQ ID NO: 1463991 - RNA, 19 nt, Homo sapiens
gucaugcacuggcccaaug

SEQ ID NO: 1463992 - RNA, 19 nt, Homo sapiens
ggaacgagaggccaacaag

SEQ ID NO: 1463993 - RNA, 19 nt, Homo sapiens
cuucacuucuagauuauug

SEQ ID NO: 1463994 - RNA, 19 nt, Homo sapiens
guacauguuuggcucuacu

SEQ ID NO: 1463995 - RNA, 19 nt, Homo sapiens
ugaauagaguuuacaucca

SEQ ID NO: 1463996 - RNA, 19 nt, Homo sapiens
aagguuagcaggugauuug

SEQ ID NO: 1463997 - RNA, 19 nt, Homo sapiens
gagacucccacuuuauuuc

SEQ ID NO: 1463998 - RNA, 19 nt, Homo sapiens
gcuuucuguuuaucacuuu

SEQ ID NO: 1463999 - RNA, 19 nt, Homo sapiens
gaguaauagggaugagaua

SEQ ID NO: 1464000 - RNA, 19 nt, Homo sapiens
gcacacuuuauaagcaauu

SEQ ID NO: 1464001 - RNA, 19 nt, Homo sapiens
gguggucugugaauagagu

SEQ ID NO: 1464002 - RNA, 19 nt, Homo sapiens
agaaacagcgggagaccaa

SEQ ID NO: 1464003 - RNA, 19 nt, Homo sapiens
uuauuuccuuccucaauga

SEQ ID NO: 1464004 - RNA, 19 nt, Homo sapiens
gcacaucugaucugaacag

SEQ ID NO: 1464005 - RNA, 19 nt, Homo sapiens
ugaaaacguugacagcaaa

SEQ ID NO: 1464006 - RNA, 19 nt, Homo sapiens
gaacuuauuuguuggagaa

SEQ ID NO: 1464007 - RNA, 19 nt, Homo sapiens
ucagucagcuaaagaagua

SEQ ID NO: 1464008 - RNA, 19 nt, Homo sapiens
ggagaaaugucuucagagu

SEQ ID NO: 1464009 - RNA, 19 nt, Homo sapiens
gcgcucaucuaguacaaua

SEQ ID NO: 1464010 - RNA, 19 nt, Homo sapiens
uaaacacacugacugaauu

SEQ ID NO: 1464011 - RNA, 19 nt, Homo sapiens
gauaaagacuauggaaaug

SEQ ID NO: 1464012 - RNA, 19 nt, Homo sapiens
ucauugcgcucaucuagua

SEQ ID NO: 1464013 - RNA, 19 nt, Homo sapiens
agaaaugucuucagaguca

SEQ ID NO: 1464014 - RNA, 19 nt, Homo sapiens
gaaagccagugacaaguag

SEQ ID NO: 1464015 - RNA, 19 nt, Homo sapiens
ggaggcaucuugacuuagu

SEQ ID NO: 1464016 - RNA, 19 nt, Homo sapiens
gaacauaaguacacaaaag

SEQ ID NO: 1464017 - RNA, 19 nt, Homo sapiens
gagccuguguuggaacuua

SEQ ID NO: 1464018 - RNA, 19 nt, Homo sapiens
cauaguaguuucuaagauc

SEQ ID NO: 1464019 - RNA, 19 nt, Homo sapiens
gaucuugcuucugucauaa

SEQ ID NO: 1464020 - RNA, 19 nt, Homo sapiens
gaugcaaucuguaguggau

SEQ ID NO: 1464021 - RNA, 19 nt, Homo sapiens
ccaaagagcaaucagaugu

SEQ ID NO: 1464022 - RNA, 19 nt, Homo sapiens
cacacugacugaauuguuu

SEQ ID NO: 1464023 - RNA, 19 nt, Homo sapiens
ucagaagaguaccaaugua

SEQ ID NO: 1464024 - RNA, 19 nt, Homo sapiens
ggauaaagagagacugauu

SEQ ID NO: 1464025 - RNA, 19 nt, Homo sapiens
gguccugucucucgaguug

SEQ ID NO: 1464026 - RNA, 19 nt, Homo sapiens
guaccaauguagaggaguu

SEQ ID NO: 1464027 - RNA, 19 nt, Homo sapiens
uaagaaagccagugacaag

SEQ ID NO: 1464028 - RNA, 19 nt, Homo sapiens
cgauaaagacuauggaaau

SEQ ID NO: 1464029 - RNA, 19 nt, Homo sapiens
caaagucagcagcagauuu

SEQ ID NO: 1464030 - RNA, 19 nt, Homo sapiens
guagaggaguugcaucagu

SEQ ID NO: 1464031 - RNA, 19 nt, Homo sapiens
uguuggaacuuauuuguug

SEQ ID NO: 1464032 - RNA, 19 nt, Homo sapiens
ucuggaaucuucucuuuca

SEQ ID NO: 1464033 - RNA, 19 nt, Homo sapiens
aaacagcaguaacauccuu

SEQ ID NO: 1464034 - RNA, 19 nt, Homo sapiens
aaagagagacugauucaag

SEQ ID NO: 1464035 - RNA, 19 nt, Homo sapiens
gauaaagagagacugauuc

SEQ ID NO: 1464036 - RNA, 19 nt, Homo sapiens
uuggaggcaucuugacuua

SEQ ID NO: 1464037 - RNA, 19 nt, Homo sapiens
aaucuucucuuucacacuu

SEQ ID NO: 1464038 - RNA, 19 nt, Homo sapiens
agaucuugcuucugucaua

SEQ ID NO: 1464039 - RNA, 19 nt, Homo sapiens
uaugauagacaccuugaaa

SEQ ID NO: 1464040 - RNA, 19 nt, Homo sapiens
agaaagccagugacaagua

SEQ ID NO: 1464041 - RNA, 19 nt, Homo sapiens
aaagucagcagcagauuug

SEQ ID NO: 1464042 - RNA, 19 nt, Homo sapiens
agucuggaaucuucucuuu

SEQ ID NO: 1464043 - RNA, 19 nt, Homo sapiens
ggaauuagaagaagauagc

SEQ ID NO: 1464044 - RNA, 19 nt, Homo sapiens
gcaaaacauuuaccuguag

SEQ ID NO: 1464045 - RNA, 19 nt, Homo sapiens
caucaucucugugcuaaac

SEQ ID NO: 1464046 - RNA, 19 nt, Homo sapiens
gcgauaaagacuauggaaa

SEQ ID NO: 1464047 - RNA, 19 nt, Homo sapiens
aaagagcaaucagauguca

SEQ ID NO: 1464048 - RNA, 19 nt, Homo sapiens
gaagaguaccaauguagag

SEQ ID NO: 1464049 - RNA, 19 nt, Homo sapiens
guucuucuuucauguacaa

SEQ ID NO: 1464050 - RNA, 19 nt, Homo sapiens
gauucaagcugccaaaaug

SEQ ID NO: 1464051 - RNA, 19 nt, Homo sapiens
ggcaaaacauuuaccugua

SEQ ID NO: 1464052 - RNA, 19 nt, Homo sapiens
gcugggagccuguguugga

SEQ ID NO: 1464053 - RNA, 19 nt, Homo sapiens
gucaucaucucugugcuaa

SEQ ID NO: 1464054 - RNA, 19 nt, Homo sapiens
caauaggaauuagaagaag

SEQ ID NO: 1464055 - RNA, 19 nt, Homo sapiens
caaguagggaugcaacaga

SEQ ID NO: 1464056 - RNA, 19 nt, Homo sapiens
ggcuaugggaccaaucuua

SEQ ID NO: 1464057 - RNA, 19 nt, Homo sapiens
gcugugagaaacaauaguu

SEQ ID NO: 1464058 - RNA, 19 nt, Homo sapiens
uuggagaaaugucuucaga

SEQ ID NO: 1464059 - RNA, 19 nt, Homo sapiens
aaguagggaugcaacagaa

SEQ ID NO: 1464060 - RNA, 19 nt, Homo sapiens
gcaucagucagcuaaagaa

SEQ ID NO: 1464061 - RNA, 19 nt, Homo sapiens
cagaagaguaccaauguag

SEQ ID NO: 1464062 - RNA, 19 nt, Homo sapiens
auacagaagacaccaaaga

SEQ ID NO: 1464063 - RNA, 19 nt, Homo sapiens
guucagaagaguaccaaug

SEQ ID NO: 1464064 - RNA, 19 nt, Homo sapiens
ggaugcaagacaugacaaa

SEQ ID NO: 1464065 - RNA, 19 nt, Homo sapiens
ucauaaacacacugacuga

SEQ ID NO: 1464066 - RNA, 19 nt, Homo sapiens
gcuaugggaccaaucuuag

SEQ ID NO: 1464067 - RNA, 19 nt, Homo sapiens
acacugacugaauuguuua

SEQ ID NO: 1464068 - RNA, 19 nt, Homo sapiens
guagggaugcaacagaaau

SEQ ID NO: 1464069 - RNA, 19 nt, Homo sapiens
aaacacacugacugaauug

SEQ ID NO: 1464070 - RNA, 19 nt, Homo sapiens
acauuuaccuguaguuuug

SEQ ID NO: 1464071 - RNA, 19 nt, Homo sapiens
gucagcagcagauuuguug

SEQ ID NO: 1464072 - RNA, 19 nt, Homo sapiens
gaagacaccaaagagcaau

SEQ ID NO: 1464073 - RNA, 19 nt, Homo sapiens
gaggcaucuugacuuaguu

SEQ ID NO: 1464074 - RNA, 19 nt, Homo sapiens
gucuuuauguuccaagguu

SEQ ID NO: 1464075 - RNA, 19 nt, Homo sapiens
ugcaagacaugacaaaauu

SEQ ID NO: 1464076 - RNA, 19 nt, Homo sapiens
uuguuuagccgcaguauga

SEQ ID NO: 1464077 - RNA, 19 nt, Homo sapiens
gccaaaauguucuucuuuc

SEQ ID NO: 1464078 - RNA, 19 nt, Homo sapiens
agaaaaggauaaagagaga

SEQ ID NO: 1464079 - RNA, 19 nt, Homo sapiens
caaaagucaucuggcaaaa

SEQ ID NO: 1464080 - RNA, 19 nt, Homo sapiens
guuagaacauaaguacaca

SEQ ID NO: 1464081 - RNA, 19 nt, Homo sapiens
caccaaagagcaaucagau

SEQ ID NO: 1464082 - RNA, 19 nt, Homo sapiens
ccaaaauguucuucuuuca

SEQ ID NO: 1464083 - RNA, 19 nt, Homo sapiens
auaaagagagacugauuca

SEQ ID NO: 1464084 - RNA, 19 nt, Homo sapiens
aaagucaucuggcaaaaca

SEQ ID NO: 1464085 - RNA, 19 nt, Homo sapiens
gcuaaacagcaguaacauc

SEQ ID NO: 1464086 - RNA, 19 nt, Homo sapiens
cgaguuggaggcaucuuga

SEQ ID NO: 1464087 - RNA, 19 nt, Homo sapiens
ggccaugugcucugugguu

SEQ ID NO: 1464088 - RNA, 19 nt, Homo sapiens
caauggccaugugcucugu

SEQ ID NO: 1464089 - RNA, 19 nt, Homo sapiens
uguaguggaugcaagacau

SEQ ID NO: 1464090 - RNA, 19 nt, Homo sapiens
gaauuguuuagccgcagua

SEQ ID NO: 1464091 - RNA, 19 nt, Homo sapiens
auaaacacacugacugaau

SEQ ID NO: 1464092 - RNA, 19 nt, Homo sapiens
ucaaggcuaugggaccaau

SEQ ID NO: 1464093 - RNA, 19 nt, Homo sapiens
caaagagcaaucagauguc

SEQ ID NO: 1464094 - RNA, 19 nt, Homo sapiens
gugagaaacaauaguuaca

SEQ ID NO: 1464095 - RNA, 19 nt, Homo sapiens
uuuagccgcaguaugaaua

SEQ ID NO: 1464096 - RNA, 19 nt, Homo sapiens
agaagaguaccaauguaga

SEQ ID NO: 1464097 - RNA, 19 nt, Homo sapiens
acacacugacugaauuguu

SEQ ID NO: 1464098 - RNA, 19 nt, Homo sapiens
ucuuagagauccuccaaaa

SEQ ID NO: 1464099 - RNA, 19 nt, Homo sapiens
caaauugucaaggcuaugg

SEQ ID NO: 1464100 - RNA, 19 nt, Homo sapiens
cuauacagaagacaccaaa

SEQ ID NO: 1464101 - RNA, 19 nt, Homo sapiens
uugggagucuggaaucuuc

SEQ ID NO: 1464102 - RNA, 19 nt, Homo sapiens
guaacauccuugggagucu

SEQ ID NO: 1464103 - RNA, 19 nt, Homo sapiens
cauaaacacacugacugaa

SEQ ID NO: 1464104 - RNA, 19 nt, Homo sapiens
agaagacaccaaagagcaa

SEQ ID NO: 1464105 - RNA, 19 nt, Homo sapiens
gcccauacgccagucauca

SEQ ID NO: 1464106 - RNA, 19 nt, Homo sapiens
ucacagaucuuucucuaaa

SEQ ID NO: 1464107 - RNA, 19 nt, Homo sapiens
gcucacagaucuuucucua

SEQ ID NO: 1464108 - RNA, 19 nt, Homo sapiens
ggacagugguuugcucuga

SEQ ID NO: 1464109 - RNA, 19 nt, Homo sapiens
ugaaagaaauccacucuac

SEQ ID NO: 1464110 - RNA, 19 nt, Homo sapiens
gcccauaugugaaagaaau

SEQ ID NO: 1464111 - RNA, 19 nt, Homo sapiens
gccagaagcucacagaucu

SEQ ID NO: 1464112 - RNA, 19 nt, Homo sapiens
ugucuucccuuuauagauu

SEQ ID NO: 1464113 - RNA, 19 nt, Homo sapiens
gaggaaugucuacguauuu

SEQ ID NO: 1464114 - RNA, 19 nt, Homo sapiens
guacagggguauuauauau

SEQ ID NO: 1464115 - RNA, 19 nt, Homo sapiens
gcuacaaccucaccgacaa

SEQ ID NO: 1464116 - RNA, 19 nt, Homo sapiens
gaaagaaauccacucuaca

SEQ ID NO: 1464117 - RNA, 19 nt, Homo sapiens
agaccucgcuuccuuuaug

SEQ ID NO: 1464118 - RNA, 19 nt, Homo sapiens
agaggaaugucuacguauu

SEQ ID NO: 1464119 - RNA, 19 nt, Homo sapiens
ugggaacaauguagaauau

SEQ ID NO: 1464120 - RNA, 19 nt, Homo sapiens
ccacgggguuuccauuuua

SEQ ID NO: 1464121 - RNA, 19 nt, Homo sapiens
caauuucaaucacugacaa

SEQ ID NO: 1464122 - RNA, 19 nt, Homo sapiens
gcucaacauuggacagugu

SEQ ID NO: 1464123 - RNA, 19 nt, Homo sapiens
cgacaugguucccguggau

SEQ ID NO: 1464124 - RNA, 19 nt, Homo sapiens
agugauagcuggacacaca

SEQ ID NO: 1464125 - RNA, 19 nt, Homo sapiens
ccacaucucaugccuguuc

SEQ ID NO: 1464126 - RNA, 19 nt, Homo sapiens
uaucugucuucccuuuaua

SEQ ID NO: 1464127 - RNA, 19 nt, Homo sapiens
uucaaucacugacaaauca

SEQ ID NO: 1464128 - RNA, 19 nt, Homo sapiens
ucugagaccucgcuuccuu

SEQ ID NO: 1464129 - RNA, 19 nt, Homo sapiens
aaagaaauccacucuacau

SEQ ID NO: 1464130 - RNA, 19 nt, Homo sapiens
ugagaccucgcuuccuuua

SEQ ID NO: 1464131 - RNA, 19 nt, Homo sapiens
cagaagcucacagaucuuu

SEQ ID NO: 1464132 - RNA, 19 nt, Homo sapiens
auauaucugucuucccuuu

SEQ ID NO: 1464133 - RNA, 19 nt, Homo sapiens
gaugacagcucagguuucc

SEQ ID NO: 1464134 - RNA, 19 nt, Homo sapiens
cccaugagauagaggaaug

SEQ ID NO: 1464135 - RNA, 19 nt, Homo sapiens
gggaacaauguagaauaua

SEQ ID NO: 1464136 - RNA, 19 nt, Homo sapiens
gauguuucguucugugaca

SEQ ID NO: 1464137 - RNA, 19 nt, Homo sapiens
gcagcaacaucaccaacac

SEQ ID NO: 1464138 - RNA, 19 nt, Homo sapiens
caccaacacuggccuucug

SEQ ID NO: 1464139 - RNA, 19 nt, Homo sapiens
ugagugcccauaugugaaa

SEQ ID NO: 1464140 - RNA, 19 nt, Homo sapiens
gcuggacacacaaggaauu

SEQ ID NO: 1464141 - RNA, 19 nt, Homo sapiens
gaagcucacagaucuuucu

SEQ ID NO: 1464142 - RNA, 19 nt, Homo sapiens
gaaugucuacguauuucau

SEQ ID NO: 1464143 - RNA, 19 nt, Homo sapiens
cacaaggaauucacaacuc

SEQ ID NO: 1464144 - RNA, 19 nt, Homo sapiens
ggugaugacagcucagguu

SEQ ID NO: 1464145 - RNA, 19 nt, Homo sapiens
ggacagugugugcgcauca

SEQ ID NO: 1464146 - RNA, 19 nt, Homo sapiens
gugaugacagcucagguuu

SEQ ID NO: 1464147 - RNA, 19 nt, Homo sapiens
ucccguggaucuuuaacuu

SEQ ID NO: 1464148 - RNA, 19 nt, Homo sapiens
acaagggccuggagcugau

SEQ ID NO: 1464149 - RNA, 19 nt, Homo sapiens
uuccugcccugaaacaauu

SEQ ID NO: 1464150 - RNA, 19 nt, Homo sapiens
gcaguuuccccaugagaua

SEQ ID NO: 1464151 - RNA, 19 nt, Homo sapiens
ugacggacagugagaagga

SEQ ID NO: 1464152 - RNA, 19 nt, Homo sapiens
ucaccggcauagaccugua

SEQ ID NO: 1464153 - RNA, 19 nt, Homo sapiens
gcgcuccugugacaacauc

SEQ ID NO: 1464154 - RNA, 19 nt, Homo sapiens
cguauuucauucccuguuc

SEQ ID NO: 1464155 - RNA, 19 nt, Homo sapiens
ucacaacuccccaaagaaa

SEQ ID NO: 1464156 - RNA, 19 nt, Homo sapiens
gcauucuccugccgguuuc

SEQ ID NO: 1464157 - RNA, 19 nt, Homo sapiens
aaccugcgcuccugugaca

SEQ ID NO: 1464158 - RNA, 19 nt, Homo sapiens
gugcccauaugugaaagaa

SEQ ID NO: 1464159 - RNA, 19 nt, Homo sapiens
gcauagcccaguaccucaa

SEQ ID NO: 1464160 - RNA, 19 nt, Homo sapiens
gagccaacucaccggcaua

SEQ ID NO: 1464161 - RNA, 19 nt, Homo sapiens
gcuccugccacaucaguga

SEQ ID NO: 1464162 - RNA, 19 nt, Homo sapiens
aagaaauccacucuacauu

SEQ ID NO: 1464163 - RNA, 19 nt, Homo sapiens
uuacugagugcccauaugu

SEQ ID NO: 1464164 - RNA, 19 nt, Homo sapiens
acacuggccuucugcucau

SEQ ID NO: 1464165 - RNA, 19 nt, Homo sapiens
acagugguuugcucugaga

SEQ ID NO: 1464166 - RNA, 19 nt, Homo sapiens
ucuuuaacuuccagacuug

SEQ ID NO: 1464167 - RNA, 19 nt, Homo sapiens
uggauggccucaagucucu

SEQ ID NO: 1464168 - RNA, 19 nt, Homo sapiens
auaucugucuucccuuuau

SEQ ID NO: 1464169 - RNA, 19 nt, Homo sapiens
uaaugggaacaauguagaa

SEQ ID NO: 1464170 - RNA, 19 nt, Homo sapiens
ggaaugucuacguauuuca

SEQ ID NO: 1464171 - RNA, 19 nt, Homo sapiens
caagcuucuucgacaggaa

SEQ ID NO: 1464172 - RNA, 19 nt, Homo sapiens
gaccucgcuuccuuuaugg

SEQ ID NO: 1464173 - RNA, 19 nt, Homo sapiens
ggucugcagcgccucaaga

SEQ ID NO: 1464174 - RNA, 19 nt, Homo sapiens
gugaaagaaauccacucua

SEQ ID NO: 1464175 - RNA, 19 nt, Homo sapiens
aggaaugucuacguauuuc

SEQ ID NO: 1464176 - RNA, 19 nt, Homo sapiens
uauaucugucuucccuuua

SEQ ID NO: 1464177 - RNA, 19 nt, Homo sapiens
caacaucgagagccucaac

SEQ ID NO: 1464178 - RNA, 19 nt, Homo sapiens
gccgccaccuuucggaugu

SEQ ID NO: 1464179 - RNA, 19 nt, Homo sapiens
caaucacugacaaaucauu

SEQ ID NO: 1464180 - RNA, 19 nt, Homo sapiens
uagcuggacacacaaggaa

SEQ ID NO: 1464181 - RNA, 19 nt, Homo sapiens
ggcagaugacggacaguga

SEQ ID NO: 1464182 - RNA, 19 nt, Homo sapiens
guacucaaccugggacucu

SEQ ID NO: 1464183 - RNA, 19 nt, Homo sapiens
uuaaugggaacaauguaga

SEQ ID NO: 1464184 - RNA, 19 nt, Homo sapiens
acugagugcccauauguga

SEQ ID NO: 1464185 - RNA, 19 nt, Homo sapiens
ucacugacaaaucauuauc

SEQ ID NO: 1464186 - RNA, 19 nt, Homo sapiens
gauauguauuacugagaac

SEQ ID NO: 1464187 - RNA, 19 nt, Homo sapiens
cagcgccucaagagccuua

SEQ ID NO: 1464188 - RNA, 19 nt, Homo sapiens
caaggugggagaccagagu

SEQ ID NO: 1464189 - RNA, 19 nt, Homo sapiens
guagaauauaucugucuuc

SEQ ID NO: 1464190 - RNA, 19 nt, Homo sapiens
ggaagauggagacccacau

SEQ ID NO: 1464191 - RNA, 19 nt, Homo sapiens
guuccugcccugaaacaau

SEQ ID NO: 1464192 - RNA, 19 nt, Homo sapiens
ggacacacaaggaauucac

SEQ ID NO: 1464193 - RNA, 19 nt, Homo sapiens
ccugugacaacaucaguga

SEQ ID NO: 1464194 - RNA, 19 nt, Homo sapiens
ugguucccguggaucuuua

SEQ ID NO: 1464195 - RNA, 19 nt, Homo sapiens
caagaaggcuuuauccuaa

SEQ ID NO: 1464196 - RNA, 19 nt, Homo sapiens
aaacauaucugcauuggaa

SEQ ID NO: 1464197 - RNA, 19 nt, Homo sapiens
gcacgaguuugcauguuua

SEQ ID NO: 1464198 - RNA, 19 nt, Homo sapiens
caagcucuaucacgaauua

SEQ ID NO: 1464199 - RNA, 19 nt, Homo sapiens
gaaagcaguucaagcucua

SEQ ID NO: 1464200 - RNA, 19 nt, Homo sapiens
caacaaccauaucuagaaa

SEQ ID NO: 1464201 - RNA, 19 nt, Homo sapiens
agaaauagcuguuugucaa

SEQ ID NO: 1464202 - RNA, 19 nt, Homo sapiens
acacaacacugcauuuaaa

SEQ ID NO: 1464203 - RNA, 19 nt, Homo sapiens
ugaauucccuugaaagaaa

SEQ ID NO: 1464204 - RNA, 19 nt, Homo sapiens
gaagaggacaugaauaaug

SEQ ID NO: 1464205 - RNA, 19 nt, Homo sapiens
cacauuagcugaugaacaa

SEQ ID NO: 1464206 - RNA, 19 nt, Homo sapiens
gcucuaagaugugugaauu

SEQ ID NO: 1464207 - RNA, 19 nt, Homo sapiens
gaaguuacucuugcuguua

SEQ ID NO: 1464208 - RNA, 19 nt, Homo sapiens
gugaagaggacaugaauaa

SEQ ID NO: 1464209 - RNA, 19 nt, Homo sapiens
gcuccuauauccauuuauu

SEQ ID NO: 1464210 - RNA, 19 nt, Homo sapiens
cauggaaagucaaguauug

SEQ ID NO: 1464211 - RNA, 19 nt, Homo sapiens
caacguggauggaacuaga

SEQ ID NO: 1464212 - RNA, 19 nt, Homo sapiens
uaaaccacaucaucuugua

SEQ ID NO: 1464213 - RNA, 19 nt, Homo sapiens
ggauggagaugucagugaa

SEQ ID NO: 1464214 - RNA, 19 nt, Homo sapiens
ucacaaacauaucugcauu

SEQ ID NO: 1464215 - RNA, 19 nt, Homo sapiens
ggaaguuacucuugcuguu

SEQ ID NO: 1464216 - RNA, 19 nt, Homo sapiens
ccaagaaggcuuuauccua

SEQ ID NO: 1464217 - RNA, 19 nt, Homo sapiens
aagcagacguuaauaguau

SEQ ID NO: 1464218 - RNA, 19 nt, Homo sapiens
cuaauacgcuaaugauuca

SEQ ID NO: 1464219 - RNA, 19 nt, Homo sapiens
cauuagaguucuucaauuc

SEQ ID NO: 1464220 - RNA, 19 nt, Homo sapiens
gagaguagaaugguagaua

SEQ ID NO: 1464221 - RNA, 19 nt, Homo sapiens
ggaaaccucuggcuuugag

SEQ ID NO: 1464222 - RNA, 19 nt, Homo sapiens
caagaguucuaaugaggaa

SEQ ID NO: 1464223 - RNA, 19 nt, Homo sapiens
gaaauaagccaggcaugga

SEQ ID NO: 1464224 - RNA, 19 nt, Homo sapiens
auagagaagugcagaauau

SEQ ID NO: 1464225 - RNA, 19 nt, Homo sapiens
gcuaaugauucaaccaaga

SEQ ID NO: 1464226 - RNA, 19 nt, Homo sapiens
uaauggcaguuucucuaua

SEQ ID NO: 1464227 - RNA, 19 nt, Homo sapiens
gaauugaagggaauacuga

SEQ ID NO: 1464228 - RNA, 19 nt, Homo sapiens
gaacuagaggucacuaugu

SEQ ID NO: 1464229 - RNA, 19 nt, Homo sapiens
caccagaucugauaaaugc

SEQ ID NO: 1464230 - RNA, 19 nt, Homo sapiens
ggaauggacacugagauaa

SEQ ID NO: 1464231 - RNA, 19 nt, Homo sapiens
gguagagaguagaauggua

SEQ ID NO: 1464232 - RNA, 19 nt, Homo sapiens
uuuguugucuucccauuua

SEQ ID NO: 1464233 - RNA, 19 nt, Homo sapiens
ugacacaacacugcauuua

SEQ ID NO: 1464234 - RNA, 19 nt, Homo sapiens
cagaugaguuugacuucuu

SEQ ID NO: 1464235 - RNA, 19 nt, Homo sapiens
ccuguucucuccuguguuu

SEQ ID NO: 1464236 - RNA, 19 nt, Homo sapiens
ccauuagaguucuucaauu

SEQ ID NO: 1464237 - RNA, 19 nt, Homo sapiens
gaacaaaguagagcaucuu

SEQ ID NO: 1464238 - RNA, 19 nt, Homo sapiens
gagaagugcagaauauuca

SEQ ID NO: 1464239 - RNA, 19 nt, Homo sapiens
guacaacaaccauaucuag

SEQ ID NO: 1464240 - RNA, 19 nt, Homo sapiens
caaccacccuuucgacagu

SEQ ID NO: 1464241 - RNA, 19 nt, Homo sapiens
gaagcuaacuuuauuuugg

SEQ ID NO: 1464242 - RNA, 19 nt, Homo sapiens
aguggaagcuaacuuuauu

SEQ ID NO: 1464243 - RNA, 19 nt, Homo sapiens
ugaagggaauacugacauu

SEQ ID NO: 1464244 - RNA, 19 nt, Homo sapiens
agucagccuuugcaaguua

SEQ ID NO: 1464245 - RNA, 19 nt, Homo sapiens
gacacaacacugcauuuaa

SEQ ID NO: 1464246 - RNA, 19 nt, Homo sapiens
gaagggaauacugacauuu

SEQ ID NO: 1464247 - RNA, 19 nt, Homo sapiens
guacuaauacgcuaaugau

SEQ ID NO: 1464248 - RNA, 19 nt, Homo sapiens
gagcggcagucaggugaaa

SEQ ID NO: 1464249 - RNA, 19 nt, Homo sapiens
ggacacugagauaacauuu

SEQ ID NO: 1464250 - RNA, 19 nt, Homo sapiens
guaaugguguguggguauu

SEQ ID NO: 1464251 - RNA, 19 nt, Homo sapiens
ucaauucaaugcacguuca

SEQ ID NO: 1464252 - RNA, 19 nt, Homo sapiens
aaauuggaauggacacuga

SEQ ID NO: 1464253 - RNA, 19 nt, Homo sapiens
ucugauaaaugcaaaguag

SEQ ID NO: 1464254 - RNA, 19 nt, Homo sapiens
gaauucccuugaaagaaau

SEQ ID NO: 1464255 - RNA, 19 nt, Homo sapiens
gaguuugcauguuuagugu

SEQ ID NO: 1464256 - RNA, 19 nt, Homo sapiens
aagaggacaugaauaaugg

SEQ ID NO: 1464257 - RNA, 19 nt, Homo sapiens
ggagaugucagugaaguau

SEQ ID NO: 1464258 - RNA, 19 nt, Homo sapiens
ggaacuagaggucacuaug

SEQ ID NO: 1464259 - RNA, 19 nt, Homo sapiens
gcagaauauucaccagauc

SEQ ID NO: 1464260 - RNA, 19 nt, Homo sapiens
guaacuugcuuuaaaucca

SEQ ID NO: 1464261 - RNA, 19 nt, Homo sapiens
cacaucaucuuguacaaca

SEQ ID NO: 1464262 - RNA, 19 nt, Homo sapiens
caagagcaagugacaguga

SEQ ID NO: 1464263 - RNA, 19 nt, Homo sapiens
ggagguagagaguagaaug

SEQ ID NO: 1464264 - RNA, 19 nt, Homo sapiens
ugucugaauucccuugaaa

SEQ ID NO: 1464265 - RNA, 19 nt, Homo sapiens
gaaagcagugucagcaaca

SEQ ID NO: 1464266 - RNA, 19 nt, Homo sapiens
gcaccaagaaggcuuuauc

SEQ ID NO: 1464267 - RNA, 19 nt, Homo sapiens
aauggcaguuucucuauau

SEQ ID NO: 1464268 - RNA, 19 nt, Homo sapiens
ugacuucuuucaaauugga

SEQ ID NO: 1464269 - RNA, 19 nt, Homo sapiens
aaagcagacguuaauagua

SEQ ID NO: 1464270 - RNA, 19 nt, Homo sapiens
acaacaaccauaucuagaa

SEQ ID NO: 1464271 - RNA, 19 nt, Homo sapiens
ccucuggcuuugaguauug

SEQ ID NO: 1464272 - RNA, 19 nt, Homo sapiens
gagaaaagcagacguuaau

SEQ ID NO: 1464273 - RNA, 19 nt, Homo sapiens
aaaugcaaauugggaauga

SEQ ID NO: 1464274 - RNA, 19 nt, Homo sapiens
gcauggaaagucaaguauu

SEQ ID NO: 1464275 - RNA, 19 nt, Homo sapiens
cuagaggucacuauguuaa

SEQ ID NO: 1464276 - RNA, 19 nt, Homo sapiens
caaagaauugaagggaaua

SEQ ID NO: 1464277 - RNA, 19 nt, Homo sapiens
ggaaugaagucaauuuugc

SEQ ID NO: 1464278 - RNA, 19 nt, Homo sapiens
gaaauagcuguuugucaag

SEQ ID NO: 1464279 - RNA, 19 nt, Homo sapiens
aauaauggcaguuucucua

SEQ ID NO: 1464280 - RNA, 19 nt, Homo sapiens
gcccuggaauguauuucaa

SEQ ID NO: 1464281 - RNA, 19 nt, Homo sapiens
uggaauggacacugagaua

SEQ ID NO: 1464282 - RNA, 19 nt, Homo sapiens
agucaaguauugcauguuc

SEQ ID NO: 1464283 - RNA, 19 nt, Homo sapiens
aaagucaaguauugcaugu

SEQ ID NO: 1464284 - RNA, 19 nt, Homo sapiens
auggucagcuuuagugaaa

SEQ ID NO: 1464285 - RNA, 19 nt, Homo sapiens
agaugaguuugacuucuuu

SEQ ID NO: 1464286 - RNA, 19 nt, Homo sapiens
gcugaugccauuguucuuu

SEQ ID NO: 1464287 - RNA, 19 nt, Homo sapiens
gaaaagcagacguuaauag

SEQ ID NO: 1464288 - RNA, 19 nt, Homo sapiens
gaauauucaccagaucuga

SEQ ID NO: 1464289 - RNA, 19 nt, Homo sapiens
uauagagaagugcagaaua

SEQ ID NO: 1464290 - RNA, 19 nt, Homo sapiens
ucagugaaguaucagaaag

SEQ ID NO: 1464291 - RNA, 19 nt, Homo sapiens
gaauggacacugagauaac

SEQ ID NO: 1464292 - RNA, 19 nt, Homo sapiens
ucauggagguagagaguag

SEQ ID NO: 1464293 - RNA, 19 nt, Homo sapiens
aacuagaggucacuauguu

SEQ ID NO: 1464294 - RNA, 19 nt, Homo sapiens
agaugucagugaaguauca

SEQ ID NO: 1464295 - RNA, 19 nt, Homo sapiens
cugcagagcugacauuuga

SEQ ID NO: 1464296 - RNA, 19 nt, Homo sapiens
ggaacaugcucuucuacuu

SEQ ID NO: 1464297 - RNA, 19 nt, Homo sapiens
gagcagauccugagggaaa

SEQ ID NO: 1464298 - RNA, 19 nt, Homo sapiens
ucacagggcucuccagaca

SEQ ID NO: 1464299 - RNA, 19 nt, Homo sapiens
gaacaugcucuucuacuuc

SEQ ID NO: 1464300 - RNA, 19 nt, Homo sapiens
aaacagaggcccagagaga

SEQ ID NO: 1464301 - RNA, 19 nt, Homo sapiens
gagaauggcugcgcugucu

SEQ ID NO: 1464302 - RNA, 19 nt, Homo sapiens
gcgggaacaugcucuucua

SEQ ID NO: 1464303 - RNA, 19 nt, Homo sapiens
aaaagcaaaugcacaguua

SEQ ID NO: 1464304 - RNA, 19 nt, Homo sapiens
gaugcaagggcuaaaguaa

SEQ ID NO: 1464305 - RNA, 19 nt, Homo sapiens
ggcgaucuguggccugaaa

SEQ ID NO: 1464306 - RNA, 19 nt, Homo sapiens
cugagaaggugcuggauuc

SEQ ID NO: 1464307 - RNA, 19 nt, Homo sapiens
ggacuuccgucugaauuuu

SEQ ID NO: 1464308 - RNA, 19 nt, Homo sapiens
gcagagcugacauuugaau

SEQ ID NO: 1464309 - RNA, 19 nt, Homo sapiens
caaaaccccuuccuucugu

SEQ ID NO: 1464310 - RNA, 19 nt, Homo sapiens
ggcaagugguggccugaga

SEQ ID NO: 1464311 - RNA, 19 nt, Homo sapiens
gggcuaaaguaaaauuuug

SEQ ID NO: 1464312 - RNA, 19 nt, Homo sapiens
uuuacagacucucaaggua

SEQ ID NO: 1464313 - RNA, 19 nt, Homo sapiens
gagcugacauuugaaucca

SEQ ID NO: 1464314 - RNA, 19 nt, Homo sapiens
ggagaagcacagccagaga

SEQ ID NO: 1464315 - RNA, 19 nt, Homo sapiens
gugcaacacuaaggagaau

SEQ ID NO: 1464316 - RNA, 19 nt, Homo sapiens
gauucugagugggccuuua

SEQ ID NO: 1464317 - RNA, 19 nt, Homo sapiens
gauccuuggcugcuucauu

SEQ ID NO: 1464318 - RNA, 19 nt, Homo sapiens
ggcugggacuuccgucuga

SEQ ID NO: 1464319 - RNA, 19 nt, Homo sapiens
gaaaagcaaaugcacaguu

SEQ ID NO: 1464320 - RNA, 19 nt, Homo sapiens
cugcuuuaguuuccuguuu

SEQ ID NO: 1464321 - RNA, 19 nt, Homo sapiens
gggacuuccgucugaauuu

SEQ ID NO: 1464322 - RNA, 19 nt, Homo sapiens
gggaaugucacgugcaaca

SEQ ID NO: 1464323 - RNA, 19 nt, Homo sapiens
aaugucacgugcaacacua

SEQ ID NO: 1464324 - RNA, 19 nt, Homo sapiens
cgccuucgcugugcgcuuu

SEQ ID NO: 1464325 - RNA, 19 nt, Homo sapiens
uggcguagguuuacagacu

SEQ ID NO: 1464326 - RNA, 19 nt, Homo sapiens
auccuuggcugcuucauug

SEQ ID NO: 1464327 - RNA, 19 nt, Homo sapiens
agaaacagaggcccagaga

SEQ ID NO: 1464328 - RNA, 19 nt, Homo sapiens
gagaugcaagggcuaaagu

SEQ ID NO: 1464329 - RNA, 19 nt, Homo sapiens
aagcacagccagagacaga

SEQ ID NO: 1464330 - RNA, 19 nt, Homo sapiens
ugcaagggcuaaaguaaaa

SEQ ID NO: 1464331 - RNA, 19 nt, Homo sapiens
gcucaccuccuuccagagu

SEQ ID NO: 1464332 - RNA, 19 nt, Homo sapiens
gugacagacucagcccaaa

SEQ ID NO: 1464333 - RNA, 19 nt, Homo sapiens
gacauuugaauccagagaa

SEQ ID NO: 1464334 - RNA, 19 nt, Homo sapiens
ggaugcaggcucugagaag

SEQ ID NO: 1464335 - RNA, 19 nt, Homo sapiens
ggagguuuccugagaacuc

SEQ ID NO: 1464336 - RNA, 19 nt, Homo sapiens
gaaugucacgugcaacacu

SEQ ID NO: 1464337 - RNA, 19 nt, Homo sapiens
gagggauccuuggcugcuu

SEQ ID NO: 1464338 - RNA, 19 nt, Homo sapiens
gugugugucugcaaucaag

SEQ ID NO: 1464339 - RNA, 19 nt, Homo sapiens
gcccugaguggccugguuu

SEQ ID NO: 1464340 - RNA, 19 nt, Homo sapiens
gauccugagggaaaucaug

SEQ ID NO: 1464341 - RNA, 19 nt, Homo sapiens
gggugugugucugcaauca

SEQ ID NO: 1464342 - RNA, 19 nt, Homo sapiens
agacacuccuugacugcau

SEQ ID NO: 1464343 - RNA, 19 nt, Homo sapiens
ggagaugcaagggcuaaag

SEQ ID NO: 1464344 - RNA, 19 nt, Homo sapiens
ccuccacccugaccuugau

SEQ ID NO: 1464345 - RNA, 19 nt, Homo sapiens
ucacgugcaacacuaagga

SEQ ID NO: 1464346 - RNA, 19 nt, Homo sapiens
ggucugugacucuggacuu

SEQ ID NO: 1464347 - RNA, 19 nt, Homo sapiens
acauuugaauccagagaag

SEQ ID NO: 1464348 - RNA, 19 nt, Homo sapiens
ucccaaacgcugccucuug

SEQ ID NO: 1464349 - RNA, 19 nt, Homo sapiens
ucaccacagugcccauuuu

SEQ ID NO: 1464350 - RNA, 19 nt, Homo sapiens
acagggcucuccagacacu

SEQ ID NO: 1464351 - RNA, 19 nt, Homo sapiens
gggaugcaggcucugagaa

SEQ ID NO: 1464352 - RNA, 19 nt, Homo sapiens
gcugggacuuccgucugaa

SEQ ID NO: 1464353 - RNA, 19 nt, Homo sapiens
gaaaggagccugacucuua

SEQ ID NO: 1464354 - RNA, 19 nt, Homo sapiens
ucaaagagcuugcaguuua

SEQ ID NO: 1464355 - RNA, 19 nt, Homo sapiens
gaagagaacauaaggaaua

SEQ ID NO: 1464356 - RNA, 19 nt, Homo sapiens
gaacaggugggauaucuua

SEQ ID NO: 1464357 - RNA, 19 nt, Homo sapiens
gaaagugcauaacauauuc

SEQ ID NO: 1464358 - RNA, 19 nt, Homo sapiens
gaauagauuuguucaguuc

SEQ ID NO: 1464359 - RNA, 19 nt, Homo sapiens
gaauauggcugcaguuugg

SEQ ID NO: 1464360 - RNA, 19 nt, Homo sapiens
ggaagacauuguuguugua

SEQ ID NO: 1464361 - RNA, 19 nt, Homo sapiens
gaacuaagaggaauucaga

SEQ ID NO: 1464362 - RNA, 19 nt, Homo sapiens
aaucacagcucaagaacua

SEQ ID NO: 1464363 - RNA, 19 nt, Homo sapiens
ucaccgauguuuacaauuu

SEQ ID NO: 1464364 - RNA, 19 nt, Homo sapiens
gcaguaacaucagcuauga

SEQ ID NO: 1464365 - RNA, 19 nt, Homo sapiens
gaggauggauuuaaauugu

SEQ ID NO: 1464366 - RNA, 19 nt, Homo sapiens
ggauuuaaauugugugaga

SEQ ID NO: 1464367 - RNA, 19 nt, Homo sapiens
ccaaauggauuacaaugga

SEQ ID NO: 1464368 - RNA, 19 nt, Homo sapiens
gcagaggcauuucauaauc

SEQ ID NO: 1464369 - RNA, 19 nt, Homo sapiens
gcucgcggcugcccaauuu

SEQ ID NO: 1464370 - RNA, 19 nt, Homo sapiens
agacauuacugaagacuuu

SEQ ID NO: 1464371 - RNA, 19 nt, Homo sapiens
ggaauagauuuguucaguu

SEQ ID NO: 1464372 - RNA, 19 nt, Homo sapiens
ggaauaaccacaaaucaga

SEQ ID NO: 1464373 - RNA, 19 nt, Homo sapiens
gauaaacacuucuacaacu

SEQ ID NO: 1464374 - RNA, 19 nt, Homo sapiens
gagagaaauuuagcuguuu

SEQ ID NO: 1464375 - RNA, 19 nt, Homo sapiens
ccacaaggauucuucuaga

SEQ ID NO: 1464376 - RNA, 19 nt, Homo sapiens
gaacagggaggaauucuuc

SEQ ID NO: 1464377 - RNA, 19 nt, Homo sapiens
ugaaagggauggagaacaa

SEQ ID NO: 1464378 - RNA, 19 nt, Homo sapiens
guaagggucucaaaugcaa

SEQ ID NO: 1464379 - RNA, 19 nt, Homo sapiens
ggagaaauuuuaccgaaua

SEQ ID NO: 1464380 - RNA, 19 nt, Homo sapiens
gaucaggaauagauuuguu

SEQ ID NO: 1464381 - RNA, 19 nt, Homo sapiens
aaacugccaucagacauua

SEQ ID NO: 1464382 - RNA, 19 nt, Homo sapiens
ggaagaauuugagauuguu

SEQ ID NO: 1464383 - RNA, 19 nt, Homo sapiens
cgaggcgggugauuuauuu

SEQ ID NO: 1464384 - RNA, 19 nt, Homo sapiens
cagauuggcuucauaucaa

SEQ ID NO: 1464385 - RNA, 19 nt, Homo sapiens
ucacagaggucgccguaga

SEQ ID NO: 1464386 - RNA, 19 nt, Homo sapiens
caaagagcuugcaguuuau

SEQ ID NO: 1464387 - RNA, 19 nt, Homo sapiens
gagauaaacacuucuacaa

SEQ ID NO: 1464388 - RNA, 19 nt, Homo sapiens
ggaaucagcagaggcauuu

SEQ ID NO: 1464389 - RNA, 19 nt, Homo sapiens
gagccugacucuuaugaug

SEQ ID NO: 1464390 - RNA, 19 nt, Homo sapiens
cagcagaggcauuucauaa

SEQ ID NO: 1464391 - RNA, 19 nt, Homo sapiens
ggcgaaugcugcaggauuu

SEQ ID NO: 1464392 - RNA, 19 nt, Homo sapiens
uguauaauguguugcagua

SEQ ID NO: 1464393 - RNA, 19 nt, Homo sapiens
gcauagagacuagauaaga

SEQ ID NO: 1464394 - RNA, 19 nt, Homo sapiens
caaaugcaaugucaaagag

SEQ ID NO: 1464395 - RNA, 19 nt, Homo sapiens
cauaaggaauagagguuaa

SEQ ID NO: 1464396 - RNA, 19 nt, Homo sapiens
ucagagaggagucacaaua

SEQ ID NO: 1464397 - RNA, 19 nt, Homo sapiens
gaaauagaaacaagcaaug

SEQ ID NO: 1464398 - RNA, 19 nt, Homo sapiens
gaaacaagcaauggauuau

SEQ ID NO: 1464399 - RNA, 19 nt, Homo sapiens
ccaaugacgucuggauuau

SEQ ID NO: 1464400 - RNA, 19 nt, Homo sapiens
caaaugaagaacaaccaua

SEQ ID NO: 1464401 - RNA, 19 nt, Homo sapiens
ugagauacuugacuggauu

SEQ ID NO: 1464402 - RNA, 19 nt, Homo sapiens
ggucucaaaugcaauguca

SEQ ID NO: 1464403 - RNA, 19 nt, Homo sapiens
agagagaaauuuagcuguu

SEQ ID NO: 1464404 - RNA, 19 nt, Homo sapiens
uacagugaaugcuaugaua

SEQ ID NO: 1464405 - RNA, 19 nt, Homo sapiens
agaaacaagcaauggauua

SEQ ID NO: 1464406 - RNA, 19 nt, Homo sapiens
ggccaaguuucucuguaua

SEQ ID NO: 1464407 - RNA, 19 nt, Homo sapiens
gaccaaagcauagagacua

SEQ ID NO: 1464408 - RNA, 19 nt, Homo sapiens
acucuuagcucauucaauc

SEQ ID NO: 1464409 - RNA, 19 nt, Homo sapiens
uaaauugugugagaccaaa

SEQ ID NO: 1464410 - RNA, 19 nt, Homo sapiens
uaaguaagggucucaaaug

SEQ ID NO: 1464411 - RNA, 19 nt, Homo sapiens
cacaugggcucgaaagaug

SEQ ID NO: 1464412 - RNA, 19 nt, Homo sapiens
ugacucuuaugauggaaua

SEQ ID NO: 1464413 - RNA, 19 nt, Homo sapiens
aaaggagccugacucuuau

SEQ ID NO: 1464414 - RNA, 19 nt, Homo sapiens
cgaauaaagacucaucauu

SEQ ID NO: 1464415 - RNA, 19 nt, Homo sapiens
ggagagaucccaagguagu

SEQ ID NO: 1464416 - RNA, 19 nt, Homo sapiens
ggcagaagcuguuuugauu

SEQ ID NO: 1464417 - RNA, 19 nt, Homo sapiens
ggcauuguguuaagcauau

SEQ ID NO: 1464418 - RNA, 19 nt, Homo sapiens
gacaggaagucccgaaugg

SEQ ID NO: 1464419 - RNA, 19 nt, Homo sapiens
acggagagaucccaaggua

SEQ ID NO: 1464420 - RNA, 19 nt, Homo sapiens
gcacugagaggaaaauuaa

SEQ ID NO: 1464421 - RNA, 19 nt, Homo sapiens
gcacaggaagacauuaaug

SEQ ID NO: 1464422 - RNA, 19 nt, Homo sapiens
ggauggauuuaaauugugu

SEQ ID NO: 1464423 - RNA, 19 nt, Homo sapiens
ucccauggcaucauauuua

SEQ ID NO: 1464424 - RNA, 19 nt, Homo sapiens
guuggaaacagauaaguaa

SEQ ID NO: 1464425 - RNA, 19 nt, Homo sapiens
ggucaggcauuguguuaag

SEQ ID NO: 1464426 - RNA, 19 nt, Homo sapiens
uuacacagaucaggaauag

SEQ ID NO: 1464427 - RNA, 19 nt, Homo sapiens
gaaaaucacauaucacaug

SEQ ID NO: 1464428 - RNA, 19 nt, Homo sapiens
caagguagugguucaagaa

SEQ ID NO: 1464429 - RNA, 19 nt, Homo sapiens
uagaagagaacauaaggaa

SEQ ID NO: 1464430 - RNA, 19 nt, Homo sapiens
guacacagauuggcuucau

SEQ ID NO: 1464431 - RNA, 19 nt, Homo sapiens
gauaagaggcgaucaaaau

SEQ ID NO: 1464432 - RNA, 19 nt, Homo sapiens
cccauggcaucauauuuaa

SEQ ID NO: 1464433 - RNA, 19 nt, Homo sapiens
uaauagcaguagaagagaa

SEQ ID NO: 1464434 - RNA, 19 nt, Homo sapiens
agacauuguuguuguacuu

SEQ ID NO: 1464435 - RNA, 19 nt, Homo sapiens
aagcauagagacuagauaa

SEQ ID NO: 1464436 - RNA, 19 nt, Homo sapiens
gugcauaacauauucuaga

SEQ ID NO: 1464437 - RNA, 19 nt, Homo sapiens
cgaaagauguagagguuuu

SEQ ID NO: 1464438 - RNA, 19 nt, Homo sapiens
gcaguagaagagaacauaa

SEQ ID NO: 1464439 - RNA, 19 nt, Homo sapiens
acacagaucaggaauagau

SEQ ID NO: 1464440 - RNA, 19 nt, Homo sapiens
uaccaacucuuagcucauu

SEQ ID NO: 1464441 - RNA, 19 nt, Homo sapiens
gaucccagauauuuucaua

SEQ ID NO: 1464442 - RNA, 19 nt, Homo sapiens
gcucaagaacuaagaggaa

SEQ ID NO: 1464443 - RNA, 19 nt, Homo sapiens
ucaaaugcaaugucaaaga

SEQ ID NO: 1464444 - RNA, 19 nt, Homo sapiens
ccaaguuucucuguauaau

SEQ ID NO: 1464445 - RNA, 19 nt, Homo sapiens
gaucucaaccucuguacau

SEQ ID NO: 1464446 - RNA, 19 nt, Homo sapiens
uggaagacauuguuguugu

SEQ ID NO: 1464447 - RNA, 19 nt, Homo sapiens
ccaagguagugguucaaga

SEQ ID NO: 1464448 - RNA, 19 nt, Homo sapiens
caggaagacauuaaugaaa

SEQ ID NO: 1464449 - RNA, 19 nt, Homo sapiens
uggaagaauuugagauugu

SEQ ID NO: 1464450 - RNA, 19 nt, Homo sapiens
aacaagcaauggauuauca

SEQ ID NO: 1464451 - RNA, 19 nt, Homo sapiens
ggauggagaacaagauaau

SEQ ID NO: 1464452 - RNA, 19 nt, Homo sapiens
caaauggauuacaauggau

SEQ ID NO: 1464453 - RNA, 19 nt, Homo sapiens
gcaagaggccaacagauua

SEQ ID NO: 1464454 - RNA, 19 nt, Homo sapiens
gagcauuaauuccuauguu

SEQ ID NO: 1464455 - RNA, 19 nt, Homo sapiens
ccagauuccuucuccuuaa

SEQ ID NO: 1464456 - RNA, 19 nt, Homo sapiens
gcaaagggaugugggaagu

SEQ ID NO: 1464457 - RNA, 19 nt, Homo sapiens
gugcaugccuguaaucuca

SEQ ID NO: 1464458 - RNA, 19 nt, Homo sapiens
gacaguugcccuaggguua

SEQ ID NO: 1464459 - RNA, 19 nt, Homo sapiens
gagcaagacucugugucaa

SEQ ID NO: 1464460 - RNA, 19 nt, Homo sapiens
agacuggccucuucuuaug

SEQ ID NO: 1464461 - RNA, 19 nt, Homo sapiens
caagaggccaacagauuaa

SEQ ID NO: 1464462 - RNA, 19 nt, Homo sapiens
gaguguaaauuuggacuug

SEQ ID NO: 1464463 - RNA, 19 nt, Homo sapiens
gggagcaaguugauucuag

SEQ ID NO: 1464464 - RNA, 19 nt, Homo sapiens
acucgaggcugaccugaaa

SEQ ID NO: 1464465 - RNA, 19 nt, Homo sapiens
gcaagacucugugucaaaa

SEQ ID NO: 1464466 - RNA, 19 nt, Homo sapiens
ggucuccaguggucaaguu

SEQ ID NO: 1464467 - RNA, 19 nt, Homo sapiens
gcauuaauuccuauguuga

SEQ ID NO: 1464468 - RNA, 19 nt, Homo sapiens
aaagggaugugggaaguau

SEQ ID NO: 1464469 - RNA, 19 nt, Homo sapiens
ucaguuucuuccuagauaa

SEQ ID NO: 1464470 - RNA, 19 nt, Homo sapiens
ccucuacucuuggugcuuu

SEQ ID NO: 1464471 - RNA, 19 nt, Homo sapiens
ggguuaaagucuccuaugg

SEQ ID NO: 1464472 - RNA, 19 nt, Homo sapiens
ccugcuggcugaaggguuu

SEQ ID NO: 1464473 - RNA, 19 nt, Homo sapiens
ucagacuggccucuucuua

SEQ ID NO: 1464474 - RNA, 19 nt, Homo sapiens
ucacacauugcaucaguuu

SEQ ID NO: 1464475 - RNA, 19 nt, Homo sapiens
gcggcucacuccuguaauc

SEQ ID NO: 1464476 - RNA, 19 nt, Homo sapiens
gccccaacaucuacuuuua

SEQ ID NO: 1464477 - RNA, 19 nt, Homo sapiens
uugcaucaguuucuuccua

SEQ ID NO: 1464478 - RNA, 19 nt, Homo sapiens
uggguagucagaaagauua

SEQ ID NO: 1464479 - RNA, 19 nt, Homo sapiens
gaaaagagcauuaauuccu

SEQ ID NO: 1464480 - RNA, 19 nt, Homo sapiens
ugcaagaggccaacagauu

SEQ ID NO: 1464481 - RNA, 19 nt, Homo sapiens
ggagguugcagugagguaa

SEQ ID NO: 1464482 - RNA, 19 nt, Homo sapiens
caagaacaagucccagugu

SEQ ID NO: 1464483 - RNA, 19 nt, Homo sapiens
gggcaguguugcugaaagg

SEQ ID NO: 1464484 - RNA, 19 nt, Homo sapiens
cagacuggccucuucuuau

SEQ ID NO: 1464485 - RNA, 19 nt, Homo sapiens
cagccuggccaacauggua

SEQ ID NO: 1464486 - RNA, 19 nt, Homo sapiens
agcauuaauuccuauguug

SEQ ID NO: 1464487 - RNA, 19 nt, Homo sapiens
guagucagaaagauuacaa

SEQ ID NO: 1464488 - RNA, 19 nt, Homo sapiens
guguaaauuuggacuugug

SEQ ID NO: 1464489 - RNA, 19 nt, Homo sapiens
cccaacaucuacuuuuaua

SEQ ID NO: 1464490 - RNA, 19 nt, Homo sapiens
ucuuaggagugcaccagua

SEQ ID NO: 1464491 - RNA, 19 nt, Homo sapiens
gguaagauggcaccacuac

SEQ ID NO: 1464492 - RNA, 19 nt, Homo sapiens
gguggugcaugccuguaau

SEQ ID NO: 1464493 - RNA, 19 nt, Homo sapiens
ccuguaaucccagcacuuu

SEQ ID NO: 1464494 - RNA, 19 nt, Homo sapiens
gcaucaguuucuuccuaga

SEQ ID NO: 1464495 - RNA, 19 nt, Homo sapiens
ccaagcuucucucugucuu

SEQ ID NO: 1464496 - RNA, 19 nt, Homo sapiens
caugcagcguucccagauu

SEQ ID NO: 1464497 - RNA, 19 nt, Homo sapiens
gcuggcaggugcaggucuu

SEQ ID NO: 1464498 - RNA, 19 nt, Homo sapiens
caaagggaugugggaagua

SEQ ID NO: 1464499 - RNA, 19 nt, Homo sapiens
gucagaaagauuacaagaa

SEQ ID NO: 1464500 - RNA, 19 nt, Homo sapiens
gcaggaaaaucacuugaac

SEQ ID NO: 1464501 - RNA, 19 nt, Homo sapiens
gcugaaagggccagguugu

SEQ ID NO: 1464502 - RNA, 19 nt, Homo sapiens
aucaguuucuuccuagaua

SEQ ID NO: 1464503 - RNA, 19 nt, Homo sapiens
cagauuccuucuccuuaag

SEQ ID NO: 1464504 - RNA, 19 nt, Homo sapiens
caggguagaagcuaugaug

SEQ ID NO: 1464505 - RNA, 19 nt, Homo sapiens
acacugggacccugcaaga

SEQ ID NO: 1464506 - RNA, 19 nt, Homo sapiens
caagucccaguguguggua

SEQ ID NO: 1464507 - RNA, 19 nt, Homo sapiens
ccuacaacuucuuuaagca

SEQ ID NO: 1464508 - RNA, 19 nt, Homo sapiens
gcaggucuuugugcauucu

SEQ ID NO: 1464509 - RNA, 19 nt, Homo sapiens
ggaaaaccaucucaaugcu

SEQ ID NO: 1464510 - RNA, 19 nt, Homo sapiens
cccagauuccuucuccuua

SEQ ID NO: 1464511 - RNA, 19 nt, Homo sapiens
uaugggagcaaguugauuc

SEQ ID NO: 1464512 - RNA, 19 nt, Homo sapiens
uaagauggcaccacuacac

SEQ ID NO: 1464513 - RNA, 19 nt, Homo sapiens
cgucuagucagccaucuug

SEQ ID NO: 1464514 - RNA, 19 nt, Homo sapiens
ugucuucccuccucuacuc

SEQ ID NO: 1464515 - RNA, 19 nt, Homo sapiens
guggguagucagaaagauu

SEQ ID NO: 1464516 - RNA, 19 nt, Homo sapiens
acacauugcaucaguuucu

SEQ ID NO: 1464517 - RNA, 19 nt, Homo sapiens
uuucacacauugcaucagu

SEQ ID NO: 1464518 - RNA, 19 nt, Homo sapiens
guugcucucugccaguuca

SEQ ID NO: 1464519 - RNA, 19 nt, Homo sapiens
ccuguaaucucagcuacuc

SEQ ID NO: 1464520 - RNA, 19 nt, Homo sapiens
gcaggugcaggucuuugug

SEQ ID NO: 1464521 - RNA, 19 nt, Homo sapiens
uguaaagcaugugaagaca

SEQ ID NO: 1464522 - RNA, 19 nt, Homo sapiens
uaaaaccccgucucuacua

SEQ ID NO: 1464523 - RNA, 19 nt, Homo sapiens
ucacuugaggucaggaguu

SEQ ID NO: 1464524 - RNA, 19 nt, Homo sapiens
agaacaagucccagugugu

SEQ ID NO: 1464525 - RNA, 19 nt, Homo sapiens
cuugugcccucagcauauu

SEQ ID NO: 1464526 - RNA, 19 nt, Homo sapiens
uaacuugugcccucagcau

SEQ ID NO: 1464527 - RNA, 19 nt, Homo sapiens
caguugcccuaggguuaaa

SEQ ID NO: 1464528 - RNA, 19 nt, Homo sapiens
gguaaaaccccgucucuac

SEQ ID NO: 1464529 - RNA, 19 nt, Homo sapiens
cacuugaggucaggaguuc

SEQ ID NO: 1464530 - RNA, 19 nt, Homo sapiens
cacauugcaucaguuucuu

SEQ ID NO: 1464531 - RNA, 19 nt, Homo sapiens
acaguugcccuaggguuaa

SEQ ID NO: 1464532 - RNA, 19 nt, Homo sapiens
ggaaagugaucuagaaauu

SEQ ID NO: 1464533 - RNA, 19 nt, Homo sapiens
cagcaaauaugucaaagua

SEQ ID NO: 1464534 - RNA, 19 nt, Homo sapiens
ugacagagccauugaaaua

SEQ ID NO: 1464535 - RNA, 19 nt, Homo sapiens
gaaagaauagaacgaguua

SEQ ID NO: 1464536 - RNA, 19 nt, Homo sapiens
gcauaacgcccuucugaua

SEQ ID NO: 1464537 - RNA, 19 nt, Homo sapiens
ucagaaagcuaaaucagaa

SEQ ID NO: 1464538 - RNA, 19 nt, Homo sapiens
caaccuagaucacauuaug

SEQ ID NO: 1464539 - RNA, 19 nt, Homo sapiens
gcucagaacccagcaaaua

SEQ ID NO: 1464540 - RNA, 19 nt, Homo sapiens
uaagaaggauccaagcauu

SEQ ID NO: 1464541 - RNA, 19 nt, Homo sapiens
uaaagaaggugugauugaa

SEQ ID NO: 1464542 - RNA, 19 nt, Homo sapiens
gaauagaacgaguuaagaa

SEQ ID NO: 1464543 - RNA, 19 nt, Homo sapiens
cauuauggaugucgcaaua

SEQ ID NO: 1464544 - RNA, 19 nt, Homo sapiens
uaaagggucuguuaauucu

SEQ ID NO: 1464545 - RNA, 19 nt, Homo sapiens
ugaggaaagugaucuagaa

SEQ ID NO: 1464546 - RNA, 19 nt, Homo sapiens
gcaauaauacaaaccaaug

SEQ ID NO: 1464547 - RNA, 19 nt, Homo sapiens
uuacagugguuugccauua

SEQ ID NO: 1464548 - RNA, 19 nt, Homo sapiens
ggaggaagaagccagauga

SEQ ID NO: 1464549 - RNA, 19 nt, Homo sapiens
ggaagaagcagcccaugau

SEQ ID NO: 1464550 - RNA, 19 nt, Homo sapiens
gaaagugaucuagaaauug

SEQ ID NO: 1464551 - RNA, 19 nt, Homo sapiens
aagggucuguuaauucuua

SEQ ID NO: 1464552 - RNA, 19 nt, Homo sapiens
ggacucaaugaaauucuua

SEQ ID NO: 1464553 - RNA, 19 nt, Homo sapiens
gaacaucagagaaaguaug

SEQ ID NO: 1464554 - RNA, 19 nt, Homo sapiens
acagagccauugaaauaaa

SEQ ID NO: 1464555 - RNA, 19 nt, Homo sapiens
gggaaugccugguaauuuu

SEQ ID NO: 1464556 - RNA, 19 nt, Homo sapiens
gaacgagcuucgggccuuu

SEQ ID NO: 1464557 - RNA, 19 nt, Homo sapiens
gaaagcacacagacuucua

SEQ ID NO: 1464558 - RNA, 19 nt, Homo sapiens
aggcaaacauaacucauuu

SEQ ID NO: 1464559 - RNA, 19 nt, Homo sapiens
ccuguaaauucgauuauga

SEQ ID NO: 1464560 - RNA, 19 nt, Homo sapiens
cauaacgcccuucugauaa

SEQ ID NO: 1464561 - RNA, 19 nt, Homo sapiens
gaacccagcaaauauguca

SEQ ID NO: 1464562 - RNA, 19 nt, Homo sapiens
ccucugaccuucucaucaa

SEQ ID NO: 1464563 - RNA, 19 nt, Homo sapiens
aaauaaagcccuugcugaa

SEQ ID NO: 1464564 - RNA, 19 nt, Homo sapiens
gaagaagccagaugacagu

SEQ ID NO: 1464565 - RNA, 19 nt, Homo sapiens
gcagggaagauacuuaugu

SEQ ID NO: 1464566 - RNA, 19 nt, Homo sapiens
gugcaaugcugaaagaagu

SEQ ID NO: 1464567 - RNA, 19 nt, Homo sapiens
cggaaugccuggacucaau

SEQ ID NO: 1464568 - RNA, 19 nt, Homo sapiens
ugaagaugcuagugcaaug

SEQ ID NO: 1464569 - RNA, 19 nt, Homo sapiens
gcgaaaacgugaagaguga

SEQ ID NO: 1464570 - RNA, 19 nt, Homo sapiens
gaggcaaacauaacucauu

SEQ ID NO: 1464571 - RNA, 19 nt, Homo sapiens
acuuauguguggaagauua

SEQ ID NO: 1464572 - RNA, 19 nt, Homo sapiens
cuagugcaaugcugaaaga

SEQ ID NO: 1464573 - RNA, 19 nt, Homo sapiens
aaaaguggcugcuauugaa

SEQ ID NO: 1464574 - RNA, 19 nt, Homo sapiens
gaggaaagugaucuagaaa

SEQ ID NO: 1464575 - RNA, 19 nt, Homo sapiens
cagaacaucagagaaagua

SEQ ID NO: 1464576 - RNA, 19 nt, Homo sapiens
gacagagccauugaaauaa

SEQ ID NO: 1464577 - RNA, 19 nt, Homo sapiens
caagaaaugggagaugaaa

SEQ ID NO: 1464578 - RNA, 19 nt, Homo sapiens
auaacgcccuucugauaaa

SEQ ID NO: 1464579 - RNA, 19 nt, Homo sapiens
gagcuucgggccuuuguga

SEQ ID NO: 1464580 - RNA, 19 nt, Homo sapiens
ugauaaagaaggugugauu

SEQ ID NO: 1464581 - RNA, 19 nt, Homo sapiens
gaaagcuaaaucagaagaa

SEQ ID NO: 1464582 - RNA, 19 nt, Homo sapiens
gggaagaagcagcccauga

SEQ ID NO: 1464583 - RNA, 19 nt, Homo sapiens
cagggaagauacuuaugug

SEQ ID NO: 1464584 - RNA, 19 nt, Homo sapiens
aagcauaacgcccuucuga

SEQ ID NO: 1464585 - RNA, 19 nt, Homo sapiens
caugcaggauccagaaguu

SEQ ID NO: 1464586 - RNA, 19 nt, Homo sapiens
acccaaagguuaugaaucu

SEQ ID NO: 1464587 - RNA, 19 nt, Homo sapiens
gaagaagcagcccaugauc

SEQ ID NO: 1464588 - RNA, 19 nt, Homo sapiens
ccagugucuucgucaaauu

SEQ ID NO: 1464589 - RNA, 19 nt, Homo sapiens
aauccucgcuuggccauuu

SEQ ID NO: 1464590 - RNA, 19 nt, Homo sapiens
gaaaauaccaaggaagaaa

SEQ ID NO: 1464591 - RNA, 19 nt, Homo sapiens
ccauuaggguauucauuca

SEQ ID NO: 1464592 - RNA, 19 nt, Homo sapiens
ggaugucgcaauaauacaa

SEQ ID NO: 1464593 - RNA, 19 nt, Homo sapiens
gauaaagaaggugugauug

SEQ ID NO: 1464594 - RNA, 19 nt, Homo sapiens
uaagaaggcucgaaaagag

SEQ ID NO: 1464595 - RNA, 19 nt, Homo sapiens
agugagagaucaaagaaag

SEQ ID NO: 1464596 - RNA, 19 nt, Homo sapiens
gaucuugcccuugccugua

SEQ ID NO: 1464597 - RNA, 19 nt, Homo sapiens
caaagaaagaauagaacga

SEQ ID NO: 1464598 - RNA, 19 nt, Homo sapiens
auaaagaaggugugauuga

SEQ ID NO: 1464599 - RNA, 19 nt, Homo sapiens
gcagacgaaccaucaagug

SEQ ID NO: 1464600 - RNA, 19 nt, Homo sapiens
gggcagggaagauacuuau

SEQ ID NO: 1464601 - RNA, 19 nt, Homo sapiens
gccauuaggguauucauuc

SEQ ID NO: 1464602 - RNA, 19 nt, Homo sapiens
gaguuaagaaggcucgaaa

SEQ ID NO: 1464603 - RNA, 19 nt, Homo sapiens
gagaaaguaugagcgaaaa

SEQ ID NO: 1464604 - RNA, 19 nt, Homo sapiens
cagagccauugaaauaaau

SEQ ID NO: 1464605 - RNA, 19 nt, Homo sapiens
ucaaauuacagaagccaaa

SEQ ID NO: 1464606 - RNA, 19 nt, Homo sapiens
cuauugaagcccuaaauga

SEQ ID NO: 1464607 - RNA, 19 nt, Homo sapiens
caagagagcuggggugcuu

SEQ ID NO: 1464608 - RNA, 19 nt, Homo sapiens
ucucaucaguaaauuguca

SEQ ID NO: 1464609 - RNA, 19 nt, Homo sapiens
guaagaaggauccaagcau

SEQ ID NO: 1464610 - RNA, 19 nt, Homo sapiens
caucaagugaggaaaguga

SEQ ID NO: 1464611 - RNA, 19 nt, Homo sapiens
gauaauguuuuccuacuag

SEQ ID NO: 1464612 - RNA, 19 nt, Homo sapiens
gggaguggguggagagcau

SEQ ID NO: 1464613 - RNA, 19 nt, Homo sapiens
gagaucaaagaaagaauag

SEQ ID NO: 1464614 - RNA, 19 nt, Homo sapiens
agaagcagcccaugaucuu

SEQ ID NO: 1464615 - RNA, 19 nt, Homo sapiens
cagugucuucgucaaauua

SEQ ID NO: 1464616 - RNA, 19 nt, Homo sapiens
gccagugucuucgucaaau

SEQ ID NO: 1464617 - RNA, 19 nt, Homo sapiens
cagacgaaccaucaaguga

SEQ ID NO: 1464618 - RNA, 19 nt, Homo sapiens
ggguauucauucagauaau

SEQ ID NO: 1464619 - RNA, 19 nt, Homo sapiens
guggagagcaugggaggua

SEQ ID NO: 1464620 - RNA, 19 nt, Homo sapiens
auuuggaggucaagcauaa

SEQ ID NO: 1464621 - RNA, 19 nt, Homo sapiens
gaaucucaucaguaaauug

SEQ ID NO: 1464622 - RNA, 19 nt, Homo sapiens
gagguacugcuacucagaa

SEQ ID NO: 1464623 - RNA, 19 nt, Homo sapiens
ggagguacugcuacucaga

SEQ ID NO: 1464624 - RNA, 19 nt, Homo sapiens
gcuauugaagcccuaaaug

SEQ ID NO: 1464625 - RNA, 19 nt, Homo sapiens
acacugaugcuccucaaga

SEQ ID NO: 1464626 - RNA, 19 nt, Homo sapiens
ucagaacccagcaaauaug

SEQ ID NO: 1464627 - RNA, 19 nt, Homo sapiens
ugauugaaccagacacuga

SEQ ID NO: 1464628 - RNA, 19 nt, Homo sapiens
ugagagaucaaagaaagaa

SEQ ID NO: 1464629 - RNA, 19 nt, Homo sapiens
uugcagaacaucagagaaa

SEQ ID NO: 1464630 - RNA, 19 nt, Homo sapiens
cagcucagccuuacaagag

SEQ ID NO: 1464631 - RNA, 19 nt, Homo sapiens
auacuuauguguggaagau

SEQ ID NO: 1464632 - RNA, 19 nt, Homo sapiens
caagacagcugauggcuuu

SEQ ID NO: 1464633 - RNA, 19 nt, Homo sapiens
guaaugauguguccauauu

SEQ ID NO: 1464634 - RNA, 19 nt, Homo sapiens
acacaaagauccuggcuaa

SEQ ID NO: 1464635 - RNA, 19 nt, Homo sapiens
gggaguagcugguggaaga

SEQ ID NO: 1464636 - RNA, 19 nt, Homo sapiens
cagaagagcccgagaaauu

SEQ ID NO: 1464637 - RNA, 19 nt, Homo sapiens
gaacgaugcuggucaccuu

SEQ ID NO: 1464638 - RNA, 19 nt, Homo sapiens
gaacagggaccaaggagaa

SEQ ID NO: 1464639 - RNA, 19 nt, Homo sapiens
gaucaacaaugcgggagua

SEQ ID NO: 1464640 - RNA, 19 nt, Homo sapiens
gcugugagcuucuaggaau

SEQ ID NO: 1464641 - RNA, 19 nt, Homo sapiens
gcaaggagacggccagaga

SEQ ID NO: 1464642 - RNA, 19 nt, Homo sapiens
ucuaagaccuggaaaguca

SEQ ID NO: 1464643 - RNA, 19 nt, Homo sapiens
ggaccuauccgacaccaaa

SEQ ID NO: 1464644 - RNA, 19 nt, Homo sapiens
ggcuaacccuggccuauuu

SEQ ID NO: 1464645 - RNA, 19 nt, Homo sapiens
ucaugcagaugguuucuuu

SEQ ID NO: 1464646 - RNA, 19 nt, Homo sapiens
ggagaaggccaacccuaaa

SEQ ID NO: 1464647 - RNA, 19 nt, Homo sapiens
caacaaugcgggaguaaug

SEQ ID NO: 1464648 - RNA, 19 nt, Homo sapiens
gagcagagaagcagcagaa

SEQ ID NO: 1464649 - RNA, 19 nt, Homo sapiens
gcagcuuccuggcaaggua

SEQ ID NO: 1464650 - RNA, 19 nt, Homo sapiens
ggccaacccuaaaggauug

SEQ ID NO: 1464651 - RNA, 19 nt, Homo sapiens
aauaaagacugcauucauc

SEQ ID NO: 1464652 - RNA, 19 nt, Homo sapiens
caccaucacugccuauuuc

SEQ ID NO: 1464653 - RNA, 19 nt, Homo sapiens
gcuauacacuccaacucuu

SEQ ID NO: 1464654 - RNA, 19 nt, Homo sapiens
uauauugccugcagagaug

SEQ ID NO: 1464655 - RNA, 19 nt, Homo sapiens
gaguaaugauguguccaua

SEQ ID NO: 1464656 - RNA, 19 nt, Homo sapiens
gcaccaucacugccuauuu

SEQ ID NO: 1464657 - RNA, 19 nt, Homo sapiens
ggagucugcugccagugaa

SEQ ID NO: 1464658 - RNA, 19 nt, Homo sapiens
gcugagcgccuauggaaug

SEQ ID NO: 1464659 - RNA, 19 nt, Homo sapiens
agacugcauucaucucaaa

SEQ ID NO: 1464660 - RNA, 19 nt, Homo sapiens
gagcgccuauggaauguca

SEQ ID NO: 1464661 - RNA, 19 nt, Homo sapiens
gaaaagcagcuccauauuc

SEQ ID NO: 1464662 - RNA, 19 nt, Homo sapiens
ccaccacccuggagucuag

SEQ ID NO: 1464663 - RNA, 19 nt, Homo sapiens
gguggaguguguagaacaa

SEQ ID NO: 1464664 - RNA, 19 nt, Homo sapiens
acucuugguugaucucuuu

SEQ ID NO: 1464665 - RNA, 19 nt, Homo sapiens
cagcugagcgccuauggaa

SEQ ID NO: 1464666 - RNA, 19 nt, Homo sapiens
cugcagagauguacugaag

SEQ ID NO: 1464667 - RNA, 19 nt, Homo sapiens
caacagcagcuacagaagu

SEQ ID NO: 1464668 - RNA, 19 nt, Homo sapiens
ccgaggagcccgagucuau

SEQ ID NO: 1464669 - RNA, 19 nt, Homo sapiens
cuacagaaguuggaacgau

SEQ ID NO: 1464670 - RNA, 19 nt, Homo sapiens
gaccuucccauuucaauca

SEQ ID NO: 1464671 - RNA, 19 nt, Homo sapiens
cccaauccaugccauaaug

SEQ ID NO: 1464672 - RNA, 19 nt, Homo sapiens
aacagcagcuacagaaguu

SEQ ID NO: 1464673 - RNA, 19 nt, Homo sapiens
ggacggagaggagcagaga

SEQ ID NO: 1464674 - RNA, 19 nt, Homo sapiens
gaggagcccgagucuauau

SEQ ID NO: 1464675 - RNA, 19 nt, Homo sapiens
gaagagcccgagaaauugg

SEQ ID NO: 1464676 - RNA, 19 nt, Homo sapiens
gaaggccaacccuaaagga

SEQ ID NO: 1464677 - RNA, 19 nt, Homo sapiens
gaaaauaaagacugcauuc

SEQ ID NO: 1464678 - RNA, 19 nt, Homo sapiens
ucaccacauuggcaagauu

SEQ ID NO: 1464679 - RNA, 19 nt, Homo sapiens
caccuggaccuucccauuu

SEQ ID NO: 1464680 - RNA, 19 nt, Homo sapiens
gcuaacccuggccuauuua

SEQ ID NO: 1464681 - RNA, 19 nt, Homo sapiens
caugaguuguggacaccua

SEQ ID NO: 1464682 - RNA, 19 nt, Homo sapiens
uauggaaugucagcuguga

SEQ ID NO: 1464683 - RNA, 19 nt, Homo sapiens
gcacgggugguuaaugugu

SEQ ID NO: 1464684 - RNA, 19 nt, Homo sapiens
gacagcugauggcuuugaa

SEQ ID NO: 1464685 - RNA, 19 nt, Homo sapiens
cagagaagcagcagaagca

SEQ ID NO: 1464686 - RNA, 19 nt, Homo sapiens
ggcagaagagcccgagaaa

SEQ ID NO: 1464687 - RNA, 19 nt, Homo sapiens
gcagcuccauauucugauc

SEQ ID NO: 1464688 - RNA, 19 nt, Homo sapiens
cagcaggacugggcagauc

SEQ ID NO: 1464689 - RNA, 19 nt, Homo sapiens
gagaaggccaacccuaaag

SEQ ID NO: 1464690 - RNA, 19 nt, Homo sapiens
gugcggaaauuggaccuau

SEQ ID NO: 1464691 - RNA, 19 nt, Homo sapiens
ggagcccgagucuauauug

SEQ ID NO: 1464692 - RNA, 19 nt, Homo sapiens
ccauuucaaucaugcagau

SEQ ID NO: 1464693 - RNA, 19 nt, Homo sapiens
agaagagcccgagaaauug

SEQ ID NO: 1464694 - RNA, 19 nt, Homo sapiens
gcagggguuuugccuauug

SEQ ID NO: 1464695 - RNA, 19 nt, Homo sapiens
cugcacgggugguuaaugu

SEQ ID NO: 1464696 - RNA, 19 nt, Homo sapiens
aagcagcuccauauucuga

SEQ ID NO: 1464697 - RNA, 19 nt, Homo sapiens
aaaagcagcuccauauucu

SEQ ID NO: 1464698 - RNA, 19 nt, Homo sapiens
ucaaucaugcagaugguuu

SEQ ID NO: 1464699 - RNA, 19 nt, Homo sapiens
caucacugccuauuucuag

SEQ ID NO: 1464700 - RNA, 19 nt, Homo sapiens
gggagucugcugccaguga

SEQ ID NO: 1464701 - RNA, 19 nt, Homo sapiens
uagaacaaaugugcagcuu

SEQ ID NO: 1464702 - RNA, 19 nt, Homo sapiens
ggaguguguagaacaaaug

SEQ ID NO: 1464703 - RNA, 19 nt, Homo sapiens
gaguuccguuugccuuuca

SEQ ID NO: 1464704 - RNA, 19 nt, Homo sapiens
gcagaagagcccgagaaau

SEQ ID NO: 1464705 - RNA, 19 nt, Homo sapiens
ggcaaguacuucagugacu

SEQ ID NO: 1464706 - RNA, 19 nt, Homo sapiens
gcugguggaguguguagaa

SEQ ID NO: 1464707 - RNA, 19 nt, Homo sapiens
ggaguaaugauguguccau

SEQ ID NO: 1464708 - RNA, 19 nt, Homo sapiens
cgagaaauugggucaguuc

SEQ ID NO: 1464709 - RNA, 19 nt, Homo sapiens
aggagaaggccaacccuaa

SEQ ID NO: 1464710 - RNA, 19 nt, Homo sapiens
gccacuuccuccucaccua

SEQ ID NO: 1464711 - RNA, 19 nt, Homo sapiens
ggaaaagcagcuccauauu

SEQ ID NO: 1464712 - RNA, 19 nt, Homo sapiens
cgaggagcccgagucuaua

SEQ ID NO: 1464713 - RNA, 19 nt, Homo sapiens
ucaccuccuucuucucguu

SEQ ID NO: 1464714 - RNA, 19 nt, Homo sapiens
ggacugcucaccuccuucu

SEQ ID NO: 1464715 - RNA, 19 nt, Homo sapiens
gcaagaagagcaccaucac

SEQ ID NO: 1464716 - RNA, 19 nt, Homo sapiens
ggcaagaagagcaccauca

SEQ ID NO: 1464717 - RNA, 19 nt, Homo sapiens
uccauauucugaucaacaa

SEQ ID NO: 1464718 - RNA, 19 nt, Homo sapiens
uauccgacaccaaaucuau

SEQ ID NO: 1464719 - RNA, 19 nt, Homo sapiens
gcuuauggcaugaguugug

SEQ ID NO: 1464720 - RNA, 19 nt, Homo sapiens
gcacaccugacacucuugu

SEQ ID NO: 1464721 - RNA, 19 nt, Homo sapiens
ggagaggagcagagaagca

SEQ ID NO: 1464722 - RNA, 19 nt, Homo sapiens
uccguuugccuuucaauuu

SEQ ID NO: 1464723 - RNA, 19 nt, Homo sapiens
ccaauccaugccauaauga

SEQ ID NO: 1464724 - RNA, 19 nt, Homo sapiens
cagcagggguuuugccuau

SEQ ID NO: 1464725 - RNA, 19 nt, Homo sapiens
cauauucugaucaacaaug

SEQ ID NO: 1464726 - RNA, 19 nt, Homo sapiens
aaagacugcauucaucuca

SEQ ID NO: 1464727 - RNA, 19 nt, Homo sapiens
ucaccuggaccuucccauu

SEQ ID NO: 1464728 - RNA, 19 nt, Homo sapiens
uguaaagaguuccguuugc

SEQ ID NO: 1464729 - RNA, 19 nt, Homo sapiens
acccuggccuauuuagauu

SEQ ID NO: 1464730 - RNA, 19 nt, Homo sapiens
gagucuagaccaacacaca

SEQ ID NO: 1464731 - RNA, 19 nt, Homo sapiens
ccgagaaauugggucaguu

SEQ ID NO: 1464732 - RNA, 19 nt, Homo sapiens
gaacgaggagcuguaaaua

SEQ ID NO: 1464733 - RNA, 19 nt, Homo sapiens
gaaaguggaggucugguuu

SEQ ID NO: 1464734 - RNA, 19 nt, Homo sapiens
gcggagaaguggaacaaga

SEQ ID NO: 1464735 - RNA, 19 nt, Homo sapiens
guggaggucugguuuaaga

SEQ ID NO: 1464736 - RNA, 19 nt, Homo sapiens
ggaacgaggagcuguaaau

SEQ ID NO: 1464737 - RNA, 19 nt, Homo sapiens
auaaagugauggcgaugua

SEQ ID NO: 1464738 - RNA, 19 nt, Homo sapiens
gacagacgaugcuacuuuc

SEQ ID NO: 1464739 - RNA, 19 nt, Homo sapiens
gaggagcuguaaauagugu

SEQ ID NO: 1464740 - RNA, 19 nt, Homo sapiens
agacgaugcuacuuucuug

SEQ ID NO: 1464741 - RNA, 19 nt, Homo sapiens
agacagacgaugcuacuuu

SEQ ID NO: 1464742 - RNA, 19 nt, Homo sapiens
acgaggagcuguaaauagu

SEQ ID NO: 1464743 - RNA, 19 nt, Homo sapiens
uaaauuaagggugacagua

SEQ ID NO: 1464744 - RNA, 19 nt, Homo sapiens
cgaaggacuugcacagaca

SEQ ID NO: 1464745 - RNA, 19 nt, Homo sapiens
gagggaagaggaagguaaa

SEQ ID NO: 1464746 - RNA, 19 nt, Homo sapiens
caucagaggagucggagaa

SEQ ID NO: 1464747 - RNA, 19 nt, Homo sapiens
ggagaagagggaagaggaa

SEQ ID NO: 1464748 - RNA, 19 nt, Homo sapiens
uaagggugacaguacaaua

SEQ ID NO: 1464749 - RNA, 19 nt, Homo sapiens
gaggaacgaggagcuguaa

SEQ ID NO: 1464750 - RNA, 19 nt, Homo sapiens
gcacagacagacgaugcua

SEQ ID NO: 1464751 - RNA, 19 nt, Homo sapiens
cagcaucgacaacauccua

SEQ ID NO: 1464752 - RNA, 19 nt, Homo sapiens
acacuugcccguauuacuu

SEQ ID NO: 1464753 - RNA, 19 nt, Homo sapiens
gcagaagcgguccucauca

SEQ ID NO: 1464754 - RNA, 19 nt, Homo sapiens
aaguggaggucugguuuaa

SEQ ID NO: 1464755 - RNA, 19 nt, Homo sapiens
aaaguggaggucugguuua

SEQ ID NO: 1464756 - RNA, 19 nt, Homo sapiens
ugacaguacaauaaaguga

SEQ ID NO: 1464757 - RNA, 19 nt, Homo sapiens
acaguacaauaaagugaug

SEQ ID NO: 1464758 - RNA, 19 nt, Homo sapiens
aagggugacaguacaauaa

SEQ ID NO: 1464759 - RNA, 19 nt, Homo sapiens
gggacacuugcccguauua

SEQ ID NO: 1464760 - RNA, 19 nt, Homo sapiens
gcuacaacaacuacuucua

SEQ ID NO: 1464761 - RNA, 19 nt, Homo sapiens
caccguaguauuuauaguu

SEQ ID NO: 1464762 - RNA, 19 nt, Homo sapiens
ggacuauggcgccuucuac

SEQ ID NO: 1464763 - RNA, 19 nt, Homo sapiens
gaagagggaagaggaaggu

SEQ ID NO: 1464764 - RNA, 19 nt, Homo sapiens
cagaagcgguccucaucag

SEQ ID NO: 1464765 - RNA, 19 nt, Homo sapiens
aaagugauggcgauguaaa

SEQ ID NO: 1464766 - RNA, 19 nt, Homo sapiens
cagaugcugcccuacauga

SEQ ID NO: 1464767 - RNA, 19 nt, Homo sapiens
cuacaacaacuacuucuac

SEQ ID NO: 1464768 - RNA, 19 nt, Homo sapiens
ggcagaagcgguccucauc

SEQ ID NO: 1464769 - RNA, 19 nt, Homo sapiens
ggcgcucucuuucgguuug

SEQ ID NO: 1464770 - RNA, 19 nt, Homo sapiens
cacuugcccguauuacuua

SEQ ID NO: 1464771 - RNA, 19 nt, Homo sapiens
uaaagugauggcgauguaa

SEQ ID NO: 1464772 - RNA, 19 nt, Homo sapiens
ggugacaguacaauaaagu

SEQ ID NO: 1464773 - RNA, 19 nt, Homo sapiens
gcccguauuacuuaccuaa

SEQ ID NO: 1464774 - RNA, 19 nt, Homo sapiens
ccaaauggaggcggcagaa

SEQ ID NO: 1464775 - RNA, 19 nt, Homo sapiens
gacaguacaauaaagugau

SEQ ID NO: 1464776 - RNA, 19 nt, Homo sapiens
agagggaagaggaagguaa

SEQ ID NO: 1464777 - RNA, 19 nt, Homo sapiens
gggugacaguacaauaaag

SEQ ID NO: 1464778 - RNA, 19 nt, Homo sapiens
aauuaagggugacaguaca

SEQ ID NO: 1464779 - RNA, 19 nt, Homo sapiens
cagacgaugcuacuuucuu

SEQ ID NO: 1464780 - RNA, 19 nt, Homo sapiens
aaauuaagggugacaguac

SEQ ID NO: 1464781 - RNA, 19 nt, Homo sapiens
cguauuacuuaccuaacuc

SEQ ID NO: 1464782 - RNA, 19 nt, Homo sapiens
ccguauuacuuaccuaacu

SEQ ID NO: 1464783 - RNA, 19 nt, Homo sapiens
agaaaguggaggucugguu

SEQ ID NO: 1464784 - RNA, 19 nt, Homo sapiens
cggagaacgcggagaagug

SEQ ID NO: 1464785 - RNA, 19 nt, Homo sapiens
ggaaauacccuaccagaaa

SEQ ID NO: 1464786 - RNA, 19 nt, Homo sapiens
gaacauggacuuaggcuuu

SEQ ID NO: 1464787 - RNA, 19 nt, Homo sapiens
cuacauaggugucuccaaa

SEQ ID NO: 1464788 - RNA, 19 nt, Homo sapiens
ucaagaagcuggccuuuua

SEQ ID NO: 1464789 - RNA, 19 nt, Homo sapiens
gaaagauuguuaacccuau

SEQ ID NO: 1464790 - RNA, 19 nt, Homo sapiens
gaacauggcaagaagcaaa

SEQ ID NO: 1464791 - RNA, 19 nt, Homo sapiens
gcgcugggccuucuucuua

SEQ ID NO: 1464792 - RNA, 19 nt, Homo sapiens
ggugaaaggucuucuaaag

SEQ ID NO: 1464793 - RNA, 19 nt, Homo sapiens
ggacgauggugaucaguau

SEQ ID NO: 1464794 - RNA, 19 nt, Homo sapiens
gcacaaggcugagcugaag

SEQ ID NO: 1464795 - RNA, 19 nt, Homo sapiens
gcagaucaaugacuuuauc

SEQ ID NO: 1464796 - RNA, 19 nt, Homo sapiens
caaguuggcuaugacgaua

SEQ ID NO: 1464797 - RNA, 19 nt, Homo sapiens
ugcaauagcuuucuaggaa

SEQ ID NO: 1464798 - RNA, 19 nt, Homo sapiens
gcacacacauuggagcaaa

SEQ ID NO: 1464799 - RNA, 19 nt, Homo sapiens
gauugcagguggacacuuu

SEQ ID NO: 1464800 - RNA, 19 nt, Homo sapiens
gaaauacccuaccagaaaa

SEQ ID NO: 1464801 - RNA, 19 nt, Homo sapiens
gagcaucucuacagcuuuc

SEQ ID NO: 1464802 - RNA, 19 nt, Homo sapiens
ccuaucugcugcugauuua

SEQ ID NO: 1464803 - RNA, 19 nt, Homo sapiens
gggcuggguuccucucuuu

SEQ ID NO: 1464804 - RNA, 19 nt, Homo sapiens
ugaugcuucuugcaaauua

SEQ ID NO: 1464805 - RNA, 19 nt, Homo sapiens
gcaauagcuuucuaggaau

SEQ ID NO: 1464806 - RNA, 19 nt, Homo sapiens
caugagggcuuccauuaca

SEQ ID NO: 1464807 - RNA, 19 nt, Homo sapiens
ggacugaacauggcaagaa

SEQ ID NO: 1464808 - RNA, 19 nt, Homo sapiens
ugaagaagacucucuccua

SEQ ID NO: 1464809 - RNA, 19 nt, Homo sapiens
uuaacaaccugaucgagaa

SEQ ID NO: 1464810 - RNA, 19 nt, Homo sapiens
ggguucaacuucagaaaga

SEQ ID NO: 1464811 - RNA, 19 nt, Homo sapiens
gauguuccguaguggcaua

SEQ ID NO: 1464812 - RNA, 19 nt, Homo sapiens
ggaagaugccaagaacuuu

SEQ ID NO: 1464813 - RNA, 19 nt, Homo sapiens
ccaaauaucccaggaagug

SEQ ID NO: 1464814 - RNA, 19 nt, Homo sapiens
agaagcagaucaaugacuu

SEQ ID NO: 1464815 - RNA, 19 nt, Homo sapiens
ucagaaagaugccagaaaa

SEQ ID NO: 1464816 - RNA, 19 nt, Homo sapiens
caauagcuuucuaggaaug

SEQ ID NO: 1464817 - RNA, 19 nt, Homo sapiens
gaggauauucuucaaggaa

SEQ ID NO: 1464818 - RNA, 19 nt, Homo sapiens
gaagacucucuccuacaua

SEQ ID NO: 1464819 - RNA, 19 nt, Homo sapiens
ccaaggaauuauaaagcuu

SEQ ID NO: 1464820 - RNA, 19 nt, Homo sapiens
gaggugcaauagcuuucua

SEQ ID NO: 1464821 - RNA, 19 nt, Homo sapiens
caaauucagcagacgagua

SEQ ID NO: 1464822 - RNA, 19 nt, Homo sapiens
aggcugagcugaagaugga

SEQ ID NO: 1464823 - RNA, 19 nt, Homo sapiens
agaagacucucuccuacau

SEQ ID NO: 1464824 - RNA, 19 nt, Homo sapiens
gaucaaugacuuuaucagu

SEQ ID NO: 1464825 - RNA, 19 nt, Homo sapiens
gaagacccaggaccucaaa

SEQ ID NO: 1464826 - RNA, 19 nt, Homo sapiens
gggcuuccauuacaucauc

SEQ ID NO: 1464827 - RNA, 19 nt, Homo sapiens
gcugcgggcugguacauuc

SEQ ID NO: 1464828 - RNA, 19 nt, Homo sapiens
guacccagacuccacauga

SEQ ID NO: 1464829 - RNA, 19 nt, Homo sapiens
aaaccauccuuaccaacuu

SEQ ID NO: 1464830 - RNA, 19 nt, Homo sapiens
gaaaccauccuuaccaacu

SEQ ID NO: 1464831 - RNA, 19 nt, Homo sapiens
gaaaaugaaccccacacua

SEQ ID NO: 1464832 - RNA, 19 nt, Homo sapiens
aaauucagcagacgaguaa

SEQ ID NO: 1464833 - RNA, 19 nt, Homo sapiens
ggaaguggaugguuuuauc

SEQ ID NO: 1464834 - RNA, 19 nt, Homo sapiens
caaaacagcagcacaagaa

SEQ ID NO: 1464835 - RNA, 19 nt, Homo sapiens
cuuaccaacuuucagaauu

SEQ ID NO: 1464836 - RNA, 19 nt, Homo sapiens
aacauggacuuaggcuuua

SEQ ID NO: 1464837 - RNA, 19 nt, Homo sapiens
gcagagagagcaagaacag

SEQ ID NO: 1464838 - RNA, 19 nt, Homo sapiens
gaagcagaucaaugacuuu

SEQ ID NO: 1464839 - RNA, 19 nt, Homo sapiens
gcucagaagcagaucaaug

SEQ ID NO: 1464840 - RNA, 19 nt, Homo sapiens
cccaggaaguggaugguuu

SEQ ID NO: 1464841 - RNA, 19 nt, Homo sapiens
cgagccagguggaaacaug

SEQ ID NO: 1464842 - RNA, 19 nt, Homo sapiens
ccgaaaccauccuuaccaa

SEQ ID NO: 1464843 - RNA, 19 nt, Homo sapiens
ccgcguuuguaaaugaaua

SEQ ID NO: 1464844 - RNA, 19 nt, Homo sapiens
ucaaggugcccaugauguu

SEQ ID NO: 1464845 - RNA, 19 nt, Homo sapiens
agacaccacucgucgucaa

SEQ ID NO: 1464846 - RNA, 19 nt, Homo sapiens
aagcagaucaaugacuuua

SEQ ID NO: 1464847 - RNA, 19 nt, Homo sapiens
cucagaagcagaucaauga

SEQ ID NO: 1464848 - RNA, 19 nt, Homo sapiens
gcagccacagcguaaguuu

SEQ ID NO: 1464849 - RNA, 19 nt, Homo sapiens
uccacgagcugacccagaa

SEQ ID NO: 1464850 - RNA, 19 nt, Homo sapiens
gcucuacuccagaacagaa

SEQ ID NO: 1464851 - RNA, 19 nt, Homo sapiens
guaguggcauauaccaagu

SEQ ID NO: 1464852 - RNA, 19 nt, Homo sapiens
cccaugauguuccguagug

SEQ ID NO: 1464853 - RNA, 19 nt, Homo sapiens
acaaccugaucgagaauau

SEQ ID NO: 1464854 - RNA, 19 nt, Homo sapiens
ggaauuauaaagcuuugag

SEQ ID NO: 1464855 - RNA, 19 nt, Homo sapiens
aagacucucuccuacauag

SEQ ID NO: 1464856 - RNA, 19 nt, Homo sapiens
uaucacagccaucuucauc

SEQ ID NO: 1464857 - RNA, 19 nt, Homo sapiens
caaccugaucgagaauaua

SEQ ID NO: 1464858 - RNA, 19 nt, Homo sapiens
gaagaugccaagaacuuuu

SEQ ID NO: 1464859 - RNA, 19 nt, Homo sapiens
aaacugagcauugggaaca

SEQ ID NO: 1464860 - RNA, 19 nt, Homo sapiens
gagcuucucaccaaggaau

SEQ ID NO: 1464861 - RNA, 19 nt, Homo sapiens
aggauauucuucaaggaaa

SEQ ID NO: 1464862 - RNA, 19 nt, Homo sapiens
aagggcagauggaaaguuc

SEQ ID NO: 1464863 - RNA, 19 nt, Homo sapiens
gggacgauggugaucagua

SEQ ID NO: 1464864 - RNA, 19 nt, Homo sapiens
gacugaacauggcaagaag

SEQ ID NO: 1464865 - RNA, 19 nt, Homo sapiens
gcacuuggagaagggauug

SEQ ID NO: 1464866 - RNA, 19 nt, Homo sapiens
gaugcuucuugcaaauuau

SEQ ID NO: 1464867 - RNA, 19 nt, Homo sapiens
ggcagaacauggacuuagg

SEQ ID NO: 1464868 - RNA, 19 nt, Homo sapiens
gguggaagcccagcucaug

SEQ ID NO: 1464869 - RNA, 19 nt, Homo sapiens
gcaaaagcuuccaguacug

SEQ ID NO: 1464870 - RNA, 19 nt, Homo sapiens
uggaagaugccaagaacuu

SEQ ID NO: 1464871 - RNA, 19 nt, Homo sapiens
guccagauccguagacaca

SEQ ID NO: 1464872 - RNA, 19 nt, Homo sapiens
aaccauccuuaccaacuuu

SEQ ID NO: 1464873 - RNA, 19 nt, Homo sapiens
ucucaccaaggaauuauaa

SEQ ID NO: 1464874 - RNA, 19 nt, Homo sapiens
gcaaaggcaagggcagaug

SEQ ID NO: 1464875 - RNA, 19 nt, Homo sapiens
caucggcccuacagagaag

SEQ ID NO: 1464876 - RNA, 19 nt, Homo sapiens
gagcugaagauggaugaga

SEQ ID NO: 1464877 - RNA, 19 nt, Homo sapiens
ugaggaacauggugaucuc

SEQ ID NO: 1464878 - RNA, 19 nt, Homo sapiens
aaauaucacagccaucuuc

SEQ ID NO: 1464879 - RNA, 19 nt, Homo sapiens
gauccaaauguaacuaaag

SEQ ID NO: 1464880 - RNA, 19 nt, Homo sapiens
caaggcagaacauggacuu

SEQ ID NO: 1464881 - RNA, 19 nt, Homo sapiens
aacccgcguuuguaaauga

SEQ ID NO: 1464882 - RNA, 19 nt, Homo sapiens
gagccagguggaaacauga

SEQ ID NO: 1464883 - RNA, 19 nt, Homo sapiens
uaccaacuuucagaauuug

SEQ ID NO: 1464884 - RNA, 19 nt, Homo sapiens
gggccuucuucuuaaguug

SEQ ID NO: 1464885 - RNA, 19 nt, Homo sapiens
gagaauaacugcagaagaa

SEQ ID NO: 1464886 - RNA, 19 nt, Homo sapiens
ggagagagaugaagcaauu

SEQ ID NO: 1464887 - RNA, 19 nt, Homo sapiens
gaaauccacugaauuaguu

SEQ ID NO: 1464888 - RNA, 19 nt, Homo sapiens
gaaauuggcuaaagaagau

SEQ ID NO: 1464889 - RNA, 19 nt, Homo sapiens
uaaaggagcucauagaaug

SEQ ID NO: 1464890 - RNA, 19 nt, Homo sapiens
gaacagaaauacaaaugga

SEQ ID NO: 1464891 - RNA, 19 nt, Homo sapiens
ggaacgaggucucacuaua

SEQ ID NO: 1464892 - RNA, 19 nt, Homo sapiens
gggcagagaucaacgaauu

SEQ ID NO: 1464893 - RNA, 19 nt, Homo sapiens
agaaaugagugcacuaaua

SEQ ID NO: 1464894 - RNA, 19 nt, Homo sapiens
gaaagaaacagaagcuaaa

SEQ ID NO: 1464895 - RNA, 19 nt, Homo sapiens
gaauggagcuauaauugug

SEQ ID NO: 1464896 - RNA, 19 nt, Homo sapiens
gagcaaauauggaauuaca

SEQ ID NO: 1464897 - RNA, 19 nt, Homo sapiens
gaguuuggcuuagagauua

SEQ ID NO: 1464898 - RNA, 19 nt, Homo sapiens
gaaauaacaugugagaaca

SEQ ID NO: 1464899 - RNA, 19 nt, Homo sapiens
ggauagcuauucagaagaa

SEQ ID NO: 1464900 - RNA, 19 nt, Homo sapiens
gacaauagcauuucuucua

SEQ ID NO: 1464901 - RNA, 19 nt, Homo sapiens
gcaaacaagaacagaaaua

SEQ ID NO: 1464902 - RNA, 19 nt, Homo sapiens
gauuaaagcuccuucuauc

SEQ ID NO: 1464903 - RNA, 19 nt, Homo sapiens
gaacgaggucucacuauau

SEQ ID NO: 1464904 - RNA, 19 nt, Homo sapiens
gaaaugagugcacuaauag

SEQ ID NO: 1464905 - RNA, 19 nt, Homo sapiens
uagaaugccuuuaaugcua

SEQ ID NO: 1464906 - RNA, 19 nt, Homo sapiens
gcucauagaaugccuuuaa

SEQ ID NO: 1464907 - RNA, 19 nt, Homo sapiens
gaagaauggagcuauaauu

SEQ ID NO: 1464908 - RNA, 19 nt, Homo sapiens
gaagaaaugagugcacuaa

SEQ ID NO: 1464909 - RNA, 19 nt, Homo sapiens
ggaaaugucucuaaaagug

SEQ ID NO: 1464910 - RNA, 19 nt, Homo sapiens
ggacagugaucugauugaa

SEQ ID NO: 1464911 - RNA, 19 nt, Homo sapiens
gcgagcaaauauggaauua

SEQ ID NO: 1464912 - RNA, 19 nt, Homo sapiens
ucagaagaauggagcuaua

SEQ ID NO: 1464913 - RNA, 19 nt, Homo sapiens
gagcaaacaagaacagaaa

SEQ ID NO: 1464914 - RNA, 19 nt, Homo sapiens
gcaaaguuguuaucuaugc

SEQ ID NO: 1464915 - RNA, 19 nt, Homo sapiens
gaaccagacuucagcaaac

SEQ ID NO: 1464916 - RNA, 19 nt, Homo sapiens
cagcagcucugguugaaga

SEQ ID NO: 1464917 - RNA, 19 nt, Homo sapiens
ugacagagcgagcaaauau

SEQ ID NO: 1464918 - RNA, 19 nt, Homo sapiens
gaaggaacgugaugaagcu

SEQ ID NO: 1464919 - RNA, 19 nt, Homo sapiens
gaagauaaagaacagagaa

SEQ ID NO: 1464920 - RNA, 19 nt, Homo sapiens
ucacugagaguuuggcuua

SEQ ID NO: 1464921 - RNA, 19 nt, Homo sapiens
ggaacuggcuacucaacug

SEQ ID NO: 1464922 - RNA, 19 nt, Homo sapiens
ggaauuacugaacagaaua

SEQ ID NO: 1464923 - RNA, 19 nt, Homo sapiens
gcaagguucucaagguugu

SEQ ID NO: 1464924 - RNA, 19 nt, Homo sapiens
ucggaaauccacugaauua

SEQ ID NO: 1464925 - RNA, 19 nt, Homo sapiens
gaugagcaacugacuauga

SEQ ID NO: 1464926 - RNA, 19 nt, Homo sapiens
uaaagcuccuucuaucuug

SEQ ID NO: 1464927 - RNA, 19 nt, Homo sapiens
gcaaacaacaugagacauc

SEQ ID NO: 1464928 - RNA, 19 nt, Homo sapiens
ccaaagugauggaauuaca

SEQ ID NO: 1464929 - RNA, 19 nt, Homo sapiens
gcagaaauuggcuaaagaa

SEQ ID NO: 1464930 - RNA, 19 nt, Homo sapiens
ccacaguuaucuugaacaa

SEQ ID NO: 1464931 - RNA, 19 nt, Homo sapiens
gacaugacauuacaggaau

SEQ ID NO: 1464932 - RNA, 19 nt, Homo sapiens
ugaccaggcugcuucauuc

SEQ ID NO: 1464933 - RNA, 19 nt, Homo sapiens
guacauaugaagaagcuuu

SEQ ID NO: 1464934 - RNA, 19 nt, Homo sapiens
aggcaaaguuguuaucuau

SEQ ID NO: 1464935 - RNA, 19 nt, Homo sapiens
ugaugaagcuguuaugucu

SEQ ID NO: 1464936 - RNA, 19 nt, Homo sapiens
ggaaauccacugaauuagu

SEQ ID NO: 1464937 - RNA, 19 nt, Homo sapiens
caucggaaauccacugaau

SEQ ID NO: 1464938 - RNA, 19 nt, Homo sapiens
acaccaaagccuuaacuua

SEQ ID NO: 1464939 - RNA, 19 nt, Homo sapiens
gacagcagcucugguugaa

SEQ ID NO: 1464940 - RNA, 19 nt, Homo sapiens
uggaaaggcugguggaugu

SEQ ID NO: 1464941 - RNA, 19 nt, Homo sapiens
gaucaucaguucuuaucca

SEQ ID NO: 1464942 - RNA, 19 nt, Homo sapiens
gagcaacugacuaugaauu

SEQ ID NO: 1464943 - RNA, 19 nt, Homo sapiens
gcuaaaggagcucauagaa

SEQ ID NO: 1464944 - RNA, 19 nt, Homo sapiens
gagauuaaagcuccuucua

SEQ ID NO: 1464945 - RNA, 19 nt, Homo sapiens
gagccaagcauauggaaau

SEQ ID NO: 1464946 - RNA, 19 nt, Homo sapiens
gcagaaggaacgugaugaa

SEQ ID NO: 1464947 - RNA, 19 nt, Homo sapiens
gaauuacaacuucaacaug

SEQ ID NO: 1464948 - RNA, 19 nt, Homo sapiens
ggaauuacaacuucaacau

SEQ ID NO: 1464949 - RNA, 19 nt, Homo sapiens
acacagggauagcuauuca

SEQ ID NO: 1464950 - RNA, 19 nt, Homo sapiens
ggaacgugaugaagcuguu

SEQ ID NO: 1464951 - RNA, 19 nt, Homo sapiens
gaaacuacggggauaaaua

SEQ ID NO: 1464952 - RNA, 19 nt, Homo sapiens
agaaugccuuuaaugcuaa

SEQ ID NO: 1464953 - RNA, 19 nt, Homo sapiens
ugaggacagugaucugauu

SEQ ID NO: 1464954 - RNA, 19 nt, Homo sapiens
gaugcugccuugucuaagu

SEQ ID NO: 1464955 - RNA, 19 nt, Homo sapiens
gagaagagaaggcuaaagg

SEQ ID NO: 1464956 - RNA, 19 nt, Homo sapiens
gcaacaagccagagaaacu

SEQ ID NO: 1464957 - RNA, 19 nt, Homo sapiens
ucaagaacgugcucugaag

SEQ ID NO: 1464958 - RNA, 19 nt, Homo sapiens
ugagugcacuaauagaaga

SEQ ID NO: 1464959 - RNA, 19 nt, Homo sapiens
agaaagaaacagaagcuaa

SEQ ID NO: 1464960 - RNA, 19 nt, Homo sapiens
cagcagaaauuggcuaaag

SEQ ID NO: 1464961 - RNA, 19 nt, Homo sapiens
caucaguucuuauccagau

SEQ ID NO: 1464962 - RNA, 19 nt, Homo sapiens
caccaaagccuuaacuuag

SEQ ID NO: 1464963 - RNA, 19 nt, Homo sapiens
guucuuauccagaugauga

SEQ ID NO: 1464964 - RNA, 19 nt, Homo sapiens
ucugugagcugcaaaucuu

SEQ ID NO: 1464965 - RNA, 19 nt, Homo sapiens
gagcaggagcuucaucaug

SEQ ID NO: 1464966 - RNA, 19 nt, Homo sapiens
uuacaggaauuacugaaca

SEQ ID NO: 1464967 - RNA, 19 nt, Homo sapiens
ugacaugacauuacaggaa

SEQ ID NO: 1464968 - RNA, 19 nt, Homo sapiens
gaacgugaugaagcuguua

SEQ ID NO: 1464969 - RNA, 19 nt, Homo sapiens
cugcaaaucuuggagcaaa

SEQ ID NO: 1464970 - RNA, 19 nt, Homo sapiens
uguaaacaccaaagccuua

SEQ ID NO: 1464971 - RNA, 19 nt, Homo sapiens
gaauuacaggugugaauca

SEQ ID NO: 1464972 - RNA, 19 nt, Homo sapiens
gggaugcugccuugucuaa

SEQ ID NO: 1464973 - RNA, 19 nt, Homo sapiens
gaauaacugcagaagaaau

SEQ ID NO: 1464974 - RNA, 19 nt, Homo sapiens
aagaauggagcuauaauug

SEQ ID NO: 1464975 - RNA, 19 nt, Homo sapiens
gcagacacagggauagcua

SEQ ID NO: 1464976 - RNA, 19 nt, Homo sapiens
ccaagcauauggaaauguc

SEQ ID NO: 1464977 - RNA, 19 nt, Homo sapiens
gaacuccaagagaaagaaa

SEQ ID NO: 1464978 - RNA, 19 nt, Homo sapiens
aacgaggucucacuauauu

SEQ ID NO: 1464979 - RNA, 19 nt, Homo sapiens
gaacuggucaaaagacaua

SEQ ID NO: 1464980 - RNA, 19 nt, Homo sapiens
gcaaauauggaauuacaac

SEQ ID NO: 1464981 - RNA, 19 nt, Homo sapiens
caaacaacaugagacaucu

SEQ ID NO: 1464982 - RNA, 19 nt, Homo sapiens
gcaggagcuucaucaugug

SEQ ID NO: 1464983 - RNA, 19 nt, Homo sapiens
gaacagaauaaacaaugca

SEQ ID NO: 1464984 - RNA, 19 nt, Homo sapiens
cagaugagcaacugacuau

SEQ ID NO: 1464985 - RNA, 19 nt, Homo sapiens
ugacagagauugaagaaga

SEQ ID NO: 1464986 - RNA, 19 nt, Homo sapiens
ucagacagguugacagaua

SEQ ID NO: 1464987 - RNA, 19 nt, Homo sapiens
uaaguaaccugguacauuc

SEQ ID NO: 1464988 - RNA, 19 nt, Homo sapiens
guacauauguggcuuggau

SEQ ID NO: 1464989 - RNA, 19 nt, Homo sapiens
gcaguucacuuugcagaaa

SEQ ID NO: 1464990 - RNA, 19 nt, Homo sapiens
gcaaaacgcccagcaauua

SEQ ID NO: 1464991 - RNA, 19 nt, Homo sapiens
ggagauauccuuccuugau

SEQ ID NO: 1464992 - RNA, 19 nt, Homo sapiens
aaccagaacucuugaauuc

SEQ ID NO: 1464993 - RNA, 19 nt, Homo sapiens
gaugaaaccagaacucuug

SEQ ID NO: 1464994 - RNA, 19 nt, Homo sapiens
gagauauccuuccuugaug

SEQ ID NO: 1464995 - RNA, 19 nt, Homo sapiens
guagggagacucuuucgua

SEQ ID NO: 1464996 - RNA, 19 nt, Homo sapiens
cagcggaucuguucuuuua

SEQ ID NO: 1464997 - RNA, 19 nt, Homo sapiens
gaaguucuuugaguccuuu

SEQ ID NO: 1464998 - RNA, 19 nt, Homo sapiens
cuacuuaucccauuacuug

SEQ ID NO: 1464999 - RNA, 19 nt, Homo sapiens
gaugauaagucagcuaaag

SEQ ID NO: 1465000 - RNA, 19 nt, Homo sapiens
ugaaacaucacccucauuu

SEQ ID NO: 1465001 - RNA, 19 nt, Homo sapiens
gagccucgaugucuauuca

SEQ ID NO: 1465002 - RNA, 19 nt, Homo sapiens
gcaggaggcgugaagauga

SEQ ID NO: 1465003 - RNA, 19 nt, Homo sapiens
gaaguacuguauccuugug

SEQ ID NO: 1465004 - RNA, 19 nt, Homo sapiens
gacagagauugaagaagaa

SEQ ID NO: 1465005 - RNA, 19 nt, Homo sapiens
gcuacaagauacugagaug

SEQ ID NO: 1465006 - RNA, 19 nt, Homo sapiens
ggucaacagggcaccauua

SEQ ID NO: 1465007 - RNA, 19 nt, Homo sapiens
cagacagguugacagauaa

SEQ ID NO: 1465008 - RNA, 19 nt, Homo sapiens
aaacaucacccucauuuua

SEQ ID NO: 1465009 - RNA, 19 nt, Homo sapiens
ucaaguagacgucagauuc

SEQ ID NO: 1465010 - RNA, 19 nt, Homo sapiens
ucaguugggauuacgauua

SEQ ID NO: 1465011 - RNA, 19 nt, Homo sapiens
gaaaccagaacucuugaau

SEQ ID NO: 1465012 - RNA, 19 nt, Homo sapiens
gguaggccuuguagagaaa

SEQ ID NO: 1465013 - RNA, 19 nt, Homo sapiens
ggcauuauuguacuacuua

SEQ ID NO: 1465014 - RNA, 19 nt, Homo sapiens
ccauuacacuggaugaugu

SEQ ID NO: 1465015 - RNA, 19 nt, Homo sapiens
acacuggacuuggucauga

SEQ ID NO: 1465016 - RNA, 19 nt, Homo sapiens
gcagaaguacuguauccuu

SEQ ID NO: 1465017 - RNA, 19 nt, Homo sapiens
ggauuacgauuagggaugu

SEQ ID NO: 1465018 - RNA, 19 nt, Homo sapiens
gaaaagaaacgcaugacuu

SEQ ID NO: 1465019 - RNA, 19 nt, Homo sapiens
aaagaaaggcaaagcaguu

SEQ ID NO: 1465020 - RNA, 19 nt, Homo sapiens
acaauaacaugaggauuca

SEQ ID NO: 1465021 - RNA, 19 nt, Homo sapiens
gccgguaguuggcaucuug

SEQ ID NO: 1465022 - RNA, 19 nt, Homo sapiens
gggagacucuuucguacca

SEQ ID NO: 1465023 - RNA, 19 nt, Homo sapiens
ggaaguucuuugaguccuu

SEQ ID NO: 1465024 - RNA, 19 nt, Homo sapiens
ccagaacucuugaauucag

SEQ ID NO: 1465025 - RNA, 19 nt, Homo sapiens
cuaaguaaccugguacauu

SEQ ID NO: 1465026 - RNA, 19 nt, Homo sapiens
ucaggagaaugauggcaaa

SEQ ID NO: 1465027 - RNA, 19 nt, Homo sapiens
gcgugaagaugaggaauca

SEQ ID NO: 1465028 - RNA, 19 nt, Homo sapiens
gaaguagggagacucuuuc

SEQ ID NO: 1465029 - RNA, 19 nt, Homo sapiens
uguacuacuuaucccauua

SEQ ID NO: 1465030 - RNA, 19 nt, Homo sapiens
ggaauugguuuuaagugaa

SEQ ID NO: 1465031 - RNA, 19 nt, Homo sapiens
cagcagaagucaaggaaaa

SEQ ID NO: 1465032 - RNA, 19 nt, Homo sapiens
uacacuggaugauguuaaa

SEQ ID NO: 1465033 - RNA, 19 nt, Homo sapiens
cagaagguuugccgcagaa

SEQ ID NO: 1465034 - RNA, 19 nt, Homo sapiens
cauuccauaucucaaguaa

SEQ ID NO: 1465035 - RNA, 19 nt, Homo sapiens
agaaguagggagacucuuu

SEQ ID NO: 1465036 - RNA, 19 nt, Homo sapiens
ugaaaacacuguccucuca

SEQ ID NO: 1465037 - RNA, 19 nt, Homo sapiens
gaagaaguagggagacucu

SEQ ID NO: 1465038 - RNA, 19 nt, Homo sapiens
gaaaggagaaaauaucaga

SEQ ID NO: 1465039 - RNA, 19 nt, Homo sapiens
gcuuggccgugccggauaa

SEQ ID NO: 1465040 - RNA, 19 nt, Homo sapiens
auaauuuccucauggcauu

SEQ ID NO: 1465041 - RNA, 19 nt, Homo sapiens
gcgcagaaguacuguaucc

SEQ ID NO: 1465042 - RNA, 19 nt, Homo sapiens
gcagaccccuuacuugaug

SEQ ID NO: 1465043 - RNA, 19 nt, Homo sapiens
gauuagggaugugguacug

SEQ ID NO: 1465044 - RNA, 19 nt, Homo sapiens
ccauaucucaaguaaacua

SEQ ID NO: 1465045 - RNA, 19 nt, Homo sapiens
guucaguucaggagaauga

SEQ ID NO: 1465046 - RNA, 19 nt, Homo sapiens
agagauugaagaagaagua

SEQ ID NO: 1465047 - RNA, 19 nt, Homo sapiens
aaaacucacuggaaaagaa

SEQ ID NO: 1465048 - RNA, 19 nt, Homo sapiens
gaagguuugccgcagaaga

SEQ ID NO: 1465049 - RNA, 19 nt, Homo sapiens
uuccauaucucaaguaaac

SEQ ID NO: 1465050 - RNA, 19 nt, Homo sapiens
ccugguacauuccauaucu

SEQ ID NO: 1465051 - RNA, 19 nt, Homo sapiens
ggaaagaugaaaccagaac

SEQ ID NO: 1465052 - RNA, 19 nt, Homo sapiens
aaaccagaacucuugaauu

SEQ ID NO: 1465053 - RNA, 19 nt, Homo sapiens
caacagggcaccauuacac

SEQ ID NO: 1465054 - RNA, 19 nt, Homo sapiens
uaaccugguacauuccaua

SEQ ID NO: 1465055 - RNA, 19 nt, Homo sapiens
ugggaacucuggacucugu

SEQ ID NO: 1465056 - RNA, 19 nt, Homo sapiens
gacuggaaguucuuugagu

SEQ ID NO: 1465057 - RNA, 19 nt, Homo sapiens
aaaagaaacccaaaagcua

SEQ ID NO: 1465058 - RNA, 19 nt, Homo sapiens
caguugggauuacgauuag

SEQ ID NO: 1465059 - RNA, 19 nt, Homo sapiens
uccaguggcuccugaaaca

SEQ ID NO: 1465060 - RNA, 19 nt, Homo sapiens
guacauuccauaucucaag

SEQ ID NO: 1465061 - RNA, 19 nt, Homo sapiens
gagacucuuucguaccaau

SEQ ID NO: 1465062 - RNA, 19 nt, Homo sapiens
gaaaagaaacccaaaagcu

SEQ ID NO: 1465063 - RNA, 19 nt, Homo sapiens
acacuguccucucauacau

SEQ ID NO: 1465064 - RNA, 19 nt, Homo sapiens
aaaacacuguccucucaua

SEQ ID NO: 1465065 - RNA, 19 nt, Homo sapiens
agagguacuuggcgcagaa

SEQ ID NO: 1465066 - RNA, 19 nt, Homo sapiens
aacaauaacaugaggauuc

SEQ ID NO: 1465067 - RNA, 19 nt, Homo sapiens
cggauaagcaucacaugug

SEQ ID NO: 1465068 - RNA, 19 nt, Homo sapiens
ugguaggccuuguagagaa

SEQ ID NO: 1465069 - RNA, 19 nt, Homo sapiens
acagaaagacuggaaguuc

SEQ ID NO: 1465070 - RNA, 19 nt, Homo sapiens
aagaugauaagucagcuaa

SEQ ID NO: 1465071 - RNA, 19 nt, Homo sapiens
aacaugaggauucaggaua

SEQ ID NO: 1465072 - RNA, 19 nt, Homo sapiens
cuuccgacgucaacacuug

SEQ ID NO: 1465073 - RNA, 19 nt, Homo sapiens
ucauggcauuauuguacua

SEQ ID NO: 1465074 - RNA, 19 nt, Homo sapiens
ccucauggcauuauuguac

SEQ ID NO: 1465075 - RNA, 19 nt, Homo sapiens
uacaucaugcccuaaguaa

SEQ ID NO: 1465076 - RNA, 19 nt, Homo sapiens
caaaacgcccagcaauuaa

SEQ ID NO: 1465077 - RNA, 19 nt, Homo sapiens
cagaacucuugaauucaga

SEQ ID NO: 1465078 - RNA, 19 nt, Homo sapiens
uagaagcagcacagaggua

SEQ ID NO: 1465079 - RNA, 19 nt, Homo sapiens
cuacucugcugccaucucu

SEQ ID NO: 1465080 - RNA, 19 nt, Homo sapiens
gggcagaccccuuacuuga

SEQ ID NO: 1465081 - RNA, 19 nt, Homo sapiens
gcaccauuacacuggauga

SEQ ID NO: 1465082 - RNA, 19 nt, Homo sapiens
auacaucaugcccuaagua

SEQ ID NO: 1465083 - RNA, 19 nt, Homo sapiens
acaugaggauucaggauac

SEQ ID NO: 1465084 - RNA, 19 nt, Homo sapiens
gauggaucaguugggauua

SEQ ID NO: 1465085 - RNA, 19 nt, Homo sapiens
gagaaaggcuuccagauuu

SEQ ID NO: 1465086 - RNA, 19 nt, Homo sapiens
ggacaaacacuacuaauaa

SEQ ID NO: 1465087 - RNA, 19 nt, Homo sapiens
caaaguggagucagaauua

SEQ ID NO: 1465088 - RNA, 19 nt, Homo sapiens
gcaacgaacuucacagaca

SEQ ID NO: 1465089 - RNA, 19 nt, Homo sapiens
ucaaaguccuucaaagaaa

SEQ ID NO: 1465090 - RNA, 19 nt, Homo sapiens
agagagugcuuaugccuua

SEQ ID NO: 1465091 - RNA, 19 nt, Homo sapiens
agacagcuguaacaucuua

SEQ ID NO: 1465092 - RNA, 19 nt, Homo sapiens
ugucaugacugugaaguua

SEQ ID NO: 1465093 - RNA, 19 nt, Homo sapiens
gcauuuggauuaccuggaa

SEQ ID NO: 1465094 - RNA, 19 nt, Homo sapiens
uggcuuagcuuauguuaug

SEQ ID NO: 1465095 - RNA, 19 nt, Homo sapiens
guucuuugcucuuguggua

SEQ ID NO: 1465096 - RNA, 19 nt, Homo sapiens
gcuaugucaucuuaucuuu

SEQ ID NO: 1465097 - RNA, 19 nt, Homo sapiens
uggauuaccuggaaaguug

SEQ ID NO: 1465098 - RNA, 19 nt, Homo sapiens
cagaaaagcuguaacaaug

SEQ ID NO: 1465099 - RNA, 19 nt, Homo sapiens
aaucauauguguuggcauu

SEQ ID NO: 1465100 - RNA, 19 nt, Homo sapiens
ucagacagcuguaacaucu

SEQ ID NO: 1465101 - RNA, 19 nt, Homo sapiens
ggagcuaugucaucuuauc

SEQ ID NO: 1465102 - RNA, 19 nt, Homo sapiens
ccucugacauuaaauuaug

SEQ ID NO: 1465103 - RNA, 19 nt, Homo sapiens
gcaggcaccauaauaauuc

SEQ ID NO: 1465104 - RNA, 19 nt, Homo sapiens
agagaaaggcuuccagauu

SEQ ID NO: 1465105 - RNA, 19 nt, Homo sapiens
ccaggacuauuuuaucuua

SEQ ID NO: 1465106 - RNA, 19 nt, Homo sapiens
gcuguaacaucuuaugaag

SEQ ID NO: 1465107 - RNA, 19 nt, Homo sapiens
uauauucccaggacuauuu

SEQ ID NO: 1465108 - RNA, 19 nt, Homo sapiens
gugaaguuaugcauacuau

SEQ ID NO: 1465109 - RNA, 19 nt, Homo sapiens
uuggagcuaugucaucuua

SEQ ID NO: 1465110 - RNA, 19 nt, Homo sapiens
gcaccauaauaauucagaa

SEQ ID NO: 1465111 - RNA, 19 nt, Homo sapiens
gcucuuucauuucuccaaa

SEQ ID NO: 1465112 - RNA, 19 nt, Homo sapiens
ggcauuguguucccucuug

SEQ ID NO: 1465113 - RNA, 19 nt, Homo sapiens
cuuaguauguguauucaga

SEQ ID NO: 1465114 - RNA, 19 nt, Homo sapiens
gcagaauguuaccaauaca

SEQ ID NO: 1465115 - RNA, 19 nt, Homo sapiens
ccaaagagagugcuuaugc

SEQ ID NO: 1465116 - RNA, 19 nt, Homo sapiens
uggacaaacacuacuaaua

SEQ ID NO: 1465117 - RNA, 19 nt, Homo sapiens
uugcucaucuuuggaauuu

SEQ ID NO: 1465118 - RNA, 19 nt, Homo sapiens
aaacuuagcagagaggauu

SEQ ID NO: 1465119 - RNA, 19 nt, Homo sapiens
acucuagcacucaauauua

SEQ ID NO: 1465120 - RNA, 19 nt, Homo sapiens
gaaaagcuguaacaaugau

SEQ ID NO: 1465121 - RNA, 19 nt, Homo sapiens
gauggacaaacacuacuaa

SEQ ID NO: 1465122 - RNA, 19 nt, Homo sapiens
gcccauauacugugaacuu

SEQ ID NO: 1465123 - RNA, 19 nt, Homo sapiens
gaauauuggagcuauguca

SEQ ID NO: 1465124 - RNA, 19 nt, Homo sapiens
uaauaccggugucuuugga

SEQ ID NO: 1465125 - RNA, 19 nt, Homo sapiens
gaaugcagaauguuaccaa

SEQ ID NO: 1465126 - RNA, 19 nt, Homo sapiens
gagacuauaguagauauug

SEQ ID NO: 1465127 - RNA, 19 nt, Homo sapiens
gaguugaguccguugcuaa

SEQ ID NO: 1465128 - RNA, 19 nt, Homo sapiens
ccagguguuucauuugguu

SEQ ID NO: 1465129 - RNA, 19 nt, Homo sapiens
ccacuucccugccagaaaa

SEQ ID NO: 1465130 - RNA, 19 nt, Homo sapiens
caaaguccuucaaagaaaa

SEQ ID NO: 1465131 - RNA, 19 nt, Homo sapiens
ucucugccauaccucaaua

SEQ ID NO: 1465132 - RNA, 19 nt, Homo sapiens
gcuaauaccggugucuuug

SEQ ID NO: 1465133 - RNA, 19 nt, Homo sapiens
gcaauugcuuuaaguuuuc

SEQ ID NO: 1465134 - RNA, 19 nt, Homo sapiens
gauguucuuugcucuugug

SEQ ID NO: 1465135 - RNA, 19 nt, Homo sapiens
ggcaggcaccauaauaauu

SEQ ID NO: 1465136 - RNA, 19 nt, Homo sapiens
ucuccuggcuucuuacuca

SEQ ID NO: 1465137 - RNA, 19 nt, Homo sapiens
cuucaaaguccuucaaaga

SEQ ID NO: 1465138 - RNA, 19 nt, Homo sapiens
gcuuaugccuuaccaacca

SEQ ID NO: 1465139 - RNA, 19 nt, Homo sapiens
caaauguuacagaugauug

SEQ ID NO: 1465140 - RNA, 19 nt, Homo sapiens
uaguuuagcacucaucauu

SEQ ID NO: 1465141 - RNA, 19 nt, Homo sapiens
caugggaaguggcauccuu

SEQ ID NO: 1465142 - RNA, 19 nt, Homo sapiens
acucuuugcauuuggauua

SEQ ID NO: 1465143 - RNA, 19 nt, Homo sapiens
gaucuuggacucuuugcau

SEQ ID NO: 1465144 - RNA, 19 nt, Homo sapiens
ucauuugguuuaucagugu

SEQ ID NO: 1465145 - RNA, 19 nt, Homo sapiens
cauacuauuugcugugcuu

SEQ ID NO: 1465146 - RNA, 19 nt, Homo sapiens
ucaugacugugaaguuaug

SEQ ID NO: 1465147 - RNA, 19 nt, Homo sapiens
ggagucagaauuacuaaaa

SEQ ID NO: 1465148 - RNA, 19 nt, Homo sapiens
ugccauaccucaauauugc

SEQ ID NO: 1465149 - RNA, 19 nt, Homo sapiens
guggcaggcaccauaauaa

SEQ ID NO: 1465150 - RNA, 19 nt, Homo sapiens
caucuucugcuuaguaugu

SEQ ID NO: 1465151 - RNA, 19 nt, Homo sapiens
gagaggauuuucugucaug

SEQ ID NO: 1465152 - RNA, 19 nt, Homo sapiens
guuuagcacucaucauuuu

SEQ ID NO: 1465153 - RNA, 19 nt, Homo sapiens
gcucaucuuuggaauuuug

SEQ ID NO: 1465154 - RNA, 19 nt, Homo sapiens
ugcagaauguuaccaauac

SEQ ID NO: 1465155 - RNA, 19 nt, Homo sapiens
agaaaagaaugcagaaugu

SEQ ID NO: 1465156 - RNA, 19 nt, Homo sapiens
guaucuugauggacaaaca

SEQ ID NO: 1465157 - RNA, 19 nt, Homo sapiens
uggagacuauaguagauau

SEQ ID NO: 1465158 - RNA, 19 nt, Homo sapiens
uugcucuccuggcuucuua

SEQ ID NO: 1465159 - RNA, 19 nt, Homo sapiens
acaaaguggagucagaauu

SEQ ID NO: 1465160 - RNA, 19 nt, Homo sapiens
guccaucuucugcuuagua

SEQ ID NO: 1465161 - RNA, 19 nt, Homo sapiens
gguugggaauuuuaguuua

SEQ ID NO: 1465162 - RNA, 19 nt, Homo sapiens
gguguuucauuugguuuau

SEQ ID NO: 1465163 - RNA, 19 nt, Homo sapiens
cauauguguuggcauugug

SEQ ID NO: 1465164 - RNA, 19 nt, Homo sapiens
gacuggagacuauaguaga

SEQ ID NO: 1465165 - RNA, 19 nt, Homo sapiens
accggugucuuuggauuua

SEQ ID NO: 1465166 - RNA, 19 nt, Homo sapiens
cucuagcacucaauauuau

SEQ ID NO: 1465167 - RNA, 19 nt, Homo sapiens
guccucugacauuaaauua

SEQ ID NO: 1465168 - RNA, 19 nt, Homo sapiens
guuguugucaugacuguga

SEQ ID NO: 1465169 - RNA, 19 nt, Homo sapiens
cagaugauuguaagccaaa

SEQ ID NO: 1465170 - RNA, 19 nt, Homo sapiens
uguguucccucuugcacuu

SEQ ID NO: 1465171 - RNA, 19 nt, Homo sapiens
ucauauguguuggcauugu

SEQ ID NO: 1465172 - RNA, 19 nt, Homo sapiens
ucagaauauuggagcuaug

SEQ ID NO: 1465173 - RNA, 19 nt, Homo sapiens
aagcggaggccgaagaguu

SEQ ID NO: 1465174 - RNA, 19 nt, Homo sapiens
aagcaacgaacuucacaga

SEQ ID NO: 1465175 - RNA, 19 nt, Homo sapiens
uucaaaguccuucaaagaa

SEQ ID NO: 1465176 - RNA, 19 nt, Homo sapiens
ggagacuauaguagauauu

SEQ ID NO: 1465177 - RNA, 19 nt, Homo sapiens
ggcuaauaccggugucuuu

SEQ ID NO: 1465178 - RNA, 19 nt, Homo sapiens
gaaaagaaugcagaauguu

SEQ ID NO: 1465179 - RNA, 19 nt, Homo sapiens
auaccggugucuuuggauu

SEQ ID NO: 1465180 - RNA, 19 nt, Homo sapiens
agaguugaguccguugcua

SEQ ID NO: 1465181 - RNA, 19 nt, Homo sapiens
cuuggacucuuugcauuug

SEQ ID NO: 1465182 - RNA, 19 nt, Homo sapiens
cagcuguaacaucuuauga

SEQ ID NO: 1465183 - RNA, 19 nt, Homo sapiens
aaaguggagucagaauuac

SEQ ID NO: 1465184 - RNA, 19 nt, Homo sapiens
gcuuauguuauggcuaaua

SEQ ID NO: 1465185 - RNA, 19 nt, Homo sapiens
gaaggaaagcuaaagauua

SEQ ID NO: 1465186 - RNA, 19 nt, Homo sapiens
gaaacuugguguaagaaua

SEQ ID NO: 1465187 - RNA, 19 nt, Homo sapiens
gcagauaguuugcauuuca

SEQ ID NO: 1465188 - RNA, 19 nt, Homo sapiens
gaucaucucuuuguauuug

SEQ ID NO: 1465189 - RNA, 19 nt, Homo sapiens
caacaaagaugugccuuau

SEQ ID NO: 1465190 - RNA, 19 nt, Homo sapiens
gaaaagagacuuaauggua

SEQ ID NO: 1465191 - RNA, 19 nt, Homo sapiens
gcagauuggccauuucuua

SEQ ID NO: 1465192 - RNA, 19 nt, Homo sapiens
gcagcuaucucaagucguu

SEQ ID NO: 1465193 - RNA, 19 nt, Homo sapiens
gaaggacaaguacaaguua

SEQ ID NO: 1465194 - RNA, 19 nt, Homo sapiens
ugauguaccuccaaaguuu

SEQ ID NO: 1465195 - RNA, 19 nt, Homo sapiens
guaaagauuuguugaacug

SEQ ID NO: 1465196 - RNA, 19 nt, Homo sapiens
gaaagcaaacacacaaauu

SEQ ID NO: 1465197 - RNA, 19 nt, Homo sapiens
gaagaaagcaaacacacaa

SEQ ID NO: 1465198 - RNA, 19 nt, Homo sapiens
caacaaagacaguuucaga

SEQ ID NO: 1465199 - RNA, 19 nt, Homo sapiens
gcagagaauuuccgaaugg

SEQ ID NO: 1465200 - RNA, 19 nt, Homo sapiens
uaagucagaugaaugagaa

SEQ ID NO: 1465201 - RNA, 19 nt, Homo sapiens
gaaagcagauaguuugcau

SEQ ID NO: 1465202 - RNA, 19 nt, Homo sapiens
ugacaggacugggcaaauu

SEQ ID NO: 1465203 - RNA, 19 nt, Homo sapiens
gaucauacacaauagguuu

SEQ ID NO: 1465204 - RNA, 19 nt, Homo sapiens
gaagucuauuuaccagaua

SEQ ID NO: 1465205 - RNA, 19 nt, Homo sapiens
gagaggcacugaguaaaga

SEQ ID NO: 1465206 - RNA, 19 nt, Homo sapiens
gaucugauacaaccauuaa

SEQ ID NO: 1465207 - RNA, 19 nt, Homo sapiens
gguaauaaauggguuggaa

SEQ ID NO: 1465208 - RNA, 19 nt, Homo sapiens
cagcuggaguggauguuua

SEQ ID NO: 1465209 - RNA, 19 nt, Homo sapiens
ggauuacuaugggaagaua

SEQ ID NO: 1465210 - RNA, 19 nt, Homo sapiens
gauagggaaugcucgagaa

SEQ ID NO: 1465211 - RNA, 19 nt, Homo sapiens
gcucuugauuuaaauguga

SEQ ID NO: 1465212 - RNA, 19 nt, Homo sapiens
gaauggaagaagucuauuu

SEQ ID NO: 1465213 - RNA, 19 nt, Homo sapiens
ucucaagccuguaauccua

SEQ ID NO: 1465214 - RNA, 19 nt, Homo sapiens
caaccagggugacuucuag

SEQ ID NO: 1465215 - RNA, 19 nt, Homo sapiens
ccucagaacugggcuuuga

SEQ ID NO: 1465216 - RNA, 19 nt, Homo sapiens
ggacugggcaaauuaacaa

SEQ ID NO: 1465217 - RNA, 19 nt, Homo sapiens
gggcuuugaugcugcaauu

SEQ ID NO: 1465218 - RNA, 19 nt, Homo sapiens
gauggacaccuuucauauu

SEQ ID NO: 1465219 - RNA, 19 nt, Homo sapiens
ggauggaaauagccuugaa

SEQ ID NO: 1465220 - RNA, 19 nt, Homo sapiens
gacaggacugggcaaauua

SEQ ID NO: 1465221 - RNA, 19 nt, Homo sapiens
gacaggagguaacauugga

SEQ ID NO: 1465222 - RNA, 19 nt, Homo sapiens
ucauauaacugcuggaucu

SEQ ID NO: 1465223 - RNA, 19 nt, Homo sapiens
ggucaaauuucucaguaca

SEQ ID NO: 1465224 - RNA, 19 nt, Homo sapiens
gagaaaugcauccucuuga

SEQ ID NO: 1465225 - RNA, 19 nt, Homo sapiens
auggacaccuuucauauuu

SEQ ID NO: 1465226 - RNA, 19 nt, Homo sapiens
ggaagaagucuauuuacca

SEQ ID NO: 1465227 - RNA, 19 nt, Homo sapiens
aaagagugguauugaauuc

SEQ ID NO: 1465228 - RNA, 19 nt, Homo sapiens
cacauacugucaaguugua

SEQ ID NO: 1465229 - RNA, 19 nt, Homo sapiens
gaaagaaagaaacaucaca

SEQ ID NO: 1465230 - RNA, 19 nt, Homo sapiens
caaagagugguauugaauu

SEQ ID NO: 1465231 - RNA, 19 nt, Homo sapiens
gauaggagaccagcgguuu

SEQ ID NO: 1465232 - RNA, 19 nt, Homo sapiens
uuucggagcuuguguaaca

SEQ ID NO: 1465233 - RNA, 19 nt, Homo sapiens
aaacugaaacuugguguaa

SEQ ID NO: 1465234 - RNA, 19 nt, Homo sapiens
gaugacaggagguaacauu

SEQ ID NO: 1465235 - RNA, 19 nt, Homo sapiens
gcauuccaguccaugauga

SEQ ID NO: 1465236 - RNA, 19 nt, Homo sapiens
guggucaaauuucucagua

SEQ ID NO: 1465237 - RNA, 19 nt, Homo sapiens
cauccuguguggucaaauu

SEQ ID NO: 1465238 - RNA, 19 nt, Homo sapiens
acacaaauuugacuaaagg

SEQ ID NO: 1465239 - RNA, 19 nt, Homo sapiens
uauaacaccuuggcagcua

SEQ ID NO: 1465240 - RNA, 19 nt, Homo sapiens
cacuggcacugauuauaua

SEQ ID NO: 1465241 - RNA, 19 nt, Homo sapiens
guaauccaguggcagagaa

SEQ ID NO: 1465242 - RNA, 19 nt, Homo sapiens
guacucaacccucgcagaa

SEQ ID NO: 1465243 - RNA, 19 nt, Homo sapiens
agagugaaauuccaucuca

SEQ ID NO: 1465244 - RNA, 19 nt, Homo sapiens
cagaacagcuccgugaauc

SEQ ID NO: 1465245 - RNA, 19 nt, Homo sapiens
ggauggacaccuuucauau

SEQ ID NO: 1465246 - RNA, 19 nt, Homo sapiens
aacagaagcaggaguauuu

SEQ ID NO: 1465247 - RNA, 19 nt, Homo sapiens
cuacugauguaccuccaaa

SEQ ID NO: 1465248 - RNA, 19 nt, Homo sapiens
aaagagacgguaauaaaug

SEQ ID NO: 1465249 - RNA, 19 nt, Homo sapiens
uagaggcaauccagaaaga

SEQ ID NO: 1465250 - RNA, 19 nt, Homo sapiens
uaacugcuggaucuaauaa

SEQ ID NO: 1465251 - RNA, 19 nt, Homo sapiens
gaagacacuggcacugauu

SEQ ID NO: 1465252 - RNA, 19 nt, Homo sapiens
ggacaaguacaaguuagaa

SEQ ID NO: 1465253 - RNA, 19 nt, Homo sapiens
gaguaaagauuuguugaac

SEQ ID NO: 1465254 - RNA, 19 nt, Homo sapiens
gaacacaugagaaaugcau

SEQ ID NO: 1465255 - RNA, 19 nt, Homo sapiens
guaaacaucacuuguaggu

SEQ ID NO: 1465256 - RNA, 19 nt, Homo sapiens
gugauacagugauaaguca

SEQ ID NO: 1465257 - RNA, 19 nt, Homo sapiens
gaacagcuccgugaaucau

SEQ ID NO: 1465258 - RNA, 19 nt, Homo sapiens
gcacauacugucaaguugu

SEQ ID NO: 1465259 - RNA, 19 nt, Homo sapiens
uugcauaggguauuugaua

SEQ ID NO: 1465260 - RNA, 19 nt, Homo sapiens
aagcagauaguuugcauuu

SEQ ID NO: 1465261 - RNA, 19 nt, Homo sapiens
ggaaugcucgagaaacaga

SEQ ID NO: 1465262 - RNA, 19 nt, Homo sapiens
ggaaagcuaaagauuaaag

SEQ ID NO: 1465263 - RNA, 19 nt, Homo sapiens
caucacaagggaaagauuu

SEQ ID NO: 1465264 - RNA, 19 nt, Homo sapiens
agaaacagaagcaggagua

SEQ ID NO: 1465265 - RNA, 19 nt, Homo sapiens
gguuugacuuccuugauug

SEQ ID NO: 1465266 - RNA, 19 nt, Homo sapiens
ggagguauuggaauuauag

SEQ ID NO: 1465267 - RNA, 19 nt, Homo sapiens
cgacaagagugaaauucca

SEQ ID NO: 1465268 - RNA, 19 nt, Homo sapiens
gagacuuaaugguaugaug

SEQ ID NO: 1465269 - RNA, 19 nt, Homo sapiens
gaggcaauccagaaagaaa

SEQ ID NO: 1465270 - RNA, 19 nt, Homo sapiens
acaaagaugugccuuaucc

SEQ ID NO: 1465271 - RNA, 19 nt, Homo sapiens
ugauaagucagaugaauga

SEQ ID NO: 1465272 - RNA, 19 nt, Homo sapiens
gcagaacagcuccgugaau

SEQ ID NO: 1465273 - RNA, 19 nt, Homo sapiens
gcuuugaugcugcaauuaa

SEQ ID NO: 1465274 - RNA, 19 nt, Homo sapiens
cuauagguaugccugguuu

SEQ ID NO: 1465275 - RNA, 19 nt, Homo sapiens
aaagguagacccacaacuu

SEQ ID NO: 1465276 - RNA, 19 nt, Homo sapiens
ggcugaggcuggagaauca

SEQ ID NO: 1465277 - RNA, 19 nt, Homo sapiens
aggaucaucucuuuguauu

SEQ ID NO: 1465278 - RNA, 19 nt, Homo sapiens
aaagagacuuaaugguaug

SEQ ID NO: 1465279 - RNA, 19 nt, Homo sapiens
acagaaaucuugugaaacc

SEQ ID NO: 1465280 - RNA, 19 nt, Homo sapiens
uaaaugucaucaaggcaau

SEQ ID NO: 1465281 - RNA, 19 nt, Homo sapiens
gagguaacauuggaaagca

SEQ ID NO: 1465282 - RNA, 19 nt, Homo sapiens
guaauaaauggguuggaaa

SEQ ID NO: 1465283 - RNA, 19 nt, Homo sapiens
guuguagaaugaaugaaga

SEQ ID NO: 1465284 - RNA, 19 nt, Homo sapiens
ugaaggacaaguacaaguu

SEQ ID NO: 1465285 - RNA, 19 nt, Homo sapiens
gaacaaagcagaugagagu

SEQ ID NO: 1465286 - RNA, 19 nt, Homo sapiens
aagcaaagcugaaagagaa

SEQ ID NO: 1465287 - RNA, 19 nt, Homo sapiens
ccaaggaucuagccaagaa

SEQ ID NO: 1465288 - RNA, 19 nt, Homo sapiens
agaaagaacuggaggaaau

SEQ ID NO: 1465289 - RNA, 19 nt, Homo sapiens
gaacagugguaucuagaca

SEQ ID NO: 1465290 - RNA, 19 nt, Homo sapiens
gcagaacagugguaucuag

SEQ ID NO: 1465291 - RNA, 19 nt, Homo sapiens
aaagaagucucaagcaaug

SEQ ID NO: 1465292 - RNA, 19 nt, Homo sapiens
gcagcuaacuuggguuuga

SEQ ID NO: 1465293 - RNA, 19 nt, Homo sapiens
gaaagaagucucaagcaau

SEQ ID NO: 1465294 - RNA, 19 nt, Homo sapiens
ggaggaagacuuugugaga

SEQ ID NO: 1465295 - RNA, 19 nt, Homo sapiens
caaagcagaugagaguauu

SEQ ID NO: 1465296 - RNA, 19 nt, Homo sapiens
ggaagcugcucgacagaga

SEQ ID NO: 1465297 - RNA, 19 nt, Homo sapiens
ggagauggauucuacuucu

SEQ ID NO: 1465298 - RNA, 19 nt, Homo sapiens
gaacugcuccucucuucuu

SEQ ID NO: 1465299 - RNA, 19 nt, Homo sapiens
gaggaagacuuugugagaa

SEQ ID NO: 1465300 - RNA, 19 nt, Homo sapiens
gggcucaccugccuccuuu

SEQ ID NO: 1465301 - RNA, 19 nt, Homo sapiens
agaaagaagucucaagcaa

SEQ ID NO: 1465302 - RNA, 19 nt, Homo sapiens
guuagaggauggacaaaug

SEQ ID NO: 1465303 - RNA, 19 nt, Homo sapiens
ggagcugucucaucaguca

SEQ ID NO: 1465304 - RNA, 19 nt, Homo sapiens
gaaaugaagcagcgaauac

SEQ ID NO: 1465305 - RNA, 19 nt, Homo sapiens
ggaaaugaagcagcgaaua

SEQ ID NO: 1465306 - RNA, 19 nt, Homo sapiens
gaggaaguguucaaagcaa

SEQ ID NO: 1465307 - RNA, 19 nt, Homo sapiens
uggaggagcugucucauca

SEQ ID NO: 1465308 - RNA, 19 nt, Homo sapiens
aaugaagaguagcagauua

SEQ ID NO: 1465309 - RNA, 19 nt, Homo sapiens
aaagagaaccggaacaaug

SEQ ID NO: 1465310 - RNA, 19 nt, Homo sapiens
aggaggaccuggagaguuu

SEQ ID NO: 1465311 - RNA, 19 nt, Homo sapiens
ccagaaggauucccaaguc

SEQ ID NO: 1465312 - RNA, 19 nt, Homo sapiens
gaacuuacaggaacugaag

SEQ ID NO: 1465313 - RNA, 19 nt, Homo sapiens
gaaaaucucguaucacuug

SEQ ID NO: 1465314 - RNA, 19 nt, Homo sapiens
ugaacaaccuucccuccaa

SEQ ID NO: 1465315 - RNA, 19 nt, Homo sapiens
uacaggaacugaagcagaa

SEQ ID NO: 1465316 - RNA, 19 nt, Homo sapiens
gagcauuuaccagaacuua

SEQ ID NO: 1465317 - RNA, 19 nt, Homo sapiens
ccuaucgccuccucuagua

SEQ ID NO: 1465318 - RNA, 19 nt, Homo sapiens
ccaaggagucguucucuga

SEQ ID NO: 1465319 - RNA, 19 nt, Homo sapiens
agaaggaucucuagaacag

SEQ ID NO: 1465320 - RNA, 19 nt, Homo sapiens
gcgaaagaauauaagaaag

SEQ ID NO: 1465321 - RNA, 19 nt, Homo sapiens
ucucaucagucaccagaaa

SEQ ID NO: 1465322 - RNA, 19 nt, Homo sapiens
aaacaaggcccuaucucuu

SEQ ID NO: 1465323 - RNA, 19 nt, Homo sapiens
gagcgaaagaauauaagaa

SEQ ID NO: 1465324 - RNA, 19 nt, Homo sapiens
uacaaggccuuccagagaa

SEQ ID NO: 1465325 - RNA, 19 nt, Homo sapiens
ccuguaaucccaacacuuu

SEQ ID NO: 1465326 - RNA, 19 nt, Homo sapiens
gaggagcugucucaucagu

SEQ ID NO: 1465327 - RNA, 19 nt, Homo sapiens
gaaagaacuggaggaaaug

SEQ ID NO: 1465328 - RNA, 19 nt, Homo sapiens
gaacaaugaccguaaaaga

SEQ ID NO: 1465329 - RNA, 19 nt, Homo sapiens
gagaagagcagccaaaaga

SEQ ID NO: 1465330 - RNA, 19 nt, Homo sapiens
uuacaaggccuuccagaga

SEQ ID NO: 1465331 - RNA, 19 nt, Homo sapiens
aggaagacuuugugagaaa

SEQ ID NO: 1465332 - RNA, 19 nt, Homo sapiens
gaaaaccucucugaagaug

SEQ ID NO: 1465333 - RNA, 19 nt, Homo sapiens
ggacaaaugaagaguagca

SEQ ID NO: 1465334 - RNA, 19 nt, Homo sapiens
agucauggcuacuguuaga

SEQ ID NO: 1465335 - RNA, 19 nt, Homo sapiens
ggcccuaucucuuugaaca

SEQ ID NO: 1465336 - RNA, 19 nt, Homo sapiens
ucacagaugccaccaggaa

SEQ ID NO: 1465337 - RNA, 19 nt, Homo sapiens
ugacucaacugggagcauu

SEQ ID NO: 1465338 - RNA, 19 nt, Homo sapiens
gaggauggacaaaugaaga

SEQ ID NO: 1465339 - RNA, 19 nt, Homo sapiens
gagcaggguuuagaaggau

SEQ ID NO: 1465340 - RNA, 19 nt, Homo sapiens
guaaaagagcgaaagaaua

SEQ ID NO: 1465341 - RNA, 19 nt, Homo sapiens
gaaagagaaccggaacaau

SEQ ID NO: 1465342 - RNA, 19 nt, Homo sapiens
caagcaauguccaaaucug

SEQ ID NO: 1465343 - RNA, 19 nt, Homo sapiens
ggagauacacagaaagaag

SEQ ID NO: 1465344 - RNA, 19 nt, Homo sapiens
acaaggcccuaucucuuug

SEQ ID NO: 1465345 - RNA, 19 nt, Homo sapiens
aagagaaccggaacaauga

SEQ ID NO: 1465346 - RNA, 19 nt, Homo sapiens
ggauucuacuucugacuca

SEQ ID NO: 1465347 - RNA, 19 nt, Homo sapiens
gcaauguccaaaucuguga

SEQ ID NO: 1465348 - RNA, 19 nt, Homo sapiens
gcauuuaccagaacuuaca

SEQ ID NO: 1465349 - RNA, 19 nt, Homo sapiens
gaagaguagcagauuaaca

SEQ ID NO: 1465350 - RNA, 19 nt, Homo sapiens
caaaugaagaguagcagau

SEQ ID NO: 1465351 - RNA, 19 nt, Homo sapiens
gauggacaaaugaagagua

SEQ ID NO: 1465352 - RNA, 19 nt, Homo sapiens
ugaacaaguugccaaggau

SEQ ID NO: 1465353 - RNA, 19 nt, Homo sapiens
caaacaaggcccuaucucu

SEQ ID NO: 1465354 - RNA, 19 nt, Homo sapiens
ucaaagcaaagcugaaaga

SEQ ID NO: 1465355 - RNA, 19 nt, Homo sapiens
ugagucauggcuacuguua

SEQ ID NO: 1465356 - RNA, 19 nt, Homo sapiens
caagaaagaagcagaacag

SEQ ID NO: 1465357 - RNA, 19 nt, Homo sapiens
gagauggauucuacuucug

SEQ ID NO: 1465358 - RNA, 19 nt, Homo sapiens
uaagaaagaacuggaggaa

SEQ ID NO: 1465359 - RNA, 19 nt, Homo sapiens
ggcuggagauacacagaaa

SEQ ID NO: 1465360 - RNA, 19 nt, Homo sapiens
gcacacuaacuucagauuc

SEQ ID NO: 1465361 - RNA, 19 nt, Homo sapiens
cguaucacuugcuuaauca

SEQ ID NO: 1465362 - RNA, 19 nt, Homo sapiens
ggaucuagccaagaaagaa

SEQ ID NO: 1465363 - RNA, 19 nt, Homo sapiens
gagauacacagaaagaagu

SEQ ID NO: 1465364 - RNA, 19 nt, Homo sapiens
gaaggccaccagaaggauu

SEQ ID NO: 1465365 - RNA, 19 nt, Homo sapiens
caaccuucccuccaacauu

SEQ ID NO: 1465366 - RNA, 19 nt, Homo sapiens
aaacucagcaucagagauc

SEQ ID NO: 1465367 - RNA, 19 nt, Homo sapiens
aacaaggcccuaucucuuu

SEQ ID NO: 1465368 - RNA, 19 nt, Homo sapiens
ccggaacaaugaccguaaa

SEQ ID NO: 1465369 - RNA, 19 nt, Homo sapiens
ggaggaaguguucaaagca

SEQ ID NO: 1465370 - RNA, 19 nt, Homo sapiens
aaaccucucugaagaugag

SEQ ID NO: 1465371 - RNA, 19 nt, Homo sapiens
ucguaucacuugcuuaauc

SEQ ID NO: 1465372 - RNA, 19 nt, Homo sapiens
ucucguaucacuugcuuaa

SEQ ID NO: 1465373 - RNA, 19 nt, Homo sapiens
aggcugggcuggaggaaga

SEQ ID NO: 1465374 - RNA, 19 nt, Homo sapiens
ugaaagagaaccggaacaa

SEQ ID NO: 1465375 - RNA, 19 nt, Homo sapiens
gagaaggaggagcagcuaa

SEQ ID NO: 1465376 - RNA, 19 nt, Homo sapiens
ggagaaggaggagcagcua

SEQ ID NO: 1465377 - RNA, 19 nt, Homo sapiens
ccucggccauuccgcauga

SEQ ID NO: 1465378 - RNA, 19 nt, Homo sapiens
gcagaugagaguauucagu

SEQ ID NO: 1465379 - RNA, 19 nt, Homo sapiens
ccagagaagagcagccaaa

SEQ ID NO: 1465380 - RNA, 19 nt, Homo sapiens
gaggagauggauucuacuu

SEQ ID NO: 1465381 - RNA, 19 nt, Homo sapiens
aaaauucgcauccaaauga

SEQ ID NO: 1465382 - RNA, 19 nt, Homo sapiens
agagcaggguuuagaagga

SEQ ID NO: 1465383 - RNA, 19 nt, Homo sapiens
cugcuccucucuucuuuga

SEQ ID NO: 1465384 - RNA, 19 nt, Homo sapiens
cagaggaggagauggauuc

SEQ ID NO: 1465385 - RNA, 19 nt, Homo sapiens
gaagagagaucuacuggaa

SEQ ID NO: 1465386 - RNA, 19 nt, Homo sapiens
gaaauucucuucagcauca

SEQ ID NO: 1465387 - RNA, 19 nt, Homo sapiens
gacaacaacucaggaauuu

SEQ ID NO: 1465388 - RNA, 19 nt, Homo sapiens
caaggaagaugccacaaug

SEQ ID NO: 1465389 - RNA, 19 nt, Homo sapiens
guggagaugugcauauaua

SEQ ID NO: 1465390 - RNA, 19 nt, Homo sapiens
ugagagaacugauggaaga

SEQ ID NO: 1465391 - RNA, 19 nt, Homo sapiens
ucugaaggcugaaaguuua

SEQ ID NO: 1465392 - RNA, 19 nt, Homo sapiens
guagagcacuguaaagaau

SEQ ID NO: 1465393 - RNA, 19 nt, Homo sapiens
agacauaccugcagcuuug

SEQ ID NO: 1465394 - RNA, 19 nt, Homo sapiens
ggaaauugaugcagcuugu

SEQ ID NO: 1465395 - RNA, 19 nt, Homo sapiens
gaauuaacccagaaugaaa

SEQ ID NO: 1465396 - RNA, 19 nt, Homo sapiens
caaagugucuaagaacgua

SEQ ID NO: 1465397 - RNA, 19 nt, Homo sapiens
caacaacucaggaauuuga

SEQ ID NO: 1465398 - RNA, 19 nt, Homo sapiens
gcacagaaagaaugauauu

SEQ ID NO: 1465399 - RNA, 19 nt, Homo sapiens
ugugaucacuucagucaua

SEQ ID NO: 1465400 - RNA, 19 nt, Homo sapiens
gaagaugccacaaugaaug

SEQ ID NO: 1465401 - RNA, 19 nt, Homo sapiens
gagaacugauggaagauau

SEQ ID NO: 1465402 - RNA, 19 nt, Homo sapiens
gaacugaaagagagagaaa

SEQ ID NO: 1465403 - RNA, 19 nt, Homo sapiens
gcucaaggaucaacuucuu

SEQ ID NO: 1465404 - RNA, 19 nt, Homo sapiens
ggaauuaacccagaaugaa

SEQ ID NO: 1465405 - RNA, 19 nt, Homo sapiens
uauaaaugcucaggacuuu

SEQ ID NO: 1465406 - RNA, 19 nt, Homo sapiens
ugaaauacaucgugagaag

SEQ ID NO: 1465407 - RNA, 19 nt, Homo sapiens
ggacucaguggagaaauua

SEQ ID NO: 1465408 - RNA, 19 nt, Homo sapiens
gguaaaccaauccaaauaa

SEQ ID NO: 1465409 - RNA, 19 nt, Homo sapiens
gauugcagcucaaggauca

SEQ ID NO: 1465410 - RNA, 19 nt, Homo sapiens
aaugauaucugaacuguag

SEQ ID NO: 1465411 - RNA, 19 nt, Homo sapiens
gaaacugagccuacuagaa

SEQ ID NO: 1465412 - RNA, 19 nt, Homo sapiens
cuaagaacguauucccuuu

SEQ ID NO: 1465413 - RNA, 19 nt, Homo sapiens
agagagaucuacuggaaga

SEQ ID NO: 1465414 - RNA, 19 nt, Homo sapiens
gcacuguaaagaauucaua

SEQ ID NO: 1465415 - RNA, 19 nt, Homo sapiens
gcagcuaauuuauuugcaa

SEQ ID NO: 1465416 - RNA, 19 nt, Homo sapiens
gaaagcaagacuaaacuuc

SEQ ID NO: 1465417 - RNA, 19 nt, Homo sapiens
guggucagcuggagaaguu

SEQ ID NO: 1465418 - RNA, 19 nt, Homo sapiens
gaacuguagagcacuguaa

SEQ ID NO: 1465419 - RNA, 19 nt, Homo sapiens
gcugaaaguuuagaagaga

SEQ ID NO: 1465420 - RNA, 19 nt, Homo sapiens
uaagaacguauucccuuua

SEQ ID NO: 1465421 - RNA, 19 nt, Homo sapiens
ccaaauauccuacugugau

SEQ ID NO: 1465422 - RNA, 19 nt, Homo sapiens
gaguuucccuugaggcaaa

SEQ ID NO: 1465423 - RNA, 19 nt, Homo sapiens
aaacugagccuacuagaag

SEQ ID NO: 1465424 - RNA, 19 nt, Homo sapiens
gcagaaagcaagacuaaac

SEQ ID NO: 1465425 - RNA, 19 nt, Homo sapiens
guccugauauacauuauga

SEQ ID NO: 1465426 - RNA, 19 nt, Homo sapiens
ugaaugaugugcagcuaau

SEQ ID NO: 1465427 - RNA, 19 nt, Homo sapiens
gcaauuuggcccagauuau

SEQ ID NO: 1465428 - RNA, 19 nt, Homo sapiens
ugacccacaucgcugguua

SEQ ID NO: 1465429 - RNA, 19 nt, Homo sapiens
aaacaaggaaucugaguug

SEQ ID NO: 1465430 - RNA, 19 nt, Homo sapiens
caaauauccuacugugauc

SEQ ID NO: 1465431 - RNA, 19 nt, Homo sapiens
acaguccacuuuauaaaug

SEQ ID NO: 1465432 - RNA, 19 nt, Homo sapiens
gaagaggagcacuuaagga

SEQ ID NO: 1465433 - RNA, 19 nt, Homo sapiens
gaacugauggaagauauuc

SEQ ID NO: 1465434 - RNA, 19 nt, Homo sapiens
ucaaagacuucagagauuc

SEQ ID NO: 1465435 - RNA, 19 nt, Homo sapiens
aggagcagcuucuggauga

SEQ ID NO: 1465436 - RNA, 19 nt, Homo sapiens
uagcagaaagcaagacuaa

SEQ ID NO: 1465437 - RNA, 19 nt, Homo sapiens
gagcauuuauauacaacug

SEQ ID NO: 1465438 - RNA, 19 nt, Homo sapiens
ggaagaugccacaaugaau

SEQ ID NO: 1465439 - RNA, 19 nt, Homo sapiens
uggaagagacccaaagaaa

SEQ ID NO: 1465440 - RNA, 19 nt, Homo sapiens
gauggaagaggccagauug

SEQ ID NO: 1465441 - RNA, 19 nt, Homo sapiens
gagaugugcauauauaaca

SEQ ID NO: 1465442 - RNA, 19 nt, Homo sapiens
caacuuauacuagcacaga

SEQ ID NO: 1465443 - RNA, 19 nt, Homo sapiens
gaugugcagcuaauuuauu

SEQ ID NO: 1465444 - RNA, 19 nt, Homo sapiens
gaacuguugcuccagauuc

SEQ ID NO: 1465445 - RNA, 19 nt, Homo sapiens
ucaucaaagugucuaagaa

SEQ ID NO: 1465446 - RNA, 19 nt, Homo sapiens
cgucuuugguuuacuguga

SEQ ID NO: 1465447 - RNA, 19 nt, Homo sapiens
gaacucauuuaccaaaaga

SEQ ID NO: 1465448 - RNA, 19 nt, Homo sapiens
gaaguugaaaucacagugu

SEQ ID NO: 1465449 - RNA, 19 nt, Homo sapiens
ucagggagcauuuauauac

SEQ ID NO: 1465450 - RNA, 19 nt, Homo sapiens
gcaggaccguguaauugca

SEQ ID NO: 1465451 - RNA, 19 nt, Homo sapiens
gcagacaacaacucaggaa

SEQ ID NO: 1465452 - RNA, 19 nt, Homo sapiens
gaaauugaugcagcuugua

SEQ ID NO: 1465453 - RNA, 19 nt, Homo sapiens
uuagacaguccacuuuaua

SEQ ID NO: 1465454 - RNA, 19 nt, Homo sapiens
guuauaacauguggagaug

SEQ ID NO: 1465455 - RNA, 19 nt, Homo sapiens
uagcacagaaagaaugaua

SEQ ID NO: 1465456 - RNA, 19 nt, Homo sapiens
gaaggaucaacuagaagaa

SEQ ID NO: 1465457 - RNA, 19 nt, Homo sapiens
uucaaagacuucagagauu

SEQ ID NO: 1465458 - RNA, 19 nt, Homo sapiens
gaaauacaucgugagaaga

SEQ ID NO: 1465459 - RNA, 19 nt, Homo sapiens
agacaacaacucaggaauu

SEQ ID NO: 1465460 - RNA, 19 nt, Homo sapiens
cuucuaccaucccaacuuu

SEQ ID NO: 1465461 - RNA, 19 nt, Homo sapiens
gacaguccacuuuauaaau

SEQ ID NO: 1465462 - RNA, 19 nt, Homo sapiens
aaugcuuucucccuaauaa

SEQ ID NO: 1465463 - RNA, 19 nt, Homo sapiens
ggaagagacccaaagaaaa

SEQ ID NO: 1465464 - RNA, 19 nt, Homo sapiens
cagugucucuuucaacaga

SEQ ID NO: 1465465 - RNA, 19 nt, Homo sapiens
gcucaggacuuuuauaucu

SEQ ID NO: 1465466 - RNA, 19 nt, Homo sapiens
cauuagacaguccacuuua

SEQ ID NO: 1465467 - RNA, 19 nt, Homo sapiens
agaggaauaugggagcuaa

SEQ ID NO: 1465468 - RNA, 19 nt, Homo sapiens
gauaggaaaggaaauugau

SEQ ID NO: 1465469 - RNA, 19 nt, Homo sapiens
aagagaagaauauggcuaa

SEQ ID NO: 1465470 - RNA, 19 nt, Homo sapiens
cagaggaauuaacccagaa

SEQ ID NO: 1465471 - RNA, 19 nt, Homo sapiens
ugccagcacuuuagauuca

SEQ ID NO: 1465472 - RNA, 19 nt, Homo sapiens
agauucagcuucaaacaag

SEQ ID NO: 1465473 - RNA, 19 nt, Homo sapiens
uuagaucacucauccucuu

SEQ ID NO: 1465474 - RNA, 19 nt, Homo sapiens
gaauuugacugaaaacaag

SEQ ID NO: 1465475 - RNA, 19 nt, Homo sapiens
gaacguauucccuuuacac

SEQ ID NO: 1465476 - RNA, 19 nt, Homo sapiens
uaccguagcugaaaauuau

SEQ ID NO: 1465477 - RNA, 19 nt, Homo sapiens
uagacaguccacuuuauaa

SEQ ID NO: 1465478 - RNA, 19 nt, Homo sapiens
agagugaggcugagaauca

SEQ ID NO: 1465479 - RNA, 19 nt, Homo sapiens
cacaaugaauggaacaagu

SEQ ID NO: 1465480 - RNA, 19 nt, Homo sapiens
gaagagacccaaagaaaag

SEQ ID NO: 1465481 - RNA, 19 nt, Homo sapiens
uggagaaguugaaaucaca

SEQ ID NO: 1465482 - RNA, 19 nt, Homo sapiens
ugaaggaucaacuagaaga

SEQ ID NO: 1465483 - RNA, 19 nt, Homo sapiens
auacaggguucgcagaaau

SEQ ID NO: 1465484 - RNA, 19 nt, Homo sapiens
cagacugacagaggaauua

SEQ ID NO: 1465485 - RNA, 19 nt, Homo sapiens
gaugagaggcggaauauug

SEQ ID NO: 1465486 - RNA, 19 nt, Homo sapiens
ggccuaaacugaaaggaaa

SEQ ID NO: 1465487 - RNA, 19 nt, Homo sapiens
cauaagagcaggugaggua

SEQ ID NO: 1465488 - RNA, 19 nt, Homo sapiens
gcagcaagaucacacacuu

SEQ ID NO: 1465489 - RNA, 19 nt, Homo sapiens
caggugcauuuguaauuua

SEQ ID NO: 1465490 - RNA, 19 nt, Homo sapiens
gguguuaccugcauucaca

SEQ ID NO: 1465491 - RNA, 19 nt, Homo sapiens
ucaggugcauuuguaauuu

SEQ ID NO: 1465492 - RNA, 19 nt, Homo sapiens
ucacacacuuugagagguu

SEQ ID NO: 1465493 - RNA, 19 nt, Homo sapiens
ggccgaagcuggcagucuu

SEQ ID NO: 1465494 - RNA, 19 nt, Homo sapiens
gaugaugagaggcggaaua

SEQ ID NO: 1465495 - RNA, 19 nt, Homo sapiens
gcagaagacuggaauuccu

SEQ ID NO: 1465496 - RNA, 19 nt, Homo sapiens
gauggaacuguacgagaua

SEQ ID NO: 1465497 - RNA, 19 nt, Homo sapiens
gccaagacguccgacugua

SEQ ID NO: 1465498 - RNA, 19 nt, Homo sapiens
ugauggaacuguacgagau

SEQ ID NO: 1465499 - RNA, 19 nt, Homo sapiens
gacccuccguuccauaaga

SEQ ID NO: 1465500 - RNA, 19 nt, Homo sapiens
gaagcuggcagucuuugau

SEQ ID NO: 1465501 - RNA, 19 nt, Homo sapiens
cagaauggaaugaaucuuc

SEQ ID NO: 1465502 - RNA, 19 nt, Homo sapiens
gaucuucuuugaugaugag

SEQ ID NO: 1465503 - RNA, 19 nt, Homo sapiens
ggagcucuuugaccucuuc

SEQ ID NO: 1465504 - RNA, 19 nt, Homo sapiens
gcaagaucacacacuuuga

SEQ ID NO: 1465505 - RNA, 19 nt, Homo sapiens
cauuugaggccuaaacuga

SEQ ID NO: 1465506 - RNA, 19 nt, Homo sapiens
gucaaggguuagagacauu

SEQ ID NO: 1465507 - RNA, 19 nt, Homo sapiens
uaacagcagcucccgaauc

SEQ ID NO: 1465508 - RNA, 19 nt, Homo sapiens
gaauuccuuucucccagau

SEQ ID NO: 1465509 - RNA, 19 nt, Homo sapiens
uuugaggccuaaacugaaa

SEQ ID NO: 1465510 - RNA, 19 nt, Homo sapiens
aaacugaaaggaaaucaag

SEQ ID NO: 1465511 - RNA, 19 nt, Homo sapiens
gagcccauuugaggccuaa

SEQ ID NO: 1465512 - RNA, 19 nt, Homo sapiens
caagaucacacacuuugag

SEQ ID NO: 1465513 - RNA, 19 nt, Homo sapiens
gcuggcagucuuugauuug

SEQ ID NO: 1465514 - RNA, 19 nt, Homo sapiens
cagcaagaucacacacuuu

SEQ ID NO: 1465515 - RNA, 19 nt, Homo sapiens
aaggacaagugagauagaa

SEQ ID NO: 1465516 - RNA, 19 nt, Homo sapiens
caaggacaagugagauaga

SEQ ID NO: 1465517 - RNA, 19 nt, Homo sapiens
gaugaucuucuuugaugau

SEQ ID NO: 1465518 - RNA, 19 nt, Homo sapiens
agaggugccugagguccua

SEQ ID NO: 1465519 - RNA, 19 nt, Homo sapiens
guagacccuccguuccaua

SEQ ID NO: 1465520 - RNA, 19 nt, Homo sapiens
aaaguucaucuguguguga

SEQ ID NO: 1465521 - RNA, 19 nt, Homo sapiens
aacucuaagucaaggguua

SEQ ID NO: 1465522 - RNA, 19 nt, Homo sapiens
gagaggcggaauauuguag

SEQ ID NO: 1465523 - RNA, 19 nt, Homo sapiens
uauuguagacgucagcaaa

SEQ ID NO: 1465524 - RNA, 19 nt, Homo sapiens
uccuuccucucgcagauua

SEQ ID NO: 1465525 - RNA, 19 nt, Homo sapiens
cagcagaagacuggaauuc

SEQ ID NO: 1465526 - RNA, 19 nt, Homo sapiens
ugagaggcggaauauugua

SEQ ID NO: 1465527 - RNA, 19 nt, Homo sapiens
agacuggaauuccuuucuc

SEQ ID NO: 1465528 - RNA, 19 nt, Homo sapiens
uagacccuccguuccauaa

SEQ ID NO: 1465529 - RNA, 19 nt, Homo sapiens
ggaaggggagaauuucgua

SEQ ID NO: 1465530 - RNA, 19 nt, Homo sapiens
gaagacuggaauuccuuuc

SEQ ID NO: 1465531 - RNA, 19 nt, Homo sapiens
cagaagacuggaauuccuu

SEQ ID NO: 1465532 - RNA, 19 nt, Homo sapiens
uuaaaguucaucugugugu

SEQ ID NO: 1465533 - RNA, 19 nt, Homo sapiens
gucagcaaacuggguguua

SEQ ID NO: 1465534 - RNA, 19 nt, Homo sapiens
ggccaagacguccgacugu

SEQ ID NO: 1465535 - RNA, 19 nt, Homo sapiens
acugaaaggaaaucaagaa

SEQ ID NO: 1465536 - RNA, 19 nt, Homo sapiens
gcagcagaagacuggaauu

SEQ ID NO: 1465537 - RNA, 19 nt, Homo sapiens
ucagcaaacuggguguuac

SEQ ID NO: 1465538 - RNA, 19 nt, Homo sapiens
uugagagguugcagcagaa

SEQ ID NO: 1465539 - RNA, 19 nt, Homo sapiens
ccaagacguccgacuguac

SEQ ID NO: 1465540 - RNA, 19 nt, Homo sapiens
ucuucaaacucuaagucaa

SEQ ID NO: 1465541 - RNA, 19 nt, Homo sapiens
uauccaggcagcaagauca

SEQ ID NO: 1465542 - RNA, 19 nt, Homo sapiens
caagaucucugguguauga

SEQ ID NO: 1465543 - RNA, 19 nt, Homo sapiens
gaaaucagcuuuggagaug

SEQ ID NO: 1465544 - RNA, 19 nt, Homo sapiens
gaacuggugucauagaaga

SEQ ID NO: 1465545 - RNA, 19 nt, Homo sapiens
caacggcacuacuuaaauu

SEQ ID NO: 1465546 - RNA, 19 nt, Homo sapiens
ucagauaucucaacuucua

SEQ ID NO: 1465547 - RNA, 19 nt, Homo sapiens
ggaggcaccaugauuauua

SEQ ID NO: 1465548 - RNA, 19 nt, Homo sapiens
guacagaaccacagaauga

SEQ ID NO: 1465549 - RNA, 19 nt, Homo sapiens
ggacaaagggcaacacuga

SEQ ID NO: 1465550 - RNA, 19 nt, Homo sapiens
guacaaaccauauccauga

SEQ ID NO: 1465551 - RNA, 19 nt, Homo sapiens
gugcugguauucaucauua

SEQ ID NO: 1465552 - RNA, 19 nt, Homo sapiens
gaaugaagccgucacaaau

SEQ ID NO: 1465553 - RNA, 19 nt, Homo sapiens
gauccugguucuucagaua

SEQ ID NO: 1465554 - RNA, 19 nt, Homo sapiens
aagggaagcuuauuucaaa

SEQ ID NO: 1465555 - RNA, 19 nt, Homo sapiens
uaauuaagcucccucacuu

SEQ ID NO: 1465556 - RNA, 19 nt, Homo sapiens
gaucucugguguaugauaa

SEQ ID NO: 1465557 - RNA, 19 nt, Homo sapiens
ggaaagauuuugccaauau

SEQ ID NO: 1465558 - RNA, 19 nt, Homo sapiens
cagaaucccuguaaccauu

SEQ ID NO: 1465559 - RNA, 19 nt, Homo sapiens
gcacaaagccaaguacaga

SEQ ID NO: 1465560 - RNA, 19 nt, Homo sapiens
acaaucagcugacuuuaau

SEQ ID NO: 1465561 - RNA, 19 nt, Homo sapiens
gagcacauauaaagccaaa

SEQ ID NO: 1465562 - RNA, 19 nt, Homo sapiens
gguauaagguuugcaacaa

SEQ ID NO: 1465563 - RNA, 19 nt, Homo sapiens
gcaauucacuggauuucuc

SEQ ID NO: 1465564 - RNA, 19 nt, Homo sapiens
gcacauauaaagccaaaug

SEQ ID NO: 1465565 - RNA, 19 nt, Homo sapiens
ggcagaagcuacaucauca

SEQ ID NO: 1465566 - RNA, 19 nt, Homo sapiens
caagucagguucuaauaca

SEQ ID NO: 1465567 - RNA, 19 nt, Homo sapiens
uaacggaacacuugacauu

SEQ ID NO: 1465568 - RNA, 19 nt, Homo sapiens
gcucagaucuguccaaagc

SEQ ID NO: 1465569 - RNA, 19 nt, Homo sapiens
ggaacuggcuccauuagac

SEQ ID NO: 1465570 - RNA, 19 nt, Homo sapiens
gagaaugcccaguguugua

SEQ ID NO: 1465571 - RNA, 19 nt, Homo sapiens
caaauccaguacaauggua

SEQ ID NO: 1465572 - RNA, 19 nt, Homo sapiens
gaagggaagcuuauuucaa

SEQ ID NO: 1465573 - RNA, 19 nt, Homo sapiens
aaagaaauaucccuggaau

SEQ ID NO: 1465574 - RNA, 19 nt, Homo sapiens
caagaugacucgguuagau

SEQ ID NO: 1465575 - RNA, 19 nt, Homo sapiens
ggaauacguauguuucaaa

SEQ ID NO: 1465576 - RNA, 19 nt, Homo sapiens
ggagaugcuuucacucugu

SEQ ID NO: 1465577 - RNA, 19 nt, Homo sapiens
gcaaagggcagcgaaguga

SEQ ID NO: 1465578 - RNA, 19 nt, Homo sapiens
cagagaagaugacuuagag

SEQ ID NO: 1465579 - RNA, 19 nt, Homo sapiens
guccagagaagaugacuua

SEQ ID NO: 1465580 - RNA, 19 nt, Homo sapiens
gaucuguccuauaauaauc

SEQ ID NO: 1465581 - RNA, 19 nt, Homo sapiens
ggaagcaacacaaauagug

SEQ ID NO: 1465582 - RNA, 19 nt, Homo sapiens
uaucacaacuguaaaggau

SEQ ID NO: 1465583 - RNA, 19 nt, Homo sapiens
gaacaacaaucagcugacu

SEQ ID NO: 1465584 - RNA, 19 nt, Homo sapiens
caacacaaauaguggaucu

SEQ ID NO: 1465585 - RNA, 19 nt, Homo sapiens
cuggaucuguccuauaaua

SEQ ID NO: 1465586 - RNA, 19 nt, Homo sapiens
gcagaaagucuuccuacga

SEQ ID NO: 1465587 - RNA, 19 nt, Homo sapiens
ugacuaauguugaccagau

SEQ ID NO: 1465588 - RNA, 19 nt, Homo sapiens
guauaagguuugcaacaau

SEQ ID NO: 1465589 - RNA, 19 nt, Homo sapiens
caaauaaauugcagaagcu

SEQ ID NO: 1465590 - RNA, 19 nt, Homo sapiens
gaagaugguuagcuugcau

SEQ ID NO: 1465591 - RNA, 19 nt, Homo sapiens
ucagcgagcucagguacua

SEQ ID NO: 1465592 - RNA, 19 nt, Homo sapiens
cagaagaacuguggaacug

SEQ ID NO: 1465593 - RNA, 19 nt, Homo sapiens
caaauaguggaucuucaua

SEQ ID NO: 1465594 - RNA, 19 nt, Homo sapiens
cuacagcguuugaugaugu

SEQ ID NO: 1465595 - RNA, 19 nt, Homo sapiens
ggcaucaaguucuguauca

SEQ ID NO: 1465596 - RNA, 19 nt, Homo sapiens
cacagaggcuggaguuaau

SEQ ID NO: 1465597 - RNA, 19 nt, Homo sapiens
gaggcaccaugauuauuau

SEQ ID NO: 1465598 - RNA, 19 nt, Homo sapiens
cuucagauaucucaacuuc

SEQ ID NO: 1465599 - RNA, 19 nt, Homo sapiens
caacaagaucucuggugua

SEQ ID NO: 1465600 - RNA, 19 nt, Homo sapiens
gcacaagaugacucgguua

SEQ ID NO: 1465601 - RNA, 19 nt, Homo sapiens
ccaggaauacaauaaguuu

SEQ ID NO: 1465602 - RNA, 19 nt, Homo sapiens
ucuuaaaccugaucuacaa

SEQ ID NO: 1465603 - RNA, 19 nt, Homo sapiens
gacuguagaaucuugaaua

SEQ ID NO: 1465604 - RNA, 19 nt, Homo sapiens
cggcggaacuggcuccauu

SEQ ID NO: 1465605 - RNA, 19 nt, Homo sapiens
aaagaaagacuggcacaaa

SEQ ID NO: 1465606 - RNA, 19 nt, Homo sapiens
cgaagagaaugcccagugu

SEQ ID NO: 1465607 - RNA, 19 nt, Homo sapiens
uaacggggcucaaauacaa

SEQ ID NO: 1465608 - RNA, 19 nt, Homo sapiens
ucaccaagguuagcaaugu

SEQ ID NO: 1465609 - RNA, 19 nt, Homo sapiens
gcauuugaauagcaacaga

SEQ ID NO: 1465610 - RNA, 19 nt, Homo sapiens
ucgcugaccuacgaaauuu

SEQ ID NO: 1465611 - RNA, 19 nt, Homo sapiens
ggaaucauaagcccaucua

SEQ ID NO: 1465612 - RNA, 19 nt, Homo sapiens
gggaugcuguugagaagau

SEQ ID NO: 1465613 - RNA, 19 nt, Homo sapiens
ucaguggucuuuccaaucu

SEQ ID NO: 1465614 - RNA, 19 nt, Homo sapiens
gcacuucugugucccaaaa

SEQ ID NO: 1465615 - RNA, 19 nt, Homo sapiens
ucuaauacaagcaguagua

SEQ ID NO: 1465616 - RNA, 19 nt, Homo sapiens
cucccucacuuacuaaaua

SEQ ID NO: 1465617 - RNA, 19 nt, Homo sapiens
aacaagaucucugguguau

SEQ ID NO: 1465618 - RNA, 19 nt, Homo sapiens
gguggaaacccauugcauu

SEQ ID NO: 1465619 - RNA, 19 nt, Homo sapiens
caccaaacauugacagaag

SEQ ID NO: 1465620 - RNA, 19 nt, Homo sapiens
uuguugaacuggugucaua

SEQ ID NO: 1465621 - RNA, 19 nt, Homo sapiens
gaagagaaugcccaguguu

SEQ ID NO: 1465622 - RNA, 19 nt, Homo sapiens
uaugauaacggaacacuug

SEQ ID NO: 1465623 - RNA, 19 nt, Homo sapiens
gggcaacacugaggugcaa

SEQ ID NO: 1465624 - RNA, 19 nt, Homo sapiens
gaccaugguucauccucuu

SEQ ID NO: 1465625 - RNA, 19 nt, Homo sapiens
ggagccgccuuuccgauuc

SEQ ID NO: 1465626 - RNA, 19 nt, Homo sapiens
aagaaagacuggcacaaag

SEQ ID NO: 1465627 - RNA, 19 nt, Homo sapiens
cacaaggucaccaagguua

SEQ ID NO: 1465628 - RNA, 19 nt, Homo sapiens
ggaacacuugacauucuua

SEQ ID NO: 1465629 - RNA, 19 nt, Homo sapiens
ggucaauuccugaagaaga

SEQ ID NO: 1465630 - RNA, 19 nt, Homo sapiens
acaacaaucagcugacuuu

SEQ ID NO: 1465631 - RNA, 19 nt, Homo sapiens
cagccgagcacccaucuuu

SEQ ID NO: 1465632 - RNA, 19 nt, Homo sapiens
acauugccauccaugauuu

SEQ ID NO: 1465633 - RNA, 19 nt, Homo sapiens
acacagaggcuggaguuaa

SEQ ID NO: 1465634 - RNA, 19 nt, Homo sapiens
agaaugaagccgucacaaa

SEQ ID NO: 1465635 - RNA, 19 nt, Homo sapiens
ggcaccaugauuauuauua

SEQ ID NO: 1465636 - RNA, 19 nt, Homo sapiens
cuacggaacaggauuaugu

SEQ ID NO: 1465637 - RNA, 19 nt, Homo sapiens
caaagaaauaucccuggaa

SEQ ID NO: 1465638 - RNA, 19 nt, Homo sapiens
caucaacggcacuacuuaa

SEQ ID NO: 1465639 - RNA, 19 nt, Homo sapiens
gcccaguguuguaaagcua

SEQ ID NO: 1465640 - RNA, 19 nt, Homo sapiens
ggaacuauguaugacuugu

SEQ ID NO: 1465641 - RNA, 19 nt, Homo sapiens
ucacaacuguaaaggauac

SEQ ID NO: 1465642 - RNA, 19 nt, Homo sapiens
gcacaguuguuaaugagua

SEQ ID NO: 1465643 - RNA, 19 nt, Homo sapiens
gaaguaacaccaaaugaaa

SEQ ID NO: 1465644 - RNA, 19 nt, Homo sapiens
gaauuacuguuucugguuu

SEQ ID NO: 1465645 - RNA, 19 nt, Homo sapiens
gaagauaaugcuacaguuu

SEQ ID NO: 1465646 - RNA, 19 nt, Homo sapiens
cuacagaauuacccaguua

SEQ ID NO: 1465647 - RNA, 19 nt, Homo sapiens
guacuucccucuacagaau

SEQ ID NO: 1465648 - RNA, 19 nt, Homo sapiens
cauguuggaugguuucuaa

SEQ ID NO: 1465649 - RNA, 19 nt, Homo sapiens
ugaauacugugaaugcuaa

SEQ ID NO: 1465650 - RNA, 19 nt, Homo sapiens
uaagaagucucaaucucaa

SEQ ID NO: 1465651 - RNA, 19 nt, Homo sapiens
ucagagccuugauuacaua

SEQ ID NO: 1465652 - RNA, 19 nt, Homo sapiens
gagccuugauuacauagaa

SEQ ID NO: 1465653 - RNA, 19 nt, Homo sapiens
cagacacgcugagaauaua

SEQ ID NO: 1465654 - RNA, 19 nt, Homo sapiens
guuggaugguuucuaauaa

SEQ ID NO: 1465655 - RNA, 19 nt, Homo sapiens
guucaaauauucucaaugc

SEQ ID NO: 1465656 - RNA, 19 nt, Homo sapiens
gaauauaucagagccuuga

SEQ ID NO: 1465657 - RNA, 19 nt, Homo sapiens
gccaggaucugaggcaauu

SEQ ID NO: 1465658 - RNA, 19 nt, Homo sapiens
gauagugaaaugggaaaua

SEQ ID NO: 1465659 - RNA, 19 nt, Homo sapiens
ugaaguaacaccaaaugaa

SEQ ID NO: 1465660 - RNA, 19 nt, Homo sapiens
caauugaugccaugaagaa

SEQ ID NO: 1465661 - RNA, 19 nt, Homo sapiens
acagugaacuagcaacaga

SEQ ID NO: 1465662 - RNA, 19 nt, Homo sapiens
cauaagaagucucaaucuc

SEQ ID NO: 1465663 - RNA, 19 nt, Homo sapiens
gcagauguacuucccucua

SEQ ID NO: 1465664 - RNA, 19 nt, Homo sapiens
ggaacaagaccaacauuuu

SEQ ID NO: 1465665 - RNA, 19 nt, Homo sapiens
gggaacaagaccaacauuu

SEQ ID NO: 1465666 - RNA, 19 nt, Homo sapiens
cauagaagauaaugcuaca

SEQ ID NO: 1465667 - RNA, 19 nt, Homo sapiens
agaaaagcaugaugaagua

SEQ ID NO: 1465668 - RNA, 19 nt, Homo sapiens
ccagacacgcugagaauau

SEQ ID NO: 1465669 - RNA, 19 nt, Homo sapiens
ccaguuaacaacaugguaa

SEQ ID NO: 1465670 - RNA, 19 nt, Homo sapiens
gaugaaguaacaccaaaug

SEQ ID NO: 1465671 - RNA, 19 nt, Homo sapiens
agaauuacccaguuaacaa

SEQ ID NO: 1465672 - RNA, 19 nt, Homo sapiens
ggaaaacagugaacuagca

SEQ ID NO: 1465673 - RNA, 19 nt, Homo sapiens
gaacaagaccaacauuuuc

SEQ ID NO: 1465674 - RNA, 19 nt, Homo sapiens
ggcuuugggucauuucauu

SEQ ID NO: 1465675 - RNA, 19 nt, Homo sapiens
cagaugugcauaucauaaa

SEQ ID NO: 1465676 - RNA, 19 nt, Homo sapiens
auacagaugugcauaucau

SEQ ID NO: 1465677 - RNA, 19 nt, Homo sapiens
uugaugccaugaagaaauu

SEQ ID NO: 1465678 - RNA, 19 nt, Homo sapiens
agaagauaaugcuacaguu

SEQ ID NO: 1465679 - RNA, 19 nt, Homo sapiens
agaccaacauuuucugaua

SEQ ID NO: 1465680 - RNA, 19 nt, Homo sapiens
aaugcacaguuguuaauga

SEQ ID NO: 1465681 - RNA, 19 nt, Homo sapiens
aaugaguaauugccguuaa

SEQ ID NO: 1465682 - RNA, 19 nt, Homo sapiens
cacaguuguuaaugaguaa

SEQ ID NO: 1465683 - RNA, 19 nt, Homo sapiens
acagaugugcauaucauaa

SEQ ID NO: 1465684 - RNA, 19 nt, Homo sapiens
aaagcaugaugaaguaaca

SEQ ID NO: 1465685 - RNA, 19 nt, Homo sapiens
ucaaugcacaguuguuaau

SEQ ID NO: 1465686 - RNA, 19 nt, Homo sapiens
ucucaaugcacaguuguua

SEQ ID NO: 1465687 - RNA, 19 nt, Homo sapiens
cagauguacuucccucuac

SEQ ID NO: 1465688 - RNA, 19 nt, Homo sapiens
ugcgguagcuaaugccaaa

SEQ ID NO: 1465689 - RNA, 19 nt, Homo sapiens
uacugugaaugcuaaguuu

SEQ ID NO: 1465690 - RNA, 19 nt, Homo sapiens
gaauuacccaguuaacaac

SEQ ID NO: 1465691 - RNA, 19 nt, Homo sapiens
ugaauuacuguuucugguu

SEQ ID NO: 1465692 - RNA, 19 nt, Homo sapiens
auaagaagucucaaucuca

SEQ ID NO: 1465693 - RNA, 19 nt, Homo sapiens
gauugaauacugugaaugc

SEQ ID NO: 1465694 - RNA, 19 nt, Homo sapiens
augaguaauugccguuaaa

SEQ ID NO: 1465695 - RNA, 19 nt, Homo sapiens
gaaauuccuuggggagcua

SEQ ID NO: 1465696 - RNA, 19 nt, Homo sapiens
gguagcuaaugccaaaaua

SEQ ID NO: 1465697 - RNA, 19 nt, Homo sapiens
uguuggaugguuucuaaua

SEQ ID NO: 1465698 - RNA, 19 nt, Homo sapiens
aaaauuaggaugcuaguug

SEQ ID NO: 1465699 - RNA, 19 nt, Homo sapiens
uagaagauaaugcuacagu

SEQ ID NO: 1465700 - RNA, 19 nt, Homo sapiens
ucuacagaauuacccaguu

SEQ ID NO: 1465701 - RNA, 19 nt, Homo sapiens
uagaaaagcagauguacuu

SEQ ID NO: 1465702 - RNA, 19 nt, Homo sapiens
caaacucuccaucucucaa

SEQ ID NO: 1465703 - RNA, 19 nt, Homo sapiens
aaacagugaacuagcaaca

SEQ ID NO: 1465704 - RNA, 19 nt, Homo sapiens
caaauugaagaggaaauag

SEQ ID NO: 1465705 - RNA, 19 nt, Homo sapiens
uaaugaguaauugccguua

SEQ ID NO: 1465706 - RNA, 19 nt, Homo sapiens
uauucucaaugcacaguug

SEQ ID NO: 1465707 - RNA, 19 nt, Homo sapiens
uuauacagaugugcauauc

SEQ ID NO: 1465708 - RNA, 19 nt, Homo sapiens
uuacccaguuaacaacaug

SEQ ID NO: 1465709 - RNA, 19 nt, Homo sapiens
cagaauuacccaguuaaca

SEQ ID NO: 1465710 - RNA, 19 nt, Homo sapiens
acuucccucuacagaauua

SEQ ID NO: 1465711 - RNA, 19 nt, Homo sapiens
augaugaaguaacaccaaa

SEQ ID NO: 1465712 - RNA, 19 nt, Homo sapiens
uuucaugccuacuaucucu

SEQ ID NO: 1465713 - RNA, 19 nt, Homo sapiens
ccucaggauauuuggcaua

SEQ ID NO: 1465714 - RNA, 19 nt, Homo sapiens
gauagaaaagcaugaugaa

SEQ ID NO: 1465715 - RNA, 19 nt, Homo sapiens
gaccaacauuuucugauag

SEQ ID NO: 1465716 - RNA, 19 nt, Homo sapiens
cuuucugucuuucaaaugu

SEQ ID NO: 1465717 - RNA, 19 nt, Homo sapiens
gggcagcgcgguugguuuu

SEQ ID NO: 1465718 - RNA, 19 nt, Homo sapiens
uggaaccucaggauauuug

SEQ ID NO: 1465719 - RNA, 19 nt, Homo sapiens
gcaauucuggguggcugaa

SEQ ID NO: 1465720 - RNA, 19 nt, Homo sapiens
ucauuuugguucuguguuu

SEQ ID NO: 1465721 - RNA, 19 nt, Homo sapiens
uauuuggcauaucauguuc

SEQ ID NO: 1465722 - RNA, 19 nt, Homo sapiens
ucaauugaugccaugaaga

SEQ ID NO: 1465723 - RNA, 19 nt, Homo sapiens
gaaaacagugaacuagcaa

SEQ ID NO: 1465724 - RNA, 19 nt, Homo sapiens
gaaaagcaugaugaaguaa

SEQ ID NO: 1465725 - RNA, 19 nt, Homo sapiens
ccuccugcgugccugcaaa

SEQ ID NO: 1465726 - RNA, 19 nt, Homo sapiens
agaaugaucuucaggauaa

SEQ ID NO: 1465727 - RNA, 19 nt, Homo sapiens
guaacaagccuacuucaua

SEQ ID NO: 1465728 - RNA, 19 nt, Homo sapiens
gcaauuggcuguugaugug

SEQ ID NO: 1465729 - RNA, 19 nt, Homo sapiens
ucaaaggucucaccaugua

SEQ ID NO: 1465730 - RNA, 19 nt, Homo sapiens
ggacagugauggccuuuga

SEQ ID NO: 1465731 - RNA, 19 nt, Homo sapiens
uaacaagccuacuucauau

SEQ ID NO: 1465732 - RNA, 19 nt, Homo sapiens
gcaaaggugcuguggaaua

SEQ ID NO: 1465733 - RNA, 19 nt, Homo sapiens
uaagagugauuuccgauuu

SEQ ID NO: 1465734 - RNA, 19 nt, Homo sapiens
ccuaauagcuugaacacaa

SEQ ID NO: 1465735 - RNA, 19 nt, Homo sapiens
caauguaacucacaauguu

SEQ ID NO: 1465736 - RNA, 19 nt, Homo sapiens
ggacagagccugcuacuac

SEQ ID NO: 1465737 - RNA, 19 nt, Homo sapiens
ccagagaggugcagcaaga

SEQ ID NO: 1465738 - RNA, 19 nt, Homo sapiens
ggugaugcccuuagaauaa

SEQ ID NO: 1465739 - RNA, 19 nt, Homo sapiens
caacugaugggcuucuuua

SEQ ID NO: 1465740 - RNA, 19 nt, Homo sapiens
ggaaggggcuugcaguuuu

SEQ ID NO: 1465741 - RNA, 19 nt, Homo sapiens
agaagucacugcaguauuc

SEQ ID NO: 1465742 - RNA, 19 nt, Homo sapiens
caaaggugcuguggaauag

SEQ ID NO: 1465743 - RNA, 19 nt, Homo sapiens
guucauagcagcacuguga

SEQ ID NO: 1465744 - RNA, 19 nt, Homo sapiens
cuucggagcuccagaguga

SEQ ID NO: 1465745 - RNA, 19 nt, Homo sapiens
gaaggaguguucucugucu

SEQ ID NO: 1465746 - RNA, 19 nt, Homo sapiens
gcucggagggaaagauuua

SEQ ID NO: 1465747 - RNA, 19 nt, Homo sapiens
uggcaaaggugcuguggaa

SEQ ID NO: 1465748 - RNA, 19 nt, Homo sapiens
ggauugaccaggauauuga

SEQ ID NO: 1465749 - RNA, 19 nt, Homo sapiens
gauggagacccacaaagaa

SEQ ID NO: 1465750 - RNA, 19 nt, Homo sapiens
gguauugucuugccugucu

SEQ ID NO: 1465751 - RNA, 19 nt, Homo sapiens
ccauuucccugugacauuu

SEQ ID NO: 1465752 - RNA, 19 nt, Homo sapiens
cggcccagcuuuagcaauu

SEQ ID NO: 1465753 - RNA, 19 nt, Homo sapiens
cugaaucucugcaauagga

SEQ ID NO: 1465754 - RNA, 19 nt, Homo sapiens
gcugauugguauugucuug

SEQ ID NO: 1465755 - RNA, 19 nt, Homo sapiens
ccaaaugucugugcucucu

SEQ ID NO: 1465756 - RNA, 19 nt, Homo sapiens
gcaauguaacucacaaugu

SEQ ID NO: 1465757 - RNA, 19 nt, Homo sapiens
uaaauuagagaccagaaug

SEQ ID NO: 1465758 - RNA, 19 nt, Homo sapiens
gaacugaaaccccuucuga

SEQ ID NO: 1465759 - RNA, 19 nt, Homo sapiens
gagagugacaguuacaguu

SEQ ID NO: 1465760 - RNA, 19 nt, Homo sapiens
gagagccauuucccuguga

SEQ ID NO: 1465761 - RNA, 19 nt, Homo sapiens
ccagaaugaucuucaggau

SEQ ID NO: 1465762 - RNA, 19 nt, Homo sapiens
ccacuuguccuccuuggaa

SEQ ID NO: 1465763 - RNA, 19 nt, Homo sapiens
agacaaagaauguauccuu

SEQ ID NO: 1465764 - RNA, 19 nt, Homo sapiens
cagaaugaucuucaggaua

SEQ ID NO: 1465765 - RNA, 19 nt, Homo sapiens
gcccuuagaauaacacuau

SEQ ID NO: 1465766 - RNA, 19 nt, Homo sapiens
ggagugcagucagaaaucu

SEQ ID NO: 1465767 - RNA, 19 nt, Homo sapiens
ggguuccauuagcaaauua

SEQ ID NO: 1465768 - RNA, 19 nt, Homo sapiens
cgauuucucuccuuucagu

SEQ ID NO: 1465769 - RNA, 19 nt, Homo sapiens
gauggccuuugacucauga

SEQ ID NO: 1465770 - RNA, 19 nt, Homo sapiens
gaggcgacccuuguuguaa

SEQ ID NO: 1465771 - RNA, 19 nt, Homo sapiens
aaagauuuauggccucugu

SEQ ID NO: 1465772 - RNA, 19 nt, Homo sapiens
ggggaaggauggacacuuu

SEQ ID NO: 1465773 - RNA, 19 nt, Homo sapiens
gaaugaucuucaggauaaa

SEQ ID NO: 1465774 - RNA, 19 nt, Homo sapiens
gggugaugcccuuagaaua

SEQ ID NO: 1465775 - RNA, 19 nt, Homo sapiens
gcucugagaaggaguguuc

SEQ ID NO: 1465776 - RNA, 19 nt, Homo sapiens
ugaauaaagggcaguccua

SEQ ID NO: 1465777 - RNA, 19 nt, Homo sapiens
gacagccaguucagucaga

SEQ ID NO: 1465778 - RNA, 19 nt, Homo sapiens
guaagagugauuuccgauu

SEQ ID NO: 1465779 - RNA, 19 nt, Homo sapiens
ugauggagacccacaaaga

SEQ ID NO: 1465780 - RNA, 19 nt, Homo sapiens
ggaccaaagacuugaugga

SEQ ID NO: 1465781 - RNA, 19 nt, Homo sapiens
cugaugggcuucuuuaagg

SEQ ID NO: 1465782 - RNA, 19 nt, Homo sapiens
aggcgacccuuguuguaaa

SEQ ID NO: 1465783 - RNA, 19 nt, Homo sapiens
gaagacgccuauggauggu

SEQ ID NO: 1465784 - RNA, 19 nt, Homo sapiens
gagugacaguuacaguugu

SEQ ID NO: 1465785 - RNA, 19 nt, Homo sapiens
ggaguuccaugacaaaauc

SEQ ID NO: 1465786 - RNA, 19 nt, Homo sapiens
ucacugagggccacagguu

SEQ ID NO: 1465787 - RNA, 19 nt, Homo sapiens
ggacgugcucggagggaaa

SEQ ID NO: 1465788 - RNA, 19 nt, Homo sapiens
gggauugaccaggauauug

SEQ ID NO: 1465789 - RNA, 19 nt, Homo sapiens
uaagcuggcaggaucuaaa

SEQ ID NO: 1465790 - RNA, 19 nt, Homo sapiens
aaaugucugugcucucugu

SEQ ID NO: 1465791 - RNA, 19 nt, Homo sapiens
gacagagccugcuacuacu

SEQ ID NO: 1465792 - RNA, 19 nt, Homo sapiens
acaagccuacuucauauug

SEQ ID NO: 1465793 - RNA, 19 nt, Homo sapiens
cuucugaaucucugcaaua

SEQ ID NO: 1465794 - RNA, 19 nt, Homo sapiens
cugcuucccuggcucaguu

SEQ ID NO: 1465795 - RNA, 19 nt, Homo sapiens
ucacugcaguauucccaau

SEQ ID NO: 1465796 - RNA, 19 nt, Homo sapiens
caaaggucucaccauguaa

SEQ ID NO: 1465797 - RNA, 19 nt, Homo sapiens
cacuaugguuggcgucuga

SEQ ID NO: 1465798 - RNA, 19 nt, Homo sapiens
uugccuggcucuugcugua

SEQ ID NO: 1465799 - RNA, 19 nt, Homo sapiens
gcagcaagagagccauuuc

SEQ ID NO: 1465800 - RNA, 19 nt, Homo sapiens
uaaagacucggcccagcuu

SEQ ID NO: 1465801 - RNA, 19 nt, Homo sapiens
gaaucucugcaauaggaaa

SEQ ID NO: 1465802 - RNA, 19 nt, Homo sapiens
ggccuggguuccauuagca

SEQ ID NO: 1465803 - RNA, 19 nt, Homo sapiens
aagagugauuuccgauuuc

SEQ ID NO: 1465804 - RNA, 19 nt, Homo sapiens
ucaugcugcugauugguau

SEQ ID NO: 1465805 - RNA, 19 nt, Homo sapiens
gcuagaggcgacccuuguu

SEQ ID NO: 1465806 - RNA, 19 nt, Homo sapiens
gccuauggauggugcagau

SEQ ID NO: 1465807 - RNA, 19 nt, Homo sapiens
gccauuucccugugacauu

SEQ ID NO: 1465808 - RNA, 19 nt, Homo sapiens
ggaaugcuguuuucaucau

SEQ ID NO: 1465809 - RNA, 19 nt, Homo sapiens
aaauuagagaccagaauga

SEQ ID NO: 1465810 - RNA, 19 nt, Homo sapiens
gaaggggcuugcaguuuuc

SEQ ID NO: 1465811 - RNA, 19 nt, Homo sapiens
caagccuacuucauauugg

SEQ ID NO: 1465812 - RNA, 19 nt, Homo sapiens
agagugacaguuacaguug

SEQ ID NO: 1465813 - RNA, 19 nt, Homo sapiens
gagaccagaaugaucuuca

SEQ ID NO: 1465814 - RNA, 19 nt, Homo sapiens
uggguuccauuagcaaauu

SEQ ID NO: 1465815 - RNA, 19 nt, Homo sapiens
uuagaguggcuuaguguga

SEQ ID NO: 1465816 - RNA, 19 nt, Homo sapiens
uauggauggugcagauugu

SEQ ID NO: 1465817 - RNA, 19 nt, Homo sapiens
gauggacacuuuucagaag

SEQ ID NO: 1465818 - RNA, 19 nt, Homo sapiens
aagacucggcccagcuuua

SEQ ID NO: 1465819 - RNA, 19 nt, Homo sapiens
gcuggccuggguuccauua

SEQ ID NO: 1465820 - RNA, 19 nt, Homo sapiens
ggucucaccauguaagagu

SEQ ID NO: 1465821 - RNA, 19 nt, Homo sapiens
ggaggaugagugccuguca

SEQ ID NO: 1465822 - RNA, 19 nt, Homo sapiens
gaaaccaugggauccugau

SEQ ID NO: 1465823 - RNA, 19 nt, Homo sapiens
uuagagaccagaaugaucu

SEQ ID NO: 1465824 - RNA, 19 nt, Homo sapiens
agugauggccuuugacuca

SEQ ID NO: 1465825 - RNA, 19 nt, Homo sapiens
cagaagucacugcaguauu

SEQ ID NO: 1465826 - RNA, 19 nt, Homo sapiens
gggaaaggauuuaacauuu

SEQ ID NO: 1465827 - RNA, 19 nt, Homo sapiens
gagcacgccuuucggauua

SEQ ID NO: 1465828 - RNA, 19 nt, Homo sapiens
ggacagauuucucagcuuu

SEQ ID NO: 1465829 - RNA, 19 nt, Homo sapiens
gcgccgaugugaauuauua

SEQ ID NO: 1465830 - RNA, 19 nt, Homo sapiens
aaacauaacugccauagug

SEQ ID NO: 1465831 - RNA, 19 nt, Homo sapiens
gagcauaucagaaacauaa

SEQ ID NO: 1465832 - RNA, 19 nt, Homo sapiens
ccauguggauugcaaauua

SEQ ID NO: 1465833 - RNA, 19 nt, Homo sapiens
gaaaugaaagcagaaguua

SEQ ID NO: 1465834 - RNA, 19 nt, Homo sapiens
gaacaagaacggauagaaa

SEQ ID NO: 1465835 - RNA, 19 nt, Homo sapiens
gcaccauacucaucuguaa

SEQ ID NO: 1465836 - RNA, 19 nt, Homo sapiens
gaacaucaaggaaaugaaa

SEQ ID NO: 1465837 - RNA, 19 nt, Homo sapiens
gagcagagcaccaaacuga

SEQ ID NO: 1465838 - RNA, 19 nt, Homo sapiens
gaacuaauucugccuuaaa

SEQ ID NO: 1465839 - RNA, 19 nt, Homo sapiens
cagcuuuccuugauuguua

SEQ ID NO: 1465840 - RNA, 19 nt, Homo sapiens
ggacaugagagguuauaua

SEQ ID NO: 1465841 - RNA, 19 nt, Homo sapiens
caaaugaagugucuaacug

SEQ ID NO: 1465842 - RNA, 19 nt, Homo sapiens
ggaacucaguaaccagaua

SEQ ID NO: 1465843 - RNA, 19 nt, Homo sapiens
guucaucucuguauguaaa

SEQ ID NO: 1465844 - RNA, 19 nt, Homo sapiens
gaacagaguggacuuguca

SEQ ID NO: 1465845 - RNA, 19 nt, Homo sapiens
ggacaaaucacaaaugaag

SEQ ID NO: 1465846 - RNA, 19 nt, Homo sapiens
gaugauggguguuuuauuu

SEQ ID NO: 1465847 - RNA, 19 nt, Homo sapiens
gcaccaaacugaagauguc

SEQ ID NO: 1465848 - RNA, 19 nt, Homo sapiens
aaagggauauggagaagaa

SEQ ID NO: 1465849 - RNA, 19 nt, Homo sapiens
gauaauccgucagaaguau

SEQ ID NO: 1465850 - RNA, 19 nt, Homo sapiens
cagcauagcuagacuuucu

SEQ ID NO: 1465851 - RNA, 19 nt, Homo sapiens
ggaaaugaaagcagaaguu

SEQ ID NO: 1465852 - RNA, 19 nt, Homo sapiens
uaggacaaaucacaaauga

SEQ ID NO: 1465853 - RNA, 19 nt, Homo sapiens
gcacuaaugaagacuguuu

SEQ ID NO: 1465854 - RNA, 19 nt, Homo sapiens
gcacuucuuauauugguua

SEQ ID NO: 1465855 - RNA, 19 nt, Homo sapiens
agaguggacuugucaauau

SEQ ID NO: 1465856 - RNA, 19 nt, Homo sapiens
aaacuuaucuuggaaacga

SEQ ID NO: 1465857 - RNA, 19 nt, Homo sapiens
ggaacuaauucugccuuaa

SEQ ID NO: 1465858 - RNA, 19 nt, Homo sapiens
aaacuggaauccucuguau

SEQ ID NO: 1465859 - RNA, 19 nt, Homo sapiens
ucaaugcacuguacucugu

SEQ ID NO: 1465860 - RNA, 19 nt, Homo sapiens
ucaccaagcuggaguuaca

SEQ ID NO: 1465861 - RNA, 19 nt, Homo sapiens
ugccacaaauuuccacuua

SEQ ID NO: 1465862 - RNA, 19 nt, Homo sapiens
gugguuaacagucuauuua

SEQ ID NO: 1465863 - RNA, 19 nt, Homo sapiens
gauuagacuucaaccuuug

SEQ ID NO: 1465864 - RNA, 19 nt, Homo sapiens
gaggaagaguggcaagaug

SEQ ID NO: 1465865 - RNA, 19 nt, Homo sapiens
ccaaggaaagguauaauau

SEQ ID NO: 1465866 - RNA, 19 nt, Homo sapiens
ggacaacauuagcuaugga

SEQ ID NO: 1465867 - RNA, 19 nt, Homo sapiens
gagaaugucccaguagauu

SEQ ID NO: 1465868 - RNA, 19 nt, Homo sapiens
gagcaacuuuguagaugau

SEQ ID NO: 1465869 - RNA, 19 nt, Homo sapiens
uuaagagaaugucccagua

SEQ ID NO: 1465870 - RNA, 19 nt, Homo sapiens
gauaacguaaggcucaaua

SEQ ID NO: 1465871 - RNA, 19 nt, Homo sapiens
gaaagcauaggauccauca

SEQ ID NO: 1465872 - RNA, 19 nt, Homo sapiens
gaaguuaaugcuggguuua

SEQ ID NO: 1465873 - RNA, 19 nt, Homo sapiens
ccacaaauuuccacuuaac

SEQ ID NO: 1465874 - RNA, 19 nt, Homo sapiens
gacaugagagguuauauag

SEQ ID NO: 1465875 - RNA, 19 nt, Homo sapiens
ucacaaaugaagugucuaa

SEQ ID NO: 1465876 - RNA, 19 nt, Homo sapiens
cgucagaaguaugauguaa

SEQ ID NO: 1465877 - RNA, 19 nt, Homo sapiens
agauuagacuucaaccuuu

SEQ ID NO: 1465878 - RNA, 19 nt, Homo sapiens
gggacuauauuauccaaca

SEQ ID NO: 1465879 - RNA, 19 nt, Homo sapiens
cauguggauugcaaauuaa

SEQ ID NO: 1465880 - RNA, 19 nt, Homo sapiens
gcuccucacccuaaauuaa

SEQ ID NO: 1465881 - RNA, 19 nt, Homo sapiens
caacggagcacuguauuuc

SEQ ID NO: 1465882 - RNA, 19 nt, Homo sapiens
gaacucaguaaccagauau

SEQ ID NO: 1465883 - RNA, 19 nt, Homo sapiens
gaucagucauugaaaauug

SEQ ID NO: 1465884 - RNA, 19 nt, Homo sapiens
acacuuaucguaacuguau

SEQ ID NO: 1465885 - RNA, 19 nt, Homo sapiens
gaauggugguuaacagucu

SEQ ID NO: 1465886 - RNA, 19 nt, Homo sapiens
gcaagaagaggagaagaug

SEQ ID NO: 1465887 - RNA, 19 nt, Homo sapiens
agaagaagcucagccagau

SEQ ID NO: 1465888 - RNA, 19 nt, Homo sapiens
gugcuaggguuuauauaca

SEQ ID NO: 1465889 - RNA, 19 nt, Homo sapiens
auaauggaauggugguuaa

SEQ ID NO: 1465890 - RNA, 19 nt, Homo sapiens
ggaacaagaacggauagaa

SEQ ID NO: 1465891 - RNA, 19 nt, Homo sapiens
aacauuagcuauggaacua

SEQ ID NO: 1465892 - RNA, 19 nt, Homo sapiens
gccacaaauuuccacuuaa

SEQ ID NO: 1465893 - RNA, 19 nt, Homo sapiens
cuauuacuguuuacccaua

SEQ ID NO: 1465894 - RNA, 19 nt, Homo sapiens
cacaaccuguauagugaua

SEQ ID NO: 1465895 - RNA, 19 nt, Homo sapiens
aaauccagcugaugcagaa

SEQ ID NO: 1465896 - RNA, 19 nt, Homo sapiens
gcugcuaaaguacauauuu

SEQ ID NO: 1465897 - RNA, 19 nt, Homo sapiens
ugagcaacuuuguagauga

SEQ ID NO: 1465898 - RNA, 19 nt, Homo sapiens
guugaccaccuagauauua

SEQ ID NO: 1465899 - RNA, 19 nt, Homo sapiens
cauauuugaucagucauug

SEQ ID NO: 1465900 - RNA, 19 nt, Homo sapiens
cuaacuggcuauuacuguu

SEQ ID NO: 1465901 - RNA, 19 nt, Homo sapiens
acuggaauccucuguauuu

SEQ ID NO: 1465902 - RNA, 19 nt, Homo sapiens
gcacgccuuucggauuaaa

SEQ ID NO: 1465903 - RNA, 19 nt, Homo sapiens
agaaguuaaugcuggguuu

SEQ ID NO: 1465904 - RNA, 19 nt, Homo sapiens
gaaccagaacaucaaggaa

SEQ ID NO: 1465905 - RNA, 19 nt, Homo sapiens
aagcuggaguuacagauga

SEQ ID NO: 1465906 - RNA, 19 nt, Homo sapiens
acaaagugcuaggguuuau

SEQ ID NO: 1465907 - RNA, 19 nt, Homo sapiens
uccacaaccuguauaguga

SEQ ID NO: 1465908 - RNA, 19 nt, Homo sapiens
uaucugcguugaccaccua

SEQ ID NO: 1465909 - RNA, 19 nt, Homo sapiens
gaaugucccaguagauuag

SEQ ID NO: 1465910 - RNA, 19 nt, Homo sapiens
agaaugucccaguagauua

SEQ ID NO: 1465911 - RNA, 19 nt, Homo sapiens
uggaggagcauaucagaaa

SEQ ID NO: 1465912 - RNA, 19 nt, Homo sapiens
uaacuggcuauuacuguuu

SEQ ID NO: 1465913 - RNA, 19 nt, Homo sapiens
aaacuuucaucuugagcaa

SEQ ID NO: 1465914 - RNA, 19 nt, Homo sapiens
gaauuauccacaaccugua

SEQ ID NO: 1465915 - RNA, 19 nt, Homo sapiens
cagaguggacuugucaaua

SEQ ID NO: 1465916 - RNA, 19 nt, Homo sapiens
uaaucgggauaucgaggua

SEQ ID NO: 1465917 - RNA, 19 nt, Homo sapiens
uaacugccauagugaagca

SEQ ID NO: 1465918 - RNA, 19 nt, Homo sapiens
uagauuagacuucaaccuu

SEQ ID NO: 1465919 - RNA, 19 nt, Homo sapiens
cacccuaaauuaagagaau

SEQ ID NO: 1465920 - RNA, 19 nt, Homo sapiens
gaagaguggcaagauguga

SEQ ID NO: 1465921 - RNA, 19 nt, Homo sapiens
uggaacuaauucugccuua

SEQ ID NO: 1465922 - RNA, 19 nt, Homo sapiens
ggauuaaagaugacauugu

SEQ ID NO: 1465923 - RNA, 19 nt, Homo sapiens
guauggacaacaauucaaa

SEQ ID NO: 1465924 - RNA, 19 nt, Homo sapiens
gaaguaugauguaaaacug

SEQ ID NO: 1465925 - RNA, 19 nt, Homo sapiens
cuaugcacuucuuauauug

SEQ ID NO: 1465926 - RNA, 19 nt, Homo sapiens
ggaaagguaucagcaguug

SEQ ID NO: 1465927 - RNA, 19 nt, Homo sapiens
agaaagaaaugguggugua

SEQ ID NO: 1465928 - RNA, 19 nt, Homo sapiens
ccagucagcugaaagaaga

SEQ ID NO: 1465929 - RNA, 19 nt, Homo sapiens
gcgaauguauggagacuau

SEQ ID NO: 1465930 - RNA, 19 nt, Homo sapiens
caacagaaacagcucuuaa

SEQ ID NO: 1465931 - RNA, 19 nt, Homo sapiens
ggagugggcugugaucuuc

SEQ ID NO: 1465932 - RNA, 19 nt, Homo sapiens
ggagguagcgcaaguugaa

SEQ ID NO: 1465933 - RNA, 19 nt, Homo sapiens
gaaggaggcucuuuuggaa

SEQ ID NO: 1465934 - RNA, 19 nt, Homo sapiens
gaacucagccuuggcauca

SEQ ID NO: 1465935 - RNA, 19 nt, Homo sapiens
gaaccuaccaggaaacuuc

SEQ ID NO: 1465936 - RNA, 19 nt, Homo sapiens
cagcugaaaucacuguauu

SEQ ID NO: 1465937 - RNA, 19 nt, Homo sapiens
caaagcagguuggacuauu

SEQ ID NO: 1465938 - RNA, 19 nt, Homo sapiens
gaaagugaaggcagaguga

SEQ ID NO: 1465939 - RNA, 19 nt, Homo sapiens
gaaauugugaugccuucua

SEQ ID NO: 1465940 - RNA, 19 nt, Homo sapiens
agaaacagcucuuaauacu

SEQ ID NO: 1465941 - RNA, 19 nt, Homo sapiens
gcgcuagucccuugguuua

SEQ ID NO: 1465942 - RNA, 19 nt, Homo sapiens
uagaugacauggugcauug

SEQ ID NO: 1465943 - RNA, 19 nt, Homo sapiens
aaagcagguuggacuauuu

SEQ ID NO: 1465944 - RNA, 19 nt, Homo sapiens
acagaaacagcucuuaaua

SEQ ID NO: 1465945 - RNA, 19 nt, Homo sapiens
aagaagagaugaacuacau

SEQ ID NO: 1465946 - RNA, 19 nt, Homo sapiens
ugaaagaagagaugaacua

SEQ ID NO: 1465947 - RNA, 19 nt, Homo sapiens
gauauacaaggucacauuu

SEQ ID NO: 1465948 - RNA, 19 nt, Homo sapiens
aggcaggacucgugaaauu

SEQ ID NO: 1465949 - RNA, 19 nt, Homo sapiens
gaccguaccuccugagagu

SEQ ID NO: 1465950 - RNA, 19 nt, Homo sapiens
uauacaaggucacauuuca

SEQ ID NO: 1465951 - RNA, 19 nt, Homo sapiens
ggauauacaaggucacauu

SEQ ID NO: 1465952 - RNA, 19 nt, Homo sapiens
ggaacccuguggcuucaaa

SEQ ID NO: 1465953 - RNA, 19 nt, Homo sapiens
cauuaaggaucaaaucaga

SEQ ID NO: 1465954 - RNA, 19 nt, Homo sapiens
ugauagagcaugaagguuu

SEQ ID NO: 1465955 - RNA, 19 nt, Homo sapiens
ggaguuaaccaugaagaaa

SEQ ID NO: 1465956 - RNA, 19 nt, Homo sapiens
aggaguaucuggagaauca

SEQ ID NO: 1465957 - RNA, 19 nt, Homo sapiens
gagaugagacagaagauuc

SEQ ID NO: 1465958 - RNA, 19 nt, Homo sapiens
gaauguauggagacuauga

SEQ ID NO: 1465959 - RNA, 19 nt, Homo sapiens
caggugcucuuuccucuug

SEQ ID NO: 1465960 - RNA, 19 nt, Homo sapiens
aggagaagcugcaggaaga

SEQ ID NO: 1465961 - RNA, 19 nt, Homo sapiens
guucaugcaugcucuacuu

SEQ ID NO: 1465962 - RNA, 19 nt, Homo sapiens
uguagacacugaaauccua

SEQ ID NO: 1465963 - RNA, 19 nt, Homo sapiens
gaagaaaacucugacuuag

SEQ ID NO: 1465964 - RNA, 19 nt, Homo sapiens
acacaagaguccuggaguu

SEQ ID NO: 1465965 - RNA, 19 nt, Homo sapiens
ugaaaugucuggggaguua

SEQ ID NO: 1465966 - RNA, 19 nt, Homo sapiens
aggcagcguuucucugaua

SEQ ID NO: 1465967 - RNA, 19 nt, Homo sapiens
gggaaaaggacauuaauuu

SEQ ID NO: 1465968 - RNA, 19 nt, Homo sapiens
cagcagagaucagccuaga

SEQ ID NO: 1465969 - RNA, 19 nt, Homo sapiens
cgucugcccuggaucguuu

SEQ ID NO: 1465970 - RNA, 19 nt, Homo sapiens
gcacccagccaaacuugaa

SEQ ID NO: 1465971 - RNA, 19 nt, Homo sapiens
gaagaaagucaagcagaug

SEQ ID NO: 1465972 - RNA, 19 nt, Homo sapiens
agaagaaagucaagcagau

SEQ ID NO: 1465973 - RNA, 19 nt, Homo sapiens
aaaggaacgucaucaacug

SEQ ID NO: 1465974 - RNA, 19 nt, Homo sapiens
gcuagucccuugguuuaau

SEQ ID NO: 1465975 - RNA, 19 nt, Homo sapiens
ccuagaacaugaaacugaa

SEQ ID NO: 1465976 - RNA, 19 nt, Homo sapiens
gaaagaaauggugguguau

SEQ ID NO: 1465977 - RNA, 19 nt, Homo sapiens
gguaagagagggauauaca

SEQ ID NO: 1465978 - RNA, 19 nt, Homo sapiens
gaaacuuccucaggguguu

SEQ ID NO: 1465979 - RNA, 19 nt, Homo sapiens
ugcgagagaugaccaagaa

SEQ ID NO: 1465980 - RNA, 19 nt, Homo sapiens
gaugagaugagacagaaga

SEQ ID NO: 1465981 - RNA, 19 nt, Homo sapiens
caugcaugcucuacuuuga

SEQ ID NO: 1465982 - RNA, 19 nt, Homo sapiens
gcaacagaaacagcucuua

SEQ ID NO: 1465983 - RNA, 19 nt, Homo sapiens
uaacugauucugacaagga

SEQ ID NO: 1465984 - RNA, 19 nt, Homo sapiens
ugcaugcucuacuuugaua

SEQ ID NO: 1465985 - RNA, 19 nt, Homo sapiens
caagaguccuggaguuaac

SEQ ID NO: 1465986 - RNA, 19 nt, Homo sapiens
cacaagaguccuggaguua

SEQ ID NO: 1465987 - RNA, 19 nt, Homo sapiens
gagcuggacaggcugauug

SEQ ID NO: 1465988 - RNA, 19 nt, Homo sapiens
gcaggaguaucuggagaau

SEQ ID NO: 1465989 - RNA, 19 nt, Homo sapiens
ggaaaaggacauuaauuug

SEQ ID NO: 1465990 - RNA, 19 nt, Homo sapiens
gaaguggaaaccagagaga

SEQ ID NO: 1465991 - RNA, 19 nt, Homo sapiens
guuggacuauuuaacagaa

SEQ ID NO: 1465992 - RNA, 19 nt, Homo sapiens
uggagaaccuaccaggaaa

SEQ ID NO: 1465993 - RNA, 19 nt, Homo sapiens
gauagagcaugaagguuuu

SEQ ID NO: 1465994 - RNA, 19 nt, Homo sapiens
ugaagaaaacucugacuua

SEQ ID NO: 1465995 - RNA, 19 nt, Homo sapiens
gcaggacucgugaaauugu

SEQ ID NO: 1465996 - RNA, 19 nt, Homo sapiens
gaucuucuacccagccaaa

SEQ ID NO: 1465997 - RNA, 19 nt, Homo sapiens
ggaacgucaucaacugcaa

SEQ ID NO: 1465998 - RNA, 19 nt, Homo sapiens
gguggaaucgucccaagaa

SEQ ID NO: 1465999 - RNA, 19 nt, Homo sapiens
gaaagaagagaugaacuac

SEQ ID NO: 1466000 - RNA, 19 nt, Homo sapiens
gaagggugacuguuguuuc

SEQ ID NO: 1466001 - RNA, 19 nt, Homo sapiens
ggaagggugacuguuguuu

SEQ ID NO: 1466002 - RNA, 19 nt, Homo sapiens
uagaaggagagaauaauga

SEQ ID NO: 1466003 - RNA, 19 nt, Homo sapiens
ugagaaagcgaauguaugg

SEQ ID NO: 1466004 - RNA, 19 nt, Homo sapiens
ggugagaaagcgaauguau

SEQ ID NO: 1466005 - RNA, 19 nt, Homo sapiens
ugguuuaauuugugccuua

SEQ ID NO: 1466006 - RNA, 19 nt, Homo sapiens
gcagauggucgaggagauu

SEQ ID NO: 1466007 - RNA, 19 nt, Homo sapiens
caacauuaaggaucaaauc

SEQ ID NO: 1466008 - RNA, 19 nt, Homo sapiens
guccuggaguuaaccauga

SEQ ID NO: 1466009 - RNA, 19 nt, Homo sapiens
gaaacagcucuuaauacug

SEQ ID NO: 1466010 - RNA, 19 nt, Homo sapiens
acagcaacauuaaggauca

SEQ ID NO: 1466011 - RNA, 19 nt, Homo sapiens
guaagagagggauauacaa

SEQ ID NO: 1466012 - RNA, 19 nt, Homo sapiens
acucagaggcauacacuuu

SEQ ID NO: 1466013 - RNA, 19 nt, Homo sapiens
gagccacacugagagacuu

SEQ ID NO: 1466014 - RNA, 19 nt, Homo sapiens
agagaggccuguccacaag

SEQ ID NO: 1466015 - RNA, 19 nt, Homo sapiens
agagugagcagguaagaga

SEQ ID NO: 1466016 - RNA, 19 nt, Homo sapiens
ggccaagaccgaaguggaa

SEQ ID NO: 1466017 - RNA, 19 nt, Homo sapiens
gucaucaacugcaacuuca

SEQ ID NO: 1466018 - RNA, 19 nt, Homo sapiens
aagaaauggugguguaugg

SEQ ID NO: 1466019 - RNA, 19 nt, Homo sapiens
gcaugaagguuuuguuuac

SEQ ID NO: 1466020 - RNA, 19 nt, Homo sapiens
cguacugcaucaucauuug

SEQ ID NO: 1466021 - RNA, 19 nt, Homo sapiens
gagagaauaaugaacuaca

SEQ ID NO: 1466022 - RNA, 19 nt, Homo sapiens
cagaaacagcucuuaauac

SEQ ID NO: 1466023 - RNA, 19 nt, Homo sapiens
cuagucccuugguuuaauu

SEQ ID NO: 1466024 - RNA, 19 nt, Homo sapiens
augccaggauuguuugaua

SEQ ID NO: 1466025 - RNA, 19 nt, Homo sapiens
ucagacaccuagaugacau

SEQ ID NO: 1466026 - RNA, 19 nt, Homo sapiens
guaauaacauggccaauuu

SEQ ID NO: 1466027 - RNA, 19 nt, Homo sapiens
gauauacucuggauucuuu

SEQ ID NO: 1466028 - RNA, 19 nt, Homo sapiens
caagagaggauguuauuua

SEQ ID NO: 1466029 - RNA, 19 nt, Homo sapiens
agaaagaucuggaaacuau

SEQ ID NO: 1466030 - RNA, 19 nt, Homo sapiens
gggcaugacuuuagcguuu

SEQ ID NO: 1466031 - RNA, 19 nt, Homo sapiens
gaauugaugugagcauuaa

SEQ ID NO: 1466032 - RNA, 19 nt, Homo sapiens
gaaaacaccugucugcuuu

SEQ ID NO: 1466033 - RNA, 19 nt, Homo sapiens
gaagauacguauuuccaau

SEQ ID NO: 1466034 - RNA, 19 nt, Homo sapiens
cuagcuagcuuuacaauau

SEQ ID NO: 1466035 - RNA, 19 nt, Homo sapiens
aaagaaaccuaacauccua

SEQ ID NO: 1466036 - RNA, 19 nt, Homo sapiens
aaacuuggcuugugugaug

SEQ ID NO: 1466037 - RNA, 19 nt, Homo sapiens
guaaaguacuacaugguuu

SEQ ID NO: 1466038 - RNA, 19 nt, Homo sapiens
gagauccacuccuuaagaa

SEQ ID NO: 1466039 - RNA, 19 nt, Homo sapiens
gaccagagauccacuccuu

SEQ ID NO: 1466040 - RNA, 19 nt, Homo sapiens
gaguguagcuacuuuaaca

SEQ ID NO: 1466041 - RNA, 19 nt, Homo sapiens
ggagaaagaucuggaaacu

SEQ ID NO: 1466042 - RNA, 19 nt, Homo sapiens
cauaaacgaugacagcuau

SEQ ID NO: 1466043 - RNA, 19 nt, Homo sapiens
gaagagacccuauuuuauu

SEQ ID NO: 1466044 - RNA, 19 nt, Homo sapiens
ggaauugaugugagcauua

SEQ ID NO: 1466045 - RNA, 19 nt, Homo sapiens
acauaacgaucacucauuu

SEQ ID NO: 1466046 - RNA, 19 nt, Homo sapiens
ugaaguagcuggugguaca

SEQ ID NO: 1466047 - RNA, 19 nt, Homo sapiens
guugucagcugucuucauu

SEQ ID NO: 1466048 - RNA, 19 nt, Homo sapiens
gcucuuaaguccaguagau

SEQ ID NO: 1466049 - RNA, 19 nt, Homo sapiens
acaccugucugcuuucuaa

SEQ ID NO: 1466050 - RNA, 19 nt, Homo sapiens
ugacauaccuuuggaacga

SEQ ID NO: 1466051 - RNA, 19 nt, Homo sapiens
acgaagaucugguuuacaa

SEQ ID NO: 1466052 - RNA, 19 nt, Homo sapiens
gagaggauguuauuuagac

SEQ ID NO: 1466053 - RNA, 19 nt, Homo sapiens
caugauugauuacugcuuu

SEQ ID NO: 1466054 - RNA, 19 nt, Homo sapiens
gcacacaggccauuugcuu

SEQ ID NO: 1466055 - RNA, 19 nt, Homo sapiens
cauacacagugaucacaua

SEQ ID NO: 1466056 - RNA, 19 nt, Homo sapiens
gaagaucugguuuacaaga

SEQ ID NO: 1466057 - RNA, 19 nt, Homo sapiens
caucaucuauccacaguuc

SEQ ID NO: 1466058 - RNA, 19 nt, Homo sapiens
guagguagcuuuuaaguag

SEQ ID NO: 1466059 - RNA, 19 nt, Homo sapiens
guacagaaccauugucaca

SEQ ID NO: 1466060 - RNA, 19 nt, Homo sapiens
ccagagauccacuccuuaa

SEQ ID NO: 1466061 - RNA, 19 nt, Homo sapiens
gagacacuguugaacuuga

SEQ ID NO: 1466062 - RNA, 19 nt, Homo sapiens
ucagaaacaccucaauaaa

SEQ ID NO: 1466063 - RNA, 19 nt, Homo sapiens
gaaggaaugugggcaaggu

SEQ ID NO: 1466064 - RNA, 19 nt, Homo sapiens
gaaaaguggcuucguaaaa

SEQ ID NO: 1466065 - RNA, 19 nt, Homo sapiens
cagaagagacccuauuuua

SEQ ID NO: 1466066 - RNA, 19 nt, Homo sapiens
gaacauaacgaucacucau

SEQ ID NO: 1466067 - RNA, 19 nt, Homo sapiens
gaagauggaagaccguguu

SEQ ID NO: 1466068 - RNA, 19 nt, Homo sapiens
gcaacguuaguuucucuua

SEQ ID NO: 1466069 - RNA, 19 nt, Homo sapiens
gguaauaacauggccaauu

SEQ ID NO: 1466070 - RNA, 19 nt, Homo sapiens
guacaaaugagaacuucaa

SEQ ID NO: 1466071 - RNA, 19 nt, Homo sapiens
gauuacugcuuuguuagaa

SEQ ID NO: 1466072 - RNA, 19 nt, Homo sapiens
gaaccucauuggccaugga

SEQ ID NO: 1466073 - RNA, 19 nt, Homo sapiens
caacaaagaaaccuaacau

SEQ ID NO: 1466074 - RNA, 19 nt, Homo sapiens
gugcagggcuuggaaggaa

SEQ ID NO: 1466075 - RNA, 19 nt, Homo sapiens
caaaugagaacuucaagag

SEQ ID NO: 1466076 - RNA, 19 nt, Homo sapiens
ggacaccuguuuacuagcu

SEQ ID NO: 1466077 - RNA, 19 nt, Homo sapiens
uaggacaccuguuuacuag

SEQ ID NO: 1466078 - RNA, 19 nt, Homo sapiens
gcacagagaagaguuacga

SEQ ID NO: 1466079 - RNA, 19 nt, Homo sapiens
ugaggcacaucauggaauu

SEQ ID NO: 1466080 - RNA, 19 nt, Homo sapiens
ccacccaccuugacuauac

SEQ ID NO: 1466081 - RNA, 19 nt, Homo sapiens
guagcuacuuuaacagaug

SEQ ID NO: 1466082 - RNA, 19 nt, Homo sapiens
acaaaggaaugaugaugau

SEQ ID NO: 1466083 - RNA, 19 nt, Homo sapiens
ggaguuaaggcgaauuguu

SEQ ID NO: 1466084 - RNA, 19 nt, Homo sapiens
cagagaugcugaagauaca

SEQ ID NO: 1466085 - RNA, 19 nt, Homo sapiens
gggaugucaugacguuuga

SEQ ID NO: 1466086 - RNA, 19 nt, Homo sapiens
gauuacggguagucaguug

SEQ ID NO: 1466087 - RNA, 19 nt, Homo sapiens
gaagcuaucagaccacauc

SEQ ID NO: 1466088 - RNA, 19 nt, Homo sapiens
aagagaggauguuauuuag

SEQ ID NO: 1466089 - RNA, 19 nt, Homo sapiens
gugaucacauaaacgauga

SEQ ID NO: 1466090 - RNA, 19 nt, Homo sapiens
ugacgaagaucugguuuac

SEQ ID NO: 1466091 - RNA, 19 nt, Homo sapiens
uaaggcgaauuguucaaga

SEQ ID NO: 1466092 - RNA, 19 nt, Homo sapiens
gaguuaaggcgaauuguuc

SEQ ID NO: 1466093 - RNA, 19 nt, Homo sapiens
guuggccacucccuucuaa

SEQ ID NO: 1466094 - RNA, 19 nt, Homo sapiens
ucuccuggccuguuucuua

SEQ ID NO: 1466095 - RNA, 19 nt, Homo sapiens
ccgaguuacugaugucauu

SEQ ID NO: 1466096 - RNA, 19 nt, Homo sapiens
ugauuucucugccucuuga

SEQ ID NO: 1466097 - RNA, 19 nt, Homo sapiens
guucuagccuaacuucaug

SEQ ID NO: 1466098 - RNA, 19 nt, Homo sapiens
uggccaauuuguuacauaa

SEQ ID NO: 1466099 - RNA, 19 nt, Homo sapiens
caucgaggcucagcaguca

SEQ ID NO: 1466100 - RNA, 19 nt, Homo sapiens
ugagaucgaugggugagaa

SEQ ID NO: 1466101 - RNA, 19 nt, Homo sapiens
aagcugaguuguggcauuu

SEQ ID NO: 1466102 - RNA, 19 nt, Homo sapiens
agaagugagugcuccuuga

SEQ ID NO: 1466103 - RNA, 19 nt, Homo sapiens
ugccagagaugcugaagau

SEQ ID NO: 1466104 - RNA, 19 nt, Homo sapiens
uggagacacuguugaacuu

SEQ ID NO: 1466105 - RNA, 19 nt, Homo sapiens
ggaugcaccgcaaauaaug

SEQ ID NO: 1466106 - RNA, 19 nt, Homo sapiens
gagaaagaucuggaaacua

SEQ ID NO: 1466107 - RNA, 19 nt, Homo sapiens
acacagugaucacauaaac

SEQ ID NO: 1466108 - RNA, 19 nt, Homo sapiens
gaagugagugcuccuugau

SEQ ID NO: 1466109 - RNA, 19 nt, Homo sapiens
acucuggauucuuuacaua

SEQ ID NO: 1466110 - RNA, 19 nt, Homo sapiens
gaacuucaagagaggaugu

SEQ ID NO: 1466111 - RNA, 19 nt, Homo sapiens
guuaugcauuucaaguuug

SEQ ID NO: 1466112 - RNA, 19 nt, Homo sapiens
uaagcugaguuguggcauu

SEQ ID NO: 1466113 - RNA, 19 nt, Homo sapiens
caacguuaguuucucuuac

SEQ ID NO: 1466114 - RNA, 19 nt, Homo sapiens
uaacaaaggaaugaugaug

SEQ ID NO: 1466115 - RNA, 19 nt, Homo sapiens
ugucagcugucuucauuuc

SEQ ID NO: 1466116 - RNA, 19 nt, Homo sapiens
gaugcggagucacauuuca

SEQ ID NO: 1466117 - RNA, 19 nt, Homo sapiens
ugagagguuugccagaguu

SEQ ID NO: 1466118 - RNA, 19 nt, Homo sapiens
cacagaagagacccuauuu

SEQ ID NO: 1466119 - RNA, 19 nt, Homo sapiens
gagaaaacuuggcuugugu

SEQ ID NO: 1466120 - RNA, 19 nt, Homo sapiens
guacuacaugguuuaaguu

SEQ ID NO: 1466121 - RNA, 19 nt, Homo sapiens
gaaagaucuggaaacuauu

SEQ ID NO: 1466122 - RNA, 19 nt, Homo sapiens
caaagaaaccuaacauccu

SEQ ID NO: 1466123 - RNA, 19 nt, Homo sapiens
cuucagaaacaccucaaua

SEQ ID NO: 1466124 - RNA, 19 nt, Homo sapiens
gaauggaugcaccgcaaau

SEQ ID NO: 1466125 - RNA, 19 nt, Homo sapiens
cuacauaggagaaagaucu

SEQ ID NO: 1466126 - RNA, 19 nt, Homo sapiens
ggaaagaaauacacuuaug

SEQ ID NO: 1466127 - RNA, 19 nt, Homo sapiens
caacuuuccucacaaauga

SEQ ID NO: 1466128 - RNA, 19 nt, Homo sapiens
ggacugggaacauuuaaua

SEQ ID NO: 1466129 - RNA, 19 nt, Homo sapiens
caaccaaguuuaucagaaa

SEQ ID NO: 1466130 - RNA, 19 nt, Homo sapiens
ggaaaggccugucuaccau

SEQ ID NO: 1466131 - RNA, 19 nt, Homo sapiens
gaaagaugggcauugauaa

SEQ ID NO: 1466132 - RNA, 19 nt, Homo sapiens
gcacagaguaggcacuuaa

SEQ ID NO: 1466133 - RNA, 19 nt, Homo sapiens
gggcauugauaaaggauuu

SEQ ID NO: 1466134 - RNA, 19 nt, Homo sapiens
gcaaacaacaucaggaaga

SEQ ID NO: 1466135 - RNA, 19 nt, Homo sapiens
gauuggagcuguucguaau

SEQ ID NO: 1466136 - RNA, 19 nt, Homo sapiens
gaaggccacuuaauucuac

SEQ ID NO: 1466137 - RNA, 19 nt, Homo sapiens
ugagaaagaugggcauuga

SEQ ID NO: 1466138 - RNA, 19 nt, Homo sapiens
cagaggagcugguauuugg

SEQ ID NO: 1466139 - RNA, 19 nt, Homo sapiens
gaagcuaccuacagaggau

SEQ ID NO: 1466140 - RNA, 19 nt, Homo sapiens
gcugauguguguacagauu

SEQ ID NO: 1466141 - RNA, 19 nt, Homo sapiens
cagaguaggcacuuaauaa

SEQ ID NO: 1466142 - RNA, 19 nt, Homo sapiens
gaacgggcuugaccuucuu

SEQ ID NO: 1466143 - RNA, 19 nt, Homo sapiens
ugagaugcuuucuauacua

SEQ ID NO: 1466144 - RNA, 19 nt, Homo sapiens
cuucaaccaucuugucaua

SEQ ID NO: 1466145 - RNA, 19 nt, Homo sapiens
agaaagaugggcauugaua

SEQ ID NO: 1466146 - RNA, 19 nt, Homo sapiens
ggaacgggcuugaccuucu

SEQ ID NO: 1466147 - RNA, 19 nt, Homo sapiens
gccaaaugcuugcaaaugg

SEQ ID NO: 1466148 - RNA, 19 nt, Homo sapiens
gcucacgaguggaugguuu

SEQ ID NO: 1466149 - RNA, 19 nt, Homo sapiens
gagaugcuuucuauacuag

SEQ ID NO: 1466150 - RNA, 19 nt, Homo sapiens
ggcuugaccuucuuuauca

SEQ ID NO: 1466151 - RNA, 19 nt, Homo sapiens
guguacagauugcaaauuc

SEQ ID NO: 1466152 - RNA, 19 nt, Homo sapiens
gaaggggucccaccuaaua

SEQ ID NO: 1466153 - RNA, 19 nt, Homo sapiens
ccaaaugcuugcaaaugga

SEQ ID NO: 1466154 - RNA, 19 nt, Homo sapiens
gaaagaaauacacuuaugc

SEQ ID NO: 1466155 - RNA, 19 nt, Homo sapiens
cagauuugcuugagcugaa

SEQ ID NO: 1466156 - RNA, 19 nt, Homo sapiens
gcauagagaggcaccagaa

SEQ ID NO: 1466157 - RNA, 19 nt, Homo sapiens
ugugugagaugcuuucuau

SEQ ID NO: 1466158 - RNA, 19 nt, Homo sapiens
gaaaccagauuugcuugag

SEQ ID NO: 1466159 - RNA, 19 nt, Homo sapiens
gauauucuguguagcugau

SEQ ID NO: 1466160 - RNA, 19 nt, Homo sapiens
gcccaacuuuccucacaaa

SEQ ID NO: 1466161 - RNA, 19 nt, Homo sapiens
gcuccagccuucaccagaa

SEQ ID NO: 1466162 - RNA, 19 nt, Homo sapiens
cgacgaggcccuaggaaug

SEQ ID NO: 1466163 - RNA, 19 nt, Homo sapiens
gaugggcauugauaaagga

SEQ ID NO: 1466164 - RNA, 19 nt, Homo sapiens
ggucuggccuucagggaau

SEQ ID NO: 1466165 - RNA, 19 nt, Homo sapiens
ggccuugucuggcauguuc

SEQ ID NO: 1466166 - RNA, 19 nt, Homo sapiens
aaagaugggcauugauaaa

SEQ ID NO: 1466167 - RNA, 19 nt, Homo sapiens
agaguuuccuuuccugauu

SEQ ID NO: 1466168 - RNA, 19 nt, Homo sapiens
uauuggagcaucacuuuaa

SEQ ID NO: 1466169 - RNA, 19 nt, Homo sapiens
ugggaaagaaauacacuua

SEQ ID NO: 1466170 - RNA, 19 nt, Homo sapiens
cugggaacauuuaauaaga

SEQ ID NO: 1466171 - RNA, 19 nt, Homo sapiens
ucaaccaucuugucauaag

SEQ ID NO: 1466172 - RNA, 19 nt, Homo sapiens
gcaaauggaacgggcuuga

SEQ ID NO: 1466173 - RNA, 19 nt, Homo sapiens
gcaaagcugaguuaaaggu

SEQ ID NO: 1466174 - RNA, 19 nt, Homo sapiens
guacagauugcaaauucaa

SEQ ID NO: 1466175 - RNA, 19 nt, Homo sapiens
caaacaacaucaggaagag

SEQ ID NO: 1466176 - RNA, 19 nt, Homo sapiens
acaaccaaguuuaucagaa

SEQ ID NO: 1466177 - RNA, 19 nt, Homo sapiens
ggugugaggucuuucuuuu

SEQ ID NO: 1466178 - RNA, 19 nt, Homo sapiens
aggaauggguggcaaacaa

SEQ ID NO: 1466179 - RNA, 19 nt, Homo sapiens
agaguaggcacuuaauaaa

SEQ ID NO: 1466180 - RNA, 19 nt, Homo sapiens
ccacugccguuguguuagu

SEQ ID NO: 1466181 - RNA, 19 nt, Homo sapiens
cuuuaucacuccagaaaug

SEQ ID NO: 1466182 - RNA, 19 nt, Homo sapiens
gagauuggagcuguucgua

SEQ ID NO: 1466183 - RNA, 19 nt, Homo sapiens
auaaacuccugcugcauga

SEQ ID NO: 1466184 - RNA, 19 nt, Homo sapiens
agaggcaucuuaugagagu

SEQ ID NO: 1466185 - RNA, 19 nt, Homo sapiens
uagcugauguguguacaga

SEQ ID NO: 1466186 - RNA, 19 nt, Homo sapiens
ugaaggccacuuaauucua

SEQ ID NO: 1466187 - RNA, 19 nt, Homo sapiens
gggaaagaaauacacuuau

SEQ ID NO: 1466188 - RNA, 19 nt, Homo sapiens
gacacauccucgacccaaa

SEQ ID NO: 1466189 - RNA, 19 nt, Homo sapiens
gggcuugaccuucuuuauc

SEQ ID NO: 1466190 - RNA, 19 nt, Homo sapiens
gaguuuccuuuccugauuc

SEQ ID NO: 1466191 - RNA, 19 nt, Homo sapiens
gagcuguucguaauuguuc

SEQ ID NO: 1466192 - RNA, 19 nt, Homo sapiens
uuuggaagcuaccuacaga

SEQ ID NO: 1466193 - RNA, 19 nt, Homo sapiens
cuguguagcugaugugugu

SEQ ID NO: 1466194 - RNA, 19 nt, Homo sapiens
gugagaugcuuucuauacu

SEQ ID NO: 1466195 - RNA, 19 nt, Homo sapiens
ccaacuuuccucacaaaug

SEQ ID NO: 1466196 - RNA, 19 nt, Homo sapiens
caaaugcuugcaaauggaa

SEQ ID NO: 1466197 - RNA, 19 nt, Homo sapiens
gaucgacgaggcccuagga

SEQ ID NO: 1466198 - RNA, 19 nt, Homo sapiens
gaggagcugguauuuggaa

SEQ ID NO: 1466199 - RNA, 19 nt, Homo sapiens
acagaaaccagauuugcuu

SEQ ID NO: 1466200 - RNA, 19 nt, Homo sapiens
gauacagaaaccagauuug

SEQ ID NO: 1466201 - RNA, 19 nt, Homo sapiens
ccugaaggccacuuaauuc

SEQ ID NO: 1466202 - RNA, 19 nt, Homo sapiens
uguggaugcuucaaaggaa

SEQ ID NO: 1466203 - RNA, 19 nt, Homo sapiens
caaguguggaugcuucaaa

SEQ ID NO: 1466204 - RNA, 19 nt, Homo sapiens
acgaguggaugguuugaug

SEQ ID NO: 1466205 - RNA, 19 nt, Homo sapiens
ccaaagcucacgaguggau

SEQ ID NO: 1466206 - RNA, 19 nt, Homo sapiens
cauuuaagaugccaaagcu

SEQ ID NO: 1466207 - RNA, 19 nt, Homo sapiens
ggucaccccugcugagaaa

SEQ ID NO: 1466208 - RNA, 19 nt, Homo sapiens
gacugggaacauuuaauaa

SEQ ID NO: 1466209 - RNA, 19 nt, Homo sapiens
acagaguaggcacuuaaua

SEQ ID NO: 1466210 - RNA, 19 nt, Homo sapiens
ucuauuggagcaucacuuu

SEQ ID NO: 1466211 - RNA, 19 nt, Homo sapiens
gcuucuggcuucugagagu

SEQ ID NO: 1466212 - RNA, 19 nt, Homo sapiens
uuacagaucaaacaaccaa

SEQ ID NO: 1466213 - RNA, 19 nt, Homo sapiens
aguaggcacuuaauaaacu

SEQ ID NO: 1466214 - RNA, 19 nt, Homo sapiens
cgaccucgcccuucagauc

SEQ ID NO: 1466215 - RNA, 19 nt, Homo sapiens
gagcaucacuuuaaaaccu

SEQ ID NO: 1466216 - RNA, 19 nt, Homo sapiens
ggaucgccauggcaaccuu

SEQ ID NO: 1466217 - RNA, 19 nt, Homo sapiens
aaaggccugucuaccaugu

SEQ ID NO: 1466218 - RNA, 19 nt, Homo sapiens
ggaggaaaggccugucuac

SEQ ID NO: 1466219 - RNA, 19 nt, Homo sapiens
ggcacagaguaggcacuua

SEQ ID NO: 1466220 - RNA, 19 nt, Homo sapiens
cuucaaggaaacaacauaa

SEQ ID NO: 1466221 - RNA, 19 nt, Homo sapiens
caagacacgcauuccugaa

SEQ ID NO: 1466222 - RNA, 19 nt, Homo sapiens
uaagauacagaaaccagau

SEQ ID NO: 1466223 - RNA, 19 nt, Homo sapiens
ugccacugccguuguguua

SEQ ID NO: 1466224 - RNA, 19 nt, Homo sapiens
cagaucaaacaaccaaguu

SEQ ID NO: 1466225 - RNA, 19 nt, Homo sapiens
ggagcuguucguaauuguu

SEQ ID NO: 1466226 - RNA, 19 nt, Homo sapiens
gaaauauccuugagcaaua

SEQ ID NO: 1466227 - RNA, 19 nt, Homo sapiens
gaacaaagcaguccagaug

SEQ ID NO: 1466228 - RNA, 19 nt, Homo sapiens
ggauuaaccuugaccagua

SEQ ID NO: 1466229 - RNA, 19 nt, Homo sapiens
gaucaagcccucuacauaa

SEQ ID NO: 1466230 - RNA, 19 nt, Homo sapiens
gagaauagaugaagcaaac

SEQ ID NO: 1466231 - RNA, 19 nt, Homo sapiens
agaaagaucagcuggauua

SEQ ID NO: 1466232 - RNA, 19 nt, Homo sapiens
agacaaagguuaaguuaca

SEQ ID NO: 1466233 - RNA, 19 nt, Homo sapiens
gcaaagccauauccagaga

SEQ ID NO: 1466234 - RNA, 19 nt, Homo sapiens
gaagaaacagccagacuug

SEQ ID NO: 1466235 - RNA, 19 nt, Homo sapiens
gcucagaugcuucuucuuu

SEQ ID NO: 1466236 - RNA, 19 nt, Homo sapiens
gagggaaucuacaauggaa

SEQ ID NO: 1466237 - RNA, 19 nt, Homo sapiens
gaaggaguaugcauuugug

SEQ ID NO: 1466238 - RNA, 19 nt, Homo sapiens
gaaagagauuugcuucagu

SEQ ID NO: 1466239 - RNA, 19 nt, Homo sapiens
cgucaucuuuccaggauua

SEQ ID NO: 1466240 - RNA, 19 nt, Homo sapiens
acagcaagauuauucagua

SEQ ID NO: 1466241 - RNA, 19 nt, Homo sapiens
gaagacaagacacaucaaa

SEQ ID NO: 1466242 - RNA, 19 nt, Homo sapiens
ggaaagagauuugcuucag

SEQ ID NO: 1466243 - RNA, 19 nt, Homo sapiens
gauuaaccuugaccaguaa

SEQ ID NO: 1466244 - RNA, 19 nt, Homo sapiens
gaaacagccagacuugaaa

SEQ ID NO: 1466245 - RNA, 19 nt, Homo sapiens
caagaaagaucagcuggau

SEQ ID NO: 1466246 - RNA, 19 nt, Homo sapiens
aaagagauuugcuucaguu

SEQ ID NO: 1466247 - RNA, 19 nt, Homo sapiens
ugagacagaggacauguua

SEQ ID NO: 1466248 - RNA, 19 nt, Homo sapiens
cagcaagauuauucaguaa

SEQ ID NO: 1466249 - RNA, 19 nt, Homo sapiens
gagcauaccagccaaaaua

SEQ ID NO: 1466250 - RNA, 19 nt, Homo sapiens
gaaagugagaucauucaga

SEQ ID NO: 1466251 - RNA, 19 nt, Homo sapiens
ggaagaaacagccagacuu

SEQ ID NO: 1466252 - RNA, 19 nt, Homo sapiens
aagaucagcuggauuaagu

SEQ ID NO: 1466253 - RNA, 19 nt, Homo sapiens
ucaagguaaugaaggagua

SEQ ID NO: 1466254 - RNA, 19 nt, Homo sapiens
uagaagagacaaagguuaa

SEQ ID NO: 1466255 - RNA, 19 nt, Homo sapiens
caagauuggcucagucaaa

SEQ ID NO: 1466256 - RNA, 19 nt, Homo sapiens
auaaagaaguaccaggaaa

SEQ ID NO: 1466257 - RNA, 19 nt, Homo sapiens
gcuggaaagugagaucauu

SEQ ID NO: 1466258 - RNA, 19 nt, Homo sapiens
ggauuaaguagucaugauu

SEQ ID NO: 1466259 - RNA, 19 nt, Homo sapiens
agagacaaagguuaaguua

SEQ ID NO: 1466260 - RNA, 19 nt, Homo sapiens
guagaagggaggcaugaaa

SEQ ID NO: 1466261 - RNA, 19 nt, Homo sapiens
ccacugauucccuaagaaa

SEQ ID NO: 1466262 - RNA, 19 nt, Homo sapiens
aaagacagcaagauuauuc

SEQ ID NO: 1466263 - RNA, 19 nt, Homo sapiens
gagcaugaacccuguggaa

SEQ ID NO: 1466264 - RNA, 19 nt, Homo sapiens
cagccagacuugaaaggaa

SEQ ID NO: 1466265 - RNA, 19 nt, Homo sapiens
ccaaaagacagcaagauua

SEQ ID NO: 1466266 - RNA, 19 nt, Homo sapiens
caagcccucuacauaaaga

SEQ ID NO: 1466267 - RNA, 19 nt, Homo sapiens
gaacuucaacaaaagcuua

SEQ ID NO: 1466268 - RNA, 19 nt, Homo sapiens
gggagggaaucuacaaugg

SEQ ID NO: 1466269 - RNA, 19 nt, Homo sapiens
gaagggaggcaugaaacuu

SEQ ID NO: 1466270 - RNA, 19 nt, Homo sapiens
agaucaagcccucuacaua

SEQ ID NO: 1466271 - RNA, 19 nt, Homo sapiens
ugcaggagcuggaggaaga

SEQ ID NO: 1466272 - RNA, 19 nt, Homo sapiens
gaaagaucagcuggauuaa

SEQ ID NO: 1466273 - RNA, 19 nt, Homo sapiens
cacaaaagauaaccaauug

SEQ ID NO: 1466274 - RNA, 19 nt, Homo sapiens
gacuugaaaggaagaauaa

SEQ ID NO: 1466275 - RNA, 19 nt, Homo sapiens
agaaacagccagacuugaa

SEQ ID NO: 1466276 - RNA, 19 nt, Homo sapiens
gacaaagguuaaguuacaa

SEQ ID NO: 1466277 - RNA, 19 nt, Homo sapiens
ugacccagcucugugaaga

SEQ ID NO: 1466278 - RNA, 19 nt, Homo sapiens
agacguugguccacaguau

SEQ ID NO: 1466279 - RNA, 19 nt, Homo sapiens
aaaggaagaauaagacguu

SEQ ID NO: 1466280 - RNA, 19 nt, Homo sapiens
gaaagggauacgcagagaa

SEQ ID NO: 1466281 - RNA, 19 nt, Homo sapiens
ugaaagggauacgcagaga

SEQ ID NO: 1466282 - RNA, 19 nt, Homo sapiens
caagagagggaagauaaga

SEQ ID NO: 1466283 - RNA, 19 nt, Homo sapiens
ggaggaaagagauuugcuu

SEQ ID NO: 1466284 - RNA, 19 nt, Homo sapiens
gaggcucuguuccuugaga

SEQ ID NO: 1466285 - RNA, 19 nt, Homo sapiens
cuagaagagacaaagguua

SEQ ID NO: 1466286 - RNA, 19 nt, Homo sapiens
aacaaaagcuuacaaggaa

SEQ ID NO: 1466287 - RNA, 19 nt, Homo sapiens
agacuugaaaggaagaaua

SEQ ID NO: 1466288 - RNA, 19 nt, Homo sapiens
gaaggacacaagaaagauc

SEQ ID NO: 1466289 - RNA, 19 nt, Homo sapiens
caacaaaagcuuacaagga

SEQ ID NO: 1466290 - RNA, 19 nt, Homo sapiens
ggagggaaucuacaaugga

SEQ ID NO: 1466291 - RNA, 19 nt, Homo sapiens
gcaggagcaccuuguggaa

SEQ ID NO: 1466292 - RNA, 19 nt, Homo sapiens
caggaaacguugaagaaaa

SEQ ID NO: 1466293 - RNA, 19 nt, Homo sapiens
agaaguaccaggaaacguu

SEQ ID NO: 1466294 - RNA, 19 nt, Homo sapiens
gaagagacaaagguuaagu

SEQ ID NO: 1466295 - RNA, 19 nt, Homo sapiens
acaaggaaaucacaaaaga

SEQ ID NO: 1466296 - RNA, 19 nt, Homo sapiens
ggaagaauaagacguuggu

SEQ ID NO: 1466297 - RNA, 19 nt, Homo sapiens
gcagagaauagaugaagca

SEQ ID NO: 1466298 - RNA, 19 nt, Homo sapiens
agaaauauccuugagcaau

SEQ ID NO: 1466299 - RNA, 19 nt, Homo sapiens
ucaauguacugcccaaggu

SEQ ID NO: 1466300 - RNA, 19 nt, Homo sapiens
cagaucuccucgucaaugu

SEQ ID NO: 1466301 - RNA, 19 nt, Homo sapiens
ccaggaaacguugaagaaa

SEQ ID NO: 1466302 - RNA, 19 nt, Homo sapiens
gaaaauggaaaucucaaga

SEQ ID NO: 1466303 - RNA, 19 nt, Homo sapiens
guuugaacauggaccuuga

SEQ ID NO: 1466304 - RNA, 19 nt, Homo sapiens
uucagaggcuggaaaguga

SEQ ID NO: 1466305 - RNA, 19 nt, Homo sapiens
uccaagagagggaagauaa

SEQ ID NO: 1466306 - RNA, 19 nt, Homo sapiens
ggaaggacacaagaaagau

SEQ ID NO: 1466307 - RNA, 19 nt, Homo sapiens
caugaaacuuguggaggaa

SEQ ID NO: 1466308 - RNA, 19 nt, Homo sapiens
acugauucccuaagaaaua

SEQ ID NO: 1466309 - RNA, 19 nt, Homo sapiens
gaagaucaagcccucuaca

SEQ ID NO: 1466310 - RNA, 19 nt, Homo sapiens
gguccacaguauaacagaa

SEQ ID NO: 1466311 - RNA, 19 nt, Homo sapiens
caaaagacagcaagauuau

SEQ ID NO: 1466312 - RNA, 19 nt, Homo sapiens
ucagcuggauuaaguaguc

SEQ ID NO: 1466313 - RNA, 19 nt, Homo sapiens
agagagggaagauaagauu

SEQ ID NO: 1466314 - RNA, 19 nt, Homo sapiens
ccuaagaaauauccuugag

SEQ ID NO: 1466315 - RNA, 19 nt, Homo sapiens
aucaagcccucuacauaaa

SEQ ID NO: 1466316 - RNA, 19 nt, Homo sapiens
guagucaugauuaugcaaa

SEQ ID NO: 1466317 - RNA, 19 nt, Homo sapiens
cauaaagaaguaccaggaa

SEQ ID NO: 1466318 - RNA, 19 nt, Homo sapiens
gacguugguccacaguaua

SEQ ID NO: 1466319 - RNA, 19 nt, Homo sapiens
guaaagcaggucggagaaa

SEQ ID NO: 1466320 - RNA, 19 nt, Homo sapiens
aaagggauacgcagagaau

SEQ ID NO: 1466321 - RNA, 19 nt, Homo sapiens
uuccaucucucacacuuga

SEQ ID NO: 1466322 - RNA, 19 nt, Homo sapiens
ugaaggaguaugcauuugu

SEQ ID NO: 1466323 - RNA, 19 nt, Homo sapiens
ccguuugccugcuugacua

SEQ ID NO: 1466324 - RNA, 19 nt, Homo sapiens
uaaagcaggucggagaaaa

SEQ ID NO: 1466325 - RNA, 19 nt, Homo sapiens
cugauucccuaagaaauau

SEQ ID NO: 1466326 - RNA, 19 nt, Homo sapiens
gcaaucagcuggcucuaua

SEQ ID NO: 1466327 - RNA, 19 nt, Homo sapiens
ggagaaguguccuguuuca

SEQ ID NO: 1466328 - RNA, 19 nt, Homo sapiens
ggacuucucccauguaguu

SEQ ID NO: 1466329 - RNA, 19 nt, Homo sapiens
gcaagacacuguuucucau

SEQ ID NO: 1466330 - RNA, 19 nt, Homo sapiens
gaaggaagggcaugaggaa

SEQ ID NO: 1466331 - RNA, 19 nt, Homo sapiens
ucagcagccuaguauguua

SEQ ID NO: 1466332 - RNA, 19 nt, Homo sapiens
agacacuguuucucauaua

SEQ ID NO: 1466333 - RNA, 19 nt, Homo sapiens
gcuagauucucuucauugu

SEQ ID NO: 1466334 - RNA, 19 nt, Homo sapiens
gaacuaccuccaagagaga

SEQ ID NO: 1466335 - RNA, 19 nt, Homo sapiens
caagacacuguuucucaua

SEQ ID NO: 1466336 - RNA, 19 nt, Homo sapiens
gguguggccugcaaaggaa

SEQ ID NO: 1466337 - RNA, 19 nt, Homo sapiens
gcaugaacuuuucugaaua

SEQ ID NO: 1466338 - RNA, 19 nt, Homo sapiens
gacacuguuucucauauau

SEQ ID NO: 1466339 - RNA, 19 nt, Homo sapiens
caccuggucuuugaaguuu

SEQ ID NO: 1466340 - RNA, 19 nt, Homo sapiens
ggaagggcaugaggaaugg

SEQ ID NO: 1466341 - RNA, 19 nt, Homo sapiens
uagauucucuucauugucu

SEQ ID NO: 1466342 - RNA, 19 nt, Homo sapiens
ggccaaggcuagauucucu

SEQ ID NO: 1466343 - RNA, 19 nt, Homo sapiens
gaaccucgucgcgacauuu

SEQ ID NO: 1466344 - RNA, 19 nt, Homo sapiens
gguguauucuggaugucua

SEQ ID NO: 1466345 - RNA, 19 nt, Homo sapiens
gaagaaggggcgucuaaaa

SEQ ID NO: 1466346 - RNA, 19 nt, Homo sapiens
gcccagggauccacuugug

SEQ ID NO: 1466347 - RNA, 19 nt, Homo sapiens
gaagauaaacaggagaagu

SEQ ID NO: 1466348 - RNA, 19 nt, Homo sapiens
ccacuugugugucuuucug

SEQ ID NO: 1466349 - RNA, 19 nt, Homo sapiens
ggcaagacacuguuucuca

SEQ ID NO: 1466350 - RNA, 19 nt, Homo sapiens
gggauccacuugugugucu

SEQ ID NO: 1466351 - RNA, 19 nt, Homo sapiens
gcucuuccauuggucauca

SEQ ID NO: 1466352 - RNA, 19 nt, Homo sapiens
gcugcuccaucuccgcuaa

SEQ ID NO: 1466353 - RNA, 19 nt, Homo sapiens
ccauauugcugguccugau

SEQ ID NO: 1466354 - RNA, 19 nt, Homo sapiens
ugaaguuucuguccuacca

SEQ ID NO: 1466355 - RNA, 19 nt, Homo sapiens
aagacacuguuucucauau

SEQ ID NO: 1466356 - RNA, 19 nt, Homo sapiens
agaccaggcugcuccaucu

SEQ ID NO: 1466357 - RNA, 19 nt, Homo sapiens
ccaccuggucuuugaaguu

SEQ ID NO: 1466358 - RNA, 19 nt, Homo sapiens
cagaagauaaacaggagaa

SEQ ID NO: 1466359 - RNA, 19 nt, Homo sapiens
gggauaauugucuuuagug

SEQ ID NO: 1466360 - RNA, 19 nt, Homo sapiens
ggccagcccaugcaucuug

SEQ ID NO: 1466361 - RNA, 19 nt, Homo sapiens
aagauaaacaggagaagug

SEQ ID NO: 1466362 - RNA, 19 nt, Homo sapiens
gccuuucguuucccuauuc

SEQ ID NO: 1466363 - RNA, 19 nt, Homo sapiens
gauccacuugugugucuuu

SEQ ID NO: 1466364 - RNA, 19 nt, Homo sapiens
ugggauaauugucuuuagu

SEQ ID NO: 1466365 - RNA, 19 nt, Homo sapiens
cuuugaaguuucuguccua

SEQ ID NO: 1466366 - RNA, 19 nt, Homo sapiens
ucucuucauugucuccauu

SEQ ID NO: 1466367 - RNA, 19 nt, Homo sapiens
aggcuagauucucuucauu

SEQ ID NO: 1466368 - RNA, 19 nt, Homo sapiens
aaugguguauucuggaugu

SEQ ID NO: 1466369 - RNA, 19 nt, Homo sapiens
ucaaggccaaggcuagauu

SEQ ID NO: 1466370 - RNA, 19 nt, Homo sapiens
ccaguauugccuuucguuu

SEQ ID NO: 1466371 - RNA, 19 nt, Homo sapiens
ccucagcagccuaguaugu

SEQ ID NO: 1466372 - RNA, 19 nt, Homo sapiens
ucagcuggcucuauaucag

SEQ ID NO: 1466373 - RNA, 19 nt, Homo sapiens
ucuggauccuuggagcuua

SEQ ID NO: 1466374 - RNA, 19 nt, Homo sapiens
gagcuccuauagggcaaga

SEQ ID NO: 1466375 - RNA, 19 nt, Homo sapiens
ggcuagauucucuucauug

SEQ ID NO: 1466376 - RNA, 19 nt, Homo sapiens
uauucuggaugucuacuca

SEQ ID NO: 1466377 - RNA, 19 nt, Homo sapiens
agccuaguauguuaugcua

SEQ ID NO: 1466378 - RNA, 19 nt, Homo sapiens
gcccaugcaucuuguucag

SEQ ID NO: 1466379 - RNA, 19 nt, Homo sapiens
cgaagggugccaucugcuu

SEQ ID NO: 1466380 - RNA, 19 nt, Homo sapiens
gauccaaaggguucaaagg

SEQ ID NO: 1466381 - RNA, 19 nt, Homo sapiens
acagcucccucucccacuu

SEQ ID NO: 1466382 - RNA, 19 nt, Homo sapiens
gcuaacagcccagggaacu

SEQ ID NO: 1466383 - RNA, 19 nt, Homo sapiens
aaggcuagauucucuucau

SEQ ID NO: 1466384 - RNA, 19 nt, Homo sapiens
aggaagggcaugaggaaug

SEQ ID NO: 1466385 - RNA, 19 nt, Homo sapiens
caguauugccuuucguuuc

SEQ ID NO: 1466386 - RNA, 19 nt, Homo sapiens
cauccucagcagccuagua

SEQ ID NO: 1466387 - RNA, 19 nt, Homo sapiens
gaagaaacgucaaagugaa

SEQ ID NO: 1466388 - RNA, 19 nt, Homo sapiens
gaacaacacugaagaaacg

SEQ ID NO: 1466389 - RNA, 19 nt, Homo sapiens
ggacacugcagccauauaa

SEQ ID NO: 1466390 - RNA, 19 nt, Homo sapiens
gaccaagaaugaaacuauu

SEQ ID NO: 1466391 - RNA, 19 nt, Homo sapiens
ccaguucaguccaguauga

SEQ ID NO: 1466392 - RNA, 19 nt, Homo sapiens
aaauuaagaugccaacaga

SEQ ID NO: 1466393 - RNA, 19 nt, Homo sapiens
caaagugaaccaaaucauu

SEQ ID NO: 1466394 - RNA, 19 nt, Homo sapiens
ugaagaaacgucaaaguga

SEQ ID NO: 1466395 - RNA, 19 nt, Homo sapiens
gcuccagcauccaaacuaa

SEQ ID NO: 1466396 - RNA, 19 nt, Homo sapiens
uacaggagcucguugugaa

SEQ ID NO: 1466397 - RNA, 19 nt, Homo sapiens
aaagugaaccaaaucauug

SEQ ID NO: 1466398 - RNA, 19 nt, Homo sapiens
ggcauuggcgguccuagua

SEQ ID NO: 1466399 - RNA, 19 nt, Homo sapiens
gccaacagaucacgaagag

SEQ ID NO: 1466400 - RNA, 19 nt, Homo sapiens
ugaaacaccacuagguaaa

SEQ ID NO: 1466401 - RNA, 19 nt, Homo sapiens
ccaccacagucaugaacaa

SEQ ID NO: 1466402 - RNA, 19 nt, Homo sapiens
ccuaguaacacuuaucauu

SEQ ID NO: 1466403 - RNA, 19 nt, Homo sapiens
gcuguugucugcgguauuc

SEQ ID NO: 1466404 - RNA, 19 nt, Homo sapiens
cuaguaacacuuaucauug

SEQ ID NO: 1466405 - RNA, 19 nt, Homo sapiens
gauaucaaccugguagaga

SEQ ID NO: 1466406 - RNA, 19 nt, Homo sapiens
ugaccaagaaugaaacuau

SEQ ID NO: 1466407 - RNA, 19 nt, Homo sapiens
aaugaaacaccacuaggua

SEQ ID NO: 1466408 - RNA, 19 nt, Homo sapiens
guaaccuguuugaagcuuu

SEQ ID NO: 1466409 - RNA, 19 nt, Homo sapiens
guuaugugauaccuacuau

SEQ ID NO: 1466410 - RNA, 19 nt, Homo sapiens
gcagccauauaaaucagau

SEQ ID NO: 1466411 - RNA, 19 nt, Homo sapiens
ggagccuucuacuuccuuu

SEQ ID NO: 1466412 - RNA, 19 nt, Homo sapiens
cauuggagccuucuacuuc

SEQ ID NO: 1466413 - RNA, 19 nt, Homo sapiens
uaguaacacuuaucauugg

SEQ ID NO: 1466414 - RNA, 19 nt, Homo sapiens
uuucaacccuacucucuug

SEQ ID NO: 1466415 - RNA, 19 nt, Homo sapiens
uaacucguaucaugaacca

SEQ ID NO: 1466416 - RNA, 19 nt, Homo sapiens
gcauuggcgguccuaguaa

SEQ ID NO: 1466417 - RNA, 19 nt, Homo sapiens
uaugugauaccuacuauuc

SEQ ID NO: 1466418 - RNA, 19 nt, Homo sapiens
guaggugcguugaaaacua

SEQ ID NO: 1466419 - RNA, 19 nt, Homo sapiens
caaauuaagaugccaacag

SEQ ID NO: 1466420 - RNA, 19 nt, Homo sapiens
gugaaccaaaucauuguuu

SEQ ID NO: 1466421 - RNA, 19 nt, Homo sapiens
gaaaaugaaacaccacuag

SEQ ID NO: 1466422 - RNA, 19 nt, Homo sapiens
acacugcagccauauaaau

SEQ ID NO: 1466423 - RNA, 19 nt, Homo sapiens
gcgguccuaguaacacuua

SEQ ID NO: 1466424 - RNA, 19 nt, Homo sapiens
caugaacaacacugaagaa

SEQ ID NO: 1466425 - RNA, 19 nt, Homo sapiens
guucaguccaguaugauau

SEQ ID NO: 1466426 - RNA, 19 nt, Homo sapiens
uuguguaacucguaucaug

SEQ ID NO: 1466427 - RNA, 19 nt, Homo sapiens
uuacaaaggcagaaaauga

SEQ ID NO: 1466428 - RNA, 19 nt, Homo sapiens
cugaagaaacgucaaagug

SEQ ID NO: 1466429 - RNA, 19 nt, Homo sapiens
acacugaagaaacgucaaa

SEQ ID NO: 1466430 - RNA, 19 nt, Homo sapiens
ccacagucaugaacaacac

SEQ ID NO: 1466431 - RNA, 19 nt, Homo sapiens
ccacuagguaaaagaauua

SEQ ID NO: 1466432 - RNA, 19 nt, Homo sapiens
gaugccaacagaucacgaa

SEQ ID NO: 1466433 - RNA, 19 nt, Homo sapiens
gcauguccaacaaaauuua

SEQ ID NO: 1466434 - RNA, 19 nt, Homo sapiens
auaaaacgcuuguguaacu

SEQ ID NO: 1466435 - RNA, 19 nt, Homo sapiens
acucguaucaugaaccaaa

SEQ ID NO: 1466436 - RNA, 19 nt, Homo sapiens
gaaacaccacuagguaaaa

SEQ ID NO: 1466437 - RNA, 19 nt, Homo sapiens
aaacacugcauguccaaca

SEQ ID NO: 1466438 - RNA, 19 nt, Homo sapiens
guagagacgagcaguacca

SEQ ID NO: 1466439 - RNA, 19 nt, Homo sapiens
uugugugaauguacuguuu

SEQ ID NO: 1466440 - RNA, 19 nt, Homo sapiens
gacacugcagccauauaaa

SEQ ID NO: 1466441 - RNA, 19 nt, Homo sapiens
uaaccuguuugaagcuuuu

SEQ ID NO: 1466442 - RNA, 19 nt, Homo sapiens
guguaacucguaucaugaa

SEQ ID NO: 1466443 - RNA, 19 nt, Homo sapiens
aaaugaaacaccacuaggu

SEQ ID NO: 1466444 - RNA, 19 nt, Homo sapiens
uuaagaugccaacagauca

SEQ ID NO: 1466445 - RNA, 19 nt, Homo sapiens
aaaaguaaccuguuugaag

SEQ ID NO: 1466446 - RNA, 19 nt, Homo sapiens
cgucaaagugaaccaaauc

SEQ ID NO: 1466447 - RNA, 19 nt, Homo sapiens
ccagugcccaccacaguca

SEQ ID NO: 1466448 - RNA, 19 nt, Homo sapiens
gagccaguucaguccagua

SEQ ID NO: 1466449 - RNA, 19 nt, Homo sapiens
acccuacucucuugaccaa

SEQ ID NO: 1466450 - RNA, 19 nt, Homo sapiens
ucaugaacaacacugaaga

SEQ ID NO: 1466451 - RNA, 19 nt, Homo sapiens
caaagaaacucauuacuga

SEQ ID NO: 1466452 - RNA, 19 nt, Homo sapiens
gugcaguucuugcugauua

SEQ ID NO: 1466453 - RNA, 19 nt, Homo sapiens
gacagagacuggagccaua

SEQ ID NO: 1466454 - RNA, 19 nt, Homo sapiens
gaacagauaaugcaagaag

SEQ ID NO: 1466455 - RNA, 19 nt, Homo sapiens
gguauaagcugguggaacu

SEQ ID NO: 1466456 - RNA, 19 nt, Homo sapiens
ggauguguuugcaaaguuu

SEQ ID NO: 1466457 - RNA, 19 nt, Homo sapiens
ggaggaggaugccgagaug

SEQ ID NO: 1466458 - RNA, 19 nt, Homo sapiens
gcaaugaguguaauguauu

SEQ ID NO: 1466459 - RNA, 19 nt, Homo sapiens
uguaaacgcuucaaugugu

SEQ ID NO: 1466460 - RNA, 19 nt, Homo sapiens
agaagaagauuccgaucaa

SEQ ID NO: 1466461 - RNA, 19 nt, Homo sapiens
agaaggaacacauaaguaa

SEQ ID NO: 1466462 - RNA, 19 nt, Homo sapiens
gauccaaagaaacucauua

SEQ ID NO: 1466463 - RNA, 19 nt, Homo sapiens
guguguagcuuuaggaugu

SEQ ID NO: 1466464 - RNA, 19 nt, Homo sapiens
ccaaagaaacucauuacug

SEQ ID NO: 1466465 - RNA, 19 nt, Homo sapiens
gcuauuaucaggucuccua

SEQ ID NO: 1466466 - RNA, 19 nt, Homo sapiens
acacuuacauccucaucaa

SEQ ID NO: 1466467 - RNA, 19 nt, Homo sapiens
uaucaggucuccuaacuac

SEQ ID NO: 1466468 - RNA, 19 nt, Homo sapiens
gaacccagggagcauauug

SEQ ID NO: 1466469 - RNA, 19 nt, Homo sapiens
ucuuagggcucaucuuuau

SEQ ID NO: 1466470 - RNA, 19 nt, Homo sapiens
gaagaagauuccgaucaag

SEQ ID NO: 1466471 - RNA, 19 nt, Homo sapiens
gccuauauccuuauuaugu

SEQ ID NO: 1466472 - RNA, 19 nt, Homo sapiens
caagaaggaacacauaagu

SEQ ID NO: 1466473 - RNA, 19 nt, Homo sapiens
gcaguacugugaggcuuug

SEQ ID NO: 1466474 - RNA, 19 nt, Homo sapiens
gaccaaggcacgcccacua

SEQ ID NO: 1466475 - RNA, 19 nt, Homo sapiens
uggaacagauaaugcaaga

SEQ ID NO: 1466476 - RNA, 19 nt, Homo sapiens
uguccgagcuggugcaguu

SEQ ID NO: 1466477 - RNA, 19 nt, Homo sapiens
gcuguaaacgcuucaaugu

SEQ ID NO: 1466478 - RNA, 19 nt, Homo sapiens
uggccaagguccauaauca

SEQ ID NO: 1466479 - RNA, 19 nt, Homo sapiens
gcaagaaggaacacauaag

SEQ ID NO: 1466480 - RNA, 19 nt, Homo sapiens
uucaauguguguagcuuua

SEQ ID NO: 1466481 - RNA, 19 nt, Homo sapiens
gaaaccagcaagaugaaag

SEQ ID NO: 1466482 - RNA, 19 nt, Homo sapiens
uuaaagaccagaagaagau

SEQ ID NO: 1466483 - RNA, 19 nt, Homo sapiens
gcaacaccaucaaggaaac

SEQ ID NO: 1466484 - RNA, 19 nt, Homo sapiens
ggacuacaaggacaucuuc

SEQ ID NO: 1466485 - RNA, 19 nt, Homo sapiens
cgucuuagggcucaucuuu

SEQ ID NO: 1466486 - RNA, 19 nt, Homo sapiens
ggccagcgcaguacuguga

SEQ ID NO: 1466487 - RNA, 19 nt, Homo sapiens
gaaggaacacauaaguaag

SEQ ID NO: 1466488 - RNA, 19 nt, Homo sapiens
gacccaaaggcacaguuua

SEQ ID NO: 1466489 - RNA, 19 nt, Homo sapiens
ccagcaagaugaaaguucu

SEQ ID NO: 1466490 - RNA, 19 nt, Homo sapiens
cgacagcguuaccuggaau

SEQ ID NO: 1466491 - RNA, 19 nt, Homo sapiens
gggcaacaccaucaaggaa

SEQ ID NO: 1466492 - RNA, 19 nt, Homo sapiens
uuuaggauguguuugcaaa

SEQ ID NO: 1466493 - RNA, 19 nt, Homo sapiens
acacauaaguaaguugcuu

SEQ ID NO: 1466494 - RNA, 19 nt, Homo sapiens
gauaaugcaagaaggaaca

SEQ ID NO: 1466495 - RNA, 19 nt, Homo sapiens
cuacgggccuccugaugau

SEQ ID NO: 1466496 - RNA, 19 nt, Homo sapiens
aagaaggaacacauaagua

SEQ ID NO: 1466497 - RNA, 19 nt, Homo sapiens
gugaggcuuuggcagauga

SEQ ID NO: 1466498 - RNA, 19 nt, Homo sapiens
gcgacagcguuaccuggaa

SEQ ID NO: 1466499 - RNA, 19 nt, Homo sapiens
caccaagaagcauuuaauu

SEQ ID NO: 1466500 - RNA, 19 nt, Homo sapiens
ccaccaagaagcauuuaau

SEQ ID NO: 1466501 - RNA, 19 nt, Homo sapiens
cagaagaagauuccgauca

SEQ ID NO: 1466502 - RNA, 19 nt, Homo sapiens
gaaaguucuuaaguuugug

SEQ ID NO: 1466503 - RNA, 19 nt, Homo sapiens
ggaaaccagcaagaugaaa

SEQ ID NO: 1466504 - RNA, 19 nt, Homo sapiens
agcaaugaguguaauguau

SEQ ID NO: 1466505 - RNA, 19 nt, Homo sapiens
ccagcuccauccucuugaa

SEQ ID NO: 1466506 - RNA, 19 nt, Homo sapiens
ggagauccaaagaaacuca

SEQ ID NO: 1466507 - RNA, 19 nt, Homo sapiens
ggcaacaccaucaaggaaa

SEQ ID NO: 1466508 - RNA, 19 nt, Homo sapiens
auaaguaaguugcuuuggu

SEQ ID NO: 1466509 - RNA, 19 nt, Homo sapiens
uuggaaaacuugacuauga

SEQ ID NO: 1466510 - RNA, 19 nt, Homo sapiens
gaacgaacccagggagcau

SEQ ID NO: 1466511 - RNA, 19 nt, Homo sapiens
gaacccaagagcaacacuu

SEQ ID NO: 1466512 - RNA, 19 nt, Homo sapiens
gauuaaagaccagaagaag

SEQ ID NO: 1466513 - RNA, 19 nt, Homo sapiens
caguacgucuucggguaua

SEQ ID NO: 1466514 - RNA, 19 nt, Homo sapiens
ggccagaccucagccuagu

SEQ ID NO: 1466515 - RNA, 19 nt, Homo sapiens
caagguccauaaucaagac

SEQ ID NO: 1466516 - RNA, 19 nt, Homo sapiens
aacccaagagcaacacuua

SEQ ID NO: 1466517 - RNA, 19 nt, Homo sapiens
gcccagcuccauccucuug

SEQ ID NO: 1466518 - RNA, 19 nt, Homo sapiens
ccaagguccauaaucaaga

SEQ ID NO: 1466519 - RNA, 19 nt, Homo sapiens
caagagcaacacuuacauc

SEQ ID NO: 1466520 - RNA, 19 nt, Homo sapiens
aagcaaugaguguaaugua

SEQ ID NO: 1466521 - RNA, 19 nt, Homo sapiens
acacguaguuccacuucgu

SEQ ID NO: 1466522 - RNA, 19 nt, Homo sapiens
gggccgacauacugaagca

SEQ ID NO: 1466523 - RNA, 19 nt, Homo sapiens
gcuccauccucuugaaagg

SEQ ID NO: 1466524 - RNA, 19 nt, Homo sapiens
ugauuaaagaccagaagaa

SEQ ID NO: 1466525 - RNA, 19 nt, Homo sapiens
gaagggcaacaccaucaag

SEQ ID NO: 1466526 - RNA, 19 nt, Homo sapiens
ggaacacauaaguaaguug

SEQ ID NO: 1466527 - RNA, 19 nt, Homo sapiens
uaggauguguuugcaaagu

SEQ ID NO: 1466528 - RNA, 19 nt, Homo sapiens
aaacacguaguuccacuuc

SEQ ID NO: 1466529 - RNA, 19 nt, Homo sapiens
ccggagacauguugcaaaa

SEQ ID NO: 1466530 - RNA, 19 nt, Homo sapiens
aggauguguuugcaaaguu

SEQ ID NO: 1466531 - RNA, 19 nt, Homo sapiens
ccaaaggcacaguuuagag

SEQ ID NO: 1466532 - RNA, 19 nt, Homo sapiens
gcaguucuugcugauuaaa

SEQ ID NO: 1466533 - RNA, 19 nt, Homo sapiens
ggccaagguccauaaucaa

SEQ ID NO: 1466534 - RNA, 19 nt, Homo sapiens
cacauaaguaaguugcuuu

SEQ ID NO: 1466535 - RNA, 19 nt, Homo sapiens
aggaacacauaaguaaguu

SEQ ID NO: 1466536 - RNA, 19 nt, Homo sapiens
acagauaaugcaagaagga

SEQ ID NO: 1466537 - RNA, 19 nt, Homo sapiens
gucuuagggcucaucuuua

SEQ ID NO: 1466538 - RNA, 19 nt, Homo sapiens
auaagcugguggaacuuga

SEQ ID NO: 1466539 - RNA, 19 nt, Homo sapiens
caagcaaugaguguaaugu

SEQ ID NO: 1466540 - RNA, 19 nt, Homo sapiens
ccaguacgucuucggguau

SEQ ID NO: 1466541 - RNA, 19 nt, Homo sapiens
gccaagguccauaaucaag

SEQ ID NO: 1466542 - RNA, 19 nt, Homo sapiens
gcauuuaauuuucggagau

SEQ ID NO: 1466543 - RNA, 19 nt, Homo sapiens
ugcaagaaggaacacauaa

SEQ ID NO: 1466544 - RNA, 19 nt, Homo sapiens
guagcuuuaggauguguuu

SEQ ID NO: 1466545 - RNA, 19 nt, Homo sapiens
caauguguguagcuuuagg

SEQ ID NO: 1466546 - RNA, 19 nt, Homo sapiens
aggcacaguuuagaggauu

SEQ ID NO: 1466547 - RNA, 19 nt, Homo sapiens
aaggaacacauaaguaagu

SEQ ID NO: 1466548 - RNA, 19 nt, Homo sapiens
ggcacaguuuagaggauug

SEQ ID NO: 1466549 - RNA, 19 nt, Homo sapiens
uaaagaccagaagaagauu

SEQ ID NO: 1466550 - RNA, 19 nt, Homo sapiens
gacagcguuaccuggaaua

SEQ ID NO: 1466551 - RNA, 19 nt, Homo sapiens
guaaauauaugcacuggua

SEQ ID NO: 1466552 - RNA, 19 nt, Homo sapiens
uaaaugccuugccaucuua

SEQ ID NO: 1466553 - RNA, 19 nt, Homo sapiens
gcaaacaucauaacaauuc

SEQ ID NO: 1466554 - RNA, 19 nt, Homo sapiens
caacacgaaugaacuuuga

SEQ ID NO: 1466555 - RNA, 19 nt, Homo sapiens
caaauagacugagaaguga

SEQ ID NO: 1466556 - RNA, 19 nt, Homo sapiens
guaaaugccuugccaucuu

SEQ ID NO: 1466557 - RNA, 19 nt, Homo sapiens
aaaggaagccuguacauuu

SEQ ID NO: 1466558 - RNA, 19 nt, Homo sapiens
gaaacguuguguuaaguga

SEQ ID NO: 1466559 - RNA, 19 nt, Homo sapiens
gaaugaacuuugaaacguu

SEQ ID NO: 1466560 - RNA, 19 nt, Homo sapiens
ucaaagagccuccuggaaa

SEQ ID NO: 1466561 - RNA, 19 nt, Homo sapiens
gaauugugaugcuuugcua

SEQ ID NO: 1466562 - RNA, 19 nt, Homo sapiens
cagaggaagucaaagauau

SEQ ID NO: 1466563 - RNA, 19 nt, Homo sapiens
aaacagcacacucacuuua

SEQ ID NO: 1466564 - RNA, 19 nt, Homo sapiens
gagcuuggcauaucugaaa

SEQ ID NO: 1466565 - RNA, 19 nt, Homo sapiens
ucaaauagacugagaagug

SEQ ID NO: 1466566 - RNA, 19 nt, Homo sapiens
ugaaguuucuccaugaauu

SEQ ID NO: 1466567 - RNA, 19 nt, Homo sapiens
gaguuacaaugcaauacua

SEQ ID NO: 1466568 - RNA, 19 nt, Homo sapiens
caaagagccuccuggaaag

SEQ ID NO: 1466569 - RNA, 19 nt, Homo sapiens
ucaaagauauggacacucu

SEQ ID NO: 1466570 - RNA, 19 nt, Homo sapiens
ugacuaaggauuacuggua

SEQ ID NO: 1466571 - RNA, 19 nt, Homo sapiens
cuggaaagcugucaucuuc

SEQ ID NO: 1466572 - RNA, 19 nt, Homo sapiens
uauaugcacugguagaaau

SEQ ID NO: 1466573 - RNA, 19 nt, Homo sapiens
ggauuauucuaucugugua

SEQ ID NO: 1466574 - RNA, 19 nt, Homo sapiens
ggaaagcugucaucuucag

SEQ ID NO: 1466575 - RNA, 19 nt, Homo sapiens
gcagugaugugaauaaaau

SEQ ID NO: 1466576 - RNA, 19 nt, Homo sapiens
gaagauggaguuuucauuu

SEQ ID NO: 1466577 - RNA, 19 nt, Homo sapiens
cgaaugaacuuugaaacgu

SEQ ID NO: 1466578 - RNA, 19 nt, Homo sapiens
aagcugucaucuucaguua

SEQ ID NO: 1466579 - RNA, 19 nt, Homo sapiens
gaggaaauagguuuggauu

SEQ ID NO: 1466580 - RNA, 19 nt, Homo sapiens
gaaguuucuccaugaauug

SEQ ID NO: 1466581 - RNA, 19 nt, Homo sapiens
cugcaaacaucauaacaau

SEQ ID NO: 1466582 - RNA, 19 nt, Homo sapiens
ccagaggaagucaaagaua

SEQ ID NO: 1466583 - RNA, 19 nt, Homo sapiens
gcaacuguccuccuuguca

SEQ ID NO: 1466584 - RNA, 19 nt, Homo sapiens
cuaucugcaucuucaaaua

SEQ ID NO: 1466585 - RNA, 19 nt, Homo sapiens
gcugucaucuucaguuagu

SEQ ID NO: 1466586 - RNA, 19 nt, Homo sapiens
cacacucacuuuacucuga

SEQ ID NO: 1466587 - RNA, 19 nt, Homo sapiens
aaagauauggacacucuaa

SEQ ID NO: 1466588 - RNA, 19 nt, Homo sapiens
gcaaccaucaaaucaagaa

SEQ ID NO: 1466589 - RNA, 19 nt, Homo sapiens
gaacuauaccucacaugca

SEQ ID NO: 1466590 - RNA, 19 nt, Homo sapiens
gcacagaugcaugcuacaa

SEQ ID NO: 1466591 - RNA, 19 nt, Homo sapiens
uaacaggugagaagacuau

SEQ ID NO: 1466592 - RNA, 19 nt, Homo sapiens
ucacuuuacucugaacuau

SEQ ID NO: 1466593 - RNA, 19 nt, Homo sapiens
ucucauccuucccauguuu

SEQ ID NO: 1466594 - RNA, 19 nt, Homo sapiens
aagaugagcuuggcauauc

SEQ ID NO: 1466595 - RNA, 19 nt, Homo sapiens
gcccaaagcccuacagucu

SEQ ID NO: 1466596 - RNA, 19 nt, Homo sapiens
gaagugggaggaaauaggu

SEQ ID NO: 1466597 - RNA, 19 nt, Homo sapiens
guuuggcaccgauacauua

SEQ ID NO: 1466598 - RNA, 19 nt, Homo sapiens
ggcaggcagugauuuggaa

SEQ ID NO: 1466599 - RNA, 19 nt, Homo sapiens
uuaaauggcacaucuucaa

SEQ ID NO: 1466600 - RNA, 19 nt, Homo sapiens
uaucucugacuaaggauua

SEQ ID NO: 1466601 - RNA, 19 nt, Homo sapiens
caugaauugugaugcuuug

SEQ ID NO: 1466602 - RNA, 19 nt, Homo sapiens
aaagauaccagaguuacaa

SEQ ID NO: 1466603 - RNA, 19 nt, Homo sapiens
caacuguccuccuugucau

SEQ ID NO: 1466604 - RNA, 19 nt, Homo sapiens
auaagcaacuguccuccuu

SEQ ID NO: 1466605 - RNA, 19 nt, Homo sapiens
acugguaguuguugacauu

SEQ ID NO: 1466606 - RNA, 19 nt, Homo sapiens
gcacugguagaaauguauu

SEQ ID NO: 1466607 - RNA, 19 nt, Homo sapiens
gcaguuaccaugcagugau

SEQ ID NO: 1466608 - RNA, 19 nt, Homo sapiens
acagaugcaugcuacaaca

SEQ ID NO: 1466609 - RNA, 19 nt, Homo sapiens
ccagaguuacaaugcaaua

SEQ ID NO: 1466610 - RNA, 19 nt, Homo sapiens
acucuaagacucagaagaa

SEQ ID NO: 1466611 - RNA, 19 nt, Homo sapiens
gggauuauucuaucugugu

SEQ ID NO: 1466612 - RNA, 19 nt, Homo sapiens
uaccagaguuacaaugcaa

SEQ ID NO: 1466613 - RNA, 19 nt, Homo sapiens
aauggcacaucuucaaguu

SEQ ID NO: 1466614 - RNA, 19 nt, Homo sapiens
uggcaccgauacauuauuc

SEQ ID NO: 1466615 - RNA, 19 nt, Homo sapiens
uaaacagcacacucacuuu

SEQ ID NO: 1466616 - RNA, 19 nt, Homo sapiens
uuaaacagcacacucacuu

SEQ ID NO: 1466617 - RNA, 19 nt, Homo sapiens
gagaagacuaugccaugga

SEQ ID NO: 1466618 - RNA, 19 nt, Homo sapiens
ccgauacauuauuccagua

SEQ ID NO: 1466619 - RNA, 19 nt, Homo sapiens
caucaaaucaagaaauugg

SEQ ID NO: 1466620 - RNA, 19 nt, Homo sapiens
acacgucuguccuuaccuu

SEQ ID NO: 1466621 - RNA, 19 nt, Homo sapiens
cuugccaucuuauuucauu

SEQ ID NO: 1466622 - RNA, 19 nt, Homo sapiens
gauuacugguaguuguuga

SEQ ID NO: 1466623 - RNA, 19 nt, Homo sapiens
uggcacaucuucaaguucu

SEQ ID NO: 1466624 - RNA, 19 nt, Homo sapiens
gguaguuguugacauuucu

SEQ ID NO: 1466625 - RNA, 19 nt, Homo sapiens
uaguagggauaaugggauu

SEQ ID NO: 1466626 - RNA, 19 nt, Homo sapiens
cccaagaccagcuaccuaa

SEQ ID NO: 1466627 - RNA, 19 nt, Homo sapiens
acacucacuuuacucugaa

SEQ ID NO: 1466628 - RNA, 19 nt, Homo sapiens
cuaagacucagaagaacuu

SEQ ID NO: 1466629 - RNA, 19 nt, Homo sapiens
gcagggauuuucucauuag

SEQ ID NO: 1466630 - RNA, 19 nt, Homo sapiens
gggaggaaauagguuugga

SEQ ID NO: 1466631 - RNA, 19 nt, Homo sapiens
gaauggcaggcagugauuu

SEQ ID NO: 1466632 - RNA, 19 nt, Homo sapiens
cuacaacacgaaugaacuu

SEQ ID NO: 1466633 - RNA, 19 nt, Homo sapiens
ccugaaguuucuccaugaa

SEQ ID NO: 1466634 - RNA, 19 nt, Homo sapiens
uggcaaccaucaaaucaag

SEQ ID NO: 1466635 - RNA, 19 nt, Homo sapiens
gcacaacauaagcaacugu

SEQ ID NO: 1466636 - RNA, 19 nt, Homo sapiens
aaggaagccuguacauuuu

SEQ ID NO: 1466637 - RNA, 19 nt, Homo sapiens
ggaagugggaggaaauagg

SEQ ID NO: 1466638 - RNA, 19 nt, Homo sapiens
ugcauuagauggaaaauug

SEQ ID NO: 1466639 - RNA, 19 nt, Homo sapiens
cgauacauuauuccaguaa

SEQ ID NO: 1466640 - RNA, 19 nt, Homo sapiens
ccuacagucugcaaacauc

SEQ ID NO: 1466641 - RNA, 19 nt, Homo sapiens
aacguuguguuaagugaaa

SEQ ID NO: 1466642 - RNA, 19 nt, Homo sapiens
acuuugaaacguuguguua

SEQ ID NO: 1466643 - RNA, 19 nt, Homo sapiens
acacgaaugaacuuugaaa

SEQ ID NO: 1466644 - RNA, 19 nt, Homo sapiens
aagcaacuguccuccuugu

SEQ ID NO: 1466645 - RNA, 19 nt, Homo sapiens
aauagacugagaagugaua

SEQ ID NO: 1466646 - RNA, 19 nt, Homo sapiens
acacacacacacacucauu

SEQ ID NO: 1466647 - RNA, 19 nt, Homo sapiens
gauauggacacucuaagac

SEQ ID NO: 1466648 - RNA, 19 nt, Homo sapiens
ugaagccacuuaaaagcua

SEQ ID NO: 1466649 - RNA, 19 nt, Homo sapiens
ggaggaaauagguuuggau

SEQ ID NO: 1466650 - RNA, 19 nt, Homo sapiens
uuugaaacguuguguuaag

SEQ ID NO: 1466651 - RNA, 19 nt, Homo sapiens
gaauauggcuuucuuagga

SEQ ID NO: 1466652 - RNA, 19 nt, Homo sapiens
gaaaucaucacaagaguua

SEQ ID NO: 1466653 - RNA, 19 nt, Homo sapiens
aaucagagcucaagccuua

SEQ ID NO: 1466654 - RNA, 19 nt, Homo sapiens
gagaagagcuuaagugaag

SEQ ID NO: 1466655 - RNA, 19 nt, Homo sapiens
gagagagacccuauaaaua

SEQ ID NO: 1466656 - RNA, 19 nt, Homo sapiens
gagagaaaccuuauaaaug

SEQ ID NO: 1466657 - RNA, 19 nt, Homo sapiens
gagcuuaagugaaguccua

SEQ ID NO: 1466658 - RNA, 19 nt, Homo sapiens
agagaaaccuuaucaaugu

SEQ ID NO: 1466659 - RNA, 19 nt, Homo sapiens
ggagagagacccuauaaau

SEQ ID NO: 1466660 - RNA, 19 nt, Homo sapiens
gaagugcgcuuggagaaga

SEQ ID NO: 1466661 - RNA, 19 nt, Homo sapiens
ggacauuacuugcaagauc

SEQ ID NO: 1466662 - RNA, 19 nt, Homo sapiens
caacucagcugcaccuguu

SEQ ID NO: 1466663 - RNA, 19 nt, Homo sapiens
gcucaagccuuaucauuca

SEQ ID NO: 1466664 - RNA, 19 nt, Homo sapiens
gggaaaugcuucaaucaga

SEQ ID NO: 1466665 - RNA, 19 nt, Homo sapiens
ggagagaaaccuuauaaau

SEQ ID NO: 1466666 - RNA, 19 nt, Homo sapiens
ugaagaggauacugagaua

SEQ ID NO: 1466667 - RNA, 19 nt, Homo sapiens
acagucagcucccaaguaa

SEQ ID NO: 1466668 - RNA, 19 nt, Homo sapiens
gagagaaaccuuaucaaug

SEQ ID NO: 1466669 - RNA, 19 nt, Homo sapiens
ggauauuucugaggaagua

SEQ ID NO: 1466670 - RNA, 19 nt, Homo sapiens
gaagcaagcugaggaagca

SEQ ID NO: 1466671 - RNA, 19 nt, Homo sapiens
ucacaagaguuauuaagug

SEQ ID NO: 1466672 - RNA, 19 nt, Homo sapiens
ggaagauucugaugaugau

SEQ ID NO: 1466673 - RNA, 19 nt, Homo sapiens
aggagaagcucaaaccuuu

SEQ ID NO: 1466674 - RNA, 19 nt, Homo sapiens
ggagagaaaccuuaucaau

SEQ ID NO: 1466675 - RNA, 19 nt, Homo sapiens
uaagugaaguccuaaguca

SEQ ID NO: 1466676 - RNA, 19 nt, Homo sapiens
cagaagagcuaucggaaag

SEQ ID NO: 1466677 - RNA, 19 nt, Homo sapiens
agagagacccuauaaauau

SEQ ID NO: 1466678 - RNA, 19 nt, Homo sapiens
gcugagagguuaugggaau

SEQ ID NO: 1466679 - RNA, 19 nt, Homo sapiens
cguggaagauuuagaaaga

SEQ ID NO: 1466680 - RNA, 19 nt, Homo sapiens
ggaagacagugggcaaaga

SEQ ID NO: 1466681 - RNA, 19 nt, Homo sapiens
caagaguuauuaaguguuc

SEQ ID NO: 1466682 - RNA, 19 nt, Homo sapiens
gguccaaacucccuucuca

SEQ ID NO: 1466683 - RNA, 19 nt, Homo sapiens
gagagacccuauaaauauc

SEQ ID NO: 1466684 - RNA, 19 nt, Homo sapiens
gcaaugagagugacuguag

SEQ ID NO: 1466685 - RNA, 19 nt, Homo sapiens
uugaagagauggaugcuuu

SEQ ID NO: 1466686 - RNA, 19 nt, Homo sapiens
ccagaacgcuccucgcaau

SEQ ID NO: 1466687 - RNA, 19 nt, Homo sapiens
gaagcuggauuugagaaug

SEQ ID NO: 1466688 - RNA, 19 nt, Homo sapiens
guucaaaggucuccagaag

SEQ ID NO: 1466689 - RNA, 19 nt, Homo sapiens
gguaagugcuucaguaaaa

SEQ ID NO: 1466690 - RNA, 19 nt, Homo sapiens
gaagagcuaucggaaaguc

SEQ ID NO: 1466691 - RNA, 19 nt, Homo sapiens
ucaaaggucuccagaagag

SEQ ID NO: 1466692 - RNA, 19 nt, Homo sapiens
ccauauaaaugugcugauu

SEQ ID NO: 1466693 - RNA, 19 nt, Homo sapiens
ugcaagaucugaaaggaaa

SEQ ID NO: 1466694 - RNA, 19 nt, Homo sapiens
agacuuaccuugcaauucu

SEQ ID NO: 1466695 - RNA, 19 nt, Homo sapiens
cauaggacauuacuugcaa

SEQ ID NO: 1466696 - RNA, 19 nt, Homo sapiens
gaaguacaacugcauagga

SEQ ID NO: 1466697 - RNA, 19 nt, Homo sapiens
caggaacaauguccagaaa

SEQ ID NO: 1466698 - RNA, 19 nt, Homo sapiens
caaauuucaucacccauag

SEQ ID NO: 1466699 - RNA, 19 nt, Homo sapiens
gaaaagcccuaucaaugug

SEQ ID NO: 1466700 - RNA, 19 nt, Homo sapiens
uaagagagaauggcacuaa

SEQ ID NO: 1466701 - RNA, 19 nt, Homo sapiens
caaaccagcuaucggaaag

SEQ ID NO: 1466702 - RNA, 19 nt, Homo sapiens
caggaucacuggagcuuug

SEQ ID NO: 1466703 - RNA, 19 nt, Homo sapiens
gggaaaagcuucugacaca

SEQ ID NO: 1466704 - RNA, 19 nt, Homo sapiens
gagaaaagcccuaucaaug

SEQ ID NO: 1466705 - RNA, 19 nt, Homo sapiens
ucauugcccugcccaguaa

SEQ ID NO: 1466706 - RNA, 19 nt, Homo sapiens
ccagagaccugucccuucu

SEQ ID NO: 1466707 - RNA, 19 nt, Homo sapiens
augaagagaccaagacuua

SEQ ID NO: 1466708 - RNA, 19 nt, Homo sapiens
ccaaggagcagauuguaga

SEQ ID NO: 1466709 - RNA, 19 nt, Homo sapiens
gaacgcuccucgcaauucu

SEQ ID NO: 1466710 - RNA, 19 nt, Homo sapiens
gagcucaagccuuaucauu

SEQ ID NO: 1466711 - RNA, 19 nt, Homo sapiens
cgacagcguuucaggagau

SEQ ID NO: 1466712 - RNA, 19 nt, Homo sapiens
guaaaggcaaugagaguga

SEQ ID NO: 1466713 - RNA, 19 nt, Homo sapiens
gcaaaccagcuaucggaaa

SEQ ID NO: 1466714 - RNA, 19 nt, Homo sapiens
ggccaaaucagcucuaaga

SEQ ID NO: 1466715 - RNA, 19 nt, Homo sapiens
caaacucccuucucaugca

SEQ ID NO: 1466716 - RNA, 19 nt, Homo sapiens
cacaagaguuauuaagugu

SEQ ID NO: 1466717 - RNA, 19 nt, Homo sapiens
gcacaucggaggauacaca

SEQ ID NO: 1466718 - RNA, 19 nt, Homo sapiens
gagaaaccuuaucaaugug

SEQ ID NO: 1466719 - RNA, 19 nt, Homo sapiens
ggagaagagcuuaagugaa

SEQ ID NO: 1466720 - RNA, 19 nt, Homo sapiens
agaggaagauucugaugau

SEQ ID NO: 1466721 - RNA, 19 nt, Homo sapiens
gugaugacauggaucuaga

SEQ ID NO: 1466722 - RNA, 19 nt, Homo sapiens
ggaacaauguccagaaaau

SEQ ID NO: 1466723 - RNA, 19 nt, Homo sapiens
ggcagugacucucguggaa

SEQ ID NO: 1466724 - RNA, 19 nt, Homo sapiens
ucaaauuucaucacccaua

SEQ ID NO: 1466725 - RNA, 19 nt, Homo sapiens
gagagugacuguagaucag

SEQ ID NO: 1466726 - RNA, 19 nt, Homo sapiens
uaaaagcucugcccuuaau

SEQ ID NO: 1466727 - RNA, 19 nt, Homo sapiens
ugugguaagugcuucagua

SEQ ID NO: 1466728 - RNA, 19 nt, Homo sapiens
gcuccaguguuauuccaaa

SEQ ID NO: 1466729 - RNA, 19 nt, Homo sapiens
ugacagugaugacauggau

SEQ ID NO: 1466730 - RNA, 19 nt, Homo sapiens
gcacuaacucugagaccuu

SEQ ID NO: 1466731 - RNA, 19 nt, Homo sapiens
gacauuacuugcaagaucu

SEQ ID NO: 1466732 - RNA, 19 nt, Homo sapiens
gaggaaguacaacugcaua

SEQ ID NO: 1466733 - RNA, 19 nt, Homo sapiens
agagaccugucccuucuuu

SEQ ID NO: 1466734 - RNA, 19 nt, Homo sapiens
gagaaaccuuauaaauguc

SEQ ID NO: 1466735 - RNA, 19 nt, Homo sapiens
gagaaaagaggaaaacuga

SEQ ID NO: 1466736 - RNA, 19 nt, Homo sapiens
gcaccaaggagcagauugu

SEQ ID NO: 1466737 - RNA, 19 nt, Homo sapiens
ugacuuacgugcacaucau

SEQ ID NO: 1466738 - RNA, 19 nt, Homo sapiens
acacaggagagaaaccuua

SEQ ID NO: 1466739 - RNA, 19 nt, Homo sapiens
aagcuggauuugagaauga

SEQ ID NO: 1466740 - RNA, 19 nt, Homo sapiens
agaaagagagccuggaaga

SEQ ID NO: 1466741 - RNA, 19 nt, Homo sapiens
gugcacgacucauuagaca

SEQ ID NO: 1466742 - RNA, 19 nt, Homo sapiens
ugacucucguggaagauuu

SEQ ID NO: 1466743 - RNA, 19 nt, Homo sapiens
caaugagagugacuguaga

SEQ ID NO: 1466744 - RNA, 19 nt, Homo sapiens
gaacagugucggaccaagu

SEQ ID NO: 1466745 - RNA, 19 nt, Homo sapiens
gaacagugucggaccaagu

SEQ ID NO: 1466746 - RNA, 19 nt, Homo sapiens
cgugacaguucaaauuuca

SEQ ID NO: 1466747 - RNA, 19 nt, Homo sapiens
aacccgugcuccaguguua

SEQ ID NO: 1466748 - RNA, 19 nt, Homo sapiens
ccagcuaucggaaaguuaa

SEQ ID NO: 1466749 - RNA, 19 nt, Homo sapiens
agugcaugcugaucuguua

SEQ ID NO: 1466750 - RNA, 19 nt, Homo sapiens
gcagauuguagaacuguug

SEQ ID NO: 1466751 - RNA, 19 nt, Homo sapiens
guacagagauggagaauga

SEQ ID NO: 1466752 - RNA, 19 nt, Homo sapiens
gcacuaugaugaagaauau

SEQ ID NO: 1466753 - RNA, 19 nt, Homo sapiens
gcaagaaauugauuccaaa

SEQ ID NO: 1466754 - RNA, 19 nt, Homo sapiens
gaacaugaguauccauaug

SEQ ID NO: 1466755 - RNA, 19 nt, Homo sapiens
gaccauguuuguagauuua

SEQ ID NO: 1466756 - RNA, 19 nt, Homo sapiens
gaaagaccauguuuguaga

SEQ ID NO: 1466757 - RNA, 19 nt, Homo sapiens
ggaaucagcucaacaacca

SEQ ID NO: 1466758 - RNA, 19 nt, Homo sapiens
gauggaaaguguugagaaa

SEQ ID NO: 1466759 - RNA, 19 nt, Homo sapiens
aaagaaagauggaaagugu

SEQ ID NO: 1466760 - RNA, 19 nt, Homo sapiens
ccaguaaacucagcagaua

SEQ ID NO: 1466761 - RNA, 19 nt, Homo sapiens
ggagaagacuggaaaugau

SEQ ID NO: 1466762 - RNA, 19 nt, Homo sapiens
gaccauaucucuucuuugg

SEQ ID NO: 1466763 - RNA, 19 nt, Homo sapiens
cgaggcacauucaccauua

SEQ ID NO: 1466764 - RNA, 19 nt, Homo sapiens
ggaaagaccauguuuguag

SEQ ID NO: 1466765 - RNA, 19 nt, Homo sapiens
ggaggaagcagaacagauu

SEQ ID NO: 1466766 - RNA, 19 nt, Homo sapiens
ggaacuggaugccugugua

SEQ ID NO: 1466767 - RNA, 19 nt, Homo sapiens
ggagaacuauuucauugug

SEQ ID NO: 1466768 - RNA, 19 nt, Homo sapiens
uggcuuggcucgacaauuu

SEQ ID NO: 1466769 - RNA, 19 nt, Homo sapiens
gcaggcagcaaguagauua

SEQ ID NO: 1466770 - RNA, 19 nt, Homo sapiens
caaguaggcucuauuaagg

SEQ ID NO: 1466771 - RNA, 19 nt, Homo sapiens
caaaagaacuuccugauca

SEQ ID NO: 1466772 - RNA, 19 nt, Homo sapiens
caaauggucuucucaaugc

SEQ ID NO: 1466773 - RNA, 19 nt, Homo sapiens
gaugagaaguuaaguagag

SEQ ID NO: 1466774 - RNA, 19 nt, Homo sapiens
gaagaugagaaguuaagua

SEQ ID NO: 1466775 - RNA, 19 nt, Homo sapiens
caacacagaucaggucaau

SEQ ID NO: 1466776 - RNA, 19 nt, Homo sapiens
gaaucauccucuccaguuu

SEQ ID NO: 1466777 - RNA, 19 nt, Homo sapiens
gauaaggaauuaccuaagg

SEQ ID NO: 1466778 - RNA, 19 nt, Homo sapiens
gagauagacucaacuuugg

SEQ ID NO: 1466779 - RNA, 19 nt, Homo sapiens
uaaugaagcuucugacagu

SEQ ID NO: 1466780 - RNA, 19 nt, Homo sapiens
gaacuuccugaucauaaua

SEQ ID NO: 1466781 - RNA, 19 nt, Homo sapiens
aaacuucucuggcuugguu

SEQ ID NO: 1466782 - RNA, 19 nt, Homo sapiens
gauaaagcuuggaauuugu

SEQ ID NO: 1466783 - RNA, 19 nt, Homo sapiens
acaauagcaucaagacuuu

SEQ ID NO: 1466784 - RNA, 19 nt, Homo sapiens
caucaugagugaagacuug

SEQ ID NO: 1466785 - RNA, 19 nt, Homo sapiens
agauaaagcuuggaauuug

SEQ ID NO: 1466786 - RNA, 19 nt, Homo sapiens
gaugagguauuuccagaug

SEQ ID NO: 1466787 - RNA, 19 nt, Homo sapiens
gagaauuacugccacacuu

SEQ ID NO: 1466788 - RNA, 19 nt, Homo sapiens
ggucagagcuuggccuaug

SEQ ID NO: 1466789 - RNA, 19 nt, Homo sapiens
gggaagacaugaugaccuu

SEQ ID NO: 1466790 - RNA, 19 nt, Homo sapiens
ugugagaucuuccuccuaa

SEQ ID NO: 1466791 - RNA, 19 nt, Homo sapiens
ggaaucauccucuccaguu

SEQ ID NO: 1466792 - RNA, 19 nt, Homo sapiens
gcaaauggucuucucaaug

SEQ ID NO: 1466793 - RNA, 19 nt, Homo sapiens
ucaagacccucaacaacaa

SEQ ID NO: 1466794 - RNA, 19 nt, Homo sapiens
gcaaguaggcucuauuaag

SEQ ID NO: 1466795 - RNA, 19 nt, Homo sapiens
gaaaugggaagacaugaug

SEQ ID NO: 1466796 - RNA, 19 nt, Homo sapiens
gaggagagcagcuggauau

SEQ ID NO: 1466797 - RNA, 19 nt, Homo sapiens
agagauggaugccaacaaa

SEQ ID NO: 1466798 - RNA, 19 nt, Homo sapiens
ucaggcagcuguaugaaga

SEQ ID NO: 1466799 - RNA, 19 nt, Homo sapiens
caaggaguauguagaugaa

SEQ ID NO: 1466800 - RNA, 19 nt, Homo sapiens
ggaaguugcuguuuugaaa

SEQ ID NO: 1466801 - RNA, 19 nt, Homo sapiens
cagcaagaauggccugaaa

SEQ ID NO: 1466802 - RNA, 19 nt, Homo sapiens
gaaaguaacaaaucucaag

SEQ ID NO: 1466803 - RNA, 19 nt, Homo sapiens
uggcagcaauggauuuaua

SEQ ID NO: 1466804 - RNA, 19 nt, Homo sapiens
ccaacguccugcccaauuu

SEQ ID NO: 1466805 - RNA, 19 nt, Homo sapiens
gaccacaucuggcacuaug

SEQ ID NO: 1466806 - RNA, 19 nt, Homo sapiens
gacaauagcaucaagacuu

SEQ ID NO: 1466807 - RNA, 19 nt, Homo sapiens
gcuggagucuucccugaaa

SEQ ID NO: 1466808 - RNA, 19 nt, Homo sapiens
gcaaggaaagaccauguuu

SEQ ID NO: 1466809 - RNA, 19 nt, Homo sapiens
gaaacuagcuacuguuccu

SEQ ID NO: 1466810 - RNA, 19 nt, Homo sapiens
gaaaagcuccuccaaaaga

SEQ ID NO: 1466811 - RNA, 19 nt, Homo sapiens
gaacaaguaugagguugag

SEQ ID NO: 1466812 - RNA, 19 nt, Homo sapiens
ccagagcccuccuccagaa

SEQ ID NO: 1466813 - RNA, 19 nt, Homo sapiens
gagcaggaccuucaggauu

SEQ ID NO: 1466814 - RNA, 19 nt, Homo sapiens
ucagauagaucacauuggu

SEQ ID NO: 1466815 - RNA, 19 nt, Homo sapiens
gaaauuucuuccagagaca

SEQ ID NO: 1466816 - RNA, 19 nt, Homo sapiens
gaaaauggcaucccuguug

SEQ ID NO: 1466817 - RNA, 19 nt, Homo sapiens
aaugauggcucccuaacaa

SEQ ID NO: 1466818 - RNA, 19 nt, Homo sapiens
gaauucagcaucuuucuag

SEQ ID NO: 1466819 - RNA, 19 nt, Homo sapiens
gggagaaacucauuaaaau

SEQ ID NO: 1466820 - RNA, 19 nt, Homo sapiens
gaaucaaugucuuuguaca

SEQ ID NO: 1466821 - RNA, 19 nt, Homo sapiens
guagagggcagcauuguau

SEQ ID NO: 1466822 - RNA, 19 nt, Homo sapiens
gguguggucuuagcacuuu

SEQ ID NO: 1466823 - RNA, 19 nt, Homo sapiens
gaaaguuacguuccauuca

SEQ ID NO: 1466824 - RNA, 19 nt, Homo sapiens
ggaaaguguugagaaagau

SEQ ID NO: 1466825 - RNA, 19 nt, Homo sapiens
ucaagugccucugauaaau

SEQ ID NO: 1466826 - RNA, 19 nt, Homo sapiens
aagaaaagcuccuccaaaa

SEQ ID NO: 1466827 - RNA, 19 nt, Homo sapiens
cauaauagacugguuguga

SEQ ID NO: 1466828 - RNA, 19 nt, Homo sapiens
guugagaucaguaaaugua

SEQ ID NO: 1466829 - RNA, 19 nt, Homo sapiens
gaagacaugaugaccuuug

SEQ ID NO: 1466830 - RNA, 19 nt, Homo sapiens
gggcagcauuguauugaga

SEQ ID NO: 1466831 - RNA, 19 nt, Homo sapiens
gggagaagacuggaaauga

SEQ ID NO: 1466832 - RNA, 19 nt, Homo sapiens
ccauaucucuucuuuggau

SEQ ID NO: 1466833 - RNA, 19 nt, Homo sapiens
gaaagaaagauggaaagug

SEQ ID NO: 1466834 - RNA, 19 nt, Homo sapiens
aggaaucaaugucuuugua

SEQ ID NO: 1466835 - RNA, 19 nt, Homo sapiens
ggucauccuuuguaacuag

SEQ ID NO: 1466836 - RNA, 19 nt, Homo sapiens
caucaagacuuuuggagua

SEQ ID NO: 1466837 - RNA, 19 nt, Homo sapiens
agauggagcuggagucuuc

SEQ ID NO: 1466838 - RNA, 19 nt, Homo sapiens
gauggagaaugaauuugug

SEQ ID NO: 1466839 - RNA, 19 nt, Homo sapiens
ggagcaacauggacaacau

SEQ ID NO: 1466840 - RNA, 19 nt, Homo sapiens
uggaaaguguugagaaaga

SEQ ID NO: 1466841 - RNA, 19 nt, Homo sapiens
agacucaacuuuggaauca

SEQ ID NO: 1466842 - RNA, 19 nt, Homo sapiens
gaaaaucaccccuagaaau

SEQ ID NO: 1466843 - RNA, 19 nt, Homo sapiens
ugaggagccugaaguacuu

SEQ ID NO: 1466844 - RNA, 19 nt, Homo sapiens
gccagacacugacaaguuc

SEQ ID NO: 1466845 - RNA, 19 nt, Homo sapiens
ggaaaugauggcucccuaa

SEQ ID NO: 1466846 - RNA, 19 nt, Homo sapiens
uagaccauaucucuucuuu

SEQ ID NO: 1466847 - RNA, 19 nt, Homo sapiens
agaguaagccagccaguaa

SEQ ID NO: 1466848 - RNA, 19 nt, Homo sapiens
acacagaucaggucaauag

SEQ ID NO: 1466849 - RNA, 19 nt, Homo sapiens
guuaggucauccuuuguaa

SEQ ID NO: 1466850 - RNA, 19 nt, Homo sapiens
guauguagaugaagcuuac

SEQ ID NO: 1466851 - RNA, 19 nt, Homo sapiens
gcacaagacugaauuaguu

SEQ ID NO: 1466852 - RNA, 19 nt, Homo sapiens
ggaauggacucgaggauuu

SEQ ID NO: 1466853 - RNA, 19 nt, Homo sapiens
gaaagugugugcauucuuc

SEQ ID NO: 1466854 - RNA, 19 nt, Homo sapiens
gaagagaagcuacaaaaua

SEQ ID NO: 1466855 - RNA, 19 nt, Homo sapiens
gcaacucagugaacuaaau

SEQ ID NO: 1466856 - RNA, 19 nt, Homo sapiens
gaacauacccaaacaucug

SEQ ID NO: 1466857 - RNA, 19 nt, Homo sapiens
gaaauaaauggguuacuuc

SEQ ID NO: 1466858 - RNA, 19 nt, Homo sapiens
guaaauauggccaguguau

SEQ ID NO: 1466859 - RNA, 19 nt, Homo sapiens
ccauggagguuauucauuc

SEQ ID NO: 1466860 - RNA, 19 nt, Homo sapiens
caacucagugaacuaaaua

SEQ ID NO: 1466861 - RNA, 19 nt, Homo sapiens
ccagauccuuuacuacuga

SEQ ID NO: 1466862 - RNA, 19 nt, Homo sapiens
gcauucuucucauaccuaa

SEQ ID NO: 1466863 - RNA, 19 nt, Homo sapiens
ggauagcauucacuggaaa

SEQ ID NO: 1466864 - RNA, 19 nt, Homo sapiens
gcucaguucuguguacaaa

SEQ ID NO: 1466865 - RNA, 19 nt, Homo sapiens
gcaaacauuucaguaugau

SEQ ID NO: 1466866 - RNA, 19 nt, Homo sapiens
cuaaggcaauucaaguauu

SEQ ID NO: 1466867 - RNA, 19 nt, Homo sapiens
aagcaaacauuucaguaug

SEQ ID NO: 1466868 - RNA, 19 nt, Homo sapiens
gaagccauccauccauuug

SEQ ID NO: 1466869 - RNA, 19 nt, Homo sapiens
aaaauaugcucgauggaua

SEQ ID NO: 1466870 - RNA, 19 nt, Homo sapiens
ggaagaaacagagcacuca

SEQ ID NO: 1466871 - RNA, 19 nt, Homo sapiens
agucugcggucucaccuua

SEQ ID NO: 1466872 - RNA, 19 nt, Homo sapiens
uuuggaagcuccuauugaa

SEQ ID NO: 1466873 - RNA, 19 nt, Homo sapiens
ucaugggaaucauuucauu

SEQ ID NO: 1466874 - RNA, 19 nt, Homo sapiens
gacuccagauccuuuacua

SEQ ID NO: 1466875 - RNA, 19 nt, Homo sapiens
gggcaacucagugaacuaa

SEQ ID NO: 1466876 - RNA, 19 nt, Homo sapiens
ucgaggauuugaucucauu

SEQ ID NO: 1466877 - RNA, 19 nt, Homo sapiens
aaaguuugcugcugauucu

SEQ ID NO: 1466878 - RNA, 19 nt, Homo sapiens
gauuaagacaugccacuau

SEQ ID NO: 1466879 - RNA, 19 nt, Homo sapiens
uaguaaauauggccagugu

SEQ ID NO: 1466880 - RNA, 19 nt, Homo sapiens
ggucacaguuacccagcaa

SEQ ID NO: 1466881 - RNA, 19 nt, Homo sapiens
ggaagcuccuauugaacau

SEQ ID NO: 1466882 - RNA, 19 nt, Homo sapiens
ucaguaugauucuuuccaa

SEQ ID NO: 1466883 - RNA, 19 nt, Homo sapiens
gggaauuggaggauuaaga

SEQ ID NO: 1466884 - RNA, 19 nt, Homo sapiens
uggauaaacugaccaucau

SEQ ID NO: 1466885 - RNA, 19 nt, Homo sapiens
ggaauuggaggauuaagac

SEQ ID NO: 1466886 - RNA, 19 nt, Homo sapiens
caagacugaauuaguuuga

SEQ ID NO: 1466887 - RNA, 19 nt, Homo sapiens
gggaaucauuucauugacu

SEQ ID NO: 1466888 - RNA, 19 nt, Homo sapiens
uggguucucugcugucuug

SEQ ID NO: 1466889 - RNA, 19 nt, Homo sapiens
agacaugccacuaugagaa

SEQ ID NO: 1466890 - RNA, 19 nt, Homo sapiens
acaguuacccagcaacaaa

SEQ ID NO: 1466891 - RNA, 19 nt, Homo sapiens
uaugcaaagucaacucuuc

SEQ ID NO: 1466892 - RNA, 19 nt, Homo sapiens
caguaugauucuuuccaaa

SEQ ID NO: 1466893 - RNA, 19 nt, Homo sapiens
agcaaacauuucaguauga

SEQ ID NO: 1466894 - RNA, 19 nt, Homo sapiens
ugugugcauucuucucaua

SEQ ID NO: 1466895 - RNA, 19 nt, Homo sapiens
ggauuaagacaugccacua

SEQ ID NO: 1466896 - RNA, 19 nt, Homo sapiens
gaauggacucgaggauuug

SEQ ID NO: 1466897 - RNA, 19 nt, Homo sapiens
uaauccagcucaguucugu

SEQ ID NO: 1466898 - RNA, 19 nt, Homo sapiens
gauaaacugaccaucaucu

SEQ ID NO: 1466899 - RNA, 19 nt, Homo sapiens
agacugaauuaguuugaca

SEQ ID NO: 1466900 - RNA, 19 nt, Homo sapiens
ggaaagugugugcauucuu

SEQ ID NO: 1466901 - RNA, 19 nt, Homo sapiens
uggauagcauucacuggaa

SEQ ID NO: 1466902 - RNA, 19 nt, Homo sapiens
uaaacugaccaucaucuca

SEQ ID NO: 1466903 - RNA, 19 nt, Homo sapiens
gaagcuccuauugaacaua

SEQ ID NO: 1466904 - RNA, 19 nt, Homo sapiens
guguauuuggucacuauua

SEQ ID NO: 1466905 - RNA, 19 nt, Homo sapiens
cauggagguuauucauuca

SEQ ID NO: 1466906 - RNA, 19 nt, Homo sapiens
ccauccauuugauagguuu

SEQ ID NO: 1466907 - RNA, 19 nt, Homo sapiens
gcgaagagaagcuacaaaa

SEQ ID NO: 1466908 - RNA, 19 nt, Homo sapiens
ggcacucuuucucauguug

SEQ ID NO: 1466909 - RNA, 19 nt, Homo sapiens
uguccucacuuggccauuu

SEQ ID NO: 1466910 - RNA, 19 nt, Homo sapiens
uugaagccauccauccauu

SEQ ID NO: 1466911 - RNA, 19 nt, Homo sapiens
auuaagacaugccacuaug

SEQ ID NO: 1466912 - RNA, 19 nt, Homo sapiens
guucucugcugucuugaag

SEQ ID NO: 1466913 - RNA, 19 nt, Homo sapiens
cacaagacugaauuaguuu

SEQ ID NO: 1466914 - RNA, 19 nt, Homo sapiens
caucaugggaaucauuuca

SEQ ID NO: 1466915 - RNA, 19 nt, Homo sapiens
uaaagaauuuccccaugga

SEQ ID NO: 1466916 - RNA, 19 nt, Homo sapiens
uauugaacauacccaaaca

SEQ ID NO: 1466917 - RNA, 19 nt, Homo sapiens
uguaaaaucugcugaaaac

SEQ ID NO: 1466918 - RNA, 19 nt, Homo sapiens
gucuaaggcaauucaagua

SEQ ID NO: 1466919 - RNA, 19 nt, Homo sapiens
ugaagccauccauccauuu

SEQ ID NO: 1466920 - RNA, 19 nt, Homo sapiens
ccacuaugagaagauuaua

SEQ ID NO: 1466921 - RNA, 19 nt, Homo sapiens
ugucagggcaacucaguga

SEQ ID NO: 1466922 - RNA, 19 nt, Homo sapiens
uaucaucaugggaaucauu

SEQ ID NO: 1466923 - RNA, 19 nt, Homo sapiens
uggaagcuccuauugaaca

SEQ ID NO: 1466924 - RNA, 19 nt, Homo sapiens
gccauccauccauuugaua

SEQ ID NO: 1466925 - RNA, 19 nt, Homo sapiens
ccagcucaguucuguguac

SEQ ID NO: 1466926 - RNA, 19 nt, Homo sapiens
aaucaauccccauucauua

SEQ ID NO: 1466927 - RNA, 19 nt, Homo sapiens
uaagacaugccacuaugag

SEQ ID NO: 1466928 - RNA, 19 nt, Homo sapiens
ucuaaggcaauucaaguau

SEQ ID NO: 1466929 - RNA, 19 nt, Homo sapiens
caugggaaucauuucauug

SEQ ID NO: 1466930 - RNA, 19 nt, Homo sapiens
uuaaaucaauccccauuca

SEQ ID NO: 1466931 - RNA, 19 nt, Homo sapiens
gccacuaugagaagauuau

SEQ ID NO: 1466932 - RNA, 19 nt, Homo sapiens
ggucacuauuaaaucaauc

SEQ ID NO: 1466933 - RNA, 19 nt, Homo sapiens
acucgaggauuugaucuca

SEQ ID NO: 1466934 - RNA, 19 nt, Homo sapiens
gacaugccacuaugagaag

SEQ ID NO: 1466935 - RNA, 19 nt, Homo sapiens
uuaagacaugccacuauga

SEQ ID NO: 1466936 - RNA, 19 nt, Homo sapiens
gaauuggaggauuaagaca

SEQ ID NO: 1466937 - RNA, 19 nt, Homo sapiens
ggauaaacugaccaucauc

SEQ ID NO: 1466938 - RNA, 19 nt, Homo sapiens
ccggaggccucuucaagcu

SEQ ID NO: 1466939 - RNA, 19 nt, Homo sapiens
auuggaggauuaagacaug

SEQ ID NO: 1466940 - RNA, 19 nt, Homo sapiens
ccuaagaaaaucacuguaa

SEQ ID NO: 1466941 - RNA, 19 nt, Homo sapiens
gguccugccaagaugguuu

SEQ ID NO: 1466942 - RNA, 19 nt, Homo sapiens
gagcaaaguaugcauauug

SEQ ID NO: 1466943 - RNA, 19 nt, Homo sapiens
gaucccaacuccagaagaa

SEQ ID NO: 1466944 - RNA, 19 nt, Homo sapiens
caaccaaacugaagugaag

SEQ ID NO: 1466945 - RNA, 19 nt, Homo sapiens
gaaaagagaugugaaagug

SEQ ID NO: 1466946 - RNA, 19 nt, Homo sapiens
gcaaaggaccacucacuga

SEQ ID NO: 1466947 - RNA, 19 nt, Homo sapiens
ccagggagauggaggugua

SEQ ID NO: 1466948 - RNA, 19 nt, Homo sapiens
ugaaggagaugauuuaagg

SEQ ID NO: 1466949 - RNA, 19 nt, Homo sapiens
ccaaguagcugggauuaca

SEQ ID NO: 1466950 - RNA, 19 nt, Homo sapiens
gaccaaaggcuucaucaau

SEQ ID NO: 1466951 - RNA, 19 nt, Homo sapiens
gggaacagcugcggaagug

SEQ ID NO: 1466952 - RNA, 19 nt, Homo sapiens
ggagagcaaaguaugcaua

SEQ ID NO: 1466953 - RNA, 19 nt, Homo sapiens
gcagagagccuucagucau

SEQ ID NO: 1466954 - RNA, 19 nt, Homo sapiens
cagagagccuucagucaug

SEQ ID NO: 1466955 - RNA, 19 nt, Homo sapiens
ggaggugcgcgauagauuu

SEQ ID NO: 1466956 - RNA, 19 nt, Homo sapiens
gcacuuggagaagguguua

SEQ ID NO: 1466957 - RNA, 19 nt, Homo sapiens
caccacuccuggcuaauuu

SEQ ID NO: 1466958 - RNA, 19 nt, Homo sapiens
ggagacacauggugaacag

SEQ ID NO: 1466959 - RNA, 19 nt, Homo sapiens
gggcagcaccuccaucuug

SEQ ID NO: 1466960 - RNA, 19 nt, Homo sapiens
ccacauugccaccauuuga

SEQ ID NO: 1466961 - RNA, 19 nt, Homo sapiens
cccagaagcugccacauag

SEQ ID NO: 1466962 - RNA, 19 nt, Homo sapiens
gccaaacacugcagcaucu

SEQ ID NO: 1466963 - RNA, 19 nt, Homo sapiens
caccaccacuccuggcuaa

SEQ ID NO: 1466964 - RNA, 19 nt, Homo sapiens
ucuccacccugguucauaa

SEQ ID NO: 1466965 - RNA, 19 nt, Homo sapiens
gacacauggugaacaguga

SEQ ID NO: 1466966 - RNA, 19 nt, Homo sapiens
gcacucagcacucuauguc

SEQ ID NO: 1466967 - RNA, 19 nt, Homo sapiens
ugaaaaggaucccacauug

SEQ ID NO: 1466968 - RNA, 19 nt, Homo sapiens
accaaaggcuucaucaaug

SEQ ID NO: 1466969 - RNA, 19 nt, Homo sapiens
cagcaacacauauacuaaa

SEQ ID NO: 1466970 - RNA, 19 nt, Homo sapiens
gcacagcucaaaugacauc

SEQ ID NO: 1466971 - RNA, 19 nt, Homo sapiens
aggcacagcucaaaugaca

SEQ ID NO: 1466972 - RNA, 19 nt, Homo sapiens
gcagccuuguccuaaauga

SEQ ID NO: 1466973 - RNA, 19 nt, Homo sapiens
gggaagaagaaacaaguga

SEQ ID NO: 1466974 - RNA, 19 nt, Homo sapiens
caaggcacagcucaaauga

SEQ ID NO: 1466975 - RNA, 19 nt, Homo sapiens
gcugugaccugcaggaaac

SEQ ID NO: 1466976 - RNA, 19 nt, Homo sapiens
gcgguugaguuccugagaa

SEQ ID NO: 1466977 - RNA, 19 nt, Homo sapiens
gcacaccauuuccuugaac

SEQ ID NO: 1466978 - RNA, 19 nt, Homo sapiens
gcugcagccuuguccuaaa

SEQ ID NO: 1466979 - RNA, 19 nt, Homo sapiens
gagagcaaaguaugcauau

SEQ ID NO: 1466980 - RNA, 19 nt, Homo sapiens
ugaucuaacucuucuccuu

SEQ ID NO: 1466981 - RNA, 19 nt, Homo sapiens
uaaaugguggugcuucuug

SEQ ID NO: 1466982 - RNA, 19 nt, Homo sapiens
gaggucagcauccgccaaa

SEQ ID NO: 1466983 - RNA, 19 nt, Homo sapiens
caucaaggcacagcucaaa

SEQ ID NO: 1466984 - RNA, 19 nt, Homo sapiens
ucaaggcacagcucaaaug

SEQ ID NO: 1466985 - RNA, 19 nt, Homo sapiens
gaaaagucauccugcaaag

SEQ ID NO: 1466986 - RNA, 19 nt, Homo sapiens
ggguugaaauggauguuag

SEQ ID NO: 1466987 - RNA, 19 nt, Homo sapiens
ccacagaugcagcguguca

SEQ ID NO: 1466988 - RNA, 19 nt, Homo sapiens
gagcugguuuugcugauuu

SEQ ID NO: 1466989 - RNA, 19 nt, Homo sapiens
ucuggaagcugaggaagga

SEQ ID NO: 1466990 - RNA, 19 nt, Homo sapiens
cgguugaguuccugagaaa

SEQ ID NO: 1466991 - RNA, 19 nt, Homo sapiens
gugaaagugcacaccauuu

SEQ ID NO: 1466992 - RNA, 19 nt, Homo sapiens
ccaccuugcucgcugaucu

SEQ ID NO: 1466993 - RNA, 19 nt, Homo sapiens
ggacacacucuccaaaauu

SEQ ID NO: 1466994 - RNA, 19 nt, Homo sapiens
ggagaaaagagaugugaaa

SEQ ID NO: 1466995 - RNA, 19 nt, Homo sapiens
ucagcaacacauauacuaa

SEQ ID NO: 1466996 - RNA, 19 nt, Homo sapiens
gggaggugcgcgauagauu

SEQ ID NO: 1466997 - RNA, 19 nt, Homo sapiens
gugcacaccauuuccuuga

SEQ ID NO: 1466998 - RNA, 19 nt, Homo sapiens
gagauccauuggugagaca

SEQ ID NO: 1466999 - RNA, 19 nt, Homo sapiens
cagaagcugccacauagga

SEQ ID NO: 1467000 - RNA, 19 nt, Homo sapiens
ugccucagccucccaagua

SEQ ID NO: 1467001 - RNA, 19 nt, Homo sapiens
ccaccacuccuggcuaauu

SEQ ID NO: 1467002 - RNA, 19 nt, Homo sapiens
gaaggagaugauuuaagga

SEQ ID NO: 1467003 - RNA, 19 nt, Homo sapiens
gucaugaggcuaugcaaug

SEQ ID NO: 1467004 - RNA, 19 nt, Homo sapiens
gaucccacauugccaccau

SEQ ID NO: 1467005 - RNA, 19 nt, Homo sapiens
gacacacucuccaaaauuc

SEQ ID NO: 1467006 - RNA, 19 nt, Homo sapiens
uguccuaaaugaaguccaa

SEQ ID NO: 1467007 - RNA, 19 nt, Homo sapiens
gcuuucaguuuccaugauc

SEQ ID NO: 1467008 - RNA, 19 nt, Homo sapiens
cugcucaucuggguucauu

SEQ ID NO: 1467009 - RNA, 19 nt, Homo sapiens
gaagugaaggcugcucauc

SEQ ID NO: 1467010 - RNA, 19 nt, Homo sapiens
gugaagacagagcugguuu

SEQ ID NO: 1467011 - RNA, 19 nt, Homo sapiens
ggcaggaugggaugaaaug

SEQ ID NO: 1467012 - RNA, 19 nt, Homo sapiens
ucacuucagcaacacauau

SEQ ID NO: 1467013 - RNA, 19 nt, Homo sapiens
agugaaggcugcucaucug

SEQ ID NO: 1467014 - RNA, 19 nt, Homo sapiens
gacuuugucuuuuguguga

SEQ ID NO: 1467015 - RNA, 19 nt, Homo sapiens
cugcagccuuguccuaaau

SEQ ID NO: 1467016 - RNA, 19 nt, Homo sapiens
ugcagcaggugaagacaga

SEQ ID NO: 1467017 - RNA, 19 nt, Homo sapiens
ucgcugaucuaacucuucu

SEQ ID NO: 1467018 - RNA, 19 nt, Homo sapiens
gcucgcugaucuaacucuu

SEQ ID NO: 1467019 - RNA, 19 nt, Homo sapiens
caucuggguucauuuucua

SEQ ID NO: 1467020 - RNA, 19 nt, Homo sapiens
guucauaagaggcuaaugc

SEQ ID NO: 1467021 - RNA, 19 nt, Homo sapiens
caaacacugcagcaucuuc

SEQ ID NO: 1467022 - RNA, 19 nt, Homo sapiens
aaauggauguuagggaagu

SEQ ID NO: 1467023 - RNA, 19 nt, Homo sapiens
ggucagcauccgccaaaca

SEQ ID NO: 1467024 - RNA, 19 nt, Homo sapiens
ugaggacacacucuccaaa

SEQ ID NO: 1467025 - RNA, 19 nt, Homo sapiens
cgacggaaagccagacaca

SEQ ID NO: 1467026 - RNA, 19 nt, Homo sapiens
agacagagcugguuuugcu

SEQ ID NO: 1467027 - RNA, 19 nt, Homo sapiens
agagcaaaguaugcauauu

SEQ ID NO: 1467028 - RNA, 19 nt, Homo sapiens
ccaaccaaacugaagugaa

SEQ ID NO: 1467029 - RNA, 19 nt, Homo sapiens
ccuaaaugguggugcuucu

SEQ ID NO: 1467030 - RNA, 19 nt, Homo sapiens
gggccauucccgggucuua

SEQ ID NO: 1467031 - RNA, 19 nt, Homo sapiens
ccuccuggguucaaacgau

SEQ ID NO: 1467032 - RNA, 19 nt, Homo sapiens
ucaugaggcuaugcaaugg

SEQ ID NO: 1467033 - RNA, 19 nt, Homo sapiens
uaaugcagagucacaguca

SEQ ID NO: 1467034 - RNA, 19 nt, Homo sapiens
ucagaucccaacuccagaa

SEQ ID NO: 1467035 - RNA, 19 nt, Homo sapiens
cauuugaaggagaugauuu

SEQ ID NO: 1467036 - RNA, 19 nt, Homo sapiens
cagcgugucaugaggcuau

SEQ ID NO: 1467037 - RNA, 19 nt, Homo sapiens
cugcggaagugcugugaca

SEQ ID NO: 1467038 - RNA, 19 nt, Homo sapiens
gaagacagagcugguuuug

SEQ ID NO: 1467039 - RNA, 19 nt, Homo sapiens
ugguggugcuucuugcaaa

SEQ ID NO: 1467040 - RNA, 19 nt, Homo sapiens
cacauugccaccauuugaa

SEQ ID NO: 1467041 - RNA, 19 nt, Homo sapiens
cacuucagcaacacauaua

SEQ ID NO: 1467042 - RNA, 19 nt, Homo sapiens
gaagagcuuucauuuggua

SEQ ID NO: 1467043 - RNA, 19 nt, Homo sapiens
gaacagcagugauaagauc

SEQ ID NO: 1467044 - RNA, 19 nt, Homo sapiens
aaacauggcggaagaaaua

SEQ ID NO: 1467045 - RNA, 19 nt, Homo sapiens
gaaauugggcuguuuauca

SEQ ID NO: 1467046 - RNA, 19 nt, Homo sapiens
ucaaagaucucuacgacaa

SEQ ID NO: 1467047 - RNA, 19 nt, Homo sapiens
uguaugagcuucuguuaaa

SEQ ID NO: 1467048 - RNA, 19 nt, Homo sapiens
gaagugccgucucccagua

SEQ ID NO: 1467049 - RNA, 19 nt, Homo sapiens
gauggaagcuaucugaaug

SEQ ID NO: 1467050 - RNA, 19 nt, Homo sapiens
ggagaugaauuaagcucua

SEQ ID NO: 1467051 - RNA, 19 nt, Homo sapiens
ggaagugucucucuuugau

SEQ ID NO: 1467052 - RNA, 19 nt, Homo sapiens
gaucagcuccuccaacuuu

SEQ ID NO: 1467053 - RNA, 19 nt, Homo sapiens
caugagcacugacuucuuu

SEQ ID NO: 1467054 - RNA, 19 nt, Homo sapiens
gaggaaggcugaaguugug

SEQ ID NO: 1467055 - RNA, 19 nt, Homo sapiens
gcauugcucuggcucuuaa

SEQ ID NO: 1467056 - RNA, 19 nt, Homo sapiens
gcggaacacuuauggguuu

SEQ ID NO: 1467057 - RNA, 19 nt, Homo sapiens
ccuaucagguuaauuguuu

SEQ ID NO: 1467058 - RNA, 19 nt, Homo sapiens
ggagagguguuuccagaug

SEQ ID NO: 1467059 - RNA, 19 nt, Homo sapiens
ccacaaaguuuccugagau

SEQ ID NO: 1467060 - RNA, 19 nt, Homo sapiens
gaaaucccacuuauaaaga

SEQ ID NO: 1467061 - RNA, 19 nt, Homo sapiens
ggagaaagcaauacagguu

SEQ ID NO: 1467062 - RNA, 19 nt, Homo sapiens
gccauggagugucgaguua

SEQ ID NO: 1467063 - RNA, 19 nt, Homo sapiens
gaccauugcagcuggauua

SEQ ID NO: 1467064 - RNA, 19 nt, Homo sapiens
caaccuggauucaacucua

SEQ ID NO: 1467065 - RNA, 19 nt, Homo sapiens
gcuauaaacaucacugaaa

SEQ ID NO: 1467066 - RNA, 19 nt, Homo sapiens
acaaggauuugaugccaua

SEQ ID NO: 1467067 - RNA, 19 nt, Homo sapiens
ucacugaaaucccacuuau

SEQ ID NO: 1467068 - RNA, 19 nt, Homo sapiens
uaaaaugccuuccugauga

SEQ ID NO: 1467069 - RNA, 19 nt, Homo sapiens
gggacaggcugaauccauu

SEQ ID NO: 1467070 - RNA, 19 nt, Homo sapiens
gaccucagcuccauagaca

SEQ ID NO: 1467071 - RNA, 19 nt, Homo sapiens
ugaaagacaucaucaucga

SEQ ID NO: 1467072 - RNA, 19 nt, Homo sapiens
caagguauccucagcaaga

SEQ ID NO: 1467073 - RNA, 19 nt, Homo sapiens
cauggagugucgaguuaua

SEQ ID NO: 1467074 - RNA, 19 nt, Homo sapiens
gcaacccugugugcuauaa

SEQ ID NO: 1467075 - RNA, 19 nt, Homo sapiens
acugaaaucccacuuauaa

SEQ ID NO: 1467076 - RNA, 19 nt, Homo sapiens
caucuugucugccaaauac

SEQ ID NO: 1467077 - RNA, 19 nt, Homo sapiens
guuauacagugccaaauuc

SEQ ID NO: 1467078 - RNA, 19 nt, Homo sapiens
gagaaagcaauacagguuu

SEQ ID NO: 1467079 - RNA, 19 nt, Homo sapiens
gauugucuaugccaccuuu

SEQ ID NO: 1467080 - RNA, 19 nt, Homo sapiens
ggaugcaguuguagguuug

SEQ ID NO: 1467081 - RNA, 19 nt, Homo sapiens
gcagaacuccuggacauug

SEQ ID NO: 1467082 - RNA, 19 nt, Homo sapiens
ggacauggucuaugacauc

SEQ ID NO: 1467083 - RNA, 19 nt, Homo sapiens
ccaagcagcuggacauggu

SEQ ID NO: 1467084 - RNA, 19 nt, Homo sapiens
cugaugagauauucaaaga

SEQ ID NO: 1467085 - RNA, 19 nt, Homo sapiens
gcagcuggauuaacuaagg

SEQ ID NO: 1467086 - RNA, 19 nt, Homo sapiens
ggacuugggacccuuucua

SEQ ID NO: 1467087 - RNA, 19 nt, Homo sapiens
uaucugcaguguucaaaga

SEQ ID NO: 1467088 - RNA, 19 nt, Homo sapiens
uaaggaagugucucucuuu

SEQ ID NO: 1467089 - RNA, 19 nt, Homo sapiens
gcgaggaugccuuuaagaa

SEQ ID NO: 1467090 - RNA, 19 nt, Homo sapiens
aggauuugaugccauauuu

SEQ ID NO: 1467091 - RNA, 19 nt, Homo sapiens
gagaugaauuaagcucuau

SEQ ID NO: 1467092 - RNA, 19 nt, Homo sapiens
caugaaaugccucuuagaa

SEQ ID NO: 1467093 - RNA, 19 nt, Homo sapiens
uuugggacaugccaucuua

SEQ ID NO: 1467094 - RNA, 19 nt, Homo sapiens
gaacaacuucgcccugcuu

SEQ ID NO: 1467095 - RNA, 19 nt, Homo sapiens
augagaaggugcugucuuu

SEQ ID NO: 1467096 - RNA, 19 nt, Homo sapiens
aagugucucucuuugauuu

SEQ ID NO: 1467097 - RNA, 19 nt, Homo sapiens
uggcucaaguccugcuuua

SEQ ID NO: 1467098 - RNA, 19 nt, Homo sapiens
uauagaaauugggcuguuu

SEQ ID NO: 1467099 - RNA, 19 nt, Homo sapiens
gaucucauacaguuucaaa

SEQ ID NO: 1467100 - RNA, 19 nt, Homo sapiens
ugaaugcacugcuggaucu

SEQ ID NO: 1467101 - RNA, 19 nt, Homo sapiens
agaaagcaauacagguuug

SEQ ID NO: 1467102 - RNA, 19 nt, Homo sapiens
guuccgcacugccaugaaa

SEQ ID NO: 1467103 - RNA, 19 nt, Homo sapiens
gaaggcugaaguuguguuu

SEQ ID NO: 1467104 - RNA, 19 nt, Homo sapiens
aaggguaccuggaugauuc

SEQ ID NO: 1467105 - RNA, 19 nt, Homo sapiens
ggacaggcugaauccauuu

SEQ ID NO: 1467106 - RNA, 19 nt, Homo sapiens
gaggaagacacauucauca

SEQ ID NO: 1467107 - RNA, 19 nt, Homo sapiens
ggaggaagacacauucauc

SEQ ID NO: 1467108 - RNA, 19 nt, Homo sapiens
caacuucgcccugcuuuca

SEQ ID NO: 1467109 - RNA, 19 nt, Homo sapiens
guauguauccgacuuguca

SEQ ID NO: 1467110 - RNA, 19 nt, Homo sapiens
ucaccuaucguuugaagaa

SEQ ID NO: 1467111 - RNA, 19 nt, Homo sapiens
ugaaaucccacuuauaaag

SEQ ID NO: 1467112 - RNA, 19 nt, Homo sapiens
gaaguuuccagauugucua

SEQ ID NO: 1467113 - RNA, 19 nt, Homo sapiens
ggugcugucuuucuacaau

SEQ ID NO: 1467114 - RNA, 19 nt, Homo sapiens
cggaugcaguuguagguuu

SEQ ID NO: 1467115 - RNA, 19 nt, Homo sapiens
aagcagaacuccuggacau

SEQ ID NO: 1467116 - RNA, 19 nt, Homo sapiens
gcgcgaggaugccuuuaag

SEQ ID NO: 1467117 - RNA, 19 nt, Homo sapiens
gccacaaaguuuccugaga

SEQ ID NO: 1467118 - RNA, 19 nt, Homo sapiens
gaggcaaccuggauucaac

SEQ ID NO: 1467119 - RNA, 19 nt, Homo sapiens
uagccgaguuuaagaggaa

SEQ ID NO: 1467120 - RNA, 19 nt, Homo sapiens
ugaugacccugaaggagaa

SEQ ID NO: 1467121 - RNA, 19 nt, Homo sapiens
ggacagccgagaccacgaa

SEQ ID NO: 1467122 - RNA, 19 nt, Homo sapiens
uggaaauacugggaaguuu

SEQ ID NO: 1467123 - RNA, 19 nt, Homo sapiens
gaagugucucucuuugauu

SEQ ID NO: 1467124 - RNA, 19 nt, Homo sapiens
agacaucaucaucgacuua

SEQ ID NO: 1467125 - RNA, 19 nt, Homo sapiens
gccaugaaaugccucuuag

SEQ ID NO: 1467126 - RNA, 19 nt, Homo sapiens
cugcagcacacaugucuua

SEQ ID NO: 1467127 - RNA, 19 nt, Homo sapiens
uaagcucuauagccacaaa

SEQ ID NO: 1467128 - RNA, 19 nt, Homo sapiens
cugcagacauccuccaaug

SEQ ID NO: 1467129 - RNA, 19 nt, Homo sapiens
gacaaaaccucggcucauu

SEQ ID NO: 1467130 - RNA, 19 nt, Homo sapiens
gugcaacccugugugcuau

SEQ ID NO: 1467131 - RNA, 19 nt, Homo sapiens
ggacccugcccacuaaaga

SEQ ID NO: 1467132 - RNA, 19 nt, Homo sapiens
ggagagaacaccauaucgu

SEQ ID NO: 1467133 - RNA, 19 nt, Homo sapiens
gcauggaggaagacacauu

SEQ ID NO: 1467134 - RNA, 19 nt, Homo sapiens
gauaaggaacuuggaagga

SEQ ID NO: 1467135 - RNA, 19 nt, Homo sapiens
uuaaggaagugucucucuu

SEQ ID NO: 1467136 - RNA, 19 nt, Homo sapiens
gacauggucuaugacauca

SEQ ID NO: 1467137 - RNA, 19 nt, Homo sapiens
ccuaucguuugaagaaauu

SEQ ID NO: 1467138 - RNA, 19 nt, Homo sapiens
uaagaggaaggcugaaguu

SEQ ID NO: 1467139 - RNA, 19 nt, Homo sapiens
gagcuuucauuugguagga

SEQ ID NO: 1467140 - RNA, 19 nt, Homo sapiens
gaugauucaggauacagua

SEQ ID NO: 1467141 - RNA, 19 nt, Homo sapiens
uaugccaccuuuccucuug

SEQ ID NO: 1467142 - RNA, 19 nt, Homo sapiens
gaagagcuuucauuuggua

SEQ ID NO: 1467143 - RNA, 19 nt, Homo sapiens
gaacagcagugauaagauc

SEQ ID NO: 1467144 - RNA, 19 nt, Homo sapiens
uguaugagcuucuguuaaa

SEQ ID NO: 1467145 - RNA, 19 nt, Homo sapiens
gaagugccgucucccagua

SEQ ID NO: 1467146 - RNA, 19 nt, Homo sapiens
ggagaugaauuaagcucua

SEQ ID NO: 1467147 - RNA, 19 nt, Homo sapiens
ggaagugucucucuuugau

SEQ ID NO: 1467148 - RNA, 19 nt, Homo sapiens
caugagcacugacuucuuu

SEQ ID NO: 1467149 - RNA, 19 nt, Homo sapiens
gaggaaggcugaaguugug

SEQ ID NO: 1467150 - RNA, 19 nt, Homo sapiens
gcauugcucuggcucuuaa

SEQ ID NO: 1467151 - RNA, 19 nt, Homo sapiens
ccuaucagguuaauuguuu

SEQ ID NO: 1467152 - RNA, 19 nt, Homo sapiens
ccacaaaguuuccugagau

SEQ ID NO: 1467153 - RNA, 19 nt, Homo sapiens
gaaaucccacuuauaaaga

SEQ ID NO: 1467154 - RNA, 19 nt, Homo sapiens
ggagaaagcaauacagguu

SEQ ID NO: 1467155 - RNA, 19 nt, Homo sapiens
gaccauugcagcuggauua

SEQ ID NO: 1467156 - RNA, 19 nt, Homo sapiens
caaccuggauucaacucua

SEQ ID NO: 1467157 - RNA, 19 nt, Homo sapiens
gcuauaaacaucacugaaa

SEQ ID NO: 1467158 - RNA, 19 nt, Homo sapiens
acaaggauuugaugccaua

SEQ ID NO: 1467159 - RNA, 19 nt, Homo sapiens
ucacugaaaucccacuuau

SEQ ID NO: 1467160 - RNA, 19 nt, Homo sapiens
ggucucgucugagcaguua

SEQ ID NO: 1467161 - RNA, 19 nt, Homo sapiens
uaaaaugccuuccugauga

SEQ ID NO: 1467162 - RNA, 19 nt, Homo sapiens
gggacaggcugaauccauu

SEQ ID NO: 1467163 - RNA, 19 nt, Homo sapiens
gaccucagcuccauagaca

SEQ ID NO: 1467164 - RNA, 19 nt, Homo sapiens
ccaagcagcuggccaacau

SEQ ID NO: 1467165 - RNA, 19 nt, Homo sapiens
caagguauccucagcaaga

SEQ ID NO: 1467166 - RNA, 19 nt, Homo sapiens
gcaacccugugugcuauaa

SEQ ID NO: 1467167 - RNA, 19 nt, Homo sapiens
acugaaaucccacuuauaa

SEQ ID NO: 1467168 - RNA, 19 nt, Homo sapiens
caucuugucugccaaauac

SEQ ID NO: 1467169 - RNA, 19 nt, Homo sapiens
gaaaaugcaccccaaauga

SEQ ID NO: 1467170 - RNA, 19 nt, Homo sapiens
gagaaagcaauacagguuu

SEQ ID NO: 1467171 - RNA, 19 nt, Homo sapiens
gauugucuaugccaccuuu

SEQ ID NO: 1467172 - RNA, 19 nt, Homo sapiens
ggaugcaguuguagguuug

SEQ ID NO: 1467173 - RNA, 19 nt, Homo sapiens
gcagaacuccuggacauug

SEQ ID NO: 1467174 - RNA, 19 nt, Homo sapiens
cugaugagauauucaaaga

SEQ ID NO: 1467175 - RNA, 19 nt, Homo sapiens
gcagcuggauuaacuaagg

SEQ ID NO: 1467176 - RNA, 19 nt, Homo sapiens
ggacuugggacccuuucua

SEQ ID NO: 1467177 - RNA, 19 nt, Homo sapiens
gcacauuugguucaucuga

SEQ ID NO: 1467178 - RNA, 19 nt, Homo sapiens
uaaggaagugucucucuuu

SEQ ID NO: 1467179 - RNA, 19 nt, Homo sapiens
aggauuugaugccauauuu

SEQ ID NO: 1467180 - RNA, 19 nt, Homo sapiens
gagaugaauuaagcucuau

SEQ ID NO: 1467181 - RNA, 19 nt, Homo sapiens
uuugggacaugccaucuua

SEQ ID NO: 1467182 - RNA, 19 nt, Homo sapiens
gaacaacuucgcccugcuu

SEQ ID NO: 1467183 - RNA, 19 nt, Homo sapiens
augagaaggugcugucuuu

SEQ ID NO: 1467184 - RNA, 19 nt, Homo sapiens
uggcucaaguccugcuuua

SEQ ID NO: 1467185 - RNA, 19 nt, Homo sapiens
aagugucucucuuugauuu

SEQ ID NO: 1467186 - RNA, 19 nt, Homo sapiens
gagacaggaugcuccagau

SEQ ID NO: 1467187 - RNA, 19 nt, Homo sapiens
agaaagcaauacagguuug

SEQ ID NO: 1467188 - RNA, 19 nt, Homo sapiens
gaaggcugaaguuguguuu

SEQ ID NO: 1467189 - RNA, 19 nt, Homo sapiens
aaggguaccuggaugauuc

SEQ ID NO: 1467190 - RNA, 19 nt, Homo sapiens
ggacaggcugaauccauuu

SEQ ID NO: 1467191 - RNA, 19 nt, Homo sapiens
gaggaagacacauucauca

SEQ ID NO: 1467192 - RNA, 19 nt, Homo sapiens
ggaggaagacacauucauc

SEQ ID NO: 1467193 - RNA, 19 nt, Homo sapiens
caacuucgcccugcuuuca

SEQ ID NO: 1467194 - RNA, 19 nt, Homo sapiens
guauguauccgacuuguca

SEQ ID NO: 1467195 - RNA, 19 nt, Homo sapiens
ugaaaucccacuuauaaag

SEQ ID NO: 1467196 - RNA, 19 nt, Homo sapiens
gaaguuuccagauugucua

SEQ ID NO: 1467197 - RNA, 19 nt, Homo sapiens
aagcagaacuccuggacau

SEQ ID NO: 1467198 - RNA, 19 nt, Homo sapiens
ggugcugucuuucuacaau

SEQ ID NO: 1467199 - RNA, 19 nt, Homo sapiens
cggaugcaguuguagguuu

SEQ ID NO: 1467200 - RNA, 19 nt, Homo sapiens
gccacaaaguuuccugaga

SEQ ID NO: 1467201 - RNA, 19 nt, Homo sapiens
gaggcaaccuggauucaac

SEQ ID NO: 1467202 - RNA, 19 nt, Homo sapiens
gccaacauguguagagaca

SEQ ID NO: 1467203 - RNA, 19 nt, Homo sapiens
uagccgaguuuaagaggaa

SEQ ID NO: 1467204 - RNA, 19 nt, Homo sapiens
ugaugacccugaaggagaa

SEQ ID NO: 1467205 - RNA, 19 nt, Homo sapiens
ggacagccgagaccacgaa

SEQ ID NO: 1467206 - RNA, 19 nt, Homo sapiens
uggaaauacugggaaguuu

SEQ ID NO: 1467207 - RNA, 19 nt, Homo sapiens
gaagugucucucuuugauu

SEQ ID NO: 1467208 - RNA, 19 nt, Homo sapiens
cugcagcacacaugucuua

SEQ ID NO: 1467209 - RNA, 19 nt, Homo sapiens
uaagcucuauagccacaaa

SEQ ID NO: 1467210 - RNA, 19 nt, Homo sapiens
gugcaacccugugugcuau

SEQ ID NO: 1467211 - RNA, 19 nt, Homo sapiens
ggacccugcccacuaaaga

SEQ ID NO: 1467212 - RNA, 19 nt, Homo sapiens
ggagagaacaccauaucgu

SEQ ID NO: 1467213 - RNA, 19 nt, Homo sapiens
gcauggaggaagacacauu

SEQ ID NO: 1467214 - RNA, 19 nt, Homo sapiens
gauaaggaacuuggaagga

SEQ ID NO: 1467215 - RNA, 19 nt, Homo sapiens
uuaaggaagugucucucuu

SEQ ID NO: 1467216 - RNA, 19 nt, Homo sapiens
uaagaggaaggcugaaguu

SEQ ID NO: 1467217 - RNA, 19 nt, Homo sapiens
gagcuuucauuugguagga

SEQ ID NO: 1467218 - RNA, 19 nt, Homo sapiens
gaugauucaggauacagua

SEQ ID NO: 1467219 - RNA, 19 nt, Homo sapiens
uaugccaccuuuccucuug

SEQ ID NO: 1467220 - RNA, 19 nt, Homo sapiens
cauugcagcuggauuaacu

SEQ ID NO: 1467221 - RNA, 19 nt, Homo sapiens
cuugggacccuuucuagua

SEQ ID NO: 1467222 - RNA, 19 nt, Homo sapiens
cagaaggccugaggagcuu

SEQ ID NO: 1467223 - RNA, 19 nt, Homo sapiens
gauccagacccucaucuag

SEQ ID NO: 1467224 - RNA, 19 nt, Homo sapiens
gaaccugcugugucacuug

SEQ ID NO: 1467225 - RNA, 19 nt, Homo sapiens
gguuuuagauucccacaaa

SEQ ID NO: 1467226 - RNA, 19 nt, Homo sapiens
agaaccagacccucaauga

SEQ ID NO: 1467227 - RNA, 19 nt, Homo sapiens
guggaccaguucugucuug

SEQ ID NO: 1467228 - RNA, 19 nt, Homo sapiens
uuaauuguuuggcguggaa

SEQ ID NO: 1467229 - RNA, 19 nt, Homo sapiens
aaggaagugucucucuuug

SEQ ID NO: 1467230 - RNA, 19 nt, Homo sapiens
gcagcuggccaacaugugu

SEQ ID NO: 1467231 - RNA, 19 nt, Homo sapiens
ggugcaacccugugugcua

SEQ ID NO: 1467232 - RNA, 19 nt, Homo sapiens
gcgcauugcucuggcucuu

SEQ ID NO: 1467233 - RNA, 19 nt, Homo sapiens
caauacagguuugggacau

SEQ ID NO: 1467234 - RNA, 19 nt, Homo sapiens
gugauaagauccccagcua

SEQ ID NO: 1467235 - RNA, 19 nt, Homo sapiens
ggaaccugcugugucacuu

SEQ ID NO: 1467236 - RNA, 19 nt, Homo sapiens
cacccuaucagguuaauug

SEQ ID NO: 1467237 - RNA, 19 nt, Homo sapiens
gcaggagcuugggaccauu

SEQ ID NO: 1467238 - RNA, 19 nt, Homo sapiens
gauaagauccccagcuaug

SEQ ID NO: 1467239 - RNA, 19 nt, Homo sapiens
ggauccagacccucaucua

SEQ ID NO: 1467240 - RNA, 19 nt, Homo sapiens
ggaacagcagugauaagau

SEQ ID NO: 1467241 - RNA, 19 nt, Homo sapiens
gaauuccucugggcugucu

SEQ ID NO: 1467242 - RNA, 19 nt, Homo sapiens
ccuaauagcugcaaugaua

SEQ ID NO: 1467243 - RNA, 19 nt, Homo sapiens
ggaaaagaauggauuaaug

SEQ ID NO: 1467244 - RNA, 19 nt, Homo sapiens
ccaugaaucuccacuacuu

SEQ ID NO: 1467245 - RNA, 19 nt, Homo sapiens
gcuuugccauucauagaua

SEQ ID NO: 1467246 - RNA, 19 nt, Homo sapiens
gaguuugggcugccuaaua

SEQ ID NO: 1467247 - RNA, 19 nt, Homo sapiens
ucaaagaaaccacuucaga

SEQ ID NO: 1467248 - RNA, 19 nt, Homo sapiens
guaaggagccaucggacaa

SEQ ID NO: 1467249 - RNA, 19 nt, Homo sapiens
gaucaagauucggaguuug

SEQ ID NO: 1467250 - RNA, 19 nt, Homo sapiens
gcccauuucugaccucuuc

SEQ ID NO: 1467251 - RNA, 19 nt, Homo sapiens
agacagcaauaaagaguuc

SEQ ID NO: 1467252 - RNA, 19 nt, Homo sapiens
cagcaaagggaaagaaaug

SEQ ID NO: 1467253 - RNA, 19 nt, Homo sapiens
ggacaccgagucagucaug

SEQ ID NO: 1467254 - RNA, 19 nt, Homo sapiens
guacagcuuugccauucau

SEQ ID NO: 1467255 - RNA, 19 nt, Homo sapiens
agaaacagcaggagagaga

SEQ ID NO: 1467256 - RNA, 19 nt, Homo sapiens
cuacuuacuugcugugauc

SEQ ID NO: 1467257 - RNA, 19 nt, Homo sapiens
ccauggagauauccuucuu

SEQ ID NO: 1467258 - RNA, 19 nt, Homo sapiens
ucucuuccuugucuucuuu

SEQ ID NO: 1467259 - RNA, 19 nt, Homo sapiens
gaaacggcaguguauuuua

SEQ ID NO: 1467260 - RNA, 19 nt, Homo sapiens
gaagucggcgauccaugaa

SEQ ID NO: 1467261 - RNA, 19 nt, Homo sapiens
caauauguuuccacucucu

SEQ ID NO: 1467262 - RNA, 19 nt, Homo sapiens
agaucaagauucggaguuu

SEQ ID NO: 1467263 - RNA, 19 nt, Homo sapiens
agaagucggcgauccauga

SEQ ID NO: 1467264 - RNA, 19 nt, Homo sapiens
uuucugaccucuucaacga

SEQ ID NO: 1467265 - RNA, 19 nt, Homo sapiens
uagcugcaaugauacuguu

SEQ ID NO: 1467266 - RNA, 19 nt, Homo sapiens
gaaaagaauggauuaaugg

SEQ ID NO: 1467267 - RNA, 19 nt, Homo sapiens
cugaaacggcaguguauuu

SEQ ID NO: 1467268 - RNA, 19 nt, Homo sapiens
aaucuccacuacuuacuug

SEQ ID NO: 1467269 - RNA, 19 nt, Homo sapiens
gaaucuccacuacuuacuu

SEQ ID NO: 1467270 - RNA, 19 nt, Homo sapiens
ggucuuugcugugagaagu

SEQ ID NO: 1467271 - RNA, 19 nt, Homo sapiens
cuucagcuucuucaucuua

SEQ ID NO: 1467272 - RNA, 19 nt, Homo sapiens
gggccaaacccgaggaaga

SEQ ID NO: 1467273 - RNA, 19 nt, Homo sapiens
caugaaucuccacuacuua

SEQ ID NO: 1467274 - RNA, 19 nt, Homo sapiens
gagaucaagauucggaguu

SEQ ID NO: 1467275 - RNA, 19 nt, Homo sapiens
gacaccaggcacucuagua

SEQ ID NO: 1467276 - RNA, 19 nt, Homo sapiens
gccguggucuuugcuguga

SEQ ID NO: 1467277 - RNA, 19 nt, Homo sapiens
gcaggagagagaagaaaca

SEQ ID NO: 1467278 - RNA, 19 nt, Homo sapiens
ugccauucauagauacaua

SEQ ID NO: 1467279 - RNA, 19 nt, Homo sapiens
caucuuacuguacagcuuu

SEQ ID NO: 1467280 - RNA, 19 nt, Homo sapiens
aaagacagcaauaaagagu

SEQ ID NO: 1467281 - RNA, 19 nt, Homo sapiens
ccaaggacaccgagucagu

SEQ ID NO: 1467282 - RNA, 19 nt, Homo sapiens
gggaaagaaaugacuugga

SEQ ID NO: 1467283 - RNA, 19 nt, Homo sapiens
aguuugggcugccuaauag

SEQ ID NO: 1467284 - RNA, 19 nt, Homo sapiens
gcaaagggaaagaaaugac

SEQ ID NO: 1467285 - RNA, 19 nt, Homo sapiens
agucagucauggcaccuaa

SEQ ID NO: 1467286 - RNA, 19 nt, Homo sapiens
gaaacagcaggagagagaa

SEQ ID NO: 1467287 - RNA, 19 nt, Homo sapiens
gcagggcaagggaccagaa

SEQ ID NO: 1467288 - RNA, 19 nt, Homo sapiens
cagcuuugccauucauaga

SEQ ID NO: 1467289 - RNA, 19 nt, Homo sapiens
agcaauauguuuccacucu

SEQ ID NO: 1467290 - RNA, 19 nt, Homo sapiens
gauccaugaaucuccacua

SEQ ID NO: 1467291 - RNA, 19 nt, Homo sapiens
ugugggagccguggucuuu

SEQ ID NO: 1467292 - RNA, 19 nt, Homo sapiens
gcacgcugagaucaagauu

SEQ ID NO: 1467293 - RNA, 19 nt, Homo sapiens
auaaggagccaucggacaa

SEQ ID NO: 1467294 - RNA, 19 nt, Homo sapiens
ugucugaaacggcagugua

SEQ ID NO: 1467295 - RNA, 19 nt, Homo sapiens
uuacuugcugugauccuua

SEQ ID NO: 1467296 - RNA, 19 nt, Homo sapiens
uaaggagccaucggacaaa

SEQ ID NO: 1467297 - RNA, 19 nt, Homo sapiens
aagacaagaaggacgguaa

SEQ ID NO: 1467298 - RNA, 19 nt, Homo sapiens
ccucuucaacgaccugauu

SEQ ID NO: 1467299 - RNA, 19 nt, Homo sapiens
acgcugagaucaagauucg

SEQ ID NO: 1467300 - RNA, 19 nt, Homo sapiens
uaaggagccaucggacaaa

SEQ ID NO: 1467301 - RNA, 19 nt, Homo sapiens
agucggcgauccaugaauc

SEQ ID NO: 1467302 - RNA, 19 nt, Homo sapiens
uuaccaccuuugcuuggaa

SEQ ID NO: 1467303 - RNA, 19 nt, Homo sapiens
caaagggaaagaaaugacu

SEQ ID NO: 1467304 - RNA, 19 nt, Homo sapiens
gccagcaaagggaaagaaa

SEQ ID NO: 1467305 - RNA, 19 nt, Homo sapiens
ccagaaacagcaggagaga

SEQ ID NO: 1467306 - RNA, 19 nt, Homo sapiens
auagauacauacccuucau

SEQ ID NO: 1467307 - RNA, 19 nt, Homo sapiens
cuguacagcuuugccauuc

SEQ ID NO: 1467308 - RNA, 19 nt, Homo sapiens
gcuucuucaucuuacugua

SEQ ID NO: 1467309 - RNA, 19 nt, Homo sapiens
agauauccuucuucagcuu

SEQ ID NO: 1467310 - RNA, 19 nt, Homo sapiens
uaccaccuuugcuuggaaa

SEQ ID NO: 1467311 - RNA, 19 nt, Homo sapiens
auggagauauccuucuuca

SEQ ID NO: 1467312 - RNA, 19 nt, Homo sapiens
caccccaucuugaggcuua

SEQ ID NO: 1467313 - RNA, 19 nt, Homo sapiens
auacuguuguccucacuca

SEQ ID NO: 1467314 - RNA, 19 nt, Homo sapiens
ggaauuaaaagacagcaau

SEQ ID NO: 1467315 - RNA, 19 nt, Homo sapiens
acaagaaggacgguaagga

SEQ ID NO: 1467316 - RNA, 19 nt, Homo sapiens
ccgcuaccggugggaauua

SEQ ID NO: 1467317 - RNA, 19 nt, Homo sapiens
ccagcaaagggaaagaaau

SEQ ID NO: 1467318 - RNA, 19 nt, Homo sapiens
gauaggugcuuaauaaaug

SEQ ID NO: 1467319 - RNA, 19 nt, Homo sapiens
ccacuuaucuuggauguuu

SEQ ID NO: 1467320 - RNA, 19 nt, Homo sapiens
cuugauaggugcuuaauaa

SEQ ID NO: 1467321 - RNA, 19 nt, Homo sapiens
ggacucagaucuacacaca

SEQ ID NO: 1467322 - RNA, 19 nt, Homo sapiens
gaagcuacuugaccuuuga

SEQ ID NO: 1467323 - RNA, 19 nt, Homo sapiens
gcagguggcuugcagacuu

SEQ ID NO: 1467324 - RNA, 19 nt, Homo sapiens
gaaacugcagucacccuua

SEQ ID NO: 1467325 - RNA, 19 nt, Homo sapiens
caguguggcugcugcauaa

SEQ ID NO: 1467326 - RNA, 19 nt, Homo sapiens
gaucugcaguggcuguuug

SEQ ID NO: 1467327 - RNA, 19 nt, Homo sapiens
acucagugcugguuuguaa

SEQ ID NO: 1467328 - RNA, 19 nt, Homo sapiens
gaaggaaggauugcucauu

SEQ ID NO: 1467329 - RNA, 19 nt, Homo sapiens
ggaacugguuguccauugu

SEQ ID NO: 1467330 - RNA, 19 nt, Homo sapiens
gcacuuugcgucucgcuuu

SEQ ID NO: 1467331 - RNA, 19 nt, Homo sapiens
gagggcagcugguguuaag

SEQ ID NO: 1467332 - RNA, 19 nt, Homo sapiens
gcucugcccucgugcuuug

SEQ ID NO: 1467333 - RNA, 19 nt, Homo sapiens
guucacaucuccugagcuu

SEQ ID NO: 1467334 - RNA, 19 nt, Homo sapiens
cgaaaccccugauauuuaa

SEQ ID NO: 1467335 - RNA, 19 nt, Homo sapiens
gaccuuugauguuugaguu

SEQ ID NO: 1467336 - RNA, 19 nt, Homo sapiens
ucaaucauguuuccucuca

SEQ ID NO: 1467337 - RNA, 19 nt, Homo sapiens
guccggaucuugucuccua

SEQ ID NO: 1467338 - RNA, 19 nt, Homo sapiens
gcagaugcuugcccaguag

SEQ ID NO: 1467339 - RNA, 19 nt, Homo sapiens
cagcugguguuaagaaugu

SEQ ID NO: 1467340 - RNA, 19 nt, Homo sapiens
aaggaaggauugcucauug

SEQ ID NO: 1467341 - RNA, 19 nt, Homo sapiens
auaaaugucugcucaacug

SEQ ID NO: 1467342 - RNA, 19 nt, Homo sapiens
gaccacauguugagaaacu

SEQ ID NO: 1467343 - RNA, 19 nt, Homo sapiens
uaagaacucauuacugguu

SEQ ID NO: 1467344 - RNA, 19 nt, Homo sapiens
gggcaaucuuaacaucuuu

SEQ ID NO: 1467345 - RNA, 19 nt, Homo sapiens
acucagaucuacacacaga

SEQ ID NO: 1467346 - RNA, 19 nt, Homo sapiens
ggagagggcagcugguguu

SEQ ID NO: 1467347 - RNA, 19 nt, Homo sapiens
gagcugucuugcagugauu

SEQ ID NO: 1467348 - RNA, 19 nt, Homo sapiens
gaacugguuguccauuguu

SEQ ID NO: 1467349 - RNA, 19 nt, Homo sapiens
gaccagaccacaaaguuca

SEQ ID NO: 1467350 - RNA, 19 nt, Homo sapiens
ucccagaccucccucauuc

SEQ ID NO: 1467351 - RNA, 19 nt, Homo sapiens
ggagcugucuugcagugau

SEQ ID NO: 1467352 - RNA, 19 nt, Homo sapiens
gagggaggacucagaucua

SEQ ID NO: 1467353 - RNA, 19 nt, Homo sapiens
gaaggauugcucauugguu

SEQ ID NO: 1467354 - RNA, 19 nt, Homo sapiens
aauauugucuguucuaggu

SEQ ID NO: 1467355 - RNA, 19 nt, Homo sapiens
guguuaagaauguagguua

SEQ ID NO: 1467356 - RNA, 19 nt, Homo sapiens
cuacuugaccuuugauguu

SEQ ID NO: 1467357 - RNA, 19 nt, Homo sapiens
aaacugcagucacccuuag

SEQ ID NO: 1467358 - RNA, 19 nt, Homo sapiens
gccuaaagccaguccuuaa

SEQ ID NO: 1467359 - RNA, 19 nt, Homo sapiens
ccacuucccaguuugcaaa

SEQ ID NO: 1467360 - RNA, 19 nt, Homo sapiens
gcucauugguugccuucau

SEQ ID NO: 1467361 - RNA, 19 nt, Homo sapiens
uacuugaccuuugauguuu

SEQ ID NO: 1467362 - RNA, 19 nt, Homo sapiens
caucuuuacucuuauuguc

SEQ ID NO: 1467363 - RNA, 19 nt, Homo sapiens
ucacaucuccugagcuuag

SEQ ID NO: 1467364 - RNA, 19 nt, Homo sapiens
ccagauuuaccuuccagua

SEQ ID NO: 1467365 - RNA, 19 nt, Homo sapiens
ccaggaagcccuaugacau

SEQ ID NO: 1467366 - RNA, 19 nt, Homo sapiens
cagguggcuugcagacuuu

SEQ ID NO: 1467367 - RNA, 19 nt, Homo sapiens
gaccggacuuucccugcuu

SEQ ID NO: 1467368 - RNA, 19 nt, Homo sapiens
acucuccacuucccaguuu

SEQ ID NO: 1467369 - RNA, 19 nt, Homo sapiens
gauugaaacagccugauuc

SEQ ID NO: 1467370 - RNA, 19 nt, Homo sapiens
uggcauccauguaaaguag

SEQ ID NO: 1467371 - RNA, 19 nt, Homo sapiens
cgugaugccuccuaaugug

SEQ ID NO: 1467372 - RNA, 19 nt, Homo sapiens
aaucauguuuccucucaga

SEQ ID NO: 1467373 - RNA, 19 nt, Homo sapiens
gggcagcugguguuaagaa

SEQ ID NO: 1467374 - RNA, 19 nt, Homo sapiens
gagagggcagcugguguua

SEQ ID NO: 1467375 - RNA, 19 nt, Homo sapiens
uguggcugcugcauaagua

SEQ ID NO: 1467376 - RNA, 19 nt, Homo sapiens
gagcggaggcugagaacuc

SEQ ID NO: 1467377 - RNA, 19 nt, Homo sapiens
ccaaauucagugucaguga

SEQ ID NO: 1467378 - RNA, 19 nt, Homo sapiens
uaauaaaugucugcucaac

SEQ ID NO: 1467379 - RNA, 19 nt, Homo sapiens
gcugcaguguggccagauu

SEQ ID NO: 1467380 - RNA, 19 nt, Homo sapiens
cggaccacauguugagaaa

SEQ ID NO: 1467381 - RNA, 19 nt, Homo sapiens
gcaagcagucuguuugaac

SEQ ID NO: 1467382 - RNA, 19 nt, Homo sapiens
agaugucacucucauucaa

SEQ ID NO: 1467383 - RNA, 19 nt, Homo sapiens
ggauuggccuguccccuuu

SEQ ID NO: 1467384 - RNA, 19 nt, Homo sapiens
agaagcuacuugaccuuug

SEQ ID NO: 1467385 - RNA, 19 nt, Homo sapiens
ucucuaguguccuccuaaa

SEQ ID NO: 1467386 - RNA, 19 nt, Homo sapiens
ucuagguguugcccaaauu

SEQ ID NO: 1467387 - RNA, 19 nt, Homo sapiens
uggcacggcugggauguga

SEQ ID NO: 1467388 - RNA, 19 nt, Homo sapiens
ccgaaaccccugauauuua

SEQ ID NO: 1467389 - RNA, 19 nt, Homo sapiens
gcuaugggaaggaaggauu

SEQ ID NO: 1467390 - RNA, 19 nt, Homo sapiens
aggccaagcuuguccuuca

SEQ ID NO: 1467391 - RNA, 19 nt, Homo sapiens
gaacucagugcugguuugu

SEQ ID NO: 1467392 - RNA, 19 nt, Homo sapiens
gaggagcggaggcugagaa

SEQ ID NO: 1467393 - RNA, 19 nt, Homo sapiens
ucagaucuacacacagaaa

SEQ ID NO: 1467394 - RNA, 19 nt, Homo sapiens
gccgcugucucuggaagua

SEQ ID NO: 1467395 - RNA, 19 nt, Homo sapiens
cuuauugucuggaccuuca

SEQ ID NO: 1467396 - RNA, 19 nt, Homo sapiens
cuucguggcauccauguaa

SEQ ID NO: 1467397 - RNA, 19 nt, Homo sapiens
gcucgccucuucccugucu

SEQ ID NO: 1467398 - RNA, 19 nt, Homo sapiens
cccaaauuaucaaaccauu

SEQ ID NO: 1467399 - RNA, 19 nt, Homo sapiens
cagaggaaacccaggaaau

SEQ ID NO: 1467400 - RNA, 19 nt, Homo sapiens
ggaagcagagguagaagac

SEQ ID NO: 1467401 - RNA, 19 nt, Homo sapiens
agaacucagugcugguuug

SEQ ID NO: 1467402 - RNA, 19 nt, Homo sapiens
gaccgccuguguucucugu

SEQ ID NO: 1467403 - RNA, 19 nt, Homo sapiens
ugagacggaauucaucauu

SEQ ID NO: 1467404 - RNA, 19 nt, Homo sapiens
ugggcaaucuuaacaucuu

SEQ ID NO: 1467405 - RNA, 19 nt, Homo sapiens
ggccaagcuuguccuucaa

SEQ ID NO: 1467406 - RNA, 19 nt, Homo sapiens
ccgggaaucugcaaaugag

SEQ ID NO: 1467407 - RNA, 19 nt, Homo sapiens
ugguugccuucaucaguua

SEQ ID NO: 1467408 - RNA, 19 nt, Homo sapiens
gucuucguguucugacuua

SEQ ID NO: 1467409 - RNA, 19 nt, Homo sapiens
ucacccagcuguggaagca

SEQ ID NO: 1467410 - RNA, 19 nt, Homo sapiens
ggcaaucuuaacaucuuua

SEQ ID NO: 1467411 - RNA, 19 nt, Homo sapiens
guaaaagagccuugucuga

SEQ ID NO: 1467412 - RNA, 19 nt, Homo sapiens
ccucagcuuuguaccuguu

SEQ ID NO: 1467413 - RNA, 19 nt, Homo sapiens
caggccugcuucuugguuu

SEQ ID NO: 1467414 - RNA, 19 nt, Homo sapiens
gcucaccuccgucuguuca

SEQ ID NO: 1467415 - RNA, 19 nt, Homo sapiens
uaaugcaagcagucuguuu

SEQ ID NO: 1467416 - RNA, 19 nt, Homo sapiens
guaagucuucguguucuga

SEQ ID NO: 1467417 - RNA, 19 nt, Homo sapiens
agaggaaacccaggaaaug

SEQ ID NO: 1467418 - RNA, 19 nt, Homo sapiens
ugacggaugugaagaauaa

SEQ ID NO: 1467419 - RNA, 19 nt, Homo sapiens
gcacucuucucucgcuaua

SEQ ID NO: 1467420 - RNA, 19 nt, Homo sapiens
ggauugauuugguccauga

SEQ ID NO: 1467421 - RNA, 19 nt, Homo sapiens
cgaagacgcugcaggagau

SEQ ID NO: 1467422 - RNA, 19 nt, Homo sapiens
ggaaaaggcugagaaacaa

SEQ ID NO: 1467423 - RNA, 19 nt, Homo sapiens
gaagugcuuuaaccugaga

SEQ ID NO: 1467424 - RNA, 19 nt, Homo sapiens
cuacucagaccgccaguua

SEQ ID NO: 1467425 - RNA, 19 nt, Homo sapiens
ggaaguggauuugcuaaaa

SEQ ID NO: 1467426 - RNA, 19 nt, Homo sapiens
caaacacucucagaacaug

SEQ ID NO: 1467427 - RNA, 19 nt, Homo sapiens
gccaagaacagaugagaaa

SEQ ID NO: 1467428 - RNA, 19 nt, Homo sapiens
gcuaaaauguugccaagaa

SEQ ID NO: 1467429 - RNA, 19 nt, Homo sapiens
gagaagaggauugggauug

SEQ ID NO: 1467430 - RNA, 19 nt, Homo sapiens
gaggugaacugcccauugc

SEQ ID NO: 1467431 - RNA, 19 nt, Homo sapiens
ggccuagccucuucuacaa

SEQ ID NO: 1467432 - RNA, 19 nt, Homo sapiens
gaugagaagugcuuuaacc

SEQ ID NO: 1467433 - RNA, 19 nt, Homo sapiens
ggauugggauugauuuggu

SEQ ID NO: 1467434 - RNA, 19 nt, Homo sapiens
gaagaggauugggauugau

SEQ ID NO: 1467435 - RNA, 19 nt, Homo sapiens
agaagaggauugggauuga

SEQ ID NO: 1467436 - RNA, 19 nt, Homo sapiens
uggacaggcuucugacuga

SEQ ID NO: 1467437 - RNA, 19 nt, Homo sapiens
gagcuggacaggcuucuga

SEQ ID NO: 1467438 - RNA, 19 nt, Homo sapiens
gagggaggauggaguuucu

SEQ ID NO: 1467439 - RNA, 19 nt, Homo sapiens
uuacuguggucccaagaaa

SEQ ID NO: 1467440 - RNA, 19 nt, Homo sapiens
ucucugaggugacggaugu

SEQ ID NO: 1467441 - RNA, 19 nt, Homo sapiens
acaccaaccuggccuucaa

SEQ ID NO: 1467442 - RNA, 19 nt, Homo sapiens
gcuuuaaccugagaaauac

SEQ ID NO: 1467443 - RNA, 19 nt, Homo sapiens
gaacagaugagaaaauuag

SEQ ID NO: 1467444 - RNA, 19 nt, Homo sapiens
ugacugagaaccagaacuu

SEQ ID NO: 1467445 - RNA, 19 nt, Homo sapiens
gcggagcaccucuuugaga

SEQ ID NO: 1467446 - RNA, 19 nt, Homo sapiens
aagaaaugcuguggcuuga

SEQ ID NO: 1467447 - RNA, 19 nt, Homo sapiens
gcagguggccuuggagugu

SEQ ID NO: 1467448 - RNA, 19 nt, Homo sapiens
agacgcagcuggcgaagac

SEQ ID NO: 1467449 - RNA, 19 nt, Homo sapiens
ugcuuuaaccugagaaaua

SEQ ID NO: 1467450 - RNA, 19 nt, Homo sapiens
aagaauugauauccagaug

SEQ ID NO: 1467451 - RNA, 19 nt, Homo sapiens
guaacgacaacaucaaaca

SEQ ID NO: 1467452 - RNA, 19 nt, Homo sapiens
gaaauacgucagacugcau

SEQ ID NO: 1467453 - RNA, 19 nt, Homo sapiens
ggugacggaugugaagaau

SEQ ID NO: 1467454 - RNA, 19 nt, Homo sapiens
ggacaucccgcaguugaag

SEQ ID NO: 1467455 - RNA, 19 nt, Homo sapiens
gggaaguggauuugcuaaa

SEQ ID NO: 1467456 - RNA, 19 nt, Homo sapiens
gaccuugucggaucagaug

SEQ ID NO: 1467457 - RNA, 19 nt, Homo sapiens
caaguucaguaacgacaac

SEQ ID NO: 1467458 - RNA, 19 nt, Homo sapiens
aguugaagcuggugaacga

SEQ ID NO: 1467459 - RNA, 19 nt, Homo sapiens
caucaaacacucucagaac

SEQ ID NO: 1467460 - RNA, 19 nt, Homo sapiens
gggccaaguucaguaacga

SEQ ID NO: 1467461 - RNA, 19 nt, Homo sapiens
gggaggauggaguuucuug

SEQ ID NO: 1467462 - RNA, 19 nt, Homo sapiens
gaggauugggauugauuug

SEQ ID NO: 1467463 - RNA, 19 nt, Homo sapiens
caguaacgacaacaucaaa

SEQ ID NO: 1467464 - RNA, 19 nt, Homo sapiens
cccaguguaucgaugagaa

SEQ ID NO: 1467465 - RNA, 19 nt, Homo sapiens
guaccgcuaccucaauuca

SEQ ID NO: 1467466 - RNA, 19 nt, Homo sapiens
aggcggagcaccucuuuga

SEQ ID NO: 1467467 - RNA, 19 nt, Homo sapiens
gagaaaauuagcucaaaga

SEQ ID NO: 1467468 - RNA, 19 nt, Homo sapiens
cgccagugauccaggaaug

SEQ ID NO: 1467469 - RNA, 19 nt, Homo sapiens
ucgaugagaagugcuuuaa

SEQ ID NO: 1467470 - RNA, 19 nt, Homo sapiens
gcugagaaacaaaguaaaa

SEQ ID NO: 1467471 - RNA, 19 nt, Homo sapiens
aggcugagaaacaaaguaa

SEQ ID NO: 1467472 - RNA, 19 nt, Homo sapiens
ccugagaccugggccaagu

SEQ ID NO: 1467473 - RNA, 19 nt, Homo sapiens
ugaggugaacugcccauug

SEQ ID NO: 1467474 - RNA, 19 nt, Homo sapiens
caugagggaggauggaguu

SEQ ID NO: 1467475 - RNA, 19 nt, Homo sapiens
cauugcagguggccuugga

SEQ ID NO: 1467476 - RNA, 19 nt, Homo sapiens
gcuaucagcccuacuaccu

SEQ ID NO: 1467477 - RNA, 19 nt, Homo sapiens
gaaaaggcugagaaacaaa

SEQ ID NO: 1467478 - RNA, 19 nt, Homo sapiens
ccaacacccucugcaucga

SEQ ID NO: 1467479 - RNA, 19 nt, Homo sapiens
gcacgagcucgccaucaag

SEQ ID NO: 1467480 - RNA, 19 nt, Homo sapiens
ucaaacacucucagaacau

SEQ ID NO: 1467481 - RNA, 19 nt, Homo sapiens
ccaucaugcugcuggaaag

SEQ ID NO: 1467482 - RNA, 19 nt, Homo sapiens
aaagcucggcccaguguau

SEQ ID NO: 1467483 - RNA, 19 nt, Homo sapiens
gcaucgacaaggagaagug

SEQ ID NO: 1467484 - RNA, 19 nt, Homo sapiens
agcacgagcucgccaucaa

SEQ ID NO: 1467485 - RNA, 19 nt, Homo sapiens
ucaguaacgacaacaucaa

SEQ ID NO: 1467486 - RNA, 19 nt, Homo sapiens
aaugcuaucagcccuacua

SEQ ID NO: 1467487 - RNA, 19 nt, Homo sapiens
aucaaacacucucagaaca

SEQ ID NO: 1467488 - RNA, 19 nt, Homo sapiens
gacaggcuucugacugaga

SEQ ID NO: 1467489 - RNA, 19 nt, Homo sapiens
uggaggcaguucacagaca

SEQ ID NO: 1467490 - RNA, 19 nt, Homo sapiens
caacauaccuuguaaauag

SEQ ID NO: 1467491 - RNA, 19 nt, Homo sapiens
ggaaagaggugaaaaggaa

SEQ ID NO: 1467492 - RNA, 19 nt, Homo sapiens
gaucauggguggcggguau

SEQ ID NO: 1467493 - RNA, 19 nt, Homo sapiens
gguaugaucucaaccucuu

SEQ ID NO: 1467494 - RNA, 19 nt, Homo sapiens
gggccaacauaccuuguaa

SEQ ID NO: 1467495 - RNA, 19 nt, Homo sapiens
gacgcuggcugcauaguga

SEQ ID NO: 1467496 - RNA, 19 nt, Homo sapiens
gcagagcaccggcagcauu

SEQ ID NO: 1467497 - RNA, 19 nt, Homo sapiens
ccaacauaccuuguaaaua

SEQ ID NO: 1467498 - RNA, 19 nt, Homo sapiens
gccaacauaccuuguaaau

SEQ ID NO: 1467499 - RNA, 19 nt, Homo sapiens
uggcggagcucagcaacuu

SEQ ID NO: 1467500 - RNA, 19 nt, Homo sapiens
ucaagaggccagcaagguu

SEQ ID NO: 1467501 - RNA, 19 nt, Homo sapiens
aagguuguccacaugaaua

SEQ ID NO: 1467502 - RNA, 19 nt, Homo sapiens
cagagcaccggcagcauug

SEQ ID NO: 1467503 - RNA, 19 nt, Homo sapiens
ggaagucaagugcaagaac

SEQ ID NO: 1467504 - RNA, 19 nt, Homo sapiens
gccuggaagucaagugcaa

SEQ ID NO: 1467505 - RNA, 19 nt, Homo sapiens
ccaagccaccagugucguu

SEQ ID NO: 1467506 - RNA, 19 nt, Homo sapiens
ugaauaaacuccggaaaac

SEQ ID NO: 1467507 - RNA, 19 nt, Homo sapiens
ccagugucguucguagaga

SEQ ID NO: 1467508 - RNA, 19 nt, Homo sapiens
ggucacaguuauuuauuga

SEQ ID NO: 1467509 - RNA, 19 nt, Homo sapiens
ggaggucacaguuauuuau

SEQ ID NO: 1467510 - RNA, 19 nt, Homo sapiens
gggcaaacccuacaacuac

SEQ ID NO: 1467511 - RNA, 19 nt, Homo sapiens
gggagcagcugggcaagau

SEQ ID NO: 1467512 - RNA, 19 nt, Homo sapiens
ccaagaagccacacuacau

SEQ ID NO: 1467513 - RNA, 19 nt, Homo sapiens
ggagaagucacaccucuac

SEQ ID NO: 1467514 - RNA, 19 nt, Homo sapiens
gaggucacaguuauuuauu

SEQ ID NO: 1467515 - RNA, 19 nt, Homo sapiens
caagaagccacacuacauc

SEQ ID NO: 1467516 - RNA, 19 nt, Homo sapiens
ucuacaaccacaugaagua

SEQ ID NO: 1467517 - RNA, 19 nt, Homo sapiens
ucaccugccuggagaaguc

SEQ ID NO: 1467518 - RNA, 19 nt, Homo sapiens
ggcaaacccuacaacuaca

SEQ ID NO: 1467519 - RNA, 19 nt, Homo sapiens
gaagucacaccucuacaac

SEQ ID NO: 1467520 - RNA, 19 nt, Homo sapiens
gcaaacccuacaacuacaa

SEQ ID NO: 1467521 - RNA, 19 nt, Homo sapiens
ccgcaugcauguggauaga

SEQ ID NO: 1467522 - RNA, 19 nt, Homo sapiens
agucacaccucuacaacca

SEQ ID NO: 1467523 - RNA, 19 nt, Homo sapiens
agaagucacaccucuacaa

SEQ ID NO: 1467524 - RNA, 19 nt, Homo sapiens
caaacccuacaacuacaaa

SEQ ID NO: 1467525 - RNA, 19 nt, Homo sapiens
caggaagcccggagcaugu

SEQ ID NO: 1467526 - RNA, 19 nt, Homo sapiens
ugaaguacagccucugcaa

SEQ ID NO: 1467527 - RNA, 19 nt, Homo sapiens
ggucucggaagcccaagaa

SEQ ID NO: 1467528 - RNA, 19 nt, Homo sapiens
cgaccucucugugaaacgu

SEQ ID NO: 1467529 - RNA, 19 nt, Homo sapiens
gagcugggucccguguuga

SEQ ID NO: 1467530 - RNA, 19 nt, Homo sapiens
ucaaugggcucuucuggua

SEQ ID NO: 1467531 - RNA, 19 nt, Homo sapiens
gagagaugcuguugaauca

SEQ ID NO: 1467532 - RNA, 19 nt, Homo sapiens
ggaagagaguaaccaguuu

SEQ ID NO: 1467533 - RNA, 19 nt, Homo sapiens
ggacaucugugaguucauu

SEQ ID NO: 1467534 - RNA, 19 nt, Homo sapiens
gcaaagcggccuuauuuau

SEQ ID NO: 1467535 - RNA, 19 nt, Homo sapiens
ucacgugaccuguuuauaa

SEQ ID NO: 1467536 - RNA, 19 nt, Homo sapiens
caacugaagcugugauauu

SEQ ID NO: 1467537 - RNA, 19 nt, Homo sapiens
ccaaggagcucuacaacgu

SEQ ID NO: 1467538 - RNA, 19 nt, Homo sapiens
gagaugcuguugaaucaga

SEQ ID NO: 1467539 - RNA, 19 nt, Homo sapiens
agagagagaugcuguugaa

SEQ ID NO: 1467540 - RNA, 19 nt, Homo sapiens
cacgugaccuguuuauaaa

SEQ ID NO: 1467541 - RNA, 19 nt, Homo sapiens
guaaguguuucuugugcua

SEQ ID NO: 1467542 - RNA, 19 nt, Homo sapiens
gaucaacagcccaaagauu

SEQ ID NO: 1467543 - RNA, 19 nt, Homo sapiens
ccagagagccagagaguga

SEQ ID NO: 1467544 - RNA, 19 nt, Homo sapiens
gaaacggucuggugaagcu

SEQ ID NO: 1467545 - RNA, 19 nt, Homo sapiens
cugcaaagcggccuuauuu

SEQ ID NO: 1467546 - RNA, 19 nt, Homo sapiens
guacauaacgaccucauuc

SEQ ID NO: 1467547 - RNA, 19 nt, Homo sapiens
gaaacaggccaccgccaaa

SEQ ID NO: 1467548 - RNA, 19 nt, Homo sapiens
uggcaaaucucagcuguug

SEQ ID NO: 1467549 - RNA, 19 nt, Homo sapiens
acacggcgcuggccuacuu

SEQ ID NO: 1467550 - RNA, 19 nt, Homo sapiens
gcugugauauuuccaacga

SEQ ID NO: 1467551 - RNA, 19 nt, Homo sapiens
acuaugcgcucuccaagaa

SEQ ID NO: 1467552 - RNA, 19 nt, Homo sapiens
caaagcggccuuauuuauc

SEQ ID NO: 1467553 - RNA, 19 nt, Homo sapiens
aacugaagcugugauauuu

SEQ ID NO: 1467554 - RNA, 19 nt, Homo sapiens
agaaagagagugagagaga

SEQ ID NO: 1467555 - RNA, 19 nt, Homo sapiens
gaagagaguaaccaguuuc

SEQ ID NO: 1467556 - RNA, 19 nt, Homo sapiens
ugcggaagauauaaccuua

SEQ ID NO: 1467557 - RNA, 19 nt, Homo sapiens
ggacacucccuaucugguu

SEQ ID NO: 1467558 - RNA, 19 nt, Homo sapiens
aaagcggccuuauuuaucu

SEQ ID NO: 1467559 - RNA, 19 nt, Homo sapiens
gcuuugagcucuccagacu

SEQ ID NO: 1467560 - RNA, 19 nt, Homo sapiens
gcugggagaucaccaacca

SEQ ID NO: 1467561 - RNA, 19 nt, Homo sapiens
caacgacuguaggaggaaa

SEQ ID NO: 1467562 - RNA, 19 nt, Homo sapiens
ugagagagagagagaaaga

SEQ ID NO: 1467563 - RNA, 19 nt, Homo sapiens
aaacuucugucugcccaaa

SEQ ID NO: 1467564 - RNA, 19 nt, Homo sapiens
acgagaagauccucaaugg

SEQ ID NO: 1467565 - RNA, 19 nt, Homo sapiens
cgaccucauucuccuguau

SEQ ID NO: 1467566 - RNA, 19 nt, Homo sapiens
gcacgccagccaccaagaa

SEQ ID NO: 1467567 - RNA, 19 nt, Homo sapiens
ggucagcgacuccaaucuu

SEQ ID NO: 1467568 - RNA, 19 nt, Homo sapiens
uugcaagccucgagcugua

SEQ ID NO: 1467569 - RNA, 19 nt, Homo sapiens
uuuaucacgugaccuguuu

SEQ ID NO: 1467570 - RNA, 19 nt, Homo sapiens
cccgagcucuucaaguauu

SEQ ID NO: 1467571 - RNA, 19 nt, Homo sapiens
ggacacuggccucagcuau

SEQ ID NO: 1467572 - RNA, 19 nt, Homo sapiens
cucaagcgcuccaccauca

SEQ ID NO: 1467573 - RNA, 19 nt, Homo sapiens
aaugggcucuucugguauu

SEQ ID NO: 1467574 - RNA, 19 nt, Homo sapiens
gcgaucgcuuggagucauu

SEQ ID NO: 1467575 - RNA, 19 nt, Homo sapiens
gguuaugcuugaacagaug

SEQ ID NO: 1467576 - RNA, 19 nt, Homo sapiens
gaccucauucuccuguaua

SEQ ID NO: 1467577 - RNA, 19 nt, Homo sapiens
cagaucaacagcccaaaga

SEQ ID NO: 1467578 - RNA, 19 nt, Homo sapiens
agaaagagagagagagaug

SEQ ID NO: 1467579 - RNA, 19 nt, Homo sapiens
gagcgugccaggaagaugu

SEQ ID NO: 1467580 - RNA, 19 nt, Homo sapiens
agagagagaaagagaguga

SEQ ID NO: 1467581 - RNA, 19 nt, Homo sapiens
caucuuccaccgcaccaua

SEQ ID NO: 1467582 - RNA, 19 nt, Homo sapiens
ucagcuaucuguccaccau

SEQ ID NO: 1467583 - RNA, 19 nt, Homo sapiens
gcgagaaggaguucgugaa

SEQ ID NO: 1467584 - RNA, 19 nt, Homo sapiens
caaccaaccccuaaaauca

SEQ ID NO: 1467585 - RNA, 19 nt, Homo sapiens
gagagagagaugcuguuga

SEQ ID NO: 1467586 - RNA, 19 nt, Homo sapiens
uggaagagaguaaccaguu

SEQ ID NO: 1467587 - RNA, 19 nt, Homo sapiens
gauccucaaugggcucuuc

SEQ ID NO: 1467588 - RNA, 19 nt, Homo sapiens
gagguuaugcuugaacaga

SEQ ID NO: 1467589 - RNA, 19 nt, Homo sapiens
acgcaggccucgagguuau

SEQ ID NO: 1467590 - RNA, 19 nt, Homo sapiens
gacgagaagauccucaaug

SEQ ID NO: 1467591 - RNA, 19 nt, Homo sapiens
gaagcugugauauuuccaa

SEQ ID NO: 1467592 - RNA, 19 nt, Homo sapiens
gcccaaaguauuaaugcaa

SEQ ID NO: 1467593 - RNA, 19 nt, Homo sapiens
ucuccagacugugcccuua

SEQ ID NO: 1467594 - RNA, 19 nt, Homo sapiens
ucugugaguucauugacaa

SEQ ID NO: 1467595 - RNA, 19 nt, Homo sapiens
aucaacagcccaaagauuu

SEQ ID NO: 1467596 - RNA, 19 nt, Homo sapiens
gccucgagguuaugcuuga

SEQ ID NO: 1467597 - RNA, 19 nt, Homo sapiens
gcugccaggugcaagacuu

SEQ ID NO: 1467598 - RNA, 19 nt, Homo sapiens
acacuggccucagcuaucu

SEQ ID NO: 1467599 - RNA, 19 nt, Homo sapiens
ccuccaugcuugccucgaa

SEQ ID NO: 1467600 - RNA, 19 nt, Homo sapiens
agagagaugcuguugaauc

SEQ ID NO: 1467601 - RNA, 19 nt, Homo sapiens
ggacgagaagauccucaau

SEQ ID NO: 1467602 - RNA, 19 nt, Homo sapiens
gucagcgacuccaaucuuc

SEQ ID NO: 1467603 - RNA, 19 nt, Homo sapiens
uggccaggcugagagaauu

SEQ ID NO: 1467604 - RNA, 19 nt, Homo sapiens
gggcucuucugguauuucu

SEQ ID NO: 1467605 - RNA, 19 nt, Homo sapiens
agagaaagagagagagaga

SEQ ID NO: 1467606 - RNA, 19 nt, Homo sapiens
agagagagagaaagagaga

SEQ ID NO: 1467607 - RNA, 19 nt, Homo sapiens
agagagagagagaaagaga

SEQ ID NO: 1467608 - RNA, 19 nt, Homo sapiens
agagaaagagagugagaga

SEQ ID NO: 1467609 - RNA, 19 nt, Homo sapiens
ccgagcucuucaaguauuu

SEQ ID NO: 1467610 - RNA, 19 nt, Homo sapiens
gacgcaggccucgagguua

SEQ ID NO: 1467611 - RNA, 19 nt, Homo sapiens
agagagagaaagagagaga

SEQ ID NO: 1467612 - RNA, 19 nt, Homo sapiens
aaagagagugagagagaga

SEQ ID NO: 1467613 - RNA, 19 nt, Homo sapiens
ugcaaagcggccuuauuua

SEQ ID NO: 1467614 - RNA, 19 nt, Homo sapiens
uuugagcucuccagacugu

SEQ ID NO: 1467615 - RNA, 19 nt, Homo sapiens
ccaagaagggugucaaagc

SEQ ID NO: 1467616 - RNA, 19 nt, Homo sapiens
agagugagagagagaaaga

SEQ ID NO: 1467617 - RNA, 19 nt, Homo sapiens
ccagagagugagagagaga

SEQ ID NO: 1467618 - RNA, 19 nt, Homo sapiens
aguaaccaguuuccagaga

SEQ ID NO: 1467619 - RNA, 19 nt, Homo sapiens
gcaacugaagcugugauau

SEQ ID NO: 1467620 - RNA, 19 nt, Homo sapiens
gagagagagagaugcuguu

SEQ ID NO: 1467621 - RNA, 19 nt, Homo sapiens
ccacgggcuuccugcaucu

SEQ ID NO: 1467622 - RNA, 19 nt, Homo sapiens
ccacacccgcucugucuuc

SEQ ID NO: 1467623 - RNA, 19 nt, Homo sapiens
ugagagagagaaagagagu

SEQ ID NO: 1467624 - RNA, 19 nt, Homo sapiens
cgacauggcgcuggaguac

SEQ ID NO: 1467625 - RNA, 19 nt, Homo sapiens
ccaaaguauuaaugcaacu

SEQ ID NO: 1467626 - RNA, 19 nt, Homo sapiens
aaucagaaacagaucaaca

SEQ ID NO: 1467627 - RNA, 19 nt, Homo sapiens
aaguguuucuugugcuauu

SEQ ID NO: 1467628 - RNA, 19 nt, Homo sapiens
ggggagagaggaaaacaaa

SEQ ID NO: 1467629 - RNA, 19 nt, Homo sapiens
ugaaucagaaacagaucaa

SEQ ID NO: 1467630 - RNA, 19 nt, Homo sapiens
gcacagggcugcacagagu

SEQ ID NO: 1467631 - RNA, 19 nt, Homo sapiens
ccaagacggucauugaguu

SEQ ID NO: 1467632 - RNA, 19 nt, Homo sapiens
gaggaggacuuucacuuag

SEQ ID NO: 1467633 - RNA, 19 nt, Homo sapiens
cgaggaggacuuucacuua

SEQ ID NO: 1467634 - RNA, 19 nt, Homo sapiens
ucaccacgcucaacuccua

SEQ ID NO: 1467635 - RNA, 19 nt, Homo sapiens
ggaauggucgcccacauga

SEQ ID NO: 1467636 - RNA, 19 nt, Homo sapiens
gauaggagcaucagcaucu

SEQ ID NO: 1467637 - RNA, 19 nt, Homo sapiens
gggagaggauggagaagag

SEQ ID NO: 1467638 - RNA, 19 nt, Homo sapiens
gcacaagcgcaaggucuuu

SEQ ID NO: 1467639 - RNA, 19 nt, Homo sapiens
acaccaagacggucauuga

SEQ ID NO: 1467640 - RNA, 19 nt, Homo sapiens
gcacugggugugaccaaga

SEQ ID NO: 1467641 - RNA, 19 nt, Homo sapiens
ggaggacuuucacuuagac

SEQ ID NO: 1467642 - RNA, 19 nt, Homo sapiens
gugagcagcgccaugauga

SEQ ID NO: 1467643 - RNA, 19 nt, Homo sapiens
ggagcgaggaggacuuuca

SEQ ID NO: 1467644 - RNA, 19 nt, Homo sapiens
gcucaauaaaugcuuguug

SEQ ID NO: 1467645 - RNA, 19 nt, Homo sapiens
gcgaggaggacuuucacuu

SEQ ID NO: 1467646 - RNA, 19 nt, Homo sapiens
gggaauggucgcccacaug

SEQ ID NO: 1467647 - RNA, 19 nt, Homo sapiens
ucagugagcagcgccauga

SEQ ID NO: 1467648 - RNA, 19 nt, Homo sapiens
ccgaggugcuguacauucu

SEQ ID NO: 1467649 - RNA, 19 nt, Homo sapiens
aggaggacuuucacuuaga

SEQ ID NO: 1467650 - RNA, 19 nt, Homo sapiens
acccugaggccaucaagua

SEQ ID NO: 1467651 - RNA, 19 nt, Homo sapiens
ucaugugucucgagcucuu

SEQ ID NO: 1467652 - RNA, 19 nt, Homo sapiens
cugaggccaucaaguacuu

SEQ ID NO: 1467653 - RNA, 19 nt, Homo sapiens
ucuccgaggugcuguacau

SEQ ID NO: 1467654 - RNA, 19 nt, Homo sapiens
caagacggucauugaguuc

SEQ ID NO: 1467655 - RNA, 19 nt, Homo sapiens
uaaaugcuuguugaacuug

SEQ ID NO: 1467656 - RNA, 19 nt, Homo sapiens
caauaaaugcuuguugaac

SEQ ID NO: 1467657 - RNA, 19 nt, Homo sapiens
aauggucgcccacaugaug

SEQ ID NO: 1467658 - RNA, 19 nt, Homo sapiens
gaauggcuggcacccacaa

SEQ ID NO: 1467659 - RNA, 19 nt, Homo sapiens
ucgacgggcucaagcucaa

SEQ ID NO: 1467660 - RNA, 19 nt, Homo sapiens
aaaugcuuguugaacuuga

SEQ ID NO: 1467661 - RNA, 19 nt, Homo sapiens
ucauugaguuccggcacaa

SEQ ID NO: 1467662 - RNA, 19 nt, Homo sapiens
gcucuuccacuccagcaau

SEQ ID NO: 1467663 - RNA, 19 nt, Homo sapiens
gcuucagccucaugugucu

SEQ ID NO: 1467664 - RNA, 19 nt, Homo sapiens
aaacaaagcuccguccuaa

SEQ ID NO: 1467665 - RNA, 19 nt, Homo sapiens
ggaaugagccuuuggagau

SEQ ID NO: 1467666 - RNA, 19 nt, Homo sapiens
ccaaagcccugcuggacaa

SEQ ID NO: 1467667 - RNA, 19 nt, Homo sapiens
gaaugagccuuuggagaug

SEQ ID NO: 1467668 - RNA, 19 nt, Homo sapiens
guacugcuccugcuguaaa

SEQ ID NO: 1467669 - RNA, 19 nt, Homo sapiens
ucauggagcugcuguacug

SEQ ID NO: 1467670 - RNA, 19 nt, Homo sapiens
gggacaagcugcaguacag

SEQ ID NO: 1467671 - RNA, 19 nt, Homo sapiens
uaaacuggcaggacuguga

SEQ ID NO: 1467672 - RNA, 19 nt, Homo sapiens
guacaugaaacacuacuuc

SEQ ID NO: 1467673 - RNA, 19 nt, Homo sapiens
uaaacaaagcuccguccua

SEQ ID NO: 1467674 - RNA, 19 nt, Homo sapiens
caagguggaauccguguug

SEQ ID NO: 1467675 - RNA, 19 nt, Homo sapiens
agacgcugcugcugaaugu

SEQ ID NO: 1467676 - RNA, 19 nt, Homo sapiens
ggagccgacuucaguacau

SEQ ID NO: 1467677 - RNA, 19 nt, Homo sapiens
gcccagagcccucauugca

SEQ ID NO: 1467678 - RNA, 19 nt, Homo sapiens
cggcguggccauucuauga

SEQ ID NO: 1467679 - RNA, 19 nt, Homo sapiens
gagccgacuucaguacaug

SEQ ID NO: 1467680 - RNA, 19 nt, Homo sapiens
caagaucagugugccuuac

SEQ ID NO: 1467681 - RNA, 19 nt, Homo sapiens
ucaccuggcugcgcuaucu

SEQ ID NO: 1467682 - RNA, 19 nt, Homo sapiens
acaaagcuccguccuaaac

SEQ ID NO: 1467683 - RNA, 19 nt, Homo sapiens
aaugaggagugcacuguca

SEQ ID NO: 1467684 - RNA, 19 nt, Homo sapiens
cccaucaacuacaagauca

SEQ ID NO: 1467685 - RNA, 19 nt, Homo sapiens
ugccacaucuugccauagu

SEQ ID NO: 1467686 - RNA, 19 nt, Homo sapiens
ggacgaggaacaccaccau

SEQ ID NO: 1467687 - RNA, 19 nt, Homo sapiens
uuggagauguggcccuuga

SEQ ID NO: 1467688 - RNA, 19 nt, Homo sapiens
gauggugacugcggauagg

SEQ ID NO: 1467689 - RNA, 19 nt, Homo sapiens
uacaggagccgacuucagu

SEQ ID NO: 1467690 - RNA, 19 nt, Homo sapiens
aaagcuccguccuaaacug

SEQ ID NO: 1467691 - RNA, 19 nt, Homo sapiens
acaagaucagugugccuua

SEQ ID NO: 1467692 - RNA, 19 nt, Homo sapiens
ucaacuacaagaucagugu

SEQ ID NO: 1467693 - RNA, 19 nt, Homo sapiens
gaagguggauggggacaca

SEQ ID NO: 1467694 - RNA, 19 nt, Homo sapiens
ggauggugacugcggauag

SEQ ID NO: 1467695 - RNA, 19 nt, Homo sapiens
ccauguaggccgugcuuag

SEQ ID NO: 1467696 - RNA, 19 nt, Homo sapiens
ggccacccauccuggaagu

SEQ ID NO: 1467697 - RNA, 19 nt, Homo sapiens
ccacagcagggcucagcuu

SEQ ID NO: 1467698 - RNA, 19 nt, Homo sapiens
aaaggaagaccccgaaaga

SEQ ID NO: 1467699 - RNA, 19 nt, Homo sapiens
aaacacuacuuccccauca

SEQ ID NO: 1467700 - RNA, 19 nt, Homo sapiens
ggaaagaucuucaaucaua

SEQ ID NO: 1467701 - RNA, 19 nt, Homo sapiens
gagaagcccuauacaugua

SEQ ID NO: 1467702 - RNA, 19 nt, Homo sapiens
guacaaauguccugagugu

SEQ ID NO: 1467703 - RNA, 19 nt, Homo sapiens
ugagaaaccuuauaagugu

SEQ ID NO: 1467704 - RNA, 19 nt, Homo sapiens
uaguagaacucucugaaua

SEQ ID NO: 1467705 - RNA, 19 nt, Homo sapiens
gacaugaccuuuccuuguu

SEQ ID NO: 1467706 - RNA, 19 nt, Homo sapiens
gaacauucauacagaggaa

SEQ ID NO: 1467707 - RNA, 19 nt, Homo sapiens
guggaaagaucuucaauca

SEQ ID NO: 1467708 - RNA, 19 nt, Homo sapiens
guagaacucucugaauauu

SEQ ID NO: 1467709 - RNA, 19 nt, Homo sapiens
gaucauucauaccuaguuu

SEQ ID NO: 1467710 - RNA, 19 nt, Homo sapiens
gcuaagcacuuuacacaca

SEQ ID NO: 1467711 - RNA, 19 nt, Homo sapiens
gagcuuauuucccaucaga

SEQ ID NO: 1467712 - RNA, 19 nt, Homo sapiens
gaagaagauacacaacuuu

SEQ ID NO: 1467713 - RNA, 19 nt, Homo sapiens
gaaagaucuucaaucauag

SEQ ID NO: 1467714 - RNA, 19 nt, Homo sapiens
gcgcgaggccuguuauuaa

SEQ ID NO: 1467715 - RNA, 19 nt, Homo sapiens
gaaccaacacacuuucuga

SEQ ID NO: 1467716 - RNA, 19 nt, Homo sapiens
agaagaagauacacaacuu

SEQ ID NO: 1467717 - RNA, 19 nt, Homo sapiens
ggagaagcccuauacaugu

SEQ ID NO: 1467718 - RNA, 19 nt, Homo sapiens
caagugcagugccagcuuu

SEQ ID NO: 1467719 - RNA, 19 nt, Homo sapiens
ugaaggcucuugcuaaagu

SEQ ID NO: 1467720 - RNA, 19 nt, Homo sapiens
aaugaaggcucuugcuaaa

SEQ ID NO: 1467721 - RNA, 19 nt, Homo sapiens
cuacgaaucuacuaacugu

SEQ ID NO: 1467722 - RNA, 19 nt, Homo sapiens
gauuuaggcaguaucauuu

SEQ ID NO: 1467723 - RNA, 19 nt, Homo sapiens
gggacaauuucuucucauu

SEQ ID NO: 1467724 - RNA, 19 nt, Homo sapiens
ugagauuaaucagcaguua

SEQ ID NO: 1467725 - RNA, 19 nt, Homo sapiens
cagcaaagaugguacaaaa

SEQ ID NO: 1467726 - RNA, 19 nt, Homo sapiens
guacaacugugagccagaa

SEQ ID NO: 1467727 - RNA, 19 nt, Homo sapiens
ggcaguaucauuuccauuu

SEQ ID NO: 1467728 - RNA, 19 nt, Homo sapiens
cauaagcgaacucacauaa

SEQ ID NO: 1467729 - RNA, 19 nt, Homo sapiens
acacaugaauagccacgua

SEQ ID NO: 1467730 - RNA, 19 nt, Homo sapiens
gacaauuucuucucauucu

SEQ ID NO: 1467731 - RNA, 19 nt, Homo sapiens
acaaauguccugaguguga

SEQ ID NO: 1467732 - RNA, 19 nt, Homo sapiens
gaaaacaccuacgaaucua

SEQ ID NO: 1467733 - RNA, 19 nt, Homo sapiens
uaagcgaacucacauaaaa

SEQ ID NO: 1467734 - RNA, 19 nt, Homo sapiens
gcgaaaauauuaaguggaa

SEQ ID NO: 1467735 - RNA, 19 nt, Homo sapiens
uggaaacccugaagcgaaa

SEQ ID NO: 1467736 - RNA, 19 nt, Homo sapiens
gaauuugcaucucauuacu

SEQ ID NO: 1467737 - RNA, 19 nt, Homo sapiens
gugagaaaccuuauaagug

SEQ ID NO: 1467738 - RNA, 19 nt, Homo sapiens
gaaggcucuugcuaaaguu

SEQ ID NO: 1467739 - RNA, 19 nt, Homo sapiens
gaaugaacccaggauuuga

SEQ ID NO: 1467740 - RNA, 19 nt, Homo sapiens
caaaauccgugucacuaaa

SEQ ID NO: 1467741 - RNA, 19 nt, Homo sapiens
aaaugaaggcucuugcuaa

SEQ ID NO: 1467742 - RNA, 19 nt, Homo sapiens
gugaaugaacccaggauuu

SEQ ID NO: 1467743 - RNA, 19 nt, Homo sapiens
uaaaggagaagcccuauac

SEQ ID NO: 1467744 - RNA, 19 nt, Homo sapiens
cgccagcacucucaucuau

SEQ ID NO: 1467745 - RNA, 19 nt, Homo sapiens
ugacgagcuugccuuagaa

SEQ ID NO: 1467746 - RNA, 19 nt, Homo sapiens
ugaaugaacccaggauuug

SEQ ID NO: 1467747 - RNA, 19 nt, Homo sapiens
ggugagaaaccuuauaagu

SEQ ID NO: 1467748 - RNA, 19 nt, Homo sapiens
acacacaggagaauccaua

SEQ ID NO: 1467749 - RNA, 19 nt, Homo sapiens
ggacaauuucuucucauuc

SEQ ID NO: 1467750 - RNA, 19 nt, Homo sapiens
ugaggaaacauucguauca

SEQ ID NO: 1467751 - RNA, 19 nt, Homo sapiens
uugaggaucuggcugugua

SEQ ID NO: 1467752 - RNA, 19 nt, Homo sapiens
caugagagcgugggaguuu

SEQ ID NO: 1467753 - RNA, 19 nt, Homo sapiens
ggaacucccacuuacaaga

SEQ ID NO: 1467754 - RNA, 19 nt, Homo sapiens
gcaaagaugguacaaaaga

SEQ ID NO: 1467755 - RNA, 19 nt, Homo sapiens
ccagggaccaauacuguuu

SEQ ID NO: 1467756 - RNA, 19 nt, Homo sapiens
gagccaaccugaggacaca

SEQ ID NO: 1467757 - RNA, 19 nt, Homo sapiens
guaaaggagaagcccuaua

SEQ ID NO: 1467758 - RNA, 19 nt, Homo sapiens
gcaguaucauuuccauuuu

SEQ ID NO: 1467759 - RNA, 19 nt, Homo sapiens
aaacaccacguaaaguaaa

SEQ ID NO: 1467760 - RNA, 19 nt, Homo sapiens
ugacaugaccuuuccuugu

SEQ ID NO: 1467761 - RNA, 19 nt, Homo sapiens
gcaguuaagccuagagucu

SEQ ID NO: 1467762 - RNA, 19 nt, Homo sapiens
caacugugagccagaagaa

SEQ ID NO: 1467763 - RNA, 19 nt, Homo sapiens
ucagcacaaccuugauuua

SEQ ID NO: 1467764 - RNA, 19 nt, Homo sapiens
gaccuuuccuuguuucucu

SEQ ID NO: 1467765 - RNA, 19 nt, Homo sapiens
cuaagugcaugaagagcuu

SEQ ID NO: 1467766 - RNA, 19 nt, Homo sapiens
cagcgaucauucauaccua

SEQ ID NO: 1467767 - RNA, 19 nt, Homo sapiens
gcaagccugagauuaauca

SEQ ID NO: 1467768 - RNA, 19 nt, Homo sapiens
aaugagaaaccaaaucuug

SEQ ID NO: 1467769 - RNA, 19 nt, Homo sapiens
gaaucuacuaacugugaua

SEQ ID NO: 1467770 - RNA, 19 nt, Homo sapiens
uuauguggcucccaggauu

SEQ ID NO: 1467771 - RNA, 19 nt, Homo sapiens
gaacucccacuuacaagag

SEQ ID NO: 1467772 - RNA, 19 nt, Homo sapiens
uugacgagcuugccuuaga

SEQ ID NO: 1467773 - RNA, 19 nt, Homo sapiens
gcuuuggacucagaacuug

SEQ ID NO: 1467774 - RNA, 19 nt, Homo sapiens
gcaaaauccgugucacuaa

SEQ ID NO: 1467775 - RNA, 19 nt, Homo sapiens
ccagaagagccacaugcua

SEQ ID NO: 1467776 - RNA, 19 nt, Homo sapiens
ggaggaugcggcuuugaug

SEQ ID NO: 1467777 - RNA, 19 nt, Homo sapiens
uugcaucucauuacucaua

SEQ ID NO: 1467778 - RNA, 19 nt, Homo sapiens
cccuauacauguagcauau

SEQ ID NO: 1467779 - RNA, 19 nt, Homo sapiens
cuucagcgaucauucauac

SEQ ID NO: 1467780 - RNA, 19 nt, Homo sapiens
gaacccaggauuugaacuc

SEQ ID NO: 1467781 - RNA, 19 nt, Homo sapiens
caucagaacauucauacag

SEQ ID NO: 1467782 - RNA, 19 nt, Homo sapiens
gaggaaacauucguaucag

SEQ ID NO: 1467783 - RNA, 19 nt, Homo sapiens
aggagaagcccuauacaug

SEQ ID NO: 1467784 - RNA, 19 nt, Homo sapiens
ugaauagccacguaaagga

SEQ ID NO: 1467785 - RNA, 19 nt, Homo sapiens
aaacuucagcgaucauuca

SEQ ID NO: 1467786 - RNA, 19 nt, Homo sapiens
uaagcacuuuacacacauu

SEQ ID NO: 1467787 - RNA, 19 nt, Homo sapiens
acaugaccuuuccuuguuu

SEQ ID NO: 1467788 - RNA, 19 nt, Homo sapiens
gagcuucaggcaguccuua

SEQ ID NO: 1467789 - RNA, 19 nt, Homo sapiens
aauccauacuggugagaaa

SEQ ID NO: 1467790 - RNA, 19 nt, Homo sapiens
caucuaucccgacacauga

SEQ ID NO: 1467791 - RNA, 19 nt, Homo sapiens
ggaucuggcuguguauuuu

SEQ ID NO: 1467792 - RNA, 19 nt, Homo sapiens
gcuucaggcaguccuuaua

SEQ ID NO: 1467793 - RNA, 19 nt, Homo sapiens
gucaucagccuuuuaguua

SEQ ID NO: 1467794 - RNA, 19 nt, Homo sapiens
gcccagggaccaauacugu

SEQ ID NO: 1467795 - RNA, 19 nt, Homo sapiens
cccaguaccagcacacuaa

SEQ ID NO: 1467796 - RNA, 19 nt, Homo sapiens
uuaggaaccaacacacuuu

SEQ ID NO: 1467797 - RNA, 19 nt, Homo sapiens
gccagaagaagauacacaa

SEQ ID NO: 1467798 - RNA, 19 nt, Homo sapiens
cagcacaaccuugauuuag

SEQ ID NO: 1467799 - RNA, 19 nt, Homo sapiens
cgaauuugcaucucauuac

SEQ ID NO: 1467800 - RNA, 19 nt, Homo sapiens
gcccagagccuuguuauua

SEQ ID NO: 1467801 - RNA, 19 nt, Homo sapiens
cgaaucagcuuuguaaugu

SEQ ID NO: 1467802 - RNA, 19 nt, Homo sapiens
ccacagggauuucucauag

SEQ ID NO: 1467803 - RNA, 19 nt, Homo sapiens
gaaaacaacugaaugauac

SEQ ID NO: 1467804 - RNA, 19 nt, Homo sapiens
uaucagcuuugucuaagua

SEQ ID NO: 1467805 - RNA, 19 nt, Homo sapiens
caacaacuacagauacaaa

SEQ ID NO: 1467806 - RNA, 19 nt, Homo sapiens
gaagacagaaccucuaagu

SEQ ID NO: 1467807 - RNA, 19 nt, Homo sapiens
caaagaagccaagaugcua

SEQ ID NO: 1467808 - RNA, 19 nt, Homo sapiens
ccagagccuuguuauuauu

SEQ ID NO: 1467809 - RNA, 19 nt, Homo sapiens
gcaacuguauuucuugaag

SEQ ID NO: 1467810 - RNA, 19 nt, Homo sapiens
gaacaauaucuuucacaug

SEQ ID NO: 1467811 - RNA, 19 nt, Homo sapiens
guaaucagcauaaucacuu

SEQ ID NO: 1467812 - RNA, 19 nt, Homo sapiens
caacuacagauacaaagaa

SEQ ID NO: 1467813 - RNA, 19 nt, Homo sapiens
ucacuucgguucugugcaa

SEQ ID NO: 1467814 - RNA, 19 nt, Homo sapiens
ugacuuugccaucaugaua

SEQ ID NO: 1467815 - RNA, 19 nt, Homo sapiens
gaaucagcuuuguaauguu

SEQ ID NO: 1467816 - RNA, 19 nt, Homo sapiens
ccguggagcugaucgauau

SEQ ID NO: 1467817 - RNA, 19 nt, Homo sapiens
aagccaagaugcuaagcua

SEQ ID NO: 1467818 - RNA, 19 nt, Homo sapiens
ggauacuucuauuucaguu

SEQ ID NO: 1467819 - RNA, 19 nt, Homo sapiens
acaaacagaaggaaagaaa

SEQ ID NO: 1467820 - RNA, 19 nt, Homo sapiens
aagcgucucuucaauguuc

SEQ ID NO: 1467821 - RNA, 19 nt, Homo sapiens
gaucacaaacagaaggaaa

SEQ ID NO: 1467822 - RNA, 19 nt, Homo sapiens
cgauaugacuuugccauca

SEQ ID NO: 1467823 - RNA, 19 nt, Homo sapiens
cccagagccuuguuauuau

SEQ ID NO: 1467824 - RNA, 19 nt, Homo sapiens
cagaagacagaaccucuaa

SEQ ID NO: 1467825 - RNA, 19 nt, Homo sapiens
agacugaucacaaacagaa

SEQ ID NO: 1467826 - RNA, 19 nt, Homo sapiens
gccugagacugaucacaaa

SEQ ID NO: 1467827 - RNA, 19 nt, Homo sapiens
ggaaugcuuuuggcaauuu

SEQ ID NO: 1467828 - RNA, 19 nt, Homo sapiens
gcugaucgauaugacuuug

SEQ ID NO: 1467829 - RNA, 19 nt, Homo sapiens
gagcugaucgauaugacuu

SEQ ID NO: 1467830 - RNA, 19 nt, Homo sapiens
cauaaucacuucgguucug

SEQ ID NO: 1467831 - RNA, 19 nt, Homo sapiens
cagacuggauacuucuauu

SEQ ID NO: 1467832 - RNA, 19 nt, Homo sapiens
gcuaagcuaaggugacuau

SEQ ID NO: 1467833 - RNA, 19 nt, Homo sapiens
caaacuauaacuacgugaa

SEQ ID NO: 1467834 - RNA, 19 nt, Homo sapiens
gaaagaaaacaacugaaug

SEQ ID NO: 1467835 - RNA, 19 nt, Homo sapiens
agucgaaucagcuuuguaa

SEQ ID NO: 1467836 - RNA, 19 nt, Homo sapiens
aaagaagccaagaugcuaa

SEQ ID NO: 1467837 - RNA, 19 nt, Homo sapiens
auacaaagaagccaagaug

SEQ ID NO: 1467838 - RNA, 19 nt, Homo sapiens
guuccaacaacuacagaua

SEQ ID NO: 1467839 - RNA, 19 nt, Homo sapiens
ccaaucaaacuauaacuac

SEQ ID NO: 1467840 - RNA, 19 nt, Homo sapiens
gcagaacaauaucuuucac

SEQ ID NO: 1467841 - RNA, 19 nt, Homo sapiens
caaaaggugcagaacaaua

SEQ ID NO: 1467842 - RNA, 19 nt, Homo sapiens
cacaaaaggugcagaacaa

SEQ ID NO: 1467843 - RNA, 19 nt, Homo sapiens
ggaaagaaaacaacugaau

SEQ ID NO: 1467844 - RNA, 19 nt, Homo sapiens
ccagaagacagaaccucua

SEQ ID NO: 1467845 - RNA, 19 nt, Homo sapiens
gaaugauacucuggaugca

SEQ ID NO: 1467846 - RNA, 19 nt, Homo sapiens
ggccugagacugaucacaa

SEQ ID NO: 1467847 - RNA, 19 nt, Homo sapiens
gcuggucguucugaaucua

SEQ ID NO: 1467848 - RNA, 19 nt, Homo sapiens
agacuggauacuucuauuu

SEQ ID NO: 1467849 - RNA, 19 nt, Homo sapiens
ucgaaucagcuuuguaaug

SEQ ID NO: 1467850 - RNA, 19 nt, Homo sapiens
cugcaacuguauuucuuga

SEQ ID NO: 1467851 - RNA, 19 nt, Homo sapiens
gugcagaacaauaucuuuc

SEQ ID NO: 1467852 - RNA, 19 nt, Homo sapiens
uaagcuaaggugacuauag

SEQ ID NO: 1467853 - RNA, 19 nt, Homo sapiens
guggcgauacuacaacuuu

SEQ ID NO: 1467854 - RNA, 19 nt, Homo sapiens
uauagcacccuggcuguuu

SEQ ID NO: 1467855 - RNA, 19 nt, Homo sapiens
ccaagaugcuaagcuaagg

SEQ ID NO: 1467856 - RNA, 19 nt, Homo sapiens
gagccuuguuauuauucuu

SEQ ID NO: 1467857 - RNA, 19 nt, Homo sapiens
cacagggauuucucauaga

SEQ ID NO: 1467858 - RNA, 19 nt, Homo sapiens
cuauuucaguugcgagguu

SEQ ID NO: 1467859 - RNA, 19 nt, Homo sapiens
ucacaaacagaaggaaaga

SEQ ID NO: 1467860 - RNA, 19 nt, Homo sapiens
gacuggauacuucuauuuc

SEQ ID NO: 1467861 - RNA, 19 nt, Homo sapiens
uaaucagcauaaucacuuc

SEQ ID NO: 1467862 - RNA, 19 nt, Homo sapiens
cacauaacccacagggauu

SEQ ID NO: 1467863 - RNA, 19 nt, Homo sapiens
uccaacaacuacagauaca

SEQ ID NO: 1467864 - RNA, 19 nt, Homo sapiens
ucgguucugugcaagugua

SEQ ID NO: 1467865 - RNA, 19 nt, Homo sapiens
ccaggagccagaagacaga

SEQ ID NO: 1467866 - RNA, 19 nt, Homo sapiens
gcaaaauggcaauaaaauc

SEQ ID NO: 1467867 - RNA, 19 nt, Homo sapiens
gccaagaugcuaagcuaag

SEQ ID NO: 1467868 - RNA, 19 nt, Homo sapiens
gauacaaagaagccaagau

SEQ ID NO: 1467869 - RNA, 19 nt, Homo sapiens
ggauccugcaacuguauuu

SEQ ID NO: 1467870 - RNA, 19 nt, Homo sapiens
ggugcagaacaauaucuuu

SEQ ID NO: 1467871 - RNA, 19 nt, Homo sapiens
cuaaguaaucagcauaauc

SEQ ID NO: 1467872 - RNA, 19 nt, Homo sapiens
gggcuggucguucugaauc

SEQ ID NO: 1467873 - RNA, 19 nt, Homo sapiens
acaauaucuuucacaugug

SEQ ID NO: 1467874 - RNA, 19 nt, Homo sapiens
uggcgauacuacaacuuug

SEQ ID NO: 1467875 - RNA, 19 nt, Homo sapiens
acuggauacuucuauuuca

SEQ ID NO: 1467876 - RNA, 19 nt, Homo sapiens
ugucuaaguaaucagcaua

SEQ ID NO: 1467877 - RNA, 19 nt, Homo sapiens
acaacuacagauacaaaga

SEQ ID NO: 1467878 - RNA, 19 nt, Homo sapiens
ugagacugaucacaaacag

SEQ ID NO: 1467879 - RNA, 19 nt, Homo sapiens
acagggauuucucauagac

SEQ ID NO: 1467880 - RNA, 19 nt, Homo sapiens
uuagucugcugcacacauc

SEQ ID NO: 1467881 - RNA, 19 nt, Homo sapiens
gaggaaaauggcugacuuu

SEQ ID NO: 1467882 - RNA, 19 nt, Homo sapiens
augauacucuggaugcaau

SEQ ID NO: 1467883 - RNA, 19 nt, Homo sapiens
gugcaaguguaccucaacu

SEQ ID NO: 1467884 - RNA, 19 nt, Homo sapiens
guaauguuaugggacaaaa

SEQ ID NO: 1467885 - RNA, 19 nt, Homo sapiens
ucacauguggcgauacuac

SEQ ID NO: 1467886 - RNA, 19 nt, Homo sapiens
cagcuuugucuaaguaauc

SEQ ID NO: 1467887 - RNA, 19 nt, Homo sapiens
gcaguucauucacuuauua

SEQ ID NO: 1467888 - RNA, 19 nt, Homo sapiens
gaagaugcuuucagaauga

SEQ ID NO: 1467889 - RNA, 19 nt, Homo sapiens
gcucagacauguuaaagaa

SEQ ID NO: 1467890 - RNA, 19 nt, Homo sapiens
ggaagaugcuuucagaaug

SEQ ID NO: 1467891 - RNA, 19 nt, Homo sapiens
aaacacccguggauucuua

SEQ ID NO: 1467892 - RNA, 19 nt, Homo sapiens
ucacaacucucucuuccua

SEQ ID NO: 1467893 - RNA, 19 nt, Homo sapiens
caacagaggcucagacaug

SEQ ID NO: 1467894 - RNA, 19 nt, Homo sapiens
ggaagugugugcaggauuc

SEQ ID NO: 1467895 - RNA, 19 nt, Homo sapiens
gcacacauuuacuaccuau

SEQ ID NO: 1467896 - RNA, 19 nt, Homo sapiens
gcugguaacucauaaugug

SEQ ID NO: 1467897 - RNA, 19 nt, Homo sapiens
gcacauguauccuggaacu

SEQ ID NO: 1467898 - RNA, 19 nt, Homo sapiens
ccacgugccugguacauca

SEQ ID NO: 1467899 - RNA, 19 nt, Homo sapiens
ccagaacuccucuuugaaa

SEQ ID NO: 1467900 - RNA, 19 nt, Homo sapiens
gcugccaccuuucgaaauu

SEQ ID NO: 1467901 - RNA, 19 nt, Homo sapiens
gagaaacacccguggauuc

SEQ ID NO: 1467902 - RNA, 19 nt, Homo sapiens
uaacaaaccugcacauccu

SEQ ID NO: 1467903 - RNA, 19 nt, Homo sapiens
gucuaugucuuucauguuu

SEQ ID NO: 1467904 - RNA, 19 nt, Homo sapiens
caguagaucugcagagugu

SEQ ID NO: 1467905 - RNA, 19 nt, Homo sapiens
cagaggcucagacauguua

SEQ ID NO: 1467906 - RNA, 19 nt, Homo sapiens
agccagaacuccucuuuga

SEQ ID NO: 1467907 - RNA, 19 nt, Homo sapiens
cauguauccuggaacuuaa

SEQ ID NO: 1467908 - RNA, 19 nt, Homo sapiens
ucucuucaguuccauguuu

SEQ ID NO: 1467909 - RNA, 19 nt, Homo sapiens
gcccuucgcucuugcuuuc

SEQ ID NO: 1467910 - RNA, 19 nt, Homo sapiens
gcaggcagauggaaauucg

SEQ ID NO: 1467911 - RNA, 19 nt, Homo sapiens
gaacaagucccuggucucu

SEQ ID NO: 1467912 - RNA, 19 nt, Homo sapiens
ucaacuggcucuuuuauga

SEQ ID NO: 1467913 - RNA, 19 nt, Homo sapiens
augaauagcuaaugcaugu

SEQ ID NO: 1467914 - RNA, 19 nt, Homo sapiens
aggcugcagugaacuauaa

SEQ ID NO: 1467915 - RNA, 19 nt, Homo sapiens
ggauguccuuuccgccuuu

SEQ ID NO: 1467916 - RNA, 19 nt, Homo sapiens
uaacuauguuucacagcaa

SEQ ID NO: 1467917 - RNA, 19 nt, Homo sapiens
cuacuuaacagauacagaa

SEQ ID NO: 1467918 - RNA, 19 nt, Homo sapiens
gcgguucccuccucugaga

SEQ ID NO: 1467919 - RNA, 19 nt, Homo sapiens
cuugauugcuccucaugua

SEQ ID NO: 1467920 - RNA, 19 nt, Homo sapiens
guagaucugcagaguguuu

SEQ ID NO: 1467921 - RNA, 19 nt, Homo sapiens
uuacugaagugaacaaguc

SEQ ID NO: 1467922 - RNA, 19 nt, Homo sapiens
gaagugccucagagcauuu

SEQ ID NO: 1467923 - RNA, 19 nt, Homo sapiens
gcuuucagcuagucauugu

SEQ ID NO: 1467924 - RNA, 19 nt, Homo sapiens
acaagcgacuuacucaugu

SEQ ID NO: 1467925 - RNA, 19 nt, Homo sapiens
ucacaacacacuugggaaa

SEQ ID NO: 1467926 - RNA, 19 nt, Homo sapiens
cugcauacccugagaaaga

SEQ ID NO: 1467927 - RNA, 19 nt, Homo sapiens
cagaggccauccuuugaga

SEQ ID NO: 1467928 - RNA, 19 nt, Homo sapiens
acauguauccuggaacuua

SEQ ID NO: 1467929 - RNA, 19 nt, Homo sapiens
gguguccgcaacauuaaua

SEQ ID NO: 1467930 - RNA, 19 nt, Homo sapiens
cugacaacgugcuuaauug

SEQ ID NO: 1467931 - RNA, 19 nt, Homo sapiens
aauuaacagugcuacgaua

SEQ ID NO: 1467932 - RNA, 19 nt, Homo sapiens
uaacagugcuacgauaugc

SEQ ID NO: 1467933 - RNA, 19 nt, Homo sapiens
ggcaguucauucacuuauu

SEQ ID NO: 1467934 - RNA, 19 nt, Homo sapiens
gaggccauccuuugagaaa

SEQ ID NO: 1467935 - RNA, 19 nt, Homo sapiens
gcaccacuguacuccacuu

SEQ ID NO: 1467936 - RNA, 19 nt, Homo sapiens
uuacccagcugugcucaaa

SEQ ID NO: 1467937 - RNA, 19 nt, Homo sapiens
gaaauugcaugcccaaaac

SEQ ID NO: 1467938 - RNA, 19 nt, Homo sapiens
cagaaugaauagcuaaugc

SEQ ID NO: 1467939 - RNA, 19 nt, Homo sapiens
agaagugccucagagcauu

SEQ ID NO: 1467940 - RNA, 19 nt, Homo sapiens
acaacucucucuuccuaug

SEQ ID NO: 1467941 - RNA, 19 nt, Homo sapiens
ggccauccuuugagaaaca

SEQ ID NO: 1467942 - RNA, 19 nt, Homo sapiens
uccgcaacauuaauacaua

SEQ ID NO: 1467943 - RNA, 19 nt, Homo sapiens
ugugguguccgcaacauua

SEQ ID NO: 1467944 - RNA, 19 nt, Homo sapiens
guaauuaacagugcuacga

SEQ ID NO: 1467945 - RNA, 19 nt, Homo sapiens
caaaagcagugcaaacauc

SEQ ID NO: 1467946 - RNA, 19 nt, Homo sapiens
gagccucaguucugcuugu

SEQ ID NO: 1467947 - RNA, 19 nt, Homo sapiens
uuacucaugucugcuggua

SEQ ID NO: 1467948 - RNA, 19 nt, Homo sapiens
gcccaaaacuuuaugagau

SEQ ID NO: 1467949 - RNA, 19 nt, Homo sapiens
ccaccauggcacacauuua

SEQ ID NO: 1467950 - RNA, 19 nt, Homo sapiens
ccugacaacgugcuuaauu

SEQ ID NO: 1467951 - RNA, 19 nt, Homo sapiens
cucauaaugugccguuuga

SEQ ID NO: 1467952 - RNA, 19 nt, Homo sapiens
gaaaaugguguuccgugua

SEQ ID NO: 1467953 - RNA, 19 nt, Homo sapiens
gaaugaauagcuaaugcau

SEQ ID NO: 1467954 - RNA, 19 nt, Homo sapiens
gccaagcccuggaguuacu

SEQ ID NO: 1467955 - RNA, 19 nt, Homo sapiens
ugucuuucauguuugcuaa

SEQ ID NO: 1467956 - RNA, 19 nt, Homo sapiens
caugucugcugguaacuca

SEQ ID NO: 1467957 - RNA, 19 nt, Homo sapiens
ggaaacagacaaaagaguu

SEQ ID NO: 1467958 - RNA, 19 nt, Homo sapiens
gccagaggccauccuuuga

SEQ ID NO: 1467959 - RNA, 19 nt, Homo sapiens
ccauggcacacauuuacua

SEQ ID NO: 1467960 - RNA, 19 nt, Homo sapiens
ucacguccauucccucucu

SEQ ID NO: 1467961 - RNA, 19 nt, Homo sapiens
gagguuggauguccuuucc

SEQ ID NO: 1467962 - RNA, 19 nt, Homo sapiens
gaaagggcagagcguguag

SEQ ID NO: 1467963 - RNA, 19 nt, Homo sapiens
uauaauggcaccacuguac

SEQ ID NO: 1467964 - RNA, 19 nt, Homo sapiens
ggcauucucuucaguucca

SEQ ID NO: 1467965 - RNA, 19 nt, Homo sapiens
gccggcagcucuuuaaagc

SEQ ID NO: 1467966 - RNA, 19 nt, Homo sapiens
aaagaagcuuggccugagu

SEQ ID NO: 1467967 - RNA, 19 nt, Homo sapiens
caacacacuugggaaacag

SEQ ID NO: 1467968 - RNA, 19 nt, Homo sapiens
ucacuuauuaggaagaaga

SEQ ID NO: 1467969 - RNA, 19 nt, Homo sapiens
uuucauguuugcuaaccua

SEQ ID NO: 1467970 - RNA, 19 nt, Homo sapiens
ggcacacauuuacuaccua

SEQ ID NO: 1467971 - RNA, 19 nt, Homo sapiens
cacaguagaucugcagagu

SEQ ID NO: 1467972 - RNA, 19 nt, Homo sapiens
acaacacacuugggaaaca

SEQ ID NO: 1467973 - RNA, 19 nt, Homo sapiens
gauccucacaacacacuug

SEQ ID NO: 1467974 - RNA, 19 nt, Homo sapiens
guacaucacaagcacucaa

SEQ ID NO: 1467975 - RNA, 19 nt, Homo sapiens
gaaacacccguggauucuu

SEQ ID NO: 1467976 - RNA, 19 nt, Homo sapiens
gcccuggaguuacugaagu

SEQ ID NO: 1467977 - RNA, 19 nt, Homo sapiens
ccgcaacauuaauacauag

SEQ ID NO: 1467978 - RNA, 19 nt, Homo sapiens
agaaagggcagagcgugua

SEQ ID NO: 1467979 - RNA, 19 nt, Homo sapiens
gagcuuagcgccuuaaaag

SEQ ID NO: 1467980 - RNA, 19 nt, Homo sapiens
uacaagcgacuuacucaug

SEQ ID NO: 1467981 - RNA, 19 nt, Homo sapiens
gcccugacaacgugcuuaa

SEQ ID NO: 1467982 - RNA, 19 nt, Homo sapiens
guucauucacuuauuagga

SEQ ID NO: 1467983 - RNA, 19 nt, Homo sapiens
cauguuugcuaaccuaagg

SEQ ID NO: 1467984 - RNA, 19 nt, Homo sapiens
uugccaagcccuggaguua

SEQ ID NO: 1467985 - RNA, 19 nt, Homo sapiens
ugcauacccugagaaagaa

SEQ ID NO: 1467986 - RNA, 19 nt, Homo sapiens
ucacuugagcccaggaguu

SEQ ID NO: 1467987 - RNA, 19 nt, Homo sapiens
cacaguagcuggagauaua

SEQ ID NO: 1467988 - RNA, 19 nt, Homo sapiens
gaccaugccuggcuaauug

SEQ ID NO: 1467989 - RNA, 19 nt, Homo sapiens
gcaagagucgcuucacuua

SEQ ID NO: 1467990 - RNA, 19 nt, Homo sapiens
gcacaaacuaucaaacaua

SEQ ID NO: 1467991 - RNA, 19 nt, Homo sapiens
gcuuguaugucaacaguua

SEQ ID NO: 1467992 - RNA, 19 nt, Homo sapiens
gaaaggaagugggcguuug

SEQ ID NO: 1467993 - RNA, 19 nt, Homo sapiens
gcacuuuccagauauauuu

SEQ ID NO: 1467994 - RNA, 19 nt, Homo sapiens
ccaccacgcccaacuaaua

SEQ ID NO: 1467995 - RNA, 19 nt, Homo sapiens
ggccaacucuucacuguau

SEQ ID NO: 1467996 - RNA, 19 nt, Homo sapiens
ccagauauauuucaagagu

SEQ ID NO: 1467997 - RNA, 19 nt, Homo sapiens
gcucacgccuguaauccua

SEQ ID NO: 1467998 - RNA, 19 nt, Homo sapiens
gaagugggcguuugaggaa

SEQ ID NO: 1467999 - RNA, 19 nt, Homo sapiens
gaacugggccaacucuuca

SEQ ID NO: 1468000 - RNA, 19 nt, Homo sapiens
aggcaagguuuguguauuu

SEQ ID NO: 1468001 - RNA, 19 nt, Homo sapiens
cauagucuuuccagucuaa

SEQ ID NO: 1468002 - RNA, 19 nt, Homo sapiens
ccuuguagcucucugcuuu

SEQ ID NO: 1468003 - RNA, 19 nt, Homo sapiens
ggaggaggcaggaaucuga

SEQ ID NO: 1468004 - RNA, 19 nt, Homo sapiens
gaggaggguggaucacuua

SEQ ID NO: 1468005 - RNA, 19 nt, Homo sapiens
gaagaaguguccaaaacaa

SEQ ID NO: 1468006 - RNA, 19 nt, Homo sapiens
aggaaaggcugaagaagug

SEQ ID NO: 1468007 - RNA, 19 nt, Homo sapiens
ggaaugaggagaaggaaag

SEQ ID NO: 1468008 - RNA, 19 nt, Homo sapiens
aaacaaaguucugccuuag

SEQ ID NO: 1468009 - RNA, 19 nt, Homo sapiens
gcaagugcacaaacuauca

SEQ ID NO: 1468010 - RNA, 19 nt, Homo sapiens
gaggcaagguuuguguauu

SEQ ID NO: 1468011 - RNA, 19 nt, Homo sapiens
gaggguggaucacuuaagg

SEQ ID NO: 1468012 - RNA, 19 nt, Homo sapiens
ggacguggccguguacuuc

SEQ ID NO: 1468013 - RNA, 19 nt, Homo sapiens
aaaacaaaguucugccuua

SEQ ID NO: 1468014 - RNA, 19 nt, Homo sapiens
gaagaggcaagguuugugu

SEQ ID NO: 1468015 - RNA, 19 nt, Homo sapiens
gagauggaguuucgcucuu

SEQ ID NO: 1468016 - RNA, 19 nt, Homo sapiens
ggagugcaguggcgugauc

SEQ ID NO: 1468017 - RNA, 19 nt, Homo sapiens
gaaaccccaucucuacuaa

SEQ ID NO: 1468018 - RNA, 19 nt, Homo sapiens
caaugcaggugaaacaucu

SEQ ID NO: 1468019 - RNA, 19 nt, Homo sapiens
ggaacugggccaacucuuc

SEQ ID NO: 1468020 - RNA, 19 nt, Homo sapiens
ucaaagugcugggauuaca

SEQ ID NO: 1468021 - RNA, 19 nt, Homo sapiens
gaaaucaaggcauagucuu

SEQ ID NO: 1468022 - RNA, 19 nt, Homo sapiens
ccaaaguucugggauuaca

SEQ ID NO: 1468023 - RNA, 19 nt, Homo sapiens
ugccucagccuucccauua

SEQ ID NO: 1468024 - RNA, 19 nt, Homo sapiens
acaaaguucugccuuaggu

SEQ ID NO: 1468025 - RNA, 19 nt, Homo sapiens
ggcauagucuuuccagucu

SEQ ID NO: 1468026 - RNA, 19 nt, Homo sapiens
acucuucacuguaugcauu

SEQ ID NO: 1468027 - RNA, 19 nt, Homo sapiens
ggaaaggaagugggcguuu

SEQ ID NO: 1468028 - RNA, 19 nt, Homo sapiens
ucagagcccaucccuguuu

SEQ ID NO: 1468029 - RNA, 19 nt, Homo sapiens
gagaaggaaaggcugaaga

SEQ ID NO: 1468030 - RNA, 19 nt, Homo sapiens
gauauaaugccggaggauu

SEQ ID NO: 1468031 - RNA, 19 nt, Homo sapiens
ugaggaggguggaucacuu

SEQ ID NO: 1468032 - RNA, 19 nt, Homo sapiens
gcauagucuuuccagucua

SEQ ID NO: 1468033 - RNA, 19 nt, Homo sapiens
ccacgcccaacuaauauuu

SEQ ID NO: 1468034 - RNA, 19 nt, Homo sapiens
gagaggaagaggcaagguu

SEQ ID NO: 1468035 - RNA, 19 nt, Homo sapiens
cuucagauauuugcauguu

SEQ ID NO: 1468036 - RNA, 19 nt, Homo sapiens
uacauuccagugccuauua

SEQ ID NO: 1468037 - RNA, 19 nt, Homo sapiens
aaaguucugccuuagguaa

SEQ ID NO: 1468038 - RNA, 19 nt, Homo sapiens
uuccggcacuuuccagaua

SEQ ID NO: 1468039 - RNA, 19 nt, Homo sapiens
ccgaguggcuggaauugca

SEQ ID NO: 1468040 - RNA, 19 nt, Homo sapiens
ggcaagguuuguguauuug

SEQ ID NO: 1468041 - RNA, 19 nt, Homo sapiens
gguguuccuuggucuugaa

SEQ ID NO: 1468042 - RNA, 19 nt, Homo sapiens
agaaggaaaggcugaagaa

SEQ ID NO: 1468043 - RNA, 19 nt, Homo sapiens
ucacuuaaggucaggaguu

SEQ ID NO: 1468044 - RNA, 19 nt, Homo sapiens
aaaucaaggcauagucuuu

SEQ ID NO: 1468045 - RNA, 19 nt, Homo sapiens
gugcacaaacuaucaaaca

SEQ ID NO: 1468046 - RNA, 19 nt, Homo sapiens
ucucaaagugcugggauua

SEQ ID NO: 1468047 - RNA, 19 nt, Homo sapiens
gauggaguuucgcucuugu

SEQ ID NO: 1468048 - RNA, 19 nt, Homo sapiens
ugccgaggauucugccuuu

SEQ ID NO: 1468049 - RNA, 19 nt, Homo sapiens
acauuccagugccuauuaa

SEQ ID NO: 1468050 - RNA, 19 nt, Homo sapiens
agaggaagaggcaagguuu

SEQ ID NO: 1468051 - RNA, 19 nt, Homo sapiens
aaaggaagugggcguuuga

SEQ ID NO: 1468052 - RNA, 19 nt, Homo sapiens
cauuagugauugcaguguu

SEQ ID NO: 1468053 - RNA, 19 nt, Homo sapiens
gggaugggaaugaggagaa

SEQ ID NO: 1468054 - RNA, 19 nt, Homo sapiens
caggaaagcgccagcaucu

SEQ ID NO: 1468055 - RNA, 19 nt, Homo sapiens
aaaguucugggauuacauu

SEQ ID NO: 1468056 - RNA, 19 nt, Homo sapiens
caaagugcugggauuacaa

SEQ ID NO: 1468057 - RNA, 19 nt, Homo sapiens
gaaaaccauucaccuaacu

SEQ ID NO: 1468058 - RNA, 19 nt, Homo sapiens
gaggaagaggcaagguuug

SEQ ID NO: 1468059 - RNA, 19 nt, Homo sapiens
cuguaaugcuuguauguca

SEQ ID NO: 1468060 - RNA, 19 nt, Homo sapiens
cgaccaugccuggcuaauu

SEQ ID NO: 1468061 - RNA, 19 nt, Homo sapiens
gaaggaaaggcugaagaag

SEQ ID NO: 1468062 - RNA, 19 nt, Homo sapiens
caaaguucugccuuaggua

SEQ ID NO: 1468063 - RNA, 19 nt, Homo sapiens
gcaagcacacgggcgagaa

SEQ ID NO: 1468064 - RNA, 19 nt, Homo sapiens
gcgcugggauuuucaguuc

SEQ ID NO: 1468065 - RNA, 19 nt, Homo sapiens
gccuguaucucuccuacuc

SEQ ID NO: 1468066 - RNA, 19 nt, Homo sapiens
ggaagaggcaagguuugug

SEQ ID NO: 1468067 - RNA, 19 nt, Homo sapiens
ggcaugaucuuggcucacu

SEQ ID NO: 1468068 - RNA, 19 nt, Homo sapiens
agagugcaauggcaugauc

SEQ ID NO: 1468069 - RNA, 19 nt, Homo sapiens
agauggaguuucgcucuug

SEQ ID NO: 1468070 - RNA, 19 nt, Homo sapiens
caagugcacaaacuaucaa

SEQ ID NO: 1468071 - RNA, 19 nt, Homo sapiens
auuagugauugcaguguuu

SEQ ID NO: 1468072 - RNA, 19 nt, Homo sapiens
gcgccagcaucuccaccuu

SEQ ID NO: 1468073 - RNA, 19 nt, Homo sapiens
ccggcacuuuccagauaua

SEQ ID NO: 1468074 - RNA, 19 nt, Homo sapiens
uguaaugcuuguaugucaa

SEQ ID NO: 1468075 - RNA, 19 nt, Homo sapiens
uaaugccggaggauucuuu

SEQ ID NO: 1468076 - RNA, 19 nt, Homo sapiens
gggccaacucuucacugua

SEQ ID NO: 1468077 - RNA, 19 nt, Homo sapiens
uccagugccuauuaaagga

SEQ ID NO: 1468078 - RNA, 19 nt, Homo sapiens
ggaugggaaugaggagaag

SEQ ID NO: 1468079 - RNA, 19 nt, Homo sapiens
aaggaaaggcugaagaagu

SEQ ID NO: 1468080 - RNA, 19 nt, Homo sapiens
ccuguaauccuagcgguuu

SEQ ID NO: 1468081 - RNA, 19 nt, Homo sapiens
gggaaugaggagaaggaaa

SEQ ID NO: 1468082 - RNA, 19 nt, Homo sapiens
caccacgcccaacuaauau

SEQ ID NO: 1468083 - RNA, 19 nt, Homo sapiens
gaggaggcaggaaucugaa

SEQ ID NO: 1468084 - RNA, 19 nt, Homo sapiens
agucuuuccagucuaauuu

SEQ ID NO: 1468085 - RNA, 19 nt, Homo sapiens
ugaaaucaaggcauagucu

SEQ ID NO: 1468086 - RNA, 19 nt, Homo sapiens
gccagugucaggcgcguuu

SEQ ID NO: 1468087 - RNA, 19 nt, Homo sapiens
ucaaggaucccucaaguuu

SEQ ID NO: 1468088 - RNA, 19 nt, Homo sapiens
gagaggagaugucccaaac

SEQ ID NO: 1468089 - RNA, 19 nt, Homo sapiens
uagaaaggcuccugugaag

SEQ ID NO: 1468090 - RNA, 19 nt, Homo sapiens
gcacuacccagacaucuuc

SEQ ID NO: 1468091 - RNA, 19 nt, Homo sapiens
gaggagaugucccaaacag

SEQ ID NO: 1468092 - RNA, 19 nt, Homo sapiens
ggauggaacaggagaguga

SEQ ID NO: 1468093 - RNA, 19 nt, Homo sapiens
ggacguggccguguacuuc

SEQ ID NO: 1468094 - RNA, 19 nt, Homo sapiens
gaaaagugccuguaaagau

SEQ ID NO: 1468095 - RNA, 19 nt, Homo sapiens
aaaagugccuguaaagauu

SEQ ID NO: 1468096 - RNA, 19 nt, Homo sapiens
aaccagcccucaucucuug

SEQ ID NO: 1468097 - RNA, 19 nt, Homo sapiens
ggacuccggaacugaaauu

SEQ ID NO: 1468098 - RNA, 19 nt, Homo sapiens
ccucaaggaucccucaagu

SEQ ID NO: 1468099 - RNA, 19 nt, Homo sapiens
ggaagucccaagagccaaa

SEQ ID NO: 1468100 - RNA, 19 nt, Homo sapiens
ggagaggagaugucccaaa

SEQ ID NO: 1468101 - RNA, 19 nt, Homo sapiens
aaagaaaagugccuguaaa

SEQ ID NO: 1468102 - RNA, 19 nt, Homo sapiens
caaaccagcccucaucucu

SEQ ID NO: 1468103 - RNA, 19 nt, Homo sapiens
cuagaaaggcuccugugaa

SEQ ID NO: 1468104 - RNA, 19 nt, Homo sapiens
gagccaaagggccuagaaa

SEQ ID NO: 1468105 - RNA, 19 nt, Homo sapiens
aaacaggaaggaagaggaa

SEQ ID NO: 1468106 - RNA, 19 nt, Homo sapiens
ggaagaggaaccggaggaa

SEQ ID NO: 1468107 - RNA, 19 nt, Homo sapiens
gcaugcgcuucaagaggaa

SEQ ID NO: 1468108 - RNA, 19 nt, Homo sapiens
gagaugucccaaacaggaa

SEQ ID NO: 1468109 - RNA, 19 nt, Homo sapiens
cuguaaagauucgaauaga

SEQ ID NO: 1468110 - RNA, 19 nt, Homo sapiens
gaggaaguucgcaguggaa

SEQ ID NO: 1468111 - RNA, 19 nt, Homo sapiens
caaggaucccucaaguuuc

SEQ ID NO: 1468112 - RNA, 19 nt, Homo sapiens
aaaagaaaagugccuguaa

SEQ ID NO: 1468113 - RNA, 19 nt, Homo sapiens
ccuagaaaggcuccuguga

SEQ ID NO: 1468114 - RNA, 19 nt, Homo sapiens
gccaaagggccuagaaagg

SEQ ID NO: 1468115 - RNA, 19 nt, Homo sapiens
aagaggaaccggaggaagu

SEQ ID NO: 1468116 - RNA, 19 nt, Homo sapiens
ccuguaaagauucgaauag

SEQ ID NO: 1468117 - RNA, 19 nt, Homo sapiens
gccuguaaagauucgaaua

SEQ ID NO: 1468118 - RNA, 19 nt, Homo sapiens
gaguguggcaugcgcuuca

SEQ ID NO: 1468119 - RNA, 19 nt, Homo sapiens
aacccugacccagcuauua

SEQ ID NO: 1468120 - RNA, 19 nt, Homo sapiens
gaggagaacugcaccauug

SEQ ID NO: 1468121 - RNA, 19 nt, Homo sapiens
caaccucacucuccagaua

SEQ ID NO: 1468122 - RNA, 19 nt, Homo sapiens
ggaagaaccugaagaucug

SEQ ID NO: 1468123 - RNA, 19 nt, Homo sapiens
gagaacaggugugagauga

SEQ ID NO: 1468124 - RNA, 19 nt, Homo sapiens
caacagugccuuacauuga

SEQ ID NO: 1468125 - RNA, 19 nt, Homo sapiens
cagcggcucuggcuaauug

SEQ ID NO: 1468126 - RNA, 19 nt, Homo sapiens
gggaggagcggacaauaaa

SEQ ID NO: 1468127 - RNA, 19 nt, Homo sapiens
gcauguggcuggugaucga

SEQ ID NO: 1468128 - RNA, 19 nt, Homo sapiens
gcugcucacuguuucauga

SEQ ID NO: 1468129 - RNA, 19 nt, Homo sapiens
gcaggaaucaccagcuuug

SEQ ID NO: 1468130 - RNA, 19 nt, Homo sapiens
ucacugcuguggcuaccua

SEQ ID NO: 1468131 - RNA, 19 nt, Homo sapiens
cuacaacagugccuuacau

SEQ ID NO: 1468132 - RNA, 19 nt, Homo sapiens
gcugcugucuccaucuuga

SEQ ID NO: 1468133 - RNA, 19 nt, Homo sapiens
gagaaaccgcccuggaguu

SEQ ID NO: 1468134 - RNA, 19 nt, Homo sapiens
ccacagggccaccagguau

SEQ ID NO: 1468135 - RNA, 19 nt, Homo sapiens
caucagcccugcccaucug

SEQ ID NO: 1468136 - RNA, 19 nt, Homo sapiens
gcucuacaacagugccuua

SEQ ID NO: 1468137 - RNA, 19 nt, Homo sapiens
ggagcuguuugcugccauu

SEQ ID NO: 1468138 - RNA, 19 nt, Homo sapiens
ggagaacaggugugagaug

SEQ ID NO: 1468139 - RNA, 19 nt, Homo sapiens
ccauggagguggccacauc

SEQ ID NO: 1468140 - RNA, 19 nt, Homo sapiens
uggaaugacucgcguugga

SEQ ID NO: 1468141 - RNA, 19 nt, Homo sapiens
ggaggagaacugcaccauu

SEQ ID NO: 1468142 - RNA, 19 nt, Homo sapiens
aacagugccuuacauugaa

SEQ ID NO: 1468143 - RNA, 19 nt, Homo sapiens
agacugagacacagacuug

SEQ ID NO: 1468144 - RNA, 19 nt, Homo sapiens
gggaggagacugagacaca

SEQ ID NO: 1468145 - RNA, 19 nt, Homo sapiens
gcuggaggcggagcuguua

SEQ ID NO: 1468146 - RNA, 19 nt, Homo sapiens
caggagaacaggugugaga

SEQ ID NO: 1468147 - RNA, 19 nt, Homo sapiens
ccucuccgcugcucacugu

SEQ ID NO: 1468148 - RNA, 19 nt, Homo sapiens
cagaagacccagucagauc

SEQ ID NO: 1468149 - RNA, 19 nt, Homo sapiens
gacaauaaagguguaaaca

SEQ ID NO: 1468150 - RNA, 19 nt, Homo sapiens
ggacaauaaagguguaaac

SEQ ID NO: 1468151 - RNA, 19 nt, Homo sapiens
gaggccaccugucaauguc

SEQ ID NO: 1468152 - RNA, 19 nt, Homo sapiens
gcuguuugcugccauuggu

SEQ ID NO: 1468153 - RNA, 19 nt, Homo sapiens
gaggagcggacaauaaagg

SEQ ID NO: 1468154 - RNA, 19 nt, Homo sapiens
ugggaggagcggacaauaa

SEQ ID NO: 1468155 - RNA, 19 nt, Homo sapiens
gcaccugccagcugcuuuc

SEQ ID NO: 1468156 - RNA, 19 nt, Homo sapiens
cgaggccaccugucaaugu

SEQ ID NO: 1468157 - RNA, 19 nt, Homo sapiens
aggaagaaccugaagaucu

SEQ ID NO: 1468158 - RNA, 19 nt, Homo sapiens
caucuugacacaacgaauc

SEQ ID NO: 1468159 - RNA, 19 nt, Homo sapiens
gguguugggcuggaaagaa

SEQ ID NO: 1468160 - RNA, 19 nt, Homo sapiens
guguugggcuggaaagaac

SEQ ID NO: 1468161 - RNA, 19 nt, Homo sapiens
guaucccgcuuggucauca

SEQ ID NO: 1468162 - RNA, 19 nt, Homo sapiens
acaacagugccuuacauug

SEQ ID NO: 1468163 - RNA, 19 nt, Homo sapiens
gacucgcguuggagccuuu

SEQ ID NO: 1468164 - RNA, 19 nt, Homo sapiens
gaggagacugagacacaga

SEQ ID NO: 1468165 - RNA, 19 nt, Homo sapiens
cccagaagacccagucaga

SEQ ID NO: 1468166 - RNA, 19 nt, Homo sapiens
aggcaggaaucaccagcuu

SEQ ID NO: 1468167 - RNA, 19 nt, Homo sapiens
ggcaggagaacagguguga

SEQ ID NO: 1468168 - RNA, 19 nt, Homo sapiens
uacaggaaguggagcuaag

SEQ ID NO: 1468169 - RNA, 19 nt, Homo sapiens
uacaacagugccuuacauu

SEQ ID NO: 1468170 - RNA, 19 nt, Homo sapiens
aaucaccagcuuuggcuuu

SEQ ID NO: 1468171 - RNA, 19 nt, Homo sapiens
gggcgcuggugucugaaag

SEQ ID NO: 1468172 - RNA, 19 nt, Homo sapiens
ccagaagacccagucagau

SEQ ID NO: 1468173 - RNA, 19 nt, Homo sapiens
uugcagcggcucuggcuaa

SEQ ID NO: 1468174 - RNA, 19 nt, Homo sapiens
cuacaggaaguggagcuaa

SEQ ID NO: 1468175 - RNA, 19 nt, Homo sapiens
gaaggcaucuggaggauaa

SEQ ID NO: 1468176 - RNA, 19 nt, Homo sapiens
ggacacugcugaaaguaaa

SEQ ID NO: 1468177 - RNA, 19 nt, Homo sapiens
ugacggagcucuacacaga

SEQ ID NO: 1468178 - RNA, 19 nt, Homo sapiens
caccacaccuggcuaauuu

SEQ ID NO: 1468179 - RNA, 19 nt, Homo sapiens
gaaaguaaagccaccauug

SEQ ID NO: 1468180 - RNA, 19 nt, Homo sapiens
caacagagccaggacuaua

SEQ ID NO: 1468181 - RNA, 19 nt, Homo sapiens
gagcugaggccaucggaua

SEQ ID NO: 1468182 - RNA, 19 nt, Homo sapiens
ggagagagccaccgucuuc

SEQ ID NO: 1468183 - RNA, 19 nt, Homo sapiens
ggugugaacggaugaauaa

SEQ ID NO: 1468184 - RNA, 19 nt, Homo sapiens
gcaggagccucaugaccaa

SEQ ID NO: 1468185 - RNA, 19 nt, Homo sapiens
ugcugaagaugaagaauua

SEQ ID NO: 1468186 - RNA, 19 nt, Homo sapiens
gagacaggguuucaucaug

SEQ ID NO: 1468187 - RNA, 19 nt, Homo sapiens
ccaaguaccuaagagaguu

SEQ ID NO: 1468188 - RNA, 19 nt, Homo sapiens
gaucacauccugggaagaa

SEQ ID NO: 1468189 - RNA, 19 nt, Homo sapiens
gagacuguguugaauaaag

SEQ ID NO: 1468190 - RNA, 19 nt, Homo sapiens
gugaacggaugaauaaagu

SEQ ID NO: 1468191 - RNA, 19 nt, Homo sapiens
uauacauccuggcagaaua

SEQ ID NO: 1468192 - RNA, 19 nt, Homo sapiens
agacaggguuucaucaugu

SEQ ID NO: 1468193 - RNA, 19 nt, Homo sapiens
uaacugggcauccuguauu

SEQ ID NO: 1468194 - RNA, 19 nt, Homo sapiens
ggaguacaguggcgcaauc

SEQ ID NO: 1468195 - RNA, 19 nt, Homo sapiens
cgggacaucuucauggaaa

SEQ ID NO: 1468196 - RNA, 19 nt, Homo sapiens
gcuggacacugcugaaagu

SEQ ID NO: 1468197 - RNA, 19 nt, Homo sapiens
ccagucauguucuguggaa

SEQ ID NO: 1468198 - RNA, 19 nt, Homo sapiens
ccaacaugauggacuugaa

SEQ ID NO: 1468199 - RNA, 19 nt, Homo sapiens
caaugagacuguguugaau

SEQ ID NO: 1468200 - RNA, 19 nt, Homo sapiens
gacaggguuucaucauguu

SEQ ID NO: 1468201 - RNA, 19 nt, Homo sapiens
augagacuguguugaauaa

SEQ ID NO: 1468202 - RNA, 19 nt, Homo sapiens
gcgccaacaugauggacuu

SEQ ID NO: 1468203 - RNA, 19 nt, Homo sapiens
ccagagaucccuccacuac

SEQ ID NO: 1468204 - RNA, 19 nt, Homo sapiens
gagagccaccgucuuccua

SEQ ID NO: 1468205 - RNA, 19 nt, Homo sapiens
gagccaccgucuuccuaga

SEQ ID NO: 1468206 - RNA, 19 nt, Homo sapiens
gcagaaacagcaggaagga

SEQ ID NO: 1468207 - RNA, 19 nt, Homo sapiens
cuuuaguccucaucccuua

SEQ ID NO: 1468208 - RNA, 19 nt, Homo sapiens
gcugagugaucccaaguac

SEQ ID NO: 1468209 - RNA, 19 nt, Homo sapiens
guagagacaggguuucauc

SEQ ID NO: 1468210 - RNA, 19 nt, Homo sapiens
ugaauaaagggccaagguu

SEQ ID NO: 1468211 - RNA, 19 nt, Homo sapiens
aaugagacuguguugaaua

SEQ ID NO: 1468212 - RNA, 19 nt, Homo sapiens
ccaccacaccuggcuaauu

SEQ ID NO: 1468213 - RNA, 19 nt, Homo sapiens
uucaauaucagcagcauuu

SEQ ID NO: 1468214 - RNA, 19 nt, Homo sapiens
gccugaugcugaagaugaa

SEQ ID NO: 1468215 - RNA, 19 nt, Homo sapiens
ggagccugaugcugaagau

SEQ ID NO: 1468216 - RNA, 19 nt, Homo sapiens
guaacugggcauccuguau

SEQ ID NO: 1468217 - RNA, 19 nt, Homo sapiens
ggagggcacggaucacauc

SEQ ID NO: 1468218 - RNA, 19 nt, Homo sapiens
gcacuuucaaugagacugu

SEQ ID NO: 1468219 - RNA, 19 nt, Homo sapiens
ccaaagugugggauuauag

SEQ ID NO: 1468220 - RNA, 19 nt, Homo sapiens
gaacuccugaucucaagag

SEQ ID NO: 1468221 - RNA, 19 nt, Homo sapiens
gaucccaaguaccuaagag

SEQ ID NO: 1468222 - RNA, 19 nt, Homo sapiens
ucggcucacugcaaccuuu

SEQ ID NO: 1468223 - RNA, 19 nt, Homo sapiens
cuggguggcuuccuauaca

SEQ ID NO: 1468224 - RNA, 19 nt, Homo sapiens
agacuguguugaauaaagg

SEQ ID NO: 1468225 - RNA, 19 nt, Homo sapiens
cagauggaccagucauguu

SEQ ID NO: 1468226 - RNA, 19 nt, Homo sapiens
aacugggcauccuguauuu

SEQ ID NO: 1468227 - RNA, 19 nt, Homo sapiens
ggagggacccaggugugaa

SEQ ID NO: 1468228 - RNA, 19 nt, Homo sapiens
agagaucccuccacuaccu

SEQ ID NO: 1468229 - RNA, 19 nt, Homo sapiens
ccuccuggguucaagcaau

SEQ ID NO: 1468230 - RNA, 19 nt, Homo sapiens
agagugaagaggcgagaaa

SEQ ID NO: 1468231 - RNA, 19 nt, Homo sapiens
ggacuauaucaaccucuuc

SEQ ID NO: 1468232 - RNA, 19 nt, Homo sapiens
gagccaggacuauaucaac

SEQ ID NO: 1468233 - RNA, 19 nt, Homo sapiens
ggaggcugccauccagaga

SEQ ID NO: 1468234 - RNA, 19 nt, Homo sapiens
ugaaaguaaagccaccauu

SEQ ID NO: 1468235 - RNA, 19 nt, Homo sapiens
caaagugugggauuauagg

SEQ ID NO: 1468236 - RNA, 19 nt, Homo sapiens
cuccuggguucaagcaauu

SEQ ID NO: 1468237 - RNA, 19 nt, Homo sapiens
acggagcucuacacagaug

SEQ ID NO: 1468238 - RNA, 19 nt, Homo sapiens
gggcuggacacugcugaaa

SEQ ID NO: 1468239 - RNA, 19 nt, Homo sapiens
caacaugauggacuugaac

SEQ ID NO: 1468240 - RNA, 19 nt, Homo sapiens
ggaggaacagaccccuuua

SEQ ID NO: 1468241 - RNA, 19 nt, Homo sapiens
aaaguaaagccaccauugc

SEQ ID NO: 1468242 - RNA, 19 nt, Homo sapiens
gaaccugggugcagacaga

SEQ ID NO: 1468243 - RNA, 19 nt, Homo sapiens
ccaaugagcuagugguguu

SEQ ID NO: 1468244 - RNA, 19 nt, Homo sapiens
caagacaggcuuccauaaa

SEQ ID NO: 1468245 - RNA, 19 nt, Homo sapiens
gaucagggcuacagauguc

SEQ ID NO: 1468246 - RNA, 19 nt, Homo sapiens
ugaaagcucuggugaaguc

SEQ ID NO: 1468247 - RNA, 19 nt, Homo sapiens
cggaggagcuggcugaaga

SEQ ID NO: 1468248 - RNA, 19 nt, Homo sapiens
gcaagacaggcuuccauaa

SEQ ID NO: 1468249 - RNA, 19 nt, Homo sapiens
gagggagagugcugaagaa

SEQ ID NO: 1468250 - RNA, 19 nt, Homo sapiens
gaggcagucuaguaaugua

SEQ ID NO: 1468251 - RNA, 19 nt, Homo sapiens
ggaggaagcaacacaugaa

SEQ ID NO: 1468252 - RNA, 19 nt, Homo sapiens
gggaagagcagagaaauca

SEQ ID NO: 1468253 - RNA, 19 nt, Homo sapiens
gaaggugccugccgacacu

SEQ ID NO: 1468254 - RNA, 19 nt, Homo sapiens
gagaaaucaucaccaccuu

SEQ ID NO: 1468255 - RNA, 19 nt, Homo sapiens
ggaagccugucuuucaaca

SEQ ID NO: 1468256 - RNA, 19 nt, Homo sapiens
aaccaaaccucccugauuc

SEQ ID NO: 1468257 - RNA, 19 nt, Homo sapiens
aaaccaaaccucccugauu

SEQ ID NO: 1468258 - RNA, 19 nt, Homo sapiens
aauaaacucuguuccaagu

SEQ ID NO: 1468259 - RNA, 19 nt, Homo sapiens
agacggacauccuccagaa

SEQ ID NO: 1468260 - RNA, 19 nt, Homo sapiens
ggauuauggugcacugaga

SEQ ID NO: 1468261 - RNA, 19 nt, Homo sapiens
gaacugggaggaagcaaca

SEQ ID NO: 1468262 - RNA, 19 nt, Homo sapiens
gcagaugugccucaaggaa

SEQ ID NO: 1468263 - RNA, 19 nt, Homo sapiens
ggaagcagaugugccucaa

SEQ ID NO: 1468264 - RNA, 19 nt, Homo sapiens
ggaaaucgugcaccuggaa

SEQ ID NO: 1468265 - RNA, 19 nt, Homo sapiens
ggagagaaggaagaugaua

SEQ ID NO: 1468266 - RNA, 19 nt, Homo sapiens
gaagaggagcuguucaucu

SEQ ID NO: 1468267 - RNA, 19 nt, Homo sapiens
gaagagcagagaaaucauc

SEQ ID NO: 1468268 - RNA, 19 nt, Homo sapiens
gcucagggccuuucagaag

SEQ ID NO: 1468269 - RNA, 19 nt, Homo sapiens
gaagacaaccagggaaauc

SEQ ID NO: 1468270 - RNA, 19 nt, Homo sapiens
gaccagcagugacaaaggu

SEQ ID NO: 1468271 - RNA, 19 nt, Homo sapiens
ccucaaggcugucaaagac

SEQ ID NO: 1468272 - RNA, 19 nt, Homo sapiens
acaacaggcucauggaaca

SEQ ID NO: 1468273 - RNA, 19 nt, Homo sapiens
caggagagaaggaagauga

SEQ ID NO: 1468274 - RNA, 19 nt, Homo sapiens
ccucagcacugccucacaa

SEQ ID NO: 1468275 - RNA, 19 nt, Homo sapiens
gaacacaaggacaaaggau

SEQ ID NO: 1468276 - RNA, 19 nt, Homo sapiens
aagacaggcuuccauaaag

SEQ ID NO: 1468277 - RNA, 19 nt, Homo sapiens
ggcaagacaggcuuccaua

SEQ ID NO: 1468278 - RNA, 19 nt, Homo sapiens
ggauguguccugcuguuug

SEQ ID NO: 1468279 - RNA, 19 nt, Homo sapiens
gagagaaggaagaugauag

SEQ ID NO: 1468280 - RNA, 19 nt, Homo sapiens
agacaggcuuccauaaagu

SEQ ID NO: 1468281 - RNA, 19 nt, Homo sapiens
cggaggcagucuaguaaug

SEQ ID NO: 1468282 - RNA, 19 nt, Homo sapiens
agacagaacacaaggacaa

SEQ ID NO: 1468283 - RNA, 19 nt, Homo sapiens
ccacagcuccucugacagu

SEQ ID NO: 1468284 - RNA, 19 nt, Homo sapiens
ggaaggcggaggcagucua

SEQ ID NO: 1468285 - RNA, 19 nt, Homo sapiens
gggaggaagcaacacauga

SEQ ID NO: 1468286 - RNA, 19 nt, Homo sapiens
ggaggaggaggaagagaug

SEQ ID NO: 1468287 - RNA, 19 nt, Homo sapiens
gcuggaggcuguuuauagc

SEQ ID NO: 1468288 - RNA, 19 nt, Homo sapiens
caacuugaagcgugggauu

SEQ ID NO: 1468289 - RNA, 19 nt, Homo sapiens
cagcacugccucacaagaa

SEQ ID NO: 1468290 - RNA, 19 nt, Homo sapiens
gaaaauaaacucuguucca

SEQ ID NO: 1468291 - RNA, 19 nt, Homo sapiens
gcaagucaaaggcaagaca

SEQ ID NO: 1468292 - RNA, 19 nt, Homo sapiens
ggcggaggcagucuaguaa

SEQ ID NO: 1468293 - RNA, 19 nt, Homo sapiens
gggcucaggcagcacagua

SEQ ID NO: 1468294 - RNA, 19 nt, Homo sapiens
ggaagcaacacaugaagcu

SEQ ID NO: 1468295 - RNA, 19 nt, Homo sapiens
ccacaacaggcucauggaa

SEQ ID NO: 1468296 - RNA, 19 nt, Homo sapiens
caccaaagaggcagauuca

SEQ ID NO: 1468297 - RNA, 19 nt, Homo sapiens
cgacaggagagaaggaaga

SEQ ID NO: 1468298 - RNA, 19 nt, Homo sapiens
cugcagaauuggccacaga

SEQ ID NO: 1468299 - RNA, 19 nt, Homo sapiens
ggagcuggcugaagauccu

SEQ ID NO: 1468300 - RNA, 19 nt, Homo sapiens
gcagucuaguaauguaaag

SEQ ID NO: 1468301 - RNA, 19 nt, Homo sapiens
ggaggcagucuaguaaugu

SEQ ID NO: 1468302 - RNA, 19 nt, Homo sapiens
gaaaccaaaccucccugau

SEQ ID NO: 1468303 - RNA, 19 nt, Homo sapiens
gauguguccugcuguuugc

SEQ ID NO: 1468304 - RNA, 19 nt, Homo sapiens
agaaggaagaugauagaga

SEQ ID NO: 1468305 - RNA, 19 nt, Homo sapiens
gcaggggucucuucucauc

SEQ ID NO: 1468306 - RNA, 19 nt, Homo sapiens
ugaagacacagcuggauca

SEQ ID NO: 1468307 - RNA, 19 nt, Homo sapiens
gaaggcggaggcagucuag

SEQ ID NO: 1468308 - RNA, 19 nt, Homo sapiens
gggaagaggagcuguucau

SEQ ID NO: 1468309 - RNA, 19 nt, Homo sapiens
gggcaggggucucuucuca

SEQ ID NO: 1468310 - RNA, 19 nt, Homo sapiens
agagaaggaagaugauaga

SEQ ID NO: 1468311 - RNA, 19 nt, Homo sapiens
gauggaaaauaaacucugu

SEQ ID NO: 1468312 - RNA, 19 nt, Homo sapiens
agccacagcuccucugaca

SEQ ID NO: 1468313 - RNA, 19 nt, Homo sapiens
cauggcauccaacgauaaa

SEQ ID NO: 1468314 - RNA, 19 nt, Homo sapiens
uuugaaagcucuggugaag

SEQ ID NO: 1468315 - RNA, 19 nt, Homo sapiens
ccugagagcuccccggauu

SEQ ID NO: 1468316 - RNA, 19 nt, Homo sapiens
ggaagaggagcuguucauc

SEQ ID NO: 1468317 - RNA, 19 nt, Homo sapiens
gauuauggugcacugagaa

SEQ ID NO: 1468318 - RNA, 19 nt, Homo sapiens
gcgcaaaggcccgaaagag

SEQ ID NO: 1468319 - RNA, 19 nt, Homo sapiens
cuuggaagccugucuuuca

SEQ ID NO: 1468320 - RNA, 19 nt, Homo sapiens
gacagaacacaaggacaaa

SEQ ID NO: 1468321 - RNA, 19 nt, Homo sapiens
cucauggcauccaacgaua

SEQ ID NO: 1468322 - RNA, 19 nt, Homo sapiens
uuccauuucucccaccuuu

SEQ ID NO: 1468323 - RNA, 19 nt, Homo sapiens
caagaucagggcuacagau

SEQ ID NO: 1468324 - RNA, 19 nt, Homo sapiens
aagaagacaaccagggaaa

SEQ ID NO: 1468325 - RNA, 19 nt, Homo sapiens
gagucuggcgggacaagaa

SEQ ID NO: 1468326 - RNA, 19 nt, Homo sapiens
ggacauccuccagaaaguc

SEQ ID NO: 1468327 - RNA, 19 nt, Homo sapiens
uuggaagccugucuuucaa

SEQ ID NO: 1468328 - RNA, 19 nt, Homo sapiens
gcugaccaccgccaaguuc

SEQ ID NO: 1468329 - RNA, 19 nt, Homo sapiens
aggcggaggcagucuagua

SEQ ID NO: 1468330 - RNA, 19 nt, Homo sapiens
gcgcuggaggcuguuuaua

SEQ ID NO: 1468331 - RNA, 19 nt, Homo sapiens
ccucauggcauccaacgau

SEQ ID NO: 1468332 - RNA, 19 nt, Homo sapiens
agagggagagugcugaaga

SEQ ID NO: 1468333 - RNA, 19 nt, Homo sapiens
ggacucagacuccccuuug

SEQ ID NO: 1468334 - RNA, 19 nt, Homo sapiens
ugagaauguuuuacaguga

SEQ ID NO: 1468335 - RNA, 19 nt, Homo sapiens
gccuagcugucaagagcaa

SEQ ID NO: 1468336 - RNA, 19 nt, Homo sapiens
gaucacgaacugggaggaa

SEQ ID NO: 1468337 - RNA, 19 nt, Homo sapiens
acagcuggaucacgaacug

SEQ ID NO: 1468338 - RNA, 19 nt, Homo sapiens
cugggucgcugcagcugaa

SEQ ID NO: 1468339 - RNA, 19 nt, Homo sapiens
gaggaagcaacacaugaag

SEQ ID NO: 1468340 - RNA, 19 nt, Homo sapiens
cagcucagggccuuucaga

SEQ ID NO: 1468341 - RNA, 19 nt, Homo sapiens
gcacugccucacaagaauc

SEQ ID NO: 1468342 - RNA, 19 nt, Homo sapiens
caaaggagauagaauguga

SEQ ID NO: 1468343 - RNA, 19 nt, Homo sapiens
gcaagacgguaaccuauga

SEQ ID NO: 1468344 - RNA, 19 nt, Homo sapiens
gaacaagcauguacuccuu

SEQ ID NO: 1468345 - RNA, 19 nt, Homo sapiens
gaacuucuacuuugaauuc

SEQ ID NO: 1468346 - RNA, 19 nt, Homo sapiens
gaggagaguuggccacaaa

SEQ ID NO: 1468347 - RNA, 19 nt, Homo sapiens
cgagauacauuaugaaaca

SEQ ID NO: 1468348 - RNA, 19 nt, Homo sapiens
guaauggaguacugaauga

SEQ ID NO: 1468349 - RNA, 19 nt, Homo sapiens
ggagaacggugucuggaau

SEQ ID NO: 1468350 - RNA, 19 nt, Homo sapiens
ggagauagaaugugacgaa

SEQ ID NO: 1468351 - RNA, 19 nt, Homo sapiens
gagacgacacuaccaauaa

SEQ ID NO: 1468352 - RNA, 19 nt, Homo sapiens
caaagcugcugaaaugguu

SEQ ID NO: 1468353 - RNA, 19 nt, Homo sapiens
gagggaacuucuacuuuga

SEQ ID NO: 1468354 - RNA, 19 nt, Homo sapiens
gcacaugucugguuuuaug

SEQ ID NO: 1468355 - RNA, 19 nt, Homo sapiens
caagugaagaguuugauaa

SEQ ID NO: 1468356 - RNA, 19 nt, Homo sapiens
aaagagagaccacaaucua

SEQ ID NO: 1468357 - RNA, 19 nt, Homo sapiens
agccaaagcugcugaaaug

SEQ ID NO: 1468358 - RNA, 19 nt, Homo sapiens
agagggaacuucuacuuug

SEQ ID NO: 1468359 - RNA, 19 nt, Homo sapiens
aaagcaaucuggaaagaau

SEQ ID NO: 1468360 - RNA, 19 nt, Homo sapiens
agacgacacuaccaauaaa

SEQ ID NO: 1468361 - RNA, 19 nt, Homo sapiens
ggaggagggugucacaagu

SEQ ID NO: 1468362 - RNA, 19 nt, Homo sapiens
ugacggcuuugacauguuu

SEQ ID NO: 1468363 - RNA, 19 nt, Homo sapiens
ugaaugaaguaaccgaaga

SEQ ID NO: 1468364 - RNA, 19 nt, Homo sapiens
ccgaggagcugcugcaugu

SEQ ID NO: 1468365 - RNA, 19 nt, Homo sapiens
auagaagaauggcgagaua

SEQ ID NO: 1468366 - RNA, 19 nt, Homo sapiens
gagauagaaugugacgaaa

SEQ ID NO: 1468367 - RNA, 19 nt, Homo sapiens
ggacaugagccauucacaa

SEQ ID NO: 1468368 - RNA, 19 nt, Homo sapiens
gagcagcgcaagacgguaa

SEQ ID NO: 1468369 - RNA, 19 nt, Homo sapiens
ucaguucacuccagcaaug

SEQ ID NO: 1468370 - RNA, 19 nt, Homo sapiens
aacggugucuggaauauuu

SEQ ID NO: 1468371 - RNA, 19 nt, Homo sapiens
gacccucucuccaucauuc

SEQ ID NO: 1468372 - RNA, 19 nt, Homo sapiens
gagaacggugucuggaaua

SEQ ID NO: 1468373 - RNA, 19 nt, Homo sapiens
gugcauguguucccuagga

SEQ ID NO: 1468374 - RNA, 19 nt, Homo sapiens
ggaaugaggcagucuguac

SEQ ID NO: 1468375 - RNA, 19 nt, Homo sapiens
gaaacacacagaaaggaau

SEQ ID NO: 1468376 - RNA, 19 nt, Homo sapiens
caaucuaaauguccagcaa

SEQ ID NO: 1468377 - RNA, 19 nt, Homo sapiens
ggacaacugcagccagaga

SEQ ID NO: 1468378 - RNA, 19 nt, Homo sapiens
aaccgaagacaacuuaaua

SEQ ID NO: 1468379 - RNA, 19 nt, Homo sapiens
gaggagcugcugcauguga

SEQ ID NO: 1468380 - RNA, 19 nt, Homo sapiens
uaaauguccagcaauagaa

SEQ ID NO: 1468381 - RNA, 19 nt, Homo sapiens
gauagaaugugacgaaaag

SEQ ID NO: 1468382 - RNA, 19 nt, Homo sapiens
ugagacgacacuaccaaua

SEQ ID NO: 1468383 - RNA, 19 nt, Homo sapiens
ggacuugcuucugcacuag

SEQ ID NO: 1468384 - RNA, 19 nt, Homo sapiens
agagagaccacaaucuaaa

SEQ ID NO: 1468385 - RNA, 19 nt, Homo sapiens
gggaacuucuacuuugaau

SEQ ID NO: 1468386 - RNA, 19 nt, Homo sapiens
gaacggugucuggaauauu

SEQ ID NO: 1468387 - RNA, 19 nt, Homo sapiens
cuaaauguccagcaauaga

SEQ ID NO: 1468388 - RNA, 19 nt, Homo sapiens
gaggcagucuguaccaagu

SEQ ID NO: 1468389 - RNA, 19 nt, Homo sapiens
cagcuucagccacuucuuu

SEQ ID NO: 1468390 - RNA, 19 nt, Homo sapiens
gagagaccacaaucuaaau

SEQ ID NO: 1468391 - RNA, 19 nt, Homo sapiens
caacaacgucuuccuucga

SEQ ID NO: 1468392 - RNA, 19 nt, Homo sapiens
gaacgaugaccucaacaac

SEQ ID NO: 1468393 - RNA, 19 nt, Homo sapiens
gcgcaagacgguaaccuau

SEQ ID NO: 1468394 - RNA, 19 nt, Homo sapiens
ggagagggccaaggacaau

SEQ ID NO: 1468395 - RNA, 19 nt, Homo sapiens
gagccaaagcugcugaaau

SEQ ID NO: 1468396 - RNA, 19 nt, Homo sapiens
ggcagucuguaccaaguga

SEQ ID NO: 1468397 - RNA, 19 nt, Homo sapiens
gcacuggccacuccuacau

SEQ ID NO: 1468398 - RNA, 19 nt, Homo sapiens
ugaaguaaccgaagacaac

SEQ ID NO: 1468399 - RNA, 19 nt, Homo sapiens
ccaaggcccaggcagcuuu

SEQ ID NO: 1468400 - RNA, 19 nt, Homo sapiens
ggcgagauacauuaugaaa

SEQ ID NO: 1468401 - RNA, 19 nt, Homo sapiens
acgagagguucgaacgaua

SEQ ID NO: 1468402 - RNA, 19 nt, Homo sapiens
ugaaacacacagaaaggaa

SEQ ID NO: 1468403 - RNA, 19 nt, Homo sapiens
aagagagaccacaaucuaa

SEQ ID NO: 1468404 - RNA, 19 nt, Homo sapiens
gaagaauggcgagauacau

SEQ ID NO: 1468405 - RNA, 19 nt, Homo sapiens
gacgguaaccuaugaggau

SEQ ID NO: 1468406 - RNA, 19 nt, Homo sapiens
gacaugagccauucacaac

SEQ ID NO: 1468407 - RNA, 19 nt, Homo sapiens
acauuuggcuuaucagcau

SEQ ID NO: 1468408 - RNA, 19 nt, Homo sapiens
ccgaagacaacuuaauaga

SEQ ID NO: 1468409 - RNA, 19 nt, Homo sapiens
aguaaccgaagacaacuua

SEQ ID NO: 1468410 - RNA, 19 nt, Homo sapiens
ugugacauuuggcuuauca

SEQ ID NO: 1468411 - RNA, 19 nt, Homo sapiens
guccagcaauagaagaaug

SEQ ID NO: 1468412 - RNA, 19 nt, Homo sapiens
uaaccgaagacaacuuaau

SEQ ID NO: 1468413 - RNA, 19 nt, Homo sapiens
aagagggaacuucuacuuu

SEQ ID NO: 1468414 - RNA, 19 nt, Homo sapiens
acaagugaagaguuugaua

SEQ ID NO: 1468415 - RNA, 19 nt, Homo sapiens
acccagaggugcauguguu

SEQ ID NO: 1468416 - RNA, 19 nt, Homo sapiens
gagaccacaaucuaaaugu

SEQ ID NO: 1468417 - RNA, 19 nt, Homo sapiens
agaacggugucuggaauau

SEQ ID NO: 1468418 - RNA, 19 nt, Homo sapiens
ccugaagggugaugaucug

SEQ ID NO: 1468419 - RNA, 19 nt, Homo sapiens
aucuaaauguccagcaaua

SEQ ID NO: 1468420 - RNA, 19 nt, Homo sapiens
aaaugccaguaauggagua

SEQ ID NO: 1468421 - RNA, 19 nt, Homo sapiens
guacuccuuuugugacuuu

SEQ ID NO: 1468422 - RNA, 19 nt, Homo sapiens
caugagccauucacaacag

SEQ ID NO: 1468423 - RNA, 19 nt, Homo sapiens
gcuugcaggcuuagacuug

SEQ ID NO: 1468424 - RNA, 19 nt, Homo sapiens
acgaugaccucaacaacgu

SEQ ID NO: 1468425 - RNA, 19 nt, Homo sapiens
gggagagggccaaggacaa

SEQ ID NO: 1468426 - RNA, 19 nt, Homo sapiens
aaacacacagaaaggaaug

SEQ ID NO: 1468427 - RNA, 19 nt, Homo sapiens
ccaaagcugcugaaauggu

SEQ ID NO: 1468428 - RNA, 19 nt, Homo sapiens
gaggagggugucacaagug

SEQ ID NO: 1468429 - RNA, 19 nt, Homo sapiens
cgugacggcuuugacaugu

SEQ ID NO: 1468430 - RNA, 19 nt, Homo sapiens
guucacuccagcaauguaa

SEQ ID NO: 1468431 - RNA, 19 nt, Homo sapiens
uuucaaaggagauagaaug

SEQ ID NO: 1468432 - RNA, 19 nt, Homo sapiens
aggacuugcuucugcacua

SEQ ID NO: 1468433 - RNA, 19 nt, Homo sapiens
ggaacuucuacuuugaauu

SEQ ID NO: 1468434 - RNA, 19 nt, Homo sapiens
gcugagacgacacuaccaa

SEQ ID NO: 1468435 - RNA, 19 nt, Homo sapiens
cgaagacaacuuaauagac

SEQ ID NO: 1468436 - RNA, 19 nt, Homo sapiens
caacgucuuccuucgauac

SEQ ID NO: 1468437 - RNA, 19 nt, Homo sapiens
acaacgucuuccuucgaua

SEQ ID NO: 1468438 - RNA, 19 nt, Homo sapiens
acacuaccaauaaaccaaa

SEQ ID NO: 1468439 - RNA, 19 nt, Homo sapiens
ggaccagcuucagccacuu

SEQ ID NO: 1468440 - RNA, 19 nt, Homo sapiens
auggcgagauacauuauga

SEQ ID NO: 1468441 - RNA, 19 nt, Homo sapiens
uguaccaagugauggagaa

SEQ ID NO: 1468442 - RNA, 19 nt, Homo sapiens
gcacagcacuucaucaaag

SEQ ID NO: 1468443 - RNA, 19 nt, Homo sapiens
gacaugagguuucuuguau

SEQ ID NO: 1468444 - RNA, 19 nt, Homo sapiens
gcucucaccugcuccuuua

SEQ ID NO: 1468445 - RNA, 19 nt, Homo sapiens
gguuuaugcuuucugaaua

SEQ ID NO: 1468446 - RNA, 19 nt, Homo sapiens
ggagaguccuguccugaug

SEQ ID NO: 1468447 - RNA, 19 nt, Homo sapiens
uggcagggcuucagaaaug

SEQ ID NO: 1468448 - RNA, 19 nt, Homo sapiens
ccagguuccuuauuucauu

SEQ ID NO: 1468449 - RNA, 19 nt, Homo sapiens
caugagguuucuuguauga

SEQ ID NO: 1468450 - RNA, 19 nt, Homo sapiens
caacaaggccaccaagauc

SEQ ID NO: 1468451 - RNA, 19 nt, Homo sapiens
ggaacagcuuguaccagaa

SEQ ID NO: 1468452 - RNA, 19 nt, Homo sapiens
gcgacuaccagguuccuua

SEQ ID NO: 1468453 - RNA, 19 nt, Homo sapiens
acuaccagguuccuuauuu

SEQ ID NO: 1468454 - RNA, 19 nt, Homo sapiens
gagccgcgacuccuuguuu

SEQ ID NO: 1468455 - RNA, 19 nt, Homo sapiens
gcacggcugugaggcauca

SEQ ID NO: 1468456 - RNA, 19 nt, Homo sapiens
ugagguuucuuguaugaau

SEQ ID NO: 1468457 - RNA, 19 nt, Homo sapiens
ccaggcagcuugacuugag

SEQ ID NO: 1468458 - RNA, 19 nt, Homo sapiens
guggacugcucaacuguga

SEQ ID NO: 1468459 - RNA, 19 nt, Homo sapiens
cagaauuccucccagaaca

SEQ ID NO: 1468460 - RNA, 19 nt, Homo sapiens
acacgaagccucugauugg

SEQ ID NO: 1468461 - RNA, 19 nt, Homo sapiens
cagguuccuuauuucauuu

SEQ ID NO: 1468462 - RNA, 19 nt, Homo sapiens
gaacagcuuguaccagaag

SEQ ID NO: 1468463 - RNA, 19 nt, Homo sapiens
agacaugagguuucuugua

SEQ ID NO: 1468464 - RNA, 19 nt, Homo sapiens
aaacgcaacucugccuuca

SEQ ID NO: 1468465 - RNA, 19 nt, Homo sapiens
caagagcgcugggguuuau

SEQ ID NO: 1468466 - RNA, 19 nt, Homo sapiens
ccaacaaggccaccaagau

SEQ ID NO: 1468467 - RNA, 19 nt, Homo sapiens
ccacggcuccuccuucuuc

SEQ ID NO: 1468468 - RNA, 19 nt, Homo sapiens
cgggcuaccuguuugaaga

SEQ ID NO: 1468469 - RNA, 19 nt, Homo sapiens
gagguuucuuguaugaaug

SEQ ID NO: 1468470 - RNA, 19 nt, Homo sapiens
cuaccuguuugaagagauu

SEQ ID NO: 1468471 - RNA, 19 nt, Homo sapiens
cuaccagguuccuuauuuc

SEQ ID NO: 1468472 - RNA, 19 nt, Homo sapiens
ggacguccgaugaugaugu

SEQ ID NO: 1468473 - RNA, 19 nt, Homo sapiens
gaggacagcagccaaagag

SEQ ID NO: 1468474 - RNA, 19 nt, Homo sapiens
gcgcugggguuuaugcuuu

SEQ ID NO: 1468475 - RNA, 19 nt, Homo sapiens
gcacggacagcccaaagag

SEQ ID NO: 1468476 - RNA, 19 nt, Homo sapiens
ccagaggacagcagccaaa

SEQ ID NO: 1468477 - RNA, 19 nt, Homo sapiens
acgcaacucugccuucauc

SEQ ID NO: 1468478 - RNA, 19 nt, Homo sapiens
gaggccauuucaagucuca

SEQ ID NO: 1468479 - RNA, 19 nt, Homo sapiens
cgggugaccuggcagaaag

SEQ ID NO: 1468480 - RNA, 19 nt, Homo sapiens
ucagacaugagguuucuug

SEQ ID NO: 1468481 - RNA, 19 nt, Homo sapiens
ccaagauccugaggcacuu

SEQ ID NO: 1468482 - RNA, 19 nt, Homo sapiens
cggaagcgacuaccagguu

SEQ ID NO: 1468483 - RNA, 19 nt, Homo sapiens
ccuggagucuucagcuuca

SEQ ID NO: 1468484 - RNA, 19 nt, Homo sapiens
gcccuggagucuucagcuu

SEQ ID NO: 1468485 - RNA, 19 nt, Homo sapiens
ggguuuaugcuuucugaau

SEQ ID NO: 1468486 - RNA, 19 nt, Homo sapiens
gguggcagggcuucagaaa

SEQ ID NO: 1468487 - RNA, 19 nt, Homo sapiens
cguguggacugcucaacug

SEQ ID NO: 1468488 - RNA, 19 nt, Homo sapiens
cuucagaaaugucgaucuc

SEQ ID NO: 1468489 - RNA, 19 nt, Homo sapiens
gcgaggaggcacagcacuu

SEQ ID NO: 1468490 - RNA, 19 nt, Homo sapiens
gcacgggaacagcuuguac

SEQ ID NO: 1468491 - RNA, 19 nt, Homo sapiens
cgacuaccagguuccuuau

SEQ ID NO: 1468492 - RNA, 19 nt, Homo sapiens
gacguccgaugaugauguc

SEQ ID NO: 1468493 - RNA, 19 nt, Homo sapiens
uguccgggcuaccuguuug

SEQ ID NO: 1468494 - RNA, 19 nt, Homo sapiens
cacgaagccucugauugga

SEQ ID NO: 1468495 - RNA, 19 nt, Homo sapiens
ucucagaucccuacgugau

SEQ ID NO: 1468496 - RNA, 19 nt, Homo sapiens
cuacaccggcucccgauuc

SEQ ID NO: 1468497 - RNA, 19 nt, Homo sapiens
acaugagguuucuuguaug

SEQ ID NO: 1468498 - RNA, 19 nt, Homo sapiens
ucaaggugcugaagauccu

SEQ ID NO: 1468499 - RNA, 19 nt, Homo sapiens
cugaagauccugcucuauc

SEQ ID NO: 1468500 - RNA, 19 nt, Homo sapiens
ggaggcacagcacuucauc

SEQ ID NO: 1468501 - RNA, 19 nt, Homo sapiens
ggccccagcucucagaauu

SEQ ID NO: 1468502 - RNA, 19 nt, Homo sapiens
cccuagggcuaccucaguu

SEQ ID NO: 1468503 - RNA, 19 nt, Homo sapiens
gggagaguccuguccugau

SEQ ID NO: 1468504 - RNA, 19 nt, Homo sapiens
cgggaccugugaccaacaa

SEQ ID NO: 1468505 - RNA, 19 nt, Homo sapiens
cacacgaagccucugauug

SEQ ID NO: 1468506 - RNA, 19 nt, Homo sapiens
ggcacagcacuucaucaaa

SEQ ID NO: 1468507 - RNA, 19 nt, Homo sapiens
acacacgaagccucugauu

SEQ ID NO: 1468508 - RNA, 19 nt, Homo sapiens
cuacacacgaagccucuga

SEQ ID NO: 1468509 - RNA, 19 nt, Homo sapiens
aggcuguaauugcuuccua

SEQ ID NO: 1468510 - RNA, 19 nt, Homo sapiens
ggcagggcuucagaaaugu

SEQ ID NO: 1468511 - RNA, 19 nt, Homo sapiens
gcagauguauguaaguuaa

SEQ ID NO: 1468512 - RNA, 19 nt, Homo sapiens
ucaaagagguagagacaaa

SEQ ID NO: 1468513 - RNA, 19 nt, Homo sapiens
aaagauaucuguguccuaa

SEQ ID NO: 1468514 - RNA, 19 nt, Homo sapiens
aaacugaugcugacacuua

SEQ ID NO: 1468515 - RNA, 19 nt, Homo sapiens
gaaccgaccuacugcaaca

SEQ ID NO: 1468516 - RNA, 19 nt, Homo sapiens
ggaaugaugaagaugauaa

SEQ ID NO: 1468517 - RNA, 19 nt, Homo sapiens
caaggguccucauaagaaa

SEQ ID NO: 1468518 - RNA, 19 nt, Homo sapiens
ccucagaacuugugacugu

SEQ ID NO: 1468519 - RNA, 19 nt, Homo sapiens
ggacagugcagauguaugu

SEQ ID NO: 1468520 - RNA, 19 nt, Homo sapiens
cagaauugcaggagaauaa

SEQ ID NO: 1468521 - RNA, 19 nt, Homo sapiens
ccacaaggguccucauaag

SEQ ID NO: 1468522 - RNA, 19 nt, Homo sapiens
gagacaaagugaugaugga

SEQ ID NO: 1468523 - RNA, 19 nt, Homo sapiens
gcaguguguuuacagauca

SEQ ID NO: 1468524 - RNA, 19 nt, Homo sapiens
gcaggagaauaaauuugug

SEQ ID NO: 1468525 - RNA, 19 nt, Homo sapiens
ggucagagcaggaggugaa

SEQ ID NO: 1468526 - RNA, 19 nt, Homo sapiens
guuaaggacuuugagauag

SEQ ID NO: 1468527 - RNA, 19 nt, Homo sapiens
ggacauuuccuaugcaucu

SEQ ID NO: 1468528 - RNA, 19 nt, Homo sapiens
cugaggagcccacggaaua

SEQ ID NO: 1468529 - RNA, 19 nt, Homo sapiens
uuaaggacuuugagauaga

SEQ ID NO: 1468530 - RNA, 19 nt, Homo sapiens
gugcagauguauguaaguu

SEQ ID NO: 1468531 - RNA, 19 nt, Homo sapiens
cuuggaggaugaugaagua

SEQ ID NO: 1468532 - RNA, 19 nt, Homo sapiens
caaaucaccgguccaacaa

SEQ ID NO: 1468533 - RNA, 19 nt, Homo sapiens
ggagaauaaauuuguguug

SEQ ID NO: 1468534 - RNA, 19 nt, Homo sapiens
gauagagagguuauucuug

SEQ ID NO: 1468535 - RNA, 19 nt, Homo sapiens
caucaaggacaaucagaaa

SEQ ID NO: 1468536 - RNA, 19 nt, Homo sapiens
caacaugggccaccucagu

SEQ ID NO: 1468537 - RNA, 19 nt, Homo sapiens
ggucaaagagguagagaca

SEQ ID NO: 1468538 - RNA, 19 nt, Homo sapiens
acaaggguccucauaagaa

SEQ ID NO: 1468539 - RNA, 19 nt, Homo sapiens
gaaagggacagugcagaug

SEQ ID NO: 1468540 - RNA, 19 nt, Homo sapiens
ggaggaugaugaaguacca

SEQ ID NO: 1468541 - RNA, 19 nt, Homo sapiens
gaaagggaaaggaauggau

SEQ ID NO: 1468542 - RNA, 19 nt, Homo sapiens
acaaagugaugauggaagu

SEQ ID NO: 1468543 - RNA, 19 nt, Homo sapiens
gaccuugggugcugaggau

SEQ ID NO: 1468544 - RNA, 19 nt, Homo sapiens
gaaguggacguggguguga

SEQ ID NO: 1468545 - RNA, 19 nt, Homo sapiens
ucagaacuugugacuguua

SEQ ID NO: 1468546 - RNA, 19 nt, Homo sapiens
ugaugaagaugauaaugag

SEQ ID NO: 1468547 - RNA, 19 nt, Homo sapiens
gcugggagaccuacuugaa

SEQ ID NO: 1468548 - RNA, 19 nt, Homo sapiens
ucaaaucaccgguccaaca

SEQ ID NO: 1468549 - RNA, 19 nt, Homo sapiens
ugacuugagcccauugaaa

SEQ ID NO: 1468550 - RNA, 19 nt, Homo sapiens
gcucucaggcuacuccauu

SEQ ID NO: 1468551 - RNA, 19 nt, Homo sapiens
gcuacuccauugccacuca

SEQ ID NO: 1468552 - RNA, 19 nt, Homo sapiens
cagcaccagucacccaaga

SEQ ID NO: 1468553 - RNA, 19 nt, Homo sapiens
cauugaaacugaucuugag

SEQ ID NO: 1468554 - RNA, 19 nt, Homo sapiens
ccagaaagggaaaggaaug

SEQ ID NO: 1468555 - RNA, 19 nt, Homo sapiens
gaaugccgcagccuucaga

SEQ ID NO: 1468556 - RNA, 19 nt, Homo sapiens
ccagaaggucaaagaggua

SEQ ID NO: 1468557 - RNA, 19 nt, Homo sapiens
agauaucuguguccuaauc

SEQ ID NO: 1468558 - RNA, 19 nt, Homo sapiens
gaaaggcuaccacgaagcu

SEQ ID NO: 1468559 - RNA, 19 nt, Homo sapiens
gaugaaguaccagcagaaa

SEQ ID NO: 1468560 - RNA, 19 nt, Homo sapiens
ccauugaaacugaucuuga

SEQ ID NO: 1468561 - RNA, 19 nt, Homo sapiens
guccuaauccucagaacuu

SEQ ID NO: 1468562 - RNA, 19 nt, Homo sapiens
gaauugcaggagaauaaau

SEQ ID NO: 1468563 - RNA, 19 nt, Homo sapiens
aagggacagugcagaugua

SEQ ID NO: 1468564 - RNA, 19 nt, Homo sapiens
caaagauaucuguguccua

SEQ ID NO: 1468565 - RNA, 19 nt, Homo sapiens
gagguuauucuugcugauu

SEQ ID NO: 1468566 - RNA, 19 nt, Homo sapiens
ccauauugcugcugcuuuu

SEQ ID NO: 1468567 - RNA, 19 nt, Homo sapiens
aaagggaaaggaauggauu

SEQ ID NO: 1468568 - RNA, 19 nt, Homo sapiens
cacaaggguccucauaaga

SEQ ID NO: 1468569 - RNA, 19 nt, Homo sapiens
aaucaccgguccaacaaca

SEQ ID NO: 1468570 - RNA, 19 nt, Homo sapiens
ggagcuauuuggcgugacu

SEQ ID NO: 1468571 - RNA, 19 nt, Homo sapiens
caccacaaggguccucaua

SEQ ID NO: 1468572 - RNA, 19 nt, Homo sapiens
aguuaaggacuuugagaua

SEQ ID NO: 1468573 - RNA, 19 nt, Homo sapiens
gaucaggcugggagaccua

SEQ ID NO: 1468574 - RNA, 19 nt, Homo sapiens
gcuuuccucugcccagguu

SEQ ID NO: 1468575 - RNA, 19 nt, Homo sapiens
ugagauagagagguuauuc

SEQ ID NO: 1468576 - RNA, 19 nt, Homo sapiens
agagguagagacaaaguga

SEQ ID NO: 1468577 - RNA, 19 nt, Homo sapiens
gaggccagaaggucaaaga

SEQ ID NO: 1468578 - RNA, 19 nt, Homo sapiens
acuagcagcuucccaacuc

SEQ ID NO: 1468579 - RNA, 19 nt, Homo sapiens
gcaccagucacccaagaag

SEQ ID NO: 1468580 - RNA, 19 nt, Homo sapiens
gaaaacugaugcugacacu

SEQ ID NO: 1468581 - RNA, 19 nt, Homo sapiens
gacuugagcccauugaaac

SEQ ID NO: 1468582 - RNA, 19 nt, Homo sapiens
guagagacaaagugaugau

SEQ ID NO: 1468583 - RNA, 19 nt, Homo sapiens
acagugcagauguauguaa

SEQ ID NO: 1468584 - RNA, 19 nt, Homo sapiens
ucaugaaguaccauuauca

SEQ ID NO: 1468585 - RNA, 19 nt, Homo sapiens
gcccacgccuugacuugag

SEQ ID NO: 1468586 - RNA, 19 nt, Homo sapiens
gguuauucuugcugauuca

SEQ ID NO: 1468587 - RNA, 19 nt, Homo sapiens
agauagagagguuauucuu

SEQ ID NO: 1468588 - RNA, 19 nt, Homo sapiens
gagauagagagguuauucu

SEQ ID NO: 1468589 - RNA, 19 nt, Homo sapiens
ccuccucuccuacauaguu

SEQ ID NO: 1468590 - RNA, 19 nt, Homo sapiens
gaugaagaugauaaugaga

SEQ ID NO: 1468591 - RNA, 19 nt, Homo sapiens
ugaaguaccagcagaaagc

SEQ ID NO: 1468592 - RNA, 19 nt, Homo sapiens
ugauucaggugggcccaaa

SEQ ID NO: 1468593 - RNA, 19 nt, Homo sapiens
uuuauugccuaccacaugu

SEQ ID NO: 1468594 - RNA, 19 nt, Homo sapiens
gggaaugaugaagaugaua

SEQ ID NO: 1468595 - RNA, 19 nt, Homo sapiens
ccagguggaaguggaauau

SEQ ID NO: 1468596 - RNA, 19 nt, Homo sapiens
ccucaucuucaccauauug

SEQ ID NO: 1468597 - RNA, 19 nt, Homo sapiens
ggccaccacuuggacaaca

SEQ ID NO: 1468598 - RNA, 19 nt, Homo sapiens
uuacugguguggaauugag

SEQ ID NO: 1468599 - RNA, 19 nt, Homo sapiens
gguagagacaaagugauga

SEQ ID NO: 1468600 - RNA, 19 nt, Homo sapiens
cagugcagauguauguaag

SEQ ID NO: 1468601 - RNA, 19 nt, Homo sapiens
aaagggacagugcagaugu

SEQ ID NO: 1468602 - RNA, 19 nt, Homo sapiens
ugggaaugaugaagaugau

SEQ ID NO: 1468603 - RNA, 19 nt, Homo sapiens
ccaucaaggacaaucagaa

SEQ ID NO: 1468604 - RNA, 19 nt, Homo sapiens
agguggaaguggaauaugu

SEQ ID NO: 1468605 - RNA, 19 nt, Homo sapiens
cgcgaaaggcuaccacgaa

SEQ ID NO: 1468606 - RNA, 19 nt, Homo sapiens
ccagucacccaagaagaaa

SEQ ID NO: 1468607 - RNA, 19 nt, Homo sapiens
acuuugagauagagagguu

SEQ ID NO: 1468608 - RNA, 19 nt, Homo sapiens
uaaggacuuugagauagag

SEQ ID NO: 1468609 - RNA, 19 nt, Homo sapiens
uauugccuaccacauguua

SEQ ID NO: 1468610 - RNA, 19 nt, Homo sapiens
aacaugggccaccucagua

SEQ ID NO: 1468611 - RNA, 19 nt, Homo sapiens
gaagacaauuucaccauaa

SEQ ID NO: 1468612 - RNA, 19 nt, Homo sapiens
ggaagacaauuucaccaua

SEQ ID NO: 1468613 - RNA, 19 nt, Homo sapiens
cuaaagagcuacugggaua

SEQ ID NO: 1468614 - RNA, 19 nt, Homo sapiens
gcacaagaaugauacaaug

SEQ ID NO: 1468615 - RNA, 19 nt, Homo sapiens
gaagggaacuaagaaacua

SEQ ID NO: 1468616 - RNA, 19 nt, Homo sapiens
gcccaaaucugcuuucuau

SEQ ID NO: 1468617 - RNA, 19 nt, Homo sapiens
ggucaggaauggagaaauu

SEQ ID NO: 1468618 - RNA, 19 nt, Homo sapiens
gggcauggauggaugaauu

SEQ ID NO: 1468619 - RNA, 19 nt, Homo sapiens
acaaugcgguguacauaua

SEQ ID NO: 1468620 - RNA, 19 nt, Homo sapiens
gauggucccuucccucuuu

SEQ ID NO: 1468621 - RNA, 19 nt, Homo sapiens
cuaaagaccuuauccuugu

SEQ ID NO: 1468622 - RNA, 19 nt, Homo sapiens
ugaaauaacucaggaaugg

SEQ ID NO: 1468623 - RNA, 19 nt, Homo sapiens
gaauggagaaccaaauauu

SEQ ID NO: 1468624 - RNA, 19 nt, Homo sapiens
gaaccugucagauaacaaa

SEQ ID NO: 1468625 - RNA, 19 nt, Homo sapiens
uauuguacauccucacuua

SEQ ID NO: 1468626 - RNA, 19 nt, Homo sapiens
caagauaaaguguagcuaa

SEQ ID NO: 1468627 - RNA, 19 nt, Homo sapiens
guuuauagcagcacaauuu

SEQ ID NO: 1468628 - RNA, 19 nt, Homo sapiens
ccacugggaucaugaguca

SEQ ID NO: 1468629 - RNA, 19 nt, Homo sapiens
ucucagaagucacugcuaa

SEQ ID NO: 1468630 - RNA, 19 nt, Homo sapiens
caaaggcacaagaaugaua

SEQ ID NO: 1468631 - RNA, 19 nt, Homo sapiens
caagaucagugcccuaaag

SEQ ID NO: 1468632 - RNA, 19 nt, Homo sapiens
gauaaaguguagcuaacug

SEQ ID NO: 1468633 - RNA, 19 nt, Homo sapiens
uaaagaccuuauccuugua

SEQ ID NO: 1468634 - RNA, 19 nt, Homo sapiens
ggagaucauuauucuaagu

SEQ ID NO: 1468635 - RNA, 19 nt, Homo sapiens
guacauauacaccauggaa

SEQ ID NO: 1468636 - RNA, 19 nt, Homo sapiens
gaggagcacuuugggaaga

SEQ ID NO: 1468637 - RNA, 19 nt, Homo sapiens
gaauggagaaauugccuuu

SEQ ID NO: 1468638 - RNA, 19 nt, Homo sapiens
gagaacaagauaaagugua

SEQ ID NO: 1468639 - RNA, 19 nt, Homo sapiens
gaggugucauucuuugaaa

SEQ ID NO: 1468640 - RNA, 19 nt, Homo sapiens
gaaagacaacaauuaagca

SEQ ID NO: 1468641 - RNA, 19 nt, Homo sapiens
caagaaugauacaauggau

SEQ ID NO: 1468642 - RNA, 19 nt, Homo sapiens
acauauacaccauggaaua

SEQ ID NO: 1468643 - RNA, 19 nt, Homo sapiens
ucaagugucugcugauucu

SEQ ID NO: 1468644 - RNA, 19 nt, Homo sapiens
gggcuuuguucuacauuug

SEQ ID NO: 1468645 - RNA, 19 nt, Homo sapiens
caaggugugcccaaacuuu

SEQ ID NO: 1468646 - RNA, 19 nt, Homo sapiens
ggaaagacaacaauuaagc

SEQ ID NO: 1468647 - RNA, 19 nt, Homo sapiens
uacaaaggcacaagaauga

SEQ ID NO: 1468648 - RNA, 19 nt, Homo sapiens
uguacauccucacuuauaa

SEQ ID NO: 1468649 - RNA, 19 nt, Homo sapiens
cgcccgaacugacuucuuu

SEQ ID NO: 1468650 - RNA, 19 nt, Homo sapiens
uuaagcaucuaacacagaa

SEQ ID NO: 1468651 - RNA, 19 nt, Homo sapiens
caauuaagcaucuaacaca

SEQ ID NO: 1468652 - RNA, 19 nt, Homo sapiens
gaauggaaagacaacaauu

SEQ ID NO: 1468653 - RNA, 19 nt, Homo sapiens
ggaauggagaaccaaauau

SEQ ID NO: 1468654 - RNA, 19 nt, Homo sapiens
uauacaccauggaauacua

SEQ ID NO: 1468655 - RNA, 19 nt, Homo sapiens
agaacaagauaaaguguag

SEQ ID NO: 1468656 - RNA, 19 nt, Homo sapiens
gcagggagaggagcacuuu

SEQ ID NO: 1468657 - RNA, 19 nt, Homo sapiens
agacaacaauuaagcaucu

SEQ ID NO: 1468658 - RNA, 19 nt, Homo sapiens
ccgcaaaccuacucgaauc

SEQ ID NO: 1468659 - RNA, 19 nt, Homo sapiens
ggaguuggagaucauuauu

SEQ ID NO: 1468660 - RNA, 19 nt, Homo sapiens
gaaaccccaucucuacuaa

SEQ ID NO: 1468661 - RNA, 19 nt, Homo sapiens
acucaguggucacaucuuu

SEQ ID NO: 1468662 - RNA, 19 nt, Homo sapiens
ucagugcccuaaagagcua

SEQ ID NO: 1468663 - RNA, 19 nt, Homo sapiens
ggauggaguuggagaucau

SEQ ID NO: 1468664 - RNA, 19 nt, Homo sapiens
guucuuugauuacugaugu

SEQ ID NO: 1468665 - RNA, 19 nt, Homo sapiens
ggaggaacccaagcauuga

SEQ ID NO: 1468666 - RNA, 19 nt, Homo sapiens
ccaaaucugcuuucuaugg

SEQ ID NO: 1468667 - RNA, 19 nt, Homo sapiens
ugaagccacucugaaauca

SEQ ID NO: 1468668 - RNA, 19 nt, Homo sapiens
ggacaaggccagccaugag

SEQ ID NO: 1468669 - RNA, 19 nt, Homo sapiens
ugaauuggcgcugucauuu

SEQ ID NO: 1468670 - RNA, 19 nt, Homo sapiens
gaguauguaggaguaaaua

SEQ ID NO: 1468671 - RNA, 19 nt, Homo sapiens
guuauccaaucauaguuga

SEQ ID NO: 1468672 - RNA, 19 nt, Homo sapiens
ggcagcagauacaagauca

SEQ ID NO: 1468673 - RNA, 19 nt, Homo sapiens
aaaucacucugaagccaaa

SEQ ID NO: 1468674 - RNA, 19 nt, Homo sapiens
agaagucacugcuaaagac

SEQ ID NO: 1468675 - RNA, 19 nt, Homo sapiens
gcaaugaguggauaaagac

SEQ ID NO: 1468676 - RNA, 19 nt, Homo sapiens
cagccuaaaugcccaucaa

SEQ ID NO: 1468677 - RNA, 19 nt, Homo sapiens
gcagugagcccagauugca

SEQ ID NO: 1468678 - RNA, 19 nt, Homo sapiens
cccuaucccugcacacuuu

SEQ ID NO: 1468679 - RNA, 19 nt, Homo sapiens
acucgaaucuccuucaagu

SEQ ID NO: 1468680 - RNA, 19 nt, Homo sapiens
caucugaagggaacuaaga

SEQ ID NO: 1468681 - RNA, 19 nt, Homo sapiens
ggugggagcggaagacaau

SEQ ID NO: 1468682 - RNA, 19 nt, Homo sapiens
gacaaugcgguguacauau

SEQ ID NO: 1468683 - RNA, 19 nt, Homo sapiens
agacaaugcgguguacaua

SEQ ID NO: 1468684 - RNA, 19 nt, Homo sapiens
cagaguauguaggaguaaa

SEQ ID NO: 1468685 - RNA, 19 nt, Homo sapiens
ccucaagugucugcugauu

SEQ ID NO: 1468686 - RNA, 19 nt, Homo sapiens
aauccaagcucggaaguca

SEQ ID NO: 1468687 - RNA, 19 nt, Homo sapiens
gacaacaauuaagcaucua

SEQ ID NO: 1468688 - RNA, 19 nt, Homo sapiens
gaaauaacucaggaaugga

SEQ ID NO: 1468689 - RNA, 19 nt, Homo sapiens
guacacgcauguuuauagc

SEQ ID NO: 1468690 - RNA, 19 nt, Homo sapiens
uggcugcuguuguaaucua

SEQ ID NO: 1468691 - RNA, 19 nt, Homo sapiens
gacaauuucaccauaaaca

SEQ ID NO: 1468692 - RNA, 19 nt, Homo sapiens
cuucauuuguucacucuga

SEQ ID NO: 1468693 - RNA, 19 nt, Homo sapiens
auacaaaggcacaagaaug

SEQ ID NO: 1468694 - RNA, 19 nt, Homo sapiens
gauacaaaggcacaagaau

SEQ ID NO: 1468695 - RNA, 19 nt, Homo sapiens
uaaagacaaugcgguguac

SEQ ID NO: 1468696 - RNA, 19 nt, Homo sapiens
agcaaugaguggauaaaga

SEQ ID NO: 1468697 - RNA, 19 nt, Homo sapiens
uaaaugcccaucaagcaau

SEQ ID NO: 1468698 - RNA, 19 nt, Homo sapiens
aaucauaguugagaacaag

SEQ ID NO: 1468699 - RNA, 19 nt, Homo sapiens
cuauaucccuccacucagu

SEQ ID NO: 1468700 - RNA, 19 nt, Homo sapiens
gagccuuccucaagugucu

SEQ ID NO: 1468701 - RNA, 19 nt, Homo sapiens
caaacucucuucuguuccu

SEQ ID NO: 1468702 - RNA, 19 nt, Homo sapiens
uucaaacucucuucuguuc

SEQ ID NO: 1468703 - RNA, 19 nt, Homo sapiens
uuccauaucugugggcuuu

SEQ ID NO: 1468704 - RNA, 19 nt, Homo sapiens
guuguaaucuacuuguucu

SEQ ID NO: 1468705 - RNA, 19 nt, Homo sapiens
gaaggucaggaauggagaa

SEQ ID NO: 1468706 - RNA, 19 nt, Homo sapiens
acucugaaaucacucugaa

SEQ ID NO: 1468707 - RNA, 19 nt, Homo sapiens
uaaugaauaugggcaugga

SEQ ID NO: 1468708 - RNA, 19 nt, Homo sapiens
gcaccaaaaucucagaagu

SEQ ID NO: 1468709 - RNA, 19 nt, Homo sapiens
aggaauggagaaccaaaua

SEQ ID NO: 1468710 - RNA, 19 nt, Homo sapiens
gaccucagaguauguagga

SEQ ID NO: 1468711 - RNA, 19 nt, Homo sapiens
guaaauaacugucuguacu

SEQ ID NO: 1468712 - RNA, 19 nt, Homo sapiens
ggaaacaggagaaguaaau

SEQ ID NO: 1468713 - RNA, 19 nt, Homo sapiens
guagagcacugacaugugu

SEQ ID NO: 1468714 - RNA, 19 nt, Homo sapiens
guuggaagaaccuaaauua

SEQ ID NO: 1468715 - RNA, 19 nt, Homo sapiens
gccgaggccugguccuuua

SEQ ID NO: 1468716 - RNA, 19 nt, Homo sapiens
ucacucagcuguggauuug

SEQ ID NO: 1468717 - RNA, 19 nt, Homo sapiens
gauagggccugguuuacau

SEQ ID NO: 1468718 - RNA, 19 nt, Homo sapiens
gaaacaggagaaguaaaua

SEQ ID NO: 1468719 - RNA, 19 nt, Homo sapiens
gaugugagcguggcaaauu

SEQ ID NO: 1468720 - RNA, 19 nt, Homo sapiens
cgguaaaccuugcggauga

SEQ ID NO: 1468721 - RNA, 19 nt, Homo sapiens
gagcgaagccagccagaug

SEQ ID NO: 1468722 - RNA, 19 nt, Homo sapiens
agugauggcugguggauau

SEQ ID NO: 1468723 - RNA, 19 nt, Homo sapiens
gcgcuucgaauccuuguuu

SEQ ID NO: 1468724 - RNA, 19 nt, Homo sapiens
auaacugucuguacucuug

SEQ ID NO: 1468725 - RNA, 19 nt, Homo sapiens
gcugcaggcuuccuucugu

SEQ ID NO: 1468726 - RNA, 19 nt, Homo sapiens
ccacuugcccugccgguuu

SEQ ID NO: 1468727 - RNA, 19 nt, Homo sapiens
ggaguaacaagaauuugga

SEQ ID NO: 1468728 - RNA, 19 nt, Homo sapiens
uaauagggauaucauguac

SEQ ID NO: 1468729 - RNA, 19 nt, Homo sapiens
aaugauagggccugguuua

SEQ ID NO: 1468730 - RNA, 19 nt, Homo sapiens
gaggugaggccgcuucaga

SEQ ID NO: 1468731 - RNA, 19 nt, Homo sapiens
gggaauugcacucuuggaa

SEQ ID NO: 1468732 - RNA, 19 nt, Homo sapiens
gaauuuggaaacaggagaa

SEQ ID NO: 1468733 - RNA, 19 nt, Homo sapiens
uguaccaggugucccagua

SEQ ID NO: 1468734 - RNA, 19 nt, Homo sapiens
gcaccgagacuuccuugag

SEQ ID NO: 1468735 - RNA, 19 nt, Homo sapiens
gcaaauuuguccguguucu

SEQ ID NO: 1468736 - RNA, 19 nt, Homo sapiens
aaguggagcugugggaauu

SEQ ID NO: 1468737 - RNA, 19 nt, Homo sapiens
gaauccuuguuugaacuuu

SEQ ID NO: 1468738 - RNA, 19 nt, Homo sapiens
gaaagggcguugggaucca

SEQ ID NO: 1468739 - RNA, 19 nt, Homo sapiens
uggcaaauuuguccguguu

SEQ ID NO: 1468740 - RNA, 19 nt, Homo sapiens
gcacuuugugggagacuug

SEQ ID NO: 1468741 - RNA, 19 nt, Homo sapiens
cgaaugauagggccugguu

SEQ ID NO: 1468742 - RNA, 19 nt, Homo sapiens
guaacaagaauuuggaaac

SEQ ID NO: 1468743 - RNA, 19 nt, Homo sapiens
gccaccgugugaacucuuu

SEQ ID NO: 1468744 - RNA, 19 nt, Homo sapiens
ucuguuuaaugaccucuuu

SEQ ID NO: 1468745 - RNA, 19 nt, Homo sapiens
ggccugguuuacauucauu

SEQ ID NO: 1468746 - RNA, 19 nt, Homo sapiens
uccguguucuguuuaauga

SEQ ID NO: 1468747 - RNA, 19 nt, Homo sapiens
ugugaacucuuuggagguu

SEQ ID NO: 1468748 - RNA, 19 nt, Homo sapiens
ugugggaauugcacucuug

SEQ ID NO: 1468749 - RNA, 19 nt, Homo sapiens
gcugguggauaugacuuga

SEQ ID NO: 1468750 - RNA, 19 nt, Homo sapiens
cagaaccucaaaugaaaga

SEQ ID NO: 1468751 - RNA, 19 nt, Homo sapiens
gaaugauagggccugguuu

SEQ ID NO: 1468752 - RNA, 19 nt, Homo sapiens
ggccaucagaaaugucuuu

SEQ ID NO: 1468753 - RNA, 19 nt, Homo sapiens
uuuggaaacaggagaagua

SEQ ID NO: 1468754 - RNA, 19 nt, Homo sapiens
uaccaggugucccaguaga

SEQ ID NO: 1468755 - RNA, 19 nt, Homo sapiens
acuguguacucuuuaauag

SEQ ID NO: 1468756 - RNA, 19 nt, Homo sapiens
uggaggagacgaaugauag

SEQ ID NO: 1468757 - RNA, 19 nt, Homo sapiens
gaaccucaaaugaaagacu

SEQ ID NO: 1468758 - RNA, 19 nt, Homo sapiens
gaagugauggcugguggau

SEQ ID NO: 1468759 - RNA, 19 nt, Homo sapiens
gguaaaccuugcggaugau

SEQ ID NO: 1468760 - RNA, 19 nt, Homo sapiens
cgaaugcaacagggaguaa

SEQ ID NO: 1468761 - RNA, 19 nt, Homo sapiens
uaaauaacugucuguacuc

SEQ ID NO: 1468762 - RNA, 19 nt, Homo sapiens
gguaaauaacugucuguac

SEQ ID NO: 1468763 - RNA, 19 nt, Homo sapiens
auagggauaucauguacca

SEQ ID NO: 1468764 - RNA, 19 nt, Homo sapiens
gggccugguuuacauucau

SEQ ID NO: 1468765 - RNA, 19 nt, Homo sapiens
gaguaacaagaauuuggaa

SEQ ID NO: 1468766 - RNA, 19 nt, Homo sapiens
aaauaacugucuguacucu

SEQ ID NO: 1468767 - RNA, 19 nt, Homo sapiens
caaguggagcugugggaau

SEQ ID NO: 1468768 - RNA, 19 nt, Homo sapiens
gcuucagaaccucaaauga

SEQ ID NO: 1468769 - RNA, 19 nt, Homo sapiens
gguuuugcauuuuagguaa

SEQ ID NO: 1468770 - RNA, 19 nt, Homo sapiens
caaauuuguccguguucug

SEQ ID NO: 1468771 - RNA, 19 nt, Homo sapiens
ccugguuuacauucauuua

SEQ ID NO: 1468772 - RNA, 19 nt, Homo sapiens
cuucgaauccuuguuugaa

SEQ ID NO: 1468773 - RNA, 19 nt, Homo sapiens
ucaaagacaugcagaaauu

SEQ ID NO: 1468774 - RNA, 19 nt, Homo sapiens
cuaaacagcucaucacaaa

SEQ ID NO: 1468775 - RNA, 19 nt, Homo sapiens
gaaaugugcugauauugau

SEQ ID NO: 1468776 - RNA, 19 nt, Homo sapiens
gaauugaaaugugcugaua

SEQ ID NO: 1468777 - RNA, 19 nt, Homo sapiens
gcuaagugcuucacaaaug

SEQ ID NO: 1468778 - RNA, 19 nt, Homo sapiens
guacccaucucccacaaua

SEQ ID NO: 1468779 - RNA, 19 nt, Homo sapiens
ggaauccuauuguuugaaa

SEQ ID NO: 1468780 - RNA, 19 nt, Homo sapiens
gaaugaaucugaccaagca

SEQ ID NO: 1468781 - RNA, 19 nt, Homo sapiens
ggacugaugugcacuguag

SEQ ID NO: 1468782 - RNA, 19 nt, Homo sapiens
ggaaagccauucaaagaca

SEQ ID NO: 1468783 - RNA, 19 nt, Homo sapiens
ggacaaaacuggcuguauu

SEQ ID NO: 1468784 - RNA, 19 nt, Homo sapiens
ggagaccuguuuagauuug

SEQ ID NO: 1468785 - RNA, 19 nt, Homo sapiens
gaauguuugccaagaauua

SEQ ID NO: 1468786 - RNA, 19 nt, Homo sapiens
aauaacaucuucaccauug

SEQ ID NO: 1468787 - RNA, 19 nt, Homo sapiens
aaagggauuucaacaauga

SEQ ID NO: 1468788 - RNA, 19 nt, Homo sapiens
uaaaagggauagagacuua

SEQ ID NO: 1468789 - RNA, 19 nt, Homo sapiens
ggaaagguuuaaagggauu

SEQ ID NO: 1468790 - RNA, 19 nt, Homo sapiens
gaagagagcuacugauacc

SEQ ID NO: 1468791 - RNA, 19 nt, Homo sapiens
caaauaacaucuucaccau

SEQ ID NO: 1468792 - RNA, 19 nt, Homo sapiens
aaggagaccuguuuagauu

SEQ ID NO: 1468793 - RNA, 19 nt, Homo sapiens
caacugcuauuaaacaaca

SEQ ID NO: 1468794 - RNA, 19 nt, Homo sapiens
gaccaagcaugaugucuau

SEQ ID NO: 1468795 - RNA, 19 nt, Homo sapiens
gauagagacuuaccaggau

SEQ ID NO: 1468796 - RNA, 19 nt, Homo sapiens
caaagaaaauuccagcaua

SEQ ID NO: 1468797 - RNA, 19 nt, Homo sapiens
gugaagagagcuacugaua

SEQ ID NO: 1468798 - RNA, 19 nt, Homo sapiens
gacuuaagguuauaugaug

SEQ ID NO: 1468799 - RNA, 19 nt, Homo sapiens
cgaugcaacugcuauuaaa

SEQ ID NO: 1468800 - RNA, 19 nt, Homo sapiens
ucaagguucuaacagauaa

SEQ ID NO: 1468801 - RNA, 19 nt, Homo sapiens
gaacuucucagacuuuauc

SEQ ID NO: 1468802 - RNA, 19 nt, Homo sapiens
gagcuacugauaccuauaa

SEQ ID NO: 1468803 - RNA, 19 nt, Homo sapiens
ucagauagcccauauucaa

SEQ ID NO: 1468804 - RNA, 19 nt, Homo sapiens
ggauugcaauaaugaaaga

SEQ ID NO: 1468805 - RNA, 19 nt, Homo sapiens
uaaagggauuucaacaaug

SEQ ID NO: 1468806 - RNA, 19 nt, Homo sapiens
gcaaauauaaagucuaugg

SEQ ID NO: 1468807 - RNA, 19 nt, Homo sapiens
ccacauggcaguuucagaa

SEQ ID NO: 1468808 - RNA, 19 nt, Homo sapiens
gaaaagagaugcuaaaccu

SEQ ID NO: 1468809 - RNA, 19 nt, Homo sapiens
aauagaaauuccucccaua

SEQ ID NO: 1468810 - RNA, 19 nt, Homo sapiens
aaacacaggcagcaaauau

SEQ ID NO: 1468811 - RNA, 19 nt, Homo sapiens
ugaaaugugcugauauuga

SEQ ID NO: 1468812 - RNA, 19 nt, Homo sapiens
ccaagcaugaugucuauaa

SEQ ID NO: 1468813 - RNA, 19 nt, Homo sapiens
ccaauuacaacacaaagaa

SEQ ID NO: 1468814 - RNA, 19 nt, Homo sapiens
gcucaucacaaacuacuuu

SEQ ID NO: 1468815 - RNA, 19 nt, Homo sapiens
uaaacaacaugugaagaga

SEQ ID NO: 1468816 - RNA, 19 nt, Homo sapiens
caaagacaugcagaaauua

SEQ ID NO: 1468817 - RNA, 19 nt, Homo sapiens
gagaugcaauuccgguuca

SEQ ID NO: 1468818 - RNA, 19 nt, Homo sapiens
uaugaugccuaugugaaua

SEQ ID NO: 1468819 - RNA, 19 nt, Homo sapiens
ggacuuaagguuauaugau

SEQ ID NO: 1468820 - RNA, 19 nt, Homo sapiens
gcuauuaaacaacauguga

SEQ ID NO: 1468821 - RNA, 19 nt, Homo sapiens
cagagucacuggccacaug

SEQ ID NO: 1468822 - RNA, 19 nt, Homo sapiens
gagagcuacugauaccuau

SEQ ID NO: 1468823 - RNA, 19 nt, Homo sapiens
acacaggcagcaaauauaa

SEQ ID NO: 1468824 - RNA, 19 nt, Homo sapiens
gaaagccauucaaagacau

SEQ ID NO: 1468825 - RNA, 19 nt, Homo sapiens
aguaagcuauuuccaaaga

SEQ ID NO: 1468826 - RNA, 19 nt, Homo sapiens
caagaugccuacaacuucu

SEQ ID NO: 1468827 - RNA, 19 nt, Homo sapiens
cuuagaagcuggaaauuuu

SEQ ID NO: 1468828 - RNA, 19 nt, Homo sapiens
gaauuacuuucuccuaagg

SEQ ID NO: 1468829 - RNA, 19 nt, Homo sapiens
gugaacuucucagacuuua

SEQ ID NO: 1468830 - RNA, 19 nt, Homo sapiens
agcaugaugucuauaauga

SEQ ID NO: 1468831 - RNA, 19 nt, Homo sapiens
caagcaugaugucuauaau

SEQ ID NO: 1468832 - RNA, 19 nt, Homo sapiens
gaugugcacuguagcuaag

SEQ ID NO: 1468833 - RNA, 19 nt, Homo sapiens
guagguagcacggcuuaaa

SEQ ID NO: 1468834 - RNA, 19 nt, Homo sapiens
cagauccucuuccucauca

SEQ ID NO: 1468835 - RNA, 19 nt, Homo sapiens
gaucaaaugcucaagaaaa

SEQ ID NO: 1468836 - RNA, 19 nt, Homo sapiens
uaucaagguucuaacagau

SEQ ID NO: 1468837 - RNA, 19 nt, Homo sapiens
aaaacuggcuguauugauu

SEQ ID NO: 1468838 - RNA, 19 nt, Homo sapiens
guaagcuauuuccaaagaa

SEQ ID NO: 1468839 - RNA, 19 nt, Homo sapiens
ccaagaugccuacaacuuc

SEQ ID NO: 1468840 - RNA, 19 nt, Homo sapiens
cuucacaaauggcagcuuu

SEQ ID NO: 1468841 - RNA, 19 nt, Homo sapiens
aauggcagcuuuccaagau

SEQ ID NO: 1468842 - RNA, 19 nt, Homo sapiens
agaaauuccucccauaacu

SEQ ID NO: 1468843 - RNA, 19 nt, Homo sapiens
uaagcugaauccucuaaca

SEQ ID NO: 1468844 - RNA, 19 nt, Homo sapiens
ugggaaagccauucaaaga

SEQ ID NO: 1468845 - RNA, 19 nt, Homo sapiens
guucagauagcccauauuc

SEQ ID NO: 1468846 - RNA, 19 nt, Homo sapiens
gagcucaagagaugcaauu

SEQ ID NO: 1468847 - RNA, 19 nt, Homo sapiens
ccuauuguuugaaauccua

SEQ ID NO: 1468848 - RNA, 19 nt, Homo sapiens
aagguuauaugaugccuau

SEQ ID NO: 1468849 - RNA, 19 nt, Homo sapiens
caacaugugaagagagcua

SEQ ID NO: 1468850 - RNA, 19 nt, Homo sapiens
gcauuucuuugaggauuau

SEQ ID NO: 1468851 - RNA, 19 nt, Homo sapiens
cagauagcccauauucaaa

SEQ ID NO: 1468852 - RNA, 19 nt, Homo sapiens
gcaauuccgguucagauag

SEQ ID NO: 1468853 - RNA, 19 nt, Homo sapiens
ggugaacuucucagacuuu

SEQ ID NO: 1468854 - RNA, 19 nt, Homo sapiens
gagaugggaaggugaacuu

SEQ ID NO: 1468855 - RNA, 19 nt, Homo sapiens
ugaccaagcaugaugucua

SEQ ID NO: 1468856 - RNA, 19 nt, Homo sapiens
gaaauuccucccauaacuc

SEQ ID NO: 1468857 - RNA, 19 nt, Homo sapiens
gcagaaauuagagaugcua

SEQ ID NO: 1468858 - RNA, 19 nt, Homo sapiens
aaauacccaucuuuccauu

SEQ ID NO: 1468859 - RNA, 19 nt, Homo sapiens
cuucagcccuacccagaaa

SEQ ID NO: 1468860 - RNA, 19 nt, Homo sapiens
acaaauggcagcuuuccaa

SEQ ID NO: 1468861 - RNA, 19 nt, Homo sapiens
gcauggcugccuuugcuaa

SEQ ID NO: 1468862 - RNA, 19 nt, Homo sapiens
uuaccaggaucucuucaau

SEQ ID NO: 1468863 - RNA, 19 nt, Homo sapiens
uuaucaagguucuaacaga

SEQ ID NO: 1468864 - RNA, 19 nt, Homo sapiens
guuauaugaugccuaugug

SEQ ID NO: 1468865 - RNA, 19 nt, Homo sapiens
acccagaaagucuauaaua

SEQ ID NO: 1468866 - RNA, 19 nt, Homo sapiens
auagaaauuccucccauaa

SEQ ID NO: 1468867 - RNA, 19 nt, Homo sapiens
gaagagcucaagagaugca

SEQ ID NO: 1468868 - RNA, 19 nt, Homo sapiens
aaaggagaccuguuuagau

SEQ ID NO: 1468869 - RNA, 19 nt, Homo sapiens
aaacuggcuguauugauuu

SEQ ID NO: 1468870 - RNA, 19 nt, Homo sapiens
ucucagacuuuaucaaggu

SEQ ID NO: 1468871 - RNA, 19 nt, Homo sapiens
cuaagugcuucacaaaugg

SEQ ID NO: 1468872 - RNA, 19 nt, Homo sapiens
aaacagcucaucacaaacu

SEQ ID NO: 1468873 - RNA, 19 nt, Homo sapiens
caaagaagcuuggaaauag

SEQ ID NO: 1468874 - RNA, 19 nt, Homo sapiens
ugaaugccaucacauauua

SEQ ID NO: 1468875 - RNA, 19 nt, Homo sapiens
gcaaagaagcuuggaaaua

SEQ ID NO: 1468876 - RNA, 19 nt, Homo sapiens
gaacagacuugacaauucu

SEQ ID NO: 1468877 - RNA, 19 nt, Homo sapiens
ugaagaagcugcaccuuga

SEQ ID NO: 1468878 - RNA, 19 nt, Homo sapiens
gggauugucacuauuauua

SEQ ID NO: 1468879 - RNA, 19 nt, Homo sapiens
gcagaaagcaguccuaucu

SEQ ID NO: 1468880 - RNA, 19 nt, Homo sapiens
ugaacagacuugacaauuc

SEQ ID NO: 1468881 - RNA, 19 nt, Homo sapiens
ggacugagauguggacucu

SEQ ID NO: 1468882 - RNA, 19 nt, Homo sapiens
caacaucaucucccaguuu

SEQ ID NO: 1468883 - RNA, 19 nt, Homo sapiens
ccaggacuauguaaugauu

SEQ ID NO: 1468884 - RNA, 19 nt, Homo sapiens
uagcaaagcuuccauucuc

SEQ ID NO: 1468885 - RNA, 19 nt, Homo sapiens
gcauuaccuugacaacgua

SEQ ID NO: 1468886 - RNA, 19 nt, Homo sapiens
caucacauauuacaucauc

SEQ ID NO: 1468887 - RNA, 19 nt, Homo sapiens
ccagggauugucacuauua

SEQ ID NO: 1468888 - RNA, 19 nt, Homo sapiens
gaaagcaguccuaucuuca

SEQ ID NO: 1468889 - RNA, 19 nt, Homo sapiens
agaaagcaguccuaucuuc

SEQ ID NO: 1468890 - RNA, 19 nt, Homo sapiens
ggucagagacuguguucaa

SEQ ID NO: 1468891 - RNA, 19 nt, Homo sapiens
gaacuuuggcugauuccuu

SEQ ID NO: 1468892 - RNA, 19 nt, Homo sapiens
uaacuugcuuagacugauu

SEQ ID NO: 1468893 - RNA, 19 nt, Homo sapiens
guccagggauugucacuau

SEQ ID NO: 1468894 - RNA, 19 nt, Homo sapiens
ggacugcucuacagaagac

SEQ ID NO: 1468895 - RNA, 19 nt, Homo sapiens
aaagaagcuuggaaauaga

SEQ ID NO: 1468896 - RNA, 19 nt, Homo sapiens
gccaauuacuggucagaga

SEQ ID NO: 1468897 - RNA, 19 nt, Homo sapiens
ccacugggcauccuucuga

SEQ ID NO: 1468898 - RNA, 19 nt, Homo sapiens
gucaaugucugcggaguuu

SEQ ID NO: 1468899 - RNA, 19 nt, Homo sapiens
ggcauuaccuugacaacgu

SEQ ID NO: 1468900 - RNA, 19 nt, Homo sapiens
ucaacgguguggccaacua

SEQ ID NO: 1468901 - RNA, 19 nt, Homo sapiens
uagcaaagaagcuuggaaa

SEQ ID NO: 1468902 - RNA, 19 nt, Homo sapiens
ugaugucucuugcucaguu

SEQ ID NO: 1468903 - RNA, 19 nt, Homo sapiens
ucauuguguugguuaagua

SEQ ID NO: 1468904 - RNA, 19 nt, Homo sapiens
ggccaacuaugcccugguu

SEQ ID NO: 1468905 - RNA, 19 nt, Homo sapiens
cagaggaggcuaagaaaca

SEQ ID NO: 1468906 - RNA, 19 nt, Homo sapiens
ucuaugagguggccacugu

SEQ ID NO: 1468907 - RNA, 19 nt, Homo sapiens
cugcagagcuuaguguuca

SEQ ID NO: 1468908 - RNA, 19 nt, Homo sapiens
gcugggcgcucuuccucaa

SEQ ID NO: 1468909 - RNA, 19 nt, Homo sapiens
gggcauccuucugaccuuu

SEQ ID NO: 1468910 - RNA, 19 nt, Homo sapiens
ugugugggcuagagacgua

SEQ ID NO: 1468911 - RNA, 19 nt, Homo sapiens
ccaaugaugaguagagaug

SEQ ID NO: 1468912 - RNA, 19 nt, Homo sapiens
acaaucugcuggcaaaaua

SEQ ID NO: 1468913 - RNA, 19 nt, Homo sapiens
gcauguggcaccuugaugu

SEQ ID NO: 1468914 - RNA, 19 nt, Homo sapiens
gccaucacauauuacauca

SEQ ID NO: 1468915 - RNA, 19 nt, Homo sapiens
cuagagacguauucagagu

SEQ ID NO: 1468916 - RNA, 19 nt, Homo sapiens
gaugucucuugcucaguuu

SEQ ID NO: 1468917 - RNA, 19 nt, Homo sapiens
cagcauaguuggcauuucc

SEQ ID NO: 1468918 - RNA, 19 nt, Homo sapiens
uuuacaaucugcuggcaaa

SEQ ID NO: 1468919 - RNA, 19 nt, Homo sapiens
cagcagacuaucagugaaa

SEQ ID NO: 1468920 - RNA, 19 nt, Homo sapiens
aacaucaucucccaguuug

SEQ ID NO: 1468921 - RNA, 19 nt, Homo sapiens
gacccaggacuauguaaug

SEQ ID NO: 1468922 - RNA, 19 nt, Homo sapiens
cggaguuucuguaggaguu

SEQ ID NO: 1468923 - RNA, 19 nt, Homo sapiens
acaauucuguucuggucaa

SEQ ID NO: 1468924 - RNA, 19 nt, Homo sapiens
gcgguggccuuugucaaug

SEQ ID NO: 1468925 - RNA, 19 nt, Homo sapiens
gcuccuaccagcagacuau

SEQ ID NO: 1468926 - RNA, 19 nt, Homo sapiens
gagcagagagcagaaagca

SEQ ID NO: 1468927 - RNA, 19 nt, Homo sapiens
cugcugccuuuguugcuua

SEQ ID NO: 1468928 - RNA, 19 nt, Homo sapiens
agagacguauucagaguuc

SEQ ID NO: 1468929 - RNA, 19 nt, Homo sapiens
gaucgggagcuuccucaug

SEQ ID NO: 1468930 - RNA, 19 nt, Homo sapiens
gagcagaaagcaguccuau

SEQ ID NO: 1468931 - RNA, 19 nt, Homo sapiens
agccaggucuugccgguuu

SEQ ID NO: 1468932 - RNA, 19 nt, Homo sapiens
cugcggaguuucuguagga

SEQ ID NO: 1468933 - RNA, 19 nt, Homo sapiens
ccagaggcuuugggacuga

SEQ ID NO: 1468934 - RNA, 19 nt, Homo sapiens
caaaugggacacugcagau

SEQ ID NO: 1468935 - RNA, 19 nt, Homo sapiens
cagggauugucacuauuau

SEQ ID NO: 1468936 - RNA, 19 nt, Homo sapiens
ggcuagagacguauucaga

SEQ ID NO: 1468937 - RNA, 19 nt, Homo sapiens
ccaacaucaucucccaguu

SEQ ID NO: 1468938 - RNA, 19 nt, Homo sapiens
aaugggacacugcagauaa

SEQ ID NO: 1468939 - RNA, 19 nt, Homo sapiens
ccagcagacuaucagugaa

SEQ ID NO: 1468940 - RNA, 19 nt, Homo sapiens
caacguauucaaggucuga

SEQ ID NO: 1468941 - RNA, 19 nt, Homo sapiens
guaacuugcuuagacugau

SEQ ID NO: 1468942 - RNA, 19 nt, Homo sapiens
gccaggucuugccgguuua

SEQ ID NO: 1468943 - RNA, 19 nt, Homo sapiens
aaaaucagcuggggcauau

SEQ ID NO: 1468944 - RNA, 19 nt, Homo sapiens
ccuaugagaucgggagcuu

SEQ ID NO: 1468945 - RNA, 19 nt, Homo sapiens
acuaugcccugguuucugu

SEQ ID NO: 1468946 - RNA, 19 nt, Homo sapiens
uguaggaguugguuugucu

SEQ ID NO: 1468947 - RNA, 19 nt, Homo sapiens
guccugggcacccugauaa

SEQ ID NO: 1468948 - RNA, 19 nt, Homo sapiens
cagaagacaucagccaacu

SEQ ID NO: 1468949 - RNA, 19 nt, Homo sapiens
uagugucuuucacguguuu

SEQ ID NO: 1468950 - RNA, 19 nt, Homo sapiens
gguccugggcacccugaua

SEQ ID NO: 1468951 - RNA, 19 nt, Homo sapiens
acugugaccuacaugauuc

SEQ ID NO: 1468952 - RNA, 19 nt, Homo sapiens
ugcccaggcugucaucuau

SEQ ID NO: 1468953 - RNA, 19 nt, Homo sapiens
gagucagaguccagggauu

SEQ ID NO: 1468954 - RNA, 19 nt, Homo sapiens
cugcagaggaggcuaagaa

SEQ ID NO: 1468955 - RNA, 19 nt, Homo sapiens
ggacucucuuugcccuuuc

SEQ ID NO: 1468956 - RNA, 19 nt, Homo sapiens
gccgguuuauagugucuuu

SEQ ID NO: 1468957 - RNA, 19 nt, Homo sapiens
ccugauaagcauccugaaa

SEQ ID NO: 1468958 - RNA, 19 nt, Homo sapiens
gcauccuucugaccuuugu

SEQ ID NO: 1468959 - RNA, 19 nt, Homo sapiens
auucagaguuccagcuguu

SEQ ID NO: 1468960 - RNA, 19 nt, Homo sapiens
caugugagacccaaggaau

SEQ ID NO: 1468961 - RNA, 19 nt, Homo sapiens
uaccaaugaugaguagaga

SEQ ID NO: 1468962 - RNA, 19 nt, Homo sapiens
ccaacuaugcccugguuuc

SEQ ID NO: 1468963 - RNA, 19 nt, Homo sapiens
acccaggacuauguaauga

SEQ ID NO: 1468964 - RNA, 19 nt, Homo sapiens
augggacacugcagauaaa

SEQ ID NO: 1468965 - RNA, 19 nt, Homo sapiens
gcuagcaaagcuuccauuc

SEQ ID NO: 1468966 - RNA, 19 nt, Homo sapiens
gcuuaguguucagccaauu

SEQ ID NO: 1468967 - RNA, 19 nt, Homo sapiens
acuccugucuccucuacaa

SEQ ID NO: 1468968 - RNA, 19 nt, Homo sapiens
ugacuccugucuccucuac

SEQ ID NO: 1468969 - RNA, 19 nt, Homo sapiens
ggucuugccgguuuauagu

SEQ ID NO: 1468970 - RNA, 19 nt, Homo sapiens
caacuaugcccugguuucu

SEQ ID NO: 1468971 - RNA, 19 nt, Homo sapiens
caacugcacgagucagagu

SEQ ID NO: 1468972 - RNA, 19 nt, Homo sapiens
uggacucucuuugcccuuu

SEQ ID NO: 1468973 - RNA, 19 nt, Homo sapiens
ggacuaaacugcugacaga

SEQ ID NO: 1468974 - RNA, 19 nt, Homo sapiens
gauauugucuuuccauuug

SEQ ID NO: 1468975 - RNA, 19 nt, Homo sapiens
gauacuagccaacaccuua

SEQ ID NO: 1468976 - RNA, 19 nt, Homo sapiens
gaugggacuuguaucauuu

SEQ ID NO: 1468977 - RNA, 19 nt, Homo sapiens
uuagauaacuccaacacua

SEQ ID NO: 1468978 - RNA, 19 nt, Homo sapiens
cgacugauguaugucauua

SEQ ID NO: 1468979 - RNA, 19 nt, Homo sapiens
ucaagaagauucaguuaca

SEQ ID NO: 1468980 - RNA, 19 nt, Homo sapiens
ugaauaaacuaccaacuca

SEQ ID NO: 1468981 - RNA, 19 nt, Homo sapiens
cauggaagcaguaguguua

SEQ ID NO: 1468982 - RNA, 19 nt, Homo sapiens
ggacaguaaucagagaauu

SEQ ID NO: 1468983 - RNA, 19 nt, Homo sapiens
cagaagaaucgcacauuua

SEQ ID NO: 1468984 - RNA, 19 nt, Homo sapiens
ggaguugccuguggaaaga

SEQ ID NO: 1468985 - RNA, 19 nt, Homo sapiens
gcauuagggugaagaggaa

SEQ ID NO: 1468986 - RNA, 19 nt, Homo sapiens
cauagcgacuugucacuuu

SEQ ID NO: 1468987 - RNA, 19 nt, Homo sapiens
ggaugaugaugauagcuuu

SEQ ID NO: 1468988 - RNA, 19 nt, Homo sapiens
gaagacugaguuuagauaa

SEQ ID NO: 1468989 - RNA, 19 nt, Homo sapiens
acagaagaaucgcacauuu

SEQ ID NO: 1468990 - RNA, 19 nt, Homo sapiens
acagaaagauugcuuacug

SEQ ID NO: 1468991 - RNA, 19 nt, Homo sapiens
gcaacaacgucuccugcuu

SEQ ID NO: 1468992 - RNA, 19 nt, Homo sapiens
ugucaaggauauugucuuu

SEQ ID NO: 1468993 - RNA, 19 nt, Homo sapiens
cgaugggacuuguaucauu

SEQ ID NO: 1468994 - RNA, 19 nt, Homo sapiens
guacaucgccuccggacaa

SEQ ID NO: 1468995 - RNA, 19 nt, Homo sapiens
uggcggagcuggaacuuga

SEQ ID NO: 1468996 - RNA, 19 nt, Homo sapiens
caacacuagucuucauuuc

SEQ ID NO: 1468997 - RNA, 19 nt, Homo sapiens
gcuacaaacccaucaagaa

SEQ ID NO: 1468998 - RNA, 19 nt, Homo sapiens
ggaacagacagaaagauug

SEQ ID NO: 1468999 - RNA, 19 nt, Homo sapiens
guauuggaguggaugauga

SEQ ID NO: 1469000 - RNA, 19 nt, Homo sapiens
cauaugauuuauccucuug

SEQ ID NO: 1469001 - RNA, 19 nt, Homo sapiens
ccgcauaaguccaggaaau

SEQ ID NO: 1469002 - RNA, 19 nt, Homo sapiens
ggauauugucuuuccauuu

SEQ ID NO: 1469003 - RNA, 19 nt, Homo sapiens
cuaaacugcugacagaugu

SEQ ID NO: 1469004 - RNA, 19 nt, Homo sapiens
gggaugagauguuuaugac

SEQ ID NO: 1469005 - RNA, 19 nt, Homo sapiens
guucaaggcagacaucauu

SEQ ID NO: 1469006 - RNA, 19 nt, Homo sapiens
caagaagauucaguuacaa

SEQ ID NO: 1469007 - RNA, 19 nt, Homo sapiens
caucaagaagauucaguua

SEQ ID NO: 1469008 - RNA, 19 nt, Homo sapiens
caccacgacuggagauauu

SEQ ID NO: 1469009 - RNA, 19 nt, Homo sapiens
ggcaauaaauacuaaagag

SEQ ID NO: 1469010 - RNA, 19 nt, Homo sapiens
cggcaucacuucuaucaca

SEQ ID NO: 1469011 - RNA, 19 nt, Homo sapiens
uaacauggaagcaguagug

SEQ ID NO: 1469012 - RNA, 19 nt, Homo sapiens
ccauauaccuccugaagcu

SEQ ID NO: 1469013 - RNA, 19 nt, Homo sapiens
ggacacaguggcaacauca

SEQ ID NO: 1469014 - RNA, 19 nt, Homo sapiens
ucaucaguguccugcauua

SEQ ID NO: 1469015 - RNA, 19 nt, Homo sapiens
agaagaaucgcacauuuau

SEQ ID NO: 1469016 - RNA, 19 nt, Homo sapiens
ugaagacugaguuuagaua

SEQ ID NO: 1469017 - RNA, 19 nt, Homo sapiens
cgaaggacaaauucaguuu

SEQ ID NO: 1469018 - RNA, 19 nt, Homo sapiens
gcauaugauuuauccucuu

SEQ ID NO: 1469019 - RNA, 19 nt, Homo sapiens
gaacagacagaaagauugc

SEQ ID NO: 1469020 - RNA, 19 nt, Homo sapiens
gagcauagccaagagagau

SEQ ID NO: 1469021 - RNA, 19 nt, Homo sapiens
accaggagcauaugauuua

SEQ ID NO: 1469022 - RNA, 19 nt, Homo sapiens
gaccaggagcauaugauuu

SEQ ID NO: 1469023 - RNA, 19 nt, Homo sapiens
guugaagacugaguuuaga

SEQ ID NO: 1469024 - RNA, 19 nt, Homo sapiens
gaacagaagaaucgcacau

SEQ ID NO: 1469025 - RNA, 19 nt, Homo sapiens
ggacugcuggucuucugua

SEQ ID NO: 1469026 - RNA, 19 nt, Homo sapiens
guuuaugacugcuggaaau

SEQ ID NO: 1469027 - RNA, 19 nt, Homo sapiens
gcaccgaugggacuuguau

SEQ ID NO: 1469028 - RNA, 19 nt, Homo sapiens
aaucagaaccucccaagga

SEQ ID NO: 1469029 - RNA, 19 nt, Homo sapiens
cagagcaccuggacaugug

SEQ ID NO: 1469030 - RNA, 19 nt, Homo sapiens
aguguuaccuuggcagaua

SEQ ID NO: 1469031 - RNA, 19 nt, Homo sapiens
gagacaggccgacugaugu

SEQ ID NO: 1469032 - RNA, 19 nt, Homo sapiens
acaaacccaucaagaagau

SEQ ID NO: 1469033 - RNA, 19 nt, Homo sapiens
gacaguaaucagagaauug

SEQ ID NO: 1469034 - RNA, 19 nt, Homo sapiens
gcuaucacccugaggaguu

SEQ ID NO: 1469035 - RNA, 19 nt, Homo sapiens
ggaggaggcccugaaggaa

SEQ ID NO: 1469036 - RNA, 19 nt, Homo sapiens
uggcacugcugagcuauuu

SEQ ID NO: 1469037 - RNA, 19 nt, Homo sapiens
uaucacacuucgaggagaa

SEQ ID NO: 1469038 - RNA, 19 nt, Homo sapiens
gggauuauaagaacagaga

SEQ ID NO: 1469039 - RNA, 19 nt, Homo sapiens
ggagaaggacaccaguuuc

SEQ ID NO: 1469040 - RNA, 19 nt, Homo sapiens
ccaaacaggacaguugaaa

SEQ ID NO: 1469041 - RNA, 19 nt, Homo sapiens
aauugaagcucuggccuuu

SEQ ID NO: 1469042 - RNA, 19 nt, Homo sapiens
gaucaucaccagcggaaca

SEQ ID NO: 1469043 - RNA, 19 nt, Homo sapiens
gaaggaacacaagucauca

SEQ ID NO: 1469044 - RNA, 19 nt, Homo sapiens
cagcauggaacgacgguaa

SEQ ID NO: 1469045 - RNA, 19 nt, Homo sapiens
cagcuucacggauuucaaa

SEQ ID NO: 1469046 - RNA, 19 nt, Homo sapiens
acacuagucuucauuucuc

SEQ ID NO: 1469047 - RNA, 19 nt, Homo sapiens
ucaaggauauugucuuucc

SEQ ID NO: 1469048 - RNA, 19 nt, Homo sapiens
gagccggacugcuggucuu

SEQ ID NO: 1469049 - RNA, 19 nt, Homo sapiens
ccaacacuagucuucauuu

SEQ ID NO: 1469050 - RNA, 19 nt, Homo sapiens
gaauaaacuaccaacucaa

SEQ ID NO: 1469051 - RNA, 19 nt, Homo sapiens
cgauaaauggcauggauau

SEQ ID NO: 1469052 - RNA, 19 nt, Homo sapiens
ugaaggaacacaagucauc

SEQ ID NO: 1469053 - RNA, 19 nt, Homo sapiens
ccagagacaggccgacuga

SEQ ID NO: 1469054 - RNA, 19 nt, Homo sapiens
caaggcggcaucacuucua

SEQ ID NO: 1469055 - RNA, 19 nt, Homo sapiens
cuacaaacccaucaagaag

SEQ ID NO: 1469056 - RNA, 19 nt, Homo sapiens
gcauaaguccaggaaauca

SEQ ID NO: 1469057 - RNA, 19 nt, Homo sapiens
ggaacaacgaggagugugu

SEQ ID NO: 1469058 - RNA, 19 nt, Homo sapiens
gcgaaggacaaauucaguu

SEQ ID NO: 1469059 - RNA, 19 nt, Homo sapiens
gcaccacgacuggagauau

SEQ ID NO: 1469060 - RNA, 19 nt, Homo sapiens
gugccgggaugagauguuu

SEQ ID NO: 1469061 - RNA, 19 nt, Homo sapiens
gugaggguauggcagauag

SEQ ID NO: 1469062 - RNA, 19 nt, Homo sapiens
gaagaaucgcacauuuauc

SEQ ID NO: 1469063 - RNA, 19 nt, Homo sapiens
guacuugguaucacuagga

SEQ ID NO: 1469064 - RNA, 19 nt, Homo sapiens
gcucggcugucccuucaca

SEQ ID NO: 1469065 - RNA, 19 nt, Homo sapiens
gaacagagagcugcuugcu

SEQ ID NO: 1469066 - RNA, 19 nt, Homo sapiens
gucgauaaauggcauggau

SEQ ID NO: 1469067 - RNA, 19 nt, Homo sapiens
cggaacagacagaaagauu

SEQ ID NO: 1469068 - RNA, 19 nt, Homo sapiens
ccaccaaugugaucuucuc

SEQ ID NO: 1469069 - RNA, 19 nt, Homo sapiens
gcaaugccaccaaugugau

SEQ ID NO: 1469070 - RNA, 19 nt, Homo sapiens
ccugaggaguuccagauca

SEQ ID NO: 1469071 - RNA, 19 nt, Homo sapiens
gacugcuggucuucuguaa

SEQ ID NO: 1469072 - RNA, 19 nt, Homo sapiens
gacuggagauauucuaaaa

SEQ ID NO: 1469073 - RNA, 19 nt, Homo sapiens
agacagagaucgugaaaga

SEQ ID NO: 1469074 - RNA, 19 nt, Homo sapiens
gacaugauccagcaauuua

SEQ ID NO: 1469075 - RNA, 19 nt, Homo sapiens
gaaaucaugcaucaaacua

SEQ ID NO: 1469076 - RNA, 19 nt, Homo sapiens
guaaccacaucucccauaa

SEQ ID NO: 1469077 - RNA, 19 nt, Homo sapiens
agacagaaaucaugcauca

SEQ ID NO: 1469078 - RNA, 19 nt, Homo sapiens
gaaguuuguucucaaguuc

SEQ ID NO: 1469079 - RNA, 19 nt, Homo sapiens
gagggacaccugcuuauuu

SEQ ID NO: 1469080 - RNA, 19 nt, Homo sapiens
caacagcgaguccggauuu

SEQ ID NO: 1469081 - RNA, 19 nt, Homo sapiens
gaugagauccugcagcaaa

SEQ ID NO: 1469082 - RNA, 19 nt, Homo sapiens
ggagauccaugaggugauu

SEQ ID NO: 1469083 - RNA, 19 nt, Homo sapiens
gggaggaacugggcguuaa

SEQ ID NO: 1469084 - RNA, 19 nt, Homo sapiens
aaacuauggugcagaagaa

SEQ ID NO: 1469085 - RNA, 19 nt, Homo sapiens
ggacaugauccagcaauuu

SEQ ID NO: 1469086 - RNA, 19 nt, Homo sapiens
uagagaaggugguggagaa

SEQ ID NO: 1469087 - RNA, 19 nt, Homo sapiens
aggaagaccuggccgagua

SEQ ID NO: 1469088 - RNA, 19 nt, Homo sapiens
ggaaaaggaugaugagauc

SEQ ID NO: 1469089 - RNA, 19 nt, Homo sapiens
gaacaccgcagccaagaag

SEQ ID NO: 1469090 - RNA, 19 nt, Homo sapiens
gcucugcuacccacaauuu

SEQ ID NO: 1469091 - RNA, 19 nt, Homo sapiens
ugaaguuuguucucaaguu

SEQ ID NO: 1469092 - RNA, 19 nt, Homo sapiens
acaagcagcuggacaugau

SEQ ID NO: 1469093 - RNA, 19 nt, Homo sapiens
acagaaaucaugcaucaaa

SEQ ID NO: 1469094 - RNA, 19 nt, Homo sapiens
uaaggaagcccaacugaag

SEQ ID NO: 1469095 - RNA, 19 nt, Homo sapiens
gcagcaaugucaucuucug

SEQ ID NO: 1469096 - RNA, 19 nt, Homo sapiens
ggaacugggcguuaaggaa

SEQ ID NO: 1469097 - RNA, 19 nt, Homo sapiens
caacaaguaccuagagaag

SEQ ID NO: 1469098 - RNA, 19 nt, Homo sapiens
gcugagggacaccugcuua

SEQ ID NO: 1469099 - RNA, 19 nt, Homo sapiens
gguaaccacaucucccaua

SEQ ID NO: 1469100 - RNA, 19 nt, Homo sapiens
ugaagaaagccaacaagga

SEQ ID NO: 1469101 - RNA, 19 nt, Homo sapiens
ccgcagcaaugucaucuuc

SEQ ID NO: 1469102 - RNA, 19 nt, Homo sapiens
acaagacgcuggugagcau

SEQ ID NO: 1469103 - RNA, 19 nt, Homo sapiens
aaucaugcaucaaacuaug

SEQ ID NO: 1469104 - RNA, 19 nt, Homo sapiens
agaagaagaagauguuuca

SEQ ID NO: 1469105 - RNA, 19 nt, Homo sapiens
caaacuauggugcagaaga

SEQ ID NO: 1469106 - RNA, 19 nt, Homo sapiens
gcagaagaagaagauguuu

SEQ ID NO: 1469107 - RNA, 19 nt, Homo sapiens
cagagaucgugaaagaaga

SEQ ID NO: 1469108 - RNA, 19 nt, Homo sapiens
cagugaauguuauaugaag

SEQ ID NO: 1469109 - RNA, 19 nt, Homo sapiens
caacaaggagcgagaacuc

SEQ ID NO: 1469110 - RNA, 19 nt, Homo sapiens
gcugaaggacuacuacauc

SEQ ID NO: 1469111 - RNA, 19 nt, Homo sapiens
ccaucuggcuacuggagaa

SEQ ID NO: 1469112 - RNA, 19 nt, Homo sapiens
acuacuacaucuucaacaa

SEQ ID NO: 1469113 - RNA, 19 nt, Homo sapiens
guuccagaauguccugaga

SEQ ID NO: 1469114 - RNA, 19 nt, Homo sapiens
ggaaggccaggagaagauu

SEQ ID NO: 1469115 - RNA, 19 nt, Homo sapiens
ccaggagaacgaccagaaa

SEQ ID NO: 1469116 - RNA, 19 nt, Homo sapiens
ugaaggcucacauccagaa

SEQ ID NO: 1469117 - RNA, 19 nt, Homo sapiens
gcucggcaccauuaagaug

SEQ ID NO: 1469118 - RNA, 19 nt, Homo sapiens
aaugucaucuucugggaau

SEQ ID NO: 1469119 - RNA, 19 nt, Homo sapiens
caccuucuguggagucuca

SEQ ID NO: 1469120 - RNA, 19 nt, Homo sapiens
aaccacaucucccauaacu

SEQ ID NO: 1469121 - RNA, 19 nt, Homo sapiens
aaaggagacagaaaucaug

SEQ ID NO: 1469122 - RNA, 19 nt, Homo sapiens
ugagacagagaucgugaaa

SEQ ID NO: 1469123 - RNA, 19 nt, Homo sapiens
caagaccggucggacaucu

SEQ ID NO: 1469124 - RNA, 19 nt, Homo sapiens
ugagcaagcaccugaagga

SEQ ID NO: 1469125 - RNA, 19 nt, Homo sapiens
guuaaggaagcccaacuga

SEQ ID NO: 1469126 - RNA, 19 nt, Homo sapiens
cagaaaucaugcaucaaac

SEQ ID NO: 1469127 - RNA, 19 nt, Homo sapiens
acagagaucgugaaagaag

SEQ ID NO: 1469128 - RNA, 19 nt, Homo sapiens
gcaggaaggccaggagaag

SEQ ID NO: 1469129 - RNA, 19 nt, Homo sapiens
uaugaaguuuguucucaag

SEQ ID NO: 1469130 - RNA, 19 nt, Homo sapiens
gaucgugaaagaagaaguc

SEQ ID NO: 1469131 - RNA, 19 nt, Homo sapiens
uacuacaucuucaacaagu

SEQ ID NO: 1469132 - RNA, 19 nt, Homo sapiens
gcagccuuguuccagaaug

SEQ ID NO: 1469133 - RNA, 19 nt, Homo sapiens
gaaggccaggagaagauug

SEQ ID NO: 1469134 - RNA, 19 nt, Homo sapiens
ucaacaaguaccuagagaa

SEQ ID NO: 1469135 - RNA, 19 nt, Homo sapiens
ggacuacuacaucuucaac

SEQ ID NO: 1469136 - RNA, 19 nt, Homo sapiens
gaaccugcgcugggaggaa

SEQ ID NO: 1469137 - RNA, 19 nt, Homo sapiens
ggagacagaaaucaugcau

SEQ ID NO: 1469138 - RNA, 19 nt, Homo sapiens
cagccuuguuccagaaugu

SEQ ID NO: 1469139 - RNA, 19 nt, Homo sapiens
cugaaggacuacuacaucu

SEQ ID NO: 1469140 - RNA, 19 nt, Homo sapiens
uuaaggaagcccaacugaa

SEQ ID NO: 1469141 - RNA, 19 nt, Homo sapiens
gaauggaaacccugaaccu

SEQ ID NO: 1469142 - RNA, 19 nt, Homo sapiens
ccaagcugaaggacuacua

SEQ ID NO: 1469143 - RNA, 19 nt, Homo sapiens
cagaagaagaagauguuuc

SEQ ID NO: 1469144 - RNA, 19 nt, Homo sapiens
cagcgaguccggauuuaag

SEQ ID NO: 1469145 - RNA, 19 nt, Homo sapiens
gugauugcacgcuacaaga

SEQ ID NO: 1469146 - RNA, 19 nt, Homo sapiens
gcagaauggaaacccugaa

SEQ ID NO: 1469147 - RNA, 19 nt, Homo sapiens
ugagggacaccugcuuauu

SEQ ID NO: 1469148 - RNA, 19 nt, Homo sapiens
gggcaucauggaagaggaa

SEQ ID NO: 1469149 - RNA, 19 nt, Homo sapiens
gauccagcaauuuauccaa

SEQ ID NO: 1469150 - RNA, 19 nt, Homo sapiens
agaaggugguggagaacuc

SEQ ID NO: 1469151 - RNA, 19 nt, Homo sapiens
acaaggagcgagaacucaa

SEQ ID NO: 1469152 - RNA, 19 nt, Homo sapiens
cagaaacuccccaauguug

SEQ ID NO: 1469153 - RNA, 19 nt, Homo sapiens
aacagcgaguccggauuua

SEQ ID NO: 1469154 - RNA, 19 nt, Homo sapiens
ccaugaagaaagccaacaa

SEQ ID NO: 1469155 - RNA, 19 nt, Homo sapiens
gugcagaagaagaagaugu

SEQ ID NO: 1469156 - RNA, 19 nt, Homo sapiens
gccgaagggagaaacaaga

SEQ ID NO: 1469157 - RNA, 19 nt, Homo sapiens
agggacaccugcuuauuuu

SEQ ID NO: 1469158 - RNA, 19 nt, Homo sapiens
uggccacgcugaaccucuu

SEQ ID NO: 1469159 - RNA, 19 nt, Homo sapiens
ggcugcagaugcgcuuuga

SEQ ID NO: 1469160 - RNA, 19 nt, Homo sapiens
gggcgcacauccagaacac

SEQ ID NO: 1469161 - RNA, 19 nt, Homo sapiens
ggugauugcacgcuacaag

SEQ ID NO: 1469162 - RNA, 19 nt, Homo sapiens
acuacaucuucaacaagua

SEQ ID NO: 1469163 - RNA, 19 nt, Homo sapiens
ugaaggacuacuacaucuu

SEQ ID NO: 1469164 - RNA, 19 nt, Homo sapiens
ggaggaacugggcguuaag

SEQ ID NO: 1469165 - RNA, 19 nt, Homo sapiens
gaaagucaccuucaucuuc

SEQ ID NO: 1469166 - RNA, 19 nt, Homo sapiens
ucagagaccuggaaaggaa

SEQ ID NO: 1469167 - RNA, 19 nt, Homo sapiens
caggagcuguucugacuua

SEQ ID NO: 1469168 - RNA, 19 nt, Homo sapiens
gaaagagaccaacaucaga

SEQ ID NO: 1469169 - RNA, 19 nt, Homo sapiens
ugauugagcuugagugaug

SEQ ID NO: 1469170 - RNA, 19 nt, Homo sapiens
gcagaaggauacacaugug

SEQ ID NO: 1469171 - RNA, 19 nt, Homo sapiens
caagauggaugcagaguac

SEQ ID NO: 1469172 - RNA, 19 nt, Homo sapiens
ugagugauguggaauaaau

SEQ ID NO: 1469173 - RNA, 19 nt, Homo sapiens
gagcuugagugauguggaa

SEQ ID NO: 1469174 - RNA, 19 nt, Homo sapiens
ugaucgaggucuguuauua

SEQ ID NO: 1469175 - RNA, 19 nt, Homo sapiens
gcaccaaguucuguccauu

SEQ ID NO: 1469176 - RNA, 19 nt, Homo sapiens
guuauuagacuuccucauu

SEQ ID NO: 1469177 - RNA, 19 nt, Homo sapiens
caacagaauccacacauca

SEQ ID NO: 1469178 - RNA, 19 nt, Homo sapiens
gaugagaagagacaauuga

SEQ ID NO: 1469179 - RNA, 19 nt, Homo sapiens
gcaacagaauccacacauc

SEQ ID NO: 1469180 - RNA, 19 nt, Homo sapiens
caaguucuguccauucauc

SEQ ID NO: 1469181 - RNA, 19 nt, Homo sapiens
ggcuggagcuauuucauug

SEQ ID NO: 1469182 - RNA, 19 nt, Homo sapiens
gcacagacgaucacagaca

SEQ ID NO: 1469183 - RNA, 19 nt, Homo sapiens
gagcuguucugacuuagag

SEQ ID NO: 1469184 - RNA, 19 nt, Homo sapiens
caggugagcugggacaaga

SEQ ID NO: 1469185 - RNA, 19 nt, Homo sapiens
ggagacagagggugaagug

SEQ ID NO: 1469186 - RNA, 19 nt, Homo sapiens
gggcacagacgaucacaga

SEQ ID NO: 1469187 - RNA, 19 nt, Homo sapiens
ggagaaagagaccaacauc

SEQ ID NO: 1469188 - RNA, 19 nt, Homo sapiens
caacaucagagaccuggaa

SEQ ID NO: 1469189 - RNA, 19 nt, Homo sapiens
ggcuggugcuuauccuaua

SEQ ID NO: 1469190 - RNA, 19 nt, Homo sapiens
ggaaagucaccuucaucuu

SEQ ID NO: 1469191 - RNA, 19 nt, Homo sapiens
gagaaagagaccaacauca

SEQ ID NO: 1469192 - RNA, 19 nt, Homo sapiens
gugaaguggugcucaagau

SEQ ID NO: 1469193 - RNA, 19 nt, Homo sapiens
gagcagaaggauacacaug

SEQ ID NO: 1469194 - RNA, 19 nt, Homo sapiens
gugcuuauccuauacuuca

SEQ ID NO: 1469195 - RNA, 19 nt, Homo sapiens
aaagucaccuucaucuucu

SEQ ID NO: 1469196 - RNA, 19 nt, Homo sapiens
ccacacaucagcccacguu

SEQ ID NO: 1469197 - RNA, 19 nt, Homo sapiens
gaucgaggucuguuauuag

SEQ ID NO: 1469198 - RNA, 19 nt, Homo sapiens
gucauggccuucuccaaga

SEQ ID NO: 1469199 - RNA, 19 nt, Homo sapiens
uuauuagacuuccucauuc

SEQ ID NO: 1469200 - RNA, 19 nt, Homo sapiens
ugacuuagagaaugggaaa

SEQ ID NO: 1469201 - RNA, 19 nt, Homo sapiens
gaauaaauuguccgucucu

SEQ ID NO: 1469202 - RNA, 19 nt, Homo sapiens
gaauguauccauccccaua

SEQ ID NO: 1469203 - RNA, 19 nt, Homo sapiens
gguggcagcugaugaaaau

SEQ ID NO: 1469204 - RNA, 19 nt, Homo sapiens
ccgcugcccuuucaaugga

SEQ ID NO: 1469205 - RNA, 19 nt, Homo sapiens
uaaauuguccgucucuucu

SEQ ID NO: 1469206 - RNA, 19 nt, Homo sapiens
cuugagugauguggaauaa

SEQ ID NO: 1469207 - RNA, 19 nt, Homo sapiens
aaugagaaagggaggauuu

SEQ ID NO: 1469208 - RNA, 19 nt, Homo sapiens
gcaaauccaggagcuguuc

SEQ ID NO: 1469209 - RNA, 19 nt, Homo sapiens
ggucagaaggagaaagaga

SEQ ID NO: 1469210 - RNA, 19 nt, Homo sapiens
aauuguccgucucuucuuu

SEQ ID NO: 1469211 - RNA, 19 nt, Homo sapiens
aaaaguuucuggagucuga

SEQ ID NO: 1469212 - RNA, 19 nt, Homo sapiens
gcgcgauccuuugcuacuu

SEQ ID NO: 1469213 - RNA, 19 nt, Homo sapiens
cacaucagcccacguuaug

SEQ ID NO: 1469214 - RNA, 19 nt, Homo sapiens
ccauuaacaucuggaucuu

SEQ ID NO: 1469215 - RNA, 19 nt, Homo sapiens
gggaaagucaccuucaucu

SEQ ID NO: 1469216 - RNA, 19 nt, Homo sapiens
caauggagaaucacacaca

SEQ ID NO: 1469217 - RNA, 19 nt, Homo sapiens
ucaagauggaugcagagua

SEQ ID NO: 1469218 - RNA, 19 nt, Homo sapiens
ucuccacccucaugcuauu

SEQ ID NO: 1469219 - RNA, 19 nt, Homo sapiens
ccucaucauugcaaggaau

SEQ ID NO: 1469220 - RNA, 19 nt, Homo sapiens
uuagacuuccucauucuuu

SEQ ID NO: 1469221 - RNA, 19 nt, Homo sapiens
cuaggagccucuucuacca

SEQ ID NO: 1469222 - RNA, 19 nt, Homo sapiens
agaaagagaccaacaucag

SEQ ID NO: 1469223 - RNA, 19 nt, Homo sapiens
uccaggagcuguucugacu

SEQ ID NO: 1469224 - RNA, 19 nt, Homo sapiens
ggaaugagaaagggaggau

SEQ ID NO: 1469225 - RNA, 19 nt, Homo sapiens
ugaauagguugguccucau

SEQ ID NO: 1469226 - RNA, 19 nt, Homo sapiens
uugguuggcuggugcuuau

SEQ ID NO: 1469227 - RNA, 19 nt, Homo sapiens
acacaucagcccacguuau

SEQ ID NO: 1469228 - RNA, 19 nt, Homo sapiens
gaaauggcuggaccucucu

SEQ ID NO: 1469229 - RNA, 19 nt, Homo sapiens
gaacucuccgcugcccuuu

SEQ ID NO: 1469230 - RNA, 19 nt, Homo sapiens
gcuugagugauguggaaua

SEQ ID NO: 1469231 - RNA, 19 nt, Homo sapiens
caugguggcagcugaugaa

SEQ ID NO: 1469232 - RNA, 19 nt, Homo sapiens
ccugcgcgauccuuugcua

SEQ ID NO: 1469233 - RNA, 19 nt, Homo sapiens
acaucuggaucuucgaguu

SEQ ID NO: 1469234 - RNA, 19 nt, Homo sapiens
acucuccgcugcccuuuca

SEQ ID NO: 1469235 - RNA, 19 nt, Homo sapiens
uagacuuccucauucuuuc

SEQ ID NO: 1469236 - RNA, 19 nt, Homo sapiens
caucagagaccuggaaagg

SEQ ID NO: 1469237 - RNA, 19 nt, Homo sapiens
gaauagguugguccucauc

SEQ ID NO: 1469238 - RNA, 19 nt, Homo sapiens
uuugcuacuucaaccauaa

SEQ ID NO: 1469239 - RNA, 19 nt, Homo sapiens
gcgauccuuugcuacuuca

SEQ ID NO: 1469240 - RNA, 19 nt, Homo sapiens
uauuagacuuccucauucu

SEQ ID NO: 1469241 - RNA, 19 nt, Homo sapiens
guggaugucagcaacagaa

SEQ ID NO: 1469242 - RNA, 19 nt, Homo sapiens
gcucagccugguugccuuu

SEQ ID NO: 1469243 - RNA, 19 nt, Homo sapiens
caggucagaaggagaaaga

SEQ ID NO: 1469244 - RNA, 19 nt, Homo sapiens
gagugauguggaauaaauu

SEQ ID NO: 1469245 - RNA, 19 nt, Homo sapiens
caguuucggcucaguagaa

SEQ ID NO: 1469246 - RNA, 19 nt, Homo sapiens
aagaugagaagagacaauu

SEQ ID NO: 1469247 - RNA, 19 nt, Homo sapiens
caucuggaucuucgaguug

SEQ ID NO: 1469248 - RNA, 19 nt, Homo sapiens
caucuucuccacccucaug

SEQ ID NO: 1469249 - RNA, 19 nt, Homo sapiens
ggagcuguucugacuuaga

SEQ ID NO: 1469250 - RNA, 19 nt, Homo sapiens
cagccugguugccuuuauc

SEQ ID NO: 1469251 - RNA, 19 nt, Homo sapiens
guucuguccauucaucuga

SEQ ID NO: 1469252 - RNA, 19 nt, Homo sapiens
gaguuggaaaggaauguau

SEQ ID NO: 1469253 - RNA, 19 nt, Homo sapiens
ggugaaguggugcucaaga

SEQ ID NO: 1469254 - RNA, 19 nt, Homo sapiens
gaccuggaaaggaaaggaa

SEQ ID NO: 1469255 - RNA, 19 nt, Homo sapiens
accaaguucuguccauuca

SEQ ID NO: 1469256 - RNA, 19 nt, Homo sapiens
gcaugguggcagcugauga

SEQ ID NO: 1469257 - RNA, 19 nt, Homo sapiens
ccugguugccuuuauccua

SEQ ID NO: 1469258 - RNA, 19 nt, Homo sapiens
ggagaaucacacacagcuu

SEQ ID NO: 1469259 - RNA, 19 nt, Homo sapiens
gaaugagaaagggaggauu

SEQ ID NO: 1469260 - RNA, 19 nt, Homo sapiens
cagcaguuucggcucagua

SEQ ID NO: 1469261 - RNA, 19 nt, Homo sapiens
gcuggugcuuauccuauac

SEQ ID NO: 1469262 - RNA, 19 nt, Homo sapiens
caaaagaugagaagagaca

SEQ ID NO: 1469263 - RNA, 19 nt, Homo sapiens
ugaaguggugcucaagaug

SEQ ID NO: 1469264 - RNA, 19 nt, Homo sapiens
uagguugguccucaucauu

SEQ ID NO: 1469265 - RNA, 19 nt, Homo sapiens
ugacaaaccugccucuuuc

SEQ ID NO: 1469266 - RNA, 19 nt, Homo sapiens
cuaccgaccuucucucuug

SEQ ID NO: 1469267 - RNA, 19 nt, Homo sapiens
ucaagaaggcccacuguug

SEQ ID NO: 1469268 - RNA, 19 nt, Homo sapiens
ggaagaaggaaacggaaga

SEQ ID NO: 1469269 - RNA, 19 nt, Homo sapiens
ggauaagcauggugugaag

SEQ ID NO: 1469270 - RNA, 19 nt, Homo sapiens
gcacagccuugggaagaau

SEQ ID NO: 1469271 - RNA, 19 nt, Homo sapiens
gcacagccacccagccuau

SEQ ID NO: 1469272 - RNA, 19 nt, Homo sapiens
ucacacagccucaccuuca

SEQ ID NO: 1469273 - RNA, 19 nt, Homo sapiens
cuucaccucuuggguauuu

SEQ ID NO: 1469274 - RNA, 19 nt, Homo sapiens
gcugcgagcuccucuucug

SEQ ID NO: 1469275 - RNA, 19 nt, Homo sapiens
uaaaaccucugaucaaagu

SEQ ID NO: 1469276 - RNA, 19 nt, Homo sapiens
gggcacagccuugggaaga

SEQ ID NO: 1469277 - RNA, 19 nt, Homo sapiens
uuugugcccuccaucauuu

SEQ ID NO: 1469278 - RNA, 19 nt, Homo sapiens
gugcuugguucccaucugu

SEQ ID NO: 1469279 - RNA, 19 nt, Homo sapiens
ggacgcggagcaagaggaa

SEQ ID NO: 1469280 - RNA, 19 nt, Homo sapiens
gagcccagcauaaccuaga

SEQ ID NO: 1469281 - RNA, 19 nt, Homo sapiens
cugacaaaccugccucuuu

SEQ ID NO: 1469282 - RNA, 19 nt, Homo sapiens
ggcacagccuugggaagaa

SEQ ID NO: 1469283 - RNA, 19 nt, Homo sapiens
ccucuuggguauuucagau

SEQ ID NO: 1469284 - RNA, 19 nt, Homo sapiens
gcgagcuccucuucugcaa

SEQ ID NO: 1469285 - RNA, 19 nt, Homo sapiens
caauaaaaccucugaucaa

SEQ ID NO: 1469286 - RNA, 19 nt, Homo sapiens
ugggaagaauggauaagca

SEQ ID NO: 1469287 - RNA, 19 nt, Homo sapiens
gaagaaggaaacggaagag

SEQ ID NO: 1469288 - RNA, 19 nt, Homo sapiens
ccucaucccucugacaaac

SEQ ID NO: 1469289 - RNA, 19 nt, Homo sapiens
gugcagagcccagcauaac

SEQ ID NO: 1469290 - RNA, 19 nt, Homo sapiens
gauaagcauggugugaaga

SEQ ID NO: 1469291 - RNA, 19 nt, Homo sapiens
gcagagcccagcauaaccu

SEQ ID NO: 1469292 - RNA, 19 nt, Homo sapiens
gcucacacagccucaccuu

SEQ ID NO: 1469293 - RNA, 19 nt, Homo sapiens
caucaagaaggcccacugu

SEQ ID NO: 1469294 - RNA, 19 nt, Homo sapiens
ggacgaggacgaggacaac

SEQ ID NO: 1469295 - RNA, 19 nt, Homo sapiens
gggaagaauggauaagcau

SEQ ID NO: 1469296 - RNA, 19 nt, Homo sapiens
gcacugcguucuggaucac

SEQ ID NO: 1469297 - RNA, 19 nt, Homo sapiens
gaccaaggcuuaauuguaa

SEQ ID NO: 1469298 - RNA, 19 nt, Homo sapiens
ggacagagcugacacaaag

SEQ ID NO: 1469299 - RNA, 19 nt, Homo sapiens
ggaaggagcugucuuuaca

SEQ ID NO: 1469300 - RNA, 19 nt, Homo sapiens
ggacgcagauccagaguuu

SEQ ID NO: 1469301 - RNA, 19 nt, Homo sapiens
acacaaagcugaucuacaa

SEQ ID NO: 1469302 - RNA, 19 nt, Homo sapiens
gagaagagcucaccagagu

SEQ ID NO: 1469303 - RNA, 19 nt, Homo sapiens
gcaguuguuuccugaauuu

SEQ ID NO: 1469304 - RNA, 19 nt, Homo sapiens
ccagcuaucuuacccaaua

SEQ ID NO: 1469305 - RNA, 19 nt, Homo sapiens
ugacagaaguggagcagua

SEQ ID NO: 1469306 - RNA, 19 nt, Homo sapiens
gcagaccaguguauucuaa

SEQ ID NO: 1469307 - RNA, 19 nt, Homo sapiens
ugaaauagccgaguacaua

SEQ ID NO: 1469308 - RNA, 19 nt, Homo sapiens
gcagugagcugagaucaug

SEQ ID NO: 1469309 - RNA, 19 nt, Homo sapiens
gaacaaacuugggaaagau

SEQ ID NO: 1469310 - RNA, 19 nt, Homo sapiens
gaaaggaauucuagcaaag

SEQ ID NO: 1469311 - RNA, 19 nt, Homo sapiens
gaaaguguguaucagaugu

SEQ ID NO: 1469312 - RNA, 19 nt, Homo sapiens
gaaaggagcauaguguuug

SEQ ID NO: 1469313 - RNA, 19 nt, Homo sapiens
gaaauuauaggccaagaga

SEQ ID NO: 1469314 - RNA, 19 nt, Homo sapiens
caacauuuauuuccaguuc

SEQ ID NO: 1469315 - RNA, 19 nt, Homo sapiens
caacaagaaaugcaacuaa

SEQ ID NO: 1469316 - RNA, 19 nt, Homo sapiens
ggaguucucuggaucuuuc

SEQ ID NO: 1469317 - RNA, 19 nt, Homo sapiens
ugacgaagcucagaauuuc

SEQ ID NO: 1469318 - RNA, 19 nt, Homo sapiens
ggaaaggagcauaguguuu

SEQ ID NO: 1469319 - RNA, 19 nt, Homo sapiens
guacauacaacaagaaaug

SEQ ID NO: 1469320 - RNA, 19 nt, Homo sapiens
ggaagucugguuacauuaa

SEQ ID NO: 1469321 - RNA, 19 nt, Homo sapiens
gagaagaucaggaaugugu

SEQ ID NO: 1469322 - RNA, 19 nt, Homo sapiens
gagcugagaucaugucacu

SEQ ID NO: 1469323 - RNA, 19 nt, Homo sapiens
gaagaucaggaauguguuu

SEQ ID NO: 1469324 - RNA, 19 nt, Homo sapiens
cagaugaaauagccgagua

SEQ ID NO: 1469325 - RNA, 19 nt, Homo sapiens
ucaggucucucuugaguga

SEQ ID NO: 1469326 - RNA, 19 nt, Homo sapiens
ugaacaaacuugggaaaga

SEQ ID NO: 1469327 - RNA, 19 nt, Homo sapiens
agaaaggucuggaacacaa

SEQ ID NO: 1469328 - RNA, 19 nt, Homo sapiens
gagcugacacaaagaguuu

SEQ ID NO: 1469329 - RNA, 19 nt, Homo sapiens
caagucaguuagagauuug

SEQ ID NO: 1469330 - RNA, 19 nt, Homo sapiens
ccaggcaacacaaagauua

SEQ ID NO: 1469331 - RNA, 19 nt, Homo sapiens
acacagaauucucuacguu

SEQ ID NO: 1469332 - RNA, 19 nt, Homo sapiens
gaauugugauccucucuag

SEQ ID NO: 1469333 - RNA, 19 nt, Homo sapiens
ggaguguccuggagcuuga

SEQ ID NO: 1469334 - RNA, 19 nt, Homo sapiens
ggaagaacuccaaaccaaa

SEQ ID NO: 1469335 - RNA, 19 nt, Homo sapiens
caaagcugaucuacaacaa

SEQ ID NO: 1469336 - RNA, 19 nt, Homo sapiens
ugaaagcaaugaggaagaa

SEQ ID NO: 1469337 - RNA, 19 nt, Homo sapiens
gaagagcucaccagaguag

SEQ ID NO: 1469338 - RNA, 19 nt, Homo sapiens
ugaggaacuuuaucaguga

SEQ ID NO: 1469339 - RNA, 19 nt, Homo sapiens
gcaugagaaucacuugaau

SEQ ID NO: 1469340 - RNA, 19 nt, Homo sapiens
uaacccagaccaaggcuua

SEQ ID NO: 1469341 - RNA, 19 nt, Homo sapiens
gcucagaauuuccguacug

SEQ ID NO: 1469342 - RNA, 19 nt, Homo sapiens
ccagaaagauggugguuuu

SEQ ID NO: 1469343 - RNA, 19 nt, Homo sapiens
ccagaagccuccgcaagaa

SEQ ID NO: 1469344 - RNA, 19 nt, Homo sapiens
cuaaaggaguuaauacaca

SEQ ID NO: 1469345 - RNA, 19 nt, Homo sapiens
caaaucugguucugaaagu

SEQ ID NO: 1469346 - RNA, 19 nt, Homo sapiens
gaaaggggcuauucuccaa

SEQ ID NO: 1469347 - RNA, 19 nt, Homo sapiens
uaaauggguuccagguguu

SEQ ID NO: 1469348 - RNA, 19 nt, Homo sapiens
gaauuuccguacugaagau

SEQ ID NO: 1469349 - RNA, 19 nt, Homo sapiens
gaagucugguuacauuaag

SEQ ID NO: 1469350 - RNA, 19 nt, Homo sapiens
gauguacggugaacaaacu

SEQ ID NO: 1469351 - RNA, 19 nt, Homo sapiens
caaaacagcaccuauauau

SEQ ID NO: 1469352 - RNA, 19 nt, Homo sapiens
ggcaacacaaagauuauua

SEQ ID NO: 1469353 - RNA, 19 nt, Homo sapiens
gcagagacccgggaaacuu

SEQ ID NO: 1469354 - RNA, 19 nt, Homo sapiens
gcaccgccuuuacuuugaa

SEQ ID NO: 1469355 - RNA, 19 nt, Homo sapiens
ugggaagucugguuacauu

SEQ ID NO: 1469356 - RNA, 19 nt, Homo sapiens
acaagucaguuagagauuu

SEQ ID NO: 1469357 - RNA, 19 nt, Homo sapiens
aggaagaacuccaaaccaa

SEQ ID NO: 1469358 - RNA, 19 nt, Homo sapiens
gaagugacuauuaggaaga

SEQ ID NO: 1469359 - RNA, 19 nt, Homo sapiens
ucacagcccagcaguauga

SEQ ID NO: 1469360 - RNA, 19 nt, Homo sapiens
ucuaagcucuugaaagcaa

SEQ ID NO: 1469361 - RNA, 19 nt, Homo sapiens
cuagcaaaguuauucugua

SEQ ID NO: 1469362 - RNA, 19 nt, Homo sapiens
agaguuuccuccagacuuu

SEQ ID NO: 1469363 - RNA, 19 nt, Homo sapiens
agaccaaggcuuaauugua

SEQ ID NO: 1469364 - RNA, 19 nt, Homo sapiens
ccaauauucugaucugucu

SEQ ID NO: 1469365 - RNA, 19 nt, Homo sapiens
ggaauucuagcaaaguuau

SEQ ID NO: 1469366 - RNA, 19 nt, Homo sapiens
ucgcaaugcagaugaaaua

SEQ ID NO: 1469367 - RNA, 19 nt, Homo sapiens
acagaauucucuacguuug

SEQ ID NO: 1469368 - RNA, 19 nt, Homo sapiens
gcagcucagugaugcaugu

SEQ ID NO: 1469369 - RNA, 19 nt, Homo sapiens
gcaauucucagugaagcua

SEQ ID NO: 1469370 - RNA, 19 nt, Homo sapiens
gaaaccccaucucuacuaa

SEQ ID NO: 1469371 - RNA, 19 nt, Homo sapiens
auugugaucuccagaguuu

SEQ ID NO: 1469372 - RNA, 19 nt, Homo sapiens
gaaauagccgaguacauac

SEQ ID NO: 1469373 - RNA, 19 nt, Homo sapiens
ggacuaaaggaguuaauac

SEQ ID NO: 1469374 - RNA, 19 nt, Homo sapiens
gaagcauggucuguuagga

SEQ ID NO: 1469375 - RNA, 19 nt, Homo sapiens
gcucacagcccagcaguau

SEQ ID NO: 1469376 - RNA, 19 nt, Homo sapiens
cguguaguuuguugcuuua

SEQ ID NO: 1469377 - RNA, 19 nt, Homo sapiens
uaugugacuucguguaguu

SEQ ID NO: 1469378 - RNA, 19 nt, Homo sapiens
gaagaacuccaaaccaaaa

SEQ ID NO: 1469379 - RNA, 19 nt, Homo sapiens
ugaugcaugugauauguug

SEQ ID NO: 1469380 - RNA, 19 nt, Homo sapiens
ggauuacccugcguccuau

SEQ ID NO: 1469381 - RNA, 19 nt, Homo sapiens
cagugucuccgauggauua

SEQ ID NO: 1469382 - RNA, 19 nt, Homo sapiens
agacuuugcugaggccuuu

SEQ ID NO: 1469383 - RNA, 19 nt, Homo sapiens
gcugagaucaugucacugu

SEQ ID NO: 1469384 - RNA, 19 nt, Homo sapiens
gagagucccaagauaauuc

SEQ ID NO: 1469385 - RNA, 19 nt, Homo sapiens
ggaauugugauccucucua

SEQ ID NO: 1469386 - RNA, 19 nt, Homo sapiens
ggagagucccaagauaauu

SEQ ID NO: 1469387 - RNA, 19 nt, Homo sapiens
gagcuuacaggccauagga

SEQ ID NO: 1469388 - RNA, 19 nt, Homo sapiens
gcaaaacagcaccuauaua

SEQ ID NO: 1469389 - RNA, 19 nt, Homo sapiens
gggcuauucuccaaaggau

SEQ ID NO: 1469390 - RNA, 19 nt, Homo sapiens
ccgaguacauacaacaaga

SEQ ID NO: 1469391 - RNA, 19 nt, Homo sapiens
uggagaagaucaggaaugu

SEQ ID NO: 1469392 - RNA, 19 nt, Homo sapiens
aagcugaucuacaacaaca

SEQ ID NO: 1469393 - RNA, 19 nt, Homo sapiens
acccaaaucugguucugaa

SEQ ID NO: 1469394 - RNA, 19 nt, Homo sapiens
ccaaggcuuaauuguaaua

SEQ ID NO: 1469395 - RNA, 19 nt, Homo sapiens
gcucagugaugcaugugau

SEQ ID NO: 1469396 - RNA, 19 nt, Homo sapiens
agucuaagcucuugaaagc

SEQ ID NO: 1469397 - RNA, 19 nt, Homo sapiens
gaaagugguugcauagaga

SEQ ID NO: 1469398 - RNA, 19 nt, Homo sapiens
caaaucaucuguacuagca

SEQ ID NO: 1469399 - RNA, 19 nt, Homo sapiens
gaggagaagugacuggaaa

SEQ ID NO: 1469400 - RNA, 19 nt, Homo sapiens
ggcaaagacugaagacaaa

SEQ ID NO: 1469401 - RNA, 19 nt, Homo sapiens
aaacaaggauuacagugaa

SEQ ID NO: 1469402 - RNA, 19 nt, Homo sapiens
ggacagggauaaauaaagg

SEQ ID NO: 1469403 - RNA, 19 nt, Homo sapiens
agaagaaagugguugcaua

SEQ ID NO: 1469404 - RNA, 19 nt, Homo sapiens
ccagugaccuccugaguug

SEQ ID NO: 1469405 - RNA, 19 nt, Homo sapiens
ggagggacagggauaaaua

SEQ ID NO: 1469406 - RNA, 19 nt, Homo sapiens
cauaugcagucacuucuuu

SEQ ID NO: 1469407 - RNA, 19 nt, Homo sapiens
gaagaaagugguugcauag

SEQ ID NO: 1469408 - RNA, 19 nt, Homo sapiens
ugacaucaaacaaggauua

SEQ ID NO: 1469409 - RNA, 19 nt, Homo sapiens
gcagucacuucuuuguaaa

SEQ ID NO: 1469410 - RNA, 19 nt, Homo sapiens
caaacaaggauuacaguga

SEQ ID NO: 1469411 - RNA, 19 nt, Homo sapiens
ggacuucacucagcagcaa

SEQ ID NO: 1469412 - RNA, 19 nt, Homo sapiens
gaauguagaccagcuuauu

SEQ ID NO: 1469413 - RNA, 19 nt, Homo sapiens
cgacugguguggacuguug

SEQ ID NO: 1469414 - RNA, 19 nt, Homo sapiens
ggagagggacuacguggaa

SEQ ID NO: 1469415 - RNA, 19 nt, Homo sapiens
gaaaguccaaggaaagaug

SEQ ID NO: 1469416 - RNA, 19 nt, Homo sapiens
ccuauugcccugcuacuua

SEQ ID NO: 1469417 - RNA, 19 nt, Homo sapiens
ggauuacagugaaugugaa

SEQ ID NO: 1469418 - RNA, 19 nt, Homo sapiens
ugcagucacuucuuuguaa

SEQ ID NO: 1469419 - RNA, 19 nt, Homo sapiens
ggagaaaguccaaggaaag

SEQ ID NO: 1469420 - RNA, 19 nt, Homo sapiens
aguauuauaugcuccauga

SEQ ID NO: 1469421 - RNA, 19 nt, Homo sapiens
gcauagagaagaguaagaa

SEQ ID NO: 1469422 - RNA, 19 nt, Homo sapiens
gagggacagggauaaauaa

SEQ ID NO: 1469423 - RNA, 19 nt, Homo sapiens
aaauaaaggcaaagacuga

SEQ ID NO: 1469424 - RNA, 19 nt, Homo sapiens
ggugugcgcuguccuacau

SEQ ID NO: 1469425 - RNA, 19 nt, Homo sapiens
cuauugcccugcuacuuaa

SEQ ID NO: 1469426 - RNA, 19 nt, Homo sapiens
gagaaaguccaaggaaaga

SEQ ID NO: 1469427 - RNA, 19 nt, Homo sapiens
gcaaagagaagagcauugg

SEQ ID NO: 1469428 - RNA, 19 nt, Homo sapiens
uagaccagcuuauugaagu

SEQ ID NO: 1469429 - RNA, 19 nt, Homo sapiens
agaaucagggcauaacuaa

SEQ ID NO: 1469430 - RNA, 19 nt, Homo sapiens
gaggagaaaguccaaggaa

SEQ ID NO: 1469431 - RNA, 19 nt, Homo sapiens
gagaagaguaagaauguag

SEQ ID NO: 1469432 - RNA, 19 nt, Homo sapiens
uagagaagaguaagaaugu

SEQ ID NO: 1469433 - RNA, 19 nt, Homo sapiens
uacuagcacuguuaaucua

SEQ ID NO: 1469434 - RNA, 19 nt, Homo sapiens
ucacucagcagcaaagaga

SEQ ID NO: 1469435 - RNA, 19 nt, Homo sapiens
agaaagugguugcauagag

SEQ ID NO: 1469436 - RNA, 19 nt, Homo sapiens
guacuagcacuguuaaucu

SEQ ID NO: 1469437 - RNA, 19 nt, Homo sapiens
gcuggaguguuccggcaaa

SEQ ID NO: 1469438 - RNA, 19 nt, Homo sapiens
aaacaugggaggagaagug

SEQ ID NO: 1469439 - RNA, 19 nt, Homo sapiens
gaaagauggcuggcaguca

SEQ ID NO: 1469440 - RNA, 19 nt, Homo sapiens
aggagaaaguccaaggaaa

SEQ ID NO: 1469441 - RNA, 19 nt, Homo sapiens
agagaagaguaagaaugua

SEQ ID NO: 1469442 - RNA, 19 nt, Homo sapiens
gcacuguuaaucuagaaga

SEQ ID NO: 1469443 - RNA, 19 nt, Homo sapiens
agaagugacuggaaaagaa

SEQ ID NO: 1469444 - RNA, 19 nt, Homo sapiens
cccagaaccucagcuguga

SEQ ID NO: 1469445 - RNA, 19 nt, Homo sapiens
gggcauaacuaagggguaa

SEQ ID NO: 1469446 - RNA, 19 nt, Homo sapiens
uagaaucagggcauaacua

SEQ ID NO: 1469447 - RNA, 19 nt, Homo sapiens
uaaaggcaaagacugaaga

SEQ ID NO: 1469448 - RNA, 19 nt, Homo sapiens
ggauaaauaaaggcaaaga

SEQ ID NO: 1469449 - RNA, 19 nt, Homo sapiens
agggauaaauaaaggcaaa

SEQ ID NO: 1469450 - RNA, 19 nt, Homo sapiens
guggaggagugagauagaa

SEQ ID NO: 1469451 - RNA, 19 nt, Homo sapiens
uaucauaugcagucacuuc

SEQ ID NO: 1469452 - RNA, 19 nt, Homo sapiens
ggaggagaagugacuggaa

SEQ ID NO: 1469453 - RNA, 19 nt, Homo sapiens
ucugggaacuccugacauc

SEQ ID NO: 1469454 - RNA, 19 nt, Homo sapiens
gcucaacauccucagcauu

SEQ ID NO: 1469455 - RNA, 19 nt, Homo sapiens
gguggugacgugacauuga

SEQ ID NO: 1469456 - RNA, 19 nt, Homo sapiens
caacaguggccuuccuauc

SEQ ID NO: 1469457 - RNA, 19 nt, Homo sapiens
uagcacuguuaaucuagaa

SEQ ID NO: 1469458 - RNA, 19 nt, Homo sapiens
caucuguacuagcacuguu

SEQ ID NO: 1469459 - RNA, 19 nt, Homo sapiens
aggcauuucuaugacauuu

SEQ ID NO: 1469460 - RNA, 19 nt, Homo sapiens
gauuacagugaaugugaaa

SEQ ID NO: 1469461 - RNA, 19 nt, Homo sapiens
caaagacugaagacaaaca

SEQ ID NO: 1469462 - RNA, 19 nt, Homo sapiens
aggcaaagacugaagacaa

SEQ ID NO: 1469463 - RNA, 19 nt, Homo sapiens
uauuauaugcuccaugaga

SEQ ID NO: 1469464 - RNA, 19 nt, Homo sapiens
guccuagaaucagggcaua

SEQ ID NO: 1469465 - RNA, 19 nt, Homo sapiens
acaguggccuuccuaucug

SEQ ID NO: 1469466 - RNA, 19 nt, Homo sapiens
aagaauguagaccagcuua

SEQ ID NO: 1469467 - RNA, 19 nt, Homo sapiens
cauuggaugugccuacagu

SEQ ID NO: 1469468 - RNA, 19 nt, Homo sapiens
caacauccucagcauugga

SEQ ID NO: 1469469 - RNA, 19 nt, Homo sapiens
cagcauugccaucauuaca

SEQ ID NO: 1469470 - RNA, 19 nt, Homo sapiens
ugggcuauguggaggcuuu

SEQ ID NO: 1469471 - RNA, 19 nt, Homo sapiens
aauguagaccagcuuauug

SEQ ID NO: 1469472 - RNA, 19 nt, Homo sapiens
aaucagggcauaacuaagg

SEQ ID NO: 1469473 - RNA, 19 nt, Homo sapiens
gguuguggcccuuauacug

SEQ ID NO: 1469474 - RNA, 19 nt, Homo sapiens
caucaaacaaggauuacag

SEQ ID NO: 1469475 - RNA, 19 nt, Homo sapiens
cagcaaagagaagagcauu

SEQ ID NO: 1469476 - RNA, 19 nt, Homo sapiens
ccuggacucuggacacuac

SEQ ID NO: 1469477 - RNA, 19 nt, Homo sapiens
guagaccagcuuauugaag

SEQ ID NO: 1469478 - RNA, 19 nt, Homo sapiens
gucacuucuuuguaaauga

SEQ ID NO: 1469479 - RNA, 19 nt, Homo sapiens
caaggauuacagugaaugu

SEQ ID NO: 1469480 - RNA, 19 nt, Homo sapiens
caggcuggguccuagaauc

SEQ ID NO: 1469481 - RNA, 19 nt, Homo sapiens
cucaacauccucagcauug

SEQ ID NO: 1469482 - RNA, 19 nt, Homo sapiens
gacaaacaugggaggagaa

SEQ ID NO: 1469483 - RNA, 19 nt, Homo sapiens
gguggaggagugagauaga

SEQ ID NO: 1469484 - RNA, 19 nt, Homo sapiens
ggaggguggaggagugaga

SEQ ID NO: 1469485 - RNA, 19 nt, Homo sapiens
uguggcaccuucugacauc

SEQ ID NO: 1469486 - RNA, 19 nt, Homo sapiens
auagagaagaguaagaaug

SEQ ID NO: 1469487 - RNA, 19 nt, Homo sapiens
cugaguacaugaaaagaaa

SEQ ID NO: 1469488 - RNA, 19 nt, Homo sapiens
agucacuucuuuguaaaug

SEQ ID NO: 1469489 - RNA, 19 nt, Homo sapiens
gggcugcauccuaggacua

SEQ ID NO: 1469490 - RNA, 19 nt, Homo sapiens
gggacagggauaaauaaag

SEQ ID NO: 1469491 - RNA, 19 nt, Homo sapiens
gaggagugagauagaacuu

SEQ ID NO: 1469492 - RNA, 19 nt, Homo sapiens
cauccuaggacuaaucauc

SEQ ID NO: 1469493 - RNA, 19 nt, Homo sapiens
gaccuggacucuggacacu

SEQ ID NO: 1469494 - RNA, 19 nt, Homo sapiens
cacuguuaaucuagaagaa

SEQ ID NO: 1469495 - RNA, 19 nt, Homo sapiens
aggauuacagugaauguga

SEQ ID NO: 1469496 - RNA, 19 nt, Homo sapiens
cuaggacuaaucaucauug

SEQ ID NO: 1469497 - RNA, 19 nt, Homo sapiens
gcaaguggcugugcaauau

SEQ ID NO: 1469498 - RNA, 19 nt, Homo sapiens
ucaacaagcucuaugauga

SEQ ID NO: 1469499 - RNA, 19 nt, Homo sapiens
gggaugggcuucagaacua

SEQ ID NO: 1469500 - RNA, 19 nt, Homo sapiens
ggacaagaaggacuuuaua

SEQ ID NO: 1469501 - RNA, 19 nt, Homo sapiens
gaagaaggcagaagugguu

SEQ ID NO: 1469502 - RNA, 19 nt, Homo sapiens
caagaugacucaagugaca

SEQ ID NO: 1469503 - RNA, 19 nt, Homo sapiens
gcgcugaaccugcucaaua

SEQ ID NO: 1469504 - RNA, 19 nt, Homo sapiens
ggcagaagaucuuuaagga

SEQ ID NO: 1469505 - RNA, 19 nt, Homo sapiens
gcaaacaggagccagauga

SEQ ID NO: 1469506 - RNA, 19 nt, Homo sapiens
caagaucugugaggaauau

SEQ ID NO: 1469507 - RNA, 19 nt, Homo sapiens
ggaaaaggcugccaacaau

SEQ ID NO: 1469508 - RNA, 19 nt, Homo sapiens
gcggaagggucgacagaaa

SEQ ID NO: 1469509 - RNA, 19 nt, Homo sapiens
gaaggcagcccacgcucua

SEQ ID NO: 1469510 - RNA, 19 nt, Homo sapiens
ggaagauccugaagguugu

SEQ ID NO: 1469511 - RNA, 19 nt, Homo sapiens
caacucacguaccaucuau

SEQ ID NO: 1469512 - RNA, 19 nt, Homo sapiens
gaaggacuuuauagacaug

SEQ ID NO: 1469513 - RNA, 19 nt, Homo sapiens
guacagaagauguuugaga

SEQ ID NO: 1469514 - RNA, 19 nt, Homo sapiens
ucauuaaaccagugucuua

SEQ ID NO: 1469515 - RNA, 19 nt, Homo sapiens
gugcauggauuaugguuuc

SEQ ID NO: 1469516 - RNA, 19 nt, Homo sapiens
gagagggccuugccagaca

SEQ ID NO: 1469517 - RNA, 19 nt, Homo sapiens
ucaaacagaucuacaagac

SEQ ID NO: 1469518 - RNA, 19 nt, Homo sapiens
ccaucuaugugguggauaa

SEQ ID NO: 1469519 - RNA, 19 nt, Homo sapiens
ggacaucaaggcucuguau

SEQ ID NO: 1469520 - RNA, 19 nt, Homo sapiens
ggucauugccuacaaccua

SEQ ID NO: 1469521 - RNA, 19 nt, Homo sapiens
gauaauggucugaggaaga

SEQ ID NO: 1469522 - RNA, 19 nt, Homo sapiens
agaaggaccugaagcagau

SEQ ID NO: 1469523 - RNA, 19 nt, Homo sapiens
agaacuacauguuugagaa

SEQ ID NO: 1469524 - RNA, 19 nt, Homo sapiens
gaacuaugaggcucuccua

SEQ ID NO: 1469525 - RNA, 19 nt, Homo sapiens
aagaaggacuuuauagaca

SEQ ID NO: 1469526 - RNA, 19 nt, Homo sapiens
agagugagcugcuggagau

SEQ ID NO: 1469527 - RNA, 19 nt, Homo sapiens
gaaggcgggugucaucucu

SEQ ID NO: 1469528 - RNA, 19 nt, Homo sapiens
aaacugugccucaagauga

SEQ ID NO: 1469529 - RNA, 19 nt, Homo sapiens
cgcugaaccugcucaauaa

SEQ ID NO: 1469530 - RNA, 19 nt, Homo sapiens
ucagacagcccgagaaugu

SEQ ID NO: 1469531 - RNA, 19 nt, Homo sapiens
gaaacugugccucaagaug

SEQ ID NO: 1469532 - RNA, 19 nt, Homo sapiens
gacagcagcacacaagaaa

SEQ ID NO: 1469533 - RNA, 19 nt, Homo sapiens
ugaaaggugugauggagau

SEQ ID NO: 1469534 - RNA, 19 nt, Homo sapiens
ugaaccugcucaauaagaa

SEQ ID NO: 1469535 - RNA, 19 nt, Homo sapiens
ucaagugcauggauuaugg

SEQ ID NO: 1469536 - RNA, 19 nt, Homo sapiens
guucuuggcugacgggaau

SEQ ID NO: 1469537 - RNA, 19 nt, Homo sapiens
gcaacauggugcuccacaa

SEQ ID NO: 1469538 - RNA, 19 nt, Homo sapiens
ugccagacaucgagaacua

SEQ ID NO: 1469539 - RNA, 19 nt, Homo sapiens
gacaaacuccggcagaaga

SEQ ID NO: 1469540 - RNA, 19 nt, Homo sapiens
gcuggacgcugaugugaag

SEQ ID NO: 1469541 - RNA, 19 nt, Homo sapiens
augcugagcuggccaagaa

SEQ ID NO: 1469542 - RNA, 19 nt, Homo sapiens
gaacuacauguuugagaau

SEQ ID NO: 1469543 - RNA, 19 nt, Homo sapiens
gaugauaaggugcagaaug

SEQ ID NO: 1469544 - RNA, 19 nt, Homo sapiens
gcggauagaccgaaucugu

SEQ ID NO: 1469545 - RNA, 19 nt, Homo sapiens
uacagaagauguuugagau

SEQ ID NO: 1469546 - RNA, 19 nt, Homo sapiens
caucgagaacuacauguuu

SEQ ID NO: 1469547 - RNA, 19 nt, Homo sapiens
gaucgcugcugucuccaau

SEQ ID NO: 1469548 - RNA, 19 nt, Homo sapiens
ccagagccaucgacaucaa

SEQ ID NO: 1469549 - RNA, 19 nt, Homo sapiens
aagaaacugugccucaaga

SEQ ID NO: 1469550 - RNA, 19 nt, Homo sapiens
ccacaaggagguacaggaa

SEQ ID NO: 1469551 - RNA, 19 nt, Homo sapiens
gcaaagaucgcugcugucu

SEQ ID NO: 1469552 - RNA, 19 nt, Homo sapiens
ggaggaggcccugguucua

SEQ ID NO: 1469553 - RNA, 19 nt, Homo sapiens
gaaggaggaggcccugguu

SEQ ID NO: 1469554 - RNA, 19 nt, Homo sapiens
caagaaggacuuuauagac

SEQ ID NO: 1469555 - RNA, 19 nt, Homo sapiens
acaagaaggacuuuauaga

SEQ ID NO: 1469556 - RNA, 19 nt, Homo sapiens
caacagcuacgaugucaag

SEQ ID NO: 1469557 - RNA, 19 nt, Homo sapiens
caucaccaauggaguguca

SEQ ID NO: 1469558 - RNA, 19 nt, Homo sapiens
gcaagaucugugaggaaua

SEQ ID NO: 1469559 - RNA, 19 nt, Homo sapiens
acaaggagguacaggaaag

SEQ ID NO: 1469560 - RNA, 19 nt, Homo sapiens
cccaggacauggacaagaa

SEQ ID NO: 1469561 - RNA, 19 nt, Homo sapiens
caugacaacucacguacca

SEQ ID NO: 1469562 - RNA, 19 nt, Homo sapiens
ggauagaccgaaucuguag

SEQ ID NO: 1469563 - RNA, 19 nt, Homo sapiens
cauggauuaugguuucauu

SEQ ID NO: 1469564 - RNA, 19 nt, Homo sapiens
gacaagaaggacuuuauag

SEQ ID NO: 1469565 - RNA, 19 nt, Homo sapiens
gaauauaucacgggcaagu

SEQ ID NO: 1469566 - RNA, 19 nt, Homo sapiens
gagugcaguucuccacaga

SEQ ID NO: 1469567 - RNA, 19 nt, Homo sapiens
acaagaaacugugccucaa

SEQ ID NO: 1469568 - RNA, 19 nt, Homo sapiens
ggaaugaccggcugaagcu

SEQ ID NO: 1469569 - RNA, 19 nt, Homo sapiens
ucacugaccagaccaagga

SEQ ID NO: 1469570 - RNA, 19 nt, Homo sapiens
gcagguaccagugacaaga

SEQ ID NO: 1469571 - RNA, 19 nt, Homo sapiens
ccucuauccucaucaacaa

SEQ ID NO: 1469572 - RNA, 19 nt, Homo sapiens
ggaccaggccuucaaagac

SEQ ID NO: 1469573 - RNA, 19 nt, Homo sapiens
ugaaugccauccagacagu

SEQ ID NO: 1469574 - RNA, 19 nt, Homo sapiens
gcaccaacagcuacgaugu

SEQ ID NO: 1469575 - RNA, 19 nt, Homo sapiens
gccaaacagugucgcaagu

SEQ ID NO: 1469576 - RNA, 19 nt, Homo sapiens
gagaacuacauguuugaga

SEQ ID NO: 1469577 - RNA, 19 nt, Homo sapiens
gugacaaacuccggcagaa

SEQ ID NO: 1469578 - RNA, 19 nt, Homo sapiens
gaugaugguggcacuaugu

SEQ ID NO: 1469579 - RNA, 19 nt, Homo sapiens
agaaggacuuuauagacau

SEQ ID NO: 1469580 - RNA, 19 nt, Homo sapiens
gugacaagaccauccugua

SEQ ID NO: 1469581 - RNA, 19 nt, Homo sapiens
ccaagaaggaccugaagca

SEQ ID NO: 1469582 - RNA, 19 nt, Homo sapiens
ggagccagaugagaagaag

SEQ ID NO: 1469583 - RNA, 19 nt, Homo sapiens
agaagcugguggagaguga

SEQ ID NO: 1469584 - RNA, 19 nt, Homo sapiens
ugacagcagcacacaagaa

SEQ ID NO: 1469585 - RNA, 19 nt, Homo sapiens
ggaccgaggcaccauugug

SEQ ID NO: 1469586 - RNA, 19 nt, Homo sapiens
cccugaagcugaccaagga

SEQ ID NO: 1469587 - RNA, 19 nt, Homo sapiens
ucaucaagugcauggauua

SEQ ID NO: 1469588 - RNA, 19 nt, Homo sapiens
gagauccuccagcggcuuu

SEQ ID NO: 1469589 - RNA, 19 nt, Homo sapiens
acaccagcauucaggagaa

SEQ ID NO: 1469590 - RNA, 19 nt, Homo sapiens
cgcgaucacuuccgcaaga

SEQ ID NO: 1469591 - RNA, 19 nt, Homo sapiens
cggauagaccgaaucugua

SEQ ID NO: 1469592 - RNA, 19 nt, Homo sapiens
ggguacagaagauguuuga

SEQ ID NO: 1469593 - RNA, 19 nt, Homo sapiens
ggaugggcuucagaacuau

SEQ ID NO: 1469594 - RNA, 19 nt, Homo sapiens
gagaugaugguggcacuau

SEQ ID NO: 1469595 - RNA, 19 nt, Homo sapiens
cgcaagaucugugaggaau

SEQ ID NO: 1469596 - RNA, 19 nt, Homo sapiens
gaaccugcucaauaagaau

SEQ ID NO: 1469597 - RNA, 19 nt, Homo sapiens
aagcgaggcugaaaucuua

SEQ ID NO: 1469598 - RNA, 19 nt, Homo sapiens
gaggaacgcuugacaaagu

SEQ ID NO: 1469599 - RNA, 19 nt, Homo sapiens
ugaagagguuguccuaauu

SEQ ID NO: 1469600 - RNA, 19 nt, Homo sapiens
ccacuugacugacgggaaa

SEQ ID NO: 1469601 - RNA, 19 nt, Homo sapiens
gaggagauguggucagugu

SEQ ID NO: 1469602 - RNA, 19 nt, Homo sapiens
gcugaaaucuuagaaucaa

SEQ ID NO: 1469603 - RNA, 19 nt, Homo sapiens
gggcugcucuucccacuug

SEQ ID NO: 1469604 - RNA, 19 nt, Homo sapiens
gaaugaagagguuguccua

SEQ ID NO: 1469605 - RNA, 19 nt, Homo sapiens
gaccaagacuacccacaau

SEQ ID NO: 1469606 - RNA, 19 nt, Homo sapiens
gcucaguggucuugacuuc

SEQ ID NO: 1469607 - RNA, 19 nt, Homo sapiens
gaagcgaggcugaaaucuu

SEQ ID NO: 1469608 - RNA, 19 nt, Homo sapiens
gaagagguuguccuaauuc

SEQ ID NO: 1469609 - RNA, 19 nt, Homo sapiens
ggaccaagacuacccacaa

SEQ ID NO: 1469610 - RNA, 19 nt, Homo sapiens
gaauggaagccuugcaugu

SEQ ID NO: 1469611 - RNA, 19 nt, Homo sapiens
gccaugcacuuccggagaa

SEQ ID NO: 1469612 - RNA, 19 nt, Homo sapiens
guaaucaccccucguuuua

SEQ ID NO: 1469613 - RNA, 19 nt, Homo sapiens
ggagaagaccaccgacuca

SEQ ID NO: 1469614 - RNA, 19 nt, Homo sapiens
ggagagaaaccgagagaac

SEQ ID NO: 1469615 - RNA, 19 nt, Homo sapiens
gcucuucccacuugacuga

SEQ ID NO: 1469616 - RNA, 19 nt, Homo sapiens
cagcagaggcauucagguu

SEQ ID NO: 1469617 - RNA, 19 nt, Homo sapiens
cagcuccgauuccgcgaaa

SEQ ID NO: 1469618 - RNA, 19 nt, Homo sapiens
ggagcuggcaggucuacaa

SEQ ID NO: 1469619 - RNA, 19 nt, Homo sapiens
gggacagccuccagguaga

SEQ ID NO: 1469620 - RNA, 19 nt, Homo sapiens
gcccagacgcagcuucuuu

SEQ ID NO: 1469621 - RNA, 19 nt, Homo sapiens
augaagagguuguccuaau

SEQ ID NO: 1469622 - RNA, 19 nt, Homo sapiens
ggacugaagcgaggcugaa

SEQ ID NO: 1469623 - RNA, 19 nt, Homo sapiens
aggcugaaaucuuagaauc

SEQ ID NO: 1469624 - RNA, 19 nt, Homo sapiens
auggaagccuugcauguga

SEQ ID NO: 1469625 - RNA, 19 nt, Homo sapiens
gccggcagauuuaguuaag

SEQ ID NO: 1469626 - RNA, 19 nt, Homo sapiens
cuaaggcacggucaacuau

SEQ ID NO: 1469627 - RNA, 19 nt, Homo sapiens
gcucacgucugcguugaag

SEQ ID NO: 1469628 - RNA, 19 nt, Homo sapiens
ucgaggaacgcuugacaaa

SEQ ID NO: 1469629 - RNA, 19 nt, Homo sapiens
ggaagccuugcaugugauu

SEQ ID NO: 1469630 - RNA, 19 nt, Homo sapiens
ccaagacuacccacaaucu

SEQ ID NO: 1469631 - RNA, 19 nt, Homo sapiens
gggcucacgucugcguuga

SEQ ID NO: 1469632 - RNA, 19 nt, Homo sapiens
caagcguggugucgaccuu

SEQ ID NO: 1469633 - RNA, 19 nt, Homo sapiens
ggucuacaauccgguugga

SEQ ID NO: 1469634 - RNA, 19 nt, Homo sapiens
ggaaucccucucggaguuu

SEQ ID NO: 1469635 - RNA, 19 nt, Homo sapiens
gcuggcaggucuacaaucc

SEQ ID NO: 1469636 - RNA, 19 nt, Homo sapiens
gguaaucaccccucguuuu

SEQ ID NO: 1469637 - RNA, 19 nt, Homo sapiens
aaggcacggucaacuauca

SEQ ID NO: 1469638 - RNA, 19 nt, Homo sapiens
ggaggcaggaggagaugug

SEQ ID NO: 1469639 - RNA, 19 nt, Homo sapiens
gagcuggcaggucuacaau

SEQ ID NO: 1469640 - RNA, 19 nt, Homo sapiens
ugauucagggugccaauga

SEQ ID NO: 1469641 - RNA, 19 nt, Homo sapiens
aaucaccccucguuuuaaa

SEQ ID NO: 1469642 - RNA, 19 nt, Homo sapiens
acuaaggcacggucaacua

SEQ ID NO: 1469643 - RNA, 19 nt, Homo sapiens
ggacuccgggacagcaaau

SEQ ID NO: 1469644 - RNA, 19 nt, Homo sapiens
cagggacagccuccaggua

SEQ ID NO: 1469645 - RNA, 19 nt, Homo sapiens
cggcagauuuaguuaagcu

SEQ ID NO: 1469646 - RNA, 19 nt, Homo sapiens
agaagaccaccgacucaug

SEQ ID NO: 1469647 - RNA, 19 nt, Homo sapiens
gagaagaccaccgacucau

SEQ ID NO: 1469648 - RNA, 19 nt, Homo sapiens
uugacaaaguggcgaagga

SEQ ID NO: 1469649 - RNA, 19 nt, Homo sapiens
gaaucaaccccacggaaug

SEQ ID NO: 1469650 - RNA, 19 nt, Homo sapiens
gcaggacucugaauuucua

SEQ ID NO: 1469651 - RNA, 19 nt, Homo sapiens
caccacaccuggcuaauuu

SEQ ID NO: 1469652 - RNA, 19 nt, Homo sapiens
gaaaggacuucucaguaca

SEQ ID NO: 1469653 - RNA, 19 nt, Homo sapiens
guacuuccuuccacucuuu

SEQ ID NO: 1469654 - RNA, 19 nt, Homo sapiens
cgaaaggacuucucaguac

SEQ ID NO: 1469655 - RNA, 19 nt, Homo sapiens
gauucuggcuucucuuuga

SEQ ID NO: 1469656 - RNA, 19 nt, Homo sapiens
acagagcaauuaucuugua

SEQ ID NO: 1469657 - RNA, 19 nt, Homo sapiens
ccaauaagaucugcucugu

SEQ ID NO: 1469658 - RNA, 19 nt, Homo sapiens
gcagagagugguugccuuu

SEQ ID NO: 1469659 - RNA, 19 nt, Homo sapiens
ccagagacuaucauuauuu

SEQ ID NO: 1469660 - RNA, 19 nt, Homo sapiens
aauaagaucugcucugucu

SEQ ID NO: 1469661 - RNA, 19 nt, Homo sapiens
ggccagcagugaagcagua

SEQ ID NO: 1469662 - RNA, 19 nt, Homo sapiens
uuacagagcaauuaucuug

SEQ ID NO: 1469663 - RNA, 19 nt, Homo sapiens
cagagacuaucauuauuuc

SEQ ID NO: 1469664 - RNA, 19 nt, Homo sapiens
cagcuuagagucugcauuu

SEQ ID NO: 1469665 - RNA, 19 nt, Homo sapiens
gaucuggucugaguuucaa

SEQ ID NO: 1469666 - RNA, 19 nt, Homo sapiens
caccaucuaugcagaagaa

SEQ ID NO: 1469667 - RNA, 19 nt, Homo sapiens
caccagagacuaucauuau

SEQ ID NO: 1469668 - RNA, 19 nt, Homo sapiens
gugguugccuuuccauuug

SEQ ID NO: 1469669 - RNA, 19 nt, Homo sapiens
gcuucagucucccaaauug

SEQ ID NO: 1469670 - RNA, 19 nt, Homo sapiens
gaacuccugaccucaaaug

SEQ ID NO: 1469671 - RNA, 19 nt, Homo sapiens
guuccagccugaccuagaa

SEQ ID NO: 1469672 - RNA, 19 nt, Homo sapiens
gaagaaggccaggagacaa

SEQ ID NO: 1469673 - RNA, 19 nt, Homo sapiens
gaaauuaagaguuguucag

SEQ ID NO: 1469674 - RNA, 19 nt, Homo sapiens
gugcaggacucugaauuuc

SEQ ID NO: 1469675 - RNA, 19 nt, Homo sapiens
cgaugagucuuuacugauc

SEQ ID NO: 1469676 - RNA, 19 nt, Homo sapiens
ggugcaggacucugaauuu

SEQ ID NO: 1469677 - RNA, 19 nt, Homo sapiens
ggagaaaggaagcucaaca

SEQ ID NO: 1469678 - RNA, 19 nt, Homo sapiens
ggaaaucagcggguucgaa

SEQ ID NO: 1469679 - RNA, 19 nt, Homo sapiens
uuggaaagauggaggagaa

SEQ ID NO: 1469680 - RNA, 19 nt, Homo sapiens
guucuccucuugcauguuc

SEQ ID NO: 1469681 - RNA, 19 nt, Homo sapiens
ccgaguagcugggauuaca

SEQ ID NO: 1469682 - RNA, 19 nt, Homo sapiens
gaaaggguuacuugccuau

SEQ ID NO: 1469683 - RNA, 19 nt, Homo sapiens
ucaccagagacuaucauua

SEQ ID NO: 1469684 - RNA, 19 nt, Homo sapiens
uaagaguuguucaguaugc

SEQ ID NO: 1469685 - RNA, 19 nt, Homo sapiens
ccacggagacacagaggaa

SEQ ID NO: 1469686 - RNA, 19 nt, Homo sapiens
ucugguggcuagagagaaa

SEQ ID NO: 1469687 - RNA, 19 nt, Homo sapiens
cagagcaauuaucuuguau

SEQ ID NO: 1469688 - RNA, 19 nt, Homo sapiens
gggauucuggcuucucuuu

SEQ ID NO: 1469689 - RNA, 19 nt, Homo sapiens
caucuaugcagaagaagaa

SEQ ID NO: 1469690 - RNA, 19 nt, Homo sapiens
gccaugccuucuugccuuu

SEQ ID NO: 1469691 - RNA, 19 nt, Homo sapiens
gacugucgcacuugaguuu

SEQ ID NO: 1469692 - RNA, 19 nt, Homo sapiens
ucacaucccugggcagagu

SEQ ID NO: 1469693 - RNA, 19 nt, Homo sapiens
cagcaccgauucccgaaag

SEQ ID NO: 1469694 - RNA, 19 nt, Homo sapiens
acgaaaggacuucucagua

SEQ ID NO: 1469695 - RNA, 19 nt, Homo sapiens
aaaugagccuccugcuuca

SEQ ID NO: 1469696 - RNA, 19 nt, Homo sapiens
gagagugguugccuuucca

SEQ ID NO: 1469697 - RNA, 19 nt, Homo sapiens
caguggaucuggucugagu

SEQ ID NO: 1469698 - RNA, 19 nt, Homo sapiens
cccgaugagucuuuacuga

SEQ ID NO: 1469699 - RNA, 19 nt, Homo sapiens
gaaggccaggagacaauga

SEQ ID NO: 1469700 - RNA, 19 nt, Homo sapiens
ggacucugaauuucuaaca

SEQ ID NO: 1469701 - RNA, 19 nt, Homo sapiens
agacacagaggaacgagaa

SEQ ID NO: 1469702 - RNA, 19 nt, Homo sapiens
gaugagucuuuacugaucu

SEQ ID NO: 1469703 - RNA, 19 nt, Homo sapiens
cacauaauuugccgguguu

SEQ ID NO: 1469704 - RNA, 19 nt, Homo sapiens
ccaccacaccuggcuaauu

SEQ ID NO: 1469705 - RNA, 19 nt, Homo sapiens
gagaaaggaagcucaacag

SEQ ID NO: 1469706 - RNA, 19 nt, Homo sapiens
gacucugaauuucuaacaa

SEQ ID NO: 1469707 - RNA, 19 nt, Homo sapiens
caucccagcccuucaggaa

SEQ ID NO: 1469708 - RNA, 19 nt, Homo sapiens
caaauugccgggauuacag

SEQ ID NO: 1469709 - RNA, 19 nt, Homo sapiens
ucaaaugagccuccugcuu

SEQ ID NO: 1469710 - RNA, 19 nt, Homo sapiens
ugagggaccaccggaagua

SEQ ID NO: 1469711 - RNA, 19 nt, Homo sapiens
gcacuucucuguguuuuac

SEQ ID NO: 1469712 - RNA, 19 nt, Homo sapiens
accagagacuaucauuauu

SEQ ID NO: 1469713 - RNA, 19 nt, Homo sapiens
ccaaauugccgggauuaca

SEQ ID NO: 1469714 - RNA, 19 nt, Homo sapiens
ccuggcguccucagacuua

SEQ ID NO: 1469715 - RNA, 19 nt, Homo sapiens
gagacuaucauuauuucgu

SEQ ID NO: 1469716 - RNA, 19 nt, Homo sapiens
acacagaggagaguaggaa

SEQ ID NO: 1469717 - RNA, 19 nt, Homo sapiens
ggaaguacuggugcaggaa

SEQ ID NO: 1469718 - RNA, 19 nt, Homo sapiens
uaauuugccgguguucuuu

SEQ ID NO: 1469719 - RNA, 19 nt, Homo sapiens
guggaucuggucugaguuu

SEQ ID NO: 1469720 - RNA, 19 nt, Homo sapiens
gcaagacgcuggggaguac

SEQ ID NO: 1469721 - RNA, 19 nt, Homo sapiens
ucacuuuauuccagcacuu

SEQ ID NO: 1469722 - RNA, 19 nt, Homo sapiens
uuccagcacuucucugugu

SEQ ID NO: 1469723 - RNA, 19 nt, Homo sapiens
ggcaugagccacugugucu

SEQ ID NO: 1469724 - RNA, 19 nt, Homo sapiens
cacugugucuggcccuauu

SEQ ID NO: 1469725 - RNA, 19 nt, Homo sapiens
gcacauugcagggauaagc

SEQ ID NO: 1469726 - RNA, 19 nt, Homo sapiens
ccuuaucguuccaucacuu

SEQ ID NO: 1469727 - RNA, 19 nt, Homo sapiens
gaaccucacccugcaagac

SEQ ID NO: 1469728 - RNA, 19 nt, Homo sapiens
ugccucagccucccgagua

SEQ ID NO: 1469729 - RNA, 19 nt, Homo sapiens
caggucaggugcacauugc

SEQ ID NO: 1469730 - RNA, 19 nt, Homo sapiens
gcuuagagucugcauuugg

SEQ ID NO: 1469731 - RNA, 19 nt, Homo sapiens
ggaagggugggauccucuu

SEQ ID NO: 1469732 - RNA, 19 nt, Homo sapiens
ccagcacuucucuguguuu

SEQ ID NO: 1469733 - RNA, 19 nt, Homo sapiens
ggcccuauuuccuuuaaaa

SEQ ID NO: 1469734 - RNA, 19 nt, Homo sapiens
cugcuucagucucccaaau

SEQ ID NO: 1469735 - RNA, 19 nt, Homo sapiens
cuccuggguucaagugauu

SEQ ID NO: 1469736 - RNA, 19 nt, Homo sapiens
cagacaaggcucaguggau

SEQ ID NO: 1469737 - RNA, 19 nt, Homo sapiens
gaccuagaagcguuuguca

SEQ ID NO: 1469738 - RNA, 19 nt, Homo sapiens
cacagaggaacgagaaguu

SEQ ID NO: 1469739 - RNA, 19 nt, Homo sapiens
ggagggcccagaggaaauc

SEQ ID NO: 1469740 - RNA, 19 nt, Homo sapiens
gucuggcccuauuuccuuu

SEQ ID NO: 1469741 - RNA, 19 nt, Homo sapiens
agugguugccuuuccauuu

SEQ ID NO: 1469742 - RNA, 19 nt, Homo sapiens
ggaucuggucugaguuuca

SEQ ID NO: 1469743 - RNA, 19 nt, Homo sapiens
uaucguuccaucacuuuau

SEQ ID NO: 1469744 - RNA, 19 nt, Homo sapiens
gaguuguucaguaugcaaa

SEQ ID NO: 1469745 - RNA, 19 nt, Homo sapiens
aaggguuacuugccuaugg

SEQ ID NO: 1469746 - RNA, 19 nt, Homo sapiens
ugaucucucuguucgucuu

SEQ ID NO: 1469747 - RNA, 19 nt, Homo sapiens
ugacuucuccugggcucua

SEQ ID NO: 1469748 - RNA, 19 nt, Homo sapiens
ggucaggucaggugcacau

SEQ ID NO: 1469749 - RNA, 19 nt, Homo sapiens
ggauucuggcuucucuuug

SEQ ID NO: 1469750 - RNA, 19 nt, Homo sapiens
uaaagaaacuggacaugaa

SEQ ID NO: 1469751 - RNA, 19 nt, Homo sapiens
gaagugauguuuguuacua

SEQ ID NO: 1469752 - RNA, 19 nt, Homo sapiens
acaaugggcuuucuguuua

SEQ ID NO: 1469753 - RNA, 19 nt, Homo sapiens
caacuuagcucucggaaag

SEQ ID NO: 1469754 - RNA, 19 nt, Homo sapiens
ggucagaggagacuauaua

SEQ ID NO: 1469755 - RNA, 19 nt, Homo sapiens
gaauagauuucccuuucuu

SEQ ID NO: 1469756 - RNA, 19 nt, Homo sapiens
gaagauggcggcuaucgaa

SEQ ID NO: 1469757 - RNA, 19 nt, Homo sapiens
ggaauaggaauaucugaaa

SEQ ID NO: 1469758 - RNA, 19 nt, Homo sapiens
auacauauguggaugcuaa

SEQ ID NO: 1469759 - RNA, 19 nt, Homo sapiens
guaaaguacuaccaugcua

SEQ ID NO: 1469760 - RNA, 19 nt, Homo sapiens
gcagaacgccuccaggaaa

SEQ ID NO: 1469761 - RNA, 19 nt, Homo sapiens
ggacaucugguuauaggua

SEQ ID NO: 1469762 - RNA, 19 nt, Homo sapiens
ugacagagcaugacccuuu

SEQ ID NO: 1469763 - RNA, 19 nt, Homo sapiens
gaacggccgugcuuaugug

SEQ ID NO: 1469764 - RNA, 19 nt, Homo sapiens
gauaggaacuacagcagau

SEQ ID NO: 1469765 - RNA, 19 nt, Homo sapiens
gacaaugggcuuucuguuu

SEQ ID NO: 1469766 - RNA, 19 nt, Homo sapiens
uagaugaccuggaaacguu

SEQ ID NO: 1469767 - RNA, 19 nt, Homo sapiens
ggugagaagugauguuugu

SEQ ID NO: 1469768 - RNA, 19 nt, Homo sapiens
caacuugaggcuccuguua

SEQ ID NO: 1469769 - RNA, 19 nt, Homo sapiens
ggauagaugugcuagucuu

SEQ ID NO: 1469770 - RNA, 19 nt, Homo sapiens
cgugggagcucuuuguaaa

SEQ ID NO: 1469771 - RNA, 19 nt, Homo sapiens
uuagagaccugcagcuuug

SEQ ID NO: 1469772 - RNA, 19 nt, Homo sapiens
cuccagaucuuugcuguua

SEQ ID NO: 1469773 - RNA, 19 nt, Homo sapiens
cagaggagacuauauauuc

SEQ ID NO: 1469774 - RNA, 19 nt, Homo sapiens
gcucacgccuguaaucuca

SEQ ID NO: 1469775 - RNA, 19 nt, Homo sapiens
ucgaguauauacaggaaua

SEQ ID NO: 1469776 - RNA, 19 nt, Homo sapiens
guuaagcuaucuucuuuca

SEQ ID NO: 1469777 - RNA, 19 nt, Homo sapiens
ggaggaguaucucauugug

SEQ ID NO: 1469778 - RNA, 19 nt, Homo sapiens
gcaaggaugagcugacuau

SEQ ID NO: 1469779 - RNA, 19 nt, Homo sapiens
caacccagcccgagucaaa

SEQ ID NO: 1469780 - RNA, 19 nt, Homo sapiens
ggaaacguuugccuaucaa

SEQ ID NO: 1469781 - RNA, 19 nt, Homo sapiens
gaagcagaaagaacugaua

SEQ ID NO: 1469782 - RNA, 19 nt, Homo sapiens
gaggacaucugguuauagg

SEQ ID NO: 1469783 - RNA, 19 nt, Homo sapiens
gagaagugauguuuguuac

SEQ ID NO: 1469784 - RNA, 19 nt, Homo sapiens
gcccucacguccuagguua

SEQ ID NO: 1469785 - RNA, 19 nt, Homo sapiens
ccaaaugagugcaaagucu

SEQ ID NO: 1469786 - RNA, 19 nt, Homo sapiens
cagaggaugugaagaaagu

SEQ ID NO: 1469787 - RNA, 19 nt, Homo sapiens
uauuuggucuucaguguuu

SEQ ID NO: 1469788 - RNA, 19 nt, Homo sapiens
ugagaagugauguuuguua

SEQ ID NO: 1469789 - RNA, 19 nt, Homo sapiens
ggugaguacuguucuagga

SEQ ID NO: 1469790 - RNA, 19 nt, Homo sapiens
cugcagcuuugguuuauaa

SEQ ID NO: 1469791 - RNA, 19 nt, Homo sapiens
caaaauguaucacuccaaa

SEQ ID NO: 1469792 - RNA, 19 nt, Homo sapiens
ccagggaugagccuuguua

SEQ ID NO: 1469793 - RNA, 19 nt, Homo sapiens
ggacaugaaucugaaugag

SEQ ID NO: 1469794 - RNA, 19 nt, Homo sapiens
ccagcaacauguuacuuau

SEQ ID NO: 1469795 - RNA, 19 nt, Homo sapiens
uaagcuaucuucuuucacu

SEQ ID NO: 1469796 - RNA, 19 nt, Homo sapiens
gcaguaagccaagaucaug

SEQ ID NO: 1469797 - RNA, 19 nt, Homo sapiens
gcacacacaggcuuugaga

SEQ ID NO: 1469798 - RNA, 19 nt, Homo sapiens
cagcuuugguuuauaagug

SEQ ID NO: 1469799 - RNA, 19 nt, Homo sapiens
gaccugcagcuuugguuua

SEQ ID NO: 1469800 - RNA, 19 nt, Homo sapiens
gcuaucuucuuucacuuga

SEQ ID NO: 1469801 - RNA, 19 nt, Homo sapiens
aaacaaaggcagaggaugu

SEQ ID NO: 1469802 - RNA, 19 nt, Homo sapiens
gauccgagaccuugagaug

SEQ ID NO: 1469803 - RNA, 19 nt, Homo sapiens
aaacuggacaugaaucuga

SEQ ID NO: 1469804 - RNA, 19 nt, Homo sapiens
gguuauagguacuguagca

SEQ ID NO: 1469805 - RNA, 19 nt, Homo sapiens
cuacccaagucgaguauau

SEQ ID NO: 1469806 - RNA, 19 nt, Homo sapiens
gguaaccacaggucgauuu

SEQ ID NO: 1469807 - RNA, 19 nt, Homo sapiens
gagccuguauuaaaggaau

SEQ ID NO: 1469808 - RNA, 19 nt, Homo sapiens
gggugaaccucaucugcaa

SEQ ID NO: 1469809 - RNA, 19 nt, Homo sapiens
uaaaguacuaccaugcuaa

SEQ ID NO: 1469810 - RNA, 19 nt, Homo sapiens
gacagcgggugaucauaga

SEQ ID NO: 1469811 - RNA, 19 nt, Homo sapiens
uggaaacguuugccuauca

SEQ ID NO: 1469812 - RNA, 19 nt, Homo sapiens
aggaguaucucauugugaa

SEQ ID NO: 1469813 - RNA, 19 nt, Homo sapiens
uggaggacaucugguuaua

SEQ ID NO: 1469814 - RNA, 19 nt, Homo sapiens
gaauacaaaucgguaacca

SEQ ID NO: 1469815 - RNA, 19 nt, Homo sapiens
gaaaccccaucucuacuaa

SEQ ID NO: 1469816 - RNA, 19 nt, Homo sapiens
ccuguaaucucagcacauu

SEQ ID NO: 1469817 - RNA, 19 nt, Homo sapiens
gaaaccccaucucuacuaa

SEQ ID NO: 1469818 - RNA, 19 nt, Homo sapiens
guacuaccaugcuaagaac

SEQ ID NO: 1469819 - RNA, 19 nt, Homo sapiens
gcuguuagccaguuugguu

SEQ ID NO: 1469820 - RNA, 19 nt, Homo sapiens
caaugggcuuucuguuuau

SEQ ID NO: 1469821 - RNA, 19 nt, Homo sapiens
ugacaagguaguccucuuu

SEQ ID NO: 1469822 - RNA, 19 nt, Homo sapiens
gcuugagccuguauuaaag

SEQ ID NO: 1469823 - RNA, 19 nt, Homo sapiens
ggcagaggaugugaagaaa

SEQ ID NO: 1469824 - RNA, 19 nt, Homo sapiens
gggaugagccuuguuaugg

SEQ ID NO: 1469825 - RNA, 19 nt, Homo sapiens
aaagggagaagcagaaaga

SEQ ID NO: 1469826 - RNA, 19 nt, Homo sapiens
gcagaaagaacugauacug

SEQ ID NO: 1469827 - RNA, 19 nt, Homo sapiens
augaauagauuucccuuuc

SEQ ID NO: 1469828 - RNA, 19 nt, Homo sapiens
ugaaugaggacaucaguuc

SEQ ID NO: 1469829 - RNA, 19 nt, Homo sapiens
gguagugcaugccuguaau

SEQ ID NO: 1469830 - RNA, 19 nt, Homo sapiens
gaagguuguacccacagua

SEQ ID NO: 1469831 - RNA, 19 nt, Homo sapiens
gaucacaaggucaggaguu

SEQ ID NO: 1469832 - RNA, 19 nt, Homo sapiens
gcuaagaacggccgugcuu

SEQ ID NO: 1469833 - RNA, 19 nt, Homo sapiens
ggaccagagugagcaggaa

SEQ ID NO: 1469834 - RNA, 19 nt, Homo sapiens
gaaagacagcgggugauca

SEQ ID NO: 1469835 - RNA, 19 nt, Homo sapiens
gcagugcagacucagaauu

SEQ ID NO: 1469836 - RNA, 19 nt, Homo sapiens
uccgagaccuugagauguu

SEQ ID NO: 1469837 - RNA, 19 nt, Homo sapiens
gauguuuguuacuauguuc

SEQ ID NO: 1469838 - RNA, 19 nt, Homo sapiens
ugaggcuccuguuaguuaa

SEQ ID NO: 1469839 - RNA, 19 nt, Homo sapiens
gcaggagaauggcgugaac

SEQ ID NO: 1469840 - RNA, 19 nt, Homo sapiens
ucaagacccagcuagauga

SEQ ID NO: 1469841 - RNA, 19 nt, Homo sapiens
aaaucuuccugacaaggua

SEQ ID NO: 1469842 - RNA, 19 nt, Homo sapiens
uugaggcuccuguuaguua

SEQ ID NO: 1469843 - RNA, 19 nt, Homo sapiens
ugaagcagcuagccaugag

SEQ ID NO: 1469844 - RNA, 19 nt, Homo sapiens
ggacagagugaagcagcua

SEQ ID NO: 1469845 - RNA, 19 nt, Homo sapiens
ugagauguuuaucaacuuc

SEQ ID NO: 1469846 - RNA, 19 nt, Homo sapiens
ggaaaaugauacauaugug

SEQ ID NO: 1469847 - RNA, 19 nt, Homo sapiens
ucagcagccucaaguuuag

SEQ ID NO: 1469848 - RNA, 19 nt, Homo sapiens
gcacagacaaugggcuuuc

SEQ ID NO: 1469849 - RNA, 19 nt, Homo sapiens
caagagggcaguuaugacu

SEQ ID NO: 1469850 - RNA, 19 nt, Homo sapiens
ggaaagagcuggccgacuu

SEQ ID NO: 1469851 - RNA, 19 nt, Homo sapiens
gaauuagcaucaaaucuug

SEQ ID NO: 1469852 - RNA, 19 nt, Homo sapiens
gaaacuaccuucuccuucu

SEQ ID NO: 1469853 - RNA, 19 nt, Homo sapiens
ggaaacagggagcaaauaa

SEQ ID NO: 1469854 - RNA, 19 nt, Homo sapiens
uaacugacaucacagcaaa

SEQ ID NO: 1469855 - RNA, 19 nt, Homo sapiens
gcucaaaggcuuacaugua

SEQ ID NO: 1469856 - RNA, 19 nt, Homo sapiens
ucaagaagcuccgagauga

SEQ ID NO: 1469857 - RNA, 19 nt, Homo sapiens
caaauaaacagaccaagaa

SEQ ID NO: 1469858 - RNA, 19 nt, Homo sapiens
uaacaaggaccugaucuua

SEQ ID NO: 1469859 - RNA, 19 nt, Homo sapiens
ggacuucuauauugucuuc

SEQ ID NO: 1469860 - RNA, 19 nt, Homo sapiens
ggaaauggccagugcaguu

SEQ ID NO: 1469861 - RNA, 19 nt, Homo sapiens
gcaaauaaacagaccaaga

SEQ ID NO: 1469862 - RNA, 19 nt, Homo sapiens
acaaggaccugaucuuaga

SEQ ID NO: 1469863 - RNA, 19 nt, Homo sapiens
ccaccuaccuuuggcauuu

SEQ ID NO: 1469864 - RNA, 19 nt, Homo sapiens
ccacucagacacuuauuua

SEQ ID NO: 1469865 - RNA, 19 nt, Homo sapiens
caaagacaguccacucaga

SEQ ID NO: 1469866 - RNA, 19 nt, Homo sapiens
ggaaccaucuucaacaaag

SEQ ID NO: 1469867 - RNA, 19 nt, Homo sapiens
ccaaggaacgggauuauga

SEQ ID NO: 1469868 - RNA, 19 nt, Homo sapiens
auaaagaacgccagaauuu

SEQ ID NO: 1469869 - RNA, 19 nt, Homo sapiens
gauaaagaacgccagaauu

SEQ ID NO: 1469870 - RNA, 19 nt, Homo sapiens
gaaacagggagcaaauaaa

SEQ ID NO: 1469871 - RNA, 19 nt, Homo sapiens
gcuaagcagugaaagugaa

SEQ ID NO: 1469872 - RNA, 19 nt, Homo sapiens
gcagggaauuauuugauag

SEQ ID NO: 1469873 - RNA, 19 nt, Homo sapiens
gcagugaaagugaagauga

SEQ ID NO: 1469874 - RNA, 19 nt, Homo sapiens
guaaguuucugacccacaa

SEQ ID NO: 1469875 - RNA, 19 nt, Homo sapiens
ggaaagcacccugagaaga

SEQ ID NO: 1469876 - RNA, 19 nt, Homo sapiens
gaaguugcagggaauuauu

SEQ ID NO: 1469877 - RNA, 19 nt, Homo sapiens
cagcauaggguccauggua

SEQ ID NO: 1469878 - RNA, 19 nt, Homo sapiens
gaauuugcucgcagacaua

SEQ ID NO: 1469879 - RNA, 19 nt, Homo sapiens
gagccugacuguaaugaag

SEQ ID NO: 1469880 - RNA, 19 nt, Homo sapiens
gaaauggccagugcaguug

SEQ ID NO: 1469881 - RNA, 19 nt, Homo sapiens
ucagaauccuccaagaaga

SEQ ID NO: 1469882 - RNA, 19 nt, Homo sapiens
ccaaagaucccugaaguuc

SEQ ID NO: 1469883 - RNA, 19 nt, Homo sapiens
gaaggugcaucaugugacu

SEQ ID NO: 1469884 - RNA, 19 nt, Homo sapiens
gaaagggaagagaagauug

SEQ ID NO: 1469885 - RNA, 19 nt, Homo sapiens
uaugcggacuucuauauug

SEQ ID NO: 1469886 - RNA, 19 nt, Homo sapiens
ggauaaagaacgccagaau

SEQ ID NO: 1469887 - RNA, 19 nt, Homo sapiens
gaaagcacccugagaagac

SEQ ID NO: 1469888 - RNA, 19 nt, Homo sapiens
caauaaagcauuuguacca

SEQ ID NO: 1469889 - RNA, 19 nt, Homo sapiens
gcucagaauccuccaagaa

SEQ ID NO: 1469890 - RNA, 19 nt, Homo sapiens
ggaaacgcuucagggcuuu

SEQ ID NO: 1469891 - RNA, 19 nt, Homo sapiens
gaaggaaagcacccugaga

SEQ ID NO: 1469892 - RNA, 19 nt, Homo sapiens
gggagaaguugcagggaau

SEQ ID NO: 1469893 - RNA, 19 nt, Homo sapiens
gaaguuccccuccaugaua

SEQ ID NO: 1469894 - RNA, 19 nt, Homo sapiens
aagugaagaugaagaagaa

SEQ ID NO: 1469895 - RNA, 19 nt, Homo sapiens
aaacacagccagucagguu

SEQ ID NO: 1469896 - RNA, 19 nt, Homo sapiens
caucucauuguguguauua

SEQ ID NO: 1469897 - RNA, 19 nt, Homo sapiens
gaagacaggaaagaaagaa

SEQ ID NO: 1469898 - RNA, 19 nt, Homo sapiens
aaacacaaaggaacaaaga

SEQ ID NO: 1469899 - RNA, 19 nt, Homo sapiens
gauuguggaucaggagaaa

SEQ ID NO: 1469900 - RNA, 19 nt, Homo sapiens
ugcagggaauuauuugaua

SEQ ID NO: 1469901 - RNA, 19 nt, Homo sapiens
ggcagagacugaaauacug

SEQ ID NO: 1469902 - RNA, 19 nt, Homo sapiens
gagaaguugcagggaauua

SEQ ID NO: 1469903 - RNA, 19 nt, Homo sapiens
ggaacgggauuaugaugac

SEQ ID NO: 1469904 - RNA, 19 nt, Homo sapiens
uaaagaacgccagaauuug

SEQ ID NO: 1469905 - RNA, 19 nt, Homo sapiens
acagccacaucucucuuua

SEQ ID NO: 1469906 - RNA, 19 nt, Homo sapiens
gaaccgagucagccuggaa

SEQ ID NO: 1469907 - RNA, 19 nt, Homo sapiens
gagaagacaggaaagaaag

SEQ ID NO: 1469908 - RNA, 19 nt, Homo sapiens
ugagaagacaggaaagaaa

SEQ ID NO: 1469909 - RNA, 19 nt, Homo sapiens
agauagugcugacugauuc

SEQ ID NO: 1469910 - RNA, 19 nt, Homo sapiens
gaacuauccaggcguaucu

SEQ ID NO: 1469911 - RNA, 19 nt, Homo sapiens
ggagugccgcugugugauu

SEQ ID NO: 1469912 - RNA, 19 nt, Homo sapiens
caaaacaaauucugacauc

SEQ ID NO: 1469913 - RNA, 19 nt, Homo sapiens
gagaggagugcagcagaua

SEQ ID NO: 1469914 - RNA, 19 nt, Homo sapiens
gacucuagcuccccaguua

SEQ ID NO: 1469915 - RNA, 19 nt, Homo sapiens
cagugaaagugaagaugaa

SEQ ID NO: 1469916 - RNA, 19 nt, Homo sapiens
gggaaacagggagcaaaua

SEQ ID NO: 1469917 - RNA, 19 nt, Homo sapiens
acauuugccuuucugaaga

SEQ ID NO: 1469918 - RNA, 19 nt, Homo sapiens
ugaaagugaagaugaagaa

SEQ ID NO: 1469919 - RNA, 19 nt, Homo sapiens
gggcagagacugaaauacu

SEQ ID NO: 1469920 - RNA, 19 nt, Homo sapiens
uaggugaggcccagucuuu

SEQ ID NO: 1469921 - RNA, 19 nt, Homo sapiens
caacauuugccuuucugaa

SEQ ID NO: 1469922 - RNA, 19 nt, Homo sapiens
gagcaaauaaacagaccaa

SEQ ID NO: 1469923 - RNA, 19 nt, Homo sapiens
gagcagcagcuuggcagua

SEQ ID NO: 1469924 - RNA, 19 nt, Homo sapiens
gagugccgcugugugauug

SEQ ID NO: 1469925 - RNA, 19 nt, Homo sapiens
gaggccagaggaaugcuua

SEQ ID NO: 1469926 - RNA, 19 nt, Homo sapiens
agagaagauuguagugguu

SEQ ID NO: 1469927 - RNA, 19 nt, Homo sapiens
caccuaccuuuggcauuua

SEQ ID NO: 1469928 - RNA, 19 nt, Homo sapiens
ucuugggucuuauuauuug

SEQ ID NO: 1469929 - RNA, 19 nt, Homo sapiens
aaggaaccaucuucaacaa

SEQ ID NO: 1469930 - RNA, 19 nt, Homo sapiens
aaaccaagccgagucagaa

SEQ ID NO: 1469931 - RNA, 19 nt, Homo sapiens
ucacaugcgcauucacaaa

SEQ ID NO: 1469932 - RNA, 19 nt, Homo sapiens
acugauggcucuaaagaag

SEQ ID NO: 1469933 - RNA, 19 nt, Homo sapiens
gggaagagaagauuguagu

SEQ ID NO: 1469934 - RNA, 19 nt, Homo sapiens
ggcagcaccuccuggaaca

SEQ ID NO: 1469935 - RNA, 19 nt, Homo sapiens
agccacaucucucuuuaga

SEQ ID NO: 1469936 - RNA, 19 nt, Homo sapiens
aggcguaucuaccuucaga

SEQ ID NO: 1469937 - RNA, 19 nt, Homo sapiens
agaauuugcucgcagacau

SEQ ID NO: 1469938 - RNA, 19 nt, Homo sapiens
ggaagagaagauuguagug

SEQ ID NO: 1469939 - RNA, 19 nt, Homo sapiens
gaaagagcuggccgacuuc

SEQ ID NO: 1469940 - RNA, 19 nt, Homo sapiens
gaggaaugcuuaaaacaca

SEQ ID NO: 1469941 - RNA, 19 nt, Homo sapiens
caagcaaggcagaaggaaa

SEQ ID NO: 1469942 - RNA, 19 nt, Homo sapiens
gcaguaaccaaaacaaauu

SEQ ID NO: 1469943 - RNA, 19 nt, Homo sapiens
gugaagaugaagaagaauu

SEQ ID NO: 1469944 - RNA, 19 nt, Homo sapiens
gcugaaacugucacacaaa

SEQ ID NO: 1469945 - RNA, 19 nt, Homo sapiens
ugacuaugcggacuucuau

SEQ ID NO: 1469946 - RNA, 19 nt, Homo sapiens
gaaggugugacauccacuu

SEQ ID NO: 1469947 - RNA, 19 nt, Homo sapiens
caagaagcuccgagaugaa

SEQ ID NO: 1469948 - RNA, 19 nt, Homo sapiens
cgacuucacaugcgcauuc

SEQ ID NO: 1469949 - RNA, 19 nt, Homo sapiens
aaacagggagcaaauaaac

SEQ ID NO: 1469950 - RNA, 19 nt, Homo sapiens
gaucagagacaucaaauaa

SEQ ID NO: 1469951 - RNA, 19 nt, Homo sapiens
gaugauagagucuguauaa

SEQ ID NO: 1469952 - RNA, 19 nt, Homo sapiens
gaaagggauuccaaacuau

SEQ ID NO: 1469953 - RNA, 19 nt, Homo sapiens
gaaagcaagugagaucauu

SEQ ID NO: 1469954 - RNA, 19 nt, Homo sapiens
agaaagggauuccaaacua

SEQ ID NO: 1469955 - RNA, 19 nt, Homo sapiens
ucagagacaucaaauaaga

SEQ ID NO: 1469956 - RNA, 19 nt, Homo sapiens
gccaauauaucuucacaga

SEQ ID NO: 1469957 - RNA, 19 nt, Homo sapiens
caaagacgccuauguuguu

SEQ ID NO: 1469958 - RNA, 19 nt, Homo sapiens
agauacagcuggccaauga

SEQ ID NO: 1469959 - RNA, 19 nt, Homo sapiens
guaucaggcuuaguuauuu

SEQ ID NO: 1469960 - RNA, 19 nt, Homo sapiens
caacgucacuugucaggau

SEQ ID NO: 1469961 - RNA, 19 nt, Homo sapiens
guucugaagucuuguaaug

SEQ ID NO: 1469962 - RNA, 19 nt, Homo sapiens
aagaggagcugaucagaga

SEQ ID NO: 1469963 - RNA, 19 nt, Homo sapiens
guccauauguacaaacuaa

SEQ ID NO: 1469964 - RNA, 19 nt, Homo sapiens
gcccuaaucuucugugaau

SEQ ID NO: 1469965 - RNA, 19 nt, Homo sapiens
gaacuggucuuggucuauc

SEQ ID NO: 1469966 - RNA, 19 nt, Homo sapiens
gauuaguggugugaugaua

SEQ ID NO: 1469967 - RNA, 19 nt, Homo sapiens
agagaaagauggguugcua

SEQ ID NO: 1469968 - RNA, 19 nt, Homo sapiens
ggugcuagcugcauugauc

SEQ ID NO: 1469969 - RNA, 19 nt, Homo sapiens
gguaucaggcuuaguuauu

SEQ ID NO: 1469970 - RNA, 19 nt, Homo sapiens
uaagacagacucauagaga

SEQ ID NO: 1469971 - RNA, 19 nt, Homo sapiens
gcagaccuguaauugaguu

SEQ ID NO: 1469972 - RNA, 19 nt, Homo sapiens
guauucagcuccaguuagu

SEQ ID NO: 1469973 - RNA, 19 nt, Homo sapiens
uaugguccuucuucuguua

SEQ ID NO: 1469974 - RNA, 19 nt, Homo sapiens
gaacuuguccauauguaca

SEQ ID NO: 1469975 - RNA, 19 nt, Homo sapiens
gccuugaacuuguccauau

SEQ ID NO: 1469976 - RNA, 19 nt, Homo sapiens
agaaggcagugaaaucuau

SEQ ID NO: 1469977 - RNA, 19 nt, Homo sapiens
gaaaaggguaucaggcuua

SEQ ID NO: 1469978 - RNA, 19 nt, Homo sapiens
ucugaagucuuguaauguu

SEQ ID NO: 1469979 - RNA, 19 nt, Homo sapiens
gacagacucauagagauua

SEQ ID NO: 1469980 - RNA, 19 nt, Homo sapiens
uggagaagauuaagauaca

SEQ ID NO: 1469981 - RNA, 19 nt, Homo sapiens
aagauaagacagacucaua

SEQ ID NO: 1469982 - RNA, 19 nt, Homo sapiens
ucaucaccaucuucaauuu

SEQ ID NO: 1469983 - RNA, 19 nt, Homo sapiens
gauaagacagacucauaga

SEQ ID NO: 1469984 - RNA, 19 nt, Homo sapiens
guucagaagccuccaagaa

SEQ ID NO: 1469985 - RNA, 19 nt, Homo sapiens
gaucugcaccagcaucuga

SEQ ID NO: 1469986 - RNA, 19 nt, Homo sapiens
gagagaaagggauuccaaa

SEQ ID NO: 1469987 - RNA, 19 nt, Homo sapiens
ccagcuuucuccauacauu

SEQ ID NO: 1469988 - RNA, 19 nt, Homo sapiens
ccuaaucuucugugaauuu

SEQ ID NO: 1469989 - RNA, 19 nt, Homo sapiens
ccaaagacgccuauguugu

SEQ ID NO: 1469990 - RNA, 19 nt, Homo sapiens
gcaccagcaucugagagaa

SEQ ID NO: 1469991 - RNA, 19 nt, Homo sapiens
gagcauuggaggagauuga

SEQ ID NO: 1469992 - RNA, 19 nt, Homo sapiens
aaagggauuccaaacuaua

SEQ ID NO: 1469993 - RNA, 19 nt, Homo sapiens
gcuagaggaugguagaacu

SEQ ID NO: 1469994 - RNA, 19 nt, Homo sapiens
aaacuaaucaccagcuuuc

SEQ ID NO: 1469995 - RNA, 19 nt, Homo sapiens
ggucaucaccaucuucaau

SEQ ID NO: 1469996 - RNA, 19 nt, Homo sapiens
gauauggcguccucuuugc

SEQ ID NO: 1469997 - RNA, 19 nt, Homo sapiens
ggaggagauugagauaaca

SEQ ID NO: 1469998 - RNA, 19 nt, Homo sapiens
ucuguuaaauggagccaaa

SEQ ID NO: 1469999 - RNA, 19 nt, Homo sapiens
gagaaagggauuccaaacu

SEQ ID NO: 1470000 - RNA, 19 nt, Homo sapiens
ucagaagccuccaagaaaa

SEQ ID NO: 1470001 - RNA, 19 nt, Homo sapiens
cauacugccuugaacuugu

SEQ ID NO: 1470002 - RNA, 19 nt, Homo sapiens
cgucugcacuuaccuugga

SEQ ID NO: 1470003 - RNA, 19 nt, Homo sapiens
gccaaagacgccuauguug

SEQ ID NO: 1470004 - RNA, 19 nt, Homo sapiens
gauuaaaugaucacuaugg

SEQ ID NO: 1470005 - RNA, 19 nt, Homo sapiens
caaacuaaucaccagcuuu

SEQ ID NO: 1470006 - RNA, 19 nt, Homo sapiens
uuuauuguaugcaggguaa

SEQ ID NO: 1470007 - RNA, 19 nt, Homo sapiens
cuucuccaguucauucuaa

SEQ ID NO: 1470008 - RNA, 19 nt, Homo sapiens
gagcccuaaucuucuguga

SEQ ID NO: 1470009 - RNA, 19 nt, Homo sapiens
ggaaagcaagugagaucau

SEQ ID NO: 1470010 - RNA, 19 nt, Homo sapiens
uuaguggugugaugauaga

SEQ ID NO: 1470011 - RNA, 19 nt, Homo sapiens
ucugagaacuuagauuagu

SEQ ID NO: 1470012 - RNA, 19 nt, Homo sapiens
cugaagucuuguaauguuu

SEQ ID NO: 1470013 - RNA, 19 nt, Homo sapiens
gcaaaaggaaaugguguua

SEQ ID NO: 1470014 - RNA, 19 nt, Homo sapiens
gcacaagggcggugauagc

SEQ ID NO: 1470015 - RNA, 19 nt, Homo sapiens
ccaucugccuucuccaguu

SEQ ID NO: 1470016 - RNA, 19 nt, Homo sapiens
gcaagugagaucauugaag

SEQ ID NO: 1470017 - RNA, 19 nt, Homo sapiens
agacagacucauagagauu

SEQ ID NO: 1470018 - RNA, 19 nt, Homo sapiens
uggaggagauugagauaac

SEQ ID NO: 1470019 - RNA, 19 nt, Homo sapiens
ccacggaacccagaacuag

SEQ ID NO: 1470020 - RNA, 19 nt, Homo sapiens
gaggaugguagaacuggaa

SEQ ID NO: 1470021 - RNA, 19 nt, Homo sapiens
uaaugcagaccuguaauug

SEQ ID NO: 1470022 - RNA, 19 nt, Homo sapiens
caucugccuucuccaguuc

SEQ ID NO: 1470023 - RNA, 19 nt, Homo sapiens
caucaucaagucuagagaa

SEQ ID NO: 1470024 - RNA, 19 nt, Homo sapiens
uaacuggugcuucaucauc

SEQ ID NO: 1470025 - RNA, 19 nt, Homo sapiens
gagucuguauaacgcauug

SEQ ID NO: 1470026 - RNA, 19 nt, Homo sapiens
gagccaaagacgccuaugu

SEQ ID NO: 1470027 - RNA, 19 nt, Homo sapiens
acagacucauagagauuaa

SEQ ID NO: 1470028 - RNA, 19 nt, Homo sapiens
uagauauggcguccucuuu

SEQ ID NO: 1470029 - RNA, 19 nt, Homo sapiens
gggcuucaggcuccaauug

SEQ ID NO: 1470030 - RNA, 19 nt, Homo sapiens
ggccaaugaggaauauaaa

SEQ ID NO: 1470031 - RNA, 19 nt, Homo sapiens
uuagauuaguggugugaug

SEQ ID NO: 1470032 - RNA, 19 nt, Homo sapiens
gagauugagauaacacauc

SEQ ID NO: 1470033 - RNA, 19 nt, Homo sapiens
aaagacgccuauguuguuc

SEQ ID NO: 1470034 - RNA, 19 nt, Homo sapiens
caaacuauaccuccaugag

SEQ ID NO: 1470035 - RNA, 19 nt, Homo sapiens
caucugagagaaagggauu

SEQ ID NO: 1470036 - RNA, 19 nt, Homo sapiens
agaaagauggguugcuaga

SEQ ID NO: 1470037 - RNA, 19 nt, Homo sapiens
uucagaagccuccaagaaa

SEQ ID NO: 1470038 - RNA, 19 nt, Homo sapiens
uuaaugcagaccuguaauu

SEQ ID NO: 1470039 - RNA, 19 nt, Homo sapiens
gcuggagaagauuaagaua

SEQ ID NO: 1470040 - RNA, 19 nt, Homo sapiens
ggaaggcgagcugggagaa

SEQ ID NO: 1470041 - RNA, 19 nt, Homo sapiens
ucacuaugguccuucuucu

SEQ ID NO: 1470042 - RNA, 19 nt, Homo sapiens
aagacagacucauagagau

SEQ ID NO: 1470043 - RNA, 19 nt, Homo sapiens
caguaccucuuccugaauc

SEQ ID NO: 1470044 - RNA, 19 nt, Homo sapiens
gcuggccaaugaggaauau

SEQ ID NO: 1470045 - RNA, 19 nt, Homo sapiens
cgagcugggagaacuguaa

SEQ ID NO: 1470046 - RNA, 19 nt, Homo sapiens
gaagauaagacagacucau

SEQ ID NO: 1470047 - RNA, 19 nt, Homo sapiens
augcagaccuguaauugag

SEQ ID NO: 1470048 - RNA, 19 nt, Homo sapiens
ugagagaaagggauuccaa

SEQ ID NO: 1470049 - RNA, 19 nt, Homo sapiens
uggccaaugaggaauauaa

SEQ ID NO: 1470050 - RNA, 19 nt, Homo sapiens
ggacgacgcucacaauuga

SEQ ID NO: 1470051 - RNA, 19 nt, Homo sapiens
gcagcaaggugaucaagaa

SEQ ID NO: 1470052 - RNA, 19 nt, Homo sapiens
gcaaggagccugacaagug

SEQ ID NO: 1470053 - RNA, 19 nt, Homo sapiens
ucaagaagguaaagaagaa

SEQ ID NO: 1470054 - RNA, 19 nt, Homo sapiens
caagacagcuggccaggau

SEQ ID NO: 1470055 - RNA, 19 nt, Homo sapiens
gacgugagccgaucauuaa

SEQ ID NO: 1470056 - RNA, 19 nt, Homo sapiens
gcacugggcacaucaucua

SEQ ID NO: 1470057 - RNA, 19 nt, Homo sapiens
gcaaggugaucaagaaggu

SEQ ID NO: 1470058 - RNA, 19 nt, Homo sapiens
gaaaagcccgguuaaauug

SEQ ID NO: 1470059 - RNA, 19 nt, Homo sapiens
gaaagauggacuaaggaaa

SEQ ID NO: 1470060 - RNA, 19 nt, Homo sapiens
gaacacaguccaggccaaa

SEQ ID NO: 1470061 - RNA, 19 nt, Homo sapiens
agaaaggccaguugacuaa

SEQ ID NO: 1470062 - RNA, 19 nt, Homo sapiens
ucacaagccaggaagguaa

SEQ ID NO: 1470063 - RNA, 19 nt, Homo sapiens
agacgugagccgaucauua

SEQ ID NO: 1470064 - RNA, 19 nt, Homo sapiens
ccaguugacuaagaagaaa

SEQ ID NO: 1470065 - RNA, 19 nt, Homo sapiens
ccaggaagguaaacaagag

SEQ ID NO: 1470066 - RNA, 19 nt, Homo sapiens
aggaggagauggaugagaa

SEQ ID NO: 1470067 - RNA, 19 nt, Homo sapiens
gucaaccacugcaacugua

SEQ ID NO: 1470068 - RNA, 19 nt, Homo sapiens
ggaagguaaacaagagaaa

SEQ ID NO: 1470069 - RNA, 19 nt, Homo sapiens
gcacaucaucuacccuuuc

SEQ ID NO: 1470070 - RNA, 19 nt, Homo sapiens
aaaggccaguugacuaaga

SEQ ID NO: 1470071 - RNA, 19 nt, Homo sapiens
acaaggaggagauggauga

SEQ ID NO: 1470072 - RNA, 19 nt, Homo sapiens
gaaggcaaagcugaagaaa

SEQ ID NO: 1470073 - RNA, 19 nt, Homo sapiens
aagaaaggccaguugacua

SEQ ID NO: 1470074 - RNA, 19 nt, Homo sapiens
ccacagcgcccaucaccau

SEQ ID NO: 1470075 - RNA, 19 nt, Homo sapiens
uaaaugaagaagaggaaga

SEQ ID NO: 1470076 - RNA, 19 nt, Homo sapiens
gaaagacaaggaggagaug

SEQ ID NO: 1470077 - RNA, 19 nt, Homo sapiens
gaucaagaagguaaagaag

SEQ ID NO: 1470078 - RNA, 19 nt, Homo sapiens
gauccaccauccacucuac

SEQ ID NO: 1470079 - RNA, 19 nt, Homo sapiens
guggagcgauuccgguaug

SEQ ID NO: 1470080 - RNA, 19 nt, Homo sapiens
cacugcaacuguaauucua

SEQ ID NO: 1470081 - RNA, 19 nt, Homo sapiens
gagcgaggacaguuacaau

SEQ ID NO: 1470082 - RNA, 19 nt, Homo sapiens
ccaaccugcucccauguca

SEQ ID NO: 1470083 - RNA, 19 nt, Homo sapiens
guaauucuaggcugaagga

SEQ ID NO: 1470084 - RNA, 19 nt, Homo sapiens
ugaaagauggacuaaggaa

SEQ ID NO: 1470085 - RNA, 19 nt, Homo sapiens
gaagaaaagcccgguuaaa

SEQ ID NO: 1470086 - RNA, 19 nt, Homo sapiens
gguuggacuucacgcaaga

SEQ ID NO: 1470087 - RNA, 19 nt, Homo sapiens
ggaagaggaggaggaggaa

SEQ ID NO: 1470088 - RNA, 19 nt, Homo sapiens
ggaagagagagaacacagu

SEQ ID NO: 1470089 - RNA, 19 nt, Homo sapiens
uggucagggugcagaauaa

SEQ ID NO: 1470090 - RNA, 19 nt, Homo sapiens
gccaagaaaggccaguuga

SEQ ID NO: 1470091 - RNA, 19 nt, Homo sapiens
gagaaggcaaagcugaaga

SEQ ID NO: 1470092 - RNA, 19 nt, Homo sapiens
gcaccuacacucugucaac

SEQ ID NO: 1470093 - RNA, 19 nt, Homo sapiens
agaaaagcccgguuaaauu

SEQ ID NO: 1470094 - RNA, 19 nt, Homo sapiens
gccaguugacuaagaagaa

SEQ ID NO: 1470095 - RNA, 19 nt, Homo sapiens
caagaaaggccaguugacu

SEQ ID NO: 1470096 - RNA, 19 nt, Homo sapiens
ucagggugcagaauaaaug

SEQ ID NO: 1470097 - RNA, 19 nt, Homo sapiens
guggucagggugcagaaua

SEQ ID NO: 1470098 - RNA, 19 nt, Homo sapiens
gcgaggacaguuacaaugg

SEQ ID NO: 1470099 - RNA, 19 nt, Homo sapiens
ggagagcgaggacaguuac

SEQ ID NO: 1470100 - RNA, 19 nt, Homo sapiens
ugaucuaaaugaagaagag

SEQ ID NO: 1470101 - RNA, 19 nt, Homo sapiens
aaagcccgguuaaauugga

SEQ ID NO: 1470102 - RNA, 19 nt, Homo sapiens
auugaaagauggacuaagg

SEQ ID NO: 1470103 - RNA, 19 nt, Homo sapiens
caagaagguaaagaagaaa

SEQ ID NO: 1470104 - RNA, 19 nt, Homo sapiens
ugaucaagaagguaaagaa

SEQ ID NO: 1470105 - RNA, 19 nt, Homo sapiens
acaauugaaagauggacua

SEQ ID NO: 1470106 - RNA, 19 nt, Homo sapiens
caauugaaagauggacuaa

SEQ ID NO: 1470107 - RNA, 19 nt, Homo sapiens
ggcacaucaucuacccuuu

SEQ ID NO: 1470108 - RNA, 19 nt, Homo sapiens
aaagauggacuaaggaaaa

SEQ ID NO: 1470109 - RNA, 19 nt, Homo sapiens
gccaggaagguaaacaaga

SEQ ID NO: 1470110 - RNA, 19 nt, Homo sapiens
ggauauuguggaaucauca

SEQ ID NO: 1470111 - RNA, 19 nt, Homo sapiens
ccacugcaacuguaauucu

SEQ ID NO: 1470112 - RNA, 19 nt, Homo sapiens
ggucagggugcagaauaaa

SEQ ID NO: 1470113 - RNA, 19 nt, Homo sapiens
agaaagacaaggaggagau

SEQ ID NO: 1470114 - RNA, 19 nt, Homo sapiens
gaagaggaggaggaggaaa

SEQ ID NO: 1470115 - RNA, 19 nt, Homo sapiens
caucaucgcccaggaagag

SEQ ID NO: 1470116 - RNA, 19 nt, Homo sapiens
gaucauuaagcgcaagaca

SEQ ID NO: 1470117 - RNA, 19 nt, Homo sapiens
aaggccaguugacuaagaa

SEQ ID NO: 1470118 - RNA, 19 nt, Homo sapiens
agaaggcaaagcugaagaa

SEQ ID NO: 1470119 - RNA, 19 nt, Homo sapiens
ggaagggucagggcagcaa

SEQ ID NO: 1470120 - RNA, 19 nt, Homo sapiens
gaagguaaacaagagaaaa

SEQ ID NO: 1470121 - RNA, 19 nt, Homo sapiens
uggagagcgaggacaguua

SEQ ID NO: 1470122 - RNA, 19 nt, Homo sapiens
ucaggacgacgcucacaau

SEQ ID NO: 1470123 - RNA, 19 nt, Homo sapiens
gcucaggguuggacuucac

SEQ ID NO: 1470124 - RNA, 19 nt, Homo sapiens
accauccacucuaccauga

SEQ ID NO: 1470125 - RNA, 19 nt, Homo sapiens
caggacgacgcucacaauu

SEQ ID NO: 1470126 - RNA, 19 nt, Homo sapiens
aaggugaucaagaagguaa

SEQ ID NO: 1470127 - RNA, 19 nt, Homo sapiens
cgguauggcuggugcaaaa

SEQ ID NO: 1470128 - RNA, 19 nt, Homo sapiens
aggagcauguggagcgauu

SEQ ID NO: 1470129 - RNA, 19 nt, Homo sapiens
gcagaauaaaugccaucga

SEQ ID NO: 1470130 - RNA, 19 nt, Homo sapiens
gaaaggccaguugacuaag

SEQ ID NO: 1470131 - RNA, 19 nt, Homo sapiens
acgcaagaguccuguagag

SEQ ID NO: 1470132 - RNA, 19 nt, Homo sapiens
gccacagccugcaccuaca

SEQ ID NO: 1470133 - RNA, 19 nt, Homo sapiens
ucaaccacugcaacuguaa

SEQ ID NO: 1470134 - RNA, 19 nt, Homo sapiens
ccucagagcucaccagauu

SEQ ID NO: 1470135 - RNA, 19 nt, Homo sapiens
acacuaagcuggcuaaugu

SEQ ID NO: 1470136 - RNA, 19 nt, Homo sapiens
gggcauaugcugacacuaa

SEQ ID NO: 1470137 - RNA, 19 nt, Homo sapiens
uuagugaacugaucccuuu

SEQ ID NO: 1470138 - RNA, 19 nt, Homo sapiens
cugccaacauugagaauua

SEQ ID NO: 1470139 - RNA, 19 nt, Homo sapiens
gcagggaguuugcaaugug

SEQ ID NO: 1470140 - RNA, 19 nt, Homo sapiens
gcaaccgucuagcuaggua

SEQ ID NO: 1470141 - RNA, 19 nt, Homo sapiens
gugaugcacugccaacauu

SEQ ID NO: 1470142 - RNA, 19 nt, Homo sapiens
gaauucaggcuaaaguuga

SEQ ID NO: 1470143 - RNA, 19 nt, Homo sapiens
ccagauuugucuaagauga

SEQ ID NO: 1470144 - RNA, 19 nt, Homo sapiens
cuagcuagguaguuaaauu

SEQ ID NO: 1470145 - RNA, 19 nt, Homo sapiens
gcgcuuacgugcuugucua

SEQ ID NO: 1470146 - RNA, 19 nt, Homo sapiens
uaagaugggugcugagaag

SEQ ID NO: 1470147 - RNA, 19 nt, Homo sapiens
gagaauuagugaacugauc

SEQ ID NO: 1470148 - RNA, 19 nt, Homo sapiens
gccaugcccuggacacuga

SEQ ID NO: 1470149 - RNA, 19 nt, Homo sapiens
gaugggugcugagaaguga

SEQ ID NO: 1470150 - RNA, 19 nt, Homo sapiens
gagcagaggcagggaguuu

SEQ ID NO: 1470151 - RNA, 19 nt, Homo sapiens
acacugugcuucucggaaa

SEQ ID NO: 1470152 - RNA, 19 nt, Homo sapiens
ugaccuccgugguuacuuu

SEQ ID NO: 1470153 - RNA, 19 nt, Homo sapiens
gaaggaauaaugggugauu

SEQ ID NO: 1470154 - RNA, 19 nt, Homo sapiens
ccacuggcgucaccugcua

SEQ ID NO: 1470155 - RNA, 19 nt, Homo sapiens
gaucuugaccuccgugguu

SEQ ID NO: 1470156 - RNA, 19 nt, Homo sapiens
uaagaugacgcaccgaauu

SEQ ID NO: 1470157 - RNA, 19 nt, Homo sapiens
caacauugagaauuaguga

SEQ ID NO: 1470158 - RNA, 19 nt, Homo sapiens
gcugggcgcuuacgugcuu

SEQ ID NO: 1470159 - RNA, 19 nt, Homo sapiens
gcaccgaauucaggcuaaa

SEQ ID NO: 1470160 - RNA, 19 nt, Homo sapiens
caccagauuugucuaagau

SEQ ID NO: 1470161 - RNA, 19 nt, Homo sapiens
ccacaguuucucaaccuua

SEQ ID NO: 1470162 - RNA, 19 nt, Homo sapiens
uaagcuggcuaauguacug

SEQ ID NO: 1470163 - RNA, 19 nt, Homo sapiens
gcacugccaacauugagaa

SEQ ID NO: 1470164 - RNA, 19 nt, Homo sapiens
ucucggaaauuuggaugua

SEQ ID NO: 1470165 - RNA, 19 nt, Homo sapiens
ucaccagauuugucuaaga

SEQ ID NO: 1470166 - RNA, 19 nt, Homo sapiens
ccuggacacugacggguuu

SEQ ID NO: 1470167 - RNA, 19 nt, Homo sapiens
ccgucuagcuagguaguua

SEQ ID NO: 1470168 - RNA, 19 nt, Homo sapiens
gcucaccagauuugucuaa

SEQ ID NO: 1470169 - RNA, 19 nt, Homo sapiens
ccacaaugccgguaucagu

SEQ ID NO: 1470170 - RNA, 19 nt, Homo sapiens
cgaauucaggcuaaaguug

SEQ ID NO: 1470171 - RNA, 19 nt, Homo sapiens
gcuggcuaauguacuguuu

SEQ ID NO: 1470172 - RNA, 19 nt, Homo sapiens
ggacucgccuagggucuca

SEQ ID NO: 1470173 - RNA, 19 nt, Homo sapiens
cuuacgugcuugucuacua

SEQ ID NO: 1470174 - RNA, 19 nt, Homo sapiens
ucagagcucaccagauuug

SEQ ID NO: 1470175 - RNA, 19 nt, Homo sapiens
ggagauauuuugccaacug

SEQ ID NO: 1470176 - RNA, 19 nt, Homo sapiens
ggauggcugcgcccacuuu

SEQ ID NO: 1470177 - RNA, 19 nt, Homo sapiens
ccauaucggucccuuucug

SEQ ID NO: 1470178 - RNA, 19 nt, Homo sapiens
cagggaguuugcaauguga

SEQ ID NO: 1470179 - RNA, 19 nt, Homo sapiens
ggacauccucauccacaau

SEQ ID NO: 1470180 - RNA, 19 nt, Homo sapiens
caacugccauguggaagag

SEQ ID NO: 1470181 - RNA, 19 nt, Homo sapiens
caacagcggcaucggaaag

SEQ ID NO: 1470182 - RNA, 19 nt, Homo sapiens
gaaccauaucggucccuuu

SEQ ID NO: 1470183 - RNA, 19 nt, Homo sapiens
ccacccuuauugauucuga

SEQ ID NO: 1470184 - RNA, 19 nt, Homo sapiens
ggcauaugcugacacuaag

SEQ ID NO: 1470185 - RNA, 19 nt, Homo sapiens
ugacggguuugugaucuug

SEQ ID NO: 1470186 - RNA, 19 nt, Homo sapiens
gagcucaccagauuugucu

SEQ ID NO: 1470187 - RNA, 19 nt, Homo sapiens
guaagaugggugcugagaa

SEQ ID NO: 1470188 - RNA, 19 nt, Homo sapiens
gaugcacugccaacauuga

SEQ ID NO: 1470189 - RNA, 19 nt, Homo sapiens
aaugggugauuauuucuuc

SEQ ID NO: 1470190 - RNA, 19 nt, Homo sapiens
gacacugacggguuuguga

SEQ ID NO: 1470191 - RNA, 19 nt, Homo sapiens
ggacccgugaggcguuuaa

SEQ ID NO: 1470192 - RNA, 19 nt, Homo sapiens
gggcuggggucaucuguau

SEQ ID NO: 1470193 - RNA, 19 nt, Homo sapiens
ggcagggaguuugcaaugu

SEQ ID NO: 1470194 - RNA, 19 nt, Homo sapiens
ggaaauuuggauguaguau

SEQ ID NO: 1470195 - RNA, 19 nt, Homo sapiens
gguugcugcugggcgcuua

SEQ ID NO: 1470196 - RNA, 19 nt, Homo sapiens
cacaaugccgguaucaguu

SEQ ID NO: 1470197 - RNA, 19 nt, Homo sapiens
ccaggagagugggaacaau

SEQ ID NO: 1470198 - RNA, 19 nt, Homo sapiens
ccaacugccauguggaaga

SEQ ID NO: 1470199 - RNA, 19 nt, Homo sapiens
gcugcugccuugccugaag

SEQ ID NO: 1470200 - RNA, 19 nt, Homo sapiens
caggagagugggaacaaug

SEQ ID NO: 1470201 - RNA, 19 nt, Homo sapiens
gcuagacacugugcuucuc

SEQ ID NO: 1470202 - RNA, 19 nt, Homo sapiens
gcugugcccuggacaucuc

SEQ ID NO: 1470203 - RNA, 19 nt, Homo sapiens
ccugaggagcccacaguuu

SEQ ID NO: 1470204 - RNA, 19 nt, Homo sapiens
cuucauggccuuggacuug

SEQ ID NO: 1470205 - RNA, 19 nt, Homo sapiens
cugaggagcccacaguuuc

SEQ ID NO: 1470206 - RNA, 19 nt, Homo sapiens
gacauccucauccacaaug

SEQ ID NO: 1470207 - RNA, 19 nt, Homo sapiens
gacacuaagcuggcuaaug

SEQ ID NO: 1470208 - RNA, 19 nt, Homo sapiens
ggccuuugccacugccuuu

SEQ ID NO: 1470209 - RNA, 19 nt, Homo sapiens
uaaaguugagccugagauc

SEQ ID NO: 1470210 - RNA, 19 nt, Homo sapiens
agccucagcugcccacugu

SEQ ID NO: 1470211 - RNA, 19 nt, Homo sapiens
uuacgugcuugucuacuac

SEQ ID NO: 1470212 - RNA, 19 nt, Homo sapiens
gugaacugaucccuuugca

SEQ ID NO: 1470213 - RNA, 19 nt, Homo sapiens
gcccacaguuucucaaccu

SEQ ID NO: 1470214 - RNA, 19 nt, Homo sapiens
aggagggccugggaucuga

SEQ ID NO: 1470215 - RNA, 19 nt, Homo sapiens
cggaaauuuggauguagua

SEQ ID NO: 1470216 - RNA, 19 nt, Homo sapiens
ucggaaauuuggauguagu

SEQ ID NO: 1470217 - RNA, 19 nt, Homo sapiens
cacaguuucucaaccuuac

SEQ ID NO: 1470218 - RNA, 19 nt, Homo sapiens
ggggucaucuguaucugaa

SEQ ID NO: 1470219 - RNA, 19 nt, Homo sapiens
ggacacugacggguuugug

SEQ ID NO: 1470220 - RNA, 19 nt, Homo sapiens
aagaugacgcaccgaauuc

SEQ ID NO: 1470221 - RNA, 19 nt, Homo sapiens
gcgggcauaugcugacacu

SEQ ID NO: 1470222 - RNA, 19 nt, Homo sapiens
gcagaacuguauagauuua

SEQ ID NO: 1470223 - RNA, 19 nt, Homo sapiens
caaacgagcuggguaagua

SEQ ID NO: 1470224 - RNA, 19 nt, Homo sapiens
gaucuacccuugaugcuaa

SEQ ID NO: 1470225 - RNA, 19 nt, Homo sapiens
uagacaagcuccugcauuu

SEQ ID NO: 1470226 - RNA, 19 nt, Homo sapiens
caguaaagcuguaugaaau

SEQ ID NO: 1470227 - RNA, 19 nt, Homo sapiens
uaucagggcucacauacuu

SEQ ID NO: 1470228 - RNA, 19 nt, Homo sapiens
gcauuacacugagaaguuu

SEQ ID NO: 1470229 - RNA, 19 nt, Homo sapiens
ggucucagcuguucuguag

SEQ ID NO: 1470230 - RNA, 19 nt, Homo sapiens
gcagcccacuccuguuuaa

SEQ ID NO: 1470231 - RNA, 19 nt, Homo sapiens
uugcagaacuguauagauu

SEQ ID NO: 1470232 - RNA, 19 nt, Homo sapiens
ggaaucugcugaagaccaa

SEQ ID NO: 1470233 - RNA, 19 nt, Homo sapiens
ccaucaaauuguucacuua

SEQ ID NO: 1470234 - RNA, 19 nt, Homo sapiens
caaauacaggucuggguua

SEQ ID NO: 1470235 - RNA, 19 nt, Homo sapiens
gaaguuuucuccuauuuug

SEQ ID NO: 1470236 - RNA, 19 nt, Homo sapiens
uguaguagcuauuagacaa

SEQ ID NO: 1470237 - RNA, 19 nt, Homo sapiens
ccacuccuguuuaagagaa

SEQ ID NO: 1470238 - RNA, 19 nt, Homo sapiens
gcugcuccauucccaagua

SEQ ID NO: 1470239 - RNA, 19 nt, Homo sapiens
ucaguaaagcuguaugaaa

SEQ ID NO: 1470240 - RNA, 19 nt, Homo sapiens
cauagguuaucccucagua

SEQ ID NO: 1470241 - RNA, 19 nt, Homo sapiens
ugacaaacgagcuggguaa

SEQ ID NO: 1470242 - RNA, 19 nt, Homo sapiens
uaggaaccaucaaauuguu

SEQ ID NO: 1470243 - RNA, 19 nt, Homo sapiens
cuguauagauuuacuagga

SEQ ID NO: 1470244 - RNA, 19 nt, Homo sapiens
gaaagagccacagcacaga

SEQ ID NO: 1470245 - RNA, 19 nt, Homo sapiens
aagaguagcaucucgguuu

SEQ ID NO: 1470246 - RNA, 19 nt, Homo sapiens
auacaggucuggguuauca

SEQ ID NO: 1470247 - RNA, 19 nt, Homo sapiens
aagguguccugauguagua

SEQ ID NO: 1470248 - RNA, 19 nt, Homo sapiens
gaggagcauuacacugaga

SEQ ID NO: 1470249 - RNA, 19 nt, Homo sapiens
gaaggaaugaggagaggau

SEQ ID NO: 1470250 - RNA, 19 nt, Homo sapiens
gcauuuggccaguaauuag

SEQ ID NO: 1470251 - RNA, 19 nt, Homo sapiens
gagaagaggaagaguagca

SEQ ID NO: 1470252 - RNA, 19 nt, Homo sapiens
caaagaaggagggaaggaa

SEQ ID NO: 1470253 - RNA, 19 nt, Homo sapiens
ccaaguaacccacaugcau

SEQ ID NO: 1470254 - RNA, 19 nt, Homo sapiens
gcguccagcuucugcuuga

SEQ ID NO: 1470255 - RNA, 19 nt, Homo sapiens
cccaagccauggcaaagaa

SEQ ID NO: 1470256 - RNA, 19 nt, Homo sapiens
uagguuaucccucaguaaa

SEQ ID NO: 1470257 - RNA, 19 nt, Homo sapiens
ucaggugacucccaagaag

SEQ ID NO: 1470258 - RNA, 19 nt, Homo sapiens
uccaagguguccugaugua

SEQ ID NO: 1470259 - RNA, 19 nt, Homo sapiens
ggacgaaccgcuggaguag

SEQ ID NO: 1470260 - RNA, 19 nt, Homo sapiens
aaauacaggucuggguuau

SEQ ID NO: 1470261 - RNA, 19 nt, Homo sapiens
gacaagcuccugcauuugg

SEQ ID NO: 1470262 - RNA, 19 nt, Homo sapiens
cugaggagcauuacacuga

SEQ ID NO: 1470263 - RNA, 19 nt, Homo sapiens
auggguaaauuguacagua

SEQ ID NO: 1470264 - RNA, 19 nt, Homo sapiens
acuaggaaccaucaaauug

SEQ ID NO: 1470265 - RNA, 19 nt, Homo sapiens
gcaaagaaggagggaagga

SEQ ID NO: 1470266 - RNA, 19 nt, Homo sapiens
gcuucugcuugaauacuuu

SEQ ID NO: 1470267 - RNA, 19 nt, Homo sapiens
ggaucuacccuugaugcua

SEQ ID NO: 1470268 - RNA, 19 nt, Homo sapiens
aagcagcccacuccuguuu

SEQ ID NO: 1470269 - RNA, 19 nt, Homo sapiens
gcuguucuguaggcacuuu

SEQ ID NO: 1470270 - RNA, 19 nt, Homo sapiens
ggaaggccaagcagcaugu

SEQ ID NO: 1470271 - RNA, 19 nt, Homo sapiens
ggagcucaguaucucaaag

SEQ ID NO: 1470272 - RNA, 19 nt, Homo sapiens
uagcaucucgguuuuaaua

SEQ ID NO: 1470273 - RNA, 19 nt, Homo sapiens
guaggcacuuugagaagag

SEQ ID NO: 1470274 - RNA, 19 nt, Homo sapiens
gguuaucagggcucacaua

SEQ ID NO: 1470275 - RNA, 19 nt, Homo sapiens
cuuccaagguguccugaug

SEQ ID NO: 1470276 - RNA, 19 nt, Homo sapiens
ccugauguaguagcuauua

SEQ ID NO: 1470277 - RNA, 19 nt, Homo sapiens
uguaggcacuuugagaaga

SEQ ID NO: 1470278 - RNA, 19 nt, Homo sapiens
cuaggaaccaucaaauugu

SEQ ID NO: 1470279 - RNA, 19 nt, Homo sapiens
gacccugucucaaaacaaa

SEQ ID NO: 1470280 - RNA, 19 nt, Homo sapiens
guccugauguaguagcuau

SEQ ID NO: 1470281 - RNA, 19 nt, Homo sapiens
caagguguccugauguagu

SEQ ID NO: 1470282 - RNA, 19 nt, Homo sapiens
uccagcuucugcuugaaua

SEQ ID NO: 1470283 - RNA, 19 nt, Homo sapiens
uggacgaaccgcuggagua

SEQ ID NO: 1470284 - RNA, 19 nt, Homo sapiens
gcaugcugcugcacauugc

SEQ ID NO: 1470285 - RNA, 19 nt, Homo sapiens
gcccacuccuguuuaagag

SEQ ID NO: 1470286 - RNA, 19 nt, Homo sapiens
acgaaccgcuggaguaggu

SEQ ID NO: 1470287 - RNA, 19 nt, Homo sapiens
uaaguaggucucagcuguu

SEQ ID NO: 1470288 - RNA, 19 nt, Homo sapiens
agucaugguugcagaacug

SEQ ID NO: 1470289 - RNA, 19 nt, Homo sapiens
gggcucacauacuucuaag

SEQ ID NO: 1470290 - RNA, 19 nt, Homo sapiens
uuacuaggaaccaucaaau

SEQ ID NO: 1470291 - RNA, 19 nt, Homo sapiens
caugguugcagaacuguau

SEQ ID NO: 1470292 - RNA, 19 nt, Homo sapiens
caucaggugacucccaaga

SEQ ID NO: 1470293 - RNA, 19 nt, Homo sapiens
ccucaguaaagcuguauga

SEQ ID NO: 1470294 - RNA, 19 nt, Homo sapiens
gguuaucccucaguaaagc

SEQ ID NO: 1470295 - RNA, 19 nt, Homo sapiens
cuuggaaucugcugaagac

SEQ ID NO: 1470296 - RNA, 19 nt, Homo sapiens
ugauguaguagcuauuaga

SEQ ID NO: 1470297 - RNA, 19 nt, Homo sapiens
uuagacaagcuccugcauu

SEQ ID NO: 1470298 - RNA, 19 nt, Homo sapiens
cugcuccauucccaaguaa

SEQ ID NO: 1470299 - RNA, 19 nt, Homo sapiens
uacuaggaaccaucaaauu

SEQ ID NO: 1470300 - RNA, 19 nt, Homo sapiens
gauuuacuaggaaccauca

SEQ ID NO: 1470301 - RNA, 19 nt, Homo sapiens
gaccuggaucuacccuuga

SEQ ID NO: 1470302 - RNA, 19 nt, Homo sapiens
ugcauuuggccaguaauua

SEQ ID NO: 1470303 - RNA, 19 nt, Homo sapiens
gagggaaggaagcaaaggu

SEQ ID NO: 1470304 - RNA, 19 nt, Homo sapiens
aaguaggucucagcuguuc

SEQ ID NO: 1470305 - RNA, 19 nt, Homo sapiens
caugggaagcccucucuag

SEQ ID NO: 1470306 - RNA, 19 nt, Homo sapiens
caucaaauuguucacuuac

SEQ ID NO: 1470307 - RNA, 19 nt, Homo sapiens
acacccuacugccuuggaa

SEQ ID NO: 1470308 - RNA, 19 nt, Homo sapiens
guacgagccucuucauuua

SEQ ID NO: 1470309 - RNA, 19 nt, Homo sapiens
gaauaggcgugauugcuua

SEQ ID NO: 1470310 - RNA, 19 nt, Homo sapiens
gcaaaccagucaucauuaa

SEQ ID NO: 1470311 - RNA, 19 nt, Homo sapiens
gaaagucucggcagaauuu

SEQ ID NO: 1470312 - RNA, 19 nt, Homo sapiens
uaaaguggauuucucauga

SEQ ID NO: 1470313 - RNA, 19 nt, Homo sapiens
ucacugaacuuaaggauau

SEQ ID NO: 1470314 - RNA, 19 nt, Homo sapiens
ggacaacuucccaggauua

SEQ ID NO: 1470315 - RNA, 19 nt, Homo sapiens
cuacauaugugguggguuu

SEQ ID NO: 1470316 - RNA, 19 nt, Homo sapiens
gagcugugcuuggauaauu

SEQ ID NO: 1470317 - RNA, 19 nt, Homo sapiens
caacaucccuggcauuucu

SEQ ID NO: 1470318 - RNA, 19 nt, Homo sapiens
gcagaaggccuacauguuc

SEQ ID NO: 1470319 - RNA, 19 nt, Homo sapiens
gaacuuaaggauaucauug

SEQ ID NO: 1470320 - RNA, 19 nt, Homo sapiens
gaauguuacuugugaggaa

SEQ ID NO: 1470321 - RNA, 19 nt, Homo sapiens
ucaauaguguuaagcguuu

SEQ ID NO: 1470322 - RNA, 19 nt, Homo sapiens
ggaagaugcuguauuugag

SEQ ID NO: 1470323 - RNA, 19 nt, Homo sapiens
gaacaacacugaaaagaag

SEQ ID NO: 1470324 - RNA, 19 nt, Homo sapiens
gaaaggcuauguguauauc

SEQ ID NO: 1470325 - RNA, 19 nt, Homo sapiens
gcagacagaugggugaaug

SEQ ID NO: 1470326 - RNA, 19 nt, Homo sapiens
gcagaccaguuuaacauca

SEQ ID NO: 1470327 - RNA, 19 nt, Homo sapiens
ugacaguccucggcaauuu

SEQ ID NO: 1470328 - RNA, 19 nt, Homo sapiens
ucagagcugugcuuggaua

SEQ ID NO: 1470329 - RNA, 19 nt, Homo sapiens
aaacacugcugaacguuau

SEQ ID NO: 1470330 - RNA, 19 nt, Homo sapiens
ggaaacgagugccuguuca

SEQ ID NO: 1470331 - RNA, 19 nt, Homo sapiens
gaacagaggagugaugcaa

SEQ ID NO: 1470332 - RNA, 19 nt, Homo sapiens
uguaugaccucaacaugaa

SEQ ID NO: 1470333 - RNA, 19 nt, Homo sapiens
ggaauaggcgugauugcuu

SEQ ID NO: 1470334 - RNA, 19 nt, Homo sapiens
cauaagaacauccucugua

SEQ ID NO: 1470335 - RNA, 19 nt, Homo sapiens
gauuagcacugcgagauga

SEQ ID NO: 1470336 - RNA, 19 nt, Homo sapiens
gggugaauguuacuuguga

SEQ ID NO: 1470337 - RNA, 19 nt, Homo sapiens
aagaugagcucaaugucaa

SEQ ID NO: 1470338 - RNA, 19 nt, Homo sapiens
gcacaacuuugaggagaug

SEQ ID NO: 1470339 - RNA, 19 nt, Homo sapiens
ggugguggaugaccucuug

SEQ ID NO: 1470340 - RNA, 19 nt, Homo sapiens
gggaaggucuacauaugug

SEQ ID NO: 1470341 - RNA, 19 nt, Homo sapiens
acaaguggcuggaacaaca

SEQ ID NO: 1470342 - RNA, 19 nt, Homo sapiens
uagcugcaguuccuacuuu

SEQ ID NO: 1470343 - RNA, 19 nt, Homo sapiens
guggguggcuuuaaugguu

SEQ ID NO: 1470344 - RNA, 19 nt, Homo sapiens
gcaagcgccacaacacuuu

SEQ ID NO: 1470345 - RNA, 19 nt, Homo sapiens
uaaacacugcugaacguua

SEQ ID NO: 1470346 - RNA, 19 nt, Homo sapiens
uaagaugaaugacuauguc

SEQ ID NO: 1470347 - RNA, 19 nt, Homo sapiens
aagcagcacauuucaauuu

SEQ ID NO: 1470348 - RNA, 19 nt, Homo sapiens
ugagugcgauggccuguga

SEQ ID NO: 1470349 - RNA, 19 nt, Homo sapiens
ucaacgagcuuagacuaga

SEQ ID NO: 1470350 - RNA, 19 nt, Homo sapiens
uggccaauguugaggaaua

SEQ ID NO: 1470351 - RNA, 19 nt, Homo sapiens
uggaugaccucuuguuugu

SEQ ID NO: 1470352 - RNA, 19 nt, Homo sapiens
gcccugagcugaggcagaa

SEQ ID NO: 1470353 - RNA, 19 nt, Homo sapiens
cgugauugcuuauggagaa

SEQ ID NO: 1470354 - RNA, 19 nt, Homo sapiens
gcgaguuccucaagucaga

SEQ ID NO: 1470355 - RNA, 19 nt, Homo sapiens
uguacgagccucuucauuu

SEQ ID NO: 1470356 - RNA, 19 nt, Homo sapiens
ugaggaauaugcagcuaga

SEQ ID NO: 1470357 - RNA, 19 nt, Homo sapiens
guucacagcagaaguguau

SEQ ID NO: 1470358 - RNA, 19 nt, Homo sapiens
gacagaugggugaauguua

SEQ ID NO: 1470359 - RNA, 19 nt, Homo sapiens
ccucuucauuuagcuaaua

SEQ ID NO: 1470360 - RNA, 19 nt, Homo sapiens
ugauggagcuaaucgacuu

SEQ ID NO: 1470361 - RNA, 19 nt, Homo sapiens
gcugaguacuucaugaaca

SEQ ID NO: 1470362 - RNA, 19 nt, Homo sapiens
cagaaggccuacauguuca

SEQ ID NO: 1470363 - RNA, 19 nt, Homo sapiens
ugaagcuaaucauugagua

SEQ ID NO: 1470364 - RNA, 19 nt, Homo sapiens
ucacagcagaaguguauaa

SEQ ID NO: 1470365 - RNA, 19 nt, Homo sapiens
gaagcuaaucauugaguau

SEQ ID NO: 1470366 - RNA, 19 nt, Homo sapiens
auaagaacauccucuguag

SEQ ID NO: 1470367 - RNA, 19 nt, Homo sapiens
caucauuaaugcccuaaag

SEQ ID NO: 1470368 - RNA, 19 nt, Homo sapiens
gacaaguacccuaccugua

SEQ ID NO: 1470369 - RNA, 19 nt, Homo sapiens
gcacugcgagaugaaguaa

SEQ ID NO: 1470370 - RNA, 19 nt, Homo sapiens
gagcugcuguguaguacca

SEQ ID NO: 1470371 - RNA, 19 nt, Homo sapiens
gcuaacacuuggcgcacaa

SEQ ID NO: 1470372 - RNA, 19 nt, Homo sapiens
ccugugagaucuucaacga

SEQ ID NO: 1470373 - RNA, 19 nt, Homo sapiens
ccgaugcacuccagacguu

SEQ ID NO: 1470374 - RNA, 19 nt, Homo sapiens
uugaaaggcuauguguaua

SEQ ID NO: 1470375 - RNA, 19 nt, Homo sapiens
gccauccucuuugcaauug

SEQ ID NO: 1470376 - RNA, 19 nt, Homo sapiens
ucaaagacagugaggaaug

SEQ ID NO: 1470377 - RNA, 19 nt, Homo sapiens
ggauaucauugagaaagau

SEQ ID NO: 1470378 - RNA, 19 nt, Homo sapiens
gugaaagucucggcagaau

SEQ ID NO: 1470379 - RNA, 19 nt, Homo sapiens
guucauacugcacaacuuu

SEQ ID NO: 1470380 - RNA, 19 nt, Homo sapiens
agaaagaugagcucaaugu

SEQ ID NO: 1470381 - RNA, 19 nt, Homo sapiens
guaaguucacggacuacua

SEQ ID NO: 1470382 - RNA, 19 nt, Homo sapiens
ccaccaccuuuaauguuga

SEQ ID NO: 1470383 - RNA, 19 nt, Homo sapiens
gaaaagaagguauacaaca

SEQ ID NO: 1470384 - RNA, 19 nt, Homo sapiens
ccuuuaauguugagugcua

SEQ ID NO: 1470385 - RNA, 19 nt, Homo sapiens
agaccacgcuugcccuaug

SEQ ID NO: 1470386 - RNA, 19 nt, Homo sapiens
caaagacagugaggaaugc

SEQ ID NO: 1470387 - RNA, 19 nt, Homo sapiens
ucuguaaguucacggacua

SEQ ID NO: 1470388 - RNA, 19 nt, Homo sapiens
agucagagcugugcuugga

SEQ ID NO: 1470389 - RNA, 19 nt, Homo sapiens
caacuucccaggauuagca

SEQ ID NO: 1470390 - RNA, 19 nt, Homo sapiens
guugagugcuaugaugaaa

SEQ ID NO: 1470391 - RNA, 19 nt, Homo sapiens
aaaccagucaucauuaaug

SEQ ID NO: 1470392 - RNA, 19 nt, Homo sapiens
ggcagaaggccuacauguu

SEQ ID NO: 1470393 - RNA, 19 nt, Homo sapiens
gugguggguuuaauggaaa

SEQ ID NO: 1470394 - RNA, 19 nt, Homo sapiens
ugaaaggcuauguguauau

SEQ ID NO: 1470395 - RNA, 19 nt, Homo sapiens
acagaugggugaauguuac

SEQ ID NO: 1470396 - RNA, 19 nt, Homo sapiens
gaaagaugagcucaauguc

SEQ ID NO: 1470397 - RNA, 19 nt, Homo sapiens
uugaggagauggugaaagu

SEQ ID NO: 1470398 - RNA, 19 nt, Homo sapiens
gaaggccuacauguucaua

SEQ ID NO: 1470399 - RNA, 19 nt, Homo sapiens
uggcauuucuccugacaug

SEQ ID NO: 1470400 - RNA, 19 nt, Homo sapiens
ggccaauguugaggaauau

SEQ ID NO: 1470401 - RNA, 19 nt, Homo sapiens
guuaugagccagagaccaa

SEQ ID NO: 1470402 - RNA, 19 nt, Homo sapiens
aggaagaugcuguauuuga

SEQ ID NO: 1470403 - RNA, 19 nt, Homo sapiens
aaagaugagcucaauguca

SEQ ID NO: 1470404 - RNA, 19 nt, Homo sapiens
gcauuucuccugacaugau

SEQ ID NO: 1470405 - RNA, 19 nt, Homo sapiens
aaagaccgaugagugguau

SEQ ID NO: 1470406 - RNA, 19 nt, Homo sapiens
gguggaugaccucuuguuu

SEQ ID NO: 1470407 - RNA, 19 nt, Homo sapiens
ugugguggguuuaauggaa

SEQ ID NO: 1470408 - RNA, 19 nt, Homo sapiens
gcaggauucucucucauuu

SEQ ID NO: 1470409 - RNA, 19 nt, Homo sapiens
ggaauucgguccuacuuca

SEQ ID NO: 1470410 - RNA, 19 nt, Homo sapiens
gauucucucucauuucuga

SEQ ID NO: 1470411 - RNA, 19 nt, Homo sapiens
caacaccuaucucuucuac

SEQ ID NO: 1470412 - RNA, 19 nt, Homo sapiens
aaucaacuuuggcauguuu

SEQ ID NO: 1470413 - RNA, 19 nt, Homo sapiens
ggaugggccucuucuacug

SEQ ID NO: 1470414 - RNA, 19 nt, Homo sapiens
gaaguacacccuccugaag

SEQ ID NO: 1470415 - RNA, 19 nt, Homo sapiens
gaauagcgucuuccucuuc

SEQ ID NO: 1470416 - RNA, 19 nt, Homo sapiens
gacaagagcagcugugagu

SEQ ID NO: 1470417 - RNA, 19 nt, Homo sapiens
caaggaggagucccuguuu

SEQ ID NO: 1470418 - RNA, 19 nt, Homo sapiens
ggaagcagccaccaucaag

SEQ ID NO: 1470419 - RNA, 19 nt, Homo sapiens
acaaucaacuuuggcaugu

SEQ ID NO: 1470420 - RNA, 19 nt, Homo sapiens
ccagcaggauucucucuca

SEQ ID NO: 1470421 - RNA, 19 nt, Homo sapiens
gaagcagccaccaucaaga

SEQ ID NO: 1470422 - RNA, 19 nt, Homo sapiens
ugaauagcgucuuccucuu

SEQ ID NO: 1470423 - RNA, 19 nt, Homo sapiens
ggcagggccuucaccaaca

SEQ ID NO: 1470424 - RNA, 19 nt, Homo sapiens
caccaacaccuaucucuuc

SEQ ID NO: 1470425 - RNA, 19 nt, Homo sapiens
uguacaagcugaguaucuu

SEQ ID NO: 1470426 - RNA, 19 nt, Homo sapiens
gccaaggucuucuccucau

SEQ ID NO: 1470427 - RNA, 19 nt, Homo sapiens
gagacaagagcagcuguga

SEQ ID NO: 1470428 - RNA, 19 nt, Homo sapiens
uggcaggagucgucugaga

SEQ ID NO: 1470429 - RNA, 19 nt, Homo sapiens
aguacacccuccugaagaa

SEQ ID NO: 1470430 - RNA, 19 nt, Homo sapiens
ggcagacggucaccuggau

SEQ ID NO: 1470431 - RNA, 19 nt, Homo sapiens
ucucaucccuuuaaaaugu

SEQ ID NO: 1470432 - RNA, 19 nt, Homo sapiens
gaagaacuccagggcaucu

SEQ ID NO: 1470433 - RNA, 19 nt, Homo sapiens
ccaaggucuucuccucaug

SEQ ID NO: 1470434 - RNA, 19 nt, Homo sapiens
caacguuugugacuaucag

SEQ ID NO: 1470435 - RNA, 19 nt, Homo sapiens
gcaggagucgucugagaag

SEQ ID NO: 1470436 - RNA, 19 nt, Homo sapiens
uguggcagguucaggagaa

SEQ ID NO: 1470437 - RNA, 19 nt, Homo sapiens
ucaagaagcaugagaucag

SEQ ID NO: 1470438 - RNA, 19 nt, Homo sapiens
gcagcuccguguacagcau

SEQ ID NO: 1470439 - RNA, 19 nt, Homo sapiens
aagcagccaccaucaagaa

SEQ ID NO: 1470440 - RNA, 19 nt, Homo sapiens
aggauucucucucauuucu

SEQ ID NO: 1470441 - RNA, 19 nt, Homo sapiens
ggcaggagucgucugagaa

SEQ ID NO: 1470442 - RNA, 19 nt, Homo sapiens
agaaguacacccuccugaa

SEQ ID NO: 1470443 - RNA, 19 nt, Homo sapiens
gagaacuacccucccaaca

SEQ ID NO: 1470444 - RNA, 19 nt, Homo sapiens
ucaucgcccuggucaacuu

SEQ ID NO: 1470445 - RNA, 19 nt, Homo sapiens
caaucaacuuuggcauguu

SEQ ID NO: 1470446 - RNA, 19 nt, Homo sapiens
ggacuccuccagggacuug

SEQ ID NO: 1470447 - RNA, 19 nt, Homo sapiens
ggcagacucgggcaaguga

SEQ ID NO: 1470448 - RNA, 19 nt, Homo sapiens
gaucagcaacgaguucaag

SEQ ID NO: 1470449 - RNA, 19 nt, Homo sapiens
gagguuccacaaucaacuu

SEQ ID NO: 1470450 - RNA, 19 nt, Homo sapiens
cagcuccaccuucuucuuc

SEQ ID NO: 1470451 - RNA, 19 nt, Homo sapiens
guacaagcugaguaucuuc

SEQ ID NO: 1470452 - RNA, 19 nt, Homo sapiens
cagccaccaucaagaagca

SEQ ID NO: 1470453 - RNA, 19 nt, Homo sapiens
guuccacaaucaacuuugg

SEQ ID NO: 1470454 - RNA, 19 nt, Homo sapiens
cagaccauacugugcauug

SEQ ID NO: 1470455 - RNA, 19 nt, Homo sapiens
acaaggaggagucccuguu

SEQ ID NO: 1470456 - RNA, 19 nt, Homo sapiens
cuucugggcuaccaaguac

SEQ ID NO: 1470457 - RNA, 19 nt, Homo sapiens
uuccucaccuucuacauca

SEQ ID NO: 1470458 - RNA, 19 nt, Homo sapiens
aaggaggagucccuguuuc

SEQ ID NO: 1470459 - RNA, 19 nt, Homo sapiens
guacucacaggacaacaag

SEQ ID NO: 1470460 - RNA, 19 nt, Homo sapiens
ggccaucagcgccaucuuc

SEQ ID NO: 1470461 - RNA, 19 nt, Homo sapiens
caucaagaagcaugagauc

SEQ ID NO: 1470462 - RNA, 19 nt, Homo sapiens
caagcugaguaucuucaac

SEQ ID NO: 1470463 - RNA, 19 nt, Homo sapiens
uaucagugcugggagaacu

SEQ ID NO: 1470464 - RNA, 19 nt, Homo sapiens
ggucaucgcccuggucaac

SEQ ID NO: 1470465 - RNA, 19 nt, Homo sapiens
uguuucugcugcuccagua

SEQ ID NO: 1470466 - RNA, 19 nt, Homo sapiens
ccaaguacucacaggacaa

SEQ ID NO: 1470467 - RNA, 19 nt, Homo sapiens
cagcaggauucucucucau

SEQ ID NO: 1470468 - RNA, 19 nt, Homo sapiens
guucugggccuggcuggaa

SEQ ID NO: 1470469 - RNA, 19 nt, Homo sapiens
ccucuucggcacaggaauu

SEQ ID NO: 1470470 - RNA, 19 nt, Homo sapiens
ggaggagucccuguuucug

SEQ ID NO: 1470471 - RNA, 19 nt, Homo sapiens
gagaucagcaacgaguuca

SEQ ID NO: 1470472 - RNA, 19 nt, Homo sapiens
gcagggccuucaccaacac

SEQ ID NO: 1470473 - RNA, 19 nt, Homo sapiens
ccaaagauggacacacaac

SEQ ID NO: 1470474 - RNA, 19 nt, Homo sapiens
ugagaucagcaacgaguuc

SEQ ID NO: 1470475 - RNA, 19 nt, Homo sapiens
gaaaggaguuugccaagaa

SEQ ID NO: 1470476 - RNA, 19 nt, Homo sapiens
gaaauaaacugaagaccau

SEQ ID NO: 1470477 - RNA, 19 nt, Homo sapiens
ggaaggugcuccaggauaa

SEQ ID NO: 1470478 - RNA, 19 nt, Homo sapiens
ggaaggagcuggcuuugug

SEQ ID NO: 1470479 - RNA, 19 nt, Homo sapiens
ggaccaagcugaagaaggu

SEQ ID NO: 1470480 - RNA, 19 nt, Homo sapiens
gccaagaagugaucuguuu

SEQ ID NO: 1470481 - RNA, 19 nt, Homo sapiens
gaccauggcuacucuuuga

SEQ ID NO: 1470482 - RNA, 19 nt, Homo sapiens
ggaauugggucugcuuuau

SEQ ID NO: 1470483 - RNA, 19 nt, Homo sapiens
gagcagaggcuuaugaaga

SEQ ID NO: 1470484 - RNA, 19 nt, Homo sapiens
ggagaaagggcaaggaauu

SEQ ID NO: 1470485 - RNA, 19 nt, Homo sapiens
gaagugaucuguuuuaaag

SEQ ID NO: 1470486 - RNA, 19 nt, Homo sapiens
ggauggaccuucucuucuu

SEQ ID NO: 1470487 - RNA, 19 nt, Homo sapiens
caagggaggucucuuccaa

SEQ ID NO: 1470488 - RNA, 19 nt, Homo sapiens
cagagaaccuagcugguaa

SEQ ID NO: 1470489 - RNA, 19 nt, Homo sapiens
agacacaauucuuugcaua

SEQ ID NO: 1470490 - RNA, 19 nt, Homo sapiens
agccauagguuguuucuuu

SEQ ID NO: 1470491 - RNA, 19 nt, Homo sapiens
aagcuuggcagguauauua

SEQ ID NO: 1470492 - RNA, 19 nt, Homo sapiens
gagauucuaucaccacugu

SEQ ID NO: 1470493 - RNA, 19 nt, Homo sapiens
ugaagaaggugaccaacau

SEQ ID NO: 1470494 - RNA, 19 nt, Homo sapiens
gcaaagggaccaagcugaa

SEQ ID NO: 1470495 - RNA, 19 nt, Homo sapiens
gcagaggcuuaugaagaua

SEQ ID NO: 1470496 - RNA, 19 nt, Homo sapiens
ggugggagauaggaagaua

SEQ ID NO: 1470497 - RNA, 19 nt, Homo sapiens
gagagcuccuaacauguuu

SEQ ID NO: 1470498 - RNA, 19 nt, Homo sapiens
gaagugagcagaggcuuau

SEQ ID NO: 1470499 - RNA, 19 nt, Homo sapiens
ggucauauuuggagaaagg

SEQ ID NO: 1470500 - RNA, 19 nt, Homo sapiens
aauugggucugcuuuauuu

SEQ ID NO: 1470501 - RNA, 19 nt, Homo sapiens
gaaggugaccaacauuaau

SEQ ID NO: 1470502 - RNA, 19 nt, Homo sapiens
gaauugggucugcuuuauu

SEQ ID NO: 1470503 - RNA, 19 nt, Homo sapiens
gaacaaguuuccgugucuu

SEQ ID NO: 1470504 - RNA, 19 nt, Homo sapiens
acagaagggugaagaagug

SEQ ID NO: 1470505 - RNA, 19 nt, Homo sapiens
gcuccaggauaacaaagaa

SEQ ID NO: 1470506 - RNA, 19 nt, Homo sapiens
ggccuuaaccucaaucuug

SEQ ID NO: 1470507 - RNA, 19 nt, Homo sapiens
caucucaucucuggauuug

SEQ ID NO: 1470508 - RNA, 19 nt, Homo sapiens
uaacauguuucuccaaugc

SEQ ID NO: 1470509 - RNA, 19 nt, Homo sapiens
gaacaggagccauuugaac

SEQ ID NO: 1470510 - RNA, 19 nt, Homo sapiens
gugaucagacucuauauug

SEQ ID NO: 1470511 - RNA, 19 nt, Homo sapiens
ggucuuucuuggaugauuu

SEQ ID NO: 1470512 - RNA, 19 nt, Homo sapiens
gaagaaggugaccaacauu

SEQ ID NO: 1470513 - RNA, 19 nt, Homo sapiens
ccuaauaccaccagcagua

SEQ ID NO: 1470514 - RNA, 19 nt, Homo sapiens
gaagaccauuuuagaacua

SEQ ID NO: 1470515 - RNA, 19 nt, Homo sapiens
gccuuguugugaugaauua

SEQ ID NO: 1470516 - RNA, 19 nt, Homo sapiens
ccacagagacacaauucuu

SEQ ID NO: 1470517 - RNA, 19 nt, Homo sapiens
gaagauauucagauacucu

SEQ ID NO: 1470518 - RNA, 19 nt, Homo sapiens
gagcagacucuuccuguuc

SEQ ID NO: 1470519 - RNA, 19 nt, Homo sapiens
aagaaagggugaaauaaac

SEQ ID NO: 1470520 - RNA, 19 nt, Homo sapiens
gagaaagggcaaggaauug

SEQ ID NO: 1470521 - RNA, 19 nt, Homo sapiens
ugaucagacucuauauuga

SEQ ID NO: 1470522 - RNA, 19 nt, Homo sapiens
ucagagaaccuagcuggua

SEQ ID NO: 1470523 - RNA, 19 nt, Homo sapiens
uaacacagcagaguacaga

SEQ ID NO: 1470524 - RNA, 19 nt, Homo sapiens
cagcucaccuccaucuaug

SEQ ID NO: 1470525 - RNA, 19 nt, Homo sapiens
gccauagguuguuucuuug

SEQ ID NO: 1470526 - RNA, 19 nt, Homo sapiens
cccaugcccuugaaagaaa

SEQ ID NO: 1470527 - RNA, 19 nt, Homo sapiens
gggaacaggagccauuuga

SEQ ID NO: 1470528 - RNA, 19 nt, Homo sapiens
uaacaaagaagggcagguu

SEQ ID NO: 1470529 - RNA, 19 nt, Homo sapiens
ccacacaccagaugcuuug

SEQ ID NO: 1470530 - RNA, 19 nt, Homo sapiens
gauggaccuucucuucuuc

SEQ ID NO: 1470531 - RNA, 19 nt, Homo sapiens
uaaacacuuucagaggaua

SEQ ID NO: 1470532 - RNA, 19 nt, Homo sapiens
acaauucuuugcauaggaa

SEQ ID NO: 1470533 - RNA, 19 nt, Homo sapiens
ccacaccucugccuaugca

SEQ ID NO: 1470534 - RNA, 19 nt, Homo sapiens
ccaggaagcacaaagacuu

SEQ ID NO: 1470535 - RNA, 19 nt, Homo sapiens
aagaaggugaccaacauua

SEQ ID NO: 1470536 - RNA, 19 nt, Homo sapiens
ggaacaggagccauuugaa

SEQ ID NO: 1470537 - RNA, 19 nt, Homo sapiens
ccacaugaggaacaaguuu

SEQ ID NO: 1470538 - RNA, 19 nt, Homo sapiens
ugagagcuccuaacauguu

SEQ ID NO: 1470539 - RNA, 19 nt, Homo sapiens
agacuuuccugcuccagaa

SEQ ID NO: 1470540 - RNA, 19 nt, Homo sapiens
ucacagcccaccugacuga

SEQ ID NO: 1470541 - RNA, 19 nt, Homo sapiens
caaagaagggcagguugaa

SEQ ID NO: 1470542 - RNA, 19 nt, Homo sapiens
ucaguucucugcagcaaag

SEQ ID NO: 1470543 - RNA, 19 nt, Homo sapiens
ccuaacauguuucuccaau

SEQ ID NO: 1470544 - RNA, 19 nt, Homo sapiens
gagcguggcaugagagcaa

SEQ ID NO: 1470545 - RNA, 19 nt, Homo sapiens
ucccaggacugcacgguuu

SEQ ID NO: 1470546 - RNA, 19 nt, Homo sapiens
uaaccucaaucuugugucu

SEQ ID NO: 1470547 - RNA, 19 nt, Homo sapiens
agaaaggaguuugccaaga

SEQ ID NO: 1470548 - RNA, 19 nt, Homo sapiens
ggaccucucucggccuaau

SEQ ID NO: 1470549 - RNA, 19 nt, Homo sapiens
guggagggcaucauucauu

SEQ ID NO: 1470550 - RNA, 19 nt, Homo sapiens
gaaagggugaaauaaacug

SEQ ID NO: 1470551 - RNA, 19 nt, Homo sapiens
agaaggugaccaacauuaa

SEQ ID NO: 1470552 - RNA, 19 nt, Homo sapiens
gagacacaauucuuugcau

SEQ ID NO: 1470553 - RNA, 19 nt, Homo sapiens
ccaaggaugguucagagaa

SEQ ID NO: 1470554 - RNA, 19 nt, Homo sapiens
gccuuaaccucaaucuugu

SEQ ID NO: 1470555 - RNA, 19 nt, Homo sapiens
gugcuaggcugagggaugu

SEQ ID NO: 1470556 - RNA, 19 nt, Homo sapiens
ccacauuucaucaggcaaa

SEQ ID NO: 1470557 - RNA, 19 nt, Homo sapiens
caagaagugaucuguuuua

SEQ ID NO: 1470558 - RNA, 19 nt, Homo sapiens
cacagagacacaauucuuu

SEQ ID NO: 1470559 - RNA, 19 nt, Homo sapiens
gagaccauggcuacucuuu

SEQ ID NO: 1470560 - RNA, 19 nt, Homo sapiens
gcccuagacuccaaauguc

SEQ ID NO: 1470561 - RNA, 19 nt, Homo sapiens
ggggaaaauuagcuuaaaa

SEQ ID NO: 1470562 - RNA, 19 nt, Homo sapiens
aaagggaacaggagccauu

SEQ ID NO: 1470563 - RNA, 19 nt, Homo sapiens
ggaguuugccaagaaguga

SEQ ID NO: 1470564 - RNA, 19 nt, Homo sapiens
gacucuauauugacaguag

SEQ ID NO: 1470565 - RNA, 19 nt, Homo sapiens
ggugaucagacucuauauu

SEQ ID NO: 1470566 - RNA, 19 nt, Homo sapiens
ucucaucucuggauuuggu

SEQ ID NO: 1470567 - RNA, 19 nt, Homo sapiens
ccagaagaauauaaacacu

SEQ ID NO: 1470568 - RNA, 19 nt, Homo sapiens
ugagcagacucuuccuguu

SEQ ID NO: 1470569 - RNA, 19 nt, Homo sapiens
acaaagaagggcagguuga

SEQ ID NO: 1470570 - RNA, 19 nt, Homo sapiens
ucaccacuguccggucuuu

SEQ ID NO: 1470571 - RNA, 19 nt, Homo sapiens
cccaaggccuccaguaucu

SEQ ID NO: 1470572 - RNA, 19 nt, Homo sapiens
gguaggaagcugauuggau

SEQ ID NO: 1470573 - RNA, 19 nt, Homo sapiens
agcagaggcuuaugaagau

SEQ ID NO: 1470574 - RNA, 19 nt, Homo sapiens
cauggaaggagcuggcuuu

SEQ ID NO: 1470575 - RNA, 19 nt, Homo sapiens
ggagagaguugaaaugguu

SEQ ID NO: 1470576 - RNA, 19 nt, Homo sapiens
ggacaucgguugagagaag

SEQ ID NO: 1470577 - RNA, 19 nt, Homo sapiens
ggacguauccuguuguuga

SEQ ID NO: 1470578 - RNA, 19 nt, Homo sapiens
uaacuuaagucgugaggaa

SEQ ID NO: 1470579 - RNA, 19 nt, Homo sapiens
cacauucgguuaucucuaa

SEQ ID NO: 1470580 - RNA, 19 nt, Homo sapiens
ucacguugcagcauucuua

SEQ ID NO: 1470581 - RNA, 19 nt, Homo sapiens
ggucucacguugcagcauu

SEQ ID NO: 1470582 - RNA, 19 nt, Homo sapiens
ucauucagcuggucacugu

SEQ ID NO: 1470583 - RNA, 19 nt, Homo sapiens
ggagcuaacacccauuaug

SEQ ID NO: 1470584 - RNA, 19 nt, Homo sapiens
gcucgugguugcucuucaa

SEQ ID NO: 1470585 - RNA, 19 nt, Homo sapiens
ucaagggucucacguugca

SEQ ID NO: 1470586 - RNA, 19 nt, Homo sapiens
gcucucccuugaguuauuu

SEQ ID NO: 1470587 - RNA, 19 nt, Homo sapiens
caacugcagcucauucugu

SEQ ID NO: 1470588 - RNA, 19 nt, Homo sapiens
caugggacguauccuguug

SEQ ID NO: 1470589 - RNA, 19 nt, Homo sapiens
caacggugaacacaagauu

SEQ ID NO: 1470590 - RNA, 19 nt, Homo sapiens
auacaacggugaacacaag

SEQ ID NO: 1470591 - RNA, 19 nt, Homo sapiens
uuauggagauuaaccacuu

SEQ ID NO: 1470592 - RNA, 19 nt, Homo sapiens
ucuuuacucugagguguua

SEQ ID NO: 1470593 - RNA, 19 nt, Homo sapiens
uaucuugggacucuucuuu

SEQ ID NO: 1470594 - RNA, 19 nt, Homo sapiens
ggacuggaggcucuugguu

SEQ ID NO: 1470595 - RNA, 19 nt, Homo sapiens
gcucuguuguuccagcuau

SEQ ID NO: 1470596 - RNA, 19 nt, Homo sapiens
gcccaucaguucuuuacuc

SEQ ID NO: 1470597 - RNA, 19 nt, Homo sapiens
gacuggaggcucuugguuu

SEQ ID NO: 1470598 - RNA, 19 nt, Homo sapiens
gggagagaguugaaauggu

SEQ ID NO: 1470599 - RNA, 19 nt, Homo sapiens
gguguuagaguggaauaaa

SEQ ID NO: 1470600 - RNA, 19 nt, Homo sapiens
ccucaaguauucuuaaagc

SEQ ID NO: 1470601 - RNA, 19 nt, Homo sapiens
uguuagaguuccucauuca

SEQ ID NO: 1470602 - RNA, 19 nt, Homo sapiens
uauggagauuaaccacuuu

SEQ ID NO: 1470603 - RNA, 19 nt, Homo sapiens
ggaaaacgauggagcuaac

SEQ ID NO: 1470604 - RNA, 19 nt, Homo sapiens
gaauacaacggugaacaca

SEQ ID NO: 1470605 - RNA, 19 nt, Homo sapiens
caccucagcucagcaaucu

SEQ ID NO: 1470606 - RNA, 19 nt, Homo sapiens
acaagucagucucucucaa

SEQ ID NO: 1470607 - RNA, 19 nt, Homo sapiens
gcggacaucgguugagaga

SEQ ID NO: 1470608 - RNA, 19 nt, Homo sapiens
cuuccuggcucucccuuga

SEQ ID NO: 1470609 - RNA, 19 nt, Homo sapiens
gaggucacauucgguuauc

SEQ ID NO: 1470610 - RNA, 19 nt, Homo sapiens
ggcucucccuugaguuauu

SEQ ID NO: 1470611 - RNA, 19 nt, Homo sapiens
cguauccuguuguugaguu

SEQ ID NO: 1470612 - RNA, 19 nt, Homo sapiens
ggaguuccaguuccagugu

SEQ ID NO: 1470613 - RNA, 19 nt, Homo sapiens
gcucagggagagaguugaa

SEQ ID NO: 1470614 - RNA, 19 nt, Homo sapiens
ggaauacaacggugaacac

SEQ ID NO: 1470615 - RNA, 19 nt, Homo sapiens
caagucagucucucucaag

SEQ ID NO: 1470616 - RNA, 19 nt, Homo sapiens
ucuguuagaguuccucauu

SEQ ID NO: 1470617 - RNA, 19 nt, Homo sapiens
ccucagcucagcaaucuca

SEQ ID NO: 1470618 - RNA, 19 nt, Homo sapiens
gacguauccuguuguugag

SEQ ID NO: 1470619 - RNA, 19 nt, Homo sapiens
gagguguuagaguggaaua

SEQ ID NO: 1470620 - RNA, 19 nt, Homo sapiens
ucuugggacucuucuuugu

SEQ ID NO: 1470621 - RNA, 19 nt, Homo sapiens
ugaggucacauucgguuau

SEQ ID NO: 1470622 - RNA, 19 nt, Homo sapiens
acuuaagucgugaggaaua

SEQ ID NO: 1470623 - RNA, 19 nt, Homo sapiens
cuggcucucccuugaguua

SEQ ID NO: 1470624 - RNA, 19 nt, Homo sapiens
cugcucccuuccucaagua

SEQ ID NO: 1470625 - RNA, 19 nt, Homo sapiens
ucagggagagaguugaaau

SEQ ID NO: 1470626 - RNA, 19 nt, Homo sapiens
ucacauucgguuaucucua

SEQ ID NO: 1470627 - RNA, 19 nt, Homo sapiens
aacugcagcucauucuguu

SEQ ID NO: 1470628 - RNA, 19 nt, Homo sapiens
gcagcucauucuguuagag

SEQ ID NO: 1470629 - RNA, 19 nt, Homo sapiens
ugggacguauccuguuguu

SEQ ID NO: 1470630 - RNA, 19 nt, Homo sapiens
caaguacaaugucaacgaa

SEQ ID NO: 1470631 - RNA, 19 nt, Homo sapiens
cauaggaccugccacacaa

SEQ ID NO: 1470632 - RNA, 19 nt, Homo sapiens
ggaggacaacgaugaguuu

SEQ ID NO: 1470633 - RNA, 19 nt, Homo sapiens
ggaaauguauccucaaacc

SEQ ID NO: 1470634 - RNA, 19 nt, Homo sapiens
gcaaguacaaugucaacga

SEQ ID NO: 1470635 - RNA, 19 nt, Homo sapiens
ucaggacggugccuaagug

SEQ ID NO: 1470636 - RNA, 19 nt, Homo sapiens
uaaguggaccucagacaug

SEQ ID NO: 1470637 - RNA, 19 nt, Homo sapiens
ggacuuccugcaaacacua

SEQ ID NO: 1470638 - RNA, 19 nt, Homo sapiens
ucaagcugcuggugcaagu

SEQ ID NO: 1470639 - RNA, 19 nt, Homo sapiens
ugagacugcuggcaugaag

SEQ ID NO: 1470640 - RNA, 19 nt, Homo sapiens
ccaaggcagcaaugacuga

SEQ ID NO: 1470641 - RNA, 19 nt, Homo sapiens
aguacaaugucaacgaaga

SEQ ID NO: 1470642 - RNA, 19 nt, Homo sapiens
gggaggacaacgaugaguu

SEQ ID NO: 1470643 - RNA, 19 nt, Homo sapiens
auggaaauguauccucaaa

SEQ ID NO: 1470644 - RNA, 19 nt, Homo sapiens
guacaaugucaacgaagau

SEQ ID NO: 1470645 - RNA, 19 nt, Homo sapiens
gcaaugacugaacucaagu

SEQ ID NO: 1470646 - RNA, 19 nt, Homo sapiens
agcaaugacugaacucaag

SEQ ID NO: 1470647 - RNA, 19 nt, Homo sapiens
uucauggacuuccugcaaa

SEQ ID NO: 1470648 - RNA, 19 nt, Homo sapiens
ccauaggaccugccacaca

SEQ ID NO: 1470649 - RNA, 19 nt, Homo sapiens
ccaccucccacauggaaau

SEQ ID NO: 1470650 - RNA, 19 nt, Homo sapiens
cagcaaugacugaacucaa

SEQ ID NO: 1470651 - RNA, 19 nt, Homo sapiens
cucaaguccugcagagaug

SEQ ID NO: 1470652 - RNA, 19 nt, Homo sapiens
gcagcaaugacugaacuca

SEQ ID NO: 1470653 - RNA, 19 nt, Homo sapiens
cauaguaggucuucaguga

SEQ ID NO: 1470654 - RNA, 19 nt, Homo sapiens
acagggcgcugguuuauaa

SEQ ID NO: 1470655 - RNA, 19 nt, Homo sapiens
gaagggauuuccuaagugu

SEQ ID NO: 1470656 - RNA, 19 nt, Homo sapiens
uaaaugagacggcagcuuu

SEQ ID NO: 1470657 - RNA, 19 nt, Homo sapiens
gagaggauauuuaaaugag

SEQ ID NO: 1470658 - RNA, 19 nt, Homo sapiens
gaacagcugcgcucauuca

SEQ ID NO: 1470659 - RNA, 19 nt, Homo sapiens
cagaacagcugcgcucauu

SEQ ID NO: 1470660 - RNA, 19 nt, Homo sapiens
ucacuacucuguacacaau

SEQ ID NO: 1470661 - RNA, 19 nt, Homo sapiens
gaaacucauugcacauuag

SEQ ID NO: 1470662 - RNA, 19 nt, Homo sapiens
agaaacucauugcacauua

SEQ ID NO: 1470663 - RNA, 19 nt, Homo sapiens
cagaugagaggauauuuaa

SEQ ID NO: 1470664 - RNA, 19 nt, Homo sapiens
gagaugccauggagccaaa

SEQ ID NO: 1470665 - RNA, 19 nt, Homo sapiens
ccagaugagaggauauuua

SEQ ID NO: 1470666 - RNA, 19 nt, Homo sapiens
gcaugugugugcuugugua

SEQ ID NO: 1470667 - RNA, 19 nt, Homo sapiens
gcaaaugaaaguagcaguu

SEQ ID NO: 1470668 - RNA, 19 nt, Homo sapiens
ggacuccccuguuuacuuu

SEQ ID NO: 1470669 - RNA, 19 nt, Homo sapiens
gccaaaggcugcgacugua

SEQ ID NO: 1470670 - RNA, 19 nt, Homo sapiens
ccagagcgccuagcacaua

SEQ ID NO: 1470671 - RNA, 19 nt, Homo sapiens
gauccugccucaagguaga

SEQ ID NO: 1470672 - RNA, 19 nt, Homo sapiens
ccucagaguuugacuguag

SEQ ID NO: 1470673 - RNA, 19 nt, Homo sapiens
gcucaucacuacucuguac

SEQ ID NO: 1470674 - RNA, 19 nt, Homo sapiens
ccaaaccagugucgaguuc

SEQ ID NO: 1470675 - RNA, 19 nt, Homo sapiens
ggagggaugacaacagauu

SEQ ID NO: 1470676 - RNA, 19 nt, Homo sapiens
uguacacaaugucuugaua

SEQ ID NO: 1470677 - RNA, 19 nt, Homo sapiens
gggcgcugguuuauaaaga

SEQ ID NO: 1470678 - RNA, 19 nt, Homo sapiens
ugugugugcuuguguauau

SEQ ID NO: 1470679 - RNA, 19 nt, Homo sapiens
caaaugaaaguagcaguug

SEQ ID NO: 1470680 - RNA, 19 nt, Homo sapiens
acucauugcacauuaguua

SEQ ID NO: 1470681 - RNA, 19 nt, Homo sapiens
ggacauagaaacucauugc

SEQ ID NO: 1470682 - RNA, 19 nt, Homo sapiens
cuacuucggugauggagau

SEQ ID NO: 1470683 - RNA, 19 nt, Homo sapiens
gggauuuccuaaguguaua

SEQ ID NO: 1470684 - RNA, 19 nt, Homo sapiens
ucgugcaucuuacaucuuu

SEQ ID NO: 1470685 - RNA, 19 nt, Homo sapiens
acugaccgcuggcaaugua

SEQ ID NO: 1470686 - RNA, 19 nt, Homo sapiens
ggacugugcaggcaucugu

SEQ ID NO: 1470687 - RNA, 19 nt, Homo sapiens
uuauuuagcuuugccaugu

SEQ ID NO: 1470688 - RNA, 19 nt, Homo sapiens
ggauggccuuggacauaga

SEQ ID NO: 1470689 - RNA, 19 nt, Homo sapiens
cacagacccuuauguacug

SEQ ID NO: 1470690 - RNA, 19 nt, Homo sapiens
ccacagacccuuauguacu

SEQ ID NO: 1470691 - RNA, 19 nt, Homo sapiens
cauacagucuuagagcaaa

SEQ ID NO: 1470692 - RNA, 19 nt, Homo sapiens
gaccgggauugcaaagaug

SEQ ID NO: 1470693 - RNA, 19 nt, Homo sapiens
caucuguucuccucaugga

SEQ ID NO: 1470694 - RNA, 19 nt, Homo sapiens
guuccugacugcuguuugu

SEQ ID NO: 1470695 - RNA, 19 nt, Homo sapiens
agaccgggauugcaaagau

SEQ ID NO: 1470696 - RNA, 19 nt, Homo sapiens
gaacuccugaccucaagug

SEQ ID NO: 1470697 - RNA, 19 nt, Homo sapiens
gagcgccuagcacauagua

SEQ ID NO: 1470698 - RNA, 19 nt, Homo sapiens
cauguugucucgugcaucu

SEQ ID NO: 1470699 - RNA, 19 nt, Homo sapiens
cugauuagcugggauuaca

SEQ ID NO: 1470700 - RNA, 19 nt, Homo sapiens
gcacauaguaggucuucag

SEQ ID NO: 1470701 - RNA, 19 nt, Homo sapiens
gugcugcagccaaccuuua

SEQ ID NO: 1470702 - RNA, 19 nt, Homo sapiens
agagagagcagcaggugaa

SEQ ID NO: 1470703 - RNA, 19 nt, Homo sapiens
uugauacgcugaggauuga

SEQ ID NO: 1470704 - RNA, 19 nt, Homo sapiens
ccugacugcuguuuguuug

SEQ ID NO: 1470705 - RNA, 19 nt, Homo sapiens
gcugaaagccgguauugcu

SEQ ID NO: 1470706 - RNA, 19 nt, Homo sapiens
guuccacuuucuuguaaug

SEQ ID NO: 1470707 - RNA, 19 nt, Homo sapiens
ucacagggcgcugguuuau

SEQ ID NO: 1470708 - RNA, 19 nt, Homo sapiens
gggagucagugugguagga

SEQ ID NO: 1470709 - RNA, 19 nt, Homo sapiens
gaaagagucacacauucac

SEQ ID NO: 1470710 - RNA, 19 nt, Homo sapiens
uugaaagagucacacauuc

SEQ ID NO: 1470711 - RNA, 19 nt, Homo sapiens
uaacuaggccagcauucug

SEQ ID NO: 1470712 - RNA, 19 nt, Homo sapiens
cuucguggccuaucuuuau

SEQ ID NO: 1470713 - RNA, 19 nt, Homo sapiens
gauacgcugaggauugaaa

SEQ ID NO: 1470714 - RNA, 19 nt, Homo sapiens
agucuuagagcaaaugaaa

SEQ ID NO: 1470715 - RNA, 19 nt, Homo sapiens
ugauggagaugggcacaug

SEQ ID NO: 1470716 - RNA, 19 nt, Homo sapiens
cagccuggauccugcuuuc

SEQ ID NO: 1470717 - RNA, 19 nt, Homo sapiens
gggcuuuauuugugucugu

SEQ ID NO: 1470718 - RNA, 19 nt, Homo sapiens
aaaugaaaguagcaguugu

SEQ ID NO: 1470719 - RNA, 19 nt, Homo sapiens
ccugggaggugcugcuuca

SEQ ID NO: 1470720 - RNA, 19 nt, Homo sapiens
agacccgacuccagaccua

SEQ ID NO: 1470721 - RNA, 19 nt, Homo sapiens
ccgaaaugcugggauuaca

SEQ ID NO: 1470722 - RNA, 19 nt, Homo sapiens
gcaccguuauuuucuaaug

SEQ ID NO: 1470723 - RNA, 19 nt, Homo sapiens
uagaaacucauugcacauu

SEQ ID NO: 1470724 - RNA, 19 nt, Homo sapiens
uaaagacccaaaccagugu

SEQ ID NO: 1470725 - RNA, 19 nt, Homo sapiens
ugccucggccuccugauua

SEQ ID NO: 1470726 - RNA, 19 nt, Homo sapiens
uuggagggaugacaacaga

SEQ ID NO: 1470727 - RNA, 19 nt, Homo sapiens
ccuguuuacuuugauauuc

SEQ ID NO: 1470728 - RNA, 19 nt, Homo sapiens
gaccaggaacucagugauc

SEQ ID NO: 1470729 - RNA, 19 nt, Homo sapiens
gcucauucacucacuguuc

SEQ ID NO: 1470730 - RNA, 19 nt, Homo sapiens
cuguuccacuuucuuguaa

SEQ ID NO: 1470731 - RNA, 19 nt, Homo sapiens
ucccacagacccuuaugua

SEQ ID NO: 1470732 - RNA, 19 nt, Homo sapiens
ucacuguuccacuuucuug

SEQ ID NO: 1470733 - RNA, 19 nt, Homo sapiens
gccauccuguggguucuuu

SEQ ID NO: 1470734 - RNA, 19 nt, Homo sapiens
ucacucacuguuccacuuu

SEQ ID NO: 1470735 - RNA, 19 nt, Homo sapiens
caucuuacaucuuuuacug

SEQ ID NO: 1470736 - RNA, 19 nt, Homo sapiens
guacacaaugucuugauac

SEQ ID NO: 1470737 - RNA, 19 nt, Homo sapiens
cuccugaccucaagugauc

SEQ ID NO: 1470738 - RNA, 19 nt, Homo sapiens
gagggaugacaacagauug

SEQ ID NO: 1470739 - RNA, 19 nt, Homo sapiens
cagagcgccuagcacauag

SEQ ID NO: 1470740 - RNA, 19 nt, Homo sapiens
gcgcaccguuauuuucuaa

SEQ ID NO: 1470741 - RNA, 19 nt, Homo sapiens
acagggacaugcgugaaau

SEQ ID NO: 1470742 - RNA, 19 nt, Homo sapiens
caacagauuguggucuaau

SEQ ID NO: 1470743 - RNA, 19 nt, Homo sapiens
uuugaaagagucacacauu

SEQ ID NO: 1470744 - RNA, 19 nt, Homo sapiens
ccucacagggcgcugguuu

SEQ ID NO: 1470745 - RNA, 19 nt, Homo sapiens
gugcaugugugugcuugug

SEQ ID NO: 1470746 - RNA, 19 nt, Homo sapiens
gugcaugugugugcuugug

SEQ ID NO: 1470747 - RNA, 19 nt, Homo sapiens
ggauugcaaagaugacugu

SEQ ID NO: 1470748 - RNA, 19 nt, Homo sapiens
cuugauacgcugaggauug

SEQ ID NO: 1470749 - RNA, 19 nt, Homo sapiens
gaccuucaguaggcucaga

SEQ ID NO: 1470750 - RNA, 19 nt, Homo sapiens
gcuggagagaccuucagua

SEQ ID NO: 1470751 - RNA, 19 nt, Homo sapiens
ggcccuuucuugccucuca

SEQ ID NO: 1470752 - RNA, 19 nt, Homo sapiens
ccgugcaacucuccucaug

SEQ ID NO: 1470753 - RNA, 19 nt, Homo sapiens
caaauuauauccgcgguua

SEQ ID NO: 1470754 - RNA, 19 nt, Homo sapiens
ggaaaucuauaucguguug

SEQ ID NO: 1470755 - RNA, 19 nt, Homo sapiens
gcaaguguauaauauggua

SEQ ID NO: 1470756 - RNA, 19 nt, Homo sapiens
cagcuaaacuaucugauuu

SEQ ID NO: 1470757 - RNA, 19 nt, Homo sapiens
acacagaacuccaucaaga

SEQ ID NO: 1470758 - RNA, 19 nt, Homo sapiens
agacguggauuucaucaua

SEQ ID NO: 1470759 - RNA, 19 nt, Homo sapiens
ccaacaaacugcccaagaa

SEQ ID NO: 1470760 - RNA, 19 nt, Homo sapiens
aaccaugccuuccaacuua

SEQ ID NO: 1470761 - RNA, 19 nt, Homo sapiens
gauaaaucauugcaagugu

SEQ ID NO: 1470762 - RNA, 19 nt, Homo sapiens
caaacuggagacagaauua

SEQ ID NO: 1470763 - RNA, 19 nt, Homo sapiens
cagaauauccuccaucuuc

SEQ ID NO: 1470764 - RNA, 19 nt, Homo sapiens
ggaauaaaggcacacagaa

SEQ ID NO: 1470765 - RNA, 19 nt, Homo sapiens
ccaguaaggcuucuagaaa

SEQ ID NO: 1470766 - RNA, 19 nt, Homo sapiens
cgaaggaaauaugaacauu

SEQ ID NO: 1470767 - RNA, 19 nt, Homo sapiens
cuaccaaacuggagacaga

SEQ ID NO: 1470768 - RNA, 19 nt, Homo sapiens
uaaccauccuuguggcuuu

SEQ ID NO: 1470769 - RNA, 19 nt, Homo sapiens
gacguggauuucaucauaa

SEQ ID NO: 1470770 - RNA, 19 nt, Homo sapiens
agacagaaaugagaggaaa

SEQ ID NO: 1470771 - RNA, 19 nt, Homo sapiens
gcacacagaacuccaucaa

SEQ ID NO: 1470772 - RNA, 19 nt, Homo sapiens
uauccuccaucuucaaauu

SEQ ID NO: 1470773 - RNA, 19 nt, Homo sapiens
gaagaaaacccagcauauu

SEQ ID NO: 1470774 - RNA, 19 nt, Homo sapiens
ugucauaccauuacacaaa

SEQ ID NO: 1470775 - RNA, 19 nt, Homo sapiens
gaaaugagaggaaaauugu

SEQ ID NO: 1470776 - RNA, 19 nt, Homo sapiens
gcaauugcccaacaaacug

SEQ ID NO: 1470777 - RNA, 19 nt, Homo sapiens
ggauaaaucauugcaagug

SEQ ID NO: 1470778 - RNA, 19 nt, Homo sapiens
gaauaaaggcacacagaac

SEQ ID NO: 1470779 - RNA, 19 nt, Homo sapiens
ggauugauucggacacauu

SEQ ID NO: 1470780 - RNA, 19 nt, Homo sapiens
uacaugggauaaaucauug

SEQ ID NO: 1470781 - RNA, 19 nt, Homo sapiens
guacaucaagcgcuacgaa

SEQ ID NO: 1470782 - RNA, 19 nt, Homo sapiens
agaaucaccagcuaaacua

SEQ ID NO: 1470783 - RNA, 19 nt, Homo sapiens
cccagcauauuccaaacua

SEQ ID NO: 1470784 - RNA, 19 nt, Homo sapiens
ccaagaaguuuuagguuau

SEQ ID NO: 1470785 - RNA, 19 nt, Homo sapiens
gacagaauuacaugggaua

SEQ ID NO: 1470786 - RNA, 19 nt, Homo sapiens
ccagcuaaacuaucugauu

SEQ ID NO: 1470787 - RNA, 19 nt, Homo sapiens
aaacccagcauauuccaaa

SEQ ID NO: 1470788 - RNA, 19 nt, Homo sapiens
gaauauccuccaucuucaa

SEQ ID NO: 1470789 - RNA, 19 nt, Homo sapiens
agaauauccuccaucuuca

SEQ ID NO: 1470790 - RNA, 19 nt, Homo sapiens
cccaagaaguuuuagguua

SEQ ID NO: 1470791 - RNA, 19 nt, Homo sapiens
caguaaggcuucuagaaaa

SEQ ID NO: 1470792 - RNA, 19 nt, Homo sapiens
caacuuaguaaacuucauc

SEQ ID NO: 1470793 - RNA, 19 nt, Homo sapiens
ggaagaaaacccagcauau

SEQ ID NO: 1470794 - RNA, 19 nt, Homo sapiens
gcauauuccaaacuaguga

SEQ ID NO: 1470795 - RNA, 19 nt, Homo sapiens
caacaaacugcccaagaag

SEQ ID NO: 1470796 - RNA, 19 nt, Homo sapiens
guaaacuucauccucaaug

SEQ ID NO: 1470797 - RNA, 19 nt, Homo sapiens
gagacuuuaucgacuuagu

SEQ ID NO: 1470798 - RNA, 19 nt, Homo sapiens
ggaaaauuguccccaucaa

SEQ ID NO: 1470799 - RNA, 19 nt, Homo sapiens
gcgcuacgaaggaaauaug

SEQ ID NO: 1470800 - RNA, 19 nt, Homo sapiens
caucaagcgcuacgaagga

SEQ ID NO: 1470801 - RNA, 19 nt, Homo sapiens
gaauuacaugggauaaauc

SEQ ID NO: 1470802 - RNA, 19 nt, Homo sapiens
gaaucaccagcuaaacuau

SEQ ID NO: 1470803 - RNA, 19 nt, Homo sapiens
aaaccaugccuuccaacuu

SEQ ID NO: 1470804 - RNA, 19 nt, Homo sapiens
ccuccaucuucaaauuaua

SEQ ID NO: 1470805 - RNA, 19 nt, Homo sapiens
cgacuuaguguacaucaag

SEQ ID NO: 1470806 - RNA, 19 nt, Homo sapiens
ccaaacuggagacagaauu

SEQ ID NO: 1470807 - RNA, 19 nt, Homo sapiens
uaaacuucauccucaaugc

SEQ ID NO: 1470808 - RNA, 19 nt, Homo sapiens
uaucugauuuccucuacca

SEQ ID NO: 1470809 - RNA, 19 nt, Homo sapiens
ccauggaaaucuauaucgu

SEQ ID NO: 1470810 - RNA, 19 nt, Homo sapiens
gauuuccucuaccaaacug

SEQ ID NO: 1470811 - RNA, 19 nt, Homo sapiens
ccuuguggcuuuguauguu

SEQ ID NO: 1470812 - RNA, 19 nt, Homo sapiens
gucauaccauuacacaaag

SEQ ID NO: 1470813 - RNA, 19 nt, Homo sapiens
uaauaugguacacaggauu

SEQ ID NO: 1470814 - RNA, 19 nt, Homo sapiens
guuauaaucgagauacauc

SEQ ID NO: 1470815 - RNA, 19 nt, Homo sapiens
gcuaaacuaucugauuucc

SEQ ID NO: 1470816 - RNA, 19 nt, Homo sapiens
uggaauaaaggcacacaga

SEQ ID NO: 1470817 - RNA, 19 nt, Homo sapiens
uaguaaacuucauccucaa

SEQ ID NO: 1470818 - RNA, 19 nt, Homo sapiens
cagaauuacaugggauaaa

SEQ ID NO: 1470819 - RNA, 19 nt, Homo sapiens
cagaaucaccagcuaaacu

SEQ ID NO: 1470820 - RNA, 19 nt, Homo sapiens
guggauuucaucauaauag

SEQ ID NO: 1470821 - RNA, 19 nt, Homo sapiens
caucaagacguggauuuca

SEQ ID NO: 1470822 - RNA, 19 nt, Homo sapiens
cagcauauuccaaacuagu

SEQ ID NO: 1470823 - RNA, 19 nt, Homo sapiens
cuuuguauguucaccaaug

SEQ ID NO: 1470824 - RNA, 19 nt, Homo sapiens
gauucggacacauucauau

SEQ ID NO: 1470825 - RNA, 19 nt, Homo sapiens
ugauucggacacauucaua

SEQ ID NO: 1470826 - RNA, 19 nt, Homo sapiens
uugcaaguguauaauaugg

SEQ ID NO: 1470827 - RNA, 19 nt, Homo sapiens
ugcaaaagauggaauaaag

SEQ ID NO: 1470828 - RNA, 19 nt, Homo sapiens
auuccaaacuagugauguu

SEQ ID NO: 1470829 - RNA, 19 nt, Homo sapiens
guucaccaauggaagaaaa

SEQ ID NO: 1470830 - RNA, 19 nt, Homo sapiens
caagcgcuacgaaggaaau

SEQ ID NO: 1470831 - RNA, 19 nt, Homo sapiens
ggcuuuguauguucaccaa

SEQ ID NO: 1470832 - RNA, 19 nt, Homo sapiens
uccagaauauccuccaucu

SEQ ID NO: 1470833 - RNA, 19 nt, Homo sapiens
gcuacgaaggaaauaugaa

SEQ ID NO: 1470834 - RNA, 19 nt, Homo sapiens
aauauccuccaucuucaaa

SEQ ID NO: 1470835 - RNA, 19 nt, Homo sapiens
caggauugauucggacaca

SEQ ID NO: 1470836 - RNA, 19 nt, Homo sapiens
gggauaaaucauugcaagu

SEQ ID NO: 1470837 - RNA, 19 nt, Homo sapiens
aauaaaggcacacagaacu

SEQ ID NO: 1470838 - RNA, 19 nt, Homo sapiens
agauacaucaggcuggaaa

SEQ ID NO: 1470839 - RNA, 19 nt, Homo sapiens
uauguucaccaauggaaga

SEQ ID NO: 1470840 - RNA, 19 nt, Homo sapiens
gacuuuaucgacuuagugu

SEQ ID NO: 1470841 - RNA, 19 nt, Homo sapiens
gacaaucacugcagagaua

SEQ ID NO: 1470842 - RNA, 19 nt, Homo sapiens
gcaaugcgccacucaauga

SEQ ID NO: 1470843 - RNA, 19 nt, Homo sapiens
gaggauagcaggcguaaau

SEQ ID NO: 1470844 - RNA, 19 nt, Homo sapiens
ucuaaucacugcaugcuuu

SEQ ID NO: 1470845 - RNA, 19 nt, Homo sapiens
auagugaccugacuuguga

SEQ ID NO: 1470846 - RNA, 19 nt, Homo sapiens
gaagcuguuuguggcauuu

SEQ ID NO: 1470847 - RNA, 19 nt, Homo sapiens
gcguaaauaccuacuguaa

SEQ ID NO: 1470848 - RNA, 19 nt, Homo sapiens
gaaauuaacauugcgucuu

SEQ ID NO: 1470849 - RNA, 19 nt, Homo sapiens
gacaguaguaccagugaua

SEQ ID NO: 1470850 - RNA, 19 nt, Homo sapiens
aaauuaacauugcgucuuc

SEQ ID NO: 1470851 - RNA, 19 nt, Homo sapiens
gccacucaaugaagaaauu

SEQ ID NO: 1470852 - RNA, 19 nt, Homo sapiens
agacucuacuccaugauuu

SEQ ID NO: 1470853 - RNA, 19 nt, Homo sapiens
gaaguucauugucauagcu

SEQ ID NO: 1470854 - RNA, 19 nt, Homo sapiens
ugaccugacuugugacuca

SEQ ID NO: 1470855 - RNA, 19 nt, Homo sapiens
aaucucaaguucagaaaga

SEQ ID NO: 1470856 - RNA, 19 nt, Homo sapiens
gcaauccagugauaaacag

SEQ ID NO: 1470857 - RNA, 19 nt, Homo sapiens
aacauugcgucuucagaua

SEQ ID NO: 1470858 - RNA, 19 nt, Homo sapiens
caaaacaucugcuggcaau

SEQ ID NO: 1470859 - RNA, 19 nt, Homo sapiens
gauagugaccugacuugug

SEQ ID NO: 1470860 - RNA, 19 nt, Homo sapiens
cugcaaggaagaaauauaa

SEQ ID NO: 1470861 - RNA, 19 nt, Homo sapiens
uagcaggcguaaauaccua

SEQ ID NO: 1470862 - RNA, 19 nt, Homo sapiens
gcagaaguuguugaccuua

SEQ ID NO: 1470863 - RNA, 19 nt, Homo sapiens
uaacauugcgucuucagau

SEQ ID NO: 1470864 - RNA, 19 nt, Homo sapiens
gaacugagaagggacucuu

SEQ ID NO: 1470865 - RNA, 19 nt, Homo sapiens
ggauucaaacucauggaaa

SEQ ID NO: 1470866 - RNA, 19 nt, Homo sapiens
gcacuguucccuuccacuu

SEQ ID NO: 1470867 - RNA, 19 nt, Homo sapiens
gauucaaacucauggaaaa

SEQ ID NO: 1470868 - RNA, 19 nt, Homo sapiens
acauggaaguucauuguca

SEQ ID NO: 1470869 - RNA, 19 nt, Homo sapiens
ugacauggaaguucauugu

SEQ ID NO: 1470870 - RNA, 19 nt, Homo sapiens
ggacaguaguaccagugau

SEQ ID NO: 1470871 - RNA, 19 nt, Homo sapiens
aaccggcaauccagugaua

SEQ ID NO: 1470872 - RNA, 19 nt, Homo sapiens
cuguagaacuggaaucuca

SEQ ID NO: 1470873 - RNA, 19 nt, Homo sapiens
guucaagagcacaguaauu

SEQ ID NO: 1470874 - RNA, 19 nt, Homo sapiens
acccagaagugguaaaugu

SEQ ID NO: 1470875 - RNA, 19 nt, Homo sapiens
guggucaccuggcugauuc

SEQ ID NO: 1470876 - RNA, 19 nt, Homo sapiens
ggaaguucauugucauagc

SEQ ID NO: 1470877 - RNA, 19 nt, Homo sapiens
gcugcaaggaagaaauaua

SEQ ID NO: 1470878 - RNA, 19 nt, Homo sapiens
uauguuagcaccaggcaaa

SEQ ID NO: 1470879 - RNA, 19 nt, Homo sapiens
gggagcagcaagacaauca

SEQ ID NO: 1470880 - RNA, 19 nt, Homo sapiens
gucccgaucugaaagugaa

SEQ ID NO: 1470881 - RNA, 19 nt, Homo sapiens
caagagcacaguaauucug

SEQ ID NO: 1470882 - RNA, 19 nt, Homo sapiens
guaguaccagugauaguga

SEQ ID NO: 1470883 - RNA, 19 nt, Homo sapiens
ggccgagucgccaagguua

SEQ ID NO: 1470884 - RNA, 19 nt, Homo sapiens
aauacaaugucacuguguu

SEQ ID NO: 1470885 - RNA, 19 nt, Homo sapiens
ccacucaaugaagaaauua

SEQ ID NO: 1470886 - RNA, 19 nt, Homo sapiens
acaguuauuucuucaaugc

SEQ ID NO: 1470887 - RNA, 19 nt, Homo sapiens
cagaguguuucuucaugga

SEQ ID NO: 1470888 - RNA, 19 nt, Homo sapiens
agaggcaggucauuuggau

SEQ ID NO: 1470889 - RNA, 19 nt, Homo sapiens
ucagggagcagcaagacaa

SEQ ID NO: 1470890 - RNA, 19 nt, Homo sapiens
gacucuacuccaugauuua

SEQ ID NO: 1470891 - RNA, 19 nt, Homo sapiens
gagagugacaagccuacaa

SEQ ID NO: 1470892 - RNA, 19 nt, Homo sapiens
ggaaucucaaguucagaaa

SEQ ID NO: 1470893 - RNA, 19 nt, Homo sapiens
ggugugauucagaguguuu

SEQ ID NO: 1470894 - RNA, 19 nt, Homo sapiens
gauagugaaguagagauug

SEQ ID NO: 1470895 - RNA, 19 nt, Homo sapiens
uacguugucuuccgcagaa

SEQ ID NO: 1470896 - RNA, 19 nt, Homo sapiens
agaaacggcgguagaagga

SEQ ID NO: 1470897 - RNA, 19 nt, Homo sapiens
ccacuuccucauccucuuu

SEQ ID NO: 1470898 - RNA, 19 nt, Homo sapiens
gauucagaguguuucuuca

SEQ ID NO: 1470899 - RNA, 19 nt, Homo sapiens
cauggaaguucauugucau

SEQ ID NO: 1470900 - RNA, 19 nt, Homo sapiens
ggauagcaggcguaaauac

SEQ ID NO: 1470901 - RNA, 19 nt, Homo sapiens
cuccaguuguagcucauua

SEQ ID NO: 1470902 - RNA, 19 nt, Homo sapiens
auagugaaguagagauugu

SEQ ID NO: 1470903 - RNA, 19 nt, Homo sapiens
guaguucaagagcacagua

SEQ ID NO: 1470904 - RNA, 19 nt, Homo sapiens
ggagacccuucaggagugu

SEQ ID NO: 1470905 - RNA, 19 nt, Homo sapiens
caguuagcauccacagaga

SEQ ID NO: 1470906 - RNA, 19 nt, Homo sapiens
cagaaguuguugaccuuac

SEQ ID NO: 1470907 - RNA, 19 nt, Homo sapiens
gcucgggcacgcaguaugu

SEQ ID NO: 1470908 - RNA, 19 nt, Homo sapiens
guggugugauucagagugu

SEQ ID NO: 1470909 - RNA, 19 nt, Homo sapiens
gcagaggcaggucauuugg

SEQ ID NO: 1470910 - RNA, 19 nt, Homo sapiens
agaugaugaugaagagguu

SEQ ID NO: 1470911 - RNA, 19 nt, Homo sapiens
aaaagcaucugaacaagag

SEQ ID NO: 1470912 - RNA, 19 nt, Homo sapiens
auucugaaaugaagaugga

SEQ ID NO: 1470913 - RNA, 19 nt, Homo sapiens
caugcaagguguguucauc

SEQ ID NO: 1470914 - RNA, 19 nt, Homo sapiens
ggcaaugcgccacucaaug

SEQ ID NO: 1470915 - RNA, 19 nt, Homo sapiens
cggcugcaguaguucaaga

SEQ ID NO: 1470916 - RNA, 19 nt, Homo sapiens
caagcacgagcucaucaga

SEQ ID NO: 1470917 - RNA, 19 nt, Homo sapiens
cugcugcaaggaagaaaua

SEQ ID NO: 1470918 - RNA, 19 nt, Homo sapiens
gggaggcugcugcaaggaa

SEQ ID NO: 1470919 - RNA, 19 nt, Homo sapiens
uagcauccacagagaguga

SEQ ID NO: 1470920 - RNA, 19 nt, Homo sapiens
aggcguaaauaccuacugu

SEQ ID NO: 1470921 - RNA, 19 nt, Homo sapiens
gauugugggaguucaggaa

SEQ ID NO: 1470922 - RNA, 19 nt, Homo sapiens
gaccugacuugugacucaa

SEQ ID NO: 1470923 - RNA, 19 nt, Homo sapiens
ggcaauccagugauaaaca

SEQ ID NO: 1470924 - RNA, 19 nt, Homo sapiens
cuccaugauuuaacuugaa

SEQ ID NO: 1470925 - RNA, 19 nt, Homo sapiens
agaagcuguuuguggcauu

SEQ ID NO: 1470926 - RNA, 19 nt, Homo sapiens
cguaaauaccuacuguaau

SEQ ID NO: 1470927 - RNA, 19 nt, Homo sapiens
uuuauuggcggcugcagua

SEQ ID NO: 1470928 - RNA, 19 nt, Homo sapiens
gcagaaacggcgguagaag

SEQ ID NO: 1470929 - RNA, 19 nt, Homo sapiens
ggcagaaacggcgguagaa

SEQ ID NO: 1470930 - RNA, 19 nt, Homo sapiens
ugaacccucucaggcagaa

SEQ ID NO: 1470931 - RNA, 19 nt, Homo sapiens
aagaugguguagcggauuc

SEQ ID NO: 1470932 - RNA, 19 nt, Homo sapiens
uagcggauucuacaguuau

SEQ ID NO: 1470933 - RNA, 19 nt, Homo sapiens
ccaguuguagcucauuaug

SEQ ID NO: 1470934 - RNA, 19 nt, Homo sapiens
gcaaggaagaaauauaacc

SEQ ID NO: 1470935 - RNA, 19 nt, Homo sapiens
aacaagagacagccaagga

SEQ ID NO: 1470936 - RNA, 19 nt, Homo sapiens
acuccaugauuuaacuuga

SEQ ID NO: 1470937 - RNA, 19 nt, Homo sapiens
gaccagcgggcuucuagag

SEQ ID NO: 1470938 - RNA, 19 nt, Homo sapiens
auacaaugucacuguguuu

SEQ ID NO: 1470939 - RNA, 19 nt, Homo sapiens
agcagaaguuguugaccuu

SEQ ID NO: 1470940 - RNA, 19 nt, Homo sapiens
ccagcagacuugggcuuca

SEQ ID NO: 1470941 - RNA, 19 nt, Homo sapiens
gcauuuagcuguauuguga

SEQ ID NO: 1470942 - RNA, 19 nt, Homo sapiens
cagaauagauguagagaaa

SEQ ID NO: 1470943 - RNA, 19 nt, Homo sapiens
gcacuuaguuggaggcaaa

SEQ ID NO: 1470944 - RNA, 19 nt, Homo sapiens
ggaaggcauugcuauuuaa

SEQ ID NO: 1470945 - RNA, 19 nt, Homo sapiens
gauaagaguucaugaccuu

SEQ ID NO: 1470946 - RNA, 19 nt, Homo sapiens
aaacggguguggaacauua

SEQ ID NO: 1470947 - RNA, 19 nt, Homo sapiens
ggaaagcccagcccuauuu

SEQ ID NO: 1470948 - RNA, 19 nt, Homo sapiens
cauagcgucuuaauuguuu

SEQ ID NO: 1470949 - RNA, 19 nt, Homo sapiens
ggccauagcgucuuaauug

SEQ ID NO: 1470950 - RNA, 19 nt, Homo sapiens
gaaaggagaaagauacaug

SEQ ID NO: 1470951 - RNA, 19 nt, Homo sapiens
cagcuuaaaucuguucuuu

SEQ ID NO: 1470952 - RNA, 19 nt, Homo sapiens
gaugcgaucuccuugaaau

SEQ ID NO: 1470953 - RNA, 19 nt, Homo sapiens
gagccugaaaguauaauua

SEQ ID NO: 1470954 - RNA, 19 nt, Homo sapiens
aggaaggcauugcuauuua

SEQ ID NO: 1470955 - RNA, 19 nt, Homo sapiens
gaggaaggcauugcuauuu

SEQ ID NO: 1470956 - RNA, 19 nt, Homo sapiens
ccuaauaccuagcccugua

SEQ ID NO: 1470957 - RNA, 19 nt, Homo sapiens
caaggucccuggcuuaagu

SEQ ID NO: 1470958 - RNA, 19 nt, Homo sapiens
cgagaugcauuuagauuca

SEQ ID NO: 1470959 - RNA, 19 nt, Homo sapiens
uaccaccaaucucuaaaua

SEQ ID NO: 1470960 - RNA, 19 nt, Homo sapiens
gcacuguaaaucccuguua

SEQ ID NO: 1470961 - RNA, 19 nt, Homo sapiens
gcaaacaugcccacaggaa

SEQ ID NO: 1470962 - RNA, 19 nt, Homo sapiens
gacacccucuuaaccauuu

SEQ ID NO: 1470963 - RNA, 19 nt, Homo sapiens
cuacaacaauagcuugauu

SEQ ID NO: 1470964 - RNA, 19 nt, Homo sapiens
ccucagagcugccccuuua

SEQ ID NO: 1470965 - RNA, 19 nt, Homo sapiens
uagaggauacuaaugcuua

SEQ ID NO: 1470966 - RNA, 19 nt, Homo sapiens
gcucagcugccuuuaaauu

SEQ ID NO: 1470967 - RNA, 19 nt, Homo sapiens
gcgagagcaugcuugguuu

SEQ ID NO: 1470968 - RNA, 19 nt, Homo sapiens
gaucgaaaggagaaagaua

SEQ ID NO: 1470969 - RNA, 19 nt, Homo sapiens
ggaugcugauuccauguuu

SEQ ID NO: 1470970 - RNA, 19 nt, Homo sapiens
gaaaugacaguugcugcua

SEQ ID NO: 1470971 - RNA, 19 nt, Homo sapiens
ucaguuaucugggugacua

SEQ ID NO: 1470972 - RNA, 19 nt, Homo sapiens
gaccagggcuccucuacca

SEQ ID NO: 1470973 - RNA, 19 nt, Homo sapiens
guuaggguuuggcgaauuu

SEQ ID NO: 1470974 - RNA, 19 nt, Homo sapiens
uguaggccauuucagaaua

SEQ ID NO: 1470975 - RNA, 19 nt, Homo sapiens
ggauguaggccauuucaga

SEQ ID NO: 1470976 - RNA, 19 nt, Homo sapiens
ucauuaccauccucauuaa

SEQ ID NO: 1470977 - RNA, 19 nt, Homo sapiens
ucacauuucucgucuugga

SEQ ID NO: 1470978 - RNA, 19 nt, Homo sapiens
gaaacagagguaucgcuuu

SEQ ID NO: 1470979 - RNA, 19 nt, Homo sapiens
uagagaguuugccagcuua

SEQ ID NO: 1470980 - RNA, 19 nt, Homo sapiens
guagugaaguuaggguuug

SEQ ID NO: 1470981 - RNA, 19 nt, Homo sapiens
aaacagagguaucgcuuuu

SEQ ID NO: 1470982 - RNA, 19 nt, Homo sapiens
caacugccuuuguaugaca

SEQ ID NO: 1470983 - RNA, 19 nt, Homo sapiens
gcaucgcccuugugcuauu

SEQ ID NO: 1470984 - RNA, 19 nt, Homo sapiens
ccauggccauagcgucuua

SEQ ID NO: 1470985 - RNA, 19 nt, Homo sapiens
uugcucagcugccuuuaaa

SEQ ID NO: 1470986 - RNA, 19 nt, Homo sapiens
gugcaucgcccuugugcua

SEQ ID NO: 1470987 - RNA, 19 nt, Homo sapiens
aaacaaaacagcagcaaua

SEQ ID NO: 1470988 - RNA, 19 nt, Homo sapiens
gauguaggccauuucagaa

SEQ ID NO: 1470989 - RNA, 19 nt, Homo sapiens
caaauucugcccaucaguu

SEQ ID NO: 1470990 - RNA, 19 nt, Homo sapiens
aauccgagaugcauuuaga

SEQ ID NO: 1470991 - RNA, 19 nt, Homo sapiens
ucaacaagguccuaaacca

SEQ ID NO: 1470992 - RNA, 19 nt, Homo sapiens
augaugacauucugcauuu

SEQ ID NO: 1470993 - RNA, 19 nt, Homo sapiens
uaacuggagauugcacuua

SEQ ID NO: 1470994 - RNA, 19 nt, Homo sapiens
uuagagaguuugccagcuu

SEQ ID NO: 1470995 - RNA, 19 nt, Homo sapiens
caaacaugcccacaggaaa

SEQ ID NO: 1470996 - RNA, 19 nt, Homo sapiens
gaugacauucugcauuuau

SEQ ID NO: 1470997 - RNA, 19 nt, Homo sapiens
gaugauagaaugaugacau

SEQ ID NO: 1470998 - RNA, 19 nt, Homo sapiens
gggcagcgguugacaaagc

SEQ ID NO: 1470999 - RNA, 19 nt, Homo sapiens
gccauagcgucuuaauugu

SEQ ID NO: 1471000 - RNA, 19 nt, Homo sapiens
aaauucugcccaucaguua

SEQ ID NO: 1471001 - RNA, 19 nt, Homo sapiens
uaauaccaccaaucucuaa

SEQ ID NO: 1471002 - RNA, 19 nt, Homo sapiens
cacuguaaaucccuguuaa

SEQ ID NO: 1471003 - RNA, 19 nt, Homo sapiens
caucuuguuuagccgagua

SEQ ID NO: 1471004 - RNA, 19 nt, Homo sapiens
uacuuggcauuuccucuua

SEQ ID NO: 1471005 - RNA, 19 nt, Homo sapiens
ccacauuucuuucauuuuc

SEQ ID NO: 1471006 - RNA, 19 nt, Homo sapiens
agaggauacuaaugcuuaa

SEQ ID NO: 1471007 - RNA, 19 nt, Homo sapiens
gauagaggauacuaaugcu

SEQ ID NO: 1471008 - RNA, 19 nt, Homo sapiens
gaguuggucuguggguaaa

SEQ ID NO: 1471009 - RNA, 19 nt, Homo sapiens
aaacaugcccacaggaaau

SEQ ID NO: 1471010 - RNA, 19 nt, Homo sapiens
uguugagccugaaaguaua

SEQ ID NO: 1471011 - RNA, 19 nt, Homo sapiens
gauguugagccugaaagua

SEQ ID NO: 1471012 - RNA, 19 nt, Homo sapiens
uggaugcgaucuccuugaa

SEQ ID NO: 1471013 - RNA, 19 nt, Homo sapiens
ugaugacauucugcauuua

SEQ ID NO: 1471014 - RNA, 19 nt, Homo sapiens
gagauugcacuuaguugga

SEQ ID NO: 1471015 - RNA, 19 nt, Homo sapiens
guaggccauuucagaauag

SEQ ID NO: 1471016 - RNA, 19 nt, Homo sapiens
guucaugaccuuccgauag

SEQ ID NO: 1471017 - RNA, 19 nt, Homo sapiens
gaaggauguugagccugaa

SEQ ID NO: 1471018 - RNA, 19 nt, Homo sapiens
acauucugcuacaacaaua

SEQ ID NO: 1471019 - RNA, 19 nt, Homo sapiens
gguaaaauuucgcagaaug

SEQ ID NO: 1471020 - RNA, 19 nt, Homo sapiens
ucgcagggccagcgcuuua

SEQ ID NO: 1471021 - RNA, 19 nt, Homo sapiens
cuccacauuucuuucauuu

SEQ ID NO: 1471022 - RNA, 19 nt, Homo sapiens
caccaaggucccuggcuua

SEQ ID NO: 1471023 - RNA, 19 nt, Homo sapiens
aggcauaacuggagauugc

SEQ ID NO: 1471024 - RNA, 19 nt, Homo sapiens
cuuagaggcugcagcacuu

SEQ ID NO: 1471025 - RNA, 19 nt, Homo sapiens
ccaccaaucucuaaauacc

SEQ ID NO: 1471026 - RNA, 19 nt, Homo sapiens
guauugugacacccucuua

SEQ ID NO: 1471027 - RNA, 19 nt, Homo sapiens
ccaccuccacuccacauuu

SEQ ID NO: 1471028 - RNA, 19 nt, Homo sapiens
aaaugacaguugcugcuau

SEQ ID NO: 1471029 - RNA, 19 nt, Homo sapiens
ccuguuaaguggauuccuu

SEQ ID NO: 1471030 - RNA, 19 nt, Homo sapiens
ccucuggacucacauuucu

SEQ ID NO: 1471031 - RNA, 19 nt, Homo sapiens
acacaaauucugcccauca

SEQ ID NO: 1471032 - RNA, 19 nt, Homo sapiens
gugggcacuugcacgauuu

SEQ ID NO: 1471033 - RNA, 19 nt, Homo sapiens
uucaugaccuuccgauaga

SEQ ID NO: 1471034 - RNA, 19 nt, Homo sapiens
acacuaggcagaaauucaa

SEQ ID NO: 1471035 - RNA, 19 nt, Homo sapiens
ccacuccacgucugcuuaa

SEQ ID NO: 1471036 - RNA, 19 nt, Homo sapiens
acucacauuucucgucuug

SEQ ID NO: 1471037 - RNA, 19 nt, Homo sapiens
gcaacugccuuuguaugac

SEQ ID NO: 1471038 - RNA, 19 nt, Homo sapiens
uguaggauguaggccauuu

SEQ ID NO: 1471039 - RNA, 19 nt, Homo sapiens
gauacuaaugcuuaacuca

SEQ ID NO: 1471040 - RNA, 19 nt, Homo sapiens
ucagcugccuuuaaauuuu

SEQ ID NO: 1471041 - RNA, 19 nt, Homo sapiens
ggaaauugcuuauugauug

SEQ ID NO: 1471042 - RNA, 19 nt, Homo sapiens
caaaguagauuaugccuaa

SEQ ID NO: 1471043 - RNA, 19 nt, Homo sapiens
ggaagcauguguucaauuu

SEQ ID NO: 1471044 - RNA, 19 nt, Homo sapiens
gaagaagggugauuaucug

SEQ ID NO: 1471045 - RNA, 19 nt, Homo sapiens
gaacucggcuggcacuuuc

SEQ ID NO: 1471046 - RNA, 19 nt, Homo sapiens
ggaagaaugcgcugaauau

SEQ ID NO: 1471047 - RNA, 19 nt, Homo sapiens
gaugaucgaccacagaaua

SEQ ID NO: 1471048 - RNA, 19 nt, Homo sapiens
gaaaaucccuuuagaguag

SEQ ID NO: 1471049 - RNA, 19 nt, Homo sapiens
gaagggugauuaucuguca

SEQ ID NO: 1471050 - RNA, 19 nt, Homo sapiens
cccaagagcugguguagaa

SEQ ID NO: 1471051 - RNA, 19 nt, Homo sapiens
gcuauucugugcaguguuu

SEQ ID NO: 1471052 - RNA, 19 nt, Homo sapiens
agaugaggcuuuauuguaa

SEQ ID NO: 1471053 - RNA, 19 nt, Homo sapiens
gguaauuucugaacucgaa

SEQ ID NO: 1471054 - RNA, 19 nt, Homo sapiens
gaccacagaauauaacaua

SEQ ID NO: 1471055 - RNA, 19 nt, Homo sapiens
ccuacuaugugcauuauuu

SEQ ID NO: 1471056 - RNA, 19 nt, Homo sapiens
gcauuuguaucuucaguau

SEQ ID NO: 1471057 - RNA, 19 nt, Homo sapiens
caacagacccugaggacaa

SEQ ID NO: 1471058 - RNA, 19 nt, Homo sapiens
gagauaauuucacuugcuu

SEQ ID NO: 1471059 - RNA, 19 nt, Homo sapiens
ucaauccacugcuuuagaa

SEQ ID NO: 1471060 - RNA, 19 nt, Homo sapiens
uuucugaacucgaacauuu

SEQ ID NO: 1471061 - RNA, 19 nt, Homo sapiens
cagaugaggcuuuauugua

SEQ ID NO: 1471062 - RNA, 19 nt, Homo sapiens
gcauauaucacuggcauuu

SEQ ID NO: 1471063 - RNA, 19 nt, Homo sapiens
uaacacacccucugcuauu

SEQ ID NO: 1471064 - RNA, 19 nt, Homo sapiens
gcaacacguucacccaaga

SEQ ID NO: 1471065 - RNA, 19 nt, Homo sapiens
gaggacaccuggaggaauc

SEQ ID NO: 1471066 - RNA, 19 nt, Homo sapiens
ucaaguagcugggauuaca

SEQ ID NO: 1471067 - RNA, 19 nt, Homo sapiens
gaucgaccacagaauauaa

SEQ ID NO: 1471068 - RNA, 19 nt, Homo sapiens
gaaccaauguacaaugcau

SEQ ID NO: 1471069 - RNA, 19 nt, Homo sapiens
caguauuucucuuguauga

SEQ ID NO: 1471070 - RNA, 19 nt, Homo sapiens
uaccucagcuggaagaauu

SEQ ID NO: 1471071 - RNA, 19 nt, Homo sapiens
gauccuggcucacugcaau

SEQ ID NO: 1471072 - RNA, 19 nt, Homo sapiens
gaagaaugcgcugaauauu

SEQ ID NO: 1471073 - RNA, 19 nt, Homo sapiens
ugacaagucucuguucuca

SEQ ID NO: 1471074 - RNA, 19 nt, Homo sapiens
gcaaacgacucugacaagu

SEQ ID NO: 1471075 - RNA, 19 nt, Homo sapiens
agaaugcgcugaauauuuu

SEQ ID NO: 1471076 - RNA, 19 nt, Homo sapiens
uaagagucauuuagucuca

SEQ ID NO: 1471077 - RNA, 19 nt, Homo sapiens
cgaagauccuggagagaga

SEQ ID NO: 1471078 - RNA, 19 nt, Homo sapiens
gaagacugcgacugcauuu

SEQ ID NO: 1471079 - RNA, 19 nt, Homo sapiens
ucacuugcuuuagaguuua

SEQ ID NO: 1471080 - RNA, 19 nt, Homo sapiens
guauuucucuuguaugaag

SEQ ID NO: 1471081 - RNA, 19 nt, Homo sapiens
caguaucuguacaacuuua

SEQ ID NO: 1471082 - RNA, 19 nt, Homo sapiens
gggaagaaugcgcugaaua

SEQ ID NO: 1471083 - RNA, 19 nt, Homo sapiens
gaagcugauggcauaguua

SEQ ID NO: 1471084 - RNA, 19 nt, Homo sapiens
gcauagaccaauuugcaaa

SEQ ID NO: 1471085 - RNA, 19 nt, Homo sapiens
gaugaggcuuuauuguaau

SEQ ID NO: 1471086 - RNA, 19 nt, Homo sapiens
guacaaugcauuaaucauc

SEQ ID NO: 1471087 - RNA, 19 nt, Homo sapiens
gauagaaaaucccuuuaga

SEQ ID NO: 1471088 - RNA, 19 nt, Homo sapiens
aagaaugcgcugaauauuu

SEQ ID NO: 1471089 - RNA, 19 nt, Homo sapiens
gaggggaaguuaaauugua

SEQ ID NO: 1471090 - RNA, 19 nt, Homo sapiens
auaaguggcucccaucugu

SEQ ID NO: 1471091 - RNA, 19 nt, Homo sapiens
guaugaagaagggugauua

SEQ ID NO: 1471092 - RNA, 19 nt, Homo sapiens
ccaaagugcugggauuaca

SEQ ID NO: 1471093 - RNA, 19 nt, Homo sapiens
gcacugauccugaccuuuu

SEQ ID NO: 1471094 - RNA, 19 nt, Homo sapiens
ccacagaacacuggccuaa

SEQ ID NO: 1471095 - RNA, 19 nt, Homo sapiens
gcugagauaauuucacuug

SEQ ID NO: 1471096 - RNA, 19 nt, Homo sapiens
cgacugcauuuccaacaga

SEQ ID NO: 1471097 - RNA, 19 nt, Homo sapiens
uuacugguacucugaauuu

SEQ ID NO: 1471098 - RNA, 19 nt, Homo sapiens
uaaucaauccacugcuuua

SEQ ID NO: 1471099 - RNA, 19 nt, Homo sapiens
uaggucaggcaaagaauua

SEQ ID NO: 1471100 - RNA, 19 nt, Homo sapiens
acaagucucuguucucaag

SEQ ID NO: 1471101 - RNA, 19 nt, Homo sapiens
gaaccugugagccaacauu

SEQ ID NO: 1471102 - RNA, 19 nt, Homo sapiens
gaaaaugagagaauucuga

SEQ ID NO: 1471103 - RNA, 19 nt, Homo sapiens
acacuggccuaacugcauu

SEQ ID NO: 1471104 - RNA, 19 nt, Homo sapiens
ggaacucggcuggcacuuu

SEQ ID NO: 1471105 - RNA, 19 nt, Homo sapiens
ucagcuggaagaauuaaua

SEQ ID NO: 1471106 - RNA, 19 nt, Homo sapiens
aaucaucacugaagauaac

SEQ ID NO: 1471107 - RNA, 19 nt, Homo sapiens
cauuuagucucaaguaugg

SEQ ID NO: 1471108 - RNA, 19 nt, Homo sapiens
gcauuaaucaucacugaag

SEQ ID NO: 1471109 - RNA, 19 nt, Homo sapiens
acacgugcauagaccaauu

SEQ ID NO: 1471110 - RNA, 19 nt, Homo sapiens
acagaacacuggccuaacu

SEQ ID NO: 1471111 - RNA, 19 nt, Homo sapiens
gauaaccagaugaggcuuu

SEQ ID NO: 1471112 - RNA, 19 nt, Homo sapiens
ugaagaagggugauuaucu

SEQ ID NO: 1471113 - RNA, 19 nt, Homo sapiens
gggcacauguggaaauugc

SEQ ID NO: 1471114 - RNA, 19 nt, Homo sapiens
uagcaaaguucuguacaca

SEQ ID NO: 1471115 - RNA, 19 nt, Homo sapiens
cugcauagcacuuagcaaa

SEQ ID NO: 1471116 - RNA, 19 nt, Homo sapiens
gaugguuggcuguuucaaa

SEQ ID NO: 1471117 - RNA, 19 nt, Homo sapiens
gagcugguguagaaugagu

SEQ ID NO: 1471118 - RNA, 19 nt, Homo sapiens
aaugagagaauucugauug

SEQ ID NO: 1471119 - RNA, 19 nt, Homo sapiens
auaaccagaugaggcuuua

SEQ ID NO: 1471120 - RNA, 19 nt, Homo sapiens
uguggaaauugcuuauuga

SEQ ID NO: 1471121 - RNA, 19 nt, Homo sapiens
aauaagcaagcaaggaaua

SEQ ID NO: 1471122 - RNA, 19 nt, Homo sapiens
uuaauaagcaagcaaggaa

SEQ ID NO: 1471123 - RNA, 19 nt, Homo sapiens
agacuugggccucuuaaga

SEQ ID NO: 1471124 - RNA, 19 nt, Homo sapiens
ggauaauaaggacaaggua

SEQ ID NO: 1471125 - RNA, 19 nt, Homo sapiens
gcuagucauucaacauagu

SEQ ID NO: 1471126 - RNA, 19 nt, Homo sapiens
ccugugagccaacauuauu

SEQ ID NO: 1471127 - RNA, 19 nt, Homo sapiens
agaagcugauggcauaguu

SEQ ID NO: 1471128 - RNA, 19 nt, Homo sapiens
uucaguaucuguacaacuu

SEQ ID NO: 1471129 - RNA, 19 nt, Homo sapiens
cugauuggcuagucauuca

SEQ ID NO: 1471130 - RNA, 19 nt, Homo sapiens
auauaucacuggcauuugu

SEQ ID NO: 1471131 - RNA, 19 nt, Homo sapiens
gcacauguggaaauugcuu

SEQ ID NO: 1471132 - RNA, 19 nt, Homo sapiens
cagcuggaagaauuaauaa

SEQ ID NO: 1471133 - RNA, 19 nt, Homo sapiens
uggcuagucauucaacaua

SEQ ID NO: 1471134 - RNA, 19 nt, Homo sapiens
gaggacaauugggaagaau

SEQ ID NO: 1471135 - RNA, 19 nt, Homo sapiens
ucaggauggucucgauuuc

SEQ ID NO: 1471136 - RNA, 19 nt, Homo sapiens
guucacccaagaaguauuu

SEQ ID NO: 1471137 - RNA, 19 nt, Homo sapiens
cacguucacccaagaagua

SEQ ID NO: 1471138 - RNA, 19 nt, Homo sapiens
ugaggacaauugggaagaa

SEQ ID NO: 1471139 - RNA, 19 nt, Homo sapiens
aagagcugguguagaauga

SEQ ID NO: 1471140 - RNA, 19 nt, Homo sapiens
caagagcugguguagaaug

SEQ ID NO: 1471141 - RNA, 19 nt, Homo sapiens
uaacuuagcuccauauuug

SEQ ID NO: 1471142 - RNA, 19 nt, Homo sapiens
uauauaggcuugucucuuu

SEQ ID NO: 1471143 - RNA, 19 nt, Homo sapiens
gauggacuauugaacuaua

SEQ ID NO: 1471144 - RNA, 19 nt, Homo sapiens
ugaaagggaucaaaacuua

SEQ ID NO: 1471145 - RNA, 19 nt, Homo sapiens
uaaagaaggucccagaaag

SEQ ID NO: 1471146 - RNA, 19 nt, Homo sapiens
gcaaggagcagacaucaau

SEQ ID NO: 1471147 - RNA, 19 nt, Homo sapiens
aaacauccaugaccaacuu

SEQ ID NO: 1471148 - RNA, 19 nt, Homo sapiens
auucaaagauggacuauug

SEQ ID NO: 1471149 - RNA, 19 nt, Homo sapiens
guucacagauuccacagaa

SEQ ID NO: 1471150 - RNA, 19 nt, Homo sapiens
guaugucauuccaguauaa

SEQ ID NO: 1471151 - RNA, 19 nt, Homo sapiens
caacaaaggguauaaugau

SEQ ID NO: 1471152 - RNA, 19 nt, Homo sapiens
gcuguggaaucuugaguuu

SEQ ID NO: 1471153 - RNA, 19 nt, Homo sapiens
guaaagaaggucccagaaa

SEQ ID NO: 1471154 - RNA, 19 nt, Homo sapiens
agaaugcuuuguuccuuua

SEQ ID NO: 1471155 - RNA, 19 nt, Homo sapiens
cagaaugcuuuguuccuuu

SEQ ID NO: 1471156 - RNA, 19 nt, Homo sapiens
ggugguuacuuggauguua

SEQ ID NO: 1471157 - RNA, 19 nt, Homo sapiens
auaaugaugucgugagauu

SEQ ID NO: 1471158 - RNA, 19 nt, Homo sapiens
caacauuguagguagguua

SEQ ID NO: 1471159 - RNA, 19 nt, Homo sapiens
gcagacccaucccugagaa

SEQ ID NO: 1471160 - RNA, 19 nt, Homo sapiens
gcacaacagcauuauugaa

SEQ ID NO: 1471161 - RNA, 19 nt, Homo sapiens
aaacaaggccaaugaacuu

SEQ ID NO: 1471162 - RNA, 19 nt, Homo sapiens
gagacagaaugcuuuguuc

SEQ ID NO: 1471163 - RNA, 19 nt, Homo sapiens
ggagacagaaugcuuuguu

SEQ ID NO: 1471164 - RNA, 19 nt, Homo sapiens
gcaaggagacagaaugcuu

SEQ ID NO: 1471165 - RNA, 19 nt, Homo sapiens
auagaaagcuuaaccacau

SEQ ID NO: 1471166 - RNA, 19 nt, Homo sapiens
acagaaagauagaaagcuu

SEQ ID NO: 1471167 - RNA, 19 nt, Homo sapiens
aagauggacuauugaacua

SEQ ID NO: 1471168 - RNA, 19 nt, Homo sapiens
gaaacaaggccaaugaacu

SEQ ID NO: 1471169 - RNA, 19 nt, Homo sapiens
gaacuuccggcagaacuaa

SEQ ID NO: 1471170 - RNA, 19 nt, Homo sapiens
ugccuacgcuggccacaua

SEQ ID NO: 1471171 - RNA, 19 nt, Homo sapiens
cacaacagcauuauugaaa

SEQ ID NO: 1471172 - RNA, 19 nt, Homo sapiens
gauauaugcaaguacagua

SEQ ID NO: 1471173 - RNA, 19 nt, Homo sapiens
agacuguuauuagcacuua

SEQ ID NO: 1471174 - RNA, 19 nt, Homo sapiens
ggacaggguucucaguacu

SEQ ID NO: 1471175 - RNA, 19 nt, Homo sapiens
caaggagacagaaugcuuu

SEQ ID NO: 1471176 - RNA, 19 nt, Homo sapiens
gugggucccugacaaagaa

SEQ ID NO: 1471177 - RNA, 19 nt, Homo sapiens
ccaacaaaggguauaauga

SEQ ID NO: 1471178 - RNA, 19 nt, Homo sapiens
gagcauccacugaauuuag

SEQ ID NO: 1471179 - RNA, 19 nt, Homo sapiens
gcuugucucuuuggucuuu

SEQ ID NO: 1471180 - RNA, 19 nt, Homo sapiens
ccauagccaugauuguuau

SEQ ID NO: 1471181 - RNA, 19 nt, Homo sapiens
ugagaaacaaggccaauga

SEQ ID NO: 1471182 - RNA, 19 nt, Homo sapiens
gcggaacgauggcacaaca

SEQ ID NO: 1471183 - RNA, 19 nt, Homo sapiens
caacugcccuauucuuugc

SEQ ID NO: 1471184 - RNA, 19 nt, Homo sapiens
aagcugaccuucaauggau

SEQ ID NO: 1471185 - RNA, 19 nt, Homo sapiens
ccauaaugaugucgugaga

SEQ ID NO: 1471186 - RNA, 19 nt, Homo sapiens
gcaaggccauaaugauguc

SEQ ID NO: 1471187 - RNA, 19 nt, Homo sapiens
caagaaccauagccaugau

SEQ ID NO: 1471188 - RNA, 19 nt, Homo sapiens
caaaggguauaaugauguc

SEQ ID NO: 1471189 - RNA, 19 nt, Homo sapiens
guacaguauguugcuauua

SEQ ID NO: 1471190 - RNA, 19 nt, Homo sapiens
gagaaacaaggccaaugaa

SEQ ID NO: 1471191 - RNA, 19 nt, Homo sapiens
cagcaaggccauaaugaug

SEQ ID NO: 1471192 - RNA, 19 nt, Homo sapiens
uuucaacaaugcuaacuug

SEQ ID NO: 1471193 - RNA, 19 nt, Homo sapiens
guacaacugcccuauucuu

SEQ ID NO: 1471194 - RNA, 19 nt, Homo sapiens
cagaaagauagaaagcuua

SEQ ID NO: 1471195 - RNA, 19 nt, Homo sapiens
uaccuaacaugcuguggaa

SEQ ID NO: 1471196 - RNA, 19 nt, Homo sapiens
uuacguagagucaacauug

SEQ ID NO: 1471197 - RNA, 19 nt, Homo sapiens
ucuuauuccugacauguaa

SEQ ID NO: 1471198 - RNA, 19 nt, Homo sapiens
ccaagaaccauagccauga

SEQ ID NO: 1471199 - RNA, 19 nt, Homo sapiens
uagaaagcuuaaccacauu

SEQ ID NO: 1471200 - RNA, 19 nt, Homo sapiens
uuacuuggauguuauucga

SEQ ID NO: 1471201 - RNA, 19 nt, Homo sapiens
gcacggagcaaacauccau

SEQ ID NO: 1471202 - RNA, 19 nt, Homo sapiens
uaguaagucuucaucuaug

SEQ ID NO: 1471203 - RNA, 19 nt, Homo sapiens
caaguacaguauguugcua

SEQ ID NO: 1471204 - RNA, 19 nt, Homo sapiens
cuucugacauuccauuaug

SEQ ID NO: 1471205 - RNA, 19 nt, Homo sapiens
aaagaaggucccagaaaga

SEQ ID NO: 1471206 - RNA, 19 nt, Homo sapiens
gugcucaguggaaacauua

SEQ ID NO: 1471207 - RNA, 19 nt, Homo sapiens
caacagcauuauugaaagc

SEQ ID NO: 1471208 - RNA, 19 nt, Homo sapiens
aaacuccacuugccaaugc

SEQ ID NO: 1471209 - RNA, 19 nt, Homo sapiens
ccaacaccgugcugcuuga

SEQ ID NO: 1471210 - RNA, 19 nt, Homo sapiens
caagcaguguuggaaauuc

SEQ ID NO: 1471211 - RNA, 19 nt, Homo sapiens
acuuugagguccuuggaua

SEQ ID NO: 1471212 - RNA, 19 nt, Homo sapiens
ccuauuccauaaguaagua

SEQ ID NO: 1471213 - RNA, 19 nt, Homo sapiens
uaugugcuauucaaagaug

SEQ ID NO: 1471214 - RNA, 19 nt, Homo sapiens
gacguggacugcagagaca

SEQ ID NO: 1471215 - RNA, 19 nt, Homo sapiens
ugaccaacuuuaugaugga

SEQ ID NO: 1471216 - RNA, 19 nt, Homo sapiens
ccacugaauuuaggaccaa

SEQ ID NO: 1471217 - RNA, 19 nt, Homo sapiens
aacaaaggguauaaugaug

SEQ ID NO: 1471218 - RNA, 19 nt, Homo sapiens
uguaugucauuccaguaua

SEQ ID NO: 1471219 - RNA, 19 nt, Homo sapiens
acuuggaccugucaguuaa

SEQ ID NO: 1471220 - RNA, 19 nt, Homo sapiens
ggccuggcauguucacaga

SEQ ID NO: 1471221 - RNA, 19 nt, Homo sapiens
uggcacaacagcauuauug

SEQ ID NO: 1471222 - RNA, 19 nt, Homo sapiens
uacaguauguugcuauuac

SEQ ID NO: 1471223 - RNA, 19 nt, Homo sapiens
gaaccauagccaugauugu

SEQ ID NO: 1471224 - RNA, 19 nt, Homo sapiens
acaggguucucaguacuaa

SEQ ID NO: 1471225 - RNA, 19 nt, Homo sapiens
agauuucucuuuggauuug

SEQ ID NO: 1471226 - RNA, 19 nt, Homo sapiens
cccagaaagagcuaacuua

SEQ ID NO: 1471227 - RNA, 19 nt, Homo sapiens
gugguuacuuggauguuau

SEQ ID NO: 1471228 - RNA, 19 nt, Homo sapiens
acagaaugcuuuguuccuu

SEQ ID NO: 1471229 - RNA, 19 nt, Homo sapiens
ggagcauccacugaauuua

SEQ ID NO: 1471230 - RNA, 19 nt, Homo sapiens
ccuggcauguucacagauu

SEQ ID NO: 1471231 - RNA, 19 nt, Homo sapiens
gaaacuccacuugccaaug

SEQ ID NO: 1471232 - RNA, 19 nt, Homo sapiens
caguugcgcugcuccuaga

SEQ ID NO: 1471233 - RNA, 19 nt, Homo sapiens
ugugauauaugcaaguaca

SEQ ID NO: 1471234 - RNA, 19 nt, Homo sapiens
acaccgugcugcuugauag

SEQ ID NO: 1471235 - RNA, 19 nt, Homo sapiens
gcuauucaaagauggacua

SEQ ID NO: 1471236 - RNA, 19 nt, Homo sapiens
uguguuaaauguagaugug

SEQ ID NO: 1471237 - RNA, 19 nt, Homo sapiens
uacaacugcccuauucuuu

SEQ ID NO: 1471238 - RNA, 19 nt, Homo sapiens
gcuacgcucugugcacgaa

SEQ ID NO: 1471239 - RNA, 19 nt, Homo sapiens
gcuccauauuugacagaaa

SEQ ID NO: 1471240 - RNA, 19 nt, Homo sapiens
cgauggcacaacagcauua

SEQ ID NO: 1471241 - RNA, 19 nt, Homo sapiens
caacaguaauugcacuuua

SEQ ID NO: 1471242 - RNA, 19 nt, Homo sapiens
gcacaaaucccacuuauac

SEQ ID NO: 1471243 - RNA, 19 nt, Homo sapiens
gcacuugaaugccagagaa

SEQ ID NO: 1471244 - RNA, 19 nt, Homo sapiens
gcucaaacaucuccacaau

SEQ ID NO: 1471245 - RNA, 19 nt, Homo sapiens
ggaauccaaugcagaguug

SEQ ID NO: 1471246 - RNA, 19 nt, Homo sapiens
ucaaacaucuccacaaugg

SEQ ID NO: 1471247 - RNA, 19 nt, Homo sapiens
agaaacaacuaucaagcua

SEQ ID NO: 1471248 - RNA, 19 nt, Homo sapiens
ucagaaauguugcguggaa

SEQ ID NO: 1471249 - RNA, 19 nt, Homo sapiens
gcaaggaguguuugaaguu

SEQ ID NO: 1471250 - RNA, 19 nt, Homo sapiens
gagcaggacuggaaauguc

SEQ ID NO: 1471251 - RNA, 19 nt, Homo sapiens
caaggaguguuugaaguuu

SEQ ID NO: 1471252 - RNA, 19 nt, Homo sapiens
gcaccgaguucguguucaa

SEQ ID NO: 1471253 - RNA, 19 nt, Homo sapiens
gacagcaggucucauccua

SEQ ID NO: 1471254 - RNA, 19 nt, Homo sapiens
ucaaagcuuucauuucaga

SEQ ID NO: 1471255 - RNA, 19 nt, Homo sapiens
caacuucacaacaguaauu

SEQ ID NO: 1471256 - RNA, 19 nt, Homo sapiens
cuucaaggccuaccaauuu

SEQ ID NO: 1471257 - RNA, 19 nt, Homo sapiens
gagaaucaaagcuuucauu

SEQ ID NO: 1471258 - RNA, 19 nt, Homo sapiens
cauccuagguccuuagaga

SEQ ID NO: 1471259 - RNA, 19 nt, Homo sapiens
ugaaagcuagggccucuua

SEQ ID NO: 1471260 - RNA, 19 nt, Homo sapiens
gcaccaaggccgugaacuu

SEQ ID NO: 1471261 - RNA, 19 nt, Homo sapiens
aaacaacuaucaagcuaca

SEQ ID NO: 1471262 - RNA, 19 nt, Homo sapiens
gaaucaaagcuuucauuuc

SEQ ID NO: 1471263 - RNA, 19 nt, Homo sapiens
gcucuuccuuggugacauu

SEQ ID NO: 1471264 - RNA, 19 nt, Homo sapiens
ugacagauuugcuuuacca

SEQ ID NO: 1471265 - RNA, 19 nt, Homo sapiens
gugcacaaaucccacuuau

SEQ ID NO: 1471266 - RNA, 19 nt, Homo sapiens
gcagauagaaguuuuagaa

SEQ ID NO: 1471267 - RNA, 19 nt, Homo sapiens
gaacauccgcagauagaag

SEQ ID NO: 1471268 - RNA, 19 nt, Homo sapiens
gcccagaguucaucacaag

SEQ ID NO: 1471269 - RNA, 19 nt, Homo sapiens
cagccugucuuccuuugaa

SEQ ID NO: 1471270 - RNA, 19 nt, Homo sapiens
gaacuuugccaugcaugaa

SEQ ID NO: 1471271 - RNA, 19 nt, Homo sapiens
ucacaagguccuacagauu

SEQ ID NO: 1471272 - RNA, 19 nt, Homo sapiens
gauguacggucuggccaaa

SEQ ID NO: 1471273 - RNA, 19 nt, Homo sapiens
aagcuagggccucuuauuu

SEQ ID NO: 1471274 - RNA, 19 nt, Homo sapiens
gagcaacuucacaacagua

SEQ ID NO: 1471275 - RNA, 19 nt, Homo sapiens
ggaguacgagaucuucaaa

SEQ ID NO: 1471276 - RNA, 19 nt, Homo sapiens
gaguucguguucaaaguga

SEQ ID NO: 1471277 - RNA, 19 nt, Homo sapiens
uacagauucuaccacaaua

SEQ ID NO: 1471278 - RNA, 19 nt, Homo sapiens
gcagaugccaccuacaauc

SEQ ID NO: 1471279 - RNA, 19 nt, Homo sapiens
guaauugcacuuuaagaca

SEQ ID NO: 1471280 - RNA, 19 nt, Homo sapiens
caccaaggccgugaacuuu

SEQ ID NO: 1471281 - RNA, 19 nt, Homo sapiens
gccaucacaugcucaaaca

SEQ ID NO: 1471282 - RNA, 19 nt, Homo sapiens
guuugaaguuucugcuuug

SEQ ID NO: 1471283 - RNA, 19 nt, Homo sapiens
gagaggagaacggcuguga

SEQ ID NO: 1471284 - RNA, 19 nt, Homo sapiens
uguuugaaguuucugcuuu

SEQ ID NO: 1471285 - RNA, 19 nt, Homo sapiens
gaggagaacggcugugagu

SEQ ID NO: 1471286 - RNA, 19 nt, Homo sapiens
ugcaggacguggccuauga

SEQ ID NO: 1471287 - RNA, 19 nt, Homo sapiens
gcacggaagccgacuacca

SEQ ID NO: 1471288 - RNA, 19 nt, Homo sapiens
gugcagaugccaccuacaa

SEQ ID NO: 1471289 - RNA, 19 nt, Homo sapiens
ugaaguuucugcuuugaac

SEQ ID NO: 1471290 - RNA, 19 nt, Homo sapiens
ggaccucgcagaagacagu

SEQ ID NO: 1471291 - RNA, 19 nt, Homo sapiens
cuacagauucuaccacaau

SEQ ID NO: 1471292 - RNA, 19 nt, Homo sapiens
gaucaagacaccuuuuauu

SEQ ID NO: 1471293 - RNA, 19 nt, Homo sapiens
ggcgcuaucugcuguucaa

SEQ ID NO: 1471294 - RNA, 19 nt, Homo sapiens
ccacuacuaccacuacuca

SEQ ID NO: 1471295 - RNA, 19 nt, Homo sapiens
cacaagguccuacagauuc

SEQ ID NO: 1471296 - RNA, 19 nt, Homo sapiens
ccacuuauacucucaucau

SEQ ID NO: 1471297 - RNA, 19 nt, Homo sapiens
gcaguaccuucaccacaac

SEQ ID NO: 1471298 - RNA, 19 nt, Homo sapiens
gcagcaaccggugcacaaa

SEQ ID NO: 1471299 - RNA, 19 nt, Homo sapiens
aaagcuagggccucuuauu

SEQ ID NO: 1471300 - RNA, 19 nt, Homo sapiens
ccaaggccgugaacuuugc

SEQ ID NO: 1471301 - RNA, 19 nt, Homo sapiens
gcacaacguccaggugauc

SEQ ID NO: 1471302 - RNA, 19 nt, Homo sapiens
cagaaauguugcguggaaa

SEQ ID NO: 1471303 - RNA, 19 nt, Homo sapiens
caacuuuuccugccauuuu

SEQ ID NO: 1471304 - RNA, 19 nt, Homo sapiens
uggacgagcguguuuggua

SEQ ID NO: 1471305 - RNA, 19 nt, Homo sapiens
caucuuccaugacaacaac

SEQ ID NO: 1471306 - RNA, 19 nt, Homo sapiens
uggaacauccgcagauaga

SEQ ID NO: 1471307 - RNA, 19 nt, Homo sapiens
ggugcacaaaucccacuua

SEQ ID NO: 1471308 - RNA, 19 nt, Homo sapiens
caucacaugcucaaacauc

SEQ ID NO: 1471309 - RNA, 19 nt, Homo sapiens
agcaguaccuucaccacaa

SEQ ID NO: 1471310 - RNA, 19 nt, Homo sapiens
gcagaagacaguggaagca

SEQ ID NO: 1471311 - RNA, 19 nt, Homo sapiens
caaaucccacuuauacucu

SEQ ID NO: 1471312 - RNA, 19 nt, Homo sapiens
acuaucaagcuacaacuuu

SEQ ID NO: 1471313 - RNA, 19 nt, Homo sapiens
uaagacagccuagaguucu

SEQ ID NO: 1471314 - RNA, 19 nt, Homo sapiens
ccacccagaggauguucua

SEQ ID NO: 1471315 - RNA, 19 nt, Homo sapiens
caucacaagguccuacaga

SEQ ID NO: 1471316 - RNA, 19 nt, Homo sapiens
ugucuuccuuugaaauugu

SEQ ID NO: 1471317 - RNA, 19 nt, Homo sapiens
ccagacaggccagagaaga

SEQ ID NO: 1471318 - RNA, 19 nt, Homo sapiens
ccucacugcucaacgucuu

SEQ ID NO: 1471319 - RNA, 19 nt, Homo sapiens
gaaagcuagggccucuuau

SEQ ID NO: 1471320 - RNA, 19 nt, Homo sapiens
guucuggacgagcguguuu

SEQ ID NO: 1471321 - RNA, 19 nt, Homo sapiens
ggccugagcaacuucacaa

SEQ ID NO: 1471322 - RNA, 19 nt, Homo sapiens
cagcaaggaguguuugaag

SEQ ID NO: 1471323 - RNA, 19 nt, Homo sapiens
ggaacauccgcagauagaa

SEQ ID NO: 1471324 - RNA, 19 nt, Homo sapiens
gcccagacaggccagagaa

SEQ ID NO: 1471325 - RNA, 19 nt, Homo sapiens
acaaaucccacuuauacuc

SEQ ID NO: 1471326 - RNA, 19 nt, Homo sapiens
guugcagccugucuuccuu

SEQ ID NO: 1471327 - RNA, 19 nt, Homo sapiens
agaagaaacaacuaucaag

SEQ ID NO: 1471328 - RNA, 19 nt, Homo sapiens
ugagcaacuucacaacagu

SEQ ID NO: 1471329 - RNA, 19 nt, Homo sapiens
agaagagagccacguccua

SEQ ID NO: 1471330 - RNA, 19 nt, Homo sapiens
ggcccagaguucaucacaa

SEQ ID NO: 1471331 - RNA, 19 nt, Homo sapiens
cagccucacugcucaacgu

SEQ ID NO: 1471332 - RNA, 19 nt, Homo sapiens
gggagaaucaaagcuuuca

SEQ ID NO: 1471333 - RNA, 19 nt, Homo sapiens
uacgagaucuucaaaaugg

SEQ ID NO: 1471334 - RNA, 19 nt, Homo sapiens
acucagacccggugugcaa

SEQ ID NO: 1471335 - RNA, 19 nt, Homo sapiens
ccugggagggccacuacua

SEQ ID NO: 1471336 - RNA, 19 nt, Homo sapiens
acagauucuaccacaauaa

SEQ ID NO: 1471337 - RNA, 19 nt, Homo sapiens
gccgccuccugcucagaua

SEQ ID NO: 1471338 - RNA, 19 nt, Homo sapiens
cuaucaagcuacaacuuuu

SEQ ID NO: 1471339 - RNA, 19 nt, Homo sapiens
uuaagacagccuagaguuc

SEQ ID NO: 1471340 - RNA, 19 nt, Homo sapiens
gagucacagugccaucaca

SEQ ID NO: 1471341 - RNA, 19 nt, Homo sapiens
ggacaaagucggucaagaa

SEQ ID NO: 1471342 - RNA, 19 nt, Homo sapiens
gaggugauauugaugugua

SEQ ID NO: 1471343 - RNA, 19 nt, Homo sapiens
ugaaugcaguccauguuua

SEQ ID NO: 1471344 - RNA, 19 nt, Homo sapiens
gaaagacacguauaccauu

SEQ ID NO: 1471345 - RNA, 19 nt, Homo sapiens
ugaaaucgaugcugguuug

SEQ ID NO: 1471346 - RNA, 19 nt, Homo sapiens
gcucaaccauucuuaacaa

SEQ ID NO: 1471347 - RNA, 19 nt, Homo sapiens
gaaggcaauuucugacgaa

SEQ ID NO: 1471348 - RNA, 19 nt, Homo sapiens
cauccuagccuuaauguuu

SEQ ID NO: 1471349 - RNA, 19 nt, Homo sapiens
gcuaguggcuaaaggcaaa

SEQ ID NO: 1471350 - RNA, 19 nt, Homo sapiens
aaagacacguauaccauuu

SEQ ID NO: 1471351 - RNA, 19 nt, Homo sapiens
gaaggauacuuugacaguu

SEQ ID NO: 1471352 - RNA, 19 nt, Homo sapiens
aaucgaugcugguuuguuu

SEQ ID NO: 1471353 - RNA, 19 nt, Homo sapiens
cagcgcaaauuauccagua

SEQ ID NO: 1471354 - RNA, 19 nt, Homo sapiens
caaccauucuuaacaagug

SEQ ID NO: 1471355 - RNA, 19 nt, Homo sapiens
gagcgggagugaaagaaga

SEQ ID NO: 1471356 - RNA, 19 nt, Homo sapiens
caaagucggucaagaacca

SEQ ID NO: 1471357 - RNA, 19 nt, Homo sapiens
cgaaauaccaaccgugaaa

SEQ ID NO: 1471358 - RNA, 19 nt, Homo sapiens
aaggauacuuugacaguuu

SEQ ID NO: 1471359 - RNA, 19 nt, Homo sapiens
ccgaaugacuggacaagug

SEQ ID NO: 1471360 - RNA, 19 nt, Homo sapiens
caaaucagcagcuuauaca

SEQ ID NO: 1471361 - RNA, 19 nt, Homo sapiens
aaacgaggcauuccaaguu

SEQ ID NO: 1471362 - RNA, 19 nt, Homo sapiens
acauguauaugguacguuu

SEQ ID NO: 1471363 - RNA, 19 nt, Homo sapiens
uuagagagaaggauacuuu

SEQ ID NO: 1471364 - RNA, 19 nt, Homo sapiens
caagaugagcuuaaacuuc

SEQ ID NO: 1471365 - RNA, 19 nt, Homo sapiens
gaaugcaguccauguuuau

SEQ ID NO: 1471366 - RNA, 19 nt, Homo sapiens
gcaaaucagcagcuuauac

SEQ ID NO: 1471367 - RNA, 19 nt, Homo sapiens
gaaaggcccguguccagau

SEQ ID NO: 1471368 - RNA, 19 nt, Homo sapiens
caugaugccuuaauuugag

SEQ ID NO: 1471369 - RNA, 19 nt, Homo sapiens
gaugaaugcaguccauguu

SEQ ID NO: 1471370 - RNA, 19 nt, Homo sapiens
ccuccaagaugagcuuaaa

SEQ ID NO: 1471371 - RNA, 19 nt, Homo sapiens
gagugcgccuugcgaucua

SEQ ID NO: 1471372 - RNA, 19 nt, Homo sapiens
auccuagccuuaauguuua

SEQ ID NO: 1471373 - RNA, 19 nt, Homo sapiens
agagaaggauacuuugaca

SEQ ID NO: 1471374 - RNA, 19 nt, Homo sapiens
gugaugaccagcugcauga

SEQ ID NO: 1471375 - RNA, 19 nt, Homo sapiens
uaacaagugcuggcuguga

SEQ ID NO: 1471376 - RNA, 19 nt, Homo sapiens
aacgaggcauuccaaguuu

SEQ ID NO: 1471377 - RNA, 19 nt, Homo sapiens
ccagaugaaugcaguccau

SEQ ID NO: 1471378 - RNA, 19 nt, Homo sapiens
acccaauacuuacuucaaa

SEQ ID NO: 1471379 - RNA, 19 nt, Homo sapiens
guauaugguacguuucauu

SEQ ID NO: 1471380 - RNA, 19 nt, Homo sapiens
caaccagcaauguaaguga

SEQ ID NO: 1471381 - RNA, 19 nt, Homo sapiens
ugaaagacacguauaccau

SEQ ID NO: 1471382 - RNA, 19 nt, Homo sapiens
cggcuccgcuaguggcuaa

SEQ ID NO: 1471383 - RNA, 19 nt, Homo sapiens
gggagcggcugucauuugc

SEQ ID NO: 1471384 - RNA, 19 nt, Homo sapiens
gcucaaugucucauagcua

SEQ ID NO: 1471385 - RNA, 19 nt, Homo sapiens
ugugagcacuggugugugu

SEQ ID NO: 1471386 - RNA, 19 nt, Homo sapiens
gcaguccauguuuauauug

SEQ ID NO: 1471387 - RNA, 19 nt, Homo sapiens
gucagguccuccaagauga

SEQ ID NO: 1471388 - RNA, 19 nt, Homo sapiens
gcuacaagaaggcaauuuc

SEQ ID NO: 1471389 - RNA, 19 nt, Homo sapiens
ccaauacuuacuucaaaga

SEQ ID NO: 1471390 - RNA, 19 nt, Homo sapiens
ccagcaauguaagugauga

SEQ ID NO: 1471391 - RNA, 19 nt, Homo sapiens
aaauacauccuagccuuaa

SEQ ID NO: 1471392 - RNA, 19 nt, Homo sapiens
ugcaguccauguuuauauu

SEQ ID NO: 1471393 - RNA, 19 nt, Homo sapiens
caaggcaaaucagcagcuu

SEQ ID NO: 1471394 - RNA, 19 nt, Homo sapiens
caaacgaggcauuccaagu

SEQ ID NO: 1471395 - RNA, 19 nt, Homo sapiens
caguccauguuuauauuga

SEQ ID NO: 1471396 - RNA, 19 nt, Homo sapiens
uaugguacguuucauucug

SEQ ID NO: 1471397 - RNA, 19 nt, Homo sapiens
ggucggcggaggaaucuga

SEQ ID NO: 1471398 - RNA, 19 nt, Homo sapiens
gagacggcuuccugagugu

SEQ ID NO: 1471399 - RNA, 19 nt, Homo sapiens
cauuugucgucuacaugua

SEQ ID NO: 1471400 - RNA, 19 nt, Homo sapiens
gcuagagagcgaaggcaaa

SEQ ID NO: 1471401 - RNA, 19 nt, Homo sapiens
gagagaaggauacuuugac

SEQ ID NO: 1471402 - RNA, 19 nt, Homo sapiens
ugauguguauaguuuagga

SEQ ID NO: 1471403 - RNA, 19 nt, Homo sapiens
ccaagaugagcuuaaacuu

SEQ ID NO: 1471404 - RNA, 19 nt, Homo sapiens
ccucacagcgcaaauuauc

SEQ ID NO: 1471405 - RNA, 19 nt, Homo sapiens
agaaggauacuuugacagu

SEQ ID NO: 1471406 - RNA, 19 nt, Homo sapiens
guccauguuuauauugaug

SEQ ID NO: 1471407 - RNA, 19 nt, Homo sapiens
caguaugccacccgaauga

SEQ ID NO: 1471408 - RNA, 19 nt, Homo sapiens
uauaugguacguuucauuc

SEQ ID NO: 1471409 - RNA, 19 nt, Homo sapiens
agagagaaggauacuuuga

SEQ ID NO: 1471410 - RNA, 19 nt, Homo sapiens
gaugaccagcugcaugaug

SEQ ID NO: 1471411 - RNA, 19 nt, Homo sapiens
gcaaccagcaauguaagug

SEQ ID NO: 1471412 - RNA, 19 nt, Homo sapiens
ccagcucaaccauucuuaa

SEQ ID NO: 1471413 - RNA, 19 nt, Homo sapiens
aaucagcagcuuauacaga

SEQ ID NO: 1471414 - RNA, 19 nt, Homo sapiens
ggagugcgccuugcgaucu

SEQ ID NO: 1471415 - RNA, 19 nt, Homo sapiens
gacaguaugccacccgaau

SEQ ID NO: 1471416 - RNA, 19 nt, Homo sapiens
caaguuugacagcauggaa

SEQ ID NO: 1471417 - RNA, 19 nt, Homo sapiens
ugucagguccuccaagaug

SEQ ID NO: 1471418 - RNA, 19 nt, Homo sapiens
cgccucacagcgcaaauua

SEQ ID NO: 1471419 - RNA, 19 nt, Homo sapiens
cacgggagcggcugucauu

SEQ ID NO: 1471420 - RNA, 19 nt, Homo sapiens
cgaggcauuccaaguuuga

SEQ ID NO: 1471421 - RNA, 19 nt, Homo sapiens
gaaccacuuucaggcuucu

SEQ ID NO: 1471422 - RNA, 19 nt, Homo sapiens
cgugcaaccagcaauguaa

SEQ ID NO: 1471423 - RNA, 19 nt, Homo sapiens
aaaggcccguguccagaug

SEQ ID NO: 1471424 - RNA, 19 nt, Homo sapiens
ccaauguuauaaguugugu

SEQ ID NO: 1471425 - RNA, 19 nt, Homo sapiens
gacaaagucggucaagaac

SEQ ID NO: 1471426 - RNA, 19 nt, Homo sapiens
aggcaaaucagcagcuuau

SEQ ID NO: 1471427 - RNA, 19 nt, Homo sapiens
cgggagcggcugucauuug

SEQ ID NO: 1471428 - RNA, 19 nt, Homo sapiens
uucaggaggugauauugau

SEQ ID NO: 1471429 - RNA, 19 nt, Homo sapiens
gcgugcaaccagcaaugua

SEQ ID NO: 1471430 - RNA, 19 nt, Homo sapiens
gcugugagcacuggugugu

SEQ ID NO: 1471431 - RNA, 19 nt, Homo sapiens
agacacguauaccauuugg

SEQ ID NO: 1471432 - RNA, 19 nt, Homo sapiens
agugucagguccuccaaga

SEQ ID NO: 1471433 - RNA, 19 nt, Homo sapiens
gggagacggcuuccugagu

SEQ ID NO: 1471434 - RNA, 19 nt, Homo sapiens
ccaaauaaacaagaugcau

SEQ ID NO: 1471435 - RNA, 19 nt, Homo sapiens
cccaauacuuacuucaaag

SEQ ID NO: 1471436 - RNA, 19 nt, Homo sapiens
gaaauaccaaccgugaaac

SEQ ID NO: 1471437 - RNA, 19 nt, Homo sapiens
ggcuaaaggcaaagcauuc

SEQ ID NO: 1471438 - RNA, 19 nt, Homo sapiens
uacguuucauucugccuuu

SEQ ID NO: 1471439 - RNA, 19 nt, Homo sapiens
uuugucgucuacauguaua

SEQ ID NO: 1471440 - RNA, 19 nt, Homo sapiens
ggugauauugauguguaua

SEQ ID NO: 1471441 - RNA, 19 nt, Homo sapiens
uaucuaaccugcucaguaa

SEQ ID NO: 1471442 - RNA, 19 nt, Homo sapiens
ccagggaacuaaauucauu

SEQ ID NO: 1471443 - RNA, 19 nt, Homo sapiens
ggaaaacgcuuacauucaa

SEQ ID NO: 1471444 - RNA, 19 nt, Homo sapiens
guaaauauggacgcaauua

SEQ ID NO: 1471445 - RNA, 19 nt, Homo sapiens
gaaaguagguuuuggaaag

SEQ ID NO: 1471446 - RNA, 19 nt, Homo sapiens
gaagaaguagcacguaaug

SEQ ID NO: 1471447 - RNA, 19 nt, Homo sapiens
ccaaccaacuaucuaaaug

SEQ ID NO: 1471448 - RNA, 19 nt, Homo sapiens
gaauaggucucuccuucuc

SEQ ID NO: 1471449 - RNA, 19 nt, Homo sapiens
ucagucaucucaaggaaga

SEQ ID NO: 1471450 - RNA, 19 nt, Homo sapiens
caugugaaauggaaauguu

SEQ ID NO: 1471451 - RNA, 19 nt, Homo sapiens
gggagaauuuggucuuaug

SEQ ID NO: 1471452 - RNA, 19 nt, Homo sapiens
gaagcccaccagauuauuu

SEQ ID NO: 1471453 - RNA, 19 nt, Homo sapiens
guagagaccucagucaucu

SEQ ID NO: 1471454 - RNA, 19 nt, Homo sapiens
gcagcaaauuaauguugaa

SEQ ID NO: 1471455 - RNA, 19 nt, Homo sapiens
aauuaaagaugcucuagga

SEQ ID NO: 1471456 - RNA, 19 nt, Homo sapiens
gaaagggaaaccacagaga

SEQ ID NO: 1471457 - RNA, 19 nt, Homo sapiens
ccucugaagcagcaaauua

SEQ ID NO: 1471458 - RNA, 19 nt, Homo sapiens
uaaagaugcucuaggaaaa

SEQ ID NO: 1471459 - RNA, 19 nt, Homo sapiens
agucuuagguuucggugua

SEQ ID NO: 1471460 - RNA, 19 nt, Homo sapiens
caguaugucuucagcuuga

SEQ ID NO: 1471461 - RNA, 19 nt, Homo sapiens
aauguucucuuuccucuga

SEQ ID NO: 1471462 - RNA, 19 nt, Homo sapiens
guucaugagugacaagugu

SEQ ID NO: 1471463 - RNA, 19 nt, Homo sapiens
guaagguguuaaugaauag

SEQ ID NO: 1471464 - RNA, 19 nt, Homo sapiens
cuaaccugcucaguaaaua

SEQ ID NO: 1471465 - RNA, 19 nt, Homo sapiens
guaucuaaccugcucagua

SEQ ID NO: 1471466 - RNA, 19 nt, Homo sapiens
cucaucggcuucccucuua

SEQ ID NO: 1471467 - RNA, 19 nt, Homo sapiens
uuaaagaugcucuaggaaa

SEQ ID NO: 1471468 - RNA, 19 nt, Homo sapiens
ccacugaccacacaggaaa

SEQ ID NO: 1471469 - RNA, 19 nt, Homo sapiens
gcuucccucuuaaccuuua

SEQ ID NO: 1471470 - RNA, 19 nt, Homo sapiens
gaaauggaaauguucucuu

SEQ ID NO: 1471471 - RNA, 19 nt, Homo sapiens
auaagcaguucaugaguga

SEQ ID NO: 1471472 - RNA, 19 nt, Homo sapiens
gaugcuccuuggcacuaua

SEQ ID NO: 1471473 - RNA, 19 nt, Homo sapiens
ugauaaggcacaugugaaa

SEQ ID NO: 1471474 - RNA, 19 nt, Homo sapiens
gcaaaagccagccauauau

SEQ ID NO: 1471475 - RNA, 19 nt, Homo sapiens
ugaagcagcaaauuaaugu

SEQ ID NO: 1471476 - RNA, 19 nt, Homo sapiens
gcacaugugaaauggaaau

SEQ ID NO: 1471477 - RNA, 19 nt, Homo sapiens
caguaaauauggacgcaau

SEQ ID NO: 1471478 - RNA, 19 nt, Homo sapiens
cggcaaggccuuaguaaca

SEQ ID NO: 1471479 - RNA, 19 nt, Homo sapiens
ggagggaagcgcugucuag

SEQ ID NO: 1471480 - RNA, 19 nt, Homo sapiens
uuacauagacagaaaguag

SEQ ID NO: 1471481 - RNA, 19 nt, Homo sapiens
uugaagaaguagcacguaa

SEQ ID NO: 1471482 - RNA, 19 nt, Homo sapiens
ucaccaaccaacuaucuaa

SEQ ID NO: 1471483 - RNA, 19 nt, Homo sapiens
uaaaucaccaaccaacuau

SEQ ID NO: 1471484 - RNA, 19 nt, Homo sapiens
agucauggauggucucguu

SEQ ID NO: 1471485 - RNA, 19 nt, Homo sapiens
auaaaucaccaaccaacua

SEQ ID NO: 1471486 - RNA, 19 nt, Homo sapiens
gagaugcuccuuggcacua

SEQ ID NO: 1471487 - RNA, 19 nt, Homo sapiens
cggcuucccucuuaaccuu

SEQ ID NO: 1471488 - RNA, 19 nt, Homo sapiens
gucaguaugucuucagcuu

SEQ ID NO: 1471489 - RNA, 19 nt, Homo sapiens
aggcacaugugaaauggaa

SEQ ID NO: 1471490 - RNA, 19 nt, Homo sapiens
acgcuuacauucaauucuu

SEQ ID NO: 1471491 - RNA, 19 nt, Homo sapiens
auacauuugcuucuccuua

SEQ ID NO: 1471492 - RNA, 19 nt, Homo sapiens
caaggaagaauacauuugc

SEQ ID NO: 1471493 - RNA, 19 nt, Homo sapiens
ucaaggaagaauacauuug

SEQ ID NO: 1471494 - RNA, 19 nt, Homo sapiens
gugaagcccaccagauuau

SEQ ID NO: 1471495 - RNA, 19 nt, Homo sapiens
ucucaaggaagaauacauu

SEQ ID NO: 1471496 - RNA, 19 nt, Homo sapiens
ccucagucaucucaaggaa

SEQ ID NO: 1471497 - RNA, 19 nt, Homo sapiens
uaaggcacaugugaaaugg

SEQ ID NO: 1471498 - RNA, 19 nt, Homo sapiens
gauggucucguuccagaug

SEQ ID NO: 1471499 - RNA, 19 nt, Homo sapiens
aaccaacuaucuaaaugga

SEQ ID NO: 1471500 - RNA, 19 nt, Homo sapiens
gcaauuaaagaugcucuag

SEQ ID NO: 1471501 - RNA, 19 nt, Homo sapiens
gaaaacgcuuacauucaau

SEQ ID NO: 1471502 - RNA, 19 nt, Homo sapiens
cacccucucuucugaguca

SEQ ID NO: 1471503 - RNA, 19 nt, Homo sapiens
ccugcacccucucuucuga

SEQ ID NO: 1471504 - RNA, 19 nt, Homo sapiens
uagaggcguucgaacuaga

SEQ ID NO: 1471505 - RNA, 19 nt, Homo sapiens
uacauuugcuucuccuuag

SEQ ID NO: 1471506 - RNA, 19 nt, Homo sapiens
agugugcgcuccauucuca

SEQ ID NO: 1471507 - RNA, 19 nt, Homo sapiens
uaauauaggcacaggaaag

SEQ ID NO: 1471508 - RNA, 19 nt, Homo sapiens
gaucgagucaguaugucuu

SEQ ID NO: 1471509 - RNA, 19 nt, Homo sapiens
ucaauucuuuagucaugga

SEQ ID NO: 1471510 - RNA, 19 nt, Homo sapiens
cagaauagcagccacucau

SEQ ID NO: 1471511 - RNA, 19 nt, Homo sapiens
cguaauggcuuuuaucuac

SEQ ID NO: 1471512 - RNA, 19 nt, Homo sapiens
gcucaucggcuucccucuu

SEQ ID NO: 1471513 - RNA, 19 nt, Homo sapiens
agggaaaccacagagauua

SEQ ID NO: 1471514 - RNA, 19 nt, Homo sapiens
gaagcagcaaauuaauguu

SEQ ID NO: 1471515 - RNA, 19 nt, Homo sapiens
cuuagaggcguucgaacua

SEQ ID NO: 1471516 - RNA, 19 nt, Homo sapiens
acacggcaaggccuuagua

SEQ ID NO: 1471517 - RNA, 19 nt, Homo sapiens
caaccaacuaucuaaaugg

SEQ ID NO: 1471518 - RNA, 19 nt, Homo sapiens
uaauaaaacuucccuccau

SEQ ID NO: 1471519 - RNA, 19 nt, Homo sapiens
ggacgcaauuaaagaugcu

SEQ ID NO: 1471520 - RNA, 19 nt, Homo sapiens
aagcagcaaauuaauguug

SEQ ID NO: 1471521 - RNA, 19 nt, Homo sapiens
ccugauaaggcacauguga

SEQ ID NO: 1471522 - RNA, 19 nt, Homo sapiens
acagauguguuuugaagaa

SEQ ID NO: 1471523 - RNA, 19 nt, Homo sapiens
aacuagaagcuaugcguua

SEQ ID NO: 1471524 - RNA, 19 nt, Homo sapiens
ggcaaggccuuaguaacag

SEQ ID NO: 1471525 - RNA, 19 nt, Homo sapiens
gggaaaccacagagauuag

SEQ ID NO: 1471526 - RNA, 19 nt, Homo sapiens
gauaaggcacaugugaaau

SEQ ID NO: 1471527 - RNA, 19 nt, Homo sapiens
gauguguuuugaagaagua

SEQ ID NO: 1471528 - RNA, 19 nt, Homo sapiens
uugggagaauuuggucuua

SEQ ID NO: 1471529 - RNA, 19 nt, Homo sapiens
uaaccugcucaguaaauau

SEQ ID NO: 1471530 - RNA, 19 nt, Homo sapiens
aaagggaaaccacagagau

SEQ ID NO: 1471531 - RNA, 19 nt, Homo sapiens
auaaggcacaugugaaaug

SEQ ID NO: 1471532 - RNA, 19 nt, Homo sapiens
gucuucagcuugaucagau

SEQ ID NO: 1471533 - RNA, 19 nt, Homo sapiens
gcuaugcguuaccucugau

SEQ ID NO: 1471534 - RNA, 19 nt, Homo sapiens
uauaggcacaggaaagaga

SEQ ID NO: 1471535 - RNA, 19 nt, Homo sapiens
aagggaaaccacagagauu

SEQ ID NO: 1471536 - RNA, 19 nt, Homo sapiens
guucccgacuucuuugcuu

SEQ ID NO: 1471537 - RNA, 19 nt, Homo sapiens
ugaagaaguagcacguaau

SEQ ID NO: 1471538 - RNA, 19 nt, Homo sapiens
caaaagccagccauauauu

SEQ ID NO: 1471539 - RNA, 19 nt, Homo sapiens
agaauagcagccacucauu

SEQ ID NO: 1471540 - RNA, 19 nt, Homo sapiens
ggucucguuccagauguua

SEQ ID NO: 1471541 - RNA, 19 nt, Homo sapiens
gguaaagucuucaguaaua

SEQ ID NO: 1471542 - RNA, 19 nt, Homo sapiens
gguaaaggcuucagucaua

SEQ ID NO: 1471543 - RNA, 19 nt, Homo sapiens
ggaagaaucaguauuguua

SEQ ID NO: 1471544 - RNA, 19 nt, Homo sapiens
gaacaagacuguguccuuu

SEQ ID NO: 1471545 - RNA, 19 nt, Homo sapiens
gaacagaaaguacaccuua

SEQ ID NO: 1471546 - RNA, 19 nt, Homo sapiens
ggaagaggaugaagauuga

SEQ ID NO: 1471547 - RNA, 19 nt, Homo sapiens
ggaaagcacugcagcgauu

SEQ ID NO: 1471548 - RNA, 19 nt, Homo sapiens
agaaagaccuuacaaaugu

SEQ ID NO: 1471549 - RNA, 19 nt, Homo sapiens
gagagaagccuuacaaaug

SEQ ID NO: 1471550 - RNA, 19 nt, Homo sapiens
gagagaagccuuacaaaug

SEQ ID NO: 1471551 - RNA, 19 nt, Homo sapiens
gagagaagccuuacaaaug

SEQ ID NO: 1471552 - RNA, 19 nt, Homo sapiens
ggagagacuucacaauuau

SEQ ID NO: 1471553 - RNA, 19 nt, Homo sapiens
gcagaagacaaaccaauua

SEQ ID NO: 1471554 - RNA, 19 nt, Homo sapiens
gcacaacauuggagaauuc

SEQ ID NO: 1471555 - RNA, 19 nt, Homo sapiens
ccagacagauuuauaguug

SEQ ID NO: 1471556 - RNA, 19 nt, Homo sapiens
uggagagacuucacaauua

SEQ ID NO: 1471557 - RNA, 19 nt, Homo sapiens
ccaaagcaauugcaacaaa

SEQ ID NO: 1471558 - RNA, 19 nt, Homo sapiens
ggaaaagacuuaaugauga

SEQ ID NO: 1471559 - RNA, 19 nt, Homo sapiens
ccagguaagugaaagauuu

SEQ ID NO: 1471560 - RNA, 19 nt, Homo sapiens
gaaaguacaccuuagagaa

SEQ ID NO: 1471561 - RNA, 19 nt, Homo sapiens
gaauagaccuuucucaaaa

SEQ ID NO: 1471562 - RNA, 19 nt, Homo sapiens
ggaacauacuucaauaaga

SEQ ID NO: 1471563 - RNA, 19 nt, Homo sapiens
gagggaacauacuucaaua

SEQ ID NO: 1471564 - RNA, 19 nt, Homo sapiens
caacaaaugcgucaaagaa

SEQ ID NO: 1471565 - RNA, 19 nt, Homo sapiens
agagaaaccuuacaaaugu

SEQ ID NO: 1471566 - RNA, 19 nt, Homo sapiens
agagaaaccuuacaaaugu

SEQ ID NO: 1471567 - RNA, 19 nt, Homo sapiens
agagaaaccuuacaaaugu

SEQ ID NO: 1471568 - RNA, 19 nt, Homo sapiens
agagaaaccuuacaaaugu

SEQ ID NO: 1471569 - RNA, 19 nt, Homo sapiens
agagaaaccuuacaaaugu

SEQ ID NO: 1471570 - RNA, 19 nt, Homo sapiens
agagaaaccuuacaaaugu

SEQ ID NO: 1471571 - RNA, 19 nt, Homo sapiens
gcaaagauguggaaucaac

SEQ ID NO: 1471572 - RNA, 19 nt, Homo sapiens
caagauggauuaaagacuu

SEQ ID NO: 1471573 - RNA, 19 nt, Homo sapiens
caacaucccuucauuuuaa

SEQ ID NO: 1471574 - RNA, 19 nt, Homo sapiens
gagagaaaccuuacaaaug

SEQ ID NO: 1471575 - RNA, 19 nt, Homo sapiens
gagagaaaccuuacaaaug

SEQ ID NO: 1471576 - RNA, 19 nt, Homo sapiens
gagagaaaccuuacaaaug

SEQ ID NO: 1471577 - RNA, 19 nt, Homo sapiens
gaagagaaaccuuacaaau

SEQ ID NO: 1471578 - RNA, 19 nt, Homo sapiens
gagagaaaccuuacaaaug

SEQ ID NO: 1471579 - RNA, 19 nt, Homo sapiens
uaagagaacccagaaauaa

SEQ ID NO: 1471580 - RNA, 19 nt, Homo sapiens
gaaauugcaucccugaaca

SEQ ID NO: 1471581 - RNA, 19 nt, Homo sapiens
agacacaaguuaucacuaa

SEQ ID NO: 1471582 - RNA, 19 nt, Homo sapiens
gcagaacauuguagaauuc

SEQ ID NO: 1471583 - RNA, 19 nt, Homo sapiens
gagaaagaccuuacaaaug

SEQ ID NO: 1471584 - RNA, 19 nt, Homo sapiens
ggagaaagaccuuacaaau

SEQ ID NO: 1471585 - RNA, 19 nt, Homo sapiens
acaaagaucuaauccagaa

SEQ ID NO: 1471586 - RNA, 19 nt, Homo sapiens
gacaagcaaugaaguaaga

SEQ ID NO: 1471587 - RNA, 19 nt, Homo sapiens
gagagaagccguaugaaug

SEQ ID NO: 1471588 - RNA, 19 nt, Homo sapiens
gaauacagccaaccaggua

SEQ ID NO: 1471589 - RNA, 19 nt, Homo sapiens
guaagagaacccagaaaua

SEQ ID NO: 1471590 - RNA, 19 nt, Homo sapiens
guguauaccuaaaggaaua

SEQ ID NO: 1471591 - RNA, 19 nt, Homo sapiens
ggacauaagugcuggaaaa

SEQ ID NO: 1471592 - RNA, 19 nt, Homo sapiens
acacauagaucaauggaau

SEQ ID NO: 1471593 - RNA, 19 nt, Homo sapiens
ggaugaagauugaauaacu

SEQ ID NO: 1471594 - RNA, 19 nt, Homo sapiens
cgacaucgaagaauucaua

SEQ ID NO: 1471595 - RNA, 19 nt, Homo sapiens
gaugaaaggguaauaaaug

SEQ ID NO: 1471596 - RNA, 19 nt, Homo sapiens
ggacaauucauaugggaua

SEQ ID NO: 1471597 - RNA, 19 nt, Homo sapiens
caacauuggagaauucaua

SEQ ID NO: 1471598 - RNA, 19 nt, Homo sapiens
gaaggaagaggaaagcaaa

SEQ ID NO: 1471599 - RNA, 19 nt, Homo sapiens
gaauggguauuaucagaau

SEQ ID NO: 1471600 - RNA, 19 nt, Homo sapiens
gaacagaccaauaaugagu

SEQ ID NO: 1471601 - RNA, 19 nt, Homo sapiens
acaaaugcgucaaagaauu

SEQ ID NO: 1471602 - RNA, 19 nt, Homo sapiens
gauagaaacuacaaaugca

SEQ ID NO: 1471603 - RNA, 19 nt, Homo sapiens
gaucuaauccagaaucuau

SEQ ID NO: 1471604 - RNA, 19 nt, Homo sapiens
ggacguggccauagaauuc

SEQ ID NO: 1471605 - RNA, 19 nt, Homo sapiens
gacaaggucuucaaacaca

SEQ ID NO: 1471606 - RNA, 19 nt, Homo sapiens
uaagucaucucuagcaaau

SEQ ID NO: 1471607 - RNA, 19 nt, Homo sapiens
guaaaggcuucagucauaa

SEQ ID NO: 1471608 - RNA, 19 nt, Homo sapiens
gauuacacauggacucaaa

SEQ ID NO: 1471609 - RNA, 19 nt, Homo sapiens
ggagagaaaccuuacaaau

SEQ ID NO: 1471610 - RNA, 19 nt, Homo sapiens
ggagagaaaccuuacaaau

SEQ ID NO: 1471611 - RNA, 19 nt, Homo sapiens
ggagagaaaccuuacaaau

SEQ ID NO: 1471612 - RNA, 19 nt, Homo sapiens
gugguaaagucuucaguaa

SEQ ID NO: 1471613 - RNA, 19 nt, Homo sapiens
ggagagaaaccuuacaaau

SEQ ID NO: 1471614 - RNA, 19 nt, Homo sapiens
uagcaaagauguggaauca

SEQ ID NO: 1471615 - RNA, 19 nt, Homo sapiens
caacaaaacugacaagcaa

SEQ ID NO: 1471616 - RNA, 19 nt, Homo sapiens
gaauauaggugccaaaauc

SEQ ID NO: 1471617 - RNA, 19 nt, Homo sapiens
ggcaaggucuucaaucgaa

SEQ ID NO: 1471618 - RNA, 19 nt, Homo sapiens
agagaagccuuacaaaugu

SEQ ID NO: 1471619 - RNA, 19 nt, Homo sapiens
agagaagccuuacaaaugu

SEQ ID NO: 1471620 - RNA, 19 nt, Homo sapiens
agagaagccuuacaaaugu

SEQ ID NO: 1471621 - RNA, 19 nt, Homo sapiens
uggaguauccuuucacuua

SEQ ID NO: 1471622 - RNA, 19 nt, Homo sapiens
gcacagagggcuuuauaca

SEQ ID NO: 1471623 - RNA, 19 nt, Homo sapiens
cgacaucaaagaauucaua

SEQ ID NO: 1471624 - RNA, 19 nt, Homo sapiens
gcaaucaaagccacaauga

SEQ ID NO: 1471625 - RNA, 19 nt, Homo sapiens
gggcaaaggccaugaauag

SEQ ID NO: 1471626 - RNA, 19 nt, Homo sapiens
acaaagcagugcacaaaga

SEQ ID NO: 1471627 - RNA, 19 nt, Homo sapiens
ggagagaagccuuacaaau

SEQ ID NO: 1471628 - RNA, 19 nt, Homo sapiens
ggagagaagccuuacaaau

SEQ ID NO: 1471629 - RNA, 19 nt, Homo sapiens
ggagagaagccuuacaaau

SEQ ID NO: 1471630 - RNA, 19 nt, Homo sapiens
gcauuucuauacaccagua

SEQ ID NO: 1471631 - RNA, 19 nt, Homo sapiens
ggacucacagccaaauuaa

SEQ ID NO: 1471632 - RNA, 19 nt, Homo sapiens
ccuacgagauguauaaaga

SEQ ID NO: 1471633 - RNA, 19 nt, Homo sapiens
ggcaaggccuucuauagga

SEQ ID NO: 1471634 - RNA, 19 nt, Homo sapiens
gaaaugucuuccaguguca

SEQ ID NO: 1471635 - RNA, 19 nt, Homo sapiens
gggaagaggaugaagauug

SEQ ID NO: 1471636 - RNA, 19 nt, Homo sapiens
uaucccauguucucacuua

SEQ ID NO: 1471637 - RNA, 19 nt, Homo sapiens
gauguggaaucaacguaaa

SEQ ID NO: 1471638 - RNA, 19 nt, Homo sapiens
gaaaagcccaaccuaaaua

SEQ ID NO: 1471639 - RNA, 19 nt, Homo sapiens
gaagucaguuucucuugca

SEQ ID NO: 1471640 - RNA, 19 nt, Homo sapiens
caagugggaccuaauuaaa

SEQ ID NO: 1471641 - RNA, 19 nt, Homo sapiens
ggagagaaaucuuacaaau

SEQ ID NO: 1471642 - RNA, 19 nt, Homo sapiens
ggagagaaaucuuacaaau

SEQ ID NO: 1471643 - RNA, 19 nt, Homo sapiens
gauaauccauuuaggagaa

SEQ ID NO: 1471644 - RNA, 19 nt, Homo sapiens
agagaaaccuuacaaaugu

SEQ ID NO: 1471645 - RNA, 19 nt, Homo sapiens
agagaaaccuuacaaaugu

SEQ ID NO: 1471646 - RNA, 19 nt, Homo sapiens
agagaaaccuuacaaaugu

SEQ ID NO: 1471647 - RNA, 19 nt, Homo sapiens
gagagaaaccuuacaaaug

SEQ ID NO: 1471648 - RNA, 19 nt, Homo sapiens
gagagaaaccuuacaaaug

SEQ ID NO: 1471649 - RNA, 19 nt, Homo sapiens
gagagaaaccuuacaaaug

SEQ ID NO: 1471650 - RNA, 19 nt, Homo sapiens
ggagagaaaugucacaagu

SEQ ID NO: 1471651 - RNA, 19 nt, Homo sapiens
ugagaaaccuuacaagugu

SEQ ID NO: 1471652 - RNA, 19 nt, Homo sapiens
ugagaaaccuuacaagugu

SEQ ID NO: 1471653 - RNA, 19 nt, Homo sapiens
ugagaaaccuuacaagugu

SEQ ID NO: 1471654 - RNA, 19 nt, Homo sapiens
ugagaaaccuuacaagugu

SEQ ID NO: 1471655 - RNA, 19 nt, Homo sapiens
ggaaaguccuucaguuaca

SEQ ID NO: 1471656 - RNA, 19 nt, Homo sapiens
ggaaaguccuucaguuaca

SEQ ID NO: 1471657 - RNA, 19 nt, Homo sapiens
ggaaaguccuucaguuaca

SEQ ID NO: 1471658 - RNA, 19 nt, Homo sapiens
ccuaauaacuaugggaaua

SEQ ID NO: 1471659 - RNA, 19 nt, Homo sapiens
agacauaggagaauucaua

SEQ ID NO: 1471660 - RNA, 19 nt, Homo sapiens
agagaaaccuuacaagugu

SEQ ID NO: 1471661 - RNA, 19 nt, Homo sapiens
agagaaaccuuacaagugu

SEQ ID NO: 1471662 - RNA, 19 nt, Homo sapiens
agagaaaccuuacaagugu

SEQ ID NO: 1471663 - RNA, 19 nt, Homo sapiens
agagaaaccuuacaagugu

SEQ ID NO: 1471664 - RNA, 19 nt, Homo sapiens
agagaaaccuuacaagugu

SEQ ID NO: 1471665 - RNA, 19 nt, Homo sapiens
ggcgaagccuuuaauugua

SEQ ID NO: 1471666 - RNA, 19 nt, Homo sapiens
gaaguacacaugagagaaa

SEQ ID NO: 1471667 - RNA, 19 nt, Homo sapiens
ugagauaacuguucccaau

SEQ ID NO: 1471668 - RNA, 19 nt, Homo sapiens
guucauaccuugcaguuca

SEQ ID NO: 1471669 - RNA, 19 nt, Homo sapiens
gagagaaaccuuacaagug

SEQ ID NO: 1471670 - RNA, 19 nt, Homo sapiens
gagagaaaccuuacaagug

SEQ ID NO: 1471671 - RNA, 19 nt, Homo sapiens
gagagaaaccuuacaagug

SEQ ID NO: 1471672 - RNA, 19 nt, Homo sapiens
gagagaaaccuuacaagug

SEQ ID NO: 1471673 - RNA, 19 nt, Homo sapiens
gagagaaaccuuacaagug

SEQ ID NO: 1471674 - RNA, 19 nt, Homo sapiens
ugaagaaugugacagaguu

SEQ ID NO: 1471675 - RNA, 19 nt, Homo sapiens
gaaaccucgucucuacuaa

SEQ ID NO: 1471676 - RNA, 19 nt, Homo sapiens
ggagagaaaccuuacaaau

SEQ ID NO: 1471677 - RNA, 19 nt, Homo sapiens
uagggaaacuugacuaaug

SEQ ID NO: 1471678 - RNA, 19 nt, Homo sapiens
ggagagaaaccuuacaaau

SEQ ID NO: 1471679 - RNA, 19 nt, Homo sapiens
ggagagaaaccuuacaaau

SEQ ID NO: 1471680 - RNA, 19 nt, Homo sapiens
gaaacacauacuccuaaua

SEQ ID NO: 1471681 - RNA, 19 nt, Homo sapiens
guaaggaaacaucagauaa

SEQ ID NO: 1471682 - RNA, 19 nt, Homo sapiens
uuacaaaugucaucagugu

SEQ ID NO: 1471683 - RNA, 19 nt, Homo sapiens
uuacaaaugucaugacugu

SEQ ID NO: 1471684 - RNA, 19 nt, Homo sapiens
uuacaaaugugaagcaugu

SEQ ID NO: 1471685 - RNA, 19 nt, Homo sapiens
gaaaguccuucaguuacaa

SEQ ID NO: 1471686 - RNA, 19 nt, Homo sapiens
gaaaguccuucaguuacaa

SEQ ID NO: 1471687 - RNA, 19 nt, Homo sapiens
gaaaguccuucaguuacaa

SEQ ID NO: 1471688 - RNA, 19 nt, Homo sapiens
ggugaaaccucgucucuac

SEQ ID NO: 1471689 - RNA, 19 nt, Homo sapiens
agagagaucuuccgagugu

SEQ ID NO: 1471690 - RNA, 19 nt, Homo sapiens
ugaagcaugugacaaaguu

SEQ ID NO: 1471691 - RNA, 19 nt, Homo sapiens
caagagaugugagccaguu

SEQ ID NO: 1471692 - RNA, 19 nt, Homo sapiens
agucacagaucacgccuua

SEQ ID NO: 1471693 - RNA, 19 nt, Homo sapiens
guggaaaguccuucaguua

SEQ ID NO: 1471694 - RNA, 19 nt, Homo sapiens
guggaaaguccuucaguua

SEQ ID NO: 1471695 - RNA, 19 nt, Homo sapiens
guggaaaguccuucaguua

SEQ ID NO: 1471696 - RNA, 19 nt, Homo sapiens
aaacauaggagaauucaug

SEQ ID NO: 1471697 - RNA, 19 nt, Homo sapiens
ucacagaucacgccuuaaa

SEQ ID NO: 1471698 - RNA, 19 nt, Homo sapiens
gaaacaagcauggccaaga

SEQ ID NO: 1471699 - RNA, 19 nt, Homo sapiens
gagagaaaucuuacaaaug

SEQ ID NO: 1471700 - RNA, 19 nt, Homo sapiens
gagagaaaucuuacaaaug

SEQ ID NO: 1471701 - RNA, 19 nt, Homo sapiens
cacaagaccuucagucaca

SEQ ID NO: 1471702 - RNA, 19 nt, Homo sapiens
aaucaacaaucacaccuuu

SEQ ID NO: 1471703 - RNA, 19 nt, Homo sapiens
guucacaccucauuagaca

SEQ ID NO: 1471704 - RNA, 19 nt, Homo sapiens
agagaaaugucacaagugu

SEQ ID NO: 1471705 - RNA, 19 nt, Homo sapiens
gcaggcagauaacaaaguc

SEQ ID NO: 1471706 - RNA, 19 nt, Homo sapiens
gagaauccauaaugaagag

SEQ ID NO: 1471707 - RNA, 19 nt, Homo sapiens
ggagagaaaccuuacaagu

SEQ ID NO: 1471708 - RNA, 19 nt, Homo sapiens
ggagagaaaccuuacaagu

SEQ ID NO: 1471709 - RNA, 19 nt, Homo sapiens
ggagagaaaccuuacaagu

SEQ ID NO: 1471710 - RNA, 19 nt, Homo sapiens
ggagagaaaccuuacaagu

SEQ ID NO: 1471711 - RNA, 19 nt, Homo sapiens
ggagagaaaccuuacaagu

SEQ ID NO: 1471712 - RNA, 19 nt, Homo sapiens
cccagccuguuuauuauua

SEQ ID NO: 1471713 - RNA, 19 nt, Homo sapiens
gcaaaucauuggagaaucc

SEQ ID NO: 1471714 - RNA, 19 nt, Homo sapiens
agcaaaccaucaagcauua

SEQ ID NO: 1471715 - RNA, 19 nt, Homo sapiens
caucauagacuucauacug

SEQ ID NO: 1471716 - RNA, 19 nt, Homo sapiens
ggcaaaccauacuagaauu

SEQ ID NO: 1471717 - RNA, 19 nt, Homo sapiens
caucauagacuucauacug

SEQ ID NO: 1471718 - RNA, 19 nt, Homo sapiens
caucauagacuucauacug

SEQ ID NO: 1471719 - RNA, 19 nt, Homo sapiens
caucauagacuucauacug

SEQ ID NO: 1471720 - RNA, 19 nt, Homo sapiens
gucacaaagucuucaguaa

SEQ ID NO: 1471721 - RNA, 19 nt, Homo sapiens
ggaaacuugacuaauguaa

SEQ ID NO: 1471722 - RNA, 19 nt, Homo sapiens
gcgaagccuuuaauuguag

SEQ ID NO: 1471723 - RNA, 19 nt, Homo sapiens
ggccaaggcaggcagauaa

SEQ ID NO: 1471724 - RNA, 19 nt, Homo sapiens
ucccuuacaugccaucaua

SEQ ID NO: 1471725 - RNA, 19 nt, Homo sapiens
gaacucauacuggagagaa

SEQ ID NO: 1471726 - RNA, 19 nt, Homo sapiens
gaauaaaaccuuacaagug

SEQ ID NO: 1471727 - RNA, 19 nt, Homo sapiens
aaacaagcauggccaagag

SEQ ID NO: 1471728 - RNA, 19 nt, Homo sapiens
ggcaaggucuucagucaag

SEQ ID NO: 1471729 - RNA, 19 nt, Homo sapiens
ggagaauccauaaugaaga

SEQ ID NO: 1471730 - RNA, 19 nt, Homo sapiens
caguaacgcuacaacgauu

SEQ ID NO: 1471731 - RNA, 19 nt, Homo sapiens
gagaaaccuuacaaaugug

SEQ ID NO: 1471732 - RNA, 19 nt, Homo sapiens
caucguagacuucauagug

SEQ ID NO: 1471733 - RNA, 19 nt, Homo sapiens
gacacaagauaauucauac

SEQ ID NO: 1471734 - RNA, 19 nt, Homo sapiens
gaagaaugugacagaguuu

SEQ ID NO: 1471735 - RNA, 19 nt, Homo sapiens
uaauugacaugcagguguu

SEQ ID NO: 1471736 - RNA, 19 nt, Homo sapiens
ugauauauguggcaaaguc

SEQ ID NO: 1471737 - RNA, 19 nt, Homo sapiens
cagucaagcuucauccuau

SEQ ID NO: 1471738 - RNA, 19 nt, Homo sapiens
gagauggaguguugcucuu

SEQ ID NO: 1471739 - RNA, 19 nt, Homo sapiens
uuucccagccuguuuauua

SEQ ID NO: 1471740 - RNA, 19 nt, Homo sapiens
cuacuggagagaaaucuua

SEQ ID NO: 1471741 - RNA, 19 nt, Homo sapiens
ggaaagagaucauccaauc

SEQ ID NO: 1471742 - RNA, 19 nt, Homo sapiens
ggccuuagauuaccucuua

SEQ ID NO: 1471743 - RNA, 19 nt, Homo sapiens
ggauaggugugaccauuua

SEQ ID NO: 1471744 - RNA, 19 nt, Homo sapiens
gaaaagagcuaaucacaug

SEQ ID NO: 1471745 - RNA, 19 nt, Homo sapiens
guacauaucucccuuggau

SEQ ID NO: 1471746 - RNA, 19 nt, Homo sapiens
gauagcaucucuaaacuca

SEQ ID NO: 1471747 - RNA, 19 nt, Homo sapiens
caacacaugcuuacuagua

SEQ ID NO: 1471748 - RNA, 19 nt, Homo sapiens
agaaaucucuccagacaaa

SEQ ID NO: 1471749 - RNA, 19 nt, Homo sapiens
aaccagaaauuccuuguua

SEQ ID NO: 1471750 - RNA, 19 nt, Homo sapiens
gaaauuccuuguuagacuu

SEQ ID NO: 1471751 - RNA, 19 nt, Homo sapiens
gagguuacguggcuccaua

SEQ ID NO: 1471752 - RNA, 19 nt, Homo sapiens
gaaaagagcucugggucua

SEQ ID NO: 1471753 - RNA, 19 nt, Homo sapiens
ggaaaucgcaguuacacaa

SEQ ID NO: 1471754 - RNA, 19 nt, Homo sapiens
gagccaagaucgugccauu

SEQ ID NO: 1471755 - RNA, 19 nt, Homo sapiens
ucacaugguuugucccuuu

SEQ ID NO: 1471756 - RNA, 19 nt, Homo sapiens
uggcaaaccucuacacuug

SEQ ID NO: 1471757 - RNA, 19 nt, Homo sapiens
caacugcucuucucuaaac

SEQ ID NO: 1471758 - RNA, 19 nt, Homo sapiens
ucagaaaucucuccagaca

SEQ ID NO: 1471759 - RNA, 19 nt, Homo sapiens
gauggaaguccuaagauaa

SEQ ID NO: 1471760 - RNA, 19 nt, Homo sapiens
ugauggaaguccuaagaua

SEQ ID NO: 1471761 - RNA, 19 nt, Homo sapiens
ccacuaagaagcauguaua

SEQ ID NO: 1471762 - RNA, 19 nt, Homo sapiens
gcccuugucucuauaauuc

SEQ ID NO: 1471763 - RNA, 19 nt, Homo sapiens
gcuaagaguaccagagaua

SEQ ID NO: 1471764 - RNA, 19 nt, Homo sapiens
gggcaaagauucugcaacu

SEQ ID NO: 1471765 - RNA, 19 nt, Homo sapiens
uuacguggcuccauaacuu

SEQ ID NO: 1471766 - RNA, 19 nt, Homo sapiens
aaagaucuaugaugagguu

SEQ ID NO: 1471767 - RNA, 19 nt, Homo sapiens
gacaagagcaggcaaggaa

SEQ ID NO: 1471768 - RNA, 19 nt, Homo sapiens
gggagacccugaugacuuc

SEQ ID NO: 1471769 - RNA, 19 nt, Homo sapiens
aaaauaaacugcccuuuga

SEQ ID NO: 1471770 - RNA, 19 nt, Homo sapiens
ggaaguaguuacagaagac

SEQ ID NO: 1471771 - RNA, 19 nt, Homo sapiens
cuaagaagcauguauacuu

SEQ ID NO: 1471772 - RNA, 19 nt, Homo sapiens
gggaccagcugcacuuaau

SEQ ID NO: 1471773 - RNA, 19 nt, Homo sapiens
uacaacugcucuucucuaa

SEQ ID NO: 1471774 - RNA, 19 nt, Homo sapiens
gcaaagauucugcaacuac

SEQ ID NO: 1471775 - RNA, 19 nt, Homo sapiens
gcacuuaauagccugcuuu

SEQ ID NO: 1471776 - RNA, 19 nt, Homo sapiens
aaacugcccuuugauggaa

SEQ ID NO: 1471777 - RNA, 19 nt, Homo sapiens
ucacauggaggguucuaua

SEQ ID NO: 1471778 - RNA, 19 nt, Homo sapiens
acagauuggccuuagauua

SEQ ID NO: 1471779 - RNA, 19 nt, Homo sapiens
caaauagacaacauagcua

SEQ ID NO: 1471780 - RNA, 19 nt, Homo sapiens
ccucuacacuugcauuaau

SEQ ID NO: 1471781 - RNA, 19 nt, Homo sapiens
gcugauggccuccuuggaa

SEQ ID NO: 1471782 - RNA, 19 nt, Homo sapiens
gcaggaaguaguuacagaa

SEQ ID NO: 1471783 - RNA, 19 nt, Homo sapiens
cgauagaggaggauauaaa

SEQ ID NO: 1471784 - RNA, 19 nt, Homo sapiens
gacaacauagcuaagagua

SEQ ID NO: 1471785 - RNA, 19 nt, Homo sapiens
ccuguaaucccaacacuuu

SEQ ID NO: 1471786 - RNA, 19 nt, Homo sapiens
gcagguagccagacaagag

SEQ ID NO: 1471787 - RNA, 19 nt, Homo sapiens
ggaccagcugcacuuaaua

SEQ ID NO: 1471788 - RNA, 19 nt, Homo sapiens
cacaugguuugucccuuua

SEQ ID NO: 1471789 - RNA, 19 nt, Homo sapiens
ggaggcagagguuguguug

SEQ ID NO: 1471790 - RNA, 19 nt, Homo sapiens
caacagauuggccuuagau

SEQ ID NO: 1471791 - RNA, 19 nt, Homo sapiens
ccagaaauuccuuguuaga

SEQ ID NO: 1471792 - RNA, 19 nt, Homo sapiens
gguggagucugugcaguga

SEQ ID NO: 1471793 - RNA, 19 nt, Homo sapiens
uagcaucucuaaacucaag

SEQ ID NO: 1471794 - RNA, 19 nt, Homo sapiens
gaugucacccucagaaauc

SEQ ID NO: 1471795 - RNA, 19 nt, Homo sapiens
ggaucucacuccaccuuuc

SEQ ID NO: 1471796 - RNA, 19 nt, Homo sapiens
gcaggagaaucgcuugaac

SEQ ID NO: 1471797 - RNA, 19 nt, Homo sapiens
gaaaccccgucucuacuaa

SEQ ID NO: 1471798 - RNA, 19 nt, Homo sapiens
gcauguauacuucucuaau

SEQ ID NO: 1471799 - RNA, 19 nt, Homo sapiens
auaugucucuuccaggaua

SEQ ID NO: 1471800 - RNA, 19 nt, Homo sapiens
cucaaggccuccauagauu

SEQ ID NO: 1471801 - RNA, 19 nt, Homo sapiens
ggugugaccauuuauaaca

SEQ ID NO: 1471802 - RNA, 19 nt, Homo sapiens
gcuaaacaaaugaacgauu

SEQ ID NO: 1471803 - RNA, 19 nt, Homo sapiens
ggcaaagauucugcaacua

SEQ ID NO: 1471804 - RNA, 19 nt, Homo sapiens
ccagacaaauagacaacau

SEQ ID NO: 1471805 - RNA, 19 nt, Homo sapiens
uaacucagcgcaccaaguc

SEQ ID NO: 1471806 - RNA, 19 nt, Homo sapiens
agaaauuccuuguuagacu

SEQ ID NO: 1471807 - RNA, 19 nt, Homo sapiens
gcucuucucuaaaccaaac

SEQ ID NO: 1471808 - RNA, 19 nt, Homo sapiens
aaagagcucugggucuaau

SEQ ID NO: 1471809 - RNA, 19 nt, Homo sapiens
ucacuccaccuuucaauca

SEQ ID NO: 1471810 - RNA, 19 nt, Homo sapiens
cagauuggccuuagauuac

SEQ ID NO: 1471811 - RNA, 19 nt, Homo sapiens
gggauaggugugaccauuu

SEQ ID NO: 1471812 - RNA, 19 nt, Homo sapiens
aaccaaaccuguuguccau

SEQ ID NO: 1471813 - RNA, 19 nt, Homo sapiens
gagaccagccugaccaaca

SEQ ID NO: 1471814 - RNA, 19 nt, Homo sapiens
gcaccuacaaguacauauc

SEQ ID NO: 1471815 - RNA, 19 nt, Homo sapiens
uaggugugaccauuuauaa

SEQ ID NO: 1471816 - RNA, 19 nt, Homo sapiens
aagcauguauacuucucua

SEQ ID NO: 1471817 - RNA, 19 nt, Homo sapiens
guaggcagguagccagaca

SEQ ID NO: 1471818 - RNA, 19 nt, Homo sapiens
gaagacccacgacguccuu

SEQ ID NO: 1471819 - RNA, 19 nt, Homo sapiens
ggcgauagaggaggauaua

SEQ ID NO: 1471820 - RNA, 19 nt, Homo sapiens
ucuagcaaauguagucaug

SEQ ID NO: 1471821 - RNA, 19 nt, Homo sapiens
aaaucucuccagacaaaua

SEQ ID NO: 1471822 - RNA, 19 nt, Homo sapiens
gaccaguucccaacacaug

SEQ ID NO: 1471823 - RNA, 19 nt, Homo sapiens
cugauggccuccuuggaaa

SEQ ID NO: 1471824 - RNA, 19 nt, Homo sapiens
gcauuaauaacauccaaca

SEQ ID NO: 1471825 - RNA, 19 nt, Homo sapiens
uaaacugcccuuugaugga

SEQ ID NO: 1471826 - RNA, 19 nt, Homo sapiens
ggaggagcguggcuacacu

SEQ ID NO: 1471827 - RNA, 19 nt, Homo sapiens
gauagaggaggauauaaaa

SEQ ID NO: 1471828 - RNA, 19 nt, Homo sapiens
uagcuaagaguaccagaga

SEQ ID NO: 1471829 - RNA, 19 nt, Homo sapiens
cagacaaauagacaacaua

SEQ ID NO: 1471830 - RNA, 19 nt, Homo sapiens
gaaaucgcaguuacacaag

SEQ ID NO: 1471831 - RNA, 19 nt, Homo sapiens
acaggaagaacaccucuga

SEQ ID NO: 1471832 - RNA, 19 nt, Homo sapiens
gacuuuagauccaaaugac

SEQ ID NO: 1471833 - RNA, 19 nt, Homo sapiens
cuacaacugcucuucucua

SEQ ID NO: 1471834 - RNA, 19 nt, Homo sapiens
uaaacucaaggccuccaua

SEQ ID NO: 1471835 - RNA, 19 nt, Homo sapiens
ggaggguucacuuaucaug

SEQ ID NO: 1471836 - RNA, 19 nt, Homo sapiens
cccaacacaugcuuacuag

SEQ ID NO: 1471837 - RNA, 19 nt, Homo sapiens
guuagacuuuagauccaaa

SEQ ID NO: 1471838 - RNA, 19 nt, Homo sapiens
uccaggauauggcaauuuc

SEQ ID NO: 1471839 - RNA, 19 nt, Homo sapiens
gaccagcugcacuuaauag

SEQ ID NO: 1471840 - RNA, 19 nt, Homo sapiens
gaggguucacuuaucauga

SEQ ID NO: 1471841 - RNA, 19 nt, Homo sapiens
gcauagaccugcucuuguu

SEQ ID NO: 1471842 - RNA, 19 nt, Homo sapiens
ccagaaacaucaccaaaga

SEQ ID NO: 1471843 - RNA, 19 nt, Homo sapiens
gaagaggacaucaaagaaa

SEQ ID NO: 1471844 - RNA, 19 nt, Homo sapiens
caaagaaugcgucacauaa

SEQ ID NO: 1471845 - RNA, 19 nt, Homo sapiens
cagagaaccuuauggaaga

SEQ ID NO: 1471846 - RNA, 19 nt, Homo sapiens
agaagaaacugaaggaaga

SEQ ID NO: 1471847 - RNA, 19 nt, Homo sapiens
gagcguagccuucagcauu

SEQ ID NO: 1471848 - RNA, 19 nt, Homo sapiens
ccaaagagcccaaaguguu

SEQ ID NO: 1471849 - RNA, 19 nt, Homo sapiens
aaaaugagcuggaaaaguu

SEQ ID NO: 1471850 - RNA, 19 nt, Homo sapiens
ggcaaucuccuauaugaua

SEQ ID NO: 1471851 - RNA, 19 nt, Homo sapiens
ggauggcaaucuccuauau

SEQ ID NO: 1471852 - RNA, 19 nt, Homo sapiens
ggacuguagcuaaguauuu

SEQ ID NO: 1471853 - RNA, 19 nt, Homo sapiens
cagagugguuuccucauuu

SEQ ID NO: 1471854 - RNA, 19 nt, Homo sapiens
ggaagaggacaucaaagaa

SEQ ID NO: 1471855 - RNA, 19 nt, Homo sapiens
gaccugcucuuguuaaagu

SEQ ID NO: 1471856 - RNA, 19 nt, Homo sapiens
ccacucaguuauuauauca

SEQ ID NO: 1471857 - RNA, 19 nt, Homo sapiens
caacagcucgagucacuuu

SEQ ID NO: 1471858 - RNA, 19 nt, Homo sapiens
ucgagucacuuuauaagaa

SEQ ID NO: 1471859 - RNA, 19 nt, Homo sapiens
guagcuaaguauuuccuuu

SEQ ID NO: 1471860 - RNA, 19 nt, Homo sapiens
gacaacagcucgagucacu

SEQ ID NO: 1471861 - RNA, 19 nt, Homo sapiens
ggacaucaaagaaagaaau

SEQ ID NO: 1471862 - RNA, 19 nt, Homo sapiens
cagcucgagucacuuuaua

SEQ ID NO: 1471863 - RNA, 19 nt, Homo sapiens
ucagagugguuuccucauu

SEQ ID NO: 1471864 - RNA, 19 nt, Homo sapiens
aagaaugcgucacauaaug

SEQ ID NO: 1471865 - RNA, 19 nt, Homo sapiens
gcuggacuguagcuaagua

SEQ ID NO: 1471866 - RNA, 19 nt, Homo sapiens
ccugaggaauaaagcaaua

SEQ ID NO: 1471867 - RNA, 19 nt, Homo sapiens
gaaccucaggauaccguua

SEQ ID NO: 1471868 - RNA, 19 nt, Homo sapiens
gaacgaaaaugagcuggaa

SEQ ID NO: 1471869 - RNA, 19 nt, Homo sapiens
guuauuaggagaugaagaa

SEQ ID NO: 1471870 - RNA, 19 nt, Homo sapiens
acaaagaaugcgucacaua

SEQ ID NO: 1471871 - RNA, 19 nt, Homo sapiens
aaacaaagaaugcgucaca

SEQ ID NO: 1471872 - RNA, 19 nt, Homo sapiens
cuaaguauuuccuuucauc

SEQ ID NO: 1471873 - RNA, 19 nt, Homo sapiens
ggucacaaccacccagaaa

SEQ ID NO: 1471874 - RNA, 19 nt, Homo sapiens
caaagagcccaaaguguuc

SEQ ID NO: 1471875 - RNA, 19 nt, Homo sapiens
ccaucccacuggaaacaua

SEQ ID NO: 1471876 - RNA, 19 nt, Homo sapiens
uauaagaaccucaggauac

SEQ ID NO: 1471877 - RNA, 19 nt, Homo sapiens
cauccacucaguuauuaua

SEQ ID NO: 1471878 - RNA, 19 nt, Homo sapiens
caggauaccguuauuagga

SEQ ID NO: 1471879 - RNA, 19 nt, Homo sapiens
uuaauggaaugccaacuuc

SEQ ID NO: 1471880 - RNA, 19 nt, Homo sapiens
gacuguagcuaaguauuuc

SEQ ID NO: 1471881 - RNA, 19 nt, Homo sapiens
aaacauaacaggcuuacca

SEQ ID NO: 1471882 - RNA, 19 nt, Homo sapiens
acugauaauuugagaguga

SEQ ID NO: 1471883 - RNA, 19 nt, Homo sapiens
guucauccacucaguuauu

SEQ ID NO: 1471884 - RNA, 19 nt, Homo sapiens
gcaccuacuuccagagaac

SEQ ID NO: 1471885 - RNA, 19 nt, Homo sapiens
cuucuugauuccucagaua

SEQ ID NO: 1471886 - RNA, 19 nt, Homo sapiens
gaugcuggacuguagcuaa

SEQ ID NO: 1471887 - RNA, 19 nt, Homo sapiens
agaaaugccagaccuguau

SEQ ID NO: 1471888 - RNA, 19 nt, Homo sapiens
uggaagaggacaucaaaga

SEQ ID NO: 1471889 - RNA, 19 nt, Homo sapiens
ggcacaggcugaggaaaga

SEQ ID NO: 1471890 - RNA, 19 nt, Homo sapiens
aagaggacaucaaagaaag

SEQ ID NO: 1471891 - RNA, 19 nt, Homo sapiens
gcaaaacucaguaacagaa

SEQ ID NO: 1471892 - RNA, 19 nt, Homo sapiens
gaaacugaaggaagagcaa

SEQ ID NO: 1471893 - RNA, 19 nt, Homo sapiens
uagaccugcucuuguuaaa

SEQ ID NO: 1471894 - RNA, 19 nt, Homo sapiens
gcaauaauucggcauagac

SEQ ID NO: 1471895 - RNA, 19 nt, Homo sapiens
gaaaauaaagccacaugau

SEQ ID NO: 1471896 - RNA, 19 nt, Homo sapiens
auggcaaucuccuauauga

SEQ ID NO: 1471897 - RNA, 19 nt, Homo sapiens
cauagaccugcucuuguua

SEQ ID NO: 1471898 - RNA, 19 nt, Homo sapiens
uauggaagaggacaucaaa

SEQ ID NO: 1471899 - RNA, 19 nt, Homo sapiens
aaagaaugcgucacauaau

SEQ ID NO: 1471900 - RNA, 19 nt, Homo sapiens
ugagagugauggacaaggu

SEQ ID NO: 1471901 - RNA, 19 nt, Homo sapiens
uucauccacucaguuauua

SEQ ID NO: 1471902 - RNA, 19 nt, Homo sapiens
caaccacccagaaacauca

SEQ ID NO: 1471903 - RNA, 19 nt, Homo sapiens
ucacaaccacccagaaaca

SEQ ID NO: 1471904 - RNA, 19 nt, Homo sapiens
gaaggaagagcaaaacuca

SEQ ID NO: 1471905 - RNA, 19 nt, Homo sapiens
gauaaauagaggacagaug

SEQ ID NO: 1471906 - RNA, 19 nt, Homo sapiens
gggauggcaaucuccuaua

SEQ ID NO: 1471907 - RNA, 19 nt, Homo sapiens
aaagcaauaauucggcaua

SEQ ID NO: 1471908 - RNA, 19 nt, Homo sapiens
ccagaccuguaucccagaa

SEQ ID NO: 1471909 - RNA, 19 nt, Homo sapiens
gaggacaucaaagaaagaa

SEQ ID NO: 1471910 - RNA, 19 nt, Homo sapiens
cggcauagaccugcucuug

SEQ ID NO: 1471911 - RNA, 19 nt, Homo sapiens
caccaaagagcccaaagug

SEQ ID NO: 1471912 - RNA, 19 nt, Homo sapiens
gagcaaaacucaguaacag

SEQ ID NO: 1471913 - RNA, 19 nt, Homo sapiens
cagcauugcccugauaugu

SEQ ID NO: 1471914 - RNA, 19 nt, Homo sapiens
cuacgaaccccaugaaauu

SEQ ID NO: 1471915 - RNA, 19 nt, Homo sapiens
cauuuaugcuugccguaug

SEQ ID NO: 1471916 - RNA, 19 nt, Homo sapiens
aaagccacaugauauagca

SEQ ID NO: 1471917 - RNA, 19 nt, Homo sapiens
gaaugcgucacauaaugga

SEQ ID NO: 1471918 - RNA, 19 nt, Homo sapiens
gcuaaguauuuccuuucau

SEQ ID NO: 1471919 - RNA, 19 nt, Homo sapiens
gaagagcaaaacucaguaa

SEQ ID NO: 1471920 - RNA, 19 nt, Homo sapiens
gacaucaaagaaagaaaug

SEQ ID NO: 1471921 - RNA, 19 nt, Homo sapiens
uuaagaagaaacugaagga

SEQ ID NO: 1471922 - RNA, 19 nt, Homo sapiens
auuaggagaugaagaagag

SEQ ID NO: 1471923 - RNA, 19 nt, Homo sapiens
uuauaagaaccucaggaua

SEQ ID NO: 1471924 - RNA, 19 nt, Homo sapiens
gaaaugccagaccuguauc

SEQ ID NO: 1471925 - RNA, 19 nt, Homo sapiens
ccucaggauaccguuauua

SEQ ID NO: 1471926 - RNA, 19 nt, Homo sapiens
cgagucacuuuauaagaac

SEQ ID NO: 1471927 - RNA, 19 nt, Homo sapiens
gcucgagucacuuuauaag

SEQ ID NO: 1471928 - RNA, 19 nt, Homo sapiens
aagaaaugccagaccugua

SEQ ID NO: 1471929 - RNA, 19 nt, Homo sapiens
guggcuugcucccagagaa

SEQ ID NO: 1471930 - RNA, 19 nt, Homo sapiens
aaguucauccacucaguua

SEQ ID NO: 1471931 - RNA, 19 nt, Homo sapiens
gauggcaaucuccuauaug

SEQ ID NO: 1471932 - RNA, 19 nt, Homo sapiens
gaaaaugagcuggaaaagu

SEQ ID NO: 1471933 - RNA, 19 nt, Homo sapiens
uaagaagaaacugaaggaa

SEQ ID NO: 1471934 - RNA, 19 nt, Homo sapiens
gagagugauggacaagguu

SEQ ID NO: 1471935 - RNA, 19 nt, Homo sapiens
ccuuucaucuacgggauaa

SEQ ID NO: 1471936 - RNA, 19 nt, Homo sapiens
aguauuuccuuucaucuac

SEQ ID NO: 1471937 - RNA, 19 nt, Homo sapiens
cuugauuccucagauaaau

SEQ ID NO: 1471938 - RNA, 19 nt, Homo sapiens
ggaaacauaacaggcuuac

SEQ ID NO: 1471939 - RNA, 19 nt, Homo sapiens
uagcuaaguauuuccuuuc

SEQ ID NO: 1471940 - RNA, 19 nt, Homo sapiens
gaagaaacugaaggaagag

SEQ ID NO: 1471941 - RNA, 19 nt, Homo sapiens
ggauaaagcuuguaaguua

SEQ ID NO: 1471942 - RNA, 19 nt, Homo sapiens
ggaaagaccuuacaauugu

SEQ ID NO: 1471943 - RNA, 19 nt, Homo sapiens
gcaaauggaauaucuguua

SEQ ID NO: 1471944 - RNA, 19 nt, Homo sapiens
gaggaguggugucuucuua

SEQ ID NO: 1471945 - RNA, 19 nt, Homo sapiens
gaacaggaguggagcaugu

SEQ ID NO: 1471946 - RNA, 19 nt, Homo sapiens
gaaacccugucuuuacuaa

SEQ ID NO: 1471947 - RNA, 19 nt, Homo sapiens
ucucaugacugaccaaaua

SEQ ID NO: 1471948 - RNA, 19 nt, Homo sapiens
ccuagaaucucucuuguuu

SEQ ID NO: 1471949 - RNA, 19 nt, Homo sapiens
gagaauaugggaaaucuuu

SEQ ID NO: 1471950 - RNA, 19 nt, Homo sapiens
gagaaaggccuuaugaaug

SEQ ID NO: 1471951 - RNA, 19 nt, Homo sapiens
ugagguaugugggaaauua

SEQ ID NO: 1471952 - RNA, 19 nt, Homo sapiens
agagagagcuuaucacugu

SEQ ID NO: 1471953 - RNA, 19 nt, Homo sapiens
cgaaagagcagccuuauuc

SEQ ID NO: 1471954 - RNA, 19 nt, Homo sapiens
agaaaggccuuaugaaugu

SEQ ID NO: 1471955 - RNA, 19 nt, Homo sapiens
cuaagaugcuucauggaua

SEQ ID NO: 1471956 - RNA, 19 nt, Homo sapiens
gagcugagauuacgaguac

SEQ ID NO: 1471957 - RNA, 19 nt, Homo sapiens
ggagaaaggccuuaugaau

SEQ ID NO: 1471958 - RNA, 19 nt, Homo sapiens
gagaaaggccuuacaagug

SEQ ID NO: 1471959 - RNA, 19 nt, Homo sapiens
caccguagcuugcuuucua

SEQ ID NO: 1471960 - RNA, 19 nt, Homo sapiens
gggaaagaccuuacaauug

SEQ ID NO: 1471961 - RNA, 19 nt, Homo sapiens
gaacggagucucauucugu

SEQ ID NO: 1471962 - RNA, 19 nt, Homo sapiens
gaaacaucccgucucguua

SEQ ID NO: 1471963 - RNA, 19 nt, Homo sapiens
gaaccuggcucucauaucc

SEQ ID NO: 1471964 - RNA, 19 nt, Homo sapiens
gaacaugaagauaguuuga

SEQ ID NO: 1471965 - RNA, 19 nt, Homo sapiens
gggcagguguuucuccuaa

SEQ ID NO: 1471966 - RNA, 19 nt, Homo sapiens
uaaccacuguucccaaauu

SEQ ID NO: 1471967 - RNA, 19 nt, Homo sapiens
gcaagauaaucagcuauau

SEQ ID NO: 1471968 - RNA, 19 nt, Homo sapiens
uagggaaugugggaaauua

SEQ ID NO: 1471969 - RNA, 19 nt, Homo sapiens
agagaagcaucguuuguaa

SEQ ID NO: 1471970 - RNA, 19 nt, Homo sapiens
ccucagaguucucacauau

SEQ ID NO: 1471971 - RNA, 19 nt, Homo sapiens
gaaaggccuuaugaaugua

SEQ ID NO: 1471972 - RNA, 19 nt, Homo sapiens
gcucugcgcuucauguuca

SEQ ID NO: 1471973 - RNA, 19 nt, Homo sapiens
agaaaggccuuacaagugu

SEQ ID NO: 1471974 - RNA, 19 nt, Homo sapiens
agaaaggccuuaugagugu

SEQ ID NO: 1471975 - RNA, 19 nt, Homo sapiens
gcagggcacugugaccuuu

SEQ ID NO: 1471976 - RNA, 19 nt, Homo sapiens
gcuaugagcugguuaucca

SEQ ID NO: 1471977 - RNA, 19 nt, Homo sapiens
ggagaaaggccuuaugagu

SEQ ID NO: 1471978 - RNA, 19 nt, Homo sapiens
ggagaaaggccuuacaagu

SEQ ID NO: 1471979 - RNA, 19 nt, Homo sapiens
ggagaaaggccuuaugagu

SEQ ID NO: 1471980 - RNA, 19 nt, Homo sapiens
gagagugugggaaaucuua

SEQ ID NO: 1471981 - RNA, 19 nt, Homo sapiens
gcagguguuucuccuaaga

SEQ ID NO: 1471982 - RNA, 19 nt, Homo sapiens
gaauuucuguacaaagaga

SEQ ID NO: 1471983 - RNA, 19 nt, Homo sapiens
gcaugaaugucgacacugu

SEQ ID NO: 1471984 - RNA, 19 nt, Homo sapiens
gcucuacccuccuucauca

SEQ ID NO: 1471985 - RNA, 19 nt, Homo sapiens
caaggaaugugggaaauca

SEQ ID NO: 1471986 - RNA, 19 nt, Homo sapiens
gaaaauccuuuagcagaua

SEQ ID NO: 1471987 - RNA, 19 nt, Homo sapiens
gauguuaugugugcaguga

SEQ ID NO: 1471988 - RNA, 19 nt, Homo sapiens
gauaaagcuuguaaguuag

SEQ ID NO: 1471989 - RNA, 19 nt, Homo sapiens
uaagaaauguggauaaagc

SEQ ID NO: 1471990 - RNA, 19 nt, Homo sapiens
ccaggaaacucaucacaag

SEQ ID NO: 1471991 - RNA, 19 nt, Homo sapiens
ggaaaugucccagucagaa

SEQ ID NO: 1471992 - RNA, 19 nt, Homo sapiens
ggagaaaggccguaugagu

SEQ ID NO: 1471993 - RNA, 19 nt, Homo sapiens
aauaagaacugcgugacua

SEQ ID NO: 1471994 - RNA, 19 nt, Homo sapiens
ggagaaaggcccuaugagu

SEQ ID NO: 1471995 - RNA, 19 nt, Homo sapiens
cagaaagagugucagagaa

SEQ ID NO: 1471996 - RNA, 19 nt, Homo sapiens
ugaagaacaugaagauagu

SEQ ID NO: 1471997 - RNA, 19 nt, Homo sapiens
aagcaucguuuguaaagaa

SEQ ID NO: 1471998 - RNA, 19 nt, Homo sapiens
ggaugacacugcauaccuu

SEQ ID NO: 1471999 - RNA, 19 nt, Homo sapiens
caacaucagcgaggucaua

SEQ ID NO: 1472000 - RNA, 19 nt, Homo sapiens
uaugucagcuucaguaauc

SEQ ID NO: 1472001 - RNA, 19 nt, Homo sapiens
uaagagacuucgcauugga

SEQ ID NO: 1472002 - RNA, 19 nt, Homo sapiens
ggagaaaggacuuaugagu

SEQ ID NO: 1472003 - RNA, 19 nt, Homo sapiens
uuacaaguguggagaaugu

SEQ ID NO: 1472004 - RNA, 19 nt, Homo sapiens
ccuagaagguggagaggaa

SEQ ID NO: 1472005 - RNA, 19 nt, Homo sapiens
agagauggauguuaugugu

SEQ ID NO: 1472006 - RNA, 19 nt, Homo sapiens
guagcuugcuuucuauuca

SEQ ID NO: 1472007 - RNA, 19 nt, Homo sapiens
gaaaauccuuugcugaaug

SEQ ID NO: 1472008 - RNA, 19 nt, Homo sapiens
agaccacccuggacaauau

SEQ ID NO: 1472009 - RNA, 19 nt, Homo sapiens
cgucauucauccacauuaa

SEQ ID NO: 1472010 - RNA, 19 nt, Homo sapiens
aaacaucccgucucguuaa

SEQ ID NO: 1472011 - RNA, 19 nt, Homo sapiens
gaaaggccuuaugagugua

SEQ ID NO: 1472012 - RNA, 19 nt, Homo sapiens
gaaagagcagccuuauuca

SEQ ID NO: 1472013 - RNA, 19 nt, Homo sapiens
gcaccaaacacucaguuau

SEQ ID NO: 1472014 - RNA, 19 nt, Homo sapiens
cauggaaccucacaaaguc

SEQ ID NO: 1472015 - RNA, 19 nt, Homo sapiens
caguacccguugagauuua

SEQ ID NO: 1472016 - RNA, 19 nt, Homo sapiens
gagcuccaauuaccucaga

SEQ ID NO: 1472017 - RNA, 19 nt, Homo sapiens
gagaagacagacagugaaa

SEQ ID NO: 1472018 - RNA, 19 nt, Homo sapiens
ggaguggugucuucuuagu

SEQ ID NO: 1472019 - RNA, 19 nt, Homo sapiens
aguuagaaauggcaagaua

SEQ ID NO: 1472020 - RNA, 19 nt, Homo sapiens
gauaaucuccagucucugu

SEQ ID NO: 1472021 - RNA, 19 nt, Homo sapiens
gaauguaccaaauguggaa

SEQ ID NO: 1472022 - RNA, 19 nt, Homo sapiens
gaucccaccucacugaaca

SEQ ID NO: 1472023 - RNA, 19 nt, Homo sapiens
gaagugaagaacaugaaga

SEQ ID NO: 1472024 - RNA, 19 nt, Homo sapiens
gggaaugugggaaaucuuu

SEQ ID NO: 1472025 - RNA, 19 nt, Homo sapiens
gcacugugaccuuugaaga

SEQ ID NO: 1472026 - RNA, 19 nt, Homo sapiens
ugaaauguguggccucauc

SEQ ID NO: 1472027 - RNA, 19 nt, Homo sapiens
gauaaucagcuauaugaag

SEQ ID NO: 1472028 - RNA, 19 nt, Homo sapiens
ggcaagauaaucagcuaua

SEQ ID NO: 1472029 - RNA, 19 nt, Homo sapiens
aaacacaggagaguucaua

SEQ ID NO: 1472030 - RNA, 19 nt, Homo sapiens
ugaaacaucccgucucguu

SEQ ID NO: 1472031 - RNA, 19 nt, Homo sapiens
gcgaagcucuacccuccuu

SEQ ID NO: 1472032 - RNA, 19 nt, Homo sapiens
cagugaaugugguaaauca

SEQ ID NO: 1472033 - RNA, 19 nt, Homo sapiens
gaagacagacagugaaacu

SEQ ID NO: 1472034 - RNA, 19 nt, Homo sapiens
ccugagggcugccuagaau

SEQ ID NO: 1472035 - RNA, 19 nt, Homo sapiens
ucagaguucucacauaugg

SEQ ID NO: 1472036 - RNA, 19 nt, Homo sapiens
guacagaucccaccucacu

SEQ ID NO: 1472037 - RNA, 19 nt, Homo sapiens
gaagcaucguuuguaaaga

SEQ ID NO: 1472038 - RNA, 19 nt, Homo sapiens
agaaauggcaagauaauca

SEQ ID NO: 1472039 - RNA, 19 nt, Homo sapiens
caagugacaauacguauag

SEQ ID NO: 1472040 - RNA, 19 nt, Homo sapiens
guuccagucucauuaaaca

SEQ ID NO: 1472041 - RNA, 19 nt, Homo sapiens
ggagaaaguuuaccauuga

SEQ ID NO: 1472042 - RNA, 19 nt, Homo sapiens
ggagaaaggucuuaugaau

SEQ ID NO: 1472043 - RNA, 19 nt, Homo sapiens
gauauuaacuccuuaccaa

SEQ ID NO: 1472044 - RNA, 19 nt, Homo sapiens
gaagaugaguguacaagug

SEQ ID NO: 1472045 - RNA, 19 nt, Homo sapiens
gagaaaggccuuauaaaug

SEQ ID NO: 1472046 - RNA, 19 nt, Homo sapiens
caacuaaucuccagaacau

SEQ ID NO: 1472047 - RNA, 19 nt, Homo sapiens
gaaauaaugcugcuaugaa

SEQ ID NO: 1472048 - RNA, 19 nt, Homo sapiens
caucagagauuucacaaug

SEQ ID NO: 1472049 - RNA, 19 nt, Homo sapiens
ggagaaaggccuuauaaau

SEQ ID NO: 1472050 - RNA, 19 nt, Homo sapiens
gaugugagguggaaucuau

SEQ ID NO: 1472051 - RNA, 19 nt, Homo sapiens
cagaaggccuuuauuagaa

SEQ ID NO: 1472052 - RNA, 19 nt, Homo sapiens
uaacaaaugugggaaauuc

SEQ ID NO: 1472053 - RNA, 19 nt, Homo sapiens
ccagaaaugucucaacuau

SEQ ID NO: 1472054 - RNA, 19 nt, Homo sapiens
agaaaggucuuaugaaugu

SEQ ID NO: 1472055 - RNA, 19 nt, Homo sapiens
ggagaaagaccuuauaagu

SEQ ID NO: 1472056 - RNA, 19 nt, Homo sapiens
ggauugcagugaucauuaa

SEQ ID NO: 1472057 - RNA, 19 nt, Homo sapiens
gauguacuguugacucuuu

SEQ ID NO: 1472058 - RNA, 19 nt, Homo sapiens
cauaguaccugugccauuu

SEQ ID NO: 1472059 - RNA, 19 nt, Homo sapiens
guaauuggguaguaauguu

SEQ ID NO: 1472060 - RNA, 19 nt, Homo sapiens
gagaaagaccuuauaagug

SEQ ID NO: 1472061 - RNA, 19 nt, Homo sapiens
caacacaugugggaaauuc

SEQ ID NO: 1472062 - RNA, 19 nt, Homo sapiens
gaggagaucuucacaugca

SEQ ID NO: 1472063 - RNA, 19 nt, Homo sapiens
guucacccauguuguauaa

SEQ ID NO: 1472064 - RNA, 19 nt, Homo sapiens
cagaggagaucuucacaug

SEQ ID NO: 1472065 - RNA, 19 nt, Homo sapiens
ggagucaccuucacagcaa

SEQ ID NO: 1472066 - RNA, 19 nt, Homo sapiens
guacaagugucuauucaag

SEQ ID NO: 1472067 - RNA, 19 nt, Homo sapiens
ggagaaagaccuuaugagu

SEQ ID NO: 1472068 - RNA, 19 nt, Homo sapiens
ggacagcuccacacucauu

SEQ ID NO: 1472069 - RNA, 19 nt, Homo sapiens
gcggaggccuugcugauga

SEQ ID NO: 1472070 - RNA, 19 nt, Homo sapiens
caccacgccuggcuaauuu

SEQ ID NO: 1472071 - RNA, 19 nt, Homo sapiens
auaaguggauucuacagua

SEQ ID NO: 1472072 - RNA, 19 nt, Homo sapiens
gaaaguuuaccauugacua

SEQ ID NO: 1472073 - RNA, 19 nt, Homo sapiens
uagaaagucucaccugguu

SEQ ID NO: 1472074 - RNA, 19 nt, Homo sapiens
ggagaaaggccuuaugagu

SEQ ID NO: 1472075 - RNA, 19 nt, Homo sapiens
ggagaaaggccuuaugagu

SEQ ID NO: 1472076 - RNA, 19 nt, Homo sapiens
ggagaaaggccuuaugagu

SEQ ID NO: 1472077 - RNA, 19 nt, Homo sapiens
gugggaaauucuuuaagua

SEQ ID NO: 1472078 - RNA, 19 nt, Homo sapiens
ugucagagguuacaacuuc

SEQ ID NO: 1472079 - RNA, 19 nt, Homo sapiens
ggacguggccauauauuuc

SEQ ID NO: 1472080 - RNA, 19 nt, Homo sapiens
ccagaaggccuuuauuaga

SEQ ID NO: 1472081 - RNA, 19 nt, Homo sapiens
ggacacagaggacagagaa

SEQ ID NO: 1472082 - RNA, 19 nt, Homo sapiens
agaaaggccuuauaaaugc

SEQ ID NO: 1472083 - RNA, 19 nt, Homo sapiens
ggagaaaggccguaugagu

SEQ ID NO: 1472084 - RNA, 19 nt, Homo sapiens
uauaugagguaccaauaga

SEQ ID NO: 1472085 - RNA, 19 nt, Homo sapiens
uaaugggacuauuugcuuu

SEQ ID NO: 1472086 - RNA, 19 nt, Homo sapiens
gagaaaggucuuaugaaug

SEQ ID NO: 1472087 - RNA, 19 nt, Homo sapiens
guaggagugucagagguua

SEQ ID NO: 1472088 - RNA, 19 nt, Homo sapiens
gucagaauauccuuccuuu

SEQ ID NO: 1472089 - RNA, 19 nt, Homo sapiens
gagacuggcuuauuucacu

SEQ ID NO: 1472090 - RNA, 19 nt, Homo sapiens
gcuccacacucauuaaaca

SEQ ID NO: 1472091 - RNA, 19 nt, Homo sapiens
uggagaaaguuuaccauug

SEQ ID NO: 1472092 - RNA, 19 nt, Homo sapiens
gaaagucucaccugguuca

SEQ ID NO: 1472093 - RNA, 19 nt, Homo sapiens
uaaguacagugccaauuuc

SEQ ID NO: 1472094 - RNA, 19 nt, Homo sapiens
gggaaauucuuuaaguaca

SEQ ID NO: 1472095 - RNA, 19 nt, Homo sapiens
gagguggaaucuauagugu

SEQ ID NO: 1472096 - RNA, 19 nt, Homo sapiens
ccuuauaagugcaaugauu

SEQ ID NO: 1472097 - RNA, 19 nt, Homo sapiens
gaaaggucuuaugaaugua

SEQ ID NO: 1472098 - RNA, 19 nt, Homo sapiens
uaaguggauucuacaguau

SEQ ID NO: 1472099 - RNA, 19 nt, Homo sapiens
ucacaauggagaaaguuua

SEQ ID NO: 1472100 - RNA, 19 nt, Homo sapiens
guacagcuccacauuuguu

SEQ ID NO: 1472101 - RNA, 19 nt, Homo sapiens
uggaaucuauagugucuuu

SEQ ID NO: 1472102 - RNA, 19 nt, Homo sapiens
ucacccauguuguauaaug

SEQ ID NO: 1472103 - RNA, 19 nt, Homo sapiens
gaaaggccuuauaaaugca

SEQ ID NO: 1472104 - RNA, 19 nt, Homo sapiens
cgguacagcuccacauuug

SEQ ID NO: 1472105 - RNA, 19 nt, Homo sapiens
gaagcaaccauggaucaaa

SEQ ID NO: 1472106 - RNA, 19 nt, Homo sapiens
gcauuuguguaucuggaaa

SEQ ID NO: 1472107 - RNA, 19 nt, Homo sapiens
ggagugcagugcugugauc

SEQ ID NO: 1472108 - RNA, 19 nt, Homo sapiens
ucagagauuucacaaugga

SEQ ID NO: 1472109 - RNA, 19 nt, Homo sapiens
agaaggccuuuauuagaaa

SEQ ID NO: 1472110 - RNA, 19 nt, Homo sapiens
guacagugccaauuucaug

SEQ ID NO: 1472111 - RNA, 19 nt, Homo sapiens
ggaaauucuuuaaguacag

SEQ ID NO: 1472112 - RNA, 19 nt, Homo sapiens
acaagugucuauucaagau

SEQ ID NO: 1472113 - RNA, 19 nt, Homo sapiens
guuaaacauuggagaaauc

SEQ ID NO: 1472114 - RNA, 19 nt, Homo sapiens
guacaacuaccgacucaug

SEQ ID NO: 1472115 - RNA, 19 nt, Homo sapiens
uuaaguacagugccaauuu

SEQ ID NO: 1472116 - RNA, 19 nt, Homo sapiens
gugcagugcugugaucuug

SEQ ID NO: 1472117 - RNA, 19 nt, Homo sapiens
aaauaaugcugcuaugaag

SEQ ID NO: 1472118 - RNA, 19 nt, Homo sapiens
ucauauaaguggauucuac

SEQ ID NO: 1472119 - RNA, 19 nt, Homo sapiens
caugaaacaucagacaguu

SEQ ID NO: 1472120 - RNA, 19 nt, Homo sapiens
gaauucauccugagcaaca

SEQ ID NO: 1472121 - RNA, 19 nt, Homo sapiens
gauuaaugauguugaggau

SEQ ID NO: 1472122 - RNA, 19 nt, Homo sapiens
gguggaaucuauagugucu

SEQ ID NO: 1472123 - RNA, 19 nt, Homo sapiens
uaggguauauacucagaaa

SEQ ID NO: 1472124 - RNA, 19 nt, Homo sapiens
caacuccaaccucauuaaa

SEQ ID NO: 1472125 - RNA, 19 nt, Homo sapiens
cauuagacaucagagaauu

SEQ ID NO: 1472126 - RNA, 19 nt, Homo sapiens
ccacacucauuaaacauca

SEQ ID NO: 1472127 - RNA, 19 nt, Homo sapiens
guugaguuguaguucuuua

SEQ ID NO: 1472128 - RNA, 19 nt, Homo sapiens
ggguauauacucagaaaug

SEQ ID NO: 1472129 - RNA, 19 nt, Homo sapiens
uugaggacguggccauaua

SEQ ID NO: 1472130 - RNA, 19 nt, Homo sapiens
uaugagguaccaauagaua

SEQ ID NO: 1472131 - RNA, 19 nt, Homo sapiens
caaaugugggaaauucuuu

SEQ ID NO: 1472132 - RNA, 19 nt, Homo sapiens
caggagaaaggucuuauga

SEQ ID NO: 1472133 - RNA, 19 nt, Homo sapiens
gauuggauaccuucauuug

SEQ ID NO: 1472134 - RNA, 19 nt, Homo sapiens
gcauggagcugaggaugag

SEQ ID NO: 1472135 - RNA, 19 nt, Homo sapiens
uuaaugauguugaggaucu

SEQ ID NO: 1472136 - RNA, 19 nt, Homo sapiens
cuauauacauccucaccaa

SEQ ID NO: 1472137 - RNA, 19 nt, Homo sapiens
ggugcuggaucauauagga

SEQ ID NO: 1472138 - RNA, 19 nt, Homo sapiens
ugccagaaggccuuuauua

SEQ ID NO: 1472139 - RNA, 19 nt, Homo sapiens
caucuguacuaaacaugaa

SEQ ID NO: 1472140 - RNA, 19 nt, Homo sapiens
caacuccagccuuguuaaa

SEQ ID NO: 1472141 - RNA, 19 nt, Homo sapiens
gagccaagaucgcaccauu

SEQ ID NO: 1472142 - RNA, 19 nt, Homo sapiens
ccaagauccuccuuagaau

SEQ ID NO: 1472143 - RNA, 19 nt, Homo sapiens
ccuguaaucccaacacuuu

SEQ ID NO: 1472144 - RNA, 19 nt, Homo sapiens
cccaagauccuccuuagaa

SEQ ID NO: 1472145 - RNA, 19 nt, Homo sapiens
gguagcggcuccuggaagu

SEQ ID NO: 1472146 - RNA, 19 nt, Homo sapiens
gcaggagaauggcuugaac

SEQ ID NO: 1472147 - RNA, 19 nt, Homo sapiens
gaaaccccgucucuacuaa

SEQ ID NO: 1472148 - RNA, 19 nt, Homo sapiens
gaccaccaccucccucaaa

SEQ ID NO: 1472149 - RNA, 19 nt, Homo sapiens
gugcugggcccuucauaga

SEQ ID NO: 1472150 - RNA, 19 nt, Homo sapiens
caagcgaaacuccgucuca

SEQ ID NO: 1472151 - RNA, 19 nt, Homo sapiens
cccagacccuccuuagaau

SEQ ID NO: 1472152 - RNA, 19 nt, Homo sapiens
caagauccuccuuagaauc

SEQ ID NO: 1472153 - RNA, 19 nt, Homo sapiens
cccagacccuccuuagaau

SEQ ID NO: 1472154 - RNA, 19 nt, Homo sapiens
agcaaugucugugcaggua

SEQ ID NO: 1472155 - RNA, 19 nt, Homo sapiens
gcgaaacuccgucucaaaa

SEQ ID NO: 1472156 - RNA, 19 nt, Homo sapiens
aagcgaaacuccgucucaa

SEQ ID NO: 1472157 - RNA, 19 nt, Homo sapiens
ggaagcugaggcaggagaa

SEQ ID NO: 1472158 - RNA, 19 nt, Homo sapiens
gauuucaagaccagcauga

SEQ ID NO: 1472159 - RNA, 19 nt, Homo sapiens
ccaccagaacuuccacaga

SEQ ID NO: 1472160 - RNA, 19 nt, Homo sapiens
ugaccaacauggagaaacc

SEQ ID NO: 1472161 - RNA, 19 nt, Homo sapiens
gccaagaucgcaccauugc

SEQ ID NO: 1472162 - RNA, 19 nt, Homo sapiens
agaccagcaugaccaacau

SEQ ID NO: 1472163 - RNA, 19 nt, Homo sapiens
ccugagguccggauuucaa

SEQ ID NO: 1472164 - RNA, 19 nt, Homo sapiens
gcaacaaccucaccaauuu

SEQ ID NO: 1472165 - RNA, 19 nt, Homo sapiens
gaaagcaccuuguccaaug

SEQ ID NO: 1472166 - RNA, 19 nt, Homo sapiens
gcaaaucuccuaccuuguu

SEQ ID NO: 1472167 - RNA, 19 nt, Homo sapiens
gaaacugauuccagacuga

SEQ ID NO: 1472168 - RNA, 19 nt, Homo sapiens
gaacugagcuugggaucca

SEQ ID NO: 1472169 - RNA, 19 nt, Homo sapiens
ggucuuaucucugcaacaa

SEQ ID NO: 1472170 - RNA, 19 nt, Homo sapiens
caaaucuccuaccuuguuu

SEQ ID NO: 1472171 - RNA, 19 nt, Homo sapiens
gaugguggauggugcagaa

SEQ ID NO: 1472172 - RNA, 19 nt, Homo sapiens
agagacagguggacaaaga

SEQ ID NO: 1472173 - RNA, 19 nt, Homo sapiens
aggauugccucccaaauuu

SEQ ID NO: 1472174 - RNA, 19 nt, Homo sapiens
gcgagcacaugaaggauug

SEQ ID NO: 1472175 - RNA, 19 nt, Homo sapiens
cccagacucuuucacauaa

SEQ ID NO: 1472176 - RNA, 19 nt, Homo sapiens
gcagcucgucuucgucuua

SEQ ID NO: 1472177 - RNA, 19 nt, Homo sapiens
caggcaggguuucucaaua

SEQ ID NO: 1472178 - RNA, 19 nt, Homo sapiens
uagcagaguucccuuucaa

SEQ ID NO: 1472179 - RNA, 19 nt, Homo sapiens
gaacauaaccagcuuuuag

SEQ ID NO: 1472180 - RNA, 19 nt, Homo sapiens
ggucuuggcaccuuucuug

SEQ ID NO: 1472181 - RNA, 19 nt, Homo sapiens
ugagaguccugcuuugaga

SEQ ID NO: 1472182 - RNA, 19 nt, Homo sapiens
cgucuuaggccuccuguuu

SEQ ID NO: 1472183 - RNA, 19 nt, Homo sapiens
gauccagacugaaacugau

SEQ ID NO: 1472184 - RNA, 19 nt, Homo sapiens
ggaaagcaccuuguccaau

SEQ ID NO: 1472185 - RNA, 19 nt, Homo sapiens
guguuacaguuccaccuua

SEQ ID NO: 1472186 - RNA, 19 nt, Homo sapiens
ggccagcacuccuaagucu

SEQ ID NO: 1472187 - RNA, 19 nt, Homo sapiens
gaguguccauugccuccua

SEQ ID NO: 1472188 - RNA, 19 nt, Homo sapiens
ggugugcucgugaacauaa

SEQ ID NO: 1472189 - RNA, 19 nt, Homo sapiens
caacaaccucaccaauuug

SEQ ID NO: 1472190 - RNA, 19 nt, Homo sapiens
gcuauaagacccagaaagg

SEQ ID NO: 1472191 - RNA, 19 nt, Homo sapiens
ggauccagacugaaacuga

SEQ ID NO: 1472192 - RNA, 19 nt, Homo sapiens
gcacccagacucuuucaca

SEQ ID NO: 1472193 - RNA, 19 nt, Homo sapiens
gagugagaguccugcuuug

SEQ ID NO: 1472194 - RNA, 19 nt, Homo sapiens
uuacagagcaugugugucu

SEQ ID NO: 1472195 - RNA, 19 nt, Homo sapiens
cagcuguucugccuucuag

SEQ ID NO: 1472196 - RNA, 19 nt, Homo sapiens
gaccuaagugggagaguga

SEQ ID NO: 1472197 - RNA, 19 nt, Homo sapiens
acaagcacccagacucuuu

SEQ ID NO: 1472198 - RNA, 19 nt, Homo sapiens
gcuucuacguguuacaguu

SEQ ID NO: 1472199 - RNA, 19 nt, Homo sapiens
aaggauugccucccaaauu

SEQ ID NO: 1472200 - RNA, 19 nt, Homo sapiens
gguggauggugcagaaaca

SEQ ID NO: 1472201 - RNA, 19 nt, Homo sapiens
gaaggauugccucccaaau

SEQ ID NO: 1472202 - RNA, 19 nt, Homo sapiens
uguuacaguuccaccuuaa

SEQ ID NO: 1472203 - RNA, 19 nt, Homo sapiens
agagugagaguccugcuuu

SEQ ID NO: 1472204 - RNA, 19 nt, Homo sapiens
ggggagcuguccuagauaa

SEQ ID NO: 1472205 - RNA, 19 nt, Homo sapiens
ccagcacuccuaagucuau

SEQ ID NO: 1472206 - RNA, 19 nt, Homo sapiens
cgucuuacccugcgcaaau

SEQ ID NO: 1472207 - RNA, 19 nt, Homo sapiens
ucacaucugcguccuguag

SEQ ID NO: 1472208 - RNA, 19 nt, Homo sapiens
gcagaguucccuuucaaaa

SEQ ID NO: 1472209 - RNA, 19 nt, Homo sapiens
cagacucuuucacauaaca

SEQ ID NO: 1472210 - RNA, 19 nt, Homo sapiens
gagacagguggacaaagaa

SEQ ID NO: 1472211 - RNA, 19 nt, Homo sapiens
ccaaugggaggaccuaagu

SEQ ID NO: 1472212 - RNA, 19 nt, Homo sapiens
caucauauugggagcauca

SEQ ID NO: 1472213 - RNA, 19 nt, Homo sapiens
ugcaacaaccucaccaauu

SEQ ID NO: 1472214 - RNA, 19 nt, Homo sapiens
aggcaggguuucucaauac

SEQ ID NO: 1472215 - RNA, 19 nt, Homo sapiens
gggagucgugggcuuuaaa

SEQ ID NO: 1472216 - RNA, 19 nt, Homo sapiens
gaugcuauaagacccagaa

SEQ ID NO: 1472217 - RNA, 19 nt, Homo sapiens
gacagguggacaaagaauu

SEQ ID NO: 1472218 - RNA, 19 nt, Homo sapiens
ccagagacagguggacaaa

SEQ ID NO: 1472219 - RNA, 19 nt, Homo sapiens
aaacagugacccagagaca

SEQ ID NO: 1472220 - RNA, 19 nt, Homo sapiens
gagcuguccuagauaaaau

SEQ ID NO: 1472221 - RNA, 19 nt, Homo sapiens
caggggagcuguccuagau

SEQ ID NO: 1472222 - RNA, 19 nt, Homo sapiens
cgacaagcacccagacucu

SEQ ID NO: 1472223 - RNA, 19 nt, Homo sapiens
uggcugcuucuacguguua

SEQ ID NO: 1472224 - RNA, 19 nt, Homo sapiens
ucaaggccagcacuccuaa

SEQ ID NO: 1472225 - RNA, 19 nt, Homo sapiens
aaauagcagaguucccuuu

SEQ ID NO: 1472226 - RNA, 19 nt, Homo sapiens
ucuccacucugccucguau

SEQ ID NO: 1472227 - RNA, 19 nt, Homo sapiens
gagaguccugcuuugagaa

SEQ ID NO: 1472228 - RNA, 19 nt, Homo sapiens
acccagacucuuucacaua

SEQ ID NO: 1472229 - RNA, 19 nt, Homo sapiens
ugaaggauugccucccaaa

SEQ ID NO: 1472230 - RNA, 19 nt, Homo sapiens
acagguggacaaagaauuc

SEQ ID NO: 1472231 - RNA, 19 nt, Homo sapiens
gauggugcagaaacaguga

SEQ ID NO: 1472232 - RNA, 19 nt, Homo sapiens
gagagugagaguccugcuu

SEQ ID NO: 1472233 - RNA, 19 nt, Homo sapiens
ggcgagcacaugaaggauu

SEQ ID NO: 1472234 - RNA, 19 nt, Homo sapiens
gguuacagagcaugugugu

SEQ ID NO: 1472235 - RNA, 19 nt, Homo sapiens
guagcugcccgaccugugu

SEQ ID NO: 1472236 - RNA, 19 nt, Homo sapiens
aaagcaccuuguccaaugg

SEQ ID NO: 1472237 - RNA, 19 nt, Homo sapiens
cacccagacucuuucacau

SEQ ID NO: 1472238 - RNA, 19 nt, Homo sapiens
gacaagcacccagacucuu

SEQ ID NO: 1472239 - RNA, 19 nt, Homo sapiens
cauauugggagcaucaaag

SEQ ID NO: 1472240 - RNA, 19 nt, Homo sapiens
ugagacuugugcagcuguu

SEQ ID NO: 1472241 - RNA, 19 nt, Homo sapiens
gauuccagacugaccucua

SEQ ID NO: 1472242 - RNA, 19 nt, Homo sapiens
gagaaacccuguaaaugua

SEQ ID NO: 1472243 - RNA, 19 nt, Homo sapiens
gagauaagcccuaugaaua

SEQ ID NO: 1472244 - RNA, 19 nt, Homo sapiens
gagaagaccucugaaugua

SEQ ID NO: 1472245 - RNA, 19 nt, Homo sapiens
gagaaagccugaacaguug

SEQ ID NO: 1472246 - RNA, 19 nt, Homo sapiens
gagaagcccuauaaaugua

SEQ ID NO: 1472247 - RNA, 19 nt, Homo sapiens
gcucagaucuuacuaaaca

SEQ ID NO: 1472248 - RNA, 19 nt, Homo sapiens
gcucauaccuuacuaaaca

SEQ ID NO: 1472249 - RNA, 19 nt, Homo sapiens
gcucauaucuuaccaaaca

SEQ ID NO: 1472250 - RNA, 19 nt, Homo sapiens
gaaaguaacacuaucaaug

SEQ ID NO: 1472251 - RNA, 19 nt, Homo sapiens
gagagaagcccuauaaaug

SEQ ID NO: 1472252 - RNA, 19 nt, Homo sapiens
gauaagcccuaugaauaua

SEQ ID NO: 1472253 - RNA, 19 nt, Homo sapiens
ggaaagccuucauuuauca

SEQ ID NO: 1472254 - RNA, 19 nt, Homo sapiens
ggacagaaacgcuuugauu

SEQ ID NO: 1472255 - RNA, 19 nt, Homo sapiens
caacacgucugaauguauu

SEQ ID NO: 1472256 - RNA, 19 nt, Homo sapiens
gaagauagaagaaguaaca

SEQ ID NO: 1472257 - RNA, 19 nt, Homo sapiens
acagaacgcucagaucuua

SEQ ID NO: 1472258 - RNA, 19 nt, Homo sapiens
gagaagcccuuuaaguguu

SEQ ID NO: 1472259 - RNA, 19 nt, Homo sapiens
uguacuaacucaacacuua

SEQ ID NO: 1472260 - RNA, 19 nt, Homo sapiens
agagaaaccuguacaguga

SEQ ID NO: 1472261 - RNA, 19 nt, Homo sapiens
caagauaaauccuuugaag

SEQ ID NO: 1472262 - RNA, 19 nt, Homo sapiens
gaaaguguacacaagauaa

SEQ ID NO: 1472263 - RNA, 19 nt, Homo sapiens
gaacucacacuggauauaa

SEQ ID NO: 1472264 - RNA, 19 nt, Homo sapiens
gagaaacccuaugaaugua

SEQ ID NO: 1472265 - RNA, 19 nt, Homo sapiens
aaacauccaugccuuaaga

SEQ ID NO: 1472266 - RNA, 19 nt, Homo sapiens
ggauacaguuggcaagaaa

SEQ ID NO: 1472267 - RNA, 19 nt, Homo sapiens
gaacucauaugggagagaa

SEQ ID NO: 1472268 - RNA, 19 nt, Homo sapiens
ggaaagccuucacuuguca

SEQ ID NO: 1472269 - RNA, 19 nt, Homo sapiens
gaacguggccaaaguagga

SEQ ID NO: 1472270 - RNA, 19 nt, Homo sapiens
ggagagaagcccuauaaau

SEQ ID NO: 1472271 - RNA, 19 nt, Homo sapiens
gggaaagccuucauuuauc

SEQ ID NO: 1472272 - RNA, 19 nt, Homo sapiens
gagagaaacccuuugaaug

SEQ ID NO: 1472273 - RNA, 19 nt, Homo sapiens
gagagaaacccuaugaaug

SEQ ID NO: 1472274 - RNA, 19 nt, Homo sapiens
ggacguauucaacauuuaa

SEQ ID NO: 1472275 - RNA, 19 nt, Homo sapiens
gagagaagccauaugaaug

SEQ ID NO: 1472276 - RNA, 19 nt, Homo sapiens
ggauacagcuguggacuuc

SEQ ID NO: 1472277 - RNA, 19 nt, Homo sapiens
ugagaaagccugaacaguu

SEQ ID NO: 1472278 - RNA, 19 nt, Homo sapiens
gaagacacacuggagauaa

SEQ ID NO: 1472279 - RNA, 19 nt, Homo sapiens
ggaaaccauuuaccucuuc

SEQ ID NO: 1472280 - RNA, 19 nt, Homo sapiens
gaacauguacgaacucaca

SEQ ID NO: 1472281 - RNA, 19 nt, Homo sapiens
gagaaacccuuugaaugug

SEQ ID NO: 1472282 - RNA, 19 nt, Homo sapiens
gagaaaaccuuuaaaugug

SEQ ID NO: 1472283 - RNA, 19 nt, Homo sapiens
ggagagaaacccuuugaau

SEQ ID NO: 1472284 - RNA, 19 nt, Homo sapiens
ggagauaagcccuaugaau

SEQ ID NO: 1472285 - RNA, 19 nt, Homo sapiens
gagaagccauaugaaugua

SEQ ID NO: 1472286 - RNA, 19 nt, Homo sapiens
ggagagaagccauaugaau

SEQ ID NO: 1472287 - RNA, 19 nt, Homo sapiens
ggagagaaacccuaugaau

SEQ ID NO: 1472288 - RNA, 19 nt, Homo sapiens
gguacauccucagguauua

SEQ ID NO: 1472289 - RNA, 19 nt, Homo sapiens
gagaaaguguacacaagau

SEQ ID NO: 1472290 - RNA, 19 nt, Homo sapiens
aagccuaacugaacaugua

SEQ ID NO: 1472291 - RNA, 19 nt, Homo sapiens
cagucuaguugaucauuua

SEQ ID NO: 1472292 - RNA, 19 nt, Homo sapiens
guagagaaacccuguaaau

SEQ ID NO: 1472293 - RNA, 19 nt, Homo sapiens
gaauguaacgcauguggaa

SEQ ID NO: 1472294 - RNA, 19 nt, Homo sapiens
gaagaccucugaauguaac

SEQ ID NO: 1472295 - RNA, 19 nt, Homo sapiens
ggaggaagaggaagaguug

SEQ ID NO: 1472296 - RNA, 19 nt, Homo sapiens
gagaugugaugcuggagaa

SEQ ID NO: 1472297 - RNA, 19 nt, Homo sapiens
gaaacccuaugaauguaug

SEQ ID NO: 1472298 - RNA, 19 nt, Homo sapiens
aaaggaagauggcuuacug

SEQ ID NO: 1472299 - RNA, 19 nt, Homo sapiens
ccugaacaguugaaucuuu

SEQ ID NO: 1472300 - RNA, 19 nt, Homo sapiens
uaagaacucacacuggaua

SEQ ID NO: 1472301 - RNA, 19 nt, Homo sapiens
uaagaaaugugguaaagcu

SEQ ID NO: 1472302 - RNA, 19 nt, Homo sapiens
gagaagcccuaugggugua

SEQ ID NO: 1472303 - RNA, 19 nt, Homo sapiens
cuacccaccuuaauaauca

SEQ ID NO: 1472304 - RNA, 19 nt, Homo sapiens
cagaaacgcuuugauugug

SEQ ID NO: 1472305 - RNA, 19 nt, Homo sapiens
cagaaaggaagauggcuua

SEQ ID NO: 1472306 - RNA, 19 nt, Homo sapiens
gaagaagaguugagaaccu

SEQ ID NO: 1472307 - RNA, 19 nt, Homo sapiens
caggacguauucaacauuu

SEQ ID NO: 1472308 - RNA, 19 nt, Homo sapiens
gggaaagccuucacuuguc

SEQ ID NO: 1472309 - RNA, 19 nt, Homo sapiens
gacagaaacgcuuugauug

SEQ ID NO: 1472310 - RNA, 19 nt, Homo sapiens
gaggaacucuaugacugua

SEQ ID NO: 1472311 - RNA, 19 nt, Homo sapiens
agagaaacccuguaaaugu

SEQ ID NO: 1472312 - RNA, 19 nt, Homo sapiens
ggagaaaguaacacuauca

SEQ ID NO: 1472313 - RNA, 19 nt, Homo sapiens
agagaaacccuuugaaugu

SEQ ID NO: 1472314 - RNA, 19 nt, Homo sapiens
guucgggucuuucuaggaa

SEQ ID NO: 1472315 - RNA, 19 nt, Homo sapiens
agagaaacccuaugaaugu

SEQ ID NO: 1472316 - RNA, 19 nt, Homo sapiens
gguaaagcuuucacuaagu

SEQ ID NO: 1472317 - RNA, 19 nt, Homo sapiens
agaagcccuuuaaguguua

SEQ ID NO: 1472318 - RNA, 19 nt, Homo sapiens
acaagaaccuguccucagu

SEQ ID NO: 1472319 - RNA, 19 nt, Homo sapiens
cuagauauguacaaacuca

SEQ ID NO: 1472320 - RNA, 19 nt, Homo sapiens
gagaagcccuguggaugug

SEQ ID NO: 1472321 - RNA, 19 nt, Homo sapiens
gugagaagcccuuuaagug

SEQ ID NO: 1472322 - RNA, 19 nt, Homo sapiens
ccucagguauuauugaaga

SEQ ID NO: 1472323 - RNA, 19 nt, Homo sapiens
gcuguuuccucaagccuaa

SEQ ID NO: 1472324 - RNA, 19 nt, Homo sapiens
cagcucguauugcacauuu

SEQ ID NO: 1472325 - RNA, 19 nt, Homo sapiens
gaacacacgcuggagagaa

SEQ ID NO: 1472326 - RNA, 19 nt, Homo sapiens
ggaagaagaagaguugaga

SEQ ID NO: 1472327 - RNA, 19 nt, Homo sapiens
gugcuuucaugaucgcuua

SEQ ID NO: 1472328 - RNA, 19 nt, Homo sapiens
gaagccauaugaauguaag

SEQ ID NO: 1472329 - RNA, 19 nt, Homo sapiens
caugcgaacucacacagaa

SEQ ID NO: 1472330 - RNA, 19 nt, Homo sapiens
gggaaaccauuuaccucuu

SEQ ID NO: 1472331 - RNA, 19 nt, Homo sapiens
ugggaaagccuucauuuau

SEQ ID NO: 1472332 - RNA, 19 nt, Homo sapiens
aaauggaccugguaaccuu

SEQ ID NO: 1472333 - RNA, 19 nt, Homo sapiens
acaaacuucuaaugggaua

SEQ ID NO: 1472334 - RNA, 19 nt, Homo sapiens
ucagagaaacuuauacaga

SEQ ID NO: 1472335 - RNA, 19 nt, Homo sapiens
gaacaguugaaucuuucua

SEQ ID NO: 1472336 - RNA, 19 nt, Homo sapiens
gugcucauaucuuaccaaa

SEQ ID NO: 1472337 - RNA, 19 nt, Homo sapiens
cacaagccaugcuguaaau

SEQ ID NO: 1472338 - RNA, 19 nt, Homo sapiens
cagagaaaguguacacaag

SEQ ID NO: 1472339 - RNA, 19 nt, Homo sapiens
guaaacauccaugccuuaa

SEQ ID NO: 1472340 - RNA, 19 nt, Homo sapiens
gaagaagaagaguugagaa

SEQ ID NO: 1472341 - RNA, 19 nt, Homo sapiens
guacuaacucaacacuuaa

SEQ ID NO: 1472342 - RNA, 19 nt, Homo sapiens
ggacugcucaauacagaua

SEQ ID NO: 1472343 - RNA, 19 nt, Homo sapiens
gcgaggaagaggaggauua

SEQ ID NO: 1472344 - RNA, 19 nt, Homo sapiens
ggagacagagggcgaggaa

SEQ ID NO: 1472345 - RNA, 19 nt, Homo sapiens
gagcugugagggugacaua

SEQ ID NO: 1472346 - RNA, 19 nt, Homo sapiens
ggaggagggugaggagaca

SEQ ID NO: 1472347 - RNA, 19 nt, Homo sapiens
gccgggacgugcugcauau

SEQ ID NO: 1472348 - RNA, 19 nt, Homo sapiens
agacagagggcgaggaaga

SEQ ID NO: 1472349 - RNA, 19 nt, Homo sapiens
ccaaagaguccagggaugu

SEQ ID NO: 1472350 - RNA, 19 nt, Homo sapiens
gcugugagggugacauaug

SEQ ID NO: 1472351 - RNA, 19 nt, Homo sapiens
cagucgcccuguccaaaga

SEQ ID NO: 1472352 - RNA, 19 nt, Homo sapiens
cgugugacauguccaaguc

SEQ ID NO: 1472353 - RNA, 19 nt, Homo sapiens
cuccugagcugcagcaucu

SEQ ID NO: 1472354 - RNA, 19 nt, Homo sapiens
ggauucuucuacccaugga

SEQ ID NO: 1472355 - RNA, 19 nt, Homo sapiens
gcaccgagggaccaagaag

SEQ ID NO: 1472356 - RNA, 19 nt, Homo sapiens
caaagaguccagggaugug

SEQ ID NO: 1472357 - RNA, 19 nt, Homo sapiens
gccagucgcccuguccaaa

SEQ ID NO: 1472358 - RNA, 19 nt, Homo sapiens
gggcucggcagacggaaau

SEQ ID NO: 1472359 - RNA, 19 nt, Homo sapiens
gcaaguauaugcucaaguc

SEQ ID NO: 1472360 - RNA, 19 nt, Homo sapiens
ucaagauccucaagaauga

SEQ ID NO: 1472361 - RNA, 19 nt, Homo sapiens
gaaggaggcugcggguaug

SEQ ID NO: 1472362 - RNA, 19 nt, Homo sapiens
ucaaggagcuggcuaucau

SEQ ID NO: 1472363 - RNA, 19 nt, Homo sapiens
ccaucaagauccucaagaa

SEQ ID NO: 1472364 - RNA, 19 nt, Homo sapiens
gcacaccucuccuaaacac

SEQ ID NO: 1472365 - RNA, 19 nt, Homo sapiens
cuccugaacccacaaauua

SEQ ID NO: 1472366 - RNA, 19 nt, Homo sapiens
gaggaugggcccaacauug

SEQ ID NO: 1472367 - RNA, 19 nt, Homo sapiens
ggagaaggcaccagguaug

SEQ ID NO: 1472368 - RNA, 19 nt, Homo sapiens
gaggagaaggcaccaggua

SEQ ID NO: 1472369 - RNA, 19 nt, Homo sapiens
gaaggcaccagguaugcaa

SEQ ID NO: 1472370 - RNA, 19 nt, Homo sapiens
caacuucagcaaccucauu

SEQ ID NO: 1472371 - RNA, 19 nt, Homo sapiens
cauccacgcugaucucaag

SEQ ID NO: 1472372 - RNA, 19 nt, Homo sapiens
cagcagggcuuuggagucu

SEQ ID NO: 1472373 - RNA, 19 nt, Homo sapiens
gcccaacauugacaacaug

SEQ ID NO: 1472374 - RNA, 19 nt, Homo sapiens
ccaaugcggucuccgacau

SEQ ID NO: 1472375 - RNA, 19 nt, Homo sapiens
agacgaaggugcgcccauu

SEQ ID NO: 1472376 - RNA, 19 nt, Homo sapiens
gcaaggcccaccacuucuu

SEQ ID NO: 1472377 - RNA, 19 nt, Homo sapiens
ucaagucguuggaccagau

SEQ ID NO: 1472378 - RNA, 19 nt, Homo sapiens
aguauaugcucaagucguu

SEQ ID NO: 1472379 - RNA, 19 nt, Homo sapiens
caaguucuaccuggucuuu

SEQ ID NO: 1472380 - RNA, 19 nt, Homo sapiens
ugaagaggcccacgucauc

SEQ ID NO: 1472381 - RNA, 19 nt, Homo sapiens
cagcuguccuggagaaugg

SEQ ID NO: 1472382 - RNA, 19 nt, Homo sapiens
ccagaaggacagcaggaaa

SEQ ID NO: 1472383 - RNA, 19 nt, Homo sapiens
agaaggaggcugcggguau

SEQ ID NO: 1472384 - RNA, 19 nt, Homo sapiens
ccaugacgcccucaaguuc

SEQ ID NO: 1472385 - RNA, 19 nt, Homo sapiens
cugcacaccucuccuaaac

SEQ ID NO: 1472386 - RNA, 19 nt, Homo sapiens
gaacccacaaauuauucuu

SEQ ID NO: 1472387 - RNA, 19 nt, Homo sapiens
ccugaacccacaaauuauu

SEQ ID NO: 1472388 - RNA, 19 nt, Homo sapiens
ggcccaacauugacaacau

SEQ ID NO: 1472389 - RNA, 19 nt, Homo sapiens
gcccaagccacaccuguug

SEQ ID NO: 1472390 - RNA, 19 nt, Homo sapiens
gccagacccugagcucuuc

SEQ ID NO: 1472391 - RNA, 19 nt, Homo sapiens
ccagcuggaugaccugagu

SEQ ID NO: 1472392 - RNA, 19 nt, Homo sapiens
gaccagauugagacaguga

SEQ ID NO: 1472393 - RNA, 19 nt, Homo sapiens
ggccagacccugagcucuu

SEQ ID NO: 1472394 - RNA, 19 nt, Homo sapiens
aggaugggcccaacauuga

SEQ ID NO: 1472395 - RNA, 19 nt, Homo sapiens
ccacaaauuauucuuacag

SEQ ID NO: 1472396 - RNA, 19 nt, Homo sapiens
gucauccgcuuccuugagu

SEQ ID NO: 1472397 - RNA, 19 nt, Homo sapiens
ccagcuuccuccagcaugu

SEQ ID NO: 1472398 - RNA, 19 nt, Homo sapiens
gaccugggagucacacgaa

SEQ ID NO: 1472399 - RNA, 19 nt, Homo sapiens
caucaagauccucaagaau

SEQ ID NO: 1472400 - RNA, 19 nt, Homo sapiens
ugaaggagccauacaucca

SEQ ID NO: 1472401 - RNA, 19 nt, Homo sapiens
aguucuaccuggucuuuga

SEQ ID NO: 1472402 - RNA, 19 nt, Homo sapiens
cacgagugcgguucucuuu

SEQ ID NO: 1472403 - RNA, 19 nt, Homo sapiens
cugcaaggcccaccacuuc

SEQ ID NO: 1472404 - RNA, 19 nt, Homo sapiens
cgucguggccgcagaagau

SEQ ID NO: 1472405 - RNA, 19 nt, Homo sapiens
cgacaucaucgaggucuug

SEQ ID NO: 1472406 - RNA, 19 nt, Homo sapiens
gcagcuguccuggagaaug

SEQ ID NO: 1472407 - RNA, 19 nt, Homo sapiens
gagcacgccgaccucaaga

SEQ ID NO: 1472408 - RNA, 19 nt, Homo sapiens
cgagugcgguucucuuucc

SEQ ID NO: 1472409 - RNA, 19 nt, Homo sapiens
cagaaggacagcaggaaag

SEQ ID NO: 1472410 - RNA, 19 nt, Homo sapiens
aaacacagcagggcuuugg

SEQ ID NO: 1472411 - RNA, 19 nt, Homo sapiens
uccuugaguucuuccauga

SEQ ID NO: 1472412 - RNA, 19 nt, Homo sapiens
ugacugcuacgacaucauc

SEQ ID NO: 1472413 - RNA, 19 nt, Homo sapiens
cuucggauccgccagcauu

SEQ ID NO: 1472414 - RNA, 19 nt, Homo sapiens
cggcagagccagugguaca

SEQ ID NO: 1472415 - RNA, 19 nt, Homo sapiens
ucaccgggcaccacugaug

SEQ ID NO: 1472416 - RNA, 19 nt, Homo sapiens
ggcaccagguaugcaaaga

SEQ ID NO: 1472417 - RNA, 19 nt, Homo sapiens
cgagaccacccacuacuac

SEQ ID NO: 1472418 - RNA, 19 nt, Homo sapiens
cgaaggugcgcccauugga

SEQ ID NO: 1472419 - RNA, 19 nt, Homo sapiens
gacgaaggugcgcccauug

SEQ ID NO: 1472420 - RNA, 19 nt, Homo sapiens
gaccaggugcgcuacaucu

SEQ ID NO: 1472421 - RNA, 19 nt, Homo sapiens
ccgcaaccgcaucaucaaa

SEQ ID NO: 1472422 - RNA, 19 nt, Homo sapiens
caaggcccaccacuucuuc

SEQ ID NO: 1472423 - RNA, 19 nt, Homo sapiens
cgccacauccguacaguca

SEQ ID NO: 1472424 - RNA, 19 nt, Homo sapiens
gcaccagguaugcaaagag

SEQ ID NO: 1472425 - RNA, 19 nt, Homo sapiens
gagaaggcaccagguaugc

SEQ ID NO: 1472426 - RNA, 19 nt, Homo sapiens
aucaagauccucaagaaug

SEQ ID NO: 1472427 - RNA, 19 nt, Homo sapiens
uggaccagauugagacagu

SEQ ID NO: 1472428 - RNA, 19 nt, Homo sapiens
ccacucaacagcgcuggaa

SEQ ID NO: 1472429 - RNA, 19 nt, Homo sapiens
gcuacgugaaggagccaua

SEQ ID NO: 1472430 - RNA, 19 nt, Homo sapiens
gaucuuccuuguaucaaua

SEQ ID NO: 1472431 - RNA, 19 nt, Homo sapiens
guacaaacuucugcucuuu

SEQ ID NO: 1472432 - RNA, 19 nt, Homo sapiens
caacaucuguaaacuagga

SEQ ID NO: 1472433 - RNA, 19 nt, Homo sapiens
gcagaaaggccuucacaga

SEQ ID NO: 1472434 - RNA, 19 nt, Homo sapiens
gcacacaggcaaagaaaug

SEQ ID NO: 1472435 - RNA, 19 nt, Homo sapiens
ccacccagcucuucaacuu

SEQ ID NO: 1472436 - RNA, 19 nt, Homo sapiens
gcccaucgcugucuucugu

SEQ ID NO: 1472437 - RNA, 19 nt, Homo sapiens
agacggaggcgcagaauaa

SEQ ID NO: 1472438 - RNA, 19 nt, Homo sapiens
cacaacaucuguaaacuag

SEQ ID NO: 1472439 - RNA, 19 nt, Homo sapiens
caucaucuuguacgaauua

SEQ ID NO: 1472440 - RNA, 19 nt, Homo sapiens
ugaauuaccuuccguccau

SEQ ID NO: 1472441 - RNA, 19 nt, Homo sapiens
cagaaaggccuucacagaa

SEQ ID NO: 1472442 - RNA, 19 nt, Homo sapiens
cgggugaucuuccuuguau

SEQ ID NO: 1472443 - RNA, 19 nt, Homo sapiens
gcucuucucucucuggaau

SEQ ID NO: 1472444 - RNA, 19 nt, Homo sapiens
ccagaucccugagucuauu

SEQ ID NO: 1472445 - RNA, 19 nt, Homo sapiens
caggaaauguacaaacuuc

SEQ ID NO: 1472446 - RNA, 19 nt, Homo sapiens
aaaccuguggcuacaauua

SEQ ID NO: 1472447 - RNA, 19 nt, Homo sapiens
ucacaacaucuguaaacua

SEQ ID NO: 1472448 - RNA, 19 nt, Homo sapiens
gcgcugaccuccaccaaac

SEQ ID NO: 1472449 - RNA, 19 nt, Homo sapiens
ccgaggcucugaccagcua

SEQ ID NO: 1472450 - RNA, 19 nt, Homo sapiens
uaggagaacuggagaagac

SEQ ID NO: 1472451 - RNA, 19 nt, Homo sapiens
gccaggaaauguacaaacu

SEQ ID NO: 1472452 - RNA, 19 nt, Homo sapiens
ggaaauguacaaacuucug

SEQ ID NO: 1472453 - RNA, 19 nt, Homo sapiens
gagcagaaaggccuucaca

SEQ ID NO: 1472454 - RNA, 19 nt, Homo sapiens
uggcuacaauuacaaacaa

SEQ ID NO: 1472455 - RNA, 19 nt, Homo sapiens
gccagcgcaucaucuugua

SEQ ID NO: 1472456 - RNA, 19 nt, Homo sapiens
gggugaggguuaccuggaa

SEQ ID NO: 1472457 - RNA, 19 nt, Homo sapiens
gucuauggcucuggaacua

SEQ ID NO: 1472458 - RNA, 19 nt, Homo sapiens
gggcacacaggcaaagaaa

SEQ ID NO: 1472459 - RNA, 19 nt, Homo sapiens
ggaggaaggagcagaaagg

SEQ ID NO: 1472460 - RNA, 19 nt, Homo sapiens
ggucacaacaucuguaaac

SEQ ID NO: 1472461 - RNA, 19 nt, Homo sapiens
aagccuaggucacaacauc

SEQ ID NO: 1472462 - RNA, 19 nt, Homo sapiens
gcacggaguccuacuucuc

SEQ ID NO: 1472463 - RNA, 19 nt, Homo sapiens
ccugagaccacccagaauu

SEQ ID NO: 1472464 - RNA, 19 nt, Homo sapiens
ucuuugaucugcugacugu

SEQ ID NO: 1472465 - RNA, 19 nt, Homo sapiens
uguacaaacuucugcucuu

SEQ ID NO: 1472466 - RNA, 19 nt, Homo sapiens
gcaucaucuuguacgaauu

SEQ ID NO: 1472467 - RNA, 19 nt, Homo sapiens
gauggaggaaggagcagaa

SEQ ID NO: 1472468 - RNA, 19 nt, Homo sapiens
caucuuguacgaauuaaag

SEQ ID NO: 1472469 - RNA, 19 nt, Homo sapiens
cgcaucaucuuguacgaau

SEQ ID NO: 1472470 - RNA, 19 nt, Homo sapiens
gcuccucuguggccucugu

SEQ ID NO: 1472471 - RNA, 19 nt, Homo sapiens
aaacuucugcucuuugauc

SEQ ID NO: 1472472 - RNA, 19 nt, Homo sapiens
caaaaccuguggcuacaau

SEQ ID NO: 1472473 - RNA, 19 nt, Homo sapiens
ccguggagcugcaggagau

SEQ ID NO: 1472474 - RNA, 19 nt, Homo sapiens
gcccagaucccugagucua

SEQ ID NO: 1472475 - RNA, 19 nt, Homo sapiens
ggaggcccaucgcugucuu

SEQ ID NO: 1472476 - RNA, 19 nt, Homo sapiens
cggagucgccagaucguuu

SEQ ID NO: 1472477 - RNA, 19 nt, Homo sapiens
ggugaggguuaccuggaau

SEQ ID NO: 1472478 - RNA, 19 nt, Homo sapiens
uuaacgugcuggccucugu

SEQ ID NO: 1472479 - RNA, 19 nt, Homo sapiens
gcuuccugcuccuucuuaa

SEQ ID NO: 1472480 - RNA, 19 nt, Homo sapiens
ccacgcccuuccagcuuug

SEQ ID NO: 1472481 - RNA, 19 nt, Homo sapiens
acggacgccucaucucuga

SEQ ID NO: 1472482 - RNA, 19 nt, Homo sapiens
gcucauccaguuuccuaga

SEQ ID NO: 1472483 - RNA, 19 nt, Homo sapiens
guccugcucuucucucucu

SEQ ID NO: 1472484 - RNA, 19 nt, Homo sapiens
gcucaggaccguguuucuu

SEQ ID NO: 1472485 - RNA, 19 nt, Homo sapiens
cguggacacugaagaggau

SEQ ID NO: 1472486 - RNA, 19 nt, Homo sapiens
cugagaccacccagaauuu

SEQ ID NO: 1472487 - RNA, 19 nt, Homo sapiens
ucaaguuccugcugcuuuu

SEQ ID NO: 1472488 - RNA, 19 nt, Homo sapiens
gucaaguuccugcugcuuu

SEQ ID NO: 1472489 - RNA, 19 nt, Homo sapiens
gcuuaacacggucaaguuc

SEQ ID NO: 1472490 - RNA, 19 nt, Homo sapiens
ccaggaaauguacaaacuu

SEQ ID NO: 1472491 - RNA, 19 nt, Homo sapiens
ggaaugguccccucucuuc

SEQ ID NO: 1472492 - RNA, 19 nt, Homo sapiens
acacuguggcucuggcuaa

SEQ ID NO: 1472493 - RNA, 19 nt, Homo sapiens
cacccagaauuuccucuuc

SEQ ID NO: 1472494 - RNA, 19 nt, Homo sapiens
gacggaggcgcagaauaaa

SEQ ID NO: 1472495 - RNA, 19 nt, Homo sapiens
ugucuucugugcugaacga

SEQ ID NO: 1472496 - RNA, 19 nt, Homo sapiens
ucucuucuauggcuucuac

SEQ ID NO: 1472497 - RNA, 19 nt, Homo sapiens
uccacgcccuuccagcuuu

SEQ ID NO: 1472498 - RNA, 19 nt, Homo sapiens
uaggucacaacaucuguaa

SEQ ID NO: 1472499 - RNA, 19 nt, Homo sapiens
cggaggcgcagaauaaagu

SEQ ID NO: 1472500 - RNA, 19 nt, Homo sapiens
gcgcugcucauccaguuuc

SEQ ID NO: 1472501 - RNA, 19 nt, Homo sapiens
ucgcgcugcucauccaguu

SEQ ID NO: 1472502 - RNA, 19 nt, Homo sapiens
gcuggccucugugcucaug

SEQ ID NO: 1472503 - RNA, 19 nt, Homo sapiens
ggccagcaagccaggguuu

SEQ ID NO: 1472504 - RNA, 19 nt, Homo sapiens
cagaagucacccagacaga

SEQ ID NO: 1472505 - RNA, 19 nt, Homo sapiens
cuauggcucuggaacuaag

SEQ ID NO: 1472506 - RNA, 19 nt, Homo sapiens
uaccuuccguccaucuuca

SEQ ID NO: 1472507 - RNA, 19 nt, Homo sapiens
gcgcaucaucuuguacgaa

SEQ ID NO: 1472508 - RNA, 19 nt, Homo sapiens
ggccuuaucuccuccuguu

SEQ ID NO: 1472509 - RNA, 19 nt, Homo sapiens
gguggaggguggagaccua

SEQ ID NO: 1472510 - RNA, 19 nt, Homo sapiens
ggguggagaccuaaacuuu

SEQ ID NO: 1472511 - RNA, 19 nt, Homo sapiens
agaaaccucuggccuuauc

SEQ ID NO: 1472512 - RNA, 19 nt, Homo sapiens
guggagaccuaaacuuugg

SEQ ID NO: 1472513 - RNA, 19 nt, Homo sapiens
gguggagaccuaaacuuug

SEQ ID NO: 1472514 - RNA, 19 nt, Homo sapiens
ggcaggggcuguggaaaua

SEQ ID NO: 1472515 - RNA, 19 nt, Homo sapiens
uauacggucucugaagguu

SEQ ID NO: 1472516 - RNA, 19 nt, Homo sapiens
ccucaaaucggacacucaa

SEQ ID NO: 1472517 - RNA, 19 nt, Homo sapiens
gagaaaccucuggccuuau

SEQ ID NO: 1472518 - RNA, 19 nt, Homo sapiens
ccgguggucuucccguugu

SEQ ID NO: 1472519 - RNA, 19 nt, Homo sapiens
aggaagaggaggagacaga

SEQ ID NO: 1472520 - RNA, 19 nt, Homo sapiens
guuuagagcagggaguuug

SEQ ID NO: 1472521 - RNA, 19 nt, Homo sapiens
gggaaagccuucaguguuu

SEQ ID NO: 1472522 - RNA, 19 nt, Homo sapiens
gauaaacgcuaugaaugua

SEQ ID NO: 1472523 - RNA, 19 nt, Homo sapiens
ggagagaagucauaugaau

SEQ ID NO: 1472524 - RNA, 19 nt, Homo sapiens
gaaaccaugucucuacaaa

SEQ ID NO: 1472525 - RNA, 19 nt, Homo sapiens
ggagagaugcuguaugaua

SEQ ID NO: 1472526 - RNA, 19 nt, Homo sapiens
gggaaagcguuaucucaua

SEQ ID NO: 1472527 - RNA, 19 nt, Homo sapiens
ggucauuuaucccuuaaua

SEQ ID NO: 1472528 - RNA, 19 nt, Homo sapiens
gagagaugcuguaugauau

SEQ ID NO: 1472529 - RNA, 19 nt, Homo sapiens
ggacagaaacccuauaaau

SEQ ID NO: 1472530 - RNA, 19 nt, Homo sapiens
gagaaaccauauacaugua

SEQ ID NO: 1472531 - RNA, 19 nt, Homo sapiens
guagggaaguauucuuuaa

SEQ ID NO: 1472532 - RNA, 19 nt, Homo sapiens
cagaaacccuauaaaugua

SEQ ID NO: 1472533 - RNA, 19 nt, Homo sapiens
uaacaccauugucaacaua

SEQ ID NO: 1472534 - RNA, 19 nt, Homo sapiens
ggagaaaccguaugaaugu

SEQ ID NO: 1472535 - RNA, 19 nt, Homo sapiens
gaagacauaugguaaugca

SEQ ID NO: 1472536 - RNA, 19 nt, Homo sapiens
gaagacacaugauaaugca

SEQ ID NO: 1472537 - RNA, 19 nt, Homo sapiens
ggaaagcguuaucucauag

SEQ ID NO: 1472538 - RNA, 19 nt, Homo sapiens
ucuaagaugucauauggua

SEQ ID NO: 1472539 - RNA, 19 nt, Homo sapiens
gaaccuggacuguauaaga

SEQ ID NO: 1472540 - RNA, 19 nt, Homo sapiens
gagaugggccgaauaaaug

SEQ ID NO: 1472541 - RNA, 19 nt, Homo sapiens
ccucauaaaugcaagauau

SEQ ID NO: 1472542 - RNA, 19 nt, Homo sapiens
gcgcucagcucuagacuca

SEQ ID NO: 1472543 - RNA, 19 nt, Homo sapiens
gagaugcuguaugauauaa

SEQ ID NO: 1472544 - RNA, 19 nt, Homo sapiens
gagagaaacccuaugaaug

SEQ ID NO: 1472545 - RNA, 19 nt, Homo sapiens
gagagaaacccuaugaaug

SEQ ID NO: 1472546 - RNA, 19 nt, Homo sapiens
ggagaucgaccucauaaau

SEQ ID NO: 1472547 - RNA, 19 nt, Homo sapiens
gagagaaaccguaugaaug

SEQ ID NO: 1472548 - RNA, 19 nt, Homo sapiens
gacagaaacccuauaaaug

SEQ ID NO: 1472549 - RNA, 19 nt, Homo sapiens
gggaagaacagaauacuga

SEQ ID NO: 1472550 - RNA, 19 nt, Homo sapiens
ggagauaaacgcuaugaau

SEQ ID NO: 1472551 - RNA, 19 nt, Homo sapiens
gagauacucuauaaaugug

SEQ ID NO: 1472552 - RNA, 19 nt, Homo sapiens
gggaaaacguuaucucaua

SEQ ID NO: 1472553 - RNA, 19 nt, Homo sapiens
gaagucauaugaauguaag

SEQ ID NO: 1472554 - RNA, 19 nt, Homo sapiens
ggagaugggccgaauaaau

SEQ ID NO: 1472555 - RNA, 19 nt, Homo sapiens
gagaaacccuaugagugua

SEQ ID NO: 1472556 - RNA, 19 nt, Homo sapiens
ggaaagaaacgcuaugagu

SEQ ID NO: 1472557 - RNA, 19 nt, Homo sapiens
gaagccacauacacauaaa

SEQ ID NO: 1472558 - RNA, 19 nt, Homo sapiens
gauuccaguuccuauauaa

SEQ ID NO: 1472559 - RNA, 19 nt, Homo sapiens
guagaaaccuucgaagaca

SEQ ID NO: 1472560 - RNA, 19 nt, Homo sapiens
gagauaaacgcuaugaaug

SEQ ID NO: 1472561 - RNA, 19 nt, Homo sapiens
ggagagaaacccuaugaau

SEQ ID NO: 1472562 - RNA, 19 nt, Homo sapiens
ggagagaaacccuaugaau

SEQ ID NO: 1472563 - RNA, 19 nt, Homo sapiens
gagaaaccguaugaaugua

SEQ ID NO: 1472564 - RNA, 19 nt, Homo sapiens
gagaaaccguaugaaugua

SEQ ID NO: 1472565 - RNA, 19 nt, Homo sapiens
ggagagaaaccguaugaau

SEQ ID NO: 1472566 - RNA, 19 nt, Homo sapiens
gugggaaaguguucgauuu

SEQ ID NO: 1472567 - RNA, 19 nt, Homo sapiens
cuggagagaugcuguauga

SEQ ID NO: 1472568 - RNA, 19 nt, Homo sapiens
gagaagccacauacacaua

SEQ ID NO: 1472569 - RNA, 19 nt, Homo sapiens
acagauaugugaugcaaga

SEQ ID NO: 1472570 - RNA, 19 nt, Homo sapiens
auacauaaaucgacacaug

SEQ ID NO: 1472571 - RNA, 19 nt, Homo sapiens
ccgaauaaaugcaagguau

SEQ ID NO: 1472572 - RNA, 19 nt, Homo sapiens
gagagaaaccauauacaug

SEQ ID NO: 1472573 - RNA, 19 nt, Homo sapiens
ucuaaagccuugccugauu

SEQ ID NO: 1472574 - RNA, 19 nt, Homo sapiens
acagaaacccuauaaaugu

SEQ ID NO: 1472575 - RNA, 19 nt, Homo sapiens
ggagagaaacaauaugaau

SEQ ID NO: 1472576 - RNA, 19 nt, Homo sapiens
ggagagaaaccauauacau

SEQ ID NO: 1472577 - RNA, 19 nt, Homo sapiens
ucaaagcgcugagugugaa

SEQ ID NO: 1472578 - RNA, 19 nt, Homo sapiens
ggauguggcugugaacuuc

SEQ ID NO: 1472579 - RNA, 19 nt, Homo sapiens
gaacuucacccaggaggaa

SEQ ID NO: 1472580 - RNA, 19 nt, Homo sapiens
ccauauacauguaaacagu

SEQ ID NO: 1472581 - RNA, 19 nt, Homo sapiens
gggagaaaccguaugaaug

SEQ ID NO: 1472582 - RNA, 19 nt, Homo sapiens
gagagaagccacauacaca

SEQ ID NO: 1472583 - RNA, 19 nt, Homo sapiens
gcaggauaaucacuugaau

SEQ ID NO: 1472584 - RNA, 19 nt, Homo sapiens
ccaguucccuuugauauca

SEQ ID NO: 1472585 - RNA, 19 nt, Homo sapiens
gagagaaacaauaugaaug

SEQ ID NO: 1472586 - RNA, 19 nt, Homo sapiens
acacaaaccacaugaguau

SEQ ID NO: 1472587 - RNA, 19 nt, Homo sapiens
ggagaagauccaugucaaa

SEQ ID NO: 1472588 - RNA, 19 nt, Homo sapiens
gggaaguauucuuuaaugu

SEQ ID NO: 1472589 - RNA, 19 nt, Homo sapiens
gaaauguagggaaguauuc

SEQ ID NO: 1472590 - RNA, 19 nt, Homo sapiens
gagaagucauaugaaugua

SEQ ID NO: 1472591 - RNA, 19 nt, Homo sapiens
gagaucgaccucauaaaug

SEQ ID NO: 1472592 - RNA, 19 nt, Homo sapiens
gcagagaaacccuaugagu

SEQ ID NO: 1472593 - RNA, 19 nt, Homo sapiens
ucucucagguccuugcaua

SEQ ID NO: 1472594 - RNA, 19 nt, Homo sapiens
gaauguaagcaguguucua

SEQ ID NO: 1472595 - RNA, 19 nt, Homo sapiens
gaauguaagcaguguucua

SEQ ID NO: 1472596 - RNA, 19 nt, Homo sapiens
gaaaguaaagacaguaguc

SEQ ID NO: 1472597 - RNA, 19 nt, Homo sapiens
ggacacaaaccacaugagu

SEQ ID NO: 1472598 - RNA, 19 nt, Homo sapiens
uaaagacaguagucagugu

SEQ ID NO: 1472599 - RNA, 19 nt, Homo sapiens
gaggcaggauaaucacuug

SEQ ID NO: 1472600 - RNA, 19 nt, Homo sapiens
gcucagcucuagacucagu

SEQ ID NO: 1472601 - RNA, 19 nt, Homo sapiens
gugggaaagccuucaguua

SEQ ID NO: 1472602 - RNA, 19 nt, Homo sapiens
gagagaagucauaugaaug

SEQ ID NO: 1472603 - RNA, 19 nt, Homo sapiens
uaaggaaugugggaaagug

SEQ ID NO: 1472604 - RNA, 19 nt, Homo sapiens
gaauaaaugcaagguaugu

SEQ ID NO: 1472605 - RNA, 19 nt, Homo sapiens
gaaaccguaugaauguaag

SEQ ID NO: 1472606 - RNA, 19 nt, Homo sapiens
gaaaccguaugaauguaag

SEQ ID NO: 1472607 - RNA, 19 nt, Homo sapiens
guccaucacagaagaauuu

SEQ ID NO: 1472608 - RNA, 19 nt, Homo sapiens
gaacucacacuggagagaa

SEQ ID NO: 1472609 - RNA, 19 nt, Homo sapiens
gaacucacacuggagagaa

SEQ ID NO: 1472610 - RNA, 19 nt, Homo sapiens
aagaaacgcuaugagugua

SEQ ID NO: 1472611 - RNA, 19 nt, Homo sapiens
ccacaugaguaucaggaau

SEQ ID NO: 1472612 - RNA, 19 nt, Homo sapiens
aaccuggacuguauaagaa

SEQ ID NO: 1472613 - RNA, 19 nt, Homo sapiens
gacacaaaccacaugagua

SEQ ID NO: 1472614 - RNA, 19 nt, Homo sapiens
gauaugugaugcaagaaac

SEQ ID NO: 1472615 - RNA, 19 nt, Homo sapiens
agaaacauuuagccucauu

SEQ ID NO: 1472616 - RNA, 19 nt, Homo sapiens
ugauuccaguuccuauaua

SEQ ID NO: 1472617 - RNA, 19 nt, Homo sapiens
agagaaaccguaugaaugu

SEQ ID NO: 1472618 - RNA, 19 nt, Homo sapiens
gcugagagacgcccuggaa

SEQ ID NO: 1472619 - RNA, 19 nt, Homo sapiens
gcugagagacgcccuggaa

SEQ ID NO: 1472620 - RNA, 19 nt, Homo sapiens
agaucgaccucauaaaugu

SEQ ID NO: 1472621 - RNA, 19 nt, Homo sapiens
gaacugaggcuggagauuu

SEQ ID NO: 1472622 - RNA, 19 nt, Homo sapiens
gaaauuucuuccuuccuuu

SEQ ID NO: 1472623 - RNA, 19 nt, Homo sapiens
gagggaggcugguagcuuu

SEQ ID NO: 1472624 - RNA, 19 nt, Homo sapiens
gauuaagcacuaaggauua

SEQ ID NO: 1472625 - RNA, 19 nt, Homo sapiens
ggucagggccucagugauu

SEQ ID NO: 1472626 - RNA, 19 nt, Homo sapiens
ggauuaagcacuaaggauu

SEQ ID NO: 1472627 - RNA, 19 nt, Homo sapiens
ggaaggagccauccaugug

SEQ ID NO: 1472628 - RNA, 19 nt, Homo sapiens
uaugugaagucuccuaguu

SEQ ID NO: 1472629 - RNA, 19 nt, Homo sapiens
gcugacauuucuuaacaau

SEQ ID NO: 1472630 - RNA, 19 nt, Homo sapiens
gugucuagcucaauaaauc

SEQ ID NO: 1472631 - RNA, 19 nt, Homo sapiens
gcucaggaguuggcaguug

SEQ ID NO: 1472632 - RNA, 19 nt, Homo sapiens
caacucaacugccguucgu

SEQ ID NO: 1472633 - RNA, 19 nt, Homo sapiens
cgagcgggauggagugaaa

SEQ ID NO: 1472634 - RNA, 19 nt, Homo sapiens
gucaggagcuggccaugga

SEQ ID NO: 1472635 - RNA, 19 nt, Homo sapiens
gaucuuggcucugcguaag

SEQ ID NO: 1472636 - RNA, 19 nt, Homo sapiens
gauccacaucccuguauuu

SEQ ID NO: 1472637 - RNA, 19 nt, Homo sapiens
ccacagcggcucagaguca

SEQ ID NO: 1472638 - RNA, 19 nt, Homo sapiens
cagccaaccuggagagcuu

SEQ ID NO: 1472639 - RNA, 19 nt, Homo sapiens
gaaggaaggagccauccau

SEQ ID NO: 1472640 - RNA, 19 nt, Homo sapiens
ccauggagaaggacacuuu

SEQ ID NO: 1472641 - RNA, 19 nt, Homo sapiens
ggagaaggacacuuugaag

SEQ ID NO: 1472642 - RNA, 19 nt, Homo sapiens
guucguggauguccguugu

SEQ ID NO: 1472643 - RNA, 19 nt, Homo sapiens
ccacuguugcgcaggcuua

SEQ ID NO: 1472644 - RNA, 19 nt, Homo sapiens
gcagugucuagcucaauaa

SEQ ID NO: 1472645 - RNA, 19 nt, Homo sapiens
uggaggaccugaagacucu

SEQ ID NO: 1472646 - RNA, 19 nt, Homo sapiens
cagcuuggaggagcaaaua

SEQ ID NO: 1472647 - RNA, 19 nt, Homo sapiens
guucgucguucguggaugu

SEQ ID NO: 1472648 - RNA, 19 nt, Homo sapiens
agcagugucuagcucaaua

SEQ ID NO: 1472649 - RNA, 19 nt, Homo sapiens
uaaggauuauucccucaca

SEQ ID NO: 1472650 - RNA, 19 nt, Homo sapiens
ugaagcggcagcucuuuga

SEQ ID NO: 1472651 - RNA, 19 nt, Homo sapiens
uggcugagauggagacucu

SEQ ID NO: 1472652 - RNA, 19 nt, Homo sapiens
gcaguggguagauucaaau

SEQ ID NO: 1472653 - RNA, 19 nt, Homo sapiens
gaaugccggucagcuugga

SEQ ID NO: 1472654 - RNA, 19 nt, Homo sapiens
ggaguuggcaguuguagcu

SEQ ID NO: 1472655 - RNA, 19 nt, Homo sapiens
ggagggaggcugguagcuu

SEQ ID NO: 1472656 - RNA, 19 nt, Homo sapiens
agaaaacccuccagagaga

SEQ ID NO: 1472657 - RNA, 19 nt, Homo sapiens
ggaaguggcaacugcugau

SEQ ID NO: 1472658 - RNA, 19 nt, Homo sapiens
cgaggccauucgacagaaa

SEQ ID NO: 1472659 - RNA, 19 nt, Homo sapiens
gcgcaggcuuacccuagau

SEQ ID NO: 1472660 - RNA, 19 nt, Homo sapiens
gcagugggaggaagucauc

SEQ ID NO: 1472661 - RNA, 19 nt, Homo sapiens
gauugcugccugucaacua

SEQ ID NO: 1472662 - RNA, 19 nt, Homo sapiens
caucacaucugcgggaaac

SEQ ID NO: 1472663 - RNA, 19 nt, Homo sapiens
augcugacauuucuuaaca

SEQ ID NO: 1472664 - RNA, 19 nt, Homo sapiens
ccuggugccugugaugaaa

SEQ ID NO: 1472665 - RNA, 19 nt, Homo sapiens
ugcaguggguagauucaaa

SEQ ID NO: 1472666 - RNA, 19 nt, Homo sapiens
caacugcugaucucuccaa

SEQ ID NO: 1472667 - RNA, 19 nt, Homo sapiens
gggcccagcugagaagagu

SEQ ID NO: 1472668 - RNA, 19 nt, Homo sapiens
cuuggacacuuuccugguu

SEQ ID NO: 1472669 - RNA, 19 nt, Homo sapiens
gaugcacgccuccaaacau

SEQ ID NO: 1472670 - RNA, 19 nt, Homo sapiens
gggagaaugccaaauugca

SEQ ID NO: 1472671 - RNA, 19 nt, Homo sapiens
augcacgccuccaaacauu

SEQ ID NO: 1472672 - RNA, 19 nt, Homo sapiens
cuggaagaauacagaguga

SEQ ID NO: 1472673 - RNA, 19 nt, Homo sapiens
uaagcacuaaggauuauuc

SEQ ID NO: 1472674 - RNA, 19 nt, Homo sapiens
cauuguuaguccacuguug

SEQ ID NO: 1472675 - RNA, 19 nt, Homo sapiens
ccagaaaacccuccagaga

SEQ ID NO: 1472676 - RNA, 19 nt, Homo sapiens
ugaucucccugucccucua

SEQ ID NO: 1472677 - RNA, 19 nt, Homo sapiens
gaagaggaggaugcagaga

SEQ ID NO: 1472678 - RNA, 19 nt, Homo sapiens
caugagaccagugaggaaa

SEQ ID NO: 1472679 - RNA, 19 nt, Homo sapiens
uggaggagcagcugaguca

SEQ ID NO: 1472680 - RNA, 19 nt, Homo sapiens
ugagcgcacucgcgaugug

SEQ ID NO: 1472681 - RNA, 19 nt, Homo sapiens
gagccuggaggaacagaau

SEQ ID NO: 1472682 - RNA, 19 nt, Homo sapiens
ggaugcacgccuccaaaca

SEQ ID NO: 1472683 - RNA, 19 nt, Homo sapiens
uggagaaggacacuuugaa

SEQ ID NO: 1472684 - RNA, 19 nt, Homo sapiens
ugugaagucuccuaguuuu

SEQ ID NO: 1472685 - RNA, 19 nt, Homo sapiens
aacugaggcuggagauuuc

SEQ ID NO: 1472686 - RNA, 19 nt, Homo sapiens
gcagcucuuugagugugaa

SEQ ID NO: 1472687 - RNA, 19 nt, Homo sapiens
gucagggccucagugauuc

SEQ ID NO: 1472688 - RNA, 19 nt, Homo sapiens
ggaacugaggcuggagauu

SEQ ID NO: 1472689 - RNA, 19 nt, Homo sapiens
gacccuggaagaauacaga

SEQ ID NO: 1472690 - RNA, 19 nt, Homo sapiens
cuguggacuuggacacuuu

SEQ ID NO: 1472691 - RNA, 19 nt, Homo sapiens
ugaaggagggaggcuggua

SEQ ID NO: 1472692 - RNA, 19 nt, Homo sapiens
caggaugcacgccuccaaa

SEQ ID NO: 1472693 - RNA, 19 nt, Homo sapiens
uggcaguuguagcuuccua

SEQ ID NO: 1472694 - RNA, 19 nt, Homo sapiens
acacuuuccugguugucau

SEQ ID NO: 1472695 - RNA, 19 nt, Homo sapiens
ucaacugccguucgucguu

SEQ ID NO: 1472696 - RNA, 19 nt, Homo sapiens
aggauuauucccucacaaa

SEQ ID NO: 1472697 - RNA, 19 nt, Homo sapiens
gagccauccaugugguuga

SEQ ID NO: 1472698 - RNA, 19 nt, Homo sapiens
ggacaauuauggaggauuc

SEQ ID NO: 1472699 - RNA, 19 nt, Homo sapiens
ggucaugacuacaguguga

SEQ ID NO: 1472700 - RNA, 19 nt, Homo sapiens
ucucuaaccucuuuguaaa

SEQ ID NO: 1472701 - RNA, 19 nt, Homo sapiens
uuagaagccuagucuguuu

SEQ ID NO: 1472702 - RNA, 19 nt, Homo sapiens
gacaguggcuucucuggau

SEQ ID NO: 1472703 - RNA, 19 nt, Homo sapiens
uucgaucccuggacaauua

SEQ ID NO: 1472704 - RNA, 19 nt, Homo sapiens
gggcgucacuuuccucauc

SEQ ID NO: 1472705 - RNA, 19 nt, Homo sapiens
ccucagcuguuccaaucua

SEQ ID NO: 1472706 - RNA, 19 nt, Homo sapiens
ggaaggagcacugauuugg

SEQ ID NO: 1472707 - RNA, 19 nt, Homo sapiens
uacaggagguccagauuca

SEQ ID NO: 1472708 - RNA, 19 nt, Homo sapiens
cuaacagucuugguugaaa

SEQ ID NO: 1472709 - RNA, 19 nt, Homo sapiens
ccacugacccuuccacauc

SEQ ID NO: 1472710 - RNA, 19 nt, Homo sapiens
guguuucucuaaccucuuu

SEQ ID NO: 1472711 - RNA, 19 nt, Homo sapiens
gaagaucccagcucuacag

SEQ ID NO: 1472712 - RNA, 19 nt, Homo sapiens
uuccucaucuguacaguaa

SEQ ID NO: 1472713 - RNA, 19 nt, Homo sapiens
ucacuuuccucaucuguac

SEQ ID NO: 1472714 - RNA, 19 nt, Homo sapiens
gagaaucgccugccuucag

SEQ ID NO: 1472715 - RNA, 19 nt, Homo sapiens
ugacuacagugugaguuug

SEQ ID NO: 1472716 - RNA, 19 nt, Homo sapiens
uauggaggauucggaggua

SEQ ID NO: 1472717 - RNA, 19 nt, Homo sapiens
gauucuguguguuucucua

SEQ ID NO: 1472718 - RNA, 19 nt, Homo sapiens
cagcuguuccaaucuagua

SEQ ID NO: 1472719 - RNA, 19 nt, Homo sapiens
gggaaggagcacugauuug

SEQ ID NO: 1472720 - RNA, 19 nt, Homo sapiens
guagcucgggcuucuauga

SEQ ID NO: 1472721 - RNA, 19 nt, Homo sapiens
gaauuuccccguuuuaguu

SEQ ID NO: 1472722 - RNA, 19 nt, Homo sapiens
ccucaucuguacaguaagu

SEQ ID NO: 1472723 - RNA, 19 nt, Homo sapiens
ccacaucuaccuuccaaag

SEQ ID NO: 1472724 - RNA, 19 nt, Homo sapiens
ucucauuccuccuuuccuu

SEQ ID NO: 1472725 - RNA, 19 nt, Homo sapiens
cgccaaagucuucgugaaa

SEQ ID NO: 1472726 - RNA, 19 nt, Homo sapiens
ccuggacccuuaagauauc

SEQ ID NO: 1472727 - RNA, 19 nt, Homo sapiens
ggaagggaaggagcacuga

SEQ ID NO: 1472728 - RNA, 19 nt, Homo sapiens
caguaaguguccauguaug

SEQ ID NO: 1472729 - RNA, 19 nt, Homo sapiens
ucccuggacccuuaagaua

SEQ ID NO: 1472730 - RNA, 19 nt, Homo sapiens
uaacagucuugguugaaaa

SEQ ID NO: 1472731 - RNA, 19 nt, Homo sapiens
ucaaggucaugacuacagu

SEQ ID NO: 1472732 - RNA, 19 nt, Homo sapiens
guacaguaaguguccaugu

SEQ ID NO: 1472733 - RNA, 19 nt, Homo sapiens
ccgccaaagucuucgugaa

SEQ ID NO: 1472734 - RNA, 19 nt, Homo sapiens
ucaccacccucaaccuucu

SEQ ID NO: 1472735 - RNA, 19 nt, Homo sapiens
ugacccaguucagcuucua

SEQ ID NO: 1472736 - RNA, 19 nt, Homo sapiens
gccaaagucuucgugaaaa

SEQ ID NO: 1472737 - RNA, 19 nt, Homo sapiens
cuguuccaaucuaguauuu

SEQ ID NO: 1472738 - RNA, 19 nt, Homo sapiens
gaagccuagucuguuuguu

SEQ ID NO: 1472739 - RNA, 19 nt, Homo sapiens
acaguaaguguccauguau

SEQ ID NO: 1472740 - RNA, 19 nt, Homo sapiens
ccacacucccaaccacuga

SEQ ID NO: 1472741 - RNA, 19 nt, Homo sapiens
acccucagcuguuccaauc

SEQ ID NO: 1472742 - RNA, 19 nt, Homo sapiens
ugaugacccucagcuguuc

SEQ ID NO: 1472743 - RNA, 19 nt, Homo sapiens
ggaggauucggagguagaa

SEQ ID NO: 1472744 - RNA, 19 nt, Homo sapiens
gcccucucauuccuccuuu

SEQ ID NO: 1472745 - RNA, 19 nt, Homo sapiens
gaagggaaggagcacugau

SEQ ID NO: 1472746 - RNA, 19 nt, Homo sapiens
ccagugagaggcccaaguc

SEQ ID NO: 1472747 - RNA, 19 nt, Homo sapiens
gcguagcucgggcuucuau

SEQ ID NO: 1472748 - RNA, 19 nt, Homo sapiens
guuuagaagccuagucugu

SEQ ID NO: 1472749 - RNA, 19 nt, Homo sapiens
cuacaggagguccagauuc

SEQ ID NO: 1472750 - RNA, 19 nt, Homo sapiens
gcuguuccaaucuaguauu

SEQ ID NO: 1472751 - RNA, 19 nt, Homo sapiens
aagggaaggagcacugauu

SEQ ID NO: 1472752 - RNA, 19 nt, Homo sapiens
aaguguccauguaugcaaa

SEQ ID NO: 1472753 - RNA, 19 nt, Homo sapiens
acaucuaccuuccaaagac

SEQ ID NO: 1472754 - RNA, 19 nt, Homo sapiens
ccaaagucuucgugaaaau

SEQ ID NO: 1472755 - RNA, 19 nt, Homo sapiens
agggaaggagcacugauuu

SEQ ID NO: 1472756 - RNA, 19 nt, Homo sapiens
ucaccgcucucccucucau

SEQ ID NO: 1472757 - RNA, 19 nt, Homo sapiens
uaaguguccauguaugcaa

SEQ ID NO: 1472758 - RNA, 19 nt, Homo sapiens
gaaagaagaucgagaagag

SEQ ID NO: 1472759 - RNA, 19 nt, Homo sapiens
gaaaugcgguugcugaaga

SEQ ID NO: 1472760 - RNA, 19 nt, Homo sapiens
gaccaaagauucccucauc

SEQ ID NO: 1472761 - RNA, 19 nt, Homo sapiens
auuaauagcucugccgaua

SEQ ID NO: 1472762 - RNA, 19 nt, Homo sapiens
gccgauagcugguguuguc

SEQ ID NO: 1472763 - RNA, 19 nt, Homo sapiens
ccagaaagaagaucgagaa

SEQ ID NO: 1472764 - RNA, 19 nt, Homo sapiens
gaggagcccuuggaacugu

SEQ ID NO: 1472765 - RNA, 19 nt, Homo sapiens
gaacuaagcgcaggaacag

SEQ ID NO: 1472766 - RNA, 19 nt, Homo sapiens
gcugugcccugccauauac

SEQ ID NO: 1472767 - RNA, 19 nt, Homo sapiens
gacauguuaugccuccauu

SEQ ID NO: 1472768 - RNA, 19 nt, Homo sapiens
gaagagagggagggaggaa

SEQ ID NO: 1472769 - RNA, 19 nt, Homo sapiens
cgacauuggugcugaagac

SEQ ID NO: 1472770 - RNA, 19 nt, Homo sapiens
ggaacuaagcgcaggaaca

SEQ ID NO: 1472771 - RNA, 19 nt, Homo sapiens
ugucacaacugccuggaau

SEQ ID NO: 1472772 - RNA, 19 nt, Homo sapiens
gauagcugguguugucaca

SEQ ID NO: 1472773 - RNA, 19 nt, Homo sapiens
gaugggaggccucucuguu

SEQ ID NO: 1472774 - RNA, 19 nt, Homo sapiens
gucacucccugaaacacua

SEQ ID NO: 1472775 - RNA, 19 nt, Homo sapiens
gaagacgcagggacaggaa

SEQ ID NO: 1472776 - RNA, 19 nt, Homo sapiens
cccugaaacacuauuaaua

SEQ ID NO: 1472777 - RNA, 19 nt, Homo sapiens
uaauagcucugccgauagc

SEQ ID NO: 1472778 - RNA, 19 nt, Homo sapiens
ccacuugguacuagcugua

SEQ ID NO: 1472779 - RNA, 19 nt, Homo sapiens
ggaaagcccgagggaggaa

SEQ ID NO: 1472780 - RNA, 19 nt, Homo sapiens
cagaaaugcgguugcugaa

SEQ ID NO: 1472781 - RNA, 19 nt, Homo sapiens
augggaggccucucuguua

SEQ ID NO: 1472782 - RNA, 19 nt, Homo sapiens
cguggccucucccgacauu

SEQ ID NO: 1472783 - RNA, 19 nt, Homo sapiens
ugucuccuuuguauccuaa

SEQ ID NO: 1472784 - RNA, 19 nt, Homo sapiens
agaaagaagaucgagaaga

SEQ ID NO: 1472785 - RNA, 19 nt, Homo sapiens
ggacauguuaugccuccau

SEQ ID NO: 1472786 - RNA, 19 nt, Homo sapiens
ggaggagcccuuggaacug

SEQ ID NO: 1472787 - RNA, 19 nt, Homo sapiens
ggaagcugaggccaagguu

SEQ ID NO: 1472788 - RNA, 19 nt, Homo sapiens
cgcugugucuccuuuguau

SEQ ID NO: 1472789 - RNA, 19 nt, Homo sapiens
gcagggucggccagaaaga

SEQ ID NO: 1472790 - RNA, 19 nt, Homo sapiens
ugagaaagcugucauuuaa

SEQ ID NO: 1472791 - RNA, 19 nt, Homo sapiens
ggaaagauguuuagucaug

SEQ ID NO: 1472792 - RNA, 19 nt, Homo sapiens
gcgcguggcuuacuacuua

SEQ ID NO: 1472793 - RNA, 19 nt, Homo sapiens
acucaaagcucacaacuua

SEQ ID NO: 1472794 - RNA, 19 nt, Homo sapiens
gaagaggacugaucauuuc

SEQ ID NO: 1472795 - RNA, 19 nt, Homo sapiens
gaacguagcauaccacaaa

SEQ ID NO: 1472796 - RNA, 19 nt, Homo sapiens
gagaaacccuauaaaugua

SEQ ID NO: 1472797 - RNA, 19 nt, Homo sapiens
gagaaacccuaucaaugua

SEQ ID NO: 1472798 - RNA, 19 nt, Homo sapiens
gcaaagaauucucacaaau

SEQ ID NO: 1472799 - RNA, 19 nt, Homo sapiens
uaucuuagcucuacuaguu

SEQ ID NO: 1472800 - RNA, 19 nt, Homo sapiens
ugagaaaccuuaugaaugu

SEQ ID NO: 1472801 - RNA, 19 nt, Homo sapiens
ugagaaaccuuaugaaugu

SEQ ID NO: 1472802 - RNA, 19 nt, Homo sapiens
agucauggcucacaacuua

SEQ ID NO: 1472803 - RNA, 19 nt, Homo sapiens
gggaaggccuuuacucaaa

SEQ ID NO: 1472804 - RNA, 19 nt, Homo sapiens
ggcaagggaugaucauaua

SEQ ID NO: 1472805 - RNA, 19 nt, Homo sapiens
gagaaaccauaucaaugua

SEQ ID NO: 1472806 - RNA, 19 nt, Homo sapiens
gagaaaccauaucaaugua

SEQ ID NO: 1472807 - RNA, 19 nt, Homo sapiens
aagaauggcuguuucagua

SEQ ID NO: 1472808 - RNA, 19 nt, Homo sapiens
gcucagaacuuacucaaca

SEQ ID NO: 1472809 - RNA, 19 nt, Homo sapiens
caacuuacccgacaucaaa

SEQ ID NO: 1472810 - RNA, 19 nt, Homo sapiens
ggaaaugagugacagacuu

SEQ ID NO: 1472811 - RNA, 19 nt, Homo sapiens
gaacacuuaugaaacagaa

SEQ ID NO: 1472812 - RNA, 19 nt, Homo sapiens
auucguagcucacaacuua

SEQ ID NO: 1472813 - RNA, 19 nt, Homo sapiens
caaccagcauacuuacuua

SEQ ID NO: 1472814 - RNA, 19 nt, Homo sapiens
gcucacagcuuucucaaca

SEQ ID NO: 1472815 - RNA, 19 nt, Homo sapiens
guaggaaggucuuuacuca

SEQ ID NO: 1472816 - RNA, 19 nt, Homo sapiens
caugugaauugucugauua

SEQ ID NO: 1472817 - RNA, 19 nt, Homo sapiens
gagaaacccuaugaaugua

SEQ ID NO: 1472818 - RNA, 19 nt, Homo sapiens
gagaaacccuaugaaugua

SEQ ID NO: 1472819 - RNA, 19 nt, Homo sapiens
gagaaacccuaugaaugua

SEQ ID NO: 1472820 - RNA, 19 nt, Homo sapiens
agucauggcucucagcuua

SEQ ID NO: 1472821 - RNA, 19 nt, Homo sapiens
aaucguggcucacuccuua

SEQ ID NO: 1472822 - RNA, 19 nt, Homo sapiens
acucagcucucacaacuua

SEQ ID NO: 1472823 - RNA, 19 nt, Homo sapiens
ggagaacuauagcaacuug

SEQ ID NO: 1472824 - RNA, 19 nt, Homo sapiens
gagaggagaguacuuauga

SEQ ID NO: 1472825 - RNA, 19 nt, Homo sapiens
gcaaauuggagaauaguuu

SEQ ID NO: 1472826 - RNA, 19 nt, Homo sapiens
caacaucagagaauucaua

SEQ ID NO: 1472827 - RNA, 19 nt, Homo sapiens
caacaucagagaauucaua

SEQ ID NO: 1472828 - RNA, 19 nt, Homo sapiens
gggaaggccuuuacucaga

SEQ ID NO: 1472829 - RNA, 19 nt, Homo sapiens
aaccauggcucggaaauua

SEQ ID NO: 1472830 - RNA, 19 nt, Homo sapiens
agucauggcucacaaguuu

SEQ ID NO: 1472831 - RNA, 19 nt, Homo sapiens
gagaaacccuaugcaugua

SEQ ID NO: 1472832 - RNA, 19 nt, Homo sapiens
gaaacccuaugaauguaaa

SEQ ID NO: 1472833 - RNA, 19 nt, Homo sapiens
gaaacagaauuaucccaau

SEQ ID NO: 1472834 - RNA, 19 nt, Homo sapiens
guauagagaugugauguug

SEQ ID NO: 1472835 - RNA, 19 nt, Homo sapiens
gcucacaacuuacucaaca

SEQ ID NO: 1472836 - RNA, 19 nt, Homo sapiens
gcucacaacuuacucaaca

SEQ ID NO: 1472837 - RNA, 19 nt, Homo sapiens
caacaucagaggauucaua

SEQ ID NO: 1472838 - RNA, 19 nt, Homo sapiens
acucagaauucacaacuua

SEQ ID NO: 1472839 - RNA, 19 nt, Homo sapiens
gaggaaauucauacuguua

SEQ ID NO: 1472840 - RNA, 19 nt, Homo sapiens
gcacagcaucagauaauuu

SEQ ID NO: 1472841 - RNA, 19 nt, Homo sapiens
gcgcacauuugccucauaa

SEQ ID NO: 1472842 - RNA, 19 nt, Homo sapiens
guggaaagauguuuaguca

SEQ ID NO: 1472843 - RNA, 19 nt, Homo sapiens
gaauaugggcgcacauuug

SEQ ID NO: 1472844 - RNA, 19 nt, Homo sapiens
uaaggaauguggaaagaug

SEQ ID NO: 1472845 - RNA, 19 nt, Homo sapiens
ggagaaagaauggcuguuu

SEQ ID NO: 1472846 - RNA, 19 nt, Homo sapiens
caucauuacuggaaaccua

SEQ ID NO: 1472847 - RNA, 19 nt, Homo sapiens
gagaaacccuaugugugua

SEQ ID NO: 1472848 - RNA, 19 nt, Homo sapiens
gaaaagcucuaugaaugua

SEQ ID NO: 1472849 - RNA, 19 nt, Homo sapiens
ggaaggccuuuacucagaa

SEQ ID NO: 1472850 - RNA, 19 nt, Homo sapiens
ugagaaacccuauaaaugu

SEQ ID NO: 1472851 - RNA, 19 nt, Homo sapiens
ucagagagauuuguauaga

SEQ ID NO: 1472852 - RNA, 19 nt, Homo sapiens
gugagaaagcugucauuua

SEQ ID NO: 1472853 - RNA, 19 nt, Homo sapiens
gaaaugagugacagacuug

SEQ ID NO: 1472854 - RNA, 19 nt, Homo sapiens
gagaugugauguuggagaa

SEQ ID NO: 1472855 - RNA, 19 nt, Homo sapiens
caaagaauucucacaaaug

SEQ ID NO: 1472856 - RNA, 19 nt, Homo sapiens
gaaaccauaucaauguaag

SEQ ID NO: 1472857 - RNA, 19 nt, Homo sapiens
gaaaccauaucaauguaag

SEQ ID NO: 1472858 - RNA, 19 nt, Homo sapiens
gaauguagaauggccuuua

SEQ ID NO: 1472859 - RNA, 19 nt, Homo sapiens
caacaucagagaauccaua

SEQ ID NO: 1472860 - RNA, 19 nt, Homo sapiens
caagaugucauucuacuga

SEQ ID NO: 1472861 - RNA, 19 nt, Homo sapiens
ggacuuaucuccagaaaag

SEQ ID NO: 1472862 - RNA, 19 nt, Homo sapiens
ugagaaacccuaugaaugu

SEQ ID NO: 1472863 - RNA, 19 nt, Homo sapiens
ugagaaacccuaugaaugu

SEQ ID NO: 1472864 - RNA, 19 nt, Homo sapiens
ugagaaacccuaucaaugu

SEQ ID NO: 1472865 - RNA, 19 nt, Homo sapiens
gaaaagcccuaugaaugua

SEQ ID NO: 1472866 - RNA, 19 nt, Homo sapiens
ugagaaacccuaugaaugu

SEQ ID NO: 1472867 - RNA, 19 nt, Homo sapiens
caucagagaauucauauca

SEQ ID NO: 1472868 - RNA, 19 nt, Homo sapiens
ggcaaggccuuuagucaug

SEQ ID NO: 1472869 - RNA, 19 nt, Homo sapiens
agacgagccucacaccuaa

SEQ ID NO: 1472870 - RNA, 19 nt, Homo sapiens
aaacagaauuaucccaaug

SEQ ID NO: 1472871 - RNA, 19 nt, Homo sapiens
gcucagagagauuuguaua

SEQ ID NO: 1472872 - RNA, 19 nt, Homo sapiens
guucagggauguugccauu

SEQ ID NO: 1472873 - RNA, 19 nt, Homo sapiens
gaggacugaucauuucuug

SEQ ID NO: 1472874 - RNA, 19 nt, Homo sapiens
gcucucagcuuacucuaca

SEQ ID NO: 1472875 - RNA, 19 nt, Homo sapiens
agaauggccuuuacucaga

SEQ ID NO: 1472876 - RNA, 19 nt, Homo sapiens
gaauguggaaagauguuua

SEQ ID NO: 1472877 - RNA, 19 nt, Homo sapiens
gaacugcaccucugucaag

SEQ ID NO: 1472878 - RNA, 19 nt, Homo sapiens
ucagggauguugccauuga

SEQ ID NO: 1472879 - RNA, 19 nt, Homo sapiens
gaauucauaucagugagaa

SEQ ID NO: 1472880 - RNA, 19 nt, Homo sapiens
guucacaucuuucccaaca

SEQ ID NO: 1472881 - RNA, 19 nt, Homo sapiens
gugaaaagcucuaugaaug

SEQ ID NO: 1472882 - RNA, 19 nt, Homo sapiens
ucacuagacuugccuucaa

SEQ ID NO: 1472883 - RNA, 19 nt, Homo sapiens
aggaagcccuuuagccaua

SEQ ID NO: 1472884 - RNA, 19 nt, Homo sapiens
guucacagcuaacucaaca

SEQ ID NO: 1472885 - RNA, 19 nt, Homo sapiens
gagaaaccuuaugaaugua

SEQ ID NO: 1472886 - RNA, 19 nt, Homo sapiens
agucguggcucagaacuua

SEQ ID NO: 1472887 - RNA, 19 nt, Homo sapiens
gagaaaccuuaugaaugua

SEQ ID NO: 1472888 - RNA, 19 nt, Homo sapiens
gaacuauagcaacuuggua

SEQ ID NO: 1472889 - RNA, 19 nt, Homo sapiens
gagguucucugguuguuag

SEQ ID NO: 1472890 - RNA, 19 nt, Homo sapiens
uaucaaaccuuacgaaugu

SEQ ID NO: 1472891 - RNA, 19 nt, Homo sapiens
uagaaagccuugaguguaa

SEQ ID NO: 1472892 - RNA, 19 nt, Homo sapiens
gcucauaccucauucaaca

SEQ ID NO: 1472893 - RNA, 19 nt, Homo sapiens
ggucguacaucagaacuua

SEQ ID NO: 1472894 - RNA, 19 nt, Homo sapiens
gaacacuacagaauucaua

SEQ ID NO: 1472895 - RNA, 19 nt, Homo sapiens
ugagaaaccuuaugacugu

SEQ ID NO: 1472896 - RNA, 19 nt, Homo sapiens
guucacaucuggcucagua

SEQ ID NO: 1472897 - RNA, 19 nt, Homo sapiens
gggaaggcauuuagucgua

SEQ ID NO: 1472898 - RNA, 19 nt, Homo sapiens
ugucaaaccuuaugaaugu

SEQ ID NO: 1472899 - RNA, 19 nt, Homo sapiens
gauggaaugucaugaaugu

SEQ ID NO: 1472900 - RNA, 19 nt, Homo sapiens
aaucagagcaggucaaaua

SEQ ID NO: 1472901 - RNA, 19 nt, Homo sapiens
gaacuuauucuacaucaga

SEQ ID NO: 1472902 - RNA, 19 nt, Homo sapiens
ggagaaacccuaugagugu

SEQ ID NO: 1472903 - RNA, 19 nt, Homo sapiens
cgacagacccuaugaaugu

SEQ ID NO: 1472904 - RNA, 19 nt, Homo sapiens
gagaaacccuacguaugua

SEQ ID NO: 1472905 - RNA, 19 nt, Homo sapiens
aaagagcccuggaugauug

SEQ ID NO: 1472906 - RNA, 19 nt, Homo sapiens
ggagaacuuuggucacuug

SEQ ID NO: 1472907 - RNA, 19 nt, Homo sapiens
gggcaggcauuuauucuug

SEQ ID NO: 1472908 - RNA, 19 nt, Homo sapiens
gcucacaacucauugaaca

SEQ ID NO: 1472909 - RNA, 19 nt, Homo sapiens
gcucacaccuuauucaaca

SEQ ID NO: 1472910 - RNA, 19 nt, Homo sapiens
gcauucaacugggagauaa

SEQ ID NO: 1472911 - RNA, 19 nt, Homo sapiens
gaaguuacucgacaucaaa

SEQ ID NO: 1472912 - RNA, 19 nt, Homo sapiens
gugagaaacugauggaaug

SEQ ID NO: 1472913 - RNA, 19 nt, Homo sapiens
ugacaaacccuacgaaugu

SEQ ID NO: 1472914 - RNA, 19 nt, Homo sapiens
cagagcaggucaaauaguu

SEQ ID NO: 1472915 - RNA, 19 nt, Homo sapiens
guacugaauuaccuucuau

SEQ ID NO: 1472916 - RNA, 19 nt, Homo sapiens
gagaaacccuaugagugua

SEQ ID NO: 1472917 - RNA, 19 nt, Homo sapiens
gggaaggccuuuggucgua

SEQ ID NO: 1472918 - RNA, 19 nt, Homo sapiens
gaaagagcccuggaugauu

SEQ ID NO: 1472919 - RNA, 19 nt, Homo sapiens
ucacacgucucacacugua

SEQ ID NO: 1472920 - RNA, 19 nt, Homo sapiens
ggaaugcgaaggccaguuu

SEQ ID NO: 1472921 - RNA, 19 nt, Homo sapiens
ggaaagagcccuggaugau

SEQ ID NO: 1472922 - RNA, 19 nt, Homo sapiens
caucauagaacaucagaaa

SEQ ID NO: 1472923 - RNA, 19 nt, Homo sapiens
gcucaguacuagguaauuu

SEQ ID NO: 1472924 - RNA, 19 nt, Homo sapiens
cgagaaacccuacguaugu

SEQ ID NO: 1472925 - RNA, 19 nt, Homo sapiens
gagaaacccuacgagugua

SEQ ID NO: 1472926 - RNA, 19 nt, Homo sapiens
gacaaacccuacgaaugua

SEQ ID NO: 1472927 - RNA, 19 nt, Homo sapiens
gaacaucagagaauucauc

SEQ ID NO: 1472928 - RNA, 19 nt, Homo sapiens
auucacagcucagaaguua

SEQ ID NO: 1472929 - RNA, 19 nt, Homo sapiens
gagauaauggaaagccuua

SEQ ID NO: 1472930 - RNA, 19 nt, Homo sapiens
gaaaucagagcaggucaaa

SEQ ID NO: 1472931 - RNA, 19 nt, Homo sapiens
auacuggugucaaaccuua

SEQ ID NO: 1472932 - RNA, 19 nt, Homo sapiens
ggacguggccauagaguuc

SEQ ID NO: 1472933 - RNA, 19 nt, Homo sapiens
agagaagaauccagagaaa

SEQ ID NO: 1472934 - RNA, 19 nt, Homo sapiens
gauaauggaaagccuuaaa

SEQ ID NO: 1472935 - RNA, 19 nt, Homo sapiens
ucacuaggacucuccauuu

SEQ ID NO: 1472936 - RNA, 19 nt, Homo sapiens
gaacgucaccuauggacau

SEQ ID NO: 1472937 - RNA, 19 nt, Homo sapiens
cuaggacucuccauuucua

SEQ ID NO: 1472938 - RNA, 19 nt, Homo sapiens
cagggagacuggugagaaa

SEQ ID NO: 1472939 - RNA, 19 nt, Homo sapiens
caacuuaccgaacaucaga

SEQ ID NO: 1472940 - RNA, 19 nt, Homo sapiens
gaaugugggaagaccuuua

SEQ ID NO: 1472941 - RNA, 19 nt, Homo sapiens
gacagacccuaugaaugua

SEQ ID NO: 1472942 - RNA, 19 nt, Homo sapiens
cgacaucaaagaauucauu

SEQ ID NO: 1472943 - RNA, 19 nt, Homo sapiens
caucagagacuucauacug

SEQ ID NO: 1472944 - RNA, 19 nt, Homo sapiens
agagacaagucaaugaaga

SEQ ID NO: 1472945 - RNA, 19 nt, Homo sapiens
gcacagcucacacgacauc

SEQ ID NO: 1472946 - RNA, 19 nt, Homo sapiens
ugagaaacccuacgagugu

SEQ ID NO: 1472947 - RNA, 19 nt, Homo sapiens
cuacguauguaaagacugu

SEQ ID NO: 1472948 - RNA, 19 nt, Homo sapiens
cuacaucagagacuucaua

SEQ ID NO: 1472949 - RNA, 19 nt, Homo sapiens
guccaggugugagaaauuu

SEQ ID NO: 1472950 - RNA, 19 nt, Homo sapiens
ucacuuggccucacuagga

SEQ ID NO: 1472951 - RNA, 19 nt, Homo sapiens
ucacuuccaucauagaaca

SEQ ID NO: 1472952 - RNA, 19 nt, Homo sapiens
gugagaaacccuaugaaug

SEQ ID NO: 1472953 - RNA, 19 nt, Homo sapiens
gaagaauccagagaaauca

SEQ ID NO: 1472954 - RNA, 19 nt, Homo sapiens
gaauuaccuucuauuacca

SEQ ID NO: 1472955 - RNA, 19 nt, Homo sapiens
gagaauucauccugguauc

SEQ ID NO: 1472956 - RNA, 19 nt, Homo sapiens
acauuucccuugaggcuuu

SEQ ID NO: 1472957 - RNA, 19 nt, Homo sapiens
gaaacccuacguauguaaa

SEQ ID NO: 1472958 - RNA, 19 nt, Homo sapiens
ugaauuaccuucuauuacc

SEQ ID NO: 1472959 - RNA, 19 nt, Homo sapiens
gagaaaccuuaugacugua

SEQ ID NO: 1472960 - RNA, 19 nt, Homo sapiens
aaacucacacccaaagaaa

SEQ ID NO: 1472961 - RNA, 19 nt, Homo sapiens
uuagaaagccuugagugua

SEQ ID NO: 1472962 - RNA, 19 nt, Homo sapiens
gcgagaaacccuacguaug

SEQ ID NO: 1472963 - RNA, 19 nt, Homo sapiens
ucagggacguggccauaga

SEQ ID NO: 1472964 - RNA, 19 nt, Homo sapiens
ucaaugaagagugcuauuu

SEQ ID NO: 1472965 - RNA, 19 nt, Homo sapiens
ggacuacauuucccuugag

SEQ ID NO: 1472966 - RNA, 19 nt, Homo sapiens
gaauucauacugguuagaa

SEQ ID NO: 1472967 - RNA, 19 nt, Homo sapiens
gagaaacccuaugaaugca

SEQ ID NO: 1472968 - RNA, 19 nt, Homo sapiens
ugagaaacccuaugaaugc

SEQ ID NO: 1472969 - RNA, 19 nt, Homo sapiens
uuucacaacugacucauca

SEQ ID NO: 1472970 - RNA, 19 nt, Homo sapiens
aauccacacuggugagaaa

SEQ ID NO: 1472971 - RNA, 19 nt, Homo sapiens
ggccagacccuaugagugu

SEQ ID NO: 1472972 - RNA, 19 nt, Homo sapiens
gcagggagacuggugagaa

SEQ ID NO: 1472973 - RNA, 19 nt, Homo sapiens
ccuggaugauugcaaauga

SEQ ID NO: 1472974 - RNA, 19 nt, Homo sapiens
gggaaagagcccuggauga

SEQ ID NO: 1472975 - RNA, 19 nt, Homo sapiens
gaugucgucuccuuauugg

SEQ ID NO: 1472976 - RNA, 19 nt, Homo sapiens
agaaacugauggaauguca

SEQ ID NO: 1472977 - RNA, 19 nt, Homo sapiens
gcaggucaaauaguucuaa

SEQ ID NO: 1472978 - RNA, 19 nt, Homo sapiens
acagaauucauacugguua

SEQ ID NO: 1472979 - RNA, 19 nt, Homo sapiens
uuacgaauguagagagugu

SEQ ID NO: 1472980 - RNA, 19 nt, Homo sapiens
agaaguuacucgacaucaa

SEQ ID NO: 1472981 - RNA, 19 nt, Homo sapiens
ccagcaacgucgcuucuca

SEQ ID NO: 1472982 - RNA, 19 nt, Homo sapiens
gauugcaaaugaugugaca

SEQ ID NO: 1472983 - RNA, 19 nt, Homo sapiens
guaucaaaccuuacgaaug

SEQ ID NO: 1472984 - RNA, 19 nt, Homo sapiens
cuacgaauguaaggaaugu

SEQ ID NO: 1472985 - RNA, 19 nt, Homo sapiens
caacugggagauaauggaa

SEQ ID NO: 1472986 - RNA, 19 nt, Homo sapiens
agaagaauccagagaaauc

SEQ ID NO: 1472987 - RNA, 19 nt, Homo sapiens
caagagaagaauccagaga

SEQ ID NO: 1472988 - RNA, 19 nt, Homo sapiens
caucagagaguccauacug

SEQ ID NO: 1472989 - RNA, 19 nt, Homo sapiens
gagaagaauccagagaaau

SEQ ID NO: 1472990 - RNA, 19 nt, Homo sapiens
gaacauaaccuuaagaauc

SEQ ID NO: 1472991 - RNA, 19 nt, Homo sapiens
gaaaggaucucugcaugaa

SEQ ID NO: 1472992 - RNA, 19 nt, Homo sapiens
caacgagagugauagguua

SEQ ID NO: 1472993 - RNA, 19 nt, Homo sapiens
ucacugagauucaccuaua

SEQ ID NO: 1472994 - RNA, 19 nt, Homo sapiens
caacaagcuuggaacauaa

SEQ ID NO: 1472995 - RNA, 19 nt, Homo sapiens
ggacugggaccguuacuua

SEQ ID NO: 1472996 - RNA, 19 nt, Homo sapiens
gaacaucucaagcaaauga

SEQ ID NO: 1472997 - RNA, 19 nt, Homo sapiens
guacaggaauugcuaguug

SEQ ID NO: 1472998 - RNA, 19 nt, Homo sapiens
guacuccucuuucgucuuu

SEQ ID NO: 1472999 - RNA, 19 nt, Homo sapiens
guaaggaucucgcgucugu

SEQ ID NO: 1473000 - RNA, 19 nt, Homo sapiens
gcauacggauugccgcuua

SEQ ID NO: 1473001 - RNA, 19 nt, Homo sapiens
gcgaauacaucucugaaau

SEQ ID NO: 1473002 - RNA, 19 nt, Homo sapiens
gaguuuggcugacuugauu

SEQ ID NO: 1473003 - RNA, 19 nt, Homo sapiens
acaacaagcuuggaacaua

SEQ ID NO: 1473004 - RNA, 19 nt, Homo sapiens
acaagaagcugacguaucu

SEQ ID NO: 1473005 - RNA, 19 nt, Homo sapiens
uaaagaacaucucaagcaa

SEQ ID NO: 1473006 - RNA, 19 nt, Homo sapiens
aacaagaucuuucgggaua

SEQ ID NO: 1473007 - RNA, 19 nt, Homo sapiens
gcaaugaaaucggagaugu

SEQ ID NO: 1473008 - RNA, 19 nt, Homo sapiens
gcaccaagauacuucugaa

SEQ ID NO: 1473009 - RNA, 19 nt, Homo sapiens
aaacgacacuccugaugaa

SEQ ID NO: 1473010 - RNA, 19 nt, Homo sapiens
ccaagaagcuaacuuucau

SEQ ID NO: 1473011 - RNA, 19 nt, Homo sapiens
gcaguuugcugaggaagaa

SEQ ID NO: 1473012 - RNA, 19 nt, Homo sapiens
ggacagacacauuugaguu

SEQ ID NO: 1473013 - RNA, 19 nt, Homo sapiens
gaucaagcacuaugaagaa

SEQ ID NO: 1473014 - RNA, 19 nt, Homo sapiens
gaauacaucucugaaaugc

SEQ ID NO: 1473015 - RNA, 19 nt, Homo sapiens
ugacguaucugaauguauc

SEQ ID NO: 1473016 - RNA, 19 nt, Homo sapiens
guaccagucugaagcaaga

SEQ ID NO: 1473017 - RNA, 19 nt, Homo sapiens
cgaaggagcuccgggauca

SEQ ID NO: 1473018 - RNA, 19 nt, Homo sapiens
gcaagucugucacugagau

SEQ ID NO: 1473019 - RNA, 19 nt, Homo sapiens
gcagaaauucagccgcuua

SEQ ID NO: 1473020 - RNA, 19 nt, Homo sapiens
gaggaguucaggaaauuua

SEQ ID NO: 1473021 - RNA, 19 nt, Homo sapiens
guucucaccugcaguaaga

SEQ ID NO: 1473022 - RNA, 19 nt, Homo sapiens
gugauagguuaguguauuu

SEQ ID NO: 1473023 - RNA, 19 nt, Homo sapiens
gaaggacgaaggacugaaa

SEQ ID NO: 1473024 - RNA, 19 nt, Homo sapiens
gagauucaccuauacuuug

SEQ ID NO: 1473025 - RNA, 19 nt, Homo sapiens
gaaauucagccgcuuaugg

SEQ ID NO: 1473026 - RNA, 19 nt, Homo sapiens
aagaacaucucaagcaaau

SEQ ID NO: 1473027 - RNA, 19 nt, Homo sapiens
gaaacucucucgugaugac

SEQ ID NO: 1473028 - RNA, 19 nt, Homo sapiens
gaagacgaccuccggagaa

SEQ ID NO: 1473029 - RNA, 19 nt, Homo sapiens
ggagagaacaggauacaca

SEQ ID NO: 1473030 - RNA, 19 nt, Homo sapiens
gggaagaacuugcaaaccu

SEQ ID NO: 1473031 - RNA, 19 nt, Homo sapiens
ccaacugucccaagagaua

SEQ ID NO: 1473032 - RNA, 19 nt, Homo sapiens
gaacaacaagcuuggaaca

SEQ ID NO: 1473033 - RNA, 19 nt, Homo sapiens
cgaggaaccugggcucuga

SEQ ID NO: 1473034 - RNA, 19 nt, Homo sapiens
cugaaaugcuucugcguaa

SEQ ID NO: 1473035 - RNA, 19 nt, Homo sapiens
gagauaaagcagcaaauuc

SEQ ID NO: 1473036 - RNA, 19 nt, Homo sapiens
gcaaggagagcacauugga

SEQ ID NO: 1473037 - RNA, 19 nt, Homo sapiens
ggaagucaagcaagaagaa

SEQ ID NO: 1473038 - RNA, 19 nt, Homo sapiens
auacaucucugaaaugcuu

SEQ ID NO: 1473039 - RNA, 19 nt, Homo sapiens
gacagacacauuugaguuu

SEQ ID NO: 1473040 - RNA, 19 nt, Homo sapiens
gaaaugcuucugcguaaca

SEQ ID NO: 1473041 - RNA, 19 nt, Homo sapiens
cagacacgguccugguaua

SEQ ID NO: 1473042 - RNA, 19 nt, Homo sapiens
gaggguauguggacagaca

SEQ ID NO: 1473043 - RNA, 19 nt, Homo sapiens
caagcacuaugaagaacaa

SEQ ID NO: 1473044 - RNA, 19 nt, Homo sapiens
gguaaauugucaccucuca

SEQ ID NO: 1473045 - RNA, 19 nt, Homo sapiens
gagcuucacccucacgaaa

SEQ ID NO: 1473046 - RNA, 19 nt, Homo sapiens
ucagaagcuuggaauaaau

SEQ ID NO: 1473047 - RNA, 19 nt, Homo sapiens
ugagauguguacaggaauu

SEQ ID NO: 1473048 - RNA, 19 nt, Homo sapiens
gauggcagccucuuucuuc

SEQ ID NO: 1473049 - RNA, 19 nt, Homo sapiens
ucaaggaccacaaggaauu

SEQ ID NO: 1473050 - RNA, 19 nt, Homo sapiens
cagaagcuuggaauaaaua

SEQ ID NO: 1473051 - RNA, 19 nt, Homo sapiens
gagaucugauugcgaggaa

SEQ ID NO: 1473052 - RNA, 19 nt, Homo sapiens
caagagaugcagaaaggaa

SEQ ID NO: 1473053 - RNA, 19 nt, Homo sapiens
aaagauggauagaaaggau

SEQ ID NO: 1473054 - RNA, 19 nt, Homo sapiens
cacgaggauuuauuuauug

SEQ ID NO: 1473055 - RNA, 19 nt, Homo sapiens
ggaagaauguggguuaacg

SEQ ID NO: 1473056 - RNA, 19 nt, Homo sapiens
caacgaguuuggcugacuu

SEQ ID NO: 1473057 - RNA, 19 nt, Homo sapiens
ccacguacagugauuauuc

SEQ ID NO: 1473058 - RNA, 19 nt, Homo sapiens
aaacagccacguacaguga

SEQ ID NO: 1473059 - RNA, 19 nt, Homo sapiens
gcaagaagaaugugaccau

SEQ ID NO: 1473060 - RNA, 19 nt, Homo sapiens
uugcaaaccucuugaucaa

SEQ ID NO: 1473061 - RNA, 19 nt, Homo sapiens
gauucacuguguuugguaa

SEQ ID NO: 1473062 - RNA, 19 nt, Homo sapiens
cagugaaccuccuccaaga

SEQ ID NO: 1473063 - RNA, 19 nt, Homo sapiens
ggauucaacgagagugaua

SEQ ID NO: 1473064 - RNA, 19 nt, Homo sapiens
ggaucuguguggugacuug

SEQ ID NO: 1473065 - RNA, 19 nt, Homo sapiens
guuggaagaauguggguua

SEQ ID NO: 1473066 - RNA, 19 nt, Homo sapiens
gcucucaucagcaaucaaa

SEQ ID NO: 1473067 - RNA, 19 nt, Homo sapiens
caaggaaacugggaaacag

SEQ ID NO: 1473068 - RNA, 19 nt, Homo sapiens
gcacuaugaagaacaacaa

SEQ ID NO: 1473069 - RNA, 19 nt, Homo sapiens
gaccguuacuuacaugaca

SEQ ID NO: 1473070 - RNA, 19 nt, Homo sapiens
ugugagauguguacaggaa

SEQ ID NO: 1473071 - RNA, 19 nt, Homo sapiens
agaacaggauacacaaaga

SEQ ID NO: 1473072 - RNA, 19 nt, Homo sapiens
gaacuugcaaaccucuuga

SEQ ID NO: 1473073 - RNA, 19 nt, Homo sapiens
ugaagauucugcaaauugg

SEQ ID NO: 1473074 - RNA, 19 nt, Homo sapiens
gaagcugacguaucugaau

SEQ ID NO: 1473075 - RNA, 19 nt, Homo sapiens
ugucaccucucacccauug

SEQ ID NO: 1473076 - RNA, 19 nt, Homo sapiens
aaauacugcuccagcuuga

SEQ ID NO: 1473077 - RNA, 19 nt, Homo sapiens
caagaagcuaacuuucaua

SEQ ID NO: 1473078 - RNA, 19 nt, Homo sapiens
caagagauaaagcagcaaa

SEQ ID NO: 1473079 - RNA, 19 nt, Homo sapiens
ggaaacagccacguacagu

SEQ ID NO: 1473080 - RNA, 19 nt, Homo sapiens
gagaacaggauacacaaag

SEQ ID NO: 1473081 - RNA, 19 nt, Homo sapiens
ucacaaggguagagaucug

SEQ ID NO: 1473082 - RNA, 19 nt, Homo sapiens
gcugacguaucugaaugua

SEQ ID NO: 1473083 - RNA, 19 nt, Homo sapiens
agauaaagcagcaaauuca

SEQ ID NO: 1473084 - RNA, 19 nt, Homo sapiens
gugccgccuuguucuauuu

SEQ ID NO: 1473085 - RNA, 19 nt, Homo sapiens
agauucaccuauacuuuga

SEQ ID NO: 1473086 - RNA, 19 nt, Homo sapiens
gauaugauacacgugguuu

SEQ ID NO: 1473087 - RNA, 19 nt, Homo sapiens
ggaguucaggaaauuuaaa

SEQ ID NO: 1473088 - RNA, 19 nt, Homo sapiens
uucagaagcuuggaauaaa

SEQ ID NO: 1473089 - RNA, 19 nt, Homo sapiens
gagagaacaggauacacaa

SEQ ID NO: 1473090 - RNA, 19 nt, Homo sapiens
aaucaaggcucaacucuua

SEQ ID NO: 1473091 - RNA, 19 nt, Homo sapiens
gagaagaccuugagucaug

SEQ ID NO: 1473092 - RNA, 19 nt, Homo sapiens
aaacgggucucacaucuua

SEQ ID NO: 1473093 - RNA, 19 nt, Homo sapiens
gagaaacccuauaaaugua

SEQ ID NO: 1473094 - RNA, 19 nt, Homo sapiens
gcaggaaacucuaugaaug

SEQ ID NO: 1473095 - RNA, 19 nt, Homo sapiens
gaucucacaucuuaaagua

SEQ ID NO: 1473096 - RNA, 19 nt, Homo sapiens
gagaaagacuugaagaaug

SEQ ID NO: 1473097 - RNA, 19 nt, Homo sapiens
aaucggaucucacaucuua

SEQ ID NO: 1473098 - RNA, 19 nt, Homo sapiens
gagaaacccuaccaaugua

SEQ ID NO: 1473099 - RNA, 19 nt, Homo sapiens
gagaaggccuuuagucgaa

SEQ ID NO: 1473100 - RNA, 19 nt, Homo sapiens
aaauauggcucacgacuaa

SEQ ID NO: 1473101 - RNA, 19 nt, Homo sapiens
uggaaagccuuacaaguua

SEQ ID NO: 1473102 - RNA, 19 nt, Homo sapiens
gagaaacccuaucagugua

SEQ ID NO: 1473103 - RNA, 19 nt, Homo sapiens
ggaaaggccuucaauucug

SEQ ID NO: 1473104 - RNA, 19 nt, Homo sapiens
caucagacaugaagaaaug

SEQ ID NO: 1473105 - RNA, 19 nt, Homo sapiens
caaagcagcauguuuauga

SEQ ID NO: 1473106 - RNA, 19 nt, Homo sapiens
gggaaggccuuuaaauaug

SEQ ID NO: 1473107 - RNA, 19 nt, Homo sapiens
gagguaagccuuuauccua

SEQ ID NO: 1473108 - RNA, 19 nt, Homo sapiens
gaaagaagaaaguaacaga

SEQ ID NO: 1473109 - RNA, 19 nt, Homo sapiens
gagaaacacaugugaauau

SEQ ID NO: 1473110 - RNA, 19 nt, Homo sapiens
gagaaugcauaauagagaa

SEQ ID NO: 1473111 - RNA, 19 nt, Homo sapiens
gcacuaaacaugcuauuca

SEQ ID NO: 1473112 - RNA, 19 nt, Homo sapiens
uaaccacaguguaguaauu

SEQ ID NO: 1473113 - RNA, 19 nt, Homo sapiens
gaaaccguaugaauguaaa

SEQ ID NO: 1473114 - RNA, 19 nt, Homo sapiens
gauaugauaccaaggaauu

SEQ ID NO: 1473115 - RNA, 19 nt, Homo sapiens
ccucagagaaugcauaaua

SEQ ID NO: 1473116 - RNA, 19 nt, Homo sapiens
gauaaacucauaugcacua

SEQ ID NO: 1473117 - RNA, 19 nt, Homo sapiens
agaaagacuugaagaaugu

SEQ ID NO: 1473118 - RNA, 19 nt, Homo sapiens
gcucacaacucaagcaaca

SEQ ID NO: 1473119 - RNA, 19 nt, Homo sapiens
gagagaaacccuaccaaug

SEQ ID NO: 1473120 - RNA, 19 nt, Homo sapiens
ugagaaacccuauaaaugu

SEQ ID NO: 1473121 - RNA, 19 nt, Homo sapiens
gccaagagaugugaaaugu

SEQ ID NO: 1473122 - RNA, 19 nt, Homo sapiens
gaauugagaguuuaacaug

SEQ ID NO: 1473123 - RNA, 19 nt, Homo sapiens
ggauguaaauuguucagau

SEQ ID NO: 1473124 - RNA, 19 nt, Homo sapiens
ggaaggccuuuaaauaugg

SEQ ID NO: 1473125 - RNA, 19 nt, Homo sapiens
ggaaagccuuacaaguuau

SEQ ID NO: 1473126 - RNA, 19 nt, Homo sapiens
caucagagaauuuauguug

SEQ ID NO: 1473127 - RNA, 19 nt, Homo sapiens
gaaacucuaugaauguaag

SEQ ID NO: 1473128 - RNA, 19 nt, Homo sapiens
gagaaaccguaugaaugua

SEQ ID NO: 1473129 - RNA, 19 nt, Homo sapiens
gaaaccauaugaauguaag

SEQ ID NO: 1473130 - RNA, 19 nt, Homo sapiens
guaagaaaccauaugaaug

SEQ ID NO: 1473131 - RNA, 19 nt, Homo sapiens
guacagagacgugauguug

SEQ ID NO: 1473132 - RNA, 19 nt, Homo sapiens
ggucucacaucuuacugua

SEQ ID NO: 1473133 - RNA, 19 nt, Homo sapiens
gaacaucagcgaacucaca

SEQ ID NO: 1473134 - RNA, 19 nt, Homo sapiens
gugggaaggccuuuaaaua

SEQ ID NO: 1473135 - RNA, 19 nt, Homo sapiens
ggagaaagacuugaagaau

SEQ ID NO: 1473136 - RNA, 19 nt, Homo sapiens
cgacaucagagaauucaua

SEQ ID NO: 1473137 - RNA, 19 nt, Homo sapiens
ggaaagguugggagaaauu

SEQ ID NO: 1473138 - RNA, 19 nt, Homo sapiens
gagauaauggaaagccuua

SEQ ID NO: 1473139 - RNA, 19 nt, Homo sapiens
gguaagaaaccauaugaau

SEQ ID NO: 1473140 - RNA, 19 nt, Homo sapiens
gaaaagacuucuggcaaaa

SEQ ID NO: 1473141 - RNA, 19 nt, Homo sapiens
gauguaaauuguucagauc

SEQ ID NO: 1473142 - RNA, 19 nt, Homo sapiens
gcaagcaaccauaugaaug

SEQ ID NO: 1473143 - RNA, 19 nt, Homo sapiens
gcucacaguugauugaaca

SEQ ID NO: 1473144 - RNA, 19 nt, Homo sapiens
agucgaagcucacaguuga

SEQ ID NO: 1473145 - RNA, 19 nt, Homo sapiens
guuauggucuugaguguuc

SEQ ID NO: 1473146 - RNA, 19 nt, Homo sapiens
gaauuuauguuggcaagca

SEQ ID NO: 1473147 - RNA, 19 nt, Homo sapiens
cgagaaacccuaucagugu

SEQ ID NO: 1473148 - RNA, 19 nt, Homo sapiens
cuaaugagaaacccuauaa

SEQ ID NO: 1473149 - RNA, 19 nt, Homo sapiens
guucaaguuuccaagauga

SEQ ID NO: 1473150 - RNA, 19 nt, Homo sapiens
caagcaacaucagagaauu

SEQ ID NO: 1473151 - RNA, 19 nt, Homo sapiens
gaagcucacaguugauuga

SEQ ID NO: 1473152 - RNA, 19 nt, Homo sapiens
ccuaucagcccuugaaauu

SEQ ID NO: 1473153 - RNA, 19 nt, Homo sapiens
aagcuacacuggaggaauu

SEQ ID NO: 1473154 - RNA, 19 nt, Homo sapiens
gaugugaaauguggccaaa

SEQ ID NO: 1473155 - RNA, 19 nt, Homo sapiens
guucagggauguggccaua

SEQ ID NO: 1473156 - RNA, 19 nt, Homo sapiens
caacaucagagaguucaua

SEQ ID NO: 1473157 - RNA, 19 nt, Homo sapiens
cagcaugcaucccuuacuu

SEQ ID NO: 1473158 - RNA, 19 nt, Homo sapiens
gcaaagagcccuggauggu

SEQ ID NO: 1473159 - RNA, 19 nt, Homo sapiens
gaccuugagucaugauuca

SEQ ID NO: 1473160 - RNA, 19 nt, Homo sapiens
gaauauaaggaaugugaga

SEQ ID NO: 1473161 - RNA, 19 nt, Homo sapiens
gaaaagccauaugaaugua

SEQ ID NO: 1473162 - RNA, 19 nt, Homo sapiens
ggagagaaacccuaccaau

SEQ ID NO: 1473163 - RNA, 19 nt, Homo sapiens
ugagaaaccguaugaaugu

SEQ ID NO: 1473164 - RNA, 19 nt, Homo sapiens
ugugaaauguggccaaaga

SEQ ID NO: 1473165 - RNA, 19 nt, Homo sapiens
gaaagguugggagaaauuu

SEQ ID NO: 1473166 - RNA, 19 nt, Homo sapiens
guucagaucauaauuguca

SEQ ID NO: 1473167 - RNA, 19 nt, Homo sapiens
uaucagcccuugaaauucu

SEQ ID NO: 1473168 - RNA, 19 nt, Homo sapiens
agagaaacccuaccaaugu

SEQ ID NO: 1473169 - RNA, 19 nt, Homo sapiens
ggaccuaucagcccuugaa

SEQ ID NO: 1473170 - RNA, 19 nt, Homo sapiens
augaagaaaugcccacuuu

SEQ ID NO: 1473171 - RNA, 19 nt, Homo sapiens
ggaaauccagacagacauu

SEQ ID NO: 1473172 - RNA, 19 nt, Homo sapiens
gaaauguggccaaagagau

SEQ ID NO: 1473173 - RNA, 19 nt, Homo sapiens
uaauugugacugugacuua

SEQ ID NO: 1473174 - RNA, 19 nt, Homo sapiens
ggaggccuguguccaguau

SEQ ID NO: 1473175 - RNA, 19 nt, Homo sapiens
aaacucauaugcacuaaac

SEQ ID NO: 1473176 - RNA, 19 nt, Homo sapiens
gaaacccuaugagugcaaa

SEQ ID NO: 1473177 - RNA, 19 nt, Homo sapiens
gaagaaaugcccacuuuug

SEQ ID NO: 1473178 - RNA, 19 nt, Homo sapiens
ucagagggauuuguacaga

SEQ ID NO: 1473179 - RNA, 19 nt, Homo sapiens
gggaaaaccuuuagucauc

SEQ ID NO: 1473180 - RNA, 19 nt, Homo sapiens
guggaaaggccuucaauuc

SEQ ID NO: 1473181 - RNA, 19 nt, Homo sapiens
gcauguuuaugaagucgaa

SEQ ID NO: 1473182 - RNA, 19 nt, Homo sapiens
uaaacaugcuauucaaguc

SEQ ID NO: 1473183 - RNA, 19 nt, Homo sapiens
acagagacgugauguugga

SEQ ID NO: 1473184 - RNA, 19 nt, Homo sapiens
gugagaaaccguaugaaug

SEQ ID NO: 1473185 - RNA, 19 nt, Homo sapiens
gcucacgacuaauucaaca

SEQ ID NO: 1473186 - RNA, 19 nt, Homo sapiens
ugggaaggccuuuaaauau

SEQ ID NO: 1473187 - RNA, 19 nt, Homo sapiens
acagccagauuaucauuug

SEQ ID NO: 1473188 - RNA, 19 nt, Homo sapiens
caauguaagguauguggua

SEQ ID NO: 1473189 - RNA, 19 nt, Homo sapiens
gacagacauuuccaucaga

SEQ ID NO: 1473190 - RNA, 19 nt, Homo sapiens
gggaaggccuuuagcaaua

SEQ ID NO: 1473191 - RNA, 19 nt, Homo sapiens
cagaagaacugucaaauuc

SEQ ID NO: 1473192 - RNA, 19 nt, Homo sapiens
cagaggagcugaaggagua

SEQ ID NO: 1473193 - RNA, 19 nt, Homo sapiens
gaaagacccuaugaaugua

SEQ ID NO: 1473194 - RNA, 19 nt, Homo sapiens
ucgaguagcuuucuaauug

SEQ ID NO: 1473195 - RNA, 19 nt, Homo sapiens
gaagaaucauccaaaguug

SEQ ID NO: 1473196 - RNA, 19 nt, Homo sapiens
ggaaagugauguuggagaa

SEQ ID NO: 1473197 - RNA, 19 nt, Homo sapiens
aaccagagcucaucccuua

SEQ ID NO: 1473198 - RNA, 19 nt, Homo sapiens
uaacaaaucuuggcaaaca

SEQ ID NO: 1473199 - RNA, 19 nt, Homo sapiens
agagaaaccuuaugaaugu

SEQ ID NO: 1473200 - RNA, 19 nt, Homo sapiens
ggauguggcuguaaauuuc

SEQ ID NO: 1473201 - RNA, 19 nt, Homo sapiens
gagaaacccuaugaaugua

SEQ ID NO: 1473202 - RNA, 19 nt, Homo sapiens
gagaaacccuaugaaugua

SEQ ID NO: 1473203 - RNA, 19 nt, Homo sapiens
ggagaaagacccuaugaau

SEQ ID NO: 1473204 - RNA, 19 nt, Homo sapiens
caacaucagagaauucaua

SEQ ID NO: 1473205 - RNA, 19 nt, Homo sapiens
agagagaccuuucgaaugu

SEQ ID NO: 1473206 - RNA, 19 nt, Homo sapiens
gaugugaucucauuauugg

SEQ ID NO: 1473207 - RNA, 19 nt, Homo sapiens
gagagaaaccuuaugaaug

SEQ ID NO: 1473208 - RNA, 19 nt, Homo sapiens
caucaaagcaagagacaua

SEQ ID NO: 1473209 - RNA, 19 nt, Homo sapiens
ucucauuucucccucauua

SEQ ID NO: 1473210 - RNA, 19 nt, Homo sapiens
gaaacccuaugaauguaaa

SEQ ID NO: 1473211 - RNA, 19 nt, Homo sapiens
caacaucagagaagucaua

SEQ ID NO: 1473212 - RNA, 19 nt, Homo sapiens
gaaacccuaugaauguauu

SEQ ID NO: 1473213 - RNA, 19 nt, Homo sapiens
agagaaaccuuaugugugu

SEQ ID NO: 1473214 - RNA, 19 nt, Homo sapiens
agagaaaccuuaucagugu

SEQ ID NO: 1473215 - RNA, 19 nt, Homo sapiens
gcaagagacauaugaagaa

SEQ ID NO: 1473216 - RNA, 19 nt, Homo sapiens
gagagaaacccuaugaaug

SEQ ID NO: 1473217 - RNA, 19 nt, Homo sapiens
guacaucagagaauucaua

SEQ ID NO: 1473218 - RNA, 19 nt, Homo sapiens
gagagaaacccuaugaaug

SEQ ID NO: 1473219 - RNA, 19 nt, Homo sapiens
gaccuggguuccaaucuuu

SEQ ID NO: 1473220 - RNA, 19 nt, Homo sapiens
gagaaagacccuaugaaug

SEQ ID NO: 1473221 - RNA, 19 nt, Homo sapiens
ggagagaaaccuuaugaau

SEQ ID NO: 1473222 - RNA, 19 nt, Homo sapiens
ggaaagccuucagccagua

SEQ ID NO: 1473223 - RNA, 19 nt, Homo sapiens
gcucaucccuuacucuuca

SEQ ID NO: 1473224 - RNA, 19 nt, Homo sapiens
gcugggaagucaagaggua

SEQ ID NO: 1473225 - RNA, 19 nt, Homo sapiens
agaaagacccuaugaaugu

SEQ ID NO: 1473226 - RNA, 19 nt, Homo sapiens
ggagagaaaccuuaugugu

SEQ ID NO: 1473227 - RNA, 19 nt, Homo sapiens
gaagaaggagggaacaaga

SEQ ID NO: 1473228 - RNA, 19 nt, Homo sapiens
ggagagaaacccuaugaau

SEQ ID NO: 1473229 - RNA, 19 nt, Homo sapiens
caucguggauaccuaauug

SEQ ID NO: 1473230 - RNA, 19 nt, Homo sapiens
ggagagagaccuuucgaau

SEQ ID NO: 1473231 - RNA, 19 nt, Homo sapiens
ggagagaaacccuaugaau

SEQ ID NO: 1473232 - RNA, 19 nt, Homo sapiens
ccaccaggauacaaucuuu

SEQ ID NO: 1473233 - RNA, 19 nt, Homo sapiens
gugcacaucuugcucauca

SEQ ID NO: 1473234 - RNA, 19 nt, Homo sapiens
ggaggaggcgcucgacuuu

SEQ ID NO: 1473235 - RNA, 19 nt, Homo sapiens
gagaaaccuuaucagugua

SEQ ID NO: 1473236 - RNA, 19 nt, Homo sapiens
gagagaagacugucaaagu

SEQ ID NO: 1473237 - RNA, 19 nt, Homo sapiens
ccacauugcaaccaaauuu

SEQ ID NO: 1473238 - RNA, 19 nt, Homo sapiens
gaaaugaaacauaggaaag

SEQ ID NO: 1473239 - RNA, 19 nt, Homo sapiens
gagagacccuacgaaugua

SEQ ID NO: 1473240 - RNA, 19 nt, Homo sapiens
ggagagagacccuacgaau

SEQ ID NO: 1473241 - RNA, 19 nt, Homo sapiens
agagaagacugucaaagug

SEQ ID NO: 1473242 - RNA, 19 nt, Homo sapiens
ugaagaaucauccaaaguu

SEQ ID NO: 1473243 - RNA, 19 nt, Homo sapiens
agagacauaugaagaauca

SEQ ID NO: 1473244 - RNA, 19 nt, Homo sapiens
guucaucacuugcacaaca

SEQ ID NO: 1473245 - RNA, 19 nt, Homo sapiens
caaagcaagagacauauga

SEQ ID NO: 1473246 - RNA, 19 nt, Homo sapiens
gagaaaccuuaugaaugua

SEQ ID NO: 1473247 - RNA, 19 nt, Homo sapiens
ggagagaaaccuuaucagu

SEQ ID NO: 1473248 - RNA, 19 nt, Homo sapiens
gaaacccuaugcauguguu

SEQ ID NO: 1473249 - RNA, 19 nt, Homo sapiens
caagagacauaugaagaau

SEQ ID NO: 1473250 - RNA, 19 nt, Homo sapiens
gcucgacuuucucaggaua

SEQ ID NO: 1473251 - RNA, 19 nt, Homo sapiens
gagaauucauacuggagaa

SEQ ID NO: 1473252 - RNA, 19 nt, Homo sapiens
agagaaacccuaugaaugu

SEQ ID NO: 1473253 - RNA, 19 nt, Homo sapiens
gaauguaaaguauguagga

SEQ ID NO: 1473254 - RNA, 19 nt, Homo sapiens
ggaaagccuucagccagaa

SEQ ID NO: 1473255 - RNA, 19 nt, Homo sapiens
agagaaacccuaugaaugu

SEQ ID NO: 1473256 - RNA, 19 nt, Homo sapiens
caggauacaaucuuugaua

SEQ ID NO: 1473257 - RNA, 19 nt, Homo sapiens
gagaagacugucaaaguga

SEQ ID NO: 1473258 - RNA, 19 nt, Homo sapiens
gcacacauucuucaaaaua

SEQ ID NO: 1473259 - RNA, 19 nt, Homo sapiens
caaauugcauaccuugauc

SEQ ID NO: 1473260 - RNA, 19 nt, Homo sapiens
caacaucagagaguucaua

SEQ ID NO: 1473261 - RNA, 19 nt, Homo sapiens
gagagagaccuuucgaaug

SEQ ID NO: 1473262 - RNA, 19 nt, Homo sapiens
caacaucagagaguucaua

SEQ ID NO: 1473263 - RNA, 19 nt, Homo sapiens
gggauguggcuguaaauuu

SEQ ID NO: 1473264 - RNA, 19 nt, Homo sapiens
gaacuacaggagcuuggua

SEQ ID NO: 1473265 - RNA, 19 nt, Homo sapiens
ccucagaaguuaauagaag

SEQ ID NO: 1473266 - RNA, 19 nt, Homo sapiens
ucuaauuggucuccuugua

SEQ ID NO: 1473267 - RNA, 19 nt, Homo sapiens
ggaaagccuucagccaaau

SEQ ID NO: 1473268 - RNA, 19 nt, Homo sapiens
cuacaucagagaauucaua

SEQ ID NO: 1473269 - RNA, 19 nt, Homo sapiens
gagaagucauacuggagaa

SEQ ID NO: 1473270 - RNA, 19 nt, Homo sapiens
ggaaggccuuuagcaauag

SEQ ID NO: 1473271 - RNA, 19 nt, Homo sapiens
gagagaccuuucgaaugua

SEQ ID NO: 1473272 - RNA, 19 nt, Homo sapiens
gguacaucuuagucaauua

SEQ ID NO: 1473273 - RNA, 19 nt, Homo sapiens
gauugggaguauguauuua

SEQ ID NO: 1473274 - RNA, 19 nt, Homo sapiens
uuaaagccauguccaagga

SEQ ID NO: 1473275 - RNA, 19 nt, Homo sapiens
caacaucagaggguucaua

SEQ ID NO: 1473276 - RNA, 19 nt, Homo sapiens
gagagagacccuacgaaug

SEQ ID NO: 1473277 - RNA, 19 nt, Homo sapiens
ccacagaggagcugaagga

SEQ ID NO: 1473278 - RNA, 19 nt, Homo sapiens
cagcaucagagaauucaua

SEQ ID NO: 1473279 - RNA, 19 nt, Homo sapiens
caaacuuggcgcaacauaa

SEQ ID NO: 1473280 - RNA, 19 nt, Homo sapiens
gagaaacccuaugcaugug

SEQ ID NO: 1473281 - RNA, 19 nt, Homo sapiens
uaaagaaauccuuccagaa

SEQ ID NO: 1473282 - RNA, 19 nt, Homo sapiens
gcuucagucuuauuuauag

SEQ ID NO: 1473283 - RNA, 19 nt, Homo sapiens
agagagacccuacgaaugu

SEQ ID NO: 1473284 - RNA, 19 nt, Homo sapiens
uugcauaccuugaucaaca

SEQ ID NO: 1473285 - RNA, 19 nt, Homo sapiens
cauaagagaauacauacug

SEQ ID NO: 1473286 - RNA, 19 nt, Homo sapiens
gcaaacuuggcgcaacaua

SEQ ID NO: 1473287 - RNA, 19 nt, Homo sapiens
ggaauccaccucuugaauc

SEQ ID NO: 1473288 - RNA, 19 nt, Homo sapiens
agcaauaguucaucacuug

SEQ ID NO: 1473289 - RNA, 19 nt, Homo sapiens
gaaagccuucagccaaauu

SEQ ID NO: 1473290 - RNA, 19 nt, Homo sapiens
gcaagaagaagaagaagaa

SEQ ID NO: 1473291 - RNA, 19 nt, Homo sapiens
ggaguccguuuaaggcuuu

SEQ ID NO: 1473292 - RNA, 19 nt, Homo sapiens
agaagaagaagaagaagua

SEQ ID NO: 1473293 - RNA, 19 nt, Homo sapiens
ggaguugcaugcuaagauc

SEQ ID NO: 1473294 - RNA, 19 nt, Homo sapiens
gggcagugcugaucccaau

SEQ ID NO: 1473295 - RNA, 19 nt, Homo sapiens
gaagaagaagaagaaguaa

SEQ ID NO: 1473296 - RNA, 19 nt, Homo sapiens
gagccggcaugguccaaga

SEQ ID NO: 1473297 - RNA, 19 nt, Homo sapiens
gggaagcguuggagucucu

SEQ ID NO: 1473298 - RNA, 19 nt, Homo sapiens
gaucccaauucgagagguu

SEQ ID NO: 1473299 - RNA, 19 nt, Homo sapiens
gaaucggacaucuccauug

SEQ ID NO: 1473300 - RNA, 19 nt, Homo sapiens
caugagaugcuaaugcuau

SEQ ID NO: 1473301 - RNA, 19 nt, Homo sapiens
agaagaagaagaaguaaag

SEQ ID NO: 1473302 - RNA, 19 nt, Homo sapiens
gcagugcugaucccaauuc

SEQ ID NO: 1473303 - RNA, 19 nt, Homo sapiens
ccauucacgucaauaccaa

SEQ ID NO: 1473304 - RNA, 19 nt, Homo sapiens
gcugugccaucaacaaggu

SEQ ID NO: 1473305 - RNA, 19 nt, Homo sapiens
cuaaugcuaucgguaaucu

SEQ ID NO: 1473306 - RNA, 19 nt, Homo sapiens
gguccuccaugagaugcua

SEQ ID NO: 1473307 - RNA, 19 nt, Homo sapiens
ucccaaagccucagagauc

SEQ ID NO: 1473308 - RNA, 19 nt, Homo sapiens
cccaaagccucagagauca

SEQ ID NO: 1473309 - RNA, 19 nt, Homo sapiens
uggagucucugucccaaag

SEQ ID NO: 1473310 - RNA, 19 nt, Homo sapiens
gaccugcugugccaucaac

SEQ ID NO: 1473311 - RNA, 19 nt, Homo sapiens
caucuccauugcacacguu

SEQ ID NO: 1473312 - RNA, 19 nt, Homo sapiens
aaucggacaucuccauugc

SEQ ID NO: 1473313 - RNA, 19 nt, Homo sapiens
ucacgucaauaccaagaac

SEQ ID NO: 1473314 - RNA, 19 nt, Homo sapiens
ucaauaccaagaaccaugu

SEQ ID NO: 1473315 - RNA, 19 nt, Homo sapiens
gaagaagaagaaguaaagg

SEQ ID NO: 1473316 - RNA, 19 nt, Homo sapiens
ccaauucgagagguucuga

SEQ ID NO: 1473317 - RNA, 19 nt, Homo sapiens
gccaucaacaaggugcuua

SEQ ID NO: 1473318 - RNA, 19 nt, Homo sapiens
ccaaguagcugggacuaua

SEQ ID NO: 1473319 - RNA, 19 nt, Homo sapiens
gcaaagaagagaaauaaga

SEQ ID NO: 1473320 - RNA, 19 nt, Homo sapiens
gaaagaauacuaucacauc

SEQ ID NO: 1473321 - RNA, 19 nt, Homo sapiens
gucaugaucuuuaaccuaa

SEQ ID NO: 1473322 - RNA, 19 nt, Homo sapiens
gagcaauacucuuuaucaa

SEQ ID NO: 1473323 - RNA, 19 nt, Homo sapiens
aaacuguggugucuaauga

SEQ ID NO: 1473324 - RNA, 19 nt, Homo sapiens
ggaacccuaucucuacuaa

SEQ ID NO: 1473325 - RNA, 19 nt, Homo sapiens
ggagugauuuggagaacaa

SEQ ID NO: 1473326 - RNA, 19 nt, Homo sapiens
cuagaaagguuggacuaua

SEQ ID NO: 1473327 - RNA, 19 nt, Homo sapiens
acacacaccuguaaucuca

SEQ ID NO: 1473328 - RNA, 19 nt, Homo sapiens
gaaauaagagccacagaag

SEQ ID NO: 1473329 - RNA, 19 nt, Homo sapiens
ccuaaacuguggugucuaa

SEQ ID NO: 1473330 - RNA, 19 nt, Homo sapiens
gaacuccucuuggcauugu

SEQ ID NO: 1473331 - RNA, 19 nt, Homo sapiens
gguggucugugacucuuua

SEQ ID NO: 1473332 - RNA, 19 nt, Homo sapiens
gaaaauaaauugccaucug

SEQ ID NO: 1473333 - RNA, 19 nt, Homo sapiens
gacagggucucacuuuguu

SEQ ID NO: 1473334 - RNA, 19 nt, Homo sapiens
gaacaaugcauguaagucu

SEQ ID NO: 1473335 - RNA, 19 nt, Homo sapiens
gcauuggacuucuuacauc

SEQ ID NO: 1473336 - RNA, 19 nt, Homo sapiens
ugcaguaggucaugaguaa

SEQ ID NO: 1473337 - RNA, 19 nt, Homo sapiens
ggagaacaaugcauguaag

SEQ ID NO: 1473338 - RNA, 19 nt, Homo sapiens
ucaccaagcuaaauuugau

SEQ ID NO: 1473339 - RNA, 19 nt, Homo sapiens
guucaugacuaucuaauac

SEQ ID NO: 1473340 - RNA, 19 nt, Homo sapiens
uagaaagguuggacuauag

SEQ ID NO: 1473341 - RNA, 19 nt, Homo sapiens
uaaagaauccaaucucuag

SEQ ID NO: 1473342 - RNA, 19 nt, Homo sapiens
agugggaucuccaguagua

SEQ ID NO: 1473343 - RNA, 19 nt, Homo sapiens
gaccaaggcaacacaguuu

SEQ ID NO: 1473344 - RNA, 19 nt, Homo sapiens
aguagaagauuauggaaga

SEQ ID NO: 1473345 - RNA, 19 nt, Homo sapiens
aauaagagccacagaaguu

SEQ ID NO: 1473346 - RNA, 19 nt, Homo sapiens
gggaaaggaacuguaauuu

SEQ ID NO: 1473347 - RNA, 19 nt, Homo sapiens
cuaguaggguugaggauug

SEQ ID NO: 1473348 - RNA, 19 nt, Homo sapiens
ggaguuucuuugaccauug

SEQ ID NO: 1473349 - RNA, 19 nt, Homo sapiens
gaacucguauauaacuuac

SEQ ID NO: 1473350 - RNA, 19 nt, Homo sapiens
ggaaaggaacuguaauuuu

SEQ ID NO: 1473351 - RNA, 19 nt, Homo sapiens
cauaaagaauccaaucucu

SEQ ID NO: 1473352 - RNA, 19 nt, Homo sapiens
agaauacuaucacaucuag

SEQ ID NO: 1473353 - RNA, 19 nt, Homo sapiens
ccaaagugcugggauuaca

SEQ ID NO: 1473354 - RNA, 19 nt, Homo sapiens
cggcaaagaagagaaauaa

SEQ ID NO: 1473355 - RNA, 19 nt, Homo sapiens
agaauccaaucucuagaaa

SEQ ID NO: 1473356 - RNA, 19 nt, Homo sapiens
caacacaguuuugccauaa

SEQ ID NO: 1473357 - RNA, 19 nt, Homo sapiens
ggucacaguauacaaggua

SEQ ID NO: 1473358 - RNA, 19 nt, Homo sapiens
gcccuggucuuccaaaaua

SEQ ID NO: 1473359 - RNA, 19 nt, Homo sapiens
ggacuauagagugaaauaa

SEQ ID NO: 1473360 - RNA, 19 nt, Homo sapiens
ccagggaaaggaacuguaa

SEQ ID NO: 1473361 - RNA, 19 nt, Homo sapiens
cuaauacucugugcaagug

SEQ ID NO: 1473362 - RNA, 19 nt, Homo sapiens
caccacacccagcuaauuu

SEQ ID NO: 1473363 - RNA, 19 nt, Homo sapiens
caaagaagagaaauaagag

SEQ ID NO: 1473364 - RNA, 19 nt, Homo sapiens
ccagccagaaucuuuauuu

SEQ ID NO: 1473365 - RNA, 19 nt, Homo sapiens
ucagugggaucuccaguag

SEQ ID NO: 1473366 - RNA, 19 nt, Homo sapiens
uaagguauggaguuucuuu

SEQ ID NO: 1473367 - RNA, 19 nt, Homo sapiens
caacaugguggaacccuau

SEQ ID NO: 1473368 - RNA, 19 nt, Homo sapiens
uaagccauguggaugaaug

SEQ ID NO: 1473369 - RNA, 19 nt, Homo sapiens
ugaaauuagugcaguaggu

SEQ ID NO: 1473370 - RNA, 19 nt, Homo sapiens
gcgcaaucuuggcucacua

SEQ ID NO: 1473371 - RNA, 19 nt, Homo sapiens
agaaauaagagccacagaa

SEQ ID NO: 1473372 - RNA, 19 nt, Homo sapiens
aauccaaucucuagaaagg

SEQ ID NO: 1473373 - RNA, 19 nt, Homo sapiens
ugucuaccuugccacguua

SEQ ID NO: 1473374 - RNA, 19 nt, Homo sapiens
aaacaaacaccuucaaagc

SEQ ID NO: 1473375 - RNA, 19 nt, Homo sapiens
uaaacaaacaccuucaaag

SEQ ID NO: 1473376 - RNA, 19 nt, Homo sapiens
uagaacuccucuuggcauu

SEQ ID NO: 1473377 - RNA, 19 nt, Homo sapiens
aaucuuggcucacuacaac

SEQ ID NO: 1473378 - RNA, 19 nt, Homo sapiens
guggaaccauugcccuuug

SEQ ID NO: 1473379 - RNA, 19 nt, Homo sapiens
gcgggcagaucacuugaag

SEQ ID NO: 1473380 - RNA, 19 nt, Homo sapiens
gagacgggguuucagcaua

SEQ ID NO: 1473381 - RNA, 19 nt, Homo sapiens
guuggacuauagagugaaa

SEQ ID NO: 1473382 - RNA, 19 nt, Homo sapiens
gcaggagugauuuggagaa

SEQ ID NO: 1473383 - RNA, 19 nt, Homo sapiens
uccaaucucuagaaagguu

SEQ ID NO: 1473384 - RNA, 19 nt, Homo sapiens
gaguuucuuugaccauugu

SEQ ID NO: 1473385 - RNA, 19 nt, Homo sapiens
uaaauugccaucugguugu

SEQ ID NO: 1473386 - RNA, 19 nt, Homo sapiens
gaagucaggaguucaagac

SEQ ID NO: 1473387 - RNA, 19 nt, Homo sapiens
gagaacaaugcauguaagu

SEQ ID NO: 1473388 - RNA, 19 nt, Homo sapiens
aaauugccaucugguugua

SEQ ID NO: 1473389 - RNA, 19 nt, Homo sapiens
aaugacuaguugcuuguaa

SEQ ID NO: 1473390 - RNA, 19 nt, Homo sapiens
gguggaacccuaucucuac

SEQ ID NO: 1473391 - RNA, 19 nt, Homo sapiens
ggugucuaaugacuaguug

SEQ ID NO: 1473392 - RNA, 19 nt, Homo sapiens
uaucuaauacucugugcaa

SEQ ID NO: 1473393 - RNA, 19 nt, Homo sapiens
ccaccacacccagcuaauu

SEQ ID NO: 1473394 - RNA, 19 nt, Homo sapiens
uggagaacaaugcauguaa

SEQ ID NO: 1473395 - RNA, 19 nt, Homo sapiens
uaaacuguggugucuaaug

SEQ ID NO: 1473396 - RNA, 19 nt, Homo sapiens
gguauggaguuucuuugac

SEQ ID NO: 1473397 - RNA, 19 nt, Homo sapiens
guagaagauuauggaagau

SEQ ID NO: 1473398 - RNA, 19 nt, Homo sapiens
ccuguaaucccagcacuuu

SEQ ID NO: 1473399 - RNA, 19 nt, Homo sapiens
ucuuacaucugucuaccuu

SEQ ID NO: 1473400 - RNA, 19 nt, Homo sapiens
acuuacauguggaaauuug

SEQ ID NO: 1473401 - RNA, 19 nt, Homo sapiens
cagaacucguauauaacuu

SEQ ID NO: 1473402 - RNA, 19 nt, Homo sapiens
ucagaacucguauauaacu

SEQ ID NO: 1473403 - RNA, 19 nt, Homo sapiens
gucugugacucuuuaaaca

SEQ ID NO: 1473404 - RNA, 19 nt, Homo sapiens
gaaaaugugaaguuggaaa

SEQ ID NO: 1473405 - RNA, 19 nt, Homo sapiens
aagaauccaaucucuagaa

SEQ ID NO: 1473406 - RNA, 19 nt, Homo sapiens
ugaccaaggcaacacaguu

SEQ ID NO: 1473407 - RNA, 19 nt, Homo sapiens
gguggaaccauugcccuuu

SEQ ID NO: 1473408 - RNA, 19 nt, Homo sapiens
guaggguugaggauuguuu

SEQ ID NO: 1473409 - RNA, 19 nt, Homo sapiens
cuacugcccuggucuucca

SEQ ID NO: 1473410 - RNA, 19 nt, Homo sapiens
cguccagccagaaucuuua

SEQ ID NO: 1473411 - RNA, 19 nt, Homo sapiens
gguuguaccaguagaagau

SEQ ID NO: 1473412 - RNA, 19 nt, Homo sapiens
gccacugcuuuaaaucaug

SEQ ID NO: 1473413 - RNA, 19 nt, Homo sapiens
gcacccagcccagaauuuu

SEQ ID NO: 1473414 - RNA, 19 nt, Homo sapiens
cagccagaaucuuuauuuu

SEQ ID NO: 1473415 - RNA, 19 nt, Homo sapiens
aggugauucuucuggcuua

SEQ ID NO: 1473416 - RNA, 19 nt, Homo sapiens
guaagucugacaucaugau

SEQ ID NO: 1473417 - RNA, 19 nt, Homo sapiens
uggaagauuuugucauuga

SEQ ID NO: 1473418 - RNA, 19 nt, Homo sapiens
gcacggagguggaguguua

SEQ ID NO: 1473419 - RNA, 19 nt, Homo sapiens
gaacagacuucuugcagau

SEQ ID NO: 1473420 - RNA, 19 nt, Homo sapiens
gagauuaguuuuccuguua

SEQ ID NO: 1473421 - RNA, 19 nt, Homo sapiens
gaagaaggaagagggauua

SEQ ID NO: 1473422 - RNA, 19 nt, Homo sapiens
ugacucagcugaagaugaa

SEQ ID NO: 1473423 - RNA, 19 nt, Homo sapiens
caucugauaucuccuauuc

SEQ ID NO: 1473424 - RNA, 19 nt, Homo sapiens
gaaggaagagggauuacaa

SEQ ID NO: 1473425 - RNA, 19 nt, Homo sapiens
agucggagcugguaaacua

SEQ ID NO: 1473426 - RNA, 19 nt, Homo sapiens
gagcugggaugcaggaaau

SEQ ID NO: 1473427 - RNA, 19 nt, Homo sapiens
cgaguacugucucaaggua

SEQ ID NO: 1473428 - RNA, 19 nt, Homo sapiens
gggaagggcucuggcucua

SEQ ID NO: 1473429 - RNA, 19 nt, Homo sapiens
gaagaucagggcagaauag

SEQ ID NO: 1473430 - RNA, 19 nt, Homo sapiens
gcacaccuauucauucacu

SEQ ID NO: 1473431 - RNA, 19 nt, Homo sapiens
ucaaacauccguccaccua

SEQ ID NO: 1473432 - RNA, 19 nt, Homo sapiens
gaagggcucuggcucuacu

SEQ ID NO: 1473433 - RNA, 19 nt, Homo sapiens
agaugucgcuggaggauga

SEQ ID NO: 1473434 - RNA, 19 nt, Homo sapiens
ggaagaucagggcagaaua

SEQ ID NO: 1473435 - RNA, 19 nt, Homo sapiens
ggaacaggcaggaagauca

SEQ ID NO: 1473436 - RNA, 19 nt, Homo sapiens
gcagagggugccgcaaaua

SEQ ID NO: 1473437 - RNA, 19 nt, Homo sapiens
gggaggccaucggcaagua

SEQ ID NO: 1473438 - RNA, 19 nt, Homo sapiens
gcaaauacaggcgcacaga

SEQ ID NO: 1473439 - RNA, 19 nt, Homo sapiens
ggugggcgaugccaggaaa

SEQ ID NO: 1473440 - RNA, 19 nt, Homo sapiens
gcgagcugcuggauacuuc

SEQ ID NO: 1473441 - RNA, 19 nt, Homo sapiens
ugagcgagcugcuggauac

SEQ ID NO: 1473442 - RNA, 19 nt, Homo sapiens
uuaaguggcucggagagaa

SEQ ID NO: 1473443 - RNA, 19 nt, Homo sapiens
aaacauccguccaccuauc

SEQ ID NO: 1473444 - RNA, 19 nt, Homo sapiens
ccucccaccucaccaugua

SEQ ID NO: 1473445 - RNA, 19 nt, Homo sapiens
gcagacacaacacucaguu

SEQ ID NO: 1473446 - RNA, 19 nt, Homo sapiens
ccacaucugauaucuccua

SEQ ID NO: 1473447 - RNA, 19 nt, Homo sapiens
gggagagcuuggcgacuug

SEQ ID NO: 1473448 - RNA, 19 nt, Homo sapiens
ccaccuaucgcuccucuga

SEQ ID NO: 1473449 - RNA, 19 nt, Homo sapiens
ucaagguacuggagaagca

SEQ ID NO: 1473450 - RNA, 19 nt, Homo sapiens
auuaagagccaaugaagaa

SEQ ID NO: 1473451 - RNA, 19 nt, Homo sapiens
ucacgcacaccuauucauu

SEQ ID NO: 1473452 - RNA, 19 nt, Homo sapiens
gcggagcugcuucuaggua

SEQ ID NO: 1473453 - RNA, 19 nt, Homo sapiens
gccgagacgagauuaguuu

SEQ ID NO: 1473454 - RNA, 19 nt, Homo sapiens
cgggagagcuuggcgacuu

SEQ ID NO: 1473455 - RNA, 19 nt, Homo sapiens
gcgcugcuaucgagagaag

SEQ ID NO: 1473456 - RNA, 19 nt, Homo sapiens
ccagggagguguggaaguc

SEQ ID NO: 1473457 - RNA, 19 nt, Homo sapiens
cuauucaccugcucaguca

SEQ ID NO: 1473458 - RNA, 19 nt, Homo sapiens
acucauguguuuguuggua

SEQ ID NO: 1473459 - RNA, 19 nt, Homo sapiens
ggaagagggauuacaacag

SEQ ID NO: 1473460 - RNA, 19 nt, Homo sapiens
acgcacaccuauucauuca

SEQ ID NO: 1473461 - RNA, 19 nt, Homo sapiens
gucauugccacaucugaua

SEQ ID NO: 1473462 - RNA, 19 nt, Homo sapiens
gcuggaggaugagaagugu

SEQ ID NO: 1473463 - RNA, 19 nt, Homo sapiens
ugaagaaggaagagggauu

SEQ ID NO: 1473464 - RNA, 19 nt, Homo sapiens
ccacugucaucuccauuac

SEQ ID NO: 1473465 - RNA, 19 nt, Homo sapiens
uuucucaucuaccgucauu

SEQ ID NO: 1473466 - RNA, 19 nt, Homo sapiens
gaacaggcaggaagaucag

SEQ ID NO: 1473467 - RNA, 19 nt, Homo sapiens
gacccaaggugaggaaguc

SEQ ID NO: 1473468 - RNA, 19 nt, Homo sapiens
acagacuucuugcagaugu

SEQ ID NO: 1473469 - RNA, 19 nt, Homo sapiens
ucauguguuuguugguaaa

SEQ ID NO: 1473470 - RNA, 19 nt, Homo sapiens
cagcugaagaugaaucguu

SEQ ID NO: 1473471 - RNA, 19 nt, Homo sapiens
gagggaacaggcaggaaga

SEQ ID NO: 1473472 - RNA, 19 nt, Homo sapiens
guauuaagagccaaugaag

SEQ ID NO: 1473473 - RNA, 19 nt, Homo sapiens
cagcgcugcuaucgagaga

SEQ ID NO: 1473474 - RNA, 19 nt, Homo sapiens
ggagcugggaugcaggaaa

SEQ ID NO: 1473475 - RNA, 19 nt, Homo sapiens
gaaauuggggugugugugu

SEQ ID NO: 1473476 - RNA, 19 nt, Homo sapiens
aagagccaaugaagaagga

SEQ ID NO: 1473477 - RNA, 19 nt, Homo sapiens
ucugauaucuccuauucac

SEQ ID NO: 1473478 - RNA, 19 nt, Homo sapiens
caccuaccgugccggcauu

SEQ ID NO: 1473479 - RNA, 19 nt, Homo sapiens
gcuggauacuucggagaau

SEQ ID NO: 1473480 - RNA, 19 nt, Homo sapiens
ugcgauggcuccgcuguga

SEQ ID NO: 1473481 - RNA, 19 nt, Homo sapiens
gcugcuaucgagagaagaa

SEQ ID NO: 1473482 - RNA, 19 nt, Homo sapiens
gcagaugucgcuggaggau

SEQ ID NO: 1473483 - RNA, 19 nt, Homo sapiens
gcucggagagaacagacuu

SEQ ID NO: 1473484 - RNA, 19 nt, Homo sapiens
gaucaaggaaagggauuag

SEQ ID NO: 1473485 - RNA, 19 nt, Homo sapiens
gggcgaugccaggaaauug

SEQ ID NO: 1473486 - RNA, 19 nt, Homo sapiens
cccacugucaucuccauua

SEQ ID NO: 1473487 - RNA, 19 nt, Homo sapiens
gagccagggagguguggaa

SEQ ID NO: 1473488 - RNA, 19 nt, Homo sapiens
caggagggcagacacaaca

SEQ ID NO: 1473489 - RNA, 19 nt, Homo sapiens
gcccuucacccgccauuca

SEQ ID NO: 1473490 - RNA, 19 nt, Homo sapiens
gcuaucgagagaagaaguu

SEQ ID NO: 1473491 - RNA, 19 nt, Homo sapiens
gagccgagacgagauuagu

SEQ ID NO: 1473492 - RNA, 19 nt, Homo sapiens
cagacacaacacucaguuu

SEQ ID NO: 1473493 - RNA, 19 nt, Homo sapiens
caaacauccguccaccuau

SEQ ID NO: 1473494 - RNA, 19 nt, Homo sapiens
uguauuaagagccaaugaa

SEQ ID NO: 1473495 - RNA, 19 nt, Homo sapiens
gcaacuucaaggccaccua

SEQ ID NO: 1473496 - RNA, 19 nt, Homo sapiens
uggaggaugagaaguguga

SEQ ID NO: 1473497 - RNA, 19 nt, Homo sapiens
ugcaggaaauggucuuugg

SEQ ID NO: 1473498 - RNA, 19 nt, Homo sapiens
uauuaagagccaaugaaga

SEQ ID NO: 1473499 - RNA, 19 nt, Homo sapiens
uaggagaacuggcuauuua

SEQ ID NO: 1473500 - RNA, 19 nt, Homo sapiens
gaaguggcauuuaggagaa

SEQ ID NO: 1473501 - RNA, 19 nt, Homo sapiens
caaggacccucacucacua

SEQ ID NO: 1473502 - RNA, 19 nt, Homo sapiens
agaaccagcuuuacaagga

SEQ ID NO: 1473503 - RNA, 19 nt, Homo sapiens
gaagcgccguguucauuca

SEQ ID NO: 1473504 - RNA, 19 nt, Homo sapiens
gaagugauaaggcaggauu

SEQ ID NO: 1473505 - RNA, 19 nt, Homo sapiens
caauucaggcccauucuuu

SEQ ID NO: 1473506 - RNA, 19 nt, Homo sapiens
gcucugagaacuagacuug

SEQ ID NO: 1473507 - RNA, 19 nt, Homo sapiens
gcagggugguuauuaaagg

SEQ ID NO: 1473508 - RNA, 19 nt, Homo sapiens
gcgaagcgccguguucauu

SEQ ID NO: 1473509 - RNA, 19 nt, Homo sapiens
ucacgcagggugguuauua

SEQ ID NO: 1473510 - RNA, 19 nt, Homo sapiens
ggaaguuggcguacagaga

SEQ ID NO: 1473511 - RNA, 19 nt, Homo sapiens
gcccaggagucaucucaug

SEQ ID NO: 1473512 - RNA, 19 nt, Homo sapiens
cacgcagggugguuauuaa

SEQ ID NO: 1473513 - RNA, 19 nt, Homo sapiens
cgacguggcagacgaggaa

SEQ ID NO: 1473514 - RNA, 19 nt, Homo sapiens
ugacacagacaaagcauuc

SEQ ID NO: 1473515 - RNA, 19 nt, Homo sapiens
gggaaaaggaggaaacuaa

SEQ ID NO: 1473516 - RNA, 19 nt, Homo sapiens
ucugagaacuagacuugga

SEQ ID NO: 1473517 - RNA, 19 nt, Homo sapiens
ucugugagccucugccuuu

SEQ ID NO: 1473518 - RNA, 19 nt, Homo sapiens
gcagguacugacuuccaua

SEQ ID NO: 1473519 - RNA, 19 nt, Homo sapiens
gagcaauucaggcccauuc

SEQ ID NO: 1473520 - RNA, 19 nt, Homo sapiens
gacccucacucacuacucu

SEQ ID NO: 1473521 - RNA, 19 nt, Homo sapiens
ccacgccuacccaagauuu

SEQ ID NO: 1473522 - RNA, 19 nt, Homo sapiens
gcaauucaggcccauucuu

SEQ ID NO: 1473523 - RNA, 19 nt, Homo sapiens
ggaugacccucugcugaca

SEQ ID NO: 1473524 - RNA, 19 nt, Homo sapiens
ggagaacuggcuauuuaag

SEQ ID NO: 1473525 - RNA, 19 nt, Homo sapiens
uuacaaggacccucacuca

SEQ ID NO: 1473526 - RNA, 19 nt, Homo sapiens
ggagaaccagcuuuacaag

SEQ ID NO: 1473527 - RNA, 19 nt, Homo sapiens
cagggugguuauuaaagga

SEQ ID NO: 1473528 - RNA, 19 nt, Homo sapiens
ugggagcugugccaacuug

SEQ ID NO: 1473529 - RNA, 19 nt, Homo sapiens
cagggcagguacugacuuc

SEQ ID NO: 1473530 - RNA, 19 nt, Homo sapiens
gagaacuggcuauuuaagg

SEQ ID NO: 1473531 - RNA, 19 nt, Homo sapiens
acccagagcagcccuugua

SEQ ID NO: 1473532 - RNA, 19 nt, Homo sapiens
ggccacgccuacccaagau

SEQ ID NO: 1473533 - RNA, 19 nt, Homo sapiens
gcgccguguucauucauuc

SEQ ID NO: 1473534 - RNA, 19 nt, Homo sapiens
cguguucauucauucauuc

SEQ ID NO: 1473535 - RNA, 19 nt, Homo sapiens
uggagaaccagcuuuacaa

SEQ ID NO: 1473536 - RNA, 19 nt, Homo sapiens
ccaguggcucugagaacua

SEQ ID NO: 1473537 - RNA, 19 nt, Homo sapiens
ggccguccuuucccucaug

SEQ ID NO: 1473538 - RNA, 19 nt, Homo sapiens
cgaagcgccguguucauuc

SEQ ID NO: 1473539 - RNA, 19 nt, Homo sapiens
acgaggaaccacacuagaa

SEQ ID NO: 1473540 - RNA, 19 nt, Homo sapiens
acaaggacccucacucacu

SEQ ID NO: 1473541 - RNA, 19 nt, Homo sapiens
gacgaggaaccacacuaga

SEQ ID NO: 1473542 - RNA, 19 nt, Homo sapiens
uuaggagaacuggcuauuu

SEQ ID NO: 1473543 - RNA, 19 nt, Homo sapiens
ggcagguacugacuuccau

SEQ ID NO: 1473544 - RNA, 19 nt, Homo sapiens
cgaggaaccacacuagaac

SEQ ID NO: 1473545 - RNA, 19 nt, Homo sapiens
ccguguucauucauucauu

SEQ ID NO: 1473546 - RNA, 19 nt, Homo sapiens
ggcccauucuuucugaucu

SEQ ID NO: 1473547 - RNA, 19 nt, Homo sapiens
gcaaugauauucuccugua

SEQ ID NO: 1473548 - RNA, 19 nt, Homo sapiens
gagggcagccuucucauua

SEQ ID NO: 1473549 - RNA, 19 nt, Homo sapiens
gcacugguacuauuuauuc

SEQ ID NO: 1473550 - RNA, 19 nt, Homo sapiens
gaacgagacccugcauuug

SEQ ID NO: 1473551 - RNA, 19 nt, Homo sapiens
gccaaguggugcaguauga

SEQ ID NO: 1473552 - RNA, 19 nt, Homo sapiens
ucaccagccucaccaauau

SEQ ID NO: 1473553 - RNA, 19 nt, Homo sapiens
gggcagccuucucauuaaa

SEQ ID NO: 1473554 - RNA, 19 nt, Homo sapiens
gcacugggguucuacuuuu

SEQ ID NO: 1473555 - RNA, 19 nt, Homo sapiens
gcagccuucucauuaaaga

SEQ ID NO: 1473556 - RNA, 19 nt, Homo sapiens
gcucgacugucccuuagga

SEQ ID NO: 1473557 - RNA, 19 nt, Homo sapiens
gcaccaauaacacacaguu

SEQ ID NO: 1473558 - RNA, 19 nt, Homo sapiens
agaacgagacccugcauuu

SEQ ID NO: 1473559 - RNA, 19 nt, Homo sapiens
gagaagacagaauuugugu

SEQ ID NO: 1473560 - RNA, 19 nt, Homo sapiens
gaugucaccacccugcaua

SEQ ID NO: 1473561 - RNA, 19 nt, Homo sapiens
gcaguaugaaauugacuuu

SEQ ID NO: 1473562 - RNA, 19 nt, Homo sapiens
gauauucuccuguauugca

SEQ ID NO: 1473563 - RNA, 19 nt, Homo sapiens
aaggguggauuacgucauu

SEQ ID NO: 1473564 - RNA, 19 nt, Homo sapiens
gcgcacugguacuauuuau

SEQ ID NO: 1473565 - RNA, 19 nt, Homo sapiens
gcucguggcccaguucaaa

SEQ ID NO: 1473566 - RNA, 19 nt, Homo sapiens
gaugagaagacagaauuug

SEQ ID NO: 1473567 - RNA, 19 nt, Homo sapiens
aaauugacuuucaggaugu

SEQ ID NO: 1473568 - RNA, 19 nt, Homo sapiens
ccaacaggcccuacucuca

SEQ ID NO: 1473569 - RNA, 19 nt, Homo sapiens
gaggcucaguggagagaga

SEQ ID NO: 1473570 - RNA, 19 nt, Homo sapiens
caaguggugcaguaugaaa

SEQ ID NO: 1473571 - RNA, 19 nt, Homo sapiens
caaugauauucuccuguau

SEQ ID NO: 1473572 - RNA, 19 nt, Homo sapiens
ggacuucaccaccuuucug

SEQ ID NO: 1473573 - RNA, 19 nt, Homo sapiens
uaccacugcuggaacaaga

SEQ ID NO: 1473574 - RNA, 19 nt, Homo sapiens
gguacuauuuauucacaca

SEQ ID NO: 1473575 - RNA, 19 nt, Homo sapiens
augauauucuccuguauug

SEQ ID NO: 1473576 - RNA, 19 nt, Homo sapiens
ucgaugagaagacagaauu

SEQ ID NO: 1473577 - RNA, 19 nt, Homo sapiens
gucaccacccugcauauaa

SEQ ID NO: 1473578 - RNA, 19 nt, Homo sapiens
gcccuacucucaggcaaug

SEQ ID NO: 1473579 - RNA, 19 nt, Homo sapiens
gggcgcacugguacuauuu

SEQ ID NO: 1473580 - RNA, 19 nt, Homo sapiens
cacaggugcugguggugaa

SEQ ID NO: 1473581 - RNA, 19 nt, Homo sapiens
cacguccagugcaccaaua

SEQ ID NO: 1473582 - RNA, 19 nt, Homo sapiens
ucaccacccugcauauaac

SEQ ID NO: 1473583 - RNA, 19 nt, Homo sapiens
gccaggacuucaccaccuu

SEQ ID NO: 1473584 - RNA, 19 nt, Homo sapiens
ugagaagacagaauuugug

SEQ ID NO: 1473585 - RNA, 19 nt, Homo sapiens
gcagcaaacagcucauuuu

SEQ ID NO: 1473586 - RNA, 19 nt, Homo sapiens
agggcagccuucucauuaa

SEQ ID NO: 1473587 - RNA, 19 nt, Homo sapiens
cgagggcagccuucucauu

SEQ ID NO: 1473588 - RNA, 19 nt, Homo sapiens
ggcagcaaacagcucauuu

SEQ ID NO: 1473589 - RNA, 19 nt, Homo sapiens
gccgccaaguggugcagua

SEQ ID NO: 1473590 - RNA, 19 nt, Homo sapiens
guggcucgacugucccuua

SEQ ID NO: 1473591 - RNA, 19 nt, Homo sapiens
cgaugagaagacagaauuu

SEQ ID NO: 1473592 - RNA, 19 nt, Homo sapiens
guggugcaguaugaaauug

SEQ ID NO: 1473593 - RNA, 19 nt, Homo sapiens
gggcgcugcucaagugcau

SEQ ID NO: 1473594 - RNA, 19 nt, Homo sapiens
gugcugguggugaaauaaa

SEQ ID NO: 1473595 - RNA, 19 nt, Homo sapiens
cacaguuaaggguggauua

SEQ ID NO: 1473596 - RNA, 19 nt, Homo sapiens
ugucaccacccugcauaua

SEQ ID NO: 1473597 - RNA, 19 nt, Homo sapiens
ccagugcaccaauaacaca

SEQ ID NO: 1473598 - RNA, 19 nt, Homo sapiens
gggcagcaaacagcucauu

SEQ ID NO: 1473599 - RNA, 19 nt, Homo sapiens
ccucaccaauauuuccaau

SEQ ID NO: 1473600 - RNA, 19 nt, Homo sapiens
cucaccagccucaccaaua

SEQ ID NO: 1473601 - RNA, 19 nt, Homo sapiens
ggcgcacugguacuauuua

SEQ ID NO: 1473602 - RNA, 19 nt, Homo sapiens
cugguacuauuuauucaca

SEQ ID NO: 1473603 - RNA, 19 nt, Homo sapiens
gagaguaccugaucaagcu

SEQ ID NO: 1473604 - RNA, 19 nt, Homo sapiens
gcgagaggcuggccagaau

SEQ ID NO: 1473605 - RNA, 19 nt, Homo sapiens
ccacaacuauggcgucuac

SEQ ID NO: 1473606 - RNA, 19 nt, Homo sapiens
ccagauggauggcuucucu

SEQ ID NO: 1473607 - RNA, 19 nt, Homo sapiens
cguaacggcuuccgcauca

SEQ ID NO: 1473608 - RNA, 19 nt, Homo sapiens
gcacagccgucaccuucca

SEQ ID NO: 1473609 - RNA, 19 nt, Homo sapiens
ugggcgagcuggaagauga

SEQ ID NO: 1473610 - RNA, 19 nt, Homo sapiens
ggguggaggcggacaagua

SEQ ID NO: 1473611 - RNA, 19 nt, Homo sapiens
cagggcgacuuuaccauug

SEQ ID NO: 1473612 - RNA, 19 nt, Homo sapiens
cgacagcacuuggugacau

SEQ ID NO: 1473613 - RNA, 19 nt, Homo sapiens
ucaaggccaugcggaagaa

SEQ ID NO: 1473614 - RNA, 19 nt, Homo sapiens
gaguggacguccugguuca

SEQ ID NO: 1473615 - RNA, 19 nt, Homo sapiens
gaggcuggccagaauguga

SEQ ID NO: 1473616 - RNA, 19 nt, Homo sapiens
ccagggcgacuuuaccauu

SEQ ID NO: 1473617 - RNA, 19 nt, Homo sapiens
gaaggugguggcagagugu

SEQ ID NO: 1473618 - RNA, 19 nt, Homo sapiens
caagcucccugaggacugu

SEQ ID NO: 1473619 - RNA, 19 nt, Homo sapiens
gcgaguggacguccugguu

SEQ ID NO: 1473620 - RNA, 19 nt, Homo sapiens
gcgagcgcgugcacuugaa

SEQ ID NO: 1473621 - RNA, 19 nt, Homo sapiens
gacagcacuuggugacauc

SEQ ID NO: 1473622 - RNA, 19 nt, Homo sapiens
gcacugggccuggaaagac

SEQ ID NO: 1473623 - RNA, 19 nt, Homo sapiens
ccaagaaauacuccugguu

SEQ ID NO: 1473624 - RNA, 19 nt, Homo sapiens
gagaggcuggccagaaugu

SEQ ID NO: 1473625 - RNA, 19 nt, Homo sapiens
agccguaccuggugaaaca

SEQ ID NO: 1473626 - RNA, 19 nt, Homo sapiens
gagcugguccugccuucug

SEQ ID NO: 1473627 - RNA, 19 nt, Homo sapiens
gcuacguccucccagugaa

SEQ ID NO: 1473628 - RNA, 19 nt, Homo sapiens
ggccagcucuacggacuuc

SEQ ID NO: 1473629 - RNA, 19 nt, Homo sapiens
gcuuugaugguuccucuga

SEQ ID NO: 1473630 - RNA, 19 nt, Homo sapiens
gagagaagggagauucacu

SEQ ID NO: 1473631 - RNA, 19 nt, Homo sapiens
caacuauggcgucuacacu

SEQ ID NO: 1473632 - RNA, 19 nt, Homo sapiens
cagccugcguggaguucaa

SEQ ID NO: 1473633 - RNA, 19 nt, Homo sapiens
gcgcaccuacggcauguuc

SEQ ID NO: 1473634 - RNA, 19 nt, Homo sapiens
acuauggcgucuacacugu

SEQ ID NO: 1473635 - RNA, 19 nt, Homo sapiens
ccagugaccugcgcuucgu

SEQ ID NO: 1473636 - RNA, 19 nt, Homo sapiens
gaagccguaccuggugaaa

SEQ ID NO: 1473637 - RNA, 19 nt, Homo sapiens
ggccgcugcuuugaugguu

SEQ ID NO: 1473638 - RNA, 19 nt, Homo sapiens
gcgucuacacugucacuga

SEQ ID NO: 1473639 - RNA, 19 nt, Homo sapiens
uauggcgucuacacuguca

SEQ ID NO: 1473640 - RNA, 19 nt, Homo sapiens
acggacuccuucgggauua

SEQ ID NO: 1473641 - RNA, 19 nt, Homo sapiens
ugaaugcccggaccacauc

SEQ ID NO: 1473642 - RNA, 19 nt, Homo sapiens
ggaagcggaugcccgauua

SEQ ID NO: 1473643 - RNA, 19 nt, Homo sapiens
cagaagacuuugaauugua

SEQ ID NO: 1473644 - RNA, 19 nt, Homo sapiens
ggacacgccuccucacuuc

SEQ ID NO: 1473645 - RNA, 19 nt, Homo sapiens
caacaaaccagaaggaaga

SEQ ID NO: 1473646 - RNA, 19 nt, Homo sapiens
ccaaguauauaaacagguu

SEQ ID NO: 1473647 - RNA, 19 nt, Homo sapiens
gcucuugucuagcuuaaug

SEQ ID NO: 1473648 - RNA, 19 nt, Homo sapiens
caaggaggcugcuaagaag

SEQ ID NO: 1473649 - RNA, 19 nt, Homo sapiens
ccaaggaggcugcuaagaa

SEQ ID NO: 1473650 - RNA, 19 nt, Homo sapiens
gguaauuucucucucuuuc

SEQ ID NO: 1473651 - RNA, 19 nt, Homo sapiens
caagaucuccuuucugguu

SEQ ID NO: 1473652 - RNA, 19 nt, Homo sapiens
gccagaagacuuugaauug

SEQ ID NO: 1473653 - RNA, 19 nt, Homo sapiens
gauagucccuuuggagaug

SEQ ID NO: 1473654 - RNA, 19 nt, Homo sapiens
ccagaagacuuugaauugu

SEQ ID NO: 1473655 - RNA, 19 nt, Homo sapiens
gaaagggguuguuuggaaa

SEQ ID NO: 1473656 - RNA, 19 nt, Homo sapiens
ggacccagccuaaccaugu

SEQ ID NO: 1473657 - RNA, 19 nt, Homo sapiens
cauaggugcucuugucuag

SEQ ID NO: 1473658 - RNA, 19 nt, Homo sapiens
gaucuccuuucugguuaua

SEQ ID NO: 1473659 - RNA, 19 nt, Homo sapiens
aaagacaucucaaauucca

SEQ ID NO: 1473660 - RNA, 19 nt, Homo sapiens
guaguacaauggcaugauc

SEQ ID NO: 1473661 - RNA, 19 nt, Homo sapiens
gauuaucguuccuguugga

SEQ ID NO: 1473662 - RNA, 19 nt, Homo sapiens
ccaccacggucggcuaauu

SEQ ID NO: 1473663 - RNA, 19 nt, Homo sapiens
gacaagacuucuggcaaga

SEQ ID NO: 1473664 - RNA, 19 nt, Homo sapiens
ggaugauggucaggcuaua

SEQ ID NO: 1473665 - RNA, 19 nt, Homo sapiens
aagaucuccuuucugguua

SEQ ID NO: 1473666 - RNA, 19 nt, Homo sapiens
gucuuugacuucugucuuu

SEQ ID NO: 1473667 - RNA, 19 nt, Homo sapiens
agacaucucaaauuccaua

SEQ ID NO: 1473668 - RNA, 19 nt, Homo sapiens
gcuccuaccucaucaccau

SEQ ID NO: 1473669 - RNA, 19 nt, Homo sapiens
cuacuagggucaucagagu

SEQ ID NO: 1473670 - RNA, 19 nt, Homo sapiens
caccagaggccuucuaugu

SEQ ID NO: 1473671 - RNA, 19 nt, Homo sapiens
ggagugccauagugugauc

SEQ ID NO: 1473672 - RNA, 19 nt, Homo sapiens
ccucaaauuucugucugua

SEQ ID NO: 1473673 - RNA, 19 nt, Homo sapiens
gaaaguccaggccacacaa

SEQ ID NO: 1473674 - RNA, 19 nt, Homo sapiens
caucucaaauuccauaggu

SEQ ID NO: 1473675 - RNA, 19 nt, Homo sapiens
gcagagggaguuucagaca

SEQ ID NO: 1473676 - RNA, 19 nt, Homo sapiens
ggccagaagacuuugaauu

SEQ ID NO: 1473677 - RNA, 19 nt, Homo sapiens
ugucucagaucucucuuau

SEQ ID NO: 1473678 - RNA, 19 nt, Homo sapiens
aaagguaauuucucucucu

SEQ ID NO: 1473679 - RNA, 19 nt, Homo sapiens
agaauugcuugaacucaga

SEQ ID NO: 1473680 - RNA, 19 nt, Homo sapiens
ucaaauuucugucuguaac

SEQ ID NO: 1473681 - RNA, 19 nt, Homo sapiens
ccaaagugcugggauugca

SEQ ID NO: 1473682 - RNA, 19 nt, Homo sapiens
cagagggaguuucagacaa

SEQ ID NO: 1473683 - RNA, 19 nt, Homo sapiens
cauucaagauagucccuuu

SEQ ID NO: 1473684 - RNA, 19 nt, Homo sapiens
gcacccacccugauugaca

SEQ ID NO: 1473685 - RNA, 19 nt, Homo sapiens
uaauuucucucucuuucuc

SEQ ID NO: 1473686 - RNA, 19 nt, Homo sapiens
ggcagagguugcaguggaa

SEQ ID NO: 1473687 - RNA, 19 nt, Homo sapiens
caccuuaucuggcuucacu

SEQ ID NO: 1473688 - RNA, 19 nt, Homo sapiens
gggcagagggaguuucaga

SEQ ID NO: 1473689 - RNA, 19 nt, Homo sapiens
ggucaugccaauuuaagga

SEQ ID NO: 1473690 - RNA, 19 nt, Homo sapiens
uuagagcugucuuugacuu

SEQ ID NO: 1473691 - RNA, 19 nt, Homo sapiens
cugauaauccucaaauuuc

SEQ ID NO: 1473692 - RNA, 19 nt, Homo sapiens
ugccagcacuuccucauuc

SEQ ID NO: 1473693 - RNA, 19 nt, Homo sapiens
ccauacagcugucccuacu

SEQ ID NO: 1473694 - RNA, 19 nt, Homo sapiens
uuugguggcugcagucuga

SEQ ID NO: 1473695 - RNA, 19 nt, Homo sapiens
caucuccgccuuuauuuua

SEQ ID NO: 1473696 - RNA, 19 nt, Homo sapiens
ccgagucucugaaagucaa

SEQ ID NO: 1473697 - RNA, 19 nt, Homo sapiens
gcucggcuguucccugaca

SEQ ID NO: 1473698 - RNA, 19 nt, Homo sapiens
gcucaaauggaccaaagga

SEQ ID NO: 1473699 - RNA, 19 nt, Homo sapiens
agagggaguuucagacaag

SEQ ID NO: 1473700 - RNA, 19 nt, Homo sapiens
gauggaguuucacccuugu

SEQ ID NO: 1473701 - RNA, 19 nt, Homo sapiens
ccuuagagcugucuuugac

SEQ ID NO: 1473702 - RNA, 19 nt, Homo sapiens
ucaagauagucccuuugga

SEQ ID NO: 1473703 - RNA, 19 nt, Homo sapiens
caagacuucuggcaagacu

SEQ ID NO: 1473704 - RNA, 19 nt, Homo sapiens
agaaagggguuguuuggaa

SEQ ID NO: 1473705 - RNA, 19 nt, Homo sapiens
gcuaagaagggaaggagau

SEQ ID NO: 1473706 - RNA, 19 nt, Homo sapiens
gagcaggcaaccacaguca

SEQ ID NO: 1473707 - RNA, 19 nt, Homo sapiens
agaagacuuugaauuguac

SEQ ID NO: 1473708 - RNA, 19 nt, Homo sapiens
gggaagcggaugcccgauu

SEQ ID NO: 1473709 - RNA, 19 nt, Homo sapiens
agcagaaccuccacacaug

SEQ ID NO: 1473710 - RNA, 19 nt, Homo sapiens
gacuuugaauuguacagau

SEQ ID NO: 1473711 - RNA, 19 nt, Homo sapiens
caaggccgagucucugaaa

SEQ ID NO: 1473712 - RNA, 19 nt, Homo sapiens
caccacggucggcuaauuu

SEQ ID NO: 1473713 - RNA, 19 nt, Homo sapiens
gcguugacaucucuaucug

SEQ ID NO: 1473714 - RNA, 19 nt, Homo sapiens
gagggaguuucagacaaga

SEQ ID NO: 1473715 - RNA, 19 nt, Homo sapiens
ucaugccaauuuaaggaaa

SEQ ID NO: 1473716 - RNA, 19 nt, Homo sapiens
caacuccccugagcuguuu

SEQ ID NO: 1473717 - RNA, 19 nt, Homo sapiens
uagcacaucugggcucuac

SEQ ID NO: 1473718 - RNA, 19 nt, Homo sapiens
uaguagagacgguguuuca

SEQ ID NO: 1473719 - RNA, 19 nt, Homo sapiens
gugcucuugucuagcuuaa

SEQ ID NO: 1473720 - RNA, 19 nt, Homo sapiens
gugguggccaaguauauaa

SEQ ID NO: 1473721 - RNA, 19 nt, Homo sapiens
gggaagcaagggugacaga

SEQ ID NO: 1473722 - RNA, 19 nt, Homo sapiens
gauggccucucucccuucu

SEQ ID NO: 1473723 - RNA, 19 nt, Homo sapiens
ccugccaucuccgccuuua

SEQ ID NO: 1473724 - RNA, 19 nt, Homo sapiens
agacgguguuucacugugu

SEQ ID NO: 1473725 - RNA, 19 nt, Homo sapiens
ccacggaggaagcuacuag

SEQ ID NO: 1473726 - RNA, 19 nt, Homo sapiens
caaggggucaugccaauuu

SEQ ID NO: 1473727 - RNA, 19 nt, Homo sapiens
gacgguguuucacuguguu

SEQ ID NO: 1473728 - RNA, 19 nt, Homo sapiens
gguccuaaauggaguuucc

SEQ ID NO: 1473729 - RNA, 19 nt, Homo sapiens
ucacuagcccagcauguca

SEQ ID NO: 1473730 - RNA, 19 nt, Homo sapiens
ggccgagucucugaaaguc

SEQ ID NO: 1473731 - RNA, 19 nt, Homo sapiens
ugccaucuccgccuuuauu

SEQ ID NO: 1473732 - RNA, 19 nt, Homo sapiens
gagcugucuuugacuucug

SEQ ID NO: 1473733 - RNA, 19 nt, Homo sapiens
caacuuucuucggcucugu

SEQ ID NO: 1473734 - RNA, 19 nt, Homo sapiens
gauaauccucaaauuucug

SEQ ID NO: 1473735 - RNA, 19 nt, Homo sapiens
ggaagcuacuagggucauc

SEQ ID NO: 1473736 - RNA, 19 nt, Homo sapiens
cagcacccacccugauuga

SEQ ID NO: 1473737 - RNA, 19 nt, Homo sapiens
gagcugagucggcagaaaa

SEQ ID NO: 1473738 - RNA, 19 nt, Homo sapiens
ggccagaggaugacauucu

SEQ ID NO: 1473739 - RNA, 19 nt, Homo sapiens
aagcagaaccuccacacau

SEQ ID NO: 1473740 - RNA, 19 nt, Homo sapiens
acccauaggugcucuuguc

SEQ ID NO: 1473741 - RNA, 19 nt, Homo sapiens
uaucugcacccacccauag

SEQ ID NO: 1473742 - RNA, 19 nt, Homo sapiens
ggagaaaccuuaugaaugu

SEQ ID NO: 1473743 - RNA, 19 nt, Homo sapiens
gcggagagcugguuaauga

SEQ ID NO: 1473744 - RNA, 19 nt, Homo sapiens
ggaaauccuucacaaguaa

SEQ ID NO: 1473745 - RNA, 19 nt, Homo sapiens
gaucuuaccuuacuauuca

SEQ ID NO: 1473746 - RNA, 19 nt, Homo sapiens
uuaagggacuugagaauua

SEQ ID NO: 1473747 - RNA, 19 nt, Homo sapiens
acaaguaacuccuaucuuu

SEQ ID NO: 1473748 - RNA, 19 nt, Homo sapiens
ggaaacagauaacucagaa

SEQ ID NO: 1473749 - RNA, 19 nt, Homo sapiens
cagcuuaucucuguaguua

SEQ ID NO: 1473750 - RNA, 19 nt, Homo sapiens
ucacuagggugucguguua

SEQ ID NO: 1473751 - RNA, 19 nt, Homo sapiens
ggaaagcacucauugaucu

SEQ ID NO: 1473752 - RNA, 19 nt, Homo sapiens
gagaaagccuucagugaug

SEQ ID NO: 1473753 - RNA, 19 nt, Homo sapiens
gggaaauccuucacaagua

SEQ ID NO: 1473754 - RNA, 19 nt, Homo sapiens
gaacaacacucagaaaugc

SEQ ID NO: 1473755 - RNA, 19 nt, Homo sapiens
gaaauagcauucaguaacu

SEQ ID NO: 1473756 - RNA, 19 nt, Homo sapiens
ucacaugccuggaaaguug

SEQ ID NO: 1473757 - RNA, 19 nt, Homo sapiens
guguauagcuguucccuaa

SEQ ID NO: 1473758 - RNA, 19 nt, Homo sapiens
caucuaacaucuuuacuga

SEQ ID NO: 1473759 - RNA, 19 nt, Homo sapiens
gggaaagccuugaauguuc

SEQ ID NO: 1473760 - RNA, 19 nt, Homo sapiens
gaaaguugauguugguugu

SEQ ID NO: 1473761 - RNA, 19 nt, Homo sapiens
gggaaauccuucagcagua

SEQ ID NO: 1473762 - RNA, 19 nt, Homo sapiens
ccaagcaccuguccagauu

SEQ ID NO: 1473763 - RNA, 19 nt, Homo sapiens
ccaaaugguuaacuccuaa

SEQ ID NO: 1473764 - RNA, 19 nt, Homo sapiens
caagaugacuuauucacau

SEQ ID NO: 1473765 - RNA, 19 nt, Homo sapiens
gaucaggaauucaagaaca

SEQ ID NO: 1473766 - RNA, 19 nt, Homo sapiens
ccagagcgcugcgggauaa

SEQ ID NO: 1473767 - RNA, 19 nt, Homo sapiens
gagagaauccugaagaaug

SEQ ID NO: 1473768 - RNA, 19 nt, Homo sapiens
caucauccuucuacucuaa

SEQ ID NO: 1473769 - RNA, 19 nt, Homo sapiens
agaagcaucugggaaauuu

SEQ ID NO: 1473770 - RNA, 19 nt, Homo sapiens
caacacaccaauccugaua

SEQ ID NO: 1473771 - RNA, 19 nt, Homo sapiens
uaauaaacccagucugaua

SEQ ID NO: 1473772 - RNA, 19 nt, Homo sapiens
gaauggaacagcuguagaa

SEQ ID NO: 1473773 - RNA, 19 nt, Homo sapiens
caggaucucucaugccuuu

SEQ ID NO: 1473774 - RNA, 19 nt, Homo sapiens
gaagaaggaugggaaggau

SEQ ID NO: 1473775 - RNA, 19 nt, Homo sapiens
ccaaagcuauagucaucua

SEQ ID NO: 1473776 - RNA, 19 nt, Homo sapiens
gaagagcuccuaucugaca

SEQ ID NO: 1473777 - RNA, 19 nt, Homo sapiens
ggagaaacccuaugaaugc

SEQ ID NO: 1473778 - RNA, 19 nt, Homo sapiens
acaagaagguggugacaga

SEQ ID NO: 1473779 - RNA, 19 nt, Homo sapiens
gaacuugcauuugaagaag

SEQ ID NO: 1473780 - RNA, 19 nt, Homo sapiens
ggaacaacacucagaaaug

SEQ ID NO: 1473781 - RNA, 19 nt, Homo sapiens
uuaaugagcuccugacaag

SEQ ID NO: 1473782 - RNA, 19 nt, Homo sapiens
gaagaaacacuuaagaacu

SEQ ID NO: 1473783 - RNA, 19 nt, Homo sapiens
cauaagagaauccauaaug

SEQ ID NO: 1473784 - RNA, 19 nt, Homo sapiens
gaaagaggaauucuaccaa

SEQ ID NO: 1473785 - RNA, 19 nt, Homo sapiens
ggaauacccugcagcaaaa

SEQ ID NO: 1473786 - RNA, 19 nt, Homo sapiens
gaacaguccacuuccaaga

SEQ ID NO: 1473787 - RNA, 19 nt, Homo sapiens
uaagggacuugagaauuaa

SEQ ID NO: 1473788 - RNA, 19 nt, Homo sapiens
ggaauucaagaacagcuua

SEQ ID NO: 1473789 - RNA, 19 nt, Homo sapiens
gggagaaaccuuaugaaug

SEQ ID NO: 1473790 - RNA, 19 nt, Homo sapiens
aguagcagaucuuaccuua

SEQ ID NO: 1473791 - RNA, 19 nt, Homo sapiens
gaugucagccaaagcuaua

SEQ ID NO: 1473792 - RNA, 19 nt, Homo sapiens
gggaaagcauuuagugauc

SEQ ID NO: 1473793 - RNA, 19 nt, Homo sapiens
ccacuuccaagaugacuua

SEQ ID NO: 1473794 - RNA, 19 nt, Homo sapiens
gaggaaagcacucauugau

SEQ ID NO: 1473795 - RNA, 19 nt, Homo sapiens
gaaacccuaugaaugcaau

SEQ ID NO: 1473796 - RNA, 19 nt, Homo sapiens
gggagaaacccuaugaaug

SEQ ID NO: 1473797 - RNA, 19 nt, Homo sapiens
gccaaaugguuaacuccua

SEQ ID NO: 1473798 - RNA, 19 nt, Homo sapiens
guuaauaaacccagucuga

SEQ ID NO: 1473799 - RNA, 19 nt, Homo sapiens
ggaaagccuugaauguucu

SEQ ID NO: 1473800 - RNA, 19 nt, Homo sapiens
uaaguucucgccaagguua

SEQ ID NO: 1473801 - RNA, 19 nt, Homo sapiens
ggaacuugcauuugaagaa

SEQ ID NO: 1473802 - RNA, 19 nt, Homo sapiens
agugaucccucaucccuua

SEQ ID NO: 1473803 - RNA, 19 nt, Homo sapiens
uagcagaucuuaccuuacu

SEQ ID NO: 1473804 - RNA, 19 nt, Homo sapiens
gagaauucauacuggagaa

SEQ ID NO: 1473805 - RNA, 19 nt, Homo sapiens
ggaaauccuucagcaguag

SEQ ID NO: 1473806 - RNA, 19 nt, Homo sapiens
gagaaucaccaugaaugua

SEQ ID NO: 1473807 - RNA, 19 nt, Homo sapiens
acugcuggcucauuaauuu

SEQ ID NO: 1473808 - RNA, 19 nt, Homo sapiens
gaacaucaucaauauugga

SEQ ID NO: 1473809 - RNA, 19 nt, Homo sapiens
ucacuuauuuccuauugug

SEQ ID NO: 1473810 - RNA, 19 nt, Homo sapiens
aauaaucucucagcuguga

SEQ ID NO: 1473811 - RNA, 19 nt, Homo sapiens
caaugaauguaaucagugu

SEQ ID NO: 1473812 - RNA, 19 nt, Homo sapiens
gcucacacuggauauauaa

SEQ ID NO: 1473813 - RNA, 19 nt, Homo sapiens
ggaggaaagcacucauuga

SEQ ID NO: 1473814 - RNA, 19 nt, Homo sapiens
uaacucagcacaagagaau

SEQ ID NO: 1473815 - RNA, 19 nt, Homo sapiens
aggacaaucuguaugguaa

SEQ ID NO: 1473816 - RNA, 19 nt, Homo sapiens
gccauggaauuaaugaaga

SEQ ID NO: 1473817 - RNA, 19 nt, Homo sapiens
gcucucagcucgaauucuc

SEQ ID NO: 1473818 - RNA, 19 nt, Homo sapiens
gaaucaccaugaauguaau

SEQ ID NO: 1473819 - RNA, 19 nt, Homo sapiens
agaaucaccaugaauguaa

SEQ ID NO: 1473820 - RNA, 19 nt, Homo sapiens
cagcacaagagaauucaua

SEQ ID NO: 1473821 - RNA, 19 nt, Homo sapiens
gaaaucacacaauggaaca

SEQ ID NO: 1473822 - RNA, 19 nt, Homo sapiens
caagguuagugauccaaga

SEQ ID NO: 1473823 - RNA, 19 nt, Homo sapiens
cuuccaagaugacuuauuc

SEQ ID NO: 1473824 - RNA, 19 nt, Homo sapiens
gcaggaacuucuggaggaa

SEQ ID NO: 1473825 - RNA, 19 nt, Homo sapiens
gguuaacuccuaagaagaa

SEQ ID NO: 1473826 - RNA, 19 nt, Homo sapiens
ggaaagaggaauucuacca

SEQ ID NO: 1473827 - RNA, 19 nt, Homo sapiens
gggaugugaugcuggagaa

SEQ ID NO: 1473828 - RNA, 19 nt, Homo sapiens
gaggacaaucuguauggua

SEQ ID NO: 1473829 - RNA, 19 nt, Homo sapiens
caggaggacugcuaagcuu

SEQ ID NO: 1473830 - RNA, 19 nt, Homo sapiens
ucucaugccuuuacuuaca

SEQ ID NO: 1473831 - RNA, 19 nt, Homo sapiens
aagaaacacuuaagaacuc

SEQ ID NO: 1473832 - RNA, 19 nt, Homo sapiens
gugaagaaacacuuaagaa

SEQ ID NO: 1473833 - RNA, 19 nt, Homo sapiens
ucucucagcugugaagaaa

SEQ ID NO: 1473834 - RNA, 19 nt, Homo sapiens
uaaccuaacucagcacaag

SEQ ID NO: 1473835 - RNA, 19 nt, Homo sapiens
cagcaaaaguguucacauu

SEQ ID NO: 1473836 - RNA, 19 nt, Homo sapiens
cggaauacccugcagcaaa

SEQ ID NO: 1473837 - RNA, 19 nt, Homo sapiens
caccaauccugauacaaug

SEQ ID NO: 1473838 - RNA, 19 nt, Homo sapiens
ggagaaucaccaugaaugu

SEQ ID NO: 1473839 - RNA, 19 nt, Homo sapiens
gggagaaucaccaugaaug

SEQ ID NO: 1473840 - RNA, 19 nt, Homo sapiens
agacugcauuugagaauuc

SEQ ID NO: 1473841 - RNA, 19 nt, Homo sapiens
gaaaagaacagucuaaagg

SEQ ID NO: 1473842 - RNA, 19 nt, Homo sapiens
gagaggggcugacacuuua

SEQ ID NO: 1473843 - RNA, 19 nt, Homo sapiens
ccacuucuguauacauaaa

SEQ ID NO: 1473844 - RNA, 19 nt, Homo sapiens
caaggugugugcccggaaa

SEQ ID NO: 1473845 - RNA, 19 nt, Homo sapiens
ccacugcuuucuaguccuu

SEQ ID NO: 1473846 - RNA, 19 nt, Homo sapiens
ucuaguccuuuaacuccua

SEQ ID NO: 1473847 - RNA, 19 nt, Homo sapiens
acgcggaccucgagcugaa

SEQ ID NO: 1473848 - RNA, 19 nt, Homo sapiens
ggaggggccugugccaaaa

SEQ ID NO: 1473849 - RNA, 19 nt, Homo sapiens
gcgagaugcccgugcugaa

SEQ ID NO: 1473850 - RNA, 19 nt, Homo sapiens
gcaccccacuucuguauac

SEQ ID NO: 1473851 - RNA, 19 nt, Homo sapiens
auacauaaacggccaaggu

SEQ ID NO: 1473852 - RNA, 19 nt, Homo sapiens
cgagaggggcugacacuuu

SEQ ID NO: 1473853 - RNA, 19 nt, Homo sapiens
acuccuagaggcaaacuuu

SEQ ID NO: 1473854 - RNA, 19 nt, Homo sapiens
gagagaaacucaaugaaua

SEQ ID NO: 1473855 - RNA, 19 nt, Homo sapiens
gaaagcauuuguacuagaa

SEQ ID NO: 1473856 - RNA, 19 nt, Homo sapiens
ggagagaaauccuacaaau

SEQ ID NO: 1473857 - RNA, 19 nt, Homo sapiens
caucagagauuucauacuu

SEQ ID NO: 1473858 - RNA, 19 nt, Homo sapiens
gagaaacucuacaaaccua

SEQ ID NO: 1473859 - RNA, 19 nt, Homo sapiens
ucacaaaccuuacuacaca

SEQ ID NO: 1473860 - RNA, 19 nt, Homo sapiens
cuacaaaugugaagaaugu

SEQ ID NO: 1473861 - RNA, 19 nt, Homo sapiens
gaagagaaaccauacaaau

SEQ ID NO: 1473862 - RNA, 19 nt, Homo sapiens
cuacaaaugugaagaaugu

SEQ ID NO: 1473863 - RNA, 19 nt, Homo sapiens
cuacaaaugugaagaaugu

SEQ ID NO: 1473864 - RNA, 19 nt, Homo sapiens
ggagaaaucguacauaugu

SEQ ID NO: 1473865 - RNA, 19 nt, Homo sapiens
gauccucaaucuuuacuaa

SEQ ID NO: 1473866 - RNA, 19 nt, Homo sapiens
gagagaaacccuacaaaug

SEQ ID NO: 1473867 - RNA, 19 nt, Homo sapiens
gagagaaacccuacaaaug

SEQ ID NO: 1473868 - RNA, 19 nt, Homo sapiens
cuacaaacgugaagaaugu

SEQ ID NO: 1473869 - RNA, 19 nt, Homo sapiens
cuacaaacgugaagaaugu

SEQ ID NO: 1473870 - RNA, 19 nt, Homo sapiens
caacaucagagauuucaua

SEQ ID NO: 1473871 - RNA, 19 nt, Homo sapiens
ggaaagcauuuguacuaga

SEQ ID NO: 1473872 - RNA, 19 nt, Homo sapiens
ggugagaaaucuuagaaau

SEQ ID NO: 1473873 - RNA, 19 nt, Homo sapiens
uggcaaagcuucuaaccaa

SEQ ID NO: 1473874 - RNA, 19 nt, Homo sapiens
gagaaacccuacaaaugug

SEQ ID NO: 1473875 - RNA, 19 nt, Homo sapiens
gagaaacccuacaaaugug

SEQ ID NO: 1473876 - RNA, 19 nt, Homo sapiens
cuacaaaugugaagacugu

SEQ ID NO: 1473877 - RNA, 19 nt, Homo sapiens
caggaaagcauuuguacua

SEQ ID NO: 1473878 - RNA, 19 nt, Homo sapiens
gcacaggaaagcauuugua

SEQ ID NO: 1473879 - RNA, 19 nt, Homo sapiens
ccaguuauuuguucucauu

SEQ ID NO: 1473880 - RNA, 19 nt, Homo sapiens
gaaauuaugcuggugagaa

SEQ ID NO: 1473881 - RNA, 19 nt, Homo sapiens
gagaaacccuaccaaugug

SEQ ID NO: 1473882 - RNA, 19 nt, Homo sapiens
gagagaaacccuaccaaug

SEQ ID NO: 1473883 - RNA, 19 nt, Homo sapiens
gagaaacccuaccaaugug

SEQ ID NO: 1473884 - RNA, 19 nt, Homo sapiens
gagagaaacccuaccaaug

SEQ ID NO: 1473885 - RNA, 19 nt, Homo sapiens
gagaaacccuacacaugug

SEQ ID NO: 1473886 - RNA, 19 nt, Homo sapiens
gagagaaacccuacacaug

SEQ ID NO: 1473887 - RNA, 19 nt, Homo sapiens
uaauggauccucaaucuuu

SEQ ID NO: 1473888 - RNA, 19 nt, Homo sapiens
ccucaaaccuuacugaaca

SEQ ID NO: 1473889 - RNA, 19 nt, Homo sapiens
ggagagaaacccuacaaau

SEQ ID NO: 1473890 - RNA, 19 nt, Homo sapiens
ggagagaaacccuacaaau

SEQ ID NO: 1473891 - RNA, 19 nt, Homo sapiens
aaccaaugcucacaccuua

SEQ ID NO: 1473892 - RNA, 19 nt, Homo sapiens
guucacaucuuacucaaca

SEQ ID NO: 1473893 - RNA, 19 nt, Homo sapiens
uggcaaagcuuucuaucga

SEQ ID NO: 1473894 - RNA, 19 nt, Homo sapiens
agacauaagagcauucaua

SEQ ID NO: 1473895 - RNA, 19 nt, Homo sapiens
ucucaaaccuuacuacaca

SEQ ID NO: 1473896 - RNA, 19 nt, Homo sapiens
gagaaaccauacaaaugug

SEQ ID NO: 1473897 - RNA, 19 nt, Homo sapiens
aaauuaugcuggugagaaa

SEQ ID NO: 1473898 - RNA, 19 nt, Homo sapiens
gagaaauccuacaaaugug

SEQ ID NO: 1473899 - RNA, 19 nt, Homo sapiens
agagaaauccuacaaaugu

SEQ ID NO: 1473900 - RNA, 19 nt, Homo sapiens
ggacauaagguaagacaca

SEQ ID NO: 1473901 - RNA, 19 nt, Homo sapiens
gagacaaacucuacaaacg

SEQ ID NO: 1473902 - RNA, 19 nt, Homo sapiens
aaagagccuuggauuagaa

SEQ ID NO: 1473903 - RNA, 19 nt, Homo sapiens
gagagaaauccuacaaaug

SEQ ID NO: 1473904 - RNA, 19 nt, Homo sapiens
cauaagagcauucauacug

SEQ ID NO: 1473905 - RNA, 19 nt, Homo sapiens
caccagagcagaacauaaa

SEQ ID NO: 1473906 - RNA, 19 nt, Homo sapiens
cuaccaaugugaagaaugu

SEQ ID NO: 1473907 - RNA, 19 nt, Homo sapiens
aaccaguucucaaaccuua

SEQ ID NO: 1473908 - RNA, 19 nt, Homo sapiens
aaccaauccucaaaccuua

SEQ ID NO: 1473909 - RNA, 19 nt, Homo sapiens
agagaaacccuacaaaugu

SEQ ID NO: 1473910 - RNA, 19 nt, Homo sapiens
agagaaacccuacaaaugu

SEQ ID NO: 1473911 - RNA, 19 nt, Homo sapiens
ccagagagaaacucaauga

SEQ ID NO: 1473912 - RNA, 19 nt, Homo sapiens
ggagagaaacccuaccaau

SEQ ID NO: 1473913 - RNA, 19 nt, Homo sapiens
ggagagaaacccuaccaau

SEQ ID NO: 1473914 - RNA, 19 nt, Homo sapiens
auaauggacuuaaccaaug

SEQ ID NO: 1473915 - RNA, 19 nt, Homo sapiens
ucaccugucuggaacaaga

SEQ ID NO: 1473916 - RNA, 19 nt, Homo sapiens
aaccaguccucaaaccuua

SEQ ID NO: 1473917 - RNA, 19 nt, Homo sapiens
agagaaacccuaccaaugu

SEQ ID NO: 1473918 - RNA, 19 nt, Homo sapiens
agagaaacccuaccaaugu

SEQ ID NO: 1473919 - RNA, 19 nt, Homo sapiens
aaccaguccucaauccuua

SEQ ID NO: 1473920 - RNA, 19 nt, Homo sapiens
gagcauucauacuggagaa

SEQ ID NO: 1473921 - RNA, 19 nt, Homo sapiens
aauggauccucaaucuuua

SEQ ID NO: 1473922 - RNA, 19 nt, Homo sapiens
gaaacucuacaaaccuaaa

SEQ ID NO: 1473923 - RNA, 19 nt, Homo sapiens
ccucacaccuuacuagaca

SEQ ID NO: 1473924 - RNA, 19 nt, Homo sapiens
ccucacaccuuacuagaca

SEQ ID NO: 1473925 - RNA, 19 nt, Homo sapiens
ccucacaccuuacuacaca

SEQ ID NO: 1473926 - RNA, 19 nt, Homo sapiens
ggacuuaaccaauguuugc

SEQ ID NO: 1473927 - RNA, 19 nt, Homo sapiens
aaccaguccucacaccuua

SEQ ID NO: 1473928 - RNA, 19 nt, Homo sapiens
agagaaaccauacaaaugu

SEQ ID NO: 1473929 - RNA, 19 nt, Homo sapiens
uaaccaauccucaaaccuu

SEQ ID NO: 1473930 - RNA, 19 nt, Homo sapiens
aaccaguccucacaccuua

SEQ ID NO: 1473931 - RNA, 19 nt, Homo sapiens
aaccaguccucacaccuua

SEQ ID NO: 1473932 - RNA, 19 nt, Homo sapiens
gaacaugagaauuuacagu

SEQ ID NO: 1473933 - RNA, 19 nt, Homo sapiens
ccaaugcucacaccuuauu

SEQ ID NO: 1473934 - RNA, 19 nt, Homo sapiens
cuauaagugugaagaaugu

SEQ ID NO: 1473935 - RNA, 19 nt, Homo sapiens
cauaagagaauucauacug

SEQ ID NO: 1473936 - RNA, 19 nt, Homo sapiens
cauaagagaauucauacug

SEQ ID NO: 1473937 - RNA, 19 nt, Homo sapiens
gcaaagcuucuaaccaauc

SEQ ID NO: 1473938 - RNA, 19 nt, Homo sapiens
gagcagaacauaaaagauu

SEQ ID NO: 1473939 - RNA, 19 nt, Homo sapiens
aggcaguccucacaccuua

SEQ ID NO: 1473940 - RNA, 19 nt, Homo sapiens
ccucacaccuuaccagaca

SEQ ID NO: 1473941 - RNA, 19 nt, Homo sapiens
ccucacaccuuaccagaca

SEQ ID NO: 1473942 - RNA, 19 nt, Homo sapiens
ucacacauuacaacacaua

SEQ ID NO: 1473943 - RNA, 19 nt, Homo sapiens
gagaaaucguacauaugug

SEQ ID NO: 1473944 - RNA, 19 nt, Homo sapiens
agagaaacccuacacaugu

SEQ ID NO: 1473945 - RNA, 19 nt, Homo sapiens
ggagagaaacccuacacau

SEQ ID NO: 1473946 - RNA, 19 nt, Homo sapiens
gaucaccugucuggaacaa

SEQ ID NO: 1473947 - RNA, 19 nt, Homo sapiens
ucaaaccuaacucaacaua

SEQ ID NO: 1473948 - RNA, 19 nt, Homo sapiens
cacauaagguaauucauac

SEQ ID NO: 1473949 - RNA, 19 nt, Homo sapiens
gagagaaucccuacaaacg

SEQ ID NO: 1473950 - RNA, 19 nt, Homo sapiens
caaagccuguaaccaguuc

SEQ ID NO: 1473951 - RNA, 19 nt, Homo sapiens
ugaagaauguggcaaagcu

SEQ ID NO: 1473952 - RNA, 19 nt, Homo sapiens
aaaaggagguuauaaugga

SEQ ID NO: 1473953 - RNA, 19 nt, Homo sapiens
gaaauccuacaaaugugaa

SEQ ID NO: 1473954 - RNA, 19 nt, Homo sapiens
caagagcucaguuuauuaa

SEQ ID NO: 1473955 - RNA, 19 nt, Homo sapiens
gcaagagcucaguuuauua

SEQ ID NO: 1473956 - RNA, 19 nt, Homo sapiens
gcacauagacagcgaugaa

SEQ ID NO: 1473957 - RNA, 19 nt, Homo sapiens
acauaaagcuuucgugugu

SEQ ID NO: 1473958 - RNA, 19 nt, Homo sapiens
ccaguucccuucaggauga

SEQ ID NO: 1473959 - RNA, 19 nt, Homo sapiens
gcacucgccuguccacuuc

SEQ ID NO: 1473960 - RNA, 19 nt, Homo sapiens
ggaagaggauagggacauu

SEQ ID NO: 1473961 - RNA, 19 nt, Homo sapiens
ggaucgagguguuaacugu

SEQ ID NO: 1473962 - RNA, 19 nt, Homo sapiens
gaggauagggacauuauug

SEQ ID NO: 1473963 - RNA, 19 nt, Homo sapiens
cauuauugcuguacuguga

SEQ ID NO: 1473964 - RNA, 19 nt, Homo sapiens
ugcaagagcucaguuuauu

SEQ ID NO: 1473965 - RNA, 19 nt, Homo sapiens
gcugggcccugcacauaaa

SEQ ID NO: 1473966 - RNA, 19 nt, Homo sapiens
guucauccgucgucucauu

SEQ ID NO: 1473967 - RNA, 19 nt, Homo sapiens
gaagaggauagggacauua

SEQ ID NO: 1473968 - RNA, 19 nt, Homo sapiens
ggacauuauugcuguacug

SEQ ID NO: 1473969 - RNA, 19 nt, Homo sapiens
agucauagcuuuccuuguc

SEQ ID NO: 1473970 - RNA, 19 nt, Homo sapiens
aauagcaacuugaguggaa

SEQ ID NO: 1473971 - RNA, 19 nt, Homo sapiens
cauccuaaauagcaacuug

SEQ ID NO: 1473972 - RNA, 19 nt, Homo sapiens
ggcagaggauccaguguuc

SEQ ID NO: 1473973 - RNA, 19 nt, Homo sapiens
gggcugugcucccugaagu

SEQ ID NO: 1473974 - RNA, 19 nt, Homo sapiens
ucacuggucaugcuucuga

SEQ ID NO: 1473975 - RNA, 19 nt, Homo sapiens
cagcuuuguuucuugaaug

SEQ ID NO: 1473976 - RNA, 19 nt, Homo sapiens
caagccacguugaucuuca

SEQ ID NO: 1473977 - RNA, 19 nt, Homo sapiens
ggacuucucacuggucaug

SEQ ID NO: 1473978 - RNA, 19 nt, Homo sapiens
ggcggagggucuugccaaa

SEQ ID NO: 1473979 - RNA, 19 nt, Homo sapiens
gaauguggaagauguuucu

SEQ ID NO: 1473980 - RNA, 19 nt, Homo sapiens
caaugcaagagcucaguuu

SEQ ID NO: 1473981 - RNA, 19 nt, Homo sapiens
gcaaugcaagagcucaguu

SEQ ID NO: 1473982 - RNA, 19 nt, Homo sapiens
cagccagcuuuguuucuug

SEQ ID NO: 1473983 - RNA, 19 nt, Homo sapiens
auaaagcuuucgugugugu

SEQ ID NO: 1473984 - RNA, 19 nt, Homo sapiens
ggaggaccgcugugaguca

SEQ ID NO: 1473985 - RNA, 19 nt, Homo sapiens
ucucauucaugccgaguug

SEQ ID NO: 1473986 - RNA, 19 nt, Homo sapiens
gcccugcacauaaagcuuu

SEQ ID NO: 1473987 - RNA, 19 nt, Homo sapiens
aagagaagcagcccugaga

SEQ ID NO: 1473988 - RNA, 19 nt, Homo sapiens
gguguuaacugugauucca

SEQ ID NO: 1473989 - RNA, 19 nt, Homo sapiens
ccacaagccacguugaucu

SEQ ID NO: 1473990 - RNA, 19 nt, Homo sapiens
cuuauucccugaagaaagg

SEQ ID NO: 1473991 - RNA, 19 nt, Homo sapiens
aaugcaagagcucaguuua

SEQ ID NO: 1473992 - RNA, 19 nt, Homo sapiens
cggagggucuugccaaagg

SEQ ID NO: 1473993 - RNA, 19 nt, Homo sapiens
ccacugggguucuggaaga

SEQ ID NO: 1473994 - RNA, 19 nt, Homo sapiens
gcgagugcccacccaaugu

SEQ ID NO: 1473995 - RNA, 19 nt, Homo sapiens
ccagcuuuguuucuugaau

SEQ ID NO: 1473996 - RNA, 19 nt, Homo sapiens
ggugauggcggcaggcaau

SEQ ID NO: 1473997 - RNA, 19 nt, Homo sapiens
ccacagccagcuuuguuuc

SEQ ID NO: 1473998 - RNA, 19 nt, Homo sapiens
acagccagcuuuguuucuu

SEQ ID NO: 1473999 - RNA, 19 nt, Homo sapiens
gcaccagccacagcuccua

SEQ ID NO: 1474000 - RNA, 19 nt, Homo sapiens
uuauugcuguacugugauu

SEQ ID NO: 1474001 - RNA, 19 nt, Homo sapiens
aagaggauagggacauuau

SEQ ID NO: 1474002 - RNA, 19 nt, Homo sapiens
cggcagaggauccaguguu

SEQ ID NO: 1474003 - RNA, 19 nt, Homo sapiens
guguugggaucgagguguu

SEQ ID NO: 1474004 - RNA, 19 nt, Homo sapiens
uagggacauuauugcugua

SEQ ID NO: 1474005 - RNA, 19 nt, Homo sapiens
ggcugggcccugcacauaa

SEQ ID NO: 1474006 - RNA, 19 nt, Homo sapiens
aggcugggcccugcacaua

SEQ ID NO: 1474007 - RNA, 19 nt, Homo sapiens
ggauagagauggugaauuu

SEQ ID NO: 1474008 - RNA, 19 nt, Homo sapiens
ugaaggaaaugucuacuua

SEQ ID NO: 1474009 - RNA, 19 nt, Homo sapiens
ggaaaugucuacuuagcua

SEQ ID NO: 1474010 - RNA, 19 nt, Homo sapiens
uaacgauccuuucuacuuu

SEQ ID NO: 1474011 - RNA, 19 nt, Homo sapiens
ccaagaagcauaugaguuu

SEQ ID NO: 1474012 - RNA, 19 nt, Homo sapiens
uuaaagaccuggaaggaaa

SEQ ID NO: 1474013 - RNA, 19 nt, Homo sapiens
ccacacacuuugauauuug

SEQ ID NO: 1474014 - RNA, 19 nt, Homo sapiens
caagaagcauaugaguuua

SEQ ID NO: 1474015 - RNA, 19 nt, Homo sapiens
ggccauggcucuuugauag

SEQ ID NO: 1474016 - RNA, 19 nt, Homo sapiens
gguuagauguucucuguug

SEQ ID NO: 1474017 - RNA, 19 nt, Homo sapiens
cauguucgcucuuuauuuc

SEQ ID NO: 1474018 - RNA, 19 nt, Homo sapiens
ucaagucucuacuggaauu

SEQ ID NO: 1474019 - RNA, 19 nt, Homo sapiens
cuacuuagcuagacauagu

SEQ ID NO: 1474020 - RNA, 19 nt, Homo sapiens
aaugaacgcuugaaggaaa

SEQ ID NO: 1474021 - RNA, 19 nt, Homo sapiens
guaccaccaugaauaguug

SEQ ID NO: 1474022 - RNA, 19 nt, Homo sapiens
ccaccuggauucacuguug

SEQ ID NO: 1474023 - RNA, 19 nt, Homo sapiens
gaagagcugguuccgaauu

SEQ ID NO: 1474024 - RNA, 19 nt, Homo sapiens
ggaauuggauagagauggu

SEQ ID NO: 1474025 - RNA, 19 nt, Homo sapiens
ucucaagucucuacuggaa

SEQ ID NO: 1474026 - RNA, 19 nt, Homo sapiens
ggagacgacugggaacuuc

SEQ ID NO: 1474027 - RNA, 19 nt, Homo sapiens
gcucuuuauuuccuaugua

SEQ ID NO: 1474028 - RNA, 19 nt, Homo sapiens
gguaaacagugcugcaucu

SEQ ID NO: 1474029 - RNA, 19 nt, Homo sapiens
gcaagaaugccuguacaug

SEQ ID NO: 1474030 - RNA, 19 nt, Homo sapiens
gcaccagcuugcaggagaa

SEQ ID NO: 1474031 - RNA, 19 nt, Homo sapiens
ucaccauguucgcucuuua

SEQ ID NO: 1474032 - RNA, 19 nt, Homo sapiens
cagaguagcgguugagguu

SEQ ID NO: 1474033 - RNA, 19 nt, Homo sapiens
ccaauucaacacuccauuu

SEQ ID NO: 1474034 - RNA, 19 nt, Homo sapiens
ccguagaaauuauccuuga

SEQ ID NO: 1474035 - RNA, 19 nt, Homo sapiens
uggguuagauguucucugu

SEQ ID NO: 1474036 - RNA, 19 nt, Homo sapiens
gaaggaaaugucuacuuag

SEQ ID NO: 1474037 - RNA, 19 nt, Homo sapiens
ccuauguaauucucuauuc

SEQ ID NO: 1474038 - RNA, 19 nt, Homo sapiens
ucaucacguuggaaaguuu

SEQ ID NO: 1474039 - RNA, 19 nt, Homo sapiens
gccuguacaugcccaagaa

SEQ ID NO: 1474040 - RNA, 19 nt, Homo sapiens
aagcaaggcugcaaaauca

SEQ ID NO: 1474041 - RNA, 19 nt, Homo sapiens
acacaauucuggcuaacuc

SEQ ID NO: 1474042 - RNA, 19 nt, Homo sapiens
agauaacgauccuuucuac

SEQ ID NO: 1474043 - RNA, 19 nt, Homo sapiens
uaguaccgaugccuacaaa

SEQ ID NO: 1474044 - RNA, 19 nt, Homo sapiens
gcaggaaggagagaaggaa

SEQ ID NO: 1474045 - RNA, 19 nt, Homo sapiens
cguagaaauuauccuugaa

SEQ ID NO: 1474046 - RNA, 19 nt, Homo sapiens
gcagggugcguuucucaau

SEQ ID NO: 1474047 - RNA, 19 nt, Homo sapiens
ggacguggcauugcaccaa

SEQ ID NO: 1474048 - RNA, 19 nt, Homo sapiens
ggaaggagagaaggaagga

SEQ ID NO: 1474049 - RNA, 19 nt, Homo sapiens
aaaccacacacuuugauau

SEQ ID NO: 1474050 - RNA, 19 nt, Homo sapiens
gcaagacaaaacacauuua

SEQ ID NO: 1474051 - RNA, 19 nt, Homo sapiens
ucugugaucucaagucucu

SEQ ID NO: 1474052 - RNA, 19 nt, Homo sapiens
caucugugaucucaagucu

SEQ ID NO: 1474053 - RNA, 19 nt, Homo sapiens
cacacacuuugauauuuga

SEQ ID NO: 1474054 - RNA, 19 nt, Homo sapiens
ccuuguaccaccaugaaua

SEQ ID NO: 1474055 - RNA, 19 nt, Homo sapiens
auaacgauccuuucuacuu

SEQ ID NO: 1474056 - RNA, 19 nt, Homo sapiens
caucaguggguccuggaua

SEQ ID NO: 1474057 - RNA, 19 nt, Homo sapiens
guuaaagaccuggaaggaa

SEQ ID NO: 1474058 - RNA, 19 nt, Homo sapiens
ccauguucgcucuuuauuu

SEQ ID NO: 1474059 - RNA, 19 nt, Homo sapiens
ccagagcgcccaaagaacu

SEQ ID NO: 1474060 - RNA, 19 nt, Homo sapiens
cgacugggaacuucacuag

SEQ ID NO: 1474061 - RNA, 19 nt, Homo sapiens
gcucuuugauagcaauuuu

SEQ ID NO: 1474062 - RNA, 19 nt, Homo sapiens
ccaauaacuucaaaagcaa

SEQ ID NO: 1474063 - RNA, 19 nt, Homo sapiens
accacacacuuugauauuu

SEQ ID NO: 1474064 - RNA, 19 nt, Homo sapiens
aagcauaugaguuuaaugg

SEQ ID NO: 1474065 - RNA, 19 nt, Homo sapiens
ggugucaucacguuggaaa

SEQ ID NO: 1474066 - RNA, 19 nt, Homo sapiens
gagagaaggaaggaaggaa

SEQ ID NO: 1474067 - RNA, 19 nt, Homo sapiens
cagggugcguuucucaauc

SEQ ID NO: 1474068 - RNA, 19 nt, Homo sapiens
ggagagaaggaaggaagga

SEQ ID NO: 1474069 - RNA, 19 nt, Homo sapiens
aagauaacgauccuuucua

SEQ ID NO: 1474070 - RNA, 19 nt, Homo sapiens
gucaucacguuggaaaguu

SEQ ID NO: 1474071 - RNA, 19 nt, Homo sapiens
caaugaacgcuugaaggaa

SEQ ID NO: 1474072 - RNA, 19 nt, Homo sapiens
uuuacacaauucuggcuaa

SEQ ID NO: 1474073 - RNA, 19 nt, Homo sapiens
agccagagcgcccaaagaa

SEQ ID NO: 1474074 - RNA, 19 nt, Homo sapiens
ccauggcucuuugauagca

SEQ ID NO: 1474075 - RNA, 19 nt, Homo sapiens
cauagugccaccuggauuc

SEQ ID NO: 1474076 - RNA, 19 nt, Homo sapiens
aaccacacacuuugauauu

SEQ ID NO: 1474077 - RNA, 19 nt, Homo sapiens
gccaacaggcacagucgaa

SEQ ID NO: 1474078 - RNA, 19 nt, Homo sapiens
aagagcugguuccgaauuc

SEQ ID NO: 1474079 - RNA, 19 nt, Homo sapiens
cccaauaacuucaaaagca

SEQ ID NO: 1474080 - RNA, 19 nt, Homo sapiens
aaggaaaugucuacuuagc

SEQ ID NO: 1474081 - RNA, 19 nt, Homo sapiens
uggcucaucccgcaaauca

SEQ ID NO: 1474082 - RNA, 19 nt, Homo sapiens
gcucagacagcaggaagga

SEQ ID NO: 1474083 - RNA, 19 nt, Homo sapiens
cugcaucugugaucucaag

SEQ ID NO: 1474084 - RNA, 19 nt, Homo sapiens
guagaaauuauccuugaac

SEQ ID NO: 1474085 - RNA, 19 nt, Homo sapiens
cuacuggaauuggauagag

SEQ ID NO: 1474086 - RNA, 19 nt, Homo sapiens
aauuauccuugaaccagaa

SEQ ID NO: 1474087 - RNA, 19 nt, Homo sapiens
ucuacuccaucaccauguu

SEQ ID NO: 1474088 - RNA, 19 nt, Homo sapiens
gagaaggaaggaaggaacu

SEQ ID NO: 1474089 - RNA, 19 nt, Homo sapiens
gcaaggcugcaaaaucaaa

SEQ ID NO: 1474090 - RNA, 19 nt, Homo sapiens
guaaaaccacacacuuuga

SEQ ID NO: 1474091 - RNA, 19 nt, Homo sapiens
ccaacaggcacagucgaaa

SEQ ID NO: 1474092 - RNA, 19 nt, Homo sapiens
accgaugccuacaaaauua

SEQ ID NO: 1474093 - RNA, 19 nt, Homo sapiens
caccauguucgcucuuuau

SEQ ID NO: 1474094 - RNA, 19 nt, Homo sapiens
ggaccccaauaacuucaaa

SEQ ID NO: 1474095 - RNA, 19 nt, Homo sapiens
uaaaagcaaggcugcaaaa

SEQ ID NO: 1474096 - RNA, 19 nt, Homo sapiens
aguggguccuggauaguga

SEQ ID NO: 1474097 - RNA, 19 nt, Homo sapiens
guucgcucuuuauuuccua

SEQ ID NO: 1474098 - RNA, 19 nt, Homo sapiens
acugggaacuucacuagac

SEQ ID NO: 1474099 - RNA, 19 nt, Homo sapiens
cccaagaagcauaugaguu

SEQ ID NO: 1474100 - RNA, 19 nt, Homo sapiens
gagcuccgcgaggaucauu

SEQ ID NO: 1474101 - RNA, 19 nt, Homo sapiens
ccuguucucccuagccaaa

SEQ ID NO: 1474102 - RNA, 19 nt, Homo sapiens
caacaggcacagucgaaaa

SEQ ID NO: 1474103 - RNA, 19 nt, Homo sapiens
uggaggacguggcauugca

SEQ ID NO: 1474104 - RNA, 19 nt, Homo sapiens
gaaggagagaaggaaggaa

SEQ ID NO: 1474105 - RNA, 19 nt, Homo sapiens
caauucaacacuccauuuu

SEQ ID NO: 1474106 - RNA, 19 nt, Homo sapiens
caacaugacucuagcaaug

SEQ ID NO: 1474107 - RNA, 19 nt, Homo sapiens
gagcauggcagcuaaguua

SEQ ID NO: 1474108 - RNA, 19 nt, Homo sapiens
gcuauggaaugguguauuu

SEQ ID NO: 1474109 - RNA, 19 nt, Homo sapiens
gcucgugucugauuuggua

SEQ ID NO: 1474110 - RNA, 19 nt, Homo sapiens
cagaagagcuggcauugug

SEQ ID NO: 1474111 - RNA, 19 nt, Homo sapiens
gcacaucggccucagauau

SEQ ID NO: 1474112 - RNA, 19 nt, Homo sapiens
ucaggaggcugcaaucaaa

SEQ ID NO: 1474113 - RNA, 19 nt, Homo sapiens
gagcuggcauugugucuga

SEQ ID NO: 1474114 - RNA, 19 nt, Homo sapiens
ggccagagguacaucaauu

SEQ ID NO: 1474115 - RNA, 19 nt, Homo sapiens
gcuggaagcugcccuuugu

SEQ ID NO: 1474116 - RNA, 19 nt, Homo sapiens
caaaugcacccucauguga

SEQ ID NO: 1474117 - RNA, 19 nt, Homo sapiens
ugagagcauuuaucuguaa

SEQ ID NO: 1474118 - RNA, 19 nt, Homo sapiens
gagggcaucugcaauagga

SEQ ID NO: 1474119 - RNA, 19 nt, Homo sapiens
uaacaaaugaccacaaaug

SEQ ID NO: 1474120 - RNA, 19 nt, Homo sapiens
gcggaugggugacuuguau

SEQ ID NO: 1474121 - RNA, 19 nt, Homo sapiens
ggaaguggcuauggaaugg

SEQ ID NO: 1474122 - RNA, 19 nt, Homo sapiens
ccuauuugguguuaacaua

SEQ ID NO: 1474123 - RNA, 19 nt, Homo sapiens
cuuagaagcucaugugguu

SEQ ID NO: 1474124 - RNA, 19 nt, Homo sapiens
caaaugaccacaaauguag

SEQ ID NO: 1474125 - RNA, 19 nt, Homo sapiens
gggagugggugauaugguu

SEQ ID NO: 1474126 - RNA, 19 nt, Homo sapiens
cagcaagacuggauaugug

SEQ ID NO: 1474127 - RNA, 19 nt, Homo sapiens
caacacaugcuuauuaucu

SEQ ID NO: 1474128 - RNA, 19 nt, Homo sapiens
guaugagcaugacuauauu

SEQ ID NO: 1474129 - RNA, 19 nt, Homo sapiens
gacauagucuuccugcaau

SEQ ID NO: 1474130 - RNA, 19 nt, Homo sapiens
uguaacaaaugaccacaaa

SEQ ID NO: 1474131 - RNA, 19 nt, Homo sapiens
gaucuguguuccacucuau

SEQ ID NO: 1474132 - RNA, 19 nt, Homo sapiens
cggaacagaguaacgauua

SEQ ID NO: 1474133 - RNA, 19 nt, Homo sapiens
gcaccucucuccucugucu

SEQ ID NO: 1474134 - RNA, 19 nt, Homo sapiens
agccuucgcucuagacaua

SEQ ID NO: 1474135 - RNA, 19 nt, Homo sapiens
agagagggcaucugcaaua

SEQ ID NO: 1474136 - RNA, 19 nt, Homo sapiens
gagagagauugcacacaug

SEQ ID NO: 1474137 - RNA, 19 nt, Homo sapiens
acaaaugaccacaaaugua

SEQ ID NO: 1474138 - RNA, 19 nt, Homo sapiens
acagagagguggguaguug

SEQ ID NO: 1474139 - RNA, 19 nt, Homo sapiens
ggagagagggcaucugcaa

SEQ ID NO: 1474140 - RNA, 19 nt, Homo sapiens
uguaugagcaugacuauau

SEQ ID NO: 1474141 - RNA, 19 nt, Homo sapiens
gaagaugccggaacagagu

SEQ ID NO: 1474142 - RNA, 19 nt, Homo sapiens
gaaacaacacaugcuuauu

SEQ ID NO: 1474143 - RNA, 19 nt, Homo sapiens
gcaaaugcacccucaugug

SEQ ID NO: 1474144 - RNA, 19 nt, Homo sapiens
cuauguagguaacagauug

SEQ ID NO: 1474145 - RNA, 19 nt, Homo sapiens
ggaagcaacgugugugugu

SEQ ID NO: 1474146 - RNA, 19 nt, Homo sapiens
cagaaacaacacaugcuua

SEQ ID NO: 1474147 - RNA, 19 nt, Homo sapiens
agagagagauugcacacau

SEQ ID NO: 1474148 - RNA, 19 nt, Homo sapiens
gccagagguacaucaauua

SEQ ID NO: 1474149 - RNA, 19 nt, Homo sapiens
gagagggcaucugcaauag

SEQ ID NO: 1474150 - RNA, 19 nt, Homo sapiens
cuacugcuguguaacaaau

SEQ ID NO: 1474151 - RNA, 19 nt, Homo sapiens
uaauagugguguaggguau

SEQ ID NO: 1474152 - RNA, 19 nt, Homo sapiens
cggccaagaugaacuacaa

SEQ ID NO: 1474153 - RNA, 19 nt, Homo sapiens
gugaucagcugcgacaaga

SEQ ID NO: 1474154 - RNA, 19 nt, Homo sapiens
acacggaaguggcuaugga

SEQ ID NO: 1474155 - RNA, 19 nt, Homo sapiens
gcagugagagagagagaga

SEQ ID NO: 1474156 - RNA, 19 nt, Homo sapiens
ggaagugcgcuuucaugga

SEQ ID NO: 1474157 - RNA, 19 nt, Homo sapiens
ugagagagagagagagauu

SEQ ID NO: 1474158 - RNA, 19 nt, Homo sapiens
acacaugcuuauuaucuca

SEQ ID NO: 1474159 - RNA, 19 nt, Homo sapiens
gcagucuguguguguaaua

SEQ ID NO: 1474160 - RNA, 19 nt, Homo sapiens
agaaacaacacaugcuuau

SEQ ID NO: 1474161 - RNA, 19 nt, Homo sapiens
gacuuucgguuccaaaucu

SEQ ID NO: 1474162 - RNA, 19 nt, Homo sapiens
gcacguuccgcgacaccua

SEQ ID NO: 1474163 - RNA, 19 nt, Homo sapiens
gauugcucgugucugauuu

SEQ ID NO: 1474164 - RNA, 19 nt, Homo sapiens
cugagagcauuuaucugua

SEQ ID NO: 1474165 - RNA, 19 nt, Homo sapiens
augggugacuuguaucuaa

SEQ ID NO: 1474166 - RNA, 19 nt, Homo sapiens
ccucacauuugaucacugu

SEQ ID NO: 1474167 - RNA, 19 nt, Homo sapiens
gauggagguuuuggucuua

SEQ ID NO: 1474168 - RNA, 19 nt, Homo sapiens
gaaggugagauggagguuu

SEQ ID NO: 1474169 - RNA, 19 nt, Homo sapiens
gaagcugcccuuuguucug

SEQ ID NO: 1474170 - RNA, 19 nt, Homo sapiens
caaauguagcaaccagaaa

SEQ ID NO: 1474171 - RNA, 19 nt, Homo sapiens
gcacgcugcagaucacaga

SEQ ID NO: 1474172 - RNA, 19 nt, Homo sapiens
ucugagagcauuuaucugu

SEQ ID NO: 1474173 - RNA, 19 nt, Homo sapiens
gagcaugacuauauuuugg

SEQ ID NO: 1474174 - RNA, 19 nt, Homo sapiens
gggcaaaugcacccucaug

SEQ ID NO: 1474175 - RNA, 19 nt, Homo sapiens
ggaagcagaagaggacaga

SEQ ID NO: 1474176 - RNA, 19 nt, Homo sapiens
ggagaccucggccaagaug

SEQ ID NO: 1474177 - RNA, 19 nt, Homo sapiens
acauagucuuccugcaaua

SEQ ID NO: 1474178 - RNA, 19 nt, Homo sapiens
ggacuauguagguaacaga

SEQ ID NO: 1474179 - RNA, 19 nt, Homo sapiens
ggcaacaagugcgaugaga

SEQ ID NO: 1474180 - RNA, 19 nt, Homo sapiens
gagugggugauaugguuua

SEQ ID NO: 1474181 - RNA, 19 nt, Homo sapiens
gaaucuuugugccuguaug

SEQ ID NO: 1474182 - RNA, 19 nt, Homo sapiens
ggauaugugugaggugucu

SEQ ID NO: 1474183 - RNA, 19 nt, Homo sapiens
cuaagugcaucugcgugua

SEQ ID NO: 1474184 - RNA, 19 nt, Homo sapiens
ccagaaacaacacaugcuu

SEQ ID NO: 1474185 - RNA, 19 nt, Homo sapiens
gaguggaagugcgcuuuca

SEQ ID NO: 1474186 - RNA, 19 nt, Homo sapiens
uaucugagagcauuuaucu

SEQ ID NO: 1474187 - RNA, 19 nt, Homo sapiens
gugaaucuuugugccugua

SEQ ID NO: 1474188 - RNA, 19 nt, Homo sapiens
caagacuggauauguguga

SEQ ID NO: 1474189 - RNA, 19 nt, Homo sapiens
acaucggccucagauauuu

SEQ ID NO: 1474190 - RNA, 19 nt, Homo sapiens
aaaaguggauccugcauuc

SEQ ID NO: 1474191 - RNA, 19 nt, Homo sapiens
gggaagaugccggaacaga

SEQ ID NO: 1474192 - RNA, 19 nt, Homo sapiens
ggagugggugauaugguuu

SEQ ID NO: 1474193 - RNA, 19 nt, Homo sapiens
ccaccaagacagagacguu

SEQ ID NO: 1474194 - RNA, 19 nt, Homo sapiens
gcaacaugacucuagcaau

SEQ ID NO: 1474195 - RNA, 19 nt, Homo sapiens
ugagagagucugagugaca

SEQ ID NO: 1474196 - RNA, 19 nt, Homo sapiens
cacaucggccucagauauu

SEQ ID NO: 1474197 - RNA, 19 nt, Homo sapiens
gaggacagaccgcgucaag

SEQ ID NO: 1474198 - RNA, 19 nt, Homo sapiens
acaaauguagcaaccagaa

SEQ ID NO: 1474199 - RNA, 19 nt, Homo sapiens
ugaggugucugugugaauc

SEQ ID NO: 1474200 - RNA, 19 nt, Homo sapiens
caccaagacagagacguua

SEQ ID NO: 1474201 - RNA, 19 nt, Homo sapiens
cauagucuuccugcaauaa

SEQ ID NO: 1474202 - RNA, 19 nt, Homo sapiens
uaacagauugcucgugucu

SEQ ID NO: 1474203 - RNA, 19 nt, Homo sapiens
guagcaaccagaaacaaca

SEQ ID NO: 1474204 - RNA, 19 nt, Homo sapiens
cguccugucccucacauuu

SEQ ID NO: 1474205 - RNA, 19 nt, Homo sapiens
gaucucaggaggcugcaau

SEQ ID NO: 1474206 - RNA, 19 nt, Homo sapiens
gaagacauaugauuucaca

SEQ ID NO: 1474207 - RNA, 19 nt, Homo sapiens
gagaagccauauaaaugua

SEQ ID NO: 1474208 - RNA, 19 nt, Homo sapiens
gccaucaucuuuaccaaua

SEQ ID NO: 1474209 - RNA, 19 nt, Homo sapiens
gaagacacaugauaacaca

SEQ ID NO: 1474210 - RNA, 19 nt, Homo sapiens
ggaaagcauucaauuguuc

SEQ ID NO: 1474211 - RNA, 19 nt, Homo sapiens
agagaaaccuuaucaaugu

SEQ ID NO: 1474212 - RNA, 19 nt, Homo sapiens
gcggaagccuuuaguuauu

SEQ ID NO: 1474213 - RNA, 19 nt, Homo sapiens
gagagaagccacauaaaug

SEQ ID NO: 1474214 - RNA, 19 nt, Homo sapiens
uaaauaugguguugccuuu

SEQ ID NO: 1474215 - RNA, 19 nt, Homo sapiens
caaauggccaucaucuuua

SEQ ID NO: 1474216 - RNA, 19 nt, Homo sapiens
gagaaaccuuaucaaugua

SEQ ID NO: 1474217 - RNA, 19 nt, Homo sapiens
gagagaaaccuuaucaaug

SEQ ID NO: 1474218 - RNA, 19 nt, Homo sapiens
ucaauuggcccauaucuuu

SEQ ID NO: 1474219 - RNA, 19 nt, Homo sapiens
gagaagccauauaagugua

SEQ ID NO: 1474220 - RNA, 19 nt, Homo sapiens
ucaaauggccaucaucuuu

SEQ ID NO: 1474221 - RNA, 19 nt, Homo sapiens
ggagagaagccacauaaau

SEQ ID NO: 1474222 - RNA, 19 nt, Homo sapiens
gggaaagcauucaauuguu

SEQ ID NO: 1474223 - RNA, 19 nt, Homo sapiens
gagagaaacccuaugaaug

SEQ ID NO: 1474224 - RNA, 19 nt, Homo sapiens
gagagaagccauauaagug

SEQ ID NO: 1474225 - RNA, 19 nt, Homo sapiens
ggagagagacccuaugugu

SEQ ID NO: 1474226 - RNA, 19 nt, Homo sapiens
ggauauuuauggagagaaa

SEQ ID NO: 1474227 - RNA, 19 nt, Homo sapiens
ggagagaaaccuuaucaau

SEQ ID NO: 1474228 - RNA, 19 nt, Homo sapiens
gagaaacucuauaaaugca

SEQ ID NO: 1474229 - RNA, 19 nt, Homo sapiens
gagagaaacccuacgaaug

SEQ ID NO: 1474230 - RNA, 19 nt, Homo sapiens
gagagaaacccuacgaaug

SEQ ID NO: 1474231 - RNA, 19 nt, Homo sapiens
gcgagaagccauauaaaug

SEQ ID NO: 1474232 - RNA, 19 nt, Homo sapiens
gaaccuggccucaguagau

SEQ ID NO: 1474233 - RNA, 19 nt, Homo sapiens
gaacacauacuagagagaa

SEQ ID NO: 1474234 - RNA, 19 nt, Homo sapiens
ggagagaaacccuaugaau

SEQ ID NO: 1474235 - RNA, 19 nt, Homo sapiens
ggagagaagccauauaagu

SEQ ID NO: 1474236 - RNA, 19 nt, Homo sapiens
gguguugccuuuaugaguu

SEQ ID NO: 1474237 - RNA, 19 nt, Homo sapiens
gaauucaugugcagugcuu

SEQ ID NO: 1474238 - RNA, 19 nt, Homo sapiens
gagaauacacacuacagaa

SEQ ID NO: 1474239 - RNA, 19 nt, Homo sapiens
gugcggaagccuuuaguua

SEQ ID NO: 1474240 - RNA, 19 nt, Homo sapiens
ggaaugugcggaagccuuu

SEQ ID NO: 1474241 - RNA, 19 nt, Homo sapiens
gcccauaucuuuacgaaaa

SEQ ID NO: 1474242 - RNA, 19 nt, Homo sapiens
ucgaagacaugaaaggauu

SEQ ID NO: 1474243 - RNA, 19 nt, Homo sapiens
ccauauaaguguaaggaau

SEQ ID NO: 1474244 - RNA, 19 nt, Homo sapiens
ucucaagucuuacuaguca

SEQ ID NO: 1474245 - RNA, 19 nt, Homo sapiens
gacccuauguguguaaauu

SEQ ID NO: 1474246 - RNA, 19 nt, Homo sapiens
gauucacacuggagagaaa

SEQ ID NO: 1474247 - RNA, 19 nt, Homo sapiens
gauucacacugcugagaaa

SEQ ID NO: 1474248 - RNA, 19 nt, Homo sapiens
ggauguggcuguggacuuc

SEQ ID NO: 1474249 - RNA, 19 nt, Homo sapiens
ggagugggcuuugcuggau

SEQ ID NO: 1474250 - RNA, 19 nt, Homo sapiens
ggacacaaaccauaucagu

SEQ ID NO: 1474251 - RNA, 19 nt, Homo sapiens
caguauaaguguaauguag

SEQ ID NO: 1474252 - RNA, 19 nt, Homo sapiens
ggagagaaacccuaugagu

SEQ ID NO: 1474253 - RNA, 19 nt, Homo sapiens
ggagagaaacccuacgaau

SEQ ID NO: 1474254 - RNA, 19 nt, Homo sapiens
ggagagaaacccuacgaau

SEQ ID NO: 1474255 - RNA, 19 nt, Homo sapiens
gagaaaaccuacgaaugua

SEQ ID NO: 1474256 - RNA, 19 nt, Homo sapiens
gagagacccuaugugugua

SEQ ID NO: 1474257 - RNA, 19 nt, Homo sapiens
caauuggcccauaucuuua

SEQ ID NO: 1474258 - RNA, 19 nt, Homo sapiens
ucauuuaucuccaguccuu

SEQ ID NO: 1474259 - RNA, 19 nt, Homo sapiens
guauaaguguaauguagga

SEQ ID NO: 1474260 - RNA, 19 nt, Homo sapiens
caauuguuccucauccuua

SEQ ID NO: 1474261 - RNA, 19 nt, Homo sapiens
ggugcacacuggagagaaa

SEQ ID NO: 1474262 - RNA, 19 nt, Homo sapiens
gggaaaaccuucauuuauc

SEQ ID NO: 1474263 - RNA, 19 nt, Homo sapiens
gagaagcccucagccagau

SEQ ID NO: 1474264 - RNA, 19 nt, Homo sapiens
ccggagagaagccauauaa

SEQ ID NO: 1474265 - RNA, 19 nt, Homo sapiens
ggacagucuuagcaucgaa

SEQ ID NO: 1474266 - RNA, 19 nt, Homo sapiens
cgagaagccauauaaaugu

SEQ ID NO: 1474267 - RNA, 19 nt, Homo sapiens
gaagacacacaauaacaca

SEQ ID NO: 1474268 - RNA, 19 nt, Homo sapiens
gacauccuccugcaaauga

SEQ ID NO: 1474269 - RNA, 19 nt, Homo sapiens
gagacucugugaaaguaau

SEQ ID NO: 1474270 - RNA, 19 nt, Homo sapiens
gaaaguaaugaucaaugug

SEQ ID NO: 1474271 - RNA, 19 nt, Homo sapiens
aauaugguguugccuuuau

SEQ ID NO: 1474272 - RNA, 19 nt, Homo sapiens
gaaaacauaugagaacaca

SEQ ID NO: 1474273 - RNA, 19 nt, Homo sapiens
gagaaacccuaugaaugca

SEQ ID NO: 1474274 - RNA, 19 nt, Homo sapiens
gaaacccuacgaaugcaaa

SEQ ID NO: 1474275 - RNA, 19 nt, Homo sapiens
gaaacccuacgaaugcaaa

SEQ ID NO: 1474276 - RNA, 19 nt, Homo sapiens
uuucucagcaggauauuua

SEQ ID NO: 1474277 - RNA, 19 nt, Homo sapiens
ggaaaaccuucauuuaucu

SEQ ID NO: 1474278 - RNA, 19 nt, Homo sapiens
gaagccauauaaauguaag

SEQ ID NO: 1474279 - RNA, 19 nt, Homo sapiens
agaaaucucagaaaucaug

SEQ ID NO: 1474280 - RNA, 19 nt, Homo sapiens
agaauacacacuacagaaa

SEQ ID NO: 1474281 - RNA, 19 nt, Homo sapiens
agagagacccuaugugugu

SEQ ID NO: 1474282 - RNA, 19 nt, Homo sapiens
uuccacaucuuaaucugua

SEQ ID NO: 1474283 - RNA, 19 nt, Homo sapiens
gagaaacccuacgaaugca

SEQ ID NO: 1474284 - RNA, 19 nt, Homo sapiens
gagaaacccuacgaaugca

SEQ ID NO: 1474285 - RNA, 19 nt, Homo sapiens
ggacauccuccugcaaaug

SEQ ID NO: 1474286 - RNA, 19 nt, Homo sapiens
cuacgaauguaagcaaugu

SEQ ID NO: 1474287 - RNA, 19 nt, Homo sapiens
acacuggacacaaaccaua

SEQ ID NO: 1474288 - RNA, 19 nt, Homo sapiens
gagugugucuguaguucau

SEQ ID NO: 1474289 - RNA, 19 nt, Homo sapiens
caaggagugugucuguagu

SEQ ID NO: 1474290 - RNA, 19 nt, Homo sapiens
caugugcagugcuucagaa

SEQ ID NO: 1474291 - RNA, 19 nt, Homo sapiens
ugagaacacauacuagaga

SEQ ID NO: 1474292 - RNA, 19 nt, Homo sapiens
ggcgagaagccauauaaau

SEQ ID NO: 1474293 - RNA, 19 nt, Homo sapiens
uuucgaagacacacaauaa

SEQ ID NO: 1474294 - RNA, 19 nt, Homo sapiens
gggcaggccuacaguuguc

SEQ ID NO: 1474295 - RNA, 19 nt, Homo sapiens
agagaaacccuaugaaugc

SEQ ID NO: 1474296 - RNA, 19 nt, Homo sapiens
cauauaaguguaaggaaug

SEQ ID NO: 1474297 - RNA, 19 nt, Homo sapiens
caccuaagaaugcauguga

SEQ ID NO: 1474298 - RNA, 19 nt, Homo sapiens
guggagagaaacccuauga

SEQ ID NO: 1474299 - RNA, 19 nt, Homo sapiens
gaauacacacuacagaaaa

SEQ ID NO: 1474300 - RNA, 19 nt, Homo sapiens
acacuggagagaaaccuua

SEQ ID NO: 1474301 - RNA, 19 nt, Homo sapiens
uaacacacacuggagagaa

SEQ ID NO: 1474302 - RNA, 19 nt, Homo sapiens
ucaguuauucuucggcuuu

SEQ ID NO: 1474303 - RNA, 19 nt, Homo sapiens
ggggaggccuucaguuauu

SEQ ID NO: 1474304 - RNA, 19 nt, Homo sapiens
uagccacguucaccagaaa

SEQ ID NO: 1474305 - RNA, 19 nt, Homo sapiens
gaagucacaccggagagaa

SEQ ID NO: 1474306 - RNA, 19 nt, Homo sapiens
ucucaaaucucaucucuua

SEQ ID NO: 1474307 - RNA, 19 nt, Homo sapiens
ucaaagaacuucccuuauu

SEQ ID NO: 1474308 - RNA, 19 nt, Homo sapiens
ggagaaaccuuaugcaugu

SEQ ID NO: 1474309 - RNA, 19 nt, Homo sapiens
gggaaugaauggcuuauuu

SEQ ID NO: 1474310 - RNA, 19 nt, Homo sapiens
gagaagacacacucuauua

SEQ ID NO: 1474311 - RNA, 19 nt, Homo sapiens
caaagaacuucccuuauug

SEQ ID NO: 1474312 - RNA, 19 nt, Homo sapiens
gguaaagccuucucucaaa

SEQ ID NO: 1474313 - RNA, 19 nt, Homo sapiens
gugaauaaaucaagcagua

SEQ ID NO: 1474314 - RNA, 19 nt, Homo sapiens
gaaacaaacuugacaaagc

SEQ ID NO: 1474315 - RNA, 19 nt, Homo sapiens
gggaaagccuucucucaaa

SEQ ID NO: 1474316 - RNA, 19 nt, Homo sapiens
ggaaugaauggcuuauuua

SEQ ID NO: 1474317 - RNA, 19 nt, Homo sapiens
ccaagaagauacaggaauu

SEQ ID NO: 1474318 - RNA, 19 nt, Homo sapiens
gaaaagacuugacauugua

SEQ ID NO: 1474319 - RNA, 19 nt, Homo sapiens
gcuccuagccaauguauua

SEQ ID NO: 1474320 - RNA, 19 nt, Homo sapiens
ucccaaagcucaucccuua

SEQ ID NO: 1474321 - RNA, 19 nt, Homo sapiens
gagagaaaccuuaugauug

SEQ ID NO: 1474322 - RNA, 19 nt, Homo sapiens
agagaaaccuuaugaaugu

SEQ ID NO: 1474323 - RNA, 19 nt, Homo sapiens
gaagacacacucuauuauu

SEQ ID NO: 1474324 - RNA, 19 nt, Homo sapiens
gagaagcccuaucacugua

SEQ ID NO: 1474325 - RNA, 19 nt, Homo sapiens
ggagagaaaccuuaugauu

SEQ ID NO: 1474326 - RNA, 19 nt, Homo sapiens
acaaauagcugaaacaaac

SEQ ID NO: 1474327 - RNA, 19 nt, Homo sapiens
gguaaagccuucagccaaa

SEQ ID NO: 1474328 - RNA, 19 nt, Homo sapiens
ucucaaagcucagcccuua

SEQ ID NO: 1474329 - RNA, 19 nt, Homo sapiens
cuuccaaggugacaaauua

SEQ ID NO: 1474330 - RNA, 19 nt, Homo sapiens
gagaaacccuaugaaugua

SEQ ID NO: 1474331 - RNA, 19 nt, Homo sapiens
caugaucacuuccagagua

SEQ ID NO: 1474332 - RNA, 19 nt, Homo sapiens
ggaaaagccuucucucaaa

SEQ ID NO: 1474333 - RNA, 19 nt, Homo sapiens
gagaaacccuucgacugua

SEQ ID NO: 1474334 - RNA, 19 nt, Homo sapiens
ggaaaagccuucucucaaa

SEQ ID NO: 1474335 - RNA, 19 nt, Homo sapiens
gguaaagccuucccucgaa

SEQ ID NO: 1474336 - RNA, 19 nt, Homo sapiens
ggagcagucuuacaaaugu

SEQ ID NO: 1474337 - RNA, 19 nt, Homo sapiens
aaacaaguaucaacgaaga

SEQ ID NO: 1474338 - RNA, 19 nt, Homo sapiens
gagaagcccuauguaugua

SEQ ID NO: 1474339 - RNA, 19 nt, Homo sapiens
ggaaaagccuuaugaaugu

SEQ ID NO: 1474340 - RNA, 19 nt, Homo sapiens
agagaaaccuuaugauugu

SEQ ID NO: 1474341 - RNA, 19 nt, Homo sapiens
gagagaaaccuuaugaaug

SEQ ID NO: 1474342 - RNA, 19 nt, Homo sapiens
gaaacaagguaucuuccau

SEQ ID NO: 1474343 - RNA, 19 nt, Homo sapiens
agagaaaccuuaugagugu

SEQ ID NO: 1474344 - RNA, 19 nt, Homo sapiens
gcucaucccuuacuauaca

SEQ ID NO: 1474345 - RNA, 19 nt, Homo sapiens
gagagaaacccuaugaaug

SEQ ID NO: 1474346 - RNA, 19 nt, Homo sapiens
agccagaaaucaaaucuua

SEQ ID NO: 1474347 - RNA, 19 nt, Homo sapiens
gagaagcccuaugcaugua

SEQ ID NO: 1474348 - RNA, 19 nt, Homo sapiens
caacuaaagaccagaauau

SEQ ID NO: 1474349 - RNA, 19 nt, Homo sapiens
gaaacccuaugaauauugu

SEQ ID NO: 1474350 - RNA, 19 nt, Homo sapiens
ggagagaaaccuuaugaau

SEQ ID NO: 1474351 - RNA, 19 nt, Homo sapiens
ugaguuaggucuuuaucaa

SEQ ID NO: 1474352 - RNA, 19 nt, Homo sapiens
gguaaagccuucucucagu

SEQ ID NO: 1474353 - RNA, 19 nt, Homo sapiens
gaaaucaaaucucauugcu

SEQ ID NO: 1474354 - RNA, 19 nt, Homo sapiens
gaugucaaaucuuguuaga

SEQ ID NO: 1474355 - RNA, 19 nt, Homo sapiens
guaaagccuucucucaguu

SEQ ID NO: 1474356 - RNA, 19 nt, Homo sapiens
gguaaagccuucucucagu

SEQ ID NO: 1474357 - RNA, 19 nt, Homo sapiens
aaacaaacuugacaaagca

SEQ ID NO: 1474358 - RNA, 19 nt, Homo sapiens
ggaaaagccuucucccaaa

SEQ ID NO: 1474359 - RNA, 19 nt, Homo sapiens
guaaagccuucucucaaau

SEQ ID NO: 1474360 - RNA, 19 nt, Homo sapiens
ggagagaaacccuaugaau

SEQ ID NO: 1474361 - RNA, 19 nt, Homo sapiens
ugacagugcuauugaaauc

SEQ ID NO: 1474362 - RNA, 19 nt, Homo sapiens
ggaaagccuucucucaaag

SEQ ID NO: 1474363 - RNA, 19 nt, Homo sapiens
ugagaaacccuaugaaugu

SEQ ID NO: 1474364 - RNA, 19 nt, Homo sapiens
cagcagacaucuuauugau

SEQ ID NO: 1474365 - RNA, 19 nt, Homo sapiens
uaaggaacuucacaaacuu

SEQ ID NO: 1474366 - RNA, 19 nt, Homo sapiens
gaaaacaaguaucaacgaa

SEQ ID NO: 1474367 - RNA, 19 nt, Homo sapiens
ugacaaagcaaguagagaa

SEQ ID NO: 1474368 - RNA, 19 nt, Homo sapiens
gcucacugcuuaauuuaca

SEQ ID NO: 1474369 - RNA, 19 nt, Homo sapiens
uuaaggaacuucacaaacu

SEQ ID NO: 1474370 - RNA, 19 nt, Homo sapiens
acaaugaguuaggucuuua

SEQ ID NO: 1474371 - RNA, 19 nt, Homo sapiens
gcaaggccaucugaaggaa

SEQ ID NO: 1474372 - RNA, 19 nt, Homo sapiens
caaagcucaucccuuacua

SEQ ID NO: 1474373 - RNA, 19 nt, Homo sapiens
gagaaaccuuaugauugua

SEQ ID NO: 1474374 - RNA, 19 nt, Homo sapiens
gaaacccuaugaaugcaau

SEQ ID NO: 1474375 - RNA, 19 nt, Homo sapiens
gagaaaccuuaugaaugua

SEQ ID NO: 1474376 - RNA, 19 nt, Homo sapiens
guagggagcagucuuacaa

SEQ ID NO: 1474377 - RNA, 19 nt, Homo sapiens
ucucaaagaacuucccuua

SEQ ID NO: 1474378 - RNA, 19 nt, Homo sapiens
ccagaaaucaaaucucauu

SEQ ID NO: 1474379 - RNA, 19 nt, Homo sapiens
gcucagcccuuacuguaca

SEQ ID NO: 1474380 - RNA, 19 nt, Homo sapiens
gaagcccuaucacuguauu

SEQ ID NO: 1474381 - RNA, 19 nt, Homo sapiens
ucucuuacccuucauauga

SEQ ID NO: 1474382 - RNA, 19 nt, Homo sapiens
cacauuacaugaucacuuc

SEQ ID NO: 1474383 - RNA, 19 nt, Homo sapiens
gagaauucauacucauuag

SEQ ID NO: 1474384 - RNA, 19 nt, Homo sapiens
gagaaaccuuaugcaugua

SEQ ID NO: 1474385 - RNA, 19 nt, Homo sapiens
gaaagccuucucucaaaga

SEQ ID NO: 1474386 - RNA, 19 nt, Homo sapiens
gagaagucauacaggagaa

SEQ ID NO: 1474387 - RNA, 19 nt, Homo sapiens
guaguaagauagugagcau

SEQ ID NO: 1474388 - RNA, 19 nt, Homo sapiens
cauaacaacacaacacuug

SEQ ID NO: 1474389 - RNA, 19 nt, Homo sapiens
ggaauuaacaccucauugc

SEQ ID NO: 1474390 - RNA, 19 nt, Homo sapiens
gaaaagccuucucucaaau

SEQ ID NO: 1474391 - RNA, 19 nt, Homo sapiens
gcacaucagaaaguucaua

SEQ ID NO: 1474392 - RNA, 19 nt, Homo sapiens
auuuaaagcugcugucauu

SEQ ID NO: 1474393 - RNA, 19 nt, Homo sapiens
gcacauuacaugaucacuu

SEQ ID NO: 1474394 - RNA, 19 nt, Homo sapiens
guaaagccuucccucgaau

SEQ ID NO: 1474395 - RNA, 19 nt, Homo sapiens
guaugacagugcuauugaa

SEQ ID NO: 1474396 - RNA, 19 nt, Homo sapiens
ucccaaaucacuaaguuua

SEQ ID NO: 1474397 - RNA, 19 nt, Homo sapiens
ugagaaacccuucgacugu

SEQ ID NO: 1474398 - RNA, 19 nt, Homo sapiens
gaaacccuaugaauguaag

SEQ ID NO: 1474399 - RNA, 19 nt, Homo sapiens
guacauaugagaagucaca

SEQ ID NO: 1474400 - RNA, 19 nt, Homo sapiens
gccaauguauuaaguaagg

SEQ ID NO: 1474401 - RNA, 19 nt, Homo sapiens
caucaaagaauucauacug

SEQ ID NO: 1474402 - RNA, 19 nt, Homo sapiens
gugguaaagcuuucauuaa

SEQ ID NO: 1474403 - RNA, 19 nt, Homo sapiens
ugagaagcccuauguaugu

SEQ ID NO: 1474404 - RNA, 19 nt, Homo sapiens
ggugagaagcccuauguau

SEQ ID NO: 1474405 - RNA, 19 nt, Homo sapiens
gugagaaacccuaugaaug

SEQ ID NO: 1474406 - RNA, 19 nt, Homo sapiens
gauaaucacucaugaagaa

SEQ ID NO: 1474407 - RNA, 19 nt, Homo sapiens
gaacaucaaucccagaaga

SEQ ID NO: 1474408 - RNA, 19 nt, Homo sapiens
gagaaacccuauaaaugua

SEQ ID NO: 1474409 - RNA, 19 nt, Homo sapiens
aaagacaucuguacaguaa

SEQ ID NO: 1474410 - RNA, 19 nt, Homo sapiens
caaaccaagugugauauua

SEQ ID NO: 1474411 - RNA, 19 nt, Homo sapiens
agagaaaccuuaugaaugu

SEQ ID NO: 1474412 - RNA, 19 nt, Homo sapiens
gagagaaacccuauaaaug

SEQ ID NO: 1474413 - RNA, 19 nt, Homo sapiens
gagaaacccuaugaaugua

SEQ ID NO: 1474414 - RNA, 19 nt, Homo sapiens
gagaaacccuaugaaugua

SEQ ID NO: 1474415 - RNA, 19 nt, Homo sapiens
gagaaacccuaugaaugua

SEQ ID NO: 1474416 - RNA, 19 nt, Homo sapiens
uagaaacacuuacaagcua

SEQ ID NO: 1474417 - RNA, 19 nt, Homo sapiens
caacaucagagaauucaua

SEQ ID NO: 1474418 - RNA, 19 nt, Homo sapiens
caacaucagagaauucaua

SEQ ID NO: 1474419 - RNA, 19 nt, Homo sapiens
ggagagaaacccuauaaau

SEQ ID NO: 1474420 - RNA, 19 nt, Homo sapiens
gaaauguaaugacugugaa

SEQ ID NO: 1474421 - RNA, 19 nt, Homo sapiens
ggaaugggauugucuggau

SEQ ID NO: 1474422 - RNA, 19 nt, Homo sapiens
gagagaaaccuuaugaaug

SEQ ID NO: 1474423 - RNA, 19 nt, Homo sapiens
ggagagagacccuaugaau

SEQ ID NO: 1474424 - RNA, 19 nt, Homo sapiens
gaaacccuaugaauguauu

SEQ ID NO: 1474425 - RNA, 19 nt, Homo sapiens
ggagagagacccuaugaau

SEQ ID NO: 1474426 - RNA, 19 nt, Homo sapiens
gaaagcauuuagcaacaga

SEQ ID NO: 1474427 - RNA, 19 nt, Homo sapiens
caacaucagaggauucaua

SEQ ID NO: 1474428 - RNA, 19 nt, Homo sapiens
gaagagauaaucacucaug

SEQ ID NO: 1474429 - RNA, 19 nt, Homo sapiens
gagagaaacccuaugaaug

SEQ ID NO: 1474430 - RNA, 19 nt, Homo sapiens
guacaucagagaauacaua

SEQ ID NO: 1474431 - RNA, 19 nt, Homo sapiens
gagagaaacccuaugaaug

SEQ ID NO: 1474432 - RNA, 19 nt, Homo sapiens
gagagaaacccuaugaaug

SEQ ID NO: 1474433 - RNA, 19 nt, Homo sapiens
gcuauaaccuugaauacuc

SEQ ID NO: 1474434 - RNA, 19 nt, Homo sapiens
gaagaaagaauggcuguug

SEQ ID NO: 1474435 - RNA, 19 nt, Homo sapiens
ggagagaaaccuuaugaau

SEQ ID NO: 1474436 - RNA, 19 nt, Homo sapiens
gaucauccauugcucaaca

SEQ ID NO: 1474437 - RNA, 19 nt, Homo sapiens
gaaaguacauaaacaugac

SEQ ID NO: 1474438 - RNA, 19 nt, Homo sapiens
guaaugugaugcuagagaa

SEQ ID NO: 1474439 - RNA, 19 nt, Homo sapiens
gggauugucuggauucuuc

SEQ ID NO: 1474440 - RNA, 19 nt, Homo sapiens
caucagaacccacugcuuu

SEQ ID NO: 1474441 - RNA, 19 nt, Homo sapiens
gagaagaguggaaauguga

SEQ ID NO: 1474442 - RNA, 19 nt, Homo sapiens
gaaggcguguuucaaggaa

SEQ ID NO: 1474443 - RNA, 19 nt, Homo sapiens
gagagacccuaugaaugua

SEQ ID NO: 1474444 - RNA, 19 nt, Homo sapiens
ggagagaaacccuaugaau

SEQ ID NO: 1474445 - RNA, 19 nt, Homo sapiens
gagagacccuaugaaugua

SEQ ID NO: 1474446 - RNA, 19 nt, Homo sapiens
ggagagaaacccuaugaau

SEQ ID NO: 1474447 - RNA, 19 nt, Homo sapiens
ggagagaaacccuaugaau

SEQ ID NO: 1474448 - RNA, 19 nt, Homo sapiens
gcugggagccuauauguga

SEQ ID NO: 1474449 - RNA, 19 nt, Homo sapiens
caacaucagcgaguucaua

SEQ ID NO: 1474450 - RNA, 19 nt, Homo sapiens
gugcauaccuuacuguaca

SEQ ID NO: 1474451 - RNA, 19 nt, Homo sapiens
caacaucugcgaguucaua

SEQ ID NO: 1474452 - RNA, 19 nt, Homo sapiens
ugagagagaacaagaauau

SEQ ID NO: 1474453 - RNA, 19 nt, Homo sapiens
gauccugaguccuaaaugu

SEQ ID NO: 1474454 - RNA, 19 nt, Homo sapiens
gaaacccuaugaauguaau

SEQ ID NO: 1474455 - RNA, 19 nt, Homo sapiens
ggaaagccuucagucagaa

SEQ ID NO: 1474456 - RNA, 19 nt, Homo sapiens
agagaaacccuauaaaugu

SEQ ID NO: 1474457 - RNA, 19 nt, Homo sapiens
guaaucagaaggcguguuu

SEQ ID NO: 1474458 - RNA, 19 nt, Homo sapiens
ccacugcuauuucccaaga

SEQ ID NO: 1474459 - RNA, 19 nt, Homo sapiens
gggaaagcauuuagcaaca

SEQ ID NO: 1474460 - RNA, 19 nt, Homo sapiens
guucaucccuuacucuuca

SEQ ID NO: 1474461 - RNA, 19 nt, Homo sapiens
gaacuacaggaucuuggua

SEQ ID NO: 1474462 - RNA, 19 nt, Homo sapiens
gagaaaccuuaugaaugua

SEQ ID NO: 1474463 - RNA, 19 nt, Homo sapiens
gaaugggauugucuggauu

SEQ ID NO: 1474464 - RNA, 19 nt, Homo sapiens
agagaaacccuaugaaugu

SEQ ID NO: 1474465 - RNA, 19 nt, Homo sapiens
gagaauucauacuggagaa

SEQ ID NO: 1474466 - RNA, 19 nt, Homo sapiens
agagaaacccuaugaaugu

SEQ ID NO: 1474467 - RNA, 19 nt, Homo sapiens
agagaaacccuaugaaugu

SEQ ID NO: 1474468 - RNA, 19 nt, Homo sapiens
gagagagacccuaugaaug

SEQ ID NO: 1474469 - RNA, 19 nt, Homo sapiens
gagagagacccuaugaaug

SEQ ID NO: 1474470 - RNA, 19 nt, Homo sapiens
agacaucuguacaguaaug

SEQ ID NO: 1474471 - RNA, 19 nt, Homo sapiens
caaagacaucuguacagua

SEQ ID NO: 1474472 - RNA, 19 nt, Homo sapiens
ucagagauguggcuguaga

SEQ ID NO: 1474473 - RNA, 19 nt, Homo sapiens
agcaaugacucgucccuua

SEQ ID NO: 1474474 - RNA, 19 nt, Homo sapiens
guacaguaaugugaugcua

SEQ ID NO: 1474475 - RNA, 19 nt, Homo sapiens
agagagacccuaugaaugu

SEQ ID NO: 1474476 - RNA, 19 nt, Homo sapiens
agagagacccuaugaaugu

SEQ ID NO: 1474477 - RNA, 19 nt, Homo sapiens
gaaacccuaugaauguauc

SEQ ID NO: 1474478 - RNA, 19 nt, Homo sapiens
gaauguaagguaugucgaa

SEQ ID NO: 1474479 - RNA, 19 nt, Homo sapiens
agccagaguucaucccuua

SEQ ID NO: 1474480 - RNA, 19 nt, Homo sapiens
ggagaaaguacauaaacau

SEQ ID NO: 1474481 - RNA, 19 nt, Homo sapiens
gaaacacuuacaagcuaua

SEQ ID NO: 1474482 - RNA, 19 nt, Homo sapiens
ccuuaugaauguacuguuu

SEQ ID NO: 1474483 - RNA, 19 nt, Homo sapiens
gaaagcauucagccagauu

SEQ ID NO: 1474484 - RNA, 19 nt, Homo sapiens
gagauaaucacucaugaag

SEQ ID NO: 1474485 - RNA, 19 nt, Homo sapiens
gcaaccagguaaucagaag

SEQ ID NO: 1474486 - RNA, 19 nt, Homo sapiens
gcucaucaccagagaauuc

SEQ ID NO: 1474487 - RNA, 19 nt, Homo sapiens
gaggaggccguguuacaaa

SEQ ID NO: 1474488 - RNA, 19 nt, Homo sapiens
gagaaaguacauaaacaug

SEQ ID NO: 1474489 - RNA, 19 nt, Homo sapiens
ucaaagacaucuguacagu

SEQ ID NO: 1474490 - RNA, 19 nt, Homo sapiens
gcauuuagccuucgugcau

SEQ ID NO: 1474491 - RNA, 19 nt, Homo sapiens
caucaaagaauucauacug

SEQ ID NO: 1474492 - RNA, 19 nt, Homo sapiens
aggaagagauaaucacuca

SEQ ID NO: 1474493 - RNA, 19 nt, Homo sapiens
cuagagaacuacaggaucu

SEQ ID NO: 1474494 - RNA, 19 nt, Homo sapiens
ggaaagcauucagccagau

SEQ ID NO: 1474495 - RNA, 19 nt, Homo sapiens
ggaaggccuuuagccagaa

SEQ ID NO: 1474496 - RNA, 19 nt, Homo sapiens
ugaaauguaaugacuguga

SEQ ID NO: 1474497 - RNA, 19 nt, Homo sapiens
acauaaacaugacacacaa

SEQ ID NO: 1474498 - RNA, 19 nt, Homo sapiens
augugagacugaagaauua

SEQ ID NO: 1474499 - RNA, 19 nt, Homo sapiens
uaugugagacugaagaauu

SEQ ID NO: 1474500 - RNA, 19 nt, Homo sapiens
caccagagaauucacauug

SEQ ID NO: 1474501 - RNA, 19 nt, Homo sapiens
caucaaagaguucauacug

SEQ ID NO: 1474502 - RNA, 19 nt, Homo sapiens
aggaaagccuucagucaga

SEQ ID NO: 1474503 - RNA, 19 nt, Homo sapiens
gaugagagagaacaagaau

SEQ ID NO: 1474504 - RNA, 19 nt, Homo sapiens
gaaaggcaaccagguaauc

SEQ ID NO: 1474505 - RNA, 19 nt, Homo sapiens
gagagaagaguggaaaugu

SEQ ID NO: 1474506 - RNA, 19 nt, Homo sapiens
caaacacucuugcauggua

SEQ ID NO: 1474507 - RNA, 19 nt, Homo sapiens
gcaaagggcauguaaauag

SEQ ID NO: 1474508 - RNA, 19 nt, Homo sapiens
ccaccaguaugcuuaaaua

SEQ ID NO: 1474509 - RNA, 19 nt, Homo sapiens
aaauauaccugcucuaugu

SEQ ID NO: 1474510 - RNA, 19 nt, Homo sapiens
gaaucuguguacuguauuu

SEQ ID NO: 1474511 - RNA, 19 nt, Homo sapiens
ccaguaugcuuaaauaugu

SEQ ID NO: 1474512 - RNA, 19 nt, Homo sapiens
gaagccagcugugcucuau

SEQ ID NO: 1474513 - RNA, 19 nt, Homo sapiens
gaaggaaggagaugauaga

SEQ ID NO: 1474514 - RNA, 19 nt, Homo sapiens
gagaguagaccaccaguau

SEQ ID NO: 1474515 - RNA, 19 nt, Homo sapiens
gcacaaugcuguagaucag

SEQ ID NO: 1474516 - RNA, 19 nt, Homo sapiens
guacauacuugccauuucu

SEQ ID NO: 1474517 - RNA, 19 nt, Homo sapiens
gcaaauugguagauaguac

SEQ ID NO: 1474518 - RNA, 19 nt, Homo sapiens
cagcugugcucuaugauug

SEQ ID NO: 1474519 - RNA, 19 nt, Homo sapiens
gaaaacagccugauuguca

SEQ ID NO: 1474520 - RNA, 19 nt, Homo sapiens
gggcuuggcuuccugacuu

SEQ ID NO: 1474521 - RNA, 19 nt, Homo sapiens
caaauaaucaucucaacug

SEQ ID NO: 1474522 - RNA, 19 nt, Homo sapiens
caugguaaccuuguaaaua

SEQ ID NO: 1474523 - RNA, 19 nt, Homo sapiens
guaaauauaccugcucuau

SEQ ID NO: 1474524 - RNA, 19 nt, Homo sapiens
gcauguaugucagcacuug

SEQ ID NO: 1474525 - RNA, 19 nt, Homo sapiens
gaccucagaacccgauuua

SEQ ID NO: 1474526 - RNA, 19 nt, Homo sapiens
gcugagaucaucacacauu

SEQ ID NO: 1474527 - RNA, 19 nt, Homo sapiens
ggacuucacauccuugaga

SEQ ID NO: 1474528 - RNA, 19 nt, Homo sapiens
gggacuagcugccuuucug

SEQ ID NO: 1474529 - RNA, 19 nt, Homo sapiens
gauuuaggacucagaauga

SEQ ID NO: 1474530 - RNA, 19 nt, Homo sapiens
caauccugcucuauucuuu

SEQ ID NO: 1474531 - RNA, 19 nt, Homo sapiens
uaacucuccucccauauag

SEQ ID NO: 1474532 - RNA, 19 nt, Homo sapiens
gcagggugauggaagacaa

SEQ ID NO: 1474533 - RNA, 19 nt, Homo sapiens
gacaacugcuuagcucuga

SEQ ID NO: 1474534 - RNA, 19 nt, Homo sapiens
caaagggcauguaaauagg

SEQ ID NO: 1474535 - RNA, 19 nt, Homo sapiens
ucaagugucuggcugaaag

SEQ ID NO: 1474536 - RNA, 19 nt, Homo sapiens
gcucuaugauugcaacugu

SEQ ID NO: 1474537 - RNA, 19 nt, Homo sapiens
guaauacaccauucaggaa

SEQ ID NO: 1474538 - RNA, 19 nt, Homo sapiens
uagaucaguuggccacaaa

SEQ ID NO: 1474539 - RNA, 19 nt, Homo sapiens
uaaaugaucaucucuaggu

SEQ ID NO: 1474540 - RNA, 19 nt, Homo sapiens
uggaaucuguguacuguau

SEQ ID NO: 1474541 - RNA, 19 nt, Homo sapiens
cagaaugacuuugcugauc

SEQ ID NO: 1474542 - RNA, 19 nt, Homo sapiens
guagcaaauugguagauag

SEQ ID NO: 1474543 - RNA, 19 nt, Homo sapiens
gggcuauccuguucccuau

SEQ ID NO: 1474544 - RNA, 19 nt, Homo sapiens
gcuucuagaucucauguca

SEQ ID NO: 1474545 - RNA, 19 nt, Homo sapiens
cuaaggaggccauucuuga

SEQ ID NO: 1474546 - RNA, 19 nt, Homo sapiens
gcuguggcccucugacuuu

SEQ ID NO: 1474547 - RNA, 19 nt, Homo sapiens
aaagcagggugauggaaga

SEQ ID NO: 1474548 - RNA, 19 nt, Homo sapiens
guggagauguuuucauuuu

SEQ ID NO: 1474549 - RNA, 19 nt, Homo sapiens
ggaggccauucuugauguu

SEQ ID NO: 1474550 - RNA, 19 nt, Homo sapiens
gggcuuuucugcauguuua

SEQ ID NO: 1474551 - RNA, 19 nt, Homo sapiens
aaacacucuugcaugguaa

SEQ ID NO: 1474552 - RNA, 19 nt, Homo sapiens
gcauguaaauagguaaugg

SEQ ID NO: 1474553 - RNA, 19 nt, Homo sapiens
uuaacucuccucccauaua

SEQ ID NO: 1474554 - RNA, 19 nt, Homo sapiens
cuuuaacucuccucccaua

SEQ ID NO: 1474555 - RNA, 19 nt, Homo sapiens
uggcugagaucaucacaca

SEQ ID NO: 1474556 - RNA, 19 nt, Homo sapiens
gcaaauaaucaucucaacu

SEQ ID NO: 1474557 - RNA, 19 nt, Homo sapiens
gaacgccccuccucaagug

SEQ ID NO: 1474558 - RNA, 19 nt, Homo sapiens
uaccauagccuuuguggau

SEQ ID NO: 1474559 - RNA, 19 nt, Homo sapiens
ggagaaaacagccugauug

SEQ ID NO: 1474560 - RNA, 19 nt, Homo sapiens
guagaucaguuggccacaa

SEQ ID NO: 1474561 - RNA, 19 nt, Homo sapiens
ggagaguagaccaccagua

SEQ ID NO: 1474562 - RNA, 19 nt, Homo sapiens
uuauaugccuccaacugaa

SEQ ID NO: 1474563 - RNA, 19 nt, Homo sapiens
uaaauauaccugcucuaug

SEQ ID NO: 1474564 - RNA, 19 nt, Homo sapiens
gauagaaggaaggagauga

SEQ ID NO: 1474565 - RNA, 19 nt, Homo sapiens
ggagauguuuucauuuuca

SEQ ID NO: 1474566 - RNA, 19 nt, Homo sapiens
acaaugcuguagaucaguu

SEQ ID NO: 1474567 - RNA, 19 nt, Homo sapiens
gggagaugacaacugcuua

SEQ ID NO: 1474568 - RNA, 19 nt, Homo sapiens
gcuauccuguucccuauac

SEQ ID NO: 1474569 - RNA, 19 nt, Homo sapiens
ggaccagcuucaggacuug

SEQ ID NO: 1474570 - RNA, 19 nt, Homo sapiens
gcuaaggaggccauucuug

SEQ ID NO: 1474571 - RNA, 19 nt, Homo sapiens
agaaugacuuugcugaucu

SEQ ID NO: 1474572 - RNA, 19 nt, Homo sapiens
aguagcaaauugguagaua

SEQ ID NO: 1474573 - RNA, 19 nt, Homo sapiens
gguaaugguggugcuagua

SEQ ID NO: 1474574 - RNA, 19 nt, Homo sapiens
gcugcaugcuaggaaagua

SEQ ID NO: 1474575 - RNA, 19 nt, Homo sapiens
gaucaguuggccacaaaug

SEQ ID NO: 1474576 - RNA, 19 nt, Homo sapiens
ugaauacacuaaggcacaa

SEQ ID NO: 1474577 - RNA, 19 nt, Homo sapiens
caacugccaauuccaagug

SEQ ID NO: 1474578 - RNA, 19 nt, Homo sapiens
aguaaaugaucaucucuag

SEQ ID NO: 1474579 - RNA, 19 nt, Homo sapiens
ggccugagggacauucuaa

SEQ ID NO: 1474580 - RNA, 19 nt, Homo sapiens
ggacucagaaugacuuugc

SEQ ID NO: 1474581 - RNA, 19 nt, Homo sapiens
gaacccgauuuaggacuca

SEQ ID NO: 1474582 - RNA, 19 nt, Homo sapiens
caagccaucugccuucacu

SEQ ID NO: 1474583 - RNA, 19 nt, Homo sapiens
gaccaccaguaugcuuaaa

SEQ ID NO: 1474584 - RNA, 19 nt, Homo sapiens
cauacuugccauuucuaua

SEQ ID NO: 1474585 - RNA, 19 nt, Homo sapiens
gguuggggauggcaaauaa

SEQ ID NO: 1474586 - RNA, 19 nt, Homo sapiens
gaaugacuuugcugaucuc

SEQ ID NO: 1474587 - RNA, 19 nt, Homo sapiens
ggagaugacaacugcuuag

SEQ ID NO: 1474588 - RNA, 19 nt, Homo sapiens
cugagaucaucacacauuu

SEQ ID NO: 1474589 - RNA, 19 nt, Homo sapiens
ccauagccuuuguggaugu

SEQ ID NO: 1474590 - RNA, 19 nt, Homo sapiens
ggugcugcuugguaccaua

SEQ ID NO: 1474591 - RNA, 19 nt, Homo sapiens
agccagcugugcucuauga

SEQ ID NO: 1474592 - RNA, 19 nt, Homo sapiens
uagaccaccaguaugcuua

SEQ ID NO: 1474593 - RNA, 19 nt, Homo sapiens
ugauguugcuucuagaucu

SEQ ID NO: 1474594 - RNA, 19 nt, Homo sapiens
ggugcugcaugcuaggaaa

SEQ ID NO: 1474595 - RNA, 19 nt, Homo sapiens
ggaccucagaacccgauuu

SEQ ID NO: 1474596 - RNA, 19 nt, Homo sapiens
guccugagcauguauguca

SEQ ID NO: 1474597 - RNA, 19 nt, Homo sapiens
uaaggaggccauucuugau

SEQ ID NO: 1474598 - RNA, 19 nt, Homo sapiens
aagggcauguaaauaggua

SEQ ID NO: 1474599 - RNA, 19 nt, Homo sapiens
cgauuuaggacucagaaug

SEQ ID NO: 1474600 - RNA, 19 nt, Homo sapiens
gaguagaccaccaguaugc

SEQ ID NO: 1474601 - RNA, 19 nt, Homo sapiens
caucucaacugccaauucc

SEQ ID NO: 1474602 - RNA, 19 nt, Homo sapiens
ccucguggcugagaucauc

SEQ ID NO: 1474603 - RNA, 19 nt, Homo sapiens
uggaccagcuucaggacuu

SEQ ID NO: 1474604 - RNA, 19 nt, Homo sapiens
ucacauccuugagauugga

SEQ ID NO: 1474605 - RNA, 19 nt, Homo sapiens
gcaugguaaccuuguaaau

SEQ ID NO: 1474606 - RNA, 19 nt, Homo sapiens
gcaaauggcucaacaagga

SEQ ID NO: 1474607 - RNA, 19 nt, Homo sapiens
ggagugacuuccagaaaua

SEQ ID NO: 1474608 - RNA, 19 nt, Homo sapiens
ccacugggauuccuacuua

SEQ ID NO: 1474609 - RNA, 19 nt, Homo sapiens
ggaaauaaguuuugaguga

SEQ ID NO: 1474610 - RNA, 19 nt, Homo sapiens
gaaccaagaauuacagaaa

SEQ ID NO: 1474611 - RNA, 19 nt, Homo sapiens
gaaauauccugacccacaa

SEQ ID NO: 1474612 - RNA, 19 nt, Homo sapiens
ucagugagcugcccuuuga

SEQ ID NO: 1474613 - RNA, 19 nt, Homo sapiens
ggacacugcuugagaagau

SEQ ID NO: 1474614 - RNA, 19 nt, Homo sapiens
ggaagaaggaguacauuga

SEQ ID NO: 1474615 - RNA, 19 nt, Homo sapiens
ucaggaagauuuacuauag

SEQ ID NO: 1474616 - RNA, 19 nt, Homo sapiens
caagagauguccuuuaguc

SEQ ID NO: 1474617 - RNA, 19 nt, Homo sapiens
ucuaugagguugucuauga

SEQ ID NO: 1474618 - RNA, 19 nt, Homo sapiens
gcacaacaucuccuuggua

SEQ ID NO: 1474619 - RNA, 19 nt, Homo sapiens
agagugagccugaagauuu

SEQ ID NO: 1474620 - RNA, 19 nt, Homo sapiens
uaacuaggcuacaggaaca

SEQ ID NO: 1474621 - RNA, 19 nt, Homo sapiens
gaugagaugugagcuggaa

SEQ ID NO: 1474622 - RNA, 19 nt, Homo sapiens
gcaugcagaugagauguga

SEQ ID NO: 1474623 - RNA, 19 nt, Homo sapiens
gaagaaggaguacauugau

SEQ ID NO: 1474624 - RNA, 19 nt, Homo sapiens
gaaacugggccaaauguag

SEQ ID NO: 1474625 - RNA, 19 nt, Homo sapiens
ccacaaggacguaacagaa

SEQ ID NO: 1474626 - RNA, 19 nt, Homo sapiens
gcucaaacuuccaacaaag

SEQ ID NO: 1474627 - RNA, 19 nt, Homo sapiens
ucaagaaggucaggaggaa

SEQ ID NO: 1474628 - RNA, 19 nt, Homo sapiens
ggccuagucugcauuuguu

SEQ ID NO: 1474629 - RNA, 19 nt, Homo sapiens
gaagcugggucugaggauu

SEQ ID NO: 1474630 - RNA, 19 nt, Homo sapiens
gcagucagcucaggacagu

SEQ ID NO: 1474631 - RNA, 19 nt, Homo sapiens
gagugagccugaagauuuc

SEQ ID NO: 1474632 - RNA, 19 nt, Homo sapiens
gcuaccuacuucuuaaauu

SEQ ID NO: 1474633 - RNA, 19 nt, Homo sapiens
gcggcuaccuacuucuuaa

SEQ ID NO: 1474634 - RNA, 19 nt, Homo sapiens
gcauuuguuugcauauaug

SEQ ID NO: 1474635 - RNA, 19 nt, Homo sapiens
cccaagagauguccuuuag

SEQ ID NO: 1474636 - RNA, 19 nt, Homo sapiens
cuaccuacuucuuaaauuc

SEQ ID NO: 1474637 - RNA, 19 nt, Homo sapiens
gcacagaaccaagaauuac

SEQ ID NO: 1474638 - RNA, 19 nt, Homo sapiens
ggaaacugggccaaaugua

SEQ ID NO: 1474639 - RNA, 19 nt, Homo sapiens
guucuccuaugcucuauga

SEQ ID NO: 1474640 - RNA, 19 nt, Homo sapiens
gcaaccaguucuccuaugc

SEQ ID NO: 1474641 - RNA, 19 nt, Homo sapiens
gaccagcacuuguguuuug

SEQ ID NO: 1474642 - RNA, 19 nt, Homo sapiens
ggaugcaaauggcucaaca

SEQ ID NO: 1474643 - RNA, 19 nt, Homo sapiens
cggagugacuuccagaaau

SEQ ID NO: 1474644 - RNA, 19 nt, Homo sapiens
gcauuuauggugccugauu

SEQ ID NO: 1474645 - RNA, 19 nt, Homo sapiens
caguggagcccagcauuua

SEQ ID NO: 1474646 - RNA, 19 nt, Homo sapiens
caccaaacccucaggaaga

SEQ ID NO: 1474647 - RNA, 19 nt, Homo sapiens
caaacccucaggaagauuu

SEQ ID NO: 1474648 - RNA, 19 nt, Homo sapiens
gauaucuucucgacaggau

SEQ ID NO: 1474649 - RNA, 19 nt, Homo sapiens
aagcauggaucucggaauc

SEQ ID NO: 1474650 - RNA, 19 nt, Homo sapiens
ccucaaauacuucuguuau

SEQ ID NO: 1474651 - RNA, 19 nt, Homo sapiens
caacccugcugcccuguca

SEQ ID NO: 1474652 - RNA, 19 nt, Homo sapiens
cuucuuaaauuccguuugu

SEQ ID NO: 1474653 - RNA, 19 nt, Homo sapiens
cagaccagcacuuguguuu

SEQ ID NO: 1474654 - RNA, 19 nt, Homo sapiens
gagguguacugcucagaag

SEQ ID NO: 1474655 - RNA, 19 nt, Homo sapiens
cacaaggacguaacagaaa

SEQ ID NO: 1474656 - RNA, 19 nt, Homo sapiens
aagcugggucugaggauua

SEQ ID NO: 1474657 - RNA, 19 nt, Homo sapiens
aagaaggaguacauugaug

SEQ ID NO: 1474658 - RNA, 19 nt, Homo sapiens
ccaguucuccuaugcucua

SEQ ID NO: 1474659 - RNA, 19 nt, Homo sapiens
gagccaaggaugcaaaugg

SEQ ID NO: 1474660 - RNA, 19 nt, Homo sapiens
ggguuucccugcccucuca

SEQ ID NO: 1474661 - RNA, 19 nt, Homo sapiens
ggaagauuuacuauagcua

SEQ ID NO: 1474662 - RNA, 19 nt, Homo sapiens
gcacuuguguuuugauucu

SEQ ID NO: 1474663 - RNA, 19 nt, Homo sapiens
ccaaauguaggccuuaucu

SEQ ID NO: 1474664 - RNA, 19 nt, Homo sapiens
gggaaacugggccaaaugu

SEQ ID NO: 1474665 - RNA, 19 nt, Homo sapiens
gagagugagccugaagauu

SEQ ID NO: 1474666 - RNA, 19 nt, Homo sapiens
ggcauccacuuuuguagua

SEQ ID NO: 1474667 - RNA, 19 nt, Homo sapiens
cucaaauacuucuguuaug

SEQ ID NO: 1474668 - RNA, 19 nt, Homo sapiens
ggaggaaaauccguaacaa

SEQ ID NO: 1474669 - RNA, 19 nt, Homo sapiens
gauuuacuauagcuaagag

SEQ ID NO: 1474670 - RNA, 19 nt, Homo sapiens
ucaguggagcccagcauuu

SEQ ID NO: 1474671 - RNA, 19 nt, Homo sapiens
gagugagaaauaaacguuu

SEQ ID NO: 1474672 - RNA, 19 nt, Homo sapiens
ugagugagaaauaaacguu

SEQ ID NO: 1474673 - RNA, 19 nt, Homo sapiens
caacaucuccuugguagcu

SEQ ID NO: 1474674 - RNA, 19 nt, Homo sapiens
ggcaaccaguucuccuaug

SEQ ID NO: 1474675 - RNA, 19 nt, Homo sapiens
gcucuaugagguugucuau

SEQ ID NO: 1474676 - RNA, 19 nt, Homo sapiens
ucaagagagugagccugaa

SEQ ID NO: 1474677 - RNA, 19 nt, Homo sapiens
gcccagaccagcacuugug

SEQ ID NO: 1474678 - RNA, 19 nt, Homo sapiens
cagcugcagacgcuaauug

SEQ ID NO: 1474679 - RNA, 19 nt, Homo sapiens
ugcacagaaccaagaauua

SEQ ID NO: 1474680 - RNA, 19 nt, Homo sapiens
cauuuauggugccugauuc

SEQ ID NO: 1474681 - RNA, 19 nt, Homo sapiens
gggcaaccaguucuccuau

SEQ ID NO: 1474682 - RNA, 19 nt, Homo sapiens
ggacugcaaggcuggaagu

SEQ ID NO: 1474683 - RNA, 19 nt, Homo sapiens
ugcucaaacuuccaacaaa

SEQ ID NO: 1474684 - RNA, 19 nt, Homo sapiens
acaaggacguaacagaaaa

SEQ ID NO: 1474685 - RNA, 19 nt, Homo sapiens
cggaagaaggaguacauug

SEQ ID NO: 1474686 - RNA, 19 nt, Homo sapiens
guaccucaaauacuucugu

SEQ ID NO: 1474687 - RNA, 19 nt, Homo sapiens
cugcacagaaccaagaauu

SEQ ID NO: 1474688 - RNA, 19 nt, Homo sapiens
gacgcuaauugcucaaacu

SEQ ID NO: 1474689 - RNA, 19 nt, Homo sapiens
aagcaucuccuggcaguga

SEQ ID NO: 1474690 - RNA, 19 nt, Homo sapiens
caagagagugagccugaag

SEQ ID NO: 1474691 - RNA, 19 nt, Homo sapiens
ucuggagacccaaguggua

SEQ ID NO: 1474692 - RNA, 19 nt, Homo sapiens
ucagcuaggagacaccaaa

SEQ ID NO: 1474693 - RNA, 19 nt, Homo sapiens
ggcacaacaucuccuuggu

SEQ ID NO: 1474694 - RNA, 19 nt, Homo sapiens
gaggggaaauaaguuuuga

SEQ ID NO: 1474695 - RNA, 19 nt, Homo sapiens
caagaaggucaggaggaaa

SEQ ID NO: 1474696 - RNA, 19 nt, Homo sapiens
caaaagcgagggcuacaga

SEQ ID NO: 1474697 - RNA, 19 nt, Homo sapiens
cuacagaacaggcauucag

SEQ ID NO: 1474698 - RNA, 19 nt, Homo sapiens
uaccucaaauacuucuguu

SEQ ID NO: 1474699 - RNA, 19 nt, Homo sapiens
aaacccucaggaagauuua

SEQ ID NO: 1474700 - RNA, 19 nt, Homo sapiens
ccagagguuccgguaacua

SEQ ID NO: 1474701 - RNA, 19 nt, Homo sapiens
guggagcccagcauuuaug

SEQ ID NO: 1474702 - RNA, 19 nt, Homo sapiens
ggcuguggccuucaagaga

SEQ ID NO: 1474703 - RNA, 19 nt, Homo sapiens
gaugcaaauggcucaacaa

SEQ ID NO: 1474704 - RNA, 19 nt, Homo sapiens
gacaccaaacccucaggaa

SEQ ID NO: 1474705 - RNA, 19 nt, Homo sapiens
cagagguuccgguaacuag

SEQ ID NO: 1474706 - RNA, 19 nt, Homo sapiens
gaacacaagcuuucuauag

SEQ ID NO: 1474707 - RNA, 19 nt, Homo sapiens
caaaagagguuccuacauu

SEQ ID NO: 1474708 - RNA, 19 nt, Homo sapiens
cagaggagcugguuucuca

SEQ ID NO: 1474709 - RNA, 19 nt, Homo sapiens
gcugguggcuucucuugaa

SEQ ID NO: 1474710 - RNA, 19 nt, Homo sapiens
ugaacgaccugaaucacuu

SEQ ID NO: 1474711 - RNA, 19 nt, Homo sapiens
caggaaacgugcucuggaa

SEQ ID NO: 1474712 - RNA, 19 nt, Homo sapiens
agacaaggccuucuucaga

SEQ ID NO: 1474713 - RNA, 19 nt, Homo sapiens
gaaggucuaggaacuguga

SEQ ID NO: 1474714 - RNA, 19 nt, Homo sapiens
gaccugagccuggaauuug

SEQ ID NO: 1474715 - RNA, 19 nt, Homo sapiens
gaaaugcagccaagaagag

SEQ ID NO: 1474716 - RNA, 19 nt, Homo sapiens
gaaccaagccaggacauag

SEQ ID NO: 1474717 - RNA, 19 nt, Homo sapiens
ucagaugccuccucuccuu

SEQ ID NO: 1474718 - RNA, 19 nt, Homo sapiens
ggaacacaagcuuucuaua

SEQ ID NO: 1474719 - RNA, 19 nt, Homo sapiens
gugaggaguuccagccauu

SEQ ID NO: 1474720 - RNA, 19 nt, Homo sapiens
ccaccaguccaacaucuuu

SEQ ID NO: 1474721 - RNA, 19 nt, Homo sapiens
gagaagaggccagacaucu

SEQ ID NO: 1474722 - RNA, 19 nt, Homo sapiens
ggaagagcacucacucagu

SEQ ID NO: 1474723 - RNA, 19 nt, Homo sapiens
gggaacacaagcuuucuau

SEQ ID NO: 1474724 - RNA, 19 nt, Homo sapiens
gaacugugaggccugaaca

SEQ ID NO: 1474725 - RNA, 19 nt, Homo sapiens
ggagagcuucuuccagugu

SEQ ID NO: 1474726 - RNA, 19 nt, Homo sapiens
ugacugagaacaaggacuu

SEQ ID NO: 1474727 - RNA, 19 nt, Homo sapiens
aaagagguuccuacauuga

SEQ ID NO: 1474728 - RNA, 19 nt, Homo sapiens
agucggaggucuuaguuca

SEQ ID NO: 1474729 - RNA, 19 nt, Homo sapiens
gcccggaacaagaaauaaa

SEQ ID NO: 1474730 - RNA, 19 nt, Homo sapiens
gagcugguggcuucucuug

SEQ ID NO: 1474731 - RNA, 19 nt, Homo sapiens
gacaauagacagacuccau

SEQ ID NO: 1474732 - RNA, 19 nt, Homo sapiens
guccaaagcccgagacaag

SEQ ID NO: 1474733 - RNA, 19 nt, Homo sapiens
ugaaaugcagccaagaaga

SEQ ID NO: 1474734 - RNA, 19 nt, Homo sapiens
ugaagacgccagccugaug

SEQ ID NO: 1474735 - RNA, 19 nt, Homo sapiens
cccagcagcucuucugaca

SEQ ID NO: 1474736 - RNA, 19 nt, Homo sapiens
aaaagagguuccuacauug

SEQ ID NO: 1474737 - RNA, 19 nt, Homo sapiens
ccggaacaagaaauaaaua

SEQ ID NO: 1474738 - RNA, 19 nt, Homo sapiens
ggaccuuucauccucagaa

SEQ ID NO: 1474739 - RNA, 19 nt, Homo sapiens
gacugaaggucuaggaacu

SEQ ID NO: 1474740 - RNA, 19 nt, Homo sapiens
gaacgaccugaaucacuuc

SEQ ID NO: 1474741 - RNA, 19 nt, Homo sapiens
guccagcgaugccaagaag

SEQ ID NO: 1474742 - RNA, 19 nt, Homo sapiens
uggcaguucuuccuaugga

SEQ ID NO: 1474743 - RNA, 19 nt, Homo sapiens
aacacaagcuuucuauagg

SEQ ID NO: 1474744 - RNA, 19 nt, Homo sapiens
cgccaagucuccaggaagu

SEQ ID NO: 1474745 - RNA, 19 nt, Homo sapiens
cacccugacugaaggucua

SEQ ID NO: 1474746 - RNA, 19 nt, Homo sapiens
gccagagucggaggucuua

SEQ ID NO: 1474747 - RNA, 19 nt, Homo sapiens
ccaggaaagcguccacugu

SEQ ID NO: 1474748 - RNA, 19 nt, Homo sapiens
ccuggaauuugccgagaug

SEQ ID NO: 1474749 - RNA, 19 nt, Homo sapiens
cagcgagggaugccacauu

SEQ ID NO: 1474750 - RNA, 19 nt, Homo sapiens
aaaaggggcuuggaccauu

SEQ ID NO: 1474751 - RNA, 19 nt, Homo sapiens
ccaagccagugaggaguuc

SEQ ID NO: 1474752 - RNA, 19 nt, Homo sapiens
caacaucuuuauggugacu

SEQ ID NO: 1474753 - RNA, 19 nt, Homo sapiens
aaugaaguguccgaugcua

SEQ ID NO: 1474754 - RNA, 19 nt, Homo sapiens
caccaguccaacaucuuua

SEQ ID NO: 1474755 - RNA, 19 nt, Homo sapiens
ugaaguguccgaugcuaag

SEQ ID NO: 1474756 - RNA, 19 nt, Homo sapiens
gcccaggaauggcuuucuc

SEQ ID NO: 1474757 - RNA, 19 nt, Homo sapiens
gagggacaauagacagacu

SEQ ID NO: 1474758 - RNA, 19 nt, Homo sapiens
gagacaaggccuucuucag

SEQ ID NO: 1474759 - RNA, 19 nt, Homo sapiens
ggacaguggagagcuucuu

SEQ ID NO: 1474760 - RNA, 19 nt, Homo sapiens
gaccuuucauccucagaac

SEQ ID NO: 1474761 - RNA, 19 nt, Homo sapiens
gcugguuucucaccguucu

SEQ ID NO: 1474762 - RNA, 19 nt, Homo sapiens
gcgagaagaggccagacau

SEQ ID NO: 1474763 - RNA, 19 nt, Homo sapiens
ggcagacccaucacuggaa

SEQ ID NO: 1474764 - RNA, 19 nt, Homo sapiens
ggaccauuccugcaaacag

SEQ ID NO: 1474765 - RNA, 19 nt, Homo sapiens
uauggugacugagaacaag

SEQ ID NO: 1474766 - RNA, 19 nt, Homo sapiens
ccuggcaguucuuccuaug

SEQ ID NO: 1474767 - RNA, 19 nt, Homo sapiens
cuuggaccauuccugcaaa

SEQ ID NO: 1474768 - RNA, 19 nt, Homo sapiens
gacaguggagagcuucuuc

SEQ ID NO: 1474769 - RNA, 19 nt, Homo sapiens
ucggaggucuuaguucaca

SEQ ID NO: 1474770 - RNA, 19 nt, Homo sapiens
gaaagcaaguuacgauaua

SEQ ID NO: 1474771 - RNA, 19 nt, Homo sapiens
gaaagaaccagacaucaaa

SEQ ID NO: 1474772 - RNA, 19 nt, Homo sapiens
ggacaucuguucuuuagga

SEQ ID NO: 1474773 - RNA, 19 nt, Homo sapiens
gccuauaccuuucgaauuu

SEQ ID NO: 1474774 - RNA, 19 nt, Homo sapiens
gaucauacuuuauccaguu

SEQ ID NO: 1474775 - RNA, 19 nt, Homo sapiens
gaaaacaucuggagaaaau

SEQ ID NO: 1474776 - RNA, 19 nt, Homo sapiens
caaguggacugauacauug

SEQ ID NO: 1474777 - RNA, 19 nt, Homo sapiens
caaaggaccuggaccaaca

SEQ ID NO: 1474778 - RNA, 19 nt, Homo sapiens
ggaugaaucuacccaagaa

SEQ ID NO: 1474779 - RNA, 19 nt, Homo sapiens
caacuugcacuuagaauuu

SEQ ID NO: 1474780 - RNA, 19 nt, Homo sapiens
ggcugaagcucaagaagua

SEQ ID NO: 1474781 - RNA, 19 nt, Homo sapiens
gaauuucucuagcaguaaa

SEQ ID NO: 1474782 - RNA, 19 nt, Homo sapiens
cagcuuaugcuuacuguua

SEQ ID NO: 1474783 - RNA, 19 nt, Homo sapiens
caucgaagccuaaagauug

SEQ ID NO: 1474784 - RNA, 19 nt, Homo sapiens
gggauuuaauguagcuuua

SEQ ID NO: 1474785 - RNA, 19 nt, Homo sapiens
gaaccgacucugagaaauu

SEQ ID NO: 1474786 - RNA, 19 nt, Homo sapiens
gagaaaauaucuucacuug

SEQ ID NO: 1474787 - RNA, 19 nt, Homo sapiens
gaagcacuguguaaagaau

SEQ ID NO: 1474788 - RNA, 19 nt, Homo sapiens
gaccauagcucaaaaggaa

SEQ ID NO: 1474789 - RNA, 19 nt, Homo sapiens
aaucaggucucuccaagaa

SEQ ID NO: 1474790 - RNA, 19 nt, Homo sapiens
uaaaugcggugaagcaauc

SEQ ID NO: 1474791 - RNA, 19 nt, Homo sapiens
cauagaagcauacguuauu

SEQ ID NO: 1474792 - RNA, 19 nt, Homo sapiens
cagaagcacuguguaaaga

SEQ ID NO: 1474793 - RNA, 19 nt, Homo sapiens
gaacucaaagcaaauuaug

SEQ ID NO: 1474794 - RNA, 19 nt, Homo sapiens
aagcauacguuauucaaug

SEQ ID NO: 1474795 - RNA, 19 nt, Homo sapiens
cuacacagcuuaugcuuac

SEQ ID NO: 1474796 - RNA, 19 nt, Homo sapiens
gagcuguaauccagaaaug

SEQ ID NO: 1474797 - RNA, 19 nt, Homo sapiens
aggaagagauuuagaguca

SEQ ID NO: 1474798 - RNA, 19 nt, Homo sapiens
uaacagaagaugaagcaaa

SEQ ID NO: 1474799 - RNA, 19 nt, Homo sapiens
uaccaaauaugcuucaaga

SEQ ID NO: 1474800 - RNA, 19 nt, Homo sapiens
agaaagggaugaugaacga

SEQ ID NO: 1474801 - RNA, 19 nt, Homo sapiens
caggacaucuguucuuuag

SEQ ID NO: 1474802 - RNA, 19 nt, Homo sapiens
ucacugauuugagcuguaa

SEQ ID NO: 1474803 - RNA, 19 nt, Homo sapiens
uuggaaaccuugugaagaa

SEQ ID NO: 1474804 - RNA, 19 nt, Homo sapiens
gaaguucaucgaagccuaa

SEQ ID NO: 1474805 - RNA, 19 nt, Homo sapiens
gaugaagaaugcagcagau

SEQ ID NO: 1474806 - RNA, 19 nt, Homo sapiens
ugacaguacuaaacccaaa

SEQ ID NO: 1474807 - RNA, 19 nt, Homo sapiens
gugaagaacacccuagaaa

SEQ ID NO: 1474808 - RNA, 19 nt, Homo sapiens
gcucaagaaguaacaauug

SEQ ID NO: 1474809 - RNA, 19 nt, Homo sapiens
gaagaagugaaaccuguga

SEQ ID NO: 1474810 - RNA, 19 nt, Homo sapiens
caagaaagcaaguuacgau

SEQ ID NO: 1474811 - RNA, 19 nt, Homo sapiens
aaauacaacuugcacuuag

SEQ ID NO: 1474812 - RNA, 19 nt, Homo sapiens
ucaaguggacugauacauu

SEQ ID NO: 1474813 - RNA, 19 nt, Homo sapiens
aaacauuggcugcauuuga

SEQ ID NO: 1474814 - RNA, 19 nt, Homo sapiens
uaaagaauauggagaaacc

SEQ ID NO: 1474815 - RNA, 19 nt, Homo sapiens
ugaaagaaccagacaucaa

SEQ ID NO: 1474816 - RNA, 19 nt, Homo sapiens
cagaaacauuggcugcauu

SEQ ID NO: 1474817 - RNA, 19 nt, Homo sapiens
cgaauuuccuccuacaagu

SEQ ID NO: 1474818 - RNA, 19 nt, Homo sapiens
gcagaagcacuguguaaag

SEQ ID NO: 1474819 - RNA, 19 nt, Homo sapiens
caaauuauggucucguaga

SEQ ID NO: 1474820 - RNA, 19 nt, Homo sapiens
ggaaagucaucucccaaaa

SEQ ID NO: 1474821 - RNA, 19 nt, Homo sapiens
cuucaagacuggcuggaaa

SEQ ID NO: 1474822 - RNA, 19 nt, Homo sapiens
cagaaaugaugaagaaugc

SEQ ID NO: 1474823 - RNA, 19 nt, Homo sapiens
agugaaaccugugaaagaa

SEQ ID NO: 1474824 - RNA, 19 nt, Homo sapiens
aaacagccaauuucuauca

SEQ ID NO: 1474825 - RNA, 19 nt, Homo sapiens
aaccgacucugagaaauuu

SEQ ID NO: 1474826 - RNA, 19 nt, Homo sapiens
ggaacucaaagcaaauuau

SEQ ID NO: 1474827 - RNA, 19 nt, Homo sapiens
ggaccuggaccaacaguca

SEQ ID NO: 1474828 - RNA, 19 nt, Homo sapiens
cguaugaaacagccaauuu

SEQ ID NO: 1474829 - RNA, 19 nt, Homo sapiens
ccagaaaugaugaagaaug

SEQ ID NO: 1474830 - RNA, 19 nt, Homo sapiens
gaaggccgagggagaaguu

SEQ ID NO: 1474831 - RNA, 19 nt, Homo sapiens
gcacgacuccuugaacugu

SEQ ID NO: 1474832 - RNA, 19 nt, Homo sapiens
ucguagagccuauaccuuu

SEQ ID NO: 1474833 - RNA, 19 nt, Homo sapiens
uugcugcacuggcguauga

SEQ ID NO: 1474834 - RNA, 19 nt, Homo sapiens
ccaaauaugcuucaagacu

SEQ ID NO: 1474835 - RNA, 19 nt, Homo sapiens
gaagugaaaccugugaaag

SEQ ID NO: 1474836 - RNA, 19 nt, Homo sapiens
ccaaggaugacaguacuaa

SEQ ID NO: 1474837 - RNA, 19 nt, Homo sapiens
guuuggagccugcauauuc

SEQ ID NO: 1474838 - RNA, 19 nt, Homo sapiens
gcuuguggacuccgauaua

SEQ ID NO: 1474839 - RNA, 19 nt, Homo sapiens
guucaucgaagccuaaaga

SEQ ID NO: 1474840 - RNA, 19 nt, Homo sapiens
gcaaggacagguuccaagu

SEQ ID NO: 1474841 - RNA, 19 nt, Homo sapiens
aauuucaaguggacugaua

SEQ ID NO: 1474842 - RNA, 19 nt, Homo sapiens
agucaaaccuucaggacau

SEQ ID NO: 1474843 - RNA, 19 nt, Homo sapiens
gcaaguuacgauauauuca

SEQ ID NO: 1474844 - RNA, 19 nt, Homo sapiens
ccagacaucaaaccucaaa

SEQ ID NO: 1474845 - RNA, 19 nt, Homo sapiens
uaggaaacuuggaaaccuu

SEQ ID NO: 1474846 - RNA, 19 nt, Homo sapiens
caaaccagaagaagaagug

SEQ ID NO: 1474847 - RNA, 19 nt, Homo sapiens
aacauuggcugcauuugau

SEQ ID NO: 1474848 - RNA, 19 nt, Homo sapiens
gaagcauacguuauucaau

SEQ ID NO: 1474849 - RNA, 19 nt, Homo sapiens
auccagaaaugaugaagaa

SEQ ID NO: 1474850 - RNA, 19 nt, Homo sapiens
ggaccaacagucaaaccuu

SEQ ID NO: 1474851 - RNA, 19 nt, Homo sapiens
gaauauggagaaaccaaag

SEQ ID NO: 1474852 - RNA, 19 nt, Homo sapiens
gcagcagauucauauuucu

SEQ ID NO: 1474853 - RNA, 19 nt, Homo sapiens
gggcacgacuccuugaacu

SEQ ID NO: 1474854 - RNA, 19 nt, Homo sapiens
gaauuuccuccuacaagug

SEQ ID NO: 1474855 - RNA, 19 nt, Homo sapiens
aaacuuggaaaccuuguga

SEQ ID NO: 1474856 - RNA, 19 nt, Homo sapiens
gacaucuguucuuuaggaa

SEQ ID NO: 1474857 - RNA, 19 nt, Homo sapiens
ucaggacaucuguucuuua

SEQ ID NO: 1474858 - RNA, 19 nt, Homo sapiens
agacuuuauuggcuaguga

SEQ ID NO: 1474859 - RNA, 19 nt, Homo sapiens
gggcaacucuucucuuccu

SEQ ID NO: 1474860 - RNA, 19 nt, Homo sapiens
agaaagcaaguuacgauau

SEQ ID NO: 1474861 - RNA, 19 nt, Homo sapiens
gacacugggugcuacaucu

SEQ ID NO: 1474862 - RNA, 19 nt, Homo sapiens
ccagaaacauuggcugcau

SEQ ID NO: 1474863 - RNA, 19 nt, Homo sapiens
gagccuauaccuuucgaau

SEQ ID NO: 1474864 - RNA, 19 nt, Homo sapiens
ugcagcagauucauauuuc

SEQ ID NO: 1474865 - RNA, 19 nt, Homo sapiens
ccaaaagacccaaggauga

SEQ ID NO: 1474866 - RNA, 19 nt, Homo sapiens
agaaacauuggcugcauuu

SEQ ID NO: 1474867 - RNA, 19 nt, Homo sapiens
caucuguucuuuaggaaac

SEQ ID NO: 1474868 - RNA, 19 nt, Homo sapiens
uuaccauggugagacuuua

SEQ ID NO: 1474869 - RNA, 19 nt, Homo sapiens
aaacaugcuccuggacuaa

SEQ ID NO: 1474870 - RNA, 19 nt, Homo sapiens
gcccagcucucgauacguu

SEQ ID NO: 1474871 - RNA, 19 nt, Homo sapiens
uaaagccugucccgugaaa

SEQ ID NO: 1474872 - RNA, 19 nt, Homo sapiens
aaaugugacuucaaaggaa

SEQ ID NO: 1474873 - RNA, 19 nt, Homo sapiens
gagcgaggccagcaccuuu

SEQ ID NO: 1474874 - RNA, 19 nt, Homo sapiens
ccaaguggaccguggauga

SEQ ID NO: 1474875 - RNA, 19 nt, Homo sapiens
gaccuuggcucuacuucca

SEQ ID NO: 1474876 - RNA, 19 nt, Homo sapiens
aaugugacuucaaaggaaa

SEQ ID NO: 1474877 - RNA, 19 nt, Homo sapiens
gacccacccuggcaugauc

SEQ ID NO: 1474878 - RNA, 19 nt, Homo sapiens
ggcagagccuggugcagau

SEQ ID NO: 1474879 - RNA, 19 nt, Homo sapiens
ucccaccgcuuuauuucuu

SEQ ID NO: 1474880 - RNA, 19 nt, Homo sapiens
gaaugggaccuuggcucua

SEQ ID NO: 1474881 - RNA, 19 nt, Homo sapiens
cugaggacgucaccaagug

SEQ ID NO: 1474882 - RNA, 19 nt, Homo sapiens
gcuaggcucugggcacaag

SEQ ID NO: 1474883 - RNA, 19 nt, Homo sapiens
cucgauacguuuggucuuu

SEQ ID NO: 1474884 - RNA, 19 nt, Homo sapiens
cgauacguuuggucuuuca

SEQ ID NO: 1474885 - RNA, 19 nt, Homo sapiens
gaaaaugugacuucaaagg

SEQ ID NO: 1474886 - RNA, 19 nt, Homo sapiens
caggagagcagcccuuguc

SEQ ID NO: 1474887 - RNA, 19 nt, Homo sapiens
cacaagauggcucggaaga

SEQ ID NO: 1474888 - RNA, 19 nt, Homo sapiens
gcgaggccagcaccuuuga

SEQ ID NO: 1474889 - RNA, 19 nt, Homo sapiens
ccaccgcuuuauuucuuuc

SEQ ID NO: 1474890 - RNA, 19 nt, Homo sapiens
gagccaccacucaacacaa

SEQ ID NO: 1474891 - RNA, 19 nt, Homo sapiens
ggagccaccacucaacaca

SEQ ID NO: 1474892 - RNA, 19 nt, Homo sapiens
cagcccagcucucgauacg

SEQ ID NO: 1474893 - RNA, 19 nt, Homo sapiens
agccaccacucaacacaau

SEQ ID NO: 1474894 - RNA, 19 nt, Homo sapiens
gcccuugccggucaaacuu

SEQ ID NO: 1474895 - RNA, 19 nt, Homo sapiens
gaaagaauguuaugaaugg

SEQ ID NO: 1474896 - RNA, 19 nt, Homo sapiens
gaacaaccuucaacaucua

SEQ ID NO: 1474897 - RNA, 19 nt, Homo sapiens
gaacaacauucccuuugaa

SEQ ID NO: 1474898 - RNA, 19 nt, Homo sapiens
gcucuugccuccuuucuaa

SEQ ID NO: 1474899 - RNA, 19 nt, Homo sapiens
gaaaggagucuaaagaaga

SEQ ID NO: 1474900 - RNA, 19 nt, Homo sapiens
gaaagaagaauucagaugu

SEQ ID NO: 1474901 - RNA, 19 nt, Homo sapiens
gaagucaggucagcagaaa

SEQ ID NO: 1474902 - RNA, 19 nt, Homo sapiens
aaagaaaggucacugaauc

SEQ ID NO: 1474903 - RNA, 19 nt, Homo sapiens
ggacauuauuugccuguug

SEQ ID NO: 1474904 - RNA, 19 nt, Homo sapiens
caagaaaggagucuaaaga

SEQ ID NO: 1474905 - RNA, 19 nt, Homo sapiens
gaaauagagcggcuacuug

SEQ ID NO: 1474906 - RNA, 19 nt, Homo sapiens
gaugugugauugaggauga

SEQ ID NO: 1474907 - RNA, 19 nt, Homo sapiens
gaggagaaguuugaagaug

SEQ ID NO: 1474908 - RNA, 19 nt, Homo sapiens
ggaaagaagaauucagaug

SEQ ID NO: 1474909 - RNA, 19 nt, Homo sapiens
uggauaaguugaagaaaga

SEQ ID NO: 1474910 - RNA, 19 nt, Homo sapiens
gaagaaaguaaggaggaua

SEQ ID NO: 1474911 - RNA, 19 nt, Homo sapiens
gaagaugaagaagaaagua

SEQ ID NO: 1474912 - RNA, 19 nt, Homo sapiens
gcagaaaauuccucaaaau

SEQ ID NO: 1474913 - RNA, 19 nt, Homo sapiens
gaaguuugaagaugcauau

SEQ ID NO: 1474914 - RNA, 19 nt, Homo sapiens
agaagaagaacaacaagaa

SEQ ID NO: 1474915 - RNA, 19 nt, Homo sapiens
ggagaaguuugaagaugca

SEQ ID NO: 1474916 - RNA, 19 nt, Homo sapiens
gaggagagcaugccuaaac

SEQ ID NO: 1474917 - RNA, 19 nt, Homo sapiens
caaagaaaggucacugaau

SEQ ID NO: 1474918 - RNA, 19 nt, Homo sapiens
gacauuauuugccuguugu

SEQ ID NO: 1474919 - RNA, 19 nt, Homo sapiens
agaacaaccuucaacaucu

SEQ ID NO: 1474920 - RNA, 19 nt, Homo sapiens
agagagagcagaagaacaa

SEQ ID NO: 1474921 - RNA, 19 nt, Homo sapiens
ucauugagccugaaauaga

SEQ ID NO: 1474922 - RNA, 19 nt, Homo sapiens
gcaauggcucugaguaaau

SEQ ID NO: 1474923 - RNA, 19 nt, Homo sapiens
aaauagagcggcuacuuga

SEQ ID NO: 1474924 - RNA, 19 nt, Homo sapiens
guggauaaguugaagaaag

SEQ ID NO: 1474925 - RNA, 19 nt, Homo sapiens
guacuaaggaacaacauuc

SEQ ID NO: 1474926 - RNA, 19 nt, Homo sapiens
gggaggagagcaugccuaa

SEQ ID NO: 1474927 - RNA, 19 nt, Homo sapiens
agaaaggagucuaaagaag

SEQ ID NO: 1474928 - RNA, 19 nt, Homo sapiens
gaacauaugcaggagaagu

SEQ ID NO: 1474929 - RNA, 19 nt, Homo sapiens
caacaucuacagagaagga

SEQ ID NO: 1474930 - RNA, 19 nt, Homo sapiens
guaaauccacuaacucaca

SEQ ID NO: 1474931 - RNA, 19 nt, Homo sapiens
cuacugaagaccuuuauga

SEQ ID NO: 1474932 - RNA, 19 nt, Homo sapiens
gaagaauucagaugucagu

SEQ ID NO: 1474933 - RNA, 19 nt, Homo sapiens
aaagaagaauucagauguc

SEQ ID NO: 1474934 - RNA, 19 nt, Homo sapiens
gaagaagaacaacaagaag

SEQ ID NO: 1474935 - RNA, 19 nt, Homo sapiens
caucaagaaaggagucuaa

SEQ ID NO: 1474936 - RNA, 19 nt, Homo sapiens
gaauuagucaugacaucaa

SEQ ID NO: 1474937 - RNA, 19 nt, Homo sapiens
agaaguuacuggagguuga

SEQ ID NO: 1474938 - RNA, 19 nt, Homo sapiens
gaugagaggcuuagaugca

SEQ ID NO: 1474939 - RNA, 19 nt, Homo sapiens
cagcaauggcucugaguaa

SEQ ID NO: 1474940 - RNA, 19 nt, Homo sapiens
gaaaggucacugaauccaa

SEQ ID NO: 1474941 - RNA, 19 nt, Homo sapiens
caagaugaaagagaaguaa

SEQ ID NO: 1474942 - RNA, 19 nt, Homo sapiens
cuagaggaauuagucauga

SEQ ID NO: 1474943 - RNA, 19 nt, Homo sapiens
ugaagaugcauaugagaaa

SEQ ID NO: 1474944 - RNA, 19 nt, Homo sapiens
caauggcucugaguaaauc

SEQ ID NO: 1474945 - RNA, 19 nt, Homo sapiens
ccaaagaaaggucacugaa

SEQ ID NO: 1474946 - RNA, 19 nt, Homo sapiens
gaaaauuccucaaaaucuc

SEQ ID NO: 1474947 - RNA, 19 nt, Homo sapiens
gaagaugcauaugagaaac

SEQ ID NO: 1474948 - RNA, 19 nt, Homo sapiens
gguaugaugggauguguga

SEQ ID NO: 1474949 - RNA, 19 nt, Homo sapiens
agaagaagaagaacaacaa

SEQ ID NO: 1474950 - RNA, 19 nt, Homo sapiens
ggaauuagucaugacauca

SEQ ID NO: 1474951 - RNA, 19 nt, Homo sapiens
ggccauuguucuguacuaa

SEQ ID NO: 1474952 - RNA, 19 nt, Homo sapiens
uaaagagagagcagaagaa

SEQ ID NO: 1474953 - RNA, 19 nt, Homo sapiens
gaaaguaaggaggauagga

SEQ ID NO: 1474954 - RNA, 19 nt, Homo sapiens
agaagaacaacaagaagaa

SEQ ID NO: 1474955 - RNA, 19 nt, Homo sapiens
cagaggagaaguuugaaga

SEQ ID NO: 1474956 - RNA, 19 nt, Homo sapiens
guaccaauacuccagcuau

SEQ ID NO: 1474957 - RNA, 19 nt, Homo sapiens
aaaguaaggaggauaggaa

SEQ ID NO: 1474958 - RNA, 19 nt, Homo sapiens
guggaaagaagaauucaga

SEQ ID NO: 1474959 - RNA, 19 nt, Homo sapiens
acaacaagaagaagaagaa

SEQ ID NO: 1474960 - RNA, 19 nt, Homo sapiens
aaaggagucuaaagaagag

SEQ ID NO: 1474961 - RNA, 19 nt, Homo sapiens
aaacuucaucauacccuua

SEQ ID NO: 1474962 - RNA, 19 nt, Homo sapiens
ggaggaaaauaaagagaga

SEQ ID NO: 1474963 - RNA, 19 nt, Homo sapiens
uagagcggcuacuugaaga

SEQ ID NO: 1474964 - RNA, 19 nt, Homo sapiens
ucacagugccuugcaaaga

SEQ ID NO: 1474965 - RNA, 19 nt, Homo sapiens
aagaaaggagucuaaagaa

SEQ ID NO: 1474966 - RNA, 19 nt, Homo sapiens
uauaagagagagucagcua

SEQ ID NO: 1474967 - RNA, 19 nt, Homo sapiens
aaacucauucgauucauug

SEQ ID NO: 1474968 - RNA, 19 nt, Homo sapiens
uaaggaggauaggaaacuu

SEQ ID NO: 1474969 - RNA, 19 nt, Homo sapiens
gaagaagaagaacaacaag

SEQ ID NO: 1474970 - RNA, 19 nt, Homo sapiens
gagagagucagcuaagcaa

SEQ ID NO: 1474971 - RNA, 19 nt, Homo sapiens
cacaugcucuugccuccuu

SEQ ID NO: 1474972 - RNA, 19 nt, Homo sapiens
augaauggaucaacacaug

SEQ ID NO: 1474973 - RNA, 19 nt, Homo sapiens
aagaagaauucagauguca

SEQ ID NO: 1474974 - RNA, 19 nt, Homo sapiens
gaugcaggcuugcuuuagc

SEQ ID NO: 1474975 - RNA, 19 nt, Homo sapiens
caaggcaaccuguggaaag

SEQ ID NO: 1474976 - RNA, 19 nt, Homo sapiens
gucaugacaucaagaaagg

SEQ ID NO: 1474977 - RNA, 19 nt, Homo sapiens
uugaacauaugcaggagaa

SEQ ID NO: 1474978 - RNA, 19 nt, Homo sapiens
uaagagagagucagcuaag

SEQ ID NO: 1474979 - RNA, 19 nt, Homo sapiens
agaggaggcuguaaaagaa

SEQ ID NO: 1474980 - RNA, 19 nt, Homo sapiens
cacagugccuugcaaagag

SEQ ID NO: 1474981 - RNA, 19 nt, Homo sapiens
aagaagaacaacaagaaga

SEQ ID NO: 1474982 - RNA, 19 nt, Homo sapiens
ucaagaugaaagagaagua

SEQ ID NO: 1474983 - RNA, 19 nt, Homo sapiens
gaaguuacuggagguugaa

SEQ ID NO: 1474984 - RNA, 19 nt, Homo sapiens
uaucucuccuuccgucuau

SEQ ID NO: 1474985 - RNA, 19 nt, Homo sapiens
acaagaagaagaagaaguc

SEQ ID NO: 1474986 - RNA, 19 nt, Homo sapiens
cagcuaagcaagguacauu

SEQ ID NO: 1474987 - RNA, 19 nt, Homo sapiens
ccuccuuucuaauaucaaa

SEQ ID NO: 1474988 - RNA, 19 nt, Homo sapiens
aaauaaagagagagcagaa

SEQ ID NO: 1474989 - RNA, 19 nt, Homo sapiens
ccaauaaauaucugugcaa

SEQ ID NO: 1474990 - RNA, 19 nt, Homo sapiens
gcucugaguaaauccacua

SEQ ID NO: 1474991 - RNA, 19 nt, Homo sapiens
cucaaaaucuccaaagaaa

SEQ ID NO: 1474992 - RNA, 19 nt, Homo sapiens
gaacaacaagaagaagaag

SEQ ID NO: 1474993 - RNA, 19 nt, Homo sapiens
gaagaacaacaagaagaag

SEQ ID NO: 1474994 - RNA, 19 nt, Homo sapiens
ccagcuauuugagcaguug

SEQ ID NO: 1474995 - RNA, 19 nt, Homo sapiens
gcaaucagcuucuuuauau

SEQ ID NO: 1474996 - RNA, 19 nt, Homo sapiens
ccaaagaucuacccugaga

SEQ ID NO: 1474997 - RNA, 19 nt, Homo sapiens
gaaauccaauguuccagaa

SEQ ID NO: 1474998 - RNA, 19 nt, Homo sapiens
ggacagcacuggcaaugau

SEQ ID NO: 1474999 - RNA, 19 nt, Homo sapiens
acucauagguucugucuuu

SEQ ID NO: 1475000 - RNA, 19 nt, Homo sapiens
auaguaagcugguuuagaa

SEQ ID NO: 1475001 - RNA, 19 nt, Homo sapiens
acacgaaacuagagagaaa

SEQ ID NO: 1475002 - RNA, 19 nt, Homo sapiens
caacaaauucugcaccuuu

SEQ ID NO: 1475003 - RNA, 19 nt, Homo sapiens
gguagcagcauaaagguua

SEQ ID NO: 1475004 - RNA, 19 nt, Homo sapiens
ggguuuggcucauuugaaa

SEQ ID NO: 1475005 - RNA, 19 nt, Homo sapiens
cggacaagcugaagaagaa

SEQ ID NO: 1475006 - RNA, 19 nt, Homo sapiens
gaacauggacucugacucu

SEQ ID NO: 1475007 - RNA, 19 nt, Homo sapiens
gauaacgccuguccagugu

SEQ ID NO: 1475008 - RNA, 19 nt, Homo sapiens
ucacaucguuuacaugguu

SEQ ID NO: 1475009 - RNA, 19 nt, Homo sapiens
gcauaaagguuaggcaauc

SEQ ID NO: 1475010 - RNA, 19 nt, Homo sapiens
gaagccaguuuauugugaa

SEQ ID NO: 1475011 - RNA, 19 nt, Homo sapiens
gaaaugaacacugcucuuc

SEQ ID NO: 1475012 - RNA, 19 nt, Homo sapiens
ccuaguaucuuucacacuu

SEQ ID NO: 1475013 - RNA, 19 nt, Homo sapiens
aguauuggcugauuucuug

SEQ ID NO: 1475014 - RNA, 19 nt, Homo sapiens
gaauccaugugacuuuaga

SEQ ID NO: 1475015 - RNA, 19 nt, Homo sapiens
gaucaggucaaagaaauaa

SEQ ID NO: 1475016 - RNA, 19 nt, Homo sapiens
ccucuuaguugguguguga

SEQ ID NO: 1475017 - RNA, 19 nt, Homo sapiens
gcgaagcuguuucugugaa

SEQ ID NO: 1475018 - RNA, 19 nt, Homo sapiens
aaaguucuguugcuuguau

SEQ ID NO: 1475019 - RNA, 19 nt, Homo sapiens
caaagaauaggguaaagga

SEQ ID NO: 1475020 - RNA, 19 nt, Homo sapiens
aagaauccaugugacuuua

SEQ ID NO: 1475021 - RNA, 19 nt, Homo sapiens
ugaagccaguuuauuguga

SEQ ID NO: 1475022 - RNA, 19 nt, Homo sapiens
gagauggcccguguucaua

SEQ ID NO: 1475023 - RNA, 19 nt, Homo sapiens
gguagaaacuguacauagc

SEQ ID NO: 1475024 - RNA, 19 nt, Homo sapiens
cuaauugauugguagguuu

SEQ ID NO: 1475025 - RNA, 19 nt, Homo sapiens
gcuggugguucuuagguuu

SEQ ID NO: 1475026 - RNA, 19 nt, Homo sapiens
ucaagcaagucauguuugu

SEQ ID NO: 1475027 - RNA, 19 nt, Homo sapiens
ggacucagaugacgauucc

SEQ ID NO: 1475028 - RNA, 19 nt, Homo sapiens
uaagaauccaugugacuuu

SEQ ID NO: 1475029 - RNA, 19 nt, Homo sapiens
gcaggaccguggaagacuu

SEQ ID NO: 1475030 - RNA, 19 nt, Homo sapiens
guucuuagguuuccuucug

SEQ ID NO: 1475031 - RNA, 19 nt, Homo sapiens
gcucaagcaagucauguuu

SEQ ID NO: 1475032 - RNA, 19 nt, Homo sapiens
guauaaagcgaagcuguuu

SEQ ID NO: 1475033 - RNA, 19 nt, Homo sapiens
aaaguaggcccucccauug

SEQ ID NO: 1475034 - RNA, 19 nt, Homo sapiens
gcacgacccaucugugguu

SEQ ID NO: 1475035 - RNA, 19 nt, Homo sapiens
gcacugcugguaccauuga

SEQ ID NO: 1475036 - RNA, 19 nt, Homo sapiens
ccagacacuucacaucguu

SEQ ID NO: 1475037 - RNA, 19 nt, Homo sapiens
gggacaauguggccacuuc

SEQ ID NO: 1475038 - RNA, 19 nt, Homo sapiens
cagcggguuuggcucauuu

SEQ ID NO: 1475039 - RNA, 19 nt, Homo sapiens
aagcaagucauguuuguuu

SEQ ID NO: 1475040 - RNA, 19 nt, Homo sapiens
gaacagccauacguguaag

SEQ ID NO: 1475041 - RNA, 19 nt, Homo sapiens
gcaacugucacgugugcua

SEQ ID NO: 1475042 - RNA, 19 nt, Homo sapiens
aaaggugcauuuaagaauc

SEQ ID NO: 1475043 - RNA, 19 nt, Homo sapiens
aaccagcgcuccaaagugu

SEQ ID NO: 1475044 - RNA, 19 nt, Homo sapiens
uaacaugggccuucaggau

SEQ ID NO: 1475045 - RNA, 19 nt, Homo sapiens
gcugagugcccucuuaguu

SEQ ID NO: 1475046 - RNA, 19 nt, Homo sapiens
guugguggcuaaugaagug

SEQ ID NO: 1475047 - RNA, 19 nt, Homo sapiens
gugauacucaucuccauuu

SEQ ID NO: 1475048 - RNA, 19 nt, Homo sapiens
gagccaagcccaguaacuu

SEQ ID NO: 1475049 - RNA, 19 nt, Homo sapiens
gaaugcaugugauacucau

SEQ ID NO: 1475050 - RNA, 19 nt, Homo sapiens
gaauaaccagcgcuccaaa

SEQ ID NO: 1475051 - RNA, 19 nt, Homo sapiens
caaaaguauuggcugauuu

SEQ ID NO: 1475052 - RNA, 19 nt, Homo sapiens
agccauacguguaagcuuu

SEQ ID NO: 1475053 - RNA, 19 nt, Homo sapiens
ggggagagguguucgguuu

SEQ ID NO: 1475054 - RNA, 19 nt, Homo sapiens
aaacggacaagcugaagaa

SEQ ID NO: 1475055 - RNA, 19 nt, Homo sapiens
ggcagacucuucccaccuu

SEQ ID NO: 1475056 - RNA, 19 nt, Homo sapiens
gugccgaguuccuuaaauc

SEQ ID NO: 1475057 - RNA, 19 nt, Homo sapiens
acaugggccuucaggauga

SEQ ID NO: 1475058 - RNA, 19 nt, Homo sapiens
cauaaagguuaggcaauca

SEQ ID NO: 1475059 - RNA, 19 nt, Homo sapiens
ggucagcuggugguucuua

SEQ ID NO: 1475060 - RNA, 19 nt, Homo sapiens
agaagaagaagaagaggaa

SEQ ID NO: 1475061 - RNA, 19 nt, Homo sapiens
uaucauugcuaagagauuc

SEQ ID NO: 1475062 - RNA, 19 nt, Homo sapiens
gccggaggcuguggaagaa

SEQ ID NO: 1475063 - RNA, 19 nt, Homo sapiens
ccgaguuccuuaaaucuca

SEQ ID NO: 1475064 - RNA, 19 nt, Homo sapiens
ugaacagccauacguguaa

SEQ ID NO: 1475065 - RNA, 19 nt, Homo sapiens
gcagcggguuuggcucauu

SEQ ID NO: 1475066 - RNA, 19 nt, Homo sapiens
acaugguucuguguaauuu

SEQ ID NO: 1475067 - RNA, 19 nt, Homo sapiens
ggagggaugucaccccaaa

SEQ ID NO: 1475068 - RNA, 19 nt, Homo sapiens
ccugguugguggcuaauga

SEQ ID NO: 1475069 - RNA, 19 nt, Homo sapiens
gaagucggacaccuugguu

SEQ ID NO: 1475070 - RNA, 19 nt, Homo sapiens
gaaccguaauuuggcuaau

SEQ ID NO: 1475071 - RNA, 19 nt, Homo sapiens
ggccuaugcuggcuacauc

SEQ ID NO: 1475072 - RNA, 19 nt, Homo sapiens
cugaucaggucaaagaaau

SEQ ID NO: 1475073 - RNA, 19 nt, Homo sapiens
guuccugguugguggcuaa

SEQ ID NO: 1475074 - RNA, 19 nt, Homo sapiens
cagcuucuuuauaugcaaa

SEQ ID NO: 1475075 - RNA, 19 nt, Homo sapiens
ggaaugcaugugauacuca

SEQ ID NO: 1475076 - RNA, 19 nt, Homo sapiens
gguguuccuccaaagaaua

SEQ ID NO: 1475077 - RNA, 19 nt, Homo sapiens
gaaggcaaacggacuaucg

SEQ ID NO: 1475078 - RNA, 19 nt, Homo sapiens
cauuuaagaauccauguga

SEQ ID NO: 1475079 - RNA, 19 nt, Homo sapiens
aaacagccaggacgcauug

SEQ ID NO: 1475080 - RNA, 19 nt, Homo sapiens
guauuaacacgaaacuaga

SEQ ID NO: 1475081 - RNA, 19 nt, Homo sapiens
gcauggaaagggaagaaug

SEQ ID NO: 1475082 - RNA, 19 nt, Homo sapiens
guacagcagccauccaagu

SEQ ID NO: 1475083 - RNA, 19 nt, Homo sapiens
caauguuccagaaguguuu

SEQ ID NO: 1475084 - RNA, 19 nt, Homo sapiens
ugaagaagaagaagaagag

SEQ ID NO: 1475085 - RNA, 19 nt, Homo sapiens
agacacuucacaucguuua

SEQ ID NO: 1475086 - RNA, 19 nt, Homo sapiens
caaucagcuucuuuauaug

SEQ ID NO: 1475087 - RNA, 19 nt, Homo sapiens
ugcaaucagcuucuuuaua

SEQ ID NO: 1475088 - RNA, 19 nt, Homo sapiens
ucuugaguguuaagucuuu

SEQ ID NO: 1475089 - RNA, 19 nt, Homo sapiens
gugaccugcuucugcauga

SEQ ID NO: 1475090 - RNA, 19 nt, Homo sapiens
ucagugcccuugccagucu

SEQ ID NO: 1475091 - RNA, 19 nt, Homo sapiens
caaacagccaggacgcauu

SEQ ID NO: 1475092 - RNA, 19 nt, Homo sapiens
uaacacgaaacuagagaga

SEQ ID NO: 1475093 - RNA, 19 nt, Homo sapiens
cauagguucugucuuuguc

SEQ ID NO: 1475094 - RNA, 19 nt, Homo sapiens
uaagagauucccgcugauu

SEQ ID NO: 1475095 - RNA, 19 nt, Homo sapiens
gaagauaaauccuuucuga

SEQ ID NO: 1475096 - RNA, 19 nt, Homo sapiens
guaaagaacuccaaggauu

SEQ ID NO: 1475097 - RNA, 19 nt, Homo sapiens
gaucgaagguuuccgguaa

SEQ ID NO: 1475098 - RNA, 19 nt, Homo sapiens
gaagggauguuaaagacuu

SEQ ID NO: 1475099 - RNA, 19 nt, Homo sapiens
gaauagcccuggcgaacaa

SEQ ID NO: 1475100 - RNA, 19 nt, Homo sapiens
gagggaagauaaauccuuu

SEQ ID NO: 1475101 - RNA, 19 nt, Homo sapiens
gagagaggauuaagcaguu

SEQ ID NO: 1475102 - RNA, 19 nt, Homo sapiens
acaaauagcugcccagaag

SEQ ID NO: 1475103 - RNA, 19 nt, Homo sapiens
gagaagccauccuccaguu

SEQ ID NO: 1475104 - RNA, 19 nt, Homo sapiens
ucacagaccuacucaaugg

SEQ ID NO: 1475105 - RNA, 19 nt, Homo sapiens
uaaagaacuccaaggauuu

SEQ ID NO: 1475106 - RNA, 19 nt, Homo sapiens
ccagaaagaugaccauagg

SEQ ID NO: 1475107 - RNA, 19 nt, Homo sapiens
ggacucaggcuggcgaaua

SEQ ID NO: 1475108 - RNA, 19 nt, Homo sapiens
guucauuuccuaauccuua

SEQ ID NO: 1475109 - RNA, 19 nt, Homo sapiens
uaggacaucuagcuuuaaa

SEQ ID NO: 1475110 - RNA, 19 nt, Homo sapiens
guagaagggauguuaaaga

SEQ ID NO: 1475111 - RNA, 19 nt, Homo sapiens
uccaggagcuguucuauag

SEQ ID NO: 1475112 - RNA, 19 nt, Homo sapiens
ugacuucuacuuuguguaa

SEQ ID NO: 1475113 - RNA, 19 nt, Homo sapiens
gacuugguuuccacaaaua

SEQ ID NO: 1475114 - RNA, 19 nt, Homo sapiens
gacaggauccagcguauug

SEQ ID NO: 1475115 - RNA, 19 nt, Homo sapiens
gcgaaaagaucaagagaug

SEQ ID NO: 1475116 - RNA, 19 nt, Homo sapiens
caucuagcguuucuuccua

SEQ ID NO: 1475117 - RNA, 19 nt, Homo sapiens
gguauuuacucugaacuga

SEQ ID NO: 1475118 - RNA, 19 nt, Homo sapiens
aaagaacuccaaggauuua

SEQ ID NO: 1475119 - RNA, 19 nt, Homo sapiens
gggaaggugucuuucaagu

SEQ ID NO: 1475120 - RNA, 19 nt, Homo sapiens
ccacugugacuucuacuuu

SEQ ID NO: 1475121 - RNA, 19 nt, Homo sapiens
gacuggagcuauacccuau

SEQ ID NO: 1475122 - RNA, 19 nt, Homo sapiens
ccaucagacuggagcuaua

SEQ ID NO: 1475123 - RNA, 19 nt, Homo sapiens
ggcauuggcgucauucuuu

SEQ ID NO: 1475124 - RNA, 19 nt, Homo sapiens
aggcaucgaucgaagguuu

SEQ ID NO: 1475125 - RNA, 19 nt, Homo sapiens
gcccagaagucaucauugg

SEQ ID NO: 1475126 - RNA, 19 nt, Homo sapiens
gccaguaacucugccauca

SEQ ID NO: 1475127 - RNA, 19 nt, Homo sapiens
ggauuuauaccuccucuca

SEQ ID NO: 1475128 - RNA, 19 nt, Homo sapiens
ucgcuuugcucuucaguug

SEQ ID NO: 1475129 - RNA, 19 nt, Homo sapiens
ccacaccacuccaauuugc

SEQ ID NO: 1475130 - RNA, 19 nt, Homo sapiens
gcaagcaucagcugaccaa

SEQ ID NO: 1475131 - RNA, 19 nt, Homo sapiens
agacuugguuuccacaaau

SEQ ID NO: 1475132 - RNA, 19 nt, Homo sapiens
uagaagggauguuaaagac

SEQ ID NO: 1475133 - RNA, 19 nt, Homo sapiens
gaacuccaaggauuuauac

SEQ ID NO: 1475134 - RNA, 19 nt, Homo sapiens
gcccagaaguguaaagaac

SEQ ID NO: 1475135 - RNA, 19 nt, Homo sapiens
gauucuccaucuagcguuu

SEQ ID NO: 1475136 - RNA, 19 nt, Homo sapiens
gauguuaaagacuugguuu

SEQ ID NO: 1475137 - RNA, 19 nt, Homo sapiens
ucaagucgguauuuacucu

SEQ ID NO: 1475138 - RNA, 19 nt, Homo sapiens
ccagguacuaucuccuuua

SEQ ID NO: 1475139 - RNA, 19 nt, Homo sapiens
gaagaugggucguuuugag

SEQ ID NO: 1475140 - RNA, 19 nt, Homo sapiens
aguauuaucccacgcagua

SEQ ID NO: 1475141 - RNA, 19 nt, Homo sapiens
gacucaggcuggcgaauag

SEQ ID NO: 1475142 - RNA, 19 nt, Homo sapiens
gguccucguugcuacaguu

SEQ ID NO: 1475143 - RNA, 19 nt, Homo sapiens
gauccacaccacuccaauu

SEQ ID NO: 1475144 - RNA, 19 nt, Homo sapiens
acagguagaagggauguua

SEQ ID NO: 1475145 - RNA, 19 nt, Homo sapiens
gagggagaccugcuguuug

SEQ ID NO: 1475146 - RNA, 19 nt, Homo sapiens
cuaugaaccucaccuggau

SEQ ID NO: 1475147 - RNA, 19 nt, Homo sapiens
cagcauacaccaucucauc

SEQ ID NO: 1475148 - RNA, 19 nt, Homo sapiens
cuuuagccaugguccuuua

SEQ ID NO: 1475149 - RNA, 19 nt, Homo sapiens
cagguacuaucuccuuuag

SEQ ID NO: 1475150 - RNA, 19 nt, Homo sapiens
cacaauggccagcuaugaa

SEQ ID NO: 1475151 - RNA, 19 nt, Homo sapiens
agacacagcuaggacaucu

SEQ ID NO: 1475152 - RNA, 19 nt, Homo sapiens
ccagaaguguaaagaacuc

SEQ ID NO: 1475153 - RNA, 19 nt, Homo sapiens
ggcugaagaugggucguuu

SEQ ID NO: 1475154 - RNA, 19 nt, Homo sapiens
cuaaacacccaagguugua

SEQ ID NO: 1475155 - RNA, 19 nt, Homo sapiens
uacaccaucucauccgaaa

SEQ ID NO: 1475156 - RNA, 19 nt, Homo sapiens
uuugagaccgguaauauug

SEQ ID NO: 1475157 - RNA, 19 nt, Homo sapiens
aagacuugguuuccacaaa

SEQ ID NO: 1475158 - RNA, 19 nt, Homo sapiens
ggacaggauccagcguauu

SEQ ID NO: 1475159 - RNA, 19 nt, Homo sapiens
ggaaggugucuuucaaguc

SEQ ID NO: 1475160 - RNA, 19 nt, Homo sapiens
acucugaacugagggaaga

SEQ ID NO: 1475161 - RNA, 19 nt, Homo sapiens
cacugugacuucuacuuug

SEQ ID NO: 1475162 - RNA, 19 nt, Homo sapiens
gcauuggcgucauucuuuu

SEQ ID NO: 1475163 - RNA, 19 nt, Homo sapiens
ggguucggcuucuccuaug

SEQ ID NO: 1475164 - RNA, 19 nt, Homo sapiens
ccaaucucccaguucauuu

SEQ ID NO: 1475165 - RNA, 19 nt, Homo sapiens
gugcccagauugacugcuu

SEQ ID NO: 1475166 - RNA, 19 nt, Homo sapiens
ggaaucccaagcucuuaau

SEQ ID NO: 1475167 - RNA, 19 nt, Homo sapiens
ucuuucaagucgguauuua

SEQ ID NO: 1475168 - RNA, 19 nt, Homo sapiens
ccaagccaccacagugauu

SEQ ID NO: 1475169 - RNA, 19 nt, Homo sapiens
guuaaagacuugguuucca

SEQ ID NO: 1475170 - RNA, 19 nt, Homo sapiens
gauccagcguauuguaggu

SEQ ID NO: 1475171 - RNA, 19 nt, Homo sapiens
gaaguguaaagaacuccaa

SEQ ID NO: 1475172 - RNA, 19 nt, Homo sapiens
agagggagaccugcuguuu

SEQ ID NO: 1475173 - RNA, 19 nt, Homo sapiens
gcuuugcucuucaguugca

SEQ ID NO: 1475174 - RNA, 19 nt, Homo sapiens
ccucucagcuccccaggua

SEQ ID NO: 1475175 - RNA, 19 nt, Homo sapiens
agaacuccaaggauuuaua

SEQ ID NO: 1475176 - RNA, 19 nt, Homo sapiens
acacaauggccagcuauga

SEQ ID NO: 1475177 - RNA, 19 nt, Homo sapiens
caggauccagcguauugua

SEQ ID NO: 1475178 - RNA, 19 nt, Homo sapiens
agagaggauuaagcaguuu

SEQ ID NO: 1475179 - RNA, 19 nt, Homo sapiens
gaaaagaucaagagauggu

SEQ ID NO: 1475180 - RNA, 19 nt, Homo sapiens
ugcuacaguuugccaguaa

SEQ ID NO: 1475181 - RNA, 19 nt, Homo sapiens
ucucacagaccuacucaau

SEQ ID NO: 1475182 - RNA, 19 nt, Homo sapiens
ucucccaguucauuuccua

SEQ ID NO: 1475183 - RNA, 19 nt, Homo sapiens
uaaccagcauacaccaucu

SEQ ID NO: 1475184 - RNA, 19 nt, Homo sapiens
cuacccaccuuggccagaa

SEQ ID NO: 1475185 - RNA, 19 nt, Homo sapiens
guuugagaccgguaauauu

SEQ ID NO: 1475186 - RNA, 19 nt, Homo sapiens
cuuggcaccucacacaaug

SEQ ID NO: 1475187 - RNA, 19 nt, Homo sapiens
gaacugagggaagaaaaga

SEQ ID NO: 1475188 - RNA, 19 nt, Homo sapiens
gaggcuugcugcggacuca

SEQ ID NO: 1475189 - RNA, 19 nt, Homo sapiens
guguaaagaacuccaagga

SEQ ID NO: 1475190 - RNA, 19 nt, Homo sapiens
aucaagagauggugaacug

SEQ ID NO: 1475191 - RNA, 19 nt, Homo sapiens
ccagugaacagugacuuug

SEQ ID NO: 1475192 - RNA, 19 nt, Homo sapiens
gggaagauaaauccuuucu

SEQ ID NO: 1475193 - RNA, 19 nt, Homo sapiens
caucagcugaccaagcauu

SEQ ID NO: 1475194 - RNA, 19 nt, Homo sapiens
gaaccggcauuggcgucau

SEQ ID NO: 1475195 - RNA, 19 nt, Homo sapiens
gaagaaauauggagaucaa

SEQ ID NO: 1475196 - RNA, 19 nt, Homo sapiens
gaugagacccaaacuauua

SEQ ID NO: 1475197 - RNA, 19 nt, Homo sapiens
gagaauacuucccacauuu

SEQ ID NO: 1475198 - RNA, 19 nt, Homo sapiens
gacaugcaaucaccuauua

SEQ ID NO: 1475199 - RNA, 19 nt, Homo sapiens
gcagugagcugauauugug

SEQ ID NO: 1475200 - RNA, 19 nt, Homo sapiens
gaaauaggccucuucuuga

SEQ ID NO: 1475201 - RNA, 19 nt, Homo sapiens
gaaagugauuggugacaaa

SEQ ID NO: 1475202 - RNA, 19 nt, Homo sapiens
gaacagaacccuacauaag

SEQ ID NO: 1475203 - RNA, 19 nt, Homo sapiens
ggagaauacuucccacauu

SEQ ID NO: 1475204 - RNA, 19 nt, Homo sapiens
gaacccagcaccaucagua

SEQ ID NO: 1475205 - RNA, 19 nt, Homo sapiens
ucucuuaacugcauuggua

SEQ ID NO: 1475206 - RNA, 19 nt, Homo sapiens
ugaaauaggccucuucuug

SEQ ID NO: 1475207 - RNA, 19 nt, Homo sapiens
gaaaccucaucucuacuaa

SEQ ID NO: 1475208 - RNA, 19 nt, Homo sapiens
gaggaaucauuaagaaaga

SEQ ID NO: 1475209 - RNA, 19 nt, Homo sapiens
ggugaaaccucaucucuac

SEQ ID NO: 1475210 - RNA, 19 nt, Homo sapiens
cauuauggcuucauguauu

SEQ ID NO: 1475211 - RNA, 19 nt, Homo sapiens
gugcgucccuguaugcaua

SEQ ID NO: 1475212 - RNA, 19 nt, Homo sapiens
accaaagucuuaugcaaua

SEQ ID NO: 1475213 - RNA, 19 nt, Homo sapiens
guaccaaagucuuaugcaa

SEQ ID NO: 1475214 - RNA, 19 nt, Homo sapiens
uggcauacauugggaauuu

SEQ ID NO: 1475215 - RNA, 19 nt, Homo sapiens
aaagucaucucucacauca

SEQ ID NO: 1475216 - RNA, 19 nt, Homo sapiens
ggaacagaacccuacauaa

SEQ ID NO: 1475217 - RNA, 19 nt, Homo sapiens
ggaaagugauuggugacaa

SEQ ID NO: 1475218 - RNA, 19 nt, Homo sapiens
gagaugaguuucuucuucu

SEQ ID NO: 1475219 - RNA, 19 nt, Homo sapiens
cauacuaccuuguacugaa

SEQ ID NO: 1475220 - RNA, 19 nt, Homo sapiens
caggcuaccucauuucuga

SEQ ID NO: 1475221 - RNA, 19 nt, Homo sapiens
ucauacccgugcuuacuua

SEQ ID NO: 1475222 - RNA, 19 nt, Homo sapiens
ugacuaugauaaucuggua

SEQ ID NO: 1475223 - RNA, 19 nt, Homo sapiens
gagacuagcuuggccaaca

SEQ ID NO: 1475224 - RNA, 19 nt, Homo sapiens
gcaucaaagucaucucuca

SEQ ID NO: 1475225 - RNA, 19 nt, Homo sapiens
cuaaagcuaucguuaucaa

SEQ ID NO: 1475226 - RNA, 19 nt, Homo sapiens
caucaguaccaaagucuua

SEQ ID NO: 1475227 - RNA, 19 nt, Homo sapiens
agaaaucucuuaacugcau

SEQ ID NO: 1475228 - RNA, 19 nt, Homo sapiens
ggucauuaguuguguuguu

SEQ ID NO: 1475229 - RNA, 19 nt, Homo sapiens
ggaggaaucauuaagaaag

SEQ ID NO: 1475230 - RNA, 19 nt, Homo sapiens
gcuaaucggaggaaucauu

SEQ ID NO: 1475231 - RNA, 19 nt, Homo sapiens
ccgcacagguugaagaaau

SEQ ID NO: 1475232 - RNA, 19 nt, Homo sapiens
gaugaauucuuggcauguu

SEQ ID NO: 1475233 - RNA, 19 nt, Homo sapiens
gucauuaguuguguuguuu

SEQ ID NO: 1475234 - RNA, 19 nt, Homo sapiens
ucugaaguaucccaaguuu

SEQ ID NO: 1475235 - RNA, 19 nt, Homo sapiens
aaucagcggugguucuuug

SEQ ID NO: 1475236 - RNA, 19 nt, Homo sapiens
agugauuggugacaaauuu

SEQ ID NO: 1475237 - RNA, 19 nt, Homo sapiens
agagaugaguuucuucuuc

SEQ ID NO: 1475238 - RNA, 19 nt, Homo sapiens
cugauaggaugaauucuug

SEQ ID NO: 1475239 - RNA, 19 nt, Homo sapiens
auauggagaucaacacaaa

SEQ ID NO: 1475240 - RNA, 19 nt, Homo sapiens
ugugaaagaugacuaugau

SEQ ID NO: 1475241 - RNA, 19 nt, Homo sapiens
ggucaggaguucgagacua

SEQ ID NO: 1475242 - RNA, 19 nt, Homo sapiens
agucaucucucacaucaga

SEQ ID NO: 1475243 - RNA, 19 nt, Homo sapiens
uauccugggucauuaguug

SEQ ID NO: 1475244 - RNA, 19 nt, Homo sapiens
uacuaaagcugauccacuu

SEQ ID NO: 1475245 - RNA, 19 nt, Homo sapiens
aaauaggccucuucuugau

SEQ ID NO: 1475246 - RNA, 19 nt, Homo sapiens
gcauguugauagaggacua

SEQ ID NO: 1475247 - RNA, 19 nt, Homo sapiens
cuaaauuguuggcauguuc

SEQ ID NO: 1475248 - RNA, 19 nt, Homo sapiens
gcaagaaugggaacugcuu

SEQ ID NO: 1475249 - RNA, 19 nt, Homo sapiens
gaaaucucuuaacugcauu

SEQ ID NO: 1475250 - RNA, 19 nt, Homo sapiens
guuuaucccuaucugcuuu

SEQ ID NO: 1475251 - RNA, 19 nt, Homo sapiens
gauuauagaccuccuuaag

SEQ ID NO: 1475252 - RNA, 19 nt, Homo sapiens
gaacugcuuuuaaaucugu

SEQ ID NO: 1475253 - RNA, 19 nt, Homo sapiens
ugaaaccucaucucuacua

SEQ ID NO: 1475254 - RNA, 19 nt, Homo sapiens
uuauagaccuccuuaagag

SEQ ID NO: 1475255 - RNA, 19 nt, Homo sapiens
uguaugcacucuuuucuua

SEQ ID NO: 1475256 - RNA, 19 nt, Homo sapiens
gauaaucugguacaaaugg

SEQ ID NO: 1475257 - RNA, 19 nt, Homo sapiens
ucaauagucucagcuucaa

SEQ ID NO: 1475258 - RNA, 19 nt, Homo sapiens
cgcacagguugaagaaaua

SEQ ID NO: 1475259 - RNA, 19 nt, Homo sapiens
ucggaggaaucauuaagaa

SEQ ID NO: 1475260 - RNA, 19 nt, Homo sapiens
gaugaguuucuucuucuaa

SEQ ID NO: 1475261 - RNA, 19 nt, Homo sapiens
ugcaaucaccuauuaauga

SEQ ID NO: 1475262 - RNA, 19 nt, Homo sapiens
guguaggguuuaauuucua

SEQ ID NO: 1475263 - RNA, 19 nt, Homo sapiens
cauaaggcuuggaguuuua

SEQ ID NO: 1475264 - RNA, 19 nt, Homo sapiens
cuucauguauuccguguau

SEQ ID NO: 1475265 - RNA, 19 nt, Homo sapiens
cagauuauagaccuccuua

SEQ ID NO: 1475266 - RNA, 19 nt, Homo sapiens
gguuuuaugucaccaauuu

SEQ ID NO: 1475267 - RNA, 19 nt, Homo sapiens
gcaggagaaucgcuugaac

SEQ ID NO: 1475268 - RNA, 19 nt, Homo sapiens
gcucugaaguaucccaagu

SEQ ID NO: 1475269 - RNA, 19 nt, Homo sapiens
auaaaugacuggcgacucu

SEQ ID NO: 1475270 - RNA, 19 nt, Homo sapiens
gcugauaggaugaauucuu

SEQ ID NO: 1475271 - RNA, 19 nt, Homo sapiens
ccgauaagcaaacuucauu

SEQ ID NO: 1475272 - RNA, 19 nt, Homo sapiens
ucacaucagacaagagaaa

SEQ ID NO: 1475273 - RNA, 19 nt, Homo sapiens
aaucuucccugaguucuga

SEQ ID NO: 1475274 - RNA, 19 nt, Homo sapiens
gaauacuucccacauuuua

SEQ ID NO: 1475275 - RNA, 19 nt, Homo sapiens
aagcaaacuucauuacuac

SEQ ID NO: 1475276 - RNA, 19 nt, Homo sapiens
cgauaagcaaacuucauua

SEQ ID NO: 1475277 - RNA, 19 nt, Homo sapiens
aaagagugcuaccgauaag

SEQ ID NO: 1475278 - RNA, 19 nt, Homo sapiens
ccaaguauucuaucaucaa

SEQ ID NO: 1475279 - RNA, 19 nt, Homo sapiens
gcaaaaguuuccccagguu

SEQ ID NO: 1475280 - RNA, 19 nt, Homo sapiens
caguuauccugggucauua

SEQ ID NO: 1475281 - RNA, 19 nt, Homo sapiens
uggaacagaacccuacaua

SEQ ID NO: 1475282 - RNA, 19 nt, Homo sapiens
ggagugcuggcauacauug

SEQ ID NO: 1475283 - RNA, 19 nt, Homo sapiens
gcuaccucauuucugauuu

SEQ ID NO: 1475284 - RNA, 19 nt, Homo sapiens
gaagauugaauggaacuca

SEQ ID NO: 1475285 - RNA, 19 nt, Homo sapiens
gauaagcaaacuucauuac

SEQ ID NO: 1475286 - RNA, 19 nt, Homo sapiens
cuacauaaggcuuggaguu

SEQ ID NO: 1475287 - RNA, 19 nt, Homo sapiens
auacuaccuuguacugaaa

SEQ ID NO: 1475288 - RNA, 19 nt, Homo sapiens
gacccaaacuauuacaaaa

SEQ ID NO: 1475289 - RNA, 19 nt, Homo sapiens
ccacuuugggaauauuuaa

SEQ ID NO: 1475290 - RNA, 19 nt, Homo sapiens
aaaauagucuucagaaugg

SEQ ID NO: 1475291 - RNA, 19 nt, Homo sapiens
cuaccucauuucugauuug

SEQ ID NO: 1475292 - RNA, 19 nt, Homo sapiens
ccaaagucuuaugcaauau

SEQ ID NO: 1475293 - RNA, 19 nt, Homo sapiens
cucaggcuauucagaagua

SEQ ID NO: 1475294 - RNA, 19 nt, Homo sapiens
uacccgugcuuacuuaguu

SEQ ID NO: 1475295 - RNA, 19 nt, Homo sapiens
ggaggaagcucuaaacauu

SEQ ID NO: 1475296 - RNA, 19 nt, Homo sapiens
ccaaccagcugaagaaaua

SEQ ID NO: 1475297 - RNA, 19 nt, Homo sapiens
ucagauaacugcagaaugu

SEQ ID NO: 1475298 - RNA, 19 nt, Homo sapiens
gaaagugguuugaaauagu

SEQ ID NO: 1475299 - RNA, 19 nt, Homo sapiens
caacugacauggacuuguu

SEQ ID NO: 1475300 - RNA, 19 nt, Homo sapiens
gaaaaugucgucaugauua

SEQ ID NO: 1475301 - RNA, 19 nt, Homo sapiens
ccacuaugcuccuuugauu

SEQ ID NO: 1475302 - RNA, 19 nt, Homo sapiens
ggaaagugguuugaaauag

SEQ ID NO: 1475303 - RNA, 19 nt, Homo sapiens
ggaagaugaugcacuugaa

SEQ ID NO: 1475304 - RNA, 19 nt, Homo sapiens
ucacuuggcuuccucgaaa

SEQ ID NO: 1475305 - RNA, 19 nt, Homo sapiens
ggaaugugcugucacuugu

SEQ ID NO: 1475306 - RNA, 19 nt, Homo sapiens
gaugaaagaaugucacaaa

SEQ ID NO: 1475307 - RNA, 19 nt, Homo sapiens
gaaaggacaagaaacaguu

SEQ ID NO: 1475308 - RNA, 19 nt, Homo sapiens
gcgcagagauaccaaauac

SEQ ID NO: 1475309 - RNA, 19 nt, Homo sapiens
gcugucacuuguucaaaua

SEQ ID NO: 1475310 - RNA, 19 nt, Homo sapiens
ggagcucugucccuuguaa

SEQ ID NO: 1475311 - RNA, 19 nt, Homo sapiens
guuaaggacucuaaagugu

SEQ ID NO: 1475312 - RNA, 19 nt, Homo sapiens
gaagaagacucccguucag

SEQ ID NO: 1475313 - RNA, 19 nt, Homo sapiens
uaaggacucuaaaguguug

SEQ ID NO: 1475314 - RNA, 19 nt, Homo sapiens
ggcauuggaugaacagaaa

SEQ ID NO: 1475315 - RNA, 19 nt, Homo sapiens
ggucuacauucugaaguua

SEQ ID NO: 1475316 - RNA, 19 nt, Homo sapiens
gaacaggacaacugacaug

SEQ ID NO: 1475317 - RNA, 19 nt, Homo sapiens
gggcagaguaugagcaaua

SEQ ID NO: 1475318 - RNA, 19 nt, Homo sapiens
ggagcacuuuguacucuuu

SEQ ID NO: 1475319 - RNA, 19 nt, Homo sapiens
gaauuucagacacagaaua

SEQ ID NO: 1475320 - RNA, 19 nt, Homo sapiens
gcagagauaccaaauacug

SEQ ID NO: 1475321 - RNA, 19 nt, Homo sapiens
gaaguuaucugaaaauguc

SEQ ID NO: 1475322 - RNA, 19 nt, Homo sapiens
ucaagucacuggccggauu

SEQ ID NO: 1475323 - RNA, 19 nt, Homo sapiens
gcuggaagaugaugcacuu

SEQ ID NO: 1475324 - RNA, 19 nt, Homo sapiens
guaaguaauuuggaaagug

SEQ ID NO: 1475325 - RNA, 19 nt, Homo sapiens
agaauacucuugaugacuu

SEQ ID NO: 1475326 - RNA, 19 nt, Homo sapiens
ggagaccaaugcccagaug

SEQ ID NO: 1475327 - RNA, 19 nt, Homo sapiens
ggauguugcuugacuccuu

SEQ ID NO: 1475328 - RNA, 19 nt, Homo sapiens
uuacuugacucccucaguu

SEQ ID NO: 1475329 - RNA, 19 nt, Homo sapiens
aaagcaaagugaucuugaa

SEQ ID NO: 1475330 - RNA, 19 nt, Homo sapiens
ccagagaggugcagaagac

SEQ ID NO: 1475331 - RNA, 19 nt, Homo sapiens
auacuaggauggucacuug

SEQ ID NO: 1475332 - RNA, 19 nt, Homo sapiens
ggaggaaugugcugucacu

SEQ ID NO: 1475333 - RNA, 19 nt, Homo sapiens
gcagaagacugaagaaaag

SEQ ID NO: 1475334 - RNA, 19 nt, Homo sapiens
gaagaaauacaagugugaa

SEQ ID NO: 1475335 - RNA, 19 nt, Homo sapiens
ggcgguaacccucagauaa

SEQ ID NO: 1475336 - RNA, 19 nt, Homo sapiens
cagcaaagcaaguuuaagu

SEQ ID NO: 1475337 - RNA, 19 nt, Homo sapiens
gcaaaggauggcaggauga

SEQ ID NO: 1475338 - RNA, 19 nt, Homo sapiens
gaaauacaagugugaagag

SEQ ID NO: 1475339 - RNA, 19 nt, Homo sapiens
gcagcaccuuguccucauu

SEQ ID NO: 1475340 - RNA, 19 nt, Homo sapiens
cgacucugcucugguugua

SEQ ID NO: 1475341 - RNA, 19 nt, Homo sapiens
aaagcaaguuuaaguccaa

SEQ ID NO: 1475342 - RNA, 19 nt, Homo sapiens
cagcuuggcucuuguagac

SEQ ID NO: 1475343 - RNA, 19 nt, Homo sapiens
gaggugaaaggacaagaaa

SEQ ID NO: 1475344 - RNA, 19 nt, Homo sapiens
gagaggugcagaagacuga

SEQ ID NO: 1475345 - RNA, 19 nt, Homo sapiens
gaucauucccugcccaaau

SEQ ID NO: 1475346 - RNA, 19 nt, Homo sapiens
agucagaggugcaaguuuc

SEQ ID NO: 1475347 - RNA, 19 nt, Homo sapiens
ggagauagaagaccaaagc

SEQ ID NO: 1475348 - RNA, 19 nt, Homo sapiens
ggugaaaggacaagaaaca

SEQ ID NO: 1475349 - RNA, 19 nt, Homo sapiens
uggaaagugguuugaaaua

SEQ ID NO: 1475350 - RNA, 19 nt, Homo sapiens
ggacaacugacauggacuu

SEQ ID NO: 1475351 - RNA, 19 nt, Homo sapiens
gaauacucuugaugacuuc

SEQ ID NO: 1475352 - RNA, 19 nt, Homo sapiens
ggauggauguugcuugacu

SEQ ID NO: 1475353 - RNA, 19 nt, Homo sapiens
gagaaauuccuuauaacuc

SEQ ID NO: 1475354 - RNA, 19 nt, Homo sapiens
gagacuggcauucagauuc

SEQ ID NO: 1475355 - RNA, 19 nt, Homo sapiens
gaaccaauggcccuuccaa

SEQ ID NO: 1475356 - RNA, 19 nt, Homo sapiens
uccgagaccucaaagagaa

SEQ ID NO: 1475357 - RNA, 19 nt, Homo sapiens
cacagaauacucuugauga

SEQ ID NO: 1475358 - RNA, 19 nt, Homo sapiens
uugcuggcauucuuuguaa

SEQ ID NO: 1475359 - RNA, 19 nt, Homo sapiens
gauggucacuugguuaagg

SEQ ID NO: 1475360 - RNA, 19 nt, Homo sapiens
gcaaguggagacuggcauu

SEQ ID NO: 1475361 - RNA, 19 nt, Homo sapiens
gaagacucccguucagcaa

SEQ ID NO: 1475362 - RNA, 19 nt, Homo sapiens
ccacaaacgucagcauggu

SEQ ID NO: 1475363 - RNA, 19 nt, Homo sapiens
ucagcugucuggcucaaug

SEQ ID NO: 1475364 - RNA, 19 nt, Homo sapiens
gauaacugcagaauguaga

SEQ ID NO: 1475365 - RNA, 19 nt, Homo sapiens
augcccagauggacaaaua

SEQ ID NO: 1475366 - RNA, 19 nt, Homo sapiens
agacacagaauacucuuga

SEQ ID NO: 1475367 - RNA, 19 nt, Homo sapiens
ugaagaaauacaaguguga

SEQ ID NO: 1475368 - RNA, 19 nt, Homo sapiens
gcaguuccgagaccucaaa

SEQ ID NO: 1475369 - RNA, 19 nt, Homo sapiens
gaacauccuagaaaucaac

SEQ ID NO: 1475370 - RNA, 19 nt, Homo sapiens
uuuggaaagugguuugaaa

SEQ ID NO: 1475371 - RNA, 19 nt, Homo sapiens
uaggagcucugucccuugu

SEQ ID NO: 1475372 - RNA, 19 nt, Homo sapiens
cagagaaggcccagugugu

SEQ ID NO: 1475373 - RNA, 19 nt, Homo sapiens
gauuugagaagccacauuc

SEQ ID NO: 1475374 - RNA, 19 nt, Homo sapiens
agaaaucaaccaggaauug

SEQ ID NO: 1475375 - RNA, 19 nt, Homo sapiens
acacaagggcgucaaguca

SEQ ID NO: 1475376 - RNA, 19 nt, Homo sapiens
gacuuggaguggagacuug

SEQ ID NO: 1475377 - RNA, 19 nt, Homo sapiens
cuggauggauguugcuuga

SEQ ID NO: 1475378 - RNA, 19 nt, Homo sapiens
gguuaaggacucuaaagug

SEQ ID NO: 1475379 - RNA, 19 nt, Homo sapiens
gaagaugaugcacuugaag

SEQ ID NO: 1475380 - RNA, 19 nt, Homo sapiens
gaggaagcucuaaacauuc

SEQ ID NO: 1475381 - RNA, 19 nt, Homo sapiens
agagugaacacccucauga

SEQ ID NO: 1475382 - RNA, 19 nt, Homo sapiens
auacaagugugaagaguac

SEQ ID NO: 1475383 - RNA, 19 nt, Homo sapiens
gagcaauaccauguucuug

SEQ ID NO: 1475384 - RNA, 19 nt, Homo sapiens
uaugagcaauaccauguuc

SEQ ID NO: 1475385 - RNA, 19 nt, Homo sapiens
ggagacuggcauucagauu

SEQ ID NO: 1475386 - RNA, 19 nt, Homo sapiens
agaagaagacucccguuca

SEQ ID NO: 1475387 - RNA, 19 nt, Homo sapiens
gaagaccaucagaagaaga

SEQ ID NO: 1475388 - RNA, 19 nt, Homo sapiens
gcacuugaaggcucagcaa

SEQ ID NO: 1475389 - RNA, 19 nt, Homo sapiens
caugacaaguccaacucuu

SEQ ID NO: 1475390 - RNA, 19 nt, Homo sapiens
aaaguguugugucguguuc

SEQ ID NO: 1475391 - RNA, 19 nt, Homo sapiens
cuaggauggucacuugguu

SEQ ID NO: 1475392 - RNA, 19 nt, Homo sapiens
acgcuuagccugaguuuca

SEQ ID NO: 1475393 - RNA, 19 nt, Homo sapiens
cuaccucccucacucuugu

SEQ ID NO: 1475394 - RNA, 19 nt, Homo sapiens
gaaaucaaccaggaauugc

SEQ ID NO: 1475395 - RNA, 19 nt, Homo sapiens
gcucaaaguuccaaauuuc

SEQ ID NO: 1475396 - RNA, 19 nt, Homo sapiens
gaguaaaccugaggcauuu

SEQ ID NO: 1475397 - RNA, 19 nt, Homo sapiens
gaauacugguuaaagauga

SEQ ID NO: 1475398 - RNA, 19 nt, Homo sapiens
gaaguggaauacaaacuau

SEQ ID NO: 1475399 - RNA, 19 nt, Homo sapiens
ggaaugggaaguugaaauu

SEQ ID NO: 1475400 - RNA, 19 nt, Homo sapiens
gugaagauaugauggaaug

SEQ ID NO: 1475401 - RNA, 19 nt, Homo sapiens
uuaccuaucuugcaaaguu

SEQ ID NO: 1475402 - RNA, 19 nt, Homo sapiens
caaccucauuuagugauua

SEQ ID NO: 1475403 - RNA, 19 nt, Homo sapiens
uaaccacucugaacuuguu

SEQ ID NO: 1475404 - RNA, 19 nt, Homo sapiens
cagaauagcuacaucaaaa

SEQ ID NO: 1475405 - RNA, 19 nt, Homo sapiens
gaacuccauugcucaaagu

SEQ ID NO: 1475406 - RNA, 19 nt, Homo sapiens
uagagaauccagugaauuu

SEQ ID NO: 1475407 - RNA, 19 nt, Homo sapiens
gaaauugaaggucuacaga

SEQ ID NO: 1475408 - RNA, 19 nt, Homo sapiens
caaauuucauuggacagua

SEQ ID NO: 1475409 - RNA, 19 nt, Homo sapiens
gguuuagucuuccaacuga

SEQ ID NO: 1475410 - RNA, 19 nt, Homo sapiens
gaaaauggaucuacagcau

SEQ ID NO: 1475411 - RNA, 19 nt, Homo sapiens
guaaauguaucagaccaau

SEQ ID NO: 1475412 - RNA, 19 nt, Homo sapiens
ggaagcagccagaauacug

SEQ ID NO: 1475413 - RNA, 19 nt, Homo sapiens
gcuagagaauccagugaau

SEQ ID NO: 1475414 - RNA, 19 nt, Homo sapiens
gcauuugacgcuuauuauu

SEQ ID NO: 1475415 - RNA, 19 nt, Homo sapiens
uuacuugcccuacagguua

SEQ ID NO: 1475416 - RNA, 19 nt, Homo sapiens
ccugagaaguggaauacaa

SEQ ID NO: 1475417 - RNA, 19 nt, Homo sapiens
aaugggaaguugaaauuga

SEQ ID NO: 1475418 - RNA, 19 nt, Homo sapiens
gggaaguucucguuuagag

SEQ ID NO: 1475419 - RNA, 19 nt, Homo sapiens
gccaggaguuaccuaaaga

SEQ ID NO: 1475420 - RNA, 19 nt, Homo sapiens
ggucagcccuguauagacu

SEQ ID NO: 1475421 - RNA, 19 nt, Homo sapiens
aaauggaucuacagcauca

SEQ ID NO: 1475422 - RNA, 19 nt, Homo sapiens
uaaagacccacguaaaugu

SEQ ID NO: 1475423 - RNA, 19 nt, Homo sapiens
ggacaguauuacaaaugga

SEQ ID NO: 1475424 - RNA, 19 nt, Homo sapiens
ccagacaugguccagaaua

SEQ ID NO: 1475425 - RNA, 19 nt, Homo sapiens
cugcuaagccuguaaguga

SEQ ID NO: 1475426 - RNA, 19 nt, Homo sapiens
auaaggguaucacugcuaa

SEQ ID NO: 1475427 - RNA, 19 nt, Homo sapiens
gaacaauuauaaggguauc

SEQ ID NO: 1475428 - RNA, 19 nt, Homo sapiens
agcaugagcuucagaguca

SEQ ID NO: 1475429 - RNA, 19 nt, Homo sapiens
ccuaaagacccacguaaau

SEQ ID NO: 1475430 - RNA, 19 nt, Homo sapiens
agaaguggaauacaaacua

SEQ ID NO: 1475431 - RNA, 19 nt, Homo sapiens
caauuccguuucauccaaa

SEQ ID NO: 1475432 - RNA, 19 nt, Homo sapiens
acaauuccguuucauccaa

SEQ ID NO: 1475433 - RNA, 19 nt, Homo sapiens
uuacaucggaguacaacua

SEQ ID NO: 1475434 - RNA, 19 nt, Homo sapiens
acccauaacuucaaacauc

SEQ ID NO: 1475435 - RNA, 19 nt, Homo sapiens
caucagaaagaauggaauu

SEQ ID NO: 1475436 - RNA, 19 nt, Homo sapiens
ggaagaaaauggaucuaca

SEQ ID NO: 1475437 - RNA, 19 nt, Homo sapiens
aaaacaaccucauuuagug

SEQ ID NO: 1475438 - RNA, 19 nt, Homo sapiens
uugaaggucuacagaauuc

SEQ ID NO: 1475439 - RNA, 19 nt, Homo sapiens
cuaaagacccacguaaaug

SEQ ID NO: 1475440 - RNA, 19 nt, Homo sapiens
uacagguuaugcuuucuaa

SEQ ID NO: 1475441 - RNA, 19 nt, Homo sapiens
agaguaaaccugaggcauu

SEQ ID NO: 1475442 - RNA, 19 nt, Homo sapiens
cuaauccagugcuagagaa

SEQ ID NO: 1475443 - RNA, 19 nt, Homo sapiens
aauugaaggucuacagaau

SEQ ID NO: 1475444 - RNA, 19 nt, Homo sapiens
gaaugggaaguugaaauug

SEQ ID NO: 1475445 - RNA, 19 nt, Homo sapiens
gauggaaugggaaguugaa

SEQ ID NO: 1475446 - RNA, 19 nt, Homo sapiens
guaccguucugagguucua

SEQ ID NO: 1475447 - RNA, 19 nt, Homo sapiens
caucaaaagccacagaaua

SEQ ID NO: 1475448 - RNA, 19 nt, Homo sapiens
ccagaauagcuacaucaaa

SEQ ID NO: 1475449 - RNA, 19 nt, Homo sapiens
aaacaaccucauuuaguga

SEQ ID NO: 1475450 - RNA, 19 nt, Homo sapiens
aaagacccacguaaaugua

SEQ ID NO: 1475451 - RNA, 19 nt, Homo sapiens
gccuguaagugaagauaug

SEQ ID NO: 1475452 - RNA, 19 nt, Homo sapiens
ggaucuacagcaucagaaa

SEQ ID NO: 1475453 - RNA, 19 nt, Homo sapiens
cagacaugguccagaauag

SEQ ID NO: 1475454 - RNA, 19 nt, Homo sapiens
agacuucugugaucucaag

SEQ ID NO: 1475455 - RNA, 19 nt, Homo sapiens
gagaauccagugaauuugg

SEQ ID NO: 1475456 - RNA, 19 nt, Homo sapiens
aaccuuaccuaucuugcaa

SEQ ID NO: 1475457 - RNA, 19 nt, Homo sapiens
gacaguauuacaaauggaa

SEQ ID NO: 1475458 - RNA, 19 nt, Homo sapiens
uuuggaagcagccagaaua

SEQ ID NO: 1475459 - RNA, 19 nt, Homo sapiens
uuagaggagucaggagaaa

SEQ ID NO: 1475460 - RNA, 19 nt, Homo sapiens
cagguuaugcuuucuaauc

SEQ ID NO: 1475461 - RNA, 19 nt, Homo sapiens
ggucuacagaauucaguuu

SEQ ID NO: 1475462 - RNA, 19 nt, Homo sapiens
uaagugaagauaugaugga

SEQ ID NO: 1475463 - RNA, 19 nt, Homo sapiens
cagaauacugguuaaagau

SEQ ID NO: 1475464 - RNA, 19 nt, Homo sapiens
cuuaaccacucugaacuug

SEQ ID NO: 1475465 - RNA, 19 nt, Homo sapiens
ucaacaggccauuacaaau

SEQ ID NO: 1475466 - RNA, 19 nt, Homo sapiens
uucgggaaguucucguuua

SEQ ID NO: 1475467 - RNA, 19 nt, Homo sapiens
ugcucaaaguuccaaauuu

SEQ ID NO: 1475468 - RNA, 19 nt, Homo sapiens
caucuuacuugcccuacag

SEQ ID NO: 1475469 - RNA, 19 nt, Homo sapiens
uacauugagcagcaucuua

SEQ ID NO: 1475470 - RNA, 19 nt, Homo sapiens
ucgggaaguucucguuuag

SEQ ID NO: 1475471 - RNA, 19 nt, Homo sapiens
caaaagccacagaauacua

SEQ ID NO: 1475472 - RNA, 19 nt, Homo sapiens
uauaaggguaucacugcua

SEQ ID NO: 1475473 - RNA, 19 nt, Homo sapiens
uguuauaucccaacuuuag

SEQ ID NO: 1475474 - RNA, 19 nt, Homo sapiens
uaucacugcuaagccugua

SEQ ID NO: 1475475 - RNA, 19 nt, Homo sapiens
uugcauuugacgcuuauua

SEQ ID NO: 1475476 - RNA, 19 nt, Homo sapiens
cauuggacaguauuacaaa

SEQ ID NO: 1475477 - RNA, 19 nt, Homo sapiens
gccacagaauacuacagaa

SEQ ID NO: 1475478 - RNA, 19 nt, Homo sapiens
gcaucuuacuugcccuaca

SEQ ID NO: 1475479 - RNA, 19 nt, Homo sapiens
ucagcccuguauagacuuu

SEQ ID NO: 1475480 - RNA, 19 nt, Homo sapiens
agaacuccauugcucaaag

SEQ ID NO: 1475481 - RNA, 19 nt, Homo sapiens
gguccagaauagcuacauc

SEQ ID NO: 1475482 - RNA, 19 nt, Homo sapiens
acaaccucauuuagugauu

SEQ ID NO: 1475483 - RNA, 19 nt, Homo sapiens
gguucuagaaagcaaguaa

SEQ ID NO: 1475484 - RNA, 19 nt, Homo sapiens
acacuggucagcccuguau

SEQ ID NO: 1475485 - RNA, 19 nt, Homo sapiens
aaauugaaggucuacagaa

SEQ ID NO: 1475486 - RNA, 19 nt, Homo sapiens
ggaaguugaaauugaaggu

SEQ ID NO: 1475487 - RNA, 19 nt, Homo sapiens
gaucuacagcaucagaaag

SEQ ID NO: 1475488 - RNA, 19 nt, Homo sapiens
agaauacugguuaaagaug

SEQ ID NO: 1475489 - RNA, 19 nt, Homo sapiens
cuagagaauccagugaauu

SEQ ID NO: 1475490 - RNA, 19 nt, Homo sapiens
cuacagguuaugcuuucua

SEQ ID NO: 1475491 - RNA, 19 nt, Homo sapiens
caaggagaacaauuauaag

SEQ ID NO: 1475492 - RNA, 19 nt, Homo sapiens
gaggaagugcccaagucuu

SEQ ID NO: 1475493 - RNA, 19 nt, Homo sapiens
augggaaguugaaauugaa

SEQ ID NO: 1475494 - RNA, 19 nt, Homo sapiens
uggacaguauuacaaaugg

SEQ ID NO: 1475495 - RNA, 19 nt, Homo sapiens
gcaccaggcuguuuacuua

SEQ ID NO: 1475496 - RNA, 19 nt, Homo sapiens
gaagcgaggugacgugaua

SEQ ID NO: 1475497 - RNA, 19 nt, Homo sapiens
gacaauggcuugacuuuga

SEQ ID NO: 1475498 - RNA, 19 nt, Homo sapiens
caucagaccuuccacuuaa

SEQ ID NO: 1475499 - RNA, 19 nt, Homo sapiens
uaacaccacuccucuagaa

SEQ ID NO: 1475500 - RNA, 19 nt, Homo sapiens
guacuuacaugcaauaaag

SEQ ID NO: 1475501 - RNA, 19 nt, Homo sapiens
gggaauugcuggcugcuuu

SEQ ID NO: 1475502 - RNA, 19 nt, Homo sapiens
gcgcaucacuggcuacuau

SEQ ID NO: 1475503 - RNA, 19 nt, Homo sapiens
gggaaaccuuuguggauuu

SEQ ID NO: 1475504 - RNA, 19 nt, Homo sapiens
ccuauuauccucuacuuua

SEQ ID NO: 1475505 - RNA, 19 nt, Homo sapiens
gcaaguguuuugaaucuua

SEQ ID NO: 1475506 - RNA, 19 nt, Homo sapiens
gcaaguguuuugaaucuua

SEQ ID NO: 1475507 - RNA, 19 nt, Homo sapiens
gguaaguucuaugguauuu

SEQ ID NO: 1475508 - RNA, 19 nt, Homo sapiens
ggguuagaguuuacuauuu

SEQ ID NO: 1475509 - RNA, 19 nt, Homo sapiens
ggaaggaugucugggaugu

SEQ ID NO: 1475510 - RNA, 19 nt, Homo sapiens
uggagaagccgccuuauuu

SEQ ID NO: 1475511 - RNA, 19 nt, Homo sapiens
gcuguuuacuuacacaauu

SEQ ID NO: 1475512 - RNA, 19 nt, Homo sapiens
gaaaucacagugccuucua

SEQ ID NO: 1475513 - RNA, 19 nt, Homo sapiens
agaaauggaugaugaacau

SEQ ID NO: 1475514 - RNA, 19 nt, Homo sapiens
gguguacaauacccauaua

SEQ ID NO: 1475515 - RNA, 19 nt, Homo sapiens
gcauugugaugaugaccua

SEQ ID NO: 1475516 - RNA, 19 nt, Homo sapiens
gggcgcaacucaagaagau

SEQ ID NO: 1475517 - RNA, 19 nt, Homo sapiens
gcagcgcacuccagucuuc

SEQ ID NO: 1475518 - RNA, 19 nt, Homo sapiens
guaagaucaugcaagagaa

SEQ ID NO: 1475519 - RNA, 19 nt, Homo sapiens
gcgguaaguucuaugguau

SEQ ID NO: 1475520 - RNA, 19 nt, Homo sapiens
gcucucacgugucugugua

SEQ ID NO: 1475521 - RNA, 19 nt, Homo sapiens
aggcagaaauggaugauga

SEQ ID NO: 1475522 - RNA, 19 nt, Homo sapiens
gagcggauccugcgcauca

SEQ ID NO: 1475523 - RNA, 19 nt, Homo sapiens
ugugauagaucuguaaaga

SEQ ID NO: 1475524 - RNA, 19 nt, Homo sapiens
gagcuguacucuuaauuuu

SEQ ID NO: 1475525 - RNA, 19 nt, Homo sapiens
gguaccaauucaauacaaa

SEQ ID NO: 1475526 - RNA, 19 nt, Homo sapiens
ccagucagaucgucuucaa

SEQ ID NO: 1475527 - RNA, 19 nt, Homo sapiens
ggaauugccguuacauauc

SEQ ID NO: 1475528 - RNA, 19 nt, Homo sapiens
gagacaauggcuugacuuu

SEQ ID NO: 1475529 - RNA, 19 nt, Homo sapiens
uguguaagaucaugcaaga

SEQ ID NO: 1475530 - RNA, 19 nt, Homo sapiens
acugaaaucuguaaaccuu

SEQ ID NO: 1475531 - RNA, 19 nt, Homo sapiens
ccacuuaaggguaccaauu

SEQ ID NO: 1475532 - RNA, 19 nt, Homo sapiens
caguuuccauuaccuguuu

SEQ ID NO: 1475533 - RNA, 19 nt, Homo sapiens
ucacagugccuucuacaga

SEQ ID NO: 1475534 - RNA, 19 nt, Homo sapiens
gaagaggcaaggcagaaau

SEQ ID NO: 1475535 - RNA, 19 nt, Homo sapiens
ucaccugcauuccuauuau

SEQ ID NO: 1475536 - RNA, 19 nt, Homo sapiens
cuacagaauuuucgucuuu

SEQ ID NO: 1475537 - RNA, 19 nt, Homo sapiens
gauuaaggaggaucugaaa

SEQ ID NO: 1475538 - RNA, 19 nt, Homo sapiens
ccaauuugcuugcacuuuu

SEQ ID NO: 1475539 - RNA, 19 nt, Homo sapiens
gcauuccuauuauccucua

SEQ ID NO: 1475540 - RNA, 19 nt, Homo sapiens
ucacgugucuguguaagau

SEQ ID NO: 1475541 - RNA, 19 nt, Homo sapiens
uaaggguaccaauucaaua

SEQ ID NO: 1475542 - RNA, 19 nt, Homo sapiens
gaauugccguuacauaucc

SEQ ID NO: 1475543 - RNA, 19 nt, Homo sapiens
guacaauacccauauaagg

SEQ ID NO: 1475544 - RNA, 19 nt, Homo sapiens
gauggccaguguauacaga

SEQ ID NO: 1475545 - RNA, 19 nt, Homo sapiens
gagcugauggccaguguau

SEQ ID NO: 1475546 - RNA, 19 nt, Homo sapiens
uaaggaggaucugaaaugg

SEQ ID NO: 1475547 - RNA, 19 nt, Homo sapiens
gaagaaccucucagugcuu

SEQ ID NO: 1475548 - RNA, 19 nt, Homo sapiens
uggccaaacagauuaauaa

SEQ ID NO: 1475549 - RNA, 19 nt, Homo sapiens
ggucagggguuagaguuua

SEQ ID NO: 1475550 - RNA, 19 nt, Homo sapiens
caacugaacaugacauugc

SEQ ID NO: 1475551 - RNA, 19 nt, Homo sapiens
gaaccucaguuggguaagg

SEQ ID NO: 1475552 - RNA, 19 nt, Homo sapiens
ggucaucgccaucaucauc

SEQ ID NO: 1475553 - RNA, 19 nt, Homo sapiens
cagggaaugcugucgauuu

SEQ ID NO: 1475554 - RNA, 19 nt, Homo sapiens
uuaagcaccaggcuguuua

SEQ ID NO: 1475555 - RNA, 19 nt, Homo sapiens
uuaaggaggaucugaaaug

SEQ ID NO: 1475556 - RNA, 19 nt, Homo sapiens
gcaaggcagaaauggauga

SEQ ID NO: 1475557 - RNA, 19 nt, Homo sapiens
ugggaugucugguugauca

SEQ ID NO: 1475558 - RNA, 19 nt, Homo sapiens
cacaaacuaccuguacuua

SEQ ID NO: 1475559 - RNA, 19 nt, Homo sapiens
uaaagagggucagggguua

SEQ ID NO: 1475560 - RNA, 19 nt, Homo sapiens
gaacaugacauugcacacu

SEQ ID NO: 1475561 - RNA, 19 nt, Homo sapiens
ggaaucguccucagcauac

SEQ ID NO: 1475562 - RNA, 19 nt, Homo sapiens
ccugggcagugcuaaguuu

SEQ ID NO: 1475563 - RNA, 19 nt, Homo sapiens
acaauggcuugacuuugaa

SEQ ID NO: 1475564 - RNA, 19 nt, Homo sapiens
ggccaaacagauuaauaaa

SEQ ID NO: 1475565 - RNA, 19 nt, Homo sapiens
uguaagaucaugcaagaga

SEQ ID NO: 1475566 - RNA, 19 nt, Homo sapiens
ggguaccaauucaauacaa

SEQ ID NO: 1475567 - RNA, 19 nt, Homo sapiens
ggucaucugcgguaaguuc

SEQ ID NO: 1475568 - RNA, 19 nt, Homo sapiens
ccucagagcaagaacagaa

SEQ ID NO: 1475569 - RNA, 19 nt, Homo sapiens
acucugaugucucuuggaa

SEQ ID NO: 1475570 - RNA, 19 nt, Homo sapiens
gaucaugcaagagaaauca

SEQ ID NO: 1475571 - RNA, 19 nt, Homo sapiens
aaggaugucugggauguga

SEQ ID NO: 1475572 - RNA, 19 nt, Homo sapiens
aagaaccucucagugcuuu

SEQ ID NO: 1475573 - RNA, 19 nt, Homo sapiens
gcuaacaccacuccucuag

SEQ ID NO: 1475574 - RNA, 19 nt, Homo sapiens
ucugaugucucuuggaauc

SEQ ID NO: 1475575 - RNA, 19 nt, Homo sapiens
aaauaaacacuacggaugu

SEQ ID NO: 1475576 - RNA, 19 nt, Homo sapiens
gcugauggccaguguauac

SEQ ID NO: 1475577 - RNA, 19 nt, Homo sapiens
uaagaucaugcaagagaaa

SEQ ID NO: 1475578 - RNA, 19 nt, Homo sapiens
ugcgguaaguucuauggua

SEQ ID NO: 1475579 - RNA, 19 nt, Homo sapiens
caucugcgguaaguucuau

SEQ ID NO: 1475580 - RNA, 19 nt, Homo sapiens
uuacauaucccacucugau

SEQ ID NO: 1475581 - RNA, 19 nt, Homo sapiens
uggaauugccguuacauau

SEQ ID NO: 1475582 - RNA, 19 nt, Homo sapiens
uuaccaaaguggaauacug

SEQ ID NO: 1475583 - RNA, 19 nt, Homo sapiens
ggagaagccgccuuauuuu

SEQ ID NO: 1475584 - RNA, 19 nt, Homo sapiens
gggcagugcuaaguuugga

SEQ ID NO: 1475585 - RNA, 19 nt, Homo sapiens
gaugaugaccuacgcugau

SEQ ID NO: 1475586 - RNA, 19 nt, Homo sapiens
gccaucagggcaaguguuu

SEQ ID NO: 1475587 - RNA, 19 nt, Homo sapiens
uggcugacguucuugacaa

SEQ ID NO: 1475588 - RNA, 19 nt, Homo sapiens
ucacaaacuaccuguacuu

SEQ ID NO: 1475589 - RNA, 19 nt, Homo sapiens
acaucagaccuuccacuua

SEQ ID NO: 1475590 - RNA, 19 nt, Homo sapiens
ggaaaccuuuguggauuuu

SEQ ID NO: 1475591 - RNA, 19 nt, Homo sapiens
ggccugcucucacgugucu

SEQ ID NO: 1475592 - RNA, 19 nt, Homo sapiens
aaaguucccugcguagauc

SEQ ID NO: 1475593 - RNA, 19 nt, Homo sapiens
gaauuuucgucuuuaccua

SEQ ID NO: 1475594 - RNA, 19 nt, Homo sapiens
uuggauggcugacguucuu

SEQ ID NO: 1475595 - RNA, 19 nt, Homo sapiens
ggaaagcaaucugaucaaa

SEQ ID NO: 1475596 - RNA, 19 nt, Homo sapiens
gagcugcgcuggaggagaa

SEQ ID NO: 1475597 - RNA, 19 nt, Homo sapiens
gcacauagacacagggaaa

SEQ ID NO: 1475598 - RNA, 19 nt, Homo sapiens
acacggagaugcacagaaa

SEQ ID NO: 1475599 - RNA, 19 nt, Homo sapiens
gagcagugauggaggagaa

SEQ ID NO: 1475600 - RNA, 19 nt, Homo sapiens
aaagcaaucugaucaaaca

SEQ ID NO: 1475601 - RNA, 19 nt, Homo sapiens
gaaaggagaggaagcagau

SEQ ID NO: 1475602 - RNA, 19 nt, Homo sapiens
gaaggaggccuggauguga

SEQ ID NO: 1475603 - RNA, 19 nt, Homo sapiens
gcugagagcuccugugacu

SEQ ID NO: 1475604 - RNA, 19 nt, Homo sapiens
ggaaugcaguggcgagauc

SEQ ID NO: 1475605 - RNA, 19 nt, Homo sapiens
gcacagauugguauuuguu

SEQ ID NO: 1475606 - RNA, 19 nt, Homo sapiens
gaggaaagcaaucugauca

SEQ ID NO: 1475607 - RNA, 19 nt, Homo sapiens
uuuaaacggugcucagaaa

SEQ ID NO: 1475608 - RNA, 19 nt, Homo sapiens
guaugacagcccugauuua

SEQ ID NO: 1475609 - RNA, 19 nt, Homo sapiens
gcgccuagcuccaguacca

SEQ ID NO: 1475610 - RNA, 19 nt, Homo sapiens
gcaccuccauuuccuguac

SEQ ID NO: 1475611 - RNA, 19 nt, Homo sapiens
gguuguagaguaauaugua

SEQ ID NO: 1475612 - RNA, 19 nt, Homo sapiens
ggagaggaagcagaucuaa

SEQ ID NO: 1475613 - RNA, 19 nt, Homo sapiens
guaaagcccaguaccacuu

SEQ ID NO: 1475614 - RNA, 19 nt, Homo sapiens
gcagaucuaagcacacaug

SEQ ID NO: 1475615 - RNA, 19 nt, Homo sapiens
gcccaguaccacuuuauuu

SEQ ID NO: 1475616 - RNA, 19 nt, Homo sapiens
uggcacagauugguauuug

SEQ ID NO: 1475617 - RNA, 19 nt, Homo sapiens
ggacaacacaccuacaaaa

SEQ ID NO: 1475618 - RNA, 19 nt, Homo sapiens
gaaacacacacacggagau

SEQ ID NO: 1475619 - RNA, 19 nt, Homo sapiens
cuucugcucuccucaaugu

SEQ ID NO: 1475620 - RNA, 19 nt, Homo sapiens
ggaaggaggccuggaugug

SEQ ID NO: 1475621 - RNA, 19 nt, Homo sapiens
gaaagcaaucugaucaaac

SEQ ID NO: 1475622 - RNA, 19 nt, Homo sapiens
gcuccaguaccauguuuaa

SEQ ID NO: 1475623 - RNA, 19 nt, Homo sapiens
ggaaggagaauuuucagaa

SEQ ID NO: 1475624 - RNA, 19 nt, Homo sapiens
cagaaaacgugcuaaacuu

SEQ ID NO: 1475625 - RNA, 19 nt, Homo sapiens
ggagaaaggagaggaagca

SEQ ID NO: 1475626 - RNA, 19 nt, Homo sapiens
gaaggagaauuuucagaag

SEQ ID NO: 1475627 - RNA, 19 nt, Homo sapiens
caucaaaccagaggaacaa

SEQ ID NO: 1475628 - RNA, 19 nt, Homo sapiens
caaaccagaggaacaaagu

SEQ ID NO: 1475629 - RNA, 19 nt, Homo sapiens
ugagagcuccugugacugu

SEQ ID NO: 1475630 - RNA, 19 nt, Homo sapiens
aaggaggccuggaugugaa

SEQ ID NO: 1475631 - RNA, 19 nt, Homo sapiens
uagcuccaguaccauguuu

SEQ ID NO: 1475632 - RNA, 19 nt, Homo sapiens
gauugguauuuguucugua

SEQ ID NO: 1475633 - RNA, 19 nt, Homo sapiens
gaccuuggcaaauccauuc

SEQ ID NO: 1475634 - RNA, 19 nt, Homo sapiens
aagcagaucuaagcacaca

SEQ ID NO: 1475635 - RNA, 19 nt, Homo sapiens
ggaggagaaaggagaggaa

SEQ ID NO: 1475636 - RNA, 19 nt, Homo sapiens
ggaguugccgaaucuguca

SEQ ID NO: 1475637 - RNA, 19 nt, Homo sapiens
gcacacaugggcaucaaac

SEQ ID NO: 1475638 - RNA, 19 nt, Homo sapiens
ccaguaccauguuuaaacg

SEQ ID NO: 1475639 - RNA, 19 nt, Homo sapiens
gggacaacacaccuacaaa

SEQ ID NO: 1475640 - RNA, 19 nt, Homo sapiens
gggcaucaaaccagaggaa

SEQ ID NO: 1475641 - RNA, 19 nt, Homo sapiens
gaugggaauugaaaagaga

SEQ ID NO: 1475642 - RNA, 19 nt, Homo sapiens
ccaguaccacuuuauuuua

SEQ ID NO: 1475643 - RNA, 19 nt, Homo sapiens
uguaugacagcccugauuu

SEQ ID NO: 1475644 - RNA, 19 nt, Homo sapiens
cuuggcaaauccauucuau

SEQ ID NO: 1475645 - RNA, 19 nt, Homo sapiens
gcaucaaaccagaggaaca

SEQ ID NO: 1475646 - RNA, 19 nt, Homo sapiens
ccacagaggaaagcaaucu

SEQ ID NO: 1475647 - RNA, 19 nt, Homo sapiens
gagaggaagcagaucuaag

SEQ ID NO: 1475648 - RNA, 19 nt, Homo sapiens
uggcaaauccauucuaugc

SEQ ID NO: 1475649 - RNA, 19 nt, Homo sapiens
ggcaggagcucugguaccu

SEQ ID NO: 1475650 - RNA, 19 nt, Homo sapiens
ggccuagcuuugugaccuu

SEQ ID NO: 1475651 - RNA, 19 nt, Homo sapiens
uucagaaguugcuggaguu

SEQ ID NO: 1475652 - RNA, 19 nt, Homo sapiens
ggcacagauugguauuugu

SEQ ID NO: 1475653 - RNA, 19 nt, Homo sapiens
aguaauauguaaccagacu

SEQ ID NO: 1475654 - RNA, 19 nt, Homo sapiens
gggaaggaggccuggaugu

SEQ ID NO: 1475655 - RNA, 19 nt, Homo sapiens
cuugguggaugggaauuga

SEQ ID NO: 1475656 - RNA, 19 nt, Homo sapiens
aagcacacaugggcaucaa

SEQ ID NO: 1475657 - RNA, 19 nt, Homo sapiens
agaggaagcagaucuaagc

SEQ ID NO: 1475658 - RNA, 19 nt, Homo sapiens
acagauugguauuuguucu

SEQ ID NO: 1475659 - RNA, 19 nt, Homo sapiens
uagaggagcuuaauaaaug

SEQ ID NO: 1475660 - RNA, 19 nt, Homo sapiens
ccaagugccucccucuuua

SEQ ID NO: 1475661 - RNA, 19 nt, Homo sapiens
gugccucccucuuuaauua

SEQ ID NO: 1475662 - RNA, 19 nt, Homo sapiens
cuaaugagcaggagauuua

SEQ ID NO: 1475663 - RNA, 19 nt, Homo sapiens
gccagaugcuucaggauua

SEQ ID NO: 1475664 - RNA, 19 nt, Homo sapiens
agacagaauuucacucuuu

SEQ ID NO: 1475665 - RNA, 19 nt, Homo sapiens
ggagggaacacccgacuua

SEQ ID NO: 1475666 - RNA, 19 nt, Homo sapiens
uaacuggccucaaaugaug

SEQ ID NO: 1475667 - RNA, 19 nt, Homo sapiens
caucagagccuaaaggaaa

SEQ ID NO: 1475668 - RNA, 19 nt, Homo sapiens
caucacagauccaaacaga

SEQ ID NO: 1475669 - RNA, 19 nt, Homo sapiens
ggucaggauucauugagua

SEQ ID NO: 1475670 - RNA, 19 nt, Homo sapiens
caucacacccggcuaauuu

SEQ ID NO: 1475671 - RNA, 19 nt, Homo sapiens
agaaaucccucgcuaguuc

SEQ ID NO: 1475672 - RNA, 19 nt, Homo sapiens
ucacagauccaaacagaaa

SEQ ID NO: 1475673 - RNA, 19 nt, Homo sapiens
ggaaggaugaggaacguuu

SEQ ID NO: 1475674 - RNA, 19 nt, Homo sapiens
aaauauggaucaucacaga

SEQ ID NO: 1475675 - RNA, 19 nt, Homo sapiens
gcugcuaacuggccucaaa

SEQ ID NO: 1475676 - RNA, 19 nt, Homo sapiens
gaagguuguucccaugaug

SEQ ID NO: 1475677 - RNA, 19 nt, Homo sapiens
gacagaauuucacucuuug

SEQ ID NO: 1475678 - RNA, 19 nt, Homo sapiens
acaguuggcugccgaguga

SEQ ID NO: 1475679 - RNA, 19 nt, Homo sapiens
gcagagaugcagagccuaa

SEQ ID NO: 1475680 - RNA, 19 nt, Homo sapiens
gcaccgagcacgcauguuc

SEQ ID NO: 1475681 - RNA, 19 nt, Homo sapiens
acaguaaucugagcaguga

SEQ ID NO: 1475682 - RNA, 19 nt, Homo sapiens
cagaguagcugggauuaca

SEQ ID NO: 1475683 - RNA, 19 nt, Homo sapiens
ccaaagugcugagauuaca

SEQ ID NO: 1475684 - RNA, 19 nt, Homo sapiens
cgaacggccucucagaaga

SEQ ID NO: 1475685 - RNA, 19 nt, Homo sapiens
gcaccugcccuauugcaaa

SEQ ID NO: 1475686 - RNA, 19 nt, Homo sapiens
gaagacaucagagccuaaa

SEQ ID NO: 1475687 - RNA, 19 nt, Homo sapiens
cgacuuccguugauagcaa

SEQ ID NO: 1475688 - RNA, 19 nt, Homo sapiens
guaaucauuugucaagagu

SEQ ID NO: 1475689 - RNA, 19 nt, Homo sapiens
ggagugcaauggcgcaauc

SEQ ID NO: 1475690 - RNA, 19 nt, Homo sapiens
gaacacccgacuuagcaaa

SEQ ID NO: 1475691 - RNA, 19 nt, Homo sapiens
gagcuaacccacauacuag

SEQ ID NO: 1475692 - RNA, 19 nt, Homo sapiens
gcaccuggccagcuuaugu

SEQ ID NO: 1475693 - RNA, 19 nt, Homo sapiens
caagaaaucccucgcuagu

SEQ ID NO: 1475694 - RNA, 19 nt, Homo sapiens
ggaauaauccaggaagugu

SEQ ID NO: 1475695 - RNA, 19 nt, Homo sapiens
ccagaugcuucaggauuaa

SEQ ID NO: 1475696 - RNA, 19 nt, Homo sapiens
gcucugacaggccauaauu

SEQ ID NO: 1475697 - RNA, 19 nt, Homo sapiens
gguaaucauuugucaagag

SEQ ID NO: 1475698 - RNA, 19 nt, Homo sapiens
ccacuaaccagaugcaaau

SEQ ID NO: 1475699 - RNA, 19 nt, Homo sapiens
ggagcuuaauaaaugcuuu

SEQ ID NO: 1475700 - RNA, 19 nt, Homo sapiens
caggauucauugaguagaa

SEQ ID NO: 1475701 - RNA, 19 nt, Homo sapiens
gcaggagauuuaugaaggu

SEQ ID NO: 1475702 - RNA, 19 nt, Homo sapiens
cagauggucucaguuacaa

SEQ ID NO: 1475703 - RNA, 19 nt, Homo sapiens
uggcagauggucucaguua

SEQ ID NO: 1475704 - RNA, 19 nt, Homo sapiens
ccacagcccagcuccauga

SEQ ID NO: 1475705 - RNA, 19 nt, Homo sapiens
ugagcuaacccacauacua

SEQ ID NO: 1475706 - RNA, 19 nt, Homo sapiens
gacaggccauaauuucaga

SEQ ID NO: 1475707 - RNA, 19 nt, Homo sapiens
gaaguuccacacaguaauc

SEQ ID NO: 1475708 - RNA, 19 nt, Homo sapiens
gagugacaauccagcaaga

SEQ ID NO: 1475709 - RNA, 19 nt, Homo sapiens
ggaguguaauggugcaauc

SEQ ID NO: 1475710 - RNA, 19 nt, Homo sapiens
gcacaagucccugcaacug

SEQ ID NO: 1475711 - RNA, 19 nt, Homo sapiens
guuacaacuucgcugcuuu

SEQ ID NO: 1475712 - RNA, 19 nt, Homo sapiens
gcagauggucucaguuaca

SEQ ID NO: 1475713 - RNA, 19 nt, Homo sapiens
ggccgguuauuucuuuaaa

SEQ ID NO: 1475714 - RNA, 19 nt, Homo sapiens
gcuaacuggccucaaauga

SEQ ID NO: 1475715 - RNA, 19 nt, Homo sapiens
ccgaguagcugggauuaca

SEQ ID NO: 1475716 - RNA, 19 nt, Homo sapiens
aauuagaggucaucaugga

SEQ ID NO: 1475717 - RNA, 19 nt, Homo sapiens
gagccuaaaggaccaggua

SEQ ID NO: 1475718 - RNA, 19 nt, Homo sapiens
gaaggaugaggaacguuug

SEQ ID NO: 1475719 - RNA, 19 nt, Homo sapiens
ggccaauguuguuguuguu

SEQ ID NO: 1475720 - RNA, 19 nt, Homo sapiens
caagugccucccucuuuaa

SEQ ID NO: 1475721 - RNA, 19 nt, Homo sapiens
caugugaggucaggauuca

SEQ ID NO: 1475722 - RNA, 19 nt, Homo sapiens
guuagcaccuggccagcuu

SEQ ID NO: 1475723 - RNA, 19 nt, Homo sapiens
ggccucaaaugaugcaugu

SEQ ID NO: 1475724 - RNA, 19 nt, Homo sapiens
ggcagagugugguauguca

SEQ ID NO: 1475725 - RNA, 19 nt, Homo sapiens
gggaacacccgacuuagca

SEQ ID NO: 1475726 - RNA, 19 nt, Homo sapiens
uuaauuagaggucaucaug

SEQ ID NO: 1475727 - RNA, 19 nt, Homo sapiens
ccucaaaugaugcauguga

SEQ ID NO: 1475728 - RNA, 19 nt, Homo sapiens
agagagagaagacaucaga

SEQ ID NO: 1475729 - RNA, 19 nt, Homo sapiens
aagcaccacucgcucauca

SEQ ID NO: 1475730 - RNA, 19 nt, Homo sapiens
gauggaguuucgcucuguu

SEQ ID NO: 1475731 - RNA, 19 nt, Homo sapiens
gagacguccugcacaaguc

SEQ ID NO: 1475732 - RNA, 19 nt, Homo sapiens
ggagacguccugcacaagu

SEQ ID NO: 1475733 - RNA, 19 nt, Homo sapiens
gcaagggcagagcuccuaa

SEQ ID NO: 1475734 - RNA, 19 nt, Homo sapiens
uaagacagaauuucacucu

SEQ ID NO: 1475735 - RNA, 19 nt, Homo sapiens
ucagagagucuacagaaca

SEQ ID NO: 1475736 - RNA, 19 nt, Homo sapiens
gugccuggcuugaguaaaa

SEQ ID NO: 1475737 - RNA, 19 nt, Homo sapiens
agucagagucggccacuaa

SEQ ID NO: 1475738 - RNA, 19 nt, Homo sapiens
gacaauccagcaagaaauc

SEQ ID NO: 1475739 - RNA, 19 nt, Homo sapiens
gugacaauccagcaagaaa

SEQ ID NO: 1475740 - RNA, 19 nt, Homo sapiens
cauaauuucagauccuuug

SEQ ID NO: 1475741 - RNA, 19 nt, Homo sapiens
gacaucagagccuaaagga

SEQ ID NO: 1475742 - RNA, 19 nt, Homo sapiens
gagcaggagauuuaugaag

SEQ ID NO: 1475743 - RNA, 19 nt, Homo sapiens
gcuaaugagcaggagauuu

SEQ ID NO: 1475744 - RNA, 19 nt, Homo sapiens
gcaugagggucgucuucca

SEQ ID NO: 1475745 - RNA, 19 nt, Homo sapiens
cagaauuucacucuuuguu

SEQ ID NO: 1475746 - RNA, 19 nt, Homo sapiens
cagcuucucucccuuucca

SEQ ID NO: 1475747 - RNA, 19 nt, Homo sapiens
gagccaauacgaagagaag

SEQ ID NO: 1475748 - RNA, 19 nt, Homo sapiens
gagcacugccgccacuaug

SEQ ID NO: 1475749 - RNA, 19 nt, Homo sapiens
uaugaagguuccagacagu

SEQ ID NO: 1475750 - RNA, 19 nt, Homo sapiens
cacaguauccuuuucauuu

SEQ ID NO: 1475751 - RNA, 19 nt, Homo sapiens
ugacaauccagcaagaaau

SEQ ID NO: 1475752 - RNA, 19 nt, Homo sapiens
caucaaggcggagaucaug

SEQ ID NO: 1475753 - RNA, 19 nt, Homo sapiens
gcagagccaauacgaagag

SEQ ID NO: 1475754 - RNA, 19 nt, Homo sapiens
uggaaauggucgggauauu

SEQ ID NO: 1475755 - RNA, 19 nt, Homo sapiens
gccauaauuucagauccuu

SEQ ID NO: 1475756 - RNA, 19 nt, Homo sapiens
ccaauguuguuguuguuuu

SEQ ID NO: 1475757 - RNA, 19 nt, Homo sapiens
agucagagagucuacagaa

SEQ ID NO: 1475758 - RNA, 19 nt, Homo sapiens
gcaccacucgcucaucaag

SEQ ID NO: 1475759 - RNA, 19 nt, Homo sapiens
ggaaacaucuucugcauuu

SEQ ID NO: 1475760 - RNA, 19 nt, Homo sapiens
gcgcagagcccauaauuua

SEQ ID NO: 1475761 - RNA, 19 nt, Homo sapiens
gaaagcuucuggcugauaa

SEQ ID NO: 1475762 - RNA, 19 nt, Homo sapiens
ggauaaaguuucacucuug

SEQ ID NO: 1475763 - RNA, 19 nt, Homo sapiens
ggguaaggaugaaguguua

SEQ ID NO: 1475764 - RNA, 19 nt, Homo sapiens
ggaagucucucuccaaagu

SEQ ID NO: 1475765 - RNA, 19 nt, Homo sapiens
gaaaggagauauagguaag

SEQ ID NO: 1475766 - RNA, 19 nt, Homo sapiens
caaaguggcuucacagaca

SEQ ID NO: 1475767 - RNA, 19 nt, Homo sapiens
uuacagaguucagucauua

SEQ ID NO: 1475768 - RNA, 19 nt, Homo sapiens
ucauagcacucaaagcuua

SEQ ID NO: 1475769 - RNA, 19 nt, Homo sapiens
caaaugaggacaggaaaua

SEQ ID NO: 1475770 - RNA, 19 nt, Homo sapiens
uuacagguguuguggaaua

SEQ ID NO: 1475771 - RNA, 19 nt, Homo sapiens
gaugagugcuggacgaaga

SEQ ID NO: 1475772 - RNA, 19 nt, Homo sapiens
ggaaaggagauauagguaa

SEQ ID NO: 1475773 - RNA, 19 nt, Homo sapiens
aagcauggaucagcuguua

SEQ ID NO: 1475774 - RNA, 19 nt, Homo sapiens
gguagcauccuuuccauaa

SEQ ID NO: 1475775 - RNA, 19 nt, Homo sapiens
gaacuugggagaugaacuu

SEQ ID NO: 1475776 - RNA, 19 nt, Homo sapiens
ggagauauagguaagaaga

SEQ ID NO: 1475777 - RNA, 19 nt, Homo sapiens
gaccuuaugcuaccuguaa

SEQ ID NO: 1475778 - RNA, 19 nt, Homo sapiens
agccugagcugucuucuuu

SEQ ID NO: 1475779 - RNA, 19 nt, Homo sapiens
ugacuggccuuccgcacua

SEQ ID NO: 1475780 - RNA, 19 nt, Homo sapiens
gaagguggcaggcagaaug

SEQ ID NO: 1475781 - RNA, 19 nt, Homo sapiens
gaagggacaagcucucuau

SEQ ID NO: 1475782 - RNA, 19 nt, Homo sapiens
caacuuagcaggcaacagu

SEQ ID NO: 1475783 - RNA, 19 nt, Homo sapiens
gaacuugggcugacaaagg

SEQ ID NO: 1475784 - RNA, 19 nt, Homo sapiens
caagcucucuaucccauga

SEQ ID NO: 1475785 - RNA, 19 nt, Homo sapiens
gggauaaaguuucacucuu

SEQ ID NO: 1475786 - RNA, 19 nt, Homo sapiens
ucaggaacaugcuuugaga

SEQ ID NO: 1475787 - RNA, 19 nt, Homo sapiens
ggccugggcagaacaaaua

SEQ ID NO: 1475788 - RNA, 19 nt, Homo sapiens
aaacagaagcaauggauga

SEQ ID NO: 1475789 - RNA, 19 nt, Homo sapiens
ccagcugccuuaccuuauu

SEQ ID NO: 1475790 - RNA, 19 nt, Homo sapiens
gaccaacccagcugccuua

SEQ ID NO: 1475791 - RNA, 19 nt, Homo sapiens
gaacaaaaccaaggucuuu

SEQ ID NO: 1475792 - RNA, 19 nt, Homo sapiens
ugaaugagggauaaaguuu

SEQ ID NO: 1475793 - RNA, 19 nt, Homo sapiens
cugggaaccuucuugagua

SEQ ID NO: 1475794 - RNA, 19 nt, Homo sapiens
gaucagcuguuaaucucau

SEQ ID NO: 1475795 - RNA, 19 nt, Homo sapiens
gcaagacagaggaugcuaa

SEQ ID NO: 1475796 - RNA, 19 nt, Homo sapiens
cagcuccucuccacaagaa

SEQ ID NO: 1475797 - RNA, 19 nt, Homo sapiens
ggacaucucaguagcaucu

SEQ ID NO: 1475798 - RNA, 19 nt, Homo sapiens
ccacaucucauucuucuca

SEQ ID NO: 1475799 - RNA, 19 nt, Homo sapiens
uaaaguuucacucuuggua

SEQ ID NO: 1475800 - RNA, 19 nt, Homo sapiens
gaaaacagcauggaacaaa

SEQ ID NO: 1475801 - RNA, 19 nt, Homo sapiens
uaacuucugagcucuguuu

SEQ ID NO: 1475802 - RNA, 19 nt, Homo sapiens
guaaggaugaaguguuaaa

SEQ ID NO: 1475803 - RNA, 19 nt, Homo sapiens
uaccagcccuuaacucaau

SEQ ID NO: 1475804 - RNA, 19 nt, Homo sapiens
aaugaugguugucugguuu

SEQ ID NO: 1475805 - RNA, 19 nt, Homo sapiens
caaugaugguugucugguu

SEQ ID NO: 1475806 - RNA, 19 nt, Homo sapiens
gauauucuugcguguguaa

SEQ ID NO: 1475807 - RNA, 19 nt, Homo sapiens
cagauauucuugcgugugu

SEQ ID NO: 1475808 - RNA, 19 nt, Homo sapiens
ucauugaucugcacaagag

SEQ ID NO: 1475809 - RNA, 19 nt, Homo sapiens
ggaguugguuggccucucu

SEQ ID NO: 1475810 - RNA, 19 nt, Homo sapiens
gaaaagugguccagcaaag

SEQ ID NO: 1475811 - RNA, 19 nt, Homo sapiens
gcauggaucagcuguuaau

SEQ ID NO: 1475812 - RNA, 19 nt, Homo sapiens
ccacagcuccucuccacaa

SEQ ID NO: 1475813 - RNA, 19 nt, Homo sapiens
cacacuggaaucuguauua

SEQ ID NO: 1475814 - RNA, 19 nt, Homo sapiens
uaguuucccugaaguguga

SEQ ID NO: 1475815 - RNA, 19 nt, Homo sapiens
gcacagagagaaaagaauu

SEQ ID NO: 1475816 - RNA, 19 nt, Homo sapiens
uuaguagccugaaggaaau

SEQ ID NO: 1475817 - RNA, 19 nt, Homo sapiens
gaagugugacguuuuagua

SEQ ID NO: 1475818 - RNA, 19 nt, Homo sapiens
gcuucuggcugauaaaucu

SEQ ID NO: 1475819 - RNA, 19 nt, Homo sapiens
caacccagcugccuuaccu

SEQ ID NO: 1475820 - RNA, 19 nt, Homo sapiens
ggccacauuucucaggauu

SEQ ID NO: 1475821 - RNA, 19 nt, Homo sapiens
uggagagcguggagaauga

SEQ ID NO: 1475822 - RNA, 19 nt, Homo sapiens
gaaugagggauaaaguuuc

SEQ ID NO: 1475823 - RNA, 19 nt, Homo sapiens
gacaggaaauagcagucaa

SEQ ID NO: 1475824 - RNA, 19 nt, Homo sapiens
gcagucggacaucucagua

SEQ ID NO: 1475825 - RNA, 19 nt, Homo sapiens
acacuggaaucuguauuau

SEQ ID NO: 1475826 - RNA, 19 nt, Homo sapiens
cuccacaccucuucgcuuu

SEQ ID NO: 1475827 - RNA, 19 nt, Homo sapiens
aaugagggauaaaguuuca

SEQ ID NO: 1475828 - RNA, 19 nt, Homo sapiens
agacagaggaugcuaaugg

SEQ ID NO: 1475829 - RNA, 19 nt, Homo sapiens
ugacuuauuuggccuucau

SEQ ID NO: 1475830 - RNA, 19 nt, Homo sapiens
aaacaucuucugcauuuca

SEQ ID NO: 1475831 - RNA, 19 nt, Homo sapiens
ggaacaugcuuugagaaaa

SEQ ID NO: 1475832 - RNA, 19 nt, Homo sapiens
ccagcgaauuuauauccuu

SEQ ID NO: 1475833 - RNA, 19 nt, Homo sapiens
ccacagcagggcucucaaa

SEQ ID NO: 1475834 - RNA, 19 nt, Homo sapiens
caagacagaggaugcuaau

SEQ ID NO: 1475835 - RNA, 19 nt, Homo sapiens
uggcaucucccagcaguua

SEQ ID NO: 1475836 - RNA, 19 nt, Homo sapiens
ccgcauggcugcucagacu

SEQ ID NO: 1475837 - RNA, 19 nt, Homo sapiens
gcaagcugaggacacaauu

SEQ ID NO: 1475838 - RNA, 19 nt, Homo sapiens
cagcgcagagcccauaauu

SEQ ID NO: 1475839 - RNA, 19 nt, Homo sapiens
ggacacccacaucucauuc

SEQ ID NO: 1475840 - RNA, 19 nt, Homo sapiens
uaagcaaacuggagauucc

SEQ ID NO: 1475841 - RNA, 19 nt, Homo sapiens
agggaagucucucuccaaa

SEQ ID NO: 1475842 - RNA, 19 nt, Homo sapiens
gcucaaacccacuccucuu

SEQ ID NO: 1475843 - RNA, 19 nt, Homo sapiens
ggacaggaaauagcaguca

SEQ ID NO: 1475844 - RNA, 19 nt, Homo sapiens
ccacuccucuugacacacu

SEQ ID NO: 1475845 - RNA, 19 nt, Homo sapiens
cagucucucuucccuaguu

SEQ ID NO: 1475846 - RNA, 19 nt, Homo sapiens
ugaaagcuucuggcugaua

SEQ ID NO: 1475847 - RNA, 19 nt, Homo sapiens
gagggaagucucucuccaa

SEQ ID NO: 1475848 - RNA, 19 nt, Homo sapiens
ccacaccucuucgcuuugg

SEQ ID NO: 1475849 - RNA, 19 nt, Homo sapiens
aaggagauauagguaagaa

SEQ ID NO: 1475850 - RNA, 19 nt, Homo sapiens
gaaggaaauacuaaugacu

SEQ ID NO: 1475851 - RNA, 19 nt, Homo sapiens
ugaaggaaauacuaaugac

SEQ ID NO: 1475852 - RNA, 19 nt, Homo sapiens
uuauuuggccuucaucuug

SEQ ID NO: 1475853 - RNA, 19 nt, Homo sapiens
guccucacuuugacuuauu

SEQ ID NO: 1475854 - RNA, 19 nt, Homo sapiens
aaguuucacucuugguauu

SEQ ID NO: 1475855 - RNA, 19 nt, Homo sapiens
ccugaagugugacguuuua

SEQ ID NO: 1475856 - RNA, 19 nt, Homo sapiens
ugaaacagaagcaauggau

SEQ ID NO: 1475857 - RNA, 19 nt, Homo sapiens
cagcuucgcuucguuucau

SEQ ID NO: 1475858 - RNA, 19 nt, Homo sapiens
aagcugaggacacaauuug

SEQ ID NO: 1475859 - RNA, 19 nt, Homo sapiens
ggaaagaagucuauuugau

SEQ ID NO: 1475860 - RNA, 19 nt, Homo sapiens
gauccaagcugccuacauu

SEQ ID NO: 1475861 - RNA, 19 nt, Homo sapiens
gauaaugacuuccucuuug

SEQ ID NO: 1475862 - RNA, 19 nt, Homo sapiens
gaagaugguucuaucaaug

SEQ ID NO: 1475863 - RNA, 19 nt, Homo sapiens
gcagaagacaugaucauua

SEQ ID NO: 1475864 - RNA, 19 nt, Homo sapiens
gaaagaagucuauuugaug

SEQ ID NO: 1475865 - RNA, 19 nt, Homo sapiens
aaucauggcuggagaauug

SEQ ID NO: 1475866 - RNA, 19 nt, Homo sapiens
ggagacacgugaaacaaug

SEQ ID NO: 1475867 - RNA, 19 nt, Homo sapiens
gcagauuucacccuuauaa

SEQ ID NO: 1475868 - RNA, 19 nt, Homo sapiens
gaagcucaccaucauauuu

SEQ ID NO: 1475869 - RNA, 19 nt, Homo sapiens
cagaagacaugaucauuag

SEQ ID NO: 1475870 - RNA, 19 nt, Homo sapiens
gguauguucugcuuucuug

SEQ ID NO: 1475871 - RNA, 19 nt, Homo sapiens
gaagacauaauuagggaaa

SEQ ID NO: 1475872 - RNA, 19 nt, Homo sapiens
gacaugaucauuagccaua

SEQ ID NO: 1475873 - RNA, 19 nt, Homo sapiens
agaauuggauagcagagua

SEQ ID NO: 1475874 - RNA, 19 nt, Homo sapiens
uaagguauguucugcuuuc

SEQ ID NO: 1475875 - RNA, 19 nt, Homo sapiens
ggagauacagauuggcaua

SEQ ID NO: 1475876 - RNA, 19 nt, Homo sapiens
ccucuuagcuccacuccuu

SEQ ID NO: 1475877 - RNA, 19 nt, Homo sapiens
ggagcuauaaccauugaua

SEQ ID NO: 1475878 - RNA, 19 nt, Homo sapiens
ggauaaugacuuccucuuu

SEQ ID NO: 1475879 - RNA, 19 nt, Homo sapiens
ugaagggagucucugcuuu

SEQ ID NO: 1475880 - RNA, 19 nt, Homo sapiens
gaaagcagaagacaugauc

SEQ ID NO: 1475881 - RNA, 19 nt, Homo sapiens
gcacaacuauaaucauucg

SEQ ID NO: 1475882 - RNA, 19 nt, Homo sapiens
gcugaaagcagaagacaug

SEQ ID NO: 1475883 - RNA, 19 nt, Homo sapiens
gauacagauuggcauagaa

SEQ ID NO: 1475884 - RNA, 19 nt, Homo sapiens
uggcacaacuauaaucauu

SEQ ID NO: 1475885 - RNA, 19 nt, Homo sapiens
ggaaugcauugaucagaag

SEQ ID NO: 1475886 - RNA, 19 nt, Homo sapiens
gaucauuagccauaagaaa

SEQ ID NO: 1475887 - RNA, 19 nt, Homo sapiens
uuaagaacaugcaggaaug

SEQ ID NO: 1475888 - RNA, 19 nt, Homo sapiens
gcauugaucagaaggugua

SEQ ID NO: 1475889 - RNA, 19 nt, Homo sapiens
ggauagcagaguaauguuu

SEQ ID NO: 1475890 - RNA, 19 nt, Homo sapiens
ggguugaaauuaucacaga

SEQ ID NO: 1475891 - RNA, 19 nt, Homo sapiens
gaauauguguguguaaggu

SEQ ID NO: 1475892 - RNA, 19 nt, Homo sapiens
ugaagaugguucuaucaau

SEQ ID NO: 1475893 - RNA, 19 nt, Homo sapiens
gauuucacccuuauaaguu

SEQ ID NO: 1475894 - RNA, 19 nt, Homo sapiens
ucagucccauuacuaguuu

SEQ ID NO: 1475895 - RNA, 19 nt, Homo sapiens
uacauuggcacaacuauaa

SEQ ID NO: 1475896 - RNA, 19 nt, Homo sapiens
ggagcugacccacagagua

SEQ ID NO: 1475897 - RNA, 19 nt, Homo sapiens
gauagcagaguaauguuug

SEQ ID NO: 1475898 - RNA, 19 nt, Homo sapiens
gggcaagguuacugcauuc

SEQ ID NO: 1475899 - RNA, 19 nt, Homo sapiens
aagcucaccaucauauuua

SEQ ID NO: 1475900 - RNA, 19 nt, Homo sapiens
gggaaagaagucuauuuga

SEQ ID NO: 1475901 - RNA, 19 nt, Homo sapiens
gacauuauccagagucaga

SEQ ID NO: 1475902 - RNA, 19 nt, Homo sapiens
caaaggaggaagacauaau

SEQ ID NO: 1475903 - RNA, 19 nt, Homo sapiens
ggccucuacuggauaauga

SEQ ID NO: 1475904 - RNA, 19 nt, Homo sapiens
aaaggaggaagacauaauu

SEQ ID NO: 1475905 - RNA, 19 nt, Homo sapiens
gaaacucaaaggaggaaga

SEQ ID NO: 1475906 - RNA, 19 nt, Homo sapiens
agacauaauuagggaaaga

SEQ ID NO: 1475907 - RNA, 19 nt, Homo sapiens
guuuagaggucaugaaggu

SEQ ID NO: 1475908 - RNA, 19 nt, Homo sapiens
ccagacggcugugcaagga

SEQ ID NO: 1475909 - RNA, 19 nt, Homo sapiens
gaauuggauagcagaguaa

SEQ ID NO: 1475910 - RNA, 19 nt, Homo sapiens
gagcugacccacagaguag

SEQ ID NO: 1475911 - RNA, 19 nt, Homo sapiens
gcaagauccuccgcugcaa

SEQ ID NO: 1475912 - RNA, 19 nt, Homo sapiens
uggaaacacucauucucaa

SEQ ID NO: 1475913 - RNA, 19 nt, Homo sapiens
gauuuaaggguugagauuu

SEQ ID NO: 1475914 - RNA, 19 nt, Homo sapiens
ggaaacacucauucucaau

SEQ ID NO: 1475915 - RNA, 19 nt, Homo sapiens
gauccaguuugucgauuca

SEQ ID NO: 1475916 - RNA, 19 nt, Homo sapiens
ggauccaguuugucgauuc

SEQ ID NO: 1475917 - RNA, 19 nt, Homo sapiens
uaaucuuccuguagccuuu

SEQ ID NO: 1475918 - RNA, 19 nt, Homo sapiens
caccaucacuuucacacau

SEQ ID NO: 1475919 - RNA, 19 nt, Homo sapiens
ugaugaauaugugugugua

SEQ ID NO: 1475920 - RNA, 19 nt, Homo sapiens
cugcaaugcugaguacgua

SEQ ID NO: 1475921 - RNA, 19 nt, Homo sapiens
gguggauaaucuuccugua

SEQ ID NO: 1475922 - RNA, 19 nt, Homo sapiens
aggaaugcauugaucagaa

SEQ ID NO: 1475923 - RNA, 19 nt, Homo sapiens
cagcuuccaccaucacuuu

SEQ ID NO: 1475924 - RNA, 19 nt, Homo sapiens
ggcgguacauggcaucgaa

SEQ ID NO: 1475925 - RNA, 19 nt, Homo sapiens
gcacagguaggacagaagu

SEQ ID NO: 1475926 - RNA, 19 nt, Homo sapiens
ggaggaagacauaauuagg

SEQ ID NO: 1475927 - RNA, 19 nt, Homo sapiens
uggcauagaagaauguaaa

SEQ ID NO: 1475928 - RNA, 19 nt, Homo sapiens
gaccaucagucccauuacu

SEQ ID NO: 1475929 - RNA, 19 nt, Homo sapiens
ggacccuugugacuaugaa

SEQ ID NO: 1475930 - RNA, 19 nt, Homo sapiens
gaagggagucucugcuuuu

SEQ ID NO: 1475931 - RNA, 19 nt, Homo sapiens
uguaagguauguucugcuu

SEQ ID NO: 1475932 - RNA, 19 nt, Homo sapiens
gcaguccaggguugaaauu

SEQ ID NO: 1475933 - RNA, 19 nt, Homo sapiens
aggcugagguggauaaucu

SEQ ID NO: 1475934 - RNA, 19 nt, Homo sapiens
ggaagcucaccaucauauu

SEQ ID NO: 1475935 - RNA, 19 nt, Homo sapiens
auaaugacuuccucuuugu

SEQ ID NO: 1475936 - RNA, 19 nt, Homo sapiens
ucgaagaccugaugaucca

SEQ ID NO: 1475937 - RNA, 19 nt, Homo sapiens
guucugcuuucuugauuca

SEQ ID NO: 1475938 - RNA, 19 nt, Homo sapiens
gagccuuccugccagacuu

SEQ ID NO: 1475939 - RNA, 19 nt, Homo sapiens
cuacauuggcacaacuaua

SEQ ID NO: 1475940 - RNA, 19 nt, Homo sapiens
gaugaauauguguguguaa

SEQ ID NO: 1475941 - RNA, 19 nt, Homo sapiens
gguugaaauuaucacagaa

SEQ ID NO: 1475942 - RNA, 19 nt, Homo sapiens
aaggaggaagacauaauua

SEQ ID NO: 1475943 - RNA, 19 nt, Homo sapiens
cugcagauuucacccuuau

SEQ ID NO: 1475944 - RNA, 19 nt, Homo sapiens
guccaggguugaaauuauc

SEQ ID NO: 1475945 - RNA, 19 nt, Homo sapiens
gcauagaagaauguaaaga

SEQ ID NO: 1475946 - RNA, 19 nt, Homo sapiens
gggagucucugcuuuugaa

SEQ ID NO: 1475947 - RNA, 19 nt, Homo sapiens
ggcauugucuagcucuuag

SEQ ID NO: 1475948 - RNA, 19 nt, Homo sapiens
uuagaggucaugaagguuu

SEQ ID NO: 1475949 - RNA, 19 nt, Homo sapiens
ggaccucgccuuccauucg

SEQ ID NO: 1475950 - RNA, 19 nt, Homo sapiens
agauacagauuggcauaga

SEQ ID NO: 1475951 - RNA, 19 nt, Homo sapiens
gaccugcagcucuguguug

SEQ ID NO: 1475952 - RNA, 19 nt, Homo sapiens
ugggcaagguuacugcauu

SEQ ID NO: 1475953 - RNA, 19 nt, Homo sapiens
aguccaggguugaaauuau

SEQ ID NO: 1475954 - RNA, 19 nt, Homo sapiens
cggaagcucaccaucauau

SEQ ID NO: 1475955 - RNA, 19 nt, Homo sapiens
uagggaaagaagucuauuu

SEQ ID NO: 1475956 - RNA, 19 nt, Homo sapiens
gagacacgugaaacaauga

SEQ ID NO: 1475957 - RNA, 19 nt, Homo sapiens
gcuauaaccauugauacug

SEQ ID NO: 1475958 - RNA, 19 nt, Homo sapiens
cacaugccguguccaagga

SEQ ID NO: 1475959 - RNA, 19 nt, Homo sapiens
gaaacaagcucuauggaaa

SEQ ID NO: 1475960 - RNA, 19 nt, Homo sapiens
gaacaugaaguguacaaua

SEQ ID NO: 1475961 - RNA, 19 nt, Homo sapiens
cacaguaaauccaguauua

SEQ ID NO: 1475962 - RNA, 19 nt, Homo sapiens
caggaaagauccaguauga

SEQ ID NO: 1475963 - RNA, 19 nt, Homo sapiens
caaaugaacuggccaugga

SEQ ID NO: 1475964 - RNA, 19 nt, Homo sapiens
gaagaaccaugaagagauc

SEQ ID NO: 1475965 - RNA, 19 nt, Homo sapiens
ccaccaagcuugacucgaa

SEQ ID NO: 1475966 - RNA, 19 nt, Homo sapiens
ccaaaggccugacagaaug

SEQ ID NO: 1475967 - RNA, 19 nt, Homo sapiens
gaaggagaguucccagguu

SEQ ID NO: 1475968 - RNA, 19 nt, Homo sapiens
ggaaucaucuacugaaugc

SEQ ID NO: 1475969 - RNA, 19 nt, Homo sapiens
gcuaaaggcucugcuggaa

SEQ ID NO: 1475970 - RNA, 19 nt, Homo sapiens
gcccagagcuucaggaaag

SEQ ID NO: 1475971 - RNA, 19 nt, Homo sapiens
ggaaacaagcucuauggaa

SEQ ID NO: 1475972 - RNA, 19 nt, Homo sapiens
gcaaauccuuagcauggaa

SEQ ID NO: 1475973 - RNA, 19 nt, Homo sapiens
ggaaagauccaguaugaag

SEQ ID NO: 1475974 - RNA, 19 nt, Homo sapiens
gaggagguauggauggaaa

SEQ ID NO: 1475975 - RNA, 19 nt, Homo sapiens
cacaagagcuaaagaagca

SEQ ID NO: 1475976 - RNA, 19 nt, Homo sapiens
gcaggcagcagccacagua

SEQ ID NO: 1475977 - RNA, 19 nt, Homo sapiens
gaaccgccaugaucagaag

SEQ ID NO: 1475978 - RNA, 19 nt, Homo sapiens
caaacaggaugaagagaag

SEQ ID NO: 1475979 - RNA, 19 nt, Homo sapiens
gacagcaacugacuaccaa

SEQ ID NO: 1475980 - RNA, 19 nt, Homo sapiens
gauccuggccugugagaaa

SEQ ID NO: 1475981 - RNA, 19 nt, Homo sapiens
gaguuaauguuacagacaa

SEQ ID NO: 1475982 - RNA, 19 nt, Homo sapiens
cagccuaucuggaccuuga

SEQ ID NO: 1475983 - RNA, 19 nt, Homo sapiens
gcacuaugcucugcacaca

SEQ ID NO: 1475984 - RNA, 19 nt, Homo sapiens
uaaugaagaugcuguggau

SEQ ID NO: 1475985 - RNA, 19 nt, Homo sapiens
guacacaagagcuaaagaa

SEQ ID NO: 1475986 - RNA, 19 nt, Homo sapiens
gagcaggguuguccuaagg

SEQ ID NO: 1475987 - RNA, 19 nt, Homo sapiens
uggagcagcuuucagaaga

SEQ ID NO: 1475988 - RNA, 19 nt, Homo sapiens
guacugagacugagcaaca

SEQ ID NO: 1475989 - RNA, 19 nt, Homo sapiens
gaguggagguggaaguaug

SEQ ID NO: 1475990 - RNA, 19 nt, Homo sapiens
ugacuauccugcuugcaaa

SEQ ID NO: 1475991 - RNA, 19 nt, Homo sapiens
cuacagcaguugcgacaga

SEQ ID NO: 1475992 - RNA, 19 nt, Homo sapiens
aguauuagcuccaaagaag

SEQ ID NO: 1475993 - RNA, 19 nt, Homo sapiens
ggaaucagcauggaugaga

SEQ ID NO: 1475994 - RNA, 19 nt, Homo sapiens
gcauggugcuaaugaagau

SEQ ID NO: 1475995 - RNA, 19 nt, Homo sapiens
cuacaggaaucaucuacug

SEQ ID NO: 1475996 - RNA, 19 nt, Homo sapiens
gaugagaccagaggaggua

SEQ ID NO: 1475997 - RNA, 19 nt, Homo sapiens
uaaaggcucugcuggaaaa

SEQ ID NO: 1475998 - RNA, 19 nt, Homo sapiens
gggcuucaccugacauuau

SEQ ID NO: 1475999 - RNA, 19 nt, Homo sapiens
gacucaagcugcagccuau

SEQ ID NO: 1476000 - RNA, 19 nt, Homo sapiens
gaaccuggacccuggaauc

SEQ ID NO: 1476001 - RNA, 19 nt, Homo sapiens
uacaauauccugcugcaaa

SEQ ID NO: 1476002 - RNA, 19 nt, Homo sapiens
gaagagguucuagcaauuc

SEQ ID NO: 1476003 - RNA, 19 nt, Homo sapiens
gaaggaggccacagagaag

SEQ ID NO: 1476004 - RNA, 19 nt, Homo sapiens
gaaagauccaguaugaagu

SEQ ID NO: 1476005 - RNA, 19 nt, Homo sapiens
ggauaaugauggacguaca

SEQ ID NO: 1476006 - RNA, 19 nt, Homo sapiens
caagcucuauggaaaauaa

SEQ ID NO: 1476007 - RNA, 19 nt, Homo sapiens
aagccaagaucaaggaguu

SEQ ID NO: 1476008 - RNA, 19 nt, Homo sapiens
cagagcugcugaaagagaa

SEQ ID NO: 1476009 - RNA, 19 nt, Homo sapiens
ucaaacaggaugaagagaa

SEQ ID NO: 1476010 - RNA, 19 nt, Homo sapiens
ggagguggaaguaugaaga

SEQ ID NO: 1476011 - RNA, 19 nt, Homo sapiens
acaauauccugcugcaaau

SEQ ID NO: 1476012 - RNA, 19 nt, Homo sapiens
gagccaggcaccuccuuaa

SEQ ID NO: 1476013 - RNA, 19 nt, Homo sapiens
cagcuucugcuucaacuaa

SEQ ID NO: 1476014 - RNA, 19 nt, Homo sapiens
gaagaggagcggaggaaag

SEQ ID NO: 1476015 - RNA, 19 nt, Homo sapiens
gaaagccacaggacagcaa

SEQ ID NO: 1476016 - RNA, 19 nt, Homo sapiens
gaggagcggaggaaaguug

SEQ ID NO: 1476017 - RNA, 19 nt, Homo sapiens
gaggagugcacaaagcaaa

SEQ ID NO: 1476018 - RNA, 19 nt, Homo sapiens
gcagcugccugggagaaga

SEQ ID NO: 1476019 - RNA, 19 nt, Homo sapiens
ggacagcaacugacuacca

SEQ ID NO: 1476020 - RNA, 19 nt, Homo sapiens
gaaggucccaaccagaaga

SEQ ID NO: 1476021 - RNA, 19 nt, Homo sapiens
ggaaagcaaggcucuaguc

SEQ ID NO: 1476022 - RNA, 19 nt, Homo sapiens
agaaggaggccacagagaa

SEQ ID NO: 1476023 - RNA, 19 nt, Homo sapiens
gggaguggcugagcuaagg

SEQ ID NO: 1476024 - RNA, 19 nt, Homo sapiens
ggagaaggagaugucagua

SEQ ID NO: 1476025 - RNA, 19 nt, Homo sapiens
agggacagcuggagaagga

SEQ ID NO: 1476026 - RNA, 19 nt, Homo sapiens
gaaagcaaggcucuagucu

SEQ ID NO: 1476027 - RNA, 19 nt, Homo sapiens
agaaggagaugucaguacu

SEQ ID NO: 1476028 - RNA, 19 nt, Homo sapiens
gaaccagcuucugcuucaa

SEQ ID NO: 1476029 - RNA, 19 nt, Homo sapiens
gagaguacacaagagcuaa

SEQ ID NO: 1476030 - RNA, 19 nt, Homo sapiens
ggagcaggguuguccuaag

SEQ ID NO: 1476031 - RNA, 19 nt, Homo sapiens
gcaguucaggccacgauga

SEQ ID NO: 1476032 - RNA, 19 nt, Homo sapiens
guguuaagguucugcuuca

SEQ ID NO: 1476033 - RNA, 19 nt, Homo sapiens
ggagagcagagccugaaga

SEQ ID NO: 1476034 - RNA, 19 nt, Homo sapiens
gaccagaggagguauggau

SEQ ID NO: 1476035 - RNA, 19 nt, Homo sapiens
gacaucaacagcaagaaug

SEQ ID NO: 1476036 - RNA, 19 nt, Homo sapiens
gagaaggaggccacagaga

SEQ ID NO: 1476037 - RNA, 19 nt, Homo sapiens
ggagaguucccagguucua

SEQ ID NO: 1476038 - RNA, 19 nt, Homo sapiens
gauccaguaugaaguccau

SEQ ID NO: 1476039 - RNA, 19 nt, Homo sapiens
caggaaucaucuacugaau

SEQ ID NO: 1476040 - RNA, 19 nt, Homo sapiens
cagaagaaccaugaagaga

SEQ ID NO: 1476041 - RNA, 19 nt, Homo sapiens
uggcucggcugcaagaaga

SEQ ID NO: 1476042 - RNA, 19 nt, Homo sapiens
gcugcaguguggcgagaaa

SEQ ID NO: 1476043 - RNA, 19 nt, Homo sapiens
ggcuucaccugacauuaug

SEQ ID NO: 1476044 - RNA, 19 nt, Homo sapiens
cgaagggacagcuggagaa

SEQ ID NO: 1476045 - RNA, 19 nt, Homo sapiens
cagcaagaaugaggaugga

SEQ ID NO: 1476046 - RNA, 19 nt, Homo sapiens
ggacguacaccccugauga

SEQ ID NO: 1476047 - RNA, 19 nt, Homo sapiens
caagaucaaggaguuguug

SEQ ID NO: 1476048 - RNA, 19 nt, Homo sapiens
caaggaagccaagaucaag

SEQ ID NO: 1476049 - RNA, 19 nt, Homo sapiens
gagaggagugcacaaagca

SEQ ID NO: 1476050 - RNA, 19 nt, Homo sapiens
cgagaggagugcacaaagc

SEQ ID NO: 1476051 - RNA, 19 nt, Homo sapiens
ggcagcagccacaguaaau

SEQ ID NO: 1476052 - RNA, 19 nt, Homo sapiens
ggagaaggaggaugaagac

SEQ ID NO: 1476053 - RNA, 19 nt, Homo sapiens
gauggaaacaagcucuaug

SEQ ID NO: 1476054 - RNA, 19 nt, Homo sapiens
cagaggagguauggaugga

SEQ ID NO: 1476055 - RNA, 19 nt, Homo sapiens
agaagaaccaugaagagau

SEQ ID NO: 1476056 - RNA, 19 nt, Homo sapiens
gaagcacugcccuacacuu

SEQ ID NO: 1476057 - RNA, 19 nt, Homo sapiens
ggaaccgccaugaucagaa

SEQ ID NO: 1476058 - RNA, 19 nt, Homo sapiens
gcaaaagacagaagagugu

SEQ ID NO: 1476059 - RNA, 19 nt, Homo sapiens
cgaaacagcuugaacgaaa

SEQ ID NO: 1476060 - RNA, 19 nt, Homo sapiens
ggaaaggucucccauguac

SEQ ID NO: 1476061 - RNA, 19 nt, Homo sapiens
gaugaaagaccacaauaaa

SEQ ID NO: 1476062 - RNA, 19 nt, Homo sapiens
gaaagugucuaaccuugug

SEQ ID NO: 1476063 - RNA, 19 nt, Homo sapiens
gaggaaaggucucccaugu

SEQ ID NO: 1476064 - RNA, 19 nt, Homo sapiens
gaagugagagcuacaauuc

SEQ ID NO: 1476065 - RNA, 19 nt, Homo sapiens
acacuuuggucacucauua

SEQ ID NO: 1476066 - RNA, 19 nt, Homo sapiens
ccacauggguuguuucugu

SEQ ID NO: 1476067 - RNA, 19 nt, Homo sapiens
ugagaauccugaugaguuu

SEQ ID NO: 1476068 - RNA, 19 nt, Homo sapiens
gaugagccauuuauugugu

SEQ ID NO: 1476069 - RNA, 19 nt, Homo sapiens
gagcuacaauuccagcauu

SEQ ID NO: 1476070 - RNA, 19 nt, Homo sapiens
ggaugaaagaccacaauaa

SEQ ID NO: 1476071 - RNA, 19 nt, Homo sapiens
ggagcaggaucuucauuca

SEQ ID NO: 1476072 - RNA, 19 nt, Homo sapiens
gaugcuugcugauggauga

SEQ ID NO: 1476073 - RNA, 19 nt, Homo sapiens
gcaguggcuuugugaguga

SEQ ID NO: 1476074 - RNA, 19 nt, Homo sapiens
aaacgaggcuugcccagau

SEQ ID NO: 1476075 - RNA, 19 nt, Homo sapiens
ccgaguagcuuguguggau

SEQ ID NO: 1476076 - RNA, 19 nt, Homo sapiens
gaaacgacuccaacagcua

SEQ ID NO: 1476077 - RNA, 19 nt, Homo sapiens
gcgaugagccauuuauugu

SEQ ID NO: 1476078 - RNA, 19 nt, Homo sapiens
gaaacagcuugaacgaaag

SEQ ID NO: 1476079 - RNA, 19 nt, Homo sapiens
gaacaggaagagcacagaa

SEQ ID NO: 1476080 - RNA, 19 nt, Homo sapiens
ucacgucgccguucccuuu

SEQ ID NO: 1476081 - RNA, 19 nt, Homo sapiens
aaacaagauuagcagcaaa

SEQ ID NO: 1476082 - RNA, 19 nt, Homo sapiens
ggcagggucuggauguauu

SEQ ID NO: 1476083 - RNA, 19 nt, Homo sapiens
gaacgaaaggugguuaaca

SEQ ID NO: 1476084 - RNA, 19 nt, Homo sapiens
ucugguagcuuagcaaaga

SEQ ID NO: 1476085 - RNA, 19 nt, Homo sapiens
gugagaauccugaugaguu

SEQ ID NO: 1476086 - RNA, 19 nt, Homo sapiens
gccgacuucugguagcuua

SEQ ID NO: 1476087 - RNA, 19 nt, Homo sapiens
ggacugcaccagaaagugu

SEQ ID NO: 1476088 - RNA, 19 nt, Homo sapiens
gauagacuaacaacccuuu

SEQ ID NO: 1476089 - RNA, 19 nt, Homo sapiens
ugacuuagccuugggauuc

SEQ ID NO: 1476090 - RNA, 19 nt, Homo sapiens
caagggcuauuaguacaga

SEQ ID NO: 1476091 - RNA, 19 nt, Homo sapiens
ugagugagaauccugauga

SEQ ID NO: 1476092 - RNA, 19 nt, Homo sapiens
caacuccgacuuccuacuu

SEQ ID NO: 1476093 - RNA, 19 nt, Homo sapiens
gcaaagagaccagcugacu

SEQ ID NO: 1476094 - RNA, 19 nt, Homo sapiens
ucccuuuacugaauaguuu

SEQ ID NO: 1476095 - RNA, 19 nt, Homo sapiens
gccguucccuuuacugaau

SEQ ID NO: 1476096 - RNA, 19 nt, Homo sapiens
uggauucgcuggacugcaa

SEQ ID NO: 1476097 - RNA, 19 nt, Homo sapiens
aaagagaccagcugacugu

SEQ ID NO: 1476098 - RNA, 19 nt, Homo sapiens
cgugggacgugucaaguug

SEQ ID NO: 1476099 - RNA, 19 nt, Homo sapiens
cagcuucgccaguuucuug

SEQ ID NO: 1476100 - RNA, 19 nt, Homo sapiens
ccugucaccuuacaucuca

SEQ ID NO: 1476101 - RNA, 19 nt, Homo sapiens
gguuguuucuguuucuuug

SEQ ID NO: 1476102 - RNA, 19 nt, Homo sapiens
cagcccagcuuuguacguu

SEQ ID NO: 1476103 - RNA, 19 nt, Homo sapiens
aagcauccgugccuaggaa

SEQ ID NO: 1476104 - RNA, 19 nt, Homo sapiens
aaagugcccuggguugaga

SEQ ID NO: 1476105 - RNA, 19 nt, Homo sapiens
acaccagccucauuuccaa

SEQ ID NO: 1476106 - RNA, 19 nt, Homo sapiens
gaucacuggcggaauccua

SEQ ID NO: 1476107 - RNA, 19 nt, Homo sapiens
aauccaagggcuauuagua

SEQ ID NO: 1476108 - RNA, 19 nt, Homo sapiens
ggcgaugagccauuuauug

SEQ ID NO: 1476109 - RNA, 19 nt, Homo sapiens
gaggguuuacuaggauuua

SEQ ID NO: 1476110 - RNA, 19 nt, Homo sapiens
gaauguggcaguggcuuug

SEQ ID NO: 1476111 - RNA, 19 nt, Homo sapiens
gcugaaaccacgucaaguc

SEQ ID NO: 1476112 - RNA, 19 nt, Homo sapiens
uuacccaacucugaucuug

SEQ ID NO: 1476113 - RNA, 19 nt, Homo sapiens
ucucacaccagccucauuu

SEQ ID NO: 1476114 - RNA, 19 nt, Homo sapiens
ccagaaagugucuaaccuu

SEQ ID NO: 1476115 - RNA, 19 nt, Homo sapiens
gcagggaugcuugcugaug

SEQ ID NO: 1476116 - RNA, 19 nt, Homo sapiens
gcagggucuggauguauuu

SEQ ID NO: 1476117 - RNA, 19 nt, Homo sapiens
gggcucuggucacacuuug

SEQ ID NO: 1476118 - RNA, 19 nt, Homo sapiens
uauuacugcugcaagaaga

SEQ ID NO: 1476119 - RNA, 19 nt, Homo sapiens
gcaccugucaccuuacauc

SEQ ID NO: 1476120 - RNA, 19 nt, Homo sapiens
ggauguauuuacccaacuc

SEQ ID NO: 1476121 - RNA, 19 nt, Homo sapiens
gcaggaucuucauucaucu

SEQ ID NO: 1476122 - RNA, 19 nt, Homo sapiens
ccugugagggugugcauaa

SEQ ID NO: 1476123 - RNA, 19 nt, Homo sapiens
ggaccagucacuaaucucu

SEQ ID NO: 1476124 - RNA, 19 nt, Homo sapiens
agcaggaucuucauucauc

SEQ ID NO: 1476125 - RNA, 19 nt, Homo sapiens
ugugaucacuggcggaauc

SEQ ID NO: 1476126 - RNA, 19 nt, Homo sapiens
ucauugccguccugugcua

SEQ ID NO: 1476127 - RNA, 19 nt, Homo sapiens
guggaggguuuacuaggau

SEQ ID NO: 1476128 - RNA, 19 nt, Homo sapiens
cacauggguuguuucuguu

SEQ ID NO: 1476129 - RNA, 19 nt, Homo sapiens
guuaacacgugaccaaucc

SEQ ID NO: 1476130 - RNA, 19 nt, Homo sapiens
aaagucugaucccgaaaca

SEQ ID NO: 1476131 - RNA, 19 nt, Homo sapiens
gaugaaugacccuccaaca

SEQ ID NO: 1476132 - RNA, 19 nt, Homo sapiens
uccaagaagugagaauuuc

SEQ ID NO: 1476133 - RNA, 19 nt, Homo sapiens
gcucuaggaccagucacua

SEQ ID NO: 1476134 - RNA, 19 nt, Homo sapiens
cuucuaagggcauagcuaa

SEQ ID NO: 1476135 - RNA, 19 nt, Homo sapiens
guugauuccugaacguauc

SEQ ID NO: 1476136 - RNA, 19 nt, Homo sapiens
guucacagcccagcuuugu

SEQ ID NO: 1476137 - RNA, 19 nt, Homo sapiens
ggaggguuuacuaggauuu

SEQ ID NO: 1476138 - RNA, 19 nt, Homo sapiens
gcaguggaggguuuacuag

SEQ ID NO: 1476139 - RNA, 19 nt, Homo sapiens
gcuccaagaagugagaauu

SEQ ID NO: 1476140 - RNA, 19 nt, Homo sapiens
ccagggaaagcucagcaaa

SEQ ID NO: 1476141 - RNA, 19 nt, Homo sapiens
gauccuccucugcaucauu

SEQ ID NO: 1476142 - RNA, 19 nt, Homo sapiens
aacgaggcuugcccagaua

SEQ ID NO: 1476143 - RNA, 19 nt, Homo sapiens
gagaagugagagcuacaau

SEQ ID NO: 1476144 - RNA, 19 nt, Homo sapiens
gaagcauccgugccuagga

SEQ ID NO: 1476145 - RNA, 19 nt, Homo sapiens
agggaaagcucagcaaagg

SEQ ID NO: 1476146 - RNA, 19 nt, Homo sapiens
gaaagaccacaauaaaaca

SEQ ID NO: 1476147 - RNA, 19 nt, Homo sapiens
uggaugaaagaccacaaua

SEQ ID NO: 1476148 - RNA, 19 nt, Homo sapiens
uccaagggcuauuaguaca

SEQ ID NO: 1476149 - RNA, 19 nt, Homo sapiens
accagucacuaaucucuga

SEQ ID NO: 1476150 - RNA, 19 nt, Homo sapiens
cugaacguaucacaucuca

SEQ ID NO: 1476151 - RNA, 19 nt, Homo sapiens
cagcuuuguacguugguua

SEQ ID NO: 1476152 - RNA, 19 nt, Homo sapiens
ucacagcccagcuuuguac

SEQ ID NO: 1476153 - RNA, 19 nt, Homo sapiens
agaagugagagcuacaauu

SEQ ID NO: 1476154 - RNA, 19 nt, Homo sapiens
aguggaggguuuacuagga

SEQ ID NO: 1476155 - RNA, 19 nt, Homo sapiens
uaggaccagucacuaaucu

SEQ ID NO: 1476156 - RNA, 19 nt, Homo sapiens
ccaguggccucugcagaag

SEQ ID NO: 1476157 - RNA, 19 nt, Homo sapiens
gagugagaauccugaugag

SEQ ID NO: 1476158 - RNA, 19 nt, Homo sapiens
gagcaggaucuucauucau

SEQ ID NO: 1476159 - RNA, 19 nt, Homo sapiens
gaacaucacugucaaacuu

SEQ ID NO: 1476160 - RNA, 19 nt, Homo sapiens
ggaaggugaugcucucuua

SEQ ID NO: 1476161 - RNA, 19 nt, Homo sapiens
caagaaaucuccacaaagu

SEQ ID NO: 1476162 - RNA, 19 nt, Homo sapiens
ccagagagcuuugaaggua

SEQ ID NO: 1476163 - RNA, 19 nt, Homo sapiens
ggaaaucuacucacuauga

SEQ ID NO: 1476164 - RNA, 19 nt, Homo sapiens
ccaaugcgguguuucuuaa

SEQ ID NO: 1476165 - RNA, 19 nt, Homo sapiens
gaugaugacuguuacauag

SEQ ID NO: 1476166 - RNA, 19 nt, Homo sapiens
gaagauccuuauuccugua

SEQ ID NO: 1476167 - RNA, 19 nt, Homo sapiens
ccucgaagcuguauuuaau

SEQ ID NO: 1476168 - RNA, 19 nt, Homo sapiens
aaacaacgagcuucaauuu

SEQ ID NO: 1476169 - RNA, 19 nt, Homo sapiens
gcaccuggaugagacauuu

SEQ ID NO: 1476170 - RNA, 19 nt, Homo sapiens
gcuacagcaucccacauua

SEQ ID NO: 1476171 - RNA, 19 nt, Homo sapiens
gaaaucuacucacuaugau

SEQ ID NO: 1476172 - RNA, 19 nt, Homo sapiens
caauucaucuuaccagaga

SEQ ID NO: 1476173 - RNA, 19 nt, Homo sapiens
ccaaggacaucgucaagug

SEQ ID NO: 1476174 - RNA, 19 nt, Homo sapiens
gaaacaacgagcuucaauu

SEQ ID NO: 1476175 - RNA, 19 nt, Homo sapiens
gucaagaaaucuccacaaa

SEQ ID NO: 1476176 - RNA, 19 nt, Homo sapiens
caacuuguacuguagcaua

SEQ ID NO: 1476177 - RNA, 19 nt, Homo sapiens
gauaugugaucuccaagga

SEQ ID NO: 1476178 - RNA, 19 nt, Homo sapiens
gaaaguggcaggaguugga

SEQ ID NO: 1476179 - RNA, 19 nt, Homo sapiens
guggaaaucuacucacuau

SEQ ID NO: 1476180 - RNA, 19 nt, Homo sapiens
ucaaguggcuggcaagcaa

SEQ ID NO: 1476181 - RNA, 19 nt, Homo sapiens
caacgagcuucaauuuguu

SEQ ID NO: 1476182 - RNA, 19 nt, Homo sapiens
ggaguucucagagucauua

SEQ ID NO: 1476183 - RNA, 19 nt, Homo sapiens
gcaggugguuuuauauaua

SEQ ID NO: 1476184 - RNA, 19 nt, Homo sapiens
ugaacaagcugugguacaa

SEQ ID NO: 1476185 - RNA, 19 nt, Homo sapiens
gaggaaagcagcaucuaug

SEQ ID NO: 1476186 - RNA, 19 nt, Homo sapiens
gaacuucgaaacgugauaa

SEQ ID NO: 1476187 - RNA, 19 nt, Homo sapiens
cagaucaguuggccuuauu

SEQ ID NO: 1476188 - RNA, 19 nt, Homo sapiens
gauaacagggacuugaauu

SEQ ID NO: 1476189 - RNA, 19 nt, Homo sapiens
caggauaugugaucuccaa

SEQ ID NO: 1476190 - RNA, 19 nt, Homo sapiens
gcagaucaguuggccuuau

SEQ ID NO: 1476191 - RNA, 19 nt, Homo sapiens
ugaggaagaugccuuacug

SEQ ID NO: 1476192 - RNA, 19 nt, Homo sapiens
ggaaacaacgagcuucaau

SEQ ID NO: 1476193 - RNA, 19 nt, Homo sapiens
caacaucacaaauccaguu

SEQ ID NO: 1476194 - RNA, 19 nt, Homo sapiens
ggacuugaauuagcagagu

SEQ ID NO: 1476195 - RNA, 19 nt, Homo sapiens
ggaagaugccuuacugaag

SEQ ID NO: 1476196 - RNA, 19 nt, Homo sapiens
gugaugcucucuuacacaa

SEQ ID NO: 1476197 - RNA, 19 nt, Homo sapiens
gugcauugccucaugaauu

SEQ ID NO: 1476198 - RNA, 19 nt, Homo sapiens
gaaccaaugcgguguuucu

SEQ ID NO: 1476199 - RNA, 19 nt, Homo sapiens
cgacacuuaucguaauguu

SEQ ID NO: 1476200 - RNA, 19 nt, Homo sapiens
ggaggaaagcagcaucuau

SEQ ID NO: 1476201 - RNA, 19 nt, Homo sapiens
agaaaucuccacaaaguga

SEQ ID NO: 1476202 - RNA, 19 nt, Homo sapiens
caauaaccaugaacuucga

SEQ ID NO: 1476203 - RNA, 19 nt, Homo sapiens
uggauguugucgacacuua

SEQ ID NO: 1476204 - RNA, 19 nt, Homo sapiens
auaagaagcaccuggauga

SEQ ID NO: 1476205 - RNA, 19 nt, Homo sapiens
gcaugugggucaggauaug

SEQ ID NO: 1476206 - RNA, 19 nt, Homo sapiens
cagaaccaaugcgguguuu

SEQ ID NO: 1476207 - RNA, 19 nt, Homo sapiens
ggcaaacgauaaucugagu

SEQ ID NO: 1476208 - RNA, 19 nt, Homo sapiens
uaacagggacuugaauuag

SEQ ID NO: 1476209 - RNA, 19 nt, Homo sapiens
ugacggaacuguggaaacu

SEQ ID NO: 1476210 - RNA, 19 nt, Homo sapiens
guacaagcccguggaacaa

SEQ ID NO: 1476211 - RNA, 19 nt, Homo sapiens
guucuacgaugccaaugau

SEQ ID NO: 1476212 - RNA, 19 nt, Homo sapiens
cagcgugaguuuccgaguu

SEQ ID NO: 1476213 - RNA, 19 nt, Homo sapiens
gaugagacauuugcuacag

SEQ ID NO: 1476214 - RNA, 19 nt, Homo sapiens
auaacagggacuugaauua

SEQ ID NO: 1476215 - RNA, 19 nt, Homo sapiens
ggaaagcagcaucuaugau

SEQ ID NO: 1476216 - RNA, 19 nt, Homo sapiens
cguggaacaauucaucuua

SEQ ID NO: 1476217 - RNA, 19 nt, Homo sapiens
ugcauugccucaugaauuc

SEQ ID NO: 1476218 - RNA, 19 nt, Homo sapiens
acaucacugucaaacuuua

SEQ ID NO: 1476219 - RNA, 19 nt, Homo sapiens
cuacagcaucccacauuaa

SEQ ID NO: 1476220 - RNA, 19 nt, Homo sapiens
gguacaagcccguggaaca

SEQ ID NO: 1476221 - RNA, 19 nt, Homo sapiens
gucccaggguuuagcagua

SEQ ID NO: 1476222 - RNA, 19 nt, Homo sapiens
cuaucagggugaagaugua

SEQ ID NO: 1476223 - RNA, 19 nt, Homo sapiens
acaaagugacagugaauga

SEQ ID NO: 1476224 - RNA, 19 nt, Homo sapiens
acaagcccguggaacaauu

SEQ ID NO: 1476225 - RNA, 19 nt, Homo sapiens
cagaggaacaucacuguca

SEQ ID NO: 1476226 - RNA, 19 nt, Homo sapiens
gcugucuucuccucaguau

SEQ ID NO: 1476227 - RNA, 19 nt, Homo sapiens
uagauggacuguggaaaca

SEQ ID NO: 1476228 - RNA, 19 nt, Homo sapiens
ugucgacacuuaucguaau

SEQ ID NO: 1476229 - RNA, 19 nt, Homo sapiens
ccaugaggaagaugccuua

SEQ ID NO: 1476230 - RNA, 19 nt, Homo sapiens
ugugguaguuggcguguug

SEQ ID NO: 1476231 - RNA, 19 nt, Homo sapiens
gugaagugccuguggaaga

SEQ ID NO: 1476232 - RNA, 19 nt, Homo sapiens
agaccucgaagcuguauuu

SEQ ID NO: 1476233 - RNA, 19 nt, Homo sapiens
gauggacuguggaaacaac

SEQ ID NO: 1476234 - RNA, 19 nt, Homo sapiens
guugucagcucgcaauaac

SEQ ID NO: 1476235 - RNA, 19 nt, Homo sapiens
uauaaggaaucuccaugag

SEQ ID NO: 1476236 - RNA, 19 nt, Homo sapiens
ccacaaagugacagugaau

SEQ ID NO: 1476237 - RNA, 19 nt, Homo sapiens
ccuguaaacuacucaacau

SEQ ID NO: 1476238 - RNA, 19 nt, Homo sapiens
aaagauaccaggacagucu

SEQ ID NO: 1476239 - RNA, 19 nt, Homo sapiens
gaaucuggaugggccuaau

SEQ ID NO: 1476240 - RNA, 19 nt, Homo sapiens
caucuuaccagagagcuuu

SEQ ID NO: 1476241 - RNA, 19 nt, Homo sapiens
caaacuuuaucaggcagaa

SEQ ID NO: 1476242 - RNA, 19 nt, Homo sapiens
agaggaacaucacugucaa

SEQ ID NO: 1476243 - RNA, 19 nt, Homo sapiens
cuucgaaacgugauaagaa

SEQ ID NO: 1476244 - RNA, 19 nt, Homo sapiens
ugaggagucccaggguuua

SEQ ID NO: 1476245 - RNA, 19 nt, Homo sapiens
gaacggugcggugauccuu

SEQ ID NO: 1476246 - RNA, 19 nt, Homo sapiens
acggaacuguggaaacuga

SEQ ID NO: 1476247 - RNA, 19 nt, Homo sapiens
ugagaagaccugugagaca

SEQ ID NO: 1476248 - RNA, 19 nt, Homo sapiens
gaggaagaugccuuacuga

SEQ ID NO: 1476249 - RNA, 19 nt, Homo sapiens
ggaaucuccaugaggaaga

SEQ ID NO: 1476250 - RNA, 19 nt, Homo sapiens
gcuguggugugcaggugaa

SEQ ID NO: 1476251 - RNA, 19 nt, Homo sapiens
cuucauugcucgcuucagu

SEQ ID NO: 1476252 - RNA, 19 nt, Homo sapiens
gaggaacaucacugucaaa

SEQ ID NO: 1476253 - RNA, 19 nt, Homo sapiens
cuacucaacaucacaaauc

SEQ ID NO: 1476254 - RNA, 19 nt, Homo sapiens
aacgugugcuugugaaguu

SEQ ID NO: 1476255 - RNA, 19 nt, Homo sapiens
ugucuucuccucaguauuc

SEQ ID NO: 1476256 - RNA, 19 nt, Homo sapiens
gaucaguuggccuuauuuc

SEQ ID NO: 1476257 - RNA, 19 nt, Homo sapiens
aaagugacagugaaugaug

SEQ ID NO: 1476258 - RNA, 19 nt, Homo sapiens
guaaacuacucaacaucac

SEQ ID NO: 1476259 - RNA, 19 nt, Homo sapiens
cuccagagcuuauauauuu

SEQ ID NO: 1476260 - RNA, 19 nt, Homo sapiens
ggacuuacccaaacuguga

SEQ ID NO: 1476261 - RNA, 19 nt, Homo sapiens
ccacggcacucaccauauu

SEQ ID NO: 1476262 - RNA, 19 nt, Homo sapiens
gcgaaucccuucucaguuc

SEQ ID NO: 1476263 - RNA, 19 nt, Homo sapiens
agaaaucccuuaaccaaug

SEQ ID NO: 1476264 - RNA, 19 nt, Homo sapiens
gaaauucaucuuugaguug

SEQ ID NO: 1476265 - RNA, 19 nt, Homo sapiens
acagacagccgauucuuua

SEQ ID NO: 1476266 - RNA, 19 nt, Homo sapiens
gaaaggugccauccagauu

SEQ ID NO: 1476267 - RNA, 19 nt, Homo sapiens
gaaagcuaguguugaugaa

SEQ ID NO: 1476268 - RNA, 19 nt, Homo sapiens
ggaaagcuaguguugauga

SEQ ID NO: 1476269 - RNA, 19 nt, Homo sapiens
gcugauggcucacuuugau

SEQ ID NO: 1476270 - RNA, 19 nt, Homo sapiens
uaccauaauugucaccaua

SEQ ID NO: 1476271 - RNA, 19 nt, Homo sapiens
aaacugugauacuaccaua

SEQ ID NO: 1476272 - RNA, 19 nt, Homo sapiens
ucugagaaguccaauacua

SEQ ID NO: 1476273 - RNA, 19 nt, Homo sapiens
ggagagaaaucccuuaacc

SEQ ID NO: 1476274 - RNA, 19 nt, Homo sapiens
gaucaaaaccacauuguaa

SEQ ID NO: 1476275 - RNA, 19 nt, Homo sapiens
ccacuggcaucuacagguu

SEQ ID NO: 1476276 - RNA, 19 nt, Homo sapiens
gacagccgauucuuuacaa

SEQ ID NO: 1476277 - RNA, 19 nt, Homo sapiens
gauacuaccauaauuguca

SEQ ID NO: 1476278 - RNA, 19 nt, Homo sapiens
cauuguggcugauaacaga

SEQ ID NO: 1476279 - RNA, 19 nt, Homo sapiens
accaaugccuaucauauuu

SEQ ID NO: 1476280 - RNA, 19 nt, Homo sapiens
gaacucacgaagaacauug

SEQ ID NO: 1476281 - RNA, 19 nt, Homo sapiens
ggaccuggacuuacccaaa

SEQ ID NO: 1476282 - RNA, 19 nt, Homo sapiens
caacacagacagccgauuc

SEQ ID NO: 1476283 - RNA, 19 nt, Homo sapiens
caccauaaucagucaaaua

SEQ ID NO: 1476284 - RNA, 19 nt, Homo sapiens
aggcuugacuuaacaaaug

SEQ ID NO: 1476285 - RNA, 19 nt, Homo sapiens
gcugcccucuugucccuua

SEQ ID NO: 1476286 - RNA, 19 nt, Homo sapiens
gcuaugcugcuccuaguuu

SEQ ID NO: 1476287 - RNA, 19 nt, Homo sapiens
gcacucaccauauucaaag

SEQ ID NO: 1476288 - RNA, 19 nt, Homo sapiens
gguaaagucagcagaaauc

SEQ ID NO: 1476289 - RNA, 19 nt, Homo sapiens
caaggggccugcuggguua

SEQ ID NO: 1476290 - RNA, 19 nt, Homo sapiens
acagucaacuuccggauuc

SEQ ID NO: 1476291 - RNA, 19 nt, Homo sapiens
ugcagcaacuggcaaauga

SEQ ID NO: 1476292 - RNA, 19 nt, Homo sapiens
gaugaaagaggcgcugaaa

SEQ ID NO: 1476293 - RNA, 19 nt, Homo sapiens
uaaacucucccaagaacaa

SEQ ID NO: 1476294 - RNA, 19 nt, Homo sapiens
gagaaaucccuuaaccaau

SEQ ID NO: 1476295 - RNA, 19 nt, Homo sapiens
agagaaaucccuuaaccaa

SEQ ID NO: 1476296 - RNA, 19 nt, Homo sapiens
cgacaagaacucugugaug

SEQ ID NO: 1476297 - RNA, 19 nt, Homo sapiens
gaaagaggcgcugaaaggu

SEQ ID NO: 1476298 - RNA, 19 nt, Homo sapiens
caccaaugccuaucauauu

SEQ ID NO: 1476299 - RNA, 19 nt, Homo sapiens
gaguauagccaccuguuca

SEQ ID NO: 1476300 - RNA, 19 nt, Homo sapiens
ugaaagaggcgcugaaagg

SEQ ID NO: 1476301 - RNA, 19 nt, Homo sapiens
gaaaucccuuaaccaaugc

SEQ ID NO: 1476302 - RNA, 19 nt, Homo sapiens
gcaacuggcaaaugagguu

SEQ ID NO: 1476303 - RNA, 19 nt, Homo sapiens
gacaagcauuggcauccuu

SEQ ID NO: 1476304 - RNA, 19 nt, Homo sapiens
ccaaaggagacaagcauug

SEQ ID NO: 1476305 - RNA, 19 nt, Homo sapiens
uacccaaacugugauacua

SEQ ID NO: 1476306 - RNA, 19 nt, Homo sapiens
gaccuggacuuacccaaac

SEQ ID NO: 1476307 - RNA, 19 nt, Homo sapiens
aaccaguuguuaccugaua

SEQ ID NO: 1476308 - RNA, 19 nt, Homo sapiens
gaagaacauuguggcugau

SEQ ID NO: 1476309 - RNA, 19 nt, Homo sapiens
uccuagaacucacgaagaa

SEQ ID NO: 1476310 - RNA, 19 nt, Homo sapiens
ugagguuuauggagagaaa

SEQ ID NO: 1476311 - RNA, 19 nt, Homo sapiens
gaggaucucagcccugcua

SEQ ID NO: 1476312 - RNA, 19 nt, Homo sapiens
gcacacuggacgacaagaa

SEQ ID NO: 1476313 - RNA, 19 nt, Homo sapiens
agaacauuguggcugauaa

SEQ ID NO: 1476314 - RNA, 19 nt, Homo sapiens
caagagguccuagaacuca

SEQ ID NO: 1476315 - RNA, 19 nt, Homo sapiens
ucagagaaggguuccauga

SEQ ID NO: 1476316 - RNA, 19 nt, Homo sapiens
gcucugagaaguccaauac

SEQ ID NO: 1476317 - RNA, 19 nt, Homo sapiens
cucaugagcugucucuuca

SEQ ID NO: 1476318 - RNA, 19 nt, Homo sapiens
uaagguaaagucagcagaa

SEQ ID NO: 1476319 - RNA, 19 nt, Homo sapiens
aaacauugcccaucugucu

SEQ ID NO: 1476320 - RNA, 19 nt, Homo sapiens
ccagcuagccuucauugug

SEQ ID NO: 1476321 - RNA, 19 nt, Homo sapiens
ccauaauugucaccauaau

SEQ ID NO: 1476322 - RNA, 19 nt, Homo sapiens
cagagaaggguuccaugaa

SEQ ID NO: 1476323 - RNA, 19 nt, Homo sapiens
gaucuuucuucauuucucu

SEQ ID NO: 1476324 - RNA, 19 nt, Homo sapiens
ugucuuaugcugguuauuu

SEQ ID NO: 1476325 - RNA, 19 nt, Homo sapiens
caaagggcgucgcgaaucc

SEQ ID NO: 1476326 - RNA, 19 nt, Homo sapiens
ucccuuaaccaaugcaaua

SEQ ID NO: 1476327 - RNA, 19 nt, Homo sapiens
gaaccucaugcugcaagua

SEQ ID NO: 1476328 - RNA, 19 nt, Homo sapiens
agaacucugugauggcauu

SEQ ID NO: 1476329 - RNA, 19 nt, Homo sapiens
gaugcuuucuccagagcuu

SEQ ID NO: 1476330 - RNA, 19 nt, Homo sapiens
ucccuuaucugucuuaugc

SEQ ID NO: 1476331 - RNA, 19 nt, Homo sapiens
cuucaucucuccucucucu

SEQ ID NO: 1476332 - RNA, 19 nt, Homo sapiens
aagguaaagucagcagaaa

SEQ ID NO: 1476333 - RNA, 19 nt, Homo sapiens
ccagcuuuauccagcauga

SEQ ID NO: 1476334 - RNA, 19 nt, Homo sapiens
ucagucaaauaaagugauc

SEQ ID NO: 1476335 - RNA, 19 nt, Homo sapiens
cgacaucugcaucccuuga

SEQ ID NO: 1476336 - RNA, 19 nt, Homo sapiens
ucuuugaguugauucagaa

SEQ ID NO: 1476337 - RNA, 19 nt, Homo sapiens
gaacauuguggcugauaac

SEQ ID NO: 1476338 - RNA, 19 nt, Homo sapiens
gauucacccuggacagaca

SEQ ID NO: 1476339 - RNA, 19 nt, Homo sapiens
cuuaaccaaugcaauaauc

SEQ ID NO: 1476340 - RNA, 19 nt, Homo sapiens
acaccaaugccuaucauau

SEQ ID NO: 1476341 - RNA, 19 nt, Homo sapiens
gaacucugugauggcauua

SEQ ID NO: 1476342 - RNA, 19 nt, Homo sapiens
cccuuacucuucaauuuau

SEQ ID NO: 1476343 - RNA, 19 nt, Homo sapiens
cuuaaacucucccaagaac

SEQ ID NO: 1476344 - RNA, 19 nt, Homo sapiens
ggggaaagcuaguguugau

SEQ ID NO: 1476345 - RNA, 19 nt, Homo sapiens
ccuaugagacccaagugaa

SEQ ID NO: 1476346 - RNA, 19 nt, Homo sapiens
caaugccuaucauauuugg

SEQ ID NO: 1476347 - RNA, 19 nt, Homo sapiens
ggucagcaccagcuuuauc

SEQ ID NO: 1476348 - RNA, 19 nt, Homo sapiens
ccucaccacuggcaucuac

SEQ ID NO: 1476349 - RNA, 19 nt, Homo sapiens
caccacggcacucaccaua

SEQ ID NO: 1476350 - RNA, 19 nt, Homo sapiens
gagagaaaucccuuaacca

SEQ ID NO: 1476351 - RNA, 19 nt, Homo sapiens
ccaaugccuaucauauuug

SEQ ID NO: 1476352 - RNA, 19 nt, Homo sapiens
ugauuucauuccuaacuuc

SEQ ID NO: 1476353 - RNA, 19 nt, Homo sapiens
cugauaggagucuuuaauu

SEQ ID NO: 1476354 - RNA, 19 nt, Homo sapiens
ccugauaggagucuuuaau

SEQ ID NO: 1476355 - RNA, 19 nt, Homo sapiens
acauacagccugaagacuu

SEQ ID NO: 1476356 - RNA, 19 nt, Homo sapiens
cacagacagccgauucuuu

SEQ ID NO: 1476357 - RNA, 19 nt, Homo sapiens
gcguuuaggucagaacuac

SEQ ID NO: 1476358 - RNA, 19 nt, Homo sapiens
caaaggagacaagcauugg

SEQ ID NO: 1476359 - RNA, 19 nt, Homo sapiens
gaaauuaucuccugcgaaa

SEQ ID NO: 1476360 - RNA, 19 nt, Homo sapiens
gaaggauucuguucaaaua

SEQ ID NO: 1476361 - RNA, 19 nt, Homo sapiens
caauaagucuccacaaaua

SEQ ID NO: 1476362 - RNA, 19 nt, Homo sapiens
gaagagaaauugaaagugu

SEQ ID NO: 1476363 - RNA, 19 nt, Homo sapiens
gaugugcacuuuccauuua

SEQ ID NO: 1476364 - RNA, 19 nt, Homo sapiens
gcaacacacuaguuaauuu

SEQ ID NO: 1476365 - RNA, 19 nt, Homo sapiens
gguguaaucuacucaauaa

SEQ ID NO: 1476366 - RNA, 19 nt, Homo sapiens
gaagguggauguguaguuu

SEQ ID NO: 1476367 - RNA, 19 nt, Homo sapiens
uggcuuaggugaaaucaua

SEQ ID NO: 1476368 - RNA, 19 nt, Homo sapiens
gcaauaagagucccaauuc

SEQ ID NO: 1476369 - RNA, 19 nt, Homo sapiens
ccaaagagaccucagauga

SEQ ID NO: 1476370 - RNA, 19 nt, Homo sapiens
gaacugagccaggaucuug

SEQ ID NO: 1476371 - RNA, 19 nt, Homo sapiens
guaguaggauuguuugaga

SEQ ID NO: 1476372 - RNA, 19 nt, Homo sapiens
uaugccagcuuccuaauuu

SEQ ID NO: 1476373 - RNA, 19 nt, Homo sapiens
caagcaaacuggaaaauaa

SEQ ID NO: 1476374 - RNA, 19 nt, Homo sapiens
gaauaugcccuucuuagga

SEQ ID NO: 1476375 - RNA, 19 nt, Homo sapiens
gugaaaagaugggaaauua

SEQ ID NO: 1476376 - RNA, 19 nt, Homo sapiens
ccaauuaccuauuucaucu

SEQ ID NO: 1476377 - RNA, 19 nt, Homo sapiens
gaccucguuucuacaaaua

SEQ ID NO: 1476378 - RNA, 19 nt, Homo sapiens
gcauauaaacuugcaguaa

SEQ ID NO: 1476379 - RNA, 19 nt, Homo sapiens
uaacagagaccuugguuuc

SEQ ID NO: 1476380 - RNA, 19 nt, Homo sapiens
caaagagaccucagaugaa

SEQ ID NO: 1476381 - RNA, 19 nt, Homo sapiens
gagcagugcaugaaacauu

SEQ ID NO: 1476382 - RNA, 19 nt, Homo sapiens
ugaagacaaugcagaauag

SEQ ID NO: 1476383 - RNA, 19 nt, Homo sapiens
cugaauagccugaagguaa

SEQ ID NO: 1476384 - RNA, 19 nt, Homo sapiens
gaacauugacucccucaca

SEQ ID NO: 1476385 - RNA, 19 nt, Homo sapiens
caagccugcucaccaaauu

SEQ ID NO: 1476386 - RNA, 19 nt, Homo sapiens
gaucuugccucuuuaagcu

SEQ ID NO: 1476387 - RNA, 19 nt, Homo sapiens
gcacaagugaccaggauga

SEQ ID NO: 1476388 - RNA, 19 nt, Homo sapiens
ugaauagccugaagguaau

SEQ ID NO: 1476389 - RNA, 19 nt, Homo sapiens
gagaagagaaauugaaagu

SEQ ID NO: 1476390 - RNA, 19 nt, Homo sapiens
ccacaaccccuuuauuuua

SEQ ID NO: 1476391 - RNA, 19 nt, Homo sapiens
gugagacaguuuagagaaa

SEQ ID NO: 1476392 - RNA, 19 nt, Homo sapiens
caaggaaagugagacaguu

SEQ ID NO: 1476393 - RNA, 19 nt, Homo sapiens
gaauggcagugguucugaa

SEQ ID NO: 1476394 - RNA, 19 nt, Homo sapiens
gauguguaguuucugguuu

SEQ ID NO: 1476395 - RNA, 19 nt, Homo sapiens
gcuuaacucuuucaaccaa

SEQ ID NO: 1476396 - RNA, 19 nt, Homo sapiens
gcuacacugucauuaauca

SEQ ID NO: 1476397 - RNA, 19 nt, Homo sapiens
gugcuacacugucauuaau

SEQ ID NO: 1476398 - RNA, 19 nt, Homo sapiens
ucagaaagcagaaguguca

SEQ ID NO: 1476399 - RNA, 19 nt, Homo sapiens
gaaccugaaagacugaauu

SEQ ID NO: 1476400 - RNA, 19 nt, Homo sapiens
gaaaggaaacccagaugag

SEQ ID NO: 1476401 - RNA, 19 nt, Homo sapiens
gaguaucccuuagaugaga

SEQ ID NO: 1476402 - RNA, 19 nt, Homo sapiens
uaccgaagguggaugugua

SEQ ID NO: 1476403 - RNA, 19 nt, Homo sapiens
ugagacacaccuuguuaua

SEQ ID NO: 1476404 - RNA, 19 nt, Homo sapiens
gaugauggcuaugagaaca

SEQ ID NO: 1476405 - RNA, 19 nt, Homo sapiens
cagaaucaaccucuuuaaa

SEQ ID NO: 1476406 - RNA, 19 nt, Homo sapiens
uaacuccugucucccuaaa

SEQ ID NO: 1476407 - RNA, 19 nt, Homo sapiens
gaaccgaugugcacuuucc

SEQ ID NO: 1476408 - RNA, 19 nt, Homo sapiens
ccagugauccgaguacuuu

SEQ ID NO: 1476409 - RNA, 19 nt, Homo sapiens
gcacauuggaccaucagaa

SEQ ID NO: 1476410 - RNA, 19 nt, Homo sapiens
ccaauaagucuccacaaau

SEQ ID NO: 1476411 - RNA, 19 nt, Homo sapiens
gcucagaaucaaccucuuu

SEQ ID NO: 1476412 - RNA, 19 nt, Homo sapiens
gagcaugauuaugaaguug

SEQ ID NO: 1476413 - RNA, 19 nt, Homo sapiens
ucaauaaacuguguaagac

SEQ ID NO: 1476414 - RNA, 19 nt, Homo sapiens
cuucuuaggacuucuguua

SEQ ID NO: 1476415 - RNA, 19 nt, Homo sapiens
ucccugagcuccaaugaug

SEQ ID NO: 1476416 - RNA, 19 nt, Homo sapiens
aaaugggauucaagucuaa

SEQ ID NO: 1476417 - RNA, 19 nt, Homo sapiens
uaauuuaaccugugacuag

SEQ ID NO: 1476418 - RNA, 19 nt, Homo sapiens
ccauacauauaaugagaga

SEQ ID NO: 1476419 - RNA, 19 nt, Homo sapiens
accaauaagucuccacaaa

SEQ ID NO: 1476420 - RNA, 19 nt, Homo sapiens
ucugagggauuccaucuau

SEQ ID NO: 1476421 - RNA, 19 nt, Homo sapiens
aaacccagaugaggaaaga

SEQ ID NO: 1476422 - RNA, 19 nt, Homo sapiens
ccagaaguguuuuggauuu

SEQ ID NO: 1476423 - RNA, 19 nt, Homo sapiens
gacauuggcuuuucugaga

SEQ ID NO: 1476424 - RNA, 19 nt, Homo sapiens
caaccugacucugguguag

SEQ ID NO: 1476425 - RNA, 19 nt, Homo sapiens
gaaagaaaacggcaggaaa

SEQ ID NO: 1476426 - RNA, 19 nt, Homo sapiens
aaagagaccucagaugaac

SEQ ID NO: 1476427 - RNA, 19 nt, Homo sapiens
gagguguaaucuacucaau

SEQ ID NO: 1476428 - RNA, 19 nt, Homo sapiens
cccauccaauuaccuauuu

SEQ ID NO: 1476429 - RNA, 19 nt, Homo sapiens
caaugaagacaaugcagaa

SEQ ID NO: 1476430 - RNA, 19 nt, Homo sapiens
ugagcaugauuaugaaguu

SEQ ID NO: 1476431 - RNA, 19 nt, Homo sapiens
gaaagugagacaguuuaga

SEQ ID NO: 1476432 - RNA, 19 nt, Homo sapiens
ugagguaguaggauuguuu

SEQ ID NO: 1476433 - RNA, 19 nt, Homo sapiens
caacagagaaucgaaggau

SEQ ID NO: 1476434 - RNA, 19 nt, Homo sapiens
gaaagaaaacuucaagauc

SEQ ID NO: 1476435 - RNA, 19 nt, Homo sapiens
ggcaauaagagucccaauu

SEQ ID NO: 1476436 - RNA, 19 nt, Homo sapiens
cugaugaaauagacugauu

SEQ ID NO: 1476437 - RNA, 19 nt, Homo sapiens
gaaaagaugggaaauuauc

SEQ ID NO: 1476438 - RNA, 19 nt, Homo sapiens
ggucagagacagaauaugc

SEQ ID NO: 1476439 - RNA, 19 nt, Homo sapiens
gagaaaggucagagacaga

SEQ ID NO: 1476440 - RNA, 19 nt, Homo sapiens
ccaaugaugauggcuauga

SEQ ID NO: 1476441 - RNA, 19 nt, Homo sapiens
cgaaggauucuguucaaau

SEQ ID NO: 1476442 - RNA, 19 nt, Homo sapiens
gaaauugaaagugucacaa

SEQ ID NO: 1476443 - RNA, 19 nt, Homo sapiens
cauguuggcucagaaucaa

SEQ ID NO: 1476444 - RNA, 19 nt, Homo sapiens
gcucucuccugcuucaaga

SEQ ID NO: 1476445 - RNA, 19 nt, Homo sapiens
ugagggauuccaucuauga

SEQ ID NO: 1476446 - RNA, 19 nt, Homo sapiens
gcaugauuaugaaguugug

SEQ ID NO: 1476447 - RNA, 19 nt, Homo sapiens
gagaccucguuucuacaaa

SEQ ID NO: 1476448 - RNA, 19 nt, Homo sapiens
ugaccagacccuuugcuaa

SEQ ID NO: 1476449 - RNA, 19 nt, Homo sapiens
uaagucauguuggcucaga

SEQ ID NO: 1476450 - RNA, 19 nt, Homo sapiens
gaugaaauagacugauugu

SEQ ID NO: 1476451 - RNA, 19 nt, Homo sapiens
ugaauggacccucuucuag

SEQ ID NO: 1476452 - RNA, 19 nt, Homo sapiens
gagcugagaaaccgaguca

SEQ ID NO: 1476453 - RNA, 19 nt, Homo sapiens
aaaggucagagacagaaua

SEQ ID NO: 1476454 - RNA, 19 nt, Homo sapiens
ggaaagugagacaguuuag

SEQ ID NO: 1476455 - RNA, 19 nt, Homo sapiens
caagaaaggaaacccagau

SEQ ID NO: 1476456 - RNA, 19 nt, Homo sapiens
guuugcaacacacuaguua

SEQ ID NO: 1476457 - RNA, 19 nt, Homo sapiens
cuuaggacuucuguuagua

SEQ ID NO: 1476458 - RNA, 19 nt, Homo sapiens
agugagaccucguuucuac

SEQ ID NO: 1476459 - RNA, 19 nt, Homo sapiens
gcaaggagcuuacaguuua

SEQ ID NO: 1476460 - RNA, 19 nt, Homo sapiens
gaacagcacuucuggacuu

SEQ ID NO: 1476461 - RNA, 19 nt, Homo sapiens
caaagacgaugaauacaaa

SEQ ID NO: 1476462 - RNA, 19 nt, Homo sapiens
gauccuaucuguucaauuc

SEQ ID NO: 1476463 - RNA, 19 nt, Homo sapiens
aagagaaucuguuggaaua

SEQ ID NO: 1476464 - RNA, 19 nt, Homo sapiens
guugggaccuugaaauuaa

SEQ ID NO: 1476465 - RNA, 19 nt, Homo sapiens
gagaaucuguuggaauauu

SEQ ID NO: 1476466 - RNA, 19 nt, Homo sapiens
ggacauggacacuuucauu

SEQ ID NO: 1476467 - RNA, 19 nt, Homo sapiens
gaaauuaucacuacaacuc

SEQ ID NO: 1476468 - RNA, 19 nt, Homo sapiens
ggacuggcagcuucuguua

SEQ ID NO: 1476469 - RNA, 19 nt, Homo sapiens
ggacccagcagacagauuu

SEQ ID NO: 1476470 - RNA, 19 nt, Homo sapiens
cagcuucuguuauuucaaa

SEQ ID NO: 1476471 - RNA, 19 nt, Homo sapiens
gaaccucucuuucgcuuuu

SEQ ID NO: 1476472 - RNA, 19 nt, Homo sapiens
gaaagaaauuaugcaccuu

SEQ ID NO: 1476473 - RNA, 19 nt, Homo sapiens
gagaacuccuccccuauua

SEQ ID NO: 1476474 - RNA, 19 nt, Homo sapiens
gagagacugcuucuuguuu

SEQ ID NO: 1476475 - RNA, 19 nt, Homo sapiens
ccauagccaugaagugaaa

SEQ ID NO: 1476476 - RNA, 19 nt, Homo sapiens
acacagucauucccucuuu

SEQ ID NO: 1476477 - RNA, 19 nt, Homo sapiens
ugagacagcucuacguaca

SEQ ID NO: 1476478 - RNA, 19 nt, Homo sapiens
gaacuacucuacggcaucu

SEQ ID NO: 1476479 - RNA, 19 nt, Homo sapiens
caugagagacugcuucuug

SEQ ID NO: 1476480 - RNA, 19 nt, Homo sapiens
uaaugaugcuuucuccuau

SEQ ID NO: 1476481 - RNA, 19 nt, Homo sapiens
agagagaaauuaucacuac

SEQ ID NO: 1476482 - RNA, 19 nt, Homo sapiens
caagaucucgggcugguuu

SEQ ID NO: 1476483 - RNA, 19 nt, Homo sapiens
gaugcuagguggauuuuaa

SEQ ID NO: 1476484 - RNA, 19 nt, Homo sapiens
caugauggcccguccuuaa

SEQ ID NO: 1476485 - RNA, 19 nt, Homo sapiens
ggaaguauugguguaauug

SEQ ID NO: 1476486 - RNA, 19 nt, Homo sapiens
gagaaauuaucacuacaac

SEQ ID NO: 1476487 - RNA, 19 nt, Homo sapiens
gacuuuauguucugacguu

SEQ ID NO: 1476488 - RNA, 19 nt, Homo sapiens
gaauauuaaugcagagaac

SEQ ID NO: 1476489 - RNA, 19 nt, Homo sapiens
ccuaucuguucaauucuua

SEQ ID NO: 1476490 - RNA, 19 nt, Homo sapiens
cagcacuucuggacuuuau

SEQ ID NO: 1476491 - RNA, 19 nt, Homo sapiens
ucaaagacgaugaauacaa

SEQ ID NO: 1476492 - RNA, 19 nt, Homo sapiens
uguagugaauggaaagaaa

SEQ ID NO: 1476493 - RNA, 19 nt, Homo sapiens
cacagucauucccucuuua

SEQ ID NO: 1476494 - RNA, 19 nt, Homo sapiens
cuacaacucccgagcacua

SEQ ID NO: 1476495 - RNA, 19 nt, Homo sapiens
gagagaaauuaucacuaca

SEQ ID NO: 1476496 - RNA, 19 nt, Homo sapiens
ccacccaaguucaauuugu

SEQ ID NO: 1476497 - RNA, 19 nt, Homo sapiens
guaaguguuauuccucuuu

SEQ ID NO: 1476498 - RNA, 19 nt, Homo sapiens
acuggcagcuucuguuauu

SEQ ID NO: 1476499 - RNA, 19 nt, Homo sapiens
gaauacaaaccacccaagu

SEQ ID NO: 1476500 - RNA, 19 nt, Homo sapiens
gaaaauagucugccucagu

SEQ ID NO: 1476501 - RNA, 19 nt, Homo sapiens
ggaauauuaaugcagagaa

SEQ ID NO: 1476502 - RNA, 19 nt, Homo sapiens
cacccaaguucaauuuguu

SEQ ID NO: 1476503 - RNA, 19 nt, Homo sapiens
gcacuucuggacuuuaugu

SEQ ID NO: 1476504 - RNA, 19 nt, Homo sapiens
cuccagauguccaccauga

SEQ ID NO: 1476505 - RNA, 19 nt, Homo sapiens
agacagcucuacguacaga

SEQ ID NO: 1476506 - RNA, 19 nt, Homo sapiens
guaauugcuucugccauca

SEQ ID NO: 1476507 - RNA, 19 nt, Homo sapiens
uggaaguauugguguaauu

SEQ ID NO: 1476508 - RNA, 19 nt, Homo sapiens
uaagagaaucuguuggaau

SEQ ID NO: 1476509 - RNA, 19 nt, Homo sapiens
cuacguacagauugacuuu

SEQ ID NO: 1476510 - RNA, 19 nt, Homo sapiens
gacauggacacuuucauuc

SEQ ID NO: 1476511 - RNA, 19 nt, Homo sapiens
agagacugcuucuuguuuc

SEQ ID NO: 1476512 - RNA, 19 nt, Homo sapiens
gggagauaaugaugcuuuc

SEQ ID NO: 1476513 - RNA, 19 nt, Homo sapiens
caacaggacccagcagaca

SEQ ID NO: 1476514 - RNA, 19 nt, Homo sapiens
auacaaaccacccaaguuc

SEQ ID NO: 1476515 - RNA, 19 nt, Homo sapiens
ccagauguccaccaugaga

SEQ ID NO: 1476516 - RNA, 19 nt, Homo sapiens
auaaugaugcuuucuccua

SEQ ID NO: 1476517 - RNA, 19 nt, Homo sapiens
caacugcuuaggcuugauu

SEQ ID NO: 1476518 - RNA, 19 nt, Homo sapiens
ugguuuaggucuauacugu

SEQ ID NO: 1476519 - RNA, 19 nt, Homo sapiens
uuaagagaaucuguuggaa

SEQ ID NO: 1476520 - RNA, 19 nt, Homo sapiens
cuuugucaauggccuauuu

SEQ ID NO: 1476521 - RNA, 19 nt, Homo sapiens
caaaauggggagauaauga

SEQ ID NO: 1476522 - RNA, 19 nt, Homo sapiens
gaauggaaagaaauuaugc

SEQ ID NO: 1476523 - RNA, 19 nt, Homo sapiens
ggcagcuucuguuauuuca

SEQ ID NO: 1476524 - RNA, 19 nt, Homo sapiens
cgauagcacugccauuuug

SEQ ID NO: 1476525 - RNA, 19 nt, Homo sapiens
aaacauuguacccagcuuu

SEQ ID NO: 1476526 - RNA, 19 nt, Homo sapiens
guagugaauggaaagaaau

SEQ ID NO: 1476527 - RNA, 19 nt, Homo sapiens
gaacuccuccccuauuaga

SEQ ID NO: 1476528 - RNA, 19 nt, Homo sapiens
ccuagcagauacacuugga

SEQ ID NO: 1476529 - RNA, 19 nt, Homo sapiens
cauggacacuuucauucuc

SEQ ID NO: 1476530 - RNA, 19 nt, Homo sapiens
cuucuuguuuccauucuug

SEQ ID NO: 1476531 - RNA, 19 nt, Homo sapiens
gggcugguuuaggucuaua

SEQ ID NO: 1476532 - RNA, 19 nt, Homo sapiens
acaaaccacccaaguucaa

SEQ ID NO: 1476533 - RNA, 19 nt, Homo sapiens
gcugaugcuagguggauuu

SEQ ID NO: 1476534 - RNA, 19 nt, Homo sapiens
caaggagcuuacaguuuac

SEQ ID NO: 1476535 - RNA, 19 nt, Homo sapiens
uugcagccauguagugaau

SEQ ID NO: 1476536 - RNA, 19 nt, Homo sapiens
uguugggaccuugaaauua

SEQ ID NO: 1476537 - RNA, 19 nt, Homo sapiens
uagccauucuuauaguugu

SEQ ID NO: 1476538 - RNA, 19 nt, Homo sapiens
aauacaaaccacccaaguu

SEQ ID NO: 1476539 - RNA, 19 nt, Homo sapiens
gaaguucuggcuggcuuug

SEQ ID NO: 1476540 - RNA, 19 nt, Homo sapiens
ggaaguucuggcuggcuuu

SEQ ID NO: 1476541 - RNA, 19 nt, Homo sapiens
ugacuuugcagccauguag

SEQ ID NO: 1476542 - RNA, 19 nt, Homo sapiens
ugcaaggagcuuacaguuu

SEQ ID NO: 1476543 - RNA, 19 nt, Homo sapiens
uaauggugcucuagaucag

SEQ ID NO: 1476544 - RNA, 19 nt, Homo sapiens
ccucuuuaauggugcucua

SEQ ID NO: 1476545 - RNA, 19 nt, Homo sapiens
acagucauucccucuuuaa

SEQ ID NO: 1476546 - RNA, 19 nt, Homo sapiens
aaaccacccaaguucaauu

SEQ ID NO: 1476547 - RNA, 19 nt, Homo sapiens
ucaauuuguucggcaagau

SEQ ID NO: 1476548 - RNA, 19 nt, Homo sapiens
cuucuggacuuuauguucu

SEQ ID NO: 1476549 - RNA, 19 nt, Homo sapiens
ugagagacugcuucuuguu

SEQ ID NO: 1476550 - RNA, 19 nt, Homo sapiens
ugccauagccaugaaguga

SEQ ID NO: 1476551 - RNA, 19 nt, Homo sapiens
uuaauggugcucuagauca

SEQ ID NO: 1476552 - RNA, 19 nt, Homo sapiens
auucuuggguuugugguaa

SEQ ID NO: 1476553 - RNA, 19 nt, Homo sapiens
aaugaugcuuucuccuaug

SEQ ID NO: 1476554 - RNA, 19 nt, Homo sapiens
uuuaagagaaucuguugga

SEQ ID NO: 1476555 - RNA, 19 nt, Homo sapiens
ggacacuuucauucucaug

SEQ ID NO: 1476556 - RNA, 19 nt, Homo sapiens
gaaguauugguguaauugc

SEQ ID NO: 1476557 - RNA, 19 nt, Homo sapiens
ggccacggacacagucauu

SEQ ID NO: 1476558 - RNA, 19 nt, Homo sapiens
caaaccacccaaguucaau

SEQ ID NO: 1476559 - RNA, 19 nt, Homo sapiens
gaaagaggaugcccuggua

SEQ ID NO: 1476560 - RNA, 19 nt, Homo sapiens
gcucucagacucagaauua

SEQ ID NO: 1476561 - RNA, 19 nt, Homo sapiens
gcagaaaggcgucaaagug

SEQ ID NO: 1476562 - RNA, 19 nt, Homo sapiens
gagagaagcgacuacuaua

SEQ ID NO: 1476563 - RNA, 19 nt, Homo sapiens
cagcugaaaugccuucuga

SEQ ID NO: 1476564 - RNA, 19 nt, Homo sapiens
gcaagaaggagaugauuca

SEQ ID NO: 1476565 - RNA, 19 nt, Homo sapiens
gagaagcgacuacuauaau

SEQ ID NO: 1476566 - RNA, 19 nt, Homo sapiens
auaaucagcugaagcagaa

SEQ ID NO: 1476567 - RNA, 19 nt, Homo sapiens
ccaacgagaucucugacaa

SEQ ID NO: 1476568 - RNA, 19 nt, Homo sapiens
ugucggaacuggagagaaa

SEQ ID NO: 1476569 - RNA, 19 nt, Homo sapiens
gaagaaagacgaggagauc

SEQ ID NO: 1476570 - RNA, 19 nt, Homo sapiens
gauaagaaacaccaagaga

SEQ ID NO: 1476571 - RNA, 19 nt, Homo sapiens
cucgagagguuaaggaaua

SEQ ID NO: 1476572 - RNA, 19 nt, Homo sapiens
caggagugauugcgucuuu

SEQ ID NO: 1476573 - RNA, 19 nt, Homo sapiens
agauacagguucagaagaa

SEQ ID NO: 1476574 - RNA, 19 nt, Homo sapiens
uaagaaacaccaagagaug

SEQ ID NO: 1476575 - RNA, 19 nt, Homo sapiens
cgaaagaucaauacggaaa

SEQ ID NO: 1476576 - RNA, 19 nt, Homo sapiens
gcugaaaugccuucugaaa

SEQ ID NO: 1476577 - RNA, 19 nt, Homo sapiens
gaauggaaaccgcaccaaa

SEQ ID NO: 1476578 - RNA, 19 nt, Homo sapiens
gaagcccugcagagaauua

SEQ ID NO: 1476579 - RNA, 19 nt, Homo sapiens
ugucugagcuggagauaca

SEQ ID NO: 1476580 - RNA, 19 nt, Homo sapiens
gauugcgucuuuacaacaa

SEQ ID NO: 1476581 - RNA, 19 nt, Homo sapiens
gauacagguucagaagaaa

SEQ ID NO: 1476582 - RNA, 19 nt, Homo sapiens
gaagcgaggaggaggaaga

SEQ ID NO: 1476583 - RNA, 19 nt, Homo sapiens
ugaagacgcagcugaaaug

SEQ ID NO: 1476584 - RNA, 19 nt, Homo sapiens
gaucauccaggccaccuuu

SEQ ID NO: 1476585 - RNA, 19 nt, Homo sapiens
gcagcucagucgcaucuca

SEQ ID NO: 1476586 - RNA, 19 nt, Homo sapiens
guaagagcaucugcgaguu

SEQ ID NO: 1476587 - RNA, 19 nt, Homo sapiens
gaagcgacuacuauaauca

SEQ ID NO: 1476588 - RNA, 19 nt, Homo sapiens
gaaacccagcugcgaaaga

SEQ ID NO: 1476589 - RNA, 19 nt, Homo sapiens
ggagauacagguucagaag

SEQ ID NO: 1476590 - RNA, 19 nt, Homo sapiens
uggaagcccugcagagaau

SEQ ID NO: 1476591 - RNA, 19 nt, Homo sapiens
cgagaucucugacaaugac

SEQ ID NO: 1476592 - RNA, 19 nt, Homo sapiens
aaacccagcugcgaaagau

SEQ ID NO: 1476593 - RNA, 19 nt, Homo sapiens
uggcccagcuggaggagua

SEQ ID NO: 1476594 - RNA, 19 nt, Homo sapiens
gcaaaggccaagagacauc

SEQ ID NO: 1476595 - RNA, 19 nt, Homo sapiens
agagaagcgacuacuauaa

SEQ ID NO: 1476596 - RNA, 19 nt, Homo sapiens
gggacugugucaucucaga

SEQ ID NO: 1476597 - RNA, 19 nt, Homo sapiens
ucauucagguccacauuca

SEQ ID NO: 1476598 - RNA, 19 nt, Homo sapiens
gaagcagaaaggcgucaaa

SEQ ID NO: 1476599 - RNA, 19 nt, Homo sapiens
agagagaagcgacuacuau

SEQ ID NO: 1476600 - RNA, 19 nt, Homo sapiens
agaagcgacuacuauaauc

SEQ ID NO: 1476601 - RNA, 19 nt, Homo sapiens
ggagaaaaucccagacuuu

SEQ ID NO: 1476602 - RNA, 19 nt, Homo sapiens
gcaucugcgaguucgauua

SEQ ID NO: 1476603 - RNA, 19 nt, Homo sapiens
gcgggacugugucaucuca

SEQ ID NO: 1476604 - RNA, 19 nt, Homo sapiens
gaaaggcaaaggccaagag

SEQ ID NO: 1476605 - RNA, 19 nt, Homo sapiens
gagaggcacaguucgaugu

SEQ ID NO: 1476606 - RNA, 19 nt, Homo sapiens
gagauacagguucagaaga

SEQ ID NO: 1476607 - RNA, 19 nt, Homo sapiens
gagcaagaaggagaugauu

SEQ ID NO: 1476608 - RNA, 19 nt, Homo sapiens
cagcugcgaaagaucaaua

SEQ ID NO: 1476609 - RNA, 19 nt, Homo sapiens
ccggagagauugacaacag

SEQ ID NO: 1476610 - RNA, 19 nt, Homo sapiens
cgauuuguccggagagauu

SEQ ID NO: 1476611 - RNA, 19 nt, Homo sapiens
ccacugaggccgauuuguc

SEQ ID NO: 1476612 - RNA, 19 nt, Homo sapiens
gcaacaaagcucacuuggu

SEQ ID NO: 1476613 - RNA, 19 nt, Homo sapiens
caacgagaucucugacaau

SEQ ID NO: 1476614 - RNA, 19 nt, Homo sapiens
cuccuucccuucaguaaga

SEQ ID NO: 1476615 - RNA, 19 nt, Homo sapiens
gagagguuaaggaauaaga

SEQ ID NO: 1476616 - RNA, 19 nt, Homo sapiens
aacgagaucucugacaaug

SEQ ID NO: 1476617 - RNA, 19 nt, Homo sapiens
ucgagagguuaaggaauaa

SEQ ID NO: 1476618 - RNA, 19 nt, Homo sapiens
ucaccaagcgggacugugu

SEQ ID NO: 1476619 - RNA, 19 nt, Homo sapiens
augagacgcugcagaagga

SEQ ID NO: 1476620 - RNA, 19 nt, Homo sapiens
uacaacaacaaguggauuu

SEQ ID NO: 1476621 - RNA, 19 nt, Homo sapiens
gaccagauacucccuugca

SEQ ID NO: 1476622 - RNA, 19 nt, Homo sapiens
ugauggggcucauugaaaa

SEQ ID NO: 1476623 - RNA, 19 nt, Homo sapiens
uacaagccaugaccgacaa

SEQ ID NO: 1476624 - RNA, 19 nt, Homo sapiens
gaaacaccaagagaugaug

SEQ ID NO: 1476625 - RNA, 19 nt, Homo sapiens
cagauacucccuugcaaca

SEQ ID NO: 1476626 - RNA, 19 nt, Homo sapiens
gagaaaaucccagacuuug

SEQ ID NO: 1476627 - RNA, 19 nt, Homo sapiens
cagagagaagcgacuacua

SEQ ID NO: 1476628 - RNA, 19 nt, Homo sapiens
ugacaaugacauccuggaa

SEQ ID NO: 1476629 - RNA, 19 nt, Homo sapiens
aguccaggcucgagagguu

SEQ ID NO: 1476630 - RNA, 19 nt, Homo sapiens
ccuccgagaagauaagaaa

SEQ ID NO: 1476631 - RNA, 19 nt, Homo sapiens
cagagcugccugagaaaga

SEQ ID NO: 1476632 - RNA, 19 nt, Homo sapiens
uaagagcaucugcgaguuc

SEQ ID NO: 1476633 - RNA, 19 nt, Homo sapiens
guuaaggaauaagaucauc

SEQ ID NO: 1476634 - RNA, 19 nt, Homo sapiens
gugauugcgucuuuacaac

SEQ ID NO: 1476635 - RNA, 19 nt, Homo sapiens
gaggagauccccaggagaa

SEQ ID NO: 1476636 - RNA, 19 nt, Homo sapiens
guaccuccuucccuucagu

SEQ ID NO: 1476637 - RNA, 19 nt, Homo sapiens
gcaccagccagcagguuca

SEQ ID NO: 1476638 - RNA, 19 nt, Homo sapiens
gaauuaaaccccgguguug

SEQ ID NO: 1476639 - RNA, 19 nt, Homo sapiens
ucucagacucagaauuaaa

SEQ ID NO: 1476640 - RNA, 19 nt, Homo sapiens
ggagugauugcgucuuuac

SEQ ID NO: 1476641 - RNA, 19 nt, Homo sapiens
gaaaaucccagacuuugag

SEQ ID NO: 1476642 - RNA, 19 nt, Homo sapiens
gagguuaaggaauaagauc

SEQ ID NO: 1476643 - RNA, 19 nt, Homo sapiens
aaaaugagacgcugcagaa

SEQ ID NO: 1476644 - RNA, 19 nt, Homo sapiens
gaaagaucaauacggaaaa

SEQ ID NO: 1476645 - RNA, 19 nt, Homo sapiens
gcaccagggccacauccau

SEQ ID NO: 1476646 - RNA, 19 nt, Homo sapiens
aagaaacccagcugcgaaa

SEQ ID NO: 1476647 - RNA, 19 nt, Homo sapiens
ggaggaggaagaggaggaa

SEQ ID NO: 1476648 - RNA, 19 nt, Homo sapiens
gaaggaucacugccugucu

SEQ ID NO: 1476649 - RNA, 19 nt, Homo sapiens
ucugcgaguucgauuacuu

SEQ ID NO: 1476650 - RNA, 19 nt, Homo sapiens
gaaggggaccuccaaguag

SEQ ID NO: 1476651 - RNA, 19 nt, Homo sapiens
caggccaccuuuagcaucu

SEQ ID NO: 1476652 - RNA, 19 nt, Homo sapiens
auaagaaacaccaagagau

SEQ ID NO: 1476653 - RNA, 19 nt, Homo sapiens
aagauaagaaacaccaaga

SEQ ID NO: 1476654 - RNA, 19 nt, Homo sapiens
gaccaucagccgcuacuac

SEQ ID NO: 1476655 - RNA, 19 nt, Homo sapiens
ccugguaccucucagucau

SEQ ID NO: 1476656 - RNA, 19 nt, Homo sapiens
cgucugagaggcacaguuc

SEQ ID NO: 1476657 - RNA, 19 nt, Homo sapiens
caagcgggacugugucauc

SEQ ID NO: 1476658 - RNA, 19 nt, Homo sapiens
aagaaacaccaagagauga

SEQ ID NO: 1476659 - RNA, 19 nt, Homo sapiens
gaagggaaguggaguuaaa

SEQ ID NO: 1476660 - RNA, 19 nt, Homo sapiens
caagaaggccuguauuaua

SEQ ID NO: 1476661 - RNA, 19 nt, Homo sapiens
ggaguucccuucccuaaga

SEQ ID NO: 1476662 - RNA, 19 nt, Homo sapiens
caagaaaggugcaagaaag

SEQ ID NO: 1476663 - RNA, 19 nt, Homo sapiens
ggaaagaggguuuaacaga

SEQ ID NO: 1476664 - RNA, 19 nt, Homo sapiens
gcuuugagcuguacaagaa

SEQ ID NO: 1476665 - RNA, 19 nt, Homo sapiens
ggaaacagauggagcucuu

SEQ ID NO: 1476666 - RNA, 19 nt, Homo sapiens
gcacaggccucucucaagu

SEQ ID NO: 1476667 - RNA, 19 nt, Homo sapiens
aaauggagauggcaaauga

SEQ ID NO: 1476668 - RNA, 19 nt, Homo sapiens
gaacuugaauugggaacuu

SEQ ID NO: 1476669 - RNA, 19 nt, Homo sapiens
uaacagacccucucuagga

SEQ ID NO: 1476670 - RNA, 19 nt, Homo sapiens
gauggacgaucugaacaua

SEQ ID NO: 1476671 - RNA, 19 nt, Homo sapiens
ugagaaucauccagucuua

SEQ ID NO: 1476672 - RNA, 19 nt, Homo sapiens
gcacagaaaucucuuugcu

SEQ ID NO: 1476673 - RNA, 19 nt, Homo sapiens
acacaacuguuucugcuuu

SEQ ID NO: 1476674 - RNA, 19 nt, Homo sapiens
gcaagaaaggugcaagaaa

SEQ ID NO: 1476675 - RNA, 19 nt, Homo sapiens
cauaguaggccuuccauaa

SEQ ID NO: 1476676 - RNA, 19 nt, Homo sapiens
uagaugagaugaccuuuca

SEQ ID NO: 1476677 - RNA, 19 nt, Homo sapiens
uuggauggauggauaaaua

SEQ ID NO: 1476678 - RNA, 19 nt, Homo sapiens
ggaagacuuuauuguuguu

SEQ ID NO: 1476679 - RNA, 19 nt, Homo sapiens
ggauguaguuggugaaugg

SEQ ID NO: 1476680 - RNA, 19 nt, Homo sapiens
gaaaggugcaagaaaguga

SEQ ID NO: 1476681 - RNA, 19 nt, Homo sapiens
gaagcugccuguacuuugg

SEQ ID NO: 1476682 - RNA, 19 nt, Homo sapiens
gggaagacuuuauuguugu

SEQ ID NO: 1476683 - RNA, 19 nt, Homo sapiens
gagggaagacuuuauuguu

SEQ ID NO: 1476684 - RNA, 19 nt, Homo sapiens
gaaacagagggaagacuuu

SEQ ID NO: 1476685 - RNA, 19 nt, Homo sapiens
gcuacaagcacuucuacua

SEQ ID NO: 1476686 - RNA, 19 nt, Homo sapiens
gcaagaaagugagcagucu

SEQ ID NO: 1476687 - RNA, 19 nt, Homo sapiens
cccaugagcugacauuuua

SEQ ID NO: 1476688 - RNA, 19 nt, Homo sapiens
gcaaaugaagcacagaaau

SEQ ID NO: 1476689 - RNA, 19 nt, Homo sapiens
ugacuugcaugauggauuc

SEQ ID NO: 1476690 - RNA, 19 nt, Homo sapiens
uaucugaccauguguguaa

SEQ ID NO: 1476691 - RNA, 19 nt, Homo sapiens
ccgcagggcccaucaauug

SEQ ID NO: 1476692 - RNA, 19 nt, Homo sapiens
aauguuggauggauggaua

SEQ ID NO: 1476693 - RNA, 19 nt, Homo sapiens
aaacagagggaagacuuua

SEQ ID NO: 1476694 - RNA, 19 nt, Homo sapiens
caaaugaagcacagaaauc

SEQ ID NO: 1476695 - RNA, 19 nt, Homo sapiens
agggaagacuuuauuguug

SEQ ID NO: 1476696 - RNA, 19 nt, Homo sapiens
uaguaggccuuccauaaau

SEQ ID NO: 1476697 - RNA, 19 nt, Homo sapiens
caaagccucuggacuucug

SEQ ID NO: 1476698 - RNA, 19 nt, Homo sapiens
gcacuucuacuacuucauc

SEQ ID NO: 1476699 - RNA, 19 nt, Homo sapiens
gaagagucgggauagauga

SEQ ID NO: 1476700 - RNA, 19 nt, Homo sapiens
gagcgaggguaggagcuuu

SEQ ID NO: 1476701 - RNA, 19 nt, Homo sapiens
agaguggccuggcagcuuu

SEQ ID NO: 1476702 - RNA, 19 nt, Homo sapiens
ccaagaaggccuguauuau

SEQ ID NO: 1476703 - RNA, 19 nt, Homo sapiens
ggcaugaagucugggagua

SEQ ID NO: 1476704 - RNA, 19 nt, Homo sapiens
ggagauggcaaaugaagca

SEQ ID NO: 1476705 - RNA, 19 nt, Homo sapiens
gagccaagcauccaauauc

SEQ ID NO: 1476706 - RNA, 19 nt, Homo sapiens
uccaagaaggccuguauua

SEQ ID NO: 1476707 - RNA, 19 nt, Homo sapiens
cagaagggaaguggaguua

SEQ ID NO: 1476708 - RNA, 19 nt, Homo sapiens
gaaacugaagccaggagaa

SEQ ID NO: 1476709 - RNA, 19 nt, Homo sapiens
gaucugaagcccagcacaa

SEQ ID NO: 1476710 - RNA, 19 nt, Homo sapiens
ggggaggguuggaaaauuu

SEQ ID NO: 1476711 - RNA, 19 nt, Homo sapiens
gagggaaccugagaaucau

SEQ ID NO: 1476712 - RNA, 19 nt, Homo sapiens
agagggaaccugagaauca

SEQ ID NO: 1476713 - RNA, 19 nt, Homo sapiens
caguguaucugaccaugug

SEQ ID NO: 1476714 - RNA, 19 nt, Homo sapiens
gaagcacagaaaucucuuu

SEQ ID NO: 1476715 - RNA, 19 nt, Homo sapiens
ccaagcauccaauaucaug

SEQ ID NO: 1476716 - RNA, 19 nt, Homo sapiens
aaaugugguuguagauguu

SEQ ID NO: 1476717 - RNA, 19 nt, Homo sapiens
ugaaggcacuggaaucacu

SEQ ID NO: 1476718 - RNA, 19 nt, Homo sapiens
ucgaaggccucaucaacga

SEQ ID NO: 1476719 - RNA, 19 nt, Homo sapiens
gaucgaaggccucaucaac

SEQ ID NO: 1476720 - RNA, 19 nt, Homo sapiens
gagcaauaauuucuaaccu

SEQ ID NO: 1476721 - RNA, 19 nt, Homo sapiens
uuaaaccucuggcaugaag

SEQ ID NO: 1476722 - RNA, 19 nt, Homo sapiens
gagcaucuaggcaggcaaa

SEQ ID NO: 1476723 - RNA, 19 nt, Homo sapiens
ccuagaagcugccuguacu

SEQ ID NO: 1476724 - RNA, 19 nt, Homo sapiens
ggauagaugagaugaccuu

SEQ ID NO: 1476725 - RNA, 19 nt, Homo sapiens
gaacuuuggagucuugucu

SEQ ID NO: 1476726 - RNA, 19 nt, Homo sapiens
gaccauguccacuguagga

SEQ ID NO: 1476727 - RNA, 19 nt, Homo sapiens
ccgaggugauggcaagaaa

SEQ ID NO: 1476728 - RNA, 19 nt, Homo sapiens
acaagcacuucuacuacuu

SEQ ID NO: 1476729 - RNA, 19 nt, Homo sapiens
aaucauauacuccacucua

SEQ ID NO: 1476730 - RNA, 19 nt, Homo sapiens
gaugagaugaccuuucaca

SEQ ID NO: 1476731 - RNA, 19 nt, Homo sapiens
gcacgugguggacuucuuc

SEQ ID NO: 1476732 - RNA, 19 nt, Homo sapiens
auaaauagauugggaccau

SEQ ID NO: 1476733 - RNA, 19 nt, Homo sapiens
auaguaggccuuccauaaa

SEQ ID NO: 1476734 - RNA, 19 nt, Homo sapiens
ucacagggaggcauucaug

SEQ ID NO: 1476735 - RNA, 19 nt, Homo sapiens
gaggagccuugccuugagu

SEQ ID NO: 1476736 - RNA, 19 nt, Homo sapiens
gcacauaguaggccuucca

SEQ ID NO: 1476737 - RNA, 19 nt, Homo sapiens
acagagggaagacuuuauu

SEQ ID NO: 1476738 - RNA, 19 nt, Homo sapiens
ugaaacagagggaagacuu

SEQ ID NO: 1476739 - RNA, 19 nt, Homo sapiens
aggcuacacucuuccauca

SEQ ID NO: 1476740 - RNA, 19 nt, Homo sapiens
gcucauggacuggaucgaa

SEQ ID NO: 1476741 - RNA, 19 nt, Homo sapiens
aaaggcaaacuaaagcaaa

SEQ ID NO: 1476742 - RNA, 19 nt, Homo sapiens
gggcugauuucugggauag

SEQ ID NO: 1476743 - RNA, 19 nt, Homo sapiens
guuggugaauggacucuuc

SEQ ID NO: 1476744 - RNA, 19 nt, Homo sapiens
gauccugacccgccucuuc

SEQ ID NO: 1476745 - RNA, 19 nt, Homo sapiens
ugaagagucgggauagaug

SEQ ID NO: 1476746 - RNA, 19 nt, Homo sapiens
cacaggcucugauucucuu

SEQ ID NO: 1476747 - RNA, 19 nt, Homo sapiens
aguuaaaccucuggcauga

SEQ ID NO: 1476748 - RNA, 19 nt, Homo sapiens
acacauggaaagaggguuu

SEQ ID NO: 1476749 - RNA, 19 nt, Homo sapiens
ucauggagcuggagaaacc

SEQ ID NO: 1476750 - RNA, 19 nt, Homo sapiens
gcuuguggaacuugaauug

SEQ ID NO: 1476751 - RNA, 19 nt, Homo sapiens
ggauggauggauaaauaga

SEQ ID NO: 1476752 - RNA, 19 nt, Homo sapiens
agccaagcauccaauauca

SEQ ID NO: 1476753 - RNA, 19 nt, Homo sapiens
gaagaagagggagaaacug

SEQ ID NO: 1476754 - RNA, 19 nt, Homo sapiens
gaucucacagcacagcuau

SEQ ID NO: 1476755 - RNA, 19 nt, Homo sapiens
agccaucccugacacauuc

SEQ ID NO: 1476756 - RNA, 19 nt, Homo sapiens
gaguucccuucccuaagaa

SEQ ID NO: 1476757 - RNA, 19 nt, Homo sapiens
uagaagcugccuguacuuu

SEQ ID NO: 1476758 - RNA, 19 nt, Homo sapiens
gucuuacugucucaaugua

SEQ ID NO: 1476759 - RNA, 19 nt, Homo sapiens
ucacagaccucguguauau

SEQ ID NO: 1476760 - RNA, 19 nt, Homo sapiens
gagggcagcuugcaacuug

SEQ ID NO: 1476761 - RNA, 19 nt, Homo sapiens
gugagaggcugcugcauuu

SEQ ID NO: 1476762 - RNA, 19 nt, Homo sapiens
gacaguaagucaugauguu

SEQ ID NO: 1476763 - RNA, 19 nt, Homo sapiens
auaagaagcuccugugaug

SEQ ID NO: 1476764 - RNA, 19 nt, Homo sapiens
gcgcaucccucauagaaag

SEQ ID NO: 1476765 - RNA, 19 nt, Homo sapiens
gcgagaagcccaacaagug

SEQ ID NO: 1476766 - RNA, 19 nt, Homo sapiens
gcacccaccuagacacgaa

SEQ ID NO: 1476767 - RNA, 19 nt, Homo sapiens
gaauaagaagcuccuguga

SEQ ID NO: 1476768 - RNA, 19 nt, Homo sapiens
gcuacaagcugcucaucca

SEQ ID NO: 1476769 - RNA, 19 nt, Homo sapiens
ccacacaacacaucaaaca

SEQ ID NO: 1476770 - RNA, 19 nt, Homo sapiens
ggucaccuguguaaaugga

SEQ ID NO: 1476771 - RNA, 19 nt, Homo sapiens
caaggcccauucagccaaa

SEQ ID NO: 1476772 - RNA, 19 nt, Homo sapiens
acagaccucguguauauaa

SEQ ID NO: 1476773 - RNA, 19 nt, Homo sapiens
gagcagcaggugcguaaga

SEQ ID NO: 1476774 - RNA, 19 nt, Homo sapiens
gaagcggugcugugucuug

SEQ ID NO: 1476775 - RNA, 19 nt, Homo sapiens
cgaggacuguggcuucuuc

SEQ ID NO: 1476776 - RNA, 19 nt, Homo sapiens
agagguugaucacgacaaa

SEQ ID NO: 1476777 - RNA, 19 nt, Homo sapiens
ggccuccucucaccaauag

SEQ ID NO: 1476778 - RNA, 19 nt, Homo sapiens
gcuccaagcgcuacacaga

SEQ ID NO: 1476779 - RNA, 19 nt, Homo sapiens
gcgaggacuucaccugcuu

SEQ ID NO: 1476780 - RNA, 19 nt, Homo sapiens
ccaccugguugaauuucuu

SEQ ID NO: 1476781 - RNA, 19 nt, Homo sapiens
ggacaguaagucaugaugu

SEQ ID NO: 1476782 - RNA, 19 nt, Homo sapiens
cagucagucuuguaacuug

SEQ ID NO: 1476783 - RNA, 19 nt, Homo sapiens
uagcgcaucccucauagaa

SEQ ID NO: 1476784 - RNA, 19 nt, Homo sapiens
aaucacagaccucguguau

SEQ ID NO: 1476785 - RNA, 19 nt, Homo sapiens
gcacgucaaggcccauuca

SEQ ID NO: 1476786 - RNA, 19 nt, Homo sapiens
aaagcagucagucuuguaa

SEQ ID NO: 1476787 - RNA, 19 nt, Homo sapiens
ggcuagcgcaucccucaua

SEQ ID NO: 1476788 - RNA, 19 nt, Homo sapiens
cgacgucaccuccaucauc

SEQ ID NO: 1476789 - RNA, 19 nt, Homo sapiens
aagaagcuccugugauguu

SEQ ID NO: 1476790 - RNA, 19 nt, Homo sapiens
gaucuguggcccuguaaca

SEQ ID NO: 1476791 - RNA, 19 nt, Homo sapiens
gcuagcgcaucccucauag

SEQ ID NO: 1476792 - RNA, 19 nt, Homo sapiens
gcagucagucuuguaacuu

SEQ ID NO: 1476793 - RNA, 19 nt, Homo sapiens
ccuguaacauucccucgau

SEQ ID NO: 1476794 - RNA, 19 nt, Homo sapiens
aagagcagcaggugcguaa

SEQ ID NO: 1476795 - RNA, 19 nt, Homo sapiens
gguggacaguaagucauga

SEQ ID NO: 1476796 - RNA, 19 nt, Homo sapiens
ccacagcagccaucugaag

SEQ ID NO: 1476797 - RNA, 19 nt, Homo sapiens
guacugagacuggaugcau

SEQ ID NO: 1476798 - RNA, 19 nt, Homo sapiens
ucucuggucaccuguguaa

SEQ ID NO: 1476799 - RNA, 19 nt, Homo sapiens
ugugagaggcugcugcauu

SEQ ID NO: 1476800 - RNA, 19 nt, Homo sapiens
ccucauagaaagugaaugg

SEQ ID NO: 1476801 - RNA, 19 nt, Homo sapiens
cagaccucguguauauaaa

SEQ ID NO: 1476802 - RNA, 19 nt, Homo sapiens
cugaagcggugcugugucu

SEQ ID NO: 1476803 - RNA, 19 nt, Homo sapiens
cacagcagccaucugaaga

SEQ ID NO: 1476804 - RNA, 19 nt, Homo sapiens
ucagucuuguaacuugaaa

SEQ ID NO: 1476805 - RNA, 19 nt, Homo sapiens
acaguaagucaugauguuu

SEQ ID NO: 1476806 - RNA, 19 nt, Homo sapiens
acaagcugcucauccacau

SEQ ID NO: 1476807 - RNA, 19 nt, Homo sapiens
ugccacagcagccaucuga

SEQ ID NO: 1476808 - RNA, 19 nt, Homo sapiens
caaccacacaacacaucaa

SEQ ID NO: 1476809 - RNA, 19 nt, Homo sapiens
cggaacagccaggccauga

SEQ ID NO: 1476810 - RNA, 19 nt, Homo sapiens
gggcagcuugcaacuugaa

SEQ ID NO: 1476811 - RNA, 19 nt, Homo sapiens
cuggucaccuguguaaaug

SEQ ID NO: 1476812 - RNA, 19 nt, Homo sapiens
ucuguggcccuguaacauu

SEQ ID NO: 1476813 - RNA, 19 nt, Homo sapiens
aauaagaagcuccugugau

SEQ ID NO: 1476814 - RNA, 19 nt, Homo sapiens
gccguacgccugucagauc

SEQ ID NO: 1476815 - RNA, 19 nt, Homo sapiens
ucuggucaccuguguaaau

SEQ ID NO: 1476816 - RNA, 19 nt, Homo sapiens
gaagguaguuugcauucua

SEQ ID NO: 1476817 - RNA, 19 nt, Homo sapiens
gacagaaacucaucuauau

SEQ ID NO: 1476818 - RNA, 19 nt, Homo sapiens
ggaccucccuccagaauuu

SEQ ID NO: 1476819 - RNA, 19 nt, Homo sapiens
gcaagaaacaaaggaauua

SEQ ID NO: 1476820 - RNA, 19 nt, Homo sapiens
gcuaagaccgagaaauuua

SEQ ID NO: 1476821 - RNA, 19 nt, Homo sapiens
ugacuugcgucgucugaua

SEQ ID NO: 1476822 - RNA, 19 nt, Homo sapiens
agacagaaacucaucuaua

SEQ ID NO: 1476823 - RNA, 19 nt, Homo sapiens
gcuguuauacauacuguua

SEQ ID NO: 1476824 - RNA, 19 nt, Homo sapiens
guaaauacgcuguuauaca

SEQ ID NO: 1476825 - RNA, 19 nt, Homo sapiens
ccauugauuuaccaguuua

SEQ ID NO: 1476826 - RNA, 19 nt, Homo sapiens
gccauugauuuaccaguuu

SEQ ID NO: 1476827 - RNA, 19 nt, Homo sapiens
uuaacucgccauugauuua

SEQ ID NO: 1476828 - RNA, 19 nt, Homo sapiens
uacaaacccucugcucuuu

SEQ ID NO: 1476829 - RNA, 19 nt, Homo sapiens
guauuucucuguugugaag

SEQ ID NO: 1476830 - RNA, 19 nt, Homo sapiens
gccaccauauuuagaacua

SEQ ID NO: 1476831 - RNA, 19 nt, Homo sapiens
ucucuguugugaagaauaa

SEQ ID NO: 1476832 - RNA, 19 nt, Homo sapiens
ggaaguuggugcugcuaag

SEQ ID NO: 1476833 - RNA, 19 nt, Homo sapiens
ggaguuccguuuugaauau

SEQ ID NO: 1476834 - RNA, 19 nt, Homo sapiens
gauauuuauuggccaggaa

SEQ ID NO: 1476835 - RNA, 19 nt, Homo sapiens
ggcaagaaacaaaggaauu

SEQ ID NO: 1476836 - RNA, 19 nt, Homo sapiens
cgagaaauuuaaagaaucg

SEQ ID NO: 1476837 - RNA, 19 nt, Homo sapiens
agccuuaacucgccauuga

SEQ ID NO: 1476838 - RNA, 19 nt, Homo sapiens
cugcuaagaccgagaaauu

SEQ ID NO: 1476839 - RNA, 19 nt, Homo sapiens
ccgagaaauuuaaagaauc

SEQ ID NO: 1476840 - RNA, 19 nt, Homo sapiens
gguaguuugcauucuauuu

SEQ ID NO: 1476841 - RNA, 19 nt, Homo sapiens
gaccgagaaauuuaaagaa

SEQ ID NO: 1476842 - RNA, 19 nt, Homo sapiens
cuaagaccgagaaauuuaa

SEQ ID NO: 1476843 - RNA, 19 nt, Homo sapiens
gaagaauaaacuguaccua

SEQ ID NO: 1476844 - RNA, 19 nt, Homo sapiens
gccauggccucaggucuug

SEQ ID NO: 1476845 - RNA, 19 nt, Homo sapiens
ccucugcucuuuguauuuc

SEQ ID NO: 1476846 - RNA, 19 nt, Homo sapiens
uuacaaacccucugcucuu

SEQ ID NO: 1476847 - RNA, 19 nt, Homo sapiens
gaaguuggugcugcuaaga

SEQ ID NO: 1476848 - RNA, 19 nt, Homo sapiens
ucaggaagguaguuugcau

SEQ ID NO: 1476849 - RNA, 19 nt, Homo sapiens
ggaccuccaggccaccaua

SEQ ID NO: 1476850 - RNA, 19 nt, Homo sapiens
cgccauugauuuaccaguu

SEQ ID NO: 1476851 - RNA, 19 nt, Homo sapiens
ggaagguaguuugcauucu

SEQ ID NO: 1476852 - RNA, 19 nt, Homo sapiens
ccuccaggccaccauauuu

SEQ ID NO: 1476853 - RNA, 19 nt, Homo sapiens
uuaaagaaucggacagaug

SEQ ID NO: 1476854 - RNA, 19 nt, Homo sapiens
ggacagauggacgcagaga

SEQ ID NO: 1476855 - RNA, 19 nt, Homo sapiens
cuguaaauacgcuguuaua

SEQ ID NO: 1476856 - RNA, 19 nt, Homo sapiens
gggaugggcuggguaagac

SEQ ID NO: 1476857 - RNA, 19 nt, Homo sapiens
ggaccaaagggugcaguga

SEQ ID NO: 1476858 - RNA, 19 nt, Homo sapiens
ucuguuggcuucucagucu

SEQ ID NO: 1476859 - RNA, 19 nt, Homo sapiens
cuccaggccaccauauuua

SEQ ID NO: 1476860 - RNA, 19 nt, Homo sapiens
gaccaaagggugcagugau

SEQ ID NO: 1476861 - RNA, 19 nt, Homo sapiens
agaccgagaaauuuaaaga

SEQ ID NO: 1476862 - RNA, 19 nt, Homo sapiens
cuagguuucuggacugcaa

SEQ ID NO: 1476863 - RNA, 19 nt, Homo sapiens
accaaagggugcagugaug

SEQ ID NO: 1476864 - RNA, 19 nt, Homo sapiens
aagguaguuugcauucuau

SEQ ID NO: 1476865 - RNA, 19 nt, Homo sapiens
caccauauuuagaacuagu

SEQ ID NO: 1476866 - RNA, 19 nt, Homo sapiens
guauauaggaaccauguac

SEQ ID NO: 1476867 - RNA, 19 nt, Homo sapiens
gggcaagaaacaaaggaau

SEQ ID NO: 1476868 - RNA, 19 nt, Homo sapiens
ggagauccacaggaccaaa

SEQ ID NO: 1476869 - RNA, 19 nt, Homo sapiens
gauuuaccaguuuaacguu

SEQ ID NO: 1476870 - RNA, 19 nt, Homo sapiens
uauaggaaccauguacaga

SEQ ID NO: 1476871 - RNA, 19 nt, Homo sapiens
gcgugucgguguauauagg

SEQ ID NO: 1476872 - RNA, 19 nt, Homo sapiens
cccuguaaauacgcuguua

SEQ ID NO: 1476873 - RNA, 19 nt, Homo sapiens
gggagcaaaugaaaaucaa

SEQ ID NO: 1476874 - RNA, 19 nt, Homo sapiens
guuaacaccccuuugcuuu

SEQ ID NO: 1476875 - RNA, 19 nt, Homo sapiens
aauacgcuguuauacauac

SEQ ID NO: 1476876 - RNA, 19 nt, Homo sapiens
aaugugggaccuucucuug

SEQ ID NO: 1476877 - RNA, 19 nt, Homo sapiens
caggaagguaguuugcauu

SEQ ID NO: 1476878 - RNA, 19 nt, Homo sapiens
caggccaccauauuuagaa

SEQ ID NO: 1476879 - RNA, 19 nt, Homo sapiens
gagauccacaggaccaaag

SEQ ID NO: 1476880 - RNA, 19 nt, Homo sapiens
ccuuaacucgccauugauu

SEQ ID NO: 1476881 - RNA, 19 nt, Homo sapiens
ccaugcgugucgguguaua

SEQ ID NO: 1476882 - RNA, 19 nt, Homo sapiens
agccaugcgugucggugua

SEQ ID NO: 1476883 - RNA, 19 nt, Homo sapiens
ugugaagaauaaacuguac

SEQ ID NO: 1476884 - RNA, 19 nt, Homo sapiens
caagaaacaaaggaauuac

SEQ ID NO: 1476885 - RNA, 19 nt, Homo sapiens
ccaggccaccauauuuaga

SEQ ID NO: 1476886 - RNA, 19 nt, Homo sapiens
gauagaaccuuguguccaa

SEQ ID NO: 1476887 - RNA, 19 nt, Homo sapiens
gacaacaucuacaucagua

SEQ ID NO: 1476888 - RNA, 19 nt, Homo sapiens
ccgcaaagcugaggagaaa

SEQ ID NO: 1476889 - RNA, 19 nt, Homo sapiens
ucaaggaccugcugaguag

SEQ ID NO: 1476890 - RNA, 19 nt, Homo sapiens
ggaagaagcugggcaaacg

SEQ ID NO: 1476891 - RNA, 19 nt, Homo sapiens
cgacacagaagauguauga

SEQ ID NO: 1476892 - RNA, 19 nt, Homo sapiens
gaacaccuccucagagaca

SEQ ID NO: 1476893 - RNA, 19 nt, Homo sapiens
uguaugagcugaagaccaa

SEQ ID NO: 1476894 - RNA, 19 nt, Homo sapiens
gaagauguaugagcugaag

SEQ ID NO: 1476895 - RNA, 19 nt, Homo sapiens
gaacaucuccgccacuuuu

SEQ ID NO: 1476896 - RNA, 19 nt, Homo sapiens
gaacaucuacgaagaacag

SEQ ID NO: 1476897 - RNA, 19 nt, Homo sapiens
aaaaugcccuguacgcuua

SEQ ID NO: 1476898 - RNA, 19 nt, Homo sapiens
gaagaacagaagauuaugu

SEQ ID NO: 1476899 - RNA, 19 nt, Homo sapiens
ccaugaacaucuacgaaga

SEQ ID NO: 1476900 - RNA, 19 nt, Homo sapiens
gucauaaacuggaggugaa

SEQ ID NO: 1476901 - RNA, 19 nt, Homo sapiens
ccaaggugauggagguuug

SEQ ID NO: 1476902 - RNA, 19 nt, Homo sapiens
auacucagcugccgucguu

SEQ ID NO: 1476903 - RNA, 19 nt, Homo sapiens
ucauggacauuaaacauca

SEQ ID NO: 1476904 - RNA, 19 nt, Homo sapiens
gacacaaucucaacaacgu

SEQ ID NO: 1476905 - RNA, 19 nt, Homo sapiens
cagcugccgucguugguuu

SEQ ID NO: 1476906 - RNA, 19 nt, Homo sapiens
ggacagcuauaaccaugac

SEQ ID NO: 1476907 - RNA, 19 nt, Homo sapiens
ccaagaugcugggcaagga

SEQ ID NO: 1476908 - RNA, 19 nt, Homo sapiens
gagcagccuucaccaaacu

SEQ ID NO: 1476909 - RNA, 19 nt, Homo sapiens
caucgcagccuucuacuuc

SEQ ID NO: 1476910 - RNA, 19 nt, Homo sapiens
ggagaaaaccgucaucuuc

SEQ ID NO: 1476911 - RNA, 19 nt, Homo sapiens
ggccauaggucucuuucag

SEQ ID NO: 1476912 - RNA, 19 nt, Homo sapiens
gauggaaucaaacaacaug

SEQ ID NO: 1476913 - RNA, 19 nt, Homo sapiens
caaggaaggcaggcucuuu

SEQ ID NO: 1476914 - RNA, 19 nt, Homo sapiens
caagagggcaaagaagaaa

SEQ ID NO: 1476915 - RNA, 19 nt, Homo sapiens
gacauuaaacaucaucaga

SEQ ID NO: 1476916 - RNA, 19 nt, Homo sapiens
gagcagagacucggaacau

SEQ ID NO: 1476917 - RNA, 19 nt, Homo sapiens
acagacucauggacauuaa

SEQ ID NO: 1476918 - RNA, 19 nt, Homo sapiens
cauccaggccucagaaaug

SEQ ID NO: 1476919 - RNA, 19 nt, Homo sapiens
caagcugcguugcuccuau

SEQ ID NO: 1476920 - RNA, 19 nt, Homo sapiens
gaagaagcggauccuguuc

SEQ ID NO: 1476921 - RNA, 19 nt, Homo sapiens
agaagaagcggauccuguu

SEQ ID NO: 1476922 - RNA, 19 nt, Homo sapiens
cagagacagugauggaauc

SEQ ID NO: 1476923 - RNA, 19 nt, Homo sapiens
gcacaagagggcaaagaag

SEQ ID NO: 1476924 - RNA, 19 nt, Homo sapiens
gcagagacucggaacaucu

SEQ ID NO: 1476925 - RNA, 19 nt, Homo sapiens
ggucaucgcagccuucuac

SEQ ID NO: 1476926 - RNA, 19 nt, Homo sapiens
gagguuuggugccgcaauc

SEQ ID NO: 1476927 - RNA, 19 nt, Homo sapiens
ccguggagcugcagaucaa

SEQ ID NO: 1476928 - RNA, 19 nt, Homo sapiens
acgaagaacagaagauuau

SEQ ID NO: 1476929 - RNA, 19 nt, Homo sapiens
cacaagagggcaaagaaga

SEQ ID NO: 1476930 - RNA, 19 nt, Homo sapiens
aagagcagccuucaccaaa

SEQ ID NO: 1476931 - RNA, 19 nt, Homo sapiens
gagcugcaguaccgauugg

SEQ ID NO: 1476932 - RNA, 19 nt, Homo sapiens
ucuccuacauggacagcua

SEQ ID NO: 1476933 - RNA, 19 nt, Homo sapiens
uuaaacaucaucagaaugg

SEQ ID NO: 1476934 - RNA, 19 nt, Homo sapiens
gaagaaaacagccucauac

SEQ ID NO: 1476935 - RNA, 19 nt, Homo sapiens
gguuugaccgcaagcauga

SEQ ID NO: 1476936 - RNA, 19 nt, Homo sapiens
cuacgaagaacagaagauu

SEQ ID NO: 1476937 - RNA, 19 nt, Homo sapiens
ccgauuggccuguuagugu

SEQ ID NO: 1476938 - RNA, 19 nt, Homo sapiens
acaagagggcaaagaagaa

SEQ ID NO: 1476939 - RNA, 19 nt, Homo sapiens
uacgaagaacagaagauua

SEQ ID NO: 1476940 - RNA, 19 nt, Homo sapiens
caaguucuucuguggcauu

SEQ ID NO: 1476941 - RNA, 19 nt, Homo sapiens
ggaacaucuccgccacuuu

SEQ ID NO: 1476942 - RNA, 19 nt, Homo sapiens
caugaacaucuacgaagaa

SEQ ID NO: 1476943 - RNA, 19 nt, Homo sapiens
gcuauaaccaugacauucg

SEQ ID NO: 1476944 - RNA, 19 nt, Homo sapiens
uagccaaucugcgacacaa

SEQ ID NO: 1476945 - RNA, 19 nt, Homo sapiens
aaacagacucauggacauu

SEQ ID NO: 1476946 - RNA, 19 nt, Homo sapiens
ggcacaagagggcaaagaa

SEQ ID NO: 1476947 - RNA, 19 nt, Homo sapiens
cguccuucccgguuaauaa

SEQ ID NO: 1476948 - RNA, 19 nt, Homo sapiens
gagagcugcaguaccgauu

SEQ ID NO: 1476949 - RNA, 19 nt, Homo sapiens
gcuacacgccugaggauac

SEQ ID NO: 1476950 - RNA, 19 nt, Homo sapiens
gcugaguagcaaagaauug

SEQ ID NO: 1476951 - RNA, 19 nt, Homo sapiens
ccucagagacagugaugga

SEQ ID NO: 1476952 - RNA, 19 nt, Homo sapiens
cagcuauaaccaugacauu

SEQ ID NO: 1476953 - RNA, 19 nt, Homo sapiens
ugucgacacagaagaugua

SEQ ID NO: 1476954 - RNA, 19 nt, Homo sapiens
aaagagcagccuucaccaa

SEQ ID NO: 1476955 - RNA, 19 nt, Homo sapiens
ggaauuuucagccaauauu

SEQ ID NO: 1476956 - RNA, 19 nt, Homo sapiens
gcgacacaaucucaacaac

SEQ ID NO: 1476957 - RNA, 19 nt, Homo sapiens
caagaugcugggcaaggaa

SEQ ID NO: 1476958 - RNA, 19 nt, Homo sapiens
guccuucccgguuaauaaa

SEQ ID NO: 1476959 - RNA, 19 nt, Homo sapiens
ucagagacagugauggaau

SEQ ID NO: 1476960 - RNA, 19 nt, Homo sapiens
ugacaacaucuacaucagu

SEQ ID NO: 1476961 - RNA, 19 nt, Homo sapiens
gagcugcagaucaacaaca

SEQ ID NO: 1476962 - RNA, 19 nt, Homo sapiens
ucaucagaauggcacaaga

SEQ ID NO: 1476963 - RNA, 19 nt, Homo sapiens
gaguggugcuuccccaaaa

SEQ ID NO: 1476964 - RNA, 19 nt, Homo sapiens
gcucucuuccuccgccuuu

SEQ ID NO: 1476965 - RNA, 19 nt, Homo sapiens
ggaaggcaggcucuuuguc

SEQ ID NO: 1476966 - RNA, 19 nt, Homo sapiens
auccaggccucagaaauga

SEQ ID NO: 1476967 - RNA, 19 nt, Homo sapiens
gcaacuuugggcagaccua

SEQ ID NO: 1476968 - RNA, 19 nt, Homo sapiens
aagcugcguugcuccuaug

SEQ ID NO: 1476969 - RNA, 19 nt, Homo sapiens
gauccuguuccucuacaau

SEQ ID NO: 1476970 - RNA, 19 nt, Homo sapiens
aacagacucauggacauua

SEQ ID NO: 1476971 - RNA, 19 nt, Homo sapiens
gccaaucugcgacacaauc

SEQ ID NO: 1476972 - RNA, 19 nt, Homo sapiens
aaggaaggcaggcucuuug

SEQ ID NO: 1476973 - RNA, 19 nt, Homo sapiens
ggauccuguuccucuacaa

SEQ ID NO: 1476974 - RNA, 19 nt, Homo sapiens
ggacauuaaacaucaucag

SEQ ID NO: 1476975 - RNA, 19 nt, Homo sapiens
acaucuacaucaguaccua

SEQ ID NO: 1476976 - RNA, 19 nt, Homo sapiens
gggcugccagucuccugua

SEQ ID NO: 1476977 - RNA, 19 nt, Homo sapiens
augcccaggugaauaguga

SEQ ID NO: 1476978 - RNA, 19 nt, Homo sapiens
uucaaggaccugcugagua

SEQ ID NO: 1476979 - RNA, 19 nt, Homo sapiens
aguaccgauuggccuguua

SEQ ID NO: 1476980 - RNA, 19 nt, Homo sapiens
gacuccaccugucgacaca

SEQ ID NO: 1476981 - RNA, 19 nt, Homo sapiens
caucuacgaagaacagaag

SEQ ID NO: 1476982 - RNA, 19 nt, Homo sapiens
gcaaggaaggcaggcucuu

SEQ ID NO: 1476983 - RNA, 19 nt, Homo sapiens
gugccagccuccuacuagu

SEQ ID NO: 1476984 - RNA, 19 nt, Homo sapiens
cgaagaacagaagauuaug

SEQ ID NO: 1476985 - RNA, 19 nt, Homo sapiens
gcagauagcucagaacuag

SEQ ID NO: 1476986 - RNA, 19 nt, Homo sapiens
gaagugagacaacauaauu

SEQ ID NO: 1476987 - RNA, 19 nt, Homo sapiens
gcucacagcuuggcacuaa

SEQ ID NO: 1476988 - RNA, 19 nt, Homo sapiens
gcaccucgcuggacacuau

SEQ ID NO: 1476989 - RNA, 19 nt, Homo sapiens
gaggacaucaucuuauuua

SEQ ID NO: 1476990 - RNA, 19 nt, Homo sapiens
gguguaagcuggccuucua

SEQ ID NO: 1476991 - RNA, 19 nt, Homo sapiens
gcacauaauugccuuugau

SEQ ID NO: 1476992 - RNA, 19 nt, Homo sapiens
cauagccucuucugcauua

SEQ ID NO: 1476993 - RNA, 19 nt, Homo sapiens
agucaaagcuauguucuua

SEQ ID NO: 1476994 - RNA, 19 nt, Homo sapiens
gaacagcaccuugcaaguu

SEQ ID NO: 1476995 - RNA, 19 nt, Homo sapiens
gcaaagaccaugcacauca

SEQ ID NO: 1476996 - RNA, 19 nt, Homo sapiens
ccagaauacuccauccaua

SEQ ID NO: 1476997 - RNA, 19 nt, Homo sapiens
gguguucgcugcugauuug

SEQ ID NO: 1476998 - RNA, 19 nt, Homo sapiens
gcacuaauuugcagguguu

SEQ ID NO: 1476999 - RNA, 19 nt, Homo sapiens
gggaguaggugacgaaaca

SEQ ID NO: 1477000 - RNA, 19 nt, Homo sapiens
ugacucagguuuaugaaug

SEQ ID NO: 1477001 - RNA, 19 nt, Homo sapiens
gugaggacaucaucuuauu

SEQ ID NO: 1477002 - RNA, 19 nt, Homo sapiens
gaggauacgugagaaauag

SEQ ID NO: 1477003 - RNA, 19 nt, Homo sapiens
gcucagaacuagccuacga

SEQ ID NO: 1477004 - RNA, 19 nt, Homo sapiens
uaacauacacaggcuauuu

SEQ ID NO: 1477005 - RNA, 19 nt, Homo sapiens
ggacaucaucuuauuuaga

SEQ ID NO: 1477006 - RNA, 19 nt, Homo sapiens
ucaaagcuauguucuuaca

SEQ ID NO: 1477007 - RNA, 19 nt, Homo sapiens
ugaaacguuugcaacauga

SEQ ID NO: 1477008 - RNA, 19 nt, Homo sapiens
ggaggagggaccagaauga

SEQ ID NO: 1477009 - RNA, 19 nt, Homo sapiens
gaaugaggauacgugagaa

SEQ ID NO: 1477010 - RNA, 19 nt, Homo sapiens
uaugaaugguguuugugua

SEQ ID NO: 1477011 - RNA, 19 nt, Homo sapiens
gcagcugggagccgaguua

SEQ ID NO: 1477012 - RNA, 19 nt, Homo sapiens
caaagaccaugcacaucau

SEQ ID NO: 1477013 - RNA, 19 nt, Homo sapiens
ucgcaucgcuugucguguu

SEQ ID NO: 1477014 - RNA, 19 nt, Homo sapiens
caucacagagucuuuaaau

SEQ ID NO: 1477015 - RNA, 19 nt, Homo sapiens
gcacaaugauuuugaccuu

SEQ ID NO: 1477016 - RNA, 19 nt, Homo sapiens
uugaaagccucgagaaugu

SEQ ID NO: 1477017 - RNA, 19 nt, Homo sapiens
gaaugguguuuguguagca

SEQ ID NO: 1477018 - RNA, 19 nt, Homo sapiens
ggaagugagacaacauaau

SEQ ID NO: 1477019 - RNA, 19 nt, Homo sapiens
ucacagagucuuuaaaugc

SEQ ID NO: 1477020 - RNA, 19 nt, Homo sapiens
gaaugucccucuacuuuuc

SEQ ID NO: 1477021 - RNA, 19 nt, Homo sapiens
gcuggacacuauccguuug

SEQ ID NO: 1477022 - RNA, 19 nt, Homo sapiens
cugaaugucccucuacuuu

SEQ ID NO: 1477023 - RNA, 19 nt, Homo sapiens
ggucaaugcuagucaaagc

SEQ ID NO: 1477024 - RNA, 19 nt, Homo sapiens
ugaggauacgugagaaaua

SEQ ID NO: 1477025 - RNA, 19 nt, Homo sapiens
gaacagaaugacccagagu

SEQ ID NO: 1477026 - RNA, 19 nt, Homo sapiens
gaauugcugcuuccugaau

SEQ ID NO: 1477027 - RNA, 19 nt, Homo sapiens
uaucacuucuggagguauu

SEQ ID NO: 1477028 - RNA, 19 nt, Homo sapiens
agugagcucuuaacgcaaa

SEQ ID NO: 1477029 - RNA, 19 nt, Homo sapiens
agaaggaggccugguguaa

SEQ ID NO: 1477030 - RNA, 19 nt, Homo sapiens
guucgcugcugauuugguu

SEQ ID NO: 1477031 - RNA, 19 nt, Homo sapiens
guugaaagccucgagaaug

SEQ ID NO: 1477032 - RNA, 19 nt, Homo sapiens
ccaugcacaucaucagaga

SEQ ID NO: 1477033 - RNA, 19 nt, Homo sapiens
ggucaugaaugccgacacu

SEQ ID NO: 1477034 - RNA, 19 nt, Homo sapiens
uaauugccuuugaugaguu

SEQ ID NO: 1477035 - RNA, 19 nt, Homo sapiens
aacauacacaggcuauuua

SEQ ID NO: 1477036 - RNA, 19 nt, Homo sapiens
caggaagugagacaacaua

SEQ ID NO: 1477037 - RNA, 19 nt, Homo sapiens
cacagagucuuuaaaugca

SEQ ID NO: 1477038 - RNA, 19 nt, Homo sapiens
agaaugaggauacgugaga

SEQ ID NO: 1477039 - RNA, 19 nt, Homo sapiens
ucaugaaugccgacacuuu

SEQ ID NO: 1477040 - RNA, 19 nt, Homo sapiens
guuuaugaaugguguuugu

SEQ ID NO: 1477041 - RNA, 19 nt, Homo sapiens
caucauuuguacuguuuag

SEQ ID NO: 1477042 - RNA, 19 nt, Homo sapiens
cagagucuuuaaaugcaaa

SEQ ID NO: 1477043 - RNA, 19 nt, Homo sapiens
gguccuagagcccuucuga

SEQ ID NO: 1477044 - RNA, 19 nt, Homo sapiens
cgagggaacgguugaggaa

SEQ ID NO: 1477045 - RNA, 19 nt, Homo sapiens
cuagagcccuucugagcau

SEQ ID NO: 1477046 - RNA, 19 nt, Homo sapiens
cagaauacuccauccauag

SEQ ID NO: 1477047 - RNA, 19 nt, Homo sapiens
ucacagcuuggcacuaauu

SEQ ID NO: 1477048 - RNA, 19 nt, Homo sapiens
auacacaggcuauuuauac

SEQ ID NO: 1477049 - RNA, 19 nt, Homo sapiens
uggaguggcugcucuguac

SEQ ID NO: 1477050 - RNA, 19 nt, Homo sapiens
gaaggaggccugguguaag

SEQ ID NO: 1477051 - RNA, 19 nt, Homo sapiens
caugaaugccgacacuuug

SEQ ID NO: 1477052 - RNA, 19 nt, Homo sapiens
cauacacaggcuauuuaua

SEQ ID NO: 1477053 - RNA, 19 nt, Homo sapiens
ugcaucauuuguacuguuu

SEQ ID NO: 1477054 - RNA, 19 nt, Homo sapiens
uugaaacguuugcaacaug

SEQ ID NO: 1477055 - RNA, 19 nt, Homo sapiens
aacagcaccuugcaaguuc

SEQ ID NO: 1477056 - RNA, 19 nt, Homo sapiens
ugcaugaucuacacuuuag

SEQ ID NO: 1477057 - RNA, 19 nt, Homo sapiens
gagacggagaggugcauuu

SEQ ID NO: 1477058 - RNA, 19 nt, Homo sapiens
gaugaguuaaggacagauu

SEQ ID NO: 1477059 - RNA, 19 nt, Homo sapiens
ucaaugcuagucaaagcua

SEQ ID NO: 1477060 - RNA, 19 nt, Homo sapiens
gagggugugugggauuugu

SEQ ID NO: 1477061 - RNA, 19 nt, Homo sapiens
cauaauugccuuugaugag

SEQ ID NO: 1477062 - RNA, 19 nt, Homo sapiens
ccaaacuucuuuucuuuuc

SEQ ID NO: 1477063 - RNA, 19 nt, Homo sapiens
ugaggacaucaucuuauuu

SEQ ID NO: 1477064 - RNA, 19 nt, Homo sapiens
gaaagccucgagaaugucu

SEQ ID NO: 1477065 - RNA, 19 nt, Homo sapiens
gaccaugcacaucaucaga

SEQ ID NO: 1477066 - RNA, 19 nt, Homo sapiens
ucuacuaccuuuacugcau

SEQ ID NO: 1477067 - RNA, 19 nt, Homo sapiens
cugcugauuugguuucuuc

SEQ ID NO: 1477068 - RNA, 19 nt, Homo sapiens
cugauuugguuucuucuuc

SEQ ID NO: 1477069 - RNA, 19 nt, Homo sapiens
gcaccuugcaaguucaaau

SEQ ID NO: 1477070 - RNA, 19 nt, Homo sapiens
gaguuaacccugcgugucu

SEQ ID NO: 1477071 - RNA, 19 nt, Homo sapiens
cugcaugaucuacacuuua

SEQ ID NO: 1477072 - RNA, 19 nt, Homo sapiens
ccagugcaauccuguucau

SEQ ID NO: 1477073 - RNA, 19 nt, Homo sapiens
uacacaggcuauuuauaca

SEQ ID NO: 1477074 - RNA, 19 nt, Homo sapiens
ccucaaaccaucacagagu

SEQ ID NO: 1477075 - RNA, 19 nt, Homo sapiens
ccucccggcuaccuaaaga

SEQ ID NO: 1477076 - RNA, 19 nt, Homo sapiens
aauugccuuugaugaguua

SEQ ID NO: 1477077 - RNA, 19 nt, Homo sapiens
gccauggccuucacuuucg

SEQ ID NO: 1477078 - RNA, 19 nt, Homo sapiens
gccaggaagugagacaaca

SEQ ID NO: 1477079 - RNA, 19 nt, Homo sapiens
gcuagucaaagcuauguuc

SEQ ID NO: 1477080 - RNA, 19 nt, Homo sapiens
auaauugccuuugaugagu

SEQ ID NO: 1477081 - RNA, 19 nt, Homo sapiens
caaugcuagucaaagcuau

SEQ ID NO: 1477082 - RNA, 19 nt, Homo sapiens
ugaucaagguguuaguucu

SEQ ID NO: 1477083 - RNA, 19 nt, Homo sapiens
uggagggugugugggauuu

SEQ ID NO: 1477084 - RNA, 19 nt, Homo sapiens
cuuguugccuuucuuccaa

SEQ ID NO: 1477085 - RNA, 19 nt, Homo sapiens
gaacugguauucucaagua

SEQ ID NO: 1477086 - RNA, 19 nt, Homo sapiens
gaaaccacgucucuacuaa

SEQ ID NO: 1477087 - RNA, 19 nt, Homo sapiens
ggaaagcugugaagaacuu

SEQ ID NO: 1477088 - RNA, 19 nt, Homo sapiens
aaagggaacuucuagguuu

SEQ ID NO: 1477089 - RNA, 19 nt, Homo sapiens
caucaucugucuucucuaa

SEQ ID NO: 1477090 - RNA, 19 nt, Homo sapiens
gcacucacagguucauuua

SEQ ID NO: 1477091 - RNA, 19 nt, Homo sapiens
gaaccauauuugagacuuu

SEQ ID NO: 1477092 - RNA, 19 nt, Homo sapiens
caaguagguuugcuuaaga

SEQ ID NO: 1477093 - RNA, 19 nt, Homo sapiens
caacaaguagguuugcuua

SEQ ID NO: 1477094 - RNA, 19 nt, Homo sapiens
ggacucaucugcaggaagu

SEQ ID NO: 1477095 - RNA, 19 nt, Homo sapiens
gaccuuagauucugugaca

SEQ ID NO: 1477096 - RNA, 19 nt, Homo sapiens
ugggaacacuuucauguaa

SEQ ID NO: 1477097 - RNA, 19 nt, Homo sapiens
ggucagaggucagcagaug

SEQ ID NO: 1477098 - RNA, 19 nt, Homo sapiens
gaacccaauuaucaggaaa

SEQ ID NO: 1477099 - RNA, 19 nt, Homo sapiens
ggagaggacuaggaggaaa

SEQ ID NO: 1477100 - RNA, 19 nt, Homo sapiens
uuuaagaccucacagauuc

SEQ ID NO: 1477101 - RNA, 19 nt, Homo sapiens
gcugggaguucaguucuuu

SEQ ID NO: 1477102 - RNA, 19 nt, Homo sapiens
ugaaguggccucuguguug

SEQ ID NO: 1477103 - RNA, 19 nt, Homo sapiens
gaagaguuccuguccugaa

SEQ ID NO: 1477104 - RNA, 19 nt, Homo sapiens
ucaagcaccuuccuaugug

SEQ ID NO: 1477105 - RNA, 19 nt, Homo sapiens
guagauuccugaacccaau

SEQ ID NO: 1477106 - RNA, 19 nt, Homo sapiens
ggagauguuugugaggaaa

SEQ ID NO: 1477107 - RNA, 19 nt, Homo sapiens
uuucccagaugcauauuua

SEQ ID NO: 1477108 - RNA, 19 nt, Homo sapiens
gcggagcacuucaucaaag

SEQ ID NO: 1477109 - RNA, 19 nt, Homo sapiens
ggacaccgcccaucaguac

SEQ ID NO: 1477110 - RNA, 19 nt, Homo sapiens
agaaggccauucccaagaa

SEQ ID NO: 1477111 - RNA, 19 nt, Homo sapiens
gagaaggccauucccaaga

SEQ ID NO: 1477112 - RNA, 19 nt, Homo sapiens
aagggaacuucuagguuua

SEQ ID NO: 1477113 - RNA, 19 nt, Homo sapiens
ggguucagcugagguugua

SEQ ID NO: 1477114 - RNA, 19 nt, Homo sapiens
gcacgagggcacccagauu

SEQ ID NO: 1477115 - RNA, 19 nt, Homo sapiens
ggcuauggcuuuaccacaa

SEQ ID NO: 1477116 - RNA, 19 nt, Homo sapiens
ggacccagcuuuccuuuuc

SEQ ID NO: 1477117 - RNA, 19 nt, Homo sapiens
gcaggugacugaacuuagc

SEQ ID NO: 1477118 - RNA, 19 nt, Homo sapiens
gugaagaacuuuugugaug

SEQ ID NO: 1477119 - RNA, 19 nt, Homo sapiens
ggaaccauauuugagacuu

SEQ ID NO: 1477120 - RNA, 19 nt, Homo sapiens
cccgagaucguuuccauua

SEQ ID NO: 1477121 - RNA, 19 nt, Homo sapiens
cuacauagacaccagcauu

SEQ ID NO: 1477122 - RNA, 19 nt, Homo sapiens
uaaguuagggaaccauauu

SEQ ID NO: 1477123 - RNA, 19 nt, Homo sapiens
ugaaaccacgucucuacua

SEQ ID NO: 1477124 - RNA, 19 nt, Homo sapiens
gaggugcucuguggugaug

SEQ ID NO: 1477125 - RNA, 19 nt, Homo sapiens
acaaguagguuugcuuaag

SEQ ID NO: 1477126 - RNA, 19 nt, Homo sapiens
uggaagaugucaccaugug

SEQ ID NO: 1477127 - RNA, 19 nt, Homo sapiens
gggcggagcacuucaucaa

SEQ ID NO: 1477128 - RNA, 19 nt, Homo sapiens
uggcauggcugaugauaac

SEQ ID NO: 1477129 - RNA, 19 nt, Homo sapiens
ucaauggcaaguacuauga

SEQ ID NO: 1477130 - RNA, 19 nt, Homo sapiens
gaacuggaaagcugugaag

SEQ ID NO: 1477131 - RNA, 19 nt, Homo sapiens
gcaggagaauggcgugaac

SEQ ID NO: 1477132 - RNA, 19 nt, Homo sapiens
caaguaagcauuccuuuug

SEQ ID NO: 1477133 - RNA, 19 nt, Homo sapiens
ccaauuaucaggaaaucau

SEQ ID NO: 1477134 - RNA, 19 nt, Homo sapiens
gugaggugcugauguccuu

SEQ ID NO: 1477135 - RNA, 19 nt, Homo sapiens
gaacuucuagguuuaagcu

SEQ ID NO: 1477136 - RNA, 19 nt, Homo sapiens
gaaggccauucccaagaag

SEQ ID NO: 1477137 - RNA, 19 nt, Homo sapiens
gggccuggcuacauagaca

SEQ ID NO: 1477138 - RNA, 19 nt, Homo sapiens
caccuggcauggcugauga

SEQ ID NO: 1477139 - RNA, 19 nt, Homo sapiens
ggcuuuaccacaacaagua

SEQ ID NO: 1477140 - RNA, 19 nt, Homo sapiens
uagauucugugacaaacug

SEQ ID NO: 1477141 - RNA, 19 nt, Homo sapiens
cacaucaucugucuucucu

SEQ ID NO: 1477142 - RNA, 19 nt, Homo sapiens
gcaggcuggugcuguguag

SEQ ID NO: 1477143 - RNA, 19 nt, Homo sapiens
caucugucuucucuaaguu

SEQ ID NO: 1477144 - RNA, 19 nt, Homo sapiens
gguacugugugucucugaa

SEQ ID NO: 1477145 - RNA, 19 nt, Homo sapiens
ucgagaccauccuggcuaa

SEQ ID NO: 1477146 - RNA, 19 nt, Homo sapiens
ugaacccaauuaucaggaa

SEQ ID NO: 1477147 - RNA, 19 nt, Homo sapiens
guuagggaaccauauuuga

SEQ ID NO: 1477148 - RNA, 19 nt, Homo sapiens
cggagcacuucaucaaaga

SEQ ID NO: 1477149 - RNA, 19 nt, Homo sapiens
ucucugaaguggccucugu

SEQ ID NO: 1477150 - RNA, 19 nt, Homo sapiens
ccacccgccuguauuugga

SEQ ID NO: 1477151 - RNA, 19 nt, Homo sapiens
cagguucauuuaacacuca

SEQ ID NO: 1477152 - RNA, 19 nt, Homo sapiens
ucaucugucuucucuaagu

SEQ ID NO: 1477153 - RNA, 19 nt, Homo sapiens
gaggcuggcaggugacuga

SEQ ID NO: 1477154 - RNA, 19 nt, Homo sapiens
gagcacuucaucaaagaga

SEQ ID NO: 1477155 - RNA, 19 nt, Homo sapiens
ggugaaaccacgucucuac

SEQ ID NO: 1477156 - RNA, 19 nt, Homo sapiens
caauuggagauguuuguga

SEQ ID NO: 1477157 - RNA, 19 nt, Homo sapiens
uccaaugguuucuccuuug

SEQ ID NO: 1477158 - RNA, 19 nt, Homo sapiens
cuccaaugguuucuccuuu

SEQ ID NO: 1477159 - RNA, 19 nt, Homo sapiens
gucaggagaucgagaccau

SEQ ID NO: 1477160 - RNA, 19 nt, Homo sapiens
ccuguaaucccagcacuuu

SEQ ID NO: 1477161 - RNA, 19 nt, Homo sapiens
guggcucacuccuguaauc

SEQ ID NO: 1477162 - RNA, 19 nt, Homo sapiens
agaugcauauuuagcucua

SEQ ID NO: 1477163 - RNA, 19 nt, Homo sapiens
uggcucccauggugcauuu

SEQ ID NO: 1477164 - RNA, 19 nt, Homo sapiens
uagggaaccauauuugaga

SEQ ID NO: 1477165 - RNA, 19 nt, Homo sapiens
gggaacacuuucauguaac

SEQ ID NO: 1477166 - RNA, 19 nt, Homo sapiens
ggcgugaggugcugauguc

SEQ ID NO: 1477167 - RNA, 19 nt, Homo sapiens
aaguagguuugcuuaagaa

SEQ ID NO: 1477168 - RNA, 19 nt, Homo sapiens
gagaggacuaggaggaaau

SEQ ID NO: 1477169 - RNA, 19 nt, Homo sapiens
uuucugguguggccuugua

SEQ ID NO: 1477170 - RNA, 19 nt, Homo sapiens
acucacagguucauuuaac

SEQ ID NO: 1477171 - RNA, 19 nt, Homo sapiens
gagggcacccagauugaga

SEQ ID NO: 1477172 - RNA, 19 nt, Homo sapiens
aaugguuucuccuuugguu

SEQ ID NO: 1477173 - RNA, 19 nt, Homo sapiens
cggcauguacaccuacuuu

SEQ ID NO: 1477174 - RNA, 19 nt, Homo sapiens
agagccauguucagugcua

SEQ ID NO: 1477175 - RNA, 19 nt, Homo sapiens
ggaacacuuucauguaacc

SEQ ID NO: 1477176 - RNA, 19 nt, Homo sapiens
gcuggcaggugacugaacu

SEQ ID NO: 1477177 - RNA, 19 nt, Homo sapiens
ggucagcagauggguguuu

SEQ ID NO: 1477178 - RNA, 19 nt, Homo sapiens
ggcccgagaucguuuccau

SEQ ID NO: 1477179 - RNA, 19 nt, Homo sapiens
aaaccacgucucuacuaaa

SEQ ID NO: 1477180 - RNA, 19 nt, Homo sapiens
caucaagcaccuuccuaug

SEQ ID NO: 1477181 - RNA, 19 nt, Homo sapiens
acaccuacuuugccuccaa

SEQ ID NO: 1477182 - RNA, 19 nt, Homo sapiens
gagggccacacccacgaua

SEQ ID NO: 1477183 - RNA, 19 nt, Homo sapiens
gcuauggcuuuaccacaac

SEQ ID NO: 1477184 - RNA, 19 nt, Homo sapiens
gaggcuugcuucagguuuu

SEQ ID NO: 1477185 - RNA, 19 nt, Homo sapiens
gaaguaaccugugucauuu

SEQ ID NO: 1477186 - RNA, 19 nt, Homo sapiens
caagugagaugucaagaaa

SEQ ID NO: 1477187 - RNA, 19 nt, Homo sapiens
ucaaugggaugcaguaaua

SEQ ID NO: 1477188 - RNA, 19 nt, Homo sapiens
gaaagccacuucaauagga

SEQ ID NO: 1477189 - RNA, 19 nt, Homo sapiens
gaagccaucucagcaauaa

SEQ ID NO: 1477190 - RNA, 19 nt, Homo sapiens
guacagaaaggguaaauaa

SEQ ID NO: 1477191 - RNA, 19 nt, Homo sapiens
gcacugagcugagauugug

SEQ ID NO: 1477192 - RNA, 19 nt, Homo sapiens
caucuccacugauucauua

SEQ ID NO: 1477193 - RNA, 19 nt, Homo sapiens
gaaacccugucucuacuaa

SEQ ID NO: 1477194 - RNA, 19 nt, Homo sapiens
gaguugccaucuauuaaua

SEQ ID NO: 1477195 - RNA, 19 nt, Homo sapiens
guacugcacugcugaaugu

SEQ ID NO: 1477196 - RNA, 19 nt, Homo sapiens
aaacagcucucuauugugu

SEQ ID NO: 1477197 - RNA, 19 nt, Homo sapiens
ugagaaagcugccuugcaa

SEQ ID NO: 1477198 - RNA, 19 nt, Homo sapiens
gaaguggaauuaugugcuu

SEQ ID NO: 1477199 - RNA, 19 nt, Homo sapiens
gaauuaaggucccgaaggu

SEQ ID NO: 1477200 - RNA, 19 nt, Homo sapiens
ggaauuaugugcuucaaac

SEQ ID NO: 1477201 - RNA, 19 nt, Homo sapiens
gagcagguccuauauguug

SEQ ID NO: 1477202 - RNA, 19 nt, Homo sapiens
guacguauuucaagugaga

SEQ ID NO: 1477203 - RNA, 19 nt, Homo sapiens
gcuguuauguugucaauuc

SEQ ID NO: 1477204 - RNA, 19 nt, Homo sapiens
uaucucaccucaagcuaua

SEQ ID NO: 1477205 - RNA, 19 nt, Homo sapiens
gcucugaaguggaauuaug

SEQ ID NO: 1477206 - RNA, 19 nt, Homo sapiens
gaauuugucuccuguuugg

SEQ ID NO: 1477207 - RNA, 19 nt, Homo sapiens
gaaauuacuuccuuaacac

SEQ ID NO: 1477208 - RNA, 19 nt, Homo sapiens
ucucaacacuggauauaaa

SEQ ID NO: 1477209 - RNA, 19 nt, Homo sapiens
caaauucaccuggaugaua

SEQ ID NO: 1477210 - RNA, 19 nt, Homo sapiens
gcaaaacucugucuggaaa

SEQ ID NO: 1477211 - RNA, 19 nt, Homo sapiens
caaaacagcucucuauugu

SEQ ID NO: 1477212 - RNA, 19 nt, Homo sapiens
auacaaaucuucacaugga

SEQ ID NO: 1477213 - RNA, 19 nt, Homo sapiens
gaaauaaucccagguuaca

SEQ ID NO: 1477214 - RNA, 19 nt, Homo sapiens
gauacaaggcuacaacaaa

SEQ ID NO: 1477215 - RNA, 19 nt, Homo sapiens
caacagcucggcuuuggua

SEQ ID NO: 1477216 - RNA, 19 nt, Homo sapiens
gaggaguugccaucuauua

SEQ ID NO: 1477217 - RNA, 19 nt, Homo sapiens
ugaaguaaccugugucauu

SEQ ID NO: 1477218 - RNA, 19 nt, Homo sapiens
guggacgccucauguauuu

SEQ ID NO: 1477219 - RNA, 19 nt, Homo sapiens
agacauuucuucuggauau

SEQ ID NO: 1477220 - RNA, 19 nt, Homo sapiens
cagcucggcuuugguauaa

SEQ ID NO: 1477221 - RNA, 19 nt, Homo sapiens
gaggaaaccaccaugcuuu

SEQ ID NO: 1477222 - RNA, 19 nt, Homo sapiens
caaaacaacugcaaauuca

SEQ ID NO: 1477223 - RNA, 19 nt, Homo sapiens
ucacuaagcaacacaauau

SEQ ID NO: 1477224 - RNA, 19 nt, Homo sapiens
caauaggauuucacucuug

SEQ ID NO: 1477225 - RNA, 19 nt, Homo sapiens
agauauuccugaugaagua

SEQ ID NO: 1477226 - RNA, 19 nt, Homo sapiens
ccagugagcagguccuaua

SEQ ID NO: 1477227 - RNA, 19 nt, Homo sapiens
caacagaggagacauugga

SEQ ID NO: 1477228 - RNA, 19 nt, Homo sapiens
cgucuuugcuguuauguug

SEQ ID NO: 1477229 - RNA, 19 nt, Homo sapiens
aaauucaccuggaugauau

SEQ ID NO: 1477230 - RNA, 19 nt, Homo sapiens
agucaacuauuuccucuuu

SEQ ID NO: 1477231 - RNA, 19 nt, Homo sapiens
uaaaacaccugaaacaguu

SEQ ID NO: 1477232 - RNA, 19 nt, Homo sapiens
gauagucaaacaacaauug

SEQ ID NO: 1477233 - RNA, 19 nt, Homo sapiens
caaaauacgugguacaugu

SEQ ID NO: 1477234 - RNA, 19 nt, Homo sapiens
guagaaccagccacaauuu

SEQ ID NO: 1477235 - RNA, 19 nt, Homo sapiens
ggacacauguuuucauuuc

SEQ ID NO: 1477236 - RNA, 19 nt, Homo sapiens
gaucgugaaugaggaguug

SEQ ID NO: 1477237 - RNA, 19 nt, Homo sapiens
gugagcagguccuauaugu

SEQ ID NO: 1477238 - RNA, 19 nt, Homo sapiens
gaacugggauuaaaagaag

SEQ ID NO: 1477239 - RNA, 19 nt, Homo sapiens
gaucgucuuugcuguuaug

SEQ ID NO: 1477240 - RNA, 19 nt, Homo sapiens
cagggcaccuuacuucuga

SEQ ID NO: 1477241 - RNA, 19 nt, Homo sapiens
cgccagauauuccugauga

SEQ ID NO: 1477242 - RNA, 19 nt, Homo sapiens
ggaaccacaugcuucuaug

SEQ ID NO: 1477243 - RNA, 19 nt, Homo sapiens
guagagcuguguggucaaa

SEQ ID NO: 1477244 - RNA, 19 nt, Homo sapiens
ucaauaggauuucacucuu

SEQ ID NO: 1477245 - RNA, 19 nt, Homo sapiens
gaaugcaguucuccugaca

SEQ ID NO: 1477246 - RNA, 19 nt, Homo sapiens
gaucucaacacuggauaua

SEQ ID NO: 1477247 - RNA, 19 nt, Homo sapiens
gaagagcaacaguaucuca

SEQ ID NO: 1477248 - RNA, 19 nt, Homo sapiens
ucaccuacauagacacaaa

SEQ ID NO: 1477249 - RNA, 19 nt, Homo sapiens
gaacugccaaccaaggaaa

SEQ ID NO: 1477250 - RNA, 19 nt, Homo sapiens
ggguaugaauaucucuaua

SEQ ID NO: 1477251 - RNA, 19 nt, Homo sapiens
gguagaaccagccacaauu

SEQ ID NO: 1477252 - RNA, 19 nt, Homo sapiens
aaacugcucuggccacauc

SEQ ID NO: 1477253 - RNA, 19 nt, Homo sapiens
ucaccuggaugauauagug

SEQ ID NO: 1477254 - RNA, 19 nt, Homo sapiens
uaacaucuccacugauuca

SEQ ID NO: 1477255 - RNA, 19 nt, Homo sapiens
cauggaggaauuacaaaua

SEQ ID NO: 1477256 - RNA, 19 nt, Homo sapiens
caagagacacugauaugug

SEQ ID NO: 1477257 - RNA, 19 nt, Homo sapiens
acagaaaggguaaauaaug

SEQ ID NO: 1477258 - RNA, 19 nt, Homo sapiens
ggaagccaucucagcaaua

SEQ ID NO: 1477259 - RNA, 19 nt, Homo sapiens
ggauauaaaccccaaauuu

SEQ ID NO: 1477260 - RNA, 19 nt, Homo sapiens
cagaagaagagcaacagua

SEQ ID NO: 1477261 - RNA, 19 nt, Homo sapiens
cagaaaggguaaauaaugc

SEQ ID NO: 1477262 - RNA, 19 nt, Homo sapiens
ugacauuucugugcuccua

SEQ ID NO: 1477263 - RNA, 19 nt, Homo sapiens
gaacacaagccuacagacu

SEQ ID NO: 1477264 - RNA, 19 nt, Homo sapiens
gugaaacuauuccagaaca

SEQ ID NO: 1477265 - RNA, 19 nt, Homo sapiens
gggaagccaucucagcaau

SEQ ID NO: 1477266 - RNA, 19 nt, Homo sapiens
auuaacaucuccacugauu

SEQ ID NO: 1477267 - RNA, 19 nt, Homo sapiens
ggaguugccaucuauuaau

SEQ ID NO: 1477268 - RNA, 19 nt, Homo sapiens
ggaaauaaucccagguuac

SEQ ID NO: 1477269 - RNA, 19 nt, Homo sapiens
caaaagcauuccaacauga

SEQ ID NO: 1477270 - RNA, 19 nt, Homo sapiens
uaauagcccuuuacauacu

SEQ ID NO: 1477271 - RNA, 19 nt, Homo sapiens
caaccaaggaaacuucauu

SEQ ID NO: 1477272 - RNA, 19 nt, Homo sapiens
gcaggagaaucacuugaac

SEQ ID NO: 1477273 - RNA, 19 nt, Homo sapiens
gcaaaacagcucucuauug

SEQ ID NO: 1477274 - RNA, 19 nt, Homo sapiens
cagugaaacuauuccagaa

SEQ ID NO: 1477275 - RNA, 19 nt, Homo sapiens
gcaguucuccugacauaca

SEQ ID NO: 1477276 - RNA, 19 nt, Homo sapiens
gaugauauagugauaccuu

SEQ ID NO: 1477277 - RNA, 19 nt, Homo sapiens
ggaggaaaccaccaugcuu

SEQ ID NO: 1477278 - RNA, 19 nt, Homo sapiens
aggaaauaaucccagguua

SEQ ID NO: 1477279 - RNA, 19 nt, Homo sapiens
acaagagacuacccgcaaa

SEQ ID NO: 1477280 - RNA, 19 nt, Homo sapiens
ggaaaauagugaacuuaug

SEQ ID NO: 1477281 - RNA, 19 nt, Homo sapiens
uaacagaucauuccgaacu

SEQ ID NO: 1477282 - RNA, 19 nt, Homo sapiens
gaaaggguaaauaaugcaa

SEQ ID NO: 1477283 - RNA, 19 nt, Homo sapiens
ucuucugccucauuucuua

SEQ ID NO: 1477284 - RNA, 19 nt, Homo sapiens
uuggaaagccacuucaaua

SEQ ID NO: 1477285 - RNA, 19 nt, Homo sapiens
ccaagaggcugcagucaaa

SEQ ID NO: 1477286 - RNA, 19 nt, Homo sapiens
gaagaagggugaagguuag

SEQ ID NO: 1477287 - RNA, 19 nt, Homo sapiens
acaauaaacuguacaagga

SEQ ID NO: 1477288 - RNA, 19 nt, Homo sapiens
gggaagcucugauuauuca

SEQ ID NO: 1477289 - RNA, 19 nt, Homo sapiens
caaaugaggugaggagaug

SEQ ID NO: 1477290 - RNA, 19 nt, Homo sapiens
gcacagacacauacaaguu

SEQ ID NO: 1477291 - RNA, 19 nt, Homo sapiens
cagaugggcugcuagacua

SEQ ID NO: 1477292 - RNA, 19 nt, Homo sapiens
ccaauuugauuugcuagua

SEQ ID NO: 1477293 - RNA, 19 nt, Homo sapiens
ggauggaagucuuugucua

SEQ ID NO: 1477294 - RNA, 19 nt, Homo sapiens
ggacuugucacacuccuuu

SEQ ID NO: 1477295 - RNA, 19 nt, Homo sapiens
gaagggugaagguuagaua

SEQ ID NO: 1477296 - RNA, 19 nt, Homo sapiens
cacauuaccuccaugauca

SEQ ID NO: 1477297 - RNA, 19 nt, Homo sapiens
uuaccuccaugaucaauaa

SEQ ID NO: 1477298 - RNA, 19 nt, Homo sapiens
agaagaagggugaagguua

SEQ ID NO: 1477299 - RNA, 19 nt, Homo sapiens
gcacauuaccuccaugauc

SEQ ID NO: 1477300 - RNA, 19 nt, Homo sapiens
gggccaauuugauuugcua

SEQ ID NO: 1477301 - RNA, 19 nt, Homo sapiens
gaacauccugcucugaaug

SEQ ID NO: 1477302 - RNA, 19 nt, Homo sapiens
cagacaagguggcaucuca

SEQ ID NO: 1477303 - RNA, 19 nt, Homo sapiens
ccagugaguucugcauuug

SEQ ID NO: 1477304 - RNA, 19 nt, Homo sapiens
agauuuagguacugaagaa

SEQ ID NO: 1477305 - RNA, 19 nt, Homo sapiens
gaaagagcagacagcguaa

SEQ ID NO: 1477306 - RNA, 19 nt, Homo sapiens
gcauuuguaucuugcaagu

SEQ ID NO: 1477307 - RNA, 19 nt, Homo sapiens
gaagaaucccagugaguuc

SEQ ID NO: 1477308 - RNA, 19 nt, Homo sapiens
gcaucuuucuagccaauga

SEQ ID NO: 1477309 - RNA, 19 nt, Homo sapiens
acacacacguauaucuauu

SEQ ID NO: 1477310 - RNA, 19 nt, Homo sapiens
guucugcauuuguaucuug

SEQ ID NO: 1477311 - RNA, 19 nt, Homo sapiens
ggugaagguuagauagaug

SEQ ID NO: 1477312 - RNA, 19 nt, Homo sapiens
ggagggauggccugacuga

SEQ ID NO: 1477313 - RNA, 19 nt, Homo sapiens
gcaaggauuugggcaggau

SEQ ID NO: 1477314 - RNA, 19 nt, Homo sapiens
gcauaaaaguggccuuaga

SEQ ID NO: 1477315 - RNA, 19 nt, Homo sapiens
gauggaagucuuugucuag

SEQ ID NO: 1477316 - RNA, 19 nt, Homo sapiens
uccagggccuucucaauga

SEQ ID NO: 1477317 - RNA, 19 nt, Homo sapiens
gaggagggauggccugacu

SEQ ID NO: 1477318 - RNA, 19 nt, Homo sapiens
gcaaaugaggugaggagau

SEQ ID NO: 1477319 - RNA, 19 nt, Homo sapiens
cccagugaguucugcauuu

SEQ ID NO: 1477320 - RNA, 19 nt, Homo sapiens
gggauggccugacugaaac

SEQ ID NO: 1477321 - RNA, 19 nt, Homo sapiens
acacacacacguauaucua

SEQ ID NO: 1477322 - RNA, 19 nt, Homo sapiens
agugaguucugcauuugua

SEQ ID NO: 1477323 - RNA, 19 nt, Homo sapiens
ugaagaaucccagugaguu

SEQ ID NO: 1477324 - RNA, 19 nt, Homo sapiens
uggcagcucuuaaaacuaa

SEQ ID NO: 1477325 - RNA, 19 nt, Homo sapiens
gagcacauuaccuccauga

SEQ ID NO: 1477326 - RNA, 19 nt, Homo sapiens
gggugaagguuagauagau

SEQ ID NO: 1477327 - RNA, 19 nt, Homo sapiens
caauaaacuguacaaggaa

SEQ ID NO: 1477328 - RNA, 19 nt, Homo sapiens
ccaauuccuuuccccuuua

SEQ ID NO: 1477329 - RNA, 19 nt, Homo sapiens
uauccagacugugaaauca

SEQ ID NO: 1477330 - RNA, 19 nt, Homo sapiens
ggcaagagggaaccaauuc

SEQ ID NO: 1477331 - RNA, 19 nt, Homo sapiens
ucaaauacugcuacuguca

SEQ ID NO: 1477332 - RNA, 19 nt, Homo sapiens
cacaguggcuuccuuccau

SEQ ID NO: 1477333 - RNA, 19 nt, Homo sapiens
uagaacauccugcucugaa

SEQ ID NO: 1477334 - RNA, 19 nt, Homo sapiens
ggaggguccuacagacaag

SEQ ID NO: 1477335 - RNA, 19 nt, Homo sapiens
aaaaguggccuuagaagaa

SEQ ID NO: 1477336 - RNA, 19 nt, Homo sapiens
acacacacacacacguaua

SEQ ID NO: 1477337 - RNA, 19 nt, Homo sapiens
gggcaggauggaagucuuu

SEQ ID NO: 1477338 - RNA, 19 nt, Homo sapiens
aaacagcacuaaggauguc

SEQ ID NO: 1477339 - RNA, 19 nt, Homo sapiens
caaacagcacuaaggaugu

SEQ ID NO: 1477340 - RNA, 19 nt, Homo sapiens
uagcaucuuucuagccaau

SEQ ID NO: 1477341 - RNA, 19 nt, Homo sapiens
aagguuagauagauggaau

SEQ ID NO: 1477342 - RNA, 19 nt, Homo sapiens
aaaguggccuuagaagaag

SEQ ID NO: 1477343 - RNA, 19 nt, Homo sapiens
acacacacacacacacgua

SEQ ID NO: 1477344 - RNA, 19 nt, Homo sapiens
cuaccuggcagcucuuaaa

SEQ ID NO: 1477345 - RNA, 19 nt, Homo sapiens
cagcguaacagcagccuau

SEQ ID NO: 1477346 - RNA, 19 nt, Homo sapiens
uaaacccaauacaggaaau

SEQ ID NO: 1477347 - RNA, 19 nt, Homo sapiens
auacugcuacugucacuuu

SEQ ID NO: 1477348 - RNA, 19 nt, Homo sapiens
caugaucaauaaccaagag

SEQ ID NO: 1477349 - RNA, 19 nt, Homo sapiens
gaagcucugauuauucauc

SEQ ID NO: 1477350 - RNA, 19 nt, Homo sapiens
gcuccuggccagcguuuga

SEQ ID NO: 1477351 - RNA, 19 nt, Homo sapiens
uggccugggucacauuuau

SEQ ID NO: 1477352 - RNA, 19 nt, Homo sapiens
ggacaaacagcuguagcau

SEQ ID NO: 1477353 - RNA, 19 nt, Homo sapiens
agaacauccugcucugaau

SEQ ID NO: 1477354 - RNA, 19 nt, Homo sapiens
uauaaacccaauacaggaa

SEQ ID NO: 1477355 - RNA, 19 nt, Homo sapiens
agggauggccugacugaaa

SEQ ID NO: 1477356 - RNA, 19 nt, Homo sapiens
acugucacuuugaagauuu

SEQ ID NO: 1477357 - RNA, 19 nt, Homo sapiens
gcuacugucacuuugaaga

SEQ ID NO: 1477358 - RNA, 19 nt, Homo sapiens
cugcuacugucacuuugaa

SEQ ID NO: 1477359 - RNA, 19 nt, Homo sapiens
aagaggcugcagucaaaua

SEQ ID NO: 1477360 - RNA, 19 nt, Homo sapiens
ccuuucagcagcauucuuu

SEQ ID NO: 1477361 - RNA, 19 nt, Homo sapiens
ccccagagcucacccagaa

SEQ ID NO: 1477362 - RNA, 19 nt, Homo sapiens
agucaaauacugcuacugu

SEQ ID NO: 1477363 - RNA, 19 nt, Homo sapiens
cggaaguccuggccuaagg

SEQ ID NO: 1477364 - RNA, 19 nt, Homo sapiens
cacacacguauaucuauuu

SEQ ID NO: 1477365 - RNA, 19 nt, Homo sapiens
gucuaggucugaaaucaag

SEQ ID NO: 1477366 - RNA, 19 nt, Homo sapiens
ucacacuccuuuucacuug

SEQ ID NO: 1477367 - RNA, 19 nt, Homo sapiens
gggacaaacagcuguagca

SEQ ID NO: 1477368 - RNA, 19 nt, Homo sapiens
aacagcagccuaugccaaa

SEQ ID NO: 1477369 - RNA, 19 nt, Homo sapiens
gaagguuagauagauggaa

SEQ ID NO: 1477370 - RNA, 19 nt, Homo sapiens
guggcuuccuuccauccua

SEQ ID NO: 1477371 - RNA, 19 nt, Homo sapiens
gaaugaacagagcccagau

SEQ ID NO: 1477372 - RNA, 19 nt, Homo sapiens
guauccagacugugaaauc

SEQ ID NO: 1477373 - RNA, 19 nt, Homo sapiens
ccucuggaaggaacuguuu

SEQ ID NO: 1477374 - RNA, 19 nt, Homo sapiens
ccagagcucacccagaaag

SEQ ID NO: 1477375 - RNA, 19 nt, Homo sapiens
uacugucacuuugaagauu

SEQ ID NO: 1477376 - RNA, 19 nt, Homo sapiens
gagcucacccagaaagcau

SEQ ID NO: 1477377 - RNA, 19 nt, Homo sapiens
aggcgugaauccucuggaa

SEQ ID NO: 1477378 - RNA, 19 nt, Homo sapiens
aaacccaauacaggaaaua

SEQ ID NO: 1477379 - RNA, 19 nt, Homo sapiens
cggcaagagggaaccaauu

SEQ ID NO: 1477380 - RNA, 19 nt, Homo sapiens
gagcuccuggccagcguuu

SEQ ID NO: 1477381 - RNA, 19 nt, Homo sapiens
gccugggucacauuuauga

SEQ ID NO: 1477382 - RNA, 19 nt, Homo sapiens
cacagacacauacaaguuc

SEQ ID NO: 1477383 - RNA, 19 nt, Homo sapiens
ucagugucuuuauuuagca

SEQ ID NO: 1477384 - RNA, 19 nt, Homo sapiens
cacacacacacacguauau

SEQ ID NO: 1477385 - RNA, 19 nt, Homo sapiens
caggauagcccuucucuuu

SEQ ID NO: 1477386 - RNA, 19 nt, Homo sapiens
ggauagcccuucucuuugu

SEQ ID NO: 1477387 - RNA, 19 nt, Homo sapiens
gauaaaggcucugggaauc

SEQ ID NO: 1477388 - RNA, 19 nt, Homo sapiens
gcaaacugcugguuggaau

SEQ ID NO: 1477389 - RNA, 19 nt, Homo sapiens
ggucuuaguuacuuaucua

SEQ ID NO: 1477390 - RNA, 19 nt, Homo sapiens
gcaaugggaacugggauua

SEQ ID NO: 1477391 - RNA, 19 nt, Homo sapiens
gaaccugaccaaugaaaug

SEQ ID NO: 1477392 - RNA, 19 nt, Homo sapiens
caacacacacuucccauug

SEQ ID NO: 1477393 - RNA, 19 nt, Homo sapiens
gguggaaggugcaggaaug

SEQ ID NO: 1477394 - RNA, 19 nt, Homo sapiens
acacucaucuccaguccua

SEQ ID NO: 1477395 - RNA, 19 nt, Homo sapiens
gagaugugcuccuccuuca

SEQ ID NO: 1477396 - RNA, 19 nt, Homo sapiens
gaauggacgccguggagua

SEQ ID NO: 1477397 - RNA, 19 nt, Homo sapiens
gagccauucucccuucuga

SEQ ID NO: 1477398 - RNA, 19 nt, Homo sapiens
gaaucuaagcagaaacuuu

SEQ ID NO: 1477399 - RNA, 19 nt, Homo sapiens
ucagaucccuccaguguag

SEQ ID NO: 1477400 - RNA, 19 nt, Homo sapiens
gaaagccauuugccuacug

SEQ ID NO: 1477401 - RNA, 19 nt, Homo sapiens
caacagugucuucugaauu

SEQ ID NO: 1477402 - RNA, 19 nt, Homo sapiens
ggaauuaggacuccaguac

SEQ ID NO: 1477403 - RNA, 19 nt, Homo sapiens
guugggcccugaauucaaa

SEQ ID NO: 1477404 - RNA, 19 nt, Homo sapiens
gaccuuccauuauccucua

SEQ ID NO: 1477405 - RNA, 19 nt, Homo sapiens
agagugagccguucaauca

SEQ ID NO: 1477406 - RNA, 19 nt, Homo sapiens
gucaagcccuucauccauu

SEQ ID NO: 1477407 - RNA, 19 nt, Homo sapiens
guggucaacuuuaacauca

SEQ ID NO: 1477408 - RNA, 19 nt, Homo sapiens
cuucugaauucacugauuu

SEQ ID NO: 1477409 - RNA, 19 nt, Homo sapiens
gaguuccacugcugugauu

SEQ ID NO: 1477410 - RNA, 19 nt, Homo sapiens
ccacuuguuuggguuguuu

SEQ ID NO: 1477411 - RNA, 19 nt, Homo sapiens
gaacugaacaagcuugcau

SEQ ID NO: 1477412 - RNA, 19 nt, Homo sapiens
uggcaacccuagcaaagaa

SEQ ID NO: 1477413 - RNA, 19 nt, Homo sapiens
uaacaucagcaaaucagaa

SEQ ID NO: 1477414 - RNA, 19 nt, Homo sapiens
aacagugucuucugaauuc

SEQ ID NO: 1477415 - RNA, 19 nt, Homo sapiens
caacucaaauccuccuuuu

SEQ ID NO: 1477416 - RNA, 19 nt, Homo sapiens
cauucucccuucugacuuu

SEQ ID NO: 1477417 - RNA, 19 nt, Homo sapiens
ucaucugucugaggucuua

SEQ ID NO: 1477418 - RNA, 19 nt, Homo sapiens
gauagcccuucucuuuguu

SEQ ID NO: 1477419 - RNA, 19 nt, Homo sapiens
gcaacccuagcaaagaaua

SEQ ID NO: 1477420 - RNA, 19 nt, Homo sapiens
acucaacagugucuucuga

SEQ ID NO: 1477421 - RNA, 19 nt, Homo sapiens
ucaccgauguauucauuca

SEQ ID NO: 1477422 - RNA, 19 nt, Homo sapiens
gcuguugaccuuccauuau

SEQ ID NO: 1477423 - RNA, 19 nt, Homo sapiens
uacgugaccuaguuucuug

SEQ ID NO: 1477424 - RNA, 19 nt, Homo sapiens
gacuggcacucuacucaug

SEQ ID NO: 1477425 - RNA, 19 nt, Homo sapiens
ucaacagugucuucugaau

SEQ ID NO: 1477426 - RNA, 19 nt, Homo sapiens
cuauaacaguaucccaauu

SEQ ID NO: 1477427 - RNA, 19 nt, Homo sapiens
gaauacagagggacuaaaa

SEQ ID NO: 1477428 - RNA, 19 nt, Homo sapiens
ccugaccaaugaaauguga

SEQ ID NO: 1477429 - RNA, 19 nt, Homo sapiens
cagcaacucggauuuagga

SEQ ID NO: 1477430 - RNA, 19 nt, Homo sapiens
gcagaacgggcacucaaca

SEQ ID NO: 1477431 - RNA, 19 nt, Homo sapiens
caaacugcugguuggaaua

SEQ ID NO: 1477432 - RNA, 19 nt, Homo sapiens
gccucaagguuuaaugaug

SEQ ID NO: 1477433 - RNA, 19 nt, Homo sapiens
ccuuugggcucaagaguuc

SEQ ID NO: 1477434 - RNA, 19 nt, Homo sapiens
gaagaaauccugcuuuugc

SEQ ID NO: 1477435 - RNA, 19 nt, Homo sapiens
aaacugcugguuggaauaa

SEQ ID NO: 1477436 - RNA, 19 nt, Homo sapiens
gcuuugagaaguugccuuu

SEQ ID NO: 1477437 - RNA, 19 nt, Homo sapiens
gcuccuggguuccacuugu

SEQ ID NO: 1477438 - RNA, 19 nt, Homo sapiens
ugucugaggucuuaguuac

SEQ ID NO: 1477439 - RNA, 19 nt, Homo sapiens
ugccaucaccucucgcuua

SEQ ID NO: 1477440 - RNA, 19 nt, Homo sapiens
auucaccgauguauucauu

SEQ ID NO: 1477441 - RNA, 19 nt, Homo sapiens
agaauguacucuugucucu

SEQ ID NO: 1477442 - RNA, 19 nt, Homo sapiens
aaugggaacugggauuaga

SEQ ID NO: 1477443 - RNA, 19 nt, Homo sapiens
caccugaaccugaccaaug

SEQ ID NO: 1477444 - RNA, 19 nt, Homo sapiens
ccugguagggcuggaauua

SEQ ID NO: 1477445 - RNA, 19 nt, Homo sapiens
acagggaguuuucagauaa

SEQ ID NO: 1477446 - RNA, 19 nt, Homo sapiens
ucucagaucccuccagugu

SEQ ID NO: 1477447 - RNA, 19 nt, Homo sapiens
cuagggaucccacuucuca

SEQ ID NO: 1477448 - RNA, 19 nt, Homo sapiens
cagacuccaugaacuuugu

SEQ ID NO: 1477449 - RNA, 19 nt, Homo sapiens
ccagaagacccaccuccuu

SEQ ID NO: 1477450 - RNA, 19 nt, Homo sapiens
aagcaccuaucuuccagaa

SEQ ID NO: 1477451 - RNA, 19 nt, Homo sapiens
gagccagcccuucgagaug

SEQ ID NO: 1477452 - RNA, 19 nt, Homo sapiens
aacacacacuucccauuga

SEQ ID NO: 1477453 - RNA, 19 nt, Homo sapiens
gccguucaaucaucuuugu

SEQ ID NO: 1477454 - RNA, 19 nt, Homo sapiens
cuucucgucuccucuaguu

SEQ ID NO: 1477455 - RNA, 19 nt, Homo sapiens
caacuuuaacaucagcaaa

SEQ ID NO: 1477456 - RNA, 19 nt, Homo sapiens
gccagcaacucggauuuag

SEQ ID NO: 1477457 - RNA, 19 nt, Homo sapiens
gagccagcaacucggauuu

SEQ ID NO: 1477458 - RNA, 19 nt, Homo sapiens
caaggcauccucugugucu

SEQ ID NO: 1477459 - RNA, 19 nt, Homo sapiens
ucugaggucuuaguuacuu

SEQ ID NO: 1477460 - RNA, 19 nt, Homo sapiens
accugaaccugaccaauga

SEQ ID NO: 1477461 - RNA, 19 nt, Homo sapiens
ccacggaugcgcugcugaa

SEQ ID NO: 1477462 - RNA, 19 nt, Homo sapiens
gcucugggaauccugagaa

SEQ ID NO: 1477463 - RNA, 19 nt, Homo sapiens
gaccgugucccucacuaga

SEQ ID NO: 1477464 - RNA, 19 nt, Homo sapiens
gccaucaccucucgcuuac

SEQ ID NO: 1477465 - RNA, 19 nt, Homo sapiens
gccgaacaguagcucaaug

SEQ ID NO: 1477466 - RNA, 19 nt, Homo sapiens
ucaagcccuucauccauuc

SEQ ID NO: 1477467 - RNA, 19 nt, Homo sapiens
cauggugguucucgguaga

SEQ ID NO: 1477468 - RNA, 19 nt, Homo sapiens
ggaucccacuucucacucu

SEQ ID NO: 1477469 - RNA, 19 nt, Homo sapiens
gccagaauguacucuuguc

SEQ ID NO: 1477470 - RNA, 19 nt, Homo sapiens
ggcccgauuuguccuguuc

SEQ ID NO: 1477471 - RNA, 19 nt, Homo sapiens
gcuauccgggucugaauuc

SEQ ID NO: 1477472 - RNA, 19 nt, Homo sapiens
gggacuggcacucuacuca

SEQ ID NO: 1477473 - RNA, 19 nt, Homo sapiens
gcagauggugaccgaagug

SEQ ID NO: 1477474 - RNA, 19 nt, Homo sapiens
gagccguucaaucaucuuu

SEQ ID NO: 1477475 - RNA, 19 nt, Homo sapiens
ccaacucaaauccuccuuu

SEQ ID NO: 1477476 - RNA, 19 nt, Homo sapiens
gcucacacugccagaauca

SEQ ID NO: 1477477 - RNA, 19 nt, Homo sapiens
cccaaggcauccucugugu

SEQ ID NO: 1477478 - RNA, 19 nt, Homo sapiens
caucuuugugucccuagua

SEQ ID NO: 1477479 - RNA, 19 nt, Homo sapiens
gacgugccuuuguuuuaua

SEQ ID NO: 1477480 - RNA, 19 nt, Homo sapiens
gauuuguccuguuccaacu

SEQ ID NO: 1477481 - RNA, 19 nt, Homo sapiens
gcugcagggaccauuguuu

SEQ ID NO: 1477482 - RNA, 19 nt, Homo sapiens
guuuauccagcaacccuua

SEQ ID NO: 1477483 - RNA, 19 nt, Homo sapiens
agauaaaggcucugggaau

SEQ ID NO: 1477484 - RNA, 19 nt, Homo sapiens
cacagggaguuuucagaua

SEQ ID NO: 1477485 - RNA, 19 nt, Homo sapiens
uaacagugaugcaacauua

SEQ ID NO: 1477486 - RNA, 19 nt, Homo sapiens
gaacucagauuaguacaaa

SEQ ID NO: 1477487 - RNA, 19 nt, Homo sapiens
gauaacgucuagucaauaa

SEQ ID NO: 1477488 - RNA, 19 nt, Homo sapiens
gaaauuaagugauccaaag

SEQ ID NO: 1477489 - RNA, 19 nt, Homo sapiens
gaggagauaugaaugagua

SEQ ID NO: 1477490 - RNA, 19 nt, Homo sapiens
uaacagauauguccaagga

SEQ ID NO: 1477491 - RNA, 19 nt, Homo sapiens
gcaaauaccauggaugaua

SEQ ID NO: 1477492 - RNA, 19 nt, Homo sapiens
ccaaggaaguugagcuaua

SEQ ID NO: 1477493 - RNA, 19 nt, Homo sapiens
gaaauuagacacuaggaaa

SEQ ID NO: 1477494 - RNA, 19 nt, Homo sapiens
ugaaacaacugauuaagga

SEQ ID NO: 1477495 - RNA, 19 nt, Homo sapiens
caucagcacuuaagaaaug

SEQ ID NO: 1477496 - RNA, 19 nt, Homo sapiens
ggaaacgugacacauauua

SEQ ID NO: 1477497 - RNA, 19 nt, Homo sapiens
gcacuaagcaguaucaaga

SEQ ID NO: 1477498 - RNA, 19 nt, Homo sapiens
cagcagagauucauagaug

SEQ ID NO: 1477499 - RNA, 19 nt, Homo sapiens
caaauaccauggaugauau

SEQ ID NO: 1477500 - RNA, 19 nt, Homo sapiens
gaaaggaucacauucauag

SEQ ID NO: 1477501 - RNA, 19 nt, Homo sapiens
uuacauggcuccugaaguu

SEQ ID NO: 1477502 - RNA, 19 nt, Homo sapiens
gguaugaggugaucaggaa

SEQ ID NO: 1477503 - RNA, 19 nt, Homo sapiens
gaacuucucauuccuguga

SEQ ID NO: 1477504 - RNA, 19 nt, Homo sapiens
agaagaaccugucagugua

SEQ ID NO: 1477505 - RNA, 19 nt, Homo sapiens
cgaaugaaacaacugauua

SEQ ID NO: 1477506 - RNA, 19 nt, Homo sapiens
cagaggaaauagaauguaa

SEQ ID NO: 1477507 - RNA, 19 nt, Homo sapiens
aaacagaacauuagccuuu

SEQ ID NO: 1477508 - RNA, 19 nt, Homo sapiens
caaagcugcugaaguaugu

SEQ ID NO: 1477509 - RNA, 19 nt, Homo sapiens
ccacgucuguuuaaauuau

SEQ ID NO: 1477510 - RNA, 19 nt, Homo sapiens
gaaaagaugguuagugaua

SEQ ID NO: 1477511 - RNA, 19 nt, Homo sapiens
ugaaguaaguguuaagugu

SEQ ID NO: 1477512 - RNA, 19 nt, Homo sapiens
gaaacaguacugguaauaa

SEQ ID NO: 1477513 - RNA, 19 nt, Homo sapiens
gauaugcugcuucuguuua

SEQ ID NO: 1477514 - RNA, 19 nt, Homo sapiens
guuaguuccuagaauguua

SEQ ID NO: 1477515 - RNA, 19 nt, Homo sapiens
ggaaagauuuuaccuguga

SEQ ID NO: 1477516 - RNA, 19 nt, Homo sapiens
ucaaauguguucagaggaa

SEQ ID NO: 1477517 - RNA, 19 nt, Homo sapiens
ggaaaggaucacauucaua

SEQ ID NO: 1477518 - RNA, 19 nt, Homo sapiens
cagaagcgccuauuauuug

SEQ ID NO: 1477519 - RNA, 19 nt, Homo sapiens
caaguuggccguuuuauua

SEQ ID NO: 1477520 - RNA, 19 nt, Homo sapiens
ugaacuagaacucagauua

SEQ ID NO: 1477521 - RNA, 19 nt, Homo sapiens
gcuaagggauacuuuguca

SEQ ID NO: 1477522 - RNA, 19 nt, Homo sapiens
gcucagcacuaaagguuug

SEQ ID NO: 1477523 - RNA, 19 nt, Homo sapiens
auccaaagcugcugaagua

SEQ ID NO: 1477524 - RNA, 19 nt, Homo sapiens
gagauuugcuggugaaguc

SEQ ID NO: 1477525 - RNA, 19 nt, Homo sapiens
gaacuagaacucagauuag

SEQ ID NO: 1477526 - RNA, 19 nt, Homo sapiens
gaaauuagagguggaaaca

SEQ ID NO: 1477527 - RNA, 19 nt, Homo sapiens
gauagaaugcuuuccuaaa

SEQ ID NO: 1477528 - RNA, 19 nt, Homo sapiens
gauagaaguuuggcaggaa

SEQ ID NO: 1477529 - RNA, 19 nt, Homo sapiens
gccaaaguacgaucuaaua

SEQ ID NO: 1477530 - RNA, 19 nt, Homo sapiens
gaagaaccugucaguguaa

SEQ ID NO: 1477531 - RNA, 19 nt, Homo sapiens
gcagugcccuggcuuucuu

SEQ ID NO: 1477532 - RNA, 19 nt, Homo sapiens
ccagaagcgccuauuauuu

SEQ ID NO: 1477533 - RNA, 19 nt, Homo sapiens
cacagugccuugcccauaa

SEQ ID NO: 1477534 - RNA, 19 nt, Homo sapiens
caaggaaguugagcuauag

SEQ ID NO: 1477535 - RNA, 19 nt, Homo sapiens
ucucuugucugauuugaaa

SEQ ID NO: 1477536 - RNA, 19 nt, Homo sapiens
gguaaccgagcauuuauuu

SEQ ID NO: 1477537 - RNA, 19 nt, Homo sapiens
ccaggaaacccaaucguaa

SEQ ID NO: 1477538 - RNA, 19 nt, Homo sapiens
gcucuaauucuucccuuua

SEQ ID NO: 1477539 - RNA, 19 nt, Homo sapiens
gaacuagcccuucgugagu

SEQ ID NO: 1477540 - RNA, 19 nt, Homo sapiens
cacuaaagguuuguugaua

SEQ ID NO: 1477541 - RNA, 19 nt, Homo sapiens
ucaauaacauggcacuuca

SEQ ID NO: 1477542 - RNA, 19 nt, Homo sapiens
gggagaagauacauacaca

SEQ ID NO: 1477543 - RNA, 19 nt, Homo sapiens
aaagauagcagcugggaaa

SEQ ID NO: 1477544 - RNA, 19 nt, Homo sapiens
gaacuguaauacuugauac

SEQ ID NO: 1477545 - RNA, 19 nt, Homo sapiens
agacauuccucgucaguau

SEQ ID NO: 1477546 - RNA, 19 nt, Homo sapiens
gggcaaugcuggaaaggau

SEQ ID NO: 1477547 - RNA, 19 nt, Homo sapiens
uaagggauacuuugucauu

SEQ ID NO: 1477548 - RNA, 19 nt, Homo sapiens
gaaaaugugaucaccuuua

SEQ ID NO: 1477549 - RNA, 19 nt, Homo sapiens
gagcuucuacaaucugaua

SEQ ID NO: 1477550 - RNA, 19 nt, Homo sapiens
caaaguaauucaccagcau

SEQ ID NO: 1477551 - RNA, 19 nt, Homo sapiens
gcaggaaauuagacacuag

SEQ ID NO: 1477552 - RNA, 19 nt, Homo sapiens
gaagcagucaucagaaaga

SEQ ID NO: 1477553 - RNA, 19 nt, Homo sapiens
gaucaccagauuaguuuaa

SEQ ID NO: 1477554 - RNA, 19 nt, Homo sapiens
ggucuaaaauuaucuggua

SEQ ID NO: 1477555 - RNA, 19 nt, Homo sapiens
cagaagaaccugucagugu

SEQ ID NO: 1477556 - RNA, 19 nt, Homo sapiens
ggaaccucaugauaauuga

SEQ ID NO: 1477557 - RNA, 19 nt, Homo sapiens
ugucugauuugaaacagua

SEQ ID NO: 1477558 - RNA, 19 nt, Homo sapiens
ugugugaacuguaauacuu

SEQ ID NO: 1477559 - RNA, 19 nt, Homo sapiens
gaugauaugcugcuucugu

SEQ ID NO: 1477560 - RNA, 19 nt, Homo sapiens
ggauaccagugacuuggaa

SEQ ID NO: 1477561 - RNA, 19 nt, Homo sapiens
acaguuaguuccuagaaug

SEQ ID NO: 1477562 - RNA, 19 nt, Homo sapiens
gcacuugagcuucuacaau

SEQ ID NO: 1477563 - RNA, 19 nt, Homo sapiens
ccaauguggguguaaauuu

SEQ ID NO: 1477564 - RNA, 19 nt, Homo sapiens
aguguuaagugucagauaa

SEQ ID NO: 1477565 - RNA, 19 nt, Homo sapiens
cauuauuccucuugaaguu

SEQ ID NO: 1477566 - RNA, 19 nt, Homo sapiens
ccugauaacauccugauuu

SEQ ID NO: 1477567 - RNA, 19 nt, Homo sapiens
gggauacuuugucauuaug

SEQ ID NO: 1477568 - RNA, 19 nt, Homo sapiens
gcacuaaagguuuguugau

SEQ ID NO: 1477569 - RNA, 19 nt, Homo sapiens
ggauagaaugcuuuccuaa

SEQ ID NO: 1477570 - RNA, 19 nt, Homo sapiens
gaaggacauuacacagcaa

SEQ ID NO: 1477571 - RNA, 19 nt, Homo sapiens
gcuuguagaaacuucauua

SEQ ID NO: 1477572 - RNA, 19 nt, Homo sapiens
guuacgguguuguguauga

SEQ ID NO: 1477573 - RNA, 19 nt, Homo sapiens
gcagcagguuggugauuca

SEQ ID NO: 1477574 - RNA, 19 nt, Homo sapiens
cccuauagcugcaagaguu

SEQ ID NO: 1477575 - RNA, 19 nt, Homo sapiens
ugccacgucuguuuaaauu

SEQ ID NO: 1477576 - RNA, 19 nt, Homo sapiens
gaaacgugacacauauuau

SEQ ID NO: 1477577 - RNA, 19 nt, Homo sapiens
aagaaaagaugguuaguga

SEQ ID NO: 1477578 - RNA, 19 nt, Homo sapiens
ugaaacaguacugguaaua

SEQ ID NO: 1477579 - RNA, 19 nt, Homo sapiens
uuagguaaccgagcauuua

SEQ ID NO: 1477580 - RNA, 19 nt, Homo sapiens
ugggaaacgugacacauau

SEQ ID NO: 1477581 - RNA, 19 nt, Homo sapiens
gauagcagcugggaaacgu

SEQ ID NO: 1477582 - RNA, 19 nt, Homo sapiens
ggcaggaaauuagacacua

SEQ ID NO: 1477583 - RNA, 19 nt, Homo sapiens
acagaacauuagccuuuaa

SEQ ID NO: 1477584 - RNA, 19 nt, Homo sapiens
gagaagauacauacacagu

SEQ ID NO: 1477585 - RNA, 19 nt, Homo sapiens
gcaaugaccuugagacuga

SEQ ID NO: 1477586 - RNA, 19 nt, Homo sapiens
uaaugaagcuggaauacaa

SEQ ID NO: 1477587 - RNA, 19 nt, Homo sapiens
caaagaagcgcccaacaaa

SEQ ID NO: 1477588 - RNA, 19 nt, Homo sapiens
caucuacccucccuguuua

SEQ ID NO: 1477589 - RNA, 19 nt, Homo sapiens
gacagacacugccaacgua

SEQ ID NO: 1477590 - RNA, 19 nt, Homo sapiens
gcuggaugcugaugaaauu

SEQ ID NO: 1477591 - RNA, 19 nt, Homo sapiens
caaccacacuggaagaaga

SEQ ID NO: 1477592 - RNA, 19 nt, Homo sapiens
ggagguagcaagaaugaaa

SEQ ID NO: 1477593 - RNA, 19 nt, Homo sapiens
ggaaggaaggcaacuguga

SEQ ID NO: 1477594 - RNA, 19 nt, Homo sapiens
ugaaauugcugccaaaugc

SEQ ID NO: 1477595 - RNA, 19 nt, Homo sapiens
gaauacaaccacuuacaga

SEQ ID NO: 1477596 - RNA, 19 nt, Homo sapiens
ccgcauagauucucugauc

SEQ ID NO: 1477597 - RNA, 19 nt, Homo sapiens
caccaucacuagguacuua

SEQ ID NO: 1477598 - RNA, 19 nt, Homo sapiens
aaugaucucuucuguauag

SEQ ID NO: 1477599 - RNA, 19 nt, Homo sapiens
gcaucuacccucccuguuu

SEQ ID NO: 1477600 - RNA, 19 nt, Homo sapiens
ucaguuuacucaucuguga

SEQ ID NO: 1477601 - RNA, 19 nt, Homo sapiens
gcuggaauacaaccacuua

SEQ ID NO: 1477602 - RNA, 19 nt, Homo sapiens
gaggauccuugauguggaa

SEQ ID NO: 1477603 - RNA, 19 nt, Homo sapiens
gcccggagccugcaacaaa

SEQ ID NO: 1477604 - RNA, 19 nt, Homo sapiens
ccaaagaagcgcccaacaa

SEQ ID NO: 1477605 - RNA, 19 nt, Homo sapiens
caacaaagacagaaucaac

SEQ ID NO: 1477606 - RNA, 19 nt, Homo sapiens
aggcagacuuggauucuaa

SEQ ID NO: 1477607 - RNA, 19 nt, Homo sapiens
gaaauaaugaagcuggaau

SEQ ID NO: 1477608 - RNA, 19 nt, Homo sapiens
gcaagugggaccuuaggaa

SEQ ID NO: 1477609 - RNA, 19 nt, Homo sapiens
aaagagcccugccggacuu

SEQ ID NO: 1477610 - RNA, 19 nt, Homo sapiens
ccaaagugcugggauuaca

SEQ ID NO: 1477611 - RNA, 19 nt, Homo sapiens
gaccuucuccgcauagauu

SEQ ID NO: 1477612 - RNA, 19 nt, Homo sapiens
aagaagcgcccaacaaaga

SEQ ID NO: 1477613 - RNA, 19 nt, Homo sapiens
guagauaccaaagggauuu

SEQ ID NO: 1477614 - RNA, 19 nt, Homo sapiens
gagaaggacccuacacaag

SEQ ID NO: 1477615 - RNA, 19 nt, Homo sapiens
gaggagguagcaagaauga

SEQ ID NO: 1477616 - RNA, 19 nt, Homo sapiens
ggacagacacugccaacgu

SEQ ID NO: 1477617 - RNA, 19 nt, Homo sapiens
gaagaggagguagcaagaa

SEQ ID NO: 1477618 - RNA, 19 nt, Homo sapiens
aaucuugucuccacucugu

SEQ ID NO: 1477619 - RNA, 19 nt, Homo sapiens
gcagcaaugccaacuacaa

SEQ ID NO: 1477620 - RNA, 19 nt, Homo sapiens
gagccucaguuuacucauc

SEQ ID NO: 1477621 - RNA, 19 nt, Homo sapiens
gaagucaggcagugaaguc

SEQ ID NO: 1477622 - RNA, 19 nt, Homo sapiens
caaagacagaaucaacauu

SEQ ID NO: 1477623 - RNA, 19 nt, Homo sapiens
aagaggagguagcaagaau

SEQ ID NO: 1477624 - RNA, 19 nt, Homo sapiens
gcagacuuggauucuaaua

SEQ ID NO: 1477625 - RNA, 19 nt, Homo sapiens
guuuaaagaaggaaucuga

SEQ ID NO: 1477626 - RNA, 19 nt, Homo sapiens
uacccucccuguuuaaaga

SEQ ID NO: 1477627 - RNA, 19 nt, Homo sapiens
gcugugaaaugacuguucu

SEQ ID NO: 1477628 - RNA, 19 nt, Homo sapiens
ugaugaaauugcugccaaa

SEQ ID NO: 1477629 - RNA, 19 nt, Homo sapiens
ucacagggaucagcuagag

SEQ ID NO: 1477630 - RNA, 19 nt, Homo sapiens
uagccaagauggucucgau

SEQ ID NO: 1477631 - RNA, 19 nt, Homo sapiens
ggaauacaaccacuuacag

SEQ ID NO: 1477632 - RNA, 19 nt, Homo sapiens
aagacagaaucaacauuug

SEQ ID NO: 1477633 - RNA, 19 nt, Homo sapiens
gcaacugugaggcuucuga

SEQ ID NO: 1477634 - RNA, 19 nt, Homo sapiens
uugauuaccuggucugauc

SEQ ID NO: 1477635 - RNA, 19 nt, Homo sapiens
gcaaucuugucuccacucu

SEQ ID NO: 1477636 - RNA, 19 nt, Homo sapiens
gugaaaugacuguucuaaa

SEQ ID NO: 1477637 - RNA, 19 nt, Homo sapiens
cuucugaguucacgccauu

SEQ ID NO: 1477638 - RNA, 19 nt, Homo sapiens
uacaaccacuuacagacuu

SEQ ID NO: 1477639 - RNA, 19 nt, Homo sapiens
caucacuagguacuuaaua

SEQ ID NO: 1477640 - RNA, 19 nt, Homo sapiens
gcagcucacagaccaguug

SEQ ID NO: 1477641 - RNA, 19 nt, Homo sapiens
ugaacagucuggccaagag

SEQ ID NO: 1477642 - RNA, 19 nt, Homo sapiens
guucuucucucaguuccaa

SEQ ID NO: 1477643 - RNA, 19 nt, Homo sapiens
ggaaauaaugaagcuggaa

SEQ ID NO: 1477644 - RNA, 19 nt, Homo sapiens
caacauuuggguaccuuug

SEQ ID NO: 1477645 - RNA, 19 nt, Homo sapiens
cuccugaccucgugauuca

SEQ ID NO: 1477646 - RNA, 19 nt, Homo sapiens
ugagaaggacccuacacaa

SEQ ID NO: 1477647 - RNA, 19 nt, Homo sapiens
agaccacucuugccuugau

SEQ ID NO: 1477648 - RNA, 19 nt, Homo sapiens
gauccuugauguggaagau

SEQ ID NO: 1477649 - RNA, 19 nt, Homo sapiens
ugaagaggagguagcaaga

SEQ ID NO: 1477650 - RNA, 19 nt, Homo sapiens
gaucucuuccuccuucaug

SEQ ID NO: 1477651 - RNA, 19 nt, Homo sapiens
caaagggauuuuaggauca

SEQ ID NO: 1477652 - RNA, 19 nt, Homo sapiens
caaccuccuccuguagaua

SEQ ID NO: 1477653 - RNA, 19 nt, Homo sapiens
uuaaagaaggaaucugaga

SEQ ID NO: 1477654 - RNA, 19 nt, Homo sapiens
uaccuggucugaucucucu

SEQ ID NO: 1477655 - RNA, 19 nt, Homo sapiens
gaaaugacuguucuaaaag

SEQ ID NO: 1477656 - RNA, 19 nt, Homo sapiens
gcaaugccaacuacaacca

SEQ ID NO: 1477657 - RNA, 19 nt, Homo sapiens
cguggcaagugggaccuua

SEQ ID NO: 1477658 - RNA, 19 nt, Homo sapiens
caggcagacuuggauucua

SEQ ID NO: 1477659 - RNA, 19 nt, Homo sapiens
caccucagccucccaaagu

SEQ ID NO: 1477660 - RNA, 19 nt, Homo sapiens
uauuugcuguugaugauag

SEQ ID NO: 1477661 - RNA, 19 nt, Homo sapiens
ccacuuacagacuucacaa

SEQ ID NO: 1477662 - RNA, 19 nt, Homo sapiens
guacccagaggcagcaaug

SEQ ID NO: 1477663 - RNA, 19 nt, Homo sapiens
uucacaaccuccuccugua

SEQ ID NO: 1477664 - RNA, 19 nt, Homo sapiens
cuacaaccacacuggaaga

SEQ ID NO: 1477665 - RNA, 19 nt, Homo sapiens
ugauagcaaugaccuugag

SEQ ID NO: 1477666 - RNA, 19 nt, Homo sapiens
gaccacucuugccuugaug

SEQ ID NO: 1477667 - RNA, 19 nt, Homo sapiens
gccuugugguuuguuguaa

SEQ ID NO: 1477668 - RNA, 19 nt, Homo sapiens
agacuuggauucuaauacc

SEQ ID NO: 1477669 - RNA, 19 nt, Homo sapiens
uguaagaagaccugaguuc

SEQ ID NO: 1477670 - RNA, 19 nt, Homo sapiens
ugccucagccucccgagua

SEQ ID NO: 1477671 - RNA, 19 nt, Homo sapiens
gaugaaauugcugccaaau

SEQ ID NO: 1477672 - RNA, 19 nt, Homo sapiens
uacaggagcaucucaagca

SEQ ID NO: 1477673 - RNA, 19 nt, Homo sapiens
ucacaaccuccuccuguag

SEQ ID NO: 1477674 - RNA, 19 nt, Homo sapiens
gaagcgcccaacaaagaca

SEQ ID NO: 1477675 - RNA, 19 nt, Homo sapiens
gaugguagggaacuauuuu

SEQ ID NO: 1477676 - RNA, 19 nt, Homo sapiens
ugugaaaugacuguucuaa

SEQ ID NO: 1477677 - RNA, 19 nt, Homo sapiens
ggucuccauuucucucucu

SEQ ID NO: 1477678 - RNA, 19 nt, Homo sapiens
ugugcuggaugcugaugaa

SEQ ID NO: 1477679 - RNA, 19 nt, Homo sapiens
acaaagacagaaucaacau

SEQ ID NO: 1477680 - RNA, 19 nt, Homo sapiens
aaagaagcgcccaacaaag

SEQ ID NO: 1477681 - RNA, 19 nt, Homo sapiens
ggucaggcagacuuggauu

SEQ ID NO: 1477682 - RNA, 19 nt, Homo sapiens
ggucuccguuucucuagcu

SEQ ID NO: 1477683 - RNA, 19 nt, Homo sapiens
caggaagucaggcagugaa

SEQ ID NO: 1477684 - RNA, 19 nt, Homo sapiens
ucccuuggugauuguauua

SEQ ID NO: 1477685 - RNA, 19 nt, Homo sapiens
caagagaucugaguccuuu

SEQ ID NO: 1477686 - RNA, 19 nt, Homo sapiens
ggaagaggcuuaccugaca

SEQ ID NO: 1477687 - RNA, 19 nt, Homo sapiens
gcacaggacuggauaaagg

SEQ ID NO: 1477688 - RNA, 19 nt, Homo sapiens
ggacaguggacaugaauuu

SEQ ID NO: 1477689 - RNA, 19 nt, Homo sapiens
gggaaggagugcuuucaaa

SEQ ID NO: 1477690 - RNA, 19 nt, Homo sapiens
gaacuguagaggcuaauaa

SEQ ID NO: 1477691 - RNA, 19 nt, Homo sapiens
ggagcuggcccaacucaua

SEQ ID NO: 1477692 - RNA, 19 nt, Homo sapiens
guagaaccuugggcaaaua

SEQ ID NO: 1477693 - RNA, 19 nt, Homo sapiens
guucugaccuggagauaga

SEQ ID NO: 1477694 - RNA, 19 nt, Homo sapiens
gaugaagaauucccuagau

SEQ ID NO: 1477695 - RNA, 19 nt, Homo sapiens
agagucagcucauuaaauc

SEQ ID NO: 1477696 - RNA, 19 nt, Homo sapiens
caucugaacuguuuuguaa

SEQ ID NO: 1477697 - RNA, 19 nt, Homo sapiens
ggaugugacuggagaagau

SEQ ID NO: 1477698 - RNA, 19 nt, Homo sapiens
cuacagagguaaauaugau

SEQ ID NO: 1477699 - RNA, 19 nt, Homo sapiens
caacuacaccuaugucaug

SEQ ID NO: 1477700 - RNA, 19 nt, Homo sapiens
gguaagagaagcaucugua

SEQ ID NO: 1477701 - RNA, 19 nt, Homo sapiens
uaagagaagcaucuguaua

SEQ ID NO: 1477702 - RNA, 19 nt, Homo sapiens
gaugggaacuauacaagag

SEQ ID NO: 1477703 - RNA, 19 nt, Homo sapiens
gaagaugggaacuauacaa

SEQ ID NO: 1477704 - RNA, 19 nt, Homo sapiens
caggaagacuugugaagau

SEQ ID NO: 1477705 - RNA, 19 nt, Homo sapiens
gaaaagagguaaggaagug

SEQ ID NO: 1477706 - RNA, 19 nt, Homo sapiens
ucauugagcccuauaagaa

SEQ ID NO: 1477707 - RNA, 19 nt, Homo sapiens
cgacaacuccuagguguuu

SEQ ID NO: 1477708 - RNA, 19 nt, Homo sapiens
caugguaugugaaagcauu

SEQ ID NO: 1477709 - RNA, 19 nt, Homo sapiens
gcaccuuccucuccugaug

SEQ ID NO: 1477710 - RNA, 19 nt, Homo sapiens
gaauuugaaugggaagaug

SEQ ID NO: 1477711 - RNA, 19 nt, Homo sapiens
gaaggaggcaggaagacuu

SEQ ID NO: 1477712 - RNA, 19 nt, Homo sapiens
caggagagucagcucauua

SEQ ID NO: 1477713 - RNA, 19 nt, Homo sapiens
ggaauggcaggaugaagaa

SEQ ID NO: 1477714 - RNA, 19 nt, Homo sapiens
gagagucagcucauuaaau

SEQ ID NO: 1477715 - RNA, 19 nt, Homo sapiens
gagcagcgcguagacauga

SEQ ID NO: 1477716 - RNA, 19 nt, Homo sapiens
gcaggaagacuugugaaga

SEQ ID NO: 1477717 - RNA, 19 nt, Homo sapiens
gaaccgcuguaugcccuuu

SEQ ID NO: 1477718 - RNA, 19 nt, Homo sapiens
uacaacagcugagacagaa

SEQ ID NO: 1477719 - RNA, 19 nt, Homo sapiens
ggacggaaggcugaaugua

SEQ ID NO: 1477720 - RNA, 19 nt, Homo sapiens
cuucaucaguuccaaauuc

SEQ ID NO: 1477721 - RNA, 19 nt, Homo sapiens
cuacaccuaugucauggaa

SEQ ID NO: 1477722 - RNA, 19 nt, Homo sapiens
ccucaaugcugucauccuu

SEQ ID NO: 1477723 - RNA, 19 nt, Homo sapiens
auaagaaaguccugucuca

SEQ ID NO: 1477724 - RNA, 19 nt, Homo sapiens
acuccuagguguuuaaaga

SEQ ID NO: 1477725 - RNA, 19 nt, Homo sapiens
ugaaugggaagaugaacua

SEQ ID NO: 1477726 - RNA, 19 nt, Homo sapiens
gaagaauucccuagauugc

SEQ ID NO: 1477727 - RNA, 19 nt, Homo sapiens
gagaagcaucuguauagga

SEQ ID NO: 1477728 - RNA, 19 nt, Homo sapiens
gacaacuccuagguguuua

SEQ ID NO: 1477729 - RNA, 19 nt, Homo sapiens
caguggacaugaauuugaa

SEQ ID NO: 1477730 - RNA, 19 nt, Homo sapiens
ugaagaauucccuagauug

SEQ ID NO: 1477731 - RNA, 19 nt, Homo sapiens
aagagaagcaucuguauag

SEQ ID NO: 1477732 - RNA, 19 nt, Homo sapiens
gaagguaagagaagcaucu

SEQ ID NO: 1477733 - RNA, 19 nt, Homo sapiens
gagcuggcccaacucauau

SEQ ID NO: 1477734 - RNA, 19 nt, Homo sapiens
aaaauuaccugcuuguuca

SEQ ID NO: 1477735 - RNA, 19 nt, Homo sapiens
gaaaauuaccugcuuguuc

SEQ ID NO: 1477736 - RNA, 19 nt, Homo sapiens
ccacggugauggccucaau

SEQ ID NO: 1477737 - RNA, 19 nt, Homo sapiens
gaaaggcugggccgagguu

SEQ ID NO: 1477738 - RNA, 19 nt, Homo sapiens
ugaagacccuaaaggagau

SEQ ID NO: 1477739 - RNA, 19 nt, Homo sapiens
agaauucccuagauugcuu

SEQ ID NO: 1477740 - RNA, 19 nt, Homo sapiens
ggcaaauaacuucaucuuu

SEQ ID NO: 1477741 - RNA, 19 nt, Homo sapiens
gcuggacaguggacaugaa

SEQ ID NO: 1477742 - RNA, 19 nt, Homo sapiens
ccuauccucugcucuguau

SEQ ID NO: 1477743 - RNA, 19 nt, Homo sapiens
guaagagaagcaucuguau

SEQ ID NO: 1477744 - RNA, 19 nt, Homo sapiens
aaacuuaacagcagguaau

SEQ ID NO: 1477745 - RNA, 19 nt, Homo sapiens
ggagagucagcucauuaaa

SEQ ID NO: 1477746 - RNA, 19 nt, Homo sapiens
gggcaaauaacuucaucuu

SEQ ID NO: 1477747 - RNA, 19 nt, Homo sapiens
gcuggauacgucaguguua

SEQ ID NO: 1477748 - RNA, 19 nt, Homo sapiens
ggaugaagaauucccuaga

SEQ ID NO: 1477749 - RNA, 19 nt, Homo sapiens
uguagaggcuaauaaacug

SEQ ID NO: 1477750 - RNA, 19 nt, Homo sapiens
guuccaaauucacacgaaa

SEQ ID NO: 1477751 - RNA, 19 nt, Homo sapiens
ccaccacgcccagcuaauu

SEQ ID NO: 1477752 - RNA, 19 nt, Homo sapiens
gguuguaugugggauguga

SEQ ID NO: 1477753 - RNA, 19 nt, Homo sapiens
acaccuaugucauggaaca

SEQ ID NO: 1477754 - RNA, 19 nt, Homo sapiens
gaagcagcauccccaacua

SEQ ID NO: 1477755 - RNA, 19 nt, Homo sapiens
augaagaauucccuagauu

SEQ ID NO: 1477756 - RNA, 19 nt, Homo sapiens
caacugcuacagagguaaa

SEQ ID NO: 1477757 - RNA, 19 nt, Homo sapiens
ccaggagagucagcucauu

SEQ ID NO: 1477758 - RNA, 19 nt, Homo sapiens
uguagaaccuugggcaaau

SEQ ID NO: 1477759 - RNA, 19 nt, Homo sapiens
gacggaaggcugaauguag

SEQ ID NO: 1477760 - RNA, 19 nt, Homo sapiens
cugaaucccugaaacaucu

SEQ ID NO: 1477761 - RNA, 19 nt, Homo sapiens
gaaaguccugucucaugga

SEQ ID NO: 1477762 - RNA, 19 nt, Homo sapiens
cgucugcucccaaacuuaa

SEQ ID NO: 1477763 - RNA, 19 nt, Homo sapiens
gcuacagagguaaauauga

SEQ ID NO: 1477764 - RNA, 19 nt, Homo sapiens
aagaaaguccugucucaug

SEQ ID NO: 1477765 - RNA, 19 nt, Homo sapiens
gagguuguaugugggaugu

SEQ ID NO: 1477766 - RNA, 19 nt, Homo sapiens
ugaggaggcuggcacuucu

SEQ ID NO: 1477767 - RNA, 19 nt, Homo sapiens
ggagcagcccugagacaug

SEQ ID NO: 1477768 - RNA, 19 nt, Homo sapiens
ccucugcucuguaucucaa

SEQ ID NO: 1477769 - RNA, 19 nt, Homo sapiens
gcaagagaucugaguccuu

SEQ ID NO: 1477770 - RNA, 19 nt, Homo sapiens
cuucggcccuucaucaguu

SEQ ID NO: 1477771 - RNA, 19 nt, Homo sapiens
gaguugcggcugagucuga

SEQ ID NO: 1477772 - RNA, 19 nt, Homo sapiens
cuacaacagcugagacaga

SEQ ID NO: 1477773 - RNA, 19 nt, Homo sapiens
ggaaggagugcuuucaaaa

SEQ ID NO: 1477774 - RNA, 19 nt, Homo sapiens
ccugaaacaucugaacugu

SEQ ID NO: 1477775 - RNA, 19 nt, Homo sapiens
aaagaaggaggcaggaaga

SEQ ID NO: 1477776 - RNA, 19 nt, Homo sapiens
gcccaaguuccaccucuaa

SEQ ID NO: 1477777 - RNA, 19 nt, Homo sapiens
ggcccaaguuccaccucua

SEQ ID NO: 1477778 - RNA, 19 nt, Homo sapiens
ucaguucccuugaucuuuu

SEQ ID NO: 1477779 - RNA, 19 nt, Homo sapiens
caccggaucuucacuucuc

SEQ ID NO: 1477780 - RNA, 19 nt, Homo sapiens
gcacaagcagggcccaagu

SEQ ID NO: 1477781 - RNA, 19 nt, Homo sapiens
cauugagcccuauaagaaa

SEQ ID NO: 1477782 - RNA, 19 nt, Homo sapiens
ugcagaagcaccagaacua

SEQ ID NO: 1477783 - RNA, 19 nt, Homo sapiens
gugaagaugggaacuauac

SEQ ID NO: 1477784 - RNA, 19 nt, Homo sapiens
gcagaagcaccagaacuag

SEQ ID NO: 1477785 - RNA, 19 nt, Homo sapiens
ggacaguggacaugaauuu

SEQ ID NO: 1477786 - RNA, 19 nt, Homo sapiens
ggagcuggcccaacucaua

SEQ ID NO: 1477787 - RNA, 19 nt, Homo sapiens
guucugaccuggagauaga

SEQ ID NO: 1477788 - RNA, 19 nt, Homo sapiens
ggaugugacuggagaagau

SEQ ID NO: 1477789 - RNA, 19 nt, Homo sapiens
caacuacaccuaugucaug

SEQ ID NO: 1477790 - RNA, 19 nt, Homo sapiens
ucauugagcccuauaagaa

SEQ ID NO: 1477791 - RNA, 19 nt, Homo sapiens
caugguaugugaaagcauu

SEQ ID NO: 1477792 - RNA, 19 nt, Homo sapiens
gcaccuuccucuccugaug

SEQ ID NO: 1477793 - RNA, 19 nt, Homo sapiens
gaauuugaaugggaagaug

SEQ ID NO: 1477794 - RNA, 19 nt, Homo sapiens
gagcagcgcguagacauga

SEQ ID NO: 1477795 - RNA, 19 nt, Homo sapiens
cuucaucaguuccaaauuc

SEQ ID NO: 1477796 - RNA, 19 nt, Homo sapiens
gaacuuacgcgaggguaga

SEQ ID NO: 1477797 - RNA, 19 nt, Homo sapiens
cuacaccuaugucauggaa

SEQ ID NO: 1477798 - RNA, 19 nt, Homo sapiens
ccucaaugcugucauccuu

SEQ ID NO: 1477799 - RNA, 19 nt, Homo sapiens
auaagaaaguccugucuca

SEQ ID NO: 1477800 - RNA, 19 nt, Homo sapiens
ugaaugggaagaugaacua

SEQ ID NO: 1477801 - RNA, 19 nt, Homo sapiens
caguggacaugaauuugaa

SEQ ID NO: 1477802 - RNA, 19 nt, Homo sapiens
gagcuggcccaacucauau

SEQ ID NO: 1477803 - RNA, 19 nt, Homo sapiens
aaaauuaccugcuuguuca

SEQ ID NO: 1477804 - RNA, 19 nt, Homo sapiens
gaaaauuaccugcuuguuc

SEQ ID NO: 1477805 - RNA, 19 nt, Homo sapiens
ccacggugauggccucaau

SEQ ID NO: 1477806 - RNA, 19 nt, Homo sapiens
gaaaggcugggccgagguu

SEQ ID NO: 1477807 - RNA, 19 nt, Homo sapiens
gaggguagagcacaagaug

SEQ ID NO: 1477808 - RNA, 19 nt, Homo sapiens
gcuggacaguggacaugaa

SEQ ID NO: 1477809 - RNA, 19 nt, Homo sapiens
gcuggauacgucaguguua

SEQ ID NO: 1477810 - RNA, 19 nt, Homo sapiens
guuccaaauucacacgaaa

SEQ ID NO: 1477811 - RNA, 19 nt, Homo sapiens
agauggaaauggagcagaa

SEQ ID NO: 1477812 - RNA, 19 nt, Homo sapiens
gguuguaugugggauguga

SEQ ID NO: 1477813 - RNA, 19 nt, Homo sapiens
acaccuaugucauggaaca

SEQ ID NO: 1477814 - RNA, 19 nt, Homo sapiens
gaagcagcauccccaacua

SEQ ID NO: 1477815 - RNA, 19 nt, Homo sapiens
guagagcacaagauggaaa

SEQ ID NO: 1477816 - RNA, 19 nt, Homo sapiens
gaaaguccugucucaugga

SEQ ID NO: 1477817 - RNA, 19 nt, Homo sapiens
ggguagagcacaagaugga

SEQ ID NO: 1477818 - RNA, 19 nt, Homo sapiens
aagaaaguccugucucaug

SEQ ID NO: 1477819 - RNA, 19 nt, Homo sapiens
gagguuguaugugggaugu

SEQ ID NO: 1477820 - RNA, 19 nt, Homo sapiens
cuucggcccuucaucaguu

SEQ ID NO: 1477821 - RNA, 19 nt, Homo sapiens
gaguugcggcugagucuga

SEQ ID NO: 1477822 - RNA, 19 nt, Homo sapiens
guagaagcaugcaaaagga

SEQ ID NO: 1477823 - RNA, 19 nt, Homo sapiens
ggucauggagcgauguaga

SEQ ID NO: 1477824 - RNA, 19 nt, Homo sapiens
gcccaaguuccaccucuaa

SEQ ID NO: 1477825 - RNA, 19 nt, Homo sapiens
ggcccaaguuccaccucua

SEQ ID NO: 1477826 - RNA, 19 nt, Homo sapiens
cgauguagaagcaugcaaa

SEQ ID NO: 1477827 - RNA, 19 nt, Homo sapiens
gcacaagcagggcccaagu

SEQ ID NO: 1477828 - RNA, 19 nt, Homo sapiens
cauugagcccuauaagaaa

SEQ ID NO: 1477829 - RNA, 19 nt, Homo sapiens
uuaccugcuuguucauuug

SEQ ID NO: 1477830 - RNA, 19 nt, Homo sapiens
uggaaaugauggagcuuca

SEQ ID NO: 1477831 - RNA, 19 nt, Homo sapiens
ccuguuaucuacccagaag

SEQ ID NO: 1477832 - RNA, 19 nt, Homo sapiens
ucaaugcugucauccuuuu

SEQ ID NO: 1477833 - RNA, 19 nt, Homo sapiens
acaguggacaugaauuuga

SEQ ID NO: 1477834 - RNA, 19 nt, Homo sapiens
ucuguaaucccagcacuuu

SEQ ID NO: 1477835 - RNA, 19 nt, Homo sapiens
gcacugcuucggcccuuca

SEQ ID NO: 1477836 - RNA, 19 nt, Homo sapiens
gacaguggacaugaauuug

SEQ ID NO: 1477837 - RNA, 19 nt, Homo sapiens
ggagcagcgcguagacaug

SEQ ID NO: 1477838 - RNA, 19 nt, Homo sapiens
ccagugagacagcugaaag

SEQ ID NO: 1477839 - RNA, 19 nt, Homo sapiens
gagcacaagauggaaaugg

SEQ ID NO: 1477840 - RNA, 19 nt, Homo sapiens
auuaccugcuuguucauuu

SEQ ID NO: 1477841 - RNA, 19 nt, Homo sapiens
gguauauggugggaacucu

SEQ ID NO: 1477842 - RNA, 19 nt, Homo sapiens
gauagacgaauuggagaca

SEQ ID NO: 1477843 - RNA, 19 nt, Homo sapiens
gauggaaauggagcagaaa

SEQ ID NO: 1477844 - RNA, 19 nt, Homo sapiens
gucauugagcccuauaaga

SEQ ID NO: 1477845 - RNA, 19 nt, Homo sapiens
caucaguuccaaauucaca

SEQ ID NO: 1477846 - RNA, 19 nt, Homo sapiens
gcaguucugaccuggagau

SEQ ID NO: 1477847 - RNA, 19 nt, Homo sapiens
ccuaugucauggaacacuu

SEQ ID NO: 1477848 - RNA, 19 nt, Homo sapiens
uggaggguguuccgaaugg

SEQ ID NO: 1477849 - RNA, 19 nt, Homo sapiens
agcacaagauggaaaugga

SEQ ID NO: 1477850 - RNA, 19 nt, Homo sapiens
cgaauuggagacaccuuca

SEQ ID NO: 1477851 - RNA, 19 nt, Homo sapiens
gucauggagcgauguagaa

SEQ ID NO: 1477852 - RNA, 19 nt, Homo sapiens
gggagcagcgcguagacau

SEQ ID NO: 1477853 - RNA, 19 nt, Homo sapiens
gagaaccaguuguuaaauu

SEQ ID NO: 1477854 - RNA, 19 nt, Homo sapiens
gcagaaagaugaggagaca

SEQ ID NO: 1477855 - RNA, 19 nt, Homo sapiens
gaaagcauccaucacagaa

SEQ ID NO: 1477856 - RNA, 19 nt, Homo sapiens
agacuagccuggccaauau

SEQ ID NO: 1477857 - RNA, 19 nt, Homo sapiens
gagacuagccuggccaaua

SEQ ID NO: 1477858 - RNA, 19 nt, Homo sapiens
cagacacucuuauuucauu

SEQ ID NO: 1477859 - RNA, 19 nt, Homo sapiens
gacuguguguuucauauuu

SEQ ID NO: 1477860 - RNA, 19 nt, Homo sapiens
gaaaccaagucagaugaga

SEQ ID NO: 1477861 - RNA, 19 nt, Homo sapiens
gcacaaaguccuccuugau

SEQ ID NO: 1477862 - RNA, 19 nt, Homo sapiens
caaggucuuuguccuagaa

SEQ ID NO: 1477863 - RNA, 19 nt, Homo sapiens
ugacugcugucucguggua

SEQ ID NO: 1477864 - RNA, 19 nt, Homo sapiens
ugagaggaauguaaggaaa

SEQ ID NO: 1477865 - RNA, 19 nt, Homo sapiens
cacaaaguccuccuugaua

SEQ ID NO: 1477866 - RNA, 19 nt, Homo sapiens
agaaccaguuguuaaauug

SEQ ID NO: 1477867 - RNA, 19 nt, Homo sapiens
gggaagggccugagaggaa

SEQ ID NO: 1477868 - RNA, 19 nt, Homo sapiens
ggaaagaggccccaaggua

SEQ ID NO: 1477869 - RNA, 19 nt, Homo sapiens
ggaaagcauccaucacaga

SEQ ID NO: 1477870 - RNA, 19 nt, Homo sapiens
ggaagggccugagaggaau

SEQ ID NO: 1477871 - RNA, 19 nt, Homo sapiens
ggaaagagaagugaacauc

SEQ ID NO: 1477872 - RNA, 19 nt, Homo sapiens
ggaaagugacggaaaccaa

SEQ ID NO: 1477873 - RNA, 19 nt, Homo sapiens
gagcaagaaauaauucaga

SEQ ID NO: 1477874 - RNA, 19 nt, Homo sapiens
guaguuggcaugaagugua

SEQ ID NO: 1477875 - RNA, 19 nt, Homo sapiens
ugagaugacugccauguac

SEQ ID NO: 1477876 - RNA, 19 nt, Homo sapiens
acaaaguccuccuugauag

SEQ ID NO: 1477877 - RNA, 19 nt, Homo sapiens
caucagaagucauguagcu

SEQ ID NO: 1477878 - RNA, 19 nt, Homo sapiens
ggguggaccuggcaucaga

SEQ ID NO: 1477879 - RNA, 19 nt, Homo sapiens
uaaaaccccgugucuauua

SEQ ID NO: 1477880 - RNA, 19 nt, Homo sapiens
ccuucgagcuugacucuga

SEQ ID NO: 1477881 - RNA, 19 nt, Homo sapiens
gagaagggcuuuuggucuu

SEQ ID NO: 1477882 - RNA, 19 nt, Homo sapiens
aaagagaagugaacaucca

SEQ ID NO: 1477883 - RNA, 19 nt, Homo sapiens
gcaggagaaucgcuugaac

SEQ ID NO: 1477884 - RNA, 19 nt, Homo sapiens
gagggaaagugacggaaac

SEQ ID NO: 1477885 - RNA, 19 nt, Homo sapiens
gaaaccagcccagaucagu

SEQ ID NO: 1477886 - RNA, 19 nt, Homo sapiens
gggcugagcaagaaauaau

SEQ ID NO: 1477887 - RNA, 19 nt, Homo sapiens
cagcguaguuggcaugaag

SEQ ID NO: 1477888 - RNA, 19 nt, Homo sapiens
ggaggaaugacacaaaugg

SEQ ID NO: 1477889 - RNA, 19 nt, Homo sapiens
guccagagccacugccuuu

SEQ ID NO: 1477890 - RNA, 19 nt, Homo sapiens
ggcacaaaguccuccuuga

SEQ ID NO: 1477891 - RNA, 19 nt, Homo sapiens
uagacuguguguuucauau

SEQ ID NO: 1477892 - RNA, 19 nt, Homo sapiens
auaccuagacuguguguuu

SEQ ID NO: 1477893 - RNA, 19 nt, Homo sapiens
ggaccuggcaucagaaguc

SEQ ID NO: 1477894 - RNA, 19 nt, Homo sapiens
cccagacacucuuauuuca

SEQ ID NO: 1477895 - RNA, 19 nt, Homo sapiens
ccgagaaccaguuguuaaa

SEQ ID NO: 1477896 - RNA, 19 nt, Homo sapiens
gccugaagcuauagugcaa

SEQ ID NO: 1477897 - RNA, 19 nt, Homo sapiens
cauguacacugcagucaag

SEQ ID NO: 1477898 - RNA, 19 nt, Homo sapiens
uguaggagcuccccaugua

SEQ ID NO: 1477899 - RNA, 19 nt, Homo sapiens
cugggugccugaagcuaua

SEQ ID NO: 1477900 - RNA, 19 nt, Homo sapiens
gcauccagcugagguccaa

SEQ ID NO: 1477901 - RNA, 19 nt, Homo sapiens
agaaagaugaggagacaga

SEQ ID NO: 1477902 - RNA, 19 nt, Homo sapiens
ugccauaccuagacugugu

SEQ ID NO: 1477903 - RNA, 19 nt, Homo sapiens
gguaaaaccccgugucuau

SEQ ID NO: 1477904 - RNA, 19 nt, Homo sapiens
gucaggaguucgagacuag

SEQ ID NO: 1477905 - RNA, 19 nt, Homo sapiens
gccagaguccuuuguccua

SEQ ID NO: 1477906 - RNA, 19 nt, Homo sapiens
gguccuacccucugucuag

SEQ ID NO: 1477907 - RNA, 19 nt, Homo sapiens
caggguggguuacauagca

SEQ ID NO: 1477908 - RNA, 19 nt, Homo sapiens
gcaccuguaaucccagcua

SEQ ID NO: 1477909 - RNA, 19 nt, Homo sapiens
gcuccugggcuacuucuug

SEQ ID NO: 1477910 - RNA, 19 nt, Homo sapiens
caaugccagguaugaauuu

SEQ ID NO: 1477911 - RNA, 19 nt, Homo sapiens
ucaaugccagguaugaauu

SEQ ID NO: 1477912 - RNA, 19 nt, Homo sapiens
gaccuggcaucagaaguca

SEQ ID NO: 1477913 - RNA, 19 nt, Homo sapiens
ggccaccugacccuaaaua

SEQ ID NO: 1477914 - RNA, 19 nt, Homo sapiens
ugacagagcaagacuccau

SEQ ID NO: 1477915 - RNA, 19 nt, Homo sapiens
ggacggucacauccaauca

SEQ ID NO: 1477916 - RNA, 19 nt, Homo sapiens
gagcuugcaggcauuagga

SEQ ID NO: 1477917 - RNA, 19 nt, Homo sapiens
gaacauccagccccaauca

SEQ ID NO: 1477918 - RNA, 19 nt, Homo sapiens
uagccuggccaauauggua

SEQ ID NO: 1477919 - RNA, 19 nt, Homo sapiens
aggccgagguggguagaua

SEQ ID NO: 1477920 - RNA, 19 nt, Homo sapiens
uaaggaaaccagcccagau

SEQ ID NO: 1477921 - RNA, 19 nt, Homo sapiens
gcugagguccaaggucuuu

SEQ ID NO: 1477922 - RNA, 19 nt, Homo sapiens
gcccgagaaccaguuguua

SEQ ID NO: 1477923 - RNA, 19 nt, Homo sapiens
gaagcuauagugcaauggu

SEQ ID NO: 1477924 - RNA, 19 nt, Homo sapiens
cagcagugcggucagagaa

SEQ ID NO: 1477925 - RNA, 19 nt, Homo sapiens
ggucuuuguccuagaauca

SEQ ID NO: 1477926 - RNA, 19 nt, Homo sapiens
cacgguggcucacgcuugu

SEQ ID NO: 1477927 - RNA, 19 nt, Homo sapiens
guggccaccugacccuaaa

SEQ ID NO: 1477928 - RNA, 19 nt, Homo sapiens
ccaaggucuuuguccuaga

SEQ ID NO: 1477929 - RNA, 19 nt, Homo sapiens
cugaagcuauagugcaaug

SEQ ID NO: 1477930 - RNA, 19 nt, Homo sapiens
gcugagcaagaaauaauuc

SEQ ID NO: 1477931 - RNA, 19 nt, Homo sapiens
aagcuauagugcaaugguu

SEQ ID NO: 1477932 - RNA, 19 nt, Homo sapiens
guccaggguggguuacaua

SEQ ID NO: 1477933 - RNA, 19 nt, Homo sapiens
cccgagaaccaguuguuaa

SEQ ID NO: 1477934 - RNA, 19 nt, Homo sapiens
agacacucuuauuucauug

SEQ ID NO: 1477935 - RNA, 19 nt, Homo sapiens
gaugagaugacugccaugu

SEQ ID NO: 1477936 - RNA, 19 nt, Homo sapiens
cggaaaccaagucagauga

SEQ ID NO: 1477937 - RNA, 19 nt, Homo sapiens
gggccugagaggaauguaa

SEQ ID NO: 1477938 - RNA, 19 nt, Homo sapiens
uaugaagggcucuggaugu

SEQ ID NO: 1477939 - RNA, 19 nt, Homo sapiens
ggaaaccaagucagaugag

SEQ ID NO: 1477940 - RNA, 19 nt, Homo sapiens
uguccuacaucucccugaa

SEQ ID NO: 1477941 - RNA, 19 nt, Homo sapiens
guccaaggucuuuguccua

SEQ ID NO: 1477942 - RNA, 19 nt, Homo sapiens
caagcacaccugucaaugc

SEQ ID NO: 1477943 - RNA, 19 nt, Homo sapiens
uccaccaccugccuuguga

SEQ ID NO: 1477944 - RNA, 19 nt, Homo sapiens
ggagacagcaaccccauug

SEQ ID NO: 1477945 - RNA, 19 nt, Homo sapiens
cuuguaaucccagcacuuu

SEQ ID NO: 1477946 - RNA, 19 nt, Homo sapiens
gggaggaaugacacaaaug

SEQ ID NO: 1477947 - RNA, 19 nt, Homo sapiens
gggagggcguuaggagcuu

SEQ ID NO: 1477948 - RNA, 19 nt, Homo sapiens
gccuuggccuuggcacaaa

SEQ ID NO: 1477949 - RNA, 19 nt, Homo sapiens
cgagaaccaguuguuaaau

SEQ ID NO: 1477950 - RNA, 19 nt, Homo sapiens
cacaaugccuaggcuccaa

SEQ ID NO: 1477951 - RNA, 19 nt, Homo sapiens
cagaguccuuuguccuaca

SEQ ID NO: 1477952 - RNA, 19 nt, Homo sapiens
gucaaugccagguaugaau

SEQ ID NO: 1477953 - RNA, 19 nt, Homo sapiens
gaaugcagaugauagcaaa

SEQ ID NO: 1477954 - RNA, 19 nt, Homo sapiens
ggagaguucugcuguuuga

SEQ ID NO: 1477955 - RNA, 19 nt, Homo sapiens
gaugauagcaaacugauuu

SEQ ID NO: 1477956 - RNA, 19 nt, Homo sapiens
gaaaugggauguuuaagcu

SEQ ID NO: 1477957 - RNA, 19 nt, Homo sapiens
gcgcaaaguucuuaauaau

SEQ ID NO: 1477958 - RNA, 19 nt, Homo sapiens
ccacauggaugaaccuuga

SEQ ID NO: 1477959 - RNA, 19 nt, Homo sapiens
ggaugaaccuugaggaugu

SEQ ID NO: 1477960 - RNA, 19 nt, Homo sapiens
ggaagggaauucugcaaug

SEQ ID NO: 1477961 - RNA, 19 nt, Homo sapiens
ucaaggagauugcagauuc

SEQ ID NO: 1477962 - RNA, 19 nt, Homo sapiens
gaagaggcauauuccauca

SEQ ID NO: 1477963 - RNA, 19 nt, Homo sapiens
gaacaucucaagccugaaa

SEQ ID NO: 1477964 - RNA, 19 nt, Homo sapiens
caucagagauacaccuaaa

SEQ ID NO: 1477965 - RNA, 19 nt, Homo sapiens
aaagauaaguacaguguga

SEQ ID NO: 1477966 - RNA, 19 nt, Homo sapiens
caaacacccuggaacuauu

SEQ ID NO: 1477967 - RNA, 19 nt, Homo sapiens
cagagagccugauugaauu

SEQ ID NO: 1477968 - RNA, 19 nt, Homo sapiens
gaaugaggaaugauuguuu

SEQ ID NO: 1477969 - RNA, 19 nt, Homo sapiens
gaagggaauucugcaaugu

SEQ ID NO: 1477970 - RNA, 19 nt, Homo sapiens
caccaucuauugacuauga

SEQ ID NO: 1477971 - RNA, 19 nt, Homo sapiens
agaaggaauucaaugagua

SEQ ID NO: 1477972 - RNA, 19 nt, Homo sapiens
caaagaauacucuguuaga

SEQ ID NO: 1477973 - RNA, 19 nt, Homo sapiens
ccaacaauaucuucuacuu

SEQ ID NO: 1477974 - RNA, 19 nt, Homo sapiens
gcucagacgcugcauguuu

SEQ ID NO: 1477975 - RNA, 19 nt, Homo sapiens
gcagagcaaugauccaagu

SEQ ID NO: 1477976 - RNA, 19 nt, Homo sapiens
ggaacaauacccugccuaa

SEQ ID NO: 1477977 - RNA, 19 nt, Homo sapiens
ggaaagagagagacagaau

SEQ ID NO: 1477978 - RNA, 19 nt, Homo sapiens
gaucaugucagccguggua

SEQ ID NO: 1477979 - RNA, 19 nt, Homo sapiens
gaugauauacguucuuuca

SEQ ID NO: 1477980 - RNA, 19 nt, Homo sapiens
uaggaaaucaucagagaua

SEQ ID NO: 1477981 - RNA, 19 nt, Homo sapiens
aacaugaacuguacacuug

SEQ ID NO: 1477982 - RNA, 19 nt, Homo sapiens
ggcaauggcugcacaacau

SEQ ID NO: 1477983 - RNA, 19 nt, Homo sapiens
uaaauaaggccaaccacaa

SEQ ID NO: 1477984 - RNA, 19 nt, Homo sapiens
caucaccauuuaugaauug

SEQ ID NO: 1477985 - RNA, 19 nt, Homo sapiens
gaacaauacccugccuaaa

SEQ ID NO: 1477986 - RNA, 19 nt, Homo sapiens
uaaauuguccuuccauuca

SEQ ID NO: 1477987 - RNA, 19 nt, Homo sapiens
aagauucgcucaauugugu

SEQ ID NO: 1477988 - RNA, 19 nt, Homo sapiens
gggaagauucgcucaauug

SEQ ID NO: 1477989 - RNA, 19 nt, Homo sapiens
uguuuaagcuucuccguuu

SEQ ID NO: 1477990 - RNA, 19 nt, Homo sapiens
guacaacguuuucaccaua

SEQ ID NO: 1477991 - RNA, 19 nt, Homo sapiens
gcagucagaaucacaaaga

SEQ ID NO: 1477992 - RNA, 19 nt, Homo sapiens
gaaagagagagacagaaug

SEQ ID NO: 1477993 - RNA, 19 nt, Homo sapiens
ucaaagagccuggauguca

SEQ ID NO: 1477994 - RNA, 19 nt, Homo sapiens
agucaaaucuugucuacug

SEQ ID NO: 1477995 - RNA, 19 nt, Homo sapiens
gcaauaccaugaguacaca

SEQ ID NO: 1477996 - RNA, 19 nt, Homo sapiens
ccuaggaaaucaucagaga

SEQ ID NO: 1477997 - RNA, 19 nt, Homo sapiens
uaucuuugcuguuggauca

SEQ ID NO: 1477998 - RNA, 19 nt, Homo sapiens
ucacccuucucauaaagua

SEQ ID NO: 1477999 - RNA, 19 nt, Homo sapiens
ggagaguguuccuuuagca

SEQ ID NO: 1478000 - RNA, 19 nt, Homo sapiens
caaagagccuggaugucau

SEQ ID NO: 1478001 - RNA, 19 nt, Homo sapiens
cagaaggaauucaaugagu

SEQ ID NO: 1478002 - RNA, 19 nt, Homo sapiens
cuacuucgaugaacagauc

SEQ ID NO: 1478003 - RNA, 19 nt, Homo sapiens
gagagaaacgaaagcagaa

SEQ ID NO: 1478004 - RNA, 19 nt, Homo sapiens
ggaauucugcaaugugcua

SEQ ID NO: 1478005 - RNA, 19 nt, Homo sapiens
cgagagauaucggcguuug

SEQ ID NO: 1478006 - RNA, 19 nt, Homo sapiens
ggacacacagggaagauuc

SEQ ID NO: 1478007 - RNA, 19 nt, Homo sapiens
aaccugccaucaccauuua

SEQ ID NO: 1478008 - RNA, 19 nt, Homo sapiens
uaacaugaacuguacacuu

SEQ ID NO: 1478009 - RNA, 19 nt, Homo sapiens
gauugcagauuccuugauc

SEQ ID NO: 1478010 - RNA, 19 nt, Homo sapiens
aaacuacgccucaugaauc

SEQ ID NO: 1478011 - RNA, 19 nt, Homo sapiens
gacaaacuacgccucauga

SEQ ID NO: 1478012 - RNA, 19 nt, Homo sapiens
ucaaggaaccuaccaaugg

SEQ ID NO: 1478013 - RNA, 19 nt, Homo sapiens
gagcuucaguccacaggau

SEQ ID NO: 1478014 - RNA, 19 nt, Homo sapiens
gaaaguguccggguugcuu

SEQ ID NO: 1478015 - RNA, 19 nt, Homo sapiens
ccauucacccuucucauaa

SEQ ID NO: 1478016 - RNA, 19 nt, Homo sapiens
gacgucaccuccagaguca

SEQ ID NO: 1478017 - RNA, 19 nt, Homo sapiens
gaucagaccacacccucaa

SEQ ID NO: 1478018 - RNA, 19 nt, Homo sapiens
ggaaaugggauguuuaagc

SEQ ID NO: 1478019 - RNA, 19 nt, Homo sapiens
aaauaaggccaaccacaaa

SEQ ID NO: 1478020 - RNA, 19 nt, Homo sapiens
gaggauguuaugcuaaauu

SEQ ID NO: 1478021 - RNA, 19 nt, Homo sapiens
gcagaugauagcaaacuga

SEQ ID NO: 1478022 - RNA, 19 nt, Homo sapiens
gaguguuccuuuagcaaug

SEQ ID NO: 1478023 - RNA, 19 nt, Homo sapiens
ccauccgccuuuggaauua

SEQ ID NO: 1478024 - RNA, 19 nt, Homo sapiens
gaaucgacacucagaacaa

SEQ ID NO: 1478025 - RNA, 19 nt, Homo sapiens
gaucccacguggccaacaa

SEQ ID NO: 1478026 - RNA, 19 nt, Homo sapiens
ccauagcccugaagauugg

SEQ ID NO: 1478027 - RNA, 19 nt, Homo sapiens
cagaaugcgugcucaaguc

SEQ ID NO: 1478028 - RNA, 19 nt, Homo sapiens
aacgaaagcagaacuguuu

SEQ ID NO: 1478029 - RNA, 19 nt, Homo sapiens
gaagauucgcucaauugug

SEQ ID NO: 1478030 - RNA, 19 nt, Homo sapiens
caaacuacgccucaugaau

SEQ ID NO: 1478031 - RNA, 19 nt, Homo sapiens
guucuccacucccuuccua

SEQ ID NO: 1478032 - RNA, 19 nt, Homo sapiens
gaagagucagggcauguug

SEQ ID NO: 1478033 - RNA, 19 nt, Homo sapiens
ggaaugaggaaugauuguu

SEQ ID NO: 1478034 - RNA, 19 nt, Homo sapiens
guaaauuguccuuccauuc

SEQ ID NO: 1478035 - RNA, 19 nt, Homo sapiens
ccacgagccuagagaacau

SEQ ID NO: 1478036 - RNA, 19 nt, Homo sapiens
ccaucaccauuuaugaauu

SEQ ID NO: 1478037 - RNA, 19 nt, Homo sapiens
caugaacuguacacuugaa

SEQ ID NO: 1478038 - RNA, 19 nt, Homo sapiens
cuacggcguuugaaagugu

SEQ ID NO: 1478039 - RNA, 19 nt, Homo sapiens
ggaagauucgcucaauugu

SEQ ID NO: 1478040 - RNA, 19 nt, Homo sapiens
guacaauguggaucagaaa

SEQ ID NO: 1478041 - RNA, 19 nt, Homo sapiens
caacaauaucuucuacuuc

SEQ ID NO: 1478042 - RNA, 19 nt, Homo sapiens
gaaccuugaggauguuaug

SEQ ID NO: 1478043 - RNA, 19 nt, Homo sapiens
cauucacccuucucauaaa

SEQ ID NO: 1478044 - RNA, 19 nt, Homo sapiens
gaaccauucgugccaugaa

SEQ ID NO: 1478045 - RNA, 19 nt, Homo sapiens
caauguggaucagaaaugg

SEQ ID NO: 1478046 - RNA, 19 nt, Homo sapiens
cagauggugcuguguauga

SEQ ID NO: 1478047 - RNA, 19 nt, Homo sapiens
cuuccaaguucagaaauuu

SEQ ID NO: 1478048 - RNA, 19 nt, Homo sapiens
gaugaaccuugaggauguu

SEQ ID NO: 1478049 - RNA, 19 nt, Homo sapiens
ccaggaauuuagccuagga

SEQ ID NO: 1478050 - RNA, 19 nt, Homo sapiens
ggaaugcagaugauagcaa

SEQ ID NO: 1478051 - RNA, 19 nt, Homo sapiens
caccauuuaugaauuguca

SEQ ID NO: 1478052 - RNA, 19 nt, Homo sapiens
aaaccugccaucaccauuu

SEQ ID NO: 1478053 - RNA, 19 nt, Homo sapiens
caggagauauuccagauga

SEQ ID NO: 1478054 - RNA, 19 nt, Homo sapiens
uggcagagcuaaaggaaca

SEQ ID NO: 1478055 - RNA, 19 nt, Homo sapiens
caacugaacguguccaaca

SEQ ID NO: 1478056 - RNA, 19 nt, Homo sapiens
agacaggaauagaaauuuc

SEQ ID NO: 1478057 - RNA, 19 nt, Homo sapiens
cagcagcggucacagagau

SEQ ID NO: 1478058 - RNA, 19 nt, Homo sapiens
gagacaggaauagaaauuu

SEQ ID NO: 1478059 - RNA, 19 nt, Homo sapiens
ucagagacaggaauagaaa

SEQ ID NO: 1478060 - RNA, 19 nt, Homo sapiens
aagcuuggguccaguauag

SEQ ID NO: 1478061 - RNA, 19 nt, Homo sapiens
gggcaucggucccaagcau

SEQ ID NO: 1478062 - RNA, 19 nt, Homo sapiens
gaggagcccaggugugauu

SEQ ID NO: 1478063 - RNA, 19 nt, Homo sapiens
ggagauauuccagaugaga

SEQ ID NO: 1478064 - RNA, 19 nt, Homo sapiens
cagaagagagcgccaagga

SEQ ID NO: 1478065 - RNA, 19 nt, Homo sapiens
gcaccaccgccucuccuaa

SEQ ID NO: 1478066 - RNA, 19 nt, Homo sapiens
ccagccagcuucagaucug

SEQ ID NO: 1478067 - RNA, 19 nt, Homo sapiens
gagcuaaaggaacagaaga

SEQ ID NO: 1478068 - RNA, 19 nt, Homo sapiens
ggugugauuugccagaaca

SEQ ID NO: 1478069 - RNA, 19 nt, Homo sapiens
gcucagagacaggaauaga

SEQ ID NO: 1478070 - RNA, 19 nt, Homo sapiens
gaacguguccaacauugac

SEQ ID NO: 1478071 - RNA, 19 nt, Homo sapiens
gguucccacugccuaguuu

SEQ ID NO: 1478072 - RNA, 19 nt, Homo sapiens
agagacaggaauagaaauu

SEQ ID NO: 1478073 - RNA, 19 nt, Homo sapiens
acagagaucucagcaucau

SEQ ID NO: 1478074 - RNA, 19 nt, Homo sapiens
cugaacguguccaacauug

SEQ ID NO: 1478075 - RNA, 19 nt, Homo sapiens
gacaggaauagaaauuuca

SEQ ID NO: 1478076 - RNA, 19 nt, Homo sapiens
ugccagaacaggagauauu

SEQ ID NO: 1478077 - RNA, 19 nt, Homo sapiens
gacgcgaagugaagaggau

SEQ ID NO: 1478078 - RNA, 19 nt, Homo sapiens
cacagcagccgcucagaga

SEQ ID NO: 1478079 - RNA, 19 nt, Homo sapiens
cgaguaggcucuggcuucu

SEQ ID NO: 1478080 - RNA, 19 nt, Homo sapiens
caccaccgccucuccuaaa

SEQ ID NO: 1478081 - RNA, 19 nt, Homo sapiens
gcaucggucccaagcauca

SEQ ID NO: 1478082 - RNA, 19 nt, Homo sapiens
agagaucucagcaucauca

SEQ ID NO: 1478083 - RNA, 19 nt, Homo sapiens
aacaggagauauuccagau

SEQ ID NO: 1478084 - RNA, 19 nt, Homo sapiens
uacgggcacugcuccaaga

SEQ ID NO: 1478085 - RNA, 19 nt, Homo sapiens
caucaaggaccaacugaac

SEQ ID NO: 1478086 - RNA, 19 nt, Homo sapiens
uggaggagcccagguguga

SEQ ID NO: 1478087 - RNA, 19 nt, Homo sapiens
gccuggaagaggaguauuu

SEQ ID NO: 1478088 - RNA, 19 nt, Homo sapiens
caagcuuggguccaguaua

SEQ ID NO: 1478089 - RNA, 19 nt, Homo sapiens
gagcgacgcgaagugaaga

SEQ ID NO: 1478090 - RNA, 19 nt, Homo sapiens
ggagcgacgcgaagugaag

SEQ ID NO: 1478091 - RNA, 19 nt, Homo sapiens
ccgcucagagacaggaaua

SEQ ID NO: 1478092 - RNA, 19 nt, Homo sapiens
cauuccagccugacucuug

SEQ ID NO: 1478093 - RNA, 19 nt, Homo sapiens
caaaggccuggcagacaga

SEQ ID NO: 1478094 - RNA, 19 nt, Homo sapiens
gagcccaggugugauuugc

SEQ ID NO: 1478095 - RNA, 19 nt, Homo sapiens
caggugugauuugccagaa

SEQ ID NO: 1478096 - RNA, 19 nt, Homo sapiens
ucccaggccuccacaaagg

SEQ ID NO: 1478097 - RNA, 19 nt, Homo sapiens
gcuaaaggaacagaagaag

SEQ ID NO: 1478098 - RNA, 19 nt, Homo sapiens
gcagagcuaaaggaacaga

SEQ ID NO: 1478099 - RNA, 19 nt, Homo sapiens
caucaucaaggaccaacug

SEQ ID NO: 1478100 - RNA, 19 nt, Homo sapiens
uaccaaugcuuucuuguuu

SEQ ID NO: 1478101 - RNA, 19 nt, Homo sapiens
cagcacaucuucacuggaa

SEQ ID NO: 1478102 - RNA, 19 nt, Homo sapiens
ggucucacuuggacuauuu

SEQ ID NO: 1478103 - RNA, 19 nt, Homo sapiens
cagcaaguguccaugagua

SEQ ID NO: 1478104 - RNA, 19 nt, Homo sapiens
gcaggagauucgagaacua

SEQ ID NO: 1478105 - RNA, 19 nt, Homo sapiens
ccaaugcuuucuuguuuga

SEQ ID NO: 1478106 - RNA, 19 nt, Homo sapiens
cagaagagaugaggguuug

SEQ ID NO: 1478107 - RNA, 19 nt, Homo sapiens
gcaguuggcuuugcugauc

SEQ ID NO: 1478108 - RNA, 19 nt, Homo sapiens
gaagaucucacagaccuaa

SEQ ID NO: 1478109 - RNA, 19 nt, Homo sapiens
acucagcgcuucugcauug

SEQ ID NO: 1478110 - RNA, 19 nt, Homo sapiens
gacauugggucuagaagca

SEQ ID NO: 1478111 - RNA, 19 nt, Homo sapiens
caaagcaggagcagguuaa

SEQ ID NO: 1478112 - RNA, 19 nt, Homo sapiens
cgacccaagugaugacauu

SEQ ID NO: 1478113 - RNA, 19 nt, Homo sapiens
ccuacuauguaacagauaa

SEQ ID NO: 1478114 - RNA, 19 nt, Homo sapiens
gauccucacaucucuauga

SEQ ID NO: 1478115 - RNA, 19 nt, Homo sapiens
uaugaaguccuacuaugua

SEQ ID NO: 1478116 - RNA, 19 nt, Homo sapiens
ccucacaucucuaugaagu

SEQ ID NO: 1478117 - RNA, 19 nt, Homo sapiens
agaagcaucuagcaguuga

SEQ ID NO: 1478118 - RNA, 19 nt, Homo sapiens
gcagagaucaauccagcaa

SEQ ID NO: 1478119 - RNA, 19 nt, Homo sapiens
gcgagaggcagaacuuuau

SEQ ID NO: 1478120 - RNA, 19 nt, Homo sapiens
ggcgagaggcagaacuuua

SEQ ID NO: 1478121 - RNA, 19 nt, Homo sapiens
ucaccacaguucugacuug

SEQ ID NO: 1478122 - RNA, 19 nt, Homo sapiens
gaaguccuacuauguaaca

SEQ ID NO: 1478123 - RNA, 19 nt, Homo sapiens
gggccuauuuccagaccua

SEQ ID NO: 1478124 - RNA, 19 nt, Homo sapiens
gaucagcgggugcuaagug

SEQ ID NO: 1478125 - RNA, 19 nt, Homo sapiens
ggauuugggugcaacuaag

SEQ ID NO: 1478126 - RNA, 19 nt, Homo sapiens
ggagcagguuaacuugguu

SEQ ID NO: 1478127 - RNA, 19 nt, Homo sapiens
uaacggccagccuuuauug

SEQ ID NO: 1478128 - RNA, 19 nt, Homo sapiens
guacagacacuggcagaga

SEQ ID NO: 1478129 - RNA, 19 nt, Homo sapiens
ccaagugaauguggagaug

SEQ ID NO: 1478130 - RNA, 19 nt, Homo sapiens
gcuaacggccagccuuuau

SEQ ID NO: 1478131 - RNA, 19 nt, Homo sapiens
cagguuaacuugguucaca

SEQ ID NO: 1478132 - RNA, 19 nt, Homo sapiens
gcaggagcagguuaacuug

SEQ ID NO: 1478133 - RNA, 19 nt, Homo sapiens
ucuaugaaguccuacuaug

SEQ ID NO: 1478134 - RNA, 19 nt, Homo sapiens
gggcuggccuggucauuuu

SEQ ID NO: 1478135 - RNA, 19 nt, Homo sapiens
gaacucuggcugccgaaau

SEQ ID NO: 1478136 - RNA, 19 nt, Homo sapiens
gagccgacgccuccaaguu

SEQ ID NO: 1478137 - RNA, 19 nt, Homo sapiens
ucaaagcaggagcagguua

SEQ ID NO: 1478138 - RNA, 19 nt, Homo sapiens
caguaucuuuggucuguga

SEQ ID NO: 1478139 - RNA, 19 nt, Homo sapiens
agaugcagcuguacagaca

SEQ ID NO: 1478140 - RNA, 19 nt, Homo sapiens
ccuugaggcuuccuggauu

SEQ ID NO: 1478141 - RNA, 19 nt, Homo sapiens
agagaucaauccagcaagu

SEQ ID NO: 1478142 - RNA, 19 nt, Homo sapiens
caagaucagcgggugcuaa

SEQ ID NO: 1478143 - RNA, 19 nt, Homo sapiens
gcaucuagcaguugaguac

SEQ ID NO: 1478144 - RNA, 19 nt, Homo sapiens
guucugacauugggucuag

SEQ ID NO: 1478145 - RNA, 19 nt, Homo sapiens
gcuggugaaugcaagagau

SEQ ID NO: 1478146 - RNA, 19 nt, Homo sapiens
gcacaggacuggggccuau

SEQ ID NO: 1478147 - RNA, 19 nt, Homo sapiens
augaaguccuacuauguaa

SEQ ID NO: 1478148 - RNA, 19 nt, Homo sapiens
gacacggccuuuccucucu

SEQ ID NO: 1478149 - RNA, 19 nt, Homo sapiens
gcuagggacaccacagcua

SEQ ID NO: 1478150 - RNA, 19 nt, Homo sapiens
gaaaucuuggccuugcaaa

SEQ ID NO: 1478151 - RNA, 19 nt, Homo sapiens
ggagauucgagaacuacaa

SEQ ID NO: 1478152 - RNA, 19 nt, Homo sapiens
caucaucaguaucuuuggu

SEQ ID NO: 1478153 - RNA, 19 nt, Homo sapiens
ucgcagacccgcagaggaa

SEQ ID NO: 1478154 - RNA, 19 nt, Homo sapiens
uucuguaccucuucuguuu

SEQ ID NO: 1478155 - RNA, 19 nt, Homo sapiens
uguaacagauaaggaaauc

SEQ ID NO: 1478156 - RNA, 19 nt, Homo sapiens
ggacaccacagcuacacau

SEQ ID NO: 1478157 - RNA, 19 nt, Homo sapiens
gagaggcagaacuuuauuc

SEQ ID NO: 1478158 - RNA, 19 nt, Homo sapiens
gcggcuaucccuacaggaa

SEQ ID NO: 1478159 - RNA, 19 nt, Homo sapiens
gcuuuaccaccucccguua

SEQ ID NO: 1478160 - RNA, 19 nt, Homo sapiens
gacaccacagcuacacaua

SEQ ID NO: 1478161 - RNA, 19 nt, Homo sapiens
cuugaggcuuccuggauuu

SEQ ID NO: 1478162 - RNA, 19 nt, Homo sapiens
gaucucacagaccuaauag

SEQ ID NO: 1478163 - RNA, 19 nt, Homo sapiens
cuauguaacagauaaggaa

SEQ ID NO: 1478164 - RNA, 19 nt, Homo sapiens
uacagacacuggcagagau

SEQ ID NO: 1478165 - RNA, 19 nt, Homo sapiens
caagagaugcagcuguaca

SEQ ID NO: 1478166 - RNA, 19 nt, Homo sapiens
ggcuaucccuacaggaaau

SEQ ID NO: 1478167 - RNA, 19 nt, Homo sapiens
ccgcuccucagcucuguua

SEQ ID NO: 1478168 - RNA, 19 nt, Homo sapiens
ccuaauagacacggccuuu

SEQ ID NO: 1478169 - RNA, 19 nt, Homo sapiens
aaucuuggccuugcaaaug

SEQ ID NO: 1478170 - RNA, 19 nt, Homo sapiens
uuaacuugguucacagugu

SEQ ID NO: 1478171 - RNA, 19 nt, Homo sapiens
guccuacuauguaacagau

SEQ ID NO: 1478172 - RNA, 19 nt, Homo sapiens
gaacaaugaccagaaaccu

SEQ ID NO: 1478173 - RNA, 19 nt, Homo sapiens
gcgcuuggaggcagaaauc

SEQ ID NO: 1478174 - RNA, 19 nt, Homo sapiens
cagguuuacuacuccaugu

SEQ ID NO: 1478175 - RNA, 19 nt, Homo sapiens
caagugaauguggagauga

SEQ ID NO: 1478176 - RNA, 19 nt, Homo sapiens
cuaugaaguccuacuaugu

SEQ ID NO: 1478177 - RNA, 19 nt, Homo sapiens
agaucucacagaccuaaua

SEQ ID NO: 1478178 - RNA, 19 nt, Homo sapiens
uuaccaaugcuuucuuguu

SEQ ID NO: 1478179 - RNA, 19 nt, Homo sapiens
ccucaucaucaguaucuuu

SEQ ID NO: 1478180 - RNA, 19 nt, Homo sapiens
ccacccucaucaucaguau

SEQ ID NO: 1478181 - RNA, 19 nt, Homo sapiens
gcacgcgauggacgggaua

SEQ ID NO: 1478182 - RNA, 19 nt, Homo sapiens
cgagaggcagaacuuuauu

SEQ ID NO: 1478183 - RNA, 19 nt, Homo sapiens
ggagcacaggcaucaguug

SEQ ID NO: 1478184 - RNA, 19 nt, Homo sapiens
cugcaggucuuggcugguu

SEQ ID NO: 1478185 - RNA, 19 nt, Homo sapiens
gagauucgagaacuacaag

SEQ ID NO: 1478186 - RNA, 19 nt, Homo sapiens
ggauuaaaugaguuuguca

SEQ ID NO: 1478187 - RNA, 19 nt, Homo sapiens
acagaagagaugaggguuu

SEQ ID NO: 1478188 - RNA, 19 nt, Homo sapiens
acaucucuaugaaguccua

SEQ ID NO: 1478189 - RNA, 19 nt, Homo sapiens
cagacuaccacccucauca

SEQ ID NO: 1478190 - RNA, 19 nt, Homo sapiens
gccgacgccuccaaguugu

SEQ ID NO: 1478191 - RNA, 19 nt, Homo sapiens
uuucugaacccaagugaau

SEQ ID NO: 1478192 - RNA, 19 nt, Homo sapiens
uggacuauuugaccaagau

SEQ ID NO: 1478193 - RNA, 19 nt, Homo sapiens
gggccuggacucacacuuc

SEQ ID NO: 1478194 - RNA, 19 nt, Homo sapiens
gcgggaggccuacauucga

SEQ ID NO: 1478195 - RNA, 19 nt, Homo sapiens
ggcuuuaugucucuuucau

SEQ ID NO: 1478196 - RNA, 19 nt, Homo sapiens
cuaacggccagccuuuauu

SEQ ID NO: 1478197 - RNA, 19 nt, Homo sapiens
gaucccuucugcaggucuu

SEQ ID NO: 1478198 - RNA, 19 nt, Homo sapiens
gauggacgggauacaggaa

SEQ ID NO: 1478199 - RNA, 19 nt, Homo sapiens
ggagcaggagauucgagaa

SEQ ID NO: 1478200 - RNA, 19 nt, Homo sapiens
gaaacaacaucuucuggaa

SEQ ID NO: 1478201 - RNA, 19 nt, Homo sapiens
gaaggaagaugccacaaag

SEQ ID NO: 1478202 - RNA, 19 nt, Homo sapiens
ggagaucucagaccaauaa

SEQ ID NO: 1478203 - RNA, 19 nt, Homo sapiens
ccuaucagcugucauacua

SEQ ID NO: 1478204 - RNA, 19 nt, Homo sapiens
gcaagucagugaaggaaau

SEQ ID NO: 1478205 - RNA, 19 nt, Homo sapiens
uauaggagcuggagaaaca

SEQ ID NO: 1478206 - RNA, 19 nt, Homo sapiens
gcaccgagaugggaaaguu

SEQ ID NO: 1478207 - RNA, 19 nt, Homo sapiens
ggagaaaucaugggaauug

SEQ ID NO: 1478208 - RNA, 19 nt, Homo sapiens
gaucucagaccaauaacaa

SEQ ID NO: 1478209 - RNA, 19 nt, Homo sapiens
gaagguaaccaucccugaa

SEQ ID NO: 1478210 - RNA, 19 nt, Homo sapiens
gggaagacaagacaguaua

SEQ ID NO: 1478211 - RNA, 19 nt, Homo sapiens
gacaagacgcagacaauga

SEQ ID NO: 1478212 - RNA, 19 nt, Homo sapiens
ucaauagccuggagagcaa

SEQ ID NO: 1478213 - RNA, 19 nt, Homo sapiens
ccgagcagcugguuguuga

SEQ ID NO: 1478214 - RNA, 19 nt, Homo sapiens
caagaaagaggagaaguug

SEQ ID NO: 1478215 - RNA, 19 nt, Homo sapiens
caaagucuguugcuauacu

SEQ ID NO: 1478216 - RNA, 19 nt, Homo sapiens
ugagaagagucagauggua

SEQ ID NO: 1478217 - RNA, 19 nt, Homo sapiens
gagcaaauacguguucuuc

SEQ ID NO: 1478218 - RNA, 19 nt, Homo sapiens
gaggacagcaagucaguga

SEQ ID NO: 1478219 - RNA, 19 nt, Homo sapiens
uaucagcugucauacuaga

SEQ ID NO: 1478220 - RNA, 19 nt, Homo sapiens
ccaagaaagaggagaaguu

SEQ ID NO: 1478221 - RNA, 19 nt, Homo sapiens
gggaauuggccaagaaaga

SEQ ID NO: 1478222 - RNA, 19 nt, Homo sapiens
caugggaauuggccaagaa

SEQ ID NO: 1478223 - RNA, 19 nt, Homo sapiens
guagggaucagcaauagug

SEQ ID NO: 1478224 - RNA, 19 nt, Homo sapiens
gccaagggaucccaucaag

SEQ ID NO: 1478225 - RNA, 19 nt, Homo sapiens
cuaagggccugggcaagaa

SEQ ID NO: 1478226 - RNA, 19 nt, Homo sapiens
ggagagcaaauacguguuc

SEQ ID NO: 1478227 - RNA, 19 nt, Homo sapiens
gaagggaagacaagacagu

SEQ ID NO: 1478228 - RNA, 19 nt, Homo sapiens
gaagguugaggaacggauu

SEQ ID NO: 1478229 - RNA, 19 nt, Homo sapiens
gacaagacaguauacaauc

SEQ ID NO: 1478230 - RNA, 19 nt, Homo sapiens
gcagucacccacacaagga

SEQ ID NO: 1478231 - RNA, 19 nt, Homo sapiens
gcuccugccucucuguuca

SEQ ID NO: 1478232 - RNA, 19 nt, Homo sapiens
aaggagaaaucaugggaau

SEQ ID NO: 1478233 - RNA, 19 nt, Homo sapiens
ggacagcaagucagugaag

SEQ ID NO: 1478234 - RNA, 19 nt, Homo sapiens
agacaagacaguauacaau

SEQ ID NO: 1478235 - RNA, 19 nt, Homo sapiens
ggaauuggccaagaaagag

SEQ ID NO: 1478236 - RNA, 19 nt, Homo sapiens
acaagacgcagacaaugaa

SEQ ID NO: 1478237 - RNA, 19 nt, Homo sapiens
gcuacaggccaucaacuug

SEQ ID NO: 1478238 - RNA, 19 nt, Homo sapiens
gggagaaggaauuauagga

SEQ ID NO: 1478239 - RNA, 19 nt, Homo sapiens
gagaaaucaugggaauugg

SEQ ID NO: 1478240 - RNA, 19 nt, Homo sapiens
auaagacccugaccaccuu

SEQ ID NO: 1478241 - RNA, 19 nt, Homo sapiens
gcaggaggacagcaaguca

SEQ ID NO: 1478242 - RNA, 19 nt, Homo sapiens
agaaggaagaugccacaaa

SEQ ID NO: 1478243 - RNA, 19 nt, Homo sapiens
cugggugucuucucuaaau

SEQ ID NO: 1478244 - RNA, 19 nt, Homo sapiens
gaagacaagacaguauaca

SEQ ID NO: 1478245 - RNA, 19 nt, Homo sapiens
ggaagacaagacaguauac

SEQ ID NO: 1478246 - RNA, 19 nt, Homo sapiens
aaccaucccugaacagaag

SEQ ID NO: 1478247 - RNA, 19 nt, Homo sapiens
cagacaagacgcagacaau

SEQ ID NO: 1478248 - RNA, 19 nt, Homo sapiens
ggagcaguccuaucacaag

SEQ ID NO: 1478249 - RNA, 19 nt, Homo sapiens
gaacggauucugggugucu

SEQ ID NO: 1478250 - RNA, 19 nt, Homo sapiens
uaaccaucccugaacagaa

SEQ ID NO: 1478251 - RNA, 19 nt, Homo sapiens
cgacgccuccugcuggaaa

SEQ ID NO: 1478252 - RNA, 19 nt, Homo sapiens
gauucugggugucuucucu

SEQ ID NO: 1478253 - RNA, 19 nt, Homo sapiens
ucgccacggugcaguauca

SEQ ID NO: 1478254 - RNA, 19 nt, Homo sapiens
guaaccaucccugaacaga

SEQ ID NO: 1478255 - RNA, 19 nt, Homo sapiens
ucagaccaauaacaaaguc

SEQ ID NO: 1478256 - RNA, 19 nt, Homo sapiens
caagacgcagacaaugaaa

SEQ ID NO: 1478257 - RNA, 19 nt, Homo sapiens
gugcauugguggacaagac

SEQ ID NO: 1478258 - RNA, 19 nt, Homo sapiens
cuacaggccaucaacuugu

SEQ ID NO: 1478259 - RNA, 19 nt, Homo sapiens
gcagagagaagcgcagcau

SEQ ID NO: 1478260 - RNA, 19 nt, Homo sapiens
ccuaagggccugggcaaga

SEQ ID NO: 1478261 - RNA, 19 nt, Homo sapiens
gaugguagggaucagcaau

SEQ ID NO: 1478262 - RNA, 19 nt, Homo sapiens
ugucucugcggaacaauaa

SEQ ID NO: 1478263 - RNA, 19 nt, Homo sapiens
cauccgcgguuggaagguu

SEQ ID NO: 1478264 - RNA, 19 nt, Homo sapiens
cccaccugcuugccucuaa

SEQ ID NO: 1478265 - RNA, 19 nt, Homo sapiens
ggaugaggccauggcauuc

SEQ ID NO: 1478266 - RNA, 19 nt, Homo sapiens
acagcacgauugcgcacuu

SEQ ID NO: 1478267 - RNA, 19 nt, Homo sapiens
ccggagcaguccuaucaca

SEQ ID NO: 1478268 - RNA, 19 nt, Homo sapiens
cagcaagucagugaaggaa

SEQ ID NO: 1478269 - RNA, 19 nt, Homo sapiens
ccacggugcaguaucagau

SEQ ID NO: 1478270 - RNA, 19 nt, Homo sapiens
ggugucuucucuaaauguc

SEQ ID NO: 1478271 - RNA, 19 nt, Homo sapiens
aggaugaggccauggcauu

SEQ ID NO: 1478272 - RNA, 19 nt, Homo sapiens
cagcacgauugcgcacuug

SEQ ID NO: 1478273 - RNA, 19 nt, Homo sapiens
ugccggagcaguccuauca

SEQ ID NO: 1478274 - RNA, 19 nt, Homo sapiens
uacaggccaucaacuugug

SEQ ID NO: 1478275 - RNA, 19 nt, Homo sapiens
aagacaagacaguauacaa

SEQ ID NO: 1478276 - RNA, 19 nt, Homo sapiens
gaccaauaacaaagucugu

SEQ ID NO: 1478277 - RNA, 19 nt, Homo sapiens
agacaagacgcagacaaug

SEQ ID NO: 1478278 - RNA, 19 nt, Homo sapiens
gagagcaaauacguguucu

SEQ ID NO: 1478279 - RNA, 19 nt, Homo sapiens
guucauccacgcucagauc

SEQ ID NO: 1478280 - RNA, 19 nt, Homo sapiens
aauuauaggagcuggagaa

SEQ ID NO: 1478281 - RNA, 19 nt, Homo sapiens
gggagaucucagaccaaua

SEQ ID NO: 1478282 - RNA, 19 nt, Homo sapiens
ccaaacucagggaggauga

SEQ ID NO: 1478283 - RNA, 19 nt, Homo sapiens
ggagcaccgagaugggaaa

SEQ ID NO: 1478284 - RNA, 19 nt, Homo sapiens
gcacgauugcgcacuuguc

SEQ ID NO: 1478285 - RNA, 19 nt, Homo sapiens
acaagacaguauacaaucc

SEQ ID NO: 1478286 - RNA, 19 nt, Homo sapiens
caaaguaguuccaagauua

SEQ ID NO: 1478287 - RNA, 19 nt, Homo sapiens
gaaacacuaucucuacuaa

SEQ ID NO: 1478288 - RNA, 19 nt, Homo sapiens
ggaguaagauguccaaaga

SEQ ID NO: 1478289 - RNA, 19 nt, Homo sapiens
gaaagaagaguaugacaaa

SEQ ID NO: 1478290 - RNA, 19 nt, Homo sapiens
gauuagggcuaguuuguaa

SEQ ID NO: 1478291 - RNA, 19 nt, Homo sapiens
gagcuuuacugacugauuu

SEQ ID NO: 1478292 - RNA, 19 nt, Homo sapiens
ccuaggaacuucuuucuuu

SEQ ID NO: 1478293 - RNA, 19 nt, Homo sapiens
ggacuacuguugaagaaau

SEQ ID NO: 1478294 - RNA, 19 nt, Homo sapiens
aaacaauccucauuuccua

SEQ ID NO: 1478295 - RNA, 19 nt, Homo sapiens
gcaaccgucucacagcuaa

SEQ ID NO: 1478296 - RNA, 19 nt, Homo sapiens
ggaauaaucccaucuaaaa

SEQ ID NO: 1478297 - RNA, 19 nt, Homo sapiens
cuuuagagauggcaaauaa

SEQ ID NO: 1478298 - RNA, 19 nt, Homo sapiens
gaucuggacuacuguugaa

SEQ ID NO: 1478299 - RNA, 19 nt, Homo sapiens
ucacacaccauauuucuuu

SEQ ID NO: 1478300 - RNA, 19 nt, Homo sapiens
ccauauuucuuucaccuuu

SEQ ID NO: 1478301 - RNA, 19 nt, Homo sapiens
uugaagaaauucccaguaa

SEQ ID NO: 1478302 - RNA, 19 nt, Homo sapiens
ucaaaguaguuccaagauu

SEQ ID NO: 1478303 - RNA, 19 nt, Homo sapiens
agaagagacuggaaccaaa

SEQ ID NO: 1478304 - RNA, 19 nt, Homo sapiens
gaucuuauccucagggaau

SEQ ID NO: 1478305 - RNA, 19 nt, Homo sapiens
gagauuauaacauccugua

SEQ ID NO: 1478306 - RNA, 19 nt, Homo sapiens
ucccuuugcucacuaauuu

SEQ ID NO: 1478307 - RNA, 19 nt, Homo sapiens
gaagaaauucccaguaagg

SEQ ID NO: 1478308 - RNA, 19 nt, Homo sapiens
ugacugauuucccuauuca

SEQ ID NO: 1478309 - RNA, 19 nt, Homo sapiens
gaaacagaaagaaguguau

SEQ ID NO: 1478310 - RNA, 19 nt, Homo sapiens
ggucaggaguuugagacua

SEQ ID NO: 1478311 - RNA, 19 nt, Homo sapiens
aaagaaguguauccugcua

SEQ ID NO: 1478312 - RNA, 19 nt, Homo sapiens
ccaacauggugaaacacua

SEQ ID NO: 1478313 - RNA, 19 nt, Homo sapiens
caacugaggcauauuugau

SEQ ID NO: 1478314 - RNA, 19 nt, Homo sapiens
uaugguggcuuacgccuau

SEQ ID NO: 1478315 - RNA, 19 nt, Homo sapiens
aaggcucacuuauaucuuu

SEQ ID NO: 1478316 - RNA, 19 nt, Homo sapiens
ucaaagaaauaccaacacu

SEQ ID NO: 1478317 - RNA, 19 nt, Homo sapiens
gguguucuguuuccuagga

SEQ ID NO: 1478318 - RNA, 19 nt, Homo sapiens
gcauuucaggagauuauaa

SEQ ID NO: 1478319 - RNA, 19 nt, Homo sapiens
cgaaacagaaagaagugua

SEQ ID NO: 1478320 - RNA, 19 nt, Homo sapiens
ucugagagcuuuacugacu

SEQ ID NO: 1478321 - RNA, 19 nt, Homo sapiens
caacauggugaaacacuau

SEQ ID NO: 1478322 - RNA, 19 nt, Homo sapiens
acagagaacugcggaaucu

SEQ ID NO: 1478323 - RNA, 19 nt, Homo sapiens
aaggaauaaucccaucuaa

SEQ ID NO: 1478324 - RNA, 19 nt, Homo sapiens
aggcauauuugaugaacuu

SEQ ID NO: 1478325 - RNA, 19 nt, Homo sapiens
ugaaagaagaguaugacaa

SEQ ID NO: 1478326 - RNA, 19 nt, Homo sapiens
cucagggaauccucacuua

SEQ ID NO: 1478327 - RNA, 19 nt, Homo sapiens
gggaagagacagagaacug

SEQ ID NO: 1478328 - RNA, 19 nt, Homo sapiens
ugagagcuuuacugacuga

SEQ ID NO: 1478329 - RNA, 19 nt, Homo sapiens
cagggaauccucacuuaga

SEQ ID NO: 1478330 - RNA, 19 nt, Homo sapiens
gacuacuguugaagaaauu

SEQ ID NO: 1478331 - RNA, 19 nt, Homo sapiens
ugaaacacuaucucuacua

SEQ ID NO: 1478332 - RNA, 19 nt, Homo sapiens
gucaggaguuugagacuag

SEQ ID NO: 1478333 - RNA, 19 nt, Homo sapiens
auaaauaccuuugcucaac

SEQ ID NO: 1478334 - RNA, 19 nt, Homo sapiens
gaacuucuuucuuuucuac

SEQ ID NO: 1478335 - RNA, 19 nt, Homo sapiens
ugggcaaacuaauagaauu

SEQ ID NO: 1478336 - RNA, 19 nt, Homo sapiens
gauggcaaauaacuacaag

SEQ ID NO: 1478337 - RNA, 19 nt, Homo sapiens
ugaagaaauucccaguaag

SEQ ID NO: 1478338 - RNA, 19 nt, Homo sapiens
cucaagaucuggacuacug

SEQ ID NO: 1478339 - RNA, 19 nt, Homo sapiens
gcucacuuauaucuuuaga

SEQ ID NO: 1478340 - RNA, 19 nt, Homo sapiens
ggugaaacacuaucucuac

SEQ ID NO: 1478341 - RNA, 19 nt, Homo sapiens
cagguuaaaucuucauggu

SEQ ID NO: 1478342 - RNA, 19 nt, Homo sapiens
aaaggaauaaucccaucua

SEQ ID NO: 1478343 - RNA, 19 nt, Homo sapiens
uggcaaauaacuacaagaa

SEQ ID NO: 1478344 - RNA, 19 nt, Homo sapiens
cuacauuucugaagaucuc

SEQ ID NO: 1478345 - RNA, 19 nt, Homo sapiens
gggcaaacuaauagaauuc

SEQ ID NO: 1478346 - RNA, 19 nt, Homo sapiens
ggcaaauaacuacaagaaa

SEQ ID NO: 1478347 - RNA, 19 nt, Homo sapiens
cauccuguauuucaguuuc

SEQ ID NO: 1478348 - RNA, 19 nt, Homo sapiens
ucaaaacaauccucauuuc

SEQ ID NO: 1478349 - RNA, 19 nt, Homo sapiens
gaaaggauuagaggucauc

SEQ ID NO: 1478350 - RNA, 19 nt, Homo sapiens
gggcuaguuuguaauucug

SEQ ID NO: 1478351 - RNA, 19 nt, Homo sapiens
ccaagauuagggcuaguuu

SEQ ID NO: 1478352 - RNA, 19 nt, Homo sapiens
caucuauuauacacccauu

SEQ ID NO: 1478353 - RNA, 19 nt, Homo sapiens
ugaugaacuugacauuauc

SEQ ID NO: 1478354 - RNA, 19 nt, Homo sapiens
gaagagacuggaaccaaaa

SEQ ID NO: 1478355 - RNA, 19 nt, Homo sapiens
aacuugacauuaucucuga

SEQ ID NO: 1478356 - RNA, 19 nt, Homo sapiens
agacgaaacagaaagaagu

SEQ ID NO: 1478357 - RNA, 19 nt, Homo sapiens
gaccuugcugaaacucuua

SEQ ID NO: 1478358 - RNA, 19 nt, Homo sapiens
ugggagaccuugcugaaac

SEQ ID NO: 1478359 - RNA, 19 nt, Homo sapiens
aggcucacuuauaucuuua

SEQ ID NO: 1478360 - RNA, 19 nt, Homo sapiens
gugaaacacuaucucuacu

SEQ ID NO: 1478361 - RNA, 19 nt, Homo sapiens
ccuguaaucccagcacuuu

SEQ ID NO: 1478362 - RNA, 19 nt, Homo sapiens
uaaacgagggccuaguuca

SEQ ID NO: 1478363 - RNA, 19 nt, Homo sapiens
guuaaaucuucaugguguu

SEQ ID NO: 1478364 - RNA, 19 nt, Homo sapiens
gcauauuugaugaacuuga

SEQ ID NO: 1478365 - RNA, 19 nt, Homo sapiens
uucaggagauuauaacauc

SEQ ID NO: 1478366 - RNA, 19 nt, Homo sapiens
guugaagaaauucccagua

SEQ ID NO: 1478367 - RNA, 19 nt, Homo sapiens
ugacagagcgagacuccau

SEQ ID NO: 1478368 - RNA, 19 nt, Homo sapiens
ucaaguuucucugacauac

SEQ ID NO: 1478369 - RNA, 19 nt, Homo sapiens
guucaaguuucucugacau

SEQ ID NO: 1478370 - RNA, 19 nt, Homo sapiens
uuuccuacauuucugaaga

SEQ ID NO: 1478371 - RNA, 19 nt, Homo sapiens
agaccuugcugaaacucuu

SEQ ID NO: 1478372 - RNA, 19 nt, Homo sapiens
uggccaacauggugaaaca

SEQ ID NO: 1478373 - RNA, 19 nt, Homo sapiens
acugaggcauauuugauga

SEQ ID NO: 1478374 - RNA, 19 nt, Homo sapiens
ggauuagaggucaucaaug

SEQ ID NO: 1478375 - RNA, 19 nt, Homo sapiens
aauccucauuuccuacauu

SEQ ID NO: 1478376 - RNA, 19 nt, Homo sapiens
uagcauuucaggagauuau

SEQ ID NO: 1478377 - RNA, 19 nt, Homo sapiens
uaacauccuguauuucagu

SEQ ID NO: 1478378 - RNA, 19 nt, Homo sapiens
guaaacgagggccuaguuc

SEQ ID NO: 1478379 - RNA, 19 nt, Homo sapiens
caagauuagggcuaguuug

SEQ ID NO: 1478380 - RNA, 19 nt, Homo sapiens
cauauuugaugaacuugac

SEQ ID NO: 1478381 - RNA, 19 nt, Homo sapiens
gggagaccuugcugaaacu

SEQ ID NO: 1478382 - RNA, 19 nt, Homo sapiens
uguaaacgagggccuaguu

SEQ ID NO: 1478383 - RNA, 19 nt, Homo sapiens
aagauuagggcuaguuugu

SEQ ID NO: 1478384 - RNA, 19 nt, Homo sapiens
ucccaauauugagaucuua

SEQ ID NO: 1478385 - RNA, 19 nt, Homo sapiens
ugcggaaucuggaacuuuc

SEQ ID NO: 1478386 - RNA, 19 nt, Homo sapiens
gagccaaccuuacuacaaa

SEQ ID NO: 1478387 - RNA, 19 nt, Homo sapiens
cagaguggcuccagcauga

SEQ ID NO: 1478388 - RNA, 19 nt, Homo sapiens
gcacaaccguguccguaug

SEQ ID NO: 1478389 - RNA, 19 nt, Homo sapiens
ggagagagacuacaaacug

SEQ ID NO: 1478390 - RNA, 19 nt, Homo sapiens
gagagagacuacaaacugu

SEQ ID NO: 1478391 - RNA, 19 nt, Homo sapiens
guucuuuacugccguuuaa

SEQ ID NO: 1478392 - RNA, 19 nt, Homo sapiens
gcacagggacucgcauaaa

SEQ ID NO: 1478393 - RNA, 19 nt, Homo sapiens
ggaguacgauauauucaag

SEQ ID NO: 1478394 - RNA, 19 nt, Homo sapiens
guacggaucucuguucaag

SEQ ID NO: 1478395 - RNA, 19 nt, Homo sapiens
gagaccagcugcagagaca

SEQ ID NO: 1478396 - RNA, 19 nt, Homo sapiens
ugaagcccauuaaauaaga

SEQ ID NO: 1478397 - RNA, 19 nt, Homo sapiens
ccacagagccaauagagau

SEQ ID NO: 1478398 - RNA, 19 nt, Homo sapiens
gcaauugugucccgcucuu

SEQ ID NO: 1478399 - RNA, 19 nt, Homo sapiens
gaaagacaaccaugaaugc

SEQ ID NO: 1478400 - RNA, 19 nt, Homo sapiens
cuuugaagcccauuaaaua

SEQ ID NO: 1478401 - RNA, 19 nt, Homo sapiens
caggacagcugcagaagca

SEQ ID NO: 1478402 - RNA, 19 nt, Homo sapiens
caaaacaucuacagaacuu

SEQ ID NO: 1478403 - RNA, 19 nt, Homo sapiens
caaggcagcaaagaacuua

SEQ ID NO: 1478404 - RNA, 19 nt, Homo sapiens
gagacaagauugcccaaaa

SEQ ID NO: 1478405 - RNA, 19 nt, Homo sapiens
gaugaccucuuugccuauu

SEQ ID NO: 1478406 - RNA, 19 nt, Homo sapiens
ggccacccauggagaguaa

SEQ ID NO: 1478407 - RNA, 19 nt, Homo sapiens
caaguaugcaccgauauuu

SEQ ID NO: 1478408 - RNA, 19 nt, Homo sapiens
gcugaaagacaaccaugaa

SEQ ID NO: 1478409 - RNA, 19 nt, Homo sapiens
ggccauugcaggaguagua

SEQ ID NO: 1478410 - RNA, 19 nt, Homo sapiens
cacacgggaugaccucuuu

SEQ ID NO: 1478411 - RNA, 19 nt, Homo sapiens
ugaaagacaaccaugaaug

SEQ ID NO: 1478412 - RNA, 19 nt, Homo sapiens
ggccaccucugcugcuuau

SEQ ID NO: 1478413 - RNA, 19 nt, Homo sapiens
ucacuaggacuacaguuug

SEQ ID NO: 1478414 - RNA, 19 nt, Homo sapiens
caaccaugaaugcugauuu

SEQ ID NO: 1478415 - RNA, 19 nt, Homo sapiens
gaacgucagagccaaccuu

SEQ ID NO: 1478416 - RNA, 19 nt, Homo sapiens
caggaccucucacaaaucu

SEQ ID NO: 1478417 - RNA, 19 nt, Homo sapiens
ucaagaccaugagaaacaa

SEQ ID NO: 1478418 - RNA, 19 nt, Homo sapiens
gcaaggcagcaaagaacuu

SEQ ID NO: 1478419 - RNA, 19 nt, Homo sapiens
ucaaguaugcaccgauauu

SEQ ID NO: 1478420 - RNA, 19 nt, Homo sapiens
cacagggacucgcauaaag

SEQ ID NO: 1478421 - RNA, 19 nt, Homo sapiens
gauauuugagagcgacuuu

SEQ ID NO: 1478422 - RNA, 19 nt, Homo sapiens
cgaagaguaugcuggacau

SEQ ID NO: 1478423 - RNA, 19 nt, Homo sapiens
auucaaguaugcaccgaua

SEQ ID NO: 1478424 - RNA, 19 nt, Homo sapiens
uggagacagugaccuuuga

SEQ ID NO: 1478425 - RNA, 19 nt, Homo sapiens
uccaggaccucucacaaau

SEQ ID NO: 1478426 - RNA, 19 nt, Homo sapiens
ggugaaagccgccacaaaa

SEQ ID NO: 1478427 - RNA, 19 nt, Homo sapiens
cauuccagcugaagacaug

SEQ ID NO: 1478428 - RNA, 19 nt, Homo sapiens
gggguuagguccagaagaa

SEQ ID NO: 1478429 - RNA, 19 nt, Homo sapiens
ccaccgaggccaaggaaga

SEQ ID NO: 1478430 - RNA, 19 nt, Homo sapiens
caacagcugcgccugaagu

SEQ ID NO: 1478431 - RNA, 19 nt, Homo sapiens
gaccuuugaagcccauuaa

SEQ ID NO: 1478432 - RNA, 19 nt, Homo sapiens
caccagugcugccguugug

SEQ ID NO: 1478433 - RNA, 19 nt, Homo sapiens
gccacacgcccaucucaaa

SEQ ID NO: 1478434 - RNA, 19 nt, Homo sapiens
gagcgacuuuauccagauc

SEQ ID NO: 1478435 - RNA, 19 nt, Homo sapiens
ggagacagugaccuuugaa

SEQ ID NO: 1478436 - RNA, 19 nt, Homo sapiens
gcgcauccaugagccuuuc

SEQ ID NO: 1478437 - RNA, 19 nt, Homo sapiens
gggaguacgauauauucaa

SEQ ID NO: 1478438 - RNA, 19 nt, Homo sapiens
gcacaccacauggcagaga

SEQ ID NO: 1478439 - RNA, 19 nt, Homo sapiens
ugauguggaugccuguguu

SEQ ID NO: 1478440 - RNA, 19 nt, Homo sapiens
gggaggcucugaggcaaca

SEQ ID NO: 1478441 - RNA, 19 nt, Homo sapiens
caaaaggggagaagugauu

SEQ ID NO: 1478442 - RNA, 19 nt, Homo sapiens
gaaacugcagcgacaacug

SEQ ID NO: 1478443 - RNA, 19 nt, Homo sapiens
ccuauuccagcguucuuua

SEQ ID NO: 1478444 - RNA, 19 nt, Homo sapiens
acacgcccaucucaaagga

SEQ ID NO: 1478445 - RNA, 19 nt, Homo sapiens
cguagcaggugccuugagu

SEQ ID NO: 1478446 - RNA, 19 nt, Homo sapiens
cagcaguaccuguggcauu

SEQ ID NO: 1478447 - RNA, 19 nt, Homo sapiens
cagcugcagagacaucuuu

SEQ ID NO: 1478448 - RNA, 19 nt, Homo sapiens
gcuuauggaccaccaguuc

SEQ ID NO: 1478449 - RNA, 19 nt, Homo sapiens
ggagacaagauugcccaaa

SEQ ID NO: 1478450 - RNA, 19 nt, Homo sapiens
gaaagccgccacaaaacaa

SEQ ID NO: 1478451 - RNA, 19 nt, Homo sapiens
gugcugccguugugcugaa

SEQ ID NO: 1478452 - RNA, 19 nt, Homo sapiens
gauguggaugccuguguuu

SEQ ID NO: 1478453 - RNA, 19 nt, Homo sapiens
ggggagaagugauugaugu

SEQ ID NO: 1478454 - RNA, 19 nt, Homo sapiens
aguaugcaccgauauuuga

SEQ ID NO: 1478455 - RNA, 19 nt, Homo sapiens
gucacuaggacuacaguuu

SEQ ID NO: 1478456 - RNA, 19 nt, Homo sapiens
cauggucucugaggugugu

SEQ ID NO: 1478457 - RNA, 19 nt, Homo sapiens
aaacugcagcgacaacugu

SEQ ID NO: 1478458 - RNA, 19 nt, Homo sapiens
gagaguaacagcaguaccu

SEQ ID NO: 1478459 - RNA, 19 nt, Homo sapiens
aacaacagcugcgccugaa

SEQ ID NO: 1478460 - RNA, 19 nt, Homo sapiens
acucccagaugucaugcua

SEQ ID NO: 1478461 - RNA, 19 nt, Homo sapiens
gcaaguccucagagcaugu

SEQ ID NO: 1478462 - RNA, 19 nt, Homo sapiens
cgaugcaggaggaaacaaa

SEQ ID NO: 1478463 - RNA, 19 nt, Homo sapiens
gacuuuaacaaacccacua

SEQ ID NO: 1478464 - RNA, 19 nt, Homo sapiens
cacuaggacuacaguuugu

SEQ ID NO: 1478465 - RNA, 19 nt, Homo sapiens
uccagcagguccucauuca

SEQ ID NO: 1478466 - RNA, 19 nt, Homo sapiens
gaucucuguucaagaccau

SEQ ID NO: 1478467 - RNA, 19 nt, Homo sapiens
gcaucucuacgucuuggaa

SEQ ID NO: 1478468 - RNA, 19 nt, Homo sapiens
gccaggccaccaagagaaa

SEQ ID NO: 1478469 - RNA, 19 nt, Homo sapiens
cgucagagccaaccuuacu

SEQ ID NO: 1478470 - RNA, 19 nt, Homo sapiens
gagcaagagcagccugagu

SEQ ID NO: 1478471 - RNA, 19 nt, Homo sapiens
ggaggaaacaaaggcaaca

SEQ ID NO: 1478472 - RNA, 19 nt, Homo sapiens
gggccaccucugcugcuua

SEQ ID NO: 1478473 - RNA, 19 nt, Homo sapiens
cauccaaagccuccacaug

SEQ ID NO: 1478474 - RNA, 19 nt, Homo sapiens
uauuugagagcgacuuuau

SEQ ID NO: 1478475 - RNA, 19 nt, Homo sapiens
uuucugcugccguauuaua

SEQ ID NO: 1478476 - RNA, 19 nt, Homo sapiens
ucagggagagagacuacaa

SEQ ID NO: 1478477 - RNA, 19 nt, Homo sapiens
gggagggaaagaagggaaa

SEQ ID NO: 1478478 - RNA, 19 nt, Homo sapiens
gacaucauggagacaguga

SEQ ID NO: 1478479 - RNA, 19 nt, Homo sapiens
gagcccacccugcaucucu

SEQ ID NO: 1478480 - RNA, 19 nt, Homo sapiens
ggcacagggacucgcauaa

SEQ ID NO: 1478481 - RNA, 19 nt, Homo sapiens
aaccaugaaugcugauuuu

SEQ ID NO: 1478482 - RNA, 19 nt, Homo sapiens
uagcaggugccuugagugu

SEQ ID NO: 1478483 - RNA, 19 nt, Homo sapiens
ggaugaccucuuugccuau

SEQ ID NO: 1478484 - RNA, 19 nt, Homo sapiens
gaagcccauuaaauaagac

SEQ ID NO: 1478485 - RNA, 19 nt, Homo sapiens
gagccaauagagaugacaa

SEQ ID NO: 1478486 - RNA, 19 nt, Homo sapiens
ggaagaaguuggcucauau

SEQ ID NO: 1478487 - RNA, 19 nt, Homo sapiens
ggaacucccuguuggaauu

SEQ ID NO: 1478488 - RNA, 19 nt, Homo sapiens
uaucagggcucauaauugu

SEQ ID NO: 1478489 - RNA, 19 nt, Homo sapiens
gaccuggccugguggcaua

SEQ ID NO: 1478490 - RNA, 19 nt, Homo sapiens
gagaagcaauucaaauguc

SEQ ID NO: 1478491 - RNA, 19 nt, Homo sapiens
cggaagaaguuggcucaua

SEQ ID NO: 1478492 - RNA, 19 nt, Homo sapiens
acacugcccuuuaagagaa

SEQ ID NO: 1478493 - RNA, 19 nt, Homo sapiens
uaacagagcguccucaaag

SEQ ID NO: 1478494 - RNA, 19 nt, Homo sapiens
gcucauaucagggcucaua

SEQ ID NO: 1478495 - RNA, 19 nt, Homo sapiens
cauaauuguugccaaguau

SEQ ID NO: 1478496 - RNA, 19 nt, Homo sapiens
ggauaagacggaagaaguu

SEQ ID NO: 1478497 - RNA, 19 nt, Homo sapiens
ucauaauuguugccaagua

SEQ ID NO: 1478498 - RNA, 19 nt, Homo sapiens
ggagaagcaauucaaaugu

SEQ ID NO: 1478499 - RNA, 19 nt, Homo sapiens
gaaagucaagugugugugu

SEQ ID NO: 1478500 - RNA, 19 nt, Homo sapiens
gagcacagguagcccaucu

SEQ ID NO: 1478501 - RNA, 19 nt, Homo sapiens
gagaaacuuccgugcauga

SEQ ID NO: 1478502 - RNA, 19 nt, Homo sapiens
ccacgagacccacugcuuu

SEQ ID NO: 1478503 - RNA, 19 nt, Homo sapiens
cccaugcaguuauuuauga

SEQ ID NO: 1478504 - RNA, 19 nt, Homo sapiens
uaacagguaaccacaauca

SEQ ID NO: 1478505 - RNA, 19 nt, Homo sapiens
gagccucaguuuccucguu

SEQ ID NO: 1478506 - RNA, 19 nt, Homo sapiens
aagcaggacuggacucugu

SEQ ID NO: 1478507 - RNA, 19 nt, Homo sapiens
gcacagguagcccaucuuc

SEQ ID NO: 1478508 - RNA, 19 nt, Homo sapiens
ugccaaguauuaacaggua

SEQ ID NO: 1478509 - RNA, 19 nt, Homo sapiens
cauaucagggcucauaauu

SEQ ID NO: 1478510 - RNA, 19 nt, Homo sapiens
gguggugagcuccguguua

SEQ ID NO: 1478511 - RNA, 19 nt, Homo sapiens
gugugugaauccugagaua

SEQ ID NO: 1478512 - RNA, 19 nt, Homo sapiens
gggauaagacggaagaagu

SEQ ID NO: 1478513 - RNA, 19 nt, Homo sapiens
agaagcaauucaaauguca

SEQ ID NO: 1478514 - RNA, 19 nt, Homo sapiens
gcaauucaaaugucagaag

SEQ ID NO: 1478515 - RNA, 19 nt, Homo sapiens
ccgagaaacuuccgugcau

SEQ ID NO: 1478516 - RNA, 19 nt, Homo sapiens
ugagauaagucagguaagg

SEQ ID NO: 1478517 - RNA, 19 nt, Homo sapiens
gaagaaguuggcucauauc

SEQ ID NO: 1478518 - RNA, 19 nt, Homo sapiens
gauaagacggaagaaguug

SEQ ID NO: 1478519 - RNA, 19 nt, Homo sapiens
gauaacagagcguccucaa

SEQ ID NO: 1478520 - RNA, 19 nt, Homo sapiens
ccaugcaguuauuuaugaa

SEQ ID NO: 1478521 - RNA, 19 nt, Homo sapiens
cacaaucacacuccacaaa

SEQ ID NO: 1478522 - RNA, 19 nt, Homo sapiens
ucaguuuccucguuugcaa

SEQ ID NO: 1478523 - RNA, 19 nt, Homo sapiens
gcaggacuggacucuguuu

SEQ ID NO: 1478524 - RNA, 19 nt, Homo sapiens
uuggguaucugcuuccauu

SEQ ID NO: 1478525 - RNA, 19 nt, Homo sapiens
uggagaagcaauucaaaug

SEQ ID NO: 1478526 - RNA, 19 nt, Homo sapiens
gacacugcccuuuaagaga

SEQ ID NO: 1478527 - RNA, 19 nt, Homo sapiens
gccaaguauuaacagguaa

SEQ ID NO: 1478528 - RNA, 19 nt, Homo sapiens
ucagggcucauaauuguug

SEQ ID NO: 1478529 - RNA, 19 nt, Homo sapiens
gaggugcugcggcuuguga

SEQ ID NO: 1478530 - RNA, 19 nt, Homo sapiens
ucaagugugugugugugaa

SEQ ID NO: 1478531 - RNA, 19 nt, Homo sapiens
gaaguauuucuccugugaa

SEQ ID NO: 1478532 - RNA, 19 nt, Homo sapiens
gugcacacccagaaguauu

SEQ ID NO: 1478533 - RNA, 19 nt, Homo sapiens
ccacguucccuuccacaga

SEQ ID NO: 1478534 - RNA, 19 nt, Homo sapiens
caaucacacuccacaaagc

SEQ ID NO: 1478535 - RNA, 19 nt, Homo sapiens
acagguagcccaucuucug

SEQ ID NO: 1478536 - RNA, 19 nt, Homo sapiens
cagcuccgcccuuccgaaa

SEQ ID NO: 1478537 - RNA, 19 nt, Homo sapiens
gcuggagaagcaauucaaa

SEQ ID NO: 1478538 - RNA, 19 nt, Homo sapiens
aaacucacgucuggauucu

SEQ ID NO: 1478539 - RNA, 19 nt, Homo sapiens
guggugagcuccguguuac

SEQ ID NO: 1478540 - RNA, 19 nt, Homo sapiens
uccugacacugcccuuuaa

SEQ ID NO: 1478541 - RNA, 19 nt, Homo sapiens
ugacacugcccuuuaagag

SEQ ID NO: 1478542 - RNA, 19 nt, Homo sapiens
auuaacagguaaccacaau

SEQ ID NO: 1478543 - RNA, 19 nt, Homo sapiens
gaacucccuguuggaauuc

SEQ ID NO: 1478544 - RNA, 19 nt, Homo sapiens
acucacgucuggauucuac

SEQ ID NO: 1478545 - RNA, 19 nt, Homo sapiens
uagcccaucuucuggugau

SEQ ID NO: 1478546 - RNA, 19 nt, Homo sapiens
ccacaaccccaugcaguua

SEQ ID NO: 1478547 - RNA, 19 nt, Homo sapiens
acagguaaccacaaucaca

SEQ ID NO: 1478548 - RNA, 19 nt, Homo sapiens
agccucaguuuccucguuu

SEQ ID NO: 1478549 - RNA, 19 nt, Homo sapiens
ccauaaccccgucuucuuu

SEQ ID NO: 1478550 - RNA, 19 nt, Homo sapiens
uuccgaaagucaagugugu

SEQ ID NO: 1478551 - RNA, 19 nt, Homo sapiens
uggcuacgcuucuuacuua

SEQ ID NO: 1478552 - RNA, 19 nt, Homo sapiens
gaaaaugacuccagugugu

SEQ ID NO: 1478553 - RNA, 19 nt, Homo sapiens
aagcaagggucuucccaua

SEQ ID NO: 1478554 - RNA, 19 nt, Homo sapiens
ggguguggguccauauuaa

SEQ ID NO: 1478555 - RNA, 19 nt, Homo sapiens
caaaggcccagcugaguuu

SEQ ID NO: 1478556 - RNA, 19 nt, Homo sapiens
gcaaaggcccagcugaguu

SEQ ID NO: 1478557 - RNA, 19 nt, Homo sapiens
uagccaagauucagaggaa

SEQ ID NO: 1478558 - RNA, 19 nt, Homo sapiens
caacucaucuccucuucag

SEQ ID NO: 1478559 - RNA, 19 nt, Homo sapiens
gccaugaaguacccuuuga

SEQ ID NO: 1478560 - RNA, 19 nt, Homo sapiens
gguuugcuguuguuauuga

SEQ ID NO: 1478561 - RNA, 19 nt, Homo sapiens
gcaagggucuucccauacc

SEQ ID NO: 1478562 - RNA, 19 nt, Homo sapiens
caagaggacuuuggcaacu

SEQ ID NO: 1478563 - RNA, 19 nt, Homo sapiens
uggguuugcuguuguuauu

SEQ ID NO: 1478564 - RNA, 19 nt, Homo sapiens
guggguccauauuaaagaa

SEQ ID NO: 1478565 - RNA, 19 nt, Homo sapiens
gguguggguccauauuaaa

SEQ ID NO: 1478566 - RNA, 19 nt, Homo sapiens
caucuggcuacgcuucuua

SEQ ID NO: 1478567 - RNA, 19 nt, Homo sapiens
ugaacgaccucacauuuuc

SEQ ID NO: 1478568 - RNA, 19 nt, Homo sapiens
caugaaguacccuuugaug

SEQ ID NO: 1478569 - RNA, 19 nt, Homo sapiens
ggcaauggcagaaguggau

SEQ ID NO: 1478570 - RNA, 19 nt, Homo sapiens
ugaugccgcuggugaacga

SEQ ID NO: 1478571 - RNA, 19 nt, Homo sapiens
gaggguguggguccauauu

SEQ ID NO: 1478572 - RNA, 19 nt, Homo sapiens
ccucaaggcccacccaaag

SEQ ID NO: 1478573 - RNA, 19 nt, Homo sapiens
cggaggguguggguccaua

SEQ ID NO: 1478574 - RNA, 19 nt, Homo sapiens
ggcugccuccaccauauua

SEQ ID NO: 1478575 - RNA, 19 nt, Homo sapiens
agaggacuuuggcaacugu

SEQ ID NO: 1478576 - RNA, 19 nt, Homo sapiens
cagcagggcaguggcaaug

SEQ ID NO: 1478577 - RNA, 19 nt, Homo sapiens
ugggagcccuggagcaaag

SEQ ID NO: 1478578 - RNA, 19 nt, Homo sapiens
ccauauuagaguuugguuu

SEQ ID NO: 1478579 - RNA, 19 nt, Homo sapiens
ggaggguguggguccauau

SEQ ID NO: 1478580 - RNA, 19 nt, Homo sapiens
ccuccaccauauuagaguu

SEQ ID NO: 1478581 - RNA, 19 nt, Homo sapiens
ucagaggggucuuaaagca

SEQ ID NO: 1478582 - RNA, 19 nt, Homo sapiens
gaauauucuugcagaguuu

SEQ ID NO: 1478583 - RNA, 19 nt, Homo sapiens
gcccaaccauccagaauga

SEQ ID NO: 1478584 - RNA, 19 nt, Homo sapiens
ugaauauucuugcagaguu

SEQ ID NO: 1478585 - RNA, 19 nt, Homo sapiens
guaccaccauuuacuuaau

SEQ ID NO: 1478586 - RNA, 19 nt, Homo sapiens
gaugggcccugccuccuau

SEQ ID NO: 1478587 - RNA, 19 nt, Homo sapiens
ggaagaagggagagaaauc

SEQ ID NO: 1478588 - RNA, 19 nt, Homo sapiens
caaccauccagaaugaaua

SEQ ID NO: 1478589 - RNA, 19 nt, Homo sapiens
caaaauagcaccaugauag

SEQ ID NO: 1478590 - RNA, 19 nt, Homo sapiens
agaggcuaauucugauuua

SEQ ID NO: 1478591 - RNA, 19 nt, Homo sapiens
gagcuucccacccuuccua

SEQ ID NO: 1478592 - RNA, 19 nt, Homo sapiens
uuaaauggcucacuuuugu

SEQ ID NO: 1478593 - RNA, 19 nt, Homo sapiens
guuccagccuucugauaau

SEQ ID NO: 1478594 - RNA, 19 nt, Homo sapiens
gguuccagccuucugauaa

SEQ ID NO: 1478595 - RNA, 19 nt, Homo sapiens
gccggcagcagaaauauga

SEQ ID NO: 1478596 - RNA, 19 nt, Homo sapiens
auucaccucuuucaugauu

SEQ ID NO: 1478597 - RNA, 19 nt, Homo sapiens
gcaggaagaagggagagaa

SEQ ID NO: 1478598 - RNA, 19 nt, Homo sapiens
ucacuggccugcugacacu

SEQ ID NO: 1478599 - RNA, 19 nt, Homo sapiens
caccauaccuacaaaauag

SEQ ID NO: 1478600 - RNA, 19 nt, Homo sapiens
gaagaagggagagaaaucg

SEQ ID NO: 1478601 - RNA, 19 nt, Homo sapiens
ugagccggcagcagaaaua

SEQ ID NO: 1478602 - RNA, 19 nt, Homo sapiens
ucacaccaauccguacaug

SEQ ID NO: 1478603 - RNA, 19 nt, Homo sapiens
caucagucauucaccucuu

SEQ ID NO: 1478604 - RNA, 19 nt, Homo sapiens
ggaccaacggaaagaguuc

SEQ ID NO: 1478605 - RNA, 19 nt, Homo sapiens
gucauucaccucuuucaug

SEQ ID NO: 1478606 - RNA, 19 nt, Homo sapiens
ccaaccauccagaaugaau

SEQ ID NO: 1478607 - RNA, 19 nt, Homo sapiens
ccaugaaccaccuguguca

SEQ ID NO: 1478608 - RNA, 19 nt, Homo sapiens
caggaagaagggagagaaa

SEQ ID NO: 1478609 - RNA, 19 nt, Homo sapiens
caggaagugcugcuacaga

SEQ ID NO: 1478610 - RNA, 19 nt, Homo sapiens
cugcaccacugccauacga

SEQ ID NO: 1478611 - RNA, 19 nt, Homo sapiens
gggaccaacggaaagaguu

SEQ ID NO: 1478612 - RNA, 19 nt, Homo sapiens
aauagcaccaugauagguu

SEQ ID NO: 1478613 - RNA, 19 nt, Homo sapiens
cugccuguaccaccauuua

SEQ ID NO: 1478614 - RNA, 19 nt, Homo sapiens
ucaccauaccuacaaaaua

SEQ ID NO: 1478615 - RNA, 19 nt, Homo sapiens
ucaccucuuucaugauuuu

SEQ ID NO: 1478616 - RNA, 19 nt, Homo sapiens
ccuaacgcuuucacaccaa

SEQ ID NO: 1478617 - RNA, 19 nt, Homo sapiens
uguaccaccauuuacuuaa

SEQ ID NO: 1478618 - RNA, 19 nt, Homo sapiens
uuccaaacaucagucauuc

SEQ ID NO: 1478619 - RNA, 19 nt, Homo sapiens
ccacccuuccuaacgcuuu

SEQ ID NO: 1478620 - RNA, 19 nt, Homo sapiens
agaaaccacuucacuaaua

SEQ ID NO: 1478621 - RNA, 19 nt, Homo sapiens
ggaaaugccguuuggauaa

SEQ ID NO: 1478622 - RNA, 19 nt, Homo sapiens
gaaccaagcuuacucucau

SEQ ID NO: 1478623 - RNA, 19 nt, Homo sapiens
agaaucacaugcacacuua

SEQ ID NO: 1478624 - RNA, 19 nt, Homo sapiens
gagacaagccugggauuua

SEQ ID NO: 1478625 - RNA, 19 nt, Homo sapiens
gcacuucuguuuaccuguu

SEQ ID NO: 1478626 - RNA, 19 nt, Homo sapiens
gaaaugccguuuggauaau

SEQ ID NO: 1478627 - RNA, 19 nt, Homo sapiens
ugaaggagguggacacaug

SEQ ID NO: 1478628 - RNA, 19 nt, Homo sapiens
gaaaccacuucacuaauac

SEQ ID NO: 1478629 - RNA, 19 nt, Homo sapiens
ggaagucugugcuccugaa

SEQ ID NO: 1478630 - RNA, 19 nt, Homo sapiens
ucaaccagcuucuuuauac

SEQ ID NO: 1478631 - RNA, 19 nt, Homo sapiens
ucacaugcacacuuaaaua

SEQ ID NO: 1478632 - RNA, 19 nt, Homo sapiens
gaaccagaaugugucagaa

SEQ ID NO: 1478633 - RNA, 19 nt, Homo sapiens
gaaaaggccuggacuugga

SEQ ID NO: 1478634 - RNA, 19 nt, Homo sapiens
agagaaaccacuucacuaa

SEQ ID NO: 1478635 - RNA, 19 nt, Homo sapiens
gauggacccuggccacaug

SEQ ID NO: 1478636 - RNA, 19 nt, Homo sapiens
gaagucagaggaaccagaa

SEQ ID NO: 1478637 - RNA, 19 nt, Homo sapiens
caugcacacuuaaauauuc

SEQ ID NO: 1478638 - RNA, 19 nt, Homo sapiens
ggacaaaggccucaaucca

SEQ ID NO: 1478639 - RNA, 19 nt, Homo sapiens
ucacacagaccaagaguau

SEQ ID NO: 1478640 - RNA, 19 nt, Homo sapiens
caaaauggcacuucuguuu

SEQ ID NO: 1478641 - RNA, 19 nt, Homo sapiens
ccagagccguggaagcaaa

SEQ ID NO: 1478642 - RNA, 19 nt, Homo sapiens
cauaugagcaggcuauuuc

SEQ ID NO: 1478643 - RNA, 19 nt, Homo sapiens
uccaguaccucucaaauca

SEQ ID NO: 1478644 - RNA, 19 nt, Homo sapiens
gaaggagguggacacauga

SEQ ID NO: 1478645 - RNA, 19 nt, Homo sapiens
ggauggaccucacgugacu

SEQ ID NO: 1478646 - RNA, 19 nt, Homo sapiens
cacaauugcugaagaugga

SEQ ID NO: 1478647 - RNA, 19 nt, Homo sapiens
gauaagagaaaccacuuca

SEQ ID NO: 1478648 - RNA, 19 nt, Homo sapiens
ggagacaagccugggauuu

SEQ ID NO: 1478649 - RNA, 19 nt, Homo sapiens
ggagagaggaguaaaugca

SEQ ID NO: 1478650 - RNA, 19 nt, Homo sapiens
gaacuccagccaugccauu

SEQ ID NO: 1478651 - RNA, 19 nt, Homo sapiens
agacacgccugcccagcua

SEQ ID NO: 1478652 - RNA, 19 nt, Homo sapiens
agacauaacagcagaaagu

SEQ ID NO: 1478653 - RNA, 19 nt, Homo sapiens
gagaaaccacuucacuaau

SEQ ID NO: 1478654 - RNA, 19 nt, Homo sapiens
ccaucuggcugguuccauu

SEQ ID NO: 1478655 - RNA, 19 nt, Homo sapiens
gcgaagaggcucagaagag

SEQ ID NO: 1478656 - RNA, 19 nt, Homo sapiens
ggaaccagaaugugucaga

SEQ ID NO: 1478657 - RNA, 19 nt, Homo sapiens
gccuuucacucucuccuuu

SEQ ID NO: 1478658 - RNA, 19 nt, Homo sapiens
uggaaaugccguuuggaua

SEQ ID NO: 1478659 - RNA, 19 nt, Homo sapiens
ccaccgccuuucuccagua

SEQ ID NO: 1478660 - RNA, 19 nt, Homo sapiens
ggcuaacacuggagacgaa

SEQ ID NO: 1478661 - RNA, 19 nt, Homo sapiens
ggaaccaagcuuacucuca

SEQ ID NO: 1478662 - RNA, 19 nt, Homo sapiens
ggaauccauuaaacugaca

SEQ ID NO: 1478663 - RNA, 19 nt, Homo sapiens
ggauuuacacucaguccuu

SEQ ID NO: 1478664 - RNA, 19 nt, Homo sapiens
ggcuauuucugcuccauga

SEQ ID NO: 1478665 - RNA, 19 nt, Homo sapiens
aaauggcacuucuguuuac

SEQ ID NO: 1478666 - RNA, 19 nt, Homo sapiens
ccaagacaccaccgccuuu

SEQ ID NO: 1478667 - RNA, 19 nt, Homo sapiens
agaguaucuuugaggguua

SEQ ID NO: 1478668 - RNA, 19 nt, Homo sapiens
agacaagccugggauuuac

SEQ ID NO: 1478669 - RNA, 19 nt, Homo sapiens
cacaugcacacuuaaauau

SEQ ID NO: 1478670 - RNA, 19 nt, Homo sapiens
guacagaccacagaaaugc

SEQ ID NO: 1478671 - RNA, 19 nt, Homo sapiens
aagagaaaccacuucacua

SEQ ID NO: 1478672 - RNA, 19 nt, Homo sapiens
uaagagaaaccacuucacu

SEQ ID NO: 1478673 - RNA, 19 nt, Homo sapiens
ucaugugccugagcucaaa

SEQ ID NO: 1478674 - RNA, 19 nt, Homo sapiens
cagaggaaccagaaugugu

SEQ ID NO: 1478675 - RNA, 19 nt, Homo sapiens
gcacaggcaaggacaaagg

SEQ ID NO: 1478676 - RNA, 19 nt, Homo sapiens
cacaugggauggucagaca

SEQ ID NO: 1478677 - RNA, 19 nt, Homo sapiens
gaagaagucagaggaacca

SEQ ID NO: 1478678 - RNA, 19 nt, Homo sapiens
guucaaccagcuucuuuau

SEQ ID NO: 1478679 - RNA, 19 nt, Homo sapiens
acacagaccaagaguaucu

SEQ ID NO: 1478680 - RNA, 19 nt, Homo sapiens
gcguguggccuuacugguu

SEQ ID NO: 1478681 - RNA, 19 nt, Homo sapiens
agaaaguccucggaaccaa

SEQ ID NO: 1478682 - RNA, 19 nt, Homo sapiens
aaggacaucuugcuuccau

SEQ ID NO: 1478683 - RNA, 19 nt, Homo sapiens
aauccacaauugcugaaga

SEQ ID NO: 1478684 - RNA, 19 nt, Homo sapiens
gcagaccccuggaagaauc

SEQ ID NO: 1478685 - RNA, 19 nt, Homo sapiens
gagucaauuuugccauaua

SEQ ID NO: 1478686 - RNA, 19 nt, Homo sapiens
acucaggccucuagacucu

SEQ ID NO: 1478687 - RNA, 19 nt, Homo sapiens
guacucaggccucuagacu

SEQ ID NO: 1478688 - RNA, 19 nt, Homo sapiens
cagaugggaagaagucaga

SEQ ID NO: 1478689 - RNA, 19 nt, Homo sapiens
ggccuggacuuggagacaa

SEQ ID NO: 1478690 - RNA, 19 nt, Homo sapiens
gaaucacaugcacacuuaa

SEQ ID NO: 1478691 - RNA, 19 nt, Homo sapiens
cuaccggccuuguccaucu

SEQ ID NO: 1478692 - RNA, 19 nt, Homo sapiens
aaaauggcacuucuguuua

SEQ ID NO: 1478693 - RNA, 19 nt, Homo sapiens
ggggacaguuggcagagua

SEQ ID NO: 1478694 - RNA, 19 nt, Homo sapiens
aaucacaugcacacuuaaa

SEQ ID NO: 1478695 - RNA, 19 nt, Homo sapiens
gaaaaugccaagucaugug

SEQ ID NO: 1478696 - RNA, 19 nt, Homo sapiens
ucuuuacagugguagguuu

SEQ ID NO: 1478697 - RNA, 19 nt, Homo sapiens
ggcauccuguggucagaau

SEQ ID NO: 1478698 - RNA, 19 nt, Homo sapiens
cacuucuguuuaccuguua

SEQ ID NO: 1478699 - RNA, 19 nt, Homo sapiens
guucagucuucuuuacagu

SEQ ID NO: 1478700 - RNA, 19 nt, Homo sapiens
ggacaguuggcagaguauu

SEQ ID NO: 1478701 - RNA, 19 nt, Homo sapiens
gacaguuggcagaguauuc

SEQ ID NO: 1478702 - RNA, 19 nt, Homo sapiens
guaauuacagacauaacag

SEQ ID NO: 1478703 - RNA, 19 nt, Homo sapiens
ccauaugagcaggcuauuu

SEQ ID NO: 1478704 - RNA, 19 nt, Homo sapiens
cuuuauaccucuuuucuug

SEQ ID NO: 1478705 - RNA, 19 nt, Homo sapiens
caaggacaaaggccucaau

SEQ ID NO: 1478706 - RNA, 19 nt, Homo sapiens
cagcacaggcaaggacaaa

SEQ ID NO: 1478707 - RNA, 19 nt, Homo sapiens
auccuuauaugcuuggaaa

SEQ ID NO: 1478708 - RNA, 19 nt, Homo sapiens
gaggaaccagaauguguca

SEQ ID NO: 1478709 - RNA, 19 nt, Homo sapiens
caucuggcugguuccauuu

SEQ ID NO: 1478710 - RNA, 19 nt, Homo sapiens
agccugggauuuacacuca

SEQ ID NO: 1478711 - RNA, 19 nt, Homo sapiens
aagaaucacaugcacacuu

SEQ ID NO: 1478712 - RNA, 19 nt, Homo sapiens
agucuucuuuacaguggua

SEQ ID NO: 1478713 - RNA, 19 nt, Homo sapiens
guggaaaugccguuuggau

SEQ ID NO: 1478714 - RNA, 19 nt, Homo sapiens
cagaaugugucagaaaaug

SEQ ID NO: 1478715 - RNA, 19 nt, Homo sapiens
agucugugcuccugaacau

SEQ ID NO: 1478716 - RNA, 19 nt, Homo sapiens
gguucagucuucuuuacag

SEQ ID NO: 1478717 - RNA, 19 nt, Homo sapiens
gauaaugagggagccugaa

SEQ ID NO: 1478718 - RNA, 19 nt, Homo sapiens
gaucacacagaccaagagu

SEQ ID NO: 1478719 - RNA, 19 nt, Homo sapiens
uugcuuccauguccauaug

SEQ ID NO: 1478720 - RNA, 19 nt, Homo sapiens
gaaaaucacucaacuaaga

SEQ ID NO: 1478721 - RNA, 19 nt, Homo sapiens
gcaagugccugucucagaa

SEQ ID NO: 1478722 - RNA, 19 nt, Homo sapiens
ggaaggaaguacaucuuug

SEQ ID NO: 1478723 - RNA, 19 nt, Homo sapiens
gcagcagaauguaaugaaa

SEQ ID NO: 1478724 - RNA, 19 nt, Homo sapiens
gcugggacauuacaugaaa

SEQ ID NO: 1478725 - RNA, 19 nt, Homo sapiens
gacauucucugaggaguaa

SEQ ID NO: 1478726 - RNA, 19 nt, Homo sapiens
gacauuacaugaaaucaca

SEQ ID NO: 1478727 - RNA, 19 nt, Homo sapiens
ccaggacugucaaaggaua

SEQ ID NO: 1478728 - RNA, 19 nt, Homo sapiens
gaugauggccuucggaaau

SEQ ID NO: 1478729 - RNA, 19 nt, Homo sapiens
gggagccuuuccuuaauaa

SEQ ID NO: 1478730 - RNA, 19 nt, Homo sapiens
gcagggacccagccaagaa

SEQ ID NO: 1478731 - RNA, 19 nt, Homo sapiens
ggacauucucugaggagua

SEQ ID NO: 1478732 - RNA, 19 nt, Homo sapiens
gcuugacccugcugugaaa

SEQ ID NO: 1478733 - RNA, 19 nt, Homo sapiens
gccaucagcgugugacaua

SEQ ID NO: 1478734 - RNA, 19 nt, Homo sapiens
ccagacaccaguaacuuaa

SEQ ID NO: 1478735 - RNA, 19 nt, Homo sapiens
ugggagccuuuccuuaaua

SEQ ID NO: 1478736 - RNA, 19 nt, Homo sapiens
gccaggcucugcaaacuca

SEQ ID NO: 1478737 - RNA, 19 nt, Homo sapiens
gaaggaaguacaucuuugg

SEQ ID NO: 1478738 - RNA, 19 nt, Homo sapiens
cgugugacauaagagauua

SEQ ID NO: 1478739 - RNA, 19 nt, Homo sapiens
cagcgaggcuuucaguucu

SEQ ID NO: 1478740 - RNA, 19 nt, Homo sapiens
gcacucccuuuccucuaga

SEQ ID NO: 1478741 - RNA, 19 nt, Homo sapiens
ggaguaauuuaugcucuag

SEQ ID NO: 1478742 - RNA, 19 nt, Homo sapiens
auuaagugcuuugagguua

SEQ ID NO: 1478743 - RNA, 19 nt, Homo sapiens
ggacugucaaaggauauua

SEQ ID NO: 1478744 - RNA, 19 nt, Homo sapiens
gcgaggcuuucaguucuuu

SEQ ID NO: 1478745 - RNA, 19 nt, Homo sapiens
ccugugaccugguauugga

SEQ ID NO: 1478746 - RNA, 19 nt, Homo sapiens
agacaccaguaacuuaaau

SEQ ID NO: 1478747 - RNA, 19 nt, Homo sapiens
ucugggagccuuuccuuaa

SEQ ID NO: 1478748 - RNA, 19 nt, Homo sapiens
uaagugcuuugagguuaaa

SEQ ID NO: 1478749 - RNA, 19 nt, Homo sapiens
ugaaaggccagucagagaa

SEQ ID NO: 1478750 - RNA, 19 nt, Homo sapiens
caacagcgaggcuuucagu

SEQ ID NO: 1478751 - RNA, 19 nt, Homo sapiens
cagaaaaucacucaacuaa

SEQ ID NO: 1478752 - RNA, 19 nt, Homo sapiens
gaaaggccagucagagaag

SEQ ID NO: 1478753 - RNA, 19 nt, Homo sapiens
gugaaaggccagucagaga

SEQ ID NO: 1478754 - RNA, 19 nt, Homo sapiens
ugucaaaggauauuacuca

SEQ ID NO: 1478755 - RNA, 19 nt, Homo sapiens
gccaugaccagcaguguug

SEQ ID NO: 1478756 - RNA, 19 nt, Homo sapiens
gaggaaggaaguacaucuu

SEQ ID NO: 1478757 - RNA, 19 nt, Homo sapiens
ccagggacacccacuucua

SEQ ID NO: 1478758 - RNA, 19 nt, Homo sapiens
uaaaggcuggcaccuguga

SEQ ID NO: 1478759 - RNA, 19 nt, Homo sapiens
cagagaaggaagaggauga

SEQ ID NO: 1478760 - RNA, 19 nt, Homo sapiens
gacaccaguaacuuaaaua

SEQ ID NO: 1478761 - RNA, 19 nt, Homo sapiens
ucccuacccucccauuuau

SEQ ID NO: 1478762 - RNA, 19 nt, Homo sapiens
uggcaccugugaccuggua

SEQ ID NO: 1478763 - RNA, 19 nt, Homo sapiens
uguaaugaaagaccuguaa

SEQ ID NO: 1478764 - RNA, 19 nt, Homo sapiens
ucucugaggaguaauuuau

SEQ ID NO: 1478765 - RNA, 19 nt, Homo sapiens
ccuacccucccauuuauuu

SEQ ID NO: 1478766 - RNA, 19 nt, Homo sapiens
aggaguaauuuaugcucua

SEQ ID NO: 1478767 - RNA, 19 nt, Homo sapiens
acccaggacugucaaagga

SEQ ID NO: 1478768 - RNA, 19 nt, Homo sapiens
ggaggaaggaaguacaucu

SEQ ID NO: 1478769 - RNA, 19 nt, Homo sapiens
aguaugcccuccgcaguuu

SEQ ID NO: 1478770 - RNA, 19 nt, Homo sapiens
ugaaauguuuggucaucca

SEQ ID NO: 1478771 - RNA, 19 nt, Homo sapiens
agcagaauguaaugaaaga

SEQ ID NO: 1478772 - RNA, 19 nt, Homo sapiens
gcuuucaguucuuuggaau

SEQ ID NO: 1478773 - RNA, 19 nt, Homo sapiens
uccagacaccaguaacuua

SEQ ID NO: 1478774 - RNA, 19 nt, Homo sapiens
gcaccugugaccugguauu

SEQ ID NO: 1478775 - RNA, 19 nt, Homo sapiens
ggaugauggccuucggaaa

SEQ ID NO: 1478776 - RNA, 19 nt, Homo sapiens
ggcuuucaguucuuuggaa

SEQ ID NO: 1478777 - RNA, 19 nt, Homo sapiens
ccaucagcgugugacauaa

SEQ ID NO: 1478778 - RNA, 19 nt, Homo sapiens
uuucaguucuuuggaauuc

SEQ ID NO: 1478779 - RNA, 19 nt, Homo sapiens
gagccagucagcccauaug

SEQ ID NO: 1478780 - RNA, 19 nt, Homo sapiens
uggaggugcugugccauga

SEQ ID NO: 1478781 - RNA, 19 nt, Homo sapiens
gcgugugacauaagagauu

SEQ ID NO: 1478782 - RNA, 19 nt, Homo sapiens
gccaaacccaggacuguca

SEQ ID NO: 1478783 - RNA, 19 nt, Homo sapiens
caagugccugucucagaaa

SEQ ID NO: 1478784 - RNA, 19 nt, Homo sapiens
gagccuuuccuuaauaaac

SEQ ID NO: 1478785 - RNA, 19 nt, Homo sapiens
cugggagccuuuccuuaau

SEQ ID NO: 1478786 - RNA, 19 nt, Homo sapiens
uucccuacccucccauuua

SEQ ID NO: 1478787 - RNA, 19 nt, Homo sapiens
ggacauuacaugaaaucac

SEQ ID NO: 1478788 - RNA, 19 nt, Homo sapiens
caaucccaauuaagugcuu

SEQ ID NO: 1478789 - RNA, 19 nt, Homo sapiens
aggaaggaaguacaucuuu

SEQ ID NO: 1478790 - RNA, 19 nt, Homo sapiens
gguugcggauggugagugu

SEQ ID NO: 1478791 - RNA, 19 nt, Homo sapiens
cuacccucccauuuauuua

SEQ ID NO: 1478792 - RNA, 19 nt, Homo sapiens
aaggaaggacauucucuga

SEQ ID NO: 1478793 - RNA, 19 nt, Homo sapiens
cagcagaauguaaugaaag

SEQ ID NO: 1478794 - RNA, 19 nt, Homo sapiens
gucaaaggauauuacucau

SEQ ID NO: 1478795 - RNA, 19 nt, Homo sapiens
uauuacucauuuccucuug

SEQ ID NO: 1478796 - RNA, 19 nt, Homo sapiens
acagcgaggcuuucaguuc

SEQ ID NO: 1478797 - RNA, 19 nt, Homo sapiens
gaggcugggacauuacaug

SEQ ID NO: 1478798 - RNA, 19 nt, Homo sapiens
gauccagacaccaguaacu

SEQ ID NO: 1478799 - RNA, 19 nt, Homo sapiens
ggagccagucagcccauau

SEQ ID NO: 1478800 - RNA, 19 nt, Homo sapiens
gcccaaucccaauuaagug

SEQ ID NO: 1478801 - RNA, 19 nt, Homo sapiens
ggugugcaggguaguaaug

SEQ ID NO: 1478802 - RNA, 19 nt, Homo sapiens
cagacaccaguaacuuaaa

SEQ ID NO: 1478803 - RNA, 19 nt, Homo sapiens
gcaaacucacucucugcau

SEQ ID NO: 1478804 - RNA, 19 nt, Homo sapiens
uuacucauuuccucuugca

SEQ ID NO: 1478805 - RNA, 19 nt, Homo sapiens
cggcuuuucuccucaguuu

SEQ ID NO: 1478806 - RNA, 19 nt, Homo sapiens
gagaggagcuugacaaaga

SEQ ID NO: 1478807 - RNA, 19 nt, Homo sapiens
gagaggagauuuaugagua

SEQ ID NO: 1478808 - RNA, 19 nt, Homo sapiens
gaagugacaucaaggauau

SEQ ID NO: 1478809 - RNA, 19 nt, Homo sapiens
gcgcauagccuaauucuaa

SEQ ID NO: 1478810 - RNA, 19 nt, Homo sapiens
ggacuuaacugaacuugga

SEQ ID NO: 1478811 - RNA, 19 nt, Homo sapiens
gaagagacccauacugcua

SEQ ID NO: 1478812 - RNA, 19 nt, Homo sapiens
ggaagugacaucaaggaua

SEQ ID NO: 1478813 - RNA, 19 nt, Homo sapiens
ggaaacaggcgaacaagga

SEQ ID NO: 1478814 - RNA, 19 nt, Homo sapiens
ccagagaggagauuuauga

SEQ ID NO: 1478815 - RNA, 19 nt, Homo sapiens
gaagaccgucccacagaua

SEQ ID NO: 1478816 - RNA, 19 nt, Homo sapiens
ggacauggucugaguuaga

SEQ ID NO: 1478817 - RNA, 19 nt, Homo sapiens
caacuaacguuaaggaaaa

SEQ ID NO: 1478818 - RNA, 19 nt, Homo sapiens
gacauggucugaguuagaa

SEQ ID NO: 1478819 - RNA, 19 nt, Homo sapiens
gaacuuggacauggucuga

SEQ ID NO: 1478820 - RNA, 19 nt, Homo sapiens
caaauuugagggugacuuu

SEQ ID NO: 1478821 - RNA, 19 nt, Homo sapiens
gaaacaggcgaacaaggaa

SEQ ID NO: 1478822 - RNA, 19 nt, Homo sapiens
gagcuugacaaagaauuua

SEQ ID NO: 1478823 - RNA, 19 nt, Homo sapiens
gggaaguauucauggguaa

SEQ ID NO: 1478824 - RNA, 19 nt, Homo sapiens
gagaacagaagaccucaga

SEQ ID NO: 1478825 - RNA, 19 nt, Homo sapiens
caagacggccagcgaugua

SEQ ID NO: 1478826 - RNA, 19 nt, Homo sapiens
cugacaaccugaaugcuaa

SEQ ID NO: 1478827 - RNA, 19 nt, Homo sapiens
gcugacaaccugaaugcua

SEQ ID NO: 1478828 - RNA, 19 nt, Homo sapiens
ccaacuaacguuaaggaaa

SEQ ID NO: 1478829 - RNA, 19 nt, Homo sapiens
uuucagagcuugacuuguc

SEQ ID NO: 1478830 - RNA, 19 nt, Homo sapiens
uagccuaauucuaagguuu

SEQ ID NO: 1478831 - RNA, 19 nt, Homo sapiens
ggagcuugacaaagaauuu

SEQ ID NO: 1478832 - RNA, 19 nt, Homo sapiens
ggagauuuaugaguacauc

SEQ ID NO: 1478833 - RNA, 19 nt, Homo sapiens
gaguuagaaccacuuguuu

SEQ ID NO: 1478834 - RNA, 19 nt, Homo sapiens
gcaggugaaugacgagaac

SEQ ID NO: 1478835 - RNA, 19 nt, Homo sapiens
ugacuuugauuucgagagu

SEQ ID NO: 1478836 - RNA, 19 nt, Homo sapiens
cagaggaggcgaucaggaa

SEQ ID NO: 1478837 - RNA, 19 nt, Homo sapiens
auucauggguaaccucuuu

SEQ ID NO: 1478838 - RNA, 19 nt, Homo sapiens
gagugcaaaugcccaguuc

SEQ ID NO: 1478839 - RNA, 19 nt, Homo sapiens
gggcaaaaccguccaacua

SEQ ID NO: 1478840 - RNA, 19 nt, Homo sapiens
ugaguuagaaccacuuguu

SEQ ID NO: 1478841 - RNA, 19 nt, Homo sapiens
gaaugacgagaacagaaga

SEQ ID NO: 1478842 - RNA, 19 nt, Homo sapiens
agaggagcuugacaaagaa

SEQ ID NO: 1478843 - RNA, 19 nt, Homo sapiens
ugaagaccgucccacagau

SEQ ID NO: 1478844 - RNA, 19 nt, Homo sapiens
gagaggagcugguuuucca

SEQ ID NO: 1478845 - RNA, 19 nt, Homo sapiens
gcaggaucccgccauuguu

SEQ ID NO: 1478846 - RNA, 19 nt, Homo sapiens
gcaagacggccagcgaugu

SEQ ID NO: 1478847 - RNA, 19 nt, Homo sapiens
ggagagaggagcugguuuu

SEQ ID NO: 1478848 - RNA, 19 nt, Homo sapiens
ccgaggaagugacaucaag

SEQ ID NO: 1478849 - RNA, 19 nt, Homo sapiens
gaggaagugacaucaagga

SEQ ID NO: 1478850 - RNA, 19 nt, Homo sapiens
gugcaaaugcccaguucaa

SEQ ID NO: 1478851 - RNA, 19 nt, Homo sapiens
ucaggaaacaggcgaacaa

SEQ ID NO: 1478852 - RNA, 19 nt, Homo sapiens
cuuuaucuguguuuccuuu

SEQ ID NO: 1478853 - RNA, 19 nt, Homo sapiens
ccacagggacgcagcucaa

SEQ ID NO: 1478854 - RNA, 19 nt, Homo sapiens
gagggugacuuugauuucg

SEQ ID NO: 1478855 - RNA, 19 nt, Homo sapiens
ggagcaggcugugcagacu

SEQ ID NO: 1478856 - RNA, 19 nt, Homo sapiens
ucuuugaggucucuuuauc

SEQ ID NO: 1478857 - RNA, 19 nt, Homo sapiens
ccauacugcuacuuguguu

SEQ ID NO: 1478858 - RNA, 19 nt, Homo sapiens
gacccauacugcuacuugu

SEQ ID NO: 1478859 - RNA, 19 nt, Homo sapiens
ggcaaaaccguccaacuaa

SEQ ID NO: 1478860 - RNA, 19 nt, Homo sapiens
gaggagauuuaugaguaca

SEQ ID NO: 1478861 - RNA, 19 nt, Homo sapiens
gugaaugacgagaacagaa

SEQ ID NO: 1478862 - RNA, 19 nt, Homo sapiens
uccgaaagcucagcacaca

SEQ ID NO: 1478863 - RNA, 19 nt, Homo sapiens
gucccacauuguccuguuu

SEQ ID NO: 1478864 - RNA, 19 nt, Homo sapiens
ggucuagagaaguugguaa

SEQ ID NO: 1478865 - RNA, 19 nt, Homo sapiens
gagguccuuuggcacugaa

SEQ ID NO: 1478866 - RNA, 19 nt, Homo sapiens
uaagaagagacccauacug

SEQ ID NO: 1478867 - RNA, 19 nt, Homo sapiens
gcaaaaccguccaacuaac

SEQ ID NO: 1478868 - RNA, 19 nt, Homo sapiens
cgaaagcucagcacacacu

SEQ ID NO: 1478869 - RNA, 19 nt, Homo sapiens
caggaucccgccauuguuc

SEQ ID NO: 1478870 - RNA, 19 nt, Homo sapiens
ccgagaggagcuugacaaa

SEQ ID NO: 1478871 - RNA, 19 nt, Homo sapiens
ugaaugacgagaacagaag

SEQ ID NO: 1478872 - RNA, 19 nt, Homo sapiens
cugaagaccgucccacaga

SEQ ID NO: 1478873 - RNA, 19 nt, Homo sapiens
uuugaggucucuuuaucug

SEQ ID NO: 1478874 - RNA, 19 nt, Homo sapiens
ugagguccuuuggcacuga

SEQ ID NO: 1478875 - RNA, 19 nt, Homo sapiens
gaggucucuuuaucugugu

SEQ ID NO: 1478876 - RNA, 19 nt, Homo sapiens
agaggagauuuaugaguac

SEQ ID NO: 1478877 - RNA, 19 nt, Homo sapiens
gguccuggaaccuuggaaa

SEQ ID NO: 1478878 - RNA, 19 nt, Homo sapiens
ccacauuguccuguuuaga

SEQ ID NO: 1478879 - RNA, 19 nt, Homo sapiens
agacccauacugcuacuug

SEQ ID NO: 1478880 - RNA, 19 nt, Homo sapiens
ugagggugacuuugauuuc

SEQ ID NO: 1478881 - RNA, 19 nt, Homo sapiens
cacauuguccuguuuagag

SEQ ID NO: 1478882 - RNA, 19 nt, Homo sapiens
cuccacagcccguuucaga

SEQ ID NO: 1478883 - RNA, 19 nt, Homo sapiens
uuggacauggucugaguua

SEQ ID NO: 1478884 - RNA, 19 nt, Homo sapiens
aauuugagggugacuuuga

SEQ ID NO: 1478885 - RNA, 19 nt, Homo sapiens
acauuguccuguuuagagu

SEQ ID NO: 1478886 - RNA, 19 nt, Homo sapiens
caacacagcuguccauuau

SEQ ID NO: 1478887 - RNA, 19 nt, Homo sapiens
gaacaaggcuggccacaca

SEQ ID NO: 1478888 - RNA, 19 nt, Homo sapiens
guacagacauuaaagugaa

SEQ ID NO: 1478889 - RNA, 19 nt, Homo sapiens
caaauggaguugauaaguu

SEQ ID NO: 1478890 - RNA, 19 nt, Homo sapiens
gaaaagaagugagcaaauu

SEQ ID NO: 1478891 - RNA, 19 nt, Homo sapiens
ggaaagaacaccugacgaa

SEQ ID NO: 1478892 - RNA, 19 nt, Homo sapiens
gaaggaacaucugaaggaa

SEQ ID NO: 1478893 - RNA, 19 nt, Homo sapiens
gcugaaagcuugguggaaa

SEQ ID NO: 1478894 - RNA, 19 nt, Homo sapiens
gugcaaauauucucauaga

SEQ ID NO: 1478895 - RNA, 19 nt, Homo sapiens
aaagaacaccugacgaaua

SEQ ID NO: 1478896 - RNA, 19 nt, Homo sapiens
gagggaggcuugugcaaau

SEQ ID NO: 1478897 - RNA, 19 nt, Homo sapiens
gcaacacagcuguccauua

SEQ ID NO: 1478898 - RNA, 19 nt, Homo sapiens
aagaacaccugacgaauag

SEQ ID NO: 1478899 - RNA, 19 nt, Homo sapiens
cgaauaggauacagugaau

SEQ ID NO: 1478900 - RNA, 19 nt, Homo sapiens
ggaagauuaaguacaauga

SEQ ID NO: 1478901 - RNA, 19 nt, Homo sapiens
uaaguacaaugaguucuga

SEQ ID NO: 1478902 - RNA, 19 nt, Homo sapiens
ccucaucaaagaacaaaua

SEQ ID NO: 1478903 - RNA, 19 nt, Homo sapiens
gaacaccugacgaauagga

SEQ ID NO: 1478904 - RNA, 19 nt, Homo sapiens
gaaagaacaccugacgaau

SEQ ID NO: 1478905 - RNA, 19 nt, Homo sapiens
ggaggcuugugcaaauauu

SEQ ID NO: 1478906 - RNA, 19 nt, Homo sapiens
gcaaauggaguugauaagu

SEQ ID NO: 1478907 - RNA, 19 nt, Homo sapiens
aaauugcuguccuguggua

SEQ ID NO: 1478908 - RNA, 19 nt, Homo sapiens
guacaaugaguucugaguu

SEQ ID NO: 1478909 - RNA, 19 nt, Homo sapiens
uacaaugaguucugaguuc

SEQ ID NO: 1478910 - RNA, 19 nt, Homo sapiens
acacagcuguccauuaugc

SEQ ID NO: 1478911 - RNA, 19 nt, Homo sapiens
agaaggaacaucugaagga

SEQ ID NO: 1478912 - RNA, 19 nt, Homo sapiens
gguacagacauuaaaguga

SEQ ID NO: 1478913 - RNA, 19 nt, Homo sapiens
aggaacaucugaaggaaca

SEQ ID NO: 1478914 - RNA, 19 nt, Homo sapiens
aaauaguaauccagaagga

SEQ ID NO: 1478915 - RNA, 19 nt, Homo sapiens
gcaaaugcaaauggaguug

SEQ ID NO: 1478916 - RNA, 19 nt, Homo sapiens
gugcugauccaaauauugu

SEQ ID NO: 1478917 - RNA, 19 nt, Homo sapiens
gacauuaaagugaagaaca

SEQ ID NO: 1478918 - RNA, 19 nt, Homo sapiens
gaauaggauacagugaauu

SEQ ID NO: 1478919 - RNA, 19 nt, Homo sapiens
ccacacaccacuuuuauug

SEQ ID NO: 1478920 - RNA, 19 nt, Homo sapiens
uaacagugagaauuuguca

SEQ ID NO: 1478921 - RNA, 19 nt, Homo sapiens
gaagauuaaguacaaugag

SEQ ID NO: 1478922 - RNA, 19 nt, Homo sapiens
cauagauucuggugcugau

SEQ ID NO: 1478923 - RNA, 19 nt, Homo sapiens
gauuaaguacaaugaguuc

SEQ ID NO: 1478924 - RNA, 19 nt, Homo sapiens
aaaugcaaauggaguugau

SEQ ID NO: 1478925 - RNA, 19 nt, Homo sapiens
guagauguguauggcaaca

SEQ ID NO: 1478926 - RNA, 19 nt, Homo sapiens
gggaagauuaaguacaaug

SEQ ID NO: 1478927 - RNA, 19 nt, Homo sapiens
ccaaauauuguagaugugu

SEQ ID NO: 1478928 - RNA, 19 nt, Homo sapiens
aauaggauacagugaauuc

SEQ ID NO: 1478929 - RNA, 19 nt, Homo sapiens
gcuguccauuaugcuguua

SEQ ID NO: 1478930 - RNA, 19 nt, Homo sapiens
caaaugcaaauggaguuga

SEQ ID NO: 1478931 - RNA, 19 nt, Homo sapiens
aaagaagugagcaaauugu

SEQ ID NO: 1478932 - RNA, 19 nt, Homo sapiens
ucaaagauuuuagccugua

SEQ ID NO: 1478933 - RNA, 19 nt, Homo sapiens
caaagauuuuagccuguaa

SEQ ID NO: 1478934 - RNA, 19 nt, Homo sapiens
gaaagcuugguggaaagaa

SEQ ID NO: 1478935 - RNA, 19 nt, Homo sapiens
gggaggcuugugcaaauau

SEQ ID NO: 1478936 - RNA, 19 nt, Homo sapiens
agggaggcuugugcaaaua

SEQ ID NO: 1478937 - RNA, 19 nt, Homo sapiens
gcuggccacacaccacuuu

SEQ ID NO: 1478938 - RNA, 19 nt, Homo sapiens
acgaauaggauacagugaa

SEQ ID NO: 1478939 - RNA, 19 nt, Homo sapiens
gcugcacccuuggcggaaa

SEQ ID NO: 1478940 - RNA, 19 nt, Homo sapiens
ggaaaagaagugagcaaau

SEQ ID NO: 1478941 - RNA, 19 nt, Homo sapiens
ggugcugauccaaauauug

SEQ ID NO: 1478942 - RNA, 19 nt, Homo sapiens
uguuaacagugagaauuug

SEQ ID NO: 1478943 - RNA, 19 nt, Homo sapiens
acagugagaauuugucagu

SEQ ID NO: 1478944 - RNA, 19 nt, Homo sapiens
ugucagugguggcaaaauu

SEQ ID NO: 1478945 - RNA, 19 nt, Homo sapiens
acaccugacgaauaggaua

SEQ ID NO: 1478946 - RNA, 19 nt, Homo sapiens
gcagagagcuggaaaggua

SEQ ID NO: 1478947 - RNA, 19 nt, Homo sapiens
ggaagaauuuggaagauuu

SEQ ID NO: 1478948 - RNA, 19 nt, Homo sapiens
gaaaccaucucuacucuau

SEQ ID NO: 1478949 - RNA, 19 nt, Homo sapiens
gaaaugcaguccagagaaa

SEQ ID NO: 1478950 - RNA, 19 nt, Homo sapiens
gaaagacaguggcauaaug

SEQ ID NO: 1478951 - RNA, 19 nt, Homo sapiens
caaagaaccugcucugaug

SEQ ID NO: 1478952 - RNA, 19 nt, Homo sapiens
cuaauucacucucucuuua

SEQ ID NO: 1478953 - RNA, 19 nt, Homo sapiens
gaagaagaaacaccaguua

SEQ ID NO: 1478954 - RNA, 19 nt, Homo sapiens
uuacuuagaucccauauga

SEQ ID NO: 1478955 - RNA, 19 nt, Homo sapiens
cagaaaggguggaguaauu

SEQ ID NO: 1478956 - RNA, 19 nt, Homo sapiens
uaaauggacugaucuacaa

SEQ ID NO: 1478957 - RNA, 19 nt, Homo sapiens
uaagacagcuguaaaugga

SEQ ID NO: 1478958 - RNA, 19 nt, Homo sapiens
gcaauaagggugauaagaa

SEQ ID NO: 1478959 - RNA, 19 nt, Homo sapiens
ugaaagacauuggugauaa

SEQ ID NO: 1478960 - RNA, 19 nt, Homo sapiens
ugaaggaaaugcaaagaaa

SEQ ID NO: 1478961 - RNA, 19 nt, Homo sapiens
ggauauauaagcccaaaua

SEQ ID NO: 1478962 - RNA, 19 nt, Homo sapiens
gaugaaagccaaacaaaug

SEQ ID NO: 1478963 - RNA, 19 nt, Homo sapiens
gaacacagcucagauuuug

SEQ ID NO: 1478964 - RNA, 19 nt, Homo sapiens
auaccuagcugucauauga

SEQ ID NO: 1478965 - RNA, 19 nt, Homo sapiens
gcacugcucuaaaaucuua

SEQ ID NO: 1478966 - RNA, 19 nt, Homo sapiens
aaacagaaccaauaggaua

SEQ ID NO: 1478967 - RNA, 19 nt, Homo sapiens
guuaaagucugguggguuu

SEQ ID NO: 1478968 - RNA, 19 nt, Homo sapiens
gaagaaacaccaguuagaa

SEQ ID NO: 1478969 - RNA, 19 nt, Homo sapiens
gaaugacucuggcugcuau

SEQ ID NO: 1478970 - RNA, 19 nt, Homo sapiens
gaaaggaaguuuuaaggaa

SEQ ID NO: 1478971 - RNA, 19 nt, Homo sapiens
ucagaaaggugcagagaug

SEQ ID NO: 1478972 - RNA, 19 nt, Homo sapiens
ggaaaugcaaagaaacaua

SEQ ID NO: 1478973 - RNA, 19 nt, Homo sapiens
gaacuaaaggaaagugauu

SEQ ID NO: 1478974 - RNA, 19 nt, Homo sapiens
caaauuggaugaggcacua

SEQ ID NO: 1478975 - RNA, 19 nt, Homo sapiens
ucaguaaagugacauauuc

SEQ ID NO: 1478976 - RNA, 19 nt, Homo sapiens
gaaagacauuggugauaag

SEQ ID NO: 1478977 - RNA, 19 nt, Homo sapiens
ucaaauguuucucgacaaa

SEQ ID NO: 1478978 - RNA, 19 nt, Homo sapiens
gauaagaaguggucagacu

SEQ ID NO: 1478979 - RNA, 19 nt, Homo sapiens
gaaguuuguuugcgauaau

SEQ ID NO: 1478980 - RNA, 19 nt, Homo sapiens
ggacaugcuauuaggguua

SEQ ID NO: 1478981 - RNA, 19 nt, Homo sapiens
caaguugccuuauucaaag

SEQ ID NO: 1478982 - RNA, 19 nt, Homo sapiens
gagaggaagcgagaaguua

SEQ ID NO: 1478983 - RNA, 19 nt, Homo sapiens
cagagaaacagaaccaaua

SEQ ID NO: 1478984 - RNA, 19 nt, Homo sapiens
guaucuaugucucgacuuu

SEQ ID NO: 1478985 - RNA, 19 nt, Homo sapiens
uguaguaugucacaguaua

SEQ ID NO: 1478986 - RNA, 19 nt, Homo sapiens
gggaagaauuuggaagauu

SEQ ID NO: 1478987 - RNA, 19 nt, Homo sapiens
ggaguaauuuguccaaguc

SEQ ID NO: 1478988 - RNA, 19 nt, Homo sapiens
caauaagggugauaagaag

SEQ ID NO: 1478989 - RNA, 19 nt, Homo sapiens
ucacauugguaaucucauu

SEQ ID NO: 1478990 - RNA, 19 nt, Homo sapiens
gaaggaaguuagggaggaa

SEQ ID NO: 1478991 - RNA, 19 nt, Homo sapiens
ggaagucucgcuugaaugu

SEQ ID NO: 1478992 - RNA, 19 nt, Homo sapiens
gcuaaucucuuccagaaac

SEQ ID NO: 1478993 - RNA, 19 nt, Homo sapiens
gagaugaaagccaaacaaa

SEQ ID NO: 1478994 - RNA, 19 nt, Homo sapiens
uaacagccauggcaauuac

SEQ ID NO: 1478995 - RNA, 19 nt, Homo sapiens
gcuagagacucaggaaaga

SEQ ID NO: 1478996 - RNA, 19 nt, Homo sapiens
uauaagagaccuuuggaaa

SEQ ID NO: 1478997 - RNA, 19 nt, Homo sapiens
gaaagugccagagucguaa

SEQ ID NO: 1478998 - RNA, 19 nt, Homo sapiens
ggaagaagaaacaccaguu

SEQ ID NO: 1478999 - RNA, 19 nt, Homo sapiens
gaaaggugcagagaugaaa

SEQ ID NO: 1479000 - RNA, 19 nt, Homo sapiens
gauucaaguugccuuauuc

SEQ ID NO: 1479001 - RNA, 19 nt, Homo sapiens
cauaagcauuuaacacuuc

SEQ ID NO: 1479002 - RNA, 19 nt, Homo sapiens
ugacaauacuaaacucuca

SEQ ID NO: 1479003 - RNA, 19 nt, Homo sapiens
gaaacaccaguuagaaguu

SEQ ID NO: 1479004 - RNA, 19 nt, Homo sapiens
gugauaaggugacauuugg

SEQ ID NO: 1479005 - RNA, 19 nt, Homo sapiens
gaaguuaccguuuuaugua

SEQ ID NO: 1479006 - RNA, 19 nt, Homo sapiens
uaaagucaacccuguacua

SEQ ID NO: 1479007 - RNA, 19 nt, Homo sapiens
ucaaguugccuuauucaaa

SEQ ID NO: 1479008 - RNA, 19 nt, Homo sapiens
ggaccaugcucuccaguac

SEQ ID NO: 1479009 - RNA, 19 nt, Homo sapiens
gcauuuaacacuucagaug

SEQ ID NO: 1479010 - RNA, 19 nt, Homo sapiens
ggggacaaauaucaaauua

SEQ ID NO: 1479011 - RNA, 19 nt, Homo sapiens
guaaaugagucagcauauc

SEQ ID NO: 1479012 - RNA, 19 nt, Homo sapiens
aaggugaaaucaugcuuaa

SEQ ID NO: 1479013 - RNA, 19 nt, Homo sapiens
cagcauauccuuguaguau

SEQ ID NO: 1479014 - RNA, 19 nt, Homo sapiens
gugcaagaguggaagaaga

SEQ ID NO: 1479015 - RNA, 19 nt, Homo sapiens
acaaugaucugcuuagacu

SEQ ID NO: 1479016 - RNA, 19 nt, Homo sapiens
aaacaaugaucugcuuaga

SEQ ID NO: 1479017 - RNA, 19 nt, Homo sapiens
gugcagagaugaaaagauu

SEQ ID NO: 1479018 - RNA, 19 nt, Homo sapiens
gggcaaaagucaugaagaa

SEQ ID NO: 1479019 - RNA, 19 nt, Homo sapiens
caucagugcuuaggaacaa

SEQ ID NO: 1479020 - RNA, 19 nt, Homo sapiens
gaaaggguggaguaauuug

SEQ ID NO: 1479021 - RNA, 19 nt, Homo sapiens
gcacauaucaagaaaccau

SEQ ID NO: 1479022 - RNA, 19 nt, Homo sapiens
gaaaauaaccucguacuca

SEQ ID NO: 1479023 - RNA, 19 nt, Homo sapiens
gucacaaacuuaagaggaa

SEQ ID NO: 1479024 - RNA, 19 nt, Homo sapiens
acacucacacacacaauua

SEQ ID NO: 1479025 - RNA, 19 nt, Homo sapiens
guaaauggacugaucuaca

SEQ ID NO: 1479026 - RNA, 19 nt, Homo sapiens
ucacaguucugaaggaagu

SEQ ID NO: 1479027 - RNA, 19 nt, Homo sapiens
acacaaacauacacucaca

SEQ ID NO: 1479028 - RNA, 19 nt, Homo sapiens
uaggaagucucgcuugaau

SEQ ID NO: 1479029 - RNA, 19 nt, Homo sapiens
gcuaauucacucucucuuu

SEQ ID NO: 1479030 - RNA, 19 nt, Homo sapiens
cuacuuacguucugguugu

SEQ ID NO: 1479031 - RNA, 19 nt, Homo sapiens
ggucacaguucugaaggaa

SEQ ID NO: 1479032 - RNA, 19 nt, Homo sapiens
aaacauacacucacacaca

SEQ ID NO: 1479033 - RNA, 19 nt, Homo sapiens
aaugaucugcuuagacuua

SEQ ID NO: 1479034 - RNA, 19 nt, Homo sapiens
ucugaggaguuagaaguua

SEQ ID NO: 1479035 - RNA, 19 nt, Homo sapiens
gcugucauaugaaggaaau

SEQ ID NO: 1479036 - RNA, 19 nt, Homo sapiens
gcaauuacacacacacaca

SEQ ID NO: 1479037 - RNA, 19 nt, Homo sapiens
gaaagagagcuaauucacu

SEQ ID NO: 1479038 - RNA, 19 nt, Homo sapiens
caggaaagacaguggcaua

SEQ ID NO: 1479039 - RNA, 19 nt, Homo sapiens
gcacuggguaggacugaaa

SEQ ID NO: 1479040 - RNA, 19 nt, Homo sapiens
gaauggcuauggcuaugca

SEQ ID NO: 1479041 - RNA, 19 nt, Homo sapiens
ggaggaagccaagaaaaua

SEQ ID NO: 1479042 - RNA, 19 nt, Homo sapiens
gaaagccaaacaaaugaau

SEQ ID NO: 1479043 - RNA, 19 nt, Homo sapiens
aggagaagguggauauuuc

SEQ ID NO: 1479044 - RNA, 19 nt, Homo sapiens
ggaaagacaguggcauaau

SEQ ID NO: 1479045 - RNA, 19 nt, Homo sapiens
gaaacagaaccaauaggau

SEQ ID NO: 1479046 - RNA, 19 nt, Homo sapiens
ugagauagaugcuuucaua

SEQ ID NO: 1479047 - RNA, 19 nt, Homo sapiens
gcaaugagauagaugcuuu

SEQ ID NO: 1479048 - RNA, 19 nt, Homo sapiens
gaacaagcauguaucuuau

SEQ ID NO: 1479049 - RNA, 19 nt, Homo sapiens
ggaaacaugucaaucauau

SEQ ID NO: 1479050 - RNA, 19 nt, Homo sapiens
ggaaaugcuucacuaaauu

SEQ ID NO: 1479051 - RNA, 19 nt, Homo sapiens
gaaagggaaugguauauca

SEQ ID NO: 1479052 - RNA, 19 nt, Homo sapiens
uaacagagguggauguauu

SEQ ID NO: 1479053 - RNA, 19 nt, Homo sapiens
gcacuaugcuauacucuaa

SEQ ID NO: 1479054 - RNA, 19 nt, Homo sapiens
gaaaccaucucuacucuau

SEQ ID NO: 1479055 - RNA, 19 nt, Homo sapiens
gaaaugcaguccagagaaa

SEQ ID NO: 1479056 - RNA, 19 nt, Homo sapiens
ccuauaaccuucaaagaua

SEQ ID NO: 1479057 - RNA, 19 nt, Homo sapiens
gauagaugcuuucauaugu

SEQ ID NO: 1479058 - RNA, 19 nt, Homo sapiens
gcaaguacauaaauagaga

SEQ ID NO: 1479059 - RNA, 19 nt, Homo sapiens
gcacgugccuguaaucuca

SEQ ID NO: 1479060 - RNA, 19 nt, Homo sapiens
uaaauggacugaucuacaa

SEQ ID NO: 1479061 - RNA, 19 nt, Homo sapiens
uaagacagcuguaaaugga

SEQ ID NO: 1479062 - RNA, 19 nt, Homo sapiens
ccacagaguucacugcauu

SEQ ID NO: 1479063 - RNA, 19 nt, Homo sapiens
ugaacaagcauguaucuua

SEQ ID NO: 1479064 - RNA, 19 nt, Homo sapiens
gaacacagcucagauuuug

SEQ ID NO: 1479065 - RNA, 19 nt, Homo sapiens
gaaaggaaguuuuaaggaa

SEQ ID NO: 1479066 - RNA, 19 nt, Homo sapiens
gacaggaaaugcuucacua

SEQ ID NO: 1479067 - RNA, 19 nt, Homo sapiens
gcauuaagcaaguacauaa

SEQ ID NO: 1479068 - RNA, 19 nt, Homo sapiens
gagccgaguucaugcaauu

SEQ ID NO: 1479069 - RNA, 19 nt, Homo sapiens
gacaaaggaugccauuuua

SEQ ID NO: 1479070 - RNA, 19 nt, Homo sapiens
gaacuaaaggaaagugauu

SEQ ID NO: 1479071 - RNA, 19 nt, Homo sapiens
gaaagacacaccaagcaaa

SEQ ID NO: 1479072 - RNA, 19 nt, Homo sapiens
ucaguaaagugacauauuc

SEQ ID NO: 1479073 - RNA, 19 nt, Homo sapiens
ggaaaucacacugcaauga

SEQ ID NO: 1479074 - RNA, 19 nt, Homo sapiens
ucaaauguuucucgacaaa

SEQ ID NO: 1479075 - RNA, 19 nt, Homo sapiens
ccaucucgcuaauuauaua

SEQ ID NO: 1479076 - RNA, 19 nt, Homo sapiens
ugacuugaguuaacaauca

SEQ ID NO: 1479077 - RNA, 19 nt, Homo sapiens
caaguugccuuauucaaag

SEQ ID NO: 1479078 - RNA, 19 nt, Homo sapiens
guggauguauugcuuauga

SEQ ID NO: 1479079 - RNA, 19 nt, Homo sapiens
agacuaaacugaccaacau

SEQ ID NO: 1479080 - RNA, 19 nt, Homo sapiens
ucaacagggugaaggagua

SEQ ID NO: 1479081 - RNA, 19 nt, Homo sapiens
aaauggaagucaucgaauu

SEQ ID NO: 1479082 - RNA, 19 nt, Homo sapiens
uauaagagaccuuuggaaa

SEQ ID NO: 1479083 - RNA, 19 nt, Homo sapiens
cuuauucacucaaccagua

SEQ ID NO: 1479084 - RNA, 19 nt, Homo sapiens
gauucaaguugccuuauuc

SEQ ID NO: 1479085 - RNA, 19 nt, Homo sapiens
gaacaaaacuccgucucaa

SEQ ID NO: 1479086 - RNA, 19 nt, Homo sapiens
gcagugagccgaguucaug

SEQ ID NO: 1479087 - RNA, 19 nt, Homo sapiens
ggaaagacacaccaagcaa

SEQ ID NO: 1479088 - RNA, 19 nt, Homo sapiens
ucaaguugccuuauucaaa

SEQ ID NO: 1479089 - RNA, 19 nt, Homo sapiens
ggaccaugcucuccaguac

SEQ ID NO: 1479090 - RNA, 19 nt, Homo sapiens
gcagcaagcagacaggaaa

SEQ ID NO: 1479091 - RNA, 19 nt, Homo sapiens
aggaaaugcuucacuaaau

SEQ ID NO: 1479092 - RNA, 19 nt, Homo sapiens
gacagaaggaggauagauu

SEQ ID NO: 1479093 - RNA, 19 nt, Homo sapiens
gcacauaucaagaaaccau

SEQ ID NO: 1479094 - RNA, 19 nt, Homo sapiens
caccaucucgcuaauuaua

SEQ ID NO: 1479095 - RNA, 19 nt, Homo sapiens
gcauaagcauagaaguaau

SEQ ID NO: 1479096 - RNA, 19 nt, Homo sapiens
aagcauguaucuuauguca

SEQ ID NO: 1479097 - RNA, 19 nt, Homo sapiens
guaaauggacugaucuaca

SEQ ID NO: 1479098 - RNA, 19 nt, Homo sapiens
ggaugaggcaggagaauca

SEQ ID NO: 1479099 - RNA, 19 nt, Homo sapiens
agaugaagauacauagcua

SEQ ID NO: 1479100 - RNA, 19 nt, Homo sapiens
ucagaaagggaaugguaua

SEQ ID NO: 1479101 - RNA, 19 nt, Homo sapiens
gcacuggguaggacugaaa

SEQ ID NO: 1479102 - RNA, 19 nt, Homo sapiens
gcaggagaaucacuugaac

SEQ ID NO: 1479103 - RNA, 19 nt, Homo sapiens
gcuauuuaaaggcacauua

SEQ ID NO: 1479104 - RNA, 19 nt, Homo sapiens
gaaaucacacugcaaugag

SEQ ID NO: 1479105 - RNA, 19 nt, Homo sapiens
gaauggcuauggcuaugca

SEQ ID NO: 1479106 - RNA, 19 nt, Homo sapiens
caagaaaccaucucuacuc

SEQ ID NO: 1479107 - RNA, 19 nt, Homo sapiens
gucgggaguucgagacuaa

SEQ ID NO: 1479108 - RNA, 19 nt, Homo sapiens
agagguaaauagaugaaga

SEQ ID NO: 1479109 - RNA, 19 nt, Homo sapiens
gaaauggagaaaccacaga

SEQ ID NO: 1479110 - RNA, 19 nt, Homo sapiens
ggcaaggacuaaggugaaa

SEQ ID NO: 1479111 - RNA, 19 nt, Homo sapiens
ggagacaggcauuaagcaa

SEQ ID NO: 1479112 - RNA, 19 nt, Homo sapiens
acaagcauguaucuuaugu

SEQ ID NO: 1479113 - RNA, 19 nt, Homo sapiens
ugauucaaguugccuuauu

SEQ ID NO: 1479114 - RNA, 19 nt, Homo sapiens
uaaagaggcacauaucaag

SEQ ID NO: 1479115 - RNA, 19 nt, Homo sapiens
agaaucacuugaaccugua

SEQ ID NO: 1479116 - RNA, 19 nt, Homo sapiens
acagaaggaggauagauuu

SEQ ID NO: 1479117 - RNA, 19 nt, Homo sapiens
ucauucaucuuaccaucaa

SEQ ID NO: 1479118 - RNA, 19 nt, Homo sapiens
agacaggcauuaagcaagu

SEQ ID NO: 1479119 - RNA, 19 nt, Homo sapiens
gcaguccuuguguuuguua

SEQ ID NO: 1479120 - RNA, 19 nt, Homo sapiens
gaaaccccgucucuacuaa

SEQ ID NO: 1479121 - RNA, 19 nt, Homo sapiens
ggauguauugcuuaugaaa

SEQ ID NO: 1479122 - RNA, 19 nt, Homo sapiens
gcuauacucuaagaaaugg

SEQ ID NO: 1479123 - RNA, 19 nt, Homo sapiens
caggaaaugcuucacuaaa

SEQ ID NO: 1479124 - RNA, 19 nt, Homo sapiens
agagagaguuacaaaugga

SEQ ID NO: 1479125 - RNA, 19 nt, Homo sapiens
agagaaaagugccucauuu

SEQ ID NO: 1479126 - RNA, 19 nt, Homo sapiens
ucacugcauugaaggaaau

SEQ ID NO: 1479127 - RNA, 19 nt, Homo sapiens
ggagaaaccacagaguuca

SEQ ID NO: 1479128 - RNA, 19 nt, Homo sapiens
uagagagaguuacaaaugg

SEQ ID NO: 1479129 - RNA, 19 nt, Homo sapiens
guaauggagagguaaauag

SEQ ID NO: 1479130 - RNA, 19 nt, Homo sapiens
aaaucacacugcaaugaga

SEQ ID NO: 1479131 - RNA, 19 nt, Homo sapiens
aucaccaucucgcuaauua

SEQ ID NO: 1479132 - RNA, 19 nt, Homo sapiens
ggaacaccuuuaaauccau

SEQ ID NO: 1479133 - RNA, 19 nt, Homo sapiens
caucucuacucuaugcauu

SEQ ID NO: 1479134 - RNA, 19 nt, Homo sapiens
uaauggagagguaaauaga

SEQ ID NO: 1479135 - RNA, 19 nt, Homo sapiens
agagguggauguauugcuu

SEQ ID NO: 1479136 - RNA, 19 nt, Homo sapiens
gaaggaaaucacacugcaa

SEQ ID NO: 1479137 - RNA, 19 nt, Homo sapiens
ccaagcaaagggaagagua

SEQ ID NO: 1479138 - RNA, 19 nt, Homo sapiens
ccucagaaagggaauggua

SEQ ID NO: 1479139 - RNA, 19 nt, Homo sapiens
ugguuuagcagaguaauua

SEQ ID NO: 1479140 - RNA, 19 nt, Homo sapiens
ggccguauaucuccuuugg

SEQ ID NO: 1479141 - RNA, 19 nt, Homo sapiens
ccuguaaaguagaauuaga

SEQ ID NO: 1479142 - RNA, 19 nt, Homo sapiens
ggagagguaaauagaugaa

SEQ ID NO: 1479143 - RNA, 19 nt, Homo sapiens
gaaaggcagggacuaaggu

SEQ ID NO: 1479144 - RNA, 19 nt, Homo sapiens
acaaauggaagucaucgaa

SEQ ID NO: 1479145 - RNA, 19 nt, Homo sapiens
auagagagaguuacaaaug

SEQ ID NO: 1479146 - RNA, 19 nt, Homo sapiens
gaaaccaucucuacucuau

SEQ ID NO: 1479147 - RNA, 19 nt, Homo sapiens
gaaaugcaguccagagaaa

SEQ ID NO: 1479148 - RNA, 19 nt, Homo sapiens
gaaaggaaguuuuaaggaa

SEQ ID NO: 1479149 - RNA, 19 nt, Homo sapiens
gaacuaaaggaaagugauu

SEQ ID NO: 1479150 - RNA, 19 nt, Homo sapiens
ucaguaaagugacauauuc

SEQ ID NO: 1479151 - RNA, 19 nt, Homo sapiens
caaguugccuuauucaaag

SEQ ID NO: 1479152 - RNA, 19 nt, Homo sapiens
uauaagagaccuuuggaaa

SEQ ID NO: 1479153 - RNA, 19 nt, Homo sapiens
gauucaaguugccuuauuc

SEQ ID NO: 1479154 - RNA, 19 nt, Homo sapiens
ucaaguugccuuauucaaa

SEQ ID NO: 1479155 - RNA, 19 nt, Homo sapiens
ggaccaugcucuccaguac

SEQ ID NO: 1479156 - RNA, 19 nt, Homo sapiens
gcacauaucaagaaaccau

SEQ ID NO: 1479157 - RNA, 19 nt, Homo sapiens
gaaaauaaccucguacuca

SEQ ID NO: 1479158 - RNA, 19 nt, Homo sapiens
gcacuggguaggacugaaa

SEQ ID NO: 1479159 - RNA, 19 nt, Homo sapiens
caagaaaccaucucuacuc

SEQ ID NO: 1479160 - RNA, 19 nt, Homo sapiens
ugauucaaguugccuuauu

SEQ ID NO: 1479161 - RNA, 19 nt, Homo sapiens
uaaagaggcacauaucaag

SEQ ID NO: 1479162 - RNA, 19 nt, Homo sapiens
ggcaaggacuaaggugaaa

SEQ ID NO: 1479163 - RNA, 19 nt, Homo sapiens
agagaaaagugccucauuu

SEQ ID NO: 1479164 - RNA, 19 nt, Homo sapiens
ggaacaccuuuaaauccau

SEQ ID NO: 1479165 - RNA, 19 nt, Homo sapiens
caucucuacucuaugcauu

SEQ ID NO: 1479166 - RNA, 19 nt, Homo sapiens
ugguuuagcagaguaauua

SEQ ID NO: 1479167 - RNA, 19 nt, Homo sapiens
gaaaggcagggacuaaggu

SEQ ID NO: 1479168 - RNA, 19 nt, Homo sapiens
gaagggauuccugauuuua

SEQ ID NO: 1479169 - RNA, 19 nt, Homo sapiens
agaggcacauaucaagaaa

SEQ ID NO: 1479170 - RNA, 19 nt, Homo sapiens
agugacauauuccugguuu

SEQ ID NO: 1479171 - RNA, 19 nt, Homo sapiens
guuauaaagaggcacauau

SEQ ID NO: 1479172 - RNA, 19 nt, Homo sapiens
aagaaaccaucucuacucu

SEQ ID NO: 1479173 - RNA, 19 nt, Homo sapiens
cagaaaugcaguccagaga

SEQ ID NO: 1479174 - RNA, 19 nt, Homo sapiens
uauaaagaggcacauauca

SEQ ID NO: 1479175 - RNA, 19 nt, Homo sapiens
gugacauauuccugguuua

SEQ ID NO: 1479176 - RNA, 19 nt, Homo sapiens
gauauuuuguccuucacua

SEQ ID NO: 1479177 - RNA, 19 nt, Homo sapiens
gcauuguggaacaccuuua

SEQ ID NO: 1479178 - RNA, 19 nt, Homo sapiens
auaaagaggcacauaucaa

SEQ ID NO: 1479179 - RNA, 19 nt, Homo sapiens
caauggagaaaggaaguuu

SEQ ID NO: 1479180 - RNA, 19 nt, Homo sapiens
gcuauaagagaccuuugga

SEQ ID NO: 1479181 - RNA, 19 nt, Homo sapiens
ggaaggcaaggacuaaggu

SEQ ID NO: 1479182 - RNA, 19 nt, Homo sapiens
gcacugcgugucccaucuu

SEQ ID NO: 1479183 - RNA, 19 nt, Homo sapiens
acauauuccugguuuagca

SEQ ID NO: 1479184 - RNA, 19 nt, Homo sapiens
ucacuagcccacucauaau

SEQ ID NO: 1479185 - RNA, 19 nt, Homo sapiens
aagaggcacauaucaagaa

SEQ ID NO: 1479186 - RNA, 19 nt, Homo sapiens
aaagaggcacauaucaaga

SEQ ID NO: 1479187 - RNA, 19 nt, Homo sapiens
gcacuggcuaggacuggaa

SEQ ID NO: 1479188 - RNA, 19 nt, Homo sapiens
uucacuagcccacucauaa

SEQ ID NO: 1479189 - RNA, 19 nt, Homo sapiens
cauuguggaacaccuuuaa

SEQ ID NO: 1479190 - RNA, 19 nt, Homo sapiens
agaaaugcaguccagagaa

SEQ ID NO: 1479191 - RNA, 19 nt, Homo sapiens
ugacauauuccugguuuag

SEQ ID NO: 1479192 - RNA, 19 nt, Homo sapiens
aaccaucucuacucuaugc

SEQ ID NO: 1479193 - RNA, 19 nt, Homo sapiens
uaucaagaaaccaucucua

SEQ ID NO: 1479194 - RNA, 19 nt, Homo sapiens
gcgugucccaucuuugaaa

SEQ ID NO: 1479195 - RNA, 19 nt, Homo sapiens
cugcgugucccaucuuuga

SEQ ID NO: 1479196 - RNA, 19 nt, Homo sapiens
gcugauauuuuguccuuca

SEQ ID NO: 1479197 - RNA, 19 nt, Homo sapiens
ucaagaaaccaucucuacu

SEQ ID NO: 1479198 - RNA, 19 nt, Homo sapiens
uuauaaagaggcacauauc

SEQ ID NO: 1479199 - RNA, 19 nt, Homo sapiens
uacuuuaggcuauaagaga

SEQ ID NO: 1479200 - RNA, 19 nt, Homo sapiens
ucucuacucuaugcauugu

SEQ ID NO: 1479201 - RNA, 19 nt, Homo sapiens
uaaggugacagcugacucu

SEQ ID NO: 1479202 - RNA, 19 nt, Homo sapiens
gaaaccaucucuacucuau

SEQ ID NO: 1479203 - RNA, 19 nt, Homo sapiens
uaaauggacugaucuacaa

SEQ ID NO: 1479204 - RNA, 19 nt, Homo sapiens
uaagacagcuguaaaugga

SEQ ID NO: 1479205 - RNA, 19 nt, Homo sapiens
gaacacagcucagauuuug

SEQ ID NO: 1479206 - RNA, 19 nt, Homo sapiens
gaaaggaaguuuuaaggaa

SEQ ID NO: 1479207 - RNA, 19 nt, Homo sapiens
gaacuaaaggaaagugauu

SEQ ID NO: 1479208 - RNA, 19 nt, Homo sapiens
ucaaauguuucucgacaaa

SEQ ID NO: 1479209 - RNA, 19 nt, Homo sapiens
caaguugccuuauucaaag

SEQ ID NO: 1479210 - RNA, 19 nt, Homo sapiens
uauaagagaccuuuggaaa

SEQ ID NO: 1479211 - RNA, 19 nt, Homo sapiens
gauucaaguugccuuauuc

SEQ ID NO: 1479212 - RNA, 19 nt, Homo sapiens
ucaaguugccuuauucaaa

SEQ ID NO: 1479213 - RNA, 19 nt, Homo sapiens
ggaccaugcucuccaguac

SEQ ID NO: 1479214 - RNA, 19 nt, Homo sapiens
gcacauaucaagaaaccau

SEQ ID NO: 1479215 - RNA, 19 nt, Homo sapiens
guaaauggacugaucuaca

SEQ ID NO: 1479216 - RNA, 19 nt, Homo sapiens
gcacuggguaggacugaaa

SEQ ID NO: 1479217 - RNA, 19 nt, Homo sapiens
gaauggcuauggcuaugca

SEQ ID NO: 1479218 - RNA, 19 nt, Homo sapiens
caagaaaccaucucuacuc

SEQ ID NO: 1479219 - RNA, 19 nt, Homo sapiens
ugauucaaguugccuuauu

SEQ ID NO: 1479220 - RNA, 19 nt, Homo sapiens
ggcaaggacuaaggugaaa

SEQ ID NO: 1479221 - RNA, 19 nt, Homo sapiens
uaaagaggcacauaucaag

SEQ ID NO: 1479222 - RNA, 19 nt, Homo sapiens
gcaguccuuguguuuguua

SEQ ID NO: 1479223 - RNA, 19 nt, Homo sapiens
ggaacaccuuuaaauccau

SEQ ID NO: 1479224 - RNA, 19 nt, Homo sapiens
caucucuacucuaugcauu

SEQ ID NO: 1479225 - RNA, 19 nt, Homo sapiens
ggccguauaucuccuuugg

SEQ ID NO: 1479226 - RNA, 19 nt, Homo sapiens
gugaacacagcucagauuu

SEQ ID NO: 1479227 - RNA, 19 nt, Homo sapiens
gaaaggcagggacuaaggu

SEQ ID NO: 1479228 - RNA, 19 nt, Homo sapiens
ugcaaacucugauucuuca

SEQ ID NO: 1479229 - RNA, 19 nt, Homo sapiens
agaggcacauaucaagaaa

SEQ ID NO: 1479230 - RNA, 19 nt, Homo sapiens
gguggcaguccuuguguuu

SEQ ID NO: 1479231 - RNA, 19 nt, Homo sapiens
gucagcaacucauggacuu

SEQ ID NO: 1479232 - RNA, 19 nt, Homo sapiens
guuauaaagaggcacauau

SEQ ID NO: 1479233 - RNA, 19 nt, Homo sapiens
aagaaaccaucucuacucu

SEQ ID NO: 1479234 - RNA, 19 nt, Homo sapiens
uggcaguccuuguguuugu

SEQ ID NO: 1479235 - RNA, 19 nt, Homo sapiens
aaaguuaagacagcuguaa

SEQ ID NO: 1479236 - RNA, 19 nt, Homo sapiens
uauaaagaggcacauauca

SEQ ID NO: 1479237 - RNA, 19 nt, Homo sapiens
gauauuuuguccuucacua

SEQ ID NO: 1479238 - RNA, 19 nt, Homo sapiens
gcauuguggaacaccuuua

SEQ ID NO: 1479239 - RNA, 19 nt, Homo sapiens
auaaagaggcacauaucaa

SEQ ID NO: 1479240 - RNA, 19 nt, Homo sapiens
caauggagaaaggaaguuu

SEQ ID NO: 1479241 - RNA, 19 nt, Homo sapiens
gcuauaagagaccuuugga

SEQ ID NO: 1479242 - RNA, 19 nt, Homo sapiens
guuaagacagcuguaaaug

SEQ ID NO: 1479243 - RNA, 19 nt, Homo sapiens
cuucagcaauaucaacguu

SEQ ID NO: 1479244 - RNA, 19 nt, Homo sapiens
ggaaggcaaggacuaaggu

SEQ ID NO: 1479245 - RNA, 19 nt, Homo sapiens
gcacugcgugucccaucuu

SEQ ID NO: 1479246 - RNA, 19 nt, Homo sapiens
gaugucagcaacucaugga

SEQ ID NO: 1479247 - RNA, 19 nt, Homo sapiens
ucacuagcccacucauaau

SEQ ID NO: 1479248 - RNA, 19 nt, Homo sapiens
aagaggcacauaucaagaa

SEQ ID NO: 1479249 - RNA, 19 nt, Homo sapiens
cuugauacacagaguaauu

SEQ ID NO: 1479250 - RNA, 19 nt, Homo sapiens
aaagaggcacauaucaaga

SEQ ID NO: 1479251 - RNA, 19 nt, Homo sapiens
gcacuggcuaggacuggaa

SEQ ID NO: 1479252 - RNA, 19 nt, Homo sapiens
uggaauggcuauggcuaug

SEQ ID NO: 1479253 - RNA, 19 nt, Homo sapiens
uucacuagcccacucauaa

SEQ ID NO: 1479254 - RNA, 19 nt, Homo sapiens
cauuguggaacaccuuuaa

SEQ ID NO: 1479255 - RNA, 19 nt, Homo sapiens
gcgcuugauacacagagua

SEQ ID NO: 1479256 - RNA, 19 nt, Homo sapiens
ccuaauggccguauaucuc

SEQ ID NO: 1479257 - RNA, 19 nt, Homo sapiens
ucagcaauaucaacguuuu

SEQ ID NO: 1479258 - RNA, 19 nt, Homo sapiens
aaccaucucuacucuaugc

SEQ ID NO: 1479259 - RNA, 19 nt, Homo sapiens
uaucaagaaaccaucucua

SEQ ID NO: 1479260 - RNA, 19 nt, Homo sapiens
gcgugucccaucuuugaaa

SEQ ID NO: 1479261 - RNA, 19 nt, Homo sapiens
cagcaacucauggacuuga

SEQ ID NO: 1479262 - RNA, 19 nt, Homo sapiens
cugcgugucccaucuuuga

SEQ ID NO: 1479263 - RNA, 19 nt, Homo sapiens
ggguggcaguccuuguguu

SEQ ID NO: 1479264 - RNA, 19 nt, Homo sapiens
uuaagacagcuguaaaugg

SEQ ID NO: 1479265 - RNA, 19 nt, Homo sapiens
gcugauauuuuguccuuca

SEQ ID NO: 1479266 - RNA, 19 nt, Homo sapiens
uauaucuccuuuggcaaga

SEQ ID NO: 1479267 - RNA, 19 nt, Homo sapiens
ucaagaaaccaucucuacu

SEQ ID NO: 1479268 - RNA, 19 nt, Homo sapiens
uuauaaagaggcacauauc

SEQ ID NO: 1479269 - RNA, 19 nt, Homo sapiens
uacuuuaggcuauaagaga

SEQ ID NO: 1479270 - RNA, 19 nt, Homo sapiens
guccuuguguuuguuauac

SEQ ID NO: 1479271 - RNA, 19 nt, Homo sapiens
uaaggugacagcugacucu

SEQ ID NO: 1479272 - RNA, 19 nt, Homo sapiens
ucucuacucuaugcauugu

SEQ ID NO: 1479273 - RNA, 19 nt, Homo sapiens
gggaagaacucacucauaa

SEQ ID NO: 1479274 - RNA, 19 nt, Homo sapiens
gaaagaagagcaagaacua

SEQ ID NO: 1479275 - RNA, 19 nt, Homo sapiens
gcaagaggauucuaagaga

SEQ ID NO: 1479276 - RNA, 19 nt, Homo sapiens
aaacugagaugcagacaaa

SEQ ID NO: 1479277 - RNA, 19 nt, Homo sapiens
ccaauaagaguguugauua

SEQ ID NO: 1479278 - RNA, 19 nt, Homo sapiens
ggaaagcucauaaauacua

SEQ ID NO: 1479279 - RNA, 19 nt, Homo sapiens
gauacaacuuucagagaua

SEQ ID NO: 1479280 - RNA, 19 nt, Homo sapiens
caggaaacaucgaucauaa

SEQ ID NO: 1479281 - RNA, 19 nt, Homo sapiens
gugcuuaucuucaguuuau

SEQ ID NO: 1479282 - RNA, 19 nt, Homo sapiens
guggaaagcucauaaauac

SEQ ID NO: 1479283 - RNA, 19 nt, Homo sapiens
gaagaacucacucauaaau

SEQ ID NO: 1479284 - RNA, 19 nt, Homo sapiens
gcagagaaaugguguggau

SEQ ID NO: 1479285 - RNA, 19 nt, Homo sapiens
ugaauuagcugauaugcau

SEQ ID NO: 1479286 - RNA, 19 nt, Homo sapiens
gaacaguaaugcuuccaau

SEQ ID NO: 1479287 - RNA, 19 nt, Homo sapiens
ggauacaacuuucagagau

SEQ ID NO: 1479288 - RNA, 19 nt, Homo sapiens
gaaagaacucuaucuagga

SEQ ID NO: 1479289 - RNA, 19 nt, Homo sapiens
gaagaacccugugcuuauc

SEQ ID NO: 1479290 - RNA, 19 nt, Homo sapiens
ggagaauacuggaagacaa

SEQ ID NO: 1479291 - RNA, 19 nt, Homo sapiens
gguaagucuuccagaauaa

SEQ ID NO: 1479292 - RNA, 19 nt, Homo sapiens
gagaggaaauggagcuaga

SEQ ID NO: 1479293 - RNA, 19 nt, Homo sapiens
aaagaagcaugcagagaaa

SEQ ID NO: 1479294 - RNA, 19 nt, Homo sapiens
aaucagauguuccaccuuu

SEQ ID NO: 1479295 - RNA, 19 nt, Homo sapiens
gaucgugagcuugaaauua

SEQ ID NO: 1479296 - RNA, 19 nt, Homo sapiens
gaagccauccuuacagaaa

SEQ ID NO: 1479297 - RNA, 19 nt, Homo sapiens
aaagaacucuaucuaggaa

SEQ ID NO: 1479298 - RNA, 19 nt, Homo sapiens
uggaaugcaucacucuuua

SEQ ID NO: 1479299 - RNA, 19 nt, Homo sapiens
gaaaagcagucucauggaa

SEQ ID NO: 1479300 - RNA, 19 nt, Homo sapiens
ugaauaaacuaccaaagca

SEQ ID NO: 1479301 - RNA, 19 nt, Homo sapiens
uaaagcagccugugguaaa

SEQ ID NO: 1479302 - RNA, 19 nt, Homo sapiens
aagaagacauuacucauuc

SEQ ID NO: 1479303 - RNA, 19 nt, Homo sapiens
caucuauagucaucgaaua

SEQ ID NO: 1479304 - RNA, 19 nt, Homo sapiens
cauaaauacuacaguguga

SEQ ID NO: 1479305 - RNA, 19 nt, Homo sapiens
gacaaaugaucauccguau

SEQ ID NO: 1479306 - RNA, 19 nt, Homo sapiens
uuaaagaccucagaagaug

SEQ ID NO: 1479307 - RNA, 19 nt, Homo sapiens
gcacugcucccuacacgaa

SEQ ID NO: 1479308 - RNA, 19 nt, Homo sapiens
gaacagcgcggagcagaga

SEQ ID NO: 1479309 - RNA, 19 nt, Homo sapiens
agaaagcaaucaagaagau

SEQ ID NO: 1479310 - RNA, 19 nt, Homo sapiens
gagaauacuggaagacaaa

SEQ ID NO: 1479311 - RNA, 19 nt, Homo sapiens
caaagcaagaggauucuaa

SEQ ID NO: 1479312 - RNA, 19 nt, Homo sapiens
gugaagaacccugugcuua

SEQ ID NO: 1479313 - RNA, 19 nt, Homo sapiens
gcauucugguuugauauaa

SEQ ID NO: 1479314 - RNA, 19 nt, Homo sapiens
ugguaagucuuccagaaua

SEQ ID NO: 1479315 - RNA, 19 nt, Homo sapiens
ggaaacaucgaucauaaag

SEQ ID NO: 1479316 - RNA, 19 nt, Homo sapiens
ggaagaacucacucauaaa

SEQ ID NO: 1479317 - RNA, 19 nt, Homo sapiens
acaguaaugcuuccaauaa

SEQ ID NO: 1479318 - RNA, 19 nt, Homo sapiens
caaauacugcuggagaaua

SEQ ID NO: 1479319 - RNA, 19 nt, Homo sapiens
gccggcagcuggcuauuga

SEQ ID NO: 1479320 - RNA, 19 nt, Homo sapiens
gaaggaaauaucaguugaa

SEQ ID NO: 1479321 - RNA, 19 nt, Homo sapiens
agaaggaaauaucaguuga

SEQ ID NO: 1479322 - RNA, 19 nt, Homo sapiens
cagcaaggcuucauaaaau

SEQ ID NO: 1479323 - RNA, 19 nt, Homo sapiens
ggaaugcaucacucuuuaa

SEQ ID NO: 1479324 - RNA, 19 nt, Homo sapiens
gaaguuuaaguucucagua

SEQ ID NO: 1479325 - RNA, 19 nt, Homo sapiens
gcaagcaucucaguaacag

SEQ ID NO: 1479326 - RNA, 19 nt, Homo sapiens
ggaaaaggaucgugagcuu

SEQ ID NO: 1479327 - RNA, 19 nt, Homo sapiens
ugcuauggcucaucgaaua

SEQ ID NO: 1479328 - RNA, 19 nt, Homo sapiens
ggaagagaaacauuuggaa

SEQ ID NO: 1479329 - RNA, 19 nt, Homo sapiens
cguggaaagcucauaaaua

SEQ ID NO: 1479330 - RNA, 19 nt, Homo sapiens
caaaugaucauccguaugc

SEQ ID NO: 1479331 - RNA, 19 nt, Homo sapiens
ugaagaacccugugcuuau

SEQ ID NO: 1479332 - RNA, 19 nt, Homo sapiens
ccuaaugcauucugguuug

SEQ ID NO: 1479333 - RNA, 19 nt, Homo sapiens
ccaaucaaguccugguguu

SEQ ID NO: 1479334 - RNA, 19 nt, Homo sapiens
caaauuauggcuaaacauc

SEQ ID NO: 1479335 - RNA, 19 nt, Homo sapiens
gugcuccuguggaaguuua

SEQ ID NO: 1479336 - RNA, 19 nt, Homo sapiens
gauuauagcagaucucagu

SEQ ID NO: 1479337 - RNA, 19 nt, Homo sapiens
aaagcagucucauggaaga

SEQ ID NO: 1479338 - RNA, 19 nt, Homo sapiens
gaauaaaagugaaggauac

SEQ ID NO: 1479339 - RNA, 19 nt, Homo sapiens
gagaaagcaaucaagaaga

SEQ ID NO: 1479340 - RNA, 19 nt, Homo sapiens
aucgugagcuugaaauuaa

SEQ ID NO: 1479341 - RNA, 19 nt, Homo sapiens
caacuucagcuuaggcauu

SEQ ID NO: 1479342 - RNA, 19 nt, Homo sapiens
augcaucacucuuuaauuc

SEQ ID NO: 1479343 - RNA, 19 nt, Homo sapiens
gaaugcaucacucuuuaau

SEQ ID NO: 1479344 - RNA, 19 nt, Homo sapiens
ucaauauccuaaugcauuc

SEQ ID NO: 1479345 - RNA, 19 nt, Homo sapiens
gaaagagaaagcaaucaag

SEQ ID NO: 1479346 - RNA, 19 nt, Homo sapiens
ccauaugauugcccaaaga

SEQ ID NO: 1479347 - RNA, 19 nt, Homo sapiens
gaaagcucauaaauacuac

SEQ ID NO: 1479348 - RNA, 19 nt, Homo sapiens
caacaggaaacaucgauca

SEQ ID NO: 1479349 - RNA, 19 nt, Homo sapiens
acacagaggacuauccaaa

SEQ ID NO: 1479350 - RNA, 19 nt, Homo sapiens
guaaaacaccuucaacaaa

SEQ ID NO: 1479351 - RNA, 19 nt, Homo sapiens
uaccucaaauuauggcuaa

SEQ ID NO: 1479352 - RNA, 19 nt, Homo sapiens
gaauaaacuaccaaagcaa

SEQ ID NO: 1479353 - RNA, 19 nt, Homo sapiens
gaaacaucgaucauaaaga

SEQ ID NO: 1479354 - RNA, 19 nt, Homo sapiens
aaacaucuauagucaucga

SEQ ID NO: 1479355 - RNA, 19 nt, Homo sapiens
ucucagugcuccuguggaa

SEQ ID NO: 1479356 - RNA, 19 nt, Homo sapiens
ggaaauggagcuagagcau

SEQ ID NO: 1479357 - RNA, 19 nt, Homo sapiens
caggcaagcaucucaguaa

SEQ ID NO: 1479358 - RNA, 19 nt, Homo sapiens
aaagagaaagcaaucaaga

SEQ ID NO: 1479359 - RNA, 19 nt, Homo sapiens
gagcaagaacuaccaccaa

SEQ ID NO: 1479360 - RNA, 19 nt, Homo sapiens
uggcuaaacaucagaauga

SEQ ID NO: 1479361 - RNA, 19 nt, Homo sapiens
uuucggagacucuaaagua

SEQ ID NO: 1479362 - RNA, 19 nt, Homo sapiens
gcuagagcauucugacagu

SEQ ID NO: 1479363 - RNA, 19 nt, Homo sapiens
gcucagacagcuaccaaga

SEQ ID NO: 1479364 - RNA, 19 nt, Homo sapiens
gaaacaacuucagcuuagg

SEQ ID NO: 1479365 - RNA, 19 nt, Homo sapiens
gcaaggcuucauaaaauua

SEQ ID NO: 1479366 - RNA, 19 nt, Homo sapiens
ccaaagaagagaugcuaug

SEQ ID NO: 1479367 - RNA, 19 nt, Homo sapiens
ucuaaaaucucccaaucua

SEQ ID NO: 1479368 - RNA, 19 nt, Homo sapiens
acaaagaagacauuacuca

SEQ ID NO: 1479369 - RNA, 19 nt, Homo sapiens
aaauacugcuggagaauac

SEQ ID NO: 1479370 - RNA, 19 nt, Homo sapiens
gcagcuggcuauugagacu

SEQ ID NO: 1479371 - RNA, 19 nt, Homo sapiens
gaaaaggaaagaacucuau

SEQ ID NO: 1479372 - RNA, 19 nt, Homo sapiens
cuuaggaaaucccaggaaa

SEQ ID NO: 1479373 - RNA, 19 nt, Homo sapiens
gaagacaucuggccucaaa

SEQ ID NO: 1479374 - RNA, 19 nt, Homo sapiens
gggcagaggugacuucaaa

SEQ ID NO: 1479375 - RNA, 19 nt, Homo sapiens
gcacggacacugacucuua

SEQ ID NO: 1479376 - RNA, 19 nt, Homo sapiens
agaaauguaugccaaauga

SEQ ID NO: 1479377 - RNA, 19 nt, Homo sapiens
gacaagcacuuuacuuuca

SEQ ID NO: 1479378 - RNA, 19 nt, Homo sapiens
cuuaaacccugcaguguua

SEQ ID NO: 1479379 - RNA, 19 nt, Homo sapiens
cgaaauaagcaauacguua

SEQ ID NO: 1479380 - RNA, 19 nt, Homo sapiens
aaacgcagguugcaauaaa

SEQ ID NO: 1479381 - RNA, 19 nt, Homo sapiens
auaaacugcucaaggauua

SEQ ID NO: 1479382 - RNA, 19 nt, Homo sapiens
gaaauaagcaauacguuag

SEQ ID NO: 1479383 - RNA, 19 nt, Homo sapiens
caaggaagguaaagugaga

SEQ ID NO: 1479384 - RNA, 19 nt, Homo sapiens
ccacuuugcugccauuuau

SEQ ID NO: 1479385 - RNA, 19 nt, Homo sapiens
gcucuccacuuccugauuu

SEQ ID NO: 1479386 - RNA, 19 nt, Homo sapiens
ggaaccagcucugacaguu

SEQ ID NO: 1479387 - RNA, 19 nt, Homo sapiens
gcgcgugcauugauuacua

SEQ ID NO: 1479388 - RNA, 19 nt, Homo sapiens
gaaaaucuaucgugagguu

SEQ ID NO: 1479389 - RNA, 19 nt, Homo sapiens
aaacagaggcauugagaaa

SEQ ID NO: 1479390 - RNA, 19 nt, Homo sapiens
gcucggaccucagugguuu

SEQ ID NO: 1479391 - RNA, 19 nt, Homo sapiens
acaucaagcuggcagauuu

SEQ ID NO: 1479392 - RNA, 19 nt, Homo sapiens
ccuguucgcucauaaagaa

SEQ ID NO: 1479393 - RNA, 19 nt, Homo sapiens
cagcagcuauaaccacuuu

SEQ ID NO: 1479394 - RNA, 19 nt, Homo sapiens
ccacacaucauaaagcuuu

SEQ ID NO: 1479395 - RNA, 19 nt, Homo sapiens
gaaccauccacacaucaua

SEQ ID NO: 1479396 - RNA, 19 nt, Homo sapiens
ggaauucucuccccugaaa

SEQ ID NO: 1479397 - RNA, 19 nt, Homo sapiens
gaagguaaagugagagguu

SEQ ID NO: 1479398 - RNA, 19 nt, Homo sapiens
gugaaguugugcaauauug

SEQ ID NO: 1479399 - RNA, 19 nt, Homo sapiens
ccaaagauugacccaguua

SEQ ID NO: 1479400 - RNA, 19 nt, Homo sapiens
gcaaauccuguauauguau

SEQ ID NO: 1479401 - RNA, 19 nt, Homo sapiens
aagcaaauccuguauaugu

SEQ ID NO: 1479402 - RNA, 19 nt, Homo sapiens
cagaggaggugaagacauc

SEQ ID NO: 1479403 - RNA, 19 nt, Homo sapiens
ugggugaaguugugcaaua

SEQ ID NO: 1479404 - RNA, 19 nt, Homo sapiens
gaucaaaggccucagaaac

SEQ ID NO: 1479405 - RNA, 19 nt, Homo sapiens
gcaggaagaaccucagaga

SEQ ID NO: 1479406 - RNA, 19 nt, Homo sapiens
aguagggacuggaaacuuu

SEQ ID NO: 1479407 - RNA, 19 nt, Homo sapiens
ccaaaugauuaguugaugu

SEQ ID NO: 1479408 - RNA, 19 nt, Homo sapiens
agucaacgcucuccacuuc

SEQ ID NO: 1479409 - RNA, 19 nt, Homo sapiens
gaagcgaaauaagcaauac

SEQ ID NO: 1479410 - RNA, 19 nt, Homo sapiens
acacacaccugcacauugg

SEQ ID NO: 1479411 - RNA, 19 nt, Homo sapiens
ggacacacaccugcacauu

SEQ ID NO: 1479412 - RNA, 19 nt, Homo sapiens
ugaugaagcuucugaacca

SEQ ID NO: 1479413 - RNA, 19 nt, Homo sapiens
ugauugagauguacauagu

SEQ ID NO: 1479414 - RNA, 19 nt, Homo sapiens
uuuauuaccuccuccuuga

SEQ ID NO: 1479415 - RNA, 19 nt, Homo sapiens
ggaaacaaaggacaugcuu

SEQ ID NO: 1479416 - RNA, 19 nt, Homo sapiens
cauuguguguuuccucuuu

SEQ ID NO: 1479417 - RNA, 19 nt, Homo sapiens
gaacuuucugcuucaugua

SEQ ID NO: 1479418 - RNA, 19 nt, Homo sapiens
ggacuggaaacuuuaggaa

SEQ ID NO: 1479419 - RNA, 19 nt, Homo sapiens
guagggacuggaaacuuua

SEQ ID NO: 1479420 - RNA, 19 nt, Homo sapiens
uuacagcaauaacuucaga

SEQ ID NO: 1479421 - RNA, 19 nt, Homo sapiens
gaccuucucugcgagcaaa

SEQ ID NO: 1479422 - RNA, 19 nt, Homo sapiens
gcaaugacaagcacuuuac

SEQ ID NO: 1479423 - RNA, 19 nt, Homo sapiens
acuggaaacuuuaggaaga

SEQ ID NO: 1479424 - RNA, 19 nt, Homo sapiens
gaaccagcucugacaguug

SEQ ID NO: 1479425 - RNA, 19 nt, Homo sapiens
uuacaucgucacugaauuu

SEQ ID NO: 1479426 - RNA, 19 nt, Homo sapiens
ggacguuaaaggcguguuu

SEQ ID NO: 1479427 - RNA, 19 nt, Homo sapiens
cgauuagauucaagcaauu

SEQ ID NO: 1479428 - RNA, 19 nt, Homo sapiens
acaccaaagucuccuguuc

SEQ ID NO: 1479429 - RNA, 19 nt, Homo sapiens
acgauuagauucaagcaau

SEQ ID NO: 1479430 - RNA, 19 nt, Homo sapiens
gggugaaguugugcaauau

SEQ ID NO: 1479431 - RNA, 19 nt, Homo sapiens
ccucggacgucuacggaaa

SEQ ID NO: 1479432 - RNA, 19 nt, Homo sapiens
ggaguacugucacgaccau

SEQ ID NO: 1479433 - RNA, 19 nt, Homo sapiens
gccaaagauugacccaguu

SEQ ID NO: 1479434 - RNA, 19 nt, Homo sapiens
cagcuacuucggcuucuua

SEQ ID NO: 1479435 - RNA, 19 nt, Homo sapiens
gaaguugugcaauauugga

SEQ ID NO: 1479436 - RNA, 19 nt, Homo sapiens
gagaaauguaugccaaaug

SEQ ID NO: 1479437 - RNA, 19 nt, Homo sapiens
gagagaauccagaccaucu

SEQ ID NO: 1479438 - RNA, 19 nt, Homo sapiens
agcaaauccuguauaugua

SEQ ID NO: 1479439 - RNA, 19 nt, Homo sapiens
guuuaugcauuucaugaug

SEQ ID NO: 1479440 - RNA, 19 nt, Homo sapiens
cauaaacugcucaaggauu

SEQ ID NO: 1479441 - RNA, 19 nt, Homo sapiens
uaaccacuuugcugccauu

SEQ ID NO: 1479442 - RNA, 19 nt, Homo sapiens
gccaaaugauuaguugaug

SEQ ID NO: 1479443 - RNA, 19 nt, Homo sapiens
ugagaaauguaugccaaau

SEQ ID NO: 1479444 - RNA, 19 nt, Homo sapiens
uuaagaagcgucccuguca

SEQ ID NO: 1479445 - RNA, 19 nt, Homo sapiens
cugcugacguuuaugcauu

SEQ ID NO: 1479446 - RNA, 19 nt, Homo sapiens
gcuggcagauuuuggauuu

SEQ ID NO: 1479447 - RNA, 19 nt, Homo sapiens
gaagcaaugacaagcacuu

SEQ ID NO: 1479448 - RNA, 19 nt, Homo sapiens
ucaaaggccucagaaacca

SEQ ID NO: 1479449 - RNA, 19 nt, Homo sapiens
gagaauccagaccaucuug

SEQ ID NO: 1479450 - RNA, 19 nt, Homo sapiens
ggaaggcaacgaaggcaau

SEQ ID NO: 1479451 - RNA, 19 nt, Homo sapiens
caaauccuguauauguauc

SEQ ID NO: 1479452 - RNA, 19 nt, Homo sapiens
caacaagaacaccugacuu

SEQ ID NO: 1479453 - RNA, 19 nt, Homo sapiens
gcucuguggcuguuucaaa

SEQ ID NO: 1479454 - RNA, 19 nt, Homo sapiens
uucauaaacugcucaagga

SEQ ID NO: 1479455 - RNA, 19 nt, Homo sapiens
guuguccgcuugugugugu

SEQ ID NO: 1479456 - RNA, 19 nt, Homo sapiens
agcaauacguuagguguuu

SEQ ID NO: 1479457 - RNA, 19 nt, Homo sapiens
uaugccaaaugauuaguug

SEQ ID NO: 1479458 - RNA, 19 nt, Homo sapiens
ugacaagcacuuuacuuuc

SEQ ID NO: 1479459 - RNA, 19 nt, Homo sapiens
ccaggacucugcggaggaa

SEQ ID NO: 1479460 - RNA, 19 nt, Homo sapiens
gacacacaccugcacauug

SEQ ID NO: 1479461 - RNA, 19 nt, Homo sapiens
ccaacgggcaccugaguga

SEQ ID NO: 1479462 - RNA, 19 nt, Homo sapiens
gcaaugcugcucccugagu

SEQ ID NO: 1479463 - RNA, 19 nt, Homo sapiens
aggccgagauggacuguga

SEQ ID NO: 1479464 - RNA, 19 nt, Homo sapiens
uuaaacagaggcauugaga

SEQ ID NO: 1479465 - RNA, 19 nt, Homo sapiens
gcauugauuacuauccauu

SEQ ID NO: 1479466 - RNA, 19 nt, Homo sapiens
gcaguggcccuuguucuuc

SEQ ID NO: 1479467 - RNA, 19 nt, Homo sapiens
caucgucacugaauuugcu

SEQ ID NO: 1479468 - RNA, 19 nt, Homo sapiens
aagguaaagugagagguuu

SEQ ID NO: 1479469 - RNA, 19 nt, Homo sapiens
guucaaggaagguaaagug

SEQ ID NO: 1479470 - RNA, 19 nt, Homo sapiens
gaagaccacgcggaccaaa

SEQ ID NO: 1479471 - RNA, 19 nt, Homo sapiens
aagagugugugaugugugu

SEQ ID NO: 1479472 - RNA, 19 nt, Homo sapiens
gggagagaauccagaccau

SEQ ID NO: 1479473 - RNA, 19 nt, Homo sapiens
ggaaauacguacccuuuga

SEQ ID NO: 1479474 - RNA, 19 nt, Homo sapiens
gauaagaccuuuacagagu

SEQ ID NO: 1479475 - RNA, 19 nt, Homo sapiens
ggagaaauuuggauacaga

SEQ ID NO: 1479476 - RNA, 19 nt, Homo sapiens
gaucaugugcuccaguuua

SEQ ID NO: 1479477 - RNA, 19 nt, Homo sapiens
gagggaaggugaaguaaag

SEQ ID NO: 1479478 - RNA, 19 nt, Homo sapiens
gagauaagaccuuuacaga

SEQ ID NO: 1479479 - RNA, 19 nt, Homo sapiens
gaaaugcaaaugcuaggua

SEQ ID NO: 1479480 - RNA, 19 nt, Homo sapiens
auacguacccuuugaaaua

SEQ ID NO: 1479481 - RNA, 19 nt, Homo sapiens
ggacacaccuugauuucag

SEQ ID NO: 1479482 - RNA, 19 nt, Homo sapiens
gaaauaccaccuagaggaa

SEQ ID NO: 1479483 - RNA, 19 nt, Homo sapiens
guaagugacacguaaguuu

SEQ ID NO: 1479484 - RNA, 19 nt, Homo sapiens
acaaggaguuaauucauga

SEQ ID NO: 1479485 - RNA, 19 nt, Homo sapiens
caugauagcuuccagaacu

SEQ ID NO: 1479486 - RNA, 19 nt, Homo sapiens
gcaguguuauguugaaugu

SEQ ID NO: 1479487 - RNA, 19 nt, Homo sapiens
ugacugguguccuuucaaa

SEQ ID NO: 1479488 - RNA, 19 nt, Homo sapiens
cauuuaaccggccauauua

SEQ ID NO: 1479489 - RNA, 19 nt, Homo sapiens
cuagguaagugacacguaa

SEQ ID NO: 1479490 - RNA, 19 nt, Homo sapiens
gaaauacguacccuuugaa

SEQ ID NO: 1479491 - RNA, 19 nt, Homo sapiens
cagcaugacugguguccuu

SEQ ID NO: 1479492 - RNA, 19 nt, Homo sapiens
ggaaauugaaacucacauu

SEQ ID NO: 1479493 - RNA, 19 nt, Homo sapiens
gcaaaugcuagguaaguga

SEQ ID NO: 1479494 - RNA, 19 nt, Homo sapiens
uagacaggguuaauuauuc

SEQ ID NO: 1479495 - RNA, 19 nt, Homo sapiens
agacauagacacacacuga

SEQ ID NO: 1479496 - RNA, 19 nt, Homo sapiens
gcgugaggauagagaagua

SEQ ID NO: 1479497 - RNA, 19 nt, Homo sapiens
caccugaccuggagaguuc

SEQ ID NO: 1479498 - RNA, 19 nt, Homo sapiens
gagcugcauguaccaaaua

SEQ ID NO: 1479499 - RNA, 19 nt, Homo sapiens
gggcaaaguaucugaguga

SEQ ID NO: 1479500 - RNA, 19 nt, Homo sapiens
gcacgucacucggaauuuu

SEQ ID NO: 1479501 - RNA, 19 nt, Homo sapiens
aaaugcaaaugcuagguaa

SEQ ID NO: 1479502 - RNA, 19 nt, Homo sapiens
uuccagaacugccaaagaa

SEQ ID NO: 1479503 - RNA, 19 nt, Homo sapiens
ggagcugcauguaccaaau

SEQ ID NO: 1479504 - RNA, 19 nt, Homo sapiens
agacaggguuaauuauuca

SEQ ID NO: 1479505 - RNA, 19 nt, Homo sapiens
ugaccgugcuuggagauaa

SEQ ID NO: 1479506 - RNA, 19 nt, Homo sapiens
ggauccaccggcaauauuu

SEQ ID NO: 1479507 - RNA, 19 nt, Homo sapiens
gagccaaggucuacuucca

SEQ ID NO: 1479508 - RNA, 19 nt, Homo sapiens
auaagaccuuuacagagua

SEQ ID NO: 1479509 - RNA, 19 nt, Homo sapiens
ccaggcaacauuuauuuau

SEQ ID NO: 1479510 - RNA, 19 nt, Homo sapiens
ggacccuagugcagcauga

SEQ ID NO: 1479511 - RNA, 19 nt, Homo sapiens
cuagacaggguuaauuauu

SEQ ID NO: 1479512 - RNA, 19 nt, Homo sapiens
gauggaggcgugacacaga

SEQ ID NO: 1479513 - RNA, 19 nt, Homo sapiens
aacaaggaguuaauucaug

SEQ ID NO: 1479514 - RNA, 19 nt, Homo sapiens
gaaaguaaaacaaggaguu

SEQ ID NO: 1479515 - RNA, 19 nt, Homo sapiens
gaaauuuggauacagacau

SEQ ID NO: 1479516 - RNA, 19 nt, Homo sapiens
gcuuggagauaagaccuuu

SEQ ID NO: 1479517 - RNA, 19 nt, Homo sapiens
ggacgcugcuacccacaag

SEQ ID NO: 1479518 - RNA, 19 nt, Homo sapiens
ggagauaagaccuuuacag

SEQ ID NO: 1479519 - RNA, 19 nt, Homo sapiens
ggagagccaaggucuacuu

SEQ ID NO: 1479520 - RNA, 19 nt, Homo sapiens
gaacgcauuucuguguuuu

SEQ ID NO: 1479521 - RNA, 19 nt, Homo sapiens
ggagugacgcccuuacaag

SEQ ID NO: 1479522 - RNA, 19 nt, Homo sapiens
auacagacauagacacaca

SEQ ID NO: 1479523 - RNA, 19 nt, Homo sapiens
acauuuaaccggccauauu

SEQ ID NO: 1479524 - RNA, 19 nt, Homo sapiens
ggcagucgguuaccacaca

SEQ ID NO: 1479525 - RNA, 19 nt, Homo sapiens
caugugcuccaguuuauga

SEQ ID NO: 1479526 - RNA, 19 nt, Homo sapiens
uuaaccggccauauuauuu

SEQ ID NO: 1479527 - RNA, 19 nt, Homo sapiens
uauuugcaguguuauguug

SEQ ID NO: 1479528 - RNA, 19 nt, Homo sapiens
acaccuugauuucaggauu

SEQ ID NO: 1479529 - RNA, 19 nt, Homo sapiens
ggauacagacauagacaca

SEQ ID NO: 1479530 - RNA, 19 nt, Homo sapiens
ccgaucaugugcuccaguu

SEQ ID NO: 1479531 - RNA, 19 nt, Homo sapiens
ccagugaaaugcaaaugcu

SEQ ID NO: 1479532 - RNA, 19 nt, Homo sapiens
gugcuccaguuuaugaaau

SEQ ID NO: 1479533 - RNA, 19 nt, Homo sapiens
guaauaguacacccgauca

SEQ ID NO: 1479534 - RNA, 19 nt, Homo sapiens
gggaaauacguacccuuug

SEQ ID NO: 1479535 - RNA, 19 nt, Homo sapiens
ggaguguuaggguugaauu

SEQ ID NO: 1479536 - RNA, 19 nt, Homo sapiens
gaggauagagaaguaaaca

SEQ ID NO: 1479537 - RNA, 19 nt, Homo sapiens
cccagucugugguaucuug

SEQ ID NO: 1479538 - RNA, 19 nt, Homo sapiens
gaacgcagagcaggaaugc

SEQ ID NO: 1479539 - RNA, 19 nt, Homo sapiens
gggagugacgcccuuacaa

SEQ ID NO: 1479540 - RNA, 19 nt, Homo sapiens
caugacugguguccuuuca

SEQ ID NO: 1479541 - RNA, 19 nt, Homo sapiens
gacccagcccucagucuug

SEQ ID NO: 1479542 - RNA, 19 nt, Homo sapiens
cgaauuucuagcaaccuua

SEQ ID NO: 1479543 - RNA, 19 nt, Homo sapiens
ccgaauuucuagcaaccuu

SEQ ID NO: 1479544 - RNA, 19 nt, Homo sapiens
ggcaacauuuauuuauugg

SEQ ID NO: 1479545 - RNA, 19 nt, Homo sapiens
gguuaccacacagaauuua

SEQ ID NO: 1479546 - RNA, 19 nt, Homo sapiens
cuccaaggcucccuagaca

SEQ ID NO: 1479547 - RNA, 19 nt, Homo sapiens
caccuugauuucaggauuc

SEQ ID NO: 1479548 - RNA, 19 nt, Homo sapiens
gaaugugaccgugcuugga

SEQ ID NO: 1479549 - RNA, 19 nt, Homo sapiens
gcacaacgcacagaaacac

SEQ ID NO: 1479550 - RNA, 19 nt, Homo sapiens
gaauuucuagcaaccuuag

SEQ ID NO: 1479551 - RNA, 19 nt, Homo sapiens
gauccaccggcaauauuug

SEQ ID NO: 1479552 - RNA, 19 nt, Homo sapiens
aaggagaaauuuggauaca

SEQ ID NO: 1479553 - RNA, 19 nt, Homo sapiens
guguuaggguugaauugug

SEQ ID NO: 1479554 - RNA, 19 nt, Homo sapiens
aaauacguacccuuugaaa

SEQ ID NO: 1479555 - RNA, 19 nt, Homo sapiens
gaccgugcuuggagauaag

SEQ ID NO: 1479556 - RNA, 19 nt, Homo sapiens
cccaggcaacauuuauuua

SEQ ID NO: 1479557 - RNA, 19 nt, Homo sapiens
guucaaagugccuaacaca

SEQ ID NO: 1479558 - RNA, 19 nt, Homo sapiens
gaaauaguugcacgucacu

SEQ ID NO: 1479559 - RNA, 19 nt, Homo sapiens
ugagggaaggugaaguaaa

SEQ ID NO: 1479560 - RNA, 19 nt, Homo sapiens
ggaacgcagagcaggaaug

SEQ ID NO: 1479561 - RNA, 19 nt, Homo sapiens
uuuaggaggcccagugaaa

SEQ ID NO: 1479562 - RNA, 19 nt, Homo sapiens
guaccaaauaccacagaug

SEQ ID NO: 1479563 - RNA, 19 nt, Homo sapiens
ugcuccaguuuaugaaaua

SEQ ID NO: 1479564 - RNA, 19 nt, Homo sapiens
gagggagagccaaggucua

SEQ ID NO: 1479565 - RNA, 19 nt, Homo sapiens
uaagugacacguaaguuuu

SEQ ID NO: 1479566 - RNA, 19 nt, Homo sapiens
gcuagguaagugacacgua

SEQ ID NO: 1479567 - RNA, 19 nt, Homo sapiens
ucgguuaccacacagaauu

SEQ ID NO: 1479568 - RNA, 19 nt, Homo sapiens
uguuaggguugaauugugu

SEQ ID NO: 1479569 - RNA, 19 nt, Homo sapiens
aaagcacaacgcacagaaa

SEQ ID NO: 1479570 - RNA, 19 nt, Homo sapiens
ugaaaaugcugugcggauu

SEQ ID NO: 1479571 - RNA, 19 nt, Homo sapiens
uaacacagggacgcugcua

SEQ ID NO: 1479572 - RNA, 19 nt, Homo sapiens
gguaagugacacguaaguu

SEQ ID NO: 1479573 - RNA, 19 nt, Homo sapiens
ggaaggagcucucgaccua

SEQ ID NO: 1479574 - RNA, 19 nt, Homo sapiens
gagaaagacugauugauug

SEQ ID NO: 1479575 - RNA, 19 nt, Homo sapiens
guaaaugcuucacuaauga

SEQ ID NO: 1479576 - RNA, 19 nt, Homo sapiens
cagaauaucuuuccaagga

SEQ ID NO: 1479577 - RNA, 19 nt, Homo sapiens
gguaaaugcuucacuaaug

SEQ ID NO: 1479578 - RNA, 19 nt, Homo sapiens
gaacaaugccuauggcuau

SEQ ID NO: 1479579 - RNA, 19 nt, Homo sapiens
gacagaagguuccacagaa

SEQ ID NO: 1479580 - RNA, 19 nt, Homo sapiens
ggggaaagcuuuugacuaa

SEQ ID NO: 1479581 - RNA, 19 nt, Homo sapiens
ggaauucucugaaaacauu

SEQ ID NO: 1479582 - RNA, 19 nt, Homo sapiens
cagacucacuuguuaguuu

SEQ ID NO: 1479583 - RNA, 19 nt, Homo sapiens
ugagaaagacugauugauu

SEQ ID NO: 1479584 - RNA, 19 nt, Homo sapiens
gaauuaacggcuuguguuu

SEQ ID NO: 1479585 - RNA, 19 nt, Homo sapiens
caagugaguuaacauuuca

SEQ ID NO: 1479586 - RNA, 19 nt, Homo sapiens
ugaagcaguugucuagaaa

SEQ ID NO: 1479587 - RNA, 19 nt, Homo sapiens
ggaauuaacggcuuguguu

SEQ ID NO: 1479588 - RNA, 19 nt, Homo sapiens
gacacgaucugcauucuca

SEQ ID NO: 1479589 - RNA, 19 nt, Homo sapiens
gugaagcaguugucuagaa

SEQ ID NO: 1479590 - RNA, 19 nt, Homo sapiens
gaauaaaggcacauaucuu

SEQ ID NO: 1479591 - RNA, 19 nt, Homo sapiens
gggagggaauucucugaaa

SEQ ID NO: 1479592 - RNA, 19 nt, Homo sapiens
aaagauuucugucugcauu

SEQ ID NO: 1479593 - RNA, 19 nt, Homo sapiens
ccucagacuuuaugugauu

SEQ ID NO: 1479594 - RNA, 19 nt, Homo sapiens
guggcagacucacuuguua

SEQ ID NO: 1479595 - RNA, 19 nt, Homo sapiens
cugcugugcuggaguaaua

SEQ ID NO: 1479596 - RNA, 19 nt, Homo sapiens
gcaaguagacgcacuaacu

SEQ ID NO: 1479597 - RNA, 19 nt, Homo sapiens
gugcgaaggucauuugugu

SEQ ID NO: 1479598 - RNA, 19 nt, Homo sapiens
caaucaagcucccaguugu

SEQ ID NO: 1479599 - RNA, 19 nt, Homo sapiens
gcaaucaagcucccaguug

SEQ ID NO: 1479600 - RNA, 19 nt, Homo sapiens
gcagagaaguccguucaca

SEQ ID NO: 1479601 - RNA, 19 nt, Homo sapiens
gaagagcugggcaggaauu

SEQ ID NO: 1479602 - RNA, 19 nt, Homo sapiens
guacaccauuugaauaaag

SEQ ID NO: 1479603 - RNA, 19 nt, Homo sapiens
guugguaaaugcuucacua

SEQ ID NO: 1479604 - RNA, 19 nt, Homo sapiens
cugcugaugucucccuuua

SEQ ID NO: 1479605 - RNA, 19 nt, Homo sapiens
gacagacagugaaacaaau

SEQ ID NO: 1479606 - RNA, 19 nt, Homo sapiens
acagaagguuccacagaaa

SEQ ID NO: 1479607 - RNA, 19 nt, Homo sapiens
gcugaugucucccuuuagu

SEQ ID NO: 1479608 - RNA, 19 nt, Homo sapiens
ccaggagucucgugucuuc

SEQ ID NO: 1479609 - RNA, 19 nt, Homo sapiens
acacagagccaggugcuua

SEQ ID NO: 1479610 - RNA, 19 nt, Homo sapiens
gcgaaggucauuuguguga

SEQ ID NO: 1479611 - RNA, 19 nt, Homo sapiens
ccauuucucuccucuacaa

SEQ ID NO: 1479612 - RNA, 19 nt, Homo sapiens
acaagugaguuaacauuuc

SEQ ID NO: 1479613 - RNA, 19 nt, Homo sapiens
ucaaauaccugggcaucug

SEQ ID NO: 1479614 - RNA, 19 nt, Homo sapiens
uaacagauaaugucuccuu

SEQ ID NO: 1479615 - RNA, 19 nt, Homo sapiens
agacagacagugaaacaaa

SEQ ID NO: 1479616 - RNA, 19 nt, Homo sapiens
gaagcugcaguaacaugua

SEQ ID NO: 1479617 - RNA, 19 nt, Homo sapiens
caaggauguuugcauagug

SEQ ID NO: 1479618 - RNA, 19 nt, Homo sapiens
gcacacacaagugaguuaa

SEQ ID NO: 1479619 - RNA, 19 nt, Homo sapiens
auuaacggcuuguguuuga

SEQ ID NO: 1479620 - RNA, 19 nt, Homo sapiens
ggaaagcuuuugacuaauc

SEQ ID NO: 1479621 - RNA, 19 nt, Homo sapiens
caaugccuauggcuauuug

SEQ ID NO: 1479622 - RNA, 19 nt, Homo sapiens
aggaagagcugggcaggaa

SEQ ID NO: 1479623 - RNA, 19 nt, Homo sapiens
guguacaccauuugaauaa

SEQ ID NO: 1479624 - RNA, 19 nt, Homo sapiens
ccaaggauguuugcauagu

SEQ ID NO: 1479625 - RNA, 19 nt, Homo sapiens
uuccaaggauguuugcaua

SEQ ID NO: 1479626 - RNA, 19 nt, Homo sapiens
ggagggaauucucugaaaa

SEQ ID NO: 1479627 - RNA, 19 nt, Homo sapiens
caacagcagacauccauca

SEQ ID NO: 1479628 - RNA, 19 nt, Homo sapiens
ggagagacacgaucugcau

SEQ ID NO: 1479629 - RNA, 19 nt, Homo sapiens
acacacaagugaguuaaca

SEQ ID NO: 1479630 - RNA, 19 nt, Homo sapiens
agacucacuuguuaguuug

SEQ ID NO: 1479631 - RNA, 19 nt, Homo sapiens
uccgucagguugugguuua

SEQ ID NO: 1479632 - RNA, 19 nt, Homo sapiens
aaaggcacauaucuuaaag

SEQ ID NO: 1479633 - RNA, 19 nt, Homo sapiens
aaggauguuugcauaguga

SEQ ID NO: 1479634 - RNA, 19 nt, Homo sapiens
acacaagugaguuaacauu

SEQ ID NO: 1479635 - RNA, 19 nt, Homo sapiens
cagacagugaaacaaauua

SEQ ID NO: 1479636 - RNA, 19 nt, Homo sapiens
ccagggcccucagacagaa

SEQ ID NO: 1479637 - RNA, 19 nt, Homo sapiens
caaauaccugggcaucuga

SEQ ID NO: 1479638 - RNA, 19 nt, Homo sapiens
acucagaacacccaagaaa

SEQ ID NO: 1479639 - RNA, 19 nt, Homo sapiens
gggcugccuugccaucaga

SEQ ID NO: 1479640 - RNA, 19 nt, Homo sapiens
gugcagacccacuuugugu

SEQ ID NO: 1479641 - RNA, 19 nt, Homo sapiens
cacaagugaguuaacauuu

SEQ ID NO: 1479642 - RNA, 19 nt, Homo sapiens
cccugaagcugcaguaaca

SEQ ID NO: 1479643 - RNA, 19 nt, Homo sapiens
aagauggauuggcccagua

SEQ ID NO: 1479644 - RNA, 19 nt, Homo sapiens
ugaauaaaggcacauaucu

SEQ ID NO: 1479645 - RNA, 19 nt, Homo sapiens
agacagaagguuccacaga

SEQ ID NO: 1479646 - RNA, 19 nt, Homo sapiens
gagagacacgaucugcauu

SEQ ID NO: 1479647 - RNA, 19 nt, Homo sapiens
caaggaacaaugccuaugg

SEQ ID NO: 1479648 - RNA, 19 nt, Homo sapiens
gaaagacugauugauugau

SEQ ID NO: 1479649 - RNA, 19 nt, Homo sapiens
cagcuucccuggagaacag

SEQ ID NO: 1479650 - RNA, 19 nt, Homo sapiens
auucucagcuucccacuuc

SEQ ID NO: 1479651 - RNA, 19 nt, Homo sapiens
gagacacgaucugcauucu

SEQ ID NO: 1479652 - RNA, 19 nt, Homo sapiens
cacagaaaauccaacagua

SEQ ID NO: 1479653 - RNA, 19 nt, Homo sapiens
ugugauucuuggcaguuua

SEQ ID NO: 1479654 - RNA, 19 nt, Homo sapiens
caaguagacgcacuaacug

SEQ ID NO: 1479655 - RNA, 19 nt, Homo sapiens
ugugugagcgugugagaaa

SEQ ID NO: 1479656 - RNA, 19 nt, Homo sapiens
gagcugggcaggaauuaac

SEQ ID NO: 1479657 - RNA, 19 nt, Homo sapiens
ccacaaucccagaggaaga

SEQ ID NO: 1479658 - RNA, 19 nt, Homo sapiens
gcugcaguaacauguauuu

SEQ ID NO: 1479659 - RNA, 19 nt, Homo sapiens
aagcugcaguaacauguau

SEQ ID NO: 1479660 - RNA, 19 nt, Homo sapiens
gaaagcuuuugacuaauca

SEQ ID NO: 1479661 - RNA, 19 nt, Homo sapiens
gaacacccaagaaaagauu

SEQ ID NO: 1479662 - RNA, 19 nt, Homo sapiens
ucacucagaacacccaaga

SEQ ID NO: 1479663 - RNA, 19 nt, Homo sapiens
ggguaaaaccucagacuuu

SEQ ID NO: 1479664 - RNA, 19 nt, Homo sapiens
acugauugauugauagaug

SEQ ID NO: 1479665 - RNA, 19 nt, Homo sapiens
agaaagacugauugauuga

SEQ ID NO: 1479666 - RNA, 19 nt, Homo sapiens
ugagacagacagugaaaca

SEQ ID NO: 1479667 - RNA, 19 nt, Homo sapiens
gcaguugucuagaaaaguc

SEQ ID NO: 1479668 - RNA, 19 nt, Homo sapiens
caugauuguugguaaaugc

SEQ ID NO: 1479669 - RNA, 19 nt, Homo sapiens
gcccaggagucucgugucu

SEQ ID NO: 1479670 - RNA, 19 nt, Homo sapiens
uaaugaagcuaccccauag

SEQ ID NO: 1479671 - RNA, 19 nt, Homo sapiens
gugggucucuggcauuucu

SEQ ID NO: 1479672 - RNA, 19 nt, Homo sapiens
ugucugcauuguggcuuua

SEQ ID NO: 1479673 - RNA, 19 nt, Homo sapiens
gaaggucguuuguuucaga

SEQ ID NO: 1479674 - RNA, 19 nt, Homo sapiens
ccaaauggagcucuacuua

SEQ ID NO: 1479675 - RNA, 19 nt, Homo sapiens
acauggaucuggaggauua

SEQ ID NO: 1479676 - RNA, 19 nt, Homo sapiens
gcauugcccuuaccauuau

SEQ ID NO: 1479677 - RNA, 19 nt, Homo sapiens
aaauggagcucuacuuaug

SEQ ID NO: 1479678 - RNA, 19 nt, Homo sapiens
ggaguuauacuguuuguga

SEQ ID NO: 1479679 - RNA, 19 nt, Homo sapiens
caaauggaguuauacuguu

SEQ ID NO: 1479680 - RNA, 19 nt, Homo sapiens
ggcauuauguguucgaauu

SEQ ID NO: 1479681 - RNA, 19 nt, Homo sapiens
gggcauuucuauuagguuu

SEQ ID NO: 1479682 - RNA, 19 nt, Homo sapiens
ggauguuacuggcugguuu

SEQ ID NO: 1479683 - RNA, 19 nt, Homo sapiens
uaagaggaguauugaaugu

SEQ ID NO: 1479684 - RNA, 19 nt, Homo sapiens
agaggaguauugaauguaa

SEQ ID NO: 1479685 - RNA, 19 nt, Homo sapiens
caggugguauacuuaauaa

SEQ ID NO: 1479686 - RNA, 19 nt, Homo sapiens
cgaaggaugugaugacagu

SEQ ID NO: 1479687 - RNA, 19 nt, Homo sapiens
gcccuuaccauuauucuaa

SEQ ID NO: 1479688 - RNA, 19 nt, Homo sapiens
gaaaauggauaugguguug

SEQ ID NO: 1479689 - RNA, 19 nt, Homo sapiens
uaacacauggucuucaauu

SEQ ID NO: 1479690 - RNA, 19 nt, Homo sapiens
cuaauaauacugcacauga

SEQ ID NO: 1479691 - RNA, 19 nt, Homo sapiens
ccacaggcuuugaggcauu

SEQ ID NO: 1479692 - RNA, 19 nt, Homo sapiens
gcccaaagcuacaguacag

SEQ ID NO: 1479693 - RNA, 19 nt, Homo sapiens
ggucguuuguuucagauug

SEQ ID NO: 1479694 - RNA, 19 nt, Homo sapiens
aauaagagcugggcuugga

SEQ ID NO: 1479695 - RNA, 19 nt, Homo sapiens
gaugaaaacuuccaaacau

SEQ ID NO: 1479696 - RNA, 19 nt, Homo sapiens
gcauaucuguugccacucu

SEQ ID NO: 1479697 - RNA, 19 nt, Homo sapiens
cacauggucuucaauuuua

SEQ ID NO: 1479698 - RNA, 19 nt, Homo sapiens
ggaggauuaugcacacuag

SEQ ID NO: 1479699 - RNA, 19 nt, Homo sapiens
caaauggagcucuacuuau

SEQ ID NO: 1479700 - RNA, 19 nt, Homo sapiens
guguguuucugccgucuua

SEQ ID NO: 1479701 - RNA, 19 nt, Homo sapiens
gcaggaauguuuugggauu

SEQ ID NO: 1479702 - RNA, 19 nt, Homo sapiens
ucacuggauucaauacaug

SEQ ID NO: 1479703 - RNA, 19 nt, Homo sapiens
ucaggugguauacuuaaua

SEQ ID NO: 1479704 - RNA, 19 nt, Homo sapiens
uuugugauaugguguauga

SEQ ID NO: 1479705 - RNA, 19 nt, Homo sapiens
auacauuucuuguccucua

SEQ ID NO: 1479706 - RNA, 19 nt, Homo sapiens
caacguauugguuuacaug

SEQ ID NO: 1479707 - RNA, 19 nt, Homo sapiens
gcauuucuauuagguuugu

SEQ ID NO: 1479708 - RNA, 19 nt, Homo sapiens
ggcuaucacuggauucaau

SEQ ID NO: 1479709 - RNA, 19 nt, Homo sapiens
gaaauaaaaccacagacaa

SEQ ID NO: 1479710 - RNA, 19 nt, Homo sapiens
ccauuaugauccaagcaaa

SEQ ID NO: 1479711 - RNA, 19 nt, Homo sapiens
gcauuauguguucgaauuu

SEQ ID NO: 1479712 - RNA, 19 nt, Homo sapiens
ucuauuagguuuguucuag

SEQ ID NO: 1479713 - RNA, 19 nt, Homo sapiens
gaaauuucccuggcaaugg

SEQ ID NO: 1479714 - RNA, 19 nt, Homo sapiens
ccuaacacauggucuucaa

SEQ ID NO: 1479715 - RNA, 19 nt, Homo sapiens
uagcaugcauaccacagaa

SEQ ID NO: 1479716 - RNA, 19 nt, Homo sapiens
uggaugacauucuggcuau

SEQ ID NO: 1479717 - RNA, 19 nt, Homo sapiens
gcuguagguccaugccuua

SEQ ID NO: 1479718 - RNA, 19 nt, Homo sapiens
ccacuuccaccucuucuug

SEQ ID NO: 1479719 - RNA, 19 nt, Homo sapiens
aaccacauaucuauugaug

SEQ ID NO: 1479720 - RNA, 19 nt, Homo sapiens
uaaggaacguauguauuag

SEQ ID NO: 1479721 - RNA, 19 nt, Homo sapiens
gcuaucacuggauucaaua

SEQ ID NO: 1479722 - RNA, 19 nt, Homo sapiens
gcaagaaaauggauauggu

SEQ ID NO: 1479723 - RNA, 19 nt, Homo sapiens
acaaauggaguuauacugu

SEQ ID NO: 1479724 - RNA, 19 nt, Homo sapiens
aacacauggucuucaauuu

SEQ ID NO: 1479725 - RNA, 19 nt, Homo sapiens
gaggaguauugaauguaau

SEQ ID NO: 1479726 - RNA, 19 nt, Homo sapiens
ggagacauacauuucuugu

SEQ ID NO: 1479727 - RNA, 19 nt, Homo sapiens
ggaaccauaugcgaaggau

SEQ ID NO: 1479728 - RNA, 19 nt, Homo sapiens
gaugaaaguccaaaagauu

SEQ ID NO: 1479729 - RNA, 19 nt, Homo sapiens
gaacauuuggaggaugaaa

SEQ ID NO: 1479730 - RNA, 19 nt, Homo sapiens
gaaguuguagcaugcauac

SEQ ID NO: 1479731 - RNA, 19 nt, Homo sapiens
guuguugucccuuacauga

SEQ ID NO: 1479732 - RNA, 19 nt, Homo sapiens
auuugaaggucguuuguuu

SEQ ID NO: 1479733 - RNA, 19 nt, Homo sapiens
caaaauggucccaagaaaa

SEQ ID NO: 1479734 - RNA, 19 nt, Homo sapiens
ucuaagaggaguauugaau

SEQ ID NO: 1479735 - RNA, 19 nt, Homo sapiens
cacucuaaguuuggcauua

SEQ ID NO: 1479736 - RNA, 19 nt, Homo sapiens
uuacauggaucuggaggau

SEQ ID NO: 1479737 - RNA, 19 nt, Homo sapiens
cguauugguuuacauggau

SEQ ID NO: 1479738 - RNA, 19 nt, Homo sapiens
uuaggcagccaacguauug

SEQ ID NO: 1479739 - RNA, 19 nt, Homo sapiens
caguauggaugacauucug

SEQ ID NO: 1479740 - RNA, 19 nt, Homo sapiens
ggcauuccaaccuuauuaa

SEQ ID NO: 1479741 - RNA, 19 nt, Homo sapiens
agcauugcccuuaccauua

SEQ ID NO: 1479742 - RNA, 19 nt, Homo sapiens
ucucccugguggaaauuua

SEQ ID NO: 1479743 - RNA, 19 nt, Homo sapiens
gaagcucucccugguggaa

SEQ ID NO: 1479744 - RNA, 19 nt, Homo sapiens
gcacaugaagaaacuaaaa

SEQ ID NO: 1479745 - RNA, 19 nt, Homo sapiens
gaguuauacuguuugugau

SEQ ID NO: 1479746 - RNA, 19 nt, Homo sapiens
aaggagacauacauuucuu

SEQ ID NO: 1479747 - RNA, 19 nt, Homo sapiens
ugugaugacaguagcauuu

SEQ ID NO: 1479748 - RNA, 19 nt, Homo sapiens
uaauacugcacaugaagaa

SEQ ID NO: 1479749 - RNA, 19 nt, Homo sapiens
cuaaaacugucuuaucaga

SEQ ID NO: 1479750 - RNA, 19 nt, Homo sapiens
cugcuguuguugucccuua

SEQ ID NO: 1479751 - RNA, 19 nt, Homo sapiens
aagcauugcccuuaccauu

SEQ ID NO: 1479752 - RNA, 19 nt, Homo sapiens
cuaagaggaguauugaaug

SEQ ID NO: 1479753 - RNA, 19 nt, Homo sapiens
ugaugugcuuugcugguuu

SEQ ID NO: 1479754 - RNA, 19 nt, Homo sapiens
acucuaaguuuggcauuau

SEQ ID NO: 1479755 - RNA, 19 nt, Homo sapiens
uggauaugguguugaggaa

SEQ ID NO: 1479756 - RNA, 19 nt, Homo sapiens
aaauggauaugguguugag

SEQ ID NO: 1479757 - RNA, 19 nt, Homo sapiens
acaaaauggucccaagaaa

SEQ ID NO: 1479758 - RNA, 19 nt, Homo sapiens
gaagaaauaaaaccacaga

SEQ ID NO: 1479759 - RNA, 19 nt, Homo sapiens
uacauuucuuguccucuaa

SEQ ID NO: 1479760 - RNA, 19 nt, Homo sapiens
auuccaaccuuauuaaugg

SEQ ID NO: 1479761 - RNA, 19 nt, Homo sapiens
aggcauuccaaccuuauua

SEQ ID NO: 1479762 - RNA, 19 nt, Homo sapiens
ccucagagucucauugauc

SEQ ID NO: 1479763 - RNA, 19 nt, Homo sapiens
ccucaggugguauacuuaa

SEQ ID NO: 1479764 - RNA, 19 nt, Homo sapiens
gaaaacuuccaaacaucua

SEQ ID NO: 1479765 - RNA, 19 nt, Homo sapiens
caacucauuagaauaccuu

SEQ ID NO: 1479766 - RNA, 19 nt, Homo sapiens
ugucaacauuagaacauca

SEQ ID NO: 1479767 - RNA, 19 nt, Homo sapiens
cuauaaggaacguauguau

SEQ ID NO: 1479768 - RNA, 19 nt, Homo sapiens
gcauuccaaccuuauuaau

SEQ ID NO: 1479769 - RNA, 19 nt, Homo sapiens
augaacauuuggaggauga

SEQ ID NO: 1479770 - RNA, 19 nt, Homo sapiens
agagucucauugauccuaa

SEQ ID NO: 1479771 - RNA, 19 nt, Homo sapiens
ugguuuaguuggagcagaa

SEQ ID NO: 1479772 - RNA, 19 nt, Homo sapiens
gaugacauucuggcuauca

SEQ ID NO: 1479773 - RNA, 19 nt, Homo sapiens
ggaagugguuucuaauaaa

SEQ ID NO: 1479774 - RNA, 19 nt, Homo sapiens
gaauuguugugacucauua

SEQ ID NO: 1479775 - RNA, 19 nt, Homo sapiens
gcagaaggcuuucaaguac

SEQ ID NO: 1479776 - RNA, 19 nt, Homo sapiens
gaguaaagaugcugaaugu

SEQ ID NO: 1479777 - RNA, 19 nt, Homo sapiens
cagaagcaccguacuauua

SEQ ID NO: 1479778 - RNA, 19 nt, Homo sapiens
caucuaagcuuuccuuuua

SEQ ID NO: 1479779 - RNA, 19 nt, Homo sapiens
gagaauggccuuugaauag

SEQ ID NO: 1479780 - RNA, 19 nt, Homo sapiens
aaacuuugcugaauuguug

SEQ ID NO: 1479781 - RNA, 19 nt, Homo sapiens
auaagcagcugaggaauua

SEQ ID NO: 1479782 - RNA, 19 nt, Homo sapiens
guaaagaugcugaauguga

SEQ ID NO: 1479783 - RNA, 19 nt, Homo sapiens
gagguuaucucacguguag

SEQ ID NO: 1479784 - RNA, 19 nt, Homo sapiens
caaguuagcaucacaaaga

SEQ ID NO: 1479785 - RNA, 19 nt, Homo sapiens
gcaccguacuauuauguaa

SEQ ID NO: 1479786 - RNA, 19 nt, Homo sapiens
aaauaaggcugcauuacuu

SEQ ID NO: 1479787 - RNA, 19 nt, Homo sapiens
gaaugugacuuguuaagag

SEQ ID NO: 1479788 - RNA, 19 nt, Homo sapiens
gaaacacgaugcuggaaag

SEQ ID NO: 1479789 - RNA, 19 nt, Homo sapiens
uggaagugguuucuaauaa

SEQ ID NO: 1479790 - RNA, 19 nt, Homo sapiens
gaaauaaggcugcauuacu

SEQ ID NO: 1479791 - RNA, 19 nt, Homo sapiens
caucauaagcuaccuauug

SEQ ID NO: 1479792 - RNA, 19 nt, Homo sapiens
cccacugucucuuguauua

SEQ ID NO: 1479793 - RNA, 19 nt, Homo sapiens
gaaggaagagacucaaguu

SEQ ID NO: 1479794 - RNA, 19 nt, Homo sapiens
ggccagagacuccaucuaa

SEQ ID NO: 1479795 - RNA, 19 nt, Homo sapiens
gaaagaagaaauaguccuu

SEQ ID NO: 1479796 - RNA, 19 nt, Homo sapiens
gagacuccaucuaagcuuu

SEQ ID NO: 1479797 - RNA, 19 nt, Homo sapiens
gaauggagacaguguuuga

SEQ ID NO: 1479798 - RNA, 19 nt, Homo sapiens
gagaaauaaggcugcauua

SEQ ID NO: 1479799 - RNA, 19 nt, Homo sapiens
ggaaaacuuugcugaauug

SEQ ID NO: 1479800 - RNA, 19 nt, Homo sapiens
gccauucgcugcaauauac

SEQ ID NO: 1479801 - RNA, 19 nt, Homo sapiens
ggaagagacucaaguuagc

SEQ ID NO: 1479802 - RNA, 19 nt, Homo sapiens
accaucagcuuuauuauug

SEQ ID NO: 1479803 - RNA, 19 nt, Homo sapiens
gagaauggagacaguguuu

SEQ ID NO: 1479804 - RNA, 19 nt, Homo sapiens
ggagaaauaaggcugcauu

SEQ ID NO: 1479805 - RNA, 19 nt, Homo sapiens
uacuguaacuccugcaaua

SEQ ID NO: 1479806 - RNA, 19 nt, Homo sapiens
gagguugccuuugguuuau

SEQ ID NO: 1479807 - RNA, 19 nt, Homo sapiens
cgagaauggccuuugaaua

SEQ ID NO: 1479808 - RNA, 19 nt, Homo sapiens
uugaagagauggaugaaga

SEQ ID NO: 1479809 - RNA, 19 nt, Homo sapiens
gaagcaccguacuauuaug

SEQ ID NO: 1479810 - RNA, 19 nt, Homo sapiens
gcagaacguaucagugaaa

SEQ ID NO: 1479811 - RNA, 19 nt, Homo sapiens
cgagaaaacugaaaagaau

SEQ ID NO: 1479812 - RNA, 19 nt, Homo sapiens
gaugacauuuucccuguua

SEQ ID NO: 1479813 - RNA, 19 nt, Homo sapiens
ggaaagggagauugcauuc

SEQ ID NO: 1479814 - RNA, 19 nt, Homo sapiens
acaaagacuugaggagaaa

SEQ ID NO: 1479815 - RNA, 19 nt, Homo sapiens
gaaagcacaggaggaguuu

SEQ ID NO: 1479816 - RNA, 19 nt, Homo sapiens
gaagagauggaugaagaaa

SEQ ID NO: 1479817 - RNA, 19 nt, Homo sapiens
gccauagaauccuacacua

SEQ ID NO: 1479818 - RNA, 19 nt, Homo sapiens
cugaagagccuacccguuu

SEQ ID NO: 1479819 - RNA, 19 nt, Homo sapiens
ucauuuaccaucagcuuua

SEQ ID NO: 1479820 - RNA, 19 nt, Homo sapiens
ugagguugccuuugguuua

SEQ ID NO: 1479821 - RNA, 19 nt, Homo sapiens
gcuuuaugcuccucuucua

SEQ ID NO: 1479822 - RNA, 19 nt, Homo sapiens
aacaaagacuugaggagaa

SEQ ID NO: 1479823 - RNA, 19 nt, Homo sapiens
gcaauauacuggccaucca

SEQ ID NO: 1479824 - RNA, 19 nt, Homo sapiens
ucaaguacaugucagugau

SEQ ID NO: 1479825 - RNA, 19 nt, Homo sapiens
gcagucaggcaaaguguug

SEQ ID NO: 1479826 - RNA, 19 nt, Homo sapiens
gagccuacccguuuuguua

SEQ ID NO: 1479827 - RNA, 19 nt, Homo sapiens
gaacguaucagugaaacuc

SEQ ID NO: 1479828 - RNA, 19 nt, Homo sapiens
uguugugacucauuaauug

SEQ ID NO: 1479829 - RNA, 19 nt, Homo sapiens
agaauggccuuugaauaga

SEQ ID NO: 1479830 - RNA, 19 nt, Homo sapiens
ugucagugauucaggcuuu

SEQ ID NO: 1479831 - RNA, 19 nt, Homo sapiens
caggaggaguuucaucuuc

SEQ ID NO: 1479832 - RNA, 19 nt, Homo sapiens
acagaacaaugaguaaaga

SEQ ID NO: 1479833 - RNA, 19 nt, Homo sapiens
gacaguguuugaagagaug

SEQ ID NO: 1479834 - RNA, 19 nt, Homo sapiens
gaauggccuuugaauagag

SEQ ID NO: 1479835 - RNA, 19 nt, Homo sapiens
gcacaccauuagaaauuac

SEQ ID NO: 1479836 - RNA, 19 nt, Homo sapiens
gggaaaacuuugcugaauu

SEQ ID NO: 1479837 - RNA, 19 nt, Homo sapiens
gcuauaugcugccaucaac

SEQ ID NO: 1479838 - RNA, 19 nt, Homo sapiens
ucuuggaagugguuucuaa

SEQ ID NO: 1479839 - RNA, 19 nt, Homo sapiens
ugcugaaugugacuuguua

SEQ ID NO: 1479840 - RNA, 19 nt, Homo sapiens
gcugaauuguugugacuca

SEQ ID NO: 1479841 - RNA, 19 nt, Homo sapiens
acacuacagcuuucaguuu

SEQ ID NO: 1479842 - RNA, 19 nt, Homo sapiens
gcaaugaugauacuaccau

SEQ ID NO: 1479843 - RNA, 19 nt, Homo sapiens
auacgagaauggccuuuga

SEQ ID NO: 1479844 - RNA, 19 nt, Homo sapiens
ggaggaguuucaucuucga

SEQ ID NO: 1479845 - RNA, 19 nt, Homo sapiens
caauaugguggguacagua

SEQ ID NO: 1479846 - RNA, 19 nt, Homo sapiens
gagacaguguuugaagaga

SEQ ID NO: 1479847 - RNA, 19 nt, Homo sapiens
cauagaauccuacacuaca

SEQ ID NO: 1479848 - RNA, 19 nt, Homo sapiens
uugcaucucugaaacugaa

SEQ ID NO: 1479849 - RNA, 19 nt, Homo sapiens
agagauggaugaagaaagc

SEQ ID NO: 1479850 - RNA, 19 nt, Homo sapiens
ccauccagaucagcaauga

SEQ ID NO: 1479851 - RNA, 19 nt, Homo sapiens
caucagcuuuauuauugug

SEQ ID NO: 1479852 - RNA, 19 nt, Homo sapiens
guggugagguugccuuugg

SEQ ID NO: 1479853 - RNA, 19 nt, Homo sapiens
ccagaagcaccguacuauu

SEQ ID NO: 1479854 - RNA, 19 nt, Homo sapiens
ccucuucuaucaguauuug

SEQ ID NO: 1479855 - RNA, 19 nt, Homo sapiens
ggccauucgcugcaauaua

SEQ ID NO: 1479856 - RNA, 19 nt, Homo sapiens
ugcacaccauuagaaauua

SEQ ID NO: 1479857 - RNA, 19 nt, Homo sapiens
uuuauguucuccugugaaa

SEQ ID NO: 1479858 - RNA, 19 nt, Homo sapiens
ucacagaacaaugaguaaa

SEQ ID NO: 1479859 - RNA, 19 nt, Homo sapiens
agaagcaccguacuauuau

SEQ ID NO: 1479860 - RNA, 19 nt, Homo sapiens
agacaguguuugaagagau

SEQ ID NO: 1479861 - RNA, 19 nt, Homo sapiens
acucuggcauuguucauug

SEQ ID NO: 1479862 - RNA, 19 nt, Homo sapiens
uguagugacucuggcauug

SEQ ID NO: 1479863 - RNA, 19 nt, Homo sapiens
agcagaaggcuuucaagua

SEQ ID NO: 1479864 - RNA, 19 nt, Homo sapiens
uggagacaguguuugaaga

SEQ ID NO: 1479865 - RNA, 19 nt, Homo sapiens
ucacaaagagaaacacgau

SEQ ID NO: 1479866 - RNA, 19 nt, Homo sapiens
aaggaagagacucaaguua

SEQ ID NO: 1479867 - RNA, 19 nt, Homo sapiens
gcacauucuucuuuuagga

SEQ ID NO: 1479868 - RNA, 19 nt, Homo sapiens
ucucaacuguucucuacug

SEQ ID NO: 1479869 - RNA, 19 nt, Homo sapiens
gcauuaucuucucaacugu

SEQ ID NO: 1479870 - RNA, 19 nt, Homo sapiens
agcauuaucuucucaacug

SEQ ID NO: 1479871 - RNA, 19 nt, Homo sapiens
cagcugaggaauuacugua

SEQ ID NO: 1479872 - RNA, 19 nt, Homo sapiens
aauaagcagcugaggaauu

SEQ ID NO: 1479873 - RNA, 19 nt, Homo sapiens
aaauggaacugauggauua

SEQ ID NO: 1479874 - RNA, 19 nt, Homo sapiens
ggaaggauuuguuuauuug

SEQ ID NO: 1479875 - RNA, 19 nt, Homo sapiens
gcucaaauauagcagcuuu

SEQ ID NO: 1479876 - RNA, 19 nt, Homo sapiens
gaaggaaggauuuguuuau

SEQ ID NO: 1479877 - RNA, 19 nt, Homo sapiens
ggaaggaaggauuuguuua

SEQ ID NO: 1479878 - RNA, 19 nt, Homo sapiens
gaaauggaacugauggauu

SEQ ID NO: 1479879 - RNA, 19 nt, Homo sapiens
gagcuggauucuuuacuug

SEQ ID NO: 1479880 - RNA, 19 nt, Homo sapiens
gcuggauucuuuacuugua

SEQ ID NO: 1479881 - RNA, 19 nt, Homo sapiens
gaacugauggauuaaagug

SEQ ID NO: 1479882 - RNA, 19 nt, Homo sapiens
ucauggagcuuccuguaug

SEQ ID NO: 1479883 - RNA, 19 nt, Homo sapiens
auauugaccucgcgucuaa

SEQ ID NO: 1479884 - RNA, 19 nt, Homo sapiens
gcacucuucugaaauaaaa

SEQ ID NO: 1479885 - RNA, 19 nt, Homo sapiens
ccaagugacagauucaauu

SEQ ID NO: 1479886 - RNA, 19 nt, Homo sapiens
gggaaggaaggauuuguuu

SEQ ID NO: 1479887 - RNA, 19 nt, Homo sapiens
gguaaucugcugagccuuu

SEQ ID NO: 1479888 - RNA, 19 nt, Homo sapiens
ccaaguuucuuuucaauga

SEQ ID NO: 1479889 - RNA, 19 nt, Homo sapiens
uauuugcacucuucugaaa

SEQ ID NO: 1479890 - RNA, 19 nt, Homo sapiens
ccgcagaucccauuuaauc

SEQ ID NO: 1479891 - RNA, 19 nt, Homo sapiens
ggacucagcugggaaugcu

SEQ ID NO: 1479892 - RNA, 19 nt, Homo sapiens
uuugcacucuucugaaaua

SEQ ID NO: 1479893 - RNA, 19 nt, Homo sapiens
gcugggcucugaccucugu

SEQ ID NO: 1479894 - RNA, 19 nt, Homo sapiens
guaaucugcugagccuuug

SEQ ID NO: 1479895 - RNA, 19 nt, Homo sapiens
caagugacagauucaauuc

SEQ ID NO: 1479896 - RNA, 19 nt, Homo sapiens
aaaauuaccuggaacauac

SEQ ID NO: 1479897 - RNA, 19 nt, Homo sapiens
ggcagaaaccacaaaauua

SEQ ID NO: 1479898 - RNA, 19 nt, Homo sapiens
ccagacccaugcaggaaga

SEQ ID NO: 1479899 - RNA, 19 nt, Homo sapiens
agagcuggauucuuuacuu

SEQ ID NO: 1479900 - RNA, 19 nt, Homo sapiens
cuuccuggcugcagaguug

SEQ ID NO: 1479901 - RNA, 19 nt, Homo sapiens
acacaacuaauccaauuug

SEQ ID NO: 1479902 - RNA, 19 nt, Homo sapiens
gaggaaaggagaggcuaaa

SEQ ID NO: 1479903 - RNA, 19 nt, Homo sapiens
agccgcagaucccauuuaa

SEQ ID NO: 1479904 - RNA, 19 nt, Homo sapiens
gagccagguccuacggaua

SEQ ID NO: 1479905 - RNA, 19 nt, Homo sapiens
agugacagauucaauucaa

SEQ ID NO: 1479906 - RNA, 19 nt, Homo sapiens
ugggaaugcuggccauaga

SEQ ID NO: 1479907 - RNA, 19 nt, Homo sapiens
gaacauacacgccccaagu

SEQ ID NO: 1479908 - RNA, 19 nt, Homo sapiens
gaagagggguggggaguca

SEQ ID NO: 1479909 - RNA, 19 nt, Homo sapiens
caaaauuaccuggaacaua

SEQ ID NO: 1479910 - RNA, 19 nt, Homo sapiens
ccacacuuaccaccaugua

SEQ ID NO: 1479911 - RNA, 19 nt, Homo sapiens
ggacaacaaccagcacagu

SEQ ID NO: 1479912 - RNA, 19 nt, Homo sapiens
uaaaaggggccaugaguga

SEQ ID NO: 1479913 - RNA, 19 nt, Homo sapiens
gggagucacggcaaguuga

SEQ ID NO: 1479914 - RNA, 19 nt, Homo sapiens
ggagugugugugaugauga

SEQ ID NO: 1479915 - RNA, 19 nt, Homo sapiens
gcagaaaccacaaaauuac

SEQ ID NO: 1479916 - RNA, 19 nt, Homo sapiens
uaccuugccugcugagaca

SEQ ID NO: 1479917 - RNA, 19 nt, Homo sapiens
uggaacugauggauuaaag

SEQ ID NO: 1479918 - RNA, 19 nt, Homo sapiens
cagccgcagaucccauuua

SEQ ID NO: 1479919 - RNA, 19 nt, Homo sapiens
gugacagauucaauucaau

SEQ ID NO: 1479920 - RNA, 19 nt, Homo sapiens
cuaaacacaacuaauccaa

SEQ ID NO: 1479921 - RNA, 19 nt, Homo sapiens
ggaacugauggauuaaagu

SEQ ID NO: 1479922 - RNA, 19 nt, Homo sapiens
cuacauggugacuccagua

SEQ ID NO: 1479923 - RNA, 19 nt, Homo sapiens
gagugugugugaugaugag

SEQ ID NO: 1479924 - RNA, 19 nt, Homo sapiens
uggcugcccugaccuagca

SEQ ID NO: 1479925 - RNA, 19 nt, Homo sapiens
aauucugccuucucuccua

SEQ ID NO: 1479926 - RNA, 19 nt, Homo sapiens
ugaggaaaggagaggcuaa

SEQ ID NO: 1479927 - RNA, 19 nt, Homo sapiens
cggcaaccacugcagauuc

SEQ ID NO: 1479928 - RNA, 19 nt, Homo sapiens
ugggugggcucugagaugu

SEQ ID NO: 1479929 - RNA, 19 nt, Homo sapiens
ccacugggcagaccugacu

SEQ ID NO: 1479930 - RNA, 19 nt, Homo sapiens
ggcaaccacugcagauucc

SEQ ID NO: 1479931 - RNA, 19 nt, Homo sapiens
gaagaacccugcaacaugu

SEQ ID NO: 1479932 - RNA, 19 nt, Homo sapiens
gaacuacgaucccauugug

SEQ ID NO: 1479933 - RNA, 19 nt, Homo sapiens
ggauggagguggccgcuua

SEQ ID NO: 1479934 - RNA, 19 nt, Homo sapiens
gcaaagaaguggagaacgu

SEQ ID NO: 1479935 - RNA, 19 nt, Homo sapiens
gaacuaagaaggucguguu

SEQ ID NO: 1479936 - RNA, 19 nt, Homo sapiens
ucaaggaccucgagaaugg

SEQ ID NO: 1479937 - RNA, 19 nt, Homo sapiens
ggacaagcccugccucuuc

SEQ ID NO: 1479938 - RNA, 19 nt, Homo sapiens
ugaaggagguugugcugaa

SEQ ID NO: 1479939 - RNA, 19 nt, Homo sapiens
ucaugaagauguuugagaa

SEQ ID NO: 1479940 - RNA, 19 nt, Homo sapiens
cuaagaaggucguguucaa

SEQ ID NO: 1479941 - RNA, 19 nt, Homo sapiens
cagcaagacuggcgacaug

SEQ ID NO: 1479942 - RNA, 19 nt, Homo sapiens
uggaggagcugaaguuugu

SEQ ID NO: 1479943 - RNA, 19 nt, Homo sapiens
ggcgacauguccuggcuua

SEQ ID NO: 1479944 - RNA, 19 nt, Homo sapiens
ccgcuuaccugacggagaa

SEQ ID NO: 1479945 - RNA, 19 nt, Homo sapiens
ugaagaacccugcaacaug

SEQ ID NO: 1479946 - RNA, 19 nt, Homo sapiens
aaagugaacauuccacauu

SEQ ID NO: 1479947 - RNA, 19 nt, Homo sapiens
ggaagguguugcuggugaa

SEQ ID NO: 1479948 - RNA, 19 nt, Homo sapiens
ggaacaaccgcaaagugaa

SEQ ID NO: 1479949 - RNA, 19 nt, Homo sapiens
guucaaggauggcuucaag

SEQ ID NO: 1479950 - RNA, 19 nt, Homo sapiens
guacagcaguagcaccaau

SEQ ID NO: 1479951 - RNA, 19 nt, Homo sapiens
ccaaggugauggccaagug

SEQ ID NO: 1479952 - RNA, 19 nt, Homo sapiens
ugaaguuuguggcuuucua

SEQ ID NO: 1479953 - RNA, 19 nt, Homo sapiens
gacaagcccugccucuucu

SEQ ID NO: 1479954 - RNA, 19 nt, Homo sapiens
gaaggagguugugcugaag

SEQ ID NO: 1479955 - RNA, 19 nt, Homo sapiens
ccaagacucugagcugcaa

SEQ ID NO: 1479956 - RNA, 19 nt, Homo sapiens
gagaaggcccacucugugu

SEQ ID NO: 1479957 - RNA, 19 nt, Homo sapiens
caguggagcucaagaucga

SEQ ID NO: 1479958 - RNA, 19 nt, Homo sapiens
gagcucacaugcaguagac

SEQ ID NO: 1479959 - RNA, 19 nt, Homo sapiens
gaacaaccgcaaagugaac

SEQ ID NO: 1479960 - RNA, 19 nt, Homo sapiens
ggucgugcccucaugaaga

SEQ ID NO: 1479961 - RNA, 19 nt, Homo sapiens
gagcugcaaaggcaaagaa

SEQ ID NO: 1479962 - RNA, 19 nt, Homo sapiens
gaggaacaaccgcaaagug

SEQ ID NO: 1479963 - RNA, 19 nt, Homo sapiens
caaugucccaggcguguuu

SEQ ID NO: 1479964 - RNA, 19 nt, Homo sapiens
aaguguaucucuccaagug

SEQ ID NO: 1479965 - RNA, 19 nt, Homo sapiens
ccaaaccaguggagcucaa

SEQ ID NO: 1479966 - RNA, 19 nt, Homo sapiens
aagugaacauuccacauug

SEQ ID NO: 1479967 - RNA, 19 nt, Homo sapiens
caguggacgugagaacuaa

SEQ ID NO: 1479968 - RNA, 19 nt, Homo sapiens
ccucuggaccgccauguuu

SEQ ID NO: 1479969 - RNA, 19 nt, Homo sapiens
acaagaugaugcagaccaa

SEQ ID NO: 1479970 - RNA, 19 nt, Homo sapiens
cuucaucccugucaacaag

SEQ ID NO: 1479971 - RNA, 19 nt, Homo sapiens
acaaccgggugaaguucua

SEQ ID NO: 1479972 - RNA, 19 nt, Homo sapiens
gagaacaaccgggugaagu

SEQ ID NO: 1479973 - RNA, 19 nt, Homo sapiens
gaaggucguguucaaggau

SEQ ID NO: 1479974 - RNA, 19 nt, Homo sapiens
aggaacaaccgcaaaguga

SEQ ID NO: 1479975 - RNA, 19 nt, Homo sapiens
agaacaaccgggugaaguu

SEQ ID NO: 1479976 - RNA, 19 nt, Homo sapiens
ccucgagaauggccagaug

SEQ ID NO: 1479977 - RNA, 19 nt, Homo sapiens
agaaggucguguucaagga

SEQ ID NO: 1479978 - RNA, 19 nt, Homo sapiens
uggacagucuacacaaguu

SEQ ID NO: 1479979 - RNA, 19 nt, Homo sapiens
caugaacuacgaucccauu

SEQ ID NO: 1479980 - RNA, 19 nt, Homo sapiens
gggugaaguucuacaugca

SEQ ID NO: 1479981 - RNA, 19 nt, Homo sapiens
aggugaagauugagaagga

SEQ ID NO: 1479982 - RNA, 19 nt, Homo sapiens
ggacagucuacacaaguuc

SEQ ID NO: 1479983 - RNA, 19 nt, Homo sapiens
ccugagcucacaugcagua

SEQ ID NO: 1479984 - RNA, 19 nt, Homo sapiens
cgucaaggaccucgagaau

SEQ ID NO: 1479985 - RNA, 19 nt, Homo sapiens
acaguggacgugagaacua

SEQ ID NO: 1479986 - RNA, 19 nt, Homo sapiens
gaagaugcucaacccucaa

SEQ ID NO: 1479987 - RNA, 19 nt, Homo sapiens
guuuguggcuuucuacacu

SEQ ID NO: 1479988 - RNA, 19 nt, Homo sapiens
gaaagcugaaggagguugu

SEQ ID NO: 1479989 - RNA, 19 nt, Homo sapiens
gucgugcccucaugaagau

SEQ ID NO: 1479990 - RNA, 19 nt, Homo sapiens
gagguggugcugccugaga

SEQ ID NO: 1479991 - RNA, 19 nt, Homo sapiens
cggagaaggcccacucugu

SEQ ID NO: 1479992 - RNA, 19 nt, Homo sapiens
uacacaaguuccaggugaa

SEQ ID NO: 1479993 - RNA, 19 nt, Homo sapiens
gcucacaugcaguagacuu

SEQ ID NO: 1479994 - RNA, 19 nt, Homo sapiens
gaaguuuguggcuuucuac

SEQ ID NO: 1479995 - RNA, 19 nt, Homo sapiens
ggcaaagcggcaucgguuu

SEQ ID NO: 1479996 - RNA, 19 nt, Homo sapiens
cugcaaaggcaaagaagug

SEQ ID NO: 1479997 - RNA, 19 nt, Homo sapiens
gucccaagcucagcaaguc

SEQ ID NO: 1479998 - RNA, 19 nt, Homo sapiens
gcaagacuggcgacauguc

SEQ ID NO: 1479999 - RNA, 19 nt, Homo sapiens
gaaggacaauggggaguuc

SEQ ID NO: 1480000 - RNA, 19 nt, Homo sapiens
caaagugaacauuccacau

SEQ ID NO: 1480001 - RNA, 19 nt, Homo sapiens
ggaggaacaaccgcaaagu

SEQ ID NO: 1480002 - RNA, 19 nt, Homo sapiens
gaaggcccacucugugucu

SEQ ID NO: 1480003 - RNA, 19 nt, Homo sapiens
caaguuccaggugaagauu

SEQ ID NO: 1480004 - RNA, 19 nt, Homo sapiens
uaaaggcgacgaggugauc

SEQ ID NO: 1480005 - RNA, 19 nt, Homo sapiens
gcugaaguuuguggcuuuc

SEQ ID NO: 1480006 - RNA, 19 nt, Homo sapiens
ggacgugagaacuaagaag

SEQ ID NO: 1480007 - RNA, 19 nt, Homo sapiens
gcgaaggaccaaggugaug

SEQ ID NO: 1480008 - RNA, 19 nt, Homo sapiens
agaacccugcaacauguua

SEQ ID NO: 1480009 - RNA, 19 nt, Homo sapiens
aggcggagaugagcacugu

SEQ ID NO: 1480010 - RNA, 19 nt, Homo sapiens
caaccgcaaagugaacauu

SEQ ID NO: 1480011 - RNA, 19 nt, Homo sapiens
ggccuggugugugcagaga

SEQ ID NO: 1480012 - RNA, 19 nt, Homo sapiens
aaaggauccugagcucaca

SEQ ID NO: 1480013 - RNA, 19 nt, Homo sapiens
ugaacuacgaucccauugu

SEQ ID NO: 1480014 - RNA, 19 nt, Homo sapiens
gaaaagacacagagaagga

SEQ ID NO: 1480015 - RNA, 19 nt, Homo sapiens
gaagaaaagacacagagaa

SEQ ID NO: 1480016 - RNA, 19 nt, Homo sapiens
gcaggccgacacucacuga

SEQ ID NO: 1480017 - RNA, 19 nt, Homo sapiens
gagaaguccuuguguggua

SEQ ID NO: 1480018 - RNA, 19 nt, Homo sapiens
gcaggaagcccuuuaguca

SEQ ID NO: 1480019 - RNA, 19 nt, Homo sapiens
gauaacauuucuucucguu

SEQ ID NO: 1480020 - RNA, 19 nt, Homo sapiens
uaacauuucuucucguuuc

SEQ ID NO: 1480021 - RNA, 19 nt, Homo sapiens
uaccuuugcuuguagauaa

SEQ ID NO: 1480022 - RNA, 19 nt, Homo sapiens
gagccagacuguuuuaaaa

SEQ ID NO: 1480023 - RNA, 19 nt, Homo sapiens
gcaggagacuggcuugaac

SEQ ID NO: 1480024 - RNA, 19 nt, Homo sapiens
gccagacuguuuuaaaaua

SEQ ID NO: 1480025 - RNA, 19 nt, Homo sapiens
gaacuccugucagucagau

SEQ ID NO: 1480026 - RNA, 19 nt, Homo sapiens
cacacacucucucugcuuu

SEQ ID NO: 1480027 - RNA, 19 nt, Homo sapiens
gaaaccccgucucuacuaa

SEQ ID NO: 1480028 - RNA, 19 nt, Homo sapiens
gaccuggcauuucuuugau

SEQ ID NO: 1480029 - RNA, 19 nt, Homo sapiens
gaugccuucucauugcuuu

SEQ ID NO: 1480030 - RNA, 19 nt, Homo sapiens
ccuggcauuucuuugauaa

SEQ ID NO: 1480031 - RNA, 19 nt, Homo sapiens
ggcuggauguaguggcuua

SEQ ID NO: 1480032 - RNA, 19 nt, Homo sapiens
gaagcccuuuagucacuug

SEQ ID NO: 1480033 - RNA, 19 nt, Homo sapiens
gccgugagcugagauugug

SEQ ID NO: 1480034 - RNA, 19 nt, Homo sapiens
gaaaucacaccacuguacu

SEQ ID NO: 1480035 - RNA, 19 nt, Homo sapiens
cgaaaucacaccacuguac

SEQ ID NO: 1480036 - RNA, 19 nt, Homo sapiens
gaggcaggcagaucacuug

SEQ ID NO: 1480037 - RNA, 19 nt, Homo sapiens
agucagauguugggccuuu

SEQ ID NO: 1480038 - RNA, 19 nt, Homo sapiens
ucaguuaacccucagaaag

SEQ ID NO: 1480039 - RNA, 19 nt, Homo sapiens
ccucugaugccuucucauu

SEQ ID NO: 1480040 - RNA, 19 nt, Homo sapiens
uuggauagauucugugagu

SEQ ID NO: 1480041 - RNA, 19 nt, Homo sapiens
agaccuggcauuucuuuga

SEQ ID NO: 1480042 - RNA, 19 nt, Homo sapiens
cuugagaccuggcauuucu

SEQ ID NO: 1480043 - RNA, 19 nt, Homo sapiens
gccgaaggccacgcuguua

SEQ ID NO: 1480044 - RNA, 19 nt, Homo sapiens
gcaccuguaaucccagcua

SEQ ID NO: 1480045 - RNA, 19 nt, Homo sapiens
ccucacaccugcuggacau

SEQ ID NO: 1480046 - RNA, 19 nt, Homo sapiens
gcccguguccuccuucuug

SEQ ID NO: 1480047 - RNA, 19 nt, Homo sapiens
cgacucaggcgucuaugau

SEQ ID NO: 1480048 - RNA, 19 nt, Homo sapiens
gcagccuguccuacaauaa

SEQ ID NO: 1480049 - RNA, 19 nt, Homo sapiens
cgcagccuguccuacaaua

SEQ ID NO: 1480050 - RNA, 19 nt, Homo sapiens
uggcauuucuuugauaaca

SEQ ID NO: 1480051 - RNA, 19 nt, Homo sapiens
gcucggagaaguccuugug

SEQ ID NO: 1480052 - RNA, 19 nt, Homo sapiens
gcacugcccaaccacaauc

SEQ ID NO: 1480053 - RNA, 19 nt, Homo sapiens
ggaagcccuuuagucacuu

SEQ ID NO: 1480054 - RNA, 19 nt, Homo sapiens
ugcuacagcucuacagaug

SEQ ID NO: 1480055 - RNA, 19 nt, Homo sapiens
gccgaaaucacaccacugu

SEQ ID NO: 1480056 - RNA, 19 nt, Homo sapiens
cuacagcucuacagaugac

SEQ ID NO: 1480057 - RNA, 19 nt, Homo sapiens
caguuggcguggccggaua

SEQ ID NO: 1480058 - RNA, 19 nt, Homo sapiens
ugagaccuggcauuucuuu

SEQ ID NO: 1480059 - RNA, 19 nt, Homo sapiens
guccuucuuucuaccuuug

SEQ ID NO: 1480060 - RNA, 19 nt, Homo sapiens
cagccuguccuacaauaau

SEQ ID NO: 1480061 - RNA, 19 nt, Homo sapiens
aaagcuggcucggagaagu

SEQ ID NO: 1480062 - RNA, 19 nt, Homo sapiens
ugaggcaggaagcccuuua

SEQ ID NO: 1480063 - RNA, 19 nt, Homo sapiens
gagggcuucugagguccua

SEQ ID NO: 1480064 - RNA, 19 nt, Homo sapiens
ucugaugccuucucauugc

SEQ ID NO: 1480065 - RNA, 19 nt, Homo sapiens
aggaagcccuuuagucacu

SEQ ID NO: 1480066 - RNA, 19 nt, Homo sapiens
gccuggacuucccugacua

SEQ ID NO: 1480067 - RNA, 19 nt, Homo sapiens
gcgacucaggcgucuauga

SEQ ID NO: 1480068 - RNA, 19 nt, Homo sapiens
ggcaggagacuggcuugaa

SEQ ID NO: 1480069 - RNA, 19 nt, Homo sapiens
ccaaacacacacacucucu

SEQ ID NO: 1480070 - RNA, 19 nt, Homo sapiens
ugugaguccuucuuucuac

SEQ ID NO: 1480071 - RNA, 19 nt, Homo sapiens
ggaacuccugucagucaga

SEQ ID NO: 1480072 - RNA, 19 nt, Homo sapiens
gcuacagcucuacagauga

SEQ ID NO: 1480073 - RNA, 19 nt, Homo sapiens
ucacuugaggucaggaguu

SEQ ID NO: 1480074 - RNA, 19 nt, Homo sapiens
cuuucuaccuuugcuugua

SEQ ID NO: 1480075 - RNA, 19 nt, Homo sapiens
agaaagcuggcucggagaa

SEQ ID NO: 1480076 - RNA, 19 nt, Homo sapiens
gagguccuacgcugugcua

SEQ ID NO: 1480077 - RNA, 19 nt, Homo sapiens
aaacacacacacucucucu

SEQ ID NO: 1480078 - RNA, 19 nt, Homo sapiens
gccuugagaccuggcauuu

SEQ ID NO: 1480079 - RNA, 19 nt, Homo sapiens
ggcaggaagcccuuuaguc

SEQ ID NO: 1480080 - RNA, 19 nt, Homo sapiens
cacuugaggucaggaguuc

SEQ ID NO: 1480081 - RNA, 19 nt, Homo sapiens
ggcauuucuuugauaacau

SEQ ID NO: 1480082 - RNA, 19 nt, Homo sapiens
agaaguccuugugugguau

SEQ ID NO: 1480083 - RNA, 19 nt, Homo sapiens
ugucaaagcuaaacagaaa

SEQ ID NO: 1480084 - RNA, 19 nt, Homo sapiens
ugacaaagaugagauacuu

SEQ ID NO: 1480085 - RNA, 19 nt, Homo sapiens
ggacaggcaauuccucaua

SEQ ID NO: 1480086 - RNA, 19 nt, Homo sapiens
gaaaggacagauuaugaaa

SEQ ID NO: 1480087 - RNA, 19 nt, Homo sapiens
ugaacaagaugacuuugaa

SEQ ID NO: 1480088 - RNA, 19 nt, Homo sapiens
gcaauuccucauagaaaua

SEQ ID NO: 1480089 - RNA, 19 nt, Homo sapiens
gaagaagccaaggaaauuu

SEQ ID NO: 1480090 - RNA, 19 nt, Homo sapiens
cgagacuacuucagccuua

SEQ ID NO: 1480091 - RNA, 19 nt, Homo sapiens
gcagaggacuguaccuucu

SEQ ID NO: 1480092 - RNA, 19 nt, Homo sapiens
caagaugacuuugaagaag

SEQ ID NO: 1480093 - RNA, 19 nt, Homo sapiens
aaggacagauuaugaaaug

SEQ ID NO: 1480094 - RNA, 19 nt, Homo sapiens
cagaaagaauuuacugaca

SEQ ID NO: 1480095 - RNA, 19 nt, Homo sapiens
aagugaagcugccaugaaa

SEQ ID NO: 1480096 - RNA, 19 nt, Homo sapiens
ugaagaagccaaggaaauu

SEQ ID NO: 1480097 - RNA, 19 nt, Homo sapiens
cgcagaagcugaaagugaa

SEQ ID NO: 1480098 - RNA, 19 nt, Homo sapiens
ggcaauuccucauagaaau

SEQ ID NO: 1480099 - RNA, 19 nt, Homo sapiens
ggacagauuaugaaaugga

SEQ ID NO: 1480100 - RNA, 19 nt, Homo sapiens
ugaaaggacagauuaugaa

SEQ ID NO: 1480101 - RNA, 19 nt, Homo sapiens
gaagauuccccuuuaauug

SEQ ID NO: 1480102 - RNA, 19 nt, Homo sapiens
gacaggcaauuccucauag

SEQ ID NO: 1480103 - RNA, 19 nt, Homo sapiens
gaaagugaagcugccauga

SEQ ID NO: 1480104 - RNA, 19 nt, Homo sapiens
gaagcugccaugaaagaga

SEQ ID NO: 1480105 - RNA, 19 nt, Homo sapiens
agaauuuacugacaaugug

SEQ ID NO: 1480106 - RNA, 19 nt, Homo sapiens
gaauuuacugacaauguga

SEQ ID NO: 1480107 - RNA, 19 nt, Homo sapiens
agaggacuguaccuucuaa

SEQ ID NO: 1480108 - RNA, 19 nt, Homo sapiens
ggugaaugaugccuauaag

SEQ ID NO: 1480109 - RNA, 19 nt, Homo sapiens
gugaagcugccaugaaaga

SEQ ID NO: 1480110 - RNA, 19 nt, Homo sapiens
ucgcagaagcugaaaguga

SEQ ID NO: 1480111 - RNA, 19 nt, Homo sapiens
gacuguaccuucuaaagcu

SEQ ID NO: 1480112 - RNA, 19 nt, Homo sapiens
acaagaugacuuugaagaa

SEQ ID NO: 1480113 - RNA, 19 nt, Homo sapiens
gaacaagaugacuuugaag

SEQ ID NO: 1480114 - RNA, 19 nt, Homo sapiens
aaagugaagcugccaugaa

SEQ ID NO: 1480115 - RNA, 19 nt, Homo sapiens
gagacuacuucagccuuau

SEQ ID NO: 1480116 - RNA, 19 nt, Homo sapiens
ccucauagaaauaauggaa

SEQ ID NO: 1480117 - RNA, 19 nt, Homo sapiens
gaaauggacaggcaauucc

SEQ ID NO: 1480118 - RNA, 19 nt, Homo sapiens
gagcagaggacuguaccuu

SEQ ID NO: 1480119 - RNA, 19 nt, Homo sapiens
ucaaagcuaaacagaaaga

SEQ ID NO: 1480120 - RNA, 19 nt, Homo sapiens
cugaaaggacagauuauga

SEQ ID NO: 1480121 - RNA, 19 nt, Homo sapiens
ucuaaagcuccauggaaua

SEQ ID NO: 1480122 - RNA, 19 nt, Homo sapiens
ggacuguaccuucuaaagc

SEQ ID NO: 1480123 - RNA, 19 nt, Homo sapiens
caaccguuccuucagaguu

SEQ ID NO: 1480124 - RNA, 19 nt, Homo sapiens
gcaauuauccccgcuguug

SEQ ID NO: 1480125 - RNA, 19 nt, Homo sapiens
gcacagguaccagcaacug

SEQ ID NO: 1480126 - RNA, 19 nt, Homo sapiens
cugcaaccguuccuucaga

SEQ ID NO: 1480127 - RNA, 19 nt, Homo sapiens
ugaaauggacaggcaauuc

SEQ ID NO: 1480128 - RNA, 19 nt, Homo sapiens
acaggcaauuccucauaga

SEQ ID NO: 1480129 - RNA, 19 nt, Homo sapiens
ugaaugaugccuauaagac

SEQ ID NO: 1480130 - RNA, 19 nt, Homo sapiens
aaccguuccuucagaguug

SEQ ID NO: 1480131 - RNA, 19 nt, Homo sapiens
gcagugcuuuugaacaaga

SEQ ID NO: 1480132 - RNA, 19 nt, Homo sapiens
aauccauugucaaagcuaa

SEQ ID NO: 1480133 - RNA, 19 nt, Homo sapiens
cuaaagcuccauggaauag

SEQ ID NO: 1480134 - RNA, 19 nt, Homo sapiens
gugaaugaugccuauaaga

SEQ ID NO: 1480135 - RNA, 19 nt, Homo sapiens
ccuggugaaugaugccuau

SEQ ID NO: 1480136 - RNA, 19 nt, Homo sapiens
aagcugccaugaaagagau

SEQ ID NO: 1480137 - RNA, 19 nt, Homo sapiens
aggcaauuccucauagaaa

SEQ ID NO: 1480138 - RNA, 19 nt, Homo sapiens
aaagcuccauggaauagag

SEQ ID NO: 1480139 - RNA, 19 nt, Homo sapiens
uucuaaagcuccauggaau

SEQ ID NO: 1480140 - RNA, 19 nt, Homo sapiens
cagcaacugcagcgucuug

SEQ ID NO: 1480141 - RNA, 19 nt, Homo sapiens
gaauccauugucaaagcua

SEQ ID NO: 1480142 - RNA, 19 nt, Homo sapiens
cgacagggguucccagaag

SEQ ID NO: 1480143 - RNA, 19 nt, Homo sapiens
aacaagaugacuuugaaga

SEQ ID NO: 1480144 - RNA, 19 nt, Homo sapiens
gcaggcgggaagcaauuau

SEQ ID NO: 1480145 - RNA, 19 nt, Homo sapiens
cgucuuguccacccagauu

SEQ ID NO: 1480146 - RNA, 19 nt, Homo sapiens
cagaggacuguaccuucua

SEQ ID NO: 1480147 - RNA, 19 nt, Homo sapiens
cuucuaaagcuccauggaa

SEQ ID NO: 1480148 - RNA, 19 nt, Homo sapiens
cgaagcuccagcacaggua

SEQ ID NO: 1480149 - RNA, 19 nt, Homo sapiens
agaaggagaccgcuaagcu

SEQ ID NO: 1480150 - RNA, 19 nt, Homo sapiens
uugaagaagccaaggaaau

SEQ ID NO: 1480151 - RNA, 19 nt, Homo sapiens
cccagaaggagaccgcuaa

SEQ ID NO: 1480152 - RNA, 19 nt, Homo sapiens
uggugaaugaugccuauaa

SEQ ID NO: 1480153 - RNA, 19 nt, Homo sapiens
caggcaauuccucauagaa

SEQ ID NO: 1480154 - RNA, 19 nt, Homo sapiens
aauagagauuccugaaagg

SEQ ID NO: 1480155 - RNA, 19 nt, Homo sapiens
caacagggaugucucuuua

SEQ ID NO: 1480156 - RNA, 19 nt, Homo sapiens
caaguuaccugacaugaua

SEQ ID NO: 1480157 - RNA, 19 nt, Homo sapiens
ccaaagccauccucuaaua

SEQ ID NO: 1480158 - RNA, 19 nt, Homo sapiens
aaacagagcuuauuucagu

SEQ ID NO: 1480159 - RNA, 19 nt, Homo sapiens
caauauagcucuguugauu

SEQ ID NO: 1480160 - RNA, 19 nt, Homo sapiens
uauagaagcuguaugugua

SEQ ID NO: 1480161 - RNA, 19 nt, Homo sapiens
ggagaagcauccuuuaguu

SEQ ID NO: 1480162 - RNA, 19 nt, Homo sapiens
ugagacggguguaauaaua

SEQ ID NO: 1480163 - RNA, 19 nt, Homo sapiens
ggaugucucuuuauaauag

SEQ ID NO: 1480164 - RNA, 19 nt, Homo sapiens
ccuaaugacuggauucuuu

SEQ ID NO: 1480165 - RNA, 19 nt, Homo sapiens
gcuaaugugugaagagaaa

SEQ ID NO: 1480166 - RNA, 19 nt, Homo sapiens
gaagcugacagaaauguua

SEQ ID NO: 1480167 - RNA, 19 nt, Homo sapiens
cagcauggaucaaacauug

SEQ ID NO: 1480168 - RNA, 19 nt, Homo sapiens
cuaaaggucuuaugaugaa

SEQ ID NO: 1480169 - RNA, 19 nt, Homo sapiens
gaaaguccaguucucauaa

SEQ ID NO: 1480170 - RNA, 19 nt, Homo sapiens
ggaguaaaucccaguguua

SEQ ID NO: 1480171 - RNA, 19 nt, Homo sapiens
gaugaugauuguccaguaa

SEQ ID NO: 1480172 - RNA, 19 nt, Homo sapiens
ggaagaugcuguuaauuuu

SEQ ID NO: 1480173 - RNA, 19 nt, Homo sapiens
ucagcacguucauuuauua

SEQ ID NO: 1480174 - RNA, 19 nt, Homo sapiens
acacaaggcucugauacua

SEQ ID NO: 1480175 - RNA, 19 nt, Homo sapiens
ggaagugcuuuaucagcua

SEQ ID NO: 1480176 - RNA, 19 nt, Homo sapiens
caggugacauugagguuua

SEQ ID NO: 1480177 - RNA, 19 nt, Homo sapiens
uuacaguggugacuauaua

SEQ ID NO: 1480178 - RNA, 19 nt, Homo sapiens
acacuaaaguugucaaaug

SEQ ID NO: 1480179 - RNA, 19 nt, Homo sapiens
ggaggaggaugaugauugu

SEQ ID NO: 1480180 - RNA, 19 nt, Homo sapiens
acagggaugucucuuuaua

SEQ ID NO: 1480181 - RNA, 19 nt, Homo sapiens
gagccaagcuaagcaugua

SEQ ID NO: 1480182 - RNA, 19 nt, Homo sapiens
gacuaaaggucuuaugaug

SEQ ID NO: 1480183 - RNA, 19 nt, Homo sapiens
gaagugcuuuaucagcuaa

SEQ ID NO: 1480184 - RNA, 19 nt, Homo sapiens
ugaugaagaugaagaaguu

SEQ ID NO: 1480185 - RNA, 19 nt, Homo sapiens
gagcuuuaaugaacaaaug

SEQ ID NO: 1480186 - RNA, 19 nt, Homo sapiens
gacuuuaucuucuugcaaa

SEQ ID NO: 1480187 - RNA, 19 nt, Homo sapiens
ucacaagucuguuaauugg

SEQ ID NO: 1480188 - RNA, 19 nt, Homo sapiens
ggaugaugauuguccagua

SEQ ID NO: 1480189 - RNA, 19 nt, Homo sapiens
ugacaagaaugguucaguu

SEQ ID NO: 1480190 - RNA, 19 nt, Homo sapiens
ccaaguagcugggauuaca

SEQ ID NO: 1480191 - RNA, 19 nt, Homo sapiens
agaauccuguguucaguua

SEQ ID NO: 1480192 - RNA, 19 nt, Homo sapiens
gagguagaguuaguguuua

SEQ ID NO: 1480193 - RNA, 19 nt, Homo sapiens
gaaaugugcaaguguuuga

SEQ ID NO: 1480194 - RNA, 19 nt, Homo sapiens
uuaaggaagugcuuuauca

SEQ ID NO: 1480195 - RNA, 19 nt, Homo sapiens
aagggugacuuaaaucaua

SEQ ID NO: 1480196 - RNA, 19 nt, Homo sapiens
uuccauaccugggauauua

SEQ ID NO: 1480197 - RNA, 19 nt, Homo sapiens
aaacgaguguaaugguaua

SEQ ID NO: 1480198 - RNA, 19 nt, Homo sapiens
acauugagguuuacugaaa

SEQ ID NO: 1480199 - RNA, 19 nt, Homo sapiens
gcacgcagccagcaaguug

SEQ ID NO: 1480200 - RNA, 19 nt, Homo sapiens
gagagcagcaguagcuuaa

SEQ ID NO: 1480201 - RNA, 19 nt, Homo sapiens
cgagaugaauguaaacugu

SEQ ID NO: 1480202 - RNA, 19 nt, Homo sapiens
gguaacccaucugcaauuu

SEQ ID NO: 1480203 - RNA, 19 nt, Homo sapiens
gaagagagcagcaguagcu

SEQ ID NO: 1480204 - RNA, 19 nt, Homo sapiens
ugacagaaauguuaaccau

SEQ ID NO: 1480205 - RNA, 19 nt, Homo sapiens
uggaagaugcuguuaauuu

SEQ ID NO: 1480206 - RNA, 19 nt, Homo sapiens
guaggaaucagauaccuuu

SEQ ID NO: 1480207 - RNA, 19 nt, Homo sapiens
guccaguucucauaaauau

SEQ ID NO: 1480208 - RNA, 19 nt, Homo sapiens
gauaaacuucugccuugua

SEQ ID NO: 1480209 - RNA, 19 nt, Homo sapiens
uauuguggcucuccucuuu

SEQ ID NO: 1480210 - RNA, 19 nt, Homo sapiens
gaagaauccuguguucagu

SEQ ID NO: 1480211 - RNA, 19 nt, Homo sapiens
gagggaauuugaugagguu

SEQ ID NO: 1480212 - RNA, 19 nt, Homo sapiens
gaagucacaagucuguuaa

SEQ ID NO: 1480213 - RNA, 19 nt, Homo sapiens
ucagauaccuuuuguagaa

SEQ ID NO: 1480214 - RNA, 19 nt, Homo sapiens
uuaaacgaguguaauggua

SEQ ID NO: 1480215 - RNA, 19 nt, Homo sapiens
gaguauccucuauaaguua

SEQ ID NO: 1480216 - RNA, 19 nt, Homo sapiens
ccugggauauuagauguua

SEQ ID NO: 1480217 - RNA, 19 nt, Homo sapiens
gcucugauacuacugguaa

SEQ ID NO: 1480218 - RNA, 19 nt, Homo sapiens
ucagacacuuggagaauau

SEQ ID NO: 1480219 - RNA, 19 nt, Homo sapiens
caggugagcuuuaaugaac

SEQ ID NO: 1480220 - RNA, 19 nt, Homo sapiens
gagaggaggaggaggauga

SEQ ID NO: 1480221 - RNA, 19 nt, Homo sapiens
agaaaacagugaaggauua

SEQ ID NO: 1480222 - RNA, 19 nt, Homo sapiens
uaauugauaagcccaguua

SEQ ID NO: 1480223 - RNA, 19 nt, Homo sapiens
ccaguucucauaaauauug

SEQ ID NO: 1480224 - RNA, 19 nt, Homo sapiens
gagcuuauuucaguaguca

SEQ ID NO: 1480225 - RNA, 19 nt, Homo sapiens
uauaugagcaggugacauu

SEQ ID NO: 1480226 - RNA, 19 nt, Homo sapiens
aaaugagaaucugguguua

SEQ ID NO: 1480227 - RNA, 19 nt, Homo sapiens
gggcaggucuccgacuaaa

SEQ ID NO: 1480228 - RNA, 19 nt, Homo sapiens
cacauugucuaaacuauuc

SEQ ID NO: 1480229 - RNA, 19 nt, Homo sapiens
caggauaauugaugaagau

SEQ ID NO: 1480230 - RNA, 19 nt, Homo sapiens
ggagauugaggacaggaua

SEQ ID NO: 1480231 - RNA, 19 nt, Homo sapiens
gaagaaauggaucagacaa

SEQ ID NO: 1480232 - RNA, 19 nt, Homo sapiens
cuaggaauguucuggaaga

SEQ ID NO: 1480233 - RNA, 19 nt, Homo sapiens
gaucaaacauuggcuuacu

SEQ ID NO: 1480234 - RNA, 19 nt, Homo sapiens
gagacucuuugcauaguau

SEQ ID NO: 1480235 - RNA, 19 nt, Homo sapiens
uuacugugcuaauguguga

SEQ ID NO: 1480236 - RNA, 19 nt, Homo sapiens
ccaaacagagcuuauuuca

SEQ ID NO: 1480237 - RNA, 19 nt, Homo sapiens
gccuucaucuucuugagua

SEQ ID NO: 1480238 - RNA, 19 nt, Homo sapiens
caauuugacuggugcuuag

SEQ ID NO: 1480239 - RNA, 19 nt, Homo sapiens
gcgcggacguguuucuguu

SEQ ID NO: 1480240 - RNA, 19 nt, Homo sapiens
ccugaacuccuuucugaua

SEQ ID NO: 1480241 - RNA, 19 nt, Homo sapiens
ucccugaacuccuuucuga

SEQ ID NO: 1480242 - RNA, 19 nt, Homo sapiens
acagaaauguuaaccaucu

SEQ ID NO: 1480243 - RNA, 19 nt, Homo sapiens
gaaagaaaaggauaacuga

SEQ ID NO: 1480244 - RNA, 19 nt, Homo sapiens
gcuggaaccauaagaagaa

SEQ ID NO: 1480245 - RNA, 19 nt, Homo sapiens
aaaguccaguucucauaaa

SEQ ID NO: 1480246 - RNA, 19 nt, Homo sapiens
gagaugacagcuuuccaaa

SEQ ID NO: 1480247 - RNA, 19 nt, Homo sapiens
ggagaugacagcuuuccaa

SEQ ID NO: 1480248 - RNA, 19 nt, Homo sapiens
gagaugaauguaaacugua

SEQ ID NO: 1480249 - RNA, 19 nt, Homo sapiens
cgaguguaaugguauaaug

SEQ ID NO: 1480250 - RNA, 19 nt, Homo sapiens
gaggauagccagguuugaa

SEQ ID NO: 1480251 - RNA, 19 nt, Homo sapiens
gaagcauccuuuaguucau

SEQ ID NO: 1480252 - RNA, 19 nt, Homo sapiens
gcccaguuauucaguaaug

SEQ ID NO: 1480253 - RNA, 19 nt, Homo sapiens
cacuaaaguugucaaaugu

SEQ ID NO: 1480254 - RNA, 19 nt, Homo sapiens
ccucuaauacuaagaacua

SEQ ID NO: 1480255 - RNA, 19 nt, Homo sapiens
gcuauuaguucccuccuua

SEQ ID NO: 1480256 - RNA, 19 nt, Homo sapiens
gaaaagagauaccuacgua

SEQ ID NO: 1480257 - RNA, 19 nt, Homo sapiens
gaacagcacuacugagauc

SEQ ID NO: 1480258 - RNA, 19 nt, Homo sapiens
gaaaguacauuccuguuac

SEQ ID NO: 1480259 - RNA, 19 nt, Homo sapiens
gagucuggcucucuucuua

SEQ ID NO: 1480260 - RNA, 19 nt, Homo sapiens
acacaaggcuucuaaggaa

SEQ ID NO: 1480261 - RNA, 19 nt, Homo sapiens
guacauuccuguuaccaaa

SEQ ID NO: 1480262 - RNA, 19 nt, Homo sapiens
ggauaggaccaauaaguua

SEQ ID NO: 1480263 - RNA, 19 nt, Homo sapiens
guugcuaagugcuaaauua

SEQ ID NO: 1480264 - RNA, 19 nt, Homo sapiens
ggauagacuuaauugauga

SEQ ID NO: 1480265 - RNA, 19 nt, Homo sapiens
cuaaauuacuggccaggua

SEQ ID NO: 1480266 - RNA, 19 nt, Homo sapiens
gaaaguggaacaaacaaug

SEQ ID NO: 1480267 - RNA, 19 nt, Homo sapiens
agacuacugugaaauguuu

SEQ ID NO: 1480268 - RNA, 19 nt, Homo sapiens
gguuggacuuguugaaaua

SEQ ID NO: 1480269 - RNA, 19 nt, Homo sapiens
caaaugaugcuauuaguuc

SEQ ID NO: 1480270 - RNA, 19 nt, Homo sapiens
ccacagaguugcauaggau

SEQ ID NO: 1480271 - RNA, 19 nt, Homo sapiens
cuaugaaacuccacuacua

SEQ ID NO: 1480272 - RNA, 19 nt, Homo sapiens
gaaagaaggagccacuaug

SEQ ID NO: 1480273 - RNA, 19 nt, Homo sapiens
gagaacagcacuacugaga

SEQ ID NO: 1480274 - RNA, 19 nt, Homo sapiens
ugaggcaccuuuuauauua

SEQ ID NO: 1480275 - RNA, 19 nt, Homo sapiens
gauaggaccaauaaguuaa

SEQ ID NO: 1480276 - RNA, 19 nt, Homo sapiens
gcaaugaccauauucaaag

SEQ ID NO: 1480277 - RNA, 19 nt, Homo sapiens
cuacugagaucgcccauca

SEQ ID NO: 1480278 - RNA, 19 nt, Homo sapiens
gaucugagaaggugacuga

SEQ ID NO: 1480279 - RNA, 19 nt, Homo sapiens
ggaagaauuuggauagacu

SEQ ID NO: 1480280 - RNA, 19 nt, Homo sapiens
gcaaaugaugcuauuaguu

SEQ ID NO: 1480281 - RNA, 19 nt, Homo sapiens
gcuaagugcuaaauuacug

SEQ ID NO: 1480282 - RNA, 19 nt, Homo sapiens
gaaggugacugagauguac

SEQ ID NO: 1480283 - RNA, 19 nt, Homo sapiens
uggcaguacugacacuuua

SEQ ID NO: 1480284 - RNA, 19 nt, Homo sapiens
agaaugcaaugaccauauu

SEQ ID NO: 1480285 - RNA, 19 nt, Homo sapiens
aaacuccacuacuauaaug

SEQ ID NO: 1480286 - RNA, 19 nt, Homo sapiens
aguaugagaugaacaauag

SEQ ID NO: 1480287 - RNA, 19 nt, Homo sapiens
gaaucccucucuagcugua

SEQ ID NO: 1480288 - RNA, 19 nt, Homo sapiens
ggaacaaacaaugaagaua

SEQ ID NO: 1480289 - RNA, 19 nt, Homo sapiens
caucccaaaucacuaauga

SEQ ID NO: 1480290 - RNA, 19 nt, Homo sapiens
gaaacuccacuacuauaau

SEQ ID NO: 1480291 - RNA, 19 nt, Homo sapiens
gaaggagccacuauggauu

SEQ ID NO: 1480292 - RNA, 19 nt, Homo sapiens
cuacuuccaucucauguau

SEQ ID NO: 1480293 - RNA, 19 nt, Homo sapiens
ccaaaucacuaaugagcau

SEQ ID NO: 1480294 - RNA, 19 nt, Homo sapiens
gaugaacaauagaugacuu

SEQ ID NO: 1480295 - RNA, 19 nt, Homo sapiens
gagcugagguuggacuugu

SEQ ID NO: 1480296 - RNA, 19 nt, Homo sapiens
ucacgagguugaucagcua

SEQ ID NO: 1480297 - RNA, 19 nt, Homo sapiens
caaugaccauauucaaaga

SEQ ID NO: 1480298 - RNA, 19 nt, Homo sapiens
gaagaaugcaaugaccaua

SEQ ID NO: 1480299 - RNA, 19 nt, Homo sapiens
uggauagacuuaauugaug

SEQ ID NO: 1480300 - RNA, 19 nt, Homo sapiens
ucaaaggaaagaaggauuu

SEQ ID NO: 1480301 - RNA, 19 nt, Homo sapiens
uaaacugucuuagcaggaa

SEQ ID NO: 1480302 - RNA, 19 nt, Homo sapiens
ccugauacauuccuacaau

SEQ ID NO: 1480303 - RNA, 19 nt, Homo sapiens
uggaugaccucaguuuaaa

SEQ ID NO: 1480304 - RNA, 19 nt, Homo sapiens
gagaacgccauuuggauga

SEQ ID NO: 1480305 - RNA, 19 nt, Homo sapiens
cgaguccacuuugccauaa

SEQ ID NO: 1480306 - RNA, 19 nt, Homo sapiens
cuacugauccguaaauugu

SEQ ID NO: 1480307 - RNA, 19 nt, Homo sapiens
gugugugacuuaugguuaa

SEQ ID NO: 1480308 - RNA, 19 nt, Homo sapiens
cauauuaucagauggauuc

SEQ ID NO: 1480309 - RNA, 19 nt, Homo sapiens
uggauagcauuacuucaaa

SEQ ID NO: 1480310 - RNA, 19 nt, Homo sapiens
ugaaacuccacuacuauaa

SEQ ID NO: 1480311 - RNA, 19 nt, Homo sapiens
uugagccacuuccuaauaa

SEQ ID NO: 1480312 - RNA, 19 nt, Homo sapiens
uagcagcaguacaagcuuu

SEQ ID NO: 1480313 - RNA, 19 nt, Homo sapiens
uaaauggauaggaccaaua

SEQ ID NO: 1480314 - RNA, 19 nt, Homo sapiens
cgagguugaucagcuaauu

SEQ ID NO: 1480315 - RNA, 19 nt, Homo sapiens
caauacacaaggcuucuaa

SEQ ID NO: 1480316 - RNA, 19 nt, Homo sapiens
uaaggaaagcgggucaaua

SEQ ID NO: 1480317 - RNA, 19 nt, Homo sapiens
aaacaugcauaaacugucu

SEQ ID NO: 1480318 - RNA, 19 nt, Homo sapiens
gaagaggaaggucagugaa

SEQ ID NO: 1480319 - RNA, 19 nt, Homo sapiens
aaauggauaggaccaauaa

SEQ ID NO: 1480320 - RNA, 19 nt, Homo sapiens
ggaacaugcugcaauucag

SEQ ID NO: 1480321 - RNA, 19 nt, Homo sapiens
caaauacacgaaagaagga

SEQ ID NO: 1480322 - RNA, 19 nt, Homo sapiens
cacggaacaugcugcaauu

SEQ ID NO: 1480323 - RNA, 19 nt, Homo sapiens
gaaauguuuugacuuguug

SEQ ID NO: 1480324 - RNA, 19 nt, Homo sapiens
ccgggucacugcauauuau

SEQ ID NO: 1480325 - RNA, 19 nt, Homo sapiens
gaugauuaguaugagauga

SEQ ID NO: 1480326 - RNA, 19 nt, Homo sapiens
gcgaguccacuuugccaua

SEQ ID NO: 1480327 - RNA, 19 nt, Homo sapiens
cuucaaagcuggguuagag

SEQ ID NO: 1480328 - RNA, 19 nt, Homo sapiens
ggaagaagaaugcaaugac

SEQ ID NO: 1480329 - RNA, 19 nt, Homo sapiens
gggagaacagcacuacuga

SEQ ID NO: 1480330 - RNA, 19 nt, Homo sapiens
ugauugauuuggagaacaa

SEQ ID NO: 1480331 - RNA, 19 nt, Homo sapiens
ugcauaaacugucuuagca

SEQ ID NO: 1480332 - RNA, 19 nt, Homo sapiens
cgaaagaaggagccacuau

SEQ ID NO: 1480333 - RNA, 19 nt, Homo sapiens
gagguuggacuuguugaaa

SEQ ID NO: 1480334 - RNA, 19 nt, Homo sapiens
ucuguaaccugcaaaugau

SEQ ID NO: 1480335 - RNA, 19 nt, Homo sapiens
aaagcuggguuagagauga

SEQ ID NO: 1480336 - RNA, 19 nt, Homo sapiens
aaggaaagcgggucaauag

SEQ ID NO: 1480337 - RNA, 19 nt, Homo sapiens
ccacuuugccauaaggaaa

SEQ ID NO: 1480338 - RNA, 19 nt, Homo sapiens
cacaaggcuucuaaggaaa

SEQ ID NO: 1480339 - RNA, 19 nt, Homo sapiens
agauguaccaguucaaauu

SEQ ID NO: 1480340 - RNA, 19 nt, Homo sapiens
ggugugauuuauguguuaa

SEQ ID NO: 1480341 - RNA, 19 nt, Homo sapiens
ggauagcauuacuucaaag

SEQ ID NO: 1480342 - RNA, 19 nt, Homo sapiens
gcagugaccccacaugauu

SEQ ID NO: 1480343 - RNA, 19 nt, Homo sapiens
agucauagcagcaguacaa

SEQ ID NO: 1480344 - RNA, 19 nt, Homo sapiens
gauguaccaguucaaauuc

SEQ ID NO: 1480345 - RNA, 19 nt, Homo sapiens
ugagaugaacaauagauga

SEQ ID NO: 1480346 - RNA, 19 nt, Homo sapiens
acuuccaucucauguauaa

SEQ ID NO: 1480347 - RNA, 19 nt, Homo sapiens
ucugagugcuccaggaaga

SEQ ID NO: 1480348 - RNA, 19 nt, Homo sapiens
acaaggagccuaucaacgu

SEQ ID NO: 1480349 - RNA, 19 nt, Homo sapiens
aaaguggaacaaacaauga

SEQ ID NO: 1480350 - RNA, 19 nt, Homo sapiens
ccauuuggaugaccucagu

SEQ ID NO: 1480351 - RNA, 19 nt, Homo sapiens
gcccuguucuguuauccaa

SEQ ID NO: 1480352 - RNA, 19 nt, Homo sapiens
uaaccuguauacuggaauc

SEQ ID NO: 1480353 - RNA, 19 nt, Homo sapiens
agacugugaugaggaagaa

SEQ ID NO: 1480354 - RNA, 19 nt, Homo sapiens
cugagaaggugacugagau

SEQ ID NO: 1480355 - RNA, 19 nt, Homo sapiens
gcacagcacuuuauuguua

SEQ ID NO: 1480356 - RNA, 19 nt, Homo sapiens
gaaugaaucugcuacaauu

SEQ ID NO: 1480357 - RNA, 19 nt, Homo sapiens
gauccaaacuugaacauuc

SEQ ID NO: 1480358 - RNA, 19 nt, Homo sapiens
gcacacacauccucauaau

SEQ ID NO: 1480359 - RNA, 19 nt, Homo sapiens
guacagaucuauuguugau

SEQ ID NO: 1480360 - RNA, 19 nt, Homo sapiens
ggacacagccuagcagaaa

SEQ ID NO: 1480361 - RNA, 19 nt, Homo sapiens
ggaaguccguuugaugauu

SEQ ID NO: 1480362 - RNA, 19 nt, Homo sapiens
gaaguccguuugaugauuc

SEQ ID NO: 1480363 - RNA, 19 nt, Homo sapiens
gcacauggcaggccuggaa

SEQ ID NO: 1480364 - RNA, 19 nt, Homo sapiens
gaaggaaguccguuugaug

SEQ ID NO: 1480365 - RNA, 19 nt, Homo sapiens
gcaaauggcagcucucauc

SEQ ID NO: 1480366 - RNA, 19 nt, Homo sapiens
caagaacacugugcacaug

SEQ ID NO: 1480367 - RNA, 19 nt, Homo sapiens
ucaacaauuucuuggcaua

SEQ ID NO: 1480368 - RNA, 19 nt, Homo sapiens
gagcaucaguguccucauc

SEQ ID NO: 1480369 - RNA, 19 nt, Homo sapiens
gcuuccaccuucacuauaa

SEQ ID NO: 1480370 - RNA, 19 nt, Homo sapiens
ucgccuaccucaugaagua

SEQ ID NO: 1480371 - RNA, 19 nt, Homo sapiens
gcauuccacuguguaaauu

SEQ ID NO: 1480372 - RNA, 19 nt, Homo sapiens
gaaagcauuccacugugua

SEQ ID NO: 1480373 - RNA, 19 nt, Homo sapiens
aaagaaagcauuccacugu

SEQ ID NO: 1480374 - RNA, 19 nt, Homo sapiens
caugaaugauagacucuuu

SEQ ID NO: 1480375 - RNA, 19 nt, Homo sapiens
ggaaugaaucugcuacaau

SEQ ID NO: 1480376 - RNA, 19 nt, Homo sapiens
caagugauccucuuaccuu

SEQ ID NO: 1480377 - RNA, 19 nt, Homo sapiens
aaugaucccugacaucuau

SEQ ID NO: 1480378 - RNA, 19 nt, Homo sapiens
gcugacugcugaccacuga

SEQ ID NO: 1480379 - RNA, 19 nt, Homo sapiens
gagaugagauuuuacuaug

SEQ ID NO: 1480380 - RNA, 19 nt, Homo sapiens
gugagauggugaagauaaa

SEQ ID NO: 1480381 - RNA, 19 nt, Homo sapiens
gccagagccuuaagcauca

SEQ ID NO: 1480382 - RNA, 19 nt, Homo sapiens
ugacaucuaugagaaggaa

SEQ ID NO: 1480383 - RNA, 19 nt, Homo sapiens
aaacuguccugcucuguca

SEQ ID NO: 1480384 - RNA, 19 nt, Homo sapiens
gagaaggaaguccguuuga

SEQ ID NO: 1480385 - RNA, 19 nt, Homo sapiens
agucagagguacagaucua

SEQ ID NO: 1480386 - RNA, 19 nt, Homo sapiens
caauuccaccucauucuuu

SEQ ID NO: 1480387 - RNA, 19 nt, Homo sapiens
gaaugaucccugacaucua

SEQ ID NO: 1480388 - RNA, 19 nt, Homo sapiens
ggaaugaucccugacaucu

SEQ ID NO: 1480389 - RNA, 19 nt, Homo sapiens
uauggaaaccaaagcguua

SEQ ID NO: 1480390 - RNA, 19 nt, Homo sapiens
uauuguacauggcaaaguu

SEQ ID NO: 1480391 - RNA, 19 nt, Homo sapiens
aauggcagcucucaucaug

SEQ ID NO: 1480392 - RNA, 19 nt, Homo sapiens
gccaggauuucucugaaga

SEQ ID NO: 1480393 - RNA, 19 nt, Homo sapiens
gcgacgagcccauugcuau

SEQ ID NO: 1480394 - RNA, 19 nt, Homo sapiens
gcaagaacacugugcacau

SEQ ID NO: 1480395 - RNA, 19 nt, Homo sapiens
gaagcagggccguacuuug

SEQ ID NO: 1480396 - RNA, 19 nt, Homo sapiens
ugacuucuuugacccuauu

SEQ ID NO: 1480397 - RNA, 19 nt, Homo sapiens
ggagagaguuuuccaugga

SEQ ID NO: 1480398 - RNA, 19 nt, Homo sapiens
gagauggugaagauaaauu

SEQ ID NO: 1480399 - RNA, 19 nt, Homo sapiens
acacacauccucauaaugg

SEQ ID NO: 1480400 - RNA, 19 nt, Homo sapiens
ggccaucccucaccaaacu

SEQ ID NO: 1480401 - RNA, 19 nt, Homo sapiens
ggagugcaguagugugauc

SEQ ID NO: 1480402 - RNA, 19 nt, Homo sapiens
aaacagaugaugccuuuua

SEQ ID NO: 1480403 - RNA, 19 nt, Homo sapiens
acuaugaguuccaauuguu

SEQ ID NO: 1480404 - RNA, 19 nt, Homo sapiens
ucacaggccuuggcuugga

SEQ ID NO: 1480405 - RNA, 19 nt, Homo sapiens
gauugaggcugcgggauca

SEQ ID NO: 1480406 - RNA, 19 nt, Homo sapiens
agaaagcauuccacugugu

SEQ ID NO: 1480407 - RNA, 19 nt, Homo sapiens
ccacuaugaguuccaauug

SEQ ID NO: 1480408 - RNA, 19 nt, Homo sapiens
ucaccauggucaucaaugu

SEQ ID NO: 1480409 - RNA, 19 nt, Homo sapiens
guagugaacaccuuguaug

SEQ ID NO: 1480410 - RNA, 19 nt, Homo sapiens
cggcacaggcuauuccuuu

SEQ ID NO: 1480411 - RNA, 19 nt, Homo sapiens
aaagagggcagcacccauu

SEQ ID NO: 1480412 - RNA, 19 nt, Homo sapiens
uaaauuuucugcccuguga

SEQ ID NO: 1480413 - RNA, 19 nt, Homo sapiens
gcagauggugcccagaaga

SEQ ID NO: 1480414 - RNA, 19 nt, Homo sapiens
uguaugaggauauccagua

SEQ ID NO: 1480415 - RNA, 19 nt, Homo sapiens
uggcauuucuccuuucugu

SEQ ID NO: 1480416 - RNA, 19 nt, Homo sapiens
aagugauccucuuaccuua

SEQ ID NO: 1480417 - RNA, 19 nt, Homo sapiens
gaucaugacgggucucucu

SEQ ID NO: 1480418 - RNA, 19 nt, Homo sapiens
guaccucuugcgcuucuua

SEQ ID NO: 1480419 - RNA, 19 nt, Homo sapiens
cagauugacccaggaauga

SEQ ID NO: 1480420 - RNA, 19 nt, Homo sapiens
agguacagaucuauuguug

SEQ ID NO: 1480421 - RNA, 19 nt, Homo sapiens
gggucucucucccgaagaa

SEQ ID NO: 1480422 - RNA, 19 nt, Homo sapiens
acaaaguacucuuccaaaa

SEQ ID NO: 1480423 - RNA, 19 nt, Homo sapiens
caaauggcagcucucauca

SEQ ID NO: 1480424 - RNA, 19 nt, Homo sapiens
acagaguuauugugaagau

SEQ ID NO: 1480425 - RNA, 19 nt, Homo sapiens
acccagagccagagccuua

SEQ ID NO: 1480426 - RNA, 19 nt, Homo sapiens
aaggaaguccguuugauga

SEQ ID NO: 1480427 - RNA, 19 nt, Homo sapiens
ggccuaacaucaggucuca

SEQ ID NO: 1480428 - RNA, 19 nt, Homo sapiens
guacauggcaaaguuucaa

SEQ ID NO: 1480429 - RNA, 19 nt, Homo sapiens
uacagugagugccaaucua

SEQ ID NO: 1480430 - RNA, 19 nt, Homo sapiens
ggagucagagguacagauc

SEQ ID NO: 1480431 - RNA, 19 nt, Homo sapiens
ucccugacaucuaugagaa

SEQ ID NO: 1480432 - RNA, 19 nt, Homo sapiens
aauugugagugcuauugua

SEQ ID NO: 1480433 - RNA, 19 nt, Homo sapiens
cuagauaaauggccuucag

SEQ ID NO: 1480434 - RNA, 19 nt, Homo sapiens
gcuacaauuccaccucauu

SEQ ID NO: 1480435 - RNA, 19 nt, Homo sapiens
ugugagauggugaagauaa

SEQ ID NO: 1480436 - RNA, 19 nt, Homo sapiens
guaugaggauauccaguac

SEQ ID NO: 1480437 - RNA, 19 nt, Homo sapiens
gaacaccuuguaugaggau

SEQ ID NO: 1480438 - RNA, 19 nt, Homo sapiens
ucaaacuccuggccucaag

SEQ ID NO: 1480439 - RNA, 19 nt, Homo sapiens
ggcacaggcuauuccuuuc

SEQ ID NO: 1480440 - RNA, 19 nt, Homo sapiens
cagagguacagaucuauug

SEQ ID NO: 1480441 - RNA, 19 nt, Homo sapiens
ggcaaaagaugguguuagu

SEQ ID NO: 1480442 - RNA, 19 nt, Homo sapiens
gcuguagcuuuuaacuuua

SEQ ID NO: 1480443 - RNA, 19 nt, Homo sapiens
uagugaacaccuuguauga

SEQ ID NO: 1480444 - RNA, 19 nt, Homo sapiens
uuacaaaguacucuuccaa

SEQ ID NO: 1480445 - RNA, 19 nt, Homo sapiens
cggcacacacauccucaua

SEQ ID NO: 1480446 - RNA, 19 nt, Homo sapiens
agacgcagccuucgugcuu

SEQ ID NO: 1480447 - RNA, 19 nt, Homo sapiens
cagauggugcccagaagaa

SEQ ID NO: 1480448 - RNA, 19 nt, Homo sapiens
agaaggaaguccguuugau

SEQ ID NO: 1480449 - RNA, 19 nt, Homo sapiens
ggcacacacauccucauaa

SEQ ID NO: 1480450 - RNA, 19 nt, Homo sapiens
ugacagcccuuuucucaca

SEQ ID NO: 1480451 - RNA, 19 nt, Homo sapiens
gagguacagaucuauuguu

SEQ ID NO: 1480452 - RNA, 19 nt, Homo sapiens
ugagaaggaaguccguuug

SEQ ID NO: 1480453 - RNA, 19 nt, Homo sapiens
acacguggaccaagucaug

SEQ ID NO: 1480454 - RNA, 19 nt, Homo sapiens
gguagugaacaccuuguau

SEQ ID NO: 1480455 - RNA, 19 nt, Homo sapiens
gaaggaaggugcuggauuu

SEQ ID NO: 1480456 - RNA, 19 nt, Homo sapiens
agaaagaacuugaguagua

SEQ ID NO: 1480457 - RNA, 19 nt, Homo sapiens
gaacuugaguaguagauga

SEQ ID NO: 1480458 - RNA, 19 nt, Homo sapiens
gaaccagacucuuccaaug

SEQ ID NO: 1480459 - RNA, 19 nt, Homo sapiens
gcacuggacucgccguuau

SEQ ID NO: 1480460 - RNA, 19 nt, Homo sapiens
gaaagaacuugaguaguag

SEQ ID NO: 1480461 - RNA, 19 nt, Homo sapiens
ggaauaacuugaagacagu

SEQ ID NO: 1480462 - RNA, 19 nt, Homo sapiens
agaaaucccuccuucagaa

SEQ ID NO: 1480463 - RNA, 19 nt, Homo sapiens
caagaacuccagucuguuu

SEQ ID NO: 1480464 - RNA, 19 nt, Homo sapiens
ggaaucaccagcucaagaa

SEQ ID NO: 1480465 - RNA, 19 nt, Homo sapiens
ccacauuguuccuccugua

SEQ ID NO: 1480466 - RNA, 19 nt, Homo sapiens
ggacagucuuccagcagaa

SEQ ID NO: 1480467 - RNA, 19 nt, Homo sapiens
guuuaaagccacagugaua

SEQ ID NO: 1480468 - RNA, 19 nt, Homo sapiens
ccaguagaacuuuauagua

SEQ ID NO: 1480469 - RNA, 19 nt, Homo sapiens
uagaugaggugguuagaca

SEQ ID NO: 1480470 - RNA, 19 nt, Homo sapiens
ccacagugauacaaagaau

SEQ ID NO: 1480471 - RNA, 19 nt, Homo sapiens
gccagggucucucagugua

SEQ ID NO: 1480472 - RNA, 19 nt, Homo sapiens
gauuacaugugugugaauu

SEQ ID NO: 1480473 - RNA, 19 nt, Homo sapiens
gaggugaugaggaggaaua

SEQ ID NO: 1480474 - RNA, 19 nt, Homo sapiens
gggcacauguagaaguuga

SEQ ID NO: 1480475 - RNA, 19 nt, Homo sapiens
gaaaucccuccuucagaaa

SEQ ID NO: 1480476 - RNA, 19 nt, Homo sapiens
gccaaaggguggaaguaga

SEQ ID NO: 1480477 - RNA, 19 nt, Homo sapiens
ugaaauggcuccggcuuag

SEQ ID NO: 1480478 - RNA, 19 nt, Homo sapiens
uguagaaguugaagcuaaa

SEQ ID NO: 1480479 - RNA, 19 nt, Homo sapiens
gggaaggcauggugugcuu

SEQ ID NO: 1480480 - RNA, 19 nt, Homo sapiens
gaaguuaagggacacagau

SEQ ID NO: 1480481 - RNA, 19 nt, Homo sapiens
aaacugaaccagacucuuc

SEQ ID NO: 1480482 - RNA, 19 nt, Homo sapiens
caaacaggccucuccuaga

SEQ ID NO: 1480483 - RNA, 19 nt, Homo sapiens
ucaggagucucaccaguag

SEQ ID NO: 1480484 - RNA, 19 nt, Homo sapiens
guacaaagucacaguccuu

SEQ ID NO: 1480485 - RNA, 19 nt, Homo sapiens
aaagugggcacauguagaa

SEQ ID NO: 1480486 - RNA, 19 nt, Homo sapiens
ggaaacaggcuucauucag

SEQ ID NO: 1480487 - RNA, 19 nt, Homo sapiens
ggucaccugucccuugaug

SEQ ID NO: 1480488 - RNA, 19 nt, Homo sapiens
ccaaaggguggaaguagaa

SEQ ID NO: 1480489 - RNA, 19 nt, Homo sapiens
gcguuucgauuacaugugu

SEQ ID NO: 1480490 - RNA, 19 nt, Homo sapiens
gaggaggaauaacuugaag

SEQ ID NO: 1480491 - RNA, 19 nt, Homo sapiens
ggacucgccguuaucuuga

SEQ ID NO: 1480492 - RNA, 19 nt, Homo sapiens
ucagaaagaacuugaguag

SEQ ID NO: 1480493 - RNA, 19 nt, Homo sapiens
uaguauugcguuucgauua

SEQ ID NO: 1480494 - RNA, 19 nt, Homo sapiens
caaagaaugaagagaagga

SEQ ID NO: 1480495 - RNA, 19 nt, Homo sapiens
gcaaagugggcacauguag

SEQ ID NO: 1480496 - RNA, 19 nt, Homo sapiens
ucucaccaguagaacuuua

SEQ ID NO: 1480497 - RNA, 19 nt, Homo sapiens
ugccugagaugaagagaga

SEQ ID NO: 1480498 - RNA, 19 nt, Homo sapiens
gaacuccagucuguuucug

SEQ ID NO: 1480499 - RNA, 19 nt, Homo sapiens
gugggcacauguagaaguu

SEQ ID NO: 1480500 - RNA, 19 nt, Homo sapiens
gaaaagacuucccauucca

SEQ ID NO: 1480501 - RNA, 19 nt, Homo sapiens
acagugauacaaagaauga

SEQ ID NO: 1480502 - RNA, 19 nt, Homo sapiens
uucaagaacuccagucugu

SEQ ID NO: 1480503 - RNA, 19 nt, Homo sapiens
ucaaguuacuguggugaga

SEQ ID NO: 1480504 - RNA, 19 nt, Homo sapiens
ggaaggugcuggauuuuac

SEQ ID NO: 1480505 - RNA, 19 nt, Homo sapiens
caaagugggcacauguaga

SEQ ID NO: 1480506 - RNA, 19 nt, Homo sapiens
ucagagauuuaccacagau

SEQ ID NO: 1480507 - RNA, 19 nt, Homo sapiens
ucagugugcugcccaaguc

SEQ ID NO: 1480508 - RNA, 19 nt, Homo sapiens
gaaagaggaccccugcauu

SEQ ID NO: 1480509 - RNA, 19 nt, Homo sapiens
uacaaagaaugaagagaag

SEQ ID NO: 1480510 - RNA, 19 nt, Homo sapiens
augguuaacugaagaaauc

SEQ ID NO: 1480511 - RNA, 19 nt, Homo sapiens
aaaccucacuguccauggu

SEQ ID NO: 1480512 - RNA, 19 nt, Homo sapiens
ggagccaggagcugaaaug

SEQ ID NO: 1480513 - RNA, 19 nt, Homo sapiens
guccaugguuaacugaaga

SEQ ID NO: 1480514 - RNA, 19 nt, Homo sapiens
gaggaccccugcauuuuau

SEQ ID NO: 1480515 - RNA, 19 nt, Homo sapiens
ccagaaacacacccagguu

SEQ ID NO: 1480516 - RNA, 19 nt, Homo sapiens
gaaucaccagcucaagaaa

SEQ ID NO: 1480517 - RNA, 19 nt, Homo sapiens
gaugaggaggaauaacuug

SEQ ID NO: 1480518 - RNA, 19 nt, Homo sapiens
aguaguagaugaggugguu

SEQ ID NO: 1480519 - RNA, 19 nt, Homo sapiens
accauacccuguuagacua

SEQ ID NO: 1480520 - RNA, 19 nt, Homo sapiens
cuuugacccugagaaguua

SEQ ID NO: 1480521 - RNA, 19 nt, Homo sapiens
ccaaauacgagugggaaga

SEQ ID NO: 1480522 - RNA, 19 nt, Homo sapiens
guggaaccaauuugcauuu

SEQ ID NO: 1480523 - RNA, 19 nt, Homo sapiens
uuaauaaccauacccuguu

SEQ ID NO: 1480524 - RNA, 19 nt, Homo sapiens
gguuagugguacaaaguca

SEQ ID NO: 1480525 - RNA, 19 nt, Homo sapiens
uuagggagaugccagaaac

SEQ ID NO: 1480526 - RNA, 19 nt, Homo sapiens
gggaaacaggcuucauuca

SEQ ID NO: 1480527 - RNA, 19 nt, Homo sapiens
uggccaaaguggaaagguu

SEQ ID NO: 1480528 - RNA, 19 nt, Homo sapiens
acacaagcuccuucccuaa

SEQ ID NO: 1480529 - RNA, 19 nt, Homo sapiens
ggaggaauaacuugaagac

SEQ ID NO: 1480530 - RNA, 19 nt, Homo sapiens
gcuaaaacauucaagaacu

SEQ ID NO: 1480531 - RNA, 19 nt, Homo sapiens
auguagaaguugaagcuaa

SEQ ID NO: 1480532 - RNA, 19 nt, Homo sapiens
gcauuaacaaagcaaagug

SEQ ID NO: 1480533 - RNA, 19 nt, Homo sapiens
cggcuuagcaacccaguau

SEQ ID NO: 1480534 - RNA, 19 nt, Homo sapiens
caucaaagaguuccaagcu

SEQ ID NO: 1480535 - RNA, 19 nt, Homo sapiens
ucaccugucccuugauguu

SEQ ID NO: 1480536 - RNA, 19 nt, Homo sapiens
gaucagccagaccaucuuc

SEQ ID NO: 1480537 - RNA, 19 nt, Homo sapiens
guuaagggacacagauugu

SEQ ID NO: 1480538 - RNA, 19 nt, Homo sapiens
uaagaaaacagacugaguu

SEQ ID NO: 1480539 - RNA, 19 nt, Homo sapiens
aaagcaaagugggcacaug

SEQ ID NO: 1480540 - RNA, 19 nt, Homo sapiens
caguauggccaaaguggaa

SEQ ID NO: 1480541 - RNA, 19 nt, Homo sapiens
cugaaauggcuccggcuua

SEQ ID NO: 1480542 - RNA, 19 nt, Homo sapiens
cagccaggaccaacucuga

SEQ ID NO: 1480543 - RNA, 19 nt, Homo sapiens
aaguuacuguggugagaaa

SEQ ID NO: 1480544 - RNA, 19 nt, Homo sapiens
ccauugcugaucuggguua

SEQ ID NO: 1480545 - RNA, 19 nt, Homo sapiens
gagcaggauggcagaggaa

SEQ ID NO: 1480546 - RNA, 19 nt, Homo sapiens
ugaggaggaauaacuugaa

SEQ ID NO: 1480547 - RNA, 19 nt, Homo sapiens
cagcaggaccaccacucua

SEQ ID NO: 1480548 - RNA, 19 nt, Homo sapiens
caaccuggacucaaguuac

SEQ ID NO: 1480549 - RNA, 19 nt, Homo sapiens
gucagagauuuaccacaga

SEQ ID NO: 1480550 - RNA, 19 nt, Homo sapiens
uggaaccaauuugcauuug

SEQ ID NO: 1480551 - RNA, 19 nt, Homo sapiens
ucgauuacaugugugugaa

SEQ ID NO: 1480552 - RNA, 19 nt, Homo sapiens
ucaccaguagaacuuuaua

SEQ ID NO: 1480553 - RNA, 19 nt, Homo sapiens
uggacucgccguuaucuug

SEQ ID NO: 1480554 - RNA, 19 nt, Homo sapiens
gugguuagacaggaucuuu

SEQ ID NO: 1480555 - RNA, 19 nt, Homo sapiens
gcacuucccuccucuguga

SEQ ID NO: 1480556 - RNA, 19 nt, Homo sapiens
agacauagcugcauugaau

SEQ ID NO: 1480557 - RNA, 19 nt, Homo sapiens
ugaaagacauagcugcauu

SEQ ID NO: 1480558 - RNA, 19 nt, Homo sapiens
gcacccgccugggaacuua

SEQ ID NO: 1480559 - RNA, 19 nt, Homo sapiens
ucagacaccuuggauguuu

SEQ ID NO: 1480560 - RNA, 19 nt, Homo sapiens
ccaaggaccucaugcucaa

SEQ ID NO: 1480561 - RNA, 19 nt, Homo sapiens
ggaggcagaaguaugauuu

SEQ ID NO: 1480562 - RNA, 19 nt, Homo sapiens
gaacaggagguaccacuuc

SEQ ID NO: 1480563 - RNA, 19 nt, Homo sapiens
ggugcgagcugaccugaga

SEQ ID NO: 1480564 - RNA, 19 nt, Homo sapiens
ccuuggauguuuauucuaa

SEQ ID NO: 1480565 - RNA, 19 nt, Homo sapiens
agaagggccugcacagcua

SEQ ID NO: 1480566 - RNA, 19 nt, Homo sapiens
gaaagacauagcugcauug

SEQ ID NO: 1480567 - RNA, 19 nt, Homo sapiens
cagacaccuuggauguuua

SEQ ID NO: 1480568 - RNA, 19 nt, Homo sapiens
ugaggaggcagaaguauga

SEQ ID NO: 1480569 - RNA, 19 nt, Homo sapiens
cacccucaauccuucaaua

SEQ ID NO: 1480570 - RNA, 19 nt, Homo sapiens
gcacugaggaggcagaagu

SEQ ID NO: 1480571 - RNA, 19 nt, Homo sapiens
gggaccgacuggccaugua

SEQ ID NO: 1480572 - RNA, 19 nt, Homo sapiens
cccagaagaugcucaagga

SEQ ID NO: 1480573 - RNA, 19 nt, Homo sapiens
gcaaaauugucucaucuuc

SEQ ID NO: 1480574 - RNA, 19 nt, Homo sapiens
ugugaggacuccaagagaa

SEQ ID NO: 1480575 - RNA, 19 nt, Homo sapiens
guacaaggcggaggugaug

SEQ ID NO: 1480576 - RNA, 19 nt, Homo sapiens
caccuuggauguuuauucu

SEQ ID NO: 1480577 - RNA, 19 nt, Homo sapiens
ccucaauccuucaauaaaa

SEQ ID NO: 1480578 - RNA, 19 nt, Homo sapiens
cggcuuggcccucugguuu

SEQ ID NO: 1480579 - RNA, 19 nt, Homo sapiens
ucauggcggucgucuggaa

SEQ ID NO: 1480580 - RNA, 19 nt, Homo sapiens
cuacagggccgaguacgaa

SEQ ID NO: 1480581 - RNA, 19 nt, Homo sapiens
caacuccagcuccgucuau

SEQ ID NO: 1480582 - RNA, 19 nt, Homo sapiens
auuccacgcuggguuguua

SEQ ID NO: 1480583 - RNA, 19 nt, Homo sapiens
ccugggaacuuacuacaac

SEQ ID NO: 1480584 - RNA, 19 nt, Homo sapiens
gcuuggcccucugguuuga

SEQ ID NO: 1480585 - RNA, 19 nt, Homo sapiens
ggaccgacuggccauguau

SEQ ID NO: 1480586 - RNA, 19 nt, Homo sapiens
guuguuaccgcuacagcua

SEQ ID NO: 1480587 - RNA, 19 nt, Homo sapiens
gcagugaaaccgccaaagc

SEQ ID NO: 1480588 - RNA, 19 nt, Homo sapiens
gguauuuccuaggguacaa

SEQ ID NO: 1480589 - RNA, 19 nt, Homo sapiens
gugaggacuccaagagaaa

SEQ ID NO: 1480590 - RNA, 19 nt, Homo sapiens
ucaccugcuucuucugguu

SEQ ID NO: 1480591 - RNA, 19 nt, Homo sapiens
gggugcuacucugguauuu

SEQ ID NO: 1480592 - RNA, 19 nt, Homo sapiens
ucagacacguuuggucauc

SEQ ID NO: 1480593 - RNA, 19 nt, Homo sapiens
ccagcuccgucuauuccuu

SEQ ID NO: 1480594 - RNA, 19 nt, Homo sapiens
gcacccacuugcagucacu

SEQ ID NO: 1480595 - RNA, 19 nt, Homo sapiens
gacauagcugcauugaauu

SEQ ID NO: 1480596 - RNA, 19 nt, Homo sapiens
ggaagccagugugaaagac

SEQ ID NO: 1480597 - RNA, 19 nt, Homo sapiens
cgccaaagcccagaagaug

SEQ ID NO: 1480598 - RNA, 19 nt, Homo sapiens
gugcuacucugguauuucc

SEQ ID NO: 1480599 - RNA, 19 nt, Homo sapiens
cggaggugauggcgaggaa

SEQ ID NO: 1480600 - RNA, 19 nt, Homo sapiens
ccucugguuugaugccuau

SEQ ID NO: 1480601 - RNA, 19 nt, Homo sapiens
cgccugauguuguuacucu

SEQ ID NO: 1480602 - RNA, 19 nt, Homo sapiens
gaagccagugugaaagaca

SEQ ID NO: 1480603 - RNA, 19 nt, Homo sapiens
gaggcagaaguaugauuug

SEQ ID NO: 1480604 - RNA, 19 nt, Homo sapiens
ggucaucagacaccuugga

SEQ ID NO: 1480605 - RNA, 19 nt, Homo sapiens
cagcuccgucuauuccuuu

SEQ ID NO: 1480606 - RNA, 19 nt, Homo sapiens
aaagacauagcugcauuga

SEQ ID NO: 1480607 - RNA, 19 nt, Homo sapiens
ccacuucucccaggaucuu

SEQ ID NO: 1480608 - RNA, 19 nt, Homo sapiens
gcuacucugguauuuccua

SEQ ID NO: 1480609 - RNA, 19 nt, Homo sapiens
cagacacguuuggucauca

SEQ ID NO: 1480610 - RNA, 19 nt, Homo sapiens
uguacucaaucgccacuuc

SEQ ID NO: 1480611 - RNA, 19 nt, Homo sapiens
uuccaggccugugaaguga

SEQ ID NO: 1480612 - RNA, 19 nt, Homo sapiens
gguacaaggcggaggugau

SEQ ID NO: 1480613 - RNA, 19 nt, Homo sapiens
gaagucagcucaucucuua

SEQ ID NO: 1480614 - RNA, 19 nt, Homo sapiens
gcaaguaucuuucaaacua

SEQ ID NO: 1480615 - RNA, 19 nt, Homo sapiens
gcaaagaauuccauuagug

SEQ ID NO: 1480616 - RNA, 19 nt, Homo sapiens
gaacuuguauuacuuaugg

SEQ ID NO: 1480617 - RNA, 19 nt, Homo sapiens
gcauucagauggaugauaa

SEQ ID NO: 1480618 - RNA, 19 nt, Homo sapiens
caacaaggccuaccagaaa

SEQ ID NO: 1480619 - RNA, 19 nt, Homo sapiens
caugucaucuccugauuua

SEQ ID NO: 1480620 - RNA, 19 nt, Homo sapiens
gcaaucagcugcagaaggu

SEQ ID NO: 1480621 - RNA, 19 nt, Homo sapiens
gacaagagaucagauggua

SEQ ID NO: 1480622 - RNA, 19 nt, Homo sapiens
gaauucaaaugcauccuuu

SEQ ID NO: 1480623 - RNA, 19 nt, Homo sapiens
gcaaaugacuauucaagag

SEQ ID NO: 1480624 - RNA, 19 nt, Homo sapiens
gcagagagaugugaguuug

SEQ ID NO: 1480625 - RNA, 19 nt, Homo sapiens
ucacauugcugauggauga

SEQ ID NO: 1480626 - RNA, 19 nt, Homo sapiens
cagaggaccugaugacauu

SEQ ID NO: 1480627 - RNA, 19 nt, Homo sapiens
gaaguggcaugucggacua

SEQ ID NO: 1480628 - RNA, 19 nt, Homo sapiens
gaugucaccuuugauaauu

SEQ ID NO: 1480629 - RNA, 19 nt, Homo sapiens
aguauaagcuuccuaaguu

SEQ ID NO: 1480630 - RNA, 19 nt, Homo sapiens
ccaauuaccugucaagagu

SEQ ID NO: 1480631 - RNA, 19 nt, Homo sapiens
ggaguuaaauggaaacaag

SEQ ID NO: 1480632 - RNA, 19 nt, Homo sapiens
gcucaucucuuaucaccaa

SEQ ID NO: 1480633 - RNA, 19 nt, Homo sapiens
ucauuugggugguuuauuu

SEQ ID NO: 1480634 - RNA, 19 nt, Homo sapiens
gaugaaccauugcugugua

SEQ ID NO: 1480635 - RNA, 19 nt, Homo sapiens
uggauuaucucaucaagaa

SEQ ID NO: 1480636 - RNA, 19 nt, Homo sapiens
caacacaauuucucucuca

SEQ ID NO: 1480637 - RNA, 19 nt, Homo sapiens
gcaugagucugaauaguuc

SEQ ID NO: 1480638 - RNA, 19 nt, Homo sapiens
gaagcaaagaauuccauua

SEQ ID NO: 1480639 - RNA, 19 nt, Homo sapiens
gaaaagaccaagguuauua

SEQ ID NO: 1480640 - RNA, 19 nt, Homo sapiens
ugauagaacucgugugguu

SEQ ID NO: 1480641 - RNA, 19 nt, Homo sapiens
ccaaauaacucugauucug

SEQ ID NO: 1480642 - RNA, 19 nt, Homo sapiens
guauaagcuuccuaaguuu

SEQ ID NO: 1480643 - RNA, 19 nt, Homo sapiens
gguauacauuucacacauu

SEQ ID NO: 1480644 - RNA, 19 nt, Homo sapiens
gaagaucugagcacaguga

SEQ ID NO: 1480645 - RNA, 19 nt, Homo sapiens
caagauucaugguuggaaa

SEQ ID NO: 1480646 - RNA, 19 nt, Homo sapiens
cagcguaccucccacucua

SEQ ID NO: 1480647 - RNA, 19 nt, Homo sapiens
gagaggaaguuuggucguu

SEQ ID NO: 1480648 - RNA, 19 nt, Homo sapiens
gcacagugauccaagaacu

SEQ ID NO: 1480649 - RNA, 19 nt, Homo sapiens
cuaagcaagucaucacauu

SEQ ID NO: 1480650 - RNA, 19 nt, Homo sapiens
gaacuggcgccacguguau

SEQ ID NO: 1480651 - RNA, 19 nt, Homo sapiens
uaagucacauuucuaguag

SEQ ID NO: 1480652 - RNA, 19 nt, Homo sapiens
uaaccaggccucuguagaa

SEQ ID NO: 1480653 - RNA, 19 nt, Homo sapiens
caagagcauugccaagaug

SEQ ID NO: 1480654 - RNA, 19 nt, Homo sapiens
agaaaguuauucagcauug

SEQ ID NO: 1480655 - RNA, 19 nt, Homo sapiens
gaaccugaagcaaagaauu

SEQ ID NO: 1480656 - RNA, 19 nt, Homo sapiens
cuaguucucugauguuaga

SEQ ID NO: 1480657 - RNA, 19 nt, Homo sapiens
uaacucugauucugcuaaa

SEQ ID NO: 1480658 - RNA, 19 nt, Homo sapiens
caagcugcaucacuccuuu

SEQ ID NO: 1480659 - RNA, 19 nt, Homo sapiens
gaugugaguuuggacaaga

SEQ ID NO: 1480660 - RNA, 19 nt, Homo sapiens
cagaagaaguuuguaaucu

SEQ ID NO: 1480661 - RNA, 19 nt, Homo sapiens
agaccaagguuauuauauc

SEQ ID NO: 1480662 - RNA, 19 nt, Homo sapiens
caccuuggaacuuguauua

SEQ ID NO: 1480663 - RNA, 19 nt, Homo sapiens
guuaggaguuaaauggaaa

SEQ ID NO: 1480664 - RNA, 19 nt, Homo sapiens
ccaagggccagaaaucuuu

SEQ ID NO: 1480665 - RNA, 19 nt, Homo sapiens
caaagaauuccauuagugu

SEQ ID NO: 1480666 - RNA, 19 nt, Homo sapiens
aaaaggggaugguuuaauu

SEQ ID NO: 1480667 - RNA, 19 nt, Homo sapiens
gcacaauccagcauucaga

SEQ ID NO: 1480668 - RNA, 19 nt, Homo sapiens
guauacauuucacacauuc

SEQ ID NO: 1480669 - RNA, 19 nt, Homo sapiens
ggguuaagcauuagugaaa

SEQ ID NO: 1480670 - RNA, 19 nt, Homo sapiens
ugagggagcaucuuccuuu

SEQ ID NO: 1480671 - RNA, 19 nt, Homo sapiens
cagauucuacuuuccauaa

SEQ ID NO: 1480672 - RNA, 19 nt, Homo sapiens
cagaaggucuuaaaacauu

SEQ ID NO: 1480673 - RNA, 19 nt, Homo sapiens
caacaccuccuuccauugu

SEQ ID NO: 1480674 - RNA, 19 nt, Homo sapiens
caucaagaauggaucaaag

SEQ ID NO: 1480675 - RNA, 19 nt, Homo sapiens
caucucaccuuggaacuug

SEQ ID NO: 1480676 - RNA, 19 nt, Homo sapiens
gaccucaaacugcaaauga

SEQ ID NO: 1480677 - RNA, 19 nt, Homo sapiens
cccagugucuucugaugua

SEQ ID NO: 1480678 - RNA, 19 nt, Homo sapiens
gcauguuggucaaguaaag

SEQ ID NO: 1480679 - RNA, 19 nt, Homo sapiens
gcagaagaaguuuguaauc

SEQ ID NO: 1480680 - RNA, 19 nt, Homo sapiens
gugcaaggcaggauugaaa

SEQ ID NO: 1480681 - RNA, 19 nt, Homo sapiens
cucaggaaauugauacuuu

SEQ ID NO: 1480682 - RNA, 19 nt, Homo sapiens
aagaauggaucaaagaaag

SEQ ID NO: 1480683 - RNA, 19 nt, Homo sapiens
caagaauggaucaaagaaa

SEQ ID NO: 1480684 - RNA, 19 nt, Homo sapiens
auaaaucccuuacccuaau

SEQ ID NO: 1480685 - RNA, 19 nt, Homo sapiens
uuuauaaacccgugacaua

SEQ ID NO: 1480686 - RNA, 19 nt, Homo sapiens
caaggugaauucaaaugca

SEQ ID NO: 1480687 - RNA, 19 nt, Homo sapiens
gagcaugagucugaauagu

SEQ ID NO: 1480688 - RNA, 19 nt, Homo sapiens
cccgugacauaaacuguua

SEQ ID NO: 1480689 - RNA, 19 nt, Homo sapiens
ccaagaacuuaaugucauc

SEQ ID NO: 1480690 - RNA, 19 nt, Homo sapiens
caagagaucagaugguauc

SEQ ID NO: 1480691 - RNA, 19 nt, Homo sapiens
gagcugccuuuacuagcaa

SEQ ID NO: 1480692 - RNA, 19 nt, Homo sapiens
uauaaacccgugacauaaa

SEQ ID NO: 1480693 - RNA, 19 nt, Homo sapiens
ugucaucaauaacaucuug

SEQ ID NO: 1480694 - RNA, 19 nt, Homo sapiens
gaaacacuuccacucaaga

SEQ ID NO: 1480695 - RNA, 19 nt, Homo sapiens
gaauggaucaaagaaaguu

SEQ ID NO: 1480696 - RNA, 19 nt, Homo sapiens
gaagcucuuuaucuuucaa

SEQ ID NO: 1480697 - RNA, 19 nt, Homo sapiens
gauaaaauccucaagacaa

SEQ ID NO: 1480698 - RNA, 19 nt, Homo sapiens
ccaggccucuguagaaaca

SEQ ID NO: 1480699 - RNA, 19 nt, Homo sapiens
uauaaaucccuuacccuaa

SEQ ID NO: 1480700 - RNA, 19 nt, Homo sapiens
acagugauccaagaacuua

SEQ ID NO: 1480701 - RNA, 19 nt, Homo sapiens
ccagcauguuggucaagua

SEQ ID NO: 1480702 - RNA, 19 nt, Homo sapiens
gucagaagcagaagaaguu

SEQ ID NO: 1480703 - RNA, 19 nt, Homo sapiens
gauuaucucaucaagaaug

SEQ ID NO: 1480704 - RNA, 19 nt, Homo sapiens
caaccaagggccagaaauc

SEQ ID NO: 1480705 - RNA, 19 nt, Homo sapiens
ggguauacauuucacacau

SEQ ID NO: 1480706 - RNA, 19 nt, Homo sapiens
ccagagaagucagcucauc

SEQ ID NO: 1480707 - RNA, 19 nt, Homo sapiens
guagaaacacucugucucu

SEQ ID NO: 1480708 - RNA, 19 nt, Homo sapiens
uccaaucacuugcuuguca

SEQ ID NO: 1480709 - RNA, 19 nt, Homo sapiens
acaagagcauugccaagau

SEQ ID NO: 1480710 - RNA, 19 nt, Homo sapiens
ccauugcuguguaaagaga

SEQ ID NO: 1480711 - RNA, 19 nt, Homo sapiens
ggauaaggaggcaggaaga

SEQ ID NO: 1480712 - RNA, 19 nt, Homo sapiens
uucaagagcuuuuggauaa

SEQ ID NO: 1480713 - RNA, 19 nt, Homo sapiens
ggagguauaucuuggguua

SEQ ID NO: 1480714 - RNA, 19 nt, Homo sapiens
ccaaacauguaucucaaua

SEQ ID NO: 1480715 - RNA, 19 nt, Homo sapiens
agacauagguugcagugua

SEQ ID NO: 1480716 - RNA, 19 nt, Homo sapiens
caacaacuauucaccaaau

SEQ ID NO: 1480717 - RNA, 19 nt, Homo sapiens
uaaauaguguggccaauga

SEQ ID NO: 1480718 - RNA, 19 nt, Homo sapiens
gcucacaccuguaauccua

SEQ ID NO: 1480719 - RNA, 19 nt, Homo sapiens
gagaaggaaagguuauuua

SEQ ID NO: 1480720 - RNA, 19 nt, Homo sapiens
cagcuugggugacaaagua

SEQ ID NO: 1480721 - RNA, 19 nt, Homo sapiens
aaacagagaugcaggauac

SEQ ID NO: 1480722 - RNA, 19 nt, Homo sapiens
guaaagaggugcaaaagaa

SEQ ID NO: 1480723 - RNA, 19 nt, Homo sapiens
ugaaagugaucaagaaaga

SEQ ID NO: 1480724 - RNA, 19 nt, Homo sapiens
gacauagguugcaguguaa

SEQ ID NO: 1480725 - RNA, 19 nt, Homo sapiens
caaaagaagucuaccaaaa

SEQ ID NO: 1480726 - RNA, 19 nt, Homo sapiens
aagagaagcugaagauaau

SEQ ID NO: 1480727 - RNA, 19 nt, Homo sapiens
caucagauaucgagcaaau

SEQ ID NO: 1480728 - RNA, 19 nt, Homo sapiens
cggguaacaugguaaauuu

SEQ ID NO: 1480729 - RNA, 19 nt, Homo sapiens
guagggagcuaugaucuug

SEQ ID NO: 1480730 - RNA, 19 nt, Homo sapiens
aaagagaagcugaagauaa

SEQ ID NO: 1480731 - RNA, 19 nt, Homo sapiens
ggauuacuaugaaguucua

SEQ ID NO: 1480732 - RNA, 19 nt, Homo sapiens
gaacacagucauucaacaa

SEQ ID NO: 1480733 - RNA, 19 nt, Homo sapiens
cuacauaucuguuacaacu

SEQ ID NO: 1480734 - RNA, 19 nt, Homo sapiens
guuaaaacaugguggauua

SEQ ID NO: 1480735 - RNA, 19 nt, Homo sapiens
gacccugucucuaaagaaa

SEQ ID NO: 1480736 - RNA, 19 nt, Homo sapiens
gguucagacuacacaauua

SEQ ID NO: 1480737 - RNA, 19 nt, Homo sapiens
gagcuaugaucuugccauu

SEQ ID NO: 1480738 - RNA, 19 nt, Homo sapiens
agacaagaauguaucaaga

SEQ ID NO: 1480739 - RNA, 19 nt, Homo sapiens
gaaagagaagcugaagaua

SEQ ID NO: 1480740 - RNA, 19 nt, Homo sapiens
aaugagaccuguccucuau

SEQ ID NO: 1480741 - RNA, 19 nt, Homo sapiens
aaacgggacauuuaugaua

SEQ ID NO: 1480742 - RNA, 19 nt, Homo sapiens
ucucacagcuccaaacaug

SEQ ID NO: 1480743 - RNA, 19 nt, Homo sapiens
ugauaaauauggcacagaa

SEQ ID NO: 1480744 - RNA, 19 nt, Homo sapiens
gccagugaauauccaauuu

SEQ ID NO: 1480745 - RNA, 19 nt, Homo sapiens
uuaaauggcacccugauaa

SEQ ID NO: 1480746 - RNA, 19 nt, Homo sapiens
aaagacagcuauagucaag

SEQ ID NO: 1480747 - RNA, 19 nt, Homo sapiens
gcacacccacuuccaacua

SEQ ID NO: 1480748 - RNA, 19 nt, Homo sapiens
gcuaugaucuugccauugc

SEQ ID NO: 1480749 - RNA, 19 nt, Homo sapiens
gcaggauuguggacauuug

SEQ ID NO: 1480750 - RNA, 19 nt, Homo sapiens
gcaguauagugagaucuuu

SEQ ID NO: 1480751 - RNA, 19 nt, Homo sapiens
gacauuugguuaguaguuu

SEQ ID NO: 1480752 - RNA, 19 nt, Homo sapiens
gaaacagagaugcaggaua

SEQ ID NO: 1480753 - RNA, 19 nt, Homo sapiens
uaaagaagaagcagagaga

SEQ ID NO: 1480754 - RNA, 19 nt, Homo sapiens
gaaugcagcuggagaacac

SEQ ID NO: 1480755 - RNA, 19 nt, Homo sapiens
gaugagaaacgggacauuu

SEQ ID NO: 1480756 - RNA, 19 nt, Homo sapiens
ggagaaggaaagguuauuu

SEQ ID NO: 1480757 - RNA, 19 nt, Homo sapiens
ugagaccuguccucuauga

SEQ ID NO: 1480758 - RNA, 19 nt, Homo sapiens
gacaacuacauaucuguua

SEQ ID NO: 1480759 - RNA, 19 nt, Homo sapiens
ggaaacagaaacagagaug

SEQ ID NO: 1480760 - RNA, 19 nt, Homo sapiens
caugguggauuacuaugaa

SEQ ID NO: 1480761 - RNA, 19 nt, Homo sapiens
ggacauuugguuaguaguu

SEQ ID NO: 1480762 - RNA, 19 nt, Homo sapiens
ucacagcuccaaacaugua

SEQ ID NO: 1480763 - RNA, 19 nt, Homo sapiens
cgacaguccggguaacaua

SEQ ID NO: 1480764 - RNA, 19 nt, Homo sapiens
acacacagguucagacuac

SEQ ID NO: 1480765 - RNA, 19 nt, Homo sapiens
ggagaacacagucauucaa

SEQ ID NO: 1480766 - RNA, 19 nt, Homo sapiens
ugaagauaauggagaguug

SEQ ID NO: 1480767 - RNA, 19 nt, Homo sapiens
uaaauggcacccugauaaa

SEQ ID NO: 1480768 - RNA, 19 nt, Homo sapiens
ggacaacuacauaucuguu

SEQ ID NO: 1480769 - RNA, 19 nt, Homo sapiens
agaaguagcugaggcauac

SEQ ID NO: 1480770 - RNA, 19 nt, Homo sapiens
gaaguucuaggacugcaaa

SEQ ID NO: 1480771 - RNA, 19 nt, Homo sapiens
uguuacaacuucagacaaa

SEQ ID NO: 1480772 - RNA, 19 nt, Homo sapiens
aagagacugcggacaauua

SEQ ID NO: 1480773 - RNA, 19 nt, Homo sapiens
gauuguggacauuugguua

SEQ ID NO: 1480774 - RNA, 19 nt, Homo sapiens
auagauggguuacaaauac

SEQ ID NO: 1480775 - RNA, 19 nt, Homo sapiens
ggaggaacagcauuugaug

SEQ ID NO: 1480776 - RNA, 19 nt, Homo sapiens
gaagauaauggagaguuga

SEQ ID NO: 1480777 - RNA, 19 nt, Homo sapiens
aaacggagguggaagucau

SEQ ID NO: 1480778 - RNA, 19 nt, Homo sapiens
gaagagacugcggacaauu

SEQ ID NO: 1480779 - RNA, 19 nt, Homo sapiens
uaucuuggguuaccagcaa

SEQ ID NO: 1480780 - RNA, 19 nt, Homo sapiens
agacugcggacaauuagua

SEQ ID NO: 1480781 - RNA, 19 nt, Homo sapiens
gaugggagaaggaaagguu

SEQ ID NO: 1480782 - RNA, 19 nt, Homo sapiens
acaaauacaucagauaucg

SEQ ID NO: 1480783 - RNA, 19 nt, Homo sapiens
caggaggguugaagucaga

SEQ ID NO: 1480784 - RNA, 19 nt, Homo sapiens
acaagaauguaucaagaca

SEQ ID NO: 1480785 - RNA, 19 nt, Homo sapiens
aaacaugguggauuacuau

SEQ ID NO: 1480786 - RNA, 19 nt, Homo sapiens
ugacaguuggugcuaauaa

SEQ ID NO: 1480787 - RNA, 19 nt, Homo sapiens
gaauggguaugucagaaaa

SEQ ID NO: 1480788 - RNA, 19 nt, Homo sapiens
agaaagagaagcugaagau

SEQ ID NO: 1480789 - RNA, 19 nt, Homo sapiens
gaaacgggacauuuaugau

SEQ ID NO: 1480790 - RNA, 19 nt, Homo sapiens
uacgagguauuaucaaaug

SEQ ID NO: 1480791 - RNA, 19 nt, Homo sapiens
cacagucauucaacaacua

SEQ ID NO: 1480792 - RNA, 19 nt, Homo sapiens
gagaaacgggacauuuaug

SEQ ID NO: 1480793 - RNA, 19 nt, Homo sapiens
gaauguaucaagacacaca

SEQ ID NO: 1480794 - RNA, 19 nt, Homo sapiens
aagaauguaucaagacaca

SEQ ID NO: 1480795 - RNA, 19 nt, Homo sapiens
gcauagcauuagaagacaa

SEQ ID NO: 1480796 - RNA, 19 nt, Homo sapiens
ggugacaguuggugcuaau

SEQ ID NO: 1480797 - RNA, 19 nt, Homo sapiens
acauaucuguuacaacuuc

SEQ ID NO: 1480798 - RNA, 19 nt, Homo sapiens
cagagaugcaggauacuuu

SEQ ID NO: 1480799 - RNA, 19 nt, Homo sapiens
agaaacgggacauuuauga

SEQ ID NO: 1480800 - RNA, 19 nt, Homo sapiens
uagaagagacugcggacaa

SEQ ID NO: 1480801 - RNA, 19 nt, Homo sapiens
gagagaaaauucaaagaag

SEQ ID NO: 1480802 - RNA, 19 nt, Homo sapiens
ucgggaagcugguagaaag

SEQ ID NO: 1480803 - RNA, 19 nt, Homo sapiens
gacaguuggugcuaauaag

SEQ ID NO: 1480804 - RNA, 19 nt, Homo sapiens
auacuuucguggacaauga

SEQ ID NO: 1480805 - RNA, 19 nt, Homo sapiens
guaaauaguguggccaaug

SEQ ID NO: 1480806 - RNA, 19 nt, Homo sapiens
ugagaaacgggacauuuau

SEQ ID NO: 1480807 - RNA, 19 nt, Homo sapiens
ggacaauuaguauucaaag

SEQ ID NO: 1480808 - RNA, 19 nt, Homo sapiens
ggacugcaaagauaugcuu

SEQ ID NO: 1480809 - RNA, 19 nt, Homo sapiens
gcagaugggagaaggaaag

SEQ ID NO: 1480810 - RNA, 19 nt, Homo sapiens
gacaguccggguaacauaa

SEQ ID NO: 1480811 - RNA, 19 nt, Homo sapiens
gaugagggagguauaucuu

SEQ ID NO: 1480812 - RNA, 19 nt, Homo sapiens
gcuccaaacauguaucuca

SEQ ID NO: 1480813 - RNA, 19 nt, Homo sapiens
ggacacagcucacaaggua

SEQ ID NO: 1480814 - RNA, 19 nt, Homo sapiens
caacauaaguggauuagaa

SEQ ID NO: 1480815 - RNA, 19 nt, Homo sapiens
ggaaauggaccaaguauug

SEQ ID NO: 1480816 - RNA, 19 nt, Homo sapiens
gguagaaacucuccacauu

SEQ ID NO: 1480817 - RNA, 19 nt, Homo sapiens
ucagauaggucaaaugaug

SEQ ID NO: 1480818 - RNA, 19 nt, Homo sapiens
guagaaacucuccacauua

SEQ ID NO: 1480819 - RNA, 19 nt, Homo sapiens
gcagaaggacccucuauug

SEQ ID NO: 1480820 - RNA, 19 nt, Homo sapiens
uagaaacucuccacauuau

SEQ ID NO: 1480821 - RNA, 19 nt, Homo sapiens
acucucagcugccaucuua

SEQ ID NO: 1480822 - RNA, 19 nt, Homo sapiens
gcaguguccucucucauga

SEQ ID NO: 1480823 - RNA, 19 nt, Homo sapiens
aaugagaccuggagacaaa

SEQ ID NO: 1480824 - RNA, 19 nt, Homo sapiens
ccacaaucauggcguauau

SEQ ID NO: 1480825 - RNA, 19 nt, Homo sapiens
gaaugaggauauccaagug

SEQ ID NO: 1480826 - RNA, 19 nt, Homo sapiens
gcucacaagguacugauua

SEQ ID NO: 1480827 - RNA, 19 nt, Homo sapiens
gaaauggaccaaguauuga

SEQ ID NO: 1480828 - RNA, 19 nt, Homo sapiens
ggagccauauacucuauug

SEQ ID NO: 1480829 - RNA, 19 nt, Homo sapiens
ggagacaaagggcauaauu

SEQ ID NO: 1480830 - RNA, 19 nt, Homo sapiens
caacugcaguacccucuga

SEQ ID NO: 1480831 - RNA, 19 nt, Homo sapiens
caaaugaugugcccaacca

SEQ ID NO: 1480832 - RNA, 19 nt, Homo sapiens
ucaauaagguucagauagg

SEQ ID NO: 1480833 - RNA, 19 nt, Homo sapiens
ggacagcccugcgacaaag

SEQ ID NO: 1480834 - RNA, 19 nt, Homo sapiens
gcccagaaguggagagaga

SEQ ID NO: 1480835 - RNA, 19 nt, Homo sapiens
gaucaauaagguucagaua

SEQ ID NO: 1480836 - RNA, 19 nt, Homo sapiens
gccauauacucuauuguug

SEQ ID NO: 1480837 - RNA, 19 nt, Homo sapiens
ggaaugaggauauccaagu

SEQ ID NO: 1480838 - RNA, 19 nt, Homo sapiens
gcccagacauugguagaaa

SEQ ID NO: 1480839 - RNA, 19 nt, Homo sapiens
guucagauaggucaaauga

SEQ ID NO: 1480840 - RNA, 19 nt, Homo sapiens
gcucaggaccucaucuauu

SEQ ID NO: 1480841 - RNA, 19 nt, Homo sapiens
auacagaugggaucaauaa

SEQ ID NO: 1480842 - RNA, 19 nt, Homo sapiens
gaaacucuccacauuaucu

SEQ ID NO: 1480843 - RNA, 19 nt, Homo sapiens
gagacaaagggcauaauug

SEQ ID NO: 1480844 - RNA, 19 nt, Homo sapiens
aaucauggcguauauaguu

SEQ ID NO: 1480845 - RNA, 19 nt, Homo sapiens
cagaugggaucaauaaggu

SEQ ID NO: 1480846 - RNA, 19 nt, Homo sapiens
caaccaaggucacaaugcu

SEQ ID NO: 1480847 - RNA, 19 nt, Homo sapiens
gagauuagagggagcaaca

SEQ ID NO: 1480848 - RNA, 19 nt, Homo sapiens
gcaguacccucugaucucu

SEQ ID NO: 1480849 - RNA, 19 nt, Homo sapiens
cucaggaccucaucuauuc

SEQ ID NO: 1480850 - RNA, 19 nt, Homo sapiens
auugaaggcucucagcuuu

SEQ ID NO: 1480851 - RNA, 19 nt, Homo sapiens
gacacucucuguggaaaug

SEQ ID NO: 1480852 - RNA, 19 nt, Homo sapiens
gagcagcacaggccugaug

SEQ ID NO: 1480853 - RNA, 19 nt, Homo sapiens
caaggucacaaugcucuua

SEQ ID NO: 1480854 - RNA, 19 nt, Homo sapiens
cagaaggacccucuauugu

SEQ ID NO: 1480855 - RNA, 19 nt, Homo sapiens
gcagucaugcccauuauac

SEQ ID NO: 1480856 - RNA, 19 nt, Homo sapiens
gaaugugucagagcaagaa

SEQ ID NO: 1480857 - RNA, 19 nt, Homo sapiens
ugaugcagcucaggaaugu

SEQ ID NO: 1480858 - RNA, 19 nt, Homo sapiens
cagcugccaucuuaugcuu

SEQ ID NO: 1480859 - RNA, 19 nt, Homo sapiens
gaggaggaaugaggauauc

SEQ ID NO: 1480860 - RNA, 19 nt, Homo sapiens
caagggcaguuugcagguu

SEQ ID NO: 1480861 - RNA, 19 nt, Homo sapiens
ccauauacucuauuguuga

SEQ ID NO: 1480862 - RNA, 19 nt, Homo sapiens
guagcaguguccucucuca

SEQ ID NO: 1480863 - RNA, 19 nt, Homo sapiens
gcucaugacccuguuuaug

SEQ ID NO: 1480864 - RNA, 19 nt, Homo sapiens
ucugaucucuggcuuucuu

SEQ ID NO: 1480865 - RNA, 19 nt, Homo sapiens
gauguucccaugagagaga

SEQ ID NO: 1480866 - RNA, 19 nt, Homo sapiens
gaguagcaguguccucucu

SEQ ID NO: 1480867 - RNA, 19 nt, Homo sapiens
agaagguccucuugagcaa

SEQ ID NO: 1480868 - RNA, 19 nt, Homo sapiens
ggaagaaagaacccuccuu

SEQ ID NO: 1480869 - RNA, 19 nt, Homo sapiens
caauaagguucagauaggu

SEQ ID NO: 1480870 - RNA, 19 nt, Homo sapiens
uauuggagccuucaucaga

SEQ ID NO: 1480871 - RNA, 19 nt, Homo sapiens
gaagaggugggugauguuc

SEQ ID NO: 1480872 - RNA, 19 nt, Homo sapiens
ggucuuggaagcauuaaca

SEQ ID NO: 1480873 - RNA, 19 nt, Homo sapiens
uaucugauguucccaugag

SEQ ID NO: 1480874 - RNA, 19 nt, Homo sapiens
ccucugaucucuggcuuuc

SEQ ID NO: 1480875 - RNA, 19 nt, Homo sapiens
gaaugagaccuggagacaa

SEQ ID NO: 1480876 - RNA, 19 nt, Homo sapiens
ggugggugauguucugcaa

SEQ ID NO: 1480877 - RNA, 19 nt, Homo sapiens
caccgagccagucaacaua

SEQ ID NO: 1480878 - RNA, 19 nt, Homo sapiens
ggacagcguggccaugaag

SEQ ID NO: 1480879 - RNA, 19 nt, Homo sapiens
agaaguggagagagaauga

SEQ ID NO: 1480880 - RNA, 19 nt, Homo sapiens
agacauugguagaaacucu

SEQ ID NO: 1480881 - RNA, 19 nt, Homo sapiens
ccaagugggcggucuuauc

SEQ ID NO: 1480882 - RNA, 19 nt, Homo sapiens
agaaggacccucuauuguc

SEQ ID NO: 1480883 - RNA, 19 nt, Homo sapiens
ggaaugugucagagcaaga

SEQ ID NO: 1480884 - RNA, 19 nt, Homo sapiens
gaaauggaugacagcugaa

SEQ ID NO: 1480885 - RNA, 19 nt, Homo sapiens
uuuaugcgguaccggagua

SEQ ID NO: 1480886 - RNA, 19 nt, Homo sapiens
caacccaguguuucuugaa

SEQ ID NO: 1480887 - RNA, 19 nt, Homo sapiens
gcagcccuccuucaacuuc

SEQ ID NO: 1480888 - RNA, 19 nt, Homo sapiens
ggacuugaaggcccagaag

SEQ ID NO: 1480889 - RNA, 19 nt, Homo sapiens
gaagcccagggaagaaaga

SEQ ID NO: 1480890 - RNA, 19 nt, Homo sapiens
uuauacagaugggaucaau

SEQ ID NO: 1480891 - RNA, 19 nt, Homo sapiens
gaggaaugaggauauccaa

SEQ ID NO: 1480892 - RNA, 19 nt, Homo sapiens
ugaggaggaaugaggauau

SEQ ID NO: 1480893 - RNA, 19 nt, Homo sapiens
ggcuuuggcugaccugucu

SEQ ID NO: 1480894 - RNA, 19 nt, Homo sapiens
agaggugggugauguucug

SEQ ID NO: 1480895 - RNA, 19 nt, Homo sapiens
agagaauuccuuccucaga

SEQ ID NO: 1480896 - RNA, 19 nt, Homo sapiens
acaacccaguguuucuuga

SEQ ID NO: 1480897 - RNA, 19 nt, Homo sapiens
uggcagagcccuucuuacu

SEQ ID NO: 1480898 - RNA, 19 nt, Homo sapiens
ccuucaacuuccuguauug

SEQ ID NO: 1480899 - RNA, 19 nt, Homo sapiens
aagguccucuugagcaaug

SEQ ID NO: 1480900 - RNA, 19 nt, Homo sapiens
ucaccgagccagucaacau

SEQ ID NO: 1480901 - RNA, 19 nt, Homo sapiens
gugugacucauacuuguuu

SEQ ID NO: 1480902 - RNA, 19 nt, Homo sapiens
ucagugcccugucucuaac

SEQ ID NO: 1480903 - RNA, 19 nt, Homo sapiens
acaaucauggcguauauag

SEQ ID NO: 1480904 - RNA, 19 nt, Homo sapiens
aaauggaccaaguauugaa

SEQ ID NO: 1480905 - RNA, 19 nt, Homo sapiens
caagugggcggucuuaucc

SEQ ID NO: 1480906 - RNA, 19 nt, Homo sapiens
ggcccugcauggcuucuuc

SEQ ID NO: 1480907 - RNA, 19 nt, Homo sapiens
augaagaggugggugaugu

SEQ ID NO: 1480908 - RNA, 19 nt, Homo sapiens
ccagucaacauaaguggau

SEQ ID NO: 1480909 - RNA, 19 nt, Homo sapiens
gagccagucaacauaagug

SEQ ID NO: 1480910 - RNA, 19 nt, Homo sapiens
ggucacaaugcucuuaagu

SEQ ID NO: 1480911 - RNA, 19 nt, Homo sapiens
cuuggaugcuggagagaau

SEQ ID NO: 1480912 - RNA, 19 nt, Homo sapiens
uagaagcccagggaagaaa

SEQ ID NO: 1480913 - RNA, 19 nt, Homo sapiens
ggacagaggagcccuaaga

SEQ ID NO: 1480914 - RNA, 19 nt, Homo sapiens
gaacuuaaccuggucuaug

SEQ ID NO: 1480915 - RNA, 19 nt, Homo sapiens
ggagagaccgcauagauuc

SEQ ID NO: 1480916 - RNA, 19 nt, Homo sapiens
caaaggacuugaucugagu

SEQ ID NO: 1480917 - RNA, 19 nt, Homo sapiens
gaagaugauggcgaacuua

SEQ ID NO: 1480918 - RNA, 19 nt, Homo sapiens
cgaagaugauggcgaacuu

SEQ ID NO: 1480919 - RNA, 19 nt, Homo sapiens
gaagugcccagauccaaga

SEQ ID NO: 1480920 - RNA, 19 nt, Homo sapiens
ccgcauagauucgaagaug

SEQ ID NO: 1480921 - RNA, 19 nt, Homo sapiens
caccaaggcuuucccaucu

SEQ ID NO: 1480922 - RNA, 19 nt, Homo sapiens
cacagaagcuccugcucuu

SEQ ID NO: 1480923 - RNA, 19 nt, Homo sapiens
acagucagcuacuuucaug

SEQ ID NO: 1480924 - RNA, 19 nt, Homo sapiens
caagcagcauccuucagaa

SEQ ID NO: 1480925 - RNA, 19 nt, Homo sapiens
aacuuaaccuggucuauga

SEQ ID NO: 1480926 - RNA, 19 nt, Homo sapiens
gcagcauccuucagaaucu

SEQ ID NO: 1480927 - RNA, 19 nt, Homo sapiens
ccaagcagcauccuucaga

SEQ ID NO: 1480928 - RNA, 19 nt, Homo sapiens
gcaggaggacagucaguga

SEQ ID NO: 1480929 - RNA, 19 nt, Homo sapiens
gaagaucuccagggacaga

SEQ ID NO: 1480930 - RNA, 19 nt, Homo sapiens
cagaagcuccugcucuuug

SEQ ID NO: 1480931 - RNA, 19 nt, Homo sapiens
gaucaccuauccauacacu

SEQ ID NO: 1480932 - RNA, 19 nt, Homo sapiens
cuaagaagccaacaaacug

SEQ ID NO: 1480933 - RNA, 19 nt, Homo sapiens
gcccuaagaagccaacaaa

SEQ ID NO: 1480934 - RNA, 19 nt, Homo sapiens
gaucugaguugggaguaag

SEQ ID NO: 1480935 - RNA, 19 nt, Homo sapiens
caggagagaccgcauagau

SEQ ID NO: 1480936 - RNA, 19 nt, Homo sapiens
cagcuacuuucaugaagau

SEQ ID NO: 1480937 - RNA, 19 nt, Homo sapiens
ucagcuacuuucaugaaga

SEQ ID NO: 1480938 - RNA, 19 nt, Homo sapiens
gcauagauucgaagaugau

SEQ ID NO: 1480939 - RNA, 19 nt, Homo sapiens
ucaccggccuccugagugu

SEQ ID NO: 1480940 - RNA, 19 nt, Homo sapiens
gacagaggagcccuaagaa

SEQ ID NO: 1480941 - RNA, 19 nt, Homo sapiens
cugcugcucuggaacaaga

SEQ ID NO: 1480942 - RNA, 19 nt, Homo sapiens
gcaaggaccccaccaggaa

SEQ ID NO: 1480943 - RNA, 19 nt, Homo sapiens
gagaccgcauagauucgaa

SEQ ID NO: 1480944 - RNA, 19 nt, Homo sapiens
gagcuugcccugggucaga

SEQ ID NO: 1480945 - RNA, 19 nt, Homo sapiens
cgcauagauucgaagauga

SEQ ID NO: 1480946 - RNA, 19 nt, Homo sapiens
aagaugauggcgaacuuaa

SEQ ID NO: 1480947 - RNA, 19 nt, Homo sapiens
acacagcuaucuccuucag

SEQ ID NO: 1480948 - RNA, 19 nt, Homo sapiens
ccuaagaagccaacaaacu

SEQ ID NO: 1480949 - RNA, 19 nt, Homo sapiens
ucauuucacccucacauuc

SEQ ID NO: 1480950 - RNA, 19 nt, Homo sapiens
gggcuccaccgcucauaga

SEQ ID NO: 1480951 - RNA, 19 nt, Homo sapiens
ugaucugaguugggaguaa

SEQ ID NO: 1480952 - RNA, 19 nt, Homo sapiens
ccacuggcaccuacuacug

SEQ ID NO: 1480953 - RNA, 19 nt, Homo sapiens
aggagagaccgcauagauu

SEQ ID NO: 1480954 - RNA, 19 nt, Homo sapiens
cauuucacccucacauuca

SEQ ID NO: 1480955 - RNA, 19 nt, Homo sapiens
caccaaaggacuugaucug

SEQ ID NO: 1480956 - RNA, 19 nt, Homo sapiens
ccaacacagcuaucuccuu

SEQ ID NO: 1480957 - RNA, 19 nt, Homo sapiens
agucagcuacuuucaugaa

SEQ ID NO: 1480958 - RNA, 19 nt, Homo sapiens
gcacagcccugcagagaug

SEQ ID NO: 1480959 - RNA, 19 nt, Homo sapiens
gguaggaaaugucucuaaa

SEQ ID NO: 1480960 - RNA, 19 nt, Homo sapiens
gcagagagcgccuccuauu

SEQ ID NO: 1480961 - RNA, 19 nt, Homo sapiens
gcagauggguggcagaaag

SEQ ID NO: 1480962 - RNA, 19 nt, Homo sapiens
ccauaugcauguaaugaaa

SEQ ID NO: 1480963 - RNA, 19 nt, Homo sapiens
gagagcgccuccuauucua

SEQ ID NO: 1480964 - RNA, 19 nt, Homo sapiens
ccucuaauauccacacauu

SEQ ID NO: 1480965 - RNA, 19 nt, Homo sapiens
gaaagcaggaggaggaaga

SEQ ID NO: 1480966 - RNA, 19 nt, Homo sapiens
gagcagagagcgccuccua

SEQ ID NO: 1480967 - RNA, 19 nt, Homo sapiens
gcaaacugcaccugacauu

SEQ ID NO: 1480968 - RNA, 19 nt, Homo sapiens
gggcucaacccucuaauau

SEQ ID NO: 1480969 - RNA, 19 nt, Homo sapiens
gcaaauaccaacauaacca

SEQ ID NO: 1480970 - RNA, 19 nt, Homo sapiens
gcucaacccucuaauaucc

SEQ ID NO: 1480971 - RNA, 19 nt, Homo sapiens
caccaaagaugcacaaggu

SEQ ID NO: 1480972 - RNA, 19 nt, Homo sapiens
aaacugcaccugacauuga

SEQ ID NO: 1480973 - RNA, 19 nt, Homo sapiens
gcagagagacaaacagaca

SEQ ID NO: 1480974 - RNA, 19 nt, Homo sapiens
gaaagcagacagcaaacug

SEQ ID NO: 1480975 - RNA, 19 nt, Homo sapiens
aaacguugaucaaucugaa

SEQ ID NO: 1480976 - RNA, 19 nt, Homo sapiens
gggcaaagcauccuugaag

SEQ ID NO: 1480977 - RNA, 19 nt, Homo sapiens
gugaggauguggagagaga

SEQ ID NO: 1480978 - RNA, 19 nt, Homo sapiens
ugacauuccuucccuccuu

SEQ ID NO: 1480979 - RNA, 19 nt, Homo sapiens
ggaaaugucucuaaaacgu

SEQ ID NO: 1480980 - RNA, 19 nt, Homo sapiens
gcagacagacagacacguu

SEQ ID NO: 1480981 - RNA, 19 nt, Homo sapiens
caaacucaagcccaucuaa

SEQ ID NO: 1480982 - RNA, 19 nt, Homo sapiens
gacaucaggugugggcaaa

SEQ ID NO: 1480983 - RNA, 19 nt, Homo sapiens
gcagacagacaaacagaca

SEQ ID NO: 1480984 - RNA, 19 nt, Homo sapiens
gacagcagauagacagaca

SEQ ID NO: 1480985 - RNA, 19 nt, Homo sapiens
ugccacaaauauucaguuu

SEQ ID NO: 1480986 - RNA, 19 nt, Homo sapiens
gcagacagacaaacaaacu

SEQ ID NO: 1480987 - RNA, 19 nt, Homo sapiens
cauaaccacaucuuccuuu

SEQ ID NO: 1480988 - RNA, 19 nt, Homo sapiens
gaagcuuacagauuggaaa

SEQ ID NO: 1480989 - RNA, 19 nt, Homo sapiens
ccagacagcagacagacaa

SEQ ID NO: 1480990 - RNA, 19 nt, Homo sapiens
cagacaaacagacacauug

SEQ ID NO: 1480991 - RNA, 19 nt, Homo sapiens
ccagacagcagacagacaa

SEQ ID NO: 1480992 - RNA, 19 nt, Homo sapiens
cagggugacuucagugaca

SEQ ID NO: 1480993 - RNA, 19 nt, Homo sapiens
ccggaaagcagacagcaaa

SEQ ID NO: 1480994 - RNA, 19 nt, Homo sapiens
gcagacagacagacaaacu

SEQ ID NO: 1480995 - RNA, 19 nt, Homo sapiens
cugcacagaugacaaacug

SEQ ID NO: 1480996 - RNA, 19 nt, Homo sapiens
cagcagagagacaaacaga

SEQ ID NO: 1480997 - RNA, 19 nt, Homo sapiens
cagcagacagacaaacaaa

SEQ ID NO: 1480998 - RNA, 19 nt, Homo sapiens
agacagaaagacagacaaa

SEQ ID NO: 1480999 - RNA, 19 nt, Homo sapiens
ucaagcccaucuaauccaa

SEQ ID NO: 1481000 - RNA, 19 nt, Homo sapiens
gugccaggcuccuagaaag

SEQ ID NO: 1481001 - RNA, 19 nt, Homo sapiens
gagugaggauguggagaga

SEQ ID NO: 1481002 - RNA, 19 nt, Homo sapiens
ccagacagcagacagaaag

SEQ ID NO: 1481003 - RNA, 19 nt, Homo sapiens
gcuuacagauuggaaacug

SEQ ID NO: 1481004 - RNA, 19 nt, Homo sapiens
gcagacagaaagacagaca

SEQ ID NO: 1481005 - RNA, 19 nt, Homo sapiens
cagcagacagacagacaaa

SEQ ID NO: 1481006 - RNA, 19 nt, Homo sapiens
gggccagggugacuucagu

SEQ ID NO: 1481007 - RNA, 19 nt, Homo sapiens
cagaaagacagacaaacug

SEQ ID NO: 1481008 - RNA, 19 nt, Homo sapiens
gccaagggcagaggaugua

SEQ ID NO: 1481009 - RNA, 19 nt, Homo sapiens
gcagacgcaggccacauug

SEQ ID NO: 1481010 - RNA, 19 nt, Homo sapiens
ggguaggaaaugucucuaa

SEQ ID NO: 1481011 - RNA, 19 nt, Homo sapiens
ggaagcugacgcucacuca

SEQ ID NO: 1481012 - RNA, 19 nt, Homo sapiens
gggcagaggauguaaugag

SEQ ID NO: 1481013 - RNA, 19 nt, Homo sapiens
ccagggaguccagccauuu

SEQ ID NO: 1481014 - RNA, 19 nt, Homo sapiens
gcaacgacucugccugcaa

SEQ ID NO: 1481015 - RNA, 19 nt, Homo sapiens
ugaucaaucugaagcuuac

SEQ ID NO: 1481016 - RNA, 19 nt, Homo sapiens
gcccugcacagaugacaaa

SEQ ID NO: 1481017 - RNA, 19 nt, Homo sapiens
aguggcaaauaccaacaua

SEQ ID NO: 1481018 - RNA, 19 nt, Homo sapiens
gacagcagacagacaaaca

SEQ ID NO: 1481019 - RNA, 19 nt, Homo sapiens
gcagacagacagacacacu

SEQ ID NO: 1481020 - RNA, 19 nt, Homo sapiens
gacagcagacagacaaaca

SEQ ID NO: 1481021 - RNA, 19 nt, Homo sapiens
uuaguugccacaaauauuc

SEQ ID NO: 1481022 - RNA, 19 nt, Homo sapiens
gcagagaugcaaguaagag

SEQ ID NO: 1481023 - RNA, 19 nt, Homo sapiens
cagcagacagacaaacaga

SEQ ID NO: 1481024 - RNA, 19 nt, Homo sapiens
agaccauucuucagaugug

SEQ ID NO: 1481025 - RNA, 19 nt, Homo sapiens
ccaacaggaagaagggaaa

SEQ ID NO: 1481026 - RNA, 19 nt, Homo sapiens
cuagaaagacagggaguug

SEQ ID NO: 1481027 - RNA, 19 nt, Homo sapiens
agagagcgccuccuauucu

SEQ ID NO: 1481028 - RNA, 19 nt, Homo sapiens
cagcagacagaaagacaga

SEQ ID NO: 1481029 - RNA, 19 nt, Homo sapiens
caaacugcaccugacauug

SEQ ID NO: 1481030 - RNA, 19 nt, Homo sapiens
ugagucauuucgcaaacau

SEQ ID NO: 1481031 - RNA, 19 nt, Homo sapiens
gagaugcaaguaagagagu

SEQ ID NO: 1481032 - RNA, 19 nt, Homo sapiens
guugaucaaucugaagcuu

SEQ ID NO: 1481033 - RNA, 19 nt, Homo sapiens
aaacucaagcccaucuaau

SEQ ID NO: 1481034 - RNA, 19 nt, Homo sapiens
cagagagcgccuccuauuc

SEQ ID NO: 1481035 - RNA, 19 nt, Homo sapiens
agucauuucgcaaacauuu

SEQ ID NO: 1481036 - RNA, 19 nt, Homo sapiens
cuaaaacguugaucaaucu

SEQ ID NO: 1481037 - RNA, 19 nt, Homo sapiens
acagacaaacagacacauu

SEQ ID NO: 1481038 - RNA, 19 nt, Homo sapiens
acagaaagacagacaaacu

SEQ ID NO: 1481039 - RNA, 19 nt, Homo sapiens
guugguagccccuggauuu

SEQ ID NO: 1481040 - RNA, 19 nt, Homo sapiens
ccagacagcagacagaaaa

SEQ ID NO: 1481041 - RNA, 19 nt, Homo sapiens
gguccaugcucaggaaguc

SEQ ID NO: 1481042 - RNA, 19 nt, Homo sapiens
agacagacagacacacuuc

SEQ ID NO: 1481043 - RNA, 19 nt, Homo sapiens
ggaaagcagacagcaaacu

SEQ ID NO: 1481044 - RNA, 19 nt, Homo sapiens
gucauuucgcaaacauuua

SEQ ID NO: 1481045 - RNA, 19 nt, Homo sapiens
gacagcagacagaaagaca

SEQ ID NO: 1481046 - RNA, 19 nt, Homo sapiens
gaugccgggugucuuacuc

SEQ ID NO: 1481047 - RNA, 19 nt, Homo sapiens
uaaccacaucuuccuuuua

SEQ ID NO: 1481048 - RNA, 19 nt, Homo sapiens
auaccaacauaaccacauc

SEQ ID NO: 1481049 - RNA, 19 nt, Homo sapiens
ucuaaaacguugaucaauc

SEQ ID NO: 1481050 - RNA, 19 nt, Homo sapiens
gacagcagagagacaaaca

SEQ ID NO: 1481051 - RNA, 19 nt, Homo sapiens
cagagaugcaaguaagaga

SEQ ID NO: 1481052 - RNA, 19 nt, Homo sapiens
gacagcagacagacagaca

SEQ ID NO: 1481053 - RNA, 19 nt, Homo sapiens
gacagcagacagacagaca

SEQ ID NO: 1481054 - RNA, 19 nt, Homo sapiens
gacagcagacagacagaca

SEQ ID NO: 1481055 - RNA, 19 nt, Homo sapiens
ccagauagcuccucauaga

SEQ ID NO: 1481056 - RNA, 19 nt, Homo sapiens
gaacauggcccucgagguu

SEQ ID NO: 1481057 - RNA, 19 nt, Homo sapiens
uauggacgcuggugucuaa

SEQ ID NO: 1481058 - RNA, 19 nt, Homo sapiens
gcacacugcccuucgagua

SEQ ID NO: 1481059 - RNA, 19 nt, Homo sapiens
ggucugcaccuuauacuuu

SEQ ID NO: 1481060 - RNA, 19 nt, Homo sapiens
ggacgcuggugucuaagga

SEQ ID NO: 1481061 - RNA, 19 nt, Homo sapiens
ucaaggauguacccaacuu

SEQ ID NO: 1481062 - RNA, 19 nt, Homo sapiens
gauggaaccuguccuucuc

SEQ ID NO: 1481063 - RNA, 19 nt, Homo sapiens
gacguggacucaccaagga

SEQ ID NO: 1481064 - RNA, 19 nt, Homo sapiens
gcaacuucuuggucacuga

SEQ ID NO: 1481065 - RNA, 19 nt, Homo sapiens
caacuucagcuuccaaauc

SEQ ID NO: 1481066 - RNA, 19 nt, Homo sapiens
gcuggaggcugcacugaag

SEQ ID NO: 1481067 - RNA, 19 nt, Homo sapiens
gggcaugguugggcaguug

SEQ ID NO: 1481068 - RNA, 19 nt, Homo sapiens
gcacugaagaaagcaugua

SEQ ID NO: 1481069 - RNA, 19 nt, Homo sapiens
gcagauggaaccuguccuu

SEQ ID NO: 1481070 - RNA, 19 nt, Homo sapiens
cuggacaggugcugacgua

SEQ ID NO: 1481071 - RNA, 19 nt, Homo sapiens
ccuuauacuuuccuuucua

SEQ ID NO: 1481072 - RNA, 19 nt, Homo sapiens
ccaaggaaccagugcuaug

SEQ ID NO: 1481073 - RNA, 19 nt, Homo sapiens
gccgacaacugcagacaag

SEQ ID NO: 1481074 - RNA, 19 nt, Homo sapiens
ugcaugagcugaacgucuu

SEQ ID NO: 1481075 - RNA, 19 nt, Homo sapiens
ggccuuggucugcaccuua

SEQ ID NO: 1481076 - RNA, 19 nt, Homo sapiens
gccugucucucaacuggaa

SEQ ID NO: 1481077 - RNA, 19 nt, Homo sapiens
ugacggacgcaacuucuug

SEQ ID NO: 1481078 - RNA, 19 nt, Homo sapiens
gcuuccaaaucuccacuga

SEQ ID NO: 1481079 - RNA, 19 nt, Homo sapiens
caaggauguacccaacuuu

SEQ ID NO: 1481080 - RNA, 19 nt, Homo sapiens
gaaagugccccaugugcaa

SEQ ID NO: 1481081 - RNA, 19 nt, Homo sapiens
agauagcuccucauagaga

SEQ ID NO: 1481082 - RNA, 19 nt, Homo sapiens
caaggaaccagugcuaugg

SEQ ID NO: 1481083 - RNA, 19 nt, Homo sapiens
gccuuggucugcaccuuau

SEQ ID NO: 1481084 - RNA, 19 nt, Homo sapiens
ggauguacccaacuuugag

SEQ ID NO: 1481085 - RNA, 19 nt, Homo sapiens
caccaaggaaccagugcua

SEQ ID NO: 1481086 - RNA, 19 nt, Homo sapiens
caccuuauacuuuccuuuc

SEQ ID NO: 1481087 - RNA, 19 nt, Homo sapiens
aacuucagcuuccaaaucu

SEQ ID NO: 1481088 - RNA, 19 nt, Homo sapiens
gcaccuuauacuuuccuuu

SEQ ID NO: 1481089 - RNA, 19 nt, Homo sapiens
ggaggcugcacugaagaaa

SEQ ID NO: 1481090 - RNA, 19 nt, Homo sapiens
cagacaaggcuaccuggau

SEQ ID NO: 1481091 - RNA, 19 nt, Homo sapiens
acacugcccuucgaguaca

SEQ ID NO: 1481092 - RNA, 19 nt, Homo sapiens
ugguguggcugcccgaugu

SEQ ID NO: 1481093 - RNA, 19 nt, Homo sapiens
caacaacuugcccuuugca

SEQ ID NO: 1481094 - RNA, 19 nt, Homo sapiens
gucugcaccuuauacuuuc

SEQ ID NO: 1481095 - RNA, 19 nt, Homo sapiens
ccacucgcguccuggaaac

SEQ ID NO: 1481096 - RNA, 19 nt, Homo sapiens
caaccugcaugagcugaac

SEQ ID NO: 1481097 - RNA, 19 nt, Homo sapiens
cuucagagcuucucgauuu

SEQ ID NO: 1481098 - RNA, 19 nt, Homo sapiens
gcagugcuguugagacuuu

SEQ ID NO: 1481099 - RNA, 19 nt, Homo sapiens
ucaaggaguucaaucagua

SEQ ID NO: 1481100 - RNA, 19 nt, Homo sapiens
gcaccaagcaccucccuua

SEQ ID NO: 1481101 - RNA, 19 nt, Homo sapiens
gcacuggccucucggcaaa

SEQ ID NO: 1481102 - RNA, 19 nt, Homo sapiens
caaauaagcaugagagaga

SEQ ID NO: 1481103 - RNA, 19 nt, Homo sapiens
ccuagaaaguaguaucuua

SEQ ID NO: 1481104 - RNA, 19 nt, Homo sapiens
gaaacaaaguggcaagucu

SEQ ID NO: 1481105 - RNA, 19 nt, Homo sapiens
gaacauuacccuagaaagu

SEQ ID NO: 1481106 - RNA, 19 nt, Homo sapiens
gcacaugguucccugaauc

SEQ ID NO: 1481107 - RNA, 19 nt, Homo sapiens
acaagugcuuugaacauua

SEQ ID NO: 1481108 - RNA, 19 nt, Homo sapiens
guaacacucugccacacua

SEQ ID NO: 1481109 - RNA, 19 nt, Homo sapiens
gcaaagaugagauggaaga

SEQ ID NO: 1481110 - RNA, 19 nt, Homo sapiens
agaaggaaaugaaauguuc

SEQ ID NO: 1481111 - RNA, 19 nt, Homo sapiens
caccaacaguccuuaguuu

SEQ ID NO: 1481112 - RNA, 19 nt, Homo sapiens
guacaagcaugcaccaaca

SEQ ID NO: 1481113 - RNA, 19 nt, Homo sapiens
ccacugcucuggacuaugg

SEQ ID NO: 1481114 - RNA, 19 nt, Homo sapiens
ggaauucagccaccaauca

SEQ ID NO: 1481115 - RNA, 19 nt, Homo sapiens
ugguacaguuggugaauua

SEQ ID NO: 1481116 - RNA, 19 nt, Homo sapiens
ggaguucaaucaguaccua

SEQ ID NO: 1481117 - RNA, 19 nt, Homo sapiens
gaagcucuaugcagaacug

SEQ ID NO: 1481118 - RNA, 19 nt, Homo sapiens
aaacaacuuugguacacaa

SEQ ID NO: 1481119 - RNA, 19 nt, Homo sapiens
aaaggcaacucgcaaagau

SEQ ID NO: 1481120 - RNA, 19 nt, Homo sapiens
gaaaggcaacucgcaaaga

SEQ ID NO: 1481121 - RNA, 19 nt, Homo sapiens
acacuaagcucuguacaag

SEQ ID NO: 1481122 - RNA, 19 nt, Homo sapiens
ucagaaccauaucauguug

SEQ ID NO: 1481123 - RNA, 19 nt, Homo sapiens
gcaccaacaguccuuaguu

SEQ ID NO: 1481124 - RNA, 19 nt, Homo sapiens
gauuggacgucagagcaua

SEQ ID NO: 1481125 - RNA, 19 nt, Homo sapiens
ggaaguaugaagaaggaaa

SEQ ID NO: 1481126 - RNA, 19 nt, Homo sapiens
ggacagaugaaagagaauu

SEQ ID NO: 1481127 - RNA, 19 nt, Homo sapiens
aaggacagaugaaagagaa

SEQ ID NO: 1481128 - RNA, 19 nt, Homo sapiens
cugcagcccuagugccuua

SEQ ID NO: 1481129 - RNA, 19 nt, Homo sapiens
ucgcaaagaugagauggaa

SEQ ID NO: 1481130 - RNA, 19 nt, Homo sapiens
ugacuggauugcucuuuau

SEQ ID NO: 1481131 - RNA, 19 nt, Homo sapiens
gaagaaggaaaugaaaugu

SEQ ID NO: 1481132 - RNA, 19 nt, Homo sapiens
ucaaagaacuacgggaagu

SEQ ID NO: 1481133 - RNA, 19 nt, Homo sapiens
accaaucacugcauucaaa

SEQ ID NO: 1481134 - RNA, 19 nt, Homo sapiens
ggagguugccuguguguuc

SEQ ID NO: 1481135 - RNA, 19 nt, Homo sapiens
ccaagcaccucccuuacca

SEQ ID NO: 1481136 - RNA, 19 nt, Homo sapiens
ugaagaaggaaaugaaaug

SEQ ID NO: 1481137 - RNA, 19 nt, Homo sapiens
gaaguaugaagaaggaaau

SEQ ID NO: 1481138 - RNA, 19 nt, Homo sapiens
uacaguuggugaauuacua

SEQ ID NO: 1481139 - RNA, 19 nt, Homo sapiens
caugguucccugaaucuua

SEQ ID NO: 1481140 - RNA, 19 nt, Homo sapiens
uaacaagugcuuugaacau

SEQ ID NO: 1481141 - RNA, 19 nt, Homo sapiens
guugauaauuuccaagaca

SEQ ID NO: 1481142 - RNA, 19 nt, Homo sapiens
ggacugcuucagaaccaua

SEQ ID NO: 1481143 - RNA, 19 nt, Homo sapiens
gaaccuguaagcaucaaau

SEQ ID NO: 1481144 - RNA, 19 nt, Homo sapiens
gaugguguuuggucaguca

SEQ ID NO: 1481145 - RNA, 19 nt, Homo sapiens
caaagaacuacgggaagua

SEQ ID NO: 1481146 - RNA, 19 nt, Homo sapiens
caagugcuuugaacauuac

SEQ ID NO: 1481147 - RNA, 19 nt, Homo sapiens
guaugaagaaggaaaugaa

SEQ ID NO: 1481148 - RNA, 19 nt, Homo sapiens
cauguacaccuucguggua

SEQ ID NO: 1481149 - RNA, 19 nt, Homo sapiens
gccaggucaucgcaaguuu

SEQ ID NO: 1481150 - RNA, 19 nt, Homo sapiens
gcacgugauccagaaauau

SEQ ID NO: 1481151 - RNA, 19 nt, Homo sapiens
gagggcaacguuuggauug

SEQ ID NO: 1481152 - RNA, 19 nt, Homo sapiens
ccacccaucccuucgguaa

SEQ ID NO: 1481153 - RNA, 19 nt, Homo sapiens
gcucuucggcuuugacuuc

SEQ ID NO: 1481154 - RNA, 19 nt, Homo sapiens
aacaagugcuuugaacauu

SEQ ID NO: 1481155 - RNA, 19 nt, Homo sapiens
gaacuacgggaaguaugaa

SEQ ID NO: 1481156 - RNA, 19 nt, Homo sapiens
acuaagcucuguacaagca

SEQ ID NO: 1481157 - RNA, 19 nt, Homo sapiens
cugaagguguggcucauug

SEQ ID NO: 1481158 - RNA, 19 nt, Homo sapiens
cgggaaguaugaagaagga

SEQ ID NO: 1481159 - RNA, 19 nt, Homo sapiens
ggauggagagggcaacguu

SEQ ID NO: 1481160 - RNA, 19 nt, Homo sapiens
aaauaagcaugagagagaa

SEQ ID NO: 1481161 - RNA, 19 nt, Homo sapiens
agucugcccugaaccugua

SEQ ID NO: 1481162 - RNA, 19 nt, Homo sapiens
caaaggugguuucccucau

SEQ ID NO: 1481163 - RNA, 19 nt, Homo sapiens
uauuggagguugccugugu

SEQ ID NO: 1481164 - RNA, 19 nt, Homo sapiens
aacauuacccuagaaagua

SEQ ID NO: 1481165 - RNA, 19 nt, Homo sapiens
uaacagaaagaaagaggau

SEQ ID NO: 1481166 - RNA, 19 nt, Homo sapiens
aaaggugguuucccucauc

SEQ ID NO: 1481167 - RNA, 19 nt, Homo sapiens
gaaaacaacuuugguacac

SEQ ID NO: 1481168 - RNA, 19 nt, Homo sapiens
cuacaggggugcugacaaa

SEQ ID NO: 1481169 - RNA, 19 nt, Homo sapiens
augacuggauugcucuuua

SEQ ID NO: 1481170 - RNA, 19 nt, Homo sapiens
guaccuaacaagugcuuug

SEQ ID NO: 1481171 - RNA, 19 nt, Homo sapiens
guggaucaucaguauaaua

SEQ ID NO: 1481172 - RNA, 19 nt, Homo sapiens
ucucgccucuuauaacaga

SEQ ID NO: 1481173 - RNA, 19 nt, Homo sapiens
caagacaagcccugaacug

SEQ ID NO: 1481174 - RNA, 19 nt, Homo sapiens
caaacugugucgcaaagcu

SEQ ID NO: 1481175 - RNA, 19 nt, Homo sapiens
caucgcaaguuugacauuc

SEQ ID NO: 1481176 - RNA, 19 nt, Homo sapiens
gagcuucucgauuucauag

SEQ ID NO: 1481177 - RNA, 19 nt, Homo sapiens
gagcguggagccugccauu

SEQ ID NO: 1481178 - RNA, 19 nt, Homo sapiens
gcuucggacugcuucagaa

SEQ ID NO: 1481179 - RNA, 19 nt, Homo sapiens
cuugguggaucaucaguau

SEQ ID NO: 1481180 - RNA, 19 nt, Homo sapiens
ugcacgugauccagaaaua

SEQ ID NO: 1481181 - RNA, 19 nt, Homo sapiens
aauucuuucucgccucuua

SEQ ID NO: 1481182 - RNA, 19 nt, Homo sapiens
guaacucaaggacagauga

SEQ ID NO: 1481183 - RNA, 19 nt, Homo sapiens
acauagccauuuccagugu

SEQ ID NO: 1481184 - RNA, 19 nt, Homo sapiens
gcguggagccugccauuag

SEQ ID NO: 1481185 - RNA, 19 nt, Homo sapiens
agaacuacgggaaguauga

SEQ ID NO: 1481186 - RNA, 19 nt, Homo sapiens
ggugaaggcauucucaucu

SEQ ID NO: 1481187 - RNA, 19 nt, Homo sapiens
ccuaacaagugcuuugaac

SEQ ID NO: 1481188 - RNA, 19 nt, Homo sapiens
ugguggaucaucaguauaa

SEQ ID NO: 1481189 - RNA, 19 nt, Homo sapiens
gcauucucaucuccucaga

SEQ ID NO: 1481190 - RNA, 19 nt, Homo sapiens
caaggacagaugaaagaga

SEQ ID NO: 1481191 - RNA, 19 nt, Homo sapiens
aagcaucaaauaagcauga

SEQ ID NO: 1481192 - RNA, 19 nt, Homo sapiens
ggacgucagagcauauugg

SEQ ID NO: 1481193 - RNA, 19 nt, Homo sapiens
gcaacucgcaaagaugaga

SEQ ID NO: 1481194 - RNA, 19 nt, Homo sapiens
cuucagaaccauaucaugu

SEQ ID NO: 1481195 - RNA, 19 nt, Homo sapiens
uagugaagcuaaucaagac

SEQ ID NO: 1481196 - RNA, 19 nt, Homo sapiens
gauggagagggcaacguuu

SEQ ID NO: 1481197 - RNA, 19 nt, Homo sapiens
gcucagagaucauaaauuu

SEQ ID NO: 1481198 - RNA, 19 nt, Homo sapiens
gcucaggacuuaaguaauu

SEQ ID NO: 1481199 - RNA, 19 nt, Homo sapiens
agagaaagcuucaggagua

SEQ ID NO: 1481200 - RNA, 19 nt, Homo sapiens
ggaaacaacuagaagaaug

SEQ ID NO: 1481201 - RNA, 19 nt, Homo sapiens
gaagguuggucccacaaua

SEQ ID NO: 1481202 - RNA, 19 nt, Homo sapiens
gaauggaccuugacagaug

SEQ ID NO: 1481203 - RNA, 19 nt, Homo sapiens
caggagaacugucaagaaa

SEQ ID NO: 1481204 - RNA, 19 nt, Homo sapiens
gcaggaacacgauuuagua

SEQ ID NO: 1481205 - RNA, 19 nt, Homo sapiens
uggaagaucugaacuuuga

SEQ ID NO: 1481206 - RNA, 19 nt, Homo sapiens
ggaacacgauuuaguagug

SEQ ID NO: 1481207 - RNA, 19 nt, Homo sapiens
uggaagagcuggccaagaa

SEQ ID NO: 1481208 - RNA, 19 nt, Homo sapiens
gcaaaguuguuggcaagua

SEQ ID NO: 1481209 - RNA, 19 nt, Homo sapiens
caaaguuguuggcaaguaa

SEQ ID NO: 1481210 - RNA, 19 nt, Homo sapiens
gaacaagacagcucccaaa

SEQ ID NO: 1481211 - RNA, 19 nt, Homo sapiens
gguaucaaauuacagauug

SEQ ID NO: 1481212 - RNA, 19 nt, Homo sapiens
ggguauagcuggccugaga

SEQ ID NO: 1481213 - RNA, 19 nt, Homo sapiens
gguccaaucccuagaauaa

SEQ ID NO: 1481214 - RNA, 19 nt, Homo sapiens
gauuacuucugacucuuua

SEQ ID NO: 1481215 - RNA, 19 nt, Homo sapiens
gugcaagacaugaaauuua

SEQ ID NO: 1481216 - RNA, 19 nt, Homo sapiens
gcggaaaguuguucuuaau

SEQ ID NO: 1481217 - RNA, 19 nt, Homo sapiens
guuaacagaucaaggaaau

SEQ ID NO: 1481218 - RNA, 19 nt, Homo sapiens
ugagagagaauucuuguuu

SEQ ID NO: 1481219 - RNA, 19 nt, Homo sapiens
gaaccaacauaagacaaga

SEQ ID NO: 1481220 - RNA, 19 nt, Homo sapiens
cagcauaauuauccuggua

SEQ ID NO: 1481221 - RNA, 19 nt, Homo sapiens
aggcagaacagcauaauua

SEQ ID NO: 1481222 - RNA, 19 nt, Homo sapiens
uauggacgcucaggacuua

SEQ ID NO: 1481223 - RNA, 19 nt, Homo sapiens
gaaggaaacaacuagaaga

SEQ ID NO: 1481224 - RNA, 19 nt, Homo sapiens
aaagaaagcacaacucgaa

SEQ ID NO: 1481225 - RNA, 19 nt, Homo sapiens
gcaguuaacagaucaagga

SEQ ID NO: 1481226 - RNA, 19 nt, Homo sapiens
caaagcagcaguuaacaga

SEQ ID NO: 1481227 - RNA, 19 nt, Homo sapiens
cuacuuuaaucccaacaua

SEQ ID NO: 1481228 - RNA, 19 nt, Homo sapiens
ggguguaccuucuaaugaa

SEQ ID NO: 1481229 - RNA, 19 nt, Homo sapiens
uaaacggccuccuauggaa

SEQ ID NO: 1481230 - RNA, 19 nt, Homo sapiens
ccaaacaaacccaaauauu

SEQ ID NO: 1481231 - RNA, 19 nt, Homo sapiens
gaauuggcauggucgucua

SEQ ID NO: 1481232 - RNA, 19 nt, Homo sapiens
caacaccaauacaagaguu

SEQ ID NO: 1481233 - RNA, 19 nt, Homo sapiens
acaguauccuuguaaauga

SEQ ID NO: 1481234 - RNA, 19 nt, Homo sapiens
caagaauaauugccagaau

SEQ ID NO: 1481235 - RNA, 19 nt, Homo sapiens
ucacugggcuuacucucaa

SEQ ID NO: 1481236 - RNA, 19 nt, Homo sapiens
uaaaugggaugccggaagu

SEQ ID NO: 1481237 - RNA, 19 nt, Homo sapiens
aagaauggcagaaaucuaa

SEQ ID NO: 1481238 - RNA, 19 nt, Homo sapiens
gaagaauggcagaaaucua

SEQ ID NO: 1481239 - RNA, 19 nt, Homo sapiens
caaccaccuucuaaaucua

SEQ ID NO: 1481240 - RNA, 19 nt, Homo sapiens
ggaagugcaagacaugaaa

SEQ ID NO: 1481241 - RNA, 19 nt, Homo sapiens
gauguuaccagccauguug

SEQ ID NO: 1481242 - RNA, 19 nt, Homo sapiens
gacacuugcuucuucaguu

SEQ ID NO: 1481243 - RNA, 19 nt, Homo sapiens
ucugugaagucuugucuuu

SEQ ID NO: 1481244 - RNA, 19 nt, Homo sapiens
gggcaacuauuuguggaaa

SEQ ID NO: 1481245 - RNA, 19 nt, Homo sapiens
cguggaagaucugaacuuu

SEQ ID NO: 1481246 - RNA, 19 nt, Homo sapiens
gauggaaucugugaagucu

SEQ ID NO: 1481247 - RNA, 19 nt, Homo sapiens
gcagaaaucuaagggaaaa

SEQ ID NO: 1481248 - RNA, 19 nt, Homo sapiens
acaccaagccuuaucuaaa

SEQ ID NO: 1481249 - RNA, 19 nt, Homo sapiens
gaagagcuggccaagaaga

SEQ ID NO: 1481250 - RNA, 19 nt, Homo sapiens
ucaaccaccuucuaaaucu

SEQ ID NO: 1481251 - RNA, 19 nt, Homo sapiens
gaaucaaccaccuucuaaa

SEQ ID NO: 1481252 - RNA, 19 nt, Homo sapiens
gggaaaaucuuugcuuuau

SEQ ID NO: 1481253 - RNA, 19 nt, Homo sapiens
uggaaucugugaagucuug

SEQ ID NO: 1481254 - RNA, 19 nt, Homo sapiens
gguguaccuucuaaugaaa

SEQ ID NO: 1481255 - RNA, 19 nt, Homo sapiens
ucaaaccccugaaucauaa

SEQ ID NO: 1481256 - RNA, 19 nt, Homo sapiens
uaacauauuguccagcauu

SEQ ID NO: 1481257 - RNA, 19 nt, Homo sapiens
aaagguccaucagcauuaa

SEQ ID NO: 1481258 - RNA, 19 nt, Homo sapiens
cuagaagaauggcagaaau

SEQ ID NO: 1481259 - RNA, 19 nt, Homo sapiens
gagagagaauucuuguuuu

SEQ ID NO: 1481260 - RNA, 19 nt, Homo sapiens
caucacaguauccuuguaa

SEQ ID NO: 1481261 - RNA, 19 nt, Homo sapiens
gagggcaaguucuuucauc

SEQ ID NO: 1481262 - RNA, 19 nt, Homo sapiens
ucgaagagcggcagagaaa

SEQ ID NO: 1481263 - RNA, 19 nt, Homo sapiens
uugcaagacucaaacagaa

SEQ ID NO: 1481264 - RNA, 19 nt, Homo sapiens
cagcccagaccaccuaaua

SEQ ID NO: 1481265 - RNA, 19 nt, Homo sapiens
gguuuuaccuuagucauua

SEQ ID NO: 1481266 - RNA, 19 nt, Homo sapiens
gaaacaacuagaagaaugg

SEQ ID NO: 1481267 - RNA, 19 nt, Homo sapiens
aaaccuagucaacacauuu

SEQ ID NO: 1481268 - RNA, 19 nt, Homo sapiens
ugaaacacaauccugaauu

SEQ ID NO: 1481269 - RNA, 19 nt, Homo sapiens
aagaauaauugccagaauc

SEQ ID NO: 1481270 - RNA, 19 nt, Homo sapiens
caccaagccuuaucuaaaa

SEQ ID NO: 1481271 - RNA, 19 nt, Homo sapiens
ggauuacuucugacucuuu

SEQ ID NO: 1481272 - RNA, 19 nt, Homo sapiens
gggcaacaccaauacaaga

SEQ ID NO: 1481273 - RNA, 19 nt, Homo sapiens
gaaagcacaacucgaacug

SEQ ID NO: 1481274 - RNA, 19 nt, Homo sapiens
gcugaugucacaaccguaa

SEQ ID NO: 1481275 - RNA, 19 nt, Homo sapiens
gcagagggcaaguucuuuc

SEQ ID NO: 1481276 - RNA, 19 nt, Homo sapiens
guaguggcuucucuugaug

SEQ ID NO: 1481277 - RNA, 19 nt, Homo sapiens
cagagaugcugcaggaaca

SEQ ID NO: 1481278 - RNA, 19 nt, Homo sapiens
agucuugucuuucuccaaa

SEQ ID NO: 1481279 - RNA, 19 nt, Homo sapiens
uauaugaagaggccauuaa

SEQ ID NO: 1481280 - RNA, 19 nt, Homo sapiens
gaucugcaaagcaaaguug

SEQ ID NO: 1481281 - RNA, 19 nt, Homo sapiens
gaugaaacacaauccugaa

SEQ ID NO: 1481282 - RNA, 19 nt, Homo sapiens
gaaauuuaucacuccugua

SEQ ID NO: 1481283 - RNA, 19 nt, Homo sapiens
cggaaaguuguucuuaaua

SEQ ID NO: 1481284 - RNA, 19 nt, Homo sapiens
gaucgaaggaaacaacuag

SEQ ID NO: 1481285 - RNA, 19 nt, Homo sapiens
gcaacuauuuguggaaagg

SEQ ID NO: 1481286 - RNA, 19 nt, Homo sapiens
uccaaucccuagaauaaau

SEQ ID NO: 1481287 - RNA, 19 nt, Homo sapiens
gcauaauuauccugguauc

SEQ ID NO: 1481288 - RNA, 19 nt, Homo sapiens
gaaggcaacagcagaggau

SEQ ID NO: 1481289 - RNA, 19 nt, Homo sapiens
caagacagcucccaaaacu

SEQ ID NO: 1481290 - RNA, 19 nt, Homo sapiens
uugaugaacuguuagaagu

SEQ ID NO: 1481291 - RNA, 19 nt, Homo sapiens
gcagaacagcauaauuauc

SEQ ID NO: 1481292 - RNA, 19 nt, Homo sapiens
caagaguugcggaaaguug

SEQ ID NO: 1481293 - RNA, 19 nt, Homo sapiens
uuauugggcuauaugaaga

SEQ ID NO: 1481294 - RNA, 19 nt, Homo sapiens
ggccuccuauggaacuuaa

SEQ ID NO: 1481295 - RNA, 19 nt, Homo sapiens
cuacaaagcagcaguuaac

SEQ ID NO: 1481296 - RNA, 19 nt, Homo sapiens
ucaguucuuugcucagcua

SEQ ID NO: 1481297 - RNA, 19 nt, Homo sapiens
aaacggagcugcugaagga

SEQ ID NO: 1481298 - RNA, 19 nt, Homo sapiens
gaagagaaccaucaugcaa

SEQ ID NO: 1481299 - RNA, 19 nt, Homo sapiens
ggaaaucacagaucaggaa

SEQ ID NO: 1481300 - RNA, 19 nt, Homo sapiens
gagauggacuggucagaca

SEQ ID NO: 1481301 - RNA, 19 nt, Homo sapiens
gaggugcccuucuccauca

SEQ ID NO: 1481302 - RNA, 19 nt, Homo sapiens
gagcugcccugcaaagagu

SEQ ID NO: 1481303 - RNA, 19 nt, Homo sapiens
gaaggaagccgagcucauc

SEQ ID NO: 1481304 - RNA, 19 nt, Homo sapiens
gcaaccggcugaccacaca

SEQ ID NO: 1481305 - RNA, 19 nt, Homo sapiens
ccacagaggugcccuucuc

SEQ ID NO: 1481306 - RNA, 19 nt, Homo sapiens
gaccaacagucucuucauc

SEQ ID NO: 1481307 - RNA, 19 nt, Homo sapiens
ucacagcacugcgagagaa

SEQ ID NO: 1481308 - RNA, 19 nt, Homo sapiens
ggacuggucagacaagaug

SEQ ID NO: 1481309 - RNA, 19 nt, Homo sapiens
gagcucauccggaacauuc

SEQ ID NO: 1481310 - RNA, 19 nt, Homo sapiens
ucacagaucaggaacacaa

SEQ ID NO: 1481311 - RNA, 19 nt, Homo sapiens
ccaacagucucuucaucga

SEQ ID NO: 1481312 - RNA, 19 nt, Homo sapiens
uggaggagcugaacauguc

SEQ ID NO: 1481313 - RNA, 19 nt, Homo sapiens
caaggagaccugcgagaug

SEQ ID NO: 1481314 - RNA, 19 nt, Homo sapiens
caacguggcggcacugaag

SEQ ID NO: 1481315 - RNA, 19 nt, Homo sapiens
ugaagcaggccaucaagga

SEQ ID NO: 1481316 - RNA, 19 nt, Homo sapiens
acaagacacugcgggaaau

SEQ ID NO: 1481317 - RNA, 19 nt, Homo sapiens
acaugagccuggagaagga

SEQ ID NO: 1481318 - RNA, 19 nt, Homo sapiens
caucaccaccugcacaaga

SEQ ID NO: 1481319 - RNA, 19 nt, Homo sapiens
cacaagacacugcgggaaa

SEQ ID NO: 1481320 - RNA, 19 nt, Homo sapiens
gcacugaagcaggccauca

SEQ ID NO: 1481321 - RNA, 19 nt, Homo sapiens
caagauggaggccuacaac

SEQ ID NO: 1481322 - RNA, 19 nt, Homo sapiens
aguucaggcuguugaguga

SEQ ID NO: 1481323 - RNA, 19 nt, Homo sapiens
caggagcugcugaagagaa

SEQ ID NO: 1481324 - RNA, 19 nt, Homo sapiens
guacuccaccaccuuccaa

SEQ ID NO: 1481325 - RNA, 19 nt, Homo sapiens
ugcgggaaaucacagauca

SEQ ID NO: 1481326 - RNA, 19 nt, Homo sapiens
gcugguggacugcauccuu

SEQ ID NO: 1481327 - RNA, 19 nt, Homo sapiens
caaguucacgcaggacaau

SEQ ID NO: 1481328 - RNA, 19 nt, Homo sapiens
ucgaggacauccacaugag

SEQ ID NO: 1481329 - RNA, 19 nt, Homo sapiens
gcaagcagugagccagauc

SEQ ID NO: 1481330 - RNA, 19 nt, Homo sapiens
ggaaacggagcugcugaag

SEQ ID NO: 1481331 - RNA, 19 nt, Homo sapiens
gcaccauggcgcagacagu

SEQ ID NO: 1481332 - RNA, 19 nt, Homo sapiens
uccaccaccuuccaagaga

SEQ ID NO: 1481333 - RNA, 19 nt, Homo sapiens
gaagaaagcagacaggaaa

SEQ ID NO: 1481334 - RNA, 19 nt, Homo sapiens
aaacaucucucucuucuga

SEQ ID NO: 1481335 - RNA, 19 nt, Homo sapiens
uagcagugguuuagaauua

SEQ ID NO: 1481336 - RNA, 19 nt, Homo sapiens
ggucaaaccuucacccuau

SEQ ID NO: 1481337 - RNA, 19 nt, Homo sapiens
cauaacaacucuccuaaug

SEQ ID NO: 1481338 - RNA, 19 nt, Homo sapiens
gagcaucggccuuucuuua

SEQ ID NO: 1481339 - RNA, 19 nt, Homo sapiens
gcacagugguuaacagugu

SEQ ID NO: 1481340 - RNA, 19 nt, Homo sapiens
gggaacaaauggugucgua

SEQ ID NO: 1481341 - RNA, 19 nt, Homo sapiens
ggagguaguuuagaaaguu

SEQ ID NO: 1481342 - RNA, 19 nt, Homo sapiens
gaaaagagacucagagaaa

SEQ ID NO: 1481343 - RNA, 19 nt, Homo sapiens
ggguuaagcuuugcaaauu

SEQ ID NO: 1481344 - RNA, 19 nt, Homo sapiens
ccuaauaccuucucacugu

SEQ ID NO: 1481345 - RNA, 19 nt, Homo sapiens
aaauuuggcuucccaggua

SEQ ID NO: 1481346 - RNA, 19 nt, Homo sapiens
ccaauuaacuaucuguugu

SEQ ID NO: 1481347 - RNA, 19 nt, Homo sapiens
gaaacuguguucucuaguc

SEQ ID NO: 1481348 - RNA, 19 nt, Homo sapiens
guaagcaaccucccacuuu

SEQ ID NO: 1481349 - RNA, 19 nt, Homo sapiens
guauagcagugguuuagaa

SEQ ID NO: 1481350 - RNA, 19 nt, Homo sapiens
gaaccggcguuucagaugu

SEQ ID NO: 1481351 - RNA, 19 nt, Homo sapiens
gaagaagggcuccguguuc

SEQ ID NO: 1481352 - RNA, 19 nt, Homo sapiens
caaacaacccuauuacuuc

SEQ ID NO: 1481353 - RNA, 19 nt, Homo sapiens
gguuaagcuuugcaaauuu

SEQ ID NO: 1481354 - RNA, 19 nt, Homo sapiens
ccagagaugugaaguuauc

SEQ ID NO: 1481355 - RNA, 19 nt, Homo sapiens
ucccagagaugugaaguua

SEQ ID NO: 1481356 - RNA, 19 nt, Homo sapiens
aaacaacccuauuacuuca

SEQ ID NO: 1481357 - RNA, 19 nt, Homo sapiens
ucaauacucccacagauaa

SEQ ID NO: 1481358 - RNA, 19 nt, Homo sapiens
gcugagaggccauuucaaa

SEQ ID NO: 1481359 - RNA, 19 nt, Homo sapiens
uaagcaaccucccacuuug

SEQ ID NO: 1481360 - RNA, 19 nt, Homo sapiens
gaugugaaguuaucaaggu

SEQ ID NO: 1481361 - RNA, 19 nt, Homo sapiens
ucacuuauuuccaagaguu

SEQ ID NO: 1481362 - RNA, 19 nt, Homo sapiens
ggacuccucugcucaccuu

SEQ ID NO: 1481363 - RNA, 19 nt, Homo sapiens
ucaaacaacccuauuacuu

SEQ ID NO: 1481364 - RNA, 19 nt, Homo sapiens
cggccaagcucccuccuaa

SEQ ID NO: 1481365 - RNA, 19 nt, Homo sapiens
uuaacuaucuguuguguca

SEQ ID NO: 1481366 - RNA, 19 nt, Homo sapiens
guacgaguguguauguaug

SEQ ID NO: 1481367 - RNA, 19 nt, Homo sapiens
cuaaucccuugguaacuua

SEQ ID NO: 1481368 - RNA, 19 nt, Homo sapiens
gagguaguuuagaaaguuu

SEQ ID NO: 1481369 - RNA, 19 nt, Homo sapiens
guuaagcuuugcaaauuug

SEQ ID NO: 1481370 - RNA, 19 nt, Homo sapiens
gcuauacaccaacagcuua

SEQ ID NO: 1481371 - RNA, 19 nt, Homo sapiens
uuaagcaucucacuaguuc

SEQ ID NO: 1481372 - RNA, 19 nt, Homo sapiens
gagaggccauuucaaaguc

SEQ ID NO: 1481373 - RNA, 19 nt, Homo sapiens
gcaucucacuaguuccuuu

SEQ ID NO: 1481374 - RNA, 19 nt, Homo sapiens
gaacugaguagaagcaaag

SEQ ID NO: 1481375 - RNA, 19 nt, Homo sapiens
gaguguguauguaugugua

SEQ ID NO: 1481376 - RNA, 19 nt, Homo sapiens
gagcuugaacugaguagaa

SEQ ID NO: 1481377 - RNA, 19 nt, Homo sapiens
agaugagacuugccaguuu

SEQ ID NO: 1481378 - RNA, 19 nt, Homo sapiens
gccaagcucccuccuaauu

SEQ ID NO: 1481379 - RNA, 19 nt, Homo sapiens
uuaaauguauggcugcuau

SEQ ID NO: 1481380 - RNA, 19 nt, Homo sapiens
gaacucuccucuucuuacu

SEQ ID NO: 1481381 - RNA, 19 nt, Homo sapiens
gacuggaacucuccucuuc

SEQ ID NO: 1481382 - RNA, 19 nt, Homo sapiens
ugacugauauuuagagaac

SEQ ID NO: 1481383 - RNA, 19 nt, Homo sapiens
ggucaauacucccacagau

SEQ ID NO: 1481384 - RNA, 19 nt, Homo sapiens
ggaagaagggcuccguguu

SEQ ID NO: 1481385 - RNA, 19 nt, Homo sapiens
ggaaucuuguugccugaga

SEQ ID NO: 1481386 - RNA, 19 nt, Homo sapiens
uuacauguguuugcccaua

SEQ ID NO: 1481387 - RNA, 19 nt, Homo sapiens
gugcaacaccuuccagaaa

SEQ ID NO: 1481388 - RNA, 19 nt, Homo sapiens
guaaggugagccaacguua

SEQ ID NO: 1481389 - RNA, 19 nt, Homo sapiens
guagaagcaaagaaucaua

SEQ ID NO: 1481390 - RNA, 19 nt, Homo sapiens
ggggagaacuaauuauauu

SEQ ID NO: 1481391 - RNA, 19 nt, Homo sapiens
gcggugggcacuugguuua

SEQ ID NO: 1481392 - RNA, 19 nt, Homo sapiens
uuccaaggauggucguuua

SEQ ID NO: 1481393 - RNA, 19 nt, Homo sapiens
gaucccaggcuuacucuga

SEQ ID NO: 1481394 - RNA, 19 nt, Homo sapiens
gagacuuccuggucaauac

SEQ ID NO: 1481395 - RNA, 19 nt, Homo sapiens
cuaauaccuucucacugua

SEQ ID NO: 1481396 - RNA, 19 nt, Homo sapiens
uuacagaaccggcguuuca

SEQ ID NO: 1481397 - RNA, 19 nt, Homo sapiens
ucaccuuaguccuugauuu

SEQ ID NO: 1481398 - RNA, 19 nt, Homo sapiens
cagcaucuuucccaccauu

SEQ ID NO: 1481399 - RNA, 19 nt, Homo sapiens
uaacuuaagcgccucugaa

SEQ ID NO: 1481400 - RNA, 19 nt, Homo sapiens
ccuaaucccuugguaacuu

SEQ ID NO: 1481401 - RNA, 19 nt, Homo sapiens
ccacuuggcagaacugaug

SEQ ID NO: 1481402 - RNA, 19 nt, Homo sapiens
uuauucugcucccgacuua

SEQ ID NO: 1481403 - RNA, 19 nt, Homo sapiens
ucaaaccuucacccuauua

SEQ ID NO: 1481404 - RNA, 19 nt, Homo sapiens
gagcagagaagggaacaga

SEQ ID NO: 1481405 - RNA, 19 nt, Homo sapiens
cguuucagauguuuauuug

SEQ ID NO: 1481406 - RNA, 19 nt, Homo sapiens
gaguagaagcaaagaauca

SEQ ID NO: 1481407 - RNA, 19 nt, Homo sapiens
agucucaguuccacaaauu

SEQ ID NO: 1481408 - RNA, 19 nt, Homo sapiens
aaccuucacccuauuauuu

SEQ ID NO: 1481409 - RNA, 19 nt, Homo sapiens
ccaacaacaucacucaaac

SEQ ID NO: 1481410 - RNA, 19 nt, Homo sapiens
aaacuuggaaggaaaccua

SEQ ID NO: 1481411 - RNA, 19 nt, Homo sapiens
gaacccacaacucauaaca

SEQ ID NO: 1481412 - RNA, 19 nt, Homo sapiens
auacacaaauccaucuuuc

SEQ ID NO: 1481413 - RNA, 19 nt, Homo sapiens
gucaauacucccacagaua

SEQ ID NO: 1481414 - RNA, 19 nt, Homo sapiens
cauaggagcugagcauagg

SEQ ID NO: 1481415 - RNA, 19 nt, Homo sapiens
gagaacaagacuaaaccaa

SEQ ID NO: 1481416 - RNA, 19 nt, Homo sapiens
gaugagacuugccaguuuu

SEQ ID NO: 1481417 - RNA, 19 nt, Homo sapiens
gaggauuggguuaagcuuu

SEQ ID NO: 1481418 - RNA, 19 nt, Homo sapiens
gggagguaguuuagaaagu

SEQ ID NO: 1481419 - RNA, 19 nt, Homo sapiens
aaugaacugucucuggauu

SEQ ID NO: 1481420 - RNA, 19 nt, Homo sapiens
gagaaggcagagagaagaa

SEQ ID NO: 1481421 - RNA, 19 nt, Homo sapiens
gcagugguuuagaauuagu

SEQ ID NO: 1481422 - RNA, 19 nt, Homo sapiens
gaaagcagacaggaaacga

SEQ ID NO: 1481423 - RNA, 19 nt, Homo sapiens
caucauacagucccagaga

SEQ ID NO: 1481424 - RNA, 19 nt, Homo sapiens
caacaacaucacucaaaca

SEQ ID NO: 1481425 - RNA, 19 nt, Homo sapiens
acauguguuugcccauaua

SEQ ID NO: 1481426 - RNA, 19 nt, Homo sapiens
gagaaggucgucacagucu

SEQ ID NO: 1481427 - RNA, 19 nt, Homo sapiens
gaagaggcgagggcaagaa

SEQ ID NO: 1481428 - RNA, 19 nt, Homo sapiens
ugacacccacugcguauug

SEQ ID NO: 1481429 - RNA, 19 nt, Homo sapiens
uaaacuugcacagugguua

SEQ ID NO: 1481430 - RNA, 19 nt, Homo sapiens
ggaucugcuuauacacaaa

SEQ ID NO: 1481431 - RNA, 19 nt, Homo sapiens
uggagaaggucgucacagu

SEQ ID NO: 1481432 - RNA, 19 nt, Homo sapiens
gaagggcuccguguuccaa

SEQ ID NO: 1481433 - RNA, 19 nt, Homo sapiens
gaacuuaaccuuauuagga

SEQ ID NO: 1481434 - RNA, 19 nt, Homo sapiens
gaaagagaacuuaaccuua

SEQ ID NO: 1481435 - RNA, 19 nt, Homo sapiens
caaagaaagugauggacua

SEQ ID NO: 1481436 - RNA, 19 nt, Homo sapiens
ggaagacuauugccuuauu

SEQ ID NO: 1481437 - RNA, 19 nt, Homo sapiens
gcacugagcugaggucaug

SEQ ID NO: 1481438 - RNA, 19 nt, Homo sapiens
gcaauucucugaugaccuu

SEQ ID NO: 1481439 - RNA, 19 nt, Homo sapiens
gagcugaggucaugccauu

SEQ ID NO: 1481440 - RNA, 19 nt, Homo sapiens
gaagacuauugccuuauuu

SEQ ID NO: 1481441 - RNA, 19 nt, Homo sapiens
gaaacacuuccacuacuua

SEQ ID NO: 1481442 - RNA, 19 nt, Homo sapiens
gaagcaauuuguacguauu

SEQ ID NO: 1481443 - RNA, 19 nt, Homo sapiens
guagaacgcuguguauuuc

SEQ ID NO: 1481444 - RNA, 19 nt, Homo sapiens
gguagaacgcuguguauuu

SEQ ID NO: 1481445 - RNA, 19 nt, Homo sapiens
gauguggaaugaagcaauu

SEQ ID NO: 1481446 - RNA, 19 nt, Homo sapiens
caagaaaacuuuacaagga

SEQ ID NO: 1481447 - RNA, 19 nt, Homo sapiens
ggaaccagcgacucaguua

SEQ ID NO: 1481448 - RNA, 19 nt, Homo sapiens
uaaaucugcuacucaggua

SEQ ID NO: 1481449 - RNA, 19 nt, Homo sapiens
gaaggagaaucgcuugaag

SEQ ID NO: 1481450 - RNA, 19 nt, Homo sapiens
agaaagugauggacuagaa

SEQ ID NO: 1481451 - RNA, 19 nt, Homo sapiens
ccagauuucuucuugaaug

SEQ ID NO: 1481452 - RNA, 19 nt, Homo sapiens
ugacagauguggaaugaag

SEQ ID NO: 1481453 - RNA, 19 nt, Homo sapiens
ugacauagacacuagguuu

SEQ ID NO: 1481454 - RNA, 19 nt, Homo sapiens
aaagguaccugcaaauuac

SEQ ID NO: 1481455 - RNA, 19 nt, Homo sapiens
gaagacacaaaucaagaaa

SEQ ID NO: 1481456 - RNA, 19 nt, Homo sapiens
cuaaugggauuuucacuua

SEQ ID NO: 1481457 - RNA, 19 nt, Homo sapiens
gaaagugauggacuagaaa

SEQ ID NO: 1481458 - RNA, 19 nt, Homo sapiens
gcgacucaguuauuucaaa

SEQ ID NO: 1481459 - RNA, 19 nt, Homo sapiens
gacuagaaaugacagaugu

SEQ ID NO: 1481460 - RNA, 19 nt, Homo sapiens
uuacagcaauucucugaug

SEQ ID NO: 1481461 - RNA, 19 nt, Homo sapiens
gcaaaacuccgucucaaaa

SEQ ID NO: 1481462 - RNA, 19 nt, Homo sapiens
ugaaagagaacuuaaccuu

SEQ ID NO: 1481463 - RNA, 19 nt, Homo sapiens
guacguauuaccaaagaaa

SEQ ID NO: 1481464 - RNA, 19 nt, Homo sapiens
ggaaggagaaucgcuugaa

SEQ ID NO: 1481465 - RNA, 19 nt, Homo sapiens
ggaaugaagcaauuuguac

SEQ ID NO: 1481466 - RNA, 19 nt, Homo sapiens
aaugacagauguggaauga

SEQ ID NO: 1481467 - RNA, 19 nt, Homo sapiens
agaaacacuuccacuacuu

SEQ ID NO: 1481468 - RNA, 19 nt, Homo sapiens
ugaagcaauuuguacguau

SEQ ID NO: 1481469 - RNA, 19 nt, Homo sapiens
ggacuagaaaugacagaug

SEQ ID NO: 1481470 - RNA, 19 nt, Homo sapiens
cuaaaugccaguccaaaga

SEQ ID NO: 1481471 - RNA, 19 nt, Homo sapiens
cuacucagguaucugcuau

SEQ ID NO: 1481472 - RNA, 19 nt, Homo sapiens
agugguauaugucaaagaa

SEQ ID NO: 1481473 - RNA, 19 nt, Homo sapiens
ggaaagccuuggguucagu

SEQ ID NO: 1481474 - RNA, 19 nt, Homo sapiens
agaaaugacagauguggaa

SEQ ID NO: 1481475 - RNA, 19 nt, Homo sapiens
gcuguguauuucaagagua

SEQ ID NO: 1481476 - RNA, 19 nt, Homo sapiens
ggccaaggcgggucaauca

SEQ ID NO: 1481477 - RNA, 19 nt, Homo sapiens
aaaagguaccugcaaauua

SEQ ID NO: 1481478 - RNA, 19 nt, Homo sapiens
cgccagauuucuucuugaa

SEQ ID NO: 1481479 - RNA, 19 nt, Homo sapiens
auggaagacuauugccuua

SEQ ID NO: 1481480 - RNA, 19 nt, Homo sapiens
ugaugaccuugauauggua

SEQ ID NO: 1481481 - RNA, 19 nt, Homo sapiens
gaccccaucucuacuaaaa

SEQ ID NO: 1481482 - RNA, 19 nt, Homo sapiens
uagaagacacaaaucaaga

SEQ ID NO: 1481483 - RNA, 19 nt, Homo sapiens
gaaccagcgacucaguuau

SEQ ID NO: 1481484 - RNA, 19 nt, Homo sapiens
ucacauuuguucagcuauc

SEQ ID NO: 1481485 - RNA, 19 nt, Homo sapiens
caagauucaaagcagauuu

SEQ ID NO: 1481486 - RNA, 19 nt, Homo sapiens
ccgaugacauagacacuag

SEQ ID NO: 1481487 - RNA, 19 nt, Homo sapiens
aaacacuuccacuacuuaa

SEQ ID NO: 1481488 - RNA, 19 nt, Homo sapiens
uacagcaauucucugauga

SEQ ID NO: 1481489 - RNA, 19 nt, Homo sapiens
gcaguugcuuuagggugaa

SEQ ID NO: 1481490 - RNA, 19 nt, Homo sapiens
gaaaugacagauguggaau

SEQ ID NO: 1481491 - RNA, 19 nt, Homo sapiens
ucacuuaguaaaucugcua

SEQ ID NO: 1481492 - RNA, 19 nt, Homo sapiens
cugaugaccuugauauggu

SEQ ID NO: 1481493 - RNA, 19 nt, Homo sapiens
cuucuugaauggcaaccua

SEQ ID NO: 1481494 - RNA, 19 nt, Homo sapiens
cuguguauuucaagaguaa

SEQ ID NO: 1481495 - RNA, 19 nt, Homo sapiens
gagcaaaacuccgucucaa

SEQ ID NO: 1481496 - RNA, 19 nt, Homo sapiens
gguguugaaagagaacuua

SEQ ID NO: 1481497 - RNA, 19 nt, Homo sapiens
uuaauacgagggacugaaa

SEQ ID NO: 1481498 - RNA, 19 nt, Homo sapiens
agccuuggguucaguggua

SEQ ID NO: 1481499 - RNA, 19 nt, Homo sapiens
uugaggagacuaacaauuc

SEQ ID NO: 1481500 - RNA, 19 nt, Homo sapiens
agaagacacaaaucaagaa

SEQ ID NO: 1481501 - RNA, 19 nt, Homo sapiens
agaacgcuguguauuucaa

SEQ ID NO: 1481502 - RNA, 19 nt, Homo sapiens
cgacucaguuauuucaaaa

SEQ ID NO: 1481503 - RNA, 19 nt, Homo sapiens
uaucugcuauacauaugga

SEQ ID NO: 1481504 - RNA, 19 nt, Homo sapiens
uuucacauuuguucagcua

SEQ ID NO: 1481505 - RNA, 19 nt, Homo sapiens
aagaaacacuuccacuacu

SEQ ID NO: 1481506 - RNA, 19 nt, Homo sapiens
gcaccugugaucccagcua

SEQ ID NO: 1481507 - RNA, 19 nt, Homo sapiens
ccuguaaucccagcacuuu

SEQ ID NO: 1481508 - RNA, 19 nt, Homo sapiens
acaaaaugauggaagacua

SEQ ID NO: 1481509 - RNA, 19 nt, Homo sapiens
uggaaugaagcaauuugua

SEQ ID NO: 1481510 - RNA, 19 nt, Homo sapiens
ggaaguuaaguaaucaagu

SEQ ID NO: 1481511 - RNA, 19 nt, Homo sapiens
ugguauaugucaaagaaag

SEQ ID NO: 1481512 - RNA, 19 nt, Homo sapiens
guucagugguauaugucaa

SEQ ID NO: 1481513 - RNA, 19 nt, Homo sapiens
cagcgacucaguuauuuca

SEQ ID NO: 1481514 - RNA, 19 nt, Homo sapiens
gcugaggucaugccauugu

SEQ ID NO: 1481515 - RNA, 19 nt, Homo sapiens
uaugguagaacgcugugua

SEQ ID NO: 1481516 - RNA, 19 nt, Homo sapiens
uggguucagugguauaugu

SEQ ID NO: 1481517 - RNA, 19 nt, Homo sapiens
gaagggacuggcacaggau

SEQ ID NO: 1481518 - RNA, 19 nt, Homo sapiens
aaccagcgacucaguuauu

SEQ ID NO: 1481519 - RNA, 19 nt, Homo sapiens
cagauuucuucuugaaugg

SEQ ID NO: 1481520 - RNA, 19 nt, Homo sapiens
augaagcaauuuguacgua

SEQ ID NO: 1481521 - RNA, 19 nt, Homo sapiens
gggaaagccuuggguucag

SEQ ID NO: 1481522 - RNA, 19 nt, Homo sapiens
ggucaggaguucgcaacca

SEQ ID NO: 1481523 - RNA, 19 nt, Homo sapiens
cugaggucaugccauugua

SEQ ID NO: 1481524 - RNA, 19 nt, Homo sapiens
ugaccuugauaugguagaa

SEQ ID NO: 1481525 - RNA, 19 nt, Homo sapiens
ggcacaggaucucuuucug

SEQ ID NO: 1481526 - RNA, 19 nt, Homo sapiens
gagaacuuaaccuuauuag

SEQ ID NO: 1481527 - RNA, 19 nt, Homo sapiens
accagcgacucaguuauuu

SEQ ID NO: 1481528 - RNA, 19 nt, Homo sapiens
uuguucagcuauccuaaug

SEQ ID NO: 1481529 - RNA, 19 nt, Homo sapiens
gcaguggcucacaccugua

SEQ ID NO: 1481530 - RNA, 19 nt, Homo sapiens
aggaaacccugacaaaaug

SEQ ID NO: 1481531 - RNA, 19 nt, Homo sapiens
uaaaugccaguccaaagag

SEQ ID NO: 1481532 - RNA, 19 nt, Homo sapiens
gaacgcuguguauuucaag

SEQ ID NO: 1481533 - RNA, 19 nt, Homo sapiens
gcucagaucuguccucuua

SEQ ID NO: 1481534 - RNA, 19 nt, Homo sapiens
ccagauaccuaaaggauaa

SEQ ID NO: 1481535 - RNA, 19 nt, Homo sapiens
gcugagagguggagagaaa

SEQ ID NO: 1481536 - RNA, 19 nt, Homo sapiens
ccaaacaaauuacaugaug

SEQ ID NO: 1481537 - RNA, 19 nt, Homo sapiens
agacucagcuuaagcauug

SEQ ID NO: 1481538 - RNA, 19 nt, Homo sapiens
caugaaaccuagaccuaua

SEQ ID NO: 1481539 - RNA, 19 nt, Homo sapiens
ccaccaagcuggagaagga

SEQ ID NO: 1481540 - RNA, 19 nt, Homo sapiens
gacuuuaucuccaugagua

SEQ ID NO: 1481541 - RNA, 19 nt, Homo sapiens
ccaagaguccuaaacguua

SEQ ID NO: 1481542 - RNA, 19 nt, Homo sapiens
gaggagaaacagaaauaua

SEQ ID NO: 1481543 - RNA, 19 nt, Homo sapiens
gaaauacugaauccacaua

SEQ ID NO: 1481544 - RNA, 19 nt, Homo sapiens
gagaaaaucuuccaccaaa

SEQ ID NO: 1481545 - RNA, 19 nt, Homo sapiens
gaaguauagugcauagguu

SEQ ID NO: 1481546 - RNA, 19 nt, Homo sapiens
aaacacagcuagcauacau

SEQ ID NO: 1481547 - RNA, 19 nt, Homo sapiens
aaucugaucuucaaggaaa

SEQ ID NO: 1481548 - RNA, 19 nt, Homo sapiens
gaaacacaauuagaugaug

SEQ ID NO: 1481549 - RNA, 19 nt, Homo sapiens
ggacacagaauaaagucua

SEQ ID NO: 1481550 - RNA, 19 nt, Homo sapiens
gaaaauuagucccuuaaga

SEQ ID NO: 1481551 - RNA, 19 nt, Homo sapiens
ggaacaaagucugaagaug

SEQ ID NO: 1481552 - RNA, 19 nt, Homo sapiens
caggauggauacuuauaaa

SEQ ID NO: 1481553 - RNA, 19 nt, Homo sapiens
ggaucacucugaauaugaa

SEQ ID NO: 1481554 - RNA, 19 nt, Homo sapiens
gaggaucacucugaauaug

SEQ ID NO: 1481555 - RNA, 19 nt, Homo sapiens
gaacggaggaagaggagaa

SEQ ID NO: 1481556 - RNA, 19 nt, Homo sapiens
gaagaucauuuagacuaug

SEQ ID NO: 1481557 - RNA, 19 nt, Homo sapiens
gcaaugugccagcuccaua

SEQ ID NO: 1481558 - RNA, 19 nt, Homo sapiens
aaacuucacuguugaggau

SEQ ID NO: 1481559 - RNA, 19 nt, Homo sapiens
ccuugugccuuuacuguua

SEQ ID NO: 1481560 - RNA, 19 nt, Homo sapiens
gaucuguccucuuauccaa

SEQ ID NO: 1481561 - RNA, 19 nt, Homo sapiens
gaacacaguaacuaccaaa

SEQ ID NO: 1481562 - RNA, 19 nt, Homo sapiens
cagaggagaaacagaaaua

SEQ ID NO: 1481563 - RNA, 19 nt, Homo sapiens
cuauuaaucuucucaguca

SEQ ID NO: 1481564 - RNA, 19 nt, Homo sapiens
aaaccuagaccuauaaguu

SEQ ID NO: 1481565 - RNA, 19 nt, Homo sapiens
acuacaggauggauacuua

SEQ ID NO: 1481566 - RNA, 19 nt, Homo sapiens
gaguguuagugaugucaua

SEQ ID NO: 1481567 - RNA, 19 nt, Homo sapiens
aagaagccaucaucuagaa

SEQ ID NO: 1481568 - RNA, 19 nt, Homo sapiens
cacaguaacuaccaaacaa

SEQ ID NO: 1481569 - RNA, 19 nt, Homo sapiens
ucacagaggagaaacagaa

SEQ ID NO: 1481570 - RNA, 19 nt, Homo sapiens
ucacaugccagauaccuaa

SEQ ID NO: 1481571 - RNA, 19 nt, Homo sapiens
auacaucucucucuugcuu

SEQ ID NO: 1481572 - RNA, 19 nt, Homo sapiens
gcugauucaugcauuucua

SEQ ID NO: 1481573 - RNA, 19 nt, Homo sapiens
gacaugaaaccuagaccua

SEQ ID NO: 1481574 - RNA, 19 nt, Homo sapiens
guuauuaggucaaccaacu

SEQ ID NO: 1481575 - RNA, 19 nt, Homo sapiens
ggaaguauagugcauaggu

SEQ ID NO: 1481576 - RNA, 19 nt, Homo sapiens
ucaauauucuccuaaaugc

SEQ ID NO: 1481577 - RNA, 19 nt, Homo sapiens
gaauaaagucuagcuucuu

SEQ ID NO: 1481578 - RNA, 19 nt, Homo sapiens
aaagauaagggaaguauag

SEQ ID NO: 1481579 - RNA, 19 nt, Homo sapiens
gccaucaucuagaaacaau

SEQ ID NO: 1481580 - RNA, 19 nt, Homo sapiens
gaggaaaauuagucccuua

SEQ ID NO: 1481581 - RNA, 19 nt, Homo sapiens
caauccagcucuucacagu

SEQ ID NO: 1481582 - RNA, 19 nt, Homo sapiens
gaaacuacaggauggauac

SEQ ID NO: 1481583 - RNA, 19 nt, Homo sapiens
cgagaucuagaaauuagua

SEQ ID NO: 1481584 - RNA, 19 nt, Homo sapiens
cuucuuaggcacagcauua

SEQ ID NO: 1481585 - RNA, 19 nt, Homo sapiens
gaucagugaguaagaacuu

SEQ ID NO: 1481586 - RNA, 19 nt, Homo sapiens
guggagagaaaguugcuua

SEQ ID NO: 1481587 - RNA, 19 nt, Homo sapiens
gaacuugggcuuguuaaaa

SEQ ID NO: 1481588 - RNA, 19 nt, Homo sapiens
cagcaagacaugaaaccua

SEQ ID NO: 1481589 - RNA, 19 nt, Homo sapiens
acaaauuccucacucaucu

SEQ ID NO: 1481590 - RNA, 19 nt, Homo sapiens
ucagaucuguccucuuauc

SEQ ID NO: 1481591 - RNA, 19 nt, Homo sapiens
gcacagcauuacucaccau

SEQ ID NO: 1481592 - RNA, 19 nt, Homo sapiens
gcauacauagcaauaacuu

SEQ ID NO: 1481593 - RNA, 19 nt, Homo sapiens
accuagaccuauaaguuua

SEQ ID NO: 1481594 - RNA, 19 nt, Homo sapiens
aacaaagucugaagaugga

SEQ ID NO: 1481595 - RNA, 19 nt, Homo sapiens
caaaagaagccaucaucua

SEQ ID NO: 1481596 - RNA, 19 nt, Homo sapiens
gccaagaguccuaaacguu

SEQ ID NO: 1481597 - RNA, 19 nt, Homo sapiens
cuacacuucuggcaucaug

SEQ ID NO: 1481598 - RNA, 19 nt, Homo sapiens
cauuuagacuguaucacuu

SEQ ID NO: 1481599 - RNA, 19 nt, Homo sapiens
auaauucacugaggaucua

SEQ ID NO: 1481600 - RNA, 19 nt, Homo sapiens
guauaaguacugagugcua

SEQ ID NO: 1481601 - RNA, 19 nt, Homo sapiens
gucucgagaucuagaaauu

SEQ ID NO: 1481602 - RNA, 19 nt, Homo sapiens
gaguauacugaaacacaua

SEQ ID NO: 1481603 - RNA, 19 nt, Homo sapiens
ccuaguggacacagaauaa

SEQ ID NO: 1481604 - RNA, 19 nt, Homo sapiens
cagagcagcugggauuaca

SEQ ID NO: 1481605 - RNA, 19 nt, Homo sapiens
gaaccaacuguguguaucu

SEQ ID NO: 1481606 - RNA, 19 nt, Homo sapiens
gauaaccacaguuccugaa

SEQ ID NO: 1481607 - RNA, 19 nt, Homo sapiens
aaacuccauucaagaagga

SEQ ID NO: 1481608 - RNA, 19 nt, Homo sapiens
acaucucucucuugcuuaa

SEQ ID NO: 1481609 - RNA, 19 nt, Homo sapiens
ugugccagcuccauaguga

SEQ ID NO: 1481610 - RNA, 19 nt, Homo sapiens
uaagggaaguauagugcau

SEQ ID NO: 1481611 - RNA, 19 nt, Homo sapiens
uagcauacauagcaauaac

SEQ ID NO: 1481612 - RNA, 19 nt, Homo sapiens
gcaggauucuaaagaugag

SEQ ID NO: 1481613 - RNA, 19 nt, Homo sapiens
gccagauaccuaaaggaua

SEQ ID NO: 1481614 - RNA, 19 nt, Homo sapiens
aaccuagaccuauaaguuu

SEQ ID NO: 1481615 - RNA, 19 nt, Homo sapiens
ucaaggaaauacugaaucc

SEQ ID NO: 1481616 - RNA, 19 nt, Homo sapiens
uuuaguaccugaaucucuu

SEQ ID NO: 1481617 - RNA, 19 nt, Homo sapiens
uaaacaacagcaagacaug

SEQ ID NO: 1481618 - RNA, 19 nt, Homo sapiens
uugaggaucacucugaaua

SEQ ID NO: 1481619 - RNA, 19 nt, Homo sapiens
agaccuuucucucuaaaca

SEQ ID NO: 1481620 - RNA, 19 nt, Homo sapiens
uauccaagcuuuuccaaga

SEQ ID NO: 1481621 - RNA, 19 nt, Homo sapiens
uaugcaggauucuaaagau

SEQ ID NO: 1481622 - RNA, 19 nt, Homo sapiens
ucuccuaaaugcuguggaa

SEQ ID NO: 1481623 - RNA, 19 nt, Homo sapiens
gaucauuuagacuguauca

SEQ ID NO: 1481624 - RNA, 19 nt, Homo sapiens
aaagaagccaucaucuaga

SEQ ID NO: 1481625 - RNA, 19 nt, Homo sapiens
gacacagaauaaagucuag

SEQ ID NO: 1481626 - RNA, 19 nt, Homo sapiens
ccucaguuauucccuagug

SEQ ID NO: 1481627 - RNA, 19 nt, Homo sapiens
gaucuucaaggaaauacug

SEQ ID NO: 1481628 - RNA, 19 nt, Homo sapiens
gggaacaaagucugaagau

SEQ ID NO: 1481629 - RNA, 19 nt, Homo sapiens
ggaugacucagcagcaaug

SEQ ID NO: 1481630 - RNA, 19 nt, Homo sapiens
acaggauggauacuuauaa

SEQ ID NO: 1481631 - RNA, 19 nt, Homo sapiens
cagcauuacucaccaucuc

SEQ ID NO: 1481632 - RNA, 19 nt, Homo sapiens
ggaaauacugaauccacau

SEQ ID NO: 1481633 - RNA, 19 nt, Homo sapiens
gaacauuucuugaacacua

SEQ ID NO: 1481634 - RNA, 19 nt, Homo sapiens
ggaauugccuuugucauuu

SEQ ID NO: 1481635 - RNA, 19 nt, Homo sapiens
uauaugagcuggaaucuga

SEQ ID NO: 1481636 - RNA, 19 nt, Homo sapiens
gaacacuaguauuugcuua

SEQ ID NO: 1481637 - RNA, 19 nt, Homo sapiens
guaguaauguuguugguuu

SEQ ID NO: 1481638 - RNA, 19 nt, Homo sapiens
gaaauuagggcauuagaau

SEQ ID NO: 1481639 - RNA, 19 nt, Homo sapiens
gagcagguucuuucuguua

SEQ ID NO: 1481640 - RNA, 19 nt, Homo sapiens
gaaaacaacucuuuagaag

SEQ ID NO: 1481641 - RNA, 19 nt, Homo sapiens
ggacucaguucuuuguguu

SEQ ID NO: 1481642 - RNA, 19 nt, Homo sapiens
gagcaaaacucuuucaaau

SEQ ID NO: 1481643 - RNA, 19 nt, Homo sapiens
uaacuaauccauccucuga

SEQ ID NO: 1481644 - RNA, 19 nt, Homo sapiens
caagaucucuccugucucu

SEQ ID NO: 1481645 - RNA, 19 nt, Homo sapiens
gaccugaguucuaguuuca

SEQ ID NO: 1481646 - RNA, 19 nt, Homo sapiens
gcugguggcugcgguuaua

SEQ ID NO: 1481647 - RNA, 19 nt, Homo sapiens
guacaaacacuucuuuaca

SEQ ID NO: 1481648 - RNA, 19 nt, Homo sapiens
gggaauugccuuugucauu

SEQ ID NO: 1481649 - RNA, 19 nt, Homo sapiens
uaucauauguacucccaaa

SEQ ID NO: 1481650 - RNA, 19 nt, Homo sapiens
ggugacaaauaucccaauu

SEQ ID NO: 1481651 - RNA, 19 nt, Homo sapiens
caagcaaugucgucugaau

SEQ ID NO: 1481652 - RNA, 19 nt, Homo sapiens
ucaaaccaguagcccauuu

SEQ ID NO: 1481653 - RNA, 19 nt, Homo sapiens
gcauuagaauacaugaaga

SEQ ID NO: 1481654 - RNA, 19 nt, Homo sapiens
acaaauaucccaauuaugc

SEQ ID NO: 1481655 - RNA, 19 nt, Homo sapiens
ccauugaggucacauucuu

SEQ ID NO: 1481656 - RNA, 19 nt, Homo sapiens
guccauagguucuaauucu

SEQ ID NO: 1481657 - RNA, 19 nt, Homo sapiens
ggcacaugcuauuauaauu

SEQ ID NO: 1481658 - RNA, 19 nt, Homo sapiens
uagagugacaaaccuauua

SEQ ID NO: 1481659 - RNA, 19 nt, Homo sapiens
acaaauggcauaugggaaa

SEQ ID NO: 1481660 - RNA, 19 nt, Homo sapiens
ccagcuggguuucaaaugu

SEQ ID NO: 1481661 - RNA, 19 nt, Homo sapiens
ccucggagauccugacuca

SEQ ID NO: 1481662 - RNA, 19 nt, Homo sapiens
ccuaagaccugaguucuag

SEQ ID NO: 1481663 - RNA, 19 nt, Homo sapiens
ccucugaugucaccugcua

SEQ ID NO: 1481664 - RNA, 19 nt, Homo sapiens
ccaccugccuucccugaga

SEQ ID NO: 1481665 - RNA, 19 nt, Homo sapiens
ccuguaaucccaacacuuu

SEQ ID NO: 1481666 - RNA, 19 nt, Homo sapiens
uagaucaccugagaacauu

SEQ ID NO: 1481667 - RNA, 19 nt, Homo sapiens
cauauguacucccaaaaua

SEQ ID NO: 1481668 - RNA, 19 nt, Homo sapiens
ccuauuaagugguucuuuc

SEQ ID NO: 1481669 - RNA, 19 nt, Homo sapiens
gaaaagccauaagcaggua

SEQ ID NO: 1481670 - RNA, 19 nt, Homo sapiens
gaugucaccugcuaacaac

SEQ ID NO: 1481671 - RNA, 19 nt, Homo sapiens
agugacugcuggcaaguua

SEQ ID NO: 1481672 - RNA, 19 nt, Homo sapiens
gcucauagcaucaagaaaa

SEQ ID NO: 1481673 - RNA, 19 nt, Homo sapiens
gaggucacauucuugaagu

SEQ ID NO: 1481674 - RNA, 19 nt, Homo sapiens
gagcacagacccagguguu

SEQ ID NO: 1481675 - RNA, 19 nt, Homo sapiens
gaccucaccucccauguac

SEQ ID NO: 1481676 - RNA, 19 nt, Homo sapiens
ccaauuaugcugauuugau

SEQ ID NO: 1481677 - RNA, 19 nt, Homo sapiens
uagccaccaugauguauug

SEQ ID NO: 1481678 - RNA, 19 nt, Homo sapiens
uuacauguauuagcuccua

SEQ ID NO: 1481679 - RNA, 19 nt, Homo sapiens
ucucauccaucccuaucua

SEQ ID NO: 1481680 - RNA, 19 nt, Homo sapiens
cagguaaguuugcauccaa

SEQ ID NO: 1481681 - RNA, 19 nt, Homo sapiens
gguuaccuccuaaaucuaa

SEQ ID NO: 1481682 - RNA, 19 nt, Homo sapiens
gugacaaauaucccaauua

SEQ ID NO: 1481683 - RNA, 19 nt, Homo sapiens
gcacagacccagguguuuc

SEQ ID NO: 1481684 - RNA, 19 nt, Homo sapiens
gggaaagucauuguauauu

SEQ ID NO: 1481685 - RNA, 19 nt, Homo sapiens
uuacagaaacugcugcaaa

SEQ ID NO: 1481686 - RNA, 19 nt, Homo sapiens
gggcacaugcuauuauaau

SEQ ID NO: 1481687 - RNA, 19 nt, Homo sapiens
gcaggagaaucgcuugaac

SEQ ID NO: 1481688 - RNA, 19 nt, Homo sapiens
cuugacauauacaggaaua

SEQ ID NO: 1481689 - RNA, 19 nt, Homo sapiens
uauguuccauugcuaauag

SEQ ID NO: 1481690 - RNA, 19 nt, Homo sapiens
gaauugccuuugucauuuu

SEQ ID NO: 1481691 - RNA, 19 nt, Homo sapiens
guacuuguaaucucagcua

SEQ ID NO: 1481692 - RNA, 19 nt, Homo sapiens
gaccaaaaguccauagguu

SEQ ID NO: 1481693 - RNA, 19 nt, Homo sapiens
ccacuaguguuacagaaac

SEQ ID NO: 1481694 - RNA, 19 nt, Homo sapiens
gggaaaggcgcagaucuug

SEQ ID NO: 1481695 - RNA, 19 nt, Homo sapiens
ucucuucuccugugaaauu

SEQ ID NO: 1481696 - RNA, 19 nt, Homo sapiens
gugacaaaccuauuaagug

SEQ ID NO: 1481697 - RNA, 19 nt, Homo sapiens
gcuggcugauugaaacuga

SEQ ID NO: 1481698 - RNA, 19 nt, Homo sapiens
ucacucaaguucccaaggu

SEQ ID NO: 1481699 - RNA, 19 nt, Homo sapiens
ggaggcuaaugcaggagaa

SEQ ID NO: 1481700 - RNA, 19 nt, Homo sapiens
ggaguugugucuggcuuuc

SEQ ID NO: 1481701 - RNA, 19 nt, Homo sapiens
cagcuggguuucaaaugug

SEQ ID NO: 1481702 - RNA, 19 nt, Homo sapiens
gcagcuaucauaagggaau

SEQ ID NO: 1481703 - RNA, 19 nt, Homo sapiens
uaagugguucuuucaggua

SEQ ID NO: 1481704 - RNA, 19 nt, Homo sapiens
acacuaguauuugcuuaga

SEQ ID NO: 1481705 - RNA, 19 nt, Homo sapiens
guccaaaucagaguucuuu

SEQ ID NO: 1481706 - RNA, 19 nt, Homo sapiens
ugaccucaccucccaugua

SEQ ID NO: 1481707 - RNA, 19 nt, Homo sapiens
guggguacuuguaaucuca

SEQ ID NO: 1481708 - RNA, 19 nt, Homo sapiens
uccaagcaaugucgucuga

SEQ ID NO: 1481709 - RNA, 19 nt, Homo sapiens
ccgcaggccuuucuuucug

SEQ ID NO: 1481710 - RNA, 19 nt, Homo sapiens
cccaguacuuugcauguga

SEQ ID NO: 1481711 - RNA, 19 nt, Homo sapiens
ccaccaugauguauugaag

SEQ ID NO: 1481712 - RNA, 19 nt, Homo sapiens
gcagguucuuucuguuaca

SEQ ID NO: 1481713 - RNA, 19 nt, Homo sapiens
agacccagguguuucugaa

SEQ ID NO: 1481714 - RNA, 19 nt, Homo sapiens
gcuccuaacaacacuuuga

SEQ ID NO: 1481715 - RNA, 19 nt, Homo sapiens
uacagaaacugcugcaaac

SEQ ID NO: 1481716 - RNA, 19 nt, Homo sapiens
guccuuacuugacauauac

SEQ ID NO: 1481717 - RNA, 19 nt, Homo sapiens
gcaaugcuaauauuaugag

SEQ ID NO: 1481718 - RNA, 19 nt, Homo sapiens
augggaaagucauuguaua

SEQ ID NO: 1481719 - RNA, 19 nt, Homo sapiens
ggccuuguauugcaaacau

SEQ ID NO: 1481720 - RNA, 19 nt, Homo sapiens
ccacccagaggcucaguuu

SEQ ID NO: 1481721 - RNA, 19 nt, Homo sapiens
uuaagaaccuagggaaucu

SEQ ID NO: 1481722 - RNA, 19 nt, Homo sapiens
gggaggagaaggaauugug

SEQ ID NO: 1481723 - RNA, 19 nt, Homo sapiens
gagcuggaaucugagucaa

SEQ ID NO: 1481724 - RNA, 19 nt, Homo sapiens
ggaggaagccaggaguugu

SEQ ID NO: 1481725 - RNA, 19 nt, Homo sapiens
cagguauucuggacugugu

SEQ ID NO: 1481726 - RNA, 19 nt, Homo sapiens
cauauccacuaguguuaca

SEQ ID NO: 1481727 - RNA, 19 nt, Homo sapiens
gaaccuagggaaucuccau

SEQ ID NO: 1481728 - RNA, 19 nt, Homo sapiens
ugaaauuagggcauuagaa

SEQ ID NO: 1481729 - RNA, 19 nt, Homo sapiens
ggugguggguacuuguaau

SEQ ID NO: 1481730 - RNA, 19 nt, Homo sapiens
caaauggcauaugggaaag

SEQ ID NO: 1481731 - RNA, 19 nt, Homo sapiens
gaucaccugagaacauuuc

SEQ ID NO: 1481732 - RNA, 19 nt, Homo sapiens
gcgcagaucuuggggagaa

SEQ ID NO: 1481733 - RNA, 19 nt, Homo sapiens
ucaauaaacuccggacuga

SEQ ID NO: 1481734 - RNA, 19 nt, Homo sapiens
gaaccuucuuugcccacuu

SEQ ID NO: 1481735 - RNA, 19 nt, Homo sapiens
ccucugacuucuggaacua

SEQ ID NO: 1481736 - RNA, 19 nt, Homo sapiens
gggccugagucgcagauca

SEQ ID NO: 1481737 - RNA, 19 nt, Homo sapiens
ggccuggucucacgcucaa

SEQ ID NO: 1481738 - RNA, 19 nt, Homo sapiens
ggagucaggccuggucuca

SEQ ID NO: 1481739 - RNA, 19 nt, Homo sapiens
ccuggucucacgcucaaua

SEQ ID NO: 1481740 - RNA, 19 nt, Homo sapiens
gcuuccacguucccuauca

SEQ ID NO: 1481741 - RNA, 19 nt, Homo sapiens
aauaaacuccggacugaag

SEQ ID NO: 1481742 - RNA, 19 nt, Homo sapiens
gggcuuccacguucccuau

SEQ ID NO: 1481743 - RNA, 19 nt, Homo sapiens
ucaggaagcaccgggaaga

SEQ ID NO: 1481744 - RNA, 19 nt, Homo sapiens
ggucucacgcucaauaaac

SEQ ID NO: 1481745 - RNA, 19 nt, Homo sapiens
gaagagagaugugaacuga

SEQ ID NO: 1481746 - RNA, 19 nt, Homo sapiens
ggagagaaguggcagcuuu

SEQ ID NO: 1481747 - RNA, 19 nt, Homo sapiens
ccaaguggcugggaaguua

SEQ ID NO: 1481748 - RNA, 19 nt, Homo sapiens
gcacaggacgcuuaagaaa

SEQ ID NO: 1481749 - RNA, 19 nt, Homo sapiens
gcaccgggcucuugaugga

SEQ ID NO: 1481750 - RNA, 19 nt, Homo sapiens
caauaucaguuucuacuca

SEQ ID NO: 1481751 - RNA, 19 nt, Homo sapiens
gaacugaacgggagagaag

SEQ ID NO: 1481752 - RNA, 19 nt, Homo sapiens
acaggacgcuuaagaaaca

SEQ ID NO: 1481753 - RNA, 19 nt, Homo sapiens
gcgcuaauguuuaccagau

SEQ ID NO: 1481754 - RNA, 19 nt, Homo sapiens
ggaagaaccaauccaagug

SEQ ID NO: 1481755 - RNA, 19 nt, Homo sapiens
cagcgaagacagcacaaua

SEQ ID NO: 1481756 - RNA, 19 nt, Homo sapiens
acacagccaugcauagaug

SEQ ID NO: 1481757 - RNA, 19 nt, Homo sapiens
gaagacagcacaauaucag

SEQ ID NO: 1481758 - RNA, 19 nt, Homo sapiens
gcggaggcgcuaauguuua

SEQ ID NO: 1481759 - RNA, 19 nt, Homo sapiens
ggagaagaagggaagaaga

SEQ ID NO: 1481760 - RNA, 19 nt, Homo sapiens
gcugggaaguuaucuagag

SEQ ID NO: 1481761 - RNA, 19 nt, Homo sapiens
gggcacaggacgcuuaaga

SEQ ID NO: 1481762 - RNA, 19 nt, Homo sapiens
gggcggaggcgcuaauguu

SEQ ID NO: 1481763 - RNA, 19 nt, Homo sapiens
gacagcacaauaucaguuu

SEQ ID NO: 1481764 - RNA, 19 nt, Homo sapiens
ggccguucaugcagacuuu

SEQ ID NO: 1481765 - RNA, 19 nt, Homo sapiens
gagagaaguggcagcuuug

SEQ ID NO: 1481766 - RNA, 19 nt, Homo sapiens
gaccacacagccaugcaua

SEQ ID NO: 1481767 - RNA, 19 nt, Homo sapiens
ggcgagaggucagcgaaga

SEQ ID NO: 1481768 - RNA, 19 nt, Homo sapiens
agagagaugugaacugaac

SEQ ID NO: 1481769 - RNA, 19 nt, Homo sapiens
ccacacagccaugcauaga

SEQ ID NO: 1481770 - RNA, 19 nt, Homo sapiens
ccaacaaagcaacaaguga

SEQ ID NO: 1481771 - RNA, 19 nt, Homo sapiens
gcucugaggccggaaguga

SEQ ID NO: 1481772 - RNA, 19 nt, Homo sapiens
gcgaagacagcacaauauc

SEQ ID NO: 1481773 - RNA, 19 nt, Homo sapiens
cagagaacauccgcugugu

SEQ ID NO: 1481774 - RNA, 19 nt, Homo sapiens
ggaagagagaugugaacug

SEQ ID NO: 1481775 - RNA, 19 nt, Homo sapiens
gagaagaagggaagaagac

SEQ ID NO: 1481776 - RNA, 19 nt, Homo sapiens
cgaagacagcacaauauca

SEQ ID NO: 1481777 - RNA, 19 nt, Homo sapiens
ggcggaggcgcuaauguuu

SEQ ID NO: 1481778 - RNA, 19 nt, Homo sapiens
cggaggcgcuaauguuuac

SEQ ID NO: 1481779 - RNA, 19 nt, Homo sapiens
ggccuguggugucggaaga

SEQ ID NO: 1481780 - RNA, 19 nt, Homo sapiens
agacagcacaauaucaguu

SEQ ID NO: 1481781 - RNA, 19 nt, Homo sapiens
gugcucagaaccacaagaa

SEQ ID NO: 1481782 - RNA, 19 nt, Homo sapiens
cggaagaaccaauccaagu

SEQ ID NO: 1481783 - RNA, 19 nt, Homo sapiens
gagaaguggcagcuuugga

SEQ ID NO: 1481784 - RNA, 19 nt, Homo sapiens
gaggugcucagaaccacaa

SEQ ID NO: 1481785 - RNA, 19 nt, Homo sapiens
ggcacaggacgcuuaagaa

SEQ ID NO: 1481786 - RNA, 19 nt, Homo sapiens
gcacaauaucaguuucuac

SEQ ID NO: 1481787 - RNA, 19 nt, Homo sapiens
ggccggaagugagccuaga

SEQ ID NO: 1481788 - RNA, 19 nt, Homo sapiens
ccagcaguccuccaugguu

SEQ ID NO: 1481789 - RNA, 19 nt, Homo sapiens
ggacgcuuaagaaacaguu

SEQ ID NO: 1481790 - RNA, 19 nt, Homo sapiens
aaugggcacaggacgcuua

SEQ ID NO: 1481791 - RNA, 19 nt, Homo sapiens
gcaccaacaaagcaacaag

SEQ ID NO: 1481792 - RNA, 19 nt, Homo sapiens
aguggcagcuuuggacaga

SEQ ID NO: 1481793 - RNA, 19 nt, Homo sapiens
cacaauaucaguuucuacu

SEQ ID NO: 1481794 - RNA, 19 nt, Homo sapiens
ggccugagcuggagaguug

SEQ ID NO: 1481795 - RNA, 19 nt, Homo sapiens
gguauuaaauccucgcauu

SEQ ID NO: 1481796 - RNA, 19 nt, Homo sapiens
gaugauguaugaaggaguu

SEQ ID NO: 1481797 - RNA, 19 nt, Homo sapiens
ggacaggaaucugaauuuc

SEQ ID NO: 1481798 - RNA, 19 nt, Homo sapiens
gcacucagcucaaauacac

SEQ ID NO: 1481799 - RNA, 19 nt, Homo sapiens
acacacaccuguugccauu

SEQ ID NO: 1481800 - RNA, 19 nt, Homo sapiens
ugaaggaguuggaguuguu

SEQ ID NO: 1481801 - RNA, 19 nt, Homo sapiens
ggaauuaggcaaauaugga

SEQ ID NO: 1481802 - RNA, 19 nt, Homo sapiens
ggaagagccacaagacaaa

SEQ ID NO: 1481803 - RNA, 19 nt, Homo sapiens
gaucacaucugaccaagcu

SEQ ID NO: 1481804 - RNA, 19 nt, Homo sapiens
ggucaaagucaaccaaauu

SEQ ID NO: 1481805 - RNA, 19 nt, Homo sapiens
gaauuucuguguuuggaau

SEQ ID NO: 1481806 - RNA, 19 nt, Homo sapiens
ccacugaccuuuucuaaga

SEQ ID NO: 1481807 - RNA, 19 nt, Homo sapiens
caaauacacacaccuguug

SEQ ID NO: 1481808 - RNA, 19 nt, Homo sapiens
ucaaccagcuggaggcauu

SEQ ID NO: 1481809 - RNA, 19 nt, Homo sapiens
gaaucugaauuucuguguu

SEQ ID NO: 1481810 - RNA, 19 nt, Homo sapiens
cauuauagagcuggaauua

SEQ ID NO: 1481811 - RNA, 19 nt, Homo sapiens
ucaaggcacucagcucaaa

SEQ ID NO: 1481812 - RNA, 19 nt, Homo sapiens
aaaccaagguguccaugau

SEQ ID NO: 1481813 - RNA, 19 nt, Homo sapiens
gaaaccaagguguccauga

SEQ ID NO: 1481814 - RNA, 19 nt, Homo sapiens
gaagaugauguaugaagga

SEQ ID NO: 1481815 - RNA, 19 nt, Homo sapiens
cagccuaacugaagaugau

SEQ ID NO: 1481816 - RNA, 19 nt, Homo sapiens
acaggaaucugaauuucug

SEQ ID NO: 1481817 - RNA, 19 nt, Homo sapiens
gcaaauauggacaggaauc

SEQ ID NO: 1481818 - RNA, 19 nt, Homo sapiens
aacugaagaugauguauga

SEQ ID NO: 1481819 - RNA, 19 nt, Homo sapiens
aggcaaauauggacaggaa

SEQ ID NO: 1481820 - RNA, 19 nt, Homo sapiens
uuauagagcuggaauuagg

SEQ ID NO: 1481821 - RNA, 19 nt, Homo sapiens
gagcuggaauuaggcaaau

SEQ ID NO: 1481822 - RNA, 19 nt, Homo sapiens
acacaccuguugccauuau

SEQ ID NO: 1481823 - RNA, 19 nt, Homo sapiens
gagaguugauggcaagucu

SEQ ID NO: 1481824 - RNA, 19 nt, Homo sapiens
aaagucaaccaaauucuga

SEQ ID NO: 1481825 - RNA, 19 nt, Homo sapiens
aaggugggaucacaucuga

SEQ ID NO: 1481826 - RNA, 19 nt, Homo sapiens
cugcagacauggauuucaa

SEQ ID NO: 1481827 - RNA, 19 nt, Homo sapiens
ggaguuggaguuguugaaa

SEQ ID NO: 1481828 - RNA, 19 nt, Homo sapiens
uaacugaagaugauguaug

SEQ ID NO: 1481829 - RNA, 19 nt, Homo sapiens
ugucagagguagaagaaag

SEQ ID NO: 1481830 - RNA, 19 nt, Homo sapiens
gaagacgcugucagaggua

SEQ ID NO: 1481831 - RNA, 19 nt, Homo sapiens
gauggcaagucucagucaa

SEQ ID NO: 1481832 - RNA, 19 nt, Homo sapiens
cauucagucuucccucaaa

SEQ ID NO: 1481833 - RNA, 19 nt, Homo sapiens
caaagucaaccaaauucug

SEQ ID NO: 1481834 - RNA, 19 nt, Homo sapiens
ucaaauacacacaccuguu

SEQ ID NO: 1481835 - RNA, 19 nt, Homo sapiens
guaugaaggaguuggaguu

SEQ ID NO: 1481836 - RNA, 19 nt, Homo sapiens
cagccagccuaacugaaga

SEQ ID NO: 1481837 - RNA, 19 nt, Homo sapiens
cuacggagccagcuauauc

SEQ ID NO: 1481838 - RNA, 19 nt, Homo sapiens
gcugucagagguagaagaa

SEQ ID NO: 1481839 - RNA, 19 nt, Homo sapiens
uggaagagccacaagacaa

SEQ ID NO: 1481840 - RNA, 19 nt, Homo sapiens
ggaaucugaauuucugugu

SEQ ID NO: 1481841 - RNA, 19 nt, Homo sapiens
gcuggaauuaggcaaauau

SEQ ID NO: 1481842 - RNA, 19 nt, Homo sapiens
ugagcgggcugcugaaugc

SEQ ID NO: 1481843 - RNA, 19 nt, Homo sapiens
guauuaaauccucgcauuc

SEQ ID NO: 1481844 - RNA, 19 nt, Homo sapiens
aagcugcugucauuuccaa

SEQ ID NO: 1481845 - RNA, 19 nt, Homo sapiens
aaagcaaggugggaucaca

SEQ ID NO: 1481846 - RNA, 19 nt, Homo sapiens
gaggucaaagucaaccaaa

SEQ ID NO: 1481847 - RNA, 19 nt, Homo sapiens
aauauggacaggaaucuga

SEQ ID NO: 1481848 - RNA, 19 nt, Homo sapiens
caugaucccuccccacuga

SEQ ID NO: 1481849 - RNA, 19 nt, Homo sapiens
gaguuggaguuguugaaac

SEQ ID NO: 1481850 - RNA, 19 nt, Homo sapiens
gaaggaguuggaguuguug

SEQ ID NO: 1481851 - RNA, 19 nt, Homo sapiens
ucaaccaaauucugaagac

SEQ ID NO: 1481852 - RNA, 19 nt, Homo sapiens
gagguagaagaaaguauca

SEQ ID NO: 1481853 - RNA, 19 nt, Homo sapiens
uggacaggaaucugaauuu

SEQ ID NO: 1481854 - RNA, 19 nt, Homo sapiens
gacaggaaucugaauuucu

SEQ ID NO: 1481855 - RNA, 19 nt, Homo sapiens
gucaaagucaaccaaauuc

SEQ ID NO: 1481856 - RNA, 19 nt, Homo sapiens
gggauucuuaagucuauug

SEQ ID NO: 1481857 - RNA, 19 nt, Homo sapiens
gaguugauggcaagucuca

SEQ ID NO: 1481858 - RNA, 19 nt, Homo sapiens
ccaagcugcugucauuucc

SEQ ID NO: 1481859 - RNA, 19 nt, Homo sapiens
uauuaaauccucgcauuca

SEQ ID NO: 1481860 - RNA, 19 nt, Homo sapiens
aaggcacucagcucaaaua

SEQ ID NO: 1481861 - RNA, 19 nt, Homo sapiens
caucacagaggagcugcua

SEQ ID NO: 1481862 - RNA, 19 nt, Homo sapiens
cacaccuguugccauuaua

SEQ ID NO: 1481863 - RNA, 19 nt, Homo sapiens
gaccaagcugcugucauuu

SEQ ID NO: 1481864 - RNA, 19 nt, Homo sapiens
gcauucagucuucccucaa

SEQ ID NO: 1481865 - RNA, 19 nt, Homo sapiens
gugcccgcauugguauuaa

SEQ ID NO: 1481866 - RNA, 19 nt, Homo sapiens
ccuaacugaagaugaugua

SEQ ID NO: 1481867 - RNA, 19 nt, Homo sapiens
ucagagguagaagaaagua

SEQ ID NO: 1481868 - RNA, 19 nt, Homo sapiens
ccagcuggaggcauucuug

SEQ ID NO: 1481869 - RNA, 19 nt, Homo sapiens
caaggugggaucacaucug

SEQ ID NO: 1481870 - RNA, 19 nt, Homo sapiens
cugaauuucuguguuugga

SEQ ID NO: 1481871 - RNA, 19 nt, Homo sapiens
guacauaguugguguuuaa

SEQ ID NO: 1481872 - RNA, 19 nt, Homo sapiens
gauggaagcugccuauuau

SEQ ID NO: 1481873 - RNA, 19 nt, Homo sapiens
gaagcugccuauuauuauu

SEQ ID NO: 1481874 - RNA, 19 nt, Homo sapiens
uaaaggcccuacugaauga

SEQ ID NO: 1481875 - RNA, 19 nt, Homo sapiens
ggauggaagcugccuauua

SEQ ID NO: 1481876 - RNA, 19 nt, Homo sapiens
cauaguugguguuuaauga

SEQ ID NO: 1481877 - RNA, 19 nt, Homo sapiens
gacagaggcuggagaagga

SEQ ID NO: 1481878 - RNA, 19 nt, Homo sapiens
ggacagaccucagauccau

SEQ ID NO: 1481879 - RNA, 19 nt, Homo sapiens
ggaauuagaauggugcaua

SEQ ID NO: 1481880 - RNA, 19 nt, Homo sapiens
ucgcucagcuucuccauuu

SEQ ID NO: 1481881 - RNA, 19 nt, Homo sapiens
gggagugucuguguuguuu

SEQ ID NO: 1481882 - RNA, 19 nt, Homo sapiens
cugcaaaccuugaaugcua

SEQ ID NO: 1481883 - RNA, 19 nt, Homo sapiens
guaaaggcccuacugaaug

SEQ ID NO: 1481884 - RNA, 19 nt, Homo sapiens
uuacucaucuguugaccua

SEQ ID NO: 1481885 - RNA, 19 nt, Homo sapiens
cacuaugccuggcuaauuu

SEQ ID NO: 1481886 - RNA, 19 nt, Homo sapiens
gaccucagauccauuaaag

SEQ ID NO: 1481887 - RNA, 19 nt, Homo sapiens
gcagaaauuccuuuaagau

SEQ ID NO: 1481888 - RNA, 19 nt, Homo sapiens
ggaagcugccuauuauuau

SEQ ID NO: 1481889 - RNA, 19 nt, Homo sapiens
gguaaaggcccuacugaau

SEQ ID NO: 1481890 - RNA, 19 nt, Homo sapiens
gcagagcaccugacauuca

SEQ ID NO: 1481891 - RNA, 19 nt, Homo sapiens
uauuaucacugucagauga

SEQ ID NO: 1481892 - RNA, 19 nt, Homo sapiens
gaauuagaauggugcauac

SEQ ID NO: 1481893 - RNA, 19 nt, Homo sapiens
ggcagaaauuccuuuaaga

SEQ ID NO: 1481894 - RNA, 19 nt, Homo sapiens
ggaaugugagugaguguuu

SEQ ID NO: 1481895 - RNA, 19 nt, Homo sapiens
ggccucagcuuccucuuug

SEQ ID NO: 1481896 - RNA, 19 nt, Homo sapiens
uggaagcugccuauuauua

SEQ ID NO: 1481897 - RNA, 19 nt, Homo sapiens
ggacacugcguuccagaaa

SEQ ID NO: 1481898 - RNA, 19 nt, Homo sapiens
ggaggugacucagcgcauu

SEQ ID NO: 1481899 - RNA, 19 nt, Homo sapiens
ggagaacggcgagcucuuu

SEQ ID NO: 1481900 - RNA, 19 nt, Homo sapiens
ggaaguagcacccuugcau

SEQ ID NO: 1481901 - RNA, 19 nt, Homo sapiens
ggagcugggugcugacuuc

SEQ ID NO: 1481902 - RNA, 19 nt, Homo sapiens
gaaguagcacccuugcauu

SEQ ID NO: 1481903 - RNA, 19 nt, Homo sapiens
gaacaucagcauccaccaa

SEQ ID NO: 1481904 - RNA, 19 nt, Homo sapiens
ggagcgcgauccacacuca

SEQ ID NO: 1481905 - RNA, 19 nt, Homo sapiens
gcucaauccuuucccuuca

SEQ ID NO: 1481906 - RNA, 19 nt, Homo sapiens
guagcacccuugcauuuca

SEQ ID NO: 1481907 - RNA, 19 nt, Homo sapiens
ucagauccauuaaaguguu

SEQ ID NO: 1481908 - RNA, 19 nt, Homo sapiens
ccaaauacuuccguccuau

SEQ ID NO: 1481909 - RNA, 19 nt, Homo sapiens
gauccugugugacaugaug

SEQ ID NO: 1481910 - RNA, 19 nt, Homo sapiens
cuggaagugucuauguuua

SEQ ID NO: 1481911 - RNA, 19 nt, Homo sapiens
gcaggugugugccacuaug

SEQ ID NO: 1481912 - RNA, 19 nt, Homo sapiens
acacugcguuccagaaaug

SEQ ID NO: 1481913 - RNA, 19 nt, Homo sapiens
caaugucaccuaccugaaa

SEQ ID NO: 1481914 - RNA, 19 nt, Homo sapiens
cggcagagcaccugacauu

SEQ ID NO: 1481915 - RNA, 19 nt, Homo sapiens
cagaugagcaugcuugaau

SEQ ID NO: 1481916 - RNA, 19 nt, Homo sapiens
ggacaacagccgugugauc

SEQ ID NO: 1481917 - RNA, 19 nt, Homo sapiens
ggaagugucuauguuuaac

SEQ ID NO: 1481918 - RNA, 19 nt, Homo sapiens
aaacaaaugcucaguggau

SEQ ID NO: 1481919 - RNA, 19 nt, Homo sapiens
agacucagcucuuccacau

SEQ ID NO: 1481920 - RNA, 19 nt, Homo sapiens
gcaguggccuggcacaaaa

SEQ ID NO: 1481921 - RNA, 19 nt, Homo sapiens
gguguuuaaugaguguuua

SEQ ID NO: 1481922 - RNA, 19 nt, Homo sapiens
ggagaccucagauguccua

SEQ ID NO: 1481923 - RNA, 19 nt, Homo sapiens
ggaagaacaucagcaucca

SEQ ID NO: 1481924 - RNA, 19 nt, Homo sapiens
gaaccugucgcaacuucuu

SEQ ID NO: 1481925 - RNA, 19 nt, Homo sapiens
gcgcacgcaugaacagaug

SEQ ID NO: 1481926 - RNA, 19 nt, Homo sapiens
gcuuguuacucaucuguug

SEQ ID NO: 1481927 - RNA, 19 nt, Homo sapiens
gaauggugcauacacaaug

SEQ ID NO: 1481928 - RNA, 19 nt, Homo sapiens
gcuggaagugucuauguuu

SEQ ID NO: 1481929 - RNA, 19 nt, Homo sapiens
gucaagaccuccaaauacu

SEQ ID NO: 1481930 - RNA, 19 nt, Homo sapiens
ccacuaugccuggcuaauu

SEQ ID NO: 1481931 - RNA, 19 nt, Homo sapiens
gagaggagaguucuaaggu

SEQ ID NO: 1481932 - RNA, 19 nt, Homo sapiens
acagaccucagauccauua

SEQ ID NO: 1481933 - RNA, 19 nt, Homo sapiens
uuaccucccugaagcugua

SEQ ID NO: 1481934 - RNA, 19 nt, Homo sapiens
gaaugugagugaguguuuc

SEQ ID NO: 1481935 - RNA, 19 nt, Homo sapiens
gaggagaacagcaccuuca

SEQ ID NO: 1481936 - RNA, 19 nt, Homo sapiens
gagugucuguguuguuugu

SEQ ID NO: 1481937 - RNA, 19 nt, Homo sapiens
gagauggacagaccucaga

SEQ ID NO: 1481938 - RNA, 19 nt, Homo sapiens
gcaggccucuauucaaagg

SEQ ID NO: 1481939 - RNA, 19 nt, Homo sapiens
ccucagauccauuaaagug

SEQ ID NO: 1481940 - RNA, 19 nt, Homo sapiens
gaggagcaccuggauauca

SEQ ID NO: 1481941 - RNA, 19 nt, Homo sapiens
uggugcagcucaauccuuu

SEQ ID NO: 1481942 - RNA, 19 nt, Homo sapiens
aggcagaccuggacucaca

SEQ ID NO: 1481943 - RNA, 19 nt, Homo sapiens
ugagcaugcuugaauguag

SEQ ID NO: 1481944 - RNA, 19 nt, Homo sapiens
caagaccuccaaauacuuc

SEQ ID NO: 1481945 - RNA, 19 nt, Homo sapiens
guacguggccugggugaga

SEQ ID NO: 1481946 - RNA, 19 nt, Homo sapiens
cuugaaugcuacaguggua

SEQ ID NO: 1481947 - RNA, 19 nt, Homo sapiens
ggagcuggaugguguuggu

SEQ ID NO: 1481948 - RNA, 19 nt, Homo sapiens
aggcagaaauuccuuuaag

SEQ ID NO: 1481949 - RNA, 19 nt, Homo sapiens
gcucagcuucuccauuuau

SEQ ID NO: 1481950 - RNA, 19 nt, Homo sapiens
gcugggacccuguacauag

SEQ ID NO: 1481951 - RNA, 19 nt, Homo sapiens
gaagaggagagagaagaga

SEQ ID NO: 1481952 - RNA, 19 nt, Homo sapiens
cagauguccuagccaaugu

SEQ ID NO: 1481953 - RNA, 19 nt, Homo sapiens
gaacggcgagcucuuugag

SEQ ID NO: 1481954 - RNA, 19 nt, Homo sapiens
ccaaccagcgcacgcauga

SEQ ID NO: 1481955 - RNA, 19 nt, Homo sapiens
uagcaugacugccucuuuu

SEQ ID NO: 1481956 - RNA, 19 nt, Homo sapiens
uuugagagcuguggagaga

SEQ ID NO: 1481957 - RNA, 19 nt, Homo sapiens
gacacugcguuccagaaau

SEQ ID NO: 1481958 - RNA, 19 nt, Homo sapiens
caaccaguauaccaacaag

SEQ ID NO: 1481959 - RNA, 19 nt, Homo sapiens
ccaugaaccugucgcaacu

SEQ ID NO: 1481960 - RNA, 19 nt, Homo sapiens
ggcgagcucuuugaguuug

SEQ ID NO: 1481961 - RNA, 19 nt, Homo sapiens
uugcagagccugaaaguag

SEQ ID NO: 1481962 - RNA, 19 nt, Homo sapiens
gagaacggcgagcucuuug

SEQ ID NO: 1481963 - RNA, 19 nt, Homo sapiens
gguguggucugugccuuug

SEQ ID NO: 1481964 - RNA, 19 nt, Homo sapiens
uauaaaccagcaacaaguu

SEQ ID NO: 1481965 - RNA, 19 nt, Homo sapiens
gcuagcauccgggcaugua

SEQ ID NO: 1481966 - RNA, 19 nt, Homo sapiens
ggccacagacugcaaguuc

SEQ ID NO: 1481967 - RNA, 19 nt, Homo sapiens
uccaaauacuuccguccua

SEQ ID NO: 1481968 - RNA, 19 nt, Homo sapiens
caucaucuuugccgucaag

SEQ ID NO: 1481969 - RNA, 19 nt, Homo sapiens
ggcuggaagugucuauguu

SEQ ID NO: 1481970 - RNA, 19 nt, Homo sapiens
ucaauccuuucccuucaga

SEQ ID NO: 1481971 - RNA, 19 nt, Homo sapiens
gaauaaaccuaaucaguuc

SEQ ID NO: 1481972 - RNA, 19 nt, Homo sapiens
caaauuggauacagcuuua

SEQ ID NO: 1481973 - RNA, 19 nt, Homo sapiens
ggaauaaaccuaaucaguu

SEQ ID NO: 1481974 - RNA, 19 nt, Homo sapiens
gcagugggauccauuugua

SEQ ID NO: 1481975 - RNA, 19 nt, Homo sapiens
caacggcucugcuaucauu

SEQ ID NO: 1481976 - RNA, 19 nt, Homo sapiens
ucaaagagcugugagagaa

SEQ ID NO: 1481977 - RNA, 19 nt, Homo sapiens
caucagauaucacaaaugu

SEQ ID NO: 1481978 - RNA, 19 nt, Homo sapiens
cagcagagaugcaaguauu

SEQ ID NO: 1481979 - RNA, 19 nt, Homo sapiens
guucagacuucuacuauug

SEQ ID NO: 1481980 - RNA, 19 nt, Homo sapiens
caaauuaguguccaaauga

SEQ ID NO: 1481981 - RNA, 19 nt, Homo sapiens
ggaggaccauccauaauuc

SEQ ID NO: 1481982 - RNA, 19 nt, Homo sapiens
gcaagagguguuacuauuu

SEQ ID NO: 1481983 - RNA, 19 nt, Homo sapiens
gaccaagaauaguguguuu

SEQ ID NO: 1481984 - RNA, 19 nt, Homo sapiens
gaccaaggauucccauaau

SEQ ID NO: 1481985 - RNA, 19 nt, Homo sapiens
ucaaauaugugaagggaau

SEQ ID NO: 1481986 - RNA, 19 nt, Homo sapiens
acaaggagcuguugcacuu

SEQ ID NO: 1481987 - RNA, 19 nt, Homo sapiens
ggaauaaugaccauaucua

SEQ ID NO: 1481988 - RNA, 19 nt, Homo sapiens
ggaaggagcaccgaagaaa

SEQ ID NO: 1481989 - RNA, 19 nt, Homo sapiens
ccuaaucaguucauucgua

SEQ ID NO: 1481990 - RNA, 19 nt, Homo sapiens
ucacaacgcucuuauacag

SEQ ID NO: 1481991 - RNA, 19 nt, Homo sapiens
gaaacaaauuaguguccaa

SEQ ID NO: 1481992 - RNA, 19 nt, Homo sapiens
ggaaacauguccagaaagc

SEQ ID NO: 1481993 - RNA, 19 nt, Homo sapiens
ggugggacuuccuuccuua

SEQ ID NO: 1481994 - RNA, 19 nt, Homo sapiens
ugucauagcucuaaguaag

SEQ ID NO: 1481995 - RNA, 19 nt, Homo sapiens
gcugugcugucauucuaua

SEQ ID NO: 1481996 - RNA, 19 nt, Homo sapiens
gcagagaugcaaguauuaa

SEQ ID NO: 1481997 - RNA, 19 nt, Homo sapiens
agaagcauuuaccacauua

SEQ ID NO: 1481998 - RNA, 19 nt, Homo sapiens
cagaagcauuuaccacauu

SEQ ID NO: 1481999 - RNA, 19 nt, Homo sapiens
gauagucuguauucaguuc

SEQ ID NO: 1482000 - RNA, 19 nt, Homo sapiens
caucuacaauuacaucaga

SEQ ID NO: 1482001 - RNA, 19 nt, Homo sapiens
ggaaauucaggaugcuaua

SEQ ID NO: 1482002 - RNA, 19 nt, Homo sapiens
gcagaaggcuaauaaaaca

SEQ ID NO: 1482003 - RNA, 19 nt, Homo sapiens
gcucuuggcuacuuaacau

SEQ ID NO: 1482004 - RNA, 19 nt, Homo sapiens
caagagguguuacuauuuu

SEQ ID NO: 1482005 - RNA, 19 nt, Homo sapiens
gcuaguaaauguaaugaac

SEQ ID NO: 1482006 - RNA, 19 nt, Homo sapiens
acaaauguaucaagaccaa

SEQ ID NO: 1482007 - RNA, 19 nt, Homo sapiens
gcaagucacaacgcucuua

SEQ ID NO: 1482008 - RNA, 19 nt, Homo sapiens
acaaauuaguguccaaaug

SEQ ID NO: 1482009 - RNA, 19 nt, Homo sapiens
ccaaggauucccauaauau

SEQ ID NO: 1482010 - RNA, 19 nt, Homo sapiens
gcauuuaccacauuaggaa

SEQ ID NO: 1482011 - RNA, 19 nt, Homo sapiens
ugcaagagguguuacuauu

SEQ ID NO: 1482012 - RNA, 19 nt, Homo sapiens
ccaagaauaguguguuuga

SEQ ID NO: 1482013 - RNA, 19 nt, Homo sapiens
gaccauccauaauuccuau

SEQ ID NO: 1482014 - RNA, 19 nt, Homo sapiens
ggcuaugcauuaacacuuu

SEQ ID NO: 1482015 - RNA, 19 nt, Homo sapiens
aaaggccucccauaucuua

SEQ ID NO: 1482016 - RNA, 19 nt, Homo sapiens
ugggaaacauguccagaaa

SEQ ID NO: 1482017 - RNA, 19 nt, Homo sapiens
ggcauuccaucucuaauca

SEQ ID NO: 1482018 - RNA, 19 nt, Homo sapiens
cuaaucaguucauucguau

SEQ ID NO: 1482019 - RNA, 19 nt, Homo sapiens
acaacgcucuuauacagaa

SEQ ID NO: 1482020 - RNA, 19 nt, Homo sapiens
caaggauucccauaauauu

SEQ ID NO: 1482021 - RNA, 19 nt, Homo sapiens
gguagaagcgggaggcauu

SEQ ID NO: 1482022 - RNA, 19 nt, Homo sapiens
cauauuacuuugucugcaa

SEQ ID NO: 1482023 - RNA, 19 nt, Homo sapiens
gaccauaucuauuuucgaa

SEQ ID NO: 1482024 - RNA, 19 nt, Homo sapiens
aagagcaggcuaugcauua

SEQ ID NO: 1482025 - RNA, 19 nt, Homo sapiens
ccuuaagucuggagaagaa

SEQ ID NO: 1482026 - RNA, 19 nt, Homo sapiens
gacagggaauuuaauagca

SEQ ID NO: 1482027 - RNA, 19 nt, Homo sapiens
uggaaucacuggcaaguca

SEQ ID NO: 1482028 - RNA, 19 nt, Homo sapiens
ggaggcauuccaucucuaa

SEQ ID NO: 1482029 - RNA, 19 nt, Homo sapiens
auaaaggccucccauaucu

SEQ ID NO: 1482030 - RNA, 19 nt, Homo sapiens
gguauuguguauaggaaau

SEQ ID NO: 1482031 - RNA, 19 nt, Homo sapiens
caagaauaguguguuugaa

SEQ ID NO: 1482032 - RNA, 19 nt, Homo sapiens
ggaaucccaagccugauaa

SEQ ID NO: 1482033 - RNA, 19 nt, Homo sapiens
cauaaaggccucccauauc

SEQ ID NO: 1482034 - RNA, 19 nt, Homo sapiens
gcaggaauaaaccuaauca

SEQ ID NO: 1482035 - RNA, 19 nt, Homo sapiens
uaacauacaaugcaaaugc

SEQ ID NO: 1482036 - RNA, 19 nt, Homo sapiens
gcucugcuaucauuuguac

SEQ ID NO: 1482037 - RNA, 19 nt, Homo sapiens
gcaguauguuggaggugaa

SEQ ID NO: 1482038 - RNA, 19 nt, Homo sapiens
ucaauaaucgcuuucaaca

SEQ ID NO: 1482039 - RNA, 19 nt, Homo sapiens
accaaggauucccauaaua

SEQ ID NO: 1482040 - RNA, 19 nt, Homo sapiens
aauaauaucagcagagaug

SEQ ID NO: 1482041 - RNA, 19 nt, Homo sapiens
uguacuggcuaaagucauu

SEQ ID NO: 1482042 - RNA, 19 nt, Homo sapiens
gagguugggcgugacaaua

SEQ ID NO: 1482043 - RNA, 19 nt, Homo sapiens
ucgcugugcugucauucua

SEQ ID NO: 1482044 - RNA, 19 nt, Homo sapiens
gaaugcaggaauaaaccua

SEQ ID NO: 1482045 - RNA, 19 nt, Homo sapiens
ccagaagcauuuaccacau

SEQ ID NO: 1482046 - RNA, 19 nt, Homo sapiens
caaggauguuauugccaaa

SEQ ID NO: 1482047 - RNA, 19 nt, Homo sapiens
guaucaagaccaagaauag

SEQ ID NO: 1482048 - RNA, 19 nt, Homo sapiens
agaccaaggauucccauaa

SEQ ID NO: 1482049 - RNA, 19 nt, Homo sapiens
ugcaauggcuguggaauca

SEQ ID NO: 1482050 - RNA, 19 nt, Homo sapiens
ccugauaaaucuauugaac

SEQ ID NO: 1482051 - RNA, 19 nt, Homo sapiens
ggaccauccauaauuccua

SEQ ID NO: 1482052 - RNA, 19 nt, Homo sapiens
gaaaaugugcuaguaaaug

SEQ ID NO: 1482053 - RNA, 19 nt, Homo sapiens
acagggaauuuaauagcaa

SEQ ID NO: 1482054 - RNA, 19 nt, Homo sapiens
gacagcaggaugcaucaaa

SEQ ID NO: 1482055 - RNA, 19 nt, Homo sapiens
uggcagaacaaauuggaua

SEQ ID NO: 1482056 - RNA, 19 nt, Homo sapiens
ccaaaugaaaggugcaaug

SEQ ID NO: 1482057 - RNA, 19 nt, Homo sapiens
acauaaaggccucccauau

SEQ ID NO: 1482058 - RNA, 19 nt, Homo sapiens
cauagaaaaugugcuagua

SEQ ID NO: 1482059 - RNA, 19 nt, Homo sapiens
gugaugagccugaaguaca

SEQ ID NO: 1482060 - RNA, 19 nt, Homo sapiens
gggaggcauuccaucucua

SEQ ID NO: 1482061 - RNA, 19 nt, Homo sapiens
gcugucauagcucuaagua

SEQ ID NO: 1482062 - RNA, 19 nt, Homo sapiens
gagcugugagagaacauaa

SEQ ID NO: 1482063 - RNA, 19 nt, Homo sapiens
ucccaagccugauaaaucu

SEQ ID NO: 1482064 - RNA, 19 nt, Homo sapiens
uguauucaguucagacuuc

SEQ ID NO: 1482065 - RNA, 19 nt, Homo sapiens
agagcaggcuaugcauuaa

SEQ ID NO: 1482066 - RNA, 19 nt, Homo sapiens
ugaagggaauggaauugca

SEQ ID NO: 1482067 - RNA, 19 nt, Homo sapiens
gaaauucaggaugcuauag

SEQ ID NO: 1482068 - RNA, 19 nt, Homo sapiens
acaaauuggauacagcuuu

SEQ ID NO: 1482069 - RNA, 19 nt, Homo sapiens
caacgcucuuauacagaaa

SEQ ID NO: 1482070 - RNA, 19 nt, Homo sapiens
cagcuaaaaugcaguaugu

SEQ ID NO: 1482071 - RNA, 19 nt, Homo sapiens
gaacagacaccugguauua

SEQ ID NO: 1482072 - RNA, 19 nt, Homo sapiens
gauaggaacucuuuauugu

SEQ ID NO: 1482073 - RNA, 19 nt, Homo sapiens
gaaagaauacagucacaua

SEQ ID NO: 1482074 - RNA, 19 nt, Homo sapiens
gaagaaagaaugcauguug

SEQ ID NO: 1482075 - RNA, 19 nt, Homo sapiens
gaaauacauuccuguguug

SEQ ID NO: 1482076 - RNA, 19 nt, Homo sapiens
gaaaagaucuuccgcaaau

SEQ ID NO: 1482077 - RNA, 19 nt, Homo sapiens
ucaagaauguguccaguuu

SEQ ID NO: 1482078 - RNA, 19 nt, Homo sapiens
gcauaucgcugagauuauu

SEQ ID NO: 1482079 - RNA, 19 nt, Homo sapiens
gaaugucagugcuauugua

SEQ ID NO: 1482080 - RNA, 19 nt, Homo sapiens
gagauuauaggauggaaua

SEQ ID NO: 1482081 - RNA, 19 nt, Homo sapiens
gcaaaucuguggaauucug

SEQ ID NO: 1482082 - RNA, 19 nt, Homo sapiens
gaauguggcucauguucug

SEQ ID NO: 1482083 - RNA, 19 nt, Homo sapiens
guugaacuuuguacacuua

SEQ ID NO: 1482084 - RNA, 19 nt, Homo sapiens
agaauacagucacauauga

SEQ ID NO: 1482085 - RNA, 19 nt, Homo sapiens
agaaauacauuccuguguu

SEQ ID NO: 1482086 - RNA, 19 nt, Homo sapiens
guaauacguuuguuuccuu

SEQ ID NO: 1482087 - RNA, 19 nt, Homo sapiens
gcuguuaaauuucccagaa

SEQ ID NO: 1482088 - RNA, 19 nt, Homo sapiens
caaagaagccauugguuuc

SEQ ID NO: 1482089 - RNA, 19 nt, Homo sapiens
uaaggcagcuauagaauac

SEQ ID NO: 1482090 - RNA, 19 nt, Homo sapiens
gaaugcauguuggaaagaa

SEQ ID NO: 1482091 - RNA, 19 nt, Homo sapiens
caauagagaugaugaagcu

SEQ ID NO: 1482092 - RNA, 19 nt, Homo sapiens
ccagacagcuccugaagag

SEQ ID NO: 1482093 - RNA, 19 nt, Homo sapiens
gaggaauguuuauaucaga

SEQ ID NO: 1482094 - RNA, 19 nt, Homo sapiens
uaccaucucugcauuguga

SEQ ID NO: 1482095 - RNA, 19 nt, Homo sapiens
ccgcaaaucuguggaauuc

SEQ ID NO: 1482096 - RNA, 19 nt, Homo sapiens
gaaaacaugucaaaacaca

SEQ ID NO: 1482097 - RNA, 19 nt, Homo sapiens
cagaggaguugaugaggaa

SEQ ID NO: 1482098 - RNA, 19 nt, Homo sapiens
gcuauagaauaccaacuga

SEQ ID NO: 1482099 - RNA, 19 nt, Homo sapiens
acagacaccugguauuaug

SEQ ID NO: 1482100 - RNA, 19 nt, Homo sapiens
acaaagaagccauugguuu

SEQ ID NO: 1482101 - RNA, 19 nt, Homo sapiens
gaaagugacauauucuaag

SEQ ID NO: 1482102 - RNA, 19 nt, Homo sapiens
augaaaccauggagaaaua

SEQ ID NO: 1482103 - RNA, 19 nt, Homo sapiens
gaaugaauaugaugaaacc

SEQ ID NO: 1482104 - RNA, 19 nt, Homo sapiens
caaccuggcuuuggccuau

SEQ ID NO: 1482105 - RNA, 19 nt, Homo sapiens
gaaagaaugcauguuggaa

SEQ ID NO: 1482106 - RNA, 19 nt, Homo sapiens
cuuggaaccuuacaacaaa

SEQ ID NO: 1482107 - RNA, 19 nt, Homo sapiens
gcagauguccuggcagaaa

SEQ ID NO: 1482108 - RNA, 19 nt, Homo sapiens
gugauaguguuauucaaga

SEQ ID NO: 1482109 - RNA, 19 nt, Homo sapiens
aagcauaucgcugagauua

SEQ ID NO: 1482110 - RNA, 19 nt, Homo sapiens
caugauguguggaaguuga

SEQ ID NO: 1482111 - RNA, 19 nt, Homo sapiens
uagagcagcugccgaguag

SEQ ID NO: 1482112 - RNA, 19 nt, Homo sapiens
gcaagcugcuaucaaguac

SEQ ID NO: 1482113 - RNA, 19 nt, Homo sapiens
gaaguuguaauacguuugu

SEQ ID NO: 1482114 - RNA, 19 nt, Homo sapiens
cagaaguuguaauacguuu

SEQ ID NO: 1482115 - RNA, 19 nt, Homo sapiens
cccagaaagugacauauuc

SEQ ID NO: 1482116 - RNA, 19 nt, Homo sapiens
gucaagaagcauuaugaua

SEQ ID NO: 1482117 - RNA, 19 nt, Homo sapiens
ggaauucuguaacgaccau

SEQ ID NO: 1482118 - RNA, 19 nt, Homo sapiens
aaaaggcagugaaugaaua

SEQ ID NO: 1482119 - RNA, 19 nt, Homo sapiens
gcaagacacaauagagaug

SEQ ID NO: 1482120 - RNA, 19 nt, Homo sapiens
guagagcagcugccgagua

SEQ ID NO: 1482121 - RNA, 19 nt, Homo sapiens
uuugguauuucucgaguua

SEQ ID NO: 1482122 - RNA, 19 nt, Homo sapiens
ggaagcaagacacaauaga

SEQ ID NO: 1482123 - RNA, 19 nt, Homo sapiens
uagaauaccaacugagaaa

SEQ ID NO: 1482124 - RNA, 19 nt, Homo sapiens
gcauugauguucgcagugu

SEQ ID NO: 1482125 - RNA, 19 nt, Homo sapiens
cuagaacacugugaacuuc

SEQ ID NO: 1482126 - RNA, 19 nt, Homo sapiens
caaauacaaagaagccauu

SEQ ID NO: 1482127 - RNA, 19 nt, Homo sapiens
caagaagcccucacugaca

SEQ ID NO: 1482128 - RNA, 19 nt, Homo sapiens
uuaaggcagcuauagaaua

SEQ ID NO: 1482129 - RNA, 19 nt, Homo sapiens
gaacuucauggcagaaaca

SEQ ID NO: 1482130 - RNA, 19 nt, Homo sapiens
ugaagaagcagaggaguug

SEQ ID NO: 1482131 - RNA, 19 nt, Homo sapiens
gaagcaagacacaauagag

SEQ ID NO: 1482132 - RNA, 19 nt, Homo sapiens
gaauguguccaguuucuag

SEQ ID NO: 1482133 - RNA, 19 nt, Homo sapiens
ggaacagacaccugguauu

SEQ ID NO: 1482134 - RNA, 19 nt, Homo sapiens
gagaaauacauuccugugu

SEQ ID NO: 1482135 - RNA, 19 nt, Homo sapiens
cacccuaucucuaugacuu

SEQ ID NO: 1482136 - RNA, 19 nt, Homo sapiens
ucaaaagcuuggaaccuua

SEQ ID NO: 1482137 - RNA, 19 nt, Homo sapiens
ugauaggaacucuuuauug

SEQ ID NO: 1482138 - RNA, 19 nt, Homo sapiens
ggugauaggaacucuuuau

SEQ ID NO: 1482139 - RNA, 19 nt, Homo sapiens
gaugaaaccauggagaaau

SEQ ID NO: 1482140 - RNA, 19 nt, Homo sapiens
ccacugagggcauugaugu

SEQ ID NO: 1482141 - RNA, 19 nt, Homo sapiens
ugaagcauaucgcugagau

SEQ ID NO: 1482142 - RNA, 19 nt, Homo sapiens
aaagaaugcauguuggaaa

SEQ ID NO: 1482143 - RNA, 19 nt, Homo sapiens
ggaagaagaaagaaugcau

SEQ ID NO: 1482144 - RNA, 19 nt, Homo sapiens
gaugcuuccuguccuuguu

SEQ ID NO: 1482145 - RNA, 19 nt, Homo sapiens
ggaaauuaugacuuuggua

SEQ ID NO: 1482146 - RNA, 19 nt, Homo sapiens
uaugauaacauccugaaug

SEQ ID NO: 1482147 - RNA, 19 nt, Homo sapiens
ccucacacccuaucucuau

SEQ ID NO: 1482148 - RNA, 19 nt, Homo sapiens
uaucagaaguuguaauacg

SEQ ID NO: 1482149 - RNA, 19 nt, Homo sapiens
cauaccugcuguuauugaa

SEQ ID NO: 1482150 - RNA, 19 nt, Homo sapiens
caccugguauuaugccaaa

SEQ ID NO: 1482151 - RNA, 19 nt, Homo sapiens
gcuuggaaccuuacaacaa

SEQ ID NO: 1482152 - RNA, 19 nt, Homo sapiens
cauugugaauuuggugaua

SEQ ID NO: 1482153 - RNA, 19 nt, Homo sapiens
gcagcucucuuaugaugac

SEQ ID NO: 1482154 - RNA, 19 nt, Homo sapiens
uauagaauaccaacugaga

SEQ ID NO: 1482155 - RNA, 19 nt, Homo sapiens
aauaccaacugagaaacua

SEQ ID NO: 1482156 - RNA, 19 nt, Homo sapiens
aaagaugcuuccuguccuu

SEQ ID NO: 1482157 - RNA, 19 nt, Homo sapiens
ccaaaggaaauuaugacuu

SEQ ID NO: 1482158 - RNA, 19 nt, Homo sapiens
ggcagugaaugaauaugau

SEQ ID NO: 1482159 - RNA, 19 nt, Homo sapiens
caggaagcaagacacaaua

SEQ ID NO: 1482160 - RNA, 19 nt, Homo sapiens
ccaaacuuaugaggaaugu

SEQ ID NO: 1482161 - RNA, 19 nt, Homo sapiens
uagcugauaguggcauuua

SEQ ID NO: 1482162 - RNA, 19 nt, Homo sapiens
aagaaugcauguuggaaag

SEQ ID NO: 1482163 - RNA, 19 nt, Homo sapiens
ccugcaagcugcuaucaag

SEQ ID NO: 1482164 - RNA, 19 nt, Homo sapiens
gugauaggaacucuuuauu

SEQ ID NO: 1482165 - RNA, 19 nt, Homo sapiens
ugaggaagauugaaaagga

SEQ ID NO: 1482166 - RNA, 19 nt, Homo sapiens
ugaggaauguuuauaucag

SEQ ID NO: 1482167 - RNA, 19 nt, Homo sapiens
ccauagucaagaagcauua

SEQ ID NO: 1482168 - RNA, 19 nt, Homo sapiens
gaaguugaauguggcucau

SEQ ID NO: 1482169 - RNA, 19 nt, Homo sapiens
caagacacaauagagauga

SEQ ID NO: 1482170 - RNA, 19 nt, Homo sapiens
gaacuuuguacacuuaugc

SEQ ID NO: 1482171 - RNA, 19 nt, Homo sapiens
gaggauugcuuggcuauua

SEQ ID NO: 1482172 - RNA, 19 nt, Homo sapiens
gggauuauguucuucauuu

SEQ ID NO: 1482173 - RNA, 19 nt, Homo sapiens
gaaauaguuugcucuaguu

SEQ ID NO: 1482174 - RNA, 19 nt, Homo sapiens
caacauacacgucaauuaa

SEQ ID NO: 1482175 - RNA, 19 nt, Homo sapiens
aaacauagcucaaagugau

SEQ ID NO: 1482176 - RNA, 19 nt, Homo sapiens
caauagaguugaugaguga

SEQ ID NO: 1482177 - RNA, 19 nt, Homo sapiens
agaagagucuccuagaaua

SEQ ID NO: 1482178 - RNA, 19 nt, Homo sapiens
gagaggacauuucaagaug

SEQ ID NO: 1482179 - RNA, 19 nt, Homo sapiens
aagaagagcugguaccauu

SEQ ID NO: 1482180 - RNA, 19 nt, Homo sapiens
gaaguuggguaacaugaug

SEQ ID NO: 1482181 - RNA, 19 nt, Homo sapiens
caaggccucuccauauuaa

SEQ ID NO: 1482182 - RNA, 19 nt, Homo sapiens
ggaauguaauuaccacuga

SEQ ID NO: 1482183 - RNA, 19 nt, Homo sapiens
gcaaacacuucugugcaua

SEQ ID NO: 1482184 - RNA, 19 nt, Homo sapiens
gagaugaccuuugccaaga

SEQ ID NO: 1482185 - RNA, 19 nt, Homo sapiens
ccaaagcaguccuucacua

SEQ ID NO: 1482186 - RNA, 19 nt, Homo sapiens
uagagaagcugagguuaaa

SEQ ID NO: 1482187 - RNA, 19 nt, Homo sapiens
agaaucaugucaucuguaa

SEQ ID NO: 1482188 - RNA, 19 nt, Homo sapiens
ucucuucccuccucuauuu

SEQ ID NO: 1482189 - RNA, 19 nt, Homo sapiens
ugucuucucugauuucuuu

SEQ ID NO: 1482190 - RNA, 19 nt, Homo sapiens
aaacaaccaucagaaacua

SEQ ID NO: 1482191 - RNA, 19 nt, Homo sapiens
agacagaccugaaaauuuu

SEQ ID NO: 1482192 - RNA, 19 nt, Homo sapiens
gaauagagaagcugagguu

SEQ ID NO: 1482193 - RNA, 19 nt, Homo sapiens
gaaguuuggcugaaggaua

SEQ ID NO: 1482194 - RNA, 19 nt, Homo sapiens
gauauagaaucaugucauc

SEQ ID NO: 1482195 - RNA, 19 nt, Homo sapiens
gauaacauauaggaacuga

SEQ ID NO: 1482196 - RNA, 19 nt, Homo sapiens
gcaauuaugaaugggauua

SEQ ID NO: 1482197 - RNA, 19 nt, Homo sapiens
ccaauacccuugaugaaca

SEQ ID NO: 1482198 - RNA, 19 nt, Homo sapiens
uagacuagcuggacauaug

SEQ ID NO: 1482199 - RNA, 19 nt, Homo sapiens
ugacaaagggaauguaauu

SEQ ID NO: 1482200 - RNA, 19 nt, Homo sapiens
ugaaugggauuauguucuu

SEQ ID NO: 1482201 - RNA, 19 nt, Homo sapiens
ugaaauaguuugcucuagu

SEQ ID NO: 1482202 - RNA, 19 nt, Homo sapiens
ucaaagugaugagcuguuu

SEQ ID NO: 1482203 - RNA, 19 nt, Homo sapiens
guacaaagaagagcuggua

SEQ ID NO: 1482204 - RNA, 19 nt, Homo sapiens
gaaauagaaacaaccauca

SEQ ID NO: 1482205 - RNA, 19 nt, Homo sapiens
caacugagccaggaagaaa

SEQ ID NO: 1482206 - RNA, 19 nt, Homo sapiens
uaaucugacucaucccaua

SEQ ID NO: 1482207 - RNA, 19 nt, Homo sapiens
auaacaagcuccgaaauug

SEQ ID NO: 1482208 - RNA, 19 nt, Homo sapiens
ggauuauguucuucauuug

SEQ ID NO: 1482209 - RNA, 19 nt, Homo sapiens
cugguuagcuguauuccua

SEQ ID NO: 1482210 - RNA, 19 nt, Homo sapiens
ugacuugcaucuguaaauu

SEQ ID NO: 1482211 - RNA, 19 nt, Homo sapiens
acacuucugugcauacaaa

SEQ ID NO: 1482212 - RNA, 19 nt, Homo sapiens
agagugaacugcagaguca

SEQ ID NO: 1482213 - RNA, 19 nt, Homo sapiens
guucaagaauugguuugua

SEQ ID NO: 1482214 - RNA, 19 nt, Homo sapiens
gauccagaaucaugacaga

SEQ ID NO: 1482215 - RNA, 19 nt, Homo sapiens
gguaaggccucuuucuaag

SEQ ID NO: 1482216 - RNA, 19 nt, Homo sapiens
ucauuugacucucugcuuu

SEQ ID NO: 1482217 - RNA, 19 nt, Homo sapiens
ggaaacauagcucaaagug

SEQ ID NO: 1482218 - RNA, 19 nt, Homo sapiens
gacaaagggaauguaauua

SEQ ID NO: 1482219 - RNA, 19 nt, Homo sapiens
gaaacaaccaucagaaacu

SEQ ID NO: 1482220 - RNA, 19 nt, Homo sapiens
uaaggccucuuucuaagga

SEQ ID NO: 1482221 - RNA, 19 nt, Homo sapiens
ggagugagcagacaauaag

SEQ ID NO: 1482222 - RNA, 19 nt, Homo sapiens
caugaugccuccagcuuug

SEQ ID NO: 1482223 - RNA, 19 nt, Homo sapiens
gaggaaacauagcucaaag

SEQ ID NO: 1482224 - RNA, 19 nt, Homo sapiens
ucaaggccucuccauauua

SEQ ID NO: 1482225 - RNA, 19 nt, Homo sapiens
ggagaggacauuucaagau

SEQ ID NO: 1482226 - RNA, 19 nt, Homo sapiens
ugaggacacugaagaagga

SEQ ID NO: 1482227 - RNA, 19 nt, Homo sapiens
ccacagaaauagaaacaac

SEQ ID NO: 1482228 - RNA, 19 nt, Homo sapiens
cagauaaucaggagaagaa

SEQ ID NO: 1482229 - RNA, 19 nt, Homo sapiens
gauaacugagugacagaua

SEQ ID NO: 1482230 - RNA, 19 nt, Homo sapiens
uuauaucacucccagguuu

SEQ ID NO: 1482231 - RNA, 19 nt, Homo sapiens
gaaacauagcucaaaguga

SEQ ID NO: 1482232 - RNA, 19 nt, Homo sapiens
guuaauccaucaugaucaa

SEQ ID NO: 1482233 - RNA, 19 nt, Homo sapiens
caucagaaacuacugcaaa

SEQ ID NO: 1482234 - RNA, 19 nt, Homo sapiens
aaaaggagauccagaauca

SEQ ID NO: 1482235 - RNA, 19 nt, Homo sapiens
gauugguguucaagaauug

SEQ ID NO: 1482236 - RNA, 19 nt, Homo sapiens
cgauugguguucaagaauu

SEQ ID NO: 1482237 - RNA, 19 nt, Homo sapiens
ggacauaugcuggcugugu

SEQ ID NO: 1482238 - RNA, 19 nt, Homo sapiens
gaacccagucauggaguua

SEQ ID NO: 1482239 - RNA, 19 nt, Homo sapiens
gaggaugauugaaauaaac

SEQ ID NO: 1482240 - RNA, 19 nt, Homo sapiens
uaacaagcuccgaaauuga

SEQ ID NO: 1482241 - RNA, 19 nt, Homo sapiens
caaauacacccucccacaa

SEQ ID NO: 1482242 - RNA, 19 nt, Homo sapiens
gaggacauuucaagaugga

SEQ ID NO: 1482243 - RNA, 19 nt, Homo sapiens
ucaacauacacgucaauua

SEQ ID NO: 1482244 - RNA, 19 nt, Homo sapiens
aagcugagguuaaaguugu

SEQ ID NO: 1482245 - RNA, 19 nt, Homo sapiens
ggucugcagcucacacaua

SEQ ID NO: 1482246 - RNA, 19 nt, Homo sapiens
caagagcucuguuuuaaag

SEQ ID NO: 1482247 - RNA, 19 nt, Homo sapiens
gcuagcagacuaauacaga

SEQ ID NO: 1482248 - RNA, 19 nt, Homo sapiens
auacagaggaugauugaaa

SEQ ID NO: 1482249 - RNA, 19 nt, Homo sapiens
gcaggcaugugugauaaca

SEQ ID NO: 1482250 - RNA, 19 nt, Homo sapiens
auaagaagcccacagaaga

SEQ ID NO: 1482251 - RNA, 19 nt, Homo sapiens
gacagaaucaauagaguug

SEQ ID NO: 1482252 - RNA, 19 nt, Homo sapiens
guuugugucuucucugauu

SEQ ID NO: 1482253 - RNA, 19 nt, Homo sapiens
gcuguagcccuguaguaua

SEQ ID NO: 1482254 - RNA, 19 nt, Homo sapiens
ugacucaucccauaaacaa

SEQ ID NO: 1482255 - RNA, 19 nt, Homo sapiens
caaagugucagauuuacug

SEQ ID NO: 1482256 - RNA, 19 nt, Homo sapiens
ugacagauaaucaggagaa

SEQ ID NO: 1482257 - RNA, 19 nt, Homo sapiens
caaaagaucuacgaauuca

SEQ ID NO: 1482258 - RNA, 19 nt, Homo sapiens
gaaaugacaaagggaaugu

SEQ ID NO: 1482259 - RNA, 19 nt, Homo sapiens
guaccaguaucaugcuguu

SEQ ID NO: 1482260 - RNA, 19 nt, Homo sapiens
gcuccgaaauugaaucagu

SEQ ID NO: 1482261 - RNA, 19 nt, Homo sapiens
cuagaaaacuucaaagaga

SEQ ID NO: 1482262 - RNA, 19 nt, Homo sapiens
gucaagagcucuguuuuaa

SEQ ID NO: 1482263 - RNA, 19 nt, Homo sapiens
acagagagaugaccuuugc

SEQ ID NO: 1482264 - RNA, 19 nt, Homo sapiens
auaacugagugacagauaa

SEQ ID NO: 1482265 - RNA, 19 nt, Homo sapiens
gaagagucuccuagaauag

SEQ ID NO: 1482266 - RNA, 19 nt, Homo sapiens
uaauacagaggaugauuga

SEQ ID NO: 1482267 - RNA, 19 nt, Homo sapiens
gcagacagaaucaauagag

SEQ ID NO: 1482268 - RNA, 19 nt, Homo sapiens
gguaagugcagcccacaaa

SEQ ID NO: 1482269 - RNA, 19 nt, Homo sapiens
uaauagggaugacuugcau

SEQ ID NO: 1482270 - RNA, 19 nt, Homo sapiens
ccaugugauuaucucaaua

SEQ ID NO: 1482271 - RNA, 19 nt, Homo sapiens
ggacaaagcuacacagaca

SEQ ID NO: 1482272 - RNA, 19 nt, Homo sapiens
aaacaaggauugauaggua

SEQ ID NO: 1482273 - RNA, 19 nt, Homo sapiens
caacuuauaccgcaagaua

SEQ ID NO: 1482274 - RNA, 19 nt, Homo sapiens
ggaauagcguggaaggauu

SEQ ID NO: 1482275 - RNA, 19 nt, Homo sapiens
ugaggaagcugaaggauag

SEQ ID NO: 1482276 - RNA, 19 nt, Homo sapiens
guaaaugcauugaacaagu

SEQ ID NO: 1482277 - RNA, 19 nt, Homo sapiens
caaaacagcuucaugaaau

SEQ ID NO: 1482278 - RNA, 19 nt, Homo sapiens
gagagacaauaucacguuu

SEQ ID NO: 1482279 - RNA, 19 nt, Homo sapiens
gaagaaagggucucacaag

SEQ ID NO: 1482280 - RNA, 19 nt, Homo sapiens
aaacguagcaaacaggaua

SEQ ID NO: 1482281 - RNA, 19 nt, Homo sapiens
aaaggaagagcaacuuaua

SEQ ID NO: 1482282 - RNA, 19 nt, Homo sapiens
caaagggauuguugacguu

SEQ ID NO: 1482283 - RNA, 19 nt, Homo sapiens
guacagaucaacuuaagga

SEQ ID NO: 1482284 - RNA, 19 nt, Homo sapiens
cggaugaccugcuuguuga

SEQ ID NO: 1482285 - RNA, 19 nt, Homo sapiens
gugcaugggcugaagaaua

SEQ ID NO: 1482286 - RNA, 19 nt, Homo sapiens
ggagagacaauaucacguu

SEQ ID NO: 1482287 - RNA, 19 nt, Homo sapiens
ccaaagagugcacuuauuc

SEQ ID NO: 1482288 - RNA, 19 nt, Homo sapiens
gcugaagaauacucugaaa

SEQ ID NO: 1482289 - RNA, 19 nt, Homo sapiens
caacaucguuccucaccau

SEQ ID NO: 1482290 - RNA, 19 nt, Homo sapiens
cagaucaacuuaaggagau

SEQ ID NO: 1482291 - RNA, 19 nt, Homo sapiens
gcaauauucguacauuaug

SEQ ID NO: 1482292 - RNA, 19 nt, Homo sapiens
gcacuuauuccuguaauuc

SEQ ID NO: 1482293 - RNA, 19 nt, Homo sapiens
ucaagccccuccaguauua

SEQ ID NO: 1482294 - RNA, 19 nt, Homo sapiens
gaaaaggaagagcaacuua

SEQ ID NO: 1482295 - RNA, 19 nt, Homo sapiens
gaagaauacucugaaaaga

SEQ ID NO: 1482296 - RNA, 19 nt, Homo sapiens
gaauagcguggaaggauug

SEQ ID NO: 1482297 - RNA, 19 nt, Homo sapiens
ggacacuggccucgggaua

SEQ ID NO: 1482298 - RNA, 19 nt, Homo sapiens
gcacugauugaaacaagaa

SEQ ID NO: 1482299 - RNA, 19 nt, Homo sapiens
gugaaagggucaaagucuu

SEQ ID NO: 1482300 - RNA, 19 nt, Homo sapiens
uaaagagaaugggaacaau

SEQ ID NO: 1482301 - RNA, 19 nt, Homo sapiens
gcaaccaugcagcuauuaa

SEQ ID NO: 1482302 - RNA, 19 nt, Homo sapiens
gcaguacagaucaacuuaa

SEQ ID NO: 1482303 - RNA, 19 nt, Homo sapiens
gcaaacaggauauucaaaa

SEQ ID NO: 1482304 - RNA, 19 nt, Homo sapiens
aaacaagaaaggucucauu

SEQ ID NO: 1482305 - RNA, 19 nt, Homo sapiens
gccaucagcuucucuacuc

SEQ ID NO: 1482306 - RNA, 19 nt, Homo sapiens
gcggaugaccugcuuguug

SEQ ID NO: 1482307 - RNA, 19 nt, Homo sapiens
ucaucgagauaaagaaaga

SEQ ID NO: 1482308 - RNA, 19 nt, Homo sapiens
ggaccaaagggauuguuga

SEQ ID NO: 1482309 - RNA, 19 nt, Homo sapiens
cgccaacccucagugcuua

SEQ ID NO: 1482310 - RNA, 19 nt, Homo sapiens
guaauucccaucaccaaau

SEQ ID NO: 1482311 - RNA, 19 nt, Homo sapiens
caaagcaggugacaaaaca

SEQ ID NO: 1482312 - RNA, 19 nt, Homo sapiens
gcuguggccucccugucua

SEQ ID NO: 1482313 - RNA, 19 nt, Homo sapiens
caucguuccucaccauuuc

SEQ ID NO: 1482314 - RNA, 19 nt, Homo sapiens
gaagcucgccggagaagag

SEQ ID NO: 1482315 - RNA, 19 nt, Homo sapiens
ggcaguacagaucaacuua

SEQ ID NO: 1482316 - RNA, 19 nt, Homo sapiens
caucaucgagauaaagaaa

SEQ ID NO: 1482317 - RNA, 19 nt, Homo sapiens
ccagcaaucuuaaucucau

SEQ ID NO: 1482318 - RNA, 19 nt, Homo sapiens
uaaagggagaugugacuga

SEQ ID NO: 1482319 - RNA, 19 nt, Homo sapiens
gugaugugcuccagcuuuc

SEQ ID NO: 1482320 - RNA, 19 nt, Homo sapiens
uugcaaagcaggugacaaa

SEQ ID NO: 1482321 - RNA, 19 nt, Homo sapiens
aaagagaaugggaacaauu

SEQ ID NO: 1482322 - RNA, 19 nt, Homo sapiens
ucccagagauaaagagaau

SEQ ID NO: 1482323 - RNA, 19 nt, Homo sapiens
uccaaagagugcacuuauu

SEQ ID NO: 1482324 - RNA, 19 nt, Homo sapiens
caguacagaucaacuuaag

SEQ ID NO: 1482325 - RNA, 19 nt, Homo sapiens
aacaaggauugauagguaa

SEQ ID NO: 1482326 - RNA, 19 nt, Homo sapiens
guagcaaacaggauauuca

SEQ ID NO: 1482327 - RNA, 19 nt, Homo sapiens
gauccuugccaacaugauu

SEQ ID NO: 1482328 - RNA, 19 nt, Homo sapiens
cacaagcgcucagcaucuu

SEQ ID NO: 1482329 - RNA, 19 nt, Homo sapiens
ggucucauucuuuaccuuu

SEQ ID NO: 1482330 - RNA, 19 nt, Homo sapiens
cuacaaacacagagcaaga

SEQ ID NO: 1482331 - RNA, 19 nt, Homo sapiens
uggcaaccaugcagcuauu

SEQ ID NO: 1482332 - RNA, 19 nt, Homo sapiens
caacuuaaggagauugcaa

SEQ ID NO: 1482333 - RNA, 19 nt, Homo sapiens
ugcaugggcugaagaauac

SEQ ID NO: 1482334 - RNA, 19 nt, Homo sapiens
ccaacaugauuccuaaagg

SEQ ID NO: 1482335 - RNA, 19 nt, Homo sapiens
uggccucccugucuacaaa

SEQ ID NO: 1482336 - RNA, 19 nt, Homo sapiens
gggaacaauucuccuuugc

SEQ ID NO: 1482337 - RNA, 19 nt, Homo sapiens
ucccaaacaaggauugaua

SEQ ID NO: 1482338 - RNA, 19 nt, Homo sapiens
aaagggagaugugacugau

SEQ ID NO: 1482339 - RNA, 19 nt, Homo sapiens
uugccaacaugauuccuaa

SEQ ID NO: 1482340 - RNA, 19 nt, Homo sapiens
ugggaacaauucuccuuug

SEQ ID NO: 1482341 - RNA, 19 nt, Homo sapiens
uaauucccaucaccaaauc

SEQ ID NO: 1482342 - RNA, 19 nt, Homo sapiens
cuuguucccuuucuagaug

SEQ ID NO: 1482343 - RNA, 19 nt, Homo sapiens
gggcugaagaauacucuga

SEQ ID NO: 1482344 - RNA, 19 nt, Homo sapiens
gguggccucuguuucuugu

SEQ ID NO: 1482345 - RNA, 19 nt, Homo sapiens
gcuuuccagugacauguga

SEQ ID NO: 1482346 - RNA, 19 nt, Homo sapiens
ucucaugacuauguucuuc

SEQ ID NO: 1482347 - RNA, 19 nt, Homo sapiens
aaacacgacagccuucuuc

SEQ ID NO: 1482348 - RNA, 19 nt, Homo sapiens
uagcaaacaggauauucaa

SEQ ID NO: 1482349 - RNA, 19 nt, Homo sapiens
acuauguucuucucccaaa

SEQ ID NO: 1482350 - RNA, 19 nt, Homo sapiens
gagagugcaugggcugaag

SEQ ID NO: 1482351 - RNA, 19 nt, Homo sapiens
gagugcacuuauuccugua

SEQ ID NO: 1482352 - RNA, 19 nt, Homo sapiens
cgccagcaguugcagagaa

SEQ ID NO: 1482353 - RNA, 19 nt, Homo sapiens
gggcaguacagaucaacuu

SEQ ID NO: 1482354 - RNA, 19 nt, Homo sapiens
gauagguaaaugcauugaa

SEQ ID NO: 1482355 - RNA, 19 nt, Homo sapiens
cuuaaucucaugacuaugu

SEQ ID NO: 1482356 - RNA, 19 nt, Homo sapiens
gcagcacgcgcagcauuga

SEQ ID NO: 1482357 - RNA, 19 nt, Homo sapiens
cagcaguugcagagaagua

SEQ ID NO: 1482358 - RNA, 19 nt, Homo sapiens
cagcaaucuuaaucucaug

SEQ ID NO: 1482359 - RNA, 19 nt, Homo sapiens
cgaggaacaaguacaguca

SEQ ID NO: 1482360 - RNA, 19 nt, Homo sapiens
gcaguugcagagaaguaaa

SEQ ID NO: 1482361 - RNA, 19 nt, Homo sapiens
caaacaggauauucaaaag

SEQ ID NO: 1482362 - RNA, 19 nt, Homo sapiens
ccaaaacagcuucaugaaa

SEQ ID NO: 1482363 - RNA, 19 nt, Homo sapiens
ccagagauaaagagaaugg

SEQ ID NO: 1482364 - RNA, 19 nt, Homo sapiens
ggauugauagguaaaugca

SEQ ID NO: 1482365 - RNA, 19 nt, Homo sapiens
caaacaaggauugauaggu

SEQ ID NO: 1482366 - RNA, 19 nt, Homo sapiens
gaaccaucuuuucuaugaa

SEQ ID NO: 1482367 - RNA, 19 nt, Homo sapiens
gcacuuccucccuggauac

SEQ ID NO: 1482368 - RNA, 19 nt, Homo sapiens
gaucccagagauaaagaga

SEQ ID NO: 1482369 - RNA, 19 nt, Homo sapiens
guuccaaagagugcacuua

SEQ ID NO: 1482370 - RNA, 19 nt, Homo sapiens
ggcaucaucgagauaaaga

SEQ ID NO: 1482371 - RNA, 19 nt, Homo sapiens
gaaagaaggugaagaagaa

SEQ ID NO: 1482372 - RNA, 19 nt, Homo sapiens
ggaaagagcuugcuugaag

SEQ ID NO: 1482373 - RNA, 19 nt, Homo sapiens
gggaagagaugauauaguu

SEQ ID NO: 1482374 - RNA, 19 nt, Homo sapiens
gaagaaagacauugaauuc

SEQ ID NO: 1482375 - RNA, 19 nt, Homo sapiens
gaacccaccucccaagaaa

SEQ ID NO: 1482376 - RNA, 19 nt, Homo sapiens
gaaagacauugaauuccua

SEQ ID NO: 1482377 - RNA, 19 nt, Homo sapiens
cuaagaagcuguaauuuca

SEQ ID NO: 1482378 - RNA, 19 nt, Homo sapiens
caagagauauaccaccuuu

SEQ ID NO: 1482379 - RNA, 19 nt, Homo sapiens
gcaccuacauuaaagaguu

SEQ ID NO: 1482380 - RNA, 19 nt, Homo sapiens
caggacacauucucuguua

SEQ ID NO: 1482381 - RNA, 19 nt, Homo sapiens
gaaauugaaugugcucaug

SEQ ID NO: 1482382 - RNA, 19 nt, Homo sapiens
ggaaggaucucuguuaguc

SEQ ID NO: 1482383 - RNA, 19 nt, Homo sapiens
acaaggaguugcucaauga

SEQ ID NO: 1482384 - RNA, 19 nt, Homo sapiens
ccaaggaugucuuaggauu

SEQ ID NO: 1482385 - RNA, 19 nt, Homo sapiens
gagggaaggaucucuguua

SEQ ID NO: 1482386 - RNA, 19 nt, Homo sapiens
uaacaucucaggaucuaua

SEQ ID NO: 1482387 - RNA, 19 nt, Homo sapiens
gcuggaaucuucaguggaa

SEQ ID NO: 1482388 - RNA, 19 nt, Homo sapiens
gaccuacagugccuuaauu

SEQ ID NO: 1482389 - RNA, 19 nt, Homo sapiens
uuaaggaacuucagcagaa

SEQ ID NO: 1482390 - RNA, 19 nt, Homo sapiens
ggugaauccucauagagua

SEQ ID NO: 1482391 - RNA, 19 nt, Homo sapiens
ccauaacggugucuugaaa

SEQ ID NO: 1482392 - RNA, 19 nt, Homo sapiens
caaauaaagcgauacagaa

SEQ ID NO: 1482393 - RNA, 19 nt, Homo sapiens
gcugggagauauaauaaau

SEQ ID NO: 1482394 - RNA, 19 nt, Homo sapiens
gaagagaagauguagaugu

SEQ ID NO: 1482395 - RNA, 19 nt, Homo sapiens
caaacuccuuggauaauug

SEQ ID NO: 1482396 - RNA, 19 nt, Homo sapiens
cagaaacaguugaggauug

SEQ ID NO: 1482397 - RNA, 19 nt, Homo sapiens
ccacaaacuccuuggauaa

SEQ ID NO: 1482398 - RNA, 19 nt, Homo sapiens
gaaagagcuugcuugaagu

SEQ ID NO: 1482399 - RNA, 19 nt, Homo sapiens
gcacaaacaggacacauuc

SEQ ID NO: 1482400 - RNA, 19 nt, Homo sapiens
gauaauugauggagaaagg

SEQ ID NO: 1482401 - RNA, 19 nt, Homo sapiens
gcgcuguucuugaaauuga

SEQ ID NO: 1482402 - RNA, 19 nt, Homo sapiens
gaagagaugauauaguuca

SEQ ID NO: 1482403 - RNA, 19 nt, Homo sapiens
gaucaucuguuggcaguau

SEQ ID NO: 1482404 - RNA, 19 nt, Homo sapiens
gaugauauaguucagcuaa

SEQ ID NO: 1482405 - RNA, 19 nt, Homo sapiens
gaacuggaagauaguauug

SEQ ID NO: 1482406 - RNA, 19 nt, Homo sapiens
ggacauccauggagcacau

SEQ ID NO: 1482407 - RNA, 19 nt, Homo sapiens
gaacuucagcagaaaauua

SEQ ID NO: 1482408 - RNA, 19 nt, Homo sapiens
ggucuuugcucacccagaa

SEQ ID NO: 1482409 - RNA, 19 nt, Homo sapiens
uuagagaggugcacaaaca

SEQ ID NO: 1482410 - RNA, 19 nt, Homo sapiens
cacauucucuguuaaccua

SEQ ID NO: 1482411 - RNA, 19 nt, Homo sapiens
caauugagcuggugaaucc

SEQ ID NO: 1482412 - RNA, 19 nt, Homo sapiens
agagauauaccaccuuuaa

SEQ ID NO: 1482413 - RNA, 19 nt, Homo sapiens
gcccaguuguugcucaaua

SEQ ID NO: 1482414 - RNA, 19 nt, Homo sapiens
ugacuagcuuucaaauuug

SEQ ID NO: 1482415 - RNA, 19 nt, Homo sapiens
auaaagcgauacagaagaa

SEQ ID NO: 1482416 - RNA, 19 nt, Homo sapiens
ggcaauaggacauaugaaa

SEQ ID NO: 1482417 - RNA, 19 nt, Homo sapiens
uagaauggcaguuaugaaa

SEQ ID NO: 1482418 - RNA, 19 nt, Homo sapiens
uguaugcgcuguucuugaa

SEQ ID NO: 1482419 - RNA, 19 nt, Homo sapiens
ccacaaaccaaacuaugaa

SEQ ID NO: 1482420 - RNA, 19 nt, Homo sapiens
caauaggacauaugaaaga

SEQ ID NO: 1482421 - RNA, 19 nt, Homo sapiens
ugaaagccuugaauaagau

SEQ ID NO: 1482422 - RNA, 19 nt, Homo sapiens
gcucaauacugguacuugu

SEQ ID NO: 1482423 - RNA, 19 nt, Homo sapiens
acauuucacuucacaagaa

SEQ ID NO: 1482424 - RNA, 19 nt, Homo sapiens
aaagaagccuacaaaugga

SEQ ID NO: 1482425 - RNA, 19 nt, Homo sapiens
aaacagcugugagacacua

SEQ ID NO: 1482426 - RNA, 19 nt, Homo sapiens
uaaagaguuuguacaugga

SEQ ID NO: 1482427 - RNA, 19 nt, Homo sapiens
aagagaagauguagaugug

SEQ ID NO: 1482428 - RNA, 19 nt, Homo sapiens
gaaaggaagcuggaaucuu

SEQ ID NO: 1482429 - RNA, 19 nt, Homo sapiens
guuaugaaagccuugaaua

SEQ ID NO: 1482430 - RNA, 19 nt, Homo sapiens
ucacuagaauggcaguuau

SEQ ID NO: 1482431 - RNA, 19 nt, Homo sapiens
ugaagugaguguggucuuu

SEQ ID NO: 1482432 - RNA, 19 nt, Homo sapiens
uagaguacauuucacuuca

SEQ ID NO: 1482433 - RNA, 19 nt, Homo sapiens
ugcaagaacuggaagauag

SEQ ID NO: 1482434 - RNA, 19 nt, Homo sapiens
caggaucuauauaugugua

SEQ ID NO: 1482435 - RNA, 19 nt, Homo sapiens
uaaggaacuucagcagaaa

SEQ ID NO: 1482436 - RNA, 19 nt, Homo sapiens
gaaagccuugaauaagaua

SEQ ID NO: 1482437 - RNA, 19 nt, Homo sapiens
augaaagccuugaauaaga

SEQ ID NO: 1482438 - RNA, 19 nt, Homo sapiens
caccugcucuggaugacua

SEQ ID NO: 1482439 - RNA, 19 nt, Homo sapiens
ggacaaauaaagcgauaca

SEQ ID NO: 1482440 - RNA, 19 nt, Homo sapiens
gcugcgauaugcccagauu

SEQ ID NO: 1482441 - RNA, 19 nt, Homo sapiens
ggagcuggauguugagucu

SEQ ID NO: 1482442 - RNA, 19 nt, Homo sapiens
ugaaagaaggugaagaaga

SEQ ID NO: 1482443 - RNA, 19 nt, Homo sapiens
gcaauaggacauaugaaag

SEQ ID NO: 1482444 - RNA, 19 nt, Homo sapiens
acaaacuccuuggauaauu

SEQ ID NO: 1482445 - RNA, 19 nt, Homo sapiens
gaauggcaguuaugaaagc

SEQ ID NO: 1482446 - RNA, 19 nt, Homo sapiens
cuuacaaacuuccauacaa

SEQ ID NO: 1482447 - RNA, 19 nt, Homo sapiens
ucaugcaccuuacaaacuu

SEQ ID NO: 1482448 - RNA, 19 nt, Homo sapiens
gagauauaccaccuuuaaa

SEQ ID NO: 1482449 - RNA, 19 nt, Homo sapiens
gagacaaagaguaugguuu

SEQ ID NO: 1482450 - RNA, 19 nt, Homo sapiens
cauaaaggacuuaaagauc

SEQ ID NO: 1482451 - RNA, 19 nt, Homo sapiens
uaugaaagaaggugaagaa

SEQ ID NO: 1482452 - RNA, 19 nt, Homo sapiens
gcugggaagagaugauaua

SEQ ID NO: 1482453 - RNA, 19 nt, Homo sapiens
uguaauguaugccuaggaa

SEQ ID NO: 1482454 - RNA, 19 nt, Homo sapiens
uuacaaacuuccauacaag

SEQ ID NO: 1482455 - RNA, 19 nt, Homo sapiens
caucucaggaucuauauau

SEQ ID NO: 1482456 - RNA, 19 nt, Homo sapiens
uguaacaucucaggaucua

SEQ ID NO: 1482457 - RNA, 19 nt, Homo sapiens
ugacauaaaggacuuaaag

SEQ ID NO: 1482458 - RNA, 19 nt, Homo sapiens
gcuggugaauccucauaga

SEQ ID NO: 1482459 - RNA, 19 nt, Homo sapiens
uaauguaugccuaggaauu

SEQ ID NO: 1482460 - RNA, 19 nt, Homo sapiens
caaggaugucuuaggauuu

SEQ ID NO: 1482461 - RNA, 19 nt, Homo sapiens
uaaaggacuuaaagaucga

SEQ ID NO: 1482462 - RNA, 19 nt, Homo sapiens
acaaauaaagcgauacaga

SEQ ID NO: 1482463 - RNA, 19 nt, Homo sapiens
cacaagaaauuaaggaacu

SEQ ID NO: 1482464 - RNA, 19 nt, Homo sapiens
cgauaugcccagauuguuu

SEQ ID NO: 1482465 - RNA, 19 nt, Homo sapiens
ccaccacaacuaucuguaa

SEQ ID NO: 1482466 - RNA, 19 nt, Homo sapiens
gaggcaauaggacauauga

SEQ ID NO: 1482467 - RNA, 19 nt, Homo sapiens
gagaggcaauaggacauau

SEQ ID NO: 1482468 - RNA, 19 nt, Homo sapiens
gcucaaugaacuacagaaa

SEQ ID NO: 1482469 - RNA, 19 nt, Homo sapiens
gagaaaggaagcuggaauc

SEQ ID NO: 1482470 - RNA, 19 nt, Homo sapiens
ccacaacuaucuguaagag

SEQ ID NO: 1482471 - RNA, 19 nt, Homo sapiens
gaaaugggcuuuacagaug

SEQ ID NO: 1482472 - RNA, 19 nt, Homo sapiens
gaaagaagccauauugaaa

SEQ ID NO: 1482473 - RNA, 19 nt, Homo sapiens
gaagagagcuaccaaccaa

SEQ ID NO: 1482474 - RNA, 19 nt, Homo sapiens
cuacauagaugcucaguuu

SEQ ID NO: 1482475 - RNA, 19 nt, Homo sapiens
ggaaaguaauguucaauug

SEQ ID NO: 1482476 - RNA, 19 nt, Homo sapiens
uauuauggcugacguauua

SEQ ID NO: 1482477 - RNA, 19 nt, Homo sapiens
gcaauggcguccagauaua

SEQ ID NO: 1482478 - RNA, 19 nt, Homo sapiens
caagguuucugcuuuaaua

SEQ ID NO: 1482479 - RNA, 19 nt, Homo sapiens
uaucguggcuaucugauua

SEQ ID NO: 1482480 - RNA, 19 nt, Homo sapiens
ggagaaagaagccauauug

SEQ ID NO: 1482481 - RNA, 19 nt, Homo sapiens
gaaggaagaagaaaugaaa

SEQ ID NO: 1482482 - RNA, 19 nt, Homo sapiens
caagaagaacugaagauua

SEQ ID NO: 1482483 - RNA, 19 nt, Homo sapiens
aaacugacauuuacucuug

SEQ ID NO: 1482484 - RNA, 19 nt, Homo sapiens
gaaugaagcuugaagaaaa

SEQ ID NO: 1482485 - RNA, 19 nt, Homo sapiens
ggucaacgcugcaaugaau

SEQ ID NO: 1482486 - RNA, 19 nt, Homo sapiens
gaacagauccauucagcaa

SEQ ID NO: 1482487 - RNA, 19 nt, Homo sapiens
ggucaaagcucgccaguac

SEQ ID NO: 1482488 - RNA, 19 nt, Homo sapiens
gaaacaagauggucaaagc

SEQ ID NO: 1482489 - RNA, 19 nt, Homo sapiens
uaagagacuucaccaagaa

SEQ ID NO: 1482490 - RNA, 19 nt, Homo sapiens
caacacugauugacacauu

SEQ ID NO: 1482491 - RNA, 19 nt, Homo sapiens
gauuaagcguucucucuuu

SEQ ID NO: 1482492 - RNA, 19 nt, Homo sapiens
ugaagaaccuugacagcaa

SEQ ID NO: 1482493 - RNA, 19 nt, Homo sapiens
gacauuuacucuugacaaa

SEQ ID NO: 1482494 - RNA, 19 nt, Homo sapiens
gaaagcuaccuccgagaua

SEQ ID NO: 1482495 - RNA, 19 nt, Homo sapiens
gaaauugaccauugugaau

SEQ ID NO: 1482496 - RNA, 19 nt, Homo sapiens
gauaagggauacucagcuu

SEQ ID NO: 1482497 - RNA, 19 nt, Homo sapiens
gagaugagguauuuuauga

SEQ ID NO: 1482498 - RNA, 19 nt, Homo sapiens
gaaaauacagaacccauua

SEQ ID NO: 1482499 - RNA, 19 nt, Homo sapiens
guacaaggucaauacauaa

SEQ ID NO: 1482500 - RNA, 19 nt, Homo sapiens
ggaaaugggcuuuacagau

SEQ ID NO: 1482501 - RNA, 19 nt, Homo sapiens
caacuuguaugucuucaca

SEQ ID NO: 1482502 - RNA, 19 nt, Homo sapiens
gcacagaaggucaucauca

SEQ ID NO: 1482503 - RNA, 19 nt, Homo sapiens
gaagaagaaaugaaacaga

SEQ ID NO: 1482504 - RNA, 19 nt, Homo sapiens
uuaaguugcuguucuguga

SEQ ID NO: 1482505 - RNA, 19 nt, Homo sapiens
gaaugauacuacaaguuga

SEQ ID NO: 1482506 - RNA, 19 nt, Homo sapiens
aguacaaggucaauacaua

SEQ ID NO: 1482507 - RNA, 19 nt, Homo sapiens
cauaugaacuccaggaaag

SEQ ID NO: 1482508 - RNA, 19 nt, Homo sapiens
ggaaggacaaggaccguaa

SEQ ID NO: 1482509 - RNA, 19 nt, Homo sapiens
cuaaaacucuaaccucuua

SEQ ID NO: 1482510 - RNA, 19 nt, Homo sapiens
guggcuaucugauuacauu

SEQ ID NO: 1482511 - RNA, 19 nt, Homo sapiens
cuagaagugugcuuugauu

SEQ ID NO: 1482512 - RNA, 19 nt, Homo sapiens
gaagccauauugaaagaag

SEQ ID NO: 1482513 - RNA, 19 nt, Homo sapiens
gaagaaaugaaacagaugu

SEQ ID NO: 1482514 - RNA, 19 nt, Homo sapiens
aaaccacugugacuuugua

SEQ ID NO: 1482515 - RNA, 19 nt, Homo sapiens
uaucacagcuuucauuagg

SEQ ID NO: 1482516 - RNA, 19 nt, Homo sapiens
gagcaucucuaauucaaaa

SEQ ID NO: 1482517 - RNA, 19 nt, Homo sapiens
ugaaugauacuacaaguug

SEQ ID NO: 1482518 - RNA, 19 nt, Homo sapiens
uuaagagacuucaccaaga

SEQ ID NO: 1482519 - RNA, 19 nt, Homo sapiens
agaucaagcucaugaguga

SEQ ID NO: 1482520 - RNA, 19 nt, Homo sapiens
ucacagcuuucauuaggaa

SEQ ID NO: 1482521 - RNA, 19 nt, Homo sapiens
auacucagcuuguaccuau

SEQ ID NO: 1482522 - RNA, 19 nt, Homo sapiens
gcagcaaccugaggaagga

SEQ ID NO: 1482523 - RNA, 19 nt, Homo sapiens
gagaaugaagcuugaagaa

SEQ ID NO: 1482524 - RNA, 19 nt, Homo sapiens
gagaaagaagccauauuga

SEQ ID NO: 1482525 - RNA, 19 nt, Homo sapiens
gaugaugacacuauugcua

SEQ ID NO: 1482526 - RNA, 19 nt, Homo sapiens
gacagcaagguaaacauua

SEQ ID NO: 1482527 - RNA, 19 nt, Homo sapiens
gcuuguaccuauauauuca

SEQ ID NO: 1482528 - RNA, 19 nt, Homo sapiens
cgacaccuuugcuuucuga

SEQ ID NO: 1482529 - RNA, 19 nt, Homo sapiens
gacuaugaauccucacauu

SEQ ID NO: 1482530 - RNA, 19 nt, Homo sapiens
ugaaagaagcugagagaga

SEQ ID NO: 1482531 - RNA, 19 nt, Homo sapiens
gcugcaaacuggaggaaau

SEQ ID NO: 1482532 - RNA, 19 nt, Homo sapiens
caacggaugaugacacuau

SEQ ID NO: 1482533 - RNA, 19 nt, Homo sapiens
aagcagauacgguuucuaa

SEQ ID NO: 1482534 - RNA, 19 nt, Homo sapiens
cuugaucucuuaaccauga

SEQ ID NO: 1482535 - RNA, 19 nt, Homo sapiens
uuaaagcucagacauauga

SEQ ID NO: 1482536 - RNA, 19 nt, Homo sapiens
ccauuaauaucguggcuau

SEQ ID NO: 1482537 - RNA, 19 nt, Homo sapiens
gacuaugucuggccauguu

SEQ ID NO: 1482538 - RNA, 19 nt, Homo sapiens
agaaagaagccauauugaa

SEQ ID NO: 1482539 - RNA, 19 nt, Homo sapiens
gaggaaggaagaagaaaug

SEQ ID NO: 1482540 - RNA, 19 nt, Homo sapiens
gcuuuaauauucucugugu

SEQ ID NO: 1482541 - RNA, 19 nt, Homo sapiens
gauguauuauggagcuaaa

SEQ ID NO: 1482542 - RNA, 19 nt, Homo sapiens
uguauaagguggaugugaa

SEQ ID NO: 1482543 - RNA, 19 nt, Homo sapiens
ggacaaggaccguaagaac

SEQ ID NO: 1482544 - RNA, 19 nt, Homo sapiens
ggaaggaagaagaaaugaa

SEQ ID NO: 1482545 - RNA, 19 nt, Homo sapiens
guucugugaugaaucuaaa

SEQ ID NO: 1482546 - RNA, 19 nt, Homo sapiens
guaaacauuauaccaguga

SEQ ID NO: 1482547 - RNA, 19 nt, Homo sapiens
auuaagcguucucucuuua

SEQ ID NO: 1482548 - RNA, 19 nt, Homo sapiens
gguuucugcuuuaauauuc

SEQ ID NO: 1482549 - RNA, 19 nt, Homo sapiens
gaagugugcuuugauuuug

SEQ ID NO: 1482550 - RNA, 19 nt, Homo sapiens
aagaagccauauugaaaga

SEQ ID NO: 1482551 - RNA, 19 nt, Homo sapiens
gaaaaccacugugacuuug

SEQ ID NO: 1482552 - RNA, 19 nt, Homo sapiens
ccaggaaaguaauguucaa

SEQ ID NO: 1482553 - RNA, 19 nt, Homo sapiens
guauuacuguggugaaaca

SEQ ID NO: 1482554 - RNA, 19 nt, Homo sapiens
aaagcuaccuccgagauau

SEQ ID NO: 1482555 - RNA, 19 nt, Homo sapiens
gaaguauggaugagguaaa

SEQ ID NO: 1482556 - RNA, 19 nt, Homo sapiens
cagcaauggcguccagaua

SEQ ID NO: 1482557 - RNA, 19 nt, Homo sapiens
agagucaucuaaguuguaa

SEQ ID NO: 1482558 - RNA, 19 nt, Homo sapiens
acagcaagguaaacauuau

SEQ ID NO: 1482559 - RNA, 19 nt, Homo sapiens
ccaagaagaacugaagauu

SEQ ID NO: 1482560 - RNA, 19 nt, Homo sapiens
gaaacuuauuagucugugu

SEQ ID NO: 1482561 - RNA, 19 nt, Homo sapiens
acucuaaccucuuaauagu

SEQ ID NO: 1482562 - RNA, 19 nt, Homo sapiens
gaaauccagaagcuucaaa

SEQ ID NO: 1482563 - RNA, 19 nt, Homo sapiens
uaagccagagugaaugaua

SEQ ID NO: 1482564 - RNA, 19 nt, Homo sapiens
gugugucucuacuucauuu

SEQ ID NO: 1482565 - RNA, 19 nt, Homo sapiens
agagagcuaccaaccaaua

SEQ ID NO: 1482566 - RNA, 19 nt, Homo sapiens
gagcaaucauagagucauc

SEQ ID NO: 1482567 - RNA, 19 nt, Homo sapiens
caugcuuuauuaugccuua

SEQ ID NO: 1482568 - RNA, 19 nt, Homo sapiens
gcagauacgguuucuaaaa

SEQ ID NO: 1482569 - RNA, 19 nt, Homo sapiens
acuuaaagcucagacauau

SEQ ID NO: 1482570 - RNA, 19 nt, Homo sapiens
gcuguucugugaugaaucu

SEQ ID NO: 1482571 - RNA, 19 nt, Homo sapiens
gaacaaagcuucaauauug

SEQ ID NO: 1482572 - RNA, 19 nt, Homo sapiens
gaacuaaacuugaagaauc

SEQ ID NO: 1482573 - RNA, 19 nt, Homo sapiens
guaaagcccuaucaguaua

SEQ ID NO: 1482574 - RNA, 19 nt, Homo sapiens
gaaaguugaggacaauuua

SEQ ID NO: 1482575 - RNA, 19 nt, Homo sapiens
cauccuagauuggaaauua

SEQ ID NO: 1482576 - RNA, 19 nt, Homo sapiens
gaagugagagcucuuauga

SEQ ID NO: 1482577 - RNA, 19 nt, Homo sapiens
gaagagaagacaccaguuu

SEQ ID NO: 1482578 - RNA, 19 nt, Homo sapiens
agacauggcagccuuauua

SEQ ID NO: 1482579 - RNA, 19 nt, Homo sapiens
gcauauggcuuaccuucuu

SEQ ID NO: 1482580 - RNA, 19 nt, Homo sapiens
caaaaucacugcuaucuuu

SEQ ID NO: 1482581 - RNA, 19 nt, Homo sapiens
gaacuacccuaugaaaugu

SEQ ID NO: 1482582 - RNA, 19 nt, Homo sapiens
ggagaaagaacuaaacuug

SEQ ID NO: 1482583 - RNA, 19 nt, Homo sapiens
caacagaaguuauuuacag

SEQ ID NO: 1482584 - RNA, 19 nt, Homo sapiens
ggaaagaugggaggaaaua

SEQ ID NO: 1482585 - RNA, 19 nt, Homo sapiens
cagaauucaucacgaaaua

SEQ ID NO: 1482586 - RNA, 19 nt, Homo sapiens
caauuaaugugucucauga

SEQ ID NO: 1482587 - RNA, 19 nt, Homo sapiens
gcagucagauggaauggaa

SEQ ID NO: 1482588 - RNA, 19 nt, Homo sapiens
cgacggagauugagaagug

SEQ ID NO: 1482589 - RNA, 19 nt, Homo sapiens
acacagguuuccacuaaua

SEQ ID NO: 1482590 - RNA, 19 nt, Homo sapiens
caccauacauacauacaua

SEQ ID NO: 1482591 - RNA, 19 nt, Homo sapiens
caaauaaggucagaaucuu

SEQ ID NO: 1482592 - RNA, 19 nt, Homo sapiens
caaggccacuucagaguuu

SEQ ID NO: 1482593 - RNA, 19 nt, Homo sapiens
cagauggaauggaagaaua

SEQ ID NO: 1482594 - RNA, 19 nt, Homo sapiens
gaacauguaucagaguuag

SEQ ID NO: 1482595 - RNA, 19 nt, Homo sapiens
gcaaagaagagauagaaga

SEQ ID NO: 1482596 - RNA, 19 nt, Homo sapiens
ugacauagauaacauugug

SEQ ID NO: 1482597 - RNA, 19 nt, Homo sapiens
gaaacagcauuaggagaaa

SEQ ID NO: 1482598 - RNA, 19 nt, Homo sapiens
gaauggaaguggcuuguag

SEQ ID NO: 1482599 - RNA, 19 nt, Homo sapiens
ggacaggacuugcuuuuga

SEQ ID NO: 1482600 - RNA, 19 nt, Homo sapiens
gaauauagagacagaaguu

SEQ ID NO: 1482601 - RNA, 19 nt, Homo sapiens
ggaaaugcauguaugaacu

SEQ ID NO: 1482602 - RNA, 19 nt, Homo sapiens
gcaaugugcugcugcaagu

SEQ ID NO: 1482603 - RNA, 19 nt, Homo sapiens
ccuaauaacuucaguagca

SEQ ID NO: 1482604 - RNA, 19 nt, Homo sapiens
gagaacauguaucagaguu

SEQ ID NO: 1482605 - RNA, 19 nt, Homo sapiens
aauguaagcugcagaauag

SEQ ID NO: 1482606 - RNA, 19 nt, Homo sapiens
uggcuuaccuucuuuaaau

SEQ ID NO: 1482607 - RNA, 19 nt, Homo sapiens
agaaauggauauucaccua

SEQ ID NO: 1482608 - RNA, 19 nt, Homo sapiens
gaaguggcuuguagacaga

SEQ ID NO: 1482609 - RNA, 19 nt, Homo sapiens
uguaugaacuacccuauga

SEQ ID NO: 1482610 - RNA, 19 nt, Homo sapiens
gaaaugcauguaugaacua

SEQ ID NO: 1482611 - RNA, 19 nt, Homo sapiens
aaagguuacucaaguugua

SEQ ID NO: 1482612 - RNA, 19 nt, Homo sapiens
caguaaagcccuaucagua

SEQ ID NO: 1482613 - RNA, 19 nt, Homo sapiens
gaaagaauacccuaauaac

SEQ ID NO: 1482614 - RNA, 19 nt, Homo sapiens
caucugaacguccugaaua

SEQ ID NO: 1482615 - RNA, 19 nt, Homo sapiens
gagaaagaacuaaacuuga

SEQ ID NO: 1482616 - RNA, 19 nt, Homo sapiens
uaagagaacauguaucaga

SEQ ID NO: 1482617 - RNA, 19 nt, Homo sapiens
gaauuuagaugagcugucu

SEQ ID NO: 1482618 - RNA, 19 nt, Homo sapiens
gcuguugucucauguugaa

SEQ ID NO: 1482619 - RNA, 19 nt, Homo sapiens
gaaauaaagcccuguucug

SEQ ID NO: 1482620 - RNA, 19 nt, Homo sapiens
ggaugaauauacccuuaga

SEQ ID NO: 1482621 - RNA, 19 nt, Homo sapiens
ggauagugguccuagaaga

SEQ ID NO: 1482622 - RNA, 19 nt, Homo sapiens
ccacagacuuugccuucaa

SEQ ID NO: 1482623 - RNA, 19 nt, Homo sapiens
acacaaaacuccuuuauuc

SEQ ID NO: 1482624 - RNA, 19 nt, Homo sapiens
ugaaacagcauuaggagaa

SEQ ID NO: 1482625 - RNA, 19 nt, Homo sapiens
gaaaagacauuugagugaa

SEQ ID NO: 1482626 - RNA, 19 nt, Homo sapiens
caaauccuguagccauaaa

SEQ ID NO: 1482627 - RNA, 19 nt, Homo sapiens
gguagucauuuguguuuau

SEQ ID NO: 1482628 - RNA, 19 nt, Homo sapiens
gacaagugguagucauuug

SEQ ID NO: 1482629 - RNA, 19 nt, Homo sapiens
caagccagguggucacuau

SEQ ID NO: 1482630 - RNA, 19 nt, Homo sapiens
guacuacccacauaacuga

SEQ ID NO: 1482631 - RNA, 19 nt, Homo sapiens
gaagacaccaguuuuaaaa

SEQ ID NO: 1482632 - RNA, 19 nt, Homo sapiens
ccauaaggguaaccagauu

SEQ ID NO: 1482633 - RNA, 19 nt, Homo sapiens
auaaaugucuggcuaaugg

SEQ ID NO: 1482634 - RNA, 19 nt, Homo sapiens
ugacugagaucaucaacag

SEQ ID NO: 1482635 - RNA, 19 nt, Homo sapiens
cuacuuuacuucuuggaaa

SEQ ID NO: 1482636 - RNA, 19 nt, Homo sapiens
guaagcugcagaauagaua

SEQ ID NO: 1482637 - RNA, 19 nt, Homo sapiens
ugaacuacccuaugaaaug

SEQ ID NO: 1482638 - RNA, 19 nt, Homo sapiens
agaauacccuaauaacuuc

SEQ ID NO: 1482639 - RNA, 19 nt, Homo sapiens
gaacacaauucggagucuu

SEQ ID NO: 1482640 - RNA, 19 nt, Homo sapiens
gaguagcuaugaacacaau

SEQ ID NO: 1482641 - RNA, 19 nt, Homo sapiens
cagaaguuauuuacaggaa

SEQ ID NO: 1482642 - RNA, 19 nt, Homo sapiens
ggucuaggacuuacuaaug

SEQ ID NO: 1482643 - RNA, 19 nt, Homo sapiens
gaagaucuuucugaugaag

SEQ ID NO: 1482644 - RNA, 19 nt, Homo sapiens
ggaggaugguuguucuuca

SEQ ID NO: 1482645 - RNA, 19 nt, Homo sapiens
gaaucaggaucccauagca

SEQ ID NO: 1482646 - RNA, 19 nt, Homo sapiens
gauagugguccuagaagaa

SEQ ID NO: 1482647 - RNA, 19 nt, Homo sapiens
ccaggcaaauaaacucaaa

SEQ ID NO: 1482648 - RNA, 19 nt, Homo sapiens
gagauuugacacuaaguuu

SEQ ID NO: 1482649 - RNA, 19 nt, Homo sapiens
cuaauuuggucauucuuug

SEQ ID NO: 1482650 - RNA, 19 nt, Homo sapiens
caaauauuggugcacuuua

SEQ ID NO: 1482651 - RNA, 19 nt, Homo sapiens
ucaugcaacuuacuuacaa

SEQ ID NO: 1482652 - RNA, 19 nt, Homo sapiens
gaaagaugggaggaaauaa

SEQ ID NO: 1482653 - RNA, 19 nt, Homo sapiens
caaagaagagauagaagau

SEQ ID NO: 1482654 - RNA, 19 nt, Homo sapiens
gaaacuccaauauaaggaa

SEQ ID NO: 1482655 - RNA, 19 nt, Homo sapiens
cagaugugccucuucauuu

SEQ ID NO: 1482656 - RNA, 19 nt, Homo sapiens
caaguuguccaggcaaaua

SEQ ID NO: 1482657 - RNA, 19 nt, Homo sapiens
cauuuggccuuaucuguga

SEQ ID NO: 1482658 - RNA, 19 nt, Homo sapiens
gcacuuuaauacuaucaca

SEQ ID NO: 1482659 - RNA, 19 nt, Homo sapiens
aaauguaagcugcagaaua

SEQ ID NO: 1482660 - RNA, 19 nt, Homo sapiens
guguuuaucaugcaacuua

SEQ ID NO: 1482661 - RNA, 19 nt, Homo sapiens
agugagagcucuuaugaca

SEQ ID NO: 1482662 - RNA, 19 nt, Homo sapiens
gcacgacggagauugagaa

SEQ ID NO: 1482663 - RNA, 19 nt, Homo sapiens
aaaccugugugccaaguga

SEQ ID NO: 1482664 - RNA, 19 nt, Homo sapiens
gaacagcagagcuuacagu

SEQ ID NO: 1482665 - RNA, 19 nt, Homo sapiens
uucggagucuuaccuauua

SEQ ID NO: 1482666 - RNA, 19 nt, Homo sapiens
caacuuggaguagcuauga

SEQ ID NO: 1482667 - RNA, 19 nt, Homo sapiens
uaggaaagaugggaggaaa

SEQ ID NO: 1482668 - RNA, 19 nt, Homo sapiens
uagcagcucugaugacgau

SEQ ID NO: 1482669 - RNA, 19 nt, Homo sapiens
gaaauggauauucaccuau

SEQ ID NO: 1482670 - RNA, 19 nt, Homo sapiens
gaaauaaaaggcaaucuug

SEQ ID NO: 1482671 - RNA, 19 nt, Homo sapiens
ggagugaacugaauuguuu

SEQ ID NO: 1482672 - RNA, 19 nt, Homo sapiens
gagaauaccuuacagaaug

SEQ ID NO: 1482673 - RNA, 19 nt, Homo sapiens
gcaaugaucugguccacua

SEQ ID NO: 1482674 - RNA, 19 nt, Homo sapiens
gcaaugaccucugugauuu

SEQ ID NO: 1482675 - RNA, 19 nt, Homo sapiens
ggaaagaggagaaauguga

SEQ ID NO: 1482676 - RNA, 19 nt, Homo sapiens
ucacaucuguuucuucuuu

SEQ ID NO: 1482677 - RNA, 19 nt, Homo sapiens
cgacaaagguaacauagga

SEQ ID NO: 1482678 - RNA, 19 nt, Homo sapiens
gcaaguaugugcuaagaag

SEQ ID NO: 1482679 - RNA, 19 nt, Homo sapiens
gcuccuaacuuccaagaaa

SEQ ID NO: 1482680 - RNA, 19 nt, Homo sapiens
gaacuucacagacaacauu

SEQ ID NO: 1482681 - RNA, 19 nt, Homo sapiens
caggaagacuggaagauaa

SEQ ID NO: 1482682 - RNA, 19 nt, Homo sapiens
gauagauuccugugacuua

SEQ ID NO: 1482683 - RNA, 19 nt, Homo sapiens
gaugauaacucaacagaac

SEQ ID NO: 1482684 - RNA, 19 nt, Homo sapiens
ggaugaagcucugcuccua

SEQ ID NO: 1482685 - RNA, 19 nt, Homo sapiens
gagaugagcauggugaaua

SEQ ID NO: 1482686 - RNA, 19 nt, Homo sapiens
gagaagcacccacuugaaa

SEQ ID NO: 1482687 - RNA, 19 nt, Homo sapiens
gagaacaucggcaccguua

SEQ ID NO: 1482688 - RNA, 19 nt, Homo sapiens
gaacacccaauaacacuuu

SEQ ID NO: 1482689 - RNA, 19 nt, Homo sapiens
ggaaagaaaccaguccuaa

SEQ ID NO: 1482690 - RNA, 19 nt, Homo sapiens
gagcaaagccaccaaauac

SEQ ID NO: 1482691 - RNA, 19 nt, Homo sapiens
gagaagacccaccaacuga

SEQ ID NO: 1482692 - RNA, 19 nt, Homo sapiens
gaaagaaaccaguccuaau

SEQ ID NO: 1482693 - RNA, 19 nt, Homo sapiens
aaacggauaugcagaggaa

SEQ ID NO: 1482694 - RNA, 19 nt, Homo sapiens
cauggaggcuucugaauuc

SEQ ID NO: 1482695 - RNA, 19 nt, Homo sapiens
gaagauaauaacccuguuu

SEQ ID NO: 1482696 - RNA, 19 nt, Homo sapiens
gagcaugccaguuauuuga

SEQ ID NO: 1482697 - RNA, 19 nt, Homo sapiens
ccagaguaauccagacuaa

SEQ ID NO: 1482698 - RNA, 19 nt, Homo sapiens
ccacugcagucgcuuaaga

SEQ ID NO: 1482699 - RNA, 19 nt, Homo sapiens
ggagaaaugugagacuuag

SEQ ID NO: 1482700 - RNA, 19 nt, Homo sapiens
ccagaucccaguccucuua

SEQ ID NO: 1482701 - RNA, 19 nt, Homo sapiens
caagaucaauaucacaugu

SEQ ID NO: 1482702 - RNA, 19 nt, Homo sapiens
acaagaaguuucaggagaa

SEQ ID NO: 1482703 - RNA, 19 nt, Homo sapiens
gaagcacccacuugaaauu

SEQ ID NO: 1482704 - RNA, 19 nt, Homo sapiens
acaaaccagucaccaaauu

SEQ ID NO: 1482705 - RNA, 19 nt, Homo sapiens
cauaggaagucaaggaguu

SEQ ID NO: 1482706 - RNA, 19 nt, Homo sapiens
ccacaaaccagucaccaaa

SEQ ID NO: 1482707 - RNA, 19 nt, Homo sapiens
ccaaagaccucggaaggau

SEQ ID NO: 1482708 - RNA, 19 nt, Homo sapiens
uaucccagaucaucacuuu

SEQ ID NO: 1482709 - RNA, 19 nt, Homo sapiens
gugcagccguucuuugaaa

SEQ ID NO: 1482710 - RNA, 19 nt, Homo sapiens
gaagacuggaagauaauaa

SEQ ID NO: 1482711 - RNA, 19 nt, Homo sapiens
ugauagcgauuacauuguu

SEQ ID NO: 1482712 - RNA, 19 nt, Homo sapiens
aaagaaaccaguccuaaug

SEQ ID NO: 1482713 - RNA, 19 nt, Homo sapiens
aaagcagcauggauucaua

SEQ ID NO: 1482714 - RNA, 19 nt, Homo sapiens
gaagacccaccaacugauu

SEQ ID NO: 1482715 - RNA, 19 nt, Homo sapiens
ggauacacuuucaggaaga

SEQ ID NO: 1482716 - RNA, 19 nt, Homo sapiens
gaggauacacuuucaggaa

SEQ ID NO: 1482717 - RNA, 19 nt, Homo sapiens
uaacgacaaagguaacaua

SEQ ID NO: 1482718 - RNA, 19 nt, Homo sapiens
gcaugccaguuauuugauu

SEQ ID NO: 1482719 - RNA, 19 nt, Homo sapiens
uccaagagcaugccaguua

SEQ ID NO: 1482720 - RNA, 19 nt, Homo sapiens
ucccaguccucuuaacuua

SEQ ID NO: 1482721 - RNA, 19 nt, Homo sapiens
ugaaauuggugguauuaca

SEQ ID NO: 1482722 - RNA, 19 nt, Homo sapiens
gagacaguauaacgacaaa

SEQ ID NO: 1482723 - RNA, 19 nt, Homo sapiens
gaaaggaugaggaguugau

SEQ ID NO: 1482724 - RNA, 19 nt, Homo sapiens
uaacauaggaagucaagga

SEQ ID NO: 1482725 - RNA, 19 nt, Homo sapiens
gaggagaaaugugagacuu

SEQ ID NO: 1482726 - RNA, 19 nt, Homo sapiens
gcgauuacauuguugugau

SEQ ID NO: 1482727 - RNA, 19 nt, Homo sapiens
ccaagagcaugccaguuau

SEQ ID NO: 1482728 - RNA, 19 nt, Homo sapiens
cagcauggauucauaacca

SEQ ID NO: 1482729 - RNA, 19 nt, Homo sapiens
guccugaaguuugaugaua

SEQ ID NO: 1482730 - RNA, 19 nt, Homo sapiens
gaaaggcccuggacauccu

SEQ ID NO: 1482731 - RNA, 19 nt, Homo sapiens
gaaauuggugguauuacau

SEQ ID NO: 1482732 - RNA, 19 nt, Homo sapiens
ggagaagacccaccaacug

SEQ ID NO: 1482733 - RNA, 19 nt, Homo sapiens
gagggaggguguuggaauc

SEQ ID NO: 1482734 - RNA, 19 nt, Homo sapiens
ggcaaugaccucugugauu

SEQ ID NO: 1482735 - RNA, 19 nt, Homo sapiens
ggaagacuggaagauaaua

SEQ ID NO: 1482736 - RNA, 19 nt, Homo sapiens
uaacaucaggcuacacuug

SEQ ID NO: 1482737 - RNA, 19 nt, Homo sapiens
guugauagcgauuacauug

SEQ ID NO: 1482738 - RNA, 19 nt, Homo sapiens
ugagcaaagccaccaaaua

SEQ ID NO: 1482739 - RNA, 19 nt, Homo sapiens
ccucaaagcagcauggauu

SEQ ID NO: 1482740 - RNA, 19 nt, Homo sapiens
gaacauccuccgggaauuc

SEQ ID NO: 1482741 - RNA, 19 nt, Homo sapiens
ggaagauaauaacccuguu

SEQ ID NO: 1482742 - RNA, 19 nt, Homo sapiens
gaagaaugacacgaggaua

SEQ ID NO: 1482743 - RNA, 19 nt, Homo sapiens
ucaggaagacuggaagaua

SEQ ID NO: 1482744 - RNA, 19 nt, Homo sapiens
ccugagaccugcagacauc

SEQ ID NO: 1482745 - RNA, 19 nt, Homo sapiens
ucacagacaacauuggaaa

SEQ ID NO: 1482746 - RNA, 19 nt, Homo sapiens
acacuugacuagggaauau

SEQ ID NO: 1482747 - RNA, 19 nt, Homo sapiens
gauagcgauuacauuguug

SEQ ID NO: 1482748 - RNA, 19 nt, Homo sapiens
aauccacacugccagagua

SEQ ID NO: 1482749 - RNA, 19 nt, Homo sapiens
ccauggaggcuucugaauu

SEQ ID NO: 1482750 - RNA, 19 nt, Homo sapiens
gggauucucugaccguaag

SEQ ID NO: 1482751 - RNA, 19 nt, Homo sapiens
gaggauggaugagccagau

SEQ ID NO: 1482752 - RNA, 19 nt, Homo sapiens
caaauucccagcaaguaug

SEQ ID NO: 1482753 - RNA, 19 nt, Homo sapiens
acacgaggauacacuuuca

SEQ ID NO: 1482754 - RNA, 19 nt, Homo sapiens
uagaggacaugauggaaag

SEQ ID NO: 1482755 - RNA, 19 nt, Homo sapiens
gugagaagcacccacuuga

SEQ ID NO: 1482756 - RNA, 19 nt, Homo sapiens
uggaaaggaugaggaguug

SEQ ID NO: 1482757 - RNA, 19 nt, Homo sapiens
guccaagucuuccuaaagg

SEQ ID NO: 1482758 - RNA, 19 nt, Homo sapiens
ugguggaccugaugaagaa

SEQ ID NO: 1482759 - RNA, 19 nt, Homo sapiens
gagggaaagaggagaaaug

SEQ ID NO: 1482760 - RNA, 19 nt, Homo sapiens
gaagcucugcuccuaacuu

SEQ ID NO: 1482761 - RNA, 19 nt, Homo sapiens
gaugaagcucugcuccuaa

SEQ ID NO: 1482762 - RNA, 19 nt, Homo sapiens
ccucacaucuguuucuucu

SEQ ID NO: 1482763 - RNA, 19 nt, Homo sapiens
agaugagcauggugaauau

SEQ ID NO: 1482764 - RNA, 19 nt, Homo sapiens
ccaaauucccagcaaguau

SEQ ID NO: 1482765 - RNA, 19 nt, Homo sapiens
caugccaguuauuugauuu

SEQ ID NO: 1482766 - RNA, 19 nt, Homo sapiens
gagagugggcgauaugaca

SEQ ID NO: 1482767 - RNA, 19 nt, Homo sapiens
uugcuacccucaucgaauu

SEQ ID NO: 1482768 - RNA, 19 nt, Homo sapiens
caaauggucccagcugguu

SEQ ID NO: 1482769 - RNA, 19 nt, Homo sapiens
ggagggaggguguuggaau

SEQ ID NO: 1482770 - RNA, 19 nt, Homo sapiens
ccgcagcuccuaccucaaa

SEQ ID NO: 1482771 - RNA, 19 nt, Homo sapiens
caacaacucugacaaauca

SEQ ID NO: 1482772 - RNA, 19 nt, Homo sapiens
ccacaaggauucagcaauu

SEQ ID NO: 1482773 - RNA, 19 nt, Homo sapiens
ggaaaccacugaagccaaa

SEQ ID NO: 1482774 - RNA, 19 nt, Homo sapiens
ccaauuaaauccuauccua

SEQ ID NO: 1482775 - RNA, 19 nt, Homo sapiens
gaagauaaagggaaguuaa

SEQ ID NO: 1482776 - RNA, 19 nt, Homo sapiens
gaaguaaacaugccaagaa

SEQ ID NO: 1482777 - RNA, 19 nt, Homo sapiens
gcaauaauguacagaagau

SEQ ID NO: 1482778 - RNA, 19 nt, Homo sapiens
gauuaaagaugcagaaugg

SEQ ID NO: 1482779 - RNA, 19 nt, Homo sapiens
cagcacacauggagauaua

SEQ ID NO: 1482780 - RNA, 19 nt, Homo sapiens
gcauuauccuggucacaua

SEQ ID NO: 1482781 - RNA, 19 nt, Homo sapiens
ccaaagaagaaacaaguua

SEQ ID NO: 1482782 - RNA, 19 nt, Homo sapiens
gcauaaagaucgaguugca

SEQ ID NO: 1482783 - RNA, 19 nt, Homo sapiens
gacaaugaauccauguauu

SEQ ID NO: 1482784 - RNA, 19 nt, Homo sapiens
gcaaacguauacaaacaga

SEQ ID NO: 1482785 - RNA, 19 nt, Homo sapiens
agaaacacaucacuagauu

SEQ ID NO: 1482786 - RNA, 19 nt, Homo sapiens
aaauugcucugcuuucuuu

SEQ ID NO: 1482787 - RNA, 19 nt, Homo sapiens
gggcaagaguuaucauaga

SEQ ID NO: 1482788 - RNA, 19 nt, Homo sapiens
auacagcccuuacaacaaa

SEQ ID NO: 1482789 - RNA, 19 nt, Homo sapiens
gguaugaucuggcuuaaaa

SEQ ID NO: 1482790 - RNA, 19 nt, Homo sapiens
gaaagaaagccacaaggau

SEQ ID NO: 1482791 - RNA, 19 nt, Homo sapiens
ucaaugagcagugcaauaa

SEQ ID NO: 1482792 - RNA, 19 nt, Homo sapiens
guaaauaacucugguaucc

SEQ ID NO: 1482793 - RNA, 19 nt, Homo sapiens
ggucaggacuacagaacaa

SEQ ID NO: 1482794 - RNA, 19 nt, Homo sapiens
guaggaaguugagaaagaa

SEQ ID NO: 1482795 - RNA, 19 nt, Homo sapiens
agaccuggaucaagauuaa

SEQ ID NO: 1482796 - RNA, 19 nt, Homo sapiens
ugacagggauuguguacug

SEQ ID NO: 1482797 - RNA, 19 nt, Homo sapiens
gagcauguauuggucagaa

SEQ ID NO: 1482798 - RNA, 19 nt, Homo sapiens
agagacugcuccuauaauu

SEQ ID NO: 1482799 - RNA, 19 nt, Homo sapiens
ccucaaaucuggcacaaca

SEQ ID NO: 1482800 - RNA, 19 nt, Homo sapiens
aaacacaucacuagauuga

SEQ ID NO: 1482801 - RNA, 19 nt, Homo sapiens
aaagaaagccacaaggauu

SEQ ID NO: 1482802 - RNA, 19 nt, Homo sapiens
ucuguucgcugaauauauu

SEQ ID NO: 1482803 - RNA, 19 nt, Homo sapiens
gcucugcuuucuuuacaaa

SEQ ID NO: 1482804 - RNA, 19 nt, Homo sapiens
acauggagauauagaauug

SEQ ID NO: 1482805 - RNA, 19 nt, Homo sapiens
aaauaacucugguauccaa

SEQ ID NO: 1482806 - RNA, 19 nt, Homo sapiens
guacuguuguugaaucaga

SEQ ID NO: 1482807 - RNA, 19 nt, Homo sapiens
gagaaacacaucacuagau

SEQ ID NO: 1482808 - RNA, 19 nt, Homo sapiens
gagagaaacacaucacuag

SEQ ID NO: 1482809 - RNA, 19 nt, Homo sapiens
cagcggagcccgaguauuc

SEQ ID NO: 1482810 - RNA, 19 nt, Homo sapiens
caacucaaacagcacauuu

SEQ ID NO: 1482811 - RNA, 19 nt, Homo sapiens
gcgcacaccuacccugaug

SEQ ID NO: 1482812 - RNA, 19 nt, Homo sapiens
ccaacuggguguauucuag

SEQ ID NO: 1482813 - RNA, 19 nt, Homo sapiens
ucaaacagcacauuucuag

SEQ ID NO: 1482814 - RNA, 19 nt, Homo sapiens
gcacacaacacaggaucua

SEQ ID NO: 1482815 - RNA, 19 nt, Homo sapiens
gagcggcacugauauaacg

SEQ ID NO: 1482816 - RNA, 19 nt, Homo sapiens
caaggauucagcaauuuaa

SEQ ID NO: 1482817 - RNA, 19 nt, Homo sapiens
ucugugauguucauguuaa

SEQ ID NO: 1482818 - RNA, 19 nt, Homo sapiens
gcuuggagcggcacugaua

SEQ ID NO: 1482819 - RNA, 19 nt, Homo sapiens
gccagcauguaaaggauuu

SEQ ID NO: 1482820 - RNA, 19 nt, Homo sapiens
aagcaaacguauacaaaca

SEQ ID NO: 1482821 - RNA, 19 nt, Homo sapiens
guagcuuccucacugguuu

SEQ ID NO: 1482822 - RNA, 19 nt, Homo sapiens
agacugcuccuauaauuga

SEQ ID NO: 1482823 - RNA, 19 nt, Homo sapiens
aguaggaaguugagaaaga

SEQ ID NO: 1482824 - RNA, 19 nt, Homo sapiens
guaaaacgucuguguauuu

SEQ ID NO: 1482825 - RNA, 19 nt, Homo sapiens
agaaagccauauaacauag

SEQ ID NO: 1482826 - RNA, 19 nt, Homo sapiens
guacugcuguauccugugu

SEQ ID NO: 1482827 - RNA, 19 nt, Homo sapiens
uuuagagacugcuccuaua

SEQ ID NO: 1482828 - RNA, 19 nt, Homo sapiens
acaaggauucagcaauuua

SEQ ID NO: 1482829 - RNA, 19 nt, Homo sapiens
ccagaaagauaugaugaag

SEQ ID NO: 1482830 - RNA, 19 nt, Homo sapiens
aaacuugcauuccagaaag

SEQ ID NO: 1482831 - RNA, 19 nt, Homo sapiens
ggcaacaacucugacaaau

SEQ ID NO: 1482832 - RNA, 19 nt, Homo sapiens
ggcuuuaucucccuacuuc

SEQ ID NO: 1482833 - RNA, 19 nt, Homo sapiens
cacaaggauucagcaauuu

SEQ ID NO: 1482834 - RNA, 19 nt, Homo sapiens
ccucuuugcuccguacuaa

SEQ ID NO: 1482835 - RNA, 19 nt, Homo sapiens
aagauaugaugaagccuuu

SEQ ID NO: 1482836 - RNA, 19 nt, Homo sapiens
gcaagaagacaaugaaucc

SEQ ID NO: 1482837 - RNA, 19 nt, Homo sapiens
gcaacaacucugacaaauc

SEQ ID NO: 1482838 - RNA, 19 nt, Homo sapiens
ucugucagcuucgcuuuaa

SEQ ID NO: 1482839 - RNA, 19 nt, Homo sapiens
gcacacauggagauauaga

SEQ ID NO: 1482840 - RNA, 19 nt, Homo sapiens
ggcaagaguuaucauagag

SEQ ID NO: 1482841 - RNA, 19 nt, Homo sapiens
gaaacacaucacuagauug

SEQ ID NO: 1482842 - RNA, 19 nt, Homo sapiens
ugugaaaucugugauguuc

SEQ ID NO: 1482843 - RNA, 19 nt, Homo sapiens
gaucaagauuaaagaugca

SEQ ID NO: 1482844 - RNA, 19 nt, Homo sapiens
ccaucaagcucugaaagug

SEQ ID NO: 1482845 - RNA, 19 nt, Homo sapiens
ggucacauacuggaaguuu

SEQ ID NO: 1482846 - RNA, 19 nt, Homo sapiens
gaucuaaacacaagaccau

SEQ ID NO: 1482847 - RNA, 19 nt, Homo sapiens
guggcucccuaaugcaaua

SEQ ID NO: 1482848 - RNA, 19 nt, Homo sapiens
cuaagcaaacguauacaaa

SEQ ID NO: 1482849 - RNA, 19 nt, Homo sapiens
cagggauuguguacuguuu

SEQ ID NO: 1482850 - RNA, 19 nt, Homo sapiens
caagaaggucaaagcacua

SEQ ID NO: 1482851 - RNA, 19 nt, Homo sapiens
guaaacaugccaagaaggu

SEQ ID NO: 1482852 - RNA, 19 nt, Homo sapiens
ggaaguaaacaugccaaga

SEQ ID NO: 1482853 - RNA, 19 nt, Homo sapiens
cuggauaucaaaccauuua

SEQ ID NO: 1482854 - RNA, 19 nt, Homo sapiens
gauaucaacaagacuggaa

SEQ ID NO: 1482855 - RNA, 19 nt, Homo sapiens
guaaauguuaggaagcaaa

SEQ ID NO: 1482856 - RNA, 19 nt, Homo sapiens
caacggaucacaaaguucu

SEQ ID NO: 1482857 - RNA, 19 nt, Homo sapiens
cgaguauucuagcagcaaa

SEQ ID NO: 1482858 - RNA, 19 nt, Homo sapiens
cagaacaagacauuucauu

SEQ ID NO: 1482859 - RNA, 19 nt, Homo sapiens
cuacagaacaagacauuuc

SEQ ID NO: 1482860 - RNA, 19 nt, Homo sapiens
ggauaucaaaccauuuaug

SEQ ID NO: 1482861 - RNA, 19 nt, Homo sapiens
gaugcagccuucacuggau

SEQ ID NO: 1482862 - RNA, 19 nt, Homo sapiens
guacaugccacacuacuac

SEQ ID NO: 1482863 - RNA, 19 nt, Homo sapiens
ucucuugucugaauuaaac

SEQ ID NO: 1482864 - RNA, 19 nt, Homo sapiens
aaauacagcccuuacaaca

SEQ ID NO: 1482865 - RNA, 19 nt, Homo sapiens
cacaggaucuaaacacaag

SEQ ID NO: 1482866 - RNA, 19 nt, Homo sapiens
acacaacacaggaucuaaa

SEQ ID NO: 1482867 - RNA, 19 nt, Homo sapiens
gcaaaguggcugugaacuc

SEQ ID NO: 1482868 - RNA, 19 nt, Homo sapiens
gcuaagcaaacguauacaa

SEQ ID NO: 1482869 - RNA, 19 nt, Homo sapiens
gagacugcuccuauaauug

SEQ ID NO: 1482870 - RNA, 19 nt, Homo sapiens
ccaguaggaaguugagaaa

SEQ ID NO: 1482871 - RNA, 19 nt, Homo sapiens
gcacagaucuagacaaugu

SEQ ID NO: 1482872 - RNA, 19 nt, Homo sapiens
gaacuuaucuuucacucuu

SEQ ID NO: 1482873 - RNA, 19 nt, Homo sapiens
ggaaaggccuggugcgauu

SEQ ID NO: 1482874 - RNA, 19 nt, Homo sapiens
gagcacagaucuagacaau

SEQ ID NO: 1482875 - RNA, 19 nt, Homo sapiens
cuagagaacuuaucuuuca

SEQ ID NO: 1482876 - RNA, 19 nt, Homo sapiens
cagaaggccuuuccaaaug

SEQ ID NO: 1482877 - RNA, 19 nt, Homo sapiens
gaggaaagaucuagaacgu

SEQ ID NO: 1482878 - RNA, 19 nt, Homo sapiens
uagaacgucuuuacagauu

SEQ ID NO: 1482879 - RNA, 19 nt, Homo sapiens
gagagauggucccgagaaa

SEQ ID NO: 1482880 - RNA, 19 nt, Homo sapiens
ccaagcaucuuucccacuu

SEQ ID NO: 1482881 - RNA, 19 nt, Homo sapiens
ggacguacgcuguguguuc

SEQ ID NO: 1482882 - RNA, 19 nt, Homo sapiens
gacaauguguggacagugu

SEQ ID NO: 1482883 - RNA, 19 nt, Homo sapiens
gaacgucuuuacagauugg

SEQ ID NO: 1482884 - RNA, 19 nt, Homo sapiens
caacaucgaaucaaacauc

SEQ ID NO: 1482885 - RNA, 19 nt, Homo sapiens
aaugggagcuccacucuuc

SEQ ID NO: 1482886 - RNA, 19 nt, Homo sapiens
cuaacuagccuccggauga

SEQ ID NO: 1482887 - RNA, 19 nt, Homo sapiens
ccacaucucuuucauuuuc

SEQ ID NO: 1482888 - RNA, 19 nt, Homo sapiens
gggcacagauauucuagag

SEQ ID NO: 1482889 - RNA, 19 nt, Homo sapiens
ucagaaggccuuuccaaau

SEQ ID NO: 1482890 - RNA, 19 nt, Homo sapiens
gcaaauggagcacagaucu

SEQ ID NO: 1482891 - RNA, 19 nt, Homo sapiens
ggaccuccguguucuugga

SEQ ID NO: 1482892 - RNA, 19 nt, Homo sapiens
ucuagaacgucuuuacaga

SEQ ID NO: 1482893 - RNA, 19 nt, Homo sapiens
uguguguucuuacugcuua

SEQ ID NO: 1482894 - RNA, 19 nt, Homo sapiens
ccacaggcccuuccucuca

SEQ ID NO: 1482895 - RNA, 19 nt, Homo sapiens
auccacaucucuuucauuu

SEQ ID NO: 1482896 - RNA, 19 nt, Homo sapiens
ccacauauccacaucucuu

SEQ ID NO: 1482897 - RNA, 19 nt, Homo sapiens
guacugcauccguguguuu

SEQ ID NO: 1482898 - RNA, 19 nt, Homo sapiens
ccacacaacaggcuacgaa

SEQ ID NO: 1482899 - RNA, 19 nt, Homo sapiens
cagaguagguagugaagag

SEQ ID NO: 1482900 - RNA, 19 nt, Homo sapiens
gaguagcaguggccacaug

SEQ ID NO: 1482901 - RNA, 19 nt, Homo sapiens
caagugcaguaacacacaa

SEQ ID NO: 1482902 - RNA, 19 nt, Homo sapiens
gcucaggccugggagacaa

SEQ ID NO: 1482903 - RNA, 19 nt, Homo sapiens
caccuucaccuucuaacua

SEQ ID NO: 1482904 - RNA, 19 nt, Homo sapiens
cacaacaggcuacgaagaa

SEQ ID NO: 1482905 - RNA, 19 nt, Homo sapiens
ggaugagccucccaagcau

SEQ ID NO: 1482906 - RNA, 19 nt, Homo sapiens
caaauggagcacagaucua

SEQ ID NO: 1482907 - RNA, 19 nt, Homo sapiens
guucuaaugugugcaagau

SEQ ID NO: 1482908 - RNA, 19 nt, Homo sapiens
gaucuagaacgucuuuaca

SEQ ID NO: 1482909 - RNA, 19 nt, Homo sapiens
guaguggaccuccguguuc

SEQ ID NO: 1482910 - RNA, 19 nt, Homo sapiens
ccagaggaaagaucuagaa

SEQ ID NO: 1482911 - RNA, 19 nt, Homo sapiens
gcuucuaguucuaaugugu

SEQ ID NO: 1482912 - RNA, 19 nt, Homo sapiens
gggcccagcuucuaguucu

SEQ ID NO: 1482913 - RNA, 19 nt, Homo sapiens
cguacgcuguguguucuua

SEQ ID NO: 1482914 - RNA, 19 nt, Homo sapiens
ccaccucucuucauguucu

SEQ ID NO: 1482915 - RNA, 19 nt, Homo sapiens
ccacugggcacagauauuc

SEQ ID NO: 1482916 - RNA, 19 nt, Homo sapiens
gccacgcccuuaucuagau

SEQ ID NO: 1482917 - RNA, 19 nt, Homo sapiens
ccagucaccuucaccuucu

SEQ ID NO: 1482918 - RNA, 19 nt, Homo sapiens
gagauggucccgagaaagg

SEQ ID NO: 1482919 - RNA, 19 nt, Homo sapiens
uguguuaugcagcaauuua

SEQ ID NO: 1482920 - RNA, 19 nt, Homo sapiens
gcagccuccucaaauguag

SEQ ID NO: 1482921 - RNA, 19 nt, Homo sapiens
ucacaaauucaccucagaa

SEQ ID NO: 1482922 - RNA, 19 nt, Homo sapiens
gcaagauuaacucacaaau

SEQ ID NO: 1482923 - RNA, 19 nt, Homo sapiens
uaacuagccuccggaugag

SEQ ID NO: 1482924 - RNA, 19 nt, Homo sapiens
cgagagauggucccgagaa

SEQ ID NO: 1482925 - RNA, 19 nt, Homo sapiens
gagccucccaagcaucuuu

SEQ ID NO: 1482926 - RNA, 19 nt, Homo sapiens
gcucagcaccugcccagau

SEQ ID NO: 1482927 - RNA, 19 nt, Homo sapiens
ccacgcccuuaucuagauu

SEQ ID NO: 1482928 - RNA, 19 nt, Homo sapiens
ccaccaggcccgaaugauc

SEQ ID NO: 1482929 - RNA, 19 nt, Homo sapiens
gcccgcagccuccucaaau

SEQ ID NO: 1482930 - RNA, 19 nt, Homo sapiens
caaaugggagcuccacucu

SEQ ID NO: 1482931 - RNA, 19 nt, Homo sapiens
agaaggccuuuccaaaugg

SEQ ID NO: 1482932 - RNA, 19 nt, Homo sapiens
gugcaagauuaacucacaa

SEQ ID NO: 1482933 - RNA, 19 nt, Homo sapiens
gcugacccaucauccgaau

SEQ ID NO: 1482934 - RNA, 19 nt, Homo sapiens
gguaguggaccuccguguu

SEQ ID NO: 1482935 - RNA, 19 nt, Homo sapiens
acacccacccuaccuagaa

SEQ ID NO: 1482936 - RNA, 19 nt, Homo sapiens
accuucaccuucuaacuaa

SEQ ID NO: 1482937 - RNA, 19 nt, Homo sapiens
cagcuucuaguucuaaugu

SEQ ID NO: 1482938 - RNA, 19 nt, Homo sapiens
acaccaucuuggacucuuu

SEQ ID NO: 1482939 - RNA, 19 nt, Homo sapiens
gacguacgcuguguguucu

SEQ ID NO: 1482940 - RNA, 19 nt, Homo sapiens
gauggccucugcgucuuuc

SEQ ID NO: 1482941 - RNA, 19 nt, Homo sapiens
cacauauccacaucucuuu

SEQ ID NO: 1482942 - RNA, 19 nt, Homo sapiens
gcccuuaucuagauuucac

SEQ ID NO: 1482943 - RNA, 19 nt, Homo sapiens
gauguggccacgcccuuau

SEQ ID NO: 1482944 - RNA, 19 nt, Homo sapiens
ggacggcagcucucaugag

SEQ ID NO: 1482945 - RNA, 19 nt, Homo sapiens
gagccacccaccagaggaa

SEQ ID NO: 1482946 - RNA, 19 nt, Homo sapiens
acacaacaggcuacgaaga

SEQ ID NO: 1482947 - RNA, 19 nt, Homo sapiens
ugacccaucauccgaauag

SEQ ID NO: 1482948 - RNA, 19 nt, Homo sapiens
agaacgucuuuacagauug

SEQ ID NO: 1482949 - RNA, 19 nt, Homo sapiens
ggcccagcuucuaguucua

SEQ ID NO: 1482950 - RNA, 19 nt, Homo sapiens
gacaccaucuuggacucuu

SEQ ID NO: 1482951 - RNA, 19 nt, Homo sapiens
cauauccacaucucuuuca

SEQ ID NO: 1482952 - RNA, 19 nt, Homo sapiens
gcauccguguguuuugaua

SEQ ID NO: 1482953 - RNA, 19 nt, Homo sapiens
gaaaggccuggugcgauuc

SEQ ID NO: 1482954 - RNA, 19 nt, Homo sapiens
gcccagcuucuaguucuaa

SEQ ID NO: 1482955 - RNA, 19 nt, Homo sapiens
cuggugcgauucucaguag

SEQ ID NO: 1482956 - RNA, 19 nt, Homo sapiens
cuagaacgucuuuacagau

SEQ ID NO: 1482957 - RNA, 19 nt, Homo sapiens
gggcaaauggagcacagau

SEQ ID NO: 1482958 - RNA, 19 nt, Homo sapiens
ggccacgcccuuaucuaga

SEQ ID NO: 1482959 - RNA, 19 nt, Homo sapiens
ccaagugcaguaacacaca

SEQ ID NO: 1482960 - RNA, 19 nt, Homo sapiens
ggagacaagggagcaaugg

SEQ ID NO: 1482961 - RNA, 19 nt, Homo sapiens
uuccaccucucuucauguu

SEQ ID NO: 1482962 - RNA, 19 nt, Homo sapiens
ccggaacucugcccacacu

SEQ ID NO: 1482963 - RNA, 19 nt, Homo sapiens
aaauggagcacagaucuag

SEQ ID NO: 1482964 - RNA, 19 nt, Homo sapiens
ucucauggagugcaaagug

SEQ ID NO: 1482965 - RNA, 19 nt, Homo sapiens
ugauguggccacgcccuua

SEQ ID NO: 1482966 - RNA, 19 nt, Homo sapiens
gauucaggacaccaucuug

SEQ ID NO: 1482967 - RNA, 19 nt, Homo sapiens
ugaauggcguccuguaccu

SEQ ID NO: 1482968 - RNA, 19 nt, Homo sapiens
gggagacaagggagcaaug

SEQ ID NO: 1482969 - RNA, 19 nt, Homo sapiens
ccucagaaggccuuuccaa

SEQ ID NO: 1482970 - RNA, 19 nt, Homo sapiens
gagcaucacugucuacuca

SEQ ID NO: 1482971 - RNA, 19 nt, Homo sapiens
uguagacacuggacuauua

SEQ ID NO: 1482972 - RNA, 19 nt, Homo sapiens
gagaaugauugaacuaguu

SEQ ID NO: 1482973 - RNA, 19 nt, Homo sapiens
gaaaccugcuguucauuau

SEQ ID NO: 1482974 - RNA, 19 nt, Homo sapiens
cuagacaacuguaaacauu

SEQ ID NO: 1482975 - RNA, 19 nt, Homo sapiens
gaaacugacuggacauucu

SEQ ID NO: 1482976 - RNA, 19 nt, Homo sapiens
gaaggagcaucacugucua

SEQ ID NO: 1482977 - RNA, 19 nt, Homo sapiens
ggacagugacuuacuuuga

SEQ ID NO: 1482978 - RNA, 19 nt, Homo sapiens
guaguucuuucaaguugua

SEQ ID NO: 1482979 - RNA, 19 nt, Homo sapiens
gcacauugaccuaaguuga

SEQ ID NO: 1482980 - RNA, 19 nt, Homo sapiens
ggacucuacuuauaauauc

SEQ ID NO: 1482981 - RNA, 19 nt, Homo sapiens
uaagcgcaaugguaucuuu

SEQ ID NO: 1482982 - RNA, 19 nt, Homo sapiens
gacagugacuuacuuugau

SEQ ID NO: 1482983 - RNA, 19 nt, Homo sapiens
ggacaaugcuugccuuuuc

SEQ ID NO: 1482984 - RNA, 19 nt, Homo sapiens
ucacaaucauccucauuau

SEQ ID NO: 1482985 - RNA, 19 nt, Homo sapiens
caucguagcugcucuuacu

SEQ ID NO: 1482986 - RNA, 19 nt, Homo sapiens
ugagaaaccugcuguucau

SEQ ID NO: 1482987 - RNA, 19 nt, Homo sapiens
agaaaccugcuguucauua

SEQ ID NO: 1482988 - RNA, 19 nt, Homo sapiens
uaaaugugcuucugcaaaa

SEQ ID NO: 1482989 - RNA, 19 nt, Homo sapiens
guaauuaaaugugcuucug

SEQ ID NO: 1482990 - RNA, 19 nt, Homo sapiens
caaguuguaggaaacauuu

SEQ ID NO: 1482991 - RNA, 19 nt, Homo sapiens
auucuggacucuacuuaua

SEQ ID NO: 1482992 - RNA, 19 nt, Homo sapiens
acacuggacuauuaggauu

SEQ ID NO: 1482993 - RNA, 19 nt, Homo sapiens
gaaugucugaguauuaaga

SEQ ID NO: 1482994 - RNA, 19 nt, Homo sapiens
caaauaaugccuacuacuc

SEQ ID NO: 1482995 - RNA, 19 nt, Homo sapiens
uggcaaaacuuaaucauga

SEQ ID NO: 1482996 - RNA, 19 nt, Homo sapiens
ggagggaugcgaccaagug

SEQ ID NO: 1482997 - RNA, 19 nt, Homo sapiens
aaacuugaauacaggacaa

SEQ ID NO: 1482998 - RNA, 19 nt, Homo sapiens
guguaguucuuucaaguug

SEQ ID NO: 1482999 - RNA, 19 nt, Homo sapiens
gcaucacugucuacucaga

SEQ ID NO: 1483000 - RNA, 19 nt, Homo sapiens
gagcgauauuguuggcaaa

SEQ ID NO: 1483001 - RNA, 19 nt, Homo sapiens
aaaugaagaugauguagac

SEQ ID NO: 1483002 - RNA, 19 nt, Homo sapiens
caagaaggagcaucacugu

SEQ ID NO: 1483003 - RNA, 19 nt, Homo sapiens
aagcaaauaaugccuacua

SEQ ID NO: 1483004 - RNA, 19 nt, Homo sapiens
acagugacuuacuuugauu

SEQ ID NO: 1483005 - RNA, 19 nt, Homo sapiens
gccaucguauuccuccuuu

SEQ ID NO: 1483006 - RNA, 19 nt, Homo sapiens
cguagcugcucuuacugua

SEQ ID NO: 1483007 - RNA, 19 nt, Homo sapiens
uaaguacuuucuucagagu

SEQ ID NO: 1483008 - RNA, 19 nt, Homo sapiens
cuuauaauaucccuaacug

SEQ ID NO: 1483009 - RNA, 19 nt, Homo sapiens
ggauucuggacucuacuua

SEQ ID NO: 1483010 - RNA, 19 nt, Homo sapiens
ugagaaugauugaacuagu

SEQ ID NO: 1483011 - RNA, 19 nt, Homo sapiens
acauugaccuaaguugaaa

SEQ ID NO: 1483012 - RNA, 19 nt, Homo sapiens
acaaucauccucauuaugg

SEQ ID NO: 1483013 - RNA, 19 nt, Homo sapiens
ccgauaagcgcaaugguau

SEQ ID NO: 1483014 - RNA, 19 nt, Homo sapiens
gcuauagcauggcgauuuu

SEQ ID NO: 1483015 - RNA, 19 nt, Homo sapiens
ccuacuugaucguuaaaga

SEQ ID NO: 1483016 - RNA, 19 nt, Homo sapiens
uuaaaugugcuucugcaaa

SEQ ID NO: 1483017 - RNA, 19 nt, Homo sapiens
guccagguccucucuauuc

SEQ ID NO: 1483018 - RNA, 19 nt, Homo sapiens
caaucauccucauuaugga

SEQ ID NO: 1483019 - RNA, 19 nt, Homo sapiens
cacauugaccuaaguugaa

SEQ ID NO: 1483020 - RNA, 19 nt, Homo sapiens
cagauuaauugggaauauc

SEQ ID NO: 1483021 - RNA, 19 nt, Homo sapiens
ggcuauagcauggcgauuu

SEQ ID NO: 1483022 - RNA, 19 nt, Homo sapiens
agaguugcaugcugagaau

SEQ ID NO: 1483023 - RNA, 19 nt, Homo sapiens
gcaaauaaugccuacuacu

SEQ ID NO: 1483024 - RNA, 19 nt, Homo sapiens
agaaggagcaucacugucu

SEQ ID NO: 1483025 - RNA, 19 nt, Homo sapiens
ugaagaugauguagacacu

SEQ ID NO: 1483026 - RNA, 19 nt, Homo sapiens
cuauuucuguuuccacaau

SEQ ID NO: 1483027 - RNA, 19 nt, Homo sapiens
aaccugcuguucauuaugu

SEQ ID NO: 1483028 - RNA, 19 nt, Homo sapiens
aacccacacuggagcgaua

SEQ ID NO: 1483029 - RNA, 19 nt, Homo sapiens
ucgccuacuugaucguuaa

SEQ ID NO: 1483030 - RNA, 19 nt, Homo sapiens
uaguugagcuagaaauacu

SEQ ID NO: 1483031 - RNA, 19 nt, Homo sapiens
guguguaguucuuucaagu

SEQ ID NO: 1483032 - RNA, 19 nt, Homo sapiens
gauuuugaauggcaucgua

SEQ ID NO: 1483033 - RNA, 19 nt, Homo sapiens
uuucuuggacagugacuua

SEQ ID NO: 1483034 - RNA, 19 nt, Homo sapiens
cuugaucguuaaagaguug

SEQ ID NO: 1483035 - RNA, 19 nt, Homo sapiens
ggaggagggaugcgaccaa

SEQ ID NO: 1483036 - RNA, 19 nt, Homo sapiens
gcauggcgauuuugaaugg

SEQ ID NO: 1483037 - RNA, 19 nt, Homo sapiens
gagaaaccugcuguucauu

SEQ ID NO: 1483038 - RNA, 19 nt, Homo sapiens
ucuggacucuacuuauaau

SEQ ID NO: 1483039 - RNA, 19 nt, Homo sapiens
gauguagacacuggacuau

SEQ ID NO: 1483040 - RNA, 19 nt, Homo sapiens
ugauguagacacuggacua

SEQ ID NO: 1483041 - RNA, 19 nt, Homo sapiens
ccaucguauuccuccuuua

SEQ ID NO: 1483042 - RNA, 19 nt, Homo sapiens
cagguccucucuauucucu

SEQ ID NO: 1483043 - RNA, 19 nt, Homo sapiens
cccgauaagcgcaauggua

SEQ ID NO: 1483044 - RNA, 19 nt, Homo sapiens
guugcaugcugagaauuug

SEQ ID NO: 1483045 - RNA, 19 nt, Homo sapiens
aaagcacauugaccuaagu

SEQ ID NO: 1483046 - RNA, 19 nt, Homo sapiens
aaaccuaguaccugccauu

SEQ ID NO: 1483047 - RNA, 19 nt, Homo sapiens
cagaguauaagauguuuac

SEQ ID NO: 1483048 - RNA, 19 nt, Homo sapiens
acacuggagcgauauuguu

SEQ ID NO: 1483049 - RNA, 19 nt, Homo sapiens
gcuggauucuccuguugca

SEQ ID NO: 1483050 - RNA, 19 nt, Homo sapiens
cuucagaguauaagauguu

SEQ ID NO: 1483051 - RNA, 19 nt, Homo sapiens
aauugggaauaucugagua

SEQ ID NO: 1483052 - RNA, 19 nt, Homo sapiens
gauucuggacucuacuuau

SEQ ID NO: 1483053 - RNA, 19 nt, Homo sapiens
ucaaguuguaggaaacauu

SEQ ID NO: 1483054 - RNA, 19 nt, Homo sapiens
uaucacaaucauccucauu

SEQ ID NO: 1483055 - RNA, 19 nt, Homo sapiens
cgccaucgccuacuugauc

SEQ ID NO: 1483056 - RNA, 19 nt, Homo sapiens
gacacuggacuauuaggau

SEQ ID NO: 1483057 - RNA, 19 nt, Homo sapiens
aaacugacuggacauucuu

SEQ ID NO: 1483058 - RNA, 19 nt, Homo sapiens
guagacacuggacuauuag

SEQ ID NO: 1483059 - RNA, 19 nt, Homo sapiens
ucgcugcucuucgccauuc

SEQ ID NO: 1483060 - RNA, 19 nt, Homo sapiens
cgcccguucugcccgauaa

SEQ ID NO: 1483061 - RNA, 19 nt, Homo sapiens
cugcuggauucuccuguug

SEQ ID NO: 1483062 - RNA, 19 nt, Homo sapiens
uuaggauucuggacucuac

SEQ ID NO: 1483063 - RNA, 19 nt, Homo sapiens
uguuacaucuagacaacug

SEQ ID NO: 1483064 - RNA, 19 nt, Homo sapiens
gacaaugcuugccuuuuca

SEQ ID NO: 1483065 - RNA, 19 nt, Homo sapiens
cacaaucauccucauuaug

SEQ ID NO: 1483066 - RNA, 19 nt, Homo sapiens
cugagaaaccugcuguuca

SEQ ID NO: 1483067 - RNA, 19 nt, Homo sapiens
cuuggacagugacuuacuu

SEQ ID NO: 1483068 - RNA, 19 nt, Homo sapiens
gaaugauugaacuaguuug

SEQ ID NO: 1483069 - RNA, 19 nt, Homo sapiens
gcucuucgccauucuucuc

SEQ ID NO: 1483070 - RNA, 19 nt, Homo sapiens
gaacaucucuguagcaauc

SEQ ID NO: 1483071 - RNA, 19 nt, Homo sapiens
ugaguaagcuuucuuggua

SEQ ID NO: 1483072 - RNA, 19 nt, Homo sapiens
gaagaaacauucacagauc

SEQ ID NO: 1483073 - RNA, 19 nt, Homo sapiens
gauaacaacuucuuagcaa

SEQ ID NO: 1483074 - RNA, 19 nt, Homo sapiens
gaaggaggacuuauaauug

SEQ ID NO: 1483075 - RNA, 19 nt, Homo sapiens
caacuuaccuccucauauc

SEQ ID NO: 1483076 - RNA, 19 nt, Homo sapiens
gagcugagauugcgccauu

SEQ ID NO: 1483077 - RNA, 19 nt, Homo sapiens
gaacugcggcgaccaugua

SEQ ID NO: 1483078 - RNA, 19 nt, Homo sapiens
agugugagauuucgauuua

SEQ ID NO: 1483079 - RNA, 19 nt, Homo sapiens
ucacagaucuucuucaaac

SEQ ID NO: 1483080 - RNA, 19 nt, Homo sapiens
gaauuugaccugauacuug

SEQ ID NO: 1483081 - RNA, 19 nt, Homo sapiens
ugagaaagguucacuacga

SEQ ID NO: 1483082 - RNA, 19 nt, Homo sapiens
ugaaaugucuuacuguaca

SEQ ID NO: 1483083 - RNA, 19 nt, Homo sapiens
gagaaagguucacuacgau

SEQ ID NO: 1483084 - RNA, 19 nt, Homo sapiens
ccagaaggaggacuuauaa

SEQ ID NO: 1483085 - RNA, 19 nt, Homo sapiens
cugcaaaucuaaccauauu

SEQ ID NO: 1483086 - RNA, 19 nt, Homo sapiens
gcagugcuuugucccauug

SEQ ID NO: 1483087 - RNA, 19 nt, Homo sapiens
gaaaugucuuacuguacaa

SEQ ID NO: 1483088 - RNA, 19 nt, Homo sapiens
gaguaagcuuucuugguaa

SEQ ID NO: 1483089 - RNA, 19 nt, Homo sapiens
agaaggaggacuuauaauu

SEQ ID NO: 1483090 - RNA, 19 nt, Homo sapiens
uggagaauuugaccugaua

SEQ ID NO: 1483091 - RNA, 19 nt, Homo sapiens
gagcuguuagugcuauuua

SEQ ID NO: 1483092 - RNA, 19 nt, Homo sapiens
gacugcaaaucuaaccaua

SEQ ID NO: 1483093 - RNA, 19 nt, Homo sapiens
gcuaugaacgggauaacaa

SEQ ID NO: 1483094 - RNA, 19 nt, Homo sapiens
ccaucguucuuuccacaua

SEQ ID NO: 1483095 - RNA, 19 nt, Homo sapiens
gaaaccccaucucuacuaa

SEQ ID NO: 1483096 - RNA, 19 nt, Homo sapiens
uaacaacuucuuagcaaug

SEQ ID NO: 1483097 - RNA, 19 nt, Homo sapiens
ccuguaaucccaccacuuu

SEQ ID NO: 1483098 - RNA, 19 nt, Homo sapiens
gcuguuagugcuauuuaaa

SEQ ID NO: 1483099 - RNA, 19 nt, Homo sapiens
aggauuaagugugagauuu

SEQ ID NO: 1483100 - RNA, 19 nt, Homo sapiens
ggcagguucugucccauug

SEQ ID NO: 1483101 - RNA, 19 nt, Homo sapiens
gaaaccagaaggaggacuu

SEQ ID NO: 1483102 - RNA, 19 nt, Homo sapiens
gaggagaccacggaauuug

SEQ ID NO: 1483103 - RNA, 19 nt, Homo sapiens
ugccuuaauuucagguaua

SEQ ID NO: 1483104 - RNA, 19 nt, Homo sapiens
ggauuaagugugagauuuc

SEQ ID NO: 1483105 - RNA, 19 nt, Homo sapiens
ugaacgggauaacaacuuc

SEQ ID NO: 1483106 - RNA, 19 nt, Homo sapiens
aaacguucaagccaacuua

SEQ ID NO: 1483107 - RNA, 19 nt, Homo sapiens
ugugagauuucgauuuaug

SEQ ID NO: 1483108 - RNA, 19 nt, Homo sapiens
aaggaggacuuauaauugg

SEQ ID NO: 1483109 - RNA, 19 nt, Homo sapiens
ccgcuaacacccagucuaa

SEQ ID NO: 1483110 - RNA, 19 nt, Homo sapiens
ggauaacaacuucuuagca

SEQ ID NO: 1483111 - RNA, 19 nt, Homo sapiens
ugaguaggauaugagcuuu

SEQ ID NO: 1483112 - RNA, 19 nt, Homo sapiens
uaucacggaucgaaaagua

SEQ ID NO: 1483113 - RNA, 19 nt, Homo sapiens
auacauuccuugagcuguu

SEQ ID NO: 1483114 - RNA, 19 nt, Homo sapiens
uaaccuauacauuccuuga

SEQ ID NO: 1483115 - RNA, 19 nt, Homo sapiens
uagaagaaacauucacaga

SEQ ID NO: 1483116 - RNA, 19 nt, Homo sapiens
acuuggugcugauaucaua

SEQ ID NO: 1483117 - RNA, 19 nt, Homo sapiens
cuccucauauccaaacuaa

SEQ ID NO: 1483118 - RNA, 19 nt, Homo sapiens
cagguucugucccauuguu

SEQ ID NO: 1483119 - RNA, 19 nt, Homo sapiens
ggaauuuggguugcagaaa

SEQ ID NO: 1483120 - RNA, 19 nt, Homo sapiens
uacauuccuugagcuguua

SEQ ID NO: 1483121 - RNA, 19 nt, Homo sapiens
ccauguauuucugguuuau

SEQ ID NO: 1483122 - RNA, 19 nt, Homo sapiens
ggucucauaucaugcuuuu

SEQ ID NO: 1483123 - RNA, 19 nt, Homo sapiens
cgauuuaugcuauuugugu

SEQ ID NO: 1483124 - RNA, 19 nt, Homo sapiens
agaagaaacauucacagau

SEQ ID NO: 1483125 - RNA, 19 nt, Homo sapiens
gagauuucgauuuaugcua

SEQ ID NO: 1483126 - RNA, 19 nt, Homo sapiens
uggaacaucucuguagcaa

SEQ ID NO: 1483127 - RNA, 19 nt, Homo sapiens
auucacagaucuucuucaa

SEQ ID NO: 1483128 - RNA, 19 nt, Homo sapiens
cuaaaacuguuguuaagga

SEQ ID NO: 1483129 - RNA, 19 nt, Homo sapiens
cugcggcgaccauguauuu

SEQ ID NO: 1483130 - RNA, 19 nt, Homo sapiens
gaaacauucacagaucuuc

SEQ ID NO: 1483131 - RNA, 19 nt, Homo sapiens
ccaacuuaccuccucauau

SEQ ID NO: 1483132 - RNA, 19 nt, Homo sapiens
gcuauuuguguaucccaua

SEQ ID NO: 1483133 - RNA, 19 nt, Homo sapiens
gccuuaauuucagguauau

SEQ ID NO: 1483134 - RNA, 19 nt, Homo sapiens
uaaaggauuaagugugaga

SEQ ID NO: 1483135 - RNA, 19 nt, Homo sapiens
gcuaacacccagucuaagg

SEQ ID NO: 1483136 - RNA, 19 nt, Homo sapiens
uuacgaagcacagaagaga

SEQ ID NO: 1483137 - RNA, 19 nt, Homo sapiens
ccucauauccaaacuaaaa

SEQ ID NO: 1483138 - RNA, 19 nt, Homo sapiens
uuaguugaguaggauauga

SEQ ID NO: 1483139 - RNA, 19 nt, Homo sapiens
aagaaacauucacagaucu

SEQ ID NO: 1483140 - RNA, 19 nt, Homo sapiens
ugaggagaccacggaauuu

SEQ ID NO: 1483141 - RNA, 19 nt, Homo sapiens
gcugggugcucaugugacu

SEQ ID NO: 1483142 - RNA, 19 nt, Homo sapiens
gggcagguucugucccauu

SEQ ID NO: 1483143 - RNA, 19 nt, Homo sapiens
uacaauguuuagcugaguu

SEQ ID NO: 1483144 - RNA, 19 nt, Homo sapiens
aaaccagaaggaggacuua

SEQ ID NO: 1483145 - RNA, 19 nt, Homo sapiens
gccaacuuaccuccucaua

SEQ ID NO: 1483146 - RNA, 19 nt, Homo sapiens
agucugaaaugcaauuaac

SEQ ID NO: 1483147 - RNA, 19 nt, Homo sapiens
acgaagcacagaagagaaa

SEQ ID NO: 1483148 - RNA, 19 nt, Homo sapiens
gcuggagaggcaauuuauu

SEQ ID NO: 1483149 - RNA, 19 nt, Homo sapiens
accagaaggaggacuuaua

SEQ ID NO: 1483150 - RNA, 19 nt, Homo sapiens
caaaccacacgauccagau

SEQ ID NO: 1483151 - RNA, 19 nt, Homo sapiens
gaaauuccacaagccucuu

SEQ ID NO: 1483152 - RNA, 19 nt, Homo sapiens
ccacggaauuuggguugca

SEQ ID NO: 1483153 - RNA, 19 nt, Homo sapiens
ggaucgaaaaguagcauua

SEQ ID NO: 1483154 - RNA, 19 nt, Homo sapiens
gauuaagugugagauuucg

SEQ ID NO: 1483155 - RNA, 19 nt, Homo sapiens
gugugucacuuaaggucuu

SEQ ID NO: 1483156 - RNA, 19 nt, Homo sapiens
uucaaacacuggaacaucu

SEQ ID NO: 1483157 - RNA, 19 nt, Homo sapiens
ggaacugcggcgaccaugu

SEQ ID NO: 1483158 - RNA, 19 nt, Homo sapiens
ugacuaucacggaucgaaa

SEQ ID NO: 1483159 - RNA, 19 nt, Homo sapiens
cacagaagagaaaccagaa

SEQ ID NO: 1483160 - RNA, 19 nt, Homo sapiens
cagaucuucuucaaacacu

SEQ ID NO: 1483161 - RNA, 19 nt, Homo sapiens
ccugauacuuggugcugau

SEQ ID NO: 1483162 - RNA, 19 nt, Homo sapiens
gagcugacuuggggacaaa

SEQ ID NO: 1483163 - RNA, 19 nt, Homo sapiens
aaaugaguaagcuuucuug

SEQ ID NO: 1483164 - RNA, 19 nt, Homo sapiens
ccauacuccucccuuuuaa

SEQ ID NO: 1483165 - RNA, 19 nt, Homo sapiens
cggcgaccauguauuucug

SEQ ID NO: 1483166 - RNA, 19 nt, Homo sapiens
gcaaugcuggagaggcaau

SEQ ID NO: 1483167 - RNA, 19 nt, Homo sapiens
acacuggaacaucucugua

SEQ ID NO: 1483168 - RNA, 19 nt, Homo sapiens
ugagauugcgccauuguac

SEQ ID NO: 1483169 - RNA, 19 nt, Homo sapiens
gcugagauugcgccauugu

SEQ ID NO: 1483170 - RNA, 19 nt, Homo sapiens
gaacagagaugcaaauaga

SEQ ID NO: 1483171 - RNA, 19 nt, Homo sapiens
ggaaagaucucaaauucaa

SEQ ID NO: 1483172 - RNA, 19 nt, Homo sapiens
gcugauaacuucauuggua

SEQ ID NO: 1483173 - RNA, 19 nt, Homo sapiens
ggacaugaaugaaauggaa

SEQ ID NO: 1483174 - RNA, 19 nt, Homo sapiens
uacaaagacuggagaaaua

SEQ ID NO: 1483175 - RNA, 19 nt, Homo sapiens
cuaaagccauccucucuua

SEQ ID NO: 1483176 - RNA, 19 nt, Homo sapiens
acacacagauauuugcuua

SEQ ID NO: 1483177 - RNA, 19 nt, Homo sapiens
cgagaugcccgaagauuua

SEQ ID NO: 1483178 - RNA, 19 nt, Homo sapiens
gcagacagcagcguuguua

SEQ ID NO: 1483179 - RNA, 19 nt, Homo sapiens
aaggaaagaucucaaauuc

SEQ ID NO: 1483180 - RNA, 19 nt, Homo sapiens
gaggaaguaucaguuauug

SEQ ID NO: 1483181 - RNA, 19 nt, Homo sapiens
gcccgaagauuuagcuuug

SEQ ID NO: 1483182 - RNA, 19 nt, Homo sapiens
ggauaacauuugucauuca

SEQ ID NO: 1483183 - RNA, 19 nt, Homo sapiens
ggaccuucaucuacaaaga

SEQ ID NO: 1483184 - RNA, 19 nt, Homo sapiens
gcaauaguaacuuugguuu

SEQ ID NO: 1483185 - RNA, 19 nt, Homo sapiens
ucaagagacucauggacaa

SEQ ID NO: 1483186 - RNA, 19 nt, Homo sapiens
aaacaugggacucuaacua

SEQ ID NO: 1483187 - RNA, 19 nt, Homo sapiens
gcauaugccuuuaaaauca

SEQ ID NO: 1483188 - RNA, 19 nt, Homo sapiens
ggauuauacuccacaggaa

SEQ ID NO: 1483189 - RNA, 19 nt, Homo sapiens
gcaaagaaagagcacagaa

SEQ ID NO: 1483190 - RNA, 19 nt, Homo sapiens
gagcuucuucaguuuaaua

SEQ ID NO: 1483191 - RNA, 19 nt, Homo sapiens
gagaucacauccacuuaca

SEQ ID NO: 1483192 - RNA, 19 nt, Homo sapiens
gcucaacaauauuucuaga

SEQ ID NO: 1483193 - RNA, 19 nt, Homo sapiens
gauaucuacuucuauugga

SEQ ID NO: 1483194 - RNA, 19 nt, Homo sapiens
cauguugcauuucuuguga

SEQ ID NO: 1483195 - RNA, 19 nt, Homo sapiens
gcaaccauuugaaccaugu

SEQ ID NO: 1483196 - RNA, 19 nt, Homo sapiens
gcaaaucucaaacggaugu

SEQ ID NO: 1483197 - RNA, 19 nt, Homo sapiens
gcgagaugcccgaagauuu

SEQ ID NO: 1483198 - RNA, 19 nt, Homo sapiens
gaaccuagaggcuauuucu

SEQ ID NO: 1483199 - RNA, 19 nt, Homo sapiens
gauccugagcacaaauuua

SEQ ID NO: 1483200 - RNA, 19 nt, Homo sapiens
aggaauacuuuaagcauga

SEQ ID NO: 1483201 - RNA, 19 nt, Homo sapiens
cagaggaaguaucaguuau

SEQ ID NO: 1483202 - RNA, 19 nt, Homo sapiens
gaaagaaugggaccuuguc

SEQ ID NO: 1483203 - RNA, 19 nt, Homo sapiens
ugugaacuauguaagguuu

SEQ ID NO: 1483204 - RNA, 19 nt, Homo sapiens
gagagaucacauccacuua

SEQ ID NO: 1483205 - RNA, 19 nt, Homo sapiens
aaucuuagaaccacaguaa

SEQ ID NO: 1483206 - RNA, 19 nt, Homo sapiens
ccaagggcaagcacaauuu

SEQ ID NO: 1483207 - RNA, 19 nt, Homo sapiens
uugcauuucuugugaacua

SEQ ID NO: 1483208 - RNA, 19 nt, Homo sapiens
acagaggaaguaucaguua

SEQ ID NO: 1483209 - RNA, 19 nt, Homo sapiens
cauauucuuugcaagcauu

SEQ ID NO: 1483210 - RNA, 19 nt, Homo sapiens
agugaaggcucccauccua

SEQ ID NO: 1483211 - RNA, 19 nt, Homo sapiens
gaggcuauuucuagauugu

SEQ ID NO: 1483212 - RNA, 19 nt, Homo sapiens
agaaagagcacagaaccua

SEQ ID NO: 1483213 - RNA, 19 nt, Homo sapiens
gaugacaacaaccugaauu

SEQ ID NO: 1483214 - RNA, 19 nt, Homo sapiens
aaguauagcucaugcucaa

SEQ ID NO: 1483215 - RNA, 19 nt, Homo sapiens
gaagagcaaccauuugaac

SEQ ID NO: 1483216 - RNA, 19 nt, Homo sapiens
ggaagagcaaccauuugaa

SEQ ID NO: 1483217 - RNA, 19 nt, Homo sapiens
agauuuagcuuuggaguca

SEQ ID NO: 1483218 - RNA, 19 nt, Homo sapiens
gcuaugagaaggucuuuca

SEQ ID NO: 1483219 - RNA, 19 nt, Homo sapiens
gcaugauccugagcacaaa

SEQ ID NO: 1483220 - RNA, 19 nt, Homo sapiens
ugugugaccuuagcaauau

SEQ ID NO: 1483221 - RNA, 19 nt, Homo sapiens
caugggaccuucaucuaca

SEQ ID NO: 1483222 - RNA, 19 nt, Homo sapiens
cacagaaccuagaggcuau

SEQ ID NO: 1483223 - RNA, 19 nt, Homo sapiens
uaacuuaugcugaaaucga

SEQ ID NO: 1483224 - RNA, 19 nt, Homo sapiens
ggaaagaaugggaccuugu

SEQ ID NO: 1483225 - RNA, 19 nt, Homo sapiens
ucauggacaacaaggauua

SEQ ID NO: 1483226 - RNA, 19 nt, Homo sapiens
uagcucaugcucaacaaua

SEQ ID NO: 1483227 - RNA, 19 nt, Homo sapiens
agaggaagagcaaccauuu

SEQ ID NO: 1483228 - RNA, 19 nt, Homo sapiens
ucaaacggaugugcgagaa

SEQ ID NO: 1483229 - RNA, 19 nt, Homo sapiens
acaugggacucuaacuaaa

SEQ ID NO: 1483230 - RNA, 19 nt, Homo sapiens
gcacagucagccagccuaa

SEQ ID NO: 1483231 - RNA, 19 nt, Homo sapiens
gacacuaaccauauaacuu

SEQ ID NO: 1483232 - RNA, 19 nt, Homo sapiens
cuacaaagacuggagaaau

SEQ ID NO: 1483233 - RNA, 19 nt, Homo sapiens
guguagagccgcuaugaga

SEQ ID NO: 1483234 - RNA, 19 nt, Homo sapiens
gaccuuagcaauauauuac

SEQ ID NO: 1483235 - RNA, 19 nt, Homo sapiens
gagcaaccauuugaaccau

SEQ ID NO: 1483236 - RNA, 19 nt, Homo sapiens
gauuauacuccacaggaaa

SEQ ID NO: 1483237 - RNA, 19 nt, Homo sapiens
uaaagaacagagaugcaaa

SEQ ID NO: 1483238 - RNA, 19 nt, Homo sapiens
gaaugggaccuugucaaug

SEQ ID NO: 1483239 - RNA, 19 nt, Homo sapiens
uggagcuucuucaguuuaa

SEQ ID NO: 1483240 - RNA, 19 nt, Homo sapiens
caacaaaacacucuucugu

SEQ ID NO: 1483241 - RNA, 19 nt, Homo sapiens
ggacaacaaggauuauacu

SEQ ID NO: 1483242 - RNA, 19 nt, Homo sapiens
guugaggacaugaaugaaa

SEQ ID NO: 1483243 - RNA, 19 nt, Homo sapiens
cgaucaggcuguauggaau

SEQ ID NO: 1483244 - RNA, 19 nt, Homo sapiens
ugagagaucacauccacuu

SEQ ID NO: 1483245 - RNA, 19 nt, Homo sapiens
gaggaagagcaaccauuug

SEQ ID NO: 1483246 - RNA, 19 nt, Homo sapiens
cauugaagcugcuagucau

SEQ ID NO: 1483247 - RNA, 19 nt, Homo sapiens
guacugcgcguccgacauc

SEQ ID NO: 1483248 - RNA, 19 nt, Homo sapiens
cuggagaaauaccaccuuu

SEQ ID NO: 1483249 - RNA, 19 nt, Homo sapiens
aaagccauccucucuuaaa

SEQ ID NO: 1483250 - RNA, 19 nt, Homo sapiens
uauggaauguggacuacug

SEQ ID NO: 1483251 - RNA, 19 nt, Homo sapiens
gcauuucuugugaacuaua

SEQ ID NO: 1483252 - RNA, 19 nt, Homo sapiens
aaacagaggaaguaucagu

SEQ ID NO: 1483253 - RNA, 19 nt, Homo sapiens
auaaacagaggaaguauca

SEQ ID NO: 1483254 - RNA, 19 nt, Homo sapiens
uggauaacauuugucauuc

SEQ ID NO: 1483255 - RNA, 19 nt, Homo sapiens
acagcagcguuguuaggua

SEQ ID NO: 1483256 - RNA, 19 nt, Homo sapiens
acacagauauuugcuuacu

SEQ ID NO: 1483257 - RNA, 19 nt, Homo sapiens
aaugggaccuugucaaugc

SEQ ID NO: 1483258 - RNA, 19 nt, Homo sapiens
ucgcagacgagucagcuua

SEQ ID NO: 1483259 - RNA, 19 nt, Homo sapiens
caguugaggacaugaauga

SEQ ID NO: 1483260 - RNA, 19 nt, Homo sapiens
ggaauacuuuaagcaugau

SEQ ID NO: 1483261 - RNA, 19 nt, Homo sapiens
ggucauaaacagaggaagu

SEQ ID NO: 1483262 - RNA, 19 nt, Homo sapiens
cuggauaacauuugucauu

SEQ ID NO: 1483263 - RNA, 19 nt, Homo sapiens
gcugugaacuauguaaggu

SEQ ID NO: 1483264 - RNA, 19 nt, Homo sapiens
uugaggacaugaaugaaau

SEQ ID NO: 1483265 - RNA, 19 nt, Homo sapiens
aggaagagcaaccauuuga

SEQ ID NO: 1483266 - RNA, 19 nt, Homo sapiens
ccgaagauuuagcuuugga

SEQ ID NO: 1483267 - RNA, 19 nt, Homo sapiens
gucauaaacagaggaagua

SEQ ID NO: 1483268 - RNA, 19 nt, Homo sapiens
cugauaacuucauugguau

SEQ ID NO: 1483269 - RNA, 19 nt, Homo sapiens
guguuuaugccaaauacua

SEQ ID NO: 1483270 - RNA, 19 nt, Homo sapiens
ggaauauucuguuguaguu

SEQ ID NO: 1483271 - RNA, 19 nt, Homo sapiens
caaauucggucuucauaga

SEQ ID NO: 1483272 - RNA, 19 nt, Homo sapiens
gcagagucuuuaaguauuu

SEQ ID NO: 1483273 - RNA, 19 nt, Homo sapiens
caacagggagugaauuaua

SEQ ID NO: 1483274 - RNA, 19 nt, Homo sapiens
guggaacucuucaacuuua

SEQ ID NO: 1483275 - RNA, 19 nt, Homo sapiens
acaacuggcugauguuuaa

SEQ ID NO: 1483276 - RNA, 19 nt, Homo sapiens
ggauaaauuugacugcauu

SEQ ID NO: 1483277 - RNA, 19 nt, Homo sapiens
uaucagauguuccacguaa

SEQ ID NO: 1483278 - RNA, 19 nt, Homo sapiens
ggagugaauuauacacaaa

SEQ ID NO: 1483279 - RNA, 19 nt, Homo sapiens
ggauauaccuuacagaaaa

SEQ ID NO: 1483280 - RNA, 19 nt, Homo sapiens
gaaaacaacuggcugaugu

SEQ ID NO: 1483281 - RNA, 19 nt, Homo sapiens
aaagagcagugacaucauu

SEQ ID NO: 1483282 - RNA, 19 nt, Homo sapiens
acaaugugcucccaacaaa

SEQ ID NO: 1483283 - RNA, 19 nt, Homo sapiens
guccucagguguugauaua

SEQ ID NO: 1483284 - RNA, 19 nt, Homo sapiens
ggcagagucuuuaaguauu

SEQ ID NO: 1483285 - RNA, 19 nt, Homo sapiens
ugcaauagaugcccaaaga

SEQ ID NO: 1483286 - RNA, 19 nt, Homo sapiens
gggcagagucuuuaaguau

SEQ ID NO: 1483287 - RNA, 19 nt, Homo sapiens
gagauaaggguguaagaga

SEQ ID NO: 1483288 - RNA, 19 nt, Homo sapiens
ugaacuacgugauucuuau

SEQ ID NO: 1483289 - RNA, 19 nt, Homo sapiens
gggagugaauuauacacaa

SEQ ID NO: 1483290 - RNA, 19 nt, Homo sapiens
cauacucauucuugcaaua

SEQ ID NO: 1483291 - RNA, 19 nt, Homo sapiens
uaauaaugcuggaguuaag

SEQ ID NO: 1483292 - RNA, 19 nt, Homo sapiens
guaauaaugcuggaguuaa

SEQ ID NO: 1483293 - RNA, 19 nt, Homo sapiens
gcaauggucaucucacugu

SEQ ID NO: 1483294 - RNA, 19 nt, Homo sapiens
uuacaaauccagcagcuuu

SEQ ID NO: 1483295 - RNA, 19 nt, Homo sapiens
ucagauguuccacguaaua

SEQ ID NO: 1483296 - RNA, 19 nt, Homo sapiens
gacaauacaaucauagaug

SEQ ID NO: 1483297 - RNA, 19 nt, Homo sapiens
agauaaggguguaagagaa

SEQ ID NO: 1483298 - RNA, 19 nt, Homo sapiens
ggaacucuucaacuuuaua

SEQ ID NO: 1483299 - RNA, 19 nt, Homo sapiens
ccucagguguugauauaau

SEQ ID NO: 1483300 - RNA, 19 nt, Homo sapiens
caauagaugcccaaagaau

SEQ ID NO: 1483301 - RNA, 19 nt, Homo sapiens
gaaaagagcagugacauca

SEQ ID NO: 1483302 - RNA, 19 nt, Homo sapiens
ucccaaugcugaaguaaga

SEQ ID NO: 1483303 - RNA, 19 nt, Homo sapiens
aaugaugucuguccaguca

SEQ ID NO: 1483304 - RNA, 19 nt, Homo sapiens
gauguuccacguaauaaug

SEQ ID NO: 1483305 - RNA, 19 nt, Homo sapiens
uacaacagggagugaauua

SEQ ID NO: 1483306 - RNA, 19 nt, Homo sapiens
gcaauagaugcccaaagaa

SEQ ID NO: 1483307 - RNA, 19 nt, Homo sapiens
uguaagagaacaugaaaug

SEQ ID NO: 1483308 - RNA, 19 nt, Homo sapiens
gguggaacucuucaacuuu

SEQ ID NO: 1483309 - RNA, 19 nt, Homo sapiens
cuacgugauucuuaucgaa

SEQ ID NO: 1483310 - RNA, 19 nt, Homo sapiens
gaguuaagaaguuuccauu

SEQ ID NO: 1483311 - RNA, 19 nt, Homo sapiens
cuucauagauuggguuuua

SEQ ID NO: 1483312 - RNA, 19 nt, Homo sapiens
uaaucccaaugcugaagua

SEQ ID NO: 1483313 - RNA, 19 nt, Homo sapiens
ugaagauugucaugauugu

SEQ ID NO: 1483314 - RNA, 19 nt, Homo sapiens
ccuauggaauauucuguug

SEQ ID NO: 1483315 - RNA, 19 nt, Homo sapiens
aaagcuuccuauugaacua

SEQ ID NO: 1483316 - RNA, 19 nt, Homo sapiens
ggucaucucacuguugaaa

SEQ ID NO: 1483317 - RNA, 19 nt, Homo sapiens
ucuguucccuguauauaga

SEQ ID NO: 1483318 - RNA, 19 nt, Homo sapiens
guaagagaacaugaaauga

SEQ ID NO: 1483319 - RNA, 19 nt, Homo sapiens
gguguaagagaacaugaaa

SEQ ID NO: 1483320 - RNA, 19 nt, Homo sapiens
gaacuacgugauucuuauc

SEQ ID NO: 1483321 - RNA, 19 nt, Homo sapiens
cagaaugucucaaaaucuu

SEQ ID NO: 1483322 - RNA, 19 nt, Homo sapiens
cguaauaaugcuggaguua

SEQ ID NO: 1483323 - RNA, 19 nt, Homo sapiens
ugguggaacucuucaacuu

SEQ ID NO: 1483324 - RNA, 19 nt, Homo sapiens
aaacugaagauugucauga

SEQ ID NO: 1483325 - RNA, 19 nt, Homo sapiens
gaauuuaugggcagagucu

SEQ ID NO: 1483326 - RNA, 19 nt, Homo sapiens
agacucuguucccuguaua

SEQ ID NO: 1483327 - RNA, 19 nt, Homo sapiens
guagauaaacaguuacaac

SEQ ID NO: 1483328 - RNA, 19 nt, Homo sapiens
ugggcagagucuuuaagua

SEQ ID NO: 1483329 - RNA, 19 nt, Homo sapiens
uaauagcaauggucaucuc

SEQ ID NO: 1483330 - RNA, 19 nt, Homo sapiens
uuuagaagcugccaguuuu

SEQ ID NO: 1483331 - RNA, 19 nt, Homo sapiens
gaagauugucaugauuguu

SEQ ID NO: 1483332 - RNA, 19 nt, Homo sapiens
aauucggucuucauagauu

SEQ ID NO: 1483333 - RNA, 19 nt, Homo sapiens
acugaagauugucaugauu

SEQ ID NO: 1483334 - RNA, 19 nt, Homo sapiens
gaaaugaaaagagcaguga

SEQ ID NO: 1483335 - RNA, 19 nt, Homo sapiens
ccuauugaacuacgugauu

SEQ ID NO: 1483336 - RNA, 19 nt, Homo sapiens
caauggucaucucacuguu

SEQ ID NO: 1483337 - RNA, 19 nt, Homo sapiens
ggagauaaggguguaagag

SEQ ID NO: 1483338 - RNA, 19 nt, Homo sapiens
cuauugaacuacgugauuc

SEQ ID NO: 1483339 - RNA, 19 nt, Homo sapiens
ccaaugcugaaguaagauu

SEQ ID NO: 1483340 - RNA, 19 nt, Homo sapiens
aagacucuguucccuguau

SEQ ID NO: 1483341 - RNA, 19 nt, Homo sapiens
ucuuggaaauacuaaguug

SEQ ID NO: 1483342 - RNA, 19 nt, Homo sapiens
uagcaauggucaucucacu

SEQ ID NO: 1483343 - RNA, 19 nt, Homo sapiens
gaacaugaaaugaaaagag

SEQ ID NO: 1483344 - RNA, 19 nt, Homo sapiens
gauaaggguguaagagaac

SEQ ID NO: 1483345 - RNA, 19 nt, Homo sapiens
cagagucuuuaaguauuug

SEQ ID NO: 1483346 - RNA, 19 nt, Homo sapiens
cagauguuccacguaauaa

SEQ ID NO: 1483347 - RNA, 19 nt, Homo sapiens
gggacuggguuuucuauca

SEQ ID NO: 1483348 - RNA, 19 nt, Homo sapiens
cucagguguugauauaauu

SEQ ID NO: 1483349 - RNA, 19 nt, Homo sapiens
augcuggaguuaagaaguu

SEQ ID NO: 1483350 - RNA, 19 nt, Homo sapiens
ggugaugguggaaaugaug

SEQ ID NO: 1483351 - RNA, 19 nt, Homo sapiens
gauugucuuggaaauacua

SEQ ID NO: 1483352 - RNA, 19 nt, Homo sapiens
aacagggagugaauuauac

SEQ ID NO: 1483353 - RNA, 19 nt, Homo sapiens
gaagacucuguucccugua

SEQ ID NO: 1483354 - RNA, 19 nt, Homo sapiens
ggaguuaagaaguuuccau

SEQ ID NO: 1483355 - RNA, 19 nt, Homo sapiens
ugguggaaaugaugucugu

SEQ ID NO: 1483356 - RNA, 19 nt, Homo sapiens
uugaacuacgugauucuua

SEQ ID NO: 1483357 - RNA, 19 nt, Homo sapiens
uugagccuauggaauauuc

SEQ ID NO: 1483358 - RNA, 19 nt, Homo sapiens
cugaagauugucaugauug

SEQ ID NO: 1483359 - RNA, 19 nt, Homo sapiens
aacugaagauugucaugau

SEQ ID NO: 1483360 - RNA, 19 nt, Homo sapiens
aggauauaccuuacagaaa

SEQ ID NO: 1483361 - RNA, 19 nt, Homo sapiens
aauagaugcccaaagaauc

SEQ ID NO: 1483362 - RNA, 19 nt, Homo sapiens
auggucaucucacuguuga

SEQ ID NO: 1483363 - RNA, 19 nt, Homo sapiens
ucaaauucggucuucauag

SEQ ID NO: 1483364 - RNA, 19 nt, Homo sapiens
gugacaucauugccuuuca

SEQ ID NO: 1483365 - RNA, 19 nt, Homo sapiens
gggagauaaggguguaaga

SEQ ID NO: 1483366 - RNA, 19 nt, Homo sapiens
uuuaugggcagagucuuua

SEQ ID NO: 1483367 - RNA, 19 nt, Homo sapiens
cagaauuuaugggcagagu

SEQ ID NO: 1483368 - RNA, 19 nt, Homo sapiens
uacaaugugcucccaacaa

SEQ ID NO: 1483369 - RNA, 19 nt, Homo sapiens
guacaaugugcucccaaca

SEQ ID NO: 1483370 - RNA, 19 nt, Homo sapiens
ucaaagacauuaccugaua

SEQ ID NO: 1483371 - RNA, 19 nt, Homo sapiens
ggaauaaagugaauuggaa

SEQ ID NO: 1483372 - RNA, 19 nt, Homo sapiens
uuacaggacuugucaaaua

SEQ ID NO: 1483373 - RNA, 19 nt, Homo sapiens
gaaggagagugucagguua

SEQ ID NO: 1483374 - RNA, 19 nt, Homo sapiens
ggaaaguugugaucaaauu

SEQ ID NO: 1483375 - RNA, 19 nt, Homo sapiens
gauaacuucuucucucuaa

SEQ ID NO: 1483376 - RNA, 19 nt, Homo sapiens
gaaaugaaccagauauaug

SEQ ID NO: 1483377 - RNA, 19 nt, Homo sapiens
gcacuaccacuuugaauaa

SEQ ID NO: 1483378 - RNA, 19 nt, Homo sapiens
gcaaagaaauaaacaggau

SEQ ID NO: 1483379 - RNA, 19 nt, Homo sapiens
ugaacaagcugauaaggaa

SEQ ID NO: 1483380 - RNA, 19 nt, Homo sapiens
gaaaccaucuccuaguaau

SEQ ID NO: 1483381 - RNA, 19 nt, Homo sapiens
gaaagucuacuguaucuga

SEQ ID NO: 1483382 - RNA, 19 nt, Homo sapiens
gaaugaaccacauguauga

SEQ ID NO: 1483383 - RNA, 19 nt, Homo sapiens
ggauuuaacugcuagugaa

SEQ ID NO: 1483384 - RNA, 19 nt, Homo sapiens
gaaaguaaaucggaagaca

SEQ ID NO: 1483385 - RNA, 19 nt, Homo sapiens
gaucaaagagacaguuuaa

SEQ ID NO: 1483386 - RNA, 19 nt, Homo sapiens
gaggaaacauacucuuuau

SEQ ID NO: 1483387 - RNA, 19 nt, Homo sapiens
uaaagaaccuaucucugaa

SEQ ID NO: 1483388 - RNA, 19 nt, Homo sapiens
gaagucaacaguaaugaaa

SEQ ID NO: 1483389 - RNA, 19 nt, Homo sapiens
uaagaagccuagacuaaau

SEQ ID NO: 1483390 - RNA, 19 nt, Homo sapiens
gguaagaagccuagacuaa

SEQ ID NO: 1483391 - RNA, 19 nt, Homo sapiens
ggaauuaagagacauuuga

SEQ ID NO: 1483392 - RNA, 19 nt, Homo sapiens
gaacggacaagcagaagaa

SEQ ID NO: 1483393 - RNA, 19 nt, Homo sapiens
acagacaucuaucuccuua

SEQ ID NO: 1483394 - RNA, 19 nt, Homo sapiens
gauggaaacuggcucacuu

SEQ ID NO: 1483395 - RNA, 19 nt, Homo sapiens
agaauucccuaacuuguaa

SEQ ID NO: 1483396 - RNA, 19 nt, Homo sapiens
cauuucaaguccagaauua

SEQ ID NO: 1483397 - RNA, 19 nt, Homo sapiens
gaagcucucaugaacaaua

SEQ ID NO: 1483398 - RNA, 19 nt, Homo sapiens
uaacaaagguguacaugac

SEQ ID NO: 1483399 - RNA, 19 nt, Homo sapiens
guggaaaccuguaugauuc

SEQ ID NO: 1483400 - RNA, 19 nt, Homo sapiens
gaacagcuggcucagauga

SEQ ID NO: 1483401 - RNA, 19 nt, Homo sapiens
gauauucccucuucaggau

SEQ ID NO: 1483402 - RNA, 19 nt, Homo sapiens
ggucagaauucccuaacuu

SEQ ID NO: 1483403 - RNA, 19 nt, Homo sapiens
ucggaaguguuauuucuua

SEQ ID NO: 1483404 - RNA, 19 nt, Homo sapiens
uagaagcucucaugaacaa

SEQ ID NO: 1483405 - RNA, 19 nt, Homo sapiens
uaacacugcugaaucugaa

SEQ ID NO: 1483406 - RNA, 19 nt, Homo sapiens
gagcguuucuucugguaaa

SEQ ID NO: 1483407 - RNA, 19 nt, Homo sapiens
guaagaagccuagacuaaa

SEQ ID NO: 1483408 - RNA, 19 nt, Homo sapiens
ccaaaguucagguaaauuu

SEQ ID NO: 1483409 - RNA, 19 nt, Homo sapiens
ucuaagacuucucuaauga

SEQ ID NO: 1483410 - RNA, 19 nt, Homo sapiens
ggauaauucggaaguguua

SEQ ID NO: 1483411 - RNA, 19 nt, Homo sapiens
caaaugaugaugaagauga

SEQ ID NO: 1483412 - RNA, 19 nt, Homo sapiens
gguguacuccuuucuauuu

SEQ ID NO: 1483413 - RNA, 19 nt, Homo sapiens
gagaaaauguacuguguaa

SEQ ID NO: 1483414 - RNA, 19 nt, Homo sapiens
ugaacaaggugacagagaa

SEQ ID NO: 1483415 - RNA, 19 nt, Homo sapiens
cauagaagcucucaugaac

SEQ ID NO: 1483416 - RNA, 19 nt, Homo sapiens
gcagagugcaugaaucaaa

SEQ ID NO: 1483417 - RNA, 19 nt, Homo sapiens
gccuaaagcuaaauaacuu

SEQ ID NO: 1483418 - RNA, 19 nt, Homo sapiens
cagaauauauuggaguuga

SEQ ID NO: 1483419 - RNA, 19 nt, Homo sapiens
gaacaaggugacagagaaa

SEQ ID NO: 1483420 - RNA, 19 nt, Homo sapiens
ggauaaugaugacuuucaa

SEQ ID NO: 1483421 - RNA, 19 nt, Homo sapiens
gcacaacaacagggcauua

SEQ ID NO: 1483422 - RNA, 19 nt, Homo sapiens
gggaaagucuacuguaucu

SEQ ID NO: 1483423 - RNA, 19 nt, Homo sapiens
caagaaagcuauacaaaag

SEQ ID NO: 1483424 - RNA, 19 nt, Homo sapiens
gaaaccaaccaaauauaug

SEQ ID NO: 1483425 - RNA, 19 nt, Homo sapiens
acauagaaguuuccaaaga

SEQ ID NO: 1483426 - RNA, 19 nt, Homo sapiens
auaaagaaccuaucucuga

SEQ ID NO: 1483427 - RNA, 19 nt, Homo sapiens
ggaaugaaccacauguaug

SEQ ID NO: 1483428 - RNA, 19 nt, Homo sapiens
gcaauaaugagauaaaugg

SEQ ID NO: 1483429 - RNA, 19 nt, Homo sapiens
caccaaagauaauggaaau

SEQ ID NO: 1483430 - RNA, 19 nt, Homo sapiens
gaagaucccgguuuuauuu

SEQ ID NO: 1483431 - RNA, 19 nt, Homo sapiens
gaauguuucucuugcuuca

SEQ ID NO: 1483432 - RNA, 19 nt, Homo sapiens
agacuucucuaaugaguga

SEQ ID NO: 1483433 - RNA, 19 nt, Homo sapiens
guugaugcgucuuccauuu

SEQ ID NO: 1483434 - RNA, 19 nt, Homo sapiens
gaaaagaugcuauugcaaa

SEQ ID NO: 1483435 - RNA, 19 nt, Homo sapiens
ccagagagccaugaaguaa

SEQ ID NO: 1483436 - RNA, 19 nt, Homo sapiens
gauuaugacacccagaaua

SEQ ID NO: 1483437 - RNA, 19 nt, Homo sapiens
cuacuaaguugaauguuuc

SEQ ID NO: 1483438 - RNA, 19 nt, Homo sapiens
caaagacauuaccugauau

SEQ ID NO: 1483439 - RNA, 19 nt, Homo sapiens
caucagaguuccuuucuac

SEQ ID NO: 1483440 - RNA, 19 nt, Homo sapiens
cuugauaacugcaauugaa

SEQ ID NO: 1483441 - RNA, 19 nt, Homo sapiens
gagauacauucaccuaaca

SEQ ID NO: 1483442 - RNA, 19 nt, Homo sapiens
ccagauauaugaggauaau

SEQ ID NO: 1483443 - RNA, 19 nt, Homo sapiens
gaauuggaagacagaaaua

SEQ ID NO: 1483444 - RNA, 19 nt, Homo sapiens
gagaguaaauuugauaagg

SEQ ID NO: 1483445 - RNA, 19 nt, Homo sapiens
gagccaagccucagagaau

SEQ ID NO: 1483446 - RNA, 19 nt, Homo sapiens
gaaaauaagucagaagauc

SEQ ID NO: 1483447 - RNA, 19 nt, Homo sapiens
aaauaacacugcugaaucu

SEQ ID NO: 1483448 - RNA, 19 nt, Homo sapiens
gagaagaugaacaagauga

SEQ ID NO: 1483449 - RNA, 19 nt, Homo sapiens
aaaggaaaguugugaucaa

SEQ ID NO: 1483450 - RNA, 19 nt, Homo sapiens
guaugucacugauauucaa

SEQ ID NO: 1483451 - RNA, 19 nt, Homo sapiens
gagaaacgcccagucuauu

SEQ ID NO: 1483452 - RNA, 19 nt, Homo sapiens
caaauaacacugcugaauc

SEQ ID NO: 1483453 - RNA, 19 nt, Homo sapiens
caaagacuacuaaguugaa

SEQ ID NO: 1483454 - RNA, 19 nt, Homo sapiens
cagggaaagucuacuguau

SEQ ID NO: 1483455 - RNA, 19 nt, Homo sapiens
gagauaaauggucauacua

SEQ ID NO: 1483456 - RNA, 19 nt, Homo sapiens
aauaggugauagaccauua

SEQ ID NO: 1483457 - RNA, 19 nt, Homo sapiens
gcucaggaauaaagugaau

SEQ ID NO: 1483458 - RNA, 19 nt, Homo sapiens
agacagacauuugugauuc

SEQ ID NO: 1483459 - RNA, 19 nt, Homo sapiens
guucagaugucgauauugg

SEQ ID NO: 1483460 - RNA, 19 nt, Homo sapiens
ugauguaccucccagagaa

SEQ ID NO: 1483461 - RNA, 19 nt, Homo sapiens
caacacaaccuuuaucaac

SEQ ID NO: 1483462 - RNA, 19 nt, Homo sapiens
gaucaacaacacaaccuuu

SEQ ID NO: 1483463 - RNA, 19 nt, Homo sapiens
gaagaugaacaagaugaaa

SEQ ID NO: 1483464 - RNA, 19 nt, Homo sapiens
acaaaggcauuuagaucuu

SEQ ID NO: 1483465 - RNA, 19 nt, Homo sapiens
agagagccaugaaguaaug

SEQ ID NO: 1483466 - RNA, 19 nt, Homo sapiens
agaacaaacuugcuucaca

SEQ ID NO: 1483467 - RNA, 19 nt, Homo sapiens
guaaaucggaagacagaaa

SEQ ID NO: 1483468 - RNA, 19 nt, Homo sapiens
cauagaaguuuccaaagag

SEQ ID NO: 1483469 - RNA, 19 nt, Homo sapiens
caaaugaacauggaaugaa

SEQ ID NO: 1483470 - RNA, 19 nt, Homo sapiens
gaauaucacuucuccauua

SEQ ID NO: 1483471 - RNA, 19 nt, Homo sapiens
gcaaaugaguuacuggaua

SEQ ID NO: 1483472 - RNA, 19 nt, Homo sapiens
gaacagaucccgugacaaa

SEQ ID NO: 1483473 - RNA, 19 nt, Homo sapiens
gaagaacacuguaauuaag

SEQ ID NO: 1483474 - RNA, 19 nt, Homo sapiens
caaaugaguuacuggauaa

SEQ ID NO: 1483475 - RNA, 19 nt, Homo sapiens
gagaagaacacuguaauua

SEQ ID NO: 1483476 - RNA, 19 nt, Homo sapiens
aaacaaagcugugaaaugu

SEQ ID NO: 1483477 - RNA, 19 nt, Homo sapiens
gaugauaagcggaauaaua

SEQ ID NO: 1483478 - RNA, 19 nt, Homo sapiens
guagauaucccucuuguaa

SEQ ID NO: 1483479 - RNA, 19 nt, Homo sapiens
ccacagaagugcacucauu

SEQ ID NO: 1483480 - RNA, 19 nt, Homo sapiens
gaagucagcaaccaaauuu

SEQ ID NO: 1483481 - RNA, 19 nt, Homo sapiens
cgagaaagcuacaguggaa

SEQ ID NO: 1483482 - RNA, 19 nt, Homo sapiens
auaaagaacugcagacauu

SEQ ID NO: 1483483 - RNA, 19 nt, Homo sapiens
gcaaccaaauuucaucuug

SEQ ID NO: 1483484 - RNA, 19 nt, Homo sapiens
gaauuuauguucuccuaug

SEQ ID NO: 1483485 - RNA, 19 nt, Homo sapiens
cugaauacauggauagaua

SEQ ID NO: 1483486 - RNA, 19 nt, Homo sapiens
uaaagagucugauagugaa

SEQ ID NO: 1483487 - RNA, 19 nt, Homo sapiens
cagaaagggugcuucauug

SEQ ID NO: 1483488 - RNA, 19 nt, Homo sapiens
ucgaugaagugaaguauuu

SEQ ID NO: 1483489 - RNA, 19 nt, Homo sapiens
gaucaaggcuuuuaggaaa

SEQ ID NO: 1483490 - RNA, 19 nt, Homo sapiens
gagaaaggccugacuauac

SEQ ID NO: 1483491 - RNA, 19 nt, Homo sapiens
cgacggcccugccuaagaa

SEQ ID NO: 1483492 - RNA, 19 nt, Homo sapiens
gcucagaugauauccauaa

SEQ ID NO: 1483493 - RNA, 19 nt, Homo sapiens
guuuggagaucucuucuuu

SEQ ID NO: 1483494 - RNA, 19 nt, Homo sapiens
guuagggaguguucagaua

SEQ ID NO: 1483495 - RNA, 19 nt, Homo sapiens
gaacgucaaucagaaagca

SEQ ID NO: 1483496 - RNA, 19 nt, Homo sapiens
gaaccaaucggaccaagau

SEQ ID NO: 1483497 - RNA, 19 nt, Homo sapiens
gugaagaacuggaaauaac

SEQ ID NO: 1483498 - RNA, 19 nt, Homo sapiens
aaaucaagaucaaggcuuu

SEQ ID NO: 1483499 - RNA, 19 nt, Homo sapiens
ccggauaucaugcacauua

SEQ ID NO: 1483500 - RNA, 19 nt, Homo sapiens
ggaccaagauaauucaacu

SEQ ID NO: 1483501 - RNA, 19 nt, Homo sapiens
guuaaaaccucuucagaaa

SEQ ID NO: 1483502 - RNA, 19 nt, Homo sapiens
ucgcaucucuauaaacaaa

SEQ ID NO: 1483503 - RNA, 19 nt, Homo sapiens
agauaucccucuuguaaau

SEQ ID NO: 1483504 - RNA, 19 nt, Homo sapiens
guaauuaaguucgaugaag

SEQ ID NO: 1483505 - RNA, 19 nt, Homo sapiens
caaccaaauuucaucuugu

SEQ ID NO: 1483506 - RNA, 19 nt, Homo sapiens
gaguagauaucccucuugu

SEQ ID NO: 1483507 - RNA, 19 nt, Homo sapiens
uaaguucgaugaagugaag

SEQ ID NO: 1483508 - RNA, 19 nt, Homo sapiens
uuaaagagucugauaguga

SEQ ID NO: 1483509 - RNA, 19 nt, Homo sapiens
gcagacaggccgcagaaga

SEQ ID NO: 1483510 - RNA, 19 nt, Homo sapiens
aaagcagacucaucucuau

SEQ ID NO: 1483511 - RNA, 19 nt, Homo sapiens
caacugcugaugcuucuaa

SEQ ID NO: 1483512 - RNA, 19 nt, Homo sapiens
gaugagaagaacacuguaa

SEQ ID NO: 1483513 - RNA, 19 nt, Homo sapiens
uaaacaaagcugugaaaug

SEQ ID NO: 1483514 - RNA, 19 nt, Homo sapiens
ggaaauaacacaggagaca

SEQ ID NO: 1483515 - RNA, 19 nt, Homo sapiens
aagcuacaguggaaaguuu

SEQ ID NO: 1483516 - RNA, 19 nt, Homo sapiens
ggauagauaaagcuaacua

SEQ ID NO: 1483517 - RNA, 19 nt, Homo sapiens
aaaacgugcuuucuuguua

SEQ ID NO: 1483518 - RNA, 19 nt, Homo sapiens
aagaggagcuugaaaauau

SEQ ID NO: 1483519 - RNA, 19 nt, Homo sapiens
guucuccuauggaaacuuu

SEQ ID NO: 1483520 - RNA, 19 nt, Homo sapiens
ucaucaggcuuaguucaua

SEQ ID NO: 1483521 - RNA, 19 nt, Homo sapiens
ucagaaagggugcuucauu

SEQ ID NO: 1483522 - RNA, 19 nt, Homo sapiens
gauacaucuuuaugaggua

SEQ ID NO: 1483523 - RNA, 19 nt, Homo sapiens
uaacacaggagacaccaaa

SEQ ID NO: 1483524 - RNA, 19 nt, Homo sapiens
gaggccagcagucagaaua

SEQ ID NO: 1483525 - RNA, 19 nt, Homo sapiens
acauaaggauucugaggaa

SEQ ID NO: 1483526 - RNA, 19 nt, Homo sapiens
ggagaucucuucuuuugug

SEQ ID NO: 1483527 - RNA, 19 nt, Homo sapiens
ugagaaaggccugacuaua

SEQ ID NO: 1483528 - RNA, 19 nt, Homo sapiens
ugaggaagcugaaacuacu

SEQ ID NO: 1483529 - RNA, 19 nt, Homo sapiens
gaaaaguaaucaaccugaa

SEQ ID NO: 1483530 - RNA, 19 nt, Homo sapiens
cacaggagacaccaaauuu

SEQ ID NO: 1483531 - RNA, 19 nt, Homo sapiens
ucacuucuccauuaacaaa

SEQ ID NO: 1483532 - RNA, 19 nt, Homo sapiens
gcagucagaauaucacuuc

SEQ ID NO: 1483533 - RNA, 19 nt, Homo sapiens
ucgcucauuugugauauua

SEQ ID NO: 1483534 - RNA, 19 nt, Homo sapiens
cagaugauauccauaacca

SEQ ID NO: 1483535 - RNA, 19 nt, Homo sapiens
gaaagcaugccagacagaa

SEQ ID NO: 1483536 - RNA, 19 nt, Homo sapiens
gggaaaggcuggaaaagau

SEQ ID NO: 1483537 - RNA, 19 nt, Homo sapiens
ggagguggaauuuauguuc

SEQ ID NO: 1483538 - RNA, 19 nt, Homo sapiens
acaaagcugugaaauguac

SEQ ID NO: 1483539 - RNA, 19 nt, Homo sapiens
uauggaaacuuugguuaug

SEQ ID NO: 1483540 - RNA, 19 nt, Homo sapiens
ggcuggagguggaauuuau

SEQ ID NO: 1483541 - RNA, 19 nt, Homo sapiens
gcagacauuuuaugccuaa

SEQ ID NO: 1483542 - RNA, 19 nt, Homo sapiens
uuucaggauuguucagaua

SEQ ID NO: 1483543 - RNA, 19 nt, Homo sapiens
cggauaucaugcacauuaa

SEQ ID NO: 1483544 - RNA, 19 nt, Homo sapiens
gaagaggagcuugaaaaua

SEQ ID NO: 1483545 - RNA, 19 nt, Homo sapiens
acugagccauccauguuua

SEQ ID NO: 1483546 - RNA, 19 nt, Homo sapiens
gcauucauauaaagaacug

SEQ ID NO: 1483547 - RNA, 19 nt, Homo sapiens
caucaggcuuaguucauau

SEQ ID NO: 1483548 - RNA, 19 nt, Homo sapiens
ucaggauuguucagauaaa

SEQ ID NO: 1483549 - RNA, 19 nt, Homo sapiens
caccacagacaguagaaua

SEQ ID NO: 1483550 - RNA, 19 nt, Homo sapiens
cgcagaagauggagagaug

SEQ ID NO: 1483551 - RNA, 19 nt, Homo sapiens
uaucacuucuccauuaaca

SEQ ID NO: 1483552 - RNA, 19 nt, Homo sapiens
ucagaaagcaugccagaca

SEQ ID NO: 1483553 - RNA, 19 nt, Homo sapiens
uugaagagguccaaguguu

SEQ ID NO: 1483554 - RNA, 19 nt, Homo sapiens
aagaacagaucccgugaca

SEQ ID NO: 1483555 - RNA, 19 nt, Homo sapiens
uuacugagccauccauguu

SEQ ID NO: 1483556 - RNA, 19 nt, Homo sapiens
ugagaagaacacuguaauu

SEQ ID NO: 1483557 - RNA, 19 nt, Homo sapiens
uaacucagaaugauaugug

SEQ ID NO: 1483558 - RNA, 19 nt, Homo sapiens
ggauaucaugcacauuaaa

SEQ ID NO: 1483559 - RNA, 19 nt, Homo sapiens
uggaauuuauguucuccua

SEQ ID NO: 1483560 - RNA, 19 nt, Homo sapiens
gagguggaauuuauguucu

SEQ ID NO: 1483561 - RNA, 19 nt, Homo sapiens
aauaaaagcaggcagaaua

SEQ ID NO: 1483562 - RNA, 19 nt, Homo sapiens
gaaacuacugcaaaugagu

SEQ ID NO: 1483563 - RNA, 19 nt, Homo sapiens
ggaaacuaauauagaugag

SEQ ID NO: 1483564 - RNA, 19 nt, Homo sapiens
gagccauccauguuuauga

SEQ ID NO: 1483565 - RNA, 19 nt, Homo sapiens
gaaacuuugguuauggauu

SEQ ID NO: 1483566 - RNA, 19 nt, Homo sapiens
uaaagaacugcagacauuu

SEQ ID NO: 1483567 - RNA, 19 nt, Homo sapiens
cauaaggauucugaggaaa

SEQ ID NO: 1483568 - RNA, 19 nt, Homo sapiens
aaacgugcuuucuuguuag

SEQ ID NO: 1483569 - RNA, 19 nt, Homo sapiens
acacaggagacaccaaauu

SEQ ID NO: 1483570 - RNA, 19 nt, Homo sapiens
caacacaacuuucuacuuu

SEQ ID NO: 1483571 - RNA, 19 nt, Homo sapiens
ggaaaggucucccucaucu

SEQ ID NO: 1483572 - RNA, 19 nt, Homo sapiens
gguaacauuuggaagauuu

SEQ ID NO: 1483573 - RNA, 19 nt, Homo sapiens
gaaaauuacugcagaaaug

SEQ ID NO: 1483574 - RNA, 19 nt, Homo sapiens
gcauuuauuugccaccaua

SEQ ID NO: 1483575 - RNA, 19 nt, Homo sapiens
agaagacgcuuggguauuu

SEQ ID NO: 1483576 - RNA, 19 nt, Homo sapiens
gauuaugucuugugucaug

SEQ ID NO: 1483577 - RNA, 19 nt, Homo sapiens
gaaacugucugaagaacca

SEQ ID NO: 1483578 - RNA, 19 nt, Homo sapiens
ccucaucucuacagguuua

SEQ ID NO: 1483579 - RNA, 19 nt, Homo sapiens
ggucgccacuucauuauug

SEQ ID NO: 1483580 - RNA, 19 nt, Homo sapiens
cagaaaugaugaccuggua

SEQ ID NO: 1483581 - RNA, 19 nt, Homo sapiens
caucgugauuucuguauuu

SEQ ID NO: 1483582 - RNA, 19 nt, Homo sapiens
ggaaauguucuacugcuuu

SEQ ID NO: 1483583 - RNA, 19 nt, Homo sapiens
gggaaucuuucaucgguuu

SEQ ID NO: 1483584 - RNA, 19 nt, Homo sapiens
caauaaaacuuucggcuuu

SEQ ID NO: 1483585 - RNA, 19 nt, Homo sapiens
ugucauugcugauugauug

SEQ ID NO: 1483586 - RNA, 19 nt, Homo sapiens
gacaauuucucucucacaa

SEQ ID NO: 1483587 - RNA, 19 nt, Homo sapiens
cgucauggcuauuacaaau

SEQ ID NO: 1483588 - RNA, 19 nt, Homo sapiens
caccauaacuccuucuuag

SEQ ID NO: 1483589 - RNA, 19 nt, Homo sapiens
uagcaaagcuuggaaaggu

SEQ ID NO: 1483590 - RNA, 19 nt, Homo sapiens
uagccacgcuugugucauu

SEQ ID NO: 1483591 - RNA, 19 nt, Homo sapiens
gcuuuagucuguauuuaug

SEQ ID NO: 1483592 - RNA, 19 nt, Homo sapiens
uguggauacuugacauuua

SEQ ID NO: 1483593 - RNA, 19 nt, Homo sapiens
caaggacacacuccgauaa

SEQ ID NO: 1483594 - RNA, 19 nt, Homo sapiens
cagcagacaacacaacuuu

SEQ ID NO: 1483595 - RNA, 19 nt, Homo sapiens
gaagaacccacaguagcua

SEQ ID NO: 1483596 - RNA, 19 nt, Homo sapiens
gaagacgcuuggguauuug

SEQ ID NO: 1483597 - RNA, 19 nt, Homo sapiens
uaacauuuacgcuugcuuu

SEQ ID NO: 1483598 - RNA, 19 nt, Homo sapiens
caaggggacuuauuugaaa

SEQ ID NO: 1483599 - RNA, 19 nt, Homo sapiens
ccuauggaaugcuuuguga

SEQ ID NO: 1483600 - RNA, 19 nt, Homo sapiens
ggacacacuccgauaagau

SEQ ID NO: 1483601 - RNA, 19 nt, Homo sapiens
augaugaccugguaacauu

SEQ ID NO: 1483602 - RNA, 19 nt, Homo sapiens
ggcaggaaauguucuacug

SEQ ID NO: 1483603 - RNA, 19 nt, Homo sapiens
gguuaugucuuuugcauuu

SEQ ID NO: 1483604 - RNA, 19 nt, Homo sapiens
guaccgaaauauagcaaag

SEQ ID NO: 1483605 - RNA, 19 nt, Homo sapiens
ggauucgucauggcuauua

SEQ ID NO: 1483606 - RNA, 19 nt, Homo sapiens
ccaaggacacacuccgaua

SEQ ID NO: 1483607 - RNA, 19 nt, Homo sapiens
gguaucugcuccucucugu

SEQ ID NO: 1483608 - RNA, 19 nt, Homo sapiens
ugaguugacugcuuuaaaa

SEQ ID NO: 1483609 - RNA, 19 nt, Homo sapiens
gcagacaacacaacuuucu

SEQ ID NO: 1483610 - RNA, 19 nt, Homo sapiens
ggucccgccuuauccauau

SEQ ID NO: 1483611 - RNA, 19 nt, Homo sapiens
cauuuacgcuugcuuuagu

SEQ ID NO: 1483612 - RNA, 19 nt, Homo sapiens
acagauaccuaccagucuu

SEQ ID NO: 1483613 - RNA, 19 nt, Homo sapiens
gacacacuccgauaagauu

SEQ ID NO: 1483614 - RNA, 19 nt, Homo sapiens
caagcuggguuuccuuugg

SEQ ID NO: 1483615 - RNA, 19 nt, Homo sapiens
ccaccauaacuccuucuua

SEQ ID NO: 1483616 - RNA, 19 nt, Homo sapiens
gaagcaagcuggguuuccu

SEQ ID NO: 1483617 - RNA, 19 nt, Homo sapiens
gaaaugaugaccugguaac

SEQ ID NO: 1483618 - RNA, 19 nt, Homo sapiens
ccgcaggauugccuuauuc

SEQ ID NO: 1483619 - RNA, 19 nt, Homo sapiens
guaauggcaagggcaauuu

SEQ ID NO: 1483620 - RNA, 19 nt, Homo sapiens
guggauacuugacauuuac

SEQ ID NO: 1483621 - RNA, 19 nt, Homo sapiens
guauauucuuugcuacaug

SEQ ID NO: 1483622 - RNA, 19 nt, Homo sapiens
cgugauuucuguauuuauc

SEQ ID NO: 1483623 - RNA, 19 nt, Homo sapiens
guuuaucggucgccacuuc

SEQ ID NO: 1483624 - RNA, 19 nt, Homo sapiens
ccauauguccaucgugauu

SEQ ID NO: 1483625 - RNA, 19 nt, Homo sapiens
uaccuuuacucugccuuua

SEQ ID NO: 1483626 - RNA, 19 nt, Homo sapiens
gccgcaggauugccuuauu

SEQ ID NO: 1483627 - RNA, 19 nt, Homo sapiens
ucuagaagaacccacagua

SEQ ID NO: 1483628 - RNA, 19 nt, Homo sapiens
ccacuucauuauuggacuu

SEQ ID NO: 1483629 - RNA, 19 nt, Homo sapiens
cuacugcuuuccugacaau

SEQ ID NO: 1483630 - RNA, 19 nt, Homo sapiens
acacacuccgauaagauua

SEQ ID NO: 1483631 - RNA, 19 nt, Homo sapiens
gaugaccugguaacauuug

SEQ ID NO: 1483632 - RNA, 19 nt, Homo sapiens
gaagaaccaaggacacacu

SEQ ID NO: 1483633 - RNA, 19 nt, Homo sapiens
ucccucaucucuacagguu

SEQ ID NO: 1483634 - RNA, 19 nt, Homo sapiens
ccucucuguucuucaguuu

SEQ ID NO: 1483635 - RNA, 19 nt, Homo sapiens
uauucuggguuucauaugu

SEQ ID NO: 1483636 - RNA, 19 nt, Homo sapiens
ccugacaauuucucucuca

SEQ ID NO: 1483637 - RNA, 19 nt, Homo sapiens
uaucugcuccucucuguuc

SEQ ID NO: 1483638 - RNA, 19 nt, Homo sapiens
ccaucgugauuucuguauu

SEQ ID NO: 1483639 - RNA, 19 nt, Homo sapiens
cagaagacgcuuggguauu

SEQ ID NO: 1483640 - RNA, 19 nt, Homo sapiens
agacuuggcuuuuaugagu

SEQ ID NO: 1483641 - RNA, 19 nt, Homo sapiens
ccucagagucucauguuca

SEQ ID NO: 1483642 - RNA, 19 nt, Homo sapiens
gcaagcuggguuuccuuug

SEQ ID NO: 1483643 - RNA, 19 nt, Homo sapiens
caaauaccucagagucuca

SEQ ID NO: 1483644 - RNA, 19 nt, Homo sapiens
cugcuuuccugacaauuuc

SEQ ID NO: 1483645 - RNA, 19 nt, Homo sapiens
gcaggauugccuuauucaa

SEQ ID NO: 1483646 - RNA, 19 nt, Homo sapiens
acgcuuggguauuugcaaa

SEQ ID NO: 1483647 - RNA, 19 nt, Homo sapiens
cuacagguuuaacaacucu

SEQ ID NO: 1483648 - RNA, 19 nt, Homo sapiens
ccugguaacauuuggaaga

SEQ ID NO: 1483649 - RNA, 19 nt, Homo sapiens
gaccugguaacauuuggaa

SEQ ID NO: 1483650 - RNA, 19 nt, Homo sapiens
cuucuuaguuuacaguucu

SEQ ID NO: 1483651 - RNA, 19 nt, Homo sapiens
gcuccucucuguucuucag

SEQ ID NO: 1483652 - RNA, 19 nt, Homo sapiens
cagacaacacaacuuucua

SEQ ID NO: 1483653 - RNA, 19 nt, Homo sapiens
uaucugaaacugucugaag

SEQ ID NO: 1483654 - RNA, 19 nt, Homo sapiens
uucacuggguccacacaua

SEQ ID NO: 1483655 - RNA, 19 nt, Homo sapiens
uuaacaacucugauucuug

SEQ ID NO: 1483656 - RNA, 19 nt, Homo sapiens
ccuuuacucugccuuuauc

SEQ ID NO: 1483657 - RNA, 19 nt, Homo sapiens
agacuuuucccuuguuuua

SEQ ID NO: 1483658 - RNA, 19 nt, Homo sapiens
cagauaccuaccagucuuu

SEQ ID NO: 1483659 - RNA, 19 nt, Homo sapiens
gcacccaugggcaggaaau

SEQ ID NO: 1483660 - RNA, 19 nt, Homo sapiens
gugcaacuccccucauuuu

SEQ ID NO: 1483661 - RNA, 19 nt, Homo sapiens
gaacccacaguagcuaagu

SEQ ID NO: 1483662 - RNA, 19 nt, Homo sapiens
acagaagacgcuuggguau

SEQ ID NO: 1483663 - RNA, 19 nt, Homo sapiens
ccacaguuaccuuuacucu

SEQ ID NO: 1483664 - RNA, 19 nt, Homo sapiens
caaugaguugacugcuuua

SEQ ID NO: 1483665 - RNA, 19 nt, Homo sapiens
gauugauugccucgggaua

SEQ ID NO: 1483666 - RNA, 19 nt, Homo sapiens
gccacagccuagagaucuu

SEQ ID NO: 1483667 - RNA, 19 nt, Homo sapiens
cuagaagaacccacaguag

SEQ ID NO: 1483668 - RNA, 19 nt, Homo sapiens
gguuuaacaacucugauuc

SEQ ID NO: 1483669 - RNA, 19 nt, Homo sapiens
aaaggucucccucaucucu

SEQ ID NO: 1483670 - RNA, 19 nt, Homo sapiens
ggagaugaaccuuuaaaua

SEQ ID NO: 1483671 - RNA, 19 nt, Homo sapiens
ggccuaagcuuccugaauu

SEQ ID NO: 1483672 - RNA, 19 nt, Homo sapiens
aaacacccauuuccucuuu

SEQ ID NO: 1483673 - RNA, 19 nt, Homo sapiens
gaagaaagagagaaagaga

SEQ ID NO: 1483674 - RNA, 19 nt, Homo sapiens
ggcaagaggcugcgaauga

SEQ ID NO: 1483675 - RNA, 19 nt, Homo sapiens
ccuaagagacuaacauuug

SEQ ID NO: 1483676 - RNA, 19 nt, Homo sapiens
ggauauguaggaaauguaa

SEQ ID NO: 1483677 - RNA, 19 nt, Homo sapiens
uaaauaagucguacguuug

SEQ ID NO: 1483678 - RNA, 19 nt, Homo sapiens
acacaugacuugcauuaag

SEQ ID NO: 1483679 - RNA, 19 nt, Homo sapiens
gagacuaacauuuggauau

SEQ ID NO: 1483680 - RNA, 19 nt, Homo sapiens
cuacacaugacuugcauua

SEQ ID NO: 1483681 - RNA, 19 nt, Homo sapiens
gaaacucuccucaccacaa

SEQ ID NO: 1483682 - RNA, 19 nt, Homo sapiens
gcaagaggcugcgaaugag

SEQ ID NO: 1483683 - RNA, 19 nt, Homo sapiens
gcgagggacaggagaauaa

SEQ ID NO: 1483684 - RNA, 19 nt, Homo sapiens
aauacuaucuggcugcaaa

SEQ ID NO: 1483685 - RNA, 19 nt, Homo sapiens
gagacaacuucgagacaau

SEQ ID NO: 1483686 - RNA, 19 nt, Homo sapiens
uaagcuuccugaauuucua

SEQ ID NO: 1483687 - RNA, 19 nt, Homo sapiens
agagaaagaaggaaagaaa

SEQ ID NO: 1483688 - RNA, 19 nt, Homo sapiens
caccgagacccguugauua

SEQ ID NO: 1483689 - RNA, 19 nt, Homo sapiens
gaccaucuccgacacagaa

SEQ ID NO: 1483690 - RNA, 19 nt, Homo sapiens
gcagcgcgcuccauuugca

SEQ ID NO: 1483691 - RNA, 19 nt, Homo sapiens
cugcauggcuaauugauuc

SEQ ID NO: 1483692 - RNA, 19 nt, Homo sapiens
uaaucugcauggcuaauug

SEQ ID NO: 1483693 - RNA, 19 nt, Homo sapiens
aaagagagaaagagaagaa

SEQ ID NO: 1483694 - RNA, 19 nt, Homo sapiens
agacuaacauuuggauaug

SEQ ID NO: 1483695 - RNA, 19 nt, Homo sapiens
cgagacaacuucgagacaa

SEQ ID NO: 1483696 - RNA, 19 nt, Homo sapiens
gagaaagaaggaaagaaau

SEQ ID NO: 1483697 - RNA, 19 nt, Homo sapiens
acacagaaacccaucgaaa

SEQ ID NO: 1483698 - RNA, 19 nt, Homo sapiens
gccuaagcuuccugaauuu

SEQ ID NO: 1483699 - RNA, 19 nt, Homo sapiens
gaaaagagagaaagaagga

SEQ ID NO: 1483700 - RNA, 19 nt, Homo sapiens
gagacuggacuccuucuga

SEQ ID NO: 1483701 - RNA, 19 nt, Homo sapiens
caaacugggucucagaaaa

SEQ ID NO: 1483702 - RNA, 19 nt, Homo sapiens
cuaagagacuaacauuugg

SEQ ID NO: 1483703 - RNA, 19 nt, Homo sapiens
aaagagagaaagaaggaaa

SEQ ID NO: 1483704 - RNA, 19 nt, Homo sapiens
gggaagaggcggaggagau

SEQ ID NO: 1483705 - RNA, 19 nt, Homo sapiens
agaguaacaugggagauga

SEQ ID NO: 1483706 - RNA, 19 nt, Homo sapiens
ugcauuaaguuccuuccua

SEQ ID NO: 1483707 - RNA, 19 nt, Homo sapiens
ggaagaggcggaggagaug

SEQ ID NO: 1483708 - RNA, 19 nt, Homo sapiens
agacugcacagccaacuaa

SEQ ID NO: 1483709 - RNA, 19 nt, Homo sapiens
gcguaucaguuuaaaggau

SEQ ID NO: 1483710 - RNA, 19 nt, Homo sapiens
gagggaagaauggagguaa

SEQ ID NO: 1483711 - RNA, 19 nt, Homo sapiens
gaagccgguucaccuccuu

SEQ ID NO: 1483712 - RNA, 19 nt, Homo sapiens
gacaaauugcggagaaguu

SEQ ID NO: 1483713 - RNA, 19 nt, Homo sapiens
aaucgagacuggacuccuu

SEQ ID NO: 1483714 - RNA, 19 nt, Homo sapiens
gacaacuucgagacaauuu

SEQ ID NO: 1483715 - RNA, 19 nt, Homo sapiens
gagagccuuucuuccuguu

SEQ ID NO: 1483716 - RNA, 19 nt, Homo sapiens
ccucagagagccuuucuuc

SEQ ID NO: 1483717 - RNA, 19 nt, Homo sapiens
guaaucugcauggcuaauu

SEQ ID NO: 1483718 - RNA, 19 nt, Homo sapiens
ccagaaccuuggagauugg

SEQ ID NO: 1483719 - RNA, 19 nt, Homo sapiens
uucuggagaugaaccuuua

SEQ ID NO: 1483720 - RNA, 19 nt, Homo sapiens
gaauuucuacacaugacuu

SEQ ID NO: 1483721 - RNA, 19 nt, Homo sapiens
gaaagagagaaagagaaga

SEQ ID NO: 1483722 - RNA, 19 nt, Homo sapiens
ggaggaggcagaguuguca

SEQ ID NO: 1483723 - RNA, 19 nt, Homo sapiens
guucuucuucgucuucuuu

SEQ ID NO: 1483724 - RNA, 19 nt, Homo sapiens
gaagaaaagagagaaagaa

SEQ ID NO: 1483725 - RNA, 19 nt, Homo sapiens
cagcguaucaguuuaaagg

SEQ ID NO: 1483726 - RNA, 19 nt, Homo sapiens
ccaccgagacccguugauu

SEQ ID NO: 1483727 - RNA, 19 nt, Homo sapiens
gagagaaagaaggaaagaa

SEQ ID NO: 1483728 - RNA, 19 nt, Homo sapiens
aaaggucgaagagucguua

SEQ ID NO: 1483729 - RNA, 19 nt, Homo sapiens
uaggaaauguaaucugcau

SEQ ID NO: 1483730 - RNA, 19 nt, Homo sapiens
cgaaaucuaauacuaucug

SEQ ID NO: 1483731 - RNA, 19 nt, Homo sapiens
gagccuuucuuccuguucu

SEQ ID NO: 1483732 - RNA, 19 nt, Homo sapiens
gagggagcaugcggcagaa

SEQ ID NO: 1483733 - RNA, 19 nt, Homo sapiens
agggacaggagaauaauuu

SEQ ID NO: 1483734 - RNA, 19 nt, Homo sapiens
gagggacaggagaauaauu

SEQ ID NO: 1483735 - RNA, 19 nt, Homo sapiens
caucucccgucacccaaga

SEQ ID NO: 1483736 - RNA, 19 nt, Homo sapiens
ucucagcguaucaguuuaa

SEQ ID NO: 1483737 - RNA, 19 nt, Homo sapiens
cgagacaauuucgaaugga

SEQ ID NO: 1483738 - RNA, 19 nt, Homo sapiens
aagaagaaagagagaaaga

SEQ ID NO: 1483739 - RNA, 19 nt, Homo sapiens
gaagaggcggaggagauga

SEQ ID NO: 1483740 - RNA, 19 nt, Homo sapiens
ggacugcagagaggcguuu

SEQ ID NO: 1483741 - RNA, 19 nt, Homo sapiens
ggacaaauugcggagaagu

SEQ ID NO: 1483742 - RNA, 19 nt, Homo sapiens
ggagggaagaauggaggua

SEQ ID NO: 1483743 - RNA, 19 nt, Homo sapiens
agaaagagagaaagagaag

SEQ ID NO: 1483744 - RNA, 19 nt, Homo sapiens
ccaacuaaacggaguaaac

SEQ ID NO: 1483745 - RNA, 19 nt, Homo sapiens
gagacugcacagccaacua

SEQ ID NO: 1483746 - RNA, 19 nt, Homo sapiens
acaaauugcggagaaguug

SEQ ID NO: 1483747 - RNA, 19 nt, Homo sapiens
cacagaaacccaucgaaag

SEQ ID NO: 1483748 - RNA, 19 nt, Homo sapiens
gacaggagaauaauuuuga

SEQ ID NO: 1483749 - RNA, 19 nt, Homo sapiens
agggaagaauggagguaaa

SEQ ID NO: 1483750 - RNA, 19 nt, Homo sapiens
gcagagaggcguuuugaag

SEQ ID NO: 1483751 - RNA, 19 nt, Homo sapiens
caacuaaacggaguaaacg

SEQ ID NO: 1483752 - RNA, 19 nt, Homo sapiens
gaucgauaucuacaugaug

SEQ ID NO: 1483753 - RNA, 19 nt, Homo sapiens
uaauugauucucagcguau

SEQ ID NO: 1483754 - RNA, 19 nt, Homo sapiens
gggacaauuucgagacaac

SEQ ID NO: 1483755 - RNA, 19 nt, Homo sapiens
ucagagagccuuucuuccu

SEQ ID NO: 1483756 - RNA, 19 nt, Homo sapiens
ggagcgagggacaggagaa

SEQ ID NO: 1483757 - RNA, 19 nt, Homo sapiens
ucaaacugggucucagaaa

SEQ ID NO: 1483758 - RNA, 19 nt, Homo sapiens
ccgcguuccucgaguuuua

SEQ ID NO: 1483759 - RNA, 19 nt, Homo sapiens
auucucagcguaucaguuu

SEQ ID NO: 1483760 - RNA, 19 nt, Homo sapiens
gacaauuucgagacaacuu

SEQ ID NO: 1483761 - RNA, 19 nt, Homo sapiens
uaaauaaaggucgaagagu

SEQ ID NO: 1483762 - RNA, 19 nt, Homo sapiens
ggagcaugcggcagaagug

SEQ ID NO: 1483763 - RNA, 19 nt, Homo sapiens
acagaaacccaucgaaagg

SEQ ID NO: 1483764 - RNA, 19 nt, Homo sapiens
gguggaggaggcagaguug

SEQ ID NO: 1483765 - RNA, 19 nt, Homo sapiens
cauaaauaaaggucgaaga

SEQ ID NO: 1483766 - RNA, 19 nt, Homo sapiens
gccuaagagacuaacauuu

SEQ ID NO: 1483767 - RNA, 19 nt, Homo sapiens
cgagacccguugauuagcu

SEQ ID NO: 1483768 - RNA, 19 nt, Homo sapiens
gcgcagccgggacaauuuc

SEQ ID NO: 1483769 - RNA, 19 nt, Homo sapiens
ucuacaugauggauauugu

SEQ ID NO: 1483770 - RNA, 19 nt, Homo sapiens
gcaaagaaccagucacaua

SEQ ID NO: 1483771 - RNA, 19 nt, Homo sapiens
gaacuuacaccgauugauu

SEQ ID NO: 1483772 - RNA, 19 nt, Homo sapiens
caaagaaccagucacauaa

SEQ ID NO: 1483773 - RNA, 19 nt, Homo sapiens
gaaacccugucucuacuaa

SEQ ID NO: 1483774 - RNA, 19 nt, Homo sapiens
gcucacaccuguaauccua

SEQ ID NO: 1483775 - RNA, 19 nt, Homo sapiens
ggaguuuccuucucuggua

SEQ ID NO: 1483776 - RNA, 19 nt, Homo sapiens
gaagaaggacaggaacuua

SEQ ID NO: 1483777 - RNA, 19 nt, Homo sapiens
caucuggucuccuugaauu

SEQ ID NO: 1483778 - RNA, 19 nt, Homo sapiens
gaaccagucacauaaaguu

SEQ ID NO: 1483779 - RNA, 19 nt, Homo sapiens
ggaagaagaaggacaggaa

SEQ ID NO: 1483780 - RNA, 19 nt, Homo sapiens
gaaaggcaaggcagcauga

SEQ ID NO: 1483781 - RNA, 19 nt, Homo sapiens
gaggcaggcagaucacuua

SEQ ID NO: 1483782 - RNA, 19 nt, Homo sapiens
uguccaggcuccauccuua

SEQ ID NO: 1483783 - RNA, 19 nt, Homo sapiens
ccacggaacuccugugcau

SEQ ID NO: 1483784 - RNA, 19 nt, Homo sapiens
auaaaguucugcucucuug

SEQ ID NO: 1483785 - RNA, 19 nt, Homo sapiens
gcagacaguugaaggaaaa

SEQ ID NO: 1483786 - RNA, 19 nt, Homo sapiens
uuugugggauucaguguua

SEQ ID NO: 1483787 - RNA, 19 nt, Homo sapiens
gcaccuauaauuccagcua

SEQ ID NO: 1483788 - RNA, 19 nt, Homo sapiens
cugcaaggcuggcucagaa

SEQ ID NO: 1483789 - RNA, 19 nt, Homo sapiens
ccucacaucaacuaucuua

SEQ ID NO: 1483790 - RNA, 19 nt, Homo sapiens
cgacuggaauagggacaua

SEQ ID NO: 1483791 - RNA, 19 nt, Homo sapiens
cacaucaacuaucuuacuu

SEQ ID NO: 1483792 - RNA, 19 nt, Homo sapiens
ucacuuaggcuaggaauuc

SEQ ID NO: 1483793 - RNA, 19 nt, Homo sapiens
ggcagacaguugaaggaaa

SEQ ID NO: 1483794 - RNA, 19 nt, Homo sapiens
ggugaaacccugucucuac

SEQ ID NO: 1483795 - RNA, 19 nt, Homo sapiens
gggcaaagaaccagucaca

SEQ ID NO: 1483796 - RNA, 19 nt, Homo sapiens
caaggucacuuccuauucc

SEQ ID NO: 1483797 - RNA, 19 nt, Homo sapiens
cuaccauccugcaaacuug

SEQ ID NO: 1483798 - RNA, 19 nt, Homo sapiens
gggagaggcagacaguuga

SEQ ID NO: 1483799 - RNA, 19 nt, Homo sapiens
cucuuacucucucuacuua

SEQ ID NO: 1483800 - RNA, 19 nt, Homo sapiens
guggauuguuucugccuuu

SEQ ID NO: 1483801 - RNA, 19 nt, Homo sapiens
aaagaaccagucacauaaa

SEQ ID NO: 1483802 - RNA, 19 nt, Homo sapiens
gauuguuucugccuuugug

SEQ ID NO: 1483803 - RNA, 19 nt, Homo sapiens
gccuguguguggauuguuu

SEQ ID NO: 1483804 - RNA, 19 nt, Homo sapiens
ugauucaucuggucuccuu

SEQ ID NO: 1483805 - RNA, 19 nt, Homo sapiens
acagggagguagcccaguu

SEQ ID NO: 1483806 - RNA, 19 nt, Homo sapiens
caugggaguuuccuucucu

SEQ ID NO: 1483807 - RNA, 19 nt, Homo sapiens
gugaaacccugucucuacu

SEQ ID NO: 1483808 - RNA, 19 nt, Homo sapiens
cagaacugcugguccuauc

SEQ ID NO: 1483809 - RNA, 19 nt, Homo sapiens
cgacagagcgagacuccau

SEQ ID NO: 1483810 - RNA, 19 nt, Homo sapiens
gaguuuccuucucugguau

SEQ ID NO: 1483811 - RNA, 19 nt, Homo sapiens
aagaaccagucacauaaag

SEQ ID NO: 1483812 - RNA, 19 nt, Homo sapiens
uaucaaggcuagggcaaag

SEQ ID NO: 1483813 - RNA, 19 nt, Homo sapiens
caccucacaucaacuaucu

SEQ ID NO: 1483814 - RNA, 19 nt, Homo sapiens
uagcaccucacaucaacua

SEQ ID NO: 1483815 - RNA, 19 nt, Homo sapiens
gggcaaagugggucuuauc

SEQ ID NO: 1483816 - RNA, 19 nt, Homo sapiens
caccaaggcaccauggauu

SEQ ID NO: 1483817 - RNA, 19 nt, Homo sapiens
ggauacccacugccucuug

SEQ ID NO: 1483818 - RNA, 19 nt, Homo sapiens
gggaggaguucuuuucuca

SEQ ID NO: 1483819 - RNA, 19 nt, Homo sapiens
ggagaggcagacaguugaa

SEQ ID NO: 1483820 - RNA, 19 nt, Homo sapiens
ccaaggucacuuccuauuc

SEQ ID NO: 1483821 - RNA, 19 nt, Homo sapiens
gcaccucacaucaacuauc

SEQ ID NO: 1483822 - RNA, 19 nt, Homo sapiens
ucaaggcuagggcaaagaa

SEQ ID NO: 1483823 - RNA, 19 nt, Homo sapiens
ccuagcaccucacaucaac

SEQ ID NO: 1483824 - RNA, 19 nt, Homo sapiens
acaggaacuuacaccgauu

SEQ ID NO: 1483825 - RNA, 19 nt, Homo sapiens
uggaaacuccucccucaug

SEQ ID NO: 1483826 - RNA, 19 nt, Homo sapiens
cagccaagacaaagcgaaa

SEQ ID NO: 1483827 - RNA, 19 nt, Homo sapiens
ccagucacauaaaguucug

SEQ ID NO: 1483828 - RNA, 19 nt, Homo sapiens
ucacaucaacuaucuuacu

SEQ ID NO: 1483829 - RNA, 19 nt, Homo sapiens
gcaaagugggucuuaucca

SEQ ID NO: 1483830 - RNA, 19 nt, Homo sapiens
ugaguggaauuggccuuug

SEQ ID NO: 1483831 - RNA, 19 nt, Homo sapiens
ccaaggcaccauggauuug

SEQ ID NO: 1483832 - RNA, 19 nt, Homo sapiens
acacuccucucccugucuu

SEQ ID NO: 1483833 - RNA, 19 nt, Homo sapiens
uaaagccuucugucuccua

SEQ ID NO: 1483834 - RNA, 19 nt, Homo sapiens
ggggaggugccuaagauua

SEQ ID NO: 1483835 - RNA, 19 nt, Homo sapiens
gagcuucaacgucaucaac

SEQ ID NO: 1483836 - RNA, 19 nt, Homo sapiens
cugcugguccuaucagauu

SEQ ID NO: 1483837 - RNA, 19 nt, Homo sapiens
gaacugcugguccuaucag

SEQ ID NO: 1483838 - RNA, 19 nt, Homo sapiens
ugaaacccugucucuacua

SEQ ID NO: 1483839 - RNA, 19 nt, Homo sapiens
gaggcagacaguugaagga

SEQ ID NO: 1483840 - RNA, 19 nt, Homo sapiens
gcaugaggcacuguaucaa

SEQ ID NO: 1483841 - RNA, 19 nt, Homo sapiens
gaguggaauuggccuuugc

SEQ ID NO: 1483842 - RNA, 19 nt, Homo sapiens
cacugccucuugcuccuaa

SEQ ID NO: 1483843 - RNA, 19 nt, Homo sapiens
aaaauuagcugggcauggu

SEQ ID NO: 1483844 - RNA, 19 nt, Homo sapiens
acauaaaguucugcucucu

SEQ ID NO: 1483845 - RNA, 19 nt, Homo sapiens
gaggaguucuuuucucagu

SEQ ID NO: 1483846 - RNA, 19 nt, Homo sapiens
guguugugcaccuauaauu

SEQ ID NO: 1483847 - RNA, 19 nt, Homo sapiens
acggaacuccugugcauga

SEQ ID NO: 1483848 - RNA, 19 nt, Homo sapiens
agaagaaggacaggaacuu

SEQ ID NO: 1483849 - RNA, 19 nt, Homo sapiens
ucaacgucaucaacucaca

SEQ ID NO: 1483850 - RNA, 19 nt, Homo sapiens
ccucuuacucucucuacuu

SEQ ID NO: 1483851 - RNA, 19 nt, Homo sapiens
gcuucaacgucaucaacuc

SEQ ID NO: 1483852 - RNA, 19 nt, Homo sapiens
guagcccaguucugcuuca

SEQ ID NO: 1483853 - RNA, 19 nt, Homo sapiens
agaaggacaggaacuuaca

SEQ ID NO: 1483854 - RNA, 19 nt, Homo sapiens
ccaccaaggcaccauggau

SEQ ID NO: 1483855 - RNA, 19 nt, Homo sapiens
gcuccugccaguuucaugu

SEQ ID NO: 1483856 - RNA, 19 nt, Homo sapiens
gaccuggacuugaacuaaa

SEQ ID NO: 1483857 - RNA, 19 nt, Homo sapiens
ucucaguccuggccuauga

SEQ ID NO: 1483858 - RNA, 19 nt, Homo sapiens
gcucacgggucuggcauug

SEQ ID NO: 1483859 - RNA, 19 nt, Homo sapiens
gguccugccuccucgucua

SEQ ID NO: 1483860 - RNA, 19 nt, Homo sapiens
ggaagggccucugcugacu

SEQ ID NO: 1483861 - RNA, 19 nt, Homo sapiens
aagcuccucuggccguuaa

SEQ ID NO: 1483862 - RNA, 19 nt, Homo sapiens
cgaccuggacuugaacuaa

SEQ ID NO: 1483863 - RNA, 19 nt, Homo sapiens
gugucgaccuggacuugaa

SEQ ID NO: 1483864 - RNA, 19 nt, Homo sapiens
gcaauaccugcucccaaca

SEQ ID NO: 1483865 - RNA, 19 nt, Homo sapiens
guggagacaccaugcacuu

SEQ ID NO: 1483866 - RNA, 19 nt, Homo sapiens
gcagcucccaggcuaucuu

SEQ ID NO: 1483867 - RNA, 19 nt, Homo sapiens
aaacaacccucuucucaaa

SEQ ID NO: 1483868 - RNA, 19 nt, Homo sapiens
ccagaaaccagcauuguua

SEQ ID NO: 1483869 - RNA, 19 nt, Homo sapiens
gaagggcgcuuauuguucu

SEQ ID NO: 1483870 - RNA, 19 nt, Homo sapiens
caccauagccaguauauuu

SEQ ID NO: 1483871 - RNA, 19 nt, Homo sapiens
ggaaguggaaauaaaguuu

SEQ ID NO: 1483872 - RNA, 19 nt, Homo sapiens
gcaacaggcuaauaaaauu

SEQ ID NO: 1483873 - RNA, 19 nt, Homo sapiens
gaagauggcgcugcgaauu

SEQ ID NO: 1483874 - RNA, 19 nt, Homo sapiens
gcgaguccauggccaguga

SEQ ID NO: 1483875 - RNA, 19 nt, Homo sapiens
gcagguuccacgauguuua

SEQ ID NO: 1483876 - RNA, 19 nt, Homo sapiens
gaaaacaacccucuucuca

SEQ ID NO: 1483877 - RNA, 19 nt, Homo sapiens
gccaguauauuuaguuugg

SEQ ID NO: 1483878 - RNA, 19 nt, Homo sapiens
caaagccuaucguguugau

SEQ ID NO: 1483879 - RNA, 19 nt, Homo sapiens
gguggaaauugguggaaau

SEQ ID NO: 1483880 - RNA, 19 nt, Homo sapiens
guggaguuguuaauuaaug

SEQ ID NO: 1483881 - RNA, 19 nt, Homo sapiens
ugguggaguuguuaauuaa

SEQ ID NO: 1483882 - RNA, 19 nt, Homo sapiens
augguggaguuguuaauua

SEQ ID NO: 1483883 - RNA, 19 nt, Homo sapiens
agacagcacuucgggauuc

SEQ ID NO: 1483884 - RNA, 19 nt, Homo sapiens
ucugggaacuugaaugugu

SEQ ID NO: 1483885 - RNA, 19 nt, Homo sapiens
gaauuucugucaguuaagg

SEQ ID NO: 1483886 - RNA, 19 nt, Homo sapiens
gaucgcaggauuuccaaga

SEQ ID NO: 1483887 - RNA, 19 nt, Homo sapiens
cagcagcaguacuaucuca

SEQ ID NO: 1483888 - RNA, 19 nt, Homo sapiens
caacagcagcccuaguaau

SEQ ID NO: 1483889 - RNA, 19 nt, Homo sapiens
ccaacuaugucaacaaagc

SEQ ID NO: 1483890 - RNA, 19 nt, Homo sapiens
gugaagggcgcuuauuguu

SEQ ID NO: 1483891 - RNA, 19 nt, Homo sapiens
cgacaaguuuggcgugaag

SEQ ID NO: 1483892 - RNA, 19 nt, Homo sapiens
ucucagauauuguaagcau

SEQ ID NO: 1483893 - RNA, 19 nt, Homo sapiens
uaagaguggauguagcuaa

SEQ ID NO: 1483894 - RNA, 19 nt, Homo sapiens
ggacgaacucggagagcuu

SEQ ID NO: 1483895 - RNA, 19 nt, Homo sapiens
ucacugcuuugguggaaau

SEQ ID NO: 1483896 - RNA, 19 nt, Homo sapiens
gauauuguaagcauucugu

SEQ ID NO: 1483897 - RNA, 19 nt, Homo sapiens
cuugugcacuugggaauaa

SEQ ID NO: 1483898 - RNA, 19 nt, Homo sapiens
caacaccauagccaguaua

SEQ ID NO: 1483899 - RNA, 19 nt, Homo sapiens
gcuaagccagacaguguuu

SEQ ID NO: 1483900 - RNA, 19 nt, Homo sapiens
guuccaggcugcgggcuaa

SEQ ID NO: 1483901 - RNA, 19 nt, Homo sapiens
gagaucugcuggacgaacu

SEQ ID NO: 1483902 - RNA, 19 nt, Homo sapiens
guaaugguggaguuguuaa

SEQ ID NO: 1483903 - RNA, 19 nt, Homo sapiens
guucacugcuuugguggaa

SEQ ID NO: 1483904 - RNA, 19 nt, Homo sapiens
cagcagcccuaguaauggu

SEQ ID NO: 1483905 - RNA, 19 nt, Homo sapiens
acauagaaaucuucaaagc

SEQ ID NO: 1483906 - RNA, 19 nt, Homo sapiens
uuccaacuaugucaacaaa

SEQ ID NO: 1483907 - RNA, 19 nt, Homo sapiens
gggccaggaaugcaucuuu

SEQ ID NO: 1483908 - RNA, 19 nt, Homo sapiens
gaguggauguagcuaagag

SEQ ID NO: 1483909 - RNA, 19 nt, Homo sapiens
ggaagauggcgcugcgaau

SEQ ID NO: 1483910 - RNA, 19 nt, Homo sapiens
caggaagucucaggaacug

SEQ ID NO: 1483911 - RNA, 19 nt, Homo sapiens
gcagucagcgguucucaac

SEQ ID NO: 1483912 - RNA, 19 nt, Homo sapiens
gguccacaccgccagguuu

SEQ ID NO: 1483913 - RNA, 19 nt, Homo sapiens
gcaucacccaccucaacua

SEQ ID NO: 1483914 - RNA, 19 nt, Homo sapiens
guuccacgauguuuauuuu

SEQ ID NO: 1483915 - RNA, 19 nt, Homo sapiens
ucagauauuguaagcauuc

SEQ ID NO: 1483916 - RNA, 19 nt, Homo sapiens
gggaaguggaaauaaaguu

SEQ ID NO: 1483917 - RNA, 19 nt, Homo sapiens
gcaggaagucucaggaacu

SEQ ID NO: 1483918 - RNA, 19 nt, Homo sapiens
uaguaaugguggaguuguu

SEQ ID NO: 1483919 - RNA, 19 nt, Homo sapiens
aaucgagccugucccuugu

SEQ ID NO: 1483920 - RNA, 19 nt, Homo sapiens
ccucaacgagacucaguuu

SEQ ID NO: 1483921 - RNA, 19 nt, Homo sapiens
ucacccaccucaacuacag

SEQ ID NO: 1483922 - RNA, 19 nt, Homo sapiens
aacagcagcccuaguaaug

SEQ ID NO: 1483923 - RNA, 19 nt, Homo sapiens
accauagccaguauauuua

SEQ ID NO: 1483924 - RNA, 19 nt, Homo sapiens
ugaagggcgcuuauuguuc

SEQ ID NO: 1483925 - RNA, 19 nt, Homo sapiens
gggaccaggagacuuuaaa

SEQ ID NO: 1483926 - RNA, 19 nt, Homo sapiens
ggaccaggagacuuuaaag

SEQ ID NO: 1483927 - RNA, 19 nt, Homo sapiens
acaacaccauagccaguau

SEQ ID NO: 1483928 - RNA, 19 nt, Homo sapiens
guucagcuccucuguggau

SEQ ID NO: 1483929 - RNA, 19 nt, Homo sapiens
aagaguggauguagcuaag

SEQ ID NO: 1483930 - RNA, 19 nt, Homo sapiens
gcuuuaauccaugauaguu

SEQ ID NO: 1483931 - RNA, 19 nt, Homo sapiens
ccuggugucugggaacuug

SEQ ID NO: 1483932 - RNA, 19 nt, Homo sapiens
gcgccgaccuaagcgucua

SEQ ID NO: 1483933 - RNA, 19 nt, Homo sapiens
cuucucggaugaugaggaa

SEQ ID NO: 1483934 - RNA, 19 nt, Homo sapiens
uucaacagcagcccuagua

SEQ ID NO: 1483935 - RNA, 19 nt, Homo sapiens
gaucauccaccugcaccaa

SEQ ID NO: 1483936 - RNA, 19 nt, Homo sapiens
ggccaggaaugcaucuuuu

SEQ ID NO: 1483937 - RNA, 19 nt, Homo sapiens
ucaacagcagcccuaguaa

SEQ ID NO: 1483938 - RNA, 19 nt, Homo sapiens
gugugaagggcgcuuauug

SEQ ID NO: 1483939 - RNA, 19 nt, Homo sapiens
gacuguggcccgacucgaa

SEQ ID NO: 1483940 - RNA, 19 nt, Homo sapiens
gggcgcuuauuguucugaa

SEQ ID NO: 1483941 - RNA, 19 nt, Homo sapiens
ugaggaagaccuggacgaa

SEQ ID NO: 1483942 - RNA, 19 nt, Homo sapiens
cagguuccacgauguuuau

SEQ ID NO: 1483943 - RNA, 19 nt, Homo sapiens
uagcuaacauugccuuuuc

SEQ ID NO: 1483944 - RNA, 19 nt, Homo sapiens
gccauuaagaguggaugua

SEQ ID NO: 1483945 - RNA, 19 nt, Homo sapiens
cauagccaguauauuuagu

SEQ ID NO: 1483946 - RNA, 19 nt, Homo sapiens
gcagcaguacuaucucaag

SEQ ID NO: 1483947 - RNA, 19 nt, Homo sapiens
ggaacuugaaugugugaag

SEQ ID NO: 1483948 - RNA, 19 nt, Homo sapiens
gccugucccuugugcacuu

SEQ ID NO: 1483949 - RNA, 19 nt, Homo sapiens
ccagaucgcaggauuucca

SEQ ID NO: 1483950 - RNA, 19 nt, Homo sapiens
gguuccacgauguuuauuu

SEQ ID NO: 1483951 - RNA, 19 nt, Homo sapiens
guuaagggguucacugcuu

SEQ ID NO: 1483952 - RNA, 19 nt, Homo sapiens
aguaaugguggaguuguua

SEQ ID NO: 1483953 - RNA, 19 nt, Homo sapiens
uggcuuuaauccaugauag

SEQ ID NO: 1483954 - RNA, 19 nt, Homo sapiens
cuagcagguuccacgaugu

SEQ ID NO: 1483955 - RNA, 19 nt, Homo sapiens
ccauagccaguauauuuag

SEQ ID NO: 1483956 - RNA, 19 nt, Homo sapiens
acuucgggauuccggguua

SEQ ID NO: 1483957 - RNA, 19 nt, Homo sapiens
gaccaggagacuuuaaagg

SEQ ID NO: 1483958 - RNA, 19 nt, Homo sapiens
uacaacaccauagccagua

SEQ ID NO: 1483959 - RNA, 19 nt, Homo sapiens
caagccagcggcaggaagu

SEQ ID NO: 1483960 - RNA, 19 nt, Homo sapiens
gcgagaagcgccguaucga

SEQ ID NO: 1483961 - RNA, 19 nt, Homo sapiens
caaggaacaucuagauaua

SEQ ID NO: 1483962 - RNA, 19 nt, Homo sapiens
aaacugagcuggauugaga

SEQ ID NO: 1483963 - RNA, 19 nt, Homo sapiens
gaggaacccuuucuauauu

SEQ ID NO: 1483964 - RNA, 19 nt, Homo sapiens
gaagaacuaugcccugguu

SEQ ID NO: 1483965 - RNA, 19 nt, Homo sapiens
gaagguagaucauuuacgu

SEQ ID NO: 1483966 - RNA, 19 nt, Homo sapiens
acaagaagcuuuacacaau

SEQ ID NO: 1483967 - RNA, 19 nt, Homo sapiens
gacacaggcuucacugaua

SEQ ID NO: 1483968 - RNA, 19 nt, Homo sapiens
caaagcaaguagaagguua

SEQ ID NO: 1483969 - RNA, 19 nt, Homo sapiens
agacagaucuucaccuauu

SEQ ID NO: 1483970 - RNA, 19 nt, Homo sapiens
gagcuaacuuugauucuga

SEQ ID NO: 1483971 - RNA, 19 nt, Homo sapiens
gaccagagcuuccaacgau

SEQ ID NO: 1483972 - RNA, 19 nt, Homo sapiens
gcuguagucuggaagauaa

SEQ ID NO: 1483973 - RNA, 19 nt, Homo sapiens
gcaaguagaagguuauuau

SEQ ID NO: 1483974 - RNA, 19 nt, Homo sapiens
caagaagcuuuacacaauu

SEQ ID NO: 1483975 - RNA, 19 nt, Homo sapiens
guauaucucuuggucauaa

SEQ ID NO: 1483976 - RNA, 19 nt, Homo sapiens
gaagggagagacuuacuuu

SEQ ID NO: 1483977 - RNA, 19 nt, Homo sapiens
aaagggagauacugcuaua

SEQ ID NO: 1483978 - RNA, 19 nt, Homo sapiens
gcuuugaaguucuguaauu

SEQ ID NO: 1483979 - RNA, 19 nt, Homo sapiens
ccugugaagucaaguauuu

SEQ ID NO: 1483980 - RNA, 19 nt, Homo sapiens
guuugaagaugaagacuuu

SEQ ID NO: 1483981 - RNA, 19 nt, Homo sapiens
ccaaugauauucaacaaag

SEQ ID NO: 1483982 - RNA, 19 nt, Homo sapiens
uaaagucaaugcagccaaa

SEQ ID NO: 1483983 - RNA, 19 nt, Homo sapiens
gaacuaugcccugguuauu

SEQ ID NO: 1483984 - RNA, 19 nt, Homo sapiens
uaucugaguuugaggguuu

SEQ ID NO: 1483985 - RNA, 19 nt, Homo sapiens
gaguuuauguggcgauuug

SEQ ID NO: 1483986 - RNA, 19 nt, Homo sapiens
cagcaucccucucaaagug

SEQ ID NO: 1483987 - RNA, 19 nt, Homo sapiens
ccuuaaggcugaagaacua

SEQ ID NO: 1483988 - RNA, 19 nt, Homo sapiens
cagaggaacccuuucuaua

SEQ ID NO: 1483989 - RNA, 19 nt, Homo sapiens
cguggagccucuucuauuu

SEQ ID NO: 1483990 - RNA, 19 nt, Homo sapiens
gcaaagaggaccagagcuu

SEQ ID NO: 1483991 - RNA, 19 nt, Homo sapiens
gagacuuacuuuggauuaa

SEQ ID NO: 1483992 - RNA, 19 nt, Homo sapiens
gggagagacuuacuuugga

SEQ ID NO: 1483993 - RNA, 19 nt, Homo sapiens
gcgauuugcucgugcuuau

SEQ ID NO: 1483994 - RNA, 19 nt, Homo sapiens
gcaaaguguuauacugauc

SEQ ID NO: 1483995 - RNA, 19 nt, Homo sapiens
ggagacauguaugaacuau

SEQ ID NO: 1483996 - RNA, 19 nt, Homo sapiens
caucucugcuccugaauau

SEQ ID NO: 1483997 - RNA, 19 nt, Homo sapiens
gcaaguggccagaaugugu

SEQ ID NO: 1483998 - RNA, 19 nt, Homo sapiens
guagaagguuauuaucugu

SEQ ID NO: 1483999 - RNA, 19 nt, Homo sapiens
ggagagacuuacuuuggau

SEQ ID NO: 1484000 - RNA, 19 nt, Homo sapiens
gugaaggccuggagaguca

SEQ ID NO: 1484001 - RNA, 19 nt, Homo sapiens
ucaaggaacaucuagauau

SEQ ID NO: 1484002 - RNA, 19 nt, Homo sapiens
agacauguaugaacuaucu

SEQ ID NO: 1484003 - RNA, 19 nt, Homo sapiens
ggccaauuauguaaagauu

SEQ ID NO: 1484004 - RNA, 19 nt, Homo sapiens
ccagaaugcuuugaaguuc

SEQ ID NO: 1484005 - RNA, 19 nt, Homo sapiens
aggaacccuuucuauauua

SEQ ID NO: 1484006 - RNA, 19 nt, Homo sapiens
gaacaucuagauauagcaa

SEQ ID NO: 1484007 - RNA, 19 nt, Homo sapiens
ucagaagguagaucauuua

SEQ ID NO: 1484008 - RNA, 19 nt, Homo sapiens
gccagaauguguuuaaucu

SEQ ID NO: 1484009 - RNA, 19 nt, Homo sapiens
agaggaacccuuucuauau

SEQ ID NO: 1484010 - RNA, 19 nt, Homo sapiens
uaauagagcacccaugaau

SEQ ID NO: 1484011 - RNA, 19 nt, Homo sapiens
ugaacuaucuacaaacaca

SEQ ID NO: 1484012 - RNA, 19 nt, Homo sapiens
guuuagagaugaaauagag

SEQ ID NO: 1484013 - RNA, 19 nt, Homo sapiens
gaggagcuguagucuggaa

SEQ ID NO: 1484014 - RNA, 19 nt, Homo sapiens
ucucugcuccugaauauaa

SEQ ID NO: 1484015 - RNA, 19 nt, Homo sapiens
ccaauuacauguacuuagc

SEQ ID NO: 1484016 - RNA, 19 nt, Homo sapiens
caaagcacaucauccuucu

SEQ ID NO: 1484017 - RNA, 19 nt, Homo sapiens
acacaggcuucacugauau

SEQ ID NO: 1484018 - RNA, 19 nt, Homo sapiens
uagcaaaguguuauacuga

SEQ ID NO: 1484019 - RNA, 19 nt, Homo sapiens
aauaccaucuucaacugua

SEQ ID NO: 1484020 - RNA, 19 nt, Homo sapiens
gaaacaaacacuacuucuc

SEQ ID NO: 1484021 - RNA, 19 nt, Homo sapiens
gacagaucuucaccuauug

SEQ ID NO: 1484022 - RNA, 19 nt, Homo sapiens
ccaaagaggagcuguaguc

SEQ ID NO: 1484023 - RNA, 19 nt, Homo sapiens
ggagauacugcuauacugu

SEQ ID NO: 1484024 - RNA, 19 nt, Homo sapiens
gggagauacugcuauacug

SEQ ID NO: 1484025 - RNA, 19 nt, Homo sapiens
ucaagcaaguggccagaau

SEQ ID NO: 1484026 - RNA, 19 nt, Homo sapiens
ccucaaagcgaauuaacuu

SEQ ID NO: 1484027 - RNA, 19 nt, Homo sapiens
caacaaagcacaucauccu

SEQ ID NO: 1484028 - RNA, 19 nt, Homo sapiens
aagcacaucauccuucuuu

SEQ ID NO: 1484029 - RNA, 19 nt, Homo sapiens
gcuccugaauauaacacua

SEQ ID NO: 1484030 - RNA, 19 nt, Homo sapiens
guucuguaauuuggcuuua

SEQ ID NO: 1484031 - RNA, 19 nt, Homo sapiens
cugcuacucuguuuggaaa

SEQ ID NO: 1484032 - RNA, 19 nt, Homo sapiens
ggaagggagagacuuacuu

SEQ ID NO: 1484033 - RNA, 19 nt, Homo sapiens
acacagaagaacagaguuu

SEQ ID NO: 1484034 - RNA, 19 nt, Homo sapiens
caagcccugucaucuguga

SEQ ID NO: 1484035 - RNA, 19 nt, Homo sapiens
gaagaucaaguuaguacag

SEQ ID NO: 1484036 - RNA, 19 nt, Homo sapiens
uucagaagguagaucauuu

SEQ ID NO: 1484037 - RNA, 19 nt, Homo sapiens
cagcuaauacugacacaga

SEQ ID NO: 1484038 - RNA, 19 nt, Homo sapiens
ccagaggaacccuuucuau

SEQ ID NO: 1484039 - RNA, 19 nt, Homo sapiens
gguagaucauuuacguaug

SEQ ID NO: 1484040 - RNA, 19 nt, Homo sapiens
uaacuucaggccuguuuga

SEQ ID NO: 1484041 - RNA, 19 nt, Homo sapiens
ccacagcaucccucucaaa

SEQ ID NO: 1484042 - RNA, 19 nt, Homo sapiens
gcaacaaaguagagcuaac

SEQ ID NO: 1484043 - RNA, 19 nt, Homo sapiens
auacugaucuugaggaaaa

SEQ ID NO: 1484044 - RNA, 19 nt, Homo sapiens
guacaagaagcuuuacaca

SEQ ID NO: 1484045 - RNA, 19 nt, Homo sapiens
ucaaagcgaauuaacuuca

SEQ ID NO: 1484046 - RNA, 19 nt, Homo sapiens
ccauaaagcuggauuuucu

SEQ ID NO: 1484047 - RNA, 19 nt, Homo sapiens
caacaaaggggccaauuau

SEQ ID NO: 1484048 - RNA, 19 nt, Homo sapiens
aguagaagguuauuaucug

SEQ ID NO: 1484049 - RNA, 19 nt, Homo sapiens
cgcaagcccugucaucugu

SEQ ID NO: 1484050 - RNA, 19 nt, Homo sapiens
caacuguacaagaagcuuu

SEQ ID NO: 1484051 - RNA, 19 nt, Homo sapiens
caaaggggccaauuaugua

SEQ ID NO: 1484052 - RNA, 19 nt, Homo sapiens
guagagcuaacuuugauuc

SEQ ID NO: 1484053 - RNA, 19 nt, Homo sapiens
aaaccagaaugcuuugaag

SEQ ID NO: 1484054 - RNA, 19 nt, Homo sapiens
ggaacccuuucuauauuac

SEQ ID NO: 1484055 - RNA, 19 nt, Homo sapiens
uuagauguccuucuucaga

SEQ ID NO: 1484056 - RNA, 19 nt, Homo sapiens
uuacacaauuuccuuaagg

SEQ ID NO: 1484057 - RNA, 19 nt, Homo sapiens
caaagggagauacugcuau

SEQ ID NO: 1484058 - RNA, 19 nt, Homo sapiens
ucaaagggagauacugcua

SEQ ID NO: 1484059 - RNA, 19 nt, Homo sapiens
caaagcgaauuaacuucag

SEQ ID NO: 1484060 - RNA, 19 nt, Homo sapiens
aaccaucucugcuccugaa

SEQ ID NO: 1484061 - RNA, 19 nt, Homo sapiens
ccagaaagcuuacagauaa

SEQ ID NO: 1484062 - RNA, 19 nt, Homo sapiens
gaacgagcaugaagauuug

SEQ ID NO: 1484063 - RNA, 19 nt, Homo sapiens
caaccuauguguuaucauu

SEQ ID NO: 1484064 - RNA, 19 nt, Homo sapiens
acacacaaauccuugaaua

SEQ ID NO: 1484065 - RNA, 19 nt, Homo sapiens
gggacagccucucuauuua

SEQ ID NO: 1484066 - RNA, 19 nt, Homo sapiens
ugacugugcugcugaagua

SEQ ID NO: 1484067 - RNA, 19 nt, Homo sapiens
gaggcaguguuaaauauuu

SEQ ID NO: 1484068 - RNA, 19 nt, Homo sapiens
uggaagaucuuaaggacua

SEQ ID NO: 1484069 - RNA, 19 nt, Homo sapiens
cuacauugcuucauuacuu

SEQ ID NO: 1484070 - RNA, 19 nt, Homo sapiens
gaaaggaccaccaaaauaa

SEQ ID NO: 1484071 - RNA, 19 nt, Homo sapiens
ccacagguaauacaauuua

SEQ ID NO: 1484072 - RNA, 19 nt, Homo sapiens
cugcaaauauuuccuguuu

SEQ ID NO: 1484073 - RNA, 19 nt, Homo sapiens
uaaaucaucuccaaggaau

SEQ ID NO: 1484074 - RNA, 19 nt, Homo sapiens
caagaggcaguguuaaaua

SEQ ID NO: 1484075 - RNA, 19 nt, Homo sapiens
gacaaaaccuuaacaaaga

SEQ ID NO: 1484076 - RNA, 19 nt, Homo sapiens
guagaaaugcccuuauaaa

SEQ ID NO: 1484077 - RNA, 19 nt, Homo sapiens
acaguuguguguugacuua

SEQ ID NO: 1484078 - RNA, 19 nt, Homo sapiens
ggaguagcgauaacaaaua

SEQ ID NO: 1484079 - RNA, 19 nt, Homo sapiens
gcaaugcucccuccucuau

SEQ ID NO: 1484080 - RNA, 19 nt, Homo sapiens
ucagugcuauccaguuaua

SEQ ID NO: 1484081 - RNA, 19 nt, Homo sapiens
gccagcaguuucaguuaua

SEQ ID NO: 1484082 - RNA, 19 nt, Homo sapiens
gaagaugacugugauccau

SEQ ID NO: 1484083 - RNA, 19 nt, Homo sapiens
acaaauagcccaucucuag

SEQ ID NO: 1484084 - RNA, 19 nt, Homo sapiens
aauggaaucuugagacaaa

SEQ ID NO: 1484085 - RNA, 19 nt, Homo sapiens
cuacauacauucuagagau

SEQ ID NO: 1484086 - RNA, 19 nt, Homo sapiens
cuacauaugugguuugcuu

SEQ ID NO: 1484087 - RNA, 19 nt, Homo sapiens
gcacuugccauuaauccua

SEQ ID NO: 1484088 - RNA, 19 nt, Homo sapiens
acagggagcuauugaucua

SEQ ID NO: 1484089 - RNA, 19 nt, Homo sapiens
aaagacagccuaguaagua

SEQ ID NO: 1484090 - RNA, 19 nt, Homo sapiens
gugcacauguuuaguauca

SEQ ID NO: 1484091 - RNA, 19 nt, Homo sapiens
ggucaucugugcgcugaua

SEQ ID NO: 1484092 - RNA, 19 nt, Homo sapiens
ugacucaacucuaauuaca

SEQ ID NO: 1484093 - RNA, 19 nt, Homo sapiens
uccaaugacucaacucuaa

SEQ ID NO: 1484094 - RNA, 19 nt, Homo sapiens
guucaaagacagccuagua

SEQ ID NO: 1484095 - RNA, 19 nt, Homo sapiens
ugaacgagcaugaagauuu

SEQ ID NO: 1484096 - RNA, 19 nt, Homo sapiens
gaauccagcucucuauuuu

SEQ ID NO: 1484097 - RNA, 19 nt, Homo sapiens
guuaacaagugauucaaug

SEQ ID NO: 1484098 - RNA, 19 nt, Homo sapiens
gaguagcgauaacaaauag

SEQ ID NO: 1484099 - RNA, 19 nt, Homo sapiens
cuaauaaugcccuuucuuu

SEQ ID NO: 1484100 - RNA, 19 nt, Homo sapiens
uaaauggaaucuugagaca

SEQ ID NO: 1484101 - RNA, 19 nt, Homo sapiens
ugacaguguuguucaaaga

SEQ ID NO: 1484102 - RNA, 19 nt, Homo sapiens
cacaaauccuugaauauca

SEQ ID NO: 1484103 - RNA, 19 nt, Homo sapiens
ugaaacgcauguuguaugu

SEQ ID NO: 1484104 - RNA, 19 nt, Homo sapiens
uaucauugccagugucuua

SEQ ID NO: 1484105 - RNA, 19 nt, Homo sapiens
cguagugacugaagacuug

SEQ ID NO: 1484106 - RNA, 19 nt, Homo sapiens
cgacuugccuugcauuagu

SEQ ID NO: 1484107 - RNA, 19 nt, Homo sapiens
gaaauugcuccgauuggaa

SEQ ID NO: 1484108 - RNA, 19 nt, Homo sapiens
gcaggaaugcuacuaggaa

SEQ ID NO: 1484109 - RNA, 19 nt, Homo sapiens
uacagcccauucucaauua

SEQ ID NO: 1484110 - RNA, 19 nt, Homo sapiens
gaauguugcuaauccaaag

SEQ ID NO: 1484111 - RNA, 19 nt, Homo sapiens
ggacugaggcgucgagcuu

SEQ ID NO: 1484112 - RNA, 19 nt, Homo sapiens
aaacaaaggcaagcucuaa

SEQ ID NO: 1484113 - RNA, 19 nt, Homo sapiens
gaauaugacuagauuucag

SEQ ID NO: 1484114 - RNA, 19 nt, Homo sapiens
gaguacggcuggaggaaug

SEQ ID NO: 1484115 - RNA, 19 nt, Homo sapiens
gcacaagaauaugacuaga

SEQ ID NO: 1484116 - RNA, 19 nt, Homo sapiens
agcaauaguucacaucuuu

SEQ ID NO: 1484117 - RNA, 19 nt, Homo sapiens
caacaucaaacuaacaaga

SEQ ID NO: 1484118 - RNA, 19 nt, Homo sapiens
gugauucaauggacaaguu

SEQ ID NO: 1484119 - RNA, 19 nt, Homo sapiens
ggaaugcuacuaggaauug

SEQ ID NO: 1484120 - RNA, 19 nt, Homo sapiens
ccucugacgucaauuauag

SEQ ID NO: 1484121 - RNA, 19 nt, Homo sapiens
gguuguguaucaucaauau

SEQ ID NO: 1484122 - RNA, 19 nt, Homo sapiens
gauugaaacgcauguugua

SEQ ID NO: 1484123 - RNA, 19 nt, Homo sapiens
gggagugguuguguaauga

SEQ ID NO: 1484124 - RNA, 19 nt, Homo sapiens
gauaacaaauagcccaucu

SEQ ID NO: 1484125 - RNA, 19 nt, Homo sapiens
gguagaaaugcccuuauaa

SEQ ID NO: 1484126 - RNA, 19 nt, Homo sapiens
ugguagaaaugcccuuaua

SEQ ID NO: 1484127 - RNA, 19 nt, Homo sapiens
gagauguaaugcuggaaga

SEQ ID NO: 1484128 - RNA, 19 nt, Homo sapiens
ugucacagccucauuugua

SEQ ID NO: 1484129 - RNA, 19 nt, Homo sapiens
uaaagaauccagcucucua

SEQ ID NO: 1484130 - RNA, 19 nt, Homo sapiens
gaaauuucuggcugccuua

SEQ ID NO: 1484131 - RNA, 19 nt, Homo sapiens
uaaagaaacacggcuugua

SEQ ID NO: 1484132 - RNA, 19 nt, Homo sapiens
ggacuaggguuuuaaauac

SEQ ID NO: 1484133 - RNA, 19 nt, Homo sapiens
ccguguagguuucauugua

SEQ ID NO: 1484134 - RNA, 19 nt, Homo sapiens
gcauacagcagcuuuguca

SEQ ID NO: 1484135 - RNA, 19 nt, Homo sapiens
aagaggcaguguuaaauau

SEQ ID NO: 1484136 - RNA, 19 nt, Homo sapiens
ugugauccaugacaucuaa

SEQ ID NO: 1484137 - RNA, 19 nt, Homo sapiens
agaacuaauugcuaacuga

SEQ ID NO: 1484138 - RNA, 19 nt, Homo sapiens
aaagaaacacggcuuguau

SEQ ID NO: 1484139 - RNA, 19 nt, Homo sapiens
cuuaaggacuacauacauu

SEQ ID NO: 1484140 - RNA, 19 nt, Homo sapiens
ugggacagccucucuauuu

SEQ ID NO: 1484141 - RNA, 19 nt, Homo sapiens
cuucugagcuguuaacaag

SEQ ID NO: 1484142 - RNA, 19 nt, Homo sapiens
caaggaauguugcuaaucc

SEQ ID NO: 1484143 - RNA, 19 nt, Homo sapiens
auucagugcuauccaguua

SEQ ID NO: 1484144 - RNA, 19 nt, Homo sapiens
cagaaagcuuacagauaaa

SEQ ID NO: 1484145 - RNA, 19 nt, Homo sapiens
gucacagccucauuuguaa

SEQ ID NO: 1484146 - RNA, 19 nt, Homo sapiens
cguguagguuucauuguaa

SEQ ID NO: 1484147 - RNA, 19 nt, Homo sapiens
gacgucaauuauagcaaua

SEQ ID NO: 1484148 - RNA, 19 nt, Homo sapiens
gaauguuuguagccuuuau

SEQ ID NO: 1484149 - RNA, 19 nt, Homo sapiens
cagccucucuauuuacaaa

SEQ ID NO: 1484150 - RNA, 19 nt, Homo sapiens
ggaaugccauguugaucca

SEQ ID NO: 1484151 - RNA, 19 nt, Homo sapiens
gacaaaagcaugguuaaua

SEQ ID NO: 1484152 - RNA, 19 nt, Homo sapiens
guacguuccuaaugacugu

SEQ ID NO: 1484153 - RNA, 19 nt, Homo sapiens
gaucaucacacacacacaa

SEQ ID NO: 1484154 - RNA, 19 nt, Homo sapiens
ucucuagacucucguguug

SEQ ID NO: 1484155 - RNA, 19 nt, Homo sapiens
agaaacacggcuuguauuu

SEQ ID NO: 1484156 - RNA, 19 nt, Homo sapiens
caacucaaccacuucuuug

SEQ ID NO: 1484157 - RNA, 19 nt, Homo sapiens
caugauaggaauacucuuu

SEQ ID NO: 1484158 - RNA, 19 nt, Homo sapiens
ugucuuaggucaaauuuac

SEQ ID NO: 1484159 - RNA, 19 nt, Homo sapiens
gauccaugacaucuaauaa

SEQ ID NO: 1484160 - RNA, 19 nt, Homo sapiens
ugaaauugcuccgauugga

SEQ ID NO: 1484161 - RNA, 19 nt, Homo sapiens
gcagguaggucgucucaga

SEQ ID NO: 1484162 - RNA, 19 nt, Homo sapiens
ccaccacacuggcuaauuu

SEQ ID NO: 1484163 - RNA, 19 nt, Homo sapiens
gagacaagcugcugugugu

SEQ ID NO: 1484164 - RNA, 19 nt, Homo sapiens
guacuugaauugcaggaaa

SEQ ID NO: 1484165 - RNA, 19 nt, Homo sapiens
gauggacgcugacccaguu

SEQ ID NO: 1484166 - RNA, 19 nt, Homo sapiens
gaugaguucugucuuuaug

SEQ ID NO: 1484167 - RNA, 19 nt, Homo sapiens
gaugagaugucagaagcua

SEQ ID NO: 1484168 - RNA, 19 nt, Homo sapiens
gaugaguggcugugaguua

SEQ ID NO: 1484169 - RNA, 19 nt, Homo sapiens
cauaagaauugcaggaaga

SEQ ID NO: 1484170 - RNA, 19 nt, Homo sapiens
guaggucgucucagauuua

SEQ ID NO: 1484171 - RNA, 19 nt, Homo sapiens
guuauagacucaugugugu

SEQ ID NO: 1484172 - RNA, 19 nt, Homo sapiens
ggucgucucagauuuaauu

SEQ ID NO: 1484173 - RNA, 19 nt, Homo sapiens
gguaggucgucucagauuu

SEQ ID NO: 1484174 - RNA, 19 nt, Homo sapiens
gcaggaagaauaccacugu

SEQ ID NO: 1484175 - RNA, 19 nt, Homo sapiens
gacaauggcaguagagaug

SEQ ID NO: 1484176 - RNA, 19 nt, Homo sapiens
uggagucuguguaacauuu

SEQ ID NO: 1484177 - RNA, 19 nt, Homo sapiens
uaaagguacuugaauugca

SEQ ID NO: 1484178 - RNA, 19 nt, Homo sapiens
ccaaagugcugggauuaca

SEQ ID NO: 1484179 - RNA, 19 nt, Homo sapiens
ggaccaggaugaggaagau

SEQ ID NO: 1484180 - RNA, 19 nt, Homo sapiens
gggaugggccucauugaug

SEQ ID NO: 1484181 - RNA, 19 nt, Homo sapiens
ggggagagguucuguuaaa

SEQ ID NO: 1484182 - RNA, 19 nt, Homo sapiens
ugacccaguucacagaauu

SEQ ID NO: 1484183 - RNA, 19 nt, Homo sapiens
ggaugaggaagauaaagaa

SEQ ID NO: 1484184 - RNA, 19 nt, Homo sapiens
uguguuugcugagaaguua

SEQ ID NO: 1484185 - RNA, 19 nt, Homo sapiens
aagaauugcaggaagaaua

SEQ ID NO: 1484186 - RNA, 19 nt, Homo sapiens
uaaggacaauggcaguaga

SEQ ID NO: 1484187 - RNA, 19 nt, Homo sapiens
gagucuguguaacauuuaa

SEQ ID NO: 1484188 - RNA, 19 nt, Homo sapiens
gaagaugagaugucagaag

SEQ ID NO: 1484189 - RNA, 19 nt, Homo sapiens
gggaagaugagaugucaga

SEQ ID NO: 1484190 - RNA, 19 nt, Homo sapiens
ggagucuguguaacauuua

SEQ ID NO: 1484191 - RNA, 19 nt, Homo sapiens
ucauguguguucugaauuc

SEQ ID NO: 1484192 - RNA, 19 nt, Homo sapiens
gauggagucuguguaacau

SEQ ID NO: 1484193 - RNA, 19 nt, Homo sapiens
uugaugaguucugucuuua

SEQ ID NO: 1484194 - RNA, 19 nt, Homo sapiens
gaaagaaaggggaggaaaa

SEQ ID NO: 1484195 - RNA, 19 nt, Homo sapiens
gcaccgcgacagccuuaaa

SEQ ID NO: 1484196 - RNA, 19 nt, Homo sapiens
uuaucugacuggcgaagua

SEQ ID NO: 1484197 - RNA, 19 nt, Homo sapiens
uaccaaagcaguaauucuu

SEQ ID NO: 1484198 - RNA, 19 nt, Homo sapiens
caccaugccuagcccagaa

SEQ ID NO: 1484199 - RNA, 19 nt, Homo sapiens
gaagacaggaacagugagu

SEQ ID NO: 1484200 - RNA, 19 nt, Homo sapiens
agacucauguguguucuga

SEQ ID NO: 1484201 - RNA, 19 nt, Homo sapiens
gcaauucccggcugauucu

SEQ ID NO: 1484202 - RNA, 19 nt, Homo sapiens
gaacuccugaccugaagug

SEQ ID NO: 1484203 - RNA, 19 nt, Homo sapiens
gcugagaaguuaauaucac

SEQ ID NO: 1484204 - RNA, 19 nt, Homo sapiens
uaggucgucucagauuuaa

SEQ ID NO: 1484205 - RNA, 19 nt, Homo sapiens
gugcauugguguggucuug

SEQ ID NO: 1484206 - RNA, 19 nt, Homo sapiens
ugaggaagauaaagaaucc

SEQ ID NO: 1484207 - RNA, 19 nt, Homo sapiens
gggcagcgaggguuauaga

SEQ ID NO: 1484208 - RNA, 19 nt, Homo sapiens
ggacaauggcaguagagau

SEQ ID NO: 1484209 - RNA, 19 nt, Homo sapiens
gucagaagcuaaggacaau

SEQ ID NO: 1484210 - RNA, 19 nt, Homo sapiens
gacccaguucacagaauua

SEQ ID NO: 1484211 - RNA, 19 nt, Homo sapiens
auugaugaguucugucuuu

SEQ ID NO: 1484212 - RNA, 19 nt, Homo sapiens
caguagagaugagguucuu

SEQ ID NO: 1484213 - RNA, 19 nt, Homo sapiens
acucauguguguucugaau

SEQ ID NO: 1484214 - RNA, 19 nt, Homo sapiens
aguucugucuuuaugcuua

SEQ ID NO: 1484215 - RNA, 19 nt, Homo sapiens
gcugugaguuagagacaag

SEQ ID NO: 1484216 - RNA, 19 nt, Homo sapiens
guagagaugagguucuugu

SEQ ID NO: 1484217 - RNA, 19 nt, Homo sapiens
gucucuggcuccuguguuu

SEQ ID NO: 1484218 - RNA, 19 nt, Homo sapiens
gagucucaguggauguuug

SEQ ID NO: 1484219 - RNA, 19 nt, Homo sapiens
gagaaguuaauaucaccaa

SEQ ID NO: 1484220 - RNA, 19 nt, Homo sapiens
aaauaagucuuuccccaaa

SEQ ID NO: 1484221 - RNA, 19 nt, Homo sapiens
ccaguucacagaauuaucu

SEQ ID NO: 1484222 - RNA, 19 nt, Homo sapiens
gcuaaggacaauggcagua

SEQ ID NO: 1484223 - RNA, 19 nt, Homo sapiens
gaaaaccuguuagggacaa

SEQ ID NO: 1484224 - RNA, 19 nt, Homo sapiens
gaaugaagacaggaacagu

SEQ ID NO: 1484225 - RNA, 19 nt, Homo sapiens
accaaagcaguaauucuua

SEQ ID NO: 1484226 - RNA, 19 nt, Homo sapiens
auacauugaugaguucugu

SEQ ID NO: 1484227 - RNA, 19 nt, Homo sapiens
gaugaggaagauaaagaau

SEQ ID NO: 1484228 - RNA, 19 nt, Homo sapiens
agacaggaacagugaguug

SEQ ID NO: 1484229 - RNA, 19 nt, Homo sapiens
uauagacucauguguguuc

SEQ ID NO: 1484230 - RNA, 19 nt, Homo sapiens
ccaggaugaggaagauaaa

SEQ ID NO: 1484231 - RNA, 19 nt, Homo sapiens
gagaaugaagacaggaaca

SEQ ID NO: 1484232 - RNA, 19 nt, Homo sapiens
gcuccuguguuugcugaga

SEQ ID NO: 1484233 - RNA, 19 nt, Homo sapiens
aaggugaacugaagaaaau

SEQ ID NO: 1484234 - RNA, 19 nt, Homo sapiens
cuugauggagucuguguaa

SEQ ID NO: 1484235 - RNA, 19 nt, Homo sapiens
guucugucuuuaugcuuau

SEQ ID NO: 1484236 - RNA, 19 nt, Homo sapiens
cgaggguuauagacucaug

SEQ ID NO: 1484237 - RNA, 19 nt, Homo sapiens
aaguuaauaucaccaagca

SEQ ID NO: 1484238 - RNA, 19 nt, Homo sapiens
ggucaaggugaacugaaga

SEQ ID NO: 1484239 - RNA, 19 nt, Homo sapiens
cgucucagauuuaauuuuc

SEQ ID NO: 1484240 - RNA, 19 nt, Homo sapiens
acuauacauugaugaguuc

SEQ ID NO: 1484241 - RNA, 19 nt, Homo sapiens
ggcaauucccggcugauuc

SEQ ID NO: 1484242 - RNA, 19 nt, Homo sapiens
gggagagguucuguuaaaa

SEQ ID NO: 1484243 - RNA, 19 nt, Homo sapiens
gacuggcgaaguaaaggua

SEQ ID NO: 1484244 - RNA, 19 nt, Homo sapiens
ucaguggauguuugacuuu

SEQ ID NO: 1484245 - RNA, 19 nt, Homo sapiens
gguagaagauggggaagau

SEQ ID NO: 1484246 - RNA, 19 nt, Homo sapiens
guaaagguacuugaauugc

SEQ ID NO: 1484247 - RNA, 19 nt, Homo sapiens
gcagcgaggguuauagacu

SEQ ID NO: 1484248 - RNA, 19 nt, Homo sapiens
ugauggagucuguguaaca

SEQ ID NO: 1484249 - RNA, 19 nt, Homo sapiens
ccaaaggagguagaagaug

SEQ ID NO: 1484250 - RNA, 19 nt, Homo sapiens
augccuagcccagaaauuu

SEQ ID NO: 1484251 - RNA, 19 nt, Homo sapiens
gccaggccaucuugaacuc

SEQ ID NO: 1484252 - RNA, 19 nt, Homo sapiens
ccacugucccgggaaagaa

SEQ ID NO: 1484253 - RNA, 19 nt, Homo sapiens
gaacugaagaaaauaaguc

SEQ ID NO: 1484254 - RNA, 19 nt, Homo sapiens
cagaagcuaaggacaaugg

SEQ ID NO: 1484255 - RNA, 19 nt, Homo sapiens
cucaguggauguuugacuu

SEQ ID NO: 1484256 - RNA, 19 nt, Homo sapiens
ugaguucugucuuuaugcu

SEQ ID NO: 1484257 - RNA, 19 nt, Homo sapiens
ggaagaugagaugucagaa

SEQ ID NO: 1484258 - RNA, 19 nt, Homo sapiens
caaggugaacugaagaaaa

SEQ ID NO: 1484259 - RNA, 19 nt, Homo sapiens
gugagagccaccaggagaa

SEQ ID NO: 1484260 - RNA, 19 nt, Homo sapiens
auaccacugucccgggaaa

SEQ ID NO: 1484261 - RNA, 19 nt, Homo sapiens
uagaaaugcuugucuuuga

SEQ ID NO: 1484262 - RNA, 19 nt, Homo sapiens
gguaagggcuacuaucuca

SEQ ID NO: 1484263 - RNA, 19 nt, Homo sapiens
gcaaacaccaauaaagauu

SEQ ID NO: 1484264 - RNA, 19 nt, Homo sapiens
uggaagagcucccaaggaa

SEQ ID NO: 1484265 - RNA, 19 nt, Homo sapiens
gggcggagcuuccagaaca

SEQ ID NO: 1484266 - RNA, 19 nt, Homo sapiens
gguaggagcucaguacaug

SEQ ID NO: 1484267 - RNA, 19 nt, Homo sapiens
gaccauaucaccaagcuaa

SEQ ID NO: 1484268 - RNA, 19 nt, Homo sapiens
gcacagcuuugaagucauc

SEQ ID NO: 1484269 - RNA, 19 nt, Homo sapiens
gcaaagugcccgugagguu

SEQ ID NO: 1484270 - RNA, 19 nt, Homo sapiens
gaagccaccuuuucuuuaa

SEQ ID NO: 1484271 - RNA, 19 nt, Homo sapiens
ucccauaccugcuuuagaa

SEQ ID NO: 1484272 - RNA, 19 nt, Homo sapiens
gaaaugcuugucuuugaaa

SEQ ID NO: 1484273 - RNA, 19 nt, Homo sapiens
ugaagcccauugugccuua

SEQ ID NO: 1484274 - RNA, 19 nt, Homo sapiens
acaaauaccugaaugucau

SEQ ID NO: 1484275 - RNA, 19 nt, Homo sapiens
gaugacaaauaccugaaug

SEQ ID NO: 1484276 - RNA, 19 nt, Homo sapiens
ccauuucugugcauucuuu

SEQ ID NO: 1484277 - RNA, 19 nt, Homo sapiens
caaggaagcuagaaaugcu

SEQ ID NO: 1484278 - RNA, 19 nt, Homo sapiens
ggagcuaucccacugagaa

SEQ ID NO: 1484279 - RNA, 19 nt, Homo sapiens
agaaaugcuugucuuugaa

SEQ ID NO: 1484280 - RNA, 19 nt, Homo sapiens
ccacugagaagccaccuuu

SEQ ID NO: 1484281 - RNA, 19 nt, Homo sapiens
ggccaauggugcugaaaug

SEQ ID NO: 1484282 - RNA, 19 nt, Homo sapiens
gggccaaugucgucccaaa

SEQ ID NO: 1484283 - RNA, 19 nt, Homo sapiens
caauggugcugaaaugaag

SEQ ID NO: 1484284 - RNA, 19 nt, Homo sapiens
ccagccaccugcccaaaga

SEQ ID NO: 1484285 - RNA, 19 nt, Homo sapiens
ccucaaagccugucuuagu

SEQ ID NO: 1484286 - RNA, 19 nt, Homo sapiens
gcuagaaaugcuugucuuu

SEQ ID NO: 1484287 - RNA, 19 nt, Homo sapiens
gcaguugaguccauguaag

SEQ ID NO: 1484288 - RNA, 19 nt, Homo sapiens
gagaggcccugggugucua

SEQ ID NO: 1484289 - RNA, 19 nt, Homo sapiens
ggagcucaguacauguaaa

SEQ ID NO: 1484290 - RNA, 19 nt, Homo sapiens
cucaaagccugucuuaguu

SEQ ID NO: 1484291 - RNA, 19 nt, Homo sapiens
uaucaacucuugcucuucu

SEQ ID NO: 1484292 - RNA, 19 nt, Homo sapiens
aagcuaagguuccugaaag

SEQ ID NO: 1484293 - RNA, 19 nt, Homo sapiens
gcacaugcacccugaaagg

SEQ ID NO: 1484294 - RNA, 19 nt, Homo sapiens
cauaccugcuuuagaaugu

SEQ ID NO: 1484295 - RNA, 19 nt, Homo sapiens
gaaggcacaguuccuagug

SEQ ID NO: 1484296 - RNA, 19 nt, Homo sapiens
ccaauggugcugaaaugaa

SEQ ID NO: 1484297 - RNA, 19 nt, Homo sapiens
gagaucgucuuugccaaca

SEQ ID NO: 1484298 - RNA, 19 nt, Homo sapiens
cugcacagcuuugaaguca

SEQ ID NO: 1484299 - RNA, 19 nt, Homo sapiens
cugcaaacaccaauaaaga

SEQ ID NO: 1484300 - RNA, 19 nt, Homo sapiens
acaaugcuauccuggacuu

SEQ ID NO: 1484301 - RNA, 19 nt, Homo sapiens
caagcuaagguuccugaaa

SEQ ID NO: 1484302 - RNA, 19 nt, Homo sapiens
cagauucccugagguaugg

SEQ ID NO: 1484303 - RNA, 19 nt, Homo sapiens
guggguugcugcugagguu

SEQ ID NO: 1484304 - RNA, 19 nt, Homo sapiens
uccguguccucaucuguua

SEQ ID NO: 1484305 - RNA, 19 nt, Homo sapiens
gggagagcaggcuggcuua

SEQ ID NO: 1484306 - RNA, 19 nt, Homo sapiens
uaggagcucaguacaugua

SEQ ID NO: 1484307 - RNA, 19 nt, Homo sapiens
gaccauuucugugcauucu

SEQ ID NO: 1484308 - RNA, 19 nt, Homo sapiens
ugguaaagguggccaaugg

SEQ ID NO: 1484309 - RNA, 19 nt, Homo sapiens
uugaguccauguaagauga

SEQ ID NO: 1484310 - RNA, 19 nt, Homo sapiens
ccagucugcuuaucaacuc

SEQ ID NO: 1484311 - RNA, 19 nt, Homo sapiens
gcugaaggcacaguuccua

SEQ ID NO: 1484312 - RNA, 19 nt, Homo sapiens
uccaggaaaucccauagga

SEQ ID NO: 1484313 - RNA, 19 nt, Homo sapiens
ggcccugggugucuacaau

SEQ ID NO: 1484314 - RNA, 19 nt, Homo sapiens
guccucaucuguuauucug

SEQ ID NO: 1484315 - RNA, 19 nt, Homo sapiens
ucaaagccugucuuaguug

SEQ ID NO: 1484316 - RNA, 19 nt, Homo sapiens
gagagcaggcuggcuuaga

SEQ ID NO: 1484317 - RNA, 19 nt, Homo sapiens
caaugcgagugccgaggaa

SEQ ID NO: 1484318 - RNA, 19 nt, Homo sapiens
gaagcugaaggcacaguuc

SEQ ID NO: 1484319 - RNA, 19 nt, Homo sapiens
aagcugcuguugaugacaa

SEQ ID NO: 1484320 - RNA, 19 nt, Homo sapiens
cuuaucaacucuugcucuu

SEQ ID NO: 1484321 - RNA, 19 nt, Homo sapiens
gcccugggugucuacaaua

SEQ ID NO: 1484322 - RNA, 19 nt, Homo sapiens
acacugcucuguggguuuc

SEQ ID NO: 1484323 - RNA, 19 nt, Homo sapiens
uucacuggcugaugacaaa

SEQ ID NO: 1484324 - RNA, 19 nt, Homo sapiens
caguugaguccauguaaga

SEQ ID NO: 1484325 - RNA, 19 nt, Homo sapiens
guccucaaagccugucuua

SEQ ID NO: 1484326 - RNA, 19 nt, Homo sapiens
gguauggcuuggucacucu

SEQ ID NO: 1484327 - RNA, 19 nt, Homo sapiens
agagcaggcuggcuuagag

SEQ ID NO: 1484328 - RNA, 19 nt, Homo sapiens
cugcagcccuuugagaaug

SEQ ID NO: 1484329 - RNA, 19 nt, Homo sapiens
uuccuucacuggcugauga

SEQ ID NO: 1484330 - RNA, 19 nt, Homo sapiens
cuagaaaugcuugucuuug

SEQ ID NO: 1484331 - RNA, 19 nt, Homo sapiens
gggcuuggccagucugcuu

SEQ ID NO: 1484332 - RNA, 19 nt, Homo sapiens
gcaggagcuaucccacuga

SEQ ID NO: 1484333 - RNA, 19 nt, Homo sapiens
ggucacugauggcgaucug

SEQ ID NO: 1484334 - RNA, 19 nt, Homo sapiens
gagacuaugggacugugaa

SEQ ID NO: 1484335 - RNA, 19 nt, Homo sapiens
gcugcaaacaccaauaaag

SEQ ID NO: 1484336 - RNA, 19 nt, Homo sapiens
uugagaaugugguaaaggu

SEQ ID NO: 1484337 - RNA, 19 nt, Homo sapiens
uggccagucugcuuaucaa

SEQ ID NO: 1484338 - RNA, 19 nt, Homo sapiens
gagcucaguacauguaaac

SEQ ID NO: 1484339 - RNA, 19 nt, Homo sapiens
acuaugggacugugaaaga

SEQ ID NO: 1484340 - RNA, 19 nt, Homo sapiens
ccagaacaaaggagaaugg

SEQ ID NO: 1484341 - RNA, 19 nt, Homo sapiens
gagcuuccagaacaaagga

SEQ ID NO: 1484342 - RNA, 19 nt, Homo sapiens
gaagcccauugugccuuau

SEQ ID NO: 1484343 - RNA, 19 nt, Homo sapiens
ggucaucaagcugcuguug

SEQ ID NO: 1484344 - RNA, 19 nt, Homo sapiens
gccaauggugcugaaauga

SEQ ID NO: 1484345 - RNA, 19 nt, Homo sapiens
ccaaggaagcuagaaaugc

SEQ ID NO: 1484346 - RNA, 19 nt, Homo sapiens
augcuauccuggacuuuga

SEQ ID NO: 1484347 - RNA, 19 nt, Homo sapiens
gguggccaauggugcugaa

SEQ ID NO: 1484348 - RNA, 19 nt, Homo sapiens
uaagggcuacuaucucaag

SEQ ID NO: 1484349 - RNA, 19 nt, Homo sapiens
cauccuccguguccucauc

SEQ ID NO: 1484350 - RNA, 19 nt, Homo sapiens
caccuguacaaucguauuu

SEQ ID NO: 1484351 - RNA, 19 nt, Homo sapiens
ccugaaagggaagaaguuu

SEQ ID NO: 1484352 - RNA, 19 nt, Homo sapiens
gugcugaaaugaagauccu

SEQ ID NO: 1484353 - RNA, 19 nt, Homo sapiens
uguccucacucacuuaaaa

SEQ ID NO: 1484354 - RNA, 19 nt, Homo sapiens
aaagaccauuucugugcau

SEQ ID NO: 1484355 - RNA, 19 nt, Homo sapiens
gggaccauaucaccaagcu

SEQ ID NO: 1484356 - RNA, 19 nt, Homo sapiens
gaguccauguaagaugauu

SEQ ID NO: 1484357 - RNA, 19 nt, Homo sapiens
ugaggcacccauccugcua

SEQ ID NO: 1484358 - RNA, 19 nt, Homo sapiens
guguguguguccucacuca

SEQ ID NO: 1484359 - RNA, 19 nt, Homo sapiens
ggcuuggccagucugcuua

SEQ ID NO: 1484360 - RNA, 19 nt, Homo sapiens
cuaaauauuggugggaaga

SEQ ID NO: 1484361 - RNA, 19 nt, Homo sapiens
ggauaagucugucauagua

SEQ ID NO: 1484362 - RNA, 19 nt, Homo sapiens
gaaacugauucacacauua

SEQ ID NO: 1484363 - RNA, 19 nt, Homo sapiens
ggaauuaccugcugcgauu

SEQ ID NO: 1484364 - RNA, 19 nt, Homo sapiens
gaauauacuucacacauug

SEQ ID NO: 1484365 - RNA, 19 nt, Homo sapiens
cuagagaacuuaugaaaga

SEQ ID NO: 1484366 - RNA, 19 nt, Homo sapiens
gaaaagaacuguugaaucu

SEQ ID NO: 1484367 - RNA, 19 nt, Homo sapiens
gcacaugaucuuggaauua

SEQ ID NO: 1484368 - RNA, 19 nt, Homo sapiens
agaacaaggucuucaguuu

SEQ ID NO: 1484369 - RNA, 19 nt, Homo sapiens
acacauggacuuacuauaa

SEQ ID NO: 1484370 - RNA, 19 nt, Homo sapiens
guacaagucccaugacaaa

SEQ ID NO: 1484371 - RNA, 19 nt, Homo sapiens
gugaacaucuggcaauuug

SEQ ID NO: 1484372 - RNA, 19 nt, Homo sapiens
gcacagucauacaaauuau

SEQ ID NO: 1484373 - RNA, 19 nt, Homo sapiens
ucagugaucucauuugaau

SEQ ID NO: 1484374 - RNA, 19 nt, Homo sapiens
guaguaaagugcugaggaa

SEQ ID NO: 1484375 - RNA, 19 nt, Homo sapiens
gcacagaacaucagcugaa

SEQ ID NO: 1484376 - RNA, 19 nt, Homo sapiens
ccagguaugucacaacuug

SEQ ID NO: 1484377 - RNA, 19 nt, Homo sapiens
ucagauggcuauucauaug

SEQ ID NO: 1484378 - RNA, 19 nt, Homo sapiens
aagaaagucuggcugauga

SEQ ID NO: 1484379 - RNA, 19 nt, Homo sapiens
uaaagaacauggugaaacu

SEQ ID NO: 1484380 - RNA, 19 nt, Homo sapiens
cacauggacuuacuauaaa

SEQ ID NO: 1484381 - RNA, 19 nt, Homo sapiens
ggaaacacuuugccaagca

SEQ ID NO: 1484382 - RNA, 19 nt, Homo sapiens
gaacauggugaaacugauu

SEQ ID NO: 1484383 - RNA, 19 nt, Homo sapiens
uuacugaacugccacauuc

SEQ ID NO: 1484384 - RNA, 19 nt, Homo sapiens
gaacaucagcugaagcaau

SEQ ID NO: 1484385 - RNA, 19 nt, Homo sapiens
ugaggugucugcauaguga

SEQ ID NO: 1484386 - RNA, 19 nt, Homo sapiens
aauggaagcuucuuuguca

SEQ ID NO: 1484387 - RNA, 19 nt, Homo sapiens
guacuuacaccaaauagga

SEQ ID NO: 1484388 - RNA, 19 nt, Homo sapiens
ggacagaugcuggcaguga

SEQ ID NO: 1484389 - RNA, 19 nt, Homo sapiens
gagcucaggaccaagguua

SEQ ID NO: 1484390 - RNA, 19 nt, Homo sapiens
aaaaugaggugucugcaua

SEQ ID NO: 1484391 - RNA, 19 nt, Homo sapiens
ggaaugcacagucauacaa

SEQ ID NO: 1484392 - RNA, 19 nt, Homo sapiens
aacaucagcugaagcaauu

SEQ ID NO: 1484393 - RNA, 19 nt, Homo sapiens
gaaaauggccaucaauaga

SEQ ID NO: 1484394 - RNA, 19 nt, Homo sapiens
gaagcaauuuaccgaagau

SEQ ID NO: 1484395 - RNA, 19 nt, Homo sapiens
cacauuagcugaucauggu

SEQ ID NO: 1484396 - RNA, 19 nt, Homo sapiens
gagaauauacuucacacau

SEQ ID NO: 1484397 - RNA, 19 nt, Homo sapiens
gguaaauacuaaucagaca

SEQ ID NO: 1484398 - RNA, 19 nt, Homo sapiens
guaccacuguccuauggaa

SEQ ID NO: 1484399 - RNA, 19 nt, Homo sapiens
gaacaaggucuucaguuuu

SEQ ID NO: 1484400 - RNA, 19 nt, Homo sapiens
gaacugugguuuuguggaa

SEQ ID NO: 1484401 - RNA, 19 nt, Homo sapiens
gcaaggagcacagaacauc

SEQ ID NO: 1484402 - RNA, 19 nt, Homo sapiens
ugacucagcacaccaggua

SEQ ID NO: 1484403 - RNA, 19 nt, Homo sapiens
ccaauaacuagagaacuua

SEQ ID NO: 1484404 - RNA, 19 nt, Homo sapiens
uccaauaacuagagaacuu

SEQ ID NO: 1484405 - RNA, 19 nt, Homo sapiens
ggucaggauugccaaguca

SEQ ID NO: 1484406 - RNA, 19 nt, Homo sapiens
gaaagucuggcugaugauu

SEQ ID NO: 1484407 - RNA, 19 nt, Homo sapiens
ugaagcaauuuaccgaaga

SEQ ID NO: 1484408 - RNA, 19 nt, Homo sapiens
gaaugcacagucauacaaa

SEQ ID NO: 1484409 - RNA, 19 nt, Homo sapiens
caauucgccuguacucguu

SEQ ID NO: 1484410 - RNA, 19 nt, Homo sapiens
cagcgguacuuacaccaaa

SEQ ID NO: 1484411 - RNA, 19 nt, Homo sapiens
uaacagugugggaugauaa

SEQ ID NO: 1484412 - RNA, 19 nt, Homo sapiens
caucagcugaagcaauuua

SEQ ID NO: 1484413 - RNA, 19 nt, Homo sapiens
gagaacaaggucuucaguu

SEQ ID NO: 1484414 - RNA, 19 nt, Homo sapiens
auagauggcuggagacaca

SEQ ID NO: 1484415 - RNA, 19 nt, Homo sapiens
aaacguacaagucccauga

SEQ ID NO: 1484416 - RNA, 19 nt, Homo sapiens
uuacccauaucuuagguuu

SEQ ID NO: 1484417 - RNA, 19 nt, Homo sapiens
ugugaggguuugccaguuu

SEQ ID NO: 1484418 - RNA, 19 nt, Homo sapiens
caagucccaugacaaaucu

SEQ ID NO: 1484419 - RNA, 19 nt, Homo sapiens
gguuaaaucccuuucuuca

SEQ ID NO: 1484420 - RNA, 19 nt, Homo sapiens
cuccucauguggugauuua

SEQ ID NO: 1484421 - RNA, 19 nt, Homo sapiens
gaaaauuggaucagcaaaa

SEQ ID NO: 1484422 - RNA, 19 nt, Homo sapiens
gcacaagauuuaaaagauc

SEQ ID NO: 1484423 - RNA, 19 nt, Homo sapiens
cgucugagcccuccauuuc

SEQ ID NO: 1484424 - RNA, 19 nt, Homo sapiens
uuauauagaugugguagug

SEQ ID NO: 1484425 - RNA, 19 nt, Homo sapiens
uuucagugaucucauuuga

SEQ ID NO: 1484426 - RNA, 19 nt, Homo sapiens
uagaugugguaguguuaaa

SEQ ID NO: 1484427 - RNA, 19 nt, Homo sapiens
guaaagugcugaggaaaau

SEQ ID NO: 1484428 - RNA, 19 nt, Homo sapiens
ggagacacaccaaaaguaa

SEQ ID NO: 1484429 - RNA, 19 nt, Homo sapiens
gaacaucuggcaauuugac

SEQ ID NO: 1484430 - RNA, 19 nt, Homo sapiens
gaugugguaguguuaaaga

SEQ ID NO: 1484431 - RNA, 19 nt, Homo sapiens
gacagaugcuggcagugau

SEQ ID NO: 1484432 - RNA, 19 nt, Homo sapiens
ccaaauaggacucugaaaa

SEQ ID NO: 1484433 - RNA, 19 nt, Homo sapiens
uugaagagcucaggaccaa

SEQ ID NO: 1484434 - RNA, 19 nt, Homo sapiens
ucucuaggacugcguagua

SEQ ID NO: 1484435 - RNA, 19 nt, Homo sapiens
uuacgugacuuuacugaac

SEQ ID NO: 1484436 - RNA, 19 nt, Homo sapiens
gaacuguugaaucuuacaa

SEQ ID NO: 1484437 - RNA, 19 nt, Homo sapiens
guggauaagucugucauag

SEQ ID NO: 1484438 - RNA, 19 nt, Homo sapiens
cacaugaucuuggaauuac

SEQ ID NO: 1484439 - RNA, 19 nt, Homo sapiens
gaaaaggaagcaauggaaa

SEQ ID NO: 1484440 - RNA, 19 nt, Homo sapiens
uuaacagugugggaugaua

SEQ ID NO: 1484441 - RNA, 19 nt, Homo sapiens
gaaaauugaaucucuagga

SEQ ID NO: 1484442 - RNA, 19 nt, Homo sapiens
agaggaggaugucucaaca

SEQ ID NO: 1484443 - RNA, 19 nt, Homo sapiens
gcaauuugaccuggaaaca

SEQ ID NO: 1484444 - RNA, 19 nt, Homo sapiens
caaauaggacucugaaaau

SEQ ID NO: 1484445 - RNA, 19 nt, Homo sapiens
gcucaggaccaagguuaaa

SEQ ID NO: 1484446 - RNA, 19 nt, Homo sapiens
aaacacauggacuuacuau

SEQ ID NO: 1484447 - RNA, 19 nt, Homo sapiens
gcgguacuuacaccaaaua

SEQ ID NO: 1484448 - RNA, 19 nt, Homo sapiens
aagucuggcugaugauuug

SEQ ID NO: 1484449 - RNA, 19 nt, Homo sapiens
caucauguggucaggauug

SEQ ID NO: 1484450 - RNA, 19 nt, Homo sapiens
ggagaacaaggucuucagu

SEQ ID NO: 1484451 - RNA, 19 nt, Homo sapiens
cuucacagccaguuucuga

SEQ ID NO: 1484452 - RNA, 19 nt, Homo sapiens
auauagaugugguaguguu

SEQ ID NO: 1484453 - RNA, 19 nt, Homo sapiens
ccugaugaauuuauauguc

SEQ ID NO: 1484454 - RNA, 19 nt, Homo sapiens
gaacugccacauucuccau

SEQ ID NO: 1484455 - RNA, 19 nt, Homo sapiens
cagugaacaucuggcaauu

SEQ ID NO: 1484456 - RNA, 19 nt, Homo sapiens
cagcacaccagguauguca

SEQ ID NO: 1484457 - RNA, 19 nt, Homo sapiens
gauaagucugucauaguau

SEQ ID NO: 1484458 - RNA, 19 nt, Homo sapiens
uauagaugugguaguguua

SEQ ID NO: 1484459 - RNA, 19 nt, Homo sapiens
gcuguccacugcugcuguu

SEQ ID NO: 1484460 - RNA, 19 nt, Homo sapiens
ugcacagucauacaaauua

SEQ ID NO: 1484461 - RNA, 19 nt, Homo sapiens
gagaauggcuucaguuaua

SEQ ID NO: 1484462 - RNA, 19 nt, Homo sapiens
guacugaacuggacaaaga

SEQ ID NO: 1484463 - RNA, 19 nt, Homo sapiens
gaaagcauuugcacuguuu

SEQ ID NO: 1484464 - RNA, 19 nt, Homo sapiens
caaauaggcugagaaauuc

SEQ ID NO: 1484465 - RNA, 19 nt, Homo sapiens
ccaaauaggcugagaaauu

SEQ ID NO: 1484466 - RNA, 19 nt, Homo sapiens
gaaauggaaucuacagugu

SEQ ID NO: 1484467 - RNA, 19 nt, Homo sapiens
acaaagaacugucugaaga

SEQ ID NO: 1484468 - RNA, 19 nt, Homo sapiens
gcuguagacuccuucuuua

SEQ ID NO: 1484469 - RNA, 19 nt, Homo sapiens
uaacaacucuggauuacau

SEQ ID NO: 1484470 - RNA, 19 nt, Homo sapiens
ggacaaggccugaagaugu

SEQ ID NO: 1484471 - RNA, 19 nt, Homo sapiens
gagagaauggcuucaguua

SEQ ID NO: 1484472 - RNA, 19 nt, Homo sapiens
guuuguagcucaaguugua

SEQ ID NO: 1484473 - RNA, 19 nt, Homo sapiens
ugaaaccaauccagaaauu

SEQ ID NO: 1484474 - RNA, 19 nt, Homo sapiens
gaagagagcauuuaaagcu

SEQ ID NO: 1484475 - RNA, 19 nt, Homo sapiens
gaucugacaggaauacaua

SEQ ID NO: 1484476 - RNA, 19 nt, Homo sapiens
guuuggagauguaaaguuu

SEQ ID NO: 1484477 - RNA, 19 nt, Homo sapiens
ugaaauccuucucucuuaa

SEQ ID NO: 1484478 - RNA, 19 nt, Homo sapiens
gcugagaaauucauagcaa

SEQ ID NO: 1484479 - RNA, 19 nt, Homo sapiens
acaaggagcucggguuuga

SEQ ID NO: 1484480 - RNA, 19 nt, Homo sapiens
caaccuaccagcaauguuu

SEQ ID NO: 1484481 - RNA, 19 nt, Homo sapiens
gaggaugacuggcacacuu

SEQ ID NO: 1484482 - RNA, 19 nt, Homo sapiens
gaccagccauuugcacaua

SEQ ID NO: 1484483 - RNA, 19 nt, Homo sapiens
gcacaaggagcucggguuu

SEQ ID NO: 1484484 - RNA, 19 nt, Homo sapiens
caacuugccucaugauguc

SEQ ID NO: 1484485 - RNA, 19 nt, Homo sapiens
gcaaagaaauccccaacuu

SEQ ID NO: 1484486 - RNA, 19 nt, Homo sapiens
gacaaggccugaagaugug

SEQ ID NO: 1484487 - RNA, 19 nt, Homo sapiens
gauucgagauuuacauaug

SEQ ID NO: 1484488 - RNA, 19 nt, Homo sapiens
caugagaucugacaggaau

SEQ ID NO: 1484489 - RNA, 19 nt, Homo sapiens
aaacugaucauccauauuc

SEQ ID NO: 1484490 - RNA, 19 nt, Homo sapiens
aauggaaucuacaguguuu

SEQ ID NO: 1484491 - RNA, 19 nt, Homo sapiens
cagaucaacuugccucaug

SEQ ID NO: 1484492 - RNA, 19 nt, Homo sapiens
uaacggauauagcuguaga

SEQ ID NO: 1484493 - RNA, 19 nt, Homo sapiens
gcacacuuguauaguaugu

SEQ ID NO: 1484494 - RNA, 19 nt, Homo sapiens
gaaauccuucucucuuaaa

SEQ ID NO: 1484495 - RNA, 19 nt, Homo sapiens
aaauguaggucuauaugga

SEQ ID NO: 1484496 - RNA, 19 nt, Homo sapiens
ugacaggaauacauauguu

SEQ ID NO: 1484497 - RNA, 19 nt, Homo sapiens
gguuguggcucaaauaaag

SEQ ID NO: 1484498 - RNA, 19 nt, Homo sapiens
ucagugaaauguaggucua

SEQ ID NO: 1484499 - RNA, 19 nt, Homo sapiens
augaaauccuucucucuua

SEQ ID NO: 1484500 - RNA, 19 nt, Homo sapiens
ucaggaauauugaaaugga

SEQ ID NO: 1484501 - RNA, 19 nt, Homo sapiens
ugaggaagcugaagaagac

SEQ ID NO: 1484502 - RNA, 19 nt, Homo sapiens
ugacuaaauugccuucuag

SEQ ID NO: 1484503 - RNA, 19 nt, Homo sapiens
gacagaaacugaucaucca

SEQ ID NO: 1484504 - RNA, 19 nt, Homo sapiens
gcaacggccucagcuccua

SEQ ID NO: 1484505 - RNA, 19 nt, Homo sapiens
guucaacuguagcaaagaa

SEQ ID NO: 1484506 - RNA, 19 nt, Homo sapiens
accagggacuguuguaaua

SEQ ID NO: 1484507 - RNA, 19 nt, Homo sapiens
gaugucaccauuauuagaa

SEQ ID NO: 1484508 - RNA, 19 nt, Homo sapiens
ggaugaagacauucucuau

SEQ ID NO: 1484509 - RNA, 19 nt, Homo sapiens
gugacuaaauugccuucua

SEQ ID NO: 1484510 - RNA, 19 nt, Homo sapiens
gaauauaacaacucuggau

SEQ ID NO: 1484511 - RNA, 19 nt, Homo sapiens
caaagaacugucugaagaa

SEQ ID NO: 1484512 - RNA, 19 nt, Homo sapiens
gaucgcaucuuggguucuu

SEQ ID NO: 1484513 - RNA, 19 nt, Homo sapiens
agaaacugaucauccauau

SEQ ID NO: 1484514 - RNA, 19 nt, Homo sapiens
ggaagcugaagaagacaua

SEQ ID NO: 1484515 - RNA, 19 nt, Homo sapiens
caauguguaccuaugauuu

SEQ ID NO: 1484516 - RNA, 19 nt, Homo sapiens
gaauuaagacuugaguuca

SEQ ID NO: 1484517 - RNA, 19 nt, Homo sapiens
gugcugcgaugucaccauu

SEQ ID NO: 1484518 - RNA, 19 nt, Homo sapiens
ccucaguaaugcaaagaaa

SEQ ID NO: 1484519 - RNA, 19 nt, Homo sapiens
uaaaacuccuggauuauga

SEQ ID NO: 1484520 - RNA, 19 nt, Homo sapiens
gcugcgaugucaccauuau

SEQ ID NO: 1484521 - RNA, 19 nt, Homo sapiens
ugaaagcauuugcacuguu

SEQ ID NO: 1484522 - RNA, 19 nt, Homo sapiens
aaagguuuguucacguuaa

SEQ ID NO: 1484523 - RNA, 19 nt, Homo sapiens
augaagacauucucuauca

SEQ ID NO: 1484524 - RNA, 19 nt, Homo sapiens
caucuuggguucuucucaa

SEQ ID NO: 1484525 - RNA, 19 nt, Homo sapiens
ggacccagaccaagaagug

SEQ ID NO: 1484526 - RNA, 19 nt, Homo sapiens
gaaacugaucauccauauu

SEQ ID NO: 1484527 - RNA, 19 nt, Homo sapiens
gugaacugaucgcaucuug

SEQ ID NO: 1484528 - RNA, 19 nt, Homo sapiens
caacuuccaccaugauugu

SEQ ID NO: 1484529 - RNA, 19 nt, Homo sapiens
ugucaggaauauugaaaug

SEQ ID NO: 1484530 - RNA, 19 nt, Homo sapiens
uuugauggaugaagacauu

SEQ ID NO: 1484531 - RNA, 19 nt, Homo sapiens
ggaauacauauguuggaaa

SEQ ID NO: 1484532 - RNA, 19 nt, Homo sapiens
cuuggguucuucucaauuu

SEQ ID NO: 1484533 - RNA, 19 nt, Homo sapiens
gaaauguaggucuauaugg

SEQ ID NO: 1484534 - RNA, 19 nt, Homo sapiens
cagaaacugaucauccaua

SEQ ID NO: 1484535 - RNA, 19 nt, Homo sapiens
gauuaugacauuuggaguu

SEQ ID NO: 1484536 - RNA, 19 nt, Homo sapiens
ccaccaugauuguaagugu

SEQ ID NO: 1484537 - RNA, 19 nt, Homo sapiens
aauaacggauauagcugua

SEQ ID NO: 1484538 - RNA, 19 nt, Homo sapiens
uauaacaacucuggauuac

SEQ ID NO: 1484539 - RNA, 19 nt, Homo sapiens
gcaaguuuguagcucaagu

SEQ ID NO: 1484540 - RNA, 19 nt, Homo sapiens
cuacaguguuugcagcuau

SEQ ID NO: 1484541 - RNA, 19 nt, Homo sapiens
uccaauagguccaugagau

SEQ ID NO: 1484542 - RNA, 19 nt, Homo sapiens
gcuggugucaggaauauug

SEQ ID NO: 1484543 - RNA, 19 nt, Homo sapiens
cuggcacacuuguauagua

SEQ ID NO: 1484544 - RNA, 19 nt, Homo sapiens
ugaauuaagacuugaguuc

SEQ ID NO: 1484545 - RNA, 19 nt, Homo sapiens
gucaggcacuucuagguau

SEQ ID NO: 1484546 - RNA, 19 nt, Homo sapiens
aaaccaauccagaaauuca

SEQ ID NO: 1484547 - RNA, 19 nt, Homo sapiens
agaacugucugaagaacug

SEQ ID NO: 1484548 - RNA, 19 nt, Homo sapiens
ugcgaugucaccauuauua

SEQ ID NO: 1484549 - RNA, 19 nt, Homo sapiens
uggcacacuuguauaguau

SEQ ID NO: 1484550 - RNA, 19 nt, Homo sapiens
gaaaccaauccagaaauuc

SEQ ID NO: 1484551 - RNA, 19 nt, Homo sapiens
gcaccagggacuguuguaa

SEQ ID NO: 1484552 - RNA, 19 nt, Homo sapiens
ccauuucuauuaugcuuca

SEQ ID NO: 1484553 - RNA, 19 nt, Homo sapiens
ucacuuggauuugggaaca

SEQ ID NO: 1484554 - RNA, 19 nt, Homo sapiens
ugaaauguaggucuauaug

SEQ ID NO: 1484555 - RNA, 19 nt, Homo sapiens
gacaagugacagaaacuga

SEQ ID NO: 1484556 - RNA, 19 nt, Homo sapiens
uagcucaaguuguaaugug

SEQ ID NO: 1484557 - RNA, 19 nt, Homo sapiens
gaacuggacaaagaacugu

SEQ ID NO: 1484558 - RNA, 19 nt, Homo sapiens
gaagacauucucuaucacu

SEQ ID NO: 1484559 - RNA, 19 nt, Homo sapiens
uaugacauuuggaguuuca

SEQ ID NO: 1484560 - RNA, 19 nt, Homo sapiens
uaaagcuggugucaggaau

SEQ ID NO: 1484561 - RNA, 19 nt, Homo sapiens
ggaaacguuuggaagcuuu

SEQ ID NO: 1484562 - RNA, 19 nt, Homo sapiens
aggaauguuugcugaauua

SEQ ID NO: 1484563 - RNA, 19 nt, Homo sapiens
caaggaauguuugcugaau

SEQ ID NO: 1484564 - RNA, 19 nt, Homo sapiens
gagcuucaauucgcaggaa

SEQ ID NO: 1484565 - RNA, 19 nt, Homo sapiens
ugagagaaccauagaacaa

SEQ ID NO: 1484566 - RNA, 19 nt, Homo sapiens
uagaagccguggagucaga

SEQ ID NO: 1484567 - RNA, 19 nt, Homo sapiens
auacagacaaggaauguuu

SEQ ID NO: 1484568 - RNA, 19 nt, Homo sapiens
ccggcuaccuucaggaauu

SEQ ID NO: 1484569 - RNA, 19 nt, Homo sapiens
gagaccaugucaggaaaga

SEQ ID NO: 1484570 - RNA, 19 nt, Homo sapiens
cacccgaccuccaucuuug

SEQ ID NO: 1484571 - RNA, 19 nt, Homo sapiens
ccacugagagaaccauaga

SEQ ID NO: 1484572 - RNA, 19 nt, Homo sapiens
ggaguuuucuuauccaguu

SEQ ID NO: 1484573 - RNA, 19 nt, Homo sapiens
uuagacuucucccuccuuu

SEQ ID NO: 1484574 - RNA, 19 nt, Homo sapiens
aaggaauguuugcugaauu

SEQ ID NO: 1484575 - RNA, 19 nt, Homo sapiens
cuucagcccucaacagcuu

SEQ ID NO: 1484576 - RNA, 19 nt, Homo sapiens
gcccacagagcuucaauuc

SEQ ID NO: 1484577 - RNA, 19 nt, Homo sapiens
gcugcucggucccugcaaa

SEQ ID NO: 1484578 - RNA, 19 nt, Homo sapiens
ccacccgaccuccaucuuu

SEQ ID NO: 1484579 - RNA, 19 nt, Homo sapiens
aaugcgagcucaggccuuu

SEQ ID NO: 1484580 - RNA, 19 nt, Homo sapiens
cuucaggaauucuuugcuu

SEQ ID NO: 1484581 - RNA, 19 nt, Homo sapiens
gcauacagacaaggaaugu

SEQ ID NO: 1484582 - RNA, 19 nt, Homo sapiens
gagagaaccauagaacaag

SEQ ID NO: 1484583 - RNA, 19 nt, Homo sapiens
gaccaugucaggaaagaag

SEQ ID NO: 1484584 - RNA, 19 nt, Homo sapiens
uggagaccaugucaggaaa

SEQ ID NO: 1484585 - RNA, 19 nt, Homo sapiens
cuggaggccuggaaacguu

SEQ ID NO: 1484586 - RNA, 19 nt, Homo sapiens
ggaauguuugcugaauuaa

SEQ ID NO: 1484587 - RNA, 19 nt, Homo sapiens
ucccgucacuccuaggaaa

SEQ ID NO: 1484588 - RNA, 19 nt, Homo sapiens
ucaggaauucuuugcuuug

SEQ ID NO: 1484589 - RNA, 19 nt, Homo sapiens
ccuagaagccguggaguca

SEQ ID NO: 1484590 - RNA, 19 nt, Homo sapiens
aagcuuugcuaaccuugga

SEQ ID NO: 1484591 - RNA, 19 nt, Homo sapiens
gccuaagccuccauuucug

SEQ ID NO: 1484592 - RNA, 19 nt, Homo sapiens
uucaggaauucuuugcuuu

SEQ ID NO: 1484593 - RNA, 19 nt, Homo sapiens
uacaguuugucccagguuu

SEQ ID NO: 1484594 - RNA, 19 nt, Homo sapiens
ccuaagccuccauuucuga

SEQ ID NO: 1484595 - RNA, 19 nt, Homo sapiens
cacccuggcuucuucuagu

SEQ ID NO: 1484596 - RNA, 19 nt, Homo sapiens
gagaaccauagaacaagga

SEQ ID NO: 1484597 - RNA, 19 nt, Homo sapiens
gcgccuccauacaguuugu

SEQ ID NO: 1484598 - RNA, 19 nt, Homo sapiens
caacagcuucgcacaacca

SEQ ID NO: 1484599 - RNA, 19 nt, Homo sapiens
uggaagcuuugcuaaccuu

SEQ ID NO: 1484600 - RNA, 19 nt, Homo sapiens
uggcauggcauacagacaa

SEQ ID NO: 1484601 - RNA, 19 nt, Homo sapiens
ggugggaccuagguuuuaa

SEQ ID NO: 1484602 - RNA, 19 nt, Homo sapiens
gcacaaccaaccccuagaa

SEQ ID NO: 1484603 - RNA, 19 nt, Homo sapiens
ggaccgcaaagcccacaga

SEQ ID NO: 1484604 - RNA, 19 nt, Homo sapiens
caggaauucuuugcuuugg

SEQ ID NO: 1484605 - RNA, 19 nt, Homo sapiens
gaaacguuuggaagcuuug

SEQ ID NO: 1484606 - RNA, 19 nt, Homo sapiens
cagccuaagccuccauuuc

SEQ ID NO: 1484607 - RNA, 19 nt, Homo sapiens
cgccuucgcuguacucacu

SEQ ID NO: 1484608 - RNA, 19 nt, Homo sapiens
ccgcaagucuggaguuuuc

SEQ ID NO: 1484609 - RNA, 19 nt, Homo sapiens
guacuugcugaauccugua

SEQ ID NO: 1484610 - RNA, 19 nt, Homo sapiens
ccucggcacauuaaucuuc

SEQ ID NO: 1484611 - RNA, 19 nt, Homo sapiens
uggaaacguuuggaagcuu

SEQ ID NO: 1484612 - RNA, 19 nt, Homo sapiens
aagccuccauuucugacaa

SEQ ID NO: 1484613 - RNA, 19 nt, Homo sapiens
ggcauggcauacagacaag

SEQ ID NO: 1484614 - RNA, 19 nt, Homo sapiens
ugcuuuggcuucugucugu

SEQ ID NO: 1484615 - RNA, 19 nt, Homo sapiens
cagggugggaccuagguuu

SEQ ID NO: 1484616 - RNA, 19 nt, Homo sapiens
gcagagaacuuaaccauug

SEQ ID NO: 1484617 - RNA, 19 nt, Homo sapiens
gcaccaauaucucuuauga

SEQ ID NO: 1484618 - RNA, 19 nt, Homo sapiens
uagcaaagcuggacuauuc

SEQ ID NO: 1484619 - RNA, 19 nt, Homo sapiens
caugggaaauggugaauua

SEQ ID NO: 1484620 - RNA, 19 nt, Homo sapiens
ugccaaagcuucuguauuu

SEQ ID NO: 1484621 - RNA, 19 nt, Homo sapiens
ggagucauccaacauauua

SEQ ID NO: 1484622 - RNA, 19 nt, Homo sapiens
gaacagaguccuccugcua

SEQ ID NO: 1484623 - RNA, 19 nt, Homo sapiens
gaaagaagguguggugcaa

SEQ ID NO: 1484624 - RNA, 19 nt, Homo sapiens
ggacaggccuucuagcaau

SEQ ID NO: 1484625 - RNA, 19 nt, Homo sapiens
guacguuucugccugguua

SEQ ID NO: 1484626 - RNA, 19 nt, Homo sapiens
gaagaacaguaucuacaga

SEQ ID NO: 1484627 - RNA, 19 nt, Homo sapiens
gaagaagucggcauuugua

SEQ ID NO: 1484628 - RNA, 19 nt, Homo sapiens
ccaaaggacuaggaaauuu

SEQ ID NO: 1484629 - RNA, 19 nt, Homo sapiens
caacauggaaguagaaauu

SEQ ID NO: 1484630 - RNA, 19 nt, Homo sapiens
gaagucggcauuuguagua

SEQ ID NO: 1484631 - RNA, 19 nt, Homo sapiens
gaauaucuccaguacauuu

SEQ ID NO: 1484632 - RNA, 19 nt, Homo sapiens
ucaguugucucuucuguaa

SEQ ID NO: 1484633 - RNA, 19 nt, Homo sapiens
auaaacagcuuccucauau

SEQ ID NO: 1484634 - RNA, 19 nt, Homo sapiens
gagcaagacucuaucucaa

SEQ ID NO: 1484635 - RNA, 19 nt, Homo sapiens
cagaauaucuccaguacau

SEQ ID NO: 1484636 - RNA, 19 nt, Homo sapiens
ggauuuaauuccacuaaug

SEQ ID NO: 1484637 - RNA, 19 nt, Homo sapiens
gaauuacacugcccaucaa

SEQ ID NO: 1484638 - RNA, 19 nt, Homo sapiens
ggaaugaugauauggaauu

SEQ ID NO: 1484639 - RNA, 19 nt, Homo sapiens
gaaagguaccuguauaugu

SEQ ID NO: 1484640 - RNA, 19 nt, Homo sapiens
gcaaagacuucugcuggaa

SEQ ID NO: 1484641 - RNA, 19 nt, Homo sapiens
gcuggacuauucccuauuu

SEQ ID NO: 1484642 - RNA, 19 nt, Homo sapiens
gaaccagacugcccaagca

SEQ ID NO: 1484643 - RNA, 19 nt, Homo sapiens
uuacugaccuuucccacua

SEQ ID NO: 1484644 - RNA, 19 nt, Homo sapiens
ggugaaccauacaaguuua

SEQ ID NO: 1484645 - RNA, 19 nt, Homo sapiens
gauagucgauuuagcaaag

SEQ ID NO: 1484646 - RNA, 19 nt, Homo sapiens
ucgcuaaucuuuacaguug

SEQ ID NO: 1484647 - RNA, 19 nt, Homo sapiens
gauuugcacuuccagcuuu

SEQ ID NO: 1484648 - RNA, 19 nt, Homo sapiens
caacacaauucaacaugga

SEQ ID NO: 1484649 - RNA, 19 nt, Homo sapiens
ggucaacuguacuauaaau

SEQ ID NO: 1484650 - RNA, 19 nt, Homo sapiens
ggagaacccuacauggaau

SEQ ID NO: 1484651 - RNA, 19 nt, Homo sapiens
caauagagccaauagcaaa

SEQ ID NO: 1484652 - RNA, 19 nt, Homo sapiens
guacuguccuagauguuaa

SEQ ID NO: 1484653 - RNA, 19 nt, Homo sapiens
gcagagaaaugguggaacu

SEQ ID NO: 1484654 - RNA, 19 nt, Homo sapiens
cgaauaugccaacauuaua

SEQ ID NO: 1484655 - RNA, 19 nt, Homo sapiens
caacugacccgacaugugu

SEQ ID NO: 1484656 - RNA, 19 nt, Homo sapiens
uuacagaacccaauaguau

SEQ ID NO: 1484657 - RNA, 19 nt, Homo sapiens
gcaggagaaucgcuugaau

SEQ ID NO: 1484658 - RNA, 19 nt, Homo sapiens
cuggugagcuggcuaauug

SEQ ID NO: 1484659 - RNA, 19 nt, Homo sapiens
uaacuuuggucagggauuu

SEQ ID NO: 1484660 - RNA, 19 nt, Homo sapiens
agaaggagcuaaagagauc

SEQ ID NO: 1484661 - RNA, 19 nt, Homo sapiens
auaggaagcugacuuagga

SEQ ID NO: 1484662 - RNA, 19 nt, Homo sapiens
ggucagggauuuauuucau

SEQ ID NO: 1484663 - RNA, 19 nt, Homo sapiens
auacgaauaugccaacauu

SEQ ID NO: 1484664 - RNA, 19 nt, Homo sapiens
ccaagagccuggaagacuu

SEQ ID NO: 1484665 - RNA, 19 nt, Homo sapiens
cgacauguguugcuguguu

SEQ ID NO: 1484666 - RNA, 19 nt, Homo sapiens
ggaagaagaacaguaucua

SEQ ID NO: 1484667 - RNA, 19 nt, Homo sapiens
guaaaugaaccagaacuuu

SEQ ID NO: 1484668 - RNA, 19 nt, Homo sapiens
gaucuggucucuggcuauu

SEQ ID NO: 1484669 - RNA, 19 nt, Homo sapiens
gggauacccuauaguugaa

SEQ ID NO: 1484670 - RNA, 19 nt, Homo sapiens
gguguaguauuugcauaua

SEQ ID NO: 1484671 - RNA, 19 nt, Homo sapiens
gaaacauugucaaagaaag

SEQ ID NO: 1484672 - RNA, 19 nt, Homo sapiens
gcaggaggcuaugaagguu

SEQ ID NO: 1484673 - RNA, 19 nt, Homo sapiens
aaagguaccuguauauguc

SEQ ID NO: 1484674 - RNA, 19 nt, Homo sapiens
cgaagcagguacuguccua

SEQ ID NO: 1484675 - RNA, 19 nt, Homo sapiens
caaacuacauacccagaau

SEQ ID NO: 1484676 - RNA, 19 nt, Homo sapiens
gcaguaacgcauggauuua

SEQ ID NO: 1484677 - RNA, 19 nt, Homo sapiens
gcaagacucuaucucaaaa

SEQ ID NO: 1484678 - RNA, 19 nt, Homo sapiens
aagaagacuugaauuccua

SEQ ID NO: 1484679 - RNA, 19 nt, Homo sapiens
gacauguguugcuguguuu

SEQ ID NO: 1484680 - RNA, 19 nt, Homo sapiens
ucccagagcugcauauuag

SEQ ID NO: 1484681 - RNA, 19 nt, Homo sapiens
gcauaucccucaugugcau

SEQ ID NO: 1484682 - RNA, 19 nt, Homo sapiens
gagaaaugguggaacucuu

SEQ ID NO: 1484683 - RNA, 19 nt, Homo sapiens
gcauugggauacccuauag

SEQ ID NO: 1484684 - RNA, 19 nt, Homo sapiens
cuaaagagaucugguugga

SEQ ID NO: 1484685 - RNA, 19 nt, Homo sapiens
agggucaacuguacuauaa

SEQ ID NO: 1484686 - RNA, 19 nt, Homo sapiens
acucaagucccuuauauaa

SEQ ID NO: 1484687 - RNA, 19 nt, Homo sapiens
cgagagaggguacaaauuc

SEQ ID NO: 1484688 - RNA, 19 nt, Homo sapiens
uauaaacagcuuccucaua

SEQ ID NO: 1484689 - RNA, 19 nt, Homo sapiens
gggagaacccuacauggaa

SEQ ID NO: 1484690 - RNA, 19 nt, Homo sapiens
ccuaagaccuaaauuaugc

SEQ ID NO: 1484691 - RNA, 19 nt, Homo sapiens
cauauuagcccaggaagaa

SEQ ID NO: 1484692 - RNA, 19 nt, Homo sapiens
ccucauaugcuuacaacua

SEQ ID NO: 1484693 - RNA, 19 nt, Homo sapiens
caucacagcuaaacuucug

SEQ ID NO: 1484694 - RNA, 19 nt, Homo sapiens
accaauaucucuuaugaug

SEQ ID NO: 1484695 - RNA, 19 nt, Homo sapiens
uccaacauauuaccaauga

SEQ ID NO: 1484696 - RNA, 19 nt, Homo sapiens
ggacacaacauugagcaaa

SEQ ID NO: 1484697 - RNA, 19 nt, Homo sapiens
cauaugccauccagaaugu

SEQ ID NO: 1484698 - RNA, 19 nt, Homo sapiens
gcacuuccagcuuuauuau

SEQ ID NO: 1484699 - RNA, 19 nt, Homo sapiens
gaaauuuugucuccagauu

SEQ ID NO: 1484700 - RNA, 19 nt, Homo sapiens
caauaaagacacagcagaa

SEQ ID NO: 1484701 - RNA, 19 nt, Homo sapiens
cccuauaguugaagcuuua

SEQ ID NO: 1484702 - RNA, 19 nt, Homo sapiens
gacugguccuuccuauaua

SEQ ID NO: 1484703 - RNA, 19 nt, Homo sapiens
auacucaagucccuuauau

SEQ ID NO: 1484704 - RNA, 19 nt, Homo sapiens
ccgaaacauugucaaagaa

SEQ ID NO: 1484705 - RNA, 19 nt, Homo sapiens
gcuaaucuuuacaguuguu

SEQ ID NO: 1484706 - RNA, 19 nt, Homo sapiens
ucauuggccuguucgcuaa

SEQ ID NO: 1484707 - RNA, 19 nt, Homo sapiens
gggaauuccugcucuccuu

SEQ ID NO: 1484708 - RNA, 19 nt, Homo sapiens
guacuaauucuucucauca

SEQ ID NO: 1484709 - RNA, 19 nt, Homo sapiens
gaucgaaagguaccuguau

SEQ ID NO: 1484710 - RNA, 19 nt, Homo sapiens
caacaggaaagauauaaag

SEQ ID NO: 1484711 - RNA, 19 nt, Homo sapiens
uaauuuaccugcagagaac

SEQ ID NO: 1484712 - RNA, 19 nt, Homo sapiens
gaacugaaugugcaaaguc

SEQ ID NO: 1484713 - RNA, 19 nt, Homo sapiens
ucaauaugaccaagacuuu

SEQ ID NO: 1484714 - RNA, 19 nt, Homo sapiens
gagccucaguugucucuuc

SEQ ID NO: 1484715 - RNA, 19 nt, Homo sapiens
gacaggccuucuagcaauu

SEQ ID NO: 1484716 - RNA, 19 nt, Homo sapiens
ggacacagcagcuuucuuu

SEQ ID NO: 1484717 - RNA, 19 nt, Homo sapiens
gaaauaaauguggcucuua

SEQ ID NO: 1484718 - RNA, 19 nt, Homo sapiens
ccugggagcugccuaaauu

SEQ ID NO: 1484719 - RNA, 19 nt, Homo sapiens
uugaggcucuguccaauua

SEQ ID NO: 1484720 - RNA, 19 nt, Homo sapiens
gcaaggagaggaugcagaa

SEQ ID NO: 1484721 - RNA, 19 nt, Homo sapiens
ccucagaugguuucauuua

SEQ ID NO: 1484722 - RNA, 19 nt, Homo sapiens
caugcuggcugcagucuuu

SEQ ID NO: 1484723 - RNA, 19 nt, Homo sapiens
gagaagaugccaauguuuc

SEQ ID NO: 1484724 - RNA, 19 nt, Homo sapiens
ggagcugccuaaauucaga

SEQ ID NO: 1484725 - RNA, 19 nt, Homo sapiens
cacagcagcuuucuuugga

SEQ ID NO: 1484726 - RNA, 19 nt, Homo sapiens
cugagaagaugccaauguu

SEQ ID NO: 1484727 - RNA, 19 nt, Homo sapiens
cacguuagcugccuuccuu

SEQ ID NO: 1484728 - RNA, 19 nt, Homo sapiens
gcccuaggcuccuguacug

SEQ ID NO: 1484729 - RNA, 19 nt, Homo sapiens
aaauguggcucuuacucaa

SEQ ID NO: 1484730 - RNA, 19 nt, Homo sapiens
gucccuggcuuguacauau

SEQ ID NO: 1484731 - RNA, 19 nt, Homo sapiens
gaaagccgucucccucaga

SEQ ID NO: 1484732 - RNA, 19 nt, Homo sapiens
aaauaaauguggcucuuac

SEQ ID NO: 1484733 - RNA, 19 nt, Homo sapiens
agaaauaaauguggcucuu

SEQ ID NO: 1484734 - RNA, 19 nt, Homo sapiens
uaaauguggcucuuacuca

SEQ ID NO: 1484735 - RNA, 19 nt, Homo sapiens
ccaccuagggaccacguua

SEQ ID NO: 1484736 - RNA, 19 nt, Homo sapiens
ucccucagaugguuucauu

SEQ ID NO: 1484737 - RNA, 19 nt, Homo sapiens
ggacaccuggcuucuugaa

SEQ ID NO: 1484738 - RNA, 19 nt, Homo sapiens
ccaggucgcaggugucuga

SEQ ID NO: 1484739 - RNA, 19 nt, Homo sapiens
ugggaaggcucuggcauga

SEQ ID NO: 1484740 - RNA, 19 nt, Homo sapiens
ggacugugggcucgccuuu

SEQ ID NO: 1484741 - RNA, 19 nt, Homo sapiens
gcugagaagaugccaaugu

SEQ ID NO: 1484742 - RNA, 19 nt, Homo sapiens
ggagucgguuuccacaucu

SEQ ID NO: 1484743 - RNA, 19 nt, Homo sapiens
ucagccaggugccguguug

SEQ ID NO: 1484744 - RNA, 19 nt, Homo sapiens
gaccagcacuugggaucug

SEQ ID NO: 1484745 - RNA, 19 nt, Homo sapiens
cucagaugguuucauuuaa

SEQ ID NO: 1484746 - RNA, 19 nt, Homo sapiens
gcugaugucacagguguuu

SEQ ID NO: 1484747 - RNA, 19 nt, Homo sapiens
gcuuguacauaugugauug

SEQ ID NO: 1484748 - RNA, 19 nt, Homo sapiens
acaccuggcuucuugaaaa

SEQ ID NO: 1484749 - RNA, 19 nt, Homo sapiens
gaggcucuguccaauuaag

SEQ ID NO: 1484750 - RNA, 19 nt, Homo sapiens
ggcaugagguuuuccuuug

SEQ ID NO: 1484751 - RNA, 19 nt, Homo sapiens
ugagaagaugccaauguuu

SEQ ID NO: 1484752 - RNA, 19 nt, Homo sapiens
gcaggacacgcuggucuga

SEQ ID NO: 1484753 - RNA, 19 nt, Homo sapiens
ggagucaucgcugagaaga

SEQ ID NO: 1484754 - RNA, 19 nt, Homo sapiens
cagccauccuccaccagaa

SEQ ID NO: 1484755 - RNA, 19 nt, Homo sapiens
aggacacgcuggucugaga

SEQ ID NO: 1484756 - RNA, 19 nt, Homo sapiens
ggccugugcuuccuguagu

SEQ ID NO: 1484757 - RNA, 19 nt, Homo sapiens
gccaggacccagaaacuca

SEQ ID NO: 1484758 - RNA, 19 nt, Homo sapiens
gcucuguccaauuaagaaa

SEQ ID NO: 1484759 - RNA, 19 nt, Homo sapiens
ugagacagaucuggaaagc

SEQ ID NO: 1484760 - RNA, 19 nt, Homo sapiens
ggugagacagaucuggaaa

SEQ ID NO: 1484761 - RNA, 19 nt, Homo sapiens
cgccugucccgaugucuua

SEQ ID NO: 1484762 - RNA, 19 nt, Homo sapiens
gaagaugccaauguuucau

SEQ ID NO: 1484763 - RNA, 19 nt, Homo sapiens
agaagaugccaauguuuca

SEQ ID NO: 1484764 - RNA, 19 nt, Homo sapiens
ggaggcaguggaccaagau

SEQ ID NO: 1484765 - RNA, 19 nt, Homo sapiens
uggaggcaguggaccaaga

SEQ ID NO: 1484766 - RNA, 19 nt, Homo sapiens
cugcugcacugguccuaug

SEQ ID NO: 1484767 - RNA, 19 nt, Homo sapiens
ggcugcugcuuccugcuaa

SEQ ID NO: 1484768 - RNA, 19 nt, Homo sapiens
ggcucuuacucaacacaaa

SEQ ID NO: 1484769 - RNA, 19 nt, Homo sapiens
aggagucgguuuccacauc

SEQ ID NO: 1484770 - RNA, 19 nt, Homo sapiens
ggagacugccuggcugugu

SEQ ID NO: 1484771 - RNA, 19 nt, Homo sapiens
gcuuuauacugccgagucu

SEQ ID NO: 1484772 - RNA, 19 nt, Homo sapiens
acacagcagcuuucuuugg

SEQ ID NO: 1484773 - RNA, 19 nt, Homo sapiens
cacaggacacagcagcuuu

SEQ ID NO: 1484774 - RNA, 19 nt, Homo sapiens
aaagccgucucccucagau

SEQ ID NO: 1484775 - RNA, 19 nt, Homo sapiens
acacgcuggucugagauga

SEQ ID NO: 1484776 - RNA, 19 nt, Homo sapiens
acagcagcuuucuuuggaa

SEQ ID NO: 1484777 - RNA, 19 nt, Homo sapiens
gaaauuagccggaaagugu

SEQ ID NO: 1484778 - RNA, 19 nt, Homo sapiens
gaacgaaucucuaaaacuu

SEQ ID NO: 1484779 - RNA, 19 nt, Homo sapiens
gagccgagauugcaccauu

SEQ ID NO: 1484780 - RNA, 19 nt, Homo sapiens
gcagguccauuauaauuca

SEQ ID NO: 1484781 - RNA, 19 nt, Homo sapiens
uuucaucgcucuugcauuu

SEQ ID NO: 1484782 - RNA, 19 nt, Homo sapiens
uguagcagguccauuauaa

SEQ ID NO: 1484783 - RNA, 19 nt, Homo sapiens
ccauguagcagguccauua

SEQ ID NO: 1484784 - RNA, 19 nt, Homo sapiens
gcaagaaccaggaguuguu

SEQ ID NO: 1484785 - RNA, 19 nt, Homo sapiens
agucugaaaugauuccuua

SEQ ID NO: 1484786 - RNA, 19 nt, Homo sapiens
ucagaaggcuggugacauc

SEQ ID NO: 1484787 - RNA, 19 nt, Homo sapiens
uuaauggucuugacaugaa

SEQ ID NO: 1484788 - RNA, 19 nt, Homo sapiens
ggugacaucuguugaagca

SEQ ID NO: 1484789 - RNA, 19 nt, Homo sapiens
gaaggaguacgagaucuuu

SEQ ID NO: 1484790 - RNA, 19 nt, Homo sapiens
gaacuccugggcucaauga

SEQ ID NO: 1484791 - RNA, 19 nt, Homo sapiens
gaaggcuggugacaucugu

SEQ ID NO: 1484792 - RNA, 19 nt, Homo sapiens
uagcagguccauuauaauu

SEQ ID NO: 1484793 - RNA, 19 nt, Homo sapiens
cuucgagucugaaaugauu

SEQ ID NO: 1484794 - RNA, 19 nt, Homo sapiens
gagcgagacuccguaucaa

SEQ ID NO: 1484795 - RNA, 19 nt, Homo sapiens
ccuguaaucccaacacuuu

SEQ ID NO: 1484796 - RNA, 19 nt, Homo sapiens
uuaagugggucuccaaagu

SEQ ID NO: 1484797 - RNA, 19 nt, Homo sapiens
ggaaggaguacgagaucuu

SEQ ID NO: 1484798 - RNA, 19 nt, Homo sapiens
gaagaaauuagccggaaag

SEQ ID NO: 1484799 - RNA, 19 nt, Homo sapiens
gaaaccccgucucuacuaa

SEQ ID NO: 1484800 - RNA, 19 nt, Homo sapiens
ggucaggaguucgagauca

SEQ ID NO: 1484801 - RNA, 19 nt, Homo sapiens
gaaauaaauaccucagacu

SEQ ID NO: 1484802 - RNA, 19 nt, Homo sapiens
gguccccgcuuuucuauuu

SEQ ID NO: 1484803 - RNA, 19 nt, Homo sapiens
gaaacugcccauuuuaauu

SEQ ID NO: 1484804 - RNA, 19 nt, Homo sapiens
guagucaaauuucccuagu

SEQ ID NO: 1484805 - RNA, 19 nt, Homo sapiens
agaagaaauuagccggaaa

SEQ ID NO: 1484806 - RNA, 19 nt, Homo sapiens
ugaggcaccuagaagaaau

SEQ ID NO: 1484807 - RNA, 19 nt, Homo sapiens
gaucucaccaugguugaaa

SEQ ID NO: 1484808 - RNA, 19 nt, Homo sapiens
aagugucgguuucuuugua

SEQ ID NO: 1484809 - RNA, 19 nt, Homo sapiens
gggcucaagugucgguuuc

SEQ ID NO: 1484810 - RNA, 19 nt, Homo sapiens
gcagugagccgagauugca

SEQ ID NO: 1484811 - RNA, 19 nt, Homo sapiens
gcucaagugucgguuucuu

SEQ ID NO: 1484812 - RNA, 19 nt, Homo sapiens
ugucguuuguguacucuuu

SEQ ID NO: 1484813 - RNA, 19 nt, Homo sapiens
cagcaaacucuuccuagga

SEQ ID NO: 1484814 - RNA, 19 nt, Homo sapiens
uccuaaaguucugggauua

SEQ ID NO: 1484815 - RNA, 19 nt, Homo sapiens
caaauuucccuaguccauu

SEQ ID NO: 1484816 - RNA, 19 nt, Homo sapiens
ucaagugucgguuucuuug

SEQ ID NO: 1484817 - RNA, 19 nt, Homo sapiens
ugaagcaacucagcaaacu

SEQ ID NO: 1484818 - RNA, 19 nt, Homo sapiens
cggcggaaacugcccauuu

SEQ ID NO: 1484819 - RNA, 19 nt, Homo sapiens
cuaaaguucugggauuaca

SEQ ID NO: 1484820 - RNA, 19 nt, Homo sapiens
ggcggaaacugcccauuuu

SEQ ID NO: 1484821 - RNA, 19 nt, Homo sapiens
guuguugugucguuugugu

SEQ ID NO: 1484822 - RNA, 19 nt, Homo sapiens
ggucguuguugugucguuu

SEQ ID NO: 1484823 - RNA, 19 nt, Homo sapiens
gagaucagccuggccaaca

SEQ ID NO: 1484824 - RNA, 19 nt, Homo sapiens
ggucuugacaugaaaauuu

SEQ ID NO: 1484825 - RNA, 19 nt, Homo sapiens
uaauggucuugacaugaaa

SEQ ID NO: 1484826 - RNA, 19 nt, Homo sapiens
ucccuaguccauuugauua

SEQ ID NO: 1484827 - RNA, 19 nt, Homo sapiens
gggagacccuugggaagca

SEQ ID NO: 1484828 - RNA, 19 nt, Homo sapiens
gcaacucagcaaacucuuc

SEQ ID NO: 1484829 - RNA, 19 nt, Homo sapiens
gggccgaacugcagguaac

SEQ ID NO: 1484830 - RNA, 19 nt, Homo sapiens
ucaucgcucuugcauuuua

SEQ ID NO: 1484831 - RNA, 19 nt, Homo sapiens
gcaccuagaagaaauuagc

SEQ ID NO: 1484832 - RNA, 19 nt, Homo sapiens
caagaaccaggaguuguug

SEQ ID NO: 1484833 - RNA, 19 nt, Homo sapiens
uaagugggucuccaaagug

SEQ ID NO: 1484834 - RNA, 19 nt, Homo sapiens
cuccuaaaguucugggauu

SEQ ID NO: 1484835 - RNA, 19 nt, Homo sapiens
gaggccauauucucuucga

SEQ ID NO: 1484836 - RNA, 19 nt, Homo sapiens
ggaaacugcccauuuuaau

SEQ ID NO: 1484837 - RNA, 19 nt, Homo sapiens
ccuaguccauuugauuaau

SEQ ID NO: 1484838 - RNA, 19 nt, Homo sapiens
cucuagauguagucaaauu

SEQ ID NO: 1484839 - RNA, 19 nt, Homo sapiens
gcuggugacaucuguugaa

SEQ ID NO: 1484840 - RNA, 19 nt, Homo sapiens
ucugugaacgaaucucuaa

SEQ ID NO: 1484841 - RNA, 19 nt, Homo sapiens
agagcgagacuccguauca

SEQ ID NO: 1484842 - RNA, 19 nt, Homo sapiens
gaucagccuggccaacaug

SEQ ID NO: 1484843 - RNA, 19 nt, Homo sapiens
uaaaguuucaucgcucuug

SEQ ID NO: 1484844 - RNA, 19 nt, Homo sapiens
agugucgguuucuuuguaa

SEQ ID NO: 1484845 - RNA, 19 nt, Homo sapiens
ucaaauuucccuaguccau

SEQ ID NO: 1484846 - RNA, 19 nt, Homo sapiens
cuagauguagucaaauuuc

SEQ ID NO: 1484847 - RNA, 19 nt, Homo sapiens
gccucggccuccuaaaguu

SEQ ID NO: 1484848 - RNA, 19 nt, Homo sapiens
uuacugugggagagacuua

SEQ ID NO: 1484849 - RNA, 19 nt, Homo sapiens
cagcaagaaccaggaguug

SEQ ID NO: 1484850 - RNA, 19 nt, Homo sapiens
uaauuugagaggccauauu

SEQ ID NO: 1484851 - RNA, 19 nt, Homo sapiens
agagguugcuuuucuguga

SEQ ID NO: 1484852 - RNA, 19 nt, Homo sapiens
guagcagguccauuauaau

SEQ ID NO: 1484853 - RNA, 19 nt, Homo sapiens
ugaaaaccuucucuagaug

SEQ ID NO: 1484854 - RNA, 19 nt, Homo sapiens
uugaaaaccuucucuagau

SEQ ID NO: 1484855 - RNA, 19 nt, Homo sapiens
ucaggaaggaguacgagau

SEQ ID NO: 1484856 - RNA, 19 nt, Homo sapiens
gcgagacuccguaucaaaa

SEQ ID NO: 1484857 - RNA, 19 nt, Homo sapiens
ucagcaagaaccaggaguu

SEQ ID NO: 1484858 - RNA, 19 nt, Homo sapiens
ucucuucgagucugaaaug

SEQ ID NO: 1484859 - RNA, 19 nt, Homo sapiens
gaaaaccuucucuagaugu

SEQ ID NO: 1484860 - RNA, 19 nt, Homo sapiens
uaguauaaagcaagagguu

SEQ ID NO: 1484861 - RNA, 19 nt, Homo sapiens
gaggucaggaguucgagau

SEQ ID NO: 1484862 - RNA, 19 nt, Homo sapiens
gaggcaccuagaagaaauu

SEQ ID NO: 1484863 - RNA, 19 nt, Homo sapiens
cauugaggcaccuagaaga

SEQ ID NO: 1484864 - RNA, 19 nt, Homo sapiens
gcuuuucuauuucugguuu

SEQ ID NO: 1484865 - RNA, 19 nt, Homo sapiens
gugaaauaaauaccucaga

SEQ ID NO: 1484866 - RNA, 19 nt, Homo sapiens
agaguucccggagucguua

SEQ ID NO: 1484867 - RNA, 19 nt, Homo sapiens
uuugaaaguucggcggaaa

SEQ ID NO: 1484868 - RNA, 19 nt, Homo sapiens
gcggaaacugcccauuuua

SEQ ID NO: 1484869 - RNA, 19 nt, Homo sapiens
aaacugagcuucuuucuuu

SEQ ID NO: 1484870 - RNA, 19 nt, Homo sapiens
ggagaaaggaggcgaauua

SEQ ID NO: 1484871 - RNA, 19 nt, Homo sapiens
ggaauugaaucaccaguuu

SEQ ID NO: 1484872 - RNA, 19 nt, Homo sapiens
ggaaagagauacccuggaa

SEQ ID NO: 1484873 - RNA, 19 nt, Homo sapiens
gaaagagggucaugaaaca

SEQ ID NO: 1484874 - RNA, 19 nt, Homo sapiens
gaaauaagccuacuauaag

SEQ ID NO: 1484875 - RNA, 19 nt, Homo sapiens
caagauaccugugaaacua

SEQ ID NO: 1484876 - RNA, 19 nt, Homo sapiens
cagcugaccugaacuguaa

SEQ ID NO: 1484877 - RNA, 19 nt, Homo sapiens
gagacucacuuccagguua

SEQ ID NO: 1484878 - RNA, 19 nt, Homo sapiens
acaaagccaugucauauaa

SEQ ID NO: 1484879 - RNA, 19 nt, Homo sapiens
gcaccauugugauuacuua

SEQ ID NO: 1484880 - RNA, 19 nt, Homo sapiens
ccaaaggaauugaguaaga

SEQ ID NO: 1484881 - RNA, 19 nt, Homo sapiens
ugacucagguugcuaguaa

SEQ ID NO: 1484882 - RNA, 19 nt, Homo sapiens
gagcagagggcauacauaa

SEQ ID NO: 1484883 - RNA, 19 nt, Homo sapiens
ccucagaacuggacaagaa

SEQ ID NO: 1484884 - RNA, 19 nt, Homo sapiens
ggaagcagcucgugagucu

SEQ ID NO: 1484885 - RNA, 19 nt, Homo sapiens
ccaagacauugaaagaaua

SEQ ID NO: 1484886 - RNA, 19 nt, Homo sapiens
gacaaguccuuacuauauu

SEQ ID NO: 1484887 - RNA, 19 nt, Homo sapiens
uaagacaacugcuggaaga

SEQ ID NO: 1484888 - RNA, 19 nt, Homo sapiens
ccaaauacuuguugacgaa

SEQ ID NO: 1484889 - RNA, 19 nt, Homo sapiens
caaacaaacuaaacuguag

SEQ ID NO: 1484890 - RNA, 19 nt, Homo sapiens
ccacaguaaugcuauauau

SEQ ID NO: 1484891 - RNA, 19 nt, Homo sapiens
gagacuggguaauugauaa

SEQ ID NO: 1484892 - RNA, 19 nt, Homo sapiens
gggcaagcauugguaauaa

SEQ ID NO: 1484893 - RNA, 19 nt, Homo sapiens
agaaagcacuuacaucaga

SEQ ID NO: 1484894 - RNA, 19 nt, Homo sapiens
gaaaggaggcgaauuaacu

SEQ ID NO: 1484895 - RNA, 19 nt, Homo sapiens
gcaggcaaauaaauucaaa

SEQ ID NO: 1484896 - RNA, 19 nt, Homo sapiens
caacaaagccaugucauau

SEQ ID NO: 1484897 - RNA, 19 nt, Homo sapiens
aaacaccgauggacauuga

SEQ ID NO: 1484898 - RNA, 19 nt, Homo sapiens
gagaaaagauuugguguaa

SEQ ID NO: 1484899 - RNA, 19 nt, Homo sapiens
ccaaagugcuggaauuaca

SEQ ID NO: 1484900 - RNA, 19 nt, Homo sapiens
gaauacagcgaacugcaua

SEQ ID NO: 1484901 - RNA, 19 nt, Homo sapiens
gaaacuauuugcugccaau

SEQ ID NO: 1484902 - RNA, 19 nt, Homo sapiens
gagcuucuuucuuucauug

SEQ ID NO: 1484903 - RNA, 19 nt, Homo sapiens
aaagagauacccuggaaua

SEQ ID NO: 1484904 - RNA, 19 nt, Homo sapiens
ugacuugaguuucuuauuc

SEQ ID NO: 1484905 - RNA, 19 nt, Homo sapiens
gaacacgagaccucaaauu

SEQ ID NO: 1484906 - RNA, 19 nt, Homo sapiens
ccaagagccuaguauauag

SEQ ID NO: 1484907 - RNA, 19 nt, Homo sapiens
gcugaaagccaaaggaauu

SEQ ID NO: 1484908 - RNA, 19 nt, Homo sapiens
ggacaccauuaguaacaaa

SEQ ID NO: 1484909 - RNA, 19 nt, Homo sapiens
acaguaagcaggcaaauaa

SEQ ID NO: 1484910 - RNA, 19 nt, Homo sapiens
gaucaaauuucaacaugag

SEQ ID NO: 1484911 - RNA, 19 nt, Homo sapiens
uuaggaggcugauuuaaug

SEQ ID NO: 1484912 - RNA, 19 nt, Homo sapiens
gaaguucccuugccuuacu

SEQ ID NO: 1484913 - RNA, 19 nt, Homo sapiens
agacaaguccuuacuauau

SEQ ID NO: 1484914 - RNA, 19 nt, Homo sapiens
ggaucaaauuucaacauga

SEQ ID NO: 1484915 - RNA, 19 nt, Homo sapiens
gcagaaaucaaaugacaga

SEQ ID NO: 1484916 - RNA, 19 nt, Homo sapiens
ggaaugcaguggugugauc

SEQ ID NO: 1484917 - RNA, 19 nt, Homo sapiens
ugucauuucuggagugaua

SEQ ID NO: 1484918 - RNA, 19 nt, Homo sapiens
gacccaagaugacauuuca

SEQ ID NO: 1484919 - RNA, 19 nt, Homo sapiens
guaagcaggcaaauaaauu

SEQ ID NO: 1484920 - RNA, 19 nt, Homo sapiens
ccucaaauuucuucacuga

SEQ ID NO: 1484921 - RNA, 19 nt, Homo sapiens
ggagagcaccaaauacuug

SEQ ID NO: 1484922 - RNA, 19 nt, Homo sapiens
gaaagcaggcauacaaaca

SEQ ID NO: 1484923 - RNA, 19 nt, Homo sapiens
ccaaagagcagagggcaua

SEQ ID NO: 1484924 - RNA, 19 nt, Homo sapiens
cuuguaaacugccauauug

SEQ ID NO: 1484925 - RNA, 19 nt, Homo sapiens
gaauugaaucaccaguuua

SEQ ID NO: 1484926 - RNA, 19 nt, Homo sapiens
ucgaguagaugggauuaua

SEQ ID NO: 1484927 - RNA, 19 nt, Homo sapiens
gagacaaguccuuacuaua

SEQ ID NO: 1484928 - RNA, 19 nt, Homo sapiens
gugcagaaaucaaaugaca

SEQ ID NO: 1484929 - RNA, 19 nt, Homo sapiens
ggacauugauagcgaugau

SEQ ID NO: 1484930 - RNA, 19 nt, Homo sapiens
caacaugaaggacauauuc

SEQ ID NO: 1484931 - RNA, 19 nt, Homo sapiens
ucaaauuucuucacugaca

SEQ ID NO: 1484932 - RNA, 19 nt, Homo sapiens
aggaauauaugacaugcua

SEQ ID NO: 1484933 - RNA, 19 nt, Homo sapiens
gaacuggacaagaaggaaa

SEQ ID NO: 1484934 - RNA, 19 nt, Homo sapiens
caaauauggucuguuuaga

SEQ ID NO: 1484935 - RNA, 19 nt, Homo sapiens
gaaaagauuugguguaaac

SEQ ID NO: 1484936 - RNA, 19 nt, Homo sapiens
ccacacaagacuaucauuu

SEQ ID NO: 1484937 - RNA, 19 nt, Homo sapiens
gagauacccuggaauacag

SEQ ID NO: 1484938 - RNA, 19 nt, Homo sapiens
gggcaucugugucaucugu

SEQ ID NO: 1484939 - RNA, 19 nt, Homo sapiens
ugauagcgaugauuccaaa

SEQ ID NO: 1484940 - RNA, 19 nt, Homo sapiens
ggcaagcauugguaauaaa

SEQ ID NO: 1484941 - RNA, 19 nt, Homo sapiens
gaauaacaaucugcuaguc

SEQ ID NO: 1484942 - RNA, 19 nt, Homo sapiens
gacaacugcuggaagaugu

SEQ ID NO: 1484943 - RNA, 19 nt, Homo sapiens
cauacuugccugauaauaa

SEQ ID NO: 1484944 - RNA, 19 nt, Homo sapiens
gcgaagcaguauguucuaa

SEQ ID NO: 1484945 - RNA, 19 nt, Homo sapiens
agaccaaguuugcugauga

SEQ ID NO: 1484946 - RNA, 19 nt, Homo sapiens
ggagauaucagagaucgaa

SEQ ID NO: 1484947 - RNA, 19 nt, Homo sapiens
cuccaaauauggucuguuu

SEQ ID NO: 1484948 - RNA, 19 nt, Homo sapiens
gagagggacagcugcauuu

SEQ ID NO: 1484949 - RNA, 19 nt, Homo sapiens
gggguacucucgcguauua

SEQ ID NO: 1484950 - RNA, 19 nt, Homo sapiens
cugcauacuugccugauaa

SEQ ID NO: 1484951 - RNA, 19 nt, Homo sapiens
acagcgaacugcauacuug

SEQ ID NO: 1484952 - RNA, 19 nt, Homo sapiens
ucaacaaagccaugucaua

SEQ ID NO: 1484953 - RNA, 19 nt, Homo sapiens
gaagcaguauguucuaaaa

SEQ ID NO: 1484954 - RNA, 19 nt, Homo sapiens
gagaaaggaggcgaauuaa

SEQ ID NO: 1484955 - RNA, 19 nt, Homo sapiens
agagacaaguccuuacuau

SEQ ID NO: 1484956 - RNA, 19 nt, Homo sapiens
gaacagcaccaagccauuc

SEQ ID NO: 1484957 - RNA, 19 nt, Homo sapiens
gaccaagagccuaguauau

SEQ ID NO: 1484958 - RNA, 19 nt, Homo sapiens
ggacaggcagguagaucua

SEQ ID NO: 1484959 - RNA, 19 nt, Homo sapiens
cauuucagcugccaaacaa

SEQ ID NO: 1484960 - RNA, 19 nt, Homo sapiens
uagcucacuuccagguuua

SEQ ID NO: 1484961 - RNA, 19 nt, Homo sapiens
gaccaugccuagcucacuu

SEQ ID NO: 1484962 - RNA, 19 nt, Homo sapiens
caacacugaggaucaaauu

SEQ ID NO: 1484963 - RNA, 19 nt, Homo sapiens
ugacagagaggaagugaga

SEQ ID NO: 1484964 - RNA, 19 nt, Homo sapiens
agagguggguccgaaauaa

SEQ ID NO: 1484965 - RNA, 19 nt, Homo sapiens
ggagugcaguggcaugauc

SEQ ID NO: 1484966 - RNA, 19 nt, Homo sapiens
ccauugugauuacuuauuc

SEQ ID NO: 1484967 - RNA, 19 nt, Homo sapiens
caaugacuuugacugguuu

SEQ ID NO: 1484968 - RNA, 19 nt, Homo sapiens
agagaaagcacuuacauca

SEQ ID NO: 1484969 - RNA, 19 nt, Homo sapiens
gaagauagcuguugcagaa

SEQ ID NO: 1484970 - RNA, 19 nt, Homo sapiens
gaugacagcuccagaaauu

SEQ ID NO: 1484971 - RNA, 19 nt, Homo sapiens
gaaagaagcccaagauauc

SEQ ID NO: 1484972 - RNA, 19 nt, Homo sapiens
gaagagccuugaaauguga

SEQ ID NO: 1484973 - RNA, 19 nt, Homo sapiens
gagaauuuguuucgagauu

SEQ ID NO: 1484974 - RNA, 19 nt, Homo sapiens
caaggagaaucauuucaaa

SEQ ID NO: 1484975 - RNA, 19 nt, Homo sapiens
gguaucaccugccaaagaa

SEQ ID NO: 1484976 - RNA, 19 nt, Homo sapiens
caucuuagccugaaggaua

SEQ ID NO: 1484977 - RNA, 19 nt, Homo sapiens
ugaaggauaucaccaaugu

SEQ ID NO: 1484978 - RNA, 19 nt, Homo sapiens
ugacagcuccagaaauuua

SEQ ID NO: 1484979 - RNA, 19 nt, Homo sapiens
uaaagaagcgaaugaaaga

SEQ ID NO: 1484980 - RNA, 19 nt, Homo sapiens
gcucagcuguguccucaaa

SEQ ID NO: 1484981 - RNA, 19 nt, Homo sapiens
cagccuacauacauaauaa

SEQ ID NO: 1484982 - RNA, 19 nt, Homo sapiens
gauucuagcuuuauguguu

SEQ ID NO: 1484983 - RNA, 19 nt, Homo sapiens
ucaccaaugucuccuugua

SEQ ID NO: 1484984 - RNA, 19 nt, Homo sapiens
cgaagagccuugaaaugug

SEQ ID NO: 1484985 - RNA, 19 nt, Homo sapiens
gcuguguccucaaauauau

SEQ ID NO: 1484986 - RNA, 19 nt, Homo sapiens
gaaccccucuuuuaaguuu

SEQ ID NO: 1484987 - RNA, 19 nt, Homo sapiens
gaagcuacaccaccugaaa

SEQ ID NO: 1484988 - RNA, 19 nt, Homo sapiens
caaauaaucaccaacacuu

SEQ ID NO: 1484989 - RNA, 19 nt, Homo sapiens
gauagcuguugcagaagua

SEQ ID NO: 1484990 - RNA, 19 nt, Homo sapiens
guuacuaucucacauguca

SEQ ID NO: 1484991 - RNA, 19 nt, Homo sapiens
ucagcuguguccucaaaua

SEQ ID NO: 1484992 - RNA, 19 nt, Homo sapiens
uguaggaaauguaaacuug

SEQ ID NO: 1484993 - RNA, 19 nt, Homo sapiens
ucagcuauaugcauugaaa

SEQ ID NO: 1484994 - RNA, 19 nt, Homo sapiens
ugaaagaagcccaagauau

SEQ ID NO: 1484995 - RNA, 19 nt, Homo sapiens
cagccagcgugaacuauaa

SEQ ID NO: 1484996 - RNA, 19 nt, Homo sapiens
gcacagccagcgugaacua

SEQ ID NO: 1484997 - RNA, 19 nt, Homo sapiens
gcugcaccaugccaaauaa

SEQ ID NO: 1484998 - RNA, 19 nt, Homo sapiens
ggcaaaggauggccaagga

SEQ ID NO: 1484999 - RNA, 19 nt, Homo sapiens
caugucagcuauaugcauu

SEQ ID NO: 1485000 - RNA, 19 nt, Homo sapiens
ggacaaggagaaucauuuc

SEQ ID NO: 1485001 - RNA, 19 nt, Homo sapiens
gacuuucucuuucuccaaa

SEQ ID NO: 1485002 - RNA, 19 nt, Homo sapiens
gcucagaaccaggaaauau

SEQ ID NO: 1485003 - RNA, 19 nt, Homo sapiens
uaagcgaaauucuccaauc

SEQ ID NO: 1485004 - RNA, 19 nt, Homo sapiens
gcagaccuuuaauagauuc

SEQ ID NO: 1485005 - RNA, 19 nt, Homo sapiens
augcagaccuuuaauagau

SEQ ID NO: 1485006 - RNA, 19 nt, Homo sapiens
caaaggauggccaaggaaa

SEQ ID NO: 1485007 - RNA, 19 nt, Homo sapiens
gcaccaugccaaauaauca

SEQ ID NO: 1485008 - RNA, 19 nt, Homo sapiens
caaggaaagaugccugaaa

SEQ ID NO: 1485009 - RNA, 19 nt, Homo sapiens
gcagucaccucaucuuagc

SEQ ID NO: 1485010 - RNA, 19 nt, Homo sapiens
cagcagucaccucaucuua

SEQ ID NO: 1485011 - RNA, 19 nt, Homo sapiens
ggaaucaguacguguugaa

SEQ ID NO: 1485012 - RNA, 19 nt, Homo sapiens
uaauguaugcagaccuuua

SEQ ID NO: 1485013 - RNA, 19 nt, Homo sapiens
aaagagcccuggagguauc

SEQ ID NO: 1485014 - RNA, 19 nt, Homo sapiens
gugaaggauuuaccgcaaa

SEQ ID NO: 1485015 - RNA, 19 nt, Homo sapiens
cuauaugcauugaaaggaa

SEQ ID NO: 1485016 - RNA, 19 nt, Homo sapiens
gggcuucacauccuuagaa

SEQ ID NO: 1485017 - RNA, 19 nt, Homo sapiens
gaaacccacaucugcuuga

SEQ ID NO: 1485018 - RNA, 19 nt, Homo sapiens
gacauaaagaagcgaauga

SEQ ID NO: 1485019 - RNA, 19 nt, Homo sapiens
gugaaagaagcccaagaua

SEQ ID NO: 1485020 - RNA, 19 nt, Homo sapiens
cauaaagaagcgaaugaaa

SEQ ID NO: 1485021 - RNA, 19 nt, Homo sapiens
gauauuguguaagcgaaau

SEQ ID NO: 1485022 - RNA, 19 nt, Homo sapiens
ucacucagccuacauacau

SEQ ID NO: 1485023 - RNA, 19 nt, Homo sapiens
ucgaagagccuugaaaugu

SEQ ID NO: 1485024 - RNA, 19 nt, Homo sapiens
uaucucacaugucagcuau

SEQ ID NO: 1485025 - RNA, 19 nt, Homo sapiens
gcaaaggauggccaaggaa

SEQ ID NO: 1485026 - RNA, 19 nt, Homo sapiens
guaugcagaccuuuaauag

SEQ ID NO: 1485027 - RNA, 19 nt, Homo sapiens
gaauggaccccaauaguga

SEQ ID NO: 1485028 - RNA, 19 nt, Homo sapiens
ucucacaugucagcuauau

SEQ ID NO: 1485029 - RNA, 19 nt, Homo sapiens
agaagcgaaugaaagagaa

SEQ ID NO: 1485030 - RNA, 19 nt, Homo sapiens
ccacaucugcuugagguaa

SEQ ID NO: 1485031 - RNA, 19 nt, Homo sapiens
caguagaaccugcucagaa

SEQ ID NO: 1485032 - RNA, 19 nt, Homo sapiens
gaaaggaaaacuuacauca

SEQ ID NO: 1485033 - RNA, 19 nt, Homo sapiens
gcauugaaaggaaaacuua

SEQ ID NO: 1485034 - RNA, 19 nt, Homo sapiens
aaacgcaggucuuuuauag

SEQ ID NO: 1485035 - RNA, 19 nt, Homo sapiens
gaagcgaaugaaagagaaa

SEQ ID NO: 1485036 - RNA, 19 nt, Homo sapiens
cacaucugcuugagguaaa

SEQ ID NO: 1485037 - RNA, 19 nt, Homo sapiens
gaaaugugaggaggaggaa

SEQ ID NO: 1485038 - RNA, 19 nt, Homo sapiens
guaggaaauguaaacuuga

SEQ ID NO: 1485039 - RNA, 19 nt, Homo sapiens
ggcaaacgcaggucuuuua

SEQ ID NO: 1485040 - RNA, 19 nt, Homo sapiens
acaaggagaaucauuucaa

SEQ ID NO: 1485041 - RNA, 19 nt, Homo sapiens
gagauugccuuuucuuucu

SEQ ID NO: 1485042 - RNA, 19 nt, Homo sapiens
uguaugcagaccuuuaaua

SEQ ID NO: 1485043 - RNA, 19 nt, Homo sapiens
aaggaaagaugccugaaaa

SEQ ID NO: 1485044 - RNA, 19 nt, Homo sapiens
ggcuucacauccuuagaaa

SEQ ID NO: 1485045 - RNA, 19 nt, Homo sapiens
gauuugagacguucuaaaa

SEQ ID NO: 1485046 - RNA, 19 nt, Homo sapiens
gugaaaaucagaagacuuu

SEQ ID NO: 1485047 - RNA, 19 nt, Homo sapiens
ccauuuccuauuucucuua

SEQ ID NO: 1485048 - RNA, 19 nt, Homo sapiens
cgaggaaucaguacguguu

SEQ ID NO: 1485049 - RNA, 19 nt, Homo sapiens
ccacgggcuucacauccuu

SEQ ID NO: 1485050 - RNA, 19 nt, Homo sapiens
cuacaccaccugaaacuca

SEQ ID NO: 1485051 - RNA, 19 nt, Homo sapiens
cccaagauaucauccuaca

SEQ ID NO: 1485052 - RNA, 19 nt, Homo sapiens
uuaccaagacaacaacaaa

SEQ ID NO: 1485053 - RNA, 19 nt, Homo sapiens
gcuguuuccuguuucucuu

SEQ ID NO: 1485054 - RNA, 19 nt, Homo sapiens
ggugaccgaggaaucagua

SEQ ID NO: 1485055 - RNA, 19 nt, Homo sapiens
ggaaauguaaacuugaaac

SEQ ID NO: 1485056 - RNA, 19 nt, Homo sapiens
uaccgcaaauuccucuuga

SEQ ID NO: 1485057 - RNA, 19 nt, Homo sapiens
ucacaugucagcuauaugc

SEQ ID NO: 1485058 - RNA, 19 nt, Homo sapiens
acuaauguaugcagaccuu

SEQ ID NO: 1485059 - RNA, 19 nt, Homo sapiens
gugaugacagcuccagaaa

SEQ ID NO: 1485060 - RNA, 19 nt, Homo sapiens
ucacuuggagauugccuuu

SEQ ID NO: 1485061 - RNA, 19 nt, Homo sapiens
ggauuugagacguucuaaa

SEQ ID NO: 1485062 - RNA, 19 nt, Homo sapiens
cuuguauccuguugugaaa

SEQ ID NO: 1485063 - RNA, 19 nt, Homo sapiens
ucagaaccaggaaauaugu

SEQ ID NO: 1485064 - RNA, 19 nt, Homo sapiens
ccugaaggauaucaccaau

SEQ ID NO: 1485065 - RNA, 19 nt, Homo sapiens
ggaauggaccccaauagug

SEQ ID NO: 1485066 - RNA, 19 nt, Homo sapiens
aaagaagcccaagauauca

SEQ ID NO: 1485067 - RNA, 19 nt, Homo sapiens
auaaagaagcgaaugaaag

SEQ ID NO: 1485068 - RNA, 19 nt, Homo sapiens
gaggaaucaguacguguug

SEQ ID NO: 1485069 - RNA, 19 nt, Homo sapiens
gaaauugaccuaacuggua

SEQ ID NO: 1485070 - RNA, 19 nt, Homo sapiens
uaacaaaccuaaugugugu

SEQ ID NO: 1485071 - RNA, 19 nt, Homo sapiens
ggugucaucugucacauuu

SEQ ID NO: 1485072 - RNA, 19 nt, Homo sapiens
ucaagagaauggaauauga

SEQ ID NO: 1485073 - RNA, 19 nt, Homo sapiens
ggaaagcugacaugaauga

SEQ ID NO: 1485074 - RNA, 19 nt, Homo sapiens
ggcaaguucuuucccauuu

SEQ ID NO: 1485075 - RNA, 19 nt, Homo sapiens
aagcugacaugaaugauaa

SEQ ID NO: 1485076 - RNA, 19 nt, Homo sapiens
uggcuaagcaucauaaaua

SEQ ID NO: 1485077 - RNA, 19 nt, Homo sapiens
cagagacaguucaugauuu

SEQ ID NO: 1485078 - RNA, 19 nt, Homo sapiens
gcacuucccuagcaaacug

SEQ ID NO: 1485079 - RNA, 19 nt, Homo sapiens
ggcuaagcaucauaaauaa

SEQ ID NO: 1485080 - RNA, 19 nt, Homo sapiens
gacaguucaugauuucuaa

SEQ ID NO: 1485081 - RNA, 19 nt, Homo sapiens
ccacagcccucagugauug

SEQ ID NO: 1485082 - RNA, 19 nt, Homo sapiens
gcacgaaauugaccuaacu

SEQ ID NO: 1485083 - RNA, 19 nt, Homo sapiens
gcaguuacuuguauauugg

SEQ ID NO: 1485084 - RNA, 19 nt, Homo sapiens
gcucugcaguuacuuguau

SEQ ID NO: 1485085 - RNA, 19 nt, Homo sapiens
uccaucagcuuuccaaauu

SEQ ID NO: 1485086 - RNA, 19 nt, Homo sapiens
gaacaugagcaccaauaau

SEQ ID NO: 1485087 - RNA, 19 nt, Homo sapiens
cuagcaaacugcaaacuug

SEQ ID NO: 1485088 - RNA, 19 nt, Homo sapiens
gaaucuccuucuaaacaaa

SEQ ID NO: 1485089 - RNA, 19 nt, Homo sapiens
gcagugaggugugaguaug

SEQ ID NO: 1485090 - RNA, 19 nt, Homo sapiens
ccaaauuugauccuucuua

SEQ ID NO: 1485091 - RNA, 19 nt, Homo sapiens
caucagcuuuccaaauuug

SEQ ID NO: 1485092 - RNA, 19 nt, Homo sapiens
caaauaccagcauacuaua

SEQ ID NO: 1485093 - RNA, 19 nt, Homo sapiens
acaaauaccagcauacuau

SEQ ID NO: 1485094 - RNA, 19 nt, Homo sapiens
gaaaaguaauuccaaagga

SEQ ID NO: 1485095 - RNA, 19 nt, Homo sapiens
ggaacaugagcaccaauaa

SEQ ID NO: 1485096 - RNA, 19 nt, Homo sapiens
caccaucacuacucaaguu

SEQ ID NO: 1485097 - RNA, 19 nt, Homo sapiens
gagaauggauaggcuuuua

SEQ ID NO: 1485098 - RNA, 19 nt, Homo sapiens
caaauuugauccuucuuac

SEQ ID NO: 1485099 - RNA, 19 nt, Homo sapiens
cacauuacccuguuccaua

SEQ ID NO: 1485100 - RNA, 19 nt, Homo sapiens
guucagagacaguucauga

SEQ ID NO: 1485101 - RNA, 19 nt, Homo sapiens
uaaacucugucaccuagug

SEQ ID NO: 1485102 - RNA, 19 nt, Homo sapiens
agaagaauacacagcaaua

SEQ ID NO: 1485103 - RNA, 19 nt, Homo sapiens
aaauugaccuaacugguau

SEQ ID NO: 1485104 - RNA, 19 nt, Homo sapiens
gaaaucaagagaauggaau

SEQ ID NO: 1485105 - RNA, 19 nt, Homo sapiens
ucuggaauauuacauguug

SEQ ID NO: 1485106 - RNA, 19 nt, Homo sapiens
gacaggaauucuacaugga

SEQ ID NO: 1485107 - RNA, 19 nt, Homo sapiens
ccagcauacuauaagauuu

SEQ ID NO: 1485108 - RNA, 19 nt, Homo sapiens
aagaggagcaggucuauga

SEQ ID NO: 1485109 - RNA, 19 nt, Homo sapiens
caacauuugauucagauga

SEQ ID NO: 1485110 - RNA, 19 nt, Homo sapiens
ggaaaucaagagaauggaa

SEQ ID NO: 1485111 - RNA, 19 nt, Homo sapiens
acauuugccugaauacuau

SEQ ID NO: 1485112 - RNA, 19 nt, Homo sapiens
caacugaugagcaacaaau

SEQ ID NO: 1485113 - RNA, 19 nt, Homo sapiens
agagacaguucaugauuuc

SEQ ID NO: 1485114 - RNA, 19 nt, Homo sapiens
caccaauaaugcuuuaaga

SEQ ID NO: 1485115 - RNA, 19 nt, Homo sapiens
ugaauacuauggcuaagca

SEQ ID NO: 1485116 - RNA, 19 nt, Homo sapiens
acaggagugucauauauuc

SEQ ID NO: 1485117 - RNA, 19 nt, Homo sapiens
caagagaauggaauaugaa

SEQ ID NO: 1485118 - RNA, 19 nt, Homo sapiens
gaugagcaacaaauaauca

SEQ ID NO: 1485119 - RNA, 19 nt, Homo sapiens
auggaaagcugacaugaau

SEQ ID NO: 1485120 - RNA, 19 nt, Homo sapiens
ggagugucauauauucuca

SEQ ID NO: 1485121 - RNA, 19 nt, Homo sapiens
gaugaggauauucuacuuu

SEQ ID NO: 1485122 - RNA, 19 nt, Homo sapiens
ccaauaaugcuuuaagagu

SEQ ID NO: 1485123 - RNA, 19 nt, Homo sapiens
cagaagcagugagguguga

SEQ ID NO: 1485124 - RNA, 19 nt, Homo sapiens
gaagaauacacagcaauag

SEQ ID NO: 1485125 - RNA, 19 nt, Homo sapiens
gguaacaaaccuaaugugu

SEQ ID NO: 1485126 - RNA, 19 nt, Homo sapiens
gaagacaggaauucuacau

SEQ ID NO: 1485127 - RNA, 19 nt, Homo sapiens
acauuacccuguuccauau

SEQ ID NO: 1485128 - RNA, 19 nt, Homo sapiens
aaugacaacugaugagcaa

SEQ ID NO: 1485129 - RNA, 19 nt, Homo sapiens
ccaucagcuuuccaaauuu

SEQ ID NO: 1485130 - RNA, 19 nt, Homo sapiens
ucagagacaguucaugauu

SEQ ID NO: 1485131 - RNA, 19 nt, Homo sapiens
uacucaaguuggagaaaua

SEQ ID NO: 1485132 - RNA, 19 nt, Homo sapiens
gauaaagggagggcaaaga

SEQ ID NO: 1485133 - RNA, 19 nt, Homo sapiens
gaaaagcccaaauuaaugu

SEQ ID NO: 1485134 - RNA, 19 nt, Homo sapiens
ugcaguuacuuguauauug

SEQ ID NO: 1485135 - RNA, 19 nt, Homo sapiens
agaauacacagcaauagaa

SEQ ID NO: 1485136 - RNA, 19 nt, Homo sapiens
aaagcugacaugaaugaua

SEQ ID NO: 1485137 - RNA, 19 nt, Homo sapiens
caggaauucuacauggaaa

SEQ ID NO: 1485138 - RNA, 19 nt, Homo sapiens
ggagugggcauuugugaag

SEQ ID NO: 1485139 - RNA, 19 nt, Homo sapiens
ugucaucugucacauuugu

SEQ ID NO: 1485140 - RNA, 19 nt, Homo sapiens
uuaaaggagugggcauuug

SEQ ID NO: 1485141 - RNA, 19 nt, Homo sapiens
gccaucacauucaccucua

SEQ ID NO: 1485142 - RNA, 19 nt, Homo sapiens
gcagagagcuccccuucca

SEQ ID NO: 1485143 - RNA, 19 nt, Homo sapiens
gauccuucuuaccaaauga

SEQ ID NO: 1485144 - RNA, 19 nt, Homo sapiens
uaaagggagggcaaagaaa

SEQ ID NO: 1485145 - RNA, 19 nt, Homo sapiens
caucacuacucaaguugga

SEQ ID NO: 1485146 - RNA, 19 nt, Homo sapiens
ugauucagaugaggauauu

SEQ ID NO: 1485147 - RNA, 19 nt, Homo sapiens
ugaaguaccauuaaacucu

SEQ ID NO: 1485148 - RNA, 19 nt, Homo sapiens
gauucugggugucaucugu

SEQ ID NO: 1485149 - RNA, 19 nt, Homo sapiens
augaacauuugccugaaua

SEQ ID NO: 1485150 - RNA, 19 nt, Homo sapiens
caugauggguuggcagaga

SEQ ID NO: 1485151 - RNA, 19 nt, Homo sapiens
uaaaggagugggcauuugu

SEQ ID NO: 1485152 - RNA, 19 nt, Homo sapiens
caauggauggguagaaaga

SEQ ID NO: 1485153 - RNA, 19 nt, Homo sapiens
ggaccacauuacccuguuc

SEQ ID NO: 1485154 - RNA, 19 nt, Homo sapiens
gaauacacagcaauagaag

SEQ ID NO: 1485155 - RNA, 19 nt, Homo sapiens
gagaagaauacacagcaau

SEQ ID NO: 1485156 - RNA, 19 nt, Homo sapiens
cauaagaagcaacauguag

SEQ ID NO: 1485157 - RNA, 19 nt, Homo sapiens
gcaccaauaaugcuuuaag

SEQ ID NO: 1485158 - RNA, 19 nt, Homo sapiens
agugauugcuguucagaga

SEQ ID NO: 1485159 - RNA, 19 nt, Homo sapiens
aacaugagcaccaauaaug

SEQ ID NO: 1485160 - RNA, 19 nt, Homo sapiens
cauaugcaagcacgaaauu

SEQ ID NO: 1485161 - RNA, 19 nt, Homo sapiens
ugagcaagggaccacauua

SEQ ID NO: 1485162 - RNA, 19 nt, Homo sapiens
aaaggaacaugagcaccaa

SEQ ID NO: 1485163 - RNA, 19 nt, Homo sapiens
uaugcaagcacgaaauuga

SEQ ID NO: 1485164 - RNA, 19 nt, Homo sapiens
gagcaagggaccacauuac

SEQ ID NO: 1485165 - RNA, 19 nt, Homo sapiens
gacaacugaugagcaacaa

SEQ ID NO: 1485166 - RNA, 19 nt, Homo sapiens
ccucagugauugcuguuca

SEQ ID NO: 1485167 - RNA, 19 nt, Homo sapiens
ccauaagaagcaacaugua

SEQ ID NO: 1485168 - RNA, 19 nt, Homo sapiens
agacaguucaugauuucua

SEQ ID NO: 1485169 - RNA, 19 nt, Homo sapiens
gaagaaagggucauuauua

SEQ ID NO: 1485170 - RNA, 19 nt, Homo sapiens
gaacaaacucuccucauaa

SEQ ID NO: 1485171 - RNA, 19 nt, Homo sapiens
gcagagauauuguguaaca

SEQ ID NO: 1485172 - RNA, 19 nt, Homo sapiens
ugaacaaacucuccucaua

SEQ ID NO: 1485173 - RNA, 19 nt, Homo sapiens
caaacugucugaugaagaa

SEQ ID NO: 1485174 - RNA, 19 nt, Homo sapiens
guaaaacacucaugugaua

SEQ ID NO: 1485175 - RNA, 19 nt, Homo sapiens
gaaaggaguguuugaaaga

SEQ ID NO: 1485176 - RNA, 19 nt, Homo sapiens
gaaaauguauggaaucuug

SEQ ID NO: 1485177 - RNA, 19 nt, Homo sapiens
ggaaaggaguguuugaaag

SEQ ID NO: 1485178 - RNA, 19 nt, Homo sapiens
uauggaaucuugcaucaaa

SEQ ID NO: 1485179 - RNA, 19 nt, Homo sapiens
ugaagaagguagugcauau

SEQ ID NO: 1485180 - RNA, 19 nt, Homo sapiens
gaaagggucauuauuaaag

SEQ ID NO: 1485181 - RNA, 19 nt, Homo sapiens
gagauauuguguaacauug

SEQ ID NO: 1485182 - RNA, 19 nt, Homo sapiens
gagaccaagugauaaaguu

SEQ ID NO: 1485183 - RNA, 19 nt, Homo sapiens
ugaagaaccugaacaaacu

SEQ ID NO: 1485184 - RNA, 19 nt, Homo sapiens
gaggagaaguuuguguuga

SEQ ID NO: 1485185 - RNA, 19 nt, Homo sapiens
uaacauuggugucaaacug

SEQ ID NO: 1485186 - RNA, 19 nt, Homo sapiens
uugcagagauauuguguaa

SEQ ID NO: 1485187 - RNA, 19 nt, Homo sapiens
ugacagaacuaauuauggu

SEQ ID NO: 1485188 - RNA, 19 nt, Homo sapiens
agaagagauugcagagaua

SEQ ID NO: 1485189 - RNA, 19 nt, Homo sapiens
aacaaacucuccucauaaa

SEQ ID NO: 1485190 - RNA, 19 nt, Homo sapiens
aagaagagauugcagagau

SEQ ID NO: 1485191 - RNA, 19 nt, Homo sapiens
uaaagaguaugaagaaagg

SEQ ID NO: 1485192 - RNA, 19 nt, Homo sapiens
ucagugacagaacuaauua

SEQ ID NO: 1485193 - RNA, 19 nt, Homo sapiens
ggagaaguuuguguugaga

SEQ ID NO: 1485194 - RNA, 19 nt, Homo sapiens
ucauaaagccagaagauau

SEQ ID NO: 1485195 - RNA, 19 nt, Homo sapiens
cauaaagccagaagauauu

SEQ ID NO: 1485196 - RNA, 19 nt, Homo sapiens
cagaccggaucaaguguaa

SEQ ID NO: 1485197 - RNA, 19 nt, Homo sapiens
gaagcaggaagcacagaaa

SEQ ID NO: 1485198 - RNA, 19 nt, Homo sapiens
cuacugaggcuaauguuga

SEQ ID NO: 1485199 - RNA, 19 nt, Homo sapiens
gaagagauugcagagauau

SEQ ID NO: 1485200 - RNA, 19 nt, Homo sapiens
gaagaagguagugcauauu

SEQ ID NO: 1485201 - RNA, 19 nt, Homo sapiens
gaacuaauuauggugaaga

SEQ ID NO: 1485202 - RNA, 19 nt, Homo sapiens
guugagaacaucagaaaug

SEQ ID NO: 1485203 - RNA, 19 nt, Homo sapiens
acugugauguggauaauga

SEQ ID NO: 1485204 - RNA, 19 nt, Homo sapiens
ucacagaggagaaguuugu

SEQ ID NO: 1485205 - RNA, 19 nt, Homo sapiens
cuucugagaccaagugaua

SEQ ID NO: 1485206 - RNA, 19 nt, Homo sapiens
cuguauguguugcuaauaa

SEQ ID NO: 1485207 - RNA, 19 nt, Homo sapiens
ugaagaaagggucauuauu

SEQ ID NO: 1485208 - RNA, 19 nt, Homo sapiens
gugucaaacugucugauga

SEQ ID NO: 1485209 - RNA, 19 nt, Homo sapiens
gacaacuucuucugagauc

SEQ ID NO: 1485210 - RNA, 19 nt, Homo sapiens
gcagaccggaucaagugua

SEQ ID NO: 1485211 - RNA, 19 nt, Homo sapiens
gauauuguguaacauuggu

SEQ ID NO: 1485212 - RNA, 19 nt, Homo sapiens
gaauucgucgcaucaguga

SEQ ID NO: 1485213 - RNA, 19 nt, Homo sapiens
ugacuacugugauguggau

SEQ ID NO: 1485214 - RNA, 19 nt, Homo sapiens
cuucugagaucaaugcaau

SEQ ID NO: 1485215 - RNA, 19 nt, Homo sapiens
gugcauauucacuacuaua

SEQ ID NO: 1485216 - RNA, 19 nt, Homo sapiens
ccagcuauuugacuacugu

SEQ ID NO: 1485217 - RNA, 19 nt, Homo sapiens
uggaccagcuauuugacua

SEQ ID NO: 1485218 - RNA, 19 nt, Homo sapiens
caucacagaggagaaguuu

SEQ ID NO: 1485219 - RNA, 19 nt, Homo sapiens
cggaaaggaguguuugaaa

SEQ ID NO: 1485220 - RNA, 19 nt, Homo sapiens
gagccauuccuucuacuug

SEQ ID NO: 1485221 - RNA, 19 nt, Homo sapiens
cauuaacuaucuggaauuc

SEQ ID NO: 1485222 - RNA, 19 nt, Homo sapiens
uguauggaaucuugcauca

SEQ ID NO: 1485223 - RNA, 19 nt, Homo sapiens
guguaacauuggugucaaa

SEQ ID NO: 1485224 - RNA, 19 nt, Homo sapiens
gccauuccuucuacuuguu

SEQ ID NO: 1485225 - RNA, 19 nt, Homo sapiens
agaagguagugcauauuca

SEQ ID NO: 1485226 - RNA, 19 nt, Homo sapiens
uaauuauggugaagaaggu

SEQ ID NO: 1485227 - RNA, 19 nt, Homo sapiens
cagaacuaauuauggugaa

SEQ ID NO: 1485228 - RNA, 19 nt, Homo sapiens
caacuucuucugagaucaa

SEQ ID NO: 1485229 - RNA, 19 nt, Homo sapiens
cuauuugacuacugugaug

SEQ ID NO: 1485230 - RNA, 19 nt, Homo sapiens
acuacuauauccuaccauu

SEQ ID NO: 1485231 - RNA, 19 nt, Homo sapiens
cuucauucauucaagcaaa

SEQ ID NO: 1485232 - RNA, 19 nt, Homo sapiens
cagaggagaaguuuguguu

SEQ ID NO: 1485233 - RNA, 19 nt, Homo sapiens
gugaagaagguagugcaua

SEQ ID NO: 1485234 - RNA, 19 nt, Homo sapiens
ggucauuauuaaagguaga

SEQ ID NO: 1485235 - RNA, 19 nt, Homo sapiens
acugucugaugaagaauuu

SEQ ID NO: 1485236 - RNA, 19 nt, Homo sapiens
caaacucuccucauaaagc

SEQ ID NO: 1485237 - RNA, 19 nt, Homo sapiens
ugaggcuaauguugaagaa

SEQ ID NO: 1485238 - RNA, 19 nt, Homo sapiens
guuuccaacuacuauaaga

SEQ ID NO: 1485239 - RNA, 19 nt, Homo sapiens
caagugauaaaguuuccaa

SEQ ID NO: 1485240 - RNA, 19 nt, Homo sapiens
ucacuacuauauccuacca

SEQ ID NO: 1485241 - RNA, 19 nt, Homo sapiens
ccauuccuucuacuuguua

SEQ ID NO: 1485242 - RNA, 19 nt, Homo sapiens
gcaauuguaggagccauuc

SEQ ID NO: 1485243 - RNA, 19 nt, Homo sapiens
aaagggucauuauuaaagg

SEQ ID NO: 1485244 - RNA, 19 nt, Homo sapiens
caacuacuauaagacaacu

SEQ ID NO: 1485245 - RNA, 19 nt, Homo sapiens
gaccaagugauaaaguuuc

SEQ ID NO: 1485246 - RNA, 19 nt, Homo sapiens
uaaacccuacugaggcuaa

SEQ ID NO: 1485247 - RNA, 19 nt, Homo sapiens
cuacugugauguggauaau

SEQ ID NO: 1485248 - RNA, 19 nt, Homo sapiens
gagaaguuuguguugagaa

SEQ ID NO: 1485249 - RNA, 19 nt, Homo sapiens
agagauugcagagauauug

SEQ ID NO: 1485250 - RNA, 19 nt, Homo sapiens
aaggaguguuugaaagaga

SEQ ID NO: 1485251 - RNA, 19 nt, Homo sapiens
agaccaagugauaaaguuu

SEQ ID NO: 1485252 - RNA, 19 nt, Homo sapiens
gcaggaagcacagaaaaga

SEQ ID NO: 1485253 - RNA, 19 nt, Homo sapiens
ccucauaaagccagaagau

SEQ ID NO: 1485254 - RNA, 19 nt, Homo sapiens
gccuguauguguugcuaau

SEQ ID NO: 1485255 - RNA, 19 nt, Homo sapiens
cuacuauauccuaccauuu

SEQ ID NO: 1485256 - RNA, 19 nt, Homo sapiens
uacugaggcuaauguugaa

SEQ ID NO: 1485257 - RNA, 19 nt, Homo sapiens
ggugucaaacugucugaug

SEQ ID NO: 1485258 - RNA, 19 nt, Homo sapiens
gagauugcagagauauugu

SEQ ID NO: 1485259 - RNA, 19 nt, Homo sapiens
gaagguagugcauauucac

SEQ ID NO: 1485260 - RNA, 19 nt, Homo sapiens
aagaagguagugcauauuc

SEQ ID NO: 1485261 - RNA, 19 nt, Homo sapiens
ucugagaccaagugauaaa

SEQ ID NO: 1485262 - RNA, 19 nt, Homo sapiens
gacaaaaugcuucuuaaag

SEQ ID NO: 1485263 - RNA, 19 nt, Homo sapiens
guagaaaaccagauugugu

SEQ ID NO: 1485264 - RNA, 19 nt, Homo sapiens
aaaggaguguuugaaagag

SEQ ID NO: 1485265 - RNA, 19 nt, Homo sapiens
ggagccauuccuucuacuu

SEQ ID NO: 1485266 - RNA, 19 nt, Homo sapiens
ucaaacugucugaugaaga

SEQ ID NO: 1485267 - RNA, 19 nt, Homo sapiens
uagaaaaccagauugugua

SEQ ID NO: 1485268 - RNA, 19 nt, Homo sapiens
gaccagcuauuugacuacu

SEQ ID NO: 1485269 - RNA, 19 nt, Homo sapiens
guaaauagcuguagaguca

SEQ ID NO: 1485270 - RNA, 19 nt, Homo sapiens
gaaauugccuuguagaugu

SEQ ID NO: 1485271 - RNA, 19 nt, Homo sapiens
caaguaagcuguuugcauu

SEQ ID NO: 1485272 - RNA, 19 nt, Homo sapiens
ggagugagcuggugagguu

SEQ ID NO: 1485273 - RNA, 19 nt, Homo sapiens
gggauaagcuucuccuuga

SEQ ID NO: 1485274 - RNA, 19 nt, Homo sapiens
ggucuuaggucuauaauca

SEQ ID NO: 1485275 - RNA, 19 nt, Homo sapiens
gcagcagucuucaacauuu

SEQ ID NO: 1485276 - RNA, 19 nt, Homo sapiens
gaaagaaagaggauaaaga

SEQ ID NO: 1485277 - RNA, 19 nt, Homo sapiens
gugaagaaauugccuugua

SEQ ID NO: 1485278 - RNA, 19 nt, Homo sapiens
gguuauagcuucccauaug

SEQ ID NO: 1485279 - RNA, 19 nt, Homo sapiens
gaacccauauugauaagug

SEQ ID NO: 1485280 - RNA, 19 nt, Homo sapiens
ucacaagccuuaccaguug

SEQ ID NO: 1485281 - RNA, 19 nt, Homo sapiens
gcacuuaacuuucuuugac

SEQ ID NO: 1485282 - RNA, 19 nt, Homo sapiens
gauaagugggccagaauua

SEQ ID NO: 1485283 - RNA, 19 nt, Homo sapiens
caugagauuugcuuacuuu

SEQ ID NO: 1485284 - RNA, 19 nt, Homo sapiens
gaaaugauacugaaugagu

SEQ ID NO: 1485285 - RNA, 19 nt, Homo sapiens
ucaacacacuggucucuuu

SEQ ID NO: 1485286 - RNA, 19 nt, Homo sapiens
gacugcagcugaauaugua

SEQ ID NO: 1485287 - RNA, 19 nt, Homo sapiens
gaagccaggugcagaguuc

SEQ ID NO: 1485288 - RNA, 19 nt, Homo sapiens
guaauaggcagcuguuaaa

SEQ ID NO: 1485289 - RNA, 19 nt, Homo sapiens
gaccagccuuugugcauuu

SEQ ID NO: 1485290 - RNA, 19 nt, Homo sapiens
ggaagcagauuuggaaugg

SEQ ID NO: 1485291 - RNA, 19 nt, Homo sapiens
gcaggugguuucaucaguu

SEQ ID NO: 1485292 - RNA, 19 nt, Homo sapiens
ugaaggaaaugauacugaa

SEQ ID NO: 1485293 - RNA, 19 nt, Homo sapiens
gauuuggaaugguuuacua

SEQ ID NO: 1485294 - RNA, 19 nt, Homo sapiens
uagcauaugugucauuuag

SEQ ID NO: 1485295 - RNA, 19 nt, Homo sapiens
gagaagcagcagccuauaa

SEQ ID NO: 1485296 - RNA, 19 nt, Homo sapiens
gcauaugugucauuuaguc

SEQ ID NO: 1485297 - RNA, 19 nt, Homo sapiens
gcuguagagucacauauau

SEQ ID NO: 1485298 - RNA, 19 nt, Homo sapiens
gagagcaggugguuucauc

SEQ ID NO: 1485299 - RNA, 19 nt, Homo sapiens
guagaugaaggaaaugaua

SEQ ID NO: 1485300 - RNA, 19 nt, Homo sapiens
ggauagaauuugagagagu

SEQ ID NO: 1485301 - RNA, 19 nt, Homo sapiens
gcagcagccuauaacugua

SEQ ID NO: 1485302 - RNA, 19 nt, Homo sapiens
gcuguuguguccucucuuu

SEQ ID NO: 1485303 - RNA, 19 nt, Homo sapiens
gcacugagaauugcuaaug

SEQ ID NO: 1485304 - RNA, 19 nt, Homo sapiens
gugaauagcauauguguca

SEQ ID NO: 1485305 - RNA, 19 nt, Homo sapiens
guucagaaauagcagcaaa

SEQ ID NO: 1485306 - RNA, 19 nt, Homo sapiens
gugggaaacuacugggaua

SEQ ID NO: 1485307 - RNA, 19 nt, Homo sapiens
auaggcagcuguuaaauuc

SEQ ID NO: 1485308 - RNA, 19 nt, Homo sapiens
gagggaugcuggugccauu

SEQ ID NO: 1485309 - RNA, 19 nt, Homo sapiens
gcaaaucuccauccacauc

SEQ ID NO: 1485310 - RNA, 19 nt, Homo sapiens
gagcauaguuuuacaguca

SEQ ID NO: 1485311 - RNA, 19 nt, Homo sapiens
ugaagaagcaguucgauuc

SEQ ID NO: 1485312 - RNA, 19 nt, Homo sapiens
guggagggcugcaaucugu

SEQ ID NO: 1485313 - RNA, 19 nt, Homo sapiens
gaagaaauugccuuguaga

SEQ ID NO: 1485314 - RNA, 19 nt, Homo sapiens
ugaagaaauugccuuguag

SEQ ID NO: 1485315 - RNA, 19 nt, Homo sapiens
gcaacacccucugccaaga

SEQ ID NO: 1485316 - RNA, 19 nt, Homo sapiens
gaagaagcaguucgauuca

SEQ ID NO: 1485317 - RNA, 19 nt, Homo sapiens
ggacuacgagaaagacaaa

SEQ ID NO: 1485318 - RNA, 19 nt, Homo sapiens
gagguuaccacccugaauu

SEQ ID NO: 1485319 - RNA, 19 nt, Homo sapiens
aggcugcccugacaauaua

SEQ ID NO: 1485320 - RNA, 19 nt, Homo sapiens
ccaaagcaguguccaggau

SEQ ID NO: 1485321 - RNA, 19 nt, Homo sapiens
uaagugggccagaauuauu

SEQ ID NO: 1485322 - RNA, 19 nt, Homo sapiens
caacagauacccugauuuu

SEQ ID NO: 1485323 - RNA, 19 nt, Homo sapiens
ugaagugaauagcauaugu

SEQ ID NO: 1485324 - RNA, 19 nt, Homo sapiens
agagagggcuagaccagaa

SEQ ID NO: 1485325 - RNA, 19 nt, Homo sapiens
uaacagucaugguggugaa

SEQ ID NO: 1485326 - RNA, 19 nt, Homo sapiens
ggcacaacguguuugauug

SEQ ID NO: 1485327 - RNA, 19 nt, Homo sapiens
gcaaagggaccuggcaguu

SEQ ID NO: 1485328 - RNA, 19 nt, Homo sapiens
caaagcaguguccaggaua

SEQ ID NO: 1485329 - RNA, 19 nt, Homo sapiens
aagcagauuuggaaugguu

SEQ ID NO: 1485330 - RNA, 19 nt, Homo sapiens
gcgugaacccauauugaua

SEQ ID NO: 1485331 - RNA, 19 nt, Homo sapiens
aacaguagaugaaggaaau

SEQ ID NO: 1485332 - RNA, 19 nt, Homo sapiens
gaauagcauaugugucauu

SEQ ID NO: 1485333 - RNA, 19 nt, Homo sapiens
gcuauuccuuugucucaug

SEQ ID NO: 1485334 - RNA, 19 nt, Homo sapiens
gggauuuggugggaaacua

SEQ ID NO: 1485335 - RNA, 19 nt, Homo sapiens
guuguguccucucuuugua

SEQ ID NO: 1485336 - RNA, 19 nt, Homo sapiens
aaagagagcaggugguuuc

SEQ ID NO: 1485337 - RNA, 19 nt, Homo sapiens
gaaggaaagaaagaggaua

SEQ ID NO: 1485338 - RNA, 19 nt, Homo sapiens
gcagauuuggaaugguuua

SEQ ID NO: 1485339 - RNA, 19 nt, Homo sapiens
acacuggucucuuuuaauu

SEQ ID NO: 1485340 - RNA, 19 nt, Homo sapiens
ccagacauccugaccuuug

SEQ ID NO: 1485341 - RNA, 19 nt, Homo sapiens
caggugguuucaucaguuu

SEQ ID NO: 1485342 - RNA, 19 nt, Homo sapiens
gagauuugcuuacuuuugu

SEQ ID NO: 1485343 - RNA, 19 nt, Homo sapiens
caggauagaauuugagaga

SEQ ID NO: 1485344 - RNA, 19 nt, Homo sapiens
gcuuaguccuuaccauaug

SEQ ID NO: 1485345 - RNA, 19 nt, Homo sapiens
cagcagauuuugucaauug

SEQ ID NO: 1485346 - RNA, 19 nt, Homo sapiens
caaagggaccuggcaguug

SEQ ID NO: 1485347 - RNA, 19 nt, Homo sapiens
gaaaggcagcagucuucaa

SEQ ID NO: 1485348 - RNA, 19 nt, Homo sapiens
aggaaaugauacugaauga

SEQ ID NO: 1485349 - RNA, 19 nt, Homo sapiens
cauuuagucucccugaaga

SEQ ID NO: 1485350 - RNA, 19 nt, Homo sapiens
gaagugaauagcauaugug

SEQ ID NO: 1485351 - RNA, 19 nt, Homo sapiens
gaagcaggcacaacguguu

SEQ ID NO: 1485352 - RNA, 19 nt, Homo sapiens
gaccagaacaugccugcuu

SEQ ID NO: 1485353 - RNA, 19 nt, Homo sapiens
ucuccaagcacuuaacuuu

SEQ ID NO: 1485354 - RNA, 19 nt, Homo sapiens
cagcagucuucaacauuug

SEQ ID NO: 1485355 - RNA, 19 nt, Homo sapiens
aguguucccuggcaaguaa

SEQ ID NO: 1485356 - RNA, 19 nt, Homo sapiens
gcaagccacaauaccauga

SEQ ID NO: 1485357 - RNA, 19 nt, Homo sapiens
uguaauaggcagcuguuaa

SEQ ID NO: 1485358 - RNA, 19 nt, Homo sapiens
cagacauccugaccuuuga

SEQ ID NO: 1485359 - RNA, 19 nt, Homo sapiens
aaagaaagaggauaaagag

SEQ ID NO: 1485360 - RNA, 19 nt, Homo sapiens
uugagagagugaagaaauu

SEQ ID NO: 1485361 - RNA, 19 nt, Homo sapiens
gugagcauuugugguuaua

SEQ ID NO: 1485362 - RNA, 19 nt, Homo sapiens
cuguaucgcuaauuuauca

SEQ ID NO: 1485363 - RNA, 19 nt, Homo sapiens
cgugaacccauauugauaa

SEQ ID NO: 1485364 - RNA, 19 nt, Homo sapiens
cacaguaagucaggaauuc

SEQ ID NO: 1485365 - RNA, 19 nt, Homo sapiens
aacagcaucuucaggacua

SEQ ID NO: 1485366 - RNA, 19 nt, Homo sapiens
ugaccaagaaaccacguua

SEQ ID NO: 1485367 - RNA, 19 nt, Homo sapiens
ucccuugcuuccuuuaaua

SEQ ID NO: 1485368 - RNA, 19 nt, Homo sapiens
gaggcugcccugacaauau

SEQ ID NO: 1485369 - RNA, 19 nt, Homo sapiens
gcacagagauccuuugaua

SEQ ID NO: 1485370 - RNA, 19 nt, Homo sapiens
gcagauaacuacacaagga

SEQ ID NO: 1485371 - RNA, 19 nt, Homo sapiens
ccacaaagcugacccgaau

SEQ ID NO: 1485372 - RNA, 19 nt, Homo sapiens
caacaacugugauguaaca

SEQ ID NO: 1485373 - RNA, 19 nt, Homo sapiens
ggucauaucaucacacuuu

SEQ ID NO: 1485374 - RNA, 19 nt, Homo sapiens
uguaauaacugcuaugaug

SEQ ID NO: 1485375 - RNA, 19 nt, Homo sapiens
ggaaacgaauuacacugaa

SEQ ID NO: 1485376 - RNA, 19 nt, Homo sapiens
gagauccuuugauacuuua

SEQ ID NO: 1485377 - RNA, 19 nt, Homo sapiens
ccaaugauacuucgcauaa

SEQ ID NO: 1485378 - RNA, 19 nt, Homo sapiens
ucauguaucuucugaauuc

SEQ ID NO: 1485379 - RNA, 19 nt, Homo sapiens
ggccuaugaucucuucuua

SEQ ID NO: 1485380 - RNA, 19 nt, Homo sapiens
uaacugcuaugauguugaa

SEQ ID NO: 1485381 - RNA, 19 nt, Homo sapiens
aguguaagcuaccaaauaa

SEQ ID NO: 1485382 - RNA, 19 nt, Homo sapiens
ccaccaauguuucaaauag

SEQ ID NO: 1485383 - RNA, 19 nt, Homo sapiens
ccaaguagcugggauuaca

SEQ ID NO: 1485384 - RNA, 19 nt, Homo sapiens
guaaagaaccaucuguuuc

SEQ ID NO: 1485385 - RNA, 19 nt, Homo sapiens
acagaaagagggaaagaua

SEQ ID NO: 1485386 - RNA, 19 nt, Homo sapiens
aaaggucacuucucccaaa

SEQ ID NO: 1485387 - RNA, 19 nt, Homo sapiens
cuaaucagauccaccaaug

SEQ ID NO: 1485388 - RNA, 19 nt, Homo sapiens
gaaacgaauuacacugaag

SEQ ID NO: 1485389 - RNA, 19 nt, Homo sapiens
uuacaagggaaacgaauua

SEQ ID NO: 1485390 - RNA, 19 nt, Homo sapiens
ggagugcaguggcgaaauc

SEQ ID NO: 1485391 - RNA, 19 nt, Homo sapiens
ggacauauuuucugagguu

SEQ ID NO: 1485392 - RNA, 19 nt, Homo sapiens
agagauccuuugauacuuu

SEQ ID NO: 1485393 - RNA, 19 nt, Homo sapiens
gcaguuaguugugaguuuc

SEQ ID NO: 1485394 - RNA, 19 nt, Homo sapiens
ggaguguccuggccagaga

SEQ ID NO: 1485395 - RNA, 19 nt, Homo sapiens
gggaaacgaauuacacuga

SEQ ID NO: 1485396 - RNA, 19 nt, Homo sapiens
cauggacuccucagaauaa

SEQ ID NO: 1485397 - RNA, 19 nt, Homo sapiens
gugaaugucaugcagauaa

SEQ ID NO: 1485398 - RNA, 19 nt, Homo sapiens
aaccaucuguuucuuauug

SEQ ID NO: 1485399 - RNA, 19 nt, Homo sapiens
cuacugugcuuccucuuug

SEQ ID NO: 1485400 - RNA, 19 nt, Homo sapiens
aguuauaggugugcauuua

SEQ ID NO: 1485401 - RNA, 19 nt, Homo sapiens
ggcaagcccuuaaaccaau

SEQ ID NO: 1485402 - RNA, 19 nt, Homo sapiens
caaacuccuucccugcuuu

SEQ ID NO: 1485403 - RNA, 19 nt, Homo sapiens
gaaucaagaccaauaccaa

SEQ ID NO: 1485404 - RNA, 19 nt, Homo sapiens
ccugauuucuguugacaaa

SEQ ID NO: 1485405 - RNA, 19 nt, Homo sapiens
gagggaaagauaaguuaaa

SEQ ID NO: 1485406 - RNA, 19 nt, Homo sapiens
ccaaucagacgaaauuuca

SEQ ID NO: 1485407 - RNA, 19 nt, Homo sapiens
ugucugcacucgucauuga

SEQ ID NO: 1485408 - RNA, 19 nt, Homo sapiens
uuagauaucugcaacaacu

SEQ ID NO: 1485409 - RNA, 19 nt, Homo sapiens
ccaaagugcugggauuaca

SEQ ID NO: 1485410 - RNA, 19 nt, Homo sapiens
uaacuacacaaggagauua

SEQ ID NO: 1485411 - RNA, 19 nt, Homo sapiens
ucaucacacuuuggucuua

SEQ ID NO: 1485412 - RNA, 19 nt, Homo sapiens
ucugagagaggacauauuu

SEQ ID NO: 1485413 - RNA, 19 nt, Homo sapiens
cugcuaugauguugaagua

SEQ ID NO: 1485414 - RNA, 19 nt, Homo sapiens
acacuuuggucuuauuuca

SEQ ID NO: 1485415 - RNA, 19 nt, Homo sapiens
cagaaagagggaaagauaa

SEQ ID NO: 1485416 - RNA, 19 nt, Homo sapiens
ggccaaggaugaugucagu

SEQ ID NO: 1485417 - RNA, 19 nt, Homo sapiens
cauccaaguucauguaucu

SEQ ID NO: 1485418 - RNA, 19 nt, Homo sapiens
ugacaaaguuacugcuagu

SEQ ID NO: 1485419 - RNA, 19 nt, Homo sapiens
ugcaacaacugugauguaa

SEQ ID NO: 1485420 - RNA, 19 nt, Homo sapiens
gaucuacgaguggauguaa

SEQ ID NO: 1485421 - RNA, 19 nt, Homo sapiens
ccaauaccaaggagaaauu

SEQ ID NO: 1485422 - RNA, 19 nt, Homo sapiens
caccaugccuggccagaau

SEQ ID NO: 1485423 - RNA, 19 nt, Homo sapiens
caccacacccagcuaauuu

SEQ ID NO: 1485424 - RNA, 19 nt, Homo sapiens
gagaggacauauuuucuga

SEQ ID NO: 1485425 - RNA, 19 nt, Homo sapiens
gccagucccugcacucuuc

SEQ ID NO: 1485426 - RNA, 19 nt, Homo sapiens
gauguaauaacugcuauga

SEQ ID NO: 1485427 - RNA, 19 nt, Homo sapiens
guugugaguuucugaguag

SEQ ID NO: 1485428 - RNA, 19 nt, Homo sapiens
gaugucaguucugcugcua

SEQ ID NO: 1485429 - RNA, 19 nt, Homo sapiens
ccaaacuccuucccugcuu

SEQ ID NO: 1485430 - RNA, 19 nt, Homo sapiens
ccuuagaggucugugaauu

SEQ ID NO: 1485431 - RNA, 19 nt, Homo sapiens
uggcgagacugaucuugaa

SEQ ID NO: 1485432 - RNA, 19 nt, Homo sapiens
uaugaucucuucuuagcau

SEQ ID NO: 1485433 - RNA, 19 nt, Homo sapiens
gcaagcccuuaaaccaaug

SEQ ID NO: 1485434 - RNA, 19 nt, Homo sapiens
uguaaagaaccaucuguuu

SEQ ID NO: 1485435 - RNA, 19 nt, Homo sapiens
ggacuccucagaauaaugg

SEQ ID NO: 1485436 - RNA, 19 nt, Homo sapiens
ucugugaauuguagguuaa

SEQ ID NO: 1485437 - RNA, 19 nt, Homo sapiens
guaauaacugcuaugaugu

SEQ ID NO: 1485438 - RNA, 19 nt, Homo sapiens
caaaggccaaugauacuuc

SEQ ID NO: 1485439 - RNA, 19 nt, Homo sapiens
gucauggacuccucagaau

SEQ ID NO: 1485440 - RNA, 19 nt, Homo sapiens
cuauacuuaucuccucaua

SEQ ID NO: 1485441 - RNA, 19 nt, Homo sapiens
aaucagauccaccaauguu

SEQ ID NO: 1485442 - RNA, 19 nt, Homo sapiens
gucugugaauuguagguua

SEQ ID NO: 1485443 - RNA, 19 nt, Homo sapiens
aaguguaagcuaccaaaua

SEQ ID NO: 1485444 - RNA, 19 nt, Homo sapiens
aagagggaaagauaaguua

SEQ ID NO: 1485445 - RNA, 19 nt, Homo sapiens
gaaagagggaaagauaagu

SEQ ID NO: 1485446 - RNA, 19 nt, Homo sapiens
ccuaugaucucuucuuagc

SEQ ID NO: 1485447 - RNA, 19 nt, Homo sapiens
cuacuagccuggaguugca

SEQ ID NO: 1485448 - RNA, 19 nt, Homo sapiens
ccaaggaugaugucaguuc

SEQ ID NO: 1485449 - RNA, 19 nt, Homo sapiens
uuagaggucugugaauugu

SEQ ID NO: 1485450 - RNA, 19 nt, Homo sapiens
guuauaggugugcauuuaa

SEQ ID NO: 1485451 - RNA, 19 nt, Homo sapiens
aaagagggaaagauaaguu

SEQ ID NO: 1485452 - RNA, 19 nt, Homo sapiens
cuacacaaggagauuaauu

SEQ ID NO: 1485453 - RNA, 19 nt, Homo sapiens
cagcauguuguaagcauuu

SEQ ID NO: 1485454 - RNA, 19 nt, Homo sapiens
caaggaugaugucaguucu

SEQ ID NO: 1485455 - RNA, 19 nt, Homo sapiens
ucagauccuuaucaccaaa

SEQ ID NO: 1485456 - RNA, 19 nt, Homo sapiens
gcuacugugcuuccucuuu

SEQ ID NO: 1485457 - RNA, 19 nt, Homo sapiens
gauccaccaauguuucaaa

SEQ ID NO: 1485458 - RNA, 19 nt, Homo sapiens
gauuucuguugacaaaguu

SEQ ID NO: 1485459 - RNA, 19 nt, Homo sapiens
ugauuucuguugacaaagu

SEQ ID NO: 1485460 - RNA, 19 nt, Homo sapiens
aaaggccuaugaucucuuc

SEQ ID NO: 1485461 - RNA, 19 nt, Homo sapiens
cagagauccuuugauacuu

SEQ ID NO: 1485462 - RNA, 19 nt, Homo sapiens
accaauggcuaaagcaguu

SEQ ID NO: 1485463 - RNA, 19 nt, Homo sapiens
caaugauacuucgcauaau

SEQ ID NO: 1485464 - RNA, 19 nt, Homo sapiens
agaggucugugaauuguag

SEQ ID NO: 1485465 - RNA, 19 nt, Homo sapiens
gaaccaucuguuucuuauu

SEQ ID NO: 1485466 - RNA, 19 nt, Homo sapiens
cauguguuaugugauguuu

SEQ ID NO: 1485467 - RNA, 19 nt, Homo sapiens
cagcuccacucugcucuug

SEQ ID NO: 1485468 - RNA, 19 nt, Homo sapiens
gaaguguaagcuaccaaau

SEQ ID NO: 1485469 - RNA, 19 nt, Homo sapiens
gauauaaccuucuauguga

SEQ ID NO: 1485470 - RNA, 19 nt, Homo sapiens
ggaaucacauuaaacauug

SEQ ID NO: 1485471 - RNA, 19 nt, Homo sapiens
gaaaaucacugucuuguug

SEQ ID NO: 1485472 - RNA, 19 nt, Homo sapiens
agaaguggaugaagaaauu

SEQ ID NO: 1485473 - RNA, 19 nt, Homo sapiens
gagaauugauugcuaaagu

SEQ ID NO: 1485474 - RNA, 19 nt, Homo sapiens
caacuuauggagaaucuua

SEQ ID NO: 1485475 - RNA, 19 nt, Homo sapiens
gaucuuuccuuuaacagaa

SEQ ID NO: 1485476 - RNA, 19 nt, Homo sapiens
gacaucaacuuauggagaa

SEQ ID NO: 1485477 - RNA, 19 nt, Homo sapiens
gcccgaagguggagaauug

SEQ ID NO: 1485478 - RNA, 19 nt, Homo sapiens
aaacaaaucucacuuucuc

SEQ ID NO: 1485479 - RNA, 19 nt, Homo sapiens
aagaaugacuggaaacaaa

SEQ ID NO: 1485480 - RNA, 19 nt, Homo sapiens
guauaacugucuauuguga

SEQ ID NO: 1485481 - RNA, 19 nt, Homo sapiens
ucacacaacaggagucuua

SEQ ID NO: 1485482 - RNA, 19 nt, Homo sapiens
cuaaagugcuacauaagaa

SEQ ID NO: 1485483 - RNA, 19 nt, Homo sapiens
caaaauaacucaugaugga

SEQ ID NO: 1485484 - RNA, 19 nt, Homo sapiens
cagcaggaaucacauuaaa

SEQ ID NO: 1485485 - RNA, 19 nt, Homo sapiens
gcgcgaaucuccagaaucu

SEQ ID NO: 1485486 - RNA, 19 nt, Homo sapiens
caacauagagggagaagga

SEQ ID NO: 1485487 - RNA, 19 nt, Homo sapiens
gcaaugcugcaaauuaauu

SEQ ID NO: 1485488 - RNA, 19 nt, Homo sapiens
cgaaacugcuucagaaaca

SEQ ID NO: 1485489 - RNA, 19 nt, Homo sapiens
cauuaaacauugcugguaa

SEQ ID NO: 1485490 - RNA, 19 nt, Homo sapiens
ggauauaaccuucuaugug

SEQ ID NO: 1485491 - RNA, 19 nt, Homo sapiens
gcaggaaucacauuaaaca

SEQ ID NO: 1485492 - RNA, 19 nt, Homo sapiens
ucaaauggguugucuaaaa

SEQ ID NO: 1485493 - RNA, 19 nt, Homo sapiens
guauuuggcugauguacug

SEQ ID NO: 1485494 - RNA, 19 nt, Homo sapiens
guggagaauugauugcuaa

SEQ ID NO: 1485495 - RNA, 19 nt, Homo sapiens
acacuugucuuauuguuuc

SEQ ID NO: 1485496 - RNA, 19 nt, Homo sapiens
ggaagagucuacaguccau

SEQ ID NO: 1485497 - RNA, 19 nt, Homo sapiens
gcuaaagugcuacauaaga

SEQ ID NO: 1485498 - RNA, 19 nt, Homo sapiens
auacagauguggagccauu

SEQ ID NO: 1485499 - RNA, 19 nt, Homo sapiens
gaugucagcugcaacaaaa

SEQ ID NO: 1485500 - RNA, 19 nt, Homo sapiens
uugcuaaagugcuacauaa

SEQ ID NO: 1485501 - RNA, 19 nt, Homo sapiens
gaagguggagaauugauug

SEQ ID NO: 1485502 - RNA, 19 nt, Homo sapiens
ucauacacuugucuuauug

SEQ ID NO: 1485503 - RNA, 19 nt, Homo sapiens
agaaucggacucugaaaua

SEQ ID NO: 1485504 - RNA, 19 nt, Homo sapiens
gguggagaauugauugcua

SEQ ID NO: 1485505 - RNA, 19 nt, Homo sapiens
gaaacugcuucagaaacaa

SEQ ID NO: 1485506 - RNA, 19 nt, Homo sapiens
agaaagaguuacaggugaa

SEQ ID NO: 1485507 - RNA, 19 nt, Homo sapiens
gaaguggaugaagaaauua

SEQ ID NO: 1485508 - RNA, 19 nt, Homo sapiens
cuacguguauaacauauuc

SEQ ID NO: 1485509 - RNA, 19 nt, Homo sapiens
gcagcaggaaucacauuaa

SEQ ID NO: 1485510 - RNA, 19 nt, Homo sapiens
aaucucacuuucucucaua

SEQ ID NO: 1485511 - RNA, 19 nt, Homo sapiens
gcacuuucacaaucaauga

SEQ ID NO: 1485512 - RNA, 19 nt, Homo sapiens
caaacuaucucagugaaac

SEQ ID NO: 1485513 - RNA, 19 nt, Homo sapiens
gugaugcacuguaucugaa

SEQ ID NO: 1485514 - RNA, 19 nt, Homo sapiens
guauacaacaguuauguga

SEQ ID NO: 1485515 - RNA, 19 nt, Homo sapiens
ggccgcauguugaaagaaa

SEQ ID NO: 1485516 - RNA, 19 nt, Homo sapiens
guguauaucuugcagaagu

SEQ ID NO: 1485517 - RNA, 19 nt, Homo sapiens
ucuaaucuguguauggaaa

SEQ ID NO: 1485518 - RNA, 19 nt, Homo sapiens
auacaacaguuaugugaug

SEQ ID NO: 1485519 - RNA, 19 nt, Homo sapiens
ccaagaaguggaugaagaa

SEQ ID NO: 1485520 - RNA, 19 nt, Homo sapiens
cugcgaaacugcuucagaa

SEQ ID NO: 1485521 - RNA, 19 nt, Homo sapiens
guuuggauguuggauauaa

SEQ ID NO: 1485522 - RNA, 19 nt, Homo sapiens
gcaacaaaauaacucauga

SEQ ID NO: 1485523 - RNA, 19 nt, Homo sapiens
guuaugugaugcacuguau

SEQ ID NO: 1485524 - RNA, 19 nt, Homo sapiens
gaugaggcuacguguauaa

SEQ ID NO: 1485525 - RNA, 19 nt, Homo sapiens
gaaucggacucugaaauac

SEQ ID NO: 1485526 - RNA, 19 nt, Homo sapiens
cauaagaaucggacucuga

SEQ ID NO: 1485527 - RNA, 19 nt, Homo sapiens
ugugguagauggacgugua

SEQ ID NO: 1485528 - RNA, 19 nt, Homo sapiens
ucucucauaucuacauuug

SEQ ID NO: 1485529 - RNA, 19 nt, Homo sapiens
acacuacccuggaaguaau

SEQ ID NO: 1485530 - RNA, 19 nt, Homo sapiens
gcauauacuccaagaagug

SEQ ID NO: 1485531 - RNA, 19 nt, Homo sapiens
gaggcuacguguauaacau

SEQ ID NO: 1485532 - RNA, 19 nt, Homo sapiens
caacacuacccuggaagua

SEQ ID NO: 1485533 - RNA, 19 nt, Homo sapiens
aagcaacacuacccuggaa

SEQ ID NO: 1485534 - RNA, 19 nt, Homo sapiens
agaauugauugcuaaagug

SEQ ID NO: 1485535 - RNA, 19 nt, Homo sapiens
cagaaacaacuuaaucuca

SEQ ID NO: 1485536 - RNA, 19 nt, Homo sapiens
gcaaacuaucucagugaaa

SEQ ID NO: 1485537 - RNA, 19 nt, Homo sapiens
gcgcaaacuaucucaguga

SEQ ID NO: 1485538 - RNA, 19 nt, Homo sapiens
augauggaaugguguauuu

SEQ ID NO: 1485539 - RNA, 19 nt, Homo sapiens
acucugaaauaccuaagaa

SEQ ID NO: 1485540 - RNA, 19 nt, Homo sapiens
ugaugaggcuacguguaua

SEQ ID NO: 1485541 - RNA, 19 nt, Homo sapiens
agaaggacuuguugcacuu

SEQ ID NO: 1485542 - RNA, 19 nt, Homo sapiens
uauuggacaucaacuuaug

SEQ ID NO: 1485543 - RNA, 19 nt, Homo sapiens
ugaaauaccuaagaaugac

SEQ ID NO: 1485544 - RNA, 19 nt, Homo sapiens
ucagugaaacucuuacuuc

SEQ ID NO: 1485545 - RNA, 19 nt, Homo sapiens
gaaaauaaagguggaaugu

SEQ ID NO: 1485546 - RNA, 19 nt, Homo sapiens
cugaaauaccuaagaauga

SEQ ID NO: 1485547 - RNA, 19 nt, Homo sapiens
gaaggacuuguugcacuuu

SEQ ID NO: 1485548 - RNA, 19 nt, Homo sapiens
ugauguuggugcauacuau

SEQ ID NO: 1485549 - RNA, 19 nt, Homo sapiens
gauggacguguauaucuug

SEQ ID NO: 1485550 - RNA, 19 nt, Homo sapiens
gcauuauuauuggacauca

SEQ ID NO: 1485551 - RNA, 19 nt, Homo sapiens
uugcagaagucuccaaugg

SEQ ID NO: 1485552 - RNA, 19 nt, Homo sapiens
uuaaagcguugucaguagu

SEQ ID NO: 1485553 - RNA, 19 nt, Homo sapiens
cuuaaagcguugucaguag

SEQ ID NO: 1485554 - RNA, 19 nt, Homo sapiens
uaucucagugaaacucuua

SEQ ID NO: 1485555 - RNA, 19 nt, Homo sapiens
aaacagugguauacaacag

SEQ ID NO: 1485556 - RNA, 19 nt, Homo sapiens
ucacugucuuguugcacua

SEQ ID NO: 1485557 - RNA, 19 nt, Homo sapiens
gaguuacaggugaagauuu

SEQ ID NO: 1485558 - RNA, 19 nt, Homo sapiens
gguagauggacguguauau

SEQ ID NO: 1485559 - RNA, 19 nt, Homo sapiens
guagucagcaacaacauag

SEQ ID NO: 1485560 - RNA, 19 nt, Homo sapiens
gcugcaaauuaauucauca

SEQ ID NO: 1485561 - RNA, 19 nt, Homo sapiens
gcuagcagcaggaaucaca

SEQ ID NO: 1485562 - RNA, 19 nt, Homo sapiens
cgaagguggagaauugauu

SEQ ID NO: 1485563 - RNA, 19 nt, Homo sapiens
cgcaaacuaucucagugaa

SEQ ID NO: 1485564 - RNA, 19 nt, Homo sapiens
gggugacugugaucuggaa

SEQ ID NO: 1485565 - RNA, 19 nt, Homo sapiens
ugguuuggauguuggauau

SEQ ID NO: 1485566 - RNA, 19 nt, Homo sapiens
guagauggacguguauauc

SEQ ID NO: 1485567 - RNA, 19 nt, Homo sapiens
acagugguauacaacaguu

SEQ ID NO: 1485568 - RNA, 19 nt, Homo sapiens
ucugaaauaccuaagaaug

SEQ ID NO: 1485569 - RNA, 19 nt, Homo sapiens
gaagaaauaugucaacuca

SEQ ID NO: 1485570 - RNA, 19 nt, Homo sapiens
caaacaagcuggacaagaa

SEQ ID NO: 1485571 - RNA, 19 nt, Homo sapiens
ggaccgaggugauugauaa

SEQ ID NO: 1485572 - RNA, 19 nt, Homo sapiens
cagaagagcuuagcaauug

SEQ ID NO: 1485573 - RNA, 19 nt, Homo sapiens
gcaaauucguccucgacua

SEQ ID NO: 1485574 - RNA, 19 nt, Homo sapiens
gaacuucacaguagccauu

SEQ ID NO: 1485575 - RNA, 19 nt, Homo sapiens
gaagaaauguaagaagaag

SEQ ID NO: 1485576 - RNA, 19 nt, Homo sapiens
cggaagaaauguaagaaga

SEQ ID NO: 1485577 - RNA, 19 nt, Homo sapiens
acagaacggugaagauuga

SEQ ID NO: 1485578 - RNA, 19 nt, Homo sapiens
ggaagaaauguaagaagaa

SEQ ID NO: 1485579 - RNA, 19 nt, Homo sapiens
gcagaagagcuuagcaauu

SEQ ID NO: 1485580 - RNA, 19 nt, Homo sapiens
caagaagugugggaccaua

SEQ ID NO: 1485581 - RNA, 19 nt, Homo sapiens
ccaccaagauugaaauuac

SEQ ID NO: 1485582 - RNA, 19 nt, Homo sapiens
caagacagagguugugaaa

SEQ ID NO: 1485583 - RNA, 19 nt, Homo sapiens
ggacuucuuugggaaauca

SEQ ID NO: 1485584 - RNA, 19 nt, Homo sapiens
gagagaucauccaggacua

SEQ ID NO: 1485585 - RNA, 19 nt, Homo sapiens
gcagagggccuggcacuau

SEQ ID NO: 1485586 - RNA, 19 nt, Homo sapiens
ccaccucucugccuucaug

SEQ ID NO: 1485587 - RNA, 19 nt, Homo sapiens
caaauucguccucgacuau

SEQ ID NO: 1485588 - RNA, 19 nt, Homo sapiens
ggaaccagguguugagcau

SEQ ID NO: 1485589 - RNA, 19 nt, Homo sapiens
caauggagacuaugacaga

SEQ ID NO: 1485590 - RNA, 19 nt, Homo sapiens
gcccugaggauuccacaua

SEQ ID NO: 1485591 - RNA, 19 nt, Homo sapiens
gcaaggcccagaaccaguu

SEQ ID NO: 1485592 - RNA, 19 nt, Homo sapiens
gaacggugaagauugaugu

SEQ ID NO: 1485593 - RNA, 19 nt, Homo sapiens
gcccaugucuaucauuauc

SEQ ID NO: 1485594 - RNA, 19 nt, Homo sapiens
gcaaacaagcuggacaaga

SEQ ID NO: 1485595 - RNA, 19 nt, Homo sapiens
ggaaccugcuagaccuuga

SEQ ID NO: 1485596 - RNA, 19 nt, Homo sapiens
cuacuuugcuccugucauc

SEQ ID NO: 1485597 - RNA, 19 nt, Homo sapiens
cggugaagauugaugugua

SEQ ID NO: 1485598 - RNA, 19 nt, Homo sapiens
ugacagaacggugaagauu

SEQ ID NO: 1485599 - RNA, 19 nt, Homo sapiens
cgucagcgccuccucauug

SEQ ID NO: 1485600 - RNA, 19 nt, Homo sapiens
gcaaugaggauggcacguu

SEQ ID NO: 1485601 - RNA, 19 nt, Homo sapiens
cuucccagcuuauggcuuu

SEQ ID NO: 1485602 - RNA, 19 nt, Homo sapiens
gaagugugggaccauauug

SEQ ID NO: 1485603 - RNA, 19 nt, Homo sapiens
gaagaagaaauaugucaac

SEQ ID NO: 1485604 - RNA, 19 nt, Homo sapiens
ggaagccacgauuucauug

SEQ ID NO: 1485605 - RNA, 19 nt, Homo sapiens
gacagaacggugaagauug

SEQ ID NO: 1485606 - RNA, 19 nt, Homo sapiens
uugcccaugucuaucauua

SEQ ID NO: 1485607 - RNA, 19 nt, Homo sapiens
ggauggaagccacgauuuc

SEQ ID NO: 1485608 - RNA, 19 nt, Homo sapiens
gcagcugugugcaaacaag

SEQ ID NO: 1485609 - RNA, 19 nt, Homo sapiens
ggacggaccgaggugauug

SEQ ID NO: 1485610 - RNA, 19 nt, Homo sapiens
acccacugcuucugcuuua

SEQ ID NO: 1485611 - RNA, 19 nt, Homo sapiens
ccucauugcccaugucuau

SEQ ID NO: 1485612 - RNA, 19 nt, Homo sapiens
gauggaagccacgauuuca

SEQ ID NO: 1485613 - RNA, 19 nt, Homo sapiens
gaugugcgcguguccucua

SEQ ID NO: 1485614 - RNA, 19 nt, Homo sapiens
uguaggaccagccauguuu

SEQ ID NO: 1485615 - RNA, 19 nt, Homo sapiens
cacaguagccauugacuuc

SEQ ID NO: 1485616 - RNA, 19 nt, Homo sapiens
ggugaagauugauguguac

SEQ ID NO: 1485617 - RNA, 19 nt, Homo sapiens
gggauggaagccacgauuu

SEQ ID NO: 1485618 - RNA, 19 nt, Homo sapiens
aaucugcgcuucgaugugu

SEQ ID NO: 1485619 - RNA, 19 nt, Homo sapiens
cagagggccuggcacuauc

SEQ ID NO: 1485620 - RNA, 19 nt, Homo sapiens
caguauaugagguucuuaa

SEQ ID NO: 1485621 - RNA, 19 nt, Homo sapiens
cguccucgacuauuucuuu

SEQ ID NO: 1485622 - RNA, 19 nt, Homo sapiens
guuggacggugaugaugug

SEQ ID NO: 1485623 - RNA, 19 nt, Homo sapiens
ugacagugauaagcucuuc

SEQ ID NO: 1485624 - RNA, 19 nt, Homo sapiens
gccuucaugccaauaauaa

SEQ ID NO: 1485625 - RNA, 19 nt, Homo sapiens
cuaccucccugcacuacau

SEQ ID NO: 1485626 - RNA, 19 nt, Homo sapiens
gagggacacagcugaacuu

SEQ ID NO: 1485627 - RNA, 19 nt, Homo sapiens
cgauuucauuggugaguuc

SEQ ID NO: 1485628 - RNA, 19 nt, Homo sapiens
gaaaucagaccccuuccuu

SEQ ID NO: 1485629 - RNA, 19 nt, Homo sapiens
gagcagcccugaggauucc

SEQ ID NO: 1485630 - RNA, 19 nt, Homo sapiens
ggacuaugacagugauaag

SEQ ID NO: 1485631 - RNA, 19 nt, Homo sapiens
ccaggacuaugacagugau

SEQ ID NO: 1485632 - RNA, 19 nt, Homo sapiens
gaagagcuuagcaauuguc

SEQ ID NO: 1485633 - RNA, 19 nt, Homo sapiens
guacuauguucugcucauc

SEQ ID NO: 1485634 - RNA, 19 nt, Homo sapiens
cacaguauaugagguucuu

SEQ ID NO: 1485635 - RNA, 19 nt, Homo sapiens
aauucguccucgacuauuu

SEQ ID NO: 1485636 - RNA, 19 nt, Homo sapiens
uggaagccacgauuucauu

SEQ ID NO: 1485637 - RNA, 19 nt, Homo sapiens
ucugugcaauggagacuau

SEQ ID NO: 1485638 - RNA, 19 nt, Homo sapiens
ugcuagaccuugauaccuu

SEQ ID NO: 1485639 - RNA, 19 nt, Homo sapiens
ucuaugggcccaccuacuu

SEQ ID NO: 1485640 - RNA, 19 nt, Homo sapiens
guucacaguauaugagguu

SEQ ID NO: 1485641 - RNA, 19 nt, Homo sapiens
aaaccaacaucuccaaacc

SEQ ID NO: 1485642 - RNA, 19 nt, Homo sapiens
gcgcuucgauguguacaac

SEQ ID NO: 1485643 - RNA, 19 nt, Homo sapiens
gccaccaagauugaaauua

SEQ ID NO: 1485644 - RNA, 19 nt, Homo sapiens
cagagcagcccugaggauu

SEQ ID NO: 1485645 - RNA, 19 nt, Homo sapiens
guccucgacuauuucuuug

SEQ ID NO: 1485646 - RNA, 19 nt, Homo sapiens
gugcaaacaagcuggacaa

SEQ ID NO: 1485647 - RNA, 19 nt, Homo sapiens
agaagagcuuagcaauugu

SEQ ID NO: 1485648 - RNA, 19 nt, Homo sapiens
ccaauaauaaagcugaucu

SEQ ID NO: 1485649 - RNA, 19 nt, Homo sapiens
gcacuaucaccaccucucu

SEQ ID NO: 1485650 - RNA, 19 nt, Homo sapiens
ucacugggagggccaacuu

SEQ ID NO: 1485651 - RNA, 19 nt, Homo sapiens
ccucgacuauuucuuugag

SEQ ID NO: 1485652 - RNA, 19 nt, Homo sapiens
uaugucaacucaggaacug

SEQ ID NO: 1485653 - RNA, 19 nt, Homo sapiens
aaauaugucaacucaggaa

SEQ ID NO: 1485654 - RNA, 19 nt, Homo sapiens
agaagugugggaccauauu

SEQ ID NO: 1485655 - RNA, 19 nt, Homo sapiens
uauaugcgcaccagagaca

SEQ ID NO: 1485656 - RNA, 19 nt, Homo sapiens
uugaggcaauggaagaguu

SEQ ID NO: 1485657 - RNA, 19 nt, Homo sapiens
agggugugcuggagagcua

SEQ ID NO: 1485658 - RNA, 19 nt, Homo sapiens
cgacuauuucuuugaggaa

SEQ ID NO: 1485659 - RNA, 19 nt, Homo sapiens
ugacuucacggcuuccaau

SEQ ID NO: 1485660 - RNA, 19 nt, Homo sapiens
gaagccacgauuucauugg

SEQ ID NO: 1485661 - RNA, 19 nt, Homo sapiens
cccugaggauuccacauau

SEQ ID NO: 1485662 - RNA, 19 nt, Homo sapiens
guaggaccagccauguuug

SEQ ID NO: 1485663 - RNA, 19 nt, Homo sapiens
ucauugcccaugucuauca

SEQ ID NO: 1485664 - RNA, 19 nt, Homo sapiens
ucugauggcucccaguacu

SEQ ID NO: 1485665 - RNA, 19 nt, Homo sapiens
ucucugauggcucccagua

SEQ ID NO: 1485666 - RNA, 19 nt, Homo sapiens
gcagccaagaucucugaug

SEQ ID NO: 1485667 - RNA, 19 nt, Homo sapiens
gagaucauccaggacuaug

SEQ ID NO: 1485668 - RNA, 19 nt, Homo sapiens
ucaaggcagugggagagau

SEQ ID NO: 1485669 - RNA, 19 nt, Homo sapiens
gcagcaaccuguuugaaua

SEQ ID NO: 1485670 - RNA, 19 nt, Homo sapiens
ggaaguagaugaugaggaa

SEQ ID NO: 1485671 - RNA, 19 nt, Homo sapiens
gaagaugguugacuaguga

SEQ ID NO: 1485672 - RNA, 19 nt, Homo sapiens
gcaagaaaaucgaaguuua

SEQ ID NO: 1485673 - RNA, 19 nt, Homo sapiens
gaaguuaugagaugaauga

SEQ ID NO: 1485674 - RNA, 19 nt, Homo sapiens
cagaucauguaaccuauua

SEQ ID NO: 1485675 - RNA, 19 nt, Homo sapiens
gaugauuucucucuucuug

SEQ ID NO: 1485676 - RNA, 19 nt, Homo sapiens
ggaauaagaagaugaugaa

SEQ ID NO: 1485677 - RNA, 19 nt, Homo sapiens
uggagaagccuaagaaaua

SEQ ID NO: 1485678 - RNA, 19 nt, Homo sapiens
gaaccaagcguuucuucaa

SEQ ID NO: 1485679 - RNA, 19 nt, Homo sapiens
ggagacaauuugaaugaau

SEQ ID NO: 1485680 - RNA, 19 nt, Homo sapiens
ucagagaaguuaugagaug

SEQ ID NO: 1485681 - RNA, 19 nt, Homo sapiens
ggagggauguacuuucaga

SEQ ID NO: 1485682 - RNA, 19 nt, Homo sapiens
gaggagacaauuugaauga

SEQ ID NO: 1485683 - RNA, 19 nt, Homo sapiens
gaaauacaauccaggucau

SEQ ID NO: 1485684 - RNA, 19 nt, Homo sapiens
caauacagucgaagugaua

SEQ ID NO: 1485685 - RNA, 19 nt, Homo sapiens
gacuaggacuccacaguga

SEQ ID NO: 1485686 - RNA, 19 nt, Homo sapiens
gaagaggagacaauuugaa

SEQ ID NO: 1485687 - RNA, 19 nt, Homo sapiens
ggagaagccuaagaaauac

SEQ ID NO: 1485688 - RNA, 19 nt, Homo sapiens
uaaugacaguagagaagua

SEQ ID NO: 1485689 - RNA, 19 nt, Homo sapiens
gaggaugauuucucucuuc

SEQ ID NO: 1485690 - RNA, 19 nt, Homo sapiens
gcaaggcagugaccaagag

SEQ ID NO: 1485691 - RNA, 19 nt, Homo sapiens
caaauggaaccaagcguuu

SEQ ID NO: 1485692 - RNA, 19 nt, Homo sapiens
gcaaauauggaacaaaugg

SEQ ID NO: 1485693 - RNA, 19 nt, Homo sapiens
gauagcagcaagaagaauu

SEQ ID NO: 1485694 - RNA, 19 nt, Homo sapiens
cagugaagaugguugacua

SEQ ID NO: 1485695 - RNA, 19 nt, Homo sapiens
gagacaauuugaaugaauc

SEQ ID NO: 1485696 - RNA, 19 nt, Homo sapiens
gggauguacuuucagauca

SEQ ID NO: 1485697 - RNA, 19 nt, Homo sapiens
ggacuggugucaacaacuc

SEQ ID NO: 1485698 - RNA, 19 nt, Homo sapiens
gaacucagccaggaauuca

SEQ ID NO: 1485699 - RNA, 19 nt, Homo sapiens
ggaagaggagacaauuuga

SEQ ID NO: 1485700 - RNA, 19 nt, Homo sapiens
ccugaaaugucacaagaga

SEQ ID NO: 1485701 - RNA, 19 nt, Homo sapiens
ccauuucgccucccauuaa

SEQ ID NO: 1485702 - RNA, 19 nt, Homo sapiens
gcuaaggcuucuagacuuc

SEQ ID NO: 1485703 - RNA, 19 nt, Homo sapiens
caaccuguuugaauacaau

SEQ ID NO: 1485704 - RNA, 19 nt, Homo sapiens
ugauuucucucuucuuguu

SEQ ID NO: 1485705 - RNA, 19 nt, Homo sapiens
caagauaugccugaaaugu

SEQ ID NO: 1485706 - RNA, 19 nt, Homo sapiens
ugaagaugguugacuagug

SEQ ID NO: 1485707 - RNA, 19 nt, Homo sapiens
gcuaagaggaauaagaaga

SEQ ID NO: 1485708 - RNA, 19 nt, Homo sapiens
ggaggaugauuucucucuu

SEQ ID NO: 1485709 - RNA, 19 nt, Homo sapiens
agauaugccugaaauguca

SEQ ID NO: 1485710 - RNA, 19 nt, Homo sapiens
aaugucagaugcaaauuug

SEQ ID NO: 1485711 - RNA, 19 nt, Homo sapiens
gagaaguuaugagaugaau

SEQ ID NO: 1485712 - RNA, 19 nt, Homo sapiens
ggucaucuacuucaaacaa

SEQ ID NO: 1485713 - RNA, 19 nt, Homo sapiens
acgcaaauauggaacaaau

SEQ ID NO: 1485714 - RNA, 19 nt, Homo sapiens
gugcuaagaggaauaagaa

SEQ ID NO: 1485715 - RNA, 19 nt, Homo sapiens
cagaagagaccaauacagu

SEQ ID NO: 1485716 - RNA, 19 nt, Homo sapiens
gagcagaagagaccaauac

SEQ ID NO: 1485717 - RNA, 19 nt, Homo sapiens
caauccaggucaucuacuu

SEQ ID NO: 1485718 - RNA, 19 nt, Homo sapiens
cagagaaguuaugagauga

SEQ ID NO: 1485719 - RNA, 19 nt, Homo sapiens
gcaaccuguuugaauacaa

SEQ ID NO: 1485720 - RNA, 19 nt, Homo sapiens
gaaaaugucagaugcaaau

SEQ ID NO: 1485721 - RNA, 19 nt, Homo sapiens
aaggagggauguacuuuca

SEQ ID NO: 1485722 - RNA, 19 nt, Homo sapiens
gaacaacggcaagauaugc

SEQ ID NO: 1485723 - RNA, 19 nt, Homo sapiens
uaaagaugacgcaaauaug

SEQ ID NO: 1485724 - RNA, 19 nt, Homo sapiens
ggauguacuuucagaucau

SEQ ID NO: 1485725 - RNA, 19 nt, Homo sapiens
uaagaggaauaagaagaug

SEQ ID NO: 1485726 - RNA, 19 nt, Homo sapiens
cuaaggcuuugaauucaug

SEQ ID NO: 1485727 - RNA, 19 nt, Homo sapiens
ccaauacagucgaagugau

SEQ ID NO: 1485728 - RNA, 19 nt, Homo sapiens
gaguacuaauggcaagaaa

SEQ ID NO: 1485729 - RNA, 19 nt, Homo sapiens
caauuuacagcuccacaaa

SEQ ID NO: 1485730 - RNA, 19 nt, Homo sapiens
cuuguuaccugccugcauu

SEQ ID NO: 1485731 - RNA, 19 nt, Homo sapiens
uggaagaggagacaauuug

SEQ ID NO: 1485732 - RNA, 19 nt, Homo sapiens
gcaauuuacagcuccacaa

SEQ ID NO: 1485733 - RNA, 19 nt, Homo sapiens
ccaagcguuucuucaacuu

SEQ ID NO: 1485734 - RNA, 19 nt, Homo sapiens
aguuaaagaugacgcaaau

SEQ ID NO: 1485735 - RNA, 19 nt, Homo sapiens
aaagaugacgcaaauaugg

SEQ ID NO: 1485736 - RNA, 19 nt, Homo sapiens
gaugaggaaagugugauuu

SEQ ID NO: 1485737 - RNA, 19 nt, Homo sapiens
gaaguagcagcaaccuguu

SEQ ID NO: 1485738 - RNA, 19 nt, Homo sapiens
gcagugaccaagagagcaa

SEQ ID NO: 1485739 - RNA, 19 nt, Homo sapiens
gucaucuacuucaaacaaa

SEQ ID NO: 1485740 - RNA, 19 nt, Homo sapiens
gauguacuuucagaucaug

SEQ ID NO: 1485741 - RNA, 19 nt, Homo sapiens
ggguacgccugcaguuuca

SEQ ID NO: 1485742 - RNA, 19 nt, Homo sapiens
ccugaacaacggcaagaua

SEQ ID NO: 1485743 - RNA, 19 nt, Homo sapiens
gaauccucaugaucuacaa

SEQ ID NO: 1485744 - RNA, 19 nt, Homo sapiens
acaggaggaugauuucucu

SEQ ID NO: 1485745 - RNA, 19 nt, Homo sapiens
ugaaugagagagcagaaga

SEQ ID NO: 1485746 - RNA, 19 nt, Homo sapiens
ugccugaaaugucacaaga

SEQ ID NO: 1485747 - RNA, 19 nt, Homo sapiens
gaugaugaggaaaguguga

SEQ ID NO: 1485748 - RNA, 19 nt, Homo sapiens
ccacagugaagaugguuga

SEQ ID NO: 1485749 - RNA, 19 nt, Homo sapiens
uuucagaucauguaaccua

SEQ ID NO: 1485750 - RNA, 19 nt, Homo sapiens
guacuuucagaucauguaa

SEQ ID NO: 1485751 - RNA, 19 nt, Homo sapiens
ggaaccaagcguuucuuca

SEQ ID NO: 1485752 - RNA, 19 nt, Homo sapiens
gaaaaucgaaguuuaucug

SEQ ID NO: 1485753 - RNA, 19 nt, Homo sapiens
aauaaagucacugcaauug

SEQ ID NO: 1485754 - RNA, 19 nt, Homo sapiens
guacuaaaggagggaugua

SEQ ID NO: 1485755 - RNA, 19 nt, Homo sapiens
gagagcaaggcuucagaga

SEQ ID NO: 1485756 - RNA, 19 nt, Homo sapiens
gcaagauaugccugaaaug

SEQ ID NO: 1485757 - RNA, 19 nt, Homo sapiens
uucaggagcuuaagaaucg

SEQ ID NO: 1485758 - RNA, 19 nt, Homo sapiens
cuaagaggaauaagaagau

SEQ ID NO: 1485759 - RNA, 19 nt, Homo sapiens
cauguuccauucccguuuc

SEQ ID NO: 1485760 - RNA, 19 nt, Homo sapiens
gucacaagagaccagauua

SEQ ID NO: 1485761 - RNA, 19 nt, Homo sapiens
ggaacucagccaggaauuc

SEQ ID NO: 1485762 - RNA, 19 nt, Homo sapiens
caacuugagucugggaacu

SEQ ID NO: 1485763 - RNA, 19 nt, Homo sapiens
ucagaugcaaauuuggaua

SEQ ID NO: 1485764 - RNA, 19 nt, Homo sapiens
ugacgcaaauauggaacaa

SEQ ID NO: 1485765 - RNA, 19 nt, Homo sapiens
cgacugugcuaagaggaau

SEQ ID NO: 1485766 - RNA, 19 nt, Homo sapiens
acucacaggaggaugauuu

SEQ ID NO: 1485767 - RNA, 19 nt, Homo sapiens
gaccaauacagucgaagug

SEQ ID NO: 1485768 - RNA, 19 nt, Homo sapiens
ccaggucaucuacuucaaa

SEQ ID NO: 1485769 - RNA, 19 nt, Homo sapiens
ccaagaagcuggagaaacu

SEQ ID NO: 1485770 - RNA, 19 nt, Homo sapiens
gagaagcacagggaacuua

SEQ ID NO: 1485771 - RNA, 19 nt, Homo sapiens
agagagauguggccaagaa

SEQ ID NO: 1485772 - RNA, 19 nt, Homo sapiens
gaacuuaggcugcggaacu

SEQ ID NO: 1485773 - RNA, 19 nt, Homo sapiens
gaugaggaccugaagaaga

SEQ ID NO: 1485774 - RNA, 19 nt, Homo sapiens
gagacucccugcccaucaa

SEQ ID NO: 1485775 - RNA, 19 nt, Homo sapiens
ccaaagaccaagcaucuca

SEQ ID NO: 1485776 - RNA, 19 nt, Homo sapiens
gccaucaccuccaguuugg

SEQ ID NO: 1485777 - RNA, 19 nt, Homo sapiens
ggaggaagaaggcgagaag

SEQ ID NO: 1485778 - RNA, 19 nt, Homo sapiens
ugacugggaccucaagaga

SEQ ID NO: 1485779 - RNA, 19 nt, Homo sapiens
acugggaccucaagagaga

SEQ ID NO: 1485780 - RNA, 19 nt, Homo sapiens
gggcuaggcuugccaucac

SEQ ID NO: 1485781 - RNA, 19 nt, Homo sapiens
ucagagaagaggaggaaga

SEQ ID NO: 1485782 - RNA, 19 nt, Homo sapiens
gaugaggucagcuccuugu

SEQ ID NO: 1485783 - RNA, 19 nt, Homo sapiens
gaccugugacuccgacuga

SEQ ID NO: 1485784 - RNA, 19 nt, Homo sapiens
ugaaggcccuacgggagaa

SEQ ID NO: 1485785 - RNA, 19 nt, Homo sapiens
cagagaagaggaggaagaa

SEQ ID NO: 1485786 - RNA, 19 nt, Homo sapiens
ggaggcagaaccagcaaca

SEQ ID NO: 1485787 - RNA, 19 nt, Homo sapiens
ggacucagagggcuauugc

SEQ ID NO: 1485788 - RNA, 19 nt, Homo sapiens
gcagaaccagcaacaacuc

SEQ ID NO: 1485789 - RNA, 19 nt, Homo sapiens
caagaagcuggagaaacua

SEQ ID NO: 1485790 - RNA, 19 nt, Homo sapiens
cuggaaauagaaacaagua

SEQ ID NO: 1485791 - RNA, 19 nt, Homo sapiens
uggaugaggucagcuccuu

SEQ ID NO: 1485792 - RNA, 19 nt, Homo sapiens
caaguaaaccccugugugu

SEQ ID NO: 1485793 - RNA, 19 nt, Homo sapiens
gaagauggggagccaaaga

SEQ ID NO: 1485794 - RNA, 19 nt, Homo sapiens
augaggaccugaagaagag

SEQ ID NO: 1485795 - RNA, 19 nt, Homo sapiens
aagaagcuggagaaacuaa

SEQ ID NO: 1485796 - RNA, 19 nt, Homo sapiens
gcaagauggaggcgacuac

SEQ ID NO: 1485797 - RNA, 19 nt, Homo sapiens
gaacaaaagaccugugacu

SEQ ID NO: 1485798 - RNA, 19 nt, Homo sapiens
ccuagccucugcaguggau

SEQ ID NO: 1485799 - RNA, 19 nt, Homo sapiens
aggaugaggaccugaagaa

SEQ ID NO: 1485800 - RNA, 19 nt, Homo sapiens
gaagcuggagaaacuaaaa

SEQ ID NO: 1485801 - RNA, 19 nt, Homo sapiens
gaggaugaggaccugaaga

SEQ ID NO: 1485802 - RNA, 19 nt, Homo sapiens
gaacuaugucccggaggau

SEQ ID NO: 1485803 - RNA, 19 nt, Homo sapiens
aacuuaggcugcggaacua

SEQ ID NO: 1485804 - RNA, 19 nt, Homo sapiens
gcgcaaggacaaggaagau

SEQ ID NO: 1485805 - RNA, 19 nt, Homo sapiens
uggaggagaaggugaagga

SEQ ID NO: 1485806 - RNA, 19 nt, Homo sapiens
ggaacaagacuaacuauuu

SEQ ID NO: 1485807 - RNA, 19 nt, Homo sapiens
caaagaaggugaagucaga

SEQ ID NO: 1485808 - RNA, 19 nt, Homo sapiens
gaugaugccuuaacuguga

SEQ ID NO: 1485809 - RNA, 19 nt, Homo sapiens
gcgacuaugugaauuguua

SEQ ID NO: 1485810 - RNA, 19 nt, Homo sapiens
gaaaugaucccagaaagaa

SEQ ID NO: 1485811 - RNA, 19 nt, Homo sapiens
ccacagaagucaccgauga

SEQ ID NO: 1485812 - RNA, 19 nt, Homo sapiens
gagaaagauuugcuacauu

SEQ ID NO: 1485813 - RNA, 19 nt, Homo sapiens
acugagaggucuaauauaa

SEQ ID NO: 1485814 - RNA, 19 nt, Homo sapiens
ggaggaaucugaugugucu

SEQ ID NO: 1485815 - RNA, 19 nt, Homo sapiens
cgaaauuucuucaguuaug

SEQ ID NO: 1485816 - RNA, 19 nt, Homo sapiens
agaaagugauggaugauuu

SEQ ID NO: 1485817 - RNA, 19 nt, Homo sapiens
ggaaauucaccaagcuaua

SEQ ID NO: 1485818 - RNA, 19 nt, Homo sapiens
ucaccaagcuauacugaga

SEQ ID NO: 1485819 - RNA, 19 nt, Homo sapiens
agaaagauuugcuacauuc

SEQ ID NO: 1485820 - RNA, 19 nt, Homo sapiens
acaaauggguugccugaga

SEQ ID NO: 1485821 - RNA, 19 nt, Homo sapiens
gaagcagguuguaaaauaa

SEQ ID NO: 1485822 - RNA, 19 nt, Homo sapiens
gagaaaugaucccagaaag

SEQ ID NO: 1485823 - RNA, 19 nt, Homo sapiens
gaaggaaagaauacugaaa

SEQ ID NO: 1485824 - RNA, 19 nt, Homo sapiens
aggaggcgcugaaagauuu

SEQ ID NO: 1485825 - RNA, 19 nt, Homo sapiens
gauccaaggagaaacuaua

SEQ ID NO: 1485826 - RNA, 19 nt, Homo sapiens
gagaaacuauacaggaaca

SEQ ID NO: 1485827 - RNA, 19 nt, Homo sapiens
gaaaugaaggaaagaauac

SEQ ID NO: 1485828 - RNA, 19 nt, Homo sapiens
agaagaggaugaagaggaa

SEQ ID NO: 1485829 - RNA, 19 nt, Homo sapiens
caaacgacuuccagcgaaa

SEQ ID NO: 1485830 - RNA, 19 nt, Homo sapiens
uaacagauccaaggagaaa

SEQ ID NO: 1485831 - RNA, 19 nt, Homo sapiens
ggaugaagaggaagaagaa

SEQ ID NO: 1485832 - RNA, 19 nt, Homo sapiens
agaagcagguuguaaaaua

SEQ ID NO: 1485833 - RNA, 19 nt, Homo sapiens
agaaucugaugaugccuua

SEQ ID NO: 1485834 - RNA, 19 nt, Homo sapiens
guacagaagaggaugaaga

SEQ ID NO: 1485835 - RNA, 19 nt, Homo sapiens
gaaggugaagucagagaaa

SEQ ID NO: 1485836 - RNA, 19 nt, Homo sapiens
cagcgaaauuucuucaguu

SEQ ID NO: 1485837 - RNA, 19 nt, Homo sapiens
ugagaaagauuugcuacau

SEQ ID NO: 1485838 - RNA, 19 nt, Homo sapiens
gaaugaaugguguuauguu

SEQ ID NO: 1485839 - RNA, 19 nt, Homo sapiens
uggagaaagugauggauga

SEQ ID NO: 1485840 - RNA, 19 nt, Homo sapiens
ucagaaguuuccucaguga

SEQ ID NO: 1485841 - RNA, 19 nt, Homo sapiens
cuggagagauucuuucaga

SEQ ID NO: 1485842 - RNA, 19 nt, Homo sapiens
ugacugccgugaaacagaa

SEQ ID NO: 1485843 - RNA, 19 nt, Homo sapiens
gaaauuucuucaguuaugg

SEQ ID NO: 1485844 - RNA, 19 nt, Homo sapiens
uacaggaacagacaaauuu

SEQ ID NO: 1485845 - RNA, 19 nt, Homo sapiens
ccgugaaacagaagaauua

SEQ ID NO: 1485846 - RNA, 19 nt, Homo sapiens
cagaagaggaugaagaaga

SEQ ID NO: 1485847 - RNA, 19 nt, Homo sapiens
agcgaaauuucuucaguua

SEQ ID NO: 1485848 - RNA, 19 nt, Homo sapiens
gaaauucaccaagcuauac

SEQ ID NO: 1485849 - RNA, 19 nt, Homo sapiens
ggagaaacaaugauucagu

SEQ ID NO: 1485850 - RNA, 19 nt, Homo sapiens
caagagaagcagguuguaa

SEQ ID NO: 1485851 - RNA, 19 nt, Homo sapiens
aagauuugcuacauucuga

SEQ ID NO: 1485852 - RNA, 19 nt, Homo sapiens
agaugaagaugcuguggaa

SEQ ID NO: 1485853 - RNA, 19 nt, Homo sapiens
guuguuagcuguguuuauc

SEQ ID NO: 1485854 - RNA, 19 nt, Homo sapiens
gucacuggauuuaauggua

SEQ ID NO: 1485855 - RNA, 19 nt, Homo sapiens
auucaguggucccaauuua

SEQ ID NO: 1485856 - RNA, 19 nt, Homo sapiens
cgaaggcccuguaaguagu

SEQ ID NO: 1485857 - RNA, 19 nt, Homo sapiens
aaacgaaggcccuguaagu

SEQ ID NO: 1485858 - RNA, 19 nt, Homo sapiens
aaucagaaguuuccucagu

SEQ ID NO: 1485859 - RNA, 19 nt, Homo sapiens
gaaacagccagucaaacga

SEQ ID NO: 1485860 - RNA, 19 nt, Homo sapiens
ucacuggauuuaaugguau

SEQ ID NO: 1485861 - RNA, 19 nt, Homo sapiens
uuacauacaguucugguuu

SEQ ID NO: 1485862 - RNA, 19 nt, Homo sapiens
agaagaggaugaagaagag

SEQ ID NO: 1485863 - RNA, 19 nt, Homo sapiens
ucaguggucccaauuuaaa

SEQ ID NO: 1485864 - RNA, 19 nt, Homo sapiens
caggauaaagacaaagaua

SEQ ID NO: 1485865 - RNA, 19 nt, Homo sapiens
ucagaaucauccauggaaa

SEQ ID NO: 1485866 - RNA, 19 nt, Homo sapiens
ugacaaagaaggugaaguc

SEQ ID NO: 1485867 - RNA, 19 nt, Homo sapiens
ucgaaugaaugguguuaug

SEQ ID NO: 1485868 - RNA, 19 nt, Homo sapiens
ggacacccaggccacuuaa

SEQ ID NO: 1485869 - RNA, 19 nt, Homo sapiens
gaaacuauacaggaacaga

SEQ ID NO: 1485870 - RNA, 19 nt, Homo sapiens
aggagaaacuauacaggaa

SEQ ID NO: 1485871 - RNA, 19 nt, Homo sapiens
gaaggcccuguaaguagua

SEQ ID NO: 1485872 - RNA, 19 nt, Homo sapiens
auacugagaggucuaauau

SEQ ID NO: 1485873 - RNA, 19 nt, Homo sapiens
gauuuaaugguaucccuuu

SEQ ID NO: 1485874 - RNA, 19 nt, Homo sapiens
aagagaagcagguuguaaa

SEQ ID NO: 1485875 - RNA, 19 nt, Homo sapiens
cggcagcacuguacagaag

SEQ ID NO: 1485876 - RNA, 19 nt, Homo sapiens
ccagcgaaauuucuucagu

SEQ ID NO: 1485877 - RNA, 19 nt, Homo sapiens
gggacacccaggccacuua

SEQ ID NO: 1485878 - RNA, 19 nt, Homo sapiens
agugauggaugauuucaga

SEQ ID NO: 1485879 - RNA, 19 nt, Homo sapiens
gaaacauuuagaugcagua

SEQ ID NO: 1485880 - RNA, 19 nt, Homo sapiens
ugacgaagccacagaaguc

SEQ ID NO: 1485881 - RNA, 19 nt, Homo sapiens
gaaacagaagcaucaucuu

SEQ ID NO: 1485882 - RNA, 19 nt, Homo sapiens
uaaguaguaguucuucuga

SEQ ID NO: 1485883 - RNA, 19 nt, Homo sapiens
gagaaagugauggaugauu

SEQ ID NO: 1485884 - RNA, 19 nt, Homo sapiens
ucaguuucuuugucaugua

SEQ ID NO: 1485885 - RNA, 19 nt, Homo sapiens
ggaacagacaaauuucuca

SEQ ID NO: 1485886 - RNA, 19 nt, Homo sapiens
gaaacagaagaauuaguag

SEQ ID NO: 1485887 - RNA, 19 nt, Homo sapiens
agagaaaugaucccagaaa

SEQ ID NO: 1485888 - RNA, 19 nt, Homo sapiens
caucuucaucucaggauaa

SEQ ID NO: 1485889 - RNA, 19 nt, Homo sapiens
gcugaaagauuuugagaag

SEQ ID NO: 1485890 - RNA, 19 nt, Homo sapiens
gauggaugauuucagaacu

SEQ ID NO: 1485891 - RNA, 19 nt, Homo sapiens
agaaaugaucccagaaaga

SEQ ID NO: 1485892 - RNA, 19 nt, Homo sapiens
uggaucaguuucuuuguca

SEQ ID NO: 1485893 - RNA, 19 nt, Homo sapiens
agagaaacagccagucaaa

SEQ ID NO: 1485894 - RNA, 19 nt, Homo sapiens
gagcacagacagcaaagag

SEQ ID NO: 1485895 - RNA, 19 nt, Homo sapiens
agaaugugaugguuguuag

SEQ ID NO: 1485896 - RNA, 19 nt, Homo sapiens
ccuuaacugugaaugaaga

SEQ ID NO: 1485897 - RNA, 19 nt, Homo sapiens
gaucaguuucuuugucaug

SEQ ID NO: 1485898 - RNA, 19 nt, Homo sapiens
gaugaaaugaaggaaagaa

SEQ ID NO: 1485899 - RNA, 19 nt, Homo sapiens
guaaguaguaguucuucug

SEQ ID NO: 1485900 - RNA, 19 nt, Homo sapiens
gaaaacgaaggcccuguaa

SEQ ID NO: 1485901 - RNA, 19 nt, Homo sapiens
ggaaucugaugugucucaa

SEQ ID NO: 1485902 - RNA, 19 nt, Homo sapiens
auaaucaaauggaggaauc

SEQ ID NO: 1485903 - RNA, 19 nt, Homo sapiens
ugccuuaacugugaaugaa

SEQ ID NO: 1485904 - RNA, 19 nt, Homo sapiens
ugaagaagaggaugaagag

SEQ ID NO: 1485905 - RNA, 19 nt, Homo sapiens
uacagaagaggaugaagaa

SEQ ID NO: 1485906 - RNA, 19 nt, Homo sapiens
gaggauagcuaauaaauca

SEQ ID NO: 1485907 - RNA, 19 nt, Homo sapiens
gcaaauucgucaucaaaga

SEQ ID NO: 1485908 - RNA, 19 nt, Homo sapiens
ccaaagagauccugcagau

SEQ ID NO: 1485909 - RNA, 19 nt, Homo sapiens
gaaagcaaauucgucauca

SEQ ID NO: 1485910 - RNA, 19 nt, Homo sapiens
uaucuaagcuuccaaacga

SEQ ID NO: 1485911 - RNA, 19 nt, Homo sapiens
gagugaggauagcuaauaa

SEQ ID NO: 1485912 - RNA, 19 nt, Homo sapiens
gaccuuagcagaaauuaaa

SEQ ID NO: 1485913 - RNA, 19 nt, Homo sapiens
ggaguuguuugaggaauuu

SEQ ID NO: 1485914 - RNA, 19 nt, Homo sapiens
gaccuagaccugaaguuua

SEQ ID NO: 1485915 - RNA, 19 nt, Homo sapiens
gaauggaaauccuuuagac

SEQ ID NO: 1485916 - RNA, 19 nt, Homo sapiens
ggaccuagaccugaaguuu

SEQ ID NO: 1485917 - RNA, 19 nt, Homo sapiens
guacaaacagaacugcuuu

SEQ ID NO: 1485918 - RNA, 19 nt, Homo sapiens
gaaguccugugauuaaggu

SEQ ID NO: 1485919 - RNA, 19 nt, Homo sapiens
caaauucgucaucaaagaa

SEQ ID NO: 1485920 - RNA, 19 nt, Homo sapiens
ugaccagacucuacucaga

SEQ ID NO: 1485921 - RNA, 19 nt, Homo sapiens
gaaaguacaaacagaacug

SEQ ID NO: 1485922 - RNA, 19 nt, Homo sapiens
gggaguuguuugaggaauu

SEQ ID NO: 1485923 - RNA, 19 nt, Homo sapiens
ggaauggaaauccuuuaga

SEQ ID NO: 1485924 - RNA, 19 nt, Homo sapiens
ccuguaaucccaacacuuu

SEQ ID NO: 1485925 - RNA, 19 nt, Homo sapiens
ugagugaggauagcuaaua

SEQ ID NO: 1485926 - RNA, 19 nt, Homo sapiens
gggagaugcagccaguuua

SEQ ID NO: 1485927 - RNA, 19 nt, Homo sapiens
cgagaaaguacaaacagaa

SEQ ID NO: 1485928 - RNA, 19 nt, Homo sapiens
accuagaccugaaguuuaa

SEQ ID NO: 1485929 - RNA, 19 nt, Homo sapiens
ucauucagcuggaccuaga

SEQ ID NO: 1485930 - RNA, 19 nt, Homo sapiens
gagaucagccugggaaaca

SEQ ID NO: 1485931 - RNA, 19 nt, Homo sapiens
caggacuucuucaccauga

SEQ ID NO: 1485932 - RNA, 19 nt, Homo sapiens
uugaggaauuugacaguuu

SEQ ID NO: 1485933 - RNA, 19 nt, Homo sapiens
ccguagaccuuagcagaaa

SEQ ID NO: 1485934 - RNA, 19 nt, Homo sapiens
cagcaauucccaaguguga

SEQ ID NO: 1485935 - RNA, 19 nt, Homo sapiens
gaccagacucuacucagaa

SEQ ID NO: 1485936 - RNA, 19 nt, Homo sapiens
uugcugugcugacggauaa

SEQ ID NO: 1485937 - RNA, 19 nt, Homo sapiens
ugaggaauuugacaguuuc

SEQ ID NO: 1485938 - RNA, 19 nt, Homo sapiens
gcauucuaguuucuuuguu

SEQ ID NO: 1485939 - RNA, 19 nt, Homo sapiens
ggaccaggaagacucauuc

SEQ ID NO: 1485940 - RNA, 19 nt, Homo sapiens
aagcaaauucgucaucaaa

SEQ ID NO: 1485941 - RNA, 19 nt, Homo sapiens
acacaaaggacacgcaugu

SEQ ID NO: 1485942 - RNA, 19 nt, Homo sapiens
gcacgcgcauucuccugau

SEQ ID NO: 1485943 - RNA, 19 nt, Homo sapiens
ucgagaaaguacaaacaga

SEQ ID NO: 1485944 - RNA, 19 nt, Homo sapiens
gcgcgaaggccaagagcuu

SEQ ID NO: 1485945 - RNA, 19 nt, Homo sapiens
uuaaugaccagcccaguau

SEQ ID NO: 1485946 - RNA, 19 nt, Homo sapiens
gagggaccauggcuacagu

SEQ ID NO: 1485947 - RNA, 19 nt, Homo sapiens
caucagaucaugcccaaag

SEQ ID NO: 1485948 - RNA, 19 nt, Homo sapiens
gugaggauagcuaauaaau

SEQ ID NO: 1485949 - RNA, 19 nt, Homo sapiens
aaagcaaauucgucaucaa

SEQ ID NO: 1485950 - RNA, 19 nt, Homo sapiens
guuucaggaucgccucuuu

SEQ ID NO: 1485951 - RNA, 19 nt, Homo sapiens
gagcaggcgacacaaagga

SEQ ID NO: 1485952 - RNA, 19 nt, Homo sapiens
ggauagcuaauaaaucauc

SEQ ID NO: 1485953 - RNA, 19 nt, Homo sapiens
gaacugucgggaccaggaa

SEQ ID NO: 1485954 - RNA, 19 nt, Homo sapiens
gcucacgucacuuggugua

SEQ ID NO: 1485955 - RNA, 19 nt, Homo sapiens
ugaccagcccaguaucuaa

SEQ ID NO: 1485956 - RNA, 19 nt, Homo sapiens
gggaaguccugugauuaag

SEQ ID NO: 1485957 - RNA, 19 nt, Homo sapiens
gcagcuggccgacaaguac

SEQ ID NO: 1485958 - RNA, 19 nt, Homo sapiens
gcuggugcuugggaccuua

SEQ ID NO: 1485959 - RNA, 19 nt, Homo sapiens
gcacacauucuggcaguuc

SEQ ID NO: 1485960 - RNA, 19 nt, Homo sapiens
caugugggcuuggaagaca

SEQ ID NO: 1485961 - RNA, 19 nt, Homo sapiens
acgaggacaugcaggagaa

SEQ ID NO: 1485962 - RNA, 19 nt, Homo sapiens
aaugccagcccaucacaua

SEQ ID NO: 1485963 - RNA, 19 nt, Homo sapiens
gguaagguaagccaagguu

SEQ ID NO: 1485964 - RNA, 19 nt, Homo sapiens
ccaccaagaggcugaagga

SEQ ID NO: 1485965 - RNA, 19 nt, Homo sapiens
agggaaguccugugauuaa

SEQ ID NO: 1485966 - RNA, 19 nt, Homo sapiens
ggacaugcaggagaacugu

SEQ ID NO: 1485967 - RNA, 19 nt, Homo sapiens
ggacuaccaccugcugaug

SEQ ID NO: 1485968 - RNA, 19 nt, Homo sapiens
guagaccuuagcagaaauu

SEQ ID NO: 1485969 - RNA, 19 nt, Homo sapiens
uaguaagcauucuaguuuc

SEQ ID NO: 1485970 - RNA, 19 nt, Homo sapiens
guaagguaagccaagguuu

SEQ ID NO: 1485971 - RNA, 19 nt, Homo sapiens
cuacagugacuccaucuuc

SEQ ID NO: 1485972 - RNA, 19 nt, Homo sapiens
gcugugcgcucccacuacu

SEQ ID NO: 1485973 - RNA, 19 nt, Homo sapiens
gggcuuggaagacauguca

SEQ ID NO: 1485974 - RNA, 19 nt, Homo sapiens
ugugguggcuugugcuugu

SEQ ID NO: 1485975 - RNA, 19 nt, Homo sapiens
guacucacagcuuguaucu

SEQ ID NO: 1485976 - RNA, 19 nt, Homo sapiens
ggagaugcagccaguuuac

SEQ ID NO: 1485977 - RNA, 19 nt, Homo sapiens
caagugcaaggucaucuuc

SEQ ID NO: 1485978 - RNA, 19 nt, Homo sapiens
gagaaaguacaaacagaac

SEQ ID NO: 1485979 - RNA, 19 nt, Homo sapiens
uaaauugacagccuuccau

SEQ ID NO: 1485980 - RNA, 19 nt, Homo sapiens
ggguccauuuguaucaauu

SEQ ID NO: 1485981 - RNA, 19 nt, Homo sapiens
uggaagacaugucacucau

SEQ ID NO: 1485982 - RNA, 19 nt, Homo sapiens
uggcuugaguccaggaguu

SEQ ID NO: 1485983 - RNA, 19 nt, Homo sapiens
ccccaucgcuacaaaauau

SEQ ID NO: 1485984 - RNA, 19 nt, Homo sapiens
cuacucagaaagcaaauuc

SEQ ID NO: 1485985 - RNA, 19 nt, Homo sapiens
uggcuacagugacgucuuc

SEQ ID NO: 1485986 - RNA, 19 nt, Homo sapiens
gacuaccaccugcugauga

SEQ ID NO: 1485987 - RNA, 19 nt, Homo sapiens
cagaucaugcccaaagaga

SEQ ID NO: 1485988 - RNA, 19 nt, Homo sapiens
caugagugaggauagcuaa

SEQ ID NO: 1485989 - RNA, 19 nt, Homo sapiens
ucaccaaggcggagcacaa

SEQ ID NO: 1485990 - RNA, 19 nt, Homo sapiens
guaggcugcagacgugaaa

SEQ ID NO: 1485991 - RNA, 19 nt, Homo sapiens
cguuagaccguagaccuua

SEQ ID NO: 1485992 - RNA, 19 nt, Homo sapiens
accagacucuacucagaaa

SEQ ID NO: 1485993 - RNA, 19 nt, Homo sapiens
ggacuucuucaccaugauc

SEQ ID NO: 1485994 - RNA, 19 nt, Homo sapiens
cgggagaugcagccaguuu

SEQ ID NO: 1485995 - RNA, 19 nt, Homo sapiens
agaccaacauccgggaguu

SEQ ID NO: 1485996 - RNA, 19 nt, Homo sapiens
gaaccccauuguccuuuau

SEQ ID NO: 1485997 - RNA, 19 nt, Homo sapiens
gcugacggauaagcucuuc

SEQ ID NO: 1485998 - RNA, 19 nt, Homo sapiens
uacaaacagaacugcuuua

SEQ ID NO: 1485999 - RNA, 19 nt, Homo sapiens
ggaaguccugugauuaagg

SEQ ID NO: 1486000 - RNA, 19 nt, Homo sapiens
gugggaggguggcuugagu

SEQ ID NO: 1486001 - RNA, 19 nt, Homo sapiens
uacagugacuccaucuucu

SEQ ID NO: 1486002 - RNA, 19 nt, Homo sapiens
uuuaaugaccagcccagua

SEQ ID NO: 1486003 - RNA, 19 nt, Homo sapiens
gggagcaggcgacacaaag

SEQ ID NO: 1486004 - RNA, 19 nt, Homo sapiens
cgucugcgccuucuacuac

SEQ ID NO: 1486005 - RNA, 19 nt, Homo sapiens
gguccauuuguaucaauuu

SEQ ID NO: 1486006 - RNA, 19 nt, Homo sapiens
caauuagucuucacaguua

SEQ ID NO: 1486007 - RNA, 19 nt, Homo sapiens
gaacagacuuuguguguag

SEQ ID NO: 1486008 - RNA, 19 nt, Homo sapiens
uguauaaucugguguguua

SEQ ID NO: 1486009 - RNA, 19 nt, Homo sapiens
gcacuaacauucccugguu

SEQ ID NO: 1486010 - RNA, 19 nt, Homo sapiens
acaaauggcuuaaggcaaa

SEQ ID NO: 1486011 - RNA, 19 nt, Homo sapiens
uuagaaagcuguuuguuug

SEQ ID NO: 1486012 - RNA, 19 nt, Homo sapiens
gaagauaguccaaguccua

SEQ ID NO: 1486013 - RNA, 19 nt, Homo sapiens
uguagaagauggagaagua

SEQ ID NO: 1486014 - RNA, 19 nt, Homo sapiens
uugaacaacuuccuucuua

SEQ ID NO: 1486015 - RNA, 19 nt, Homo sapiens
gcagcuacuuagagucuua

SEQ ID NO: 1486016 - RNA, 19 nt, Homo sapiens
gcacuuaccaguaccauau

SEQ ID NO: 1486017 - RNA, 19 nt, Homo sapiens
gcacaucccugcuuguagu

SEQ ID NO: 1486018 - RNA, 19 nt, Homo sapiens
ggauaucccucaccuguuc

SEQ ID NO: 1486019 - RNA, 19 nt, Homo sapiens
caacagguguccagaauac

SEQ ID NO: 1486020 - RNA, 19 nt, Homo sapiens
ccuuagaccugauuuguuu

SEQ ID NO: 1486021 - RNA, 19 nt, Homo sapiens
ccaaguguguugacaaaug

SEQ ID NO: 1486022 - RNA, 19 nt, Homo sapiens
ggaaucauuugcugaguca

SEQ ID NO: 1486023 - RNA, 19 nt, Homo sapiens
gaauguguguguaguuuua

SEQ ID NO: 1486024 - RNA, 19 nt, Homo sapiens
ggagguguccuuuggagua

SEQ ID NO: 1486025 - RNA, 19 nt, Homo sapiens
guaaguucuuugagcauaa

SEQ ID NO: 1486026 - RNA, 19 nt, Homo sapiens
gugggcaacucaauuguuu

SEQ ID NO: 1486027 - RNA, 19 nt, Homo sapiens
gcugucaccuucucuuuau

SEQ ID NO: 1486028 - RNA, 19 nt, Homo sapiens
gauauagcaaucuaccuua

SEQ ID NO: 1486029 - RNA, 19 nt, Homo sapiens
gaguugaccuucauuuagu

SEQ ID NO: 1486030 - RNA, 19 nt, Homo sapiens
cagcuugacuucucauaug

SEQ ID NO: 1486031 - RNA, 19 nt, Homo sapiens
caugaagucucaccuuguu

SEQ ID NO: 1486032 - RNA, 19 nt, Homo sapiens
ccuaagaagcacaaauuua

SEQ ID NO: 1486033 - RNA, 19 nt, Homo sapiens
aaucguacuugcccaauuu

SEQ ID NO: 1486034 - RNA, 19 nt, Homo sapiens
ccaacuugcuguuuccaaa

SEQ ID NO: 1486035 - RNA, 19 nt, Homo sapiens
ggacuauccauugaacuua

SEQ ID NO: 1486036 - RNA, 19 nt, Homo sapiens
gggcccaacuuucagcuuu

SEQ ID NO: 1486037 - RNA, 19 nt, Homo sapiens
ucaagaggaugcucacuuc

SEQ ID NO: 1486038 - RNA, 19 nt, Homo sapiens
gacuauccauugaacuuaa

SEQ ID NO: 1486039 - RNA, 19 nt, Homo sapiens
gaacaacuuccuucuuauc

SEQ ID NO: 1486040 - RNA, 19 nt, Homo sapiens
uaaagucaauucacagaag

SEQ ID NO: 1486041 - RNA, 19 nt, Homo sapiens
gagggugcaucaauuacaa

SEQ ID NO: 1486042 - RNA, 19 nt, Homo sapiens
gcugagggugcaucaauua

SEQ ID NO: 1486043 - RNA, 19 nt, Homo sapiens
caaggcagcuacuuagagu

SEQ ID NO: 1486044 - RNA, 19 nt, Homo sapiens
gcagugggcccaacuuuca

SEQ ID NO: 1486045 - RNA, 19 nt, Homo sapiens
gcacaugguuaaugcacau

SEQ ID NO: 1486046 - RNA, 19 nt, Homo sapiens
caugguagcuaacgugugu

SEQ ID NO: 1486047 - RNA, 19 nt, Homo sapiens
caauggaccuuucuuugca

SEQ ID NO: 1486048 - RNA, 19 nt, Homo sapiens
agacagcgccucucucauu

SEQ ID NO: 1486049 - RNA, 19 nt, Homo sapiens
ggaguugaccuucauuuag

SEQ ID NO: 1486050 - RNA, 19 nt, Homo sapiens
aaacaggaguugaccuuca

SEQ ID NO: 1486051 - RNA, 19 nt, Homo sapiens
aaaagaaggugcaauauca

SEQ ID NO: 1486052 - RNA, 19 nt, Homo sapiens
gaggguuguugguaauaaa

SEQ ID NO: 1486053 - RNA, 19 nt, Homo sapiens
uuacagcucauguuccuua

SEQ ID NO: 1486054 - RNA, 19 nt, Homo sapiens
guagcuaacguguguauga

SEQ ID NO: 1486055 - RNA, 19 nt, Homo sapiens
agaggaugcucacuucaaa

SEQ ID NO: 1486056 - RNA, 19 nt, Homo sapiens
ucucauauguguucugugu

SEQ ID NO: 1486057 - RNA, 19 nt, Homo sapiens
ucagugauuugaauguuga

SEQ ID NO: 1486058 - RNA, 19 nt, Homo sapiens
gacuaaagcagauauugaa

SEQ ID NO: 1486059 - RNA, 19 nt, Homo sapiens
gaucagcuccaucaaggaa

SEQ ID NO: 1486060 - RNA, 19 nt, Homo sapiens
gaaagggugagacuucaga

SEQ ID NO: 1486061 - RNA, 19 nt, Homo sapiens
ggcaaaagcccaucuuaua

SEQ ID NO: 1486062 - RNA, 19 nt, Homo sapiens
caucacagccuagaguuaa

SEQ ID NO: 1486063 - RNA, 19 nt, Homo sapiens
ucaggacugugauaacuug

SEQ ID NO: 1486064 - RNA, 19 nt, Homo sapiens
caaauucucgcuccaugaa

SEQ ID NO: 1486065 - RNA, 19 nt, Homo sapiens
gauagaaaaugaaguggaa

SEQ ID NO: 1486066 - RNA, 19 nt, Homo sapiens
guucagcacuuaccaguac

SEQ ID NO: 1486067 - RNA, 19 nt, Homo sapiens
gcagaaugcagucaugguu

SEQ ID NO: 1486068 - RNA, 19 nt, Homo sapiens
gaagauggagaaguagaaa

SEQ ID NO: 1486069 - RNA, 19 nt, Homo sapiens
cucauucagucuuugauua

SEQ ID NO: 1486070 - RNA, 19 nt, Homo sapiens
gaugcucacuucaaagcuu

SEQ ID NO: 1486071 - RNA, 19 nt, Homo sapiens
aagaauguguguguaguuu

SEQ ID NO: 1486072 - RNA, 19 nt, Homo sapiens
aggagaacaucuuccagua

SEQ ID NO: 1486073 - RNA, 19 nt, Homo sapiens
aaaugaaguggaacucuua

SEQ ID NO: 1486074 - RNA, 19 nt, Homo sapiens
gaucgccucugcaaaggau

SEQ ID NO: 1486075 - RNA, 19 nt, Homo sapiens
gcaccucccugucuguagu

SEQ ID NO: 1486076 - RNA, 19 nt, Homo sapiens
ugucagugcaucagaaaua

SEQ ID NO: 1486077 - RNA, 19 nt, Homo sapiens
ggaaggaagcgcagugaca

SEQ ID NO: 1486078 - RNA, 19 nt, Homo sapiens
gaccugauuuguuuugaua

SEQ ID NO: 1486079 - RNA, 19 nt, Homo sapiens
guaugacuguuggugauaa

SEQ ID NO: 1486080 - RNA, 19 nt, Homo sapiens
ucugaaaguugucuaguuc

SEQ ID NO: 1486081 - RNA, 19 nt, Homo sapiens
gugagggcaugguagcuaa

SEQ ID NO: 1486082 - RNA, 19 nt, Homo sapiens
gagucaaggcagcuacuua

SEQ ID NO: 1486083 - RNA, 19 nt, Homo sapiens
agaaugcagucaugguuga

SEQ ID NO: 1486084 - RNA, 19 nt, Homo sapiens
ggaagaagggaucgucugu

SEQ ID NO: 1486085 - RNA, 19 nt, Homo sapiens
caagaucucauauuaggau

SEQ ID NO: 1486086 - RNA, 19 nt, Homo sapiens
ccagcaauguuuaaauuac

SEQ ID NO: 1486087 - RNA, 19 nt, Homo sapiens
ugaaaguugucuaguucuu

SEQ ID NO: 1486088 - RNA, 19 nt, Homo sapiens
cagaaugaccaaccuaaga

SEQ ID NO: 1486089 - RNA, 19 nt, Homo sapiens
ugacuaaagcagauauuga

SEQ ID NO: 1486090 - RNA, 19 nt, Homo sapiens
ccaggaugcucugugguuu

SEQ ID NO: 1486091 - RNA, 19 nt, Homo sapiens
gacagcgccucucucauuc

SEQ ID NO: 1486092 - RNA, 19 nt, Homo sapiens
cauauuccauuguaucagu

SEQ ID NO: 1486093 - RNA, 19 nt, Homo sapiens
gagacauuguugccucuau

SEQ ID NO: 1486094 - RNA, 19 nt, Homo sapiens
uacaacagguguccagaau

SEQ ID NO: 1486095 - RNA, 19 nt, Homo sapiens
ucauauguguucuguguuc

SEQ ID NO: 1486096 - RNA, 19 nt, Homo sapiens
cuuagagucuuacccugua

SEQ ID NO: 1486097 - RNA, 19 nt, Homo sapiens
ugaacaacuuccuucuuau

SEQ ID NO: 1486098 - RNA, 19 nt, Homo sapiens
gagugaagauaguccaagu

SEQ ID NO: 1486099 - RNA, 19 nt, Homo sapiens
agcacaagcugcauuauuc

SEQ ID NO: 1486100 - RNA, 19 nt, Homo sapiens
caguugauguaauugcuuu

SEQ ID NO: 1486101 - RNA, 19 nt, Homo sapiens
uaauucagcuugacuucuc

SEQ ID NO: 1486102 - RNA, 19 nt, Homo sapiens
guagucuagucuauucuga

SEQ ID NO: 1486103 - RNA, 19 nt, Homo sapiens
gcuaacguguguaugagau

SEQ ID NO: 1486104 - RNA, 19 nt, Homo sapiens
cagaaacugugaguggaaa

SEQ ID NO: 1486105 - RNA, 19 nt, Homo sapiens
caaguguguugacaaaugg

SEQ ID NO: 1486106 - RNA, 19 nt, Homo sapiens
gaaaggagguggcugauag

SEQ ID NO: 1486107 - RNA, 19 nt, Homo sapiens
caaagcagcuccugaaggu

SEQ ID NO: 1486108 - RNA, 19 nt, Homo sapiens
gaagguggcagacuuaaga

SEQ ID NO: 1486109 - RNA, 19 nt, Homo sapiens
ccagggauauugacuaaga

SEQ ID NO: 1486110 - RNA, 19 nt, Homo sapiens
cuaauaugguucuguguuu

SEQ ID NO: 1486111 - RNA, 19 nt, Homo sapiens
acagugaaaucaagaacua

SEQ ID NO: 1486112 - RNA, 19 nt, Homo sapiens
gcacacacacuuggacaua

SEQ ID NO: 1486113 - RNA, 19 nt, Homo sapiens
caagcuaugccucuaauuu

SEQ ID NO: 1486114 - RNA, 19 nt, Homo sapiens
ggaagaacaccaagaagau

SEQ ID NO: 1486115 - RNA, 19 nt, Homo sapiens
gauagaugguacagugaaa

SEQ ID NO: 1486116 - RNA, 19 nt, Homo sapiens
caccagggauauugacuaa

SEQ ID NO: 1486117 - RNA, 19 nt, Homo sapiens
caagucagcuuccaaacag

SEQ ID NO: 1486118 - RNA, 19 nt, Homo sapiens
gauaugaagugccuagaac

SEQ ID NO: 1486119 - RNA, 19 nt, Homo sapiens
uuaagaacguggauaugaa

SEQ ID NO: 1486120 - RNA, 19 nt, Homo sapiens
uagaagugcuaauaugguu

SEQ ID NO: 1486121 - RNA, 19 nt, Homo sapiens
ggaaaggagguggcugaua

SEQ ID NO: 1486122 - RNA, 19 nt, Homo sapiens
gcgacaagcccaaauguuc

SEQ ID NO: 1486123 - RNA, 19 nt, Homo sapiens
ggaaggcguccgcaaguga

SEQ ID NO: 1486124 - RNA, 19 nt, Homo sapiens
gaagaacaccaagaagaug

SEQ ID NO: 1486125 - RNA, 19 nt, Homo sapiens
gcaagucagcuuccaaaca

SEQ ID NO: 1486126 - RNA, 19 nt, Homo sapiens
gauauugacuaagaagaca

SEQ ID NO: 1486127 - RNA, 19 nt, Homo sapiens
cugcaugccuccuggaauu

SEQ ID NO: 1486128 - RNA, 19 nt, Homo sapiens
cagaugcccugcugagugu

SEQ ID NO: 1486129 - RNA, 19 nt, Homo sapiens
gcauucuucuaccuuuaaa

SEQ ID NO: 1486130 - RNA, 19 nt, Homo sapiens
ccgggaggcucaacaguau

SEQ ID NO: 1486131 - RNA, 19 nt, Homo sapiens
ccacugaagcucugcaaga

SEQ ID NO: 1486132 - RNA, 19 nt, Homo sapiens
ccaaacaacaaauggagaa

SEQ ID NO: 1486133 - RNA, 19 nt, Homo sapiens
ggauaugaagugccuagaa

SEQ ID NO: 1486134 - RNA, 19 nt, Homo sapiens
ucaccagucucaagcuaug

SEQ ID NO: 1486135 - RNA, 19 nt, Homo sapiens
aauagcaacuuuacaaggu

SEQ ID NO: 1486136 - RNA, 19 nt, Homo sapiens
gcuaauaugguucuguguu

SEQ ID NO: 1486137 - RNA, 19 nt, Homo sapiens
gcauuuaccccgaugguua

SEQ ID NO: 1486138 - RNA, 19 nt, Homo sapiens
ugaaggcccacaaugagua

SEQ ID NO: 1486139 - RNA, 19 nt, Homo sapiens
gcaugggcauccuaugauc

SEQ ID NO: 1486140 - RNA, 19 nt, Homo sapiens
gggcaagucagcuuccaaa

SEQ ID NO: 1486141 - RNA, 19 nt, Homo sapiens
gggcaggccaguccucaaa

SEQ ID NO: 1486142 - RNA, 19 nt, Homo sapiens
uuaaacuucuggcauuuca

SEQ ID NO: 1486143 - RNA, 19 nt, Homo sapiens
gcaggcagggacuccauuu

SEQ ID NO: 1486144 - RNA, 19 nt, Homo sapiens
gagcaaaggaagcauuuac

SEQ ID NO: 1486145 - RNA, 19 nt, Homo sapiens
ugugugcgcucauucuuau

SEQ ID NO: 1486146 - RNA, 19 nt, Homo sapiens
cacugaagcucugcaagaa

SEQ ID NO: 1486147 - RNA, 19 nt, Homo sapiens
cuucaugcgucguaaucua

SEQ ID NO: 1486148 - RNA, 19 nt, Homo sapiens
ccucaaagcagcuccugaa

SEQ ID NO: 1486149 - RNA, 19 nt, Homo sapiens
ggccuuggauggaugaagu

SEQ ID NO: 1486150 - RNA, 19 nt, Homo sapiens
uguaugugcuugugugugu

SEQ ID NO: 1486151 - RNA, 19 nt, Homo sapiens
agaccacgauuauuuggau

SEQ ID NO: 1486152 - RNA, 19 nt, Homo sapiens
ggucuguguugcacuguca

SEQ ID NO: 1486153 - RNA, 19 nt, Homo sapiens
gcagcuccaucugucaaga

SEQ ID NO: 1486154 - RNA, 19 nt, Homo sapiens
ggagggaccaacccagaug

SEQ ID NO: 1486155 - RNA, 19 nt, Homo sapiens
caaugagggcuucuucgaa

SEQ ID NO: 1486156 - RNA, 19 nt, Homo sapiens
cugaauagcaacuuuacaa

SEQ ID NO: 1486157 - RNA, 19 nt, Homo sapiens
gaccacgauuauuuggauu

SEQ ID NO: 1486158 - RNA, 19 nt, Homo sapiens
uuaccuagaccacgauuau

SEQ ID NO: 1486159 - RNA, 19 nt, Homo sapiens
acacacacuuggacauaca

SEQ ID NO: 1486160 - RNA, 19 nt, Homo sapiens
uggaagaacaccaagaaga

SEQ ID NO: 1486161 - RNA, 19 nt, Homo sapiens
uuacuuccuugcauucuuc

SEQ ID NO: 1486162 - RNA, 19 nt, Homo sapiens
cuuaagaacguggauauga

SEQ ID NO: 1486163 - RNA, 19 nt, Homo sapiens
ccuaugaucagacaggaaa

SEQ ID NO: 1486164 - RNA, 19 nt, Homo sapiens
uauggaagaacaccaagaa

SEQ ID NO: 1486165 - RNA, 19 nt, Homo sapiens
acacuucacggccauggua

SEQ ID NO: 1486166 - RNA, 19 nt, Homo sapiens
gaugguacagugaaaucaa

SEQ ID NO: 1486167 - RNA, 19 nt, Homo sapiens
uuucuaagcaaaccucuuu

SEQ ID NO: 1486168 - RNA, 19 nt, Homo sapiens
ugucaccagucucaagcua

SEQ ID NO: 1486169 - RNA, 19 nt, Homo sapiens
uuggauggaugaagucaga

SEQ ID NO: 1486170 - RNA, 19 nt, Homo sapiens
ccugguuucuggagaguug

SEQ ID NO: 1486171 - RNA, 19 nt, Homo sapiens
ccccuucccucuuuucuua

SEQ ID NO: 1486172 - RNA, 19 nt, Homo sapiens
uugcauucuucuaccuuua

SEQ ID NO: 1486173 - RNA, 19 nt, Homo sapiens
gacuuaagaacguggauau

SEQ ID NO: 1486174 - RNA, 19 nt, Homo sapiens
ugugcgcucauucuuauua

SEQ ID NO: 1486175 - RNA, 19 nt, Homo sapiens
gugagcaaaggaagcauuu

SEQ ID NO: 1486176 - RNA, 19 nt, Homo sapiens
ccuuugugguggccagaua

SEQ ID NO: 1486177 - RNA, 19 nt, Homo sapiens
cagggauauugacuaagaa

SEQ ID NO: 1486178 - RNA, 19 nt, Homo sapiens
gaagugcuaauaugguucu

SEQ ID NO: 1486179 - RNA, 19 nt, Homo sapiens
ucuuaaacuucuggcauuu

SEQ ID NO: 1486180 - RNA, 19 nt, Homo sapiens
ggagugagcaaaggaagca

SEQ ID NO: 1486181 - RNA, 19 nt, Homo sapiens
gggaggcucaacaguauuc

SEQ ID NO: 1486182 - RNA, 19 nt, Homo sapiens
ggauauugacuaagaagac

SEQ ID NO: 1486183 - RNA, 19 nt, Homo sapiens
caaacaacaaauggagaaa

SEQ ID NO: 1486184 - RNA, 19 nt, Homo sapiens
ccuagaccacgauuauuug

SEQ ID NO: 1486185 - RNA, 19 nt, Homo sapiens
ucaaugagggcuucuucga

SEQ ID NO: 1486186 - RNA, 19 nt, Homo sapiens
ugacggguccuccuuugug

SEQ ID NO: 1486187 - RNA, 19 nt, Homo sapiens
ucaccagggauauugacua

SEQ ID NO: 1486188 - RNA, 19 nt, Homo sapiens
ucuaauuucaccagggaua

SEQ ID NO: 1486189 - RNA, 19 nt, Homo sapiens
aagcuaugccucuaauuuc

SEQ ID NO: 1486190 - RNA, 19 nt, Homo sapiens
gcaggccaguccucaaagc

SEQ ID NO: 1486191 - RNA, 19 nt, Homo sapiens
gaguugggcuaggccugaa

SEQ ID NO: 1486192 - RNA, 19 nt, Homo sapiens
ccaauggggucgccaaaca

SEQ ID NO: 1486193 - RNA, 19 nt, Homo sapiens
ggauggaugaagucagaga

SEQ ID NO: 1486194 - RNA, 19 nt, Homo sapiens
aaauagcaaaguaccacua

SEQ ID NO: 1486195 - RNA, 19 nt, Homo sapiens
acacuuggacauacaguuc

SEQ ID NO: 1486196 - RNA, 19 nt, Homo sapiens
uaagaacguggauaugaag

SEQ ID NO: 1486197 - RNA, 19 nt, Homo sapiens
caagugacggguccuccuu

SEQ ID NO: 1486198 - RNA, 19 nt, Homo sapiens
ggcauccuaugaucagaca

SEQ ID NO: 1486199 - RNA, 19 nt, Homo sapiens
ggaagguggcagacuuaag

SEQ ID NO: 1486200 - RNA, 19 nt, Homo sapiens
ugggaagguggcagacuua

SEQ ID NO: 1486201 - RNA, 19 nt, Homo sapiens
ggacuccauuuuacagaau

SEQ ID NO: 1486202 - RNA, 19 nt, Homo sapiens
gggaagguggcagacuuaa

SEQ ID NO: 1486203 - RNA, 19 nt, Homo sapiens
cggggaauguugucaauga

SEQ ID NO: 1486204 - RNA, 19 nt, Homo sapiens
ccacgauuauuuggauugg

SEQ ID NO: 1486205 - RNA, 19 nt, Homo sapiens
accuagaccacgauuauuu

SEQ ID NO: 1486206 - RNA, 19 nt, Homo sapiens
guacagaauucagcaaaua

SEQ ID NO: 1486207 - RNA, 19 nt, Homo sapiens
gaauaauccuugagagaaa

SEQ ID NO: 1486208 - RNA, 19 nt, Homo sapiens
gaacuacuguaaaguguug

SEQ ID NO: 1486209 - RNA, 19 nt, Homo sapiens
gagaaacaguguacuauuc

SEQ ID NO: 1486210 - RNA, 19 nt, Homo sapiens
gaaccucucuguacucuca

SEQ ID NO: 1486211 - RNA, 19 nt, Homo sapiens
ggauggagaucaccaaaga

SEQ ID NO: 1486212 - RNA, 19 nt, Homo sapiens
gaacacugacugaggcuua

SEQ ID NO: 1486213 - RNA, 19 nt, Homo sapiens
ucacugacuucaagaauga

SEQ ID NO: 1486214 - RNA, 19 nt, Homo sapiens
gagucucucucuauauaua

SEQ ID NO: 1486215 - RNA, 19 nt, Homo sapiens
ggaagagccuguugucuac

SEQ ID NO: 1486216 - RNA, 19 nt, Homo sapiens
aagcaucccuuuaauagaa

SEQ ID NO: 1486217 - RNA, 19 nt, Homo sapiens
gacagcaggugaaauguau

SEQ ID NO: 1486218 - RNA, 19 nt, Homo sapiens
gcagacagcaggugaaaug

SEQ ID NO: 1486219 - RNA, 19 nt, Homo sapiens
gagcaaugguguugaguuc

SEQ ID NO: 1486220 - RNA, 19 nt, Homo sapiens
gaacacggaggauccauga

SEQ ID NO: 1486221 - RNA, 19 nt, Homo sapiens
ggaaacuggugacacucua

SEQ ID NO: 1486222 - RNA, 19 nt, Homo sapiens
ccagacaccuugaaaauaa

SEQ ID NO: 1486223 - RNA, 19 nt, Homo sapiens
ggagaaacaguguacuauu

SEQ ID NO: 1486224 - RNA, 19 nt, Homo sapiens
ggucacagccacacugaaa

SEQ ID NO: 1486225 - RNA, 19 nt, Homo sapiens
gaugagagaaguaggaaga

SEQ ID NO: 1486226 - RNA, 19 nt, Homo sapiens
aauagaaacucaagaacug

SEQ ID NO: 1486227 - RNA, 19 nt, Homo sapiens
caaccaacaugaagcaucu

SEQ ID NO: 1486228 - RNA, 19 nt, Homo sapiens
caacaugaagcaucucuug

SEQ ID NO: 1486229 - RNA, 19 nt, Homo sapiens
gcagaagucaguaacaugu

SEQ ID NO: 1486230 - RNA, 19 nt, Homo sapiens
gaggauccaugaacuacug

SEQ ID NO: 1486231 - RNA, 19 nt, Homo sapiens
gaucgcgccuggagaaaca

SEQ ID NO: 1486232 - RNA, 19 nt, Homo sapiens
gccuggaucucauagguuu

SEQ ID NO: 1486233 - RNA, 19 nt, Homo sapiens
gagggaaacuggugacacu

SEQ ID NO: 1486234 - RNA, 19 nt, Homo sapiens
ccacuuguguccggaauug

SEQ ID NO: 1486235 - RNA, 19 nt, Homo sapiens
gaaacaguguacuauucug

SEQ ID NO: 1486236 - RNA, 19 nt, Homo sapiens
ugaagcaucccuuuaauag

SEQ ID NO: 1486237 - RNA, 19 nt, Homo sapiens
gaaaaugggaugugcauga

SEQ ID NO: 1486238 - RNA, 19 nt, Homo sapiens
ggacaagggaugagagaag

SEQ ID NO: 1486239 - RNA, 19 nt, Homo sapiens
gaagcaucccuuuaauaga

SEQ ID NO: 1486240 - RNA, 19 nt, Homo sapiens
cgacgagaaugcagaaguc

SEQ ID NO: 1486241 - RNA, 19 nt, Homo sapiens
uaaauacacccagcacuug

SEQ ID NO: 1486242 - RNA, 19 nt, Homo sapiens
auacacacguacacauaaa

SEQ ID NO: 1486243 - RNA, 19 nt, Homo sapiens
ggaauugguggguucuuga

SEQ ID NO: 1486244 - RNA, 19 nt, Homo sapiens
acacacguacacauaaaua

SEQ ID NO: 1486245 - RNA, 19 nt, Homo sapiens
gacaagggaugagagaagu

SEQ ID NO: 1486246 - RNA, 19 nt, Homo sapiens
cagaauaauccuugagaga

SEQ ID NO: 1486247 - RNA, 19 nt, Homo sapiens
ucccuucgguccuaaguuu

SEQ ID NO: 1486248 - RNA, 19 nt, Homo sapiens
ugaaggccauugggaggua

SEQ ID NO: 1486249 - RNA, 19 nt, Homo sapiens
gcuuccaccugguuauuga

SEQ ID NO: 1486250 - RNA, 19 nt, Homo sapiens
gacccucgcgccauccuua

SEQ ID NO: 1486251 - RNA, 19 nt, Homo sapiens
ugaaauguaugugugcaau

SEQ ID NO: 1486252 - RNA, 19 nt, Homo sapiens
uguaaaguguugacagugu

SEQ ID NO: 1486253 - RNA, 19 nt, Homo sapiens
agaauaauccuugagagaa

SEQ ID NO: 1486254 - RNA, 19 nt, Homo sapiens
gugacacucuacagucuga

SEQ ID NO: 1486255 - RNA, 19 nt, Homo sapiens
aggaagagccuguugucua

SEQ ID NO: 1486256 - RNA, 19 nt, Homo sapiens
caaguuguguuucuguuuu

SEQ ID NO: 1486257 - RNA, 19 nt, Homo sapiens
gauccaugaacuacuguaa

SEQ ID NO: 1486258 - RNA, 19 nt, Homo sapiens
gcaaugguguugaguucac

SEQ ID NO: 1486259 - RNA, 19 nt, Homo sapiens
ggagagcaggacauaaaug

SEQ ID NO: 1486260 - RNA, 19 nt, Homo sapiens
cuacacaccugcuaaacac

SEQ ID NO: 1486261 - RNA, 19 nt, Homo sapiens
uugcaaggcuagagggaaa

SEQ ID NO: 1486262 - RNA, 19 nt, Homo sapiens
gaaccuggucugcaugaca

SEQ ID NO: 1486263 - RNA, 19 nt, Homo sapiens
gaaauguaugugugcaaug

SEQ ID NO: 1486264 - RNA, 19 nt, Homo sapiens
agacagcaggugaaaugua

SEQ ID NO: 1486265 - RNA, 19 nt, Homo sapiens
ggugguuugucuaacagaa

SEQ ID NO: 1486266 - RNA, 19 nt, Homo sapiens
gagaaccuggucugcauga

SEQ ID NO: 1486267 - RNA, 19 nt, Homo sapiens
cgaggaacaugucaaaaug

SEQ ID NO: 1486268 - RNA, 19 nt, Homo sapiens
ccauacaaccuucguguca

SEQ ID NO: 1486269 - RNA, 19 nt, Homo sapiens
ggagcaaugguguugaguu

SEQ ID NO: 1486270 - RNA, 19 nt, Homo sapiens
uauacacacguacacauaa

SEQ ID NO: 1486271 - RNA, 19 nt, Homo sapiens
cagggugguuugucuaaca

SEQ ID NO: 1486272 - RNA, 19 nt, Homo sapiens
ccgagaaccuggucugcau

SEQ ID NO: 1486273 - RNA, 19 nt, Homo sapiens
gggccuggaucucauaggu

SEQ ID NO: 1486274 - RNA, 19 nt, Homo sapiens
cugaagcaucccuuuaaua

SEQ ID NO: 1486275 - RNA, 19 nt, Homo sapiens
ccugaagcaucccuuuaau

SEQ ID NO: 1486276 - RNA, 19 nt, Homo sapiens
gcaggugaaauguaugugu

SEQ ID NO: 1486277 - RNA, 19 nt, Homo sapiens
gagcccacuuucccagaau

SEQ ID NO: 1486278 - RNA, 19 nt, Homo sapiens
cuggagagcaggacauaaa

SEQ ID NO: 1486279 - RNA, 19 nt, Homo sapiens
ucacggccacugugccaua

SEQ ID NO: 1486280 - RNA, 19 nt, Homo sapiens
uccaugaacuacuguaaag

SEQ ID NO: 1486281 - RNA, 19 nt, Homo sapiens
gaggcagggugguuugucu

SEQ ID NO: 1486282 - RNA, 19 nt, Homo sapiens
caugaacuacuguaaagug

SEQ ID NO: 1486283 - RNA, 19 nt, Homo sapiens
cuucaucccuucgguccua

SEQ ID NO: 1486284 - RNA, 19 nt, Homo sapiens
cggaauugguggguucuug

SEQ ID NO: 1486285 - RNA, 19 nt, Homo sapiens
guugguaaaguacagaauu

SEQ ID NO: 1486286 - RNA, 19 nt, Homo sapiens
gagaaugcagaagucagua

SEQ ID NO: 1486287 - RNA, 19 nt, Homo sapiens
cugaagguccugaguguga

SEQ ID NO: 1486288 - RNA, 19 nt, Homo sapiens
gaaguaggaagagccuguu

SEQ ID NO: 1486289 - RNA, 19 nt, Homo sapiens
aaugggaugugcaugaaca

SEQ ID NO: 1486290 - RNA, 19 nt, Homo sapiens
auaaauacacccagcacuu

SEQ ID NO: 1486291 - RNA, 19 nt, Homo sapiens
gcaaugcgacgagaaugca

SEQ ID NO: 1486292 - RNA, 19 nt, Homo sapiens
auauacacacguacacaua

SEQ ID NO: 1486293 - RNA, 19 nt, Homo sapiens
gagcaacccugggaaaagu

SEQ ID NO: 1486294 - RNA, 19 nt, Homo sapiens
gcugagcaacccugggaaa

SEQ ID NO: 1486295 - RNA, 19 nt, Homo sapiens
ucuguacucucaaccaaca

SEQ ID NO: 1486296 - RNA, 19 nt, Homo sapiens
ccacuuucccagaauaauc

SEQ ID NO: 1486297 - RNA, 19 nt, Homo sapiens
cuaaacacacacacacaga

SEQ ID NO: 1486298 - RNA, 19 nt, Homo sapiens
gauggcuuccaccugguua

SEQ ID NO: 1486299 - RNA, 19 nt, Homo sapiens
uugguaaaguacagaauuc

SEQ ID NO: 1486300 - RNA, 19 nt, Homo sapiens
cucuauauauacacacgua

SEQ ID NO: 1486301 - RNA, 19 nt, Homo sapiens
ucucuguacucucaaccaa

SEQ ID NO: 1486302 - RNA, 19 nt, Homo sapiens
ggcagggugguuugucuaa

SEQ ID NO: 1486303 - RNA, 19 nt, Homo sapiens
ucuagaagcaaccaucaga

SEQ ID NO: 1486304 - RNA, 19 nt, Homo sapiens
guaggaagagccuguuguc

SEQ ID NO: 1486305 - RNA, 19 nt, Homo sapiens
gugugaaggcccagacauu

SEQ ID NO: 1486306 - RNA, 19 nt, Homo sapiens
agacacagauuccuaauua

SEQ ID NO: 1486307 - RNA, 19 nt, Homo sapiens
gaaauaaagggcacaauaa

SEQ ID NO: 1486308 - RNA, 19 nt, Homo sapiens
ggaccuggguuuggaauua

SEQ ID NO: 1486309 - RNA, 19 nt, Homo sapiens
gagcagaggucagauauca

SEQ ID NO: 1486310 - RNA, 19 nt, Homo sapiens
uaacggagauggaauguca

SEQ ID NO: 1486311 - RNA, 19 nt, Homo sapiens
cagggaagcuuaaucugua

SEQ ID NO: 1486312 - RNA, 19 nt, Homo sapiens
gaucagaaaucaugcaagu

SEQ ID NO: 1486313 - RNA, 19 nt, Homo sapiens
gugaacaccuuauguaugu

SEQ ID NO: 1486314 - RNA, 19 nt, Homo sapiens
gaucagcuguggcaugaga

SEQ ID NO: 1486315 - RNA, 19 nt, Homo sapiens
gaaccgggcuacacagcaa

SEQ ID NO: 1486316 - RNA, 19 nt, Homo sapiens
gcaaagaacacagggauga

SEQ ID NO: 1486317 - RNA, 19 nt, Homo sapiens
gaacaccuuauguauguaa

SEQ ID NO: 1486318 - RNA, 19 nt, Homo sapiens
gguuaaaggucacggaaga

SEQ ID NO: 1486319 - RNA, 19 nt, Homo sapiens
ccucaaauauggaucagaa

SEQ ID NO: 1486320 - RNA, 19 nt, Homo sapiens
gaacuuuggcugccuguga

SEQ ID NO: 1486321 - RNA, 19 nt, Homo sapiens
ggagagugcugcuucuauc

SEQ ID NO: 1486322 - RNA, 19 nt, Homo sapiens
guagugaacaccuuaugua

SEQ ID NO: 1486323 - RNA, 19 nt, Homo sapiens
agaaauaaagggcacaaua

SEQ ID NO: 1486324 - RNA, 19 nt, Homo sapiens
gcaaucauccuacaagauc

SEQ ID NO: 1486325 - RNA, 19 nt, Homo sapiens
gacaccugcuuuauucuuu

SEQ ID NO: 1486326 - RNA, 19 nt, Homo sapiens
ugagagggaucuagguuau

SEQ ID NO: 1486327 - RNA, 19 nt, Homo sapiens
cagaucagcuguggcauga

SEQ ID NO: 1486328 - RNA, 19 nt, Homo sapiens
ucccaccgauucuacauua

SEQ ID NO: 1486329 - RNA, 19 nt, Homo sapiens
ccuacaagaucuuaauguu

SEQ ID NO: 1486330 - RNA, 19 nt, Homo sapiens
uauggugaguuguguaauu

SEQ ID NO: 1486331 - RNA, 19 nt, Homo sapiens
guaucagaaucuaacagua

SEQ ID NO: 1486332 - RNA, 19 nt, Homo sapiens
gggaaaaccucaaauaugg

SEQ ID NO: 1486333 - RNA, 19 nt, Homo sapiens
ccucuuauaucucguagug

SEQ ID NO: 1486334 - RNA, 19 nt, Homo sapiens
gguccugccugauuucguu

SEQ ID NO: 1486335 - RNA, 19 nt, Homo sapiens
guucgguccugccugauuu

SEQ ID NO: 1486336 - RNA, 19 nt, Homo sapiens
cauaggagcuggaacuacu

SEQ ID NO: 1486337 - RNA, 19 nt, Homo sapiens
ccuaacaccugcaaucauc

SEQ ID NO: 1486338 - RNA, 19 nt, Homo sapiens
ggaagcuuaaucuguauuu

SEQ ID NO: 1486339 - RNA, 19 nt, Homo sapiens
ucagaaaucaugcaaguuc

SEQ ID NO: 1486340 - RNA, 19 nt, Homo sapiens
gcccauggccuguuaggaa

SEQ ID NO: 1486341 - RNA, 19 nt, Homo sapiens
gagaguccauauucugauc

SEQ ID NO: 1486342 - RNA, 19 nt, Homo sapiens
ugaaacugcuuacauuguc

SEQ ID NO: 1486343 - RNA, 19 nt, Homo sapiens
ggugaguuguguaauuguu

SEQ ID NO: 1486344 - RNA, 19 nt, Homo sapiens
ccuuugauaucaucugaaa

SEQ ID NO: 1486345 - RNA, 19 nt, Homo sapiens
gcagaggucagauaucaca

SEQ ID NO: 1486346 - RNA, 19 nt, Homo sapiens
ucuuauaucucguagugaa

SEQ ID NO: 1486347 - RNA, 19 nt, Homo sapiens
ggacaccugcuuuauucuu

SEQ ID NO: 1486348 - RNA, 19 nt, Homo sapiens
aaauccaggucaggaguua

SEQ ID NO: 1486349 - RNA, 19 nt, Homo sapiens
gagaaucuaaugccugaug

SEQ ID NO: 1486350 - RNA, 19 nt, Homo sapiens
gaaacugcuuacauugucu

SEQ ID NO: 1486351 - RNA, 19 nt, Homo sapiens
uagguuaugcuccuuauga

SEQ ID NO: 1486352 - RNA, 19 nt, Homo sapiens
guuaugcuccuuaugagaa

SEQ ID NO: 1486353 - RNA, 19 nt, Homo sapiens
uaucaggccuuggagaugu

SEQ ID NO: 1486354 - RNA, 19 nt, Homo sapiens
gguccugagugucaacgaa

SEQ ID NO: 1486355 - RNA, 19 nt, Homo sapiens
caaauauggaucagaaauc

SEQ ID NO: 1486356 - RNA, 19 nt, Homo sapiens
ucugaucccuaaauguauu

SEQ ID NO: 1486357 - RNA, 19 nt, Homo sapiens
uuggacaccugcuuuauuc

SEQ ID NO: 1486358 - RNA, 19 nt, Homo sapiens
ucuaaugccugaugaucug

SEQ ID NO: 1486359 - RNA, 19 nt, Homo sapiens
ggagcuggaacuacuguga

SEQ ID NO: 1486360 - RNA, 19 nt, Homo sapiens
uagcuaggauucugugucu

SEQ ID NO: 1486361 - RNA, 19 nt, Homo sapiens
ucacaagggacccggguuu

SEQ ID NO: 1486362 - RNA, 19 nt, Homo sapiens
ugaauccucagguccauuu

SEQ ID NO: 1486363 - RNA, 19 nt, Homo sapiens
gaugggacaagcacaaugu

SEQ ID NO: 1486364 - RNA, 19 nt, Homo sapiens
gaagacacagauuccuaau

SEQ ID NO: 1486365 - RNA, 19 nt, Homo sapiens
gagcuggaacuacugugaa

SEQ ID NO: 1486366 - RNA, 19 nt, Homo sapiens
ccagggaagcuuaaucugu

SEQ ID NO: 1486367 - RNA, 19 nt, Homo sapiens
cuggaacacugccuuaaca

SEQ ID NO: 1486368 - RNA, 19 nt, Homo sapiens
uaucaucugaaacugcuua

SEQ ID NO: 1486369 - RNA, 19 nt, Homo sapiens
gcuccucgcugaucuuuug

SEQ ID NO: 1486370 - RNA, 19 nt, Homo sapiens
agaaucuaaugccugauga

SEQ ID NO: 1486371 - RNA, 19 nt, Homo sapiens
auucugaucccuaaaugua

SEQ ID NO: 1486372 - RNA, 19 nt, Homo sapiens
gcuaggauucugugucuuc

SEQ ID NO: 1486373 - RNA, 19 nt, Homo sapiens
cggcuacggcgacuucuuu

SEQ ID NO: 1486374 - RNA, 19 nt, Homo sapiens
uccauauucugaucccuaa

SEQ ID NO: 1486375 - RNA, 19 nt, Homo sapiens
uacauugucuccgguauca

SEQ ID NO: 1486376 - RNA, 19 nt, Homo sapiens
uuaugugccucauuuaucu

SEQ ID NO: 1486377 - RNA, 19 nt, Homo sapiens
gacacagauuccuaauuag

SEQ ID NO: 1486378 - RNA, 19 nt, Homo sapiens
ccuaauugauaguguucuu

SEQ ID NO: 1486379 - RNA, 19 nt, Homo sapiens
gggagagugcugcuucuau

SEQ ID NO: 1486380 - RNA, 19 nt, Homo sapiens
gaccuggguuuggaauuag

SEQ ID NO: 1486381 - RNA, 19 nt, Homo sapiens
ugaguuguguaauuguuuc

SEQ ID NO: 1486382 - RNA, 19 nt, Homo sapiens
gaucuagguuaugcuccuu

SEQ ID NO: 1486383 - RNA, 19 nt, Homo sapiens
uaccuuugauaucaucuga

SEQ ID NO: 1486384 - RNA, 19 nt, Homo sapiens
aguccaaauuuacuccuaa

SEQ ID NO: 1486385 - RNA, 19 nt, Homo sapiens
cuacacagcaagaagugaa

SEQ ID NO: 1486386 - RNA, 19 nt, Homo sapiens
caucugaaacugcuuacau

SEQ ID NO: 1486387 - RNA, 19 nt, Homo sapiens
acacagauuccuaauuagu

SEQ ID NO: 1486388 - RNA, 19 nt, Homo sapiens
gagugcugcuucuaucgau

SEQ ID NO: 1486389 - RNA, 19 nt, Homo sapiens
ccaccgauucuacauuaug

SEQ ID NO: 1486390 - RNA, 19 nt, Homo sapiens
gguaucagaaucuaacagu

SEQ ID NO: 1486391 - RNA, 19 nt, Homo sapiens
ggcccuaauugauaguguu

SEQ ID NO: 1486392 - RNA, 19 nt, Homo sapiens
gcucacagaggcuaacuac

SEQ ID NO: 1486393 - RNA, 19 nt, Homo sapiens
gggcacaauaaauauaaug

SEQ ID NO: 1486394 - RNA, 19 nt, Homo sapiens
cauauucugaucccuaaau

SEQ ID NO: 1486395 - RNA, 19 nt, Homo sapiens
gauccuggccauuccauac

SEQ ID NO: 1486396 - RNA, 19 nt, Homo sapiens
gaucuccacguucuagcaa

SEQ ID NO: 1486397 - RNA, 19 nt, Homo sapiens
ucccuucccugaacucuuc

SEQ ID NO: 1486398 - RNA, 19 nt, Homo sapiens
acucuggccuuaggagaaa

SEQ ID NO: 1486399 - RNA, 19 nt, Homo sapiens
gacaacggcagcaggugaa

SEQ ID NO: 1486400 - RNA, 19 nt, Homo sapiens
guacgguccugagugucaa

SEQ ID NO: 1486401 - RNA, 19 nt, Homo sapiens
caugagagggaucuagguu

SEQ ID NO: 1486402 - RNA, 19 nt, Homo sapiens
auguuuaugugccucauuu

SEQ ID NO: 1486403 - RNA, 19 nt, Homo sapiens
gaaucuaacaguauaugcu

SEQ ID NO: 1486404 - RNA, 19 nt, Homo sapiens
cuaaaacccugaacuuugg

SEQ ID NO: 1486405 - RNA, 19 nt, Homo sapiens
cugcaaucauccuacaaga

SEQ ID NO: 1486406 - RNA, 19 nt, Homo sapiens
gcuggaagcucugggcaua

SEQ ID NO: 1486407 - RNA, 19 nt, Homo sapiens
caagaagucucaccagagu

SEQ ID NO: 1486408 - RNA, 19 nt, Homo sapiens
caucgucacugccagaauu

SEQ ID NO: 1486409 - RNA, 19 nt, Homo sapiens
acaccaagcuaauaaacug

SEQ ID NO: 1486410 - RNA, 19 nt, Homo sapiens
gcucggggcuccagauuuu

SEQ ID NO: 1486411 - RNA, 19 nt, Homo sapiens
ccaagaaguuuccguacag

SEQ ID NO: 1486412 - RNA, 19 nt, Homo sapiens
gccaagaaguuuccguaca

SEQ ID NO: 1486413 - RNA, 19 nt, Homo sapiens
agaagucucaccagaguaa

SEQ ID NO: 1486414 - RNA, 19 nt, Homo sapiens
guguguggccuucuuauug

SEQ ID NO: 1486415 - RNA, 19 nt, Homo sapiens
ccugggaggucacaaacga

SEQ ID NO: 1486416 - RNA, 19 nt, Homo sapiens
gaccauggccagcuucagu

SEQ ID NO: 1486417 - RNA, 19 nt, Homo sapiens
ccaggacucucugaucaca

SEQ ID NO: 1486418 - RNA, 19 nt, Homo sapiens
gagacugggcucugugugu

SEQ ID NO: 1486419 - RNA, 19 nt, Homo sapiens
ccuccacugugcaaccuuu

SEQ ID NO: 1486420 - RNA, 19 nt, Homo sapiens
ucauagaccgggagugguu

SEQ ID NO: 1486421 - RNA, 19 nt, Homo sapiens
ccagacaacucgccuuccu

SEQ ID NO: 1486422 - RNA, 19 nt, Homo sapiens
gauccaggcccaggagaau

SEQ ID NO: 1486423 - RNA, 19 nt, Homo sapiens
uuccaggacucucugauca

SEQ ID NO: 1486424 - RNA, 19 nt, Homo sapiens
gcuacaccaagcuaauaaa

SEQ ID NO: 1486425 - RNA, 19 nt, Homo sapiens
agaaguuuccguacagguu

SEQ ID NO: 1486426 - RNA, 19 nt, Homo sapiens
ggauccaggcccaggagaa

SEQ ID NO: 1486427 - RNA, 19 nt, Homo sapiens
uguguggccuucuuauugg

SEQ ID NO: 1486428 - RNA, 19 nt, Homo sapiens
gccacagagacuuuaguaa

SEQ ID NO: 1486429 - RNA, 19 nt, Homo sapiens
gcaguagccacagagacuu

SEQ ID NO: 1486430 - RNA, 19 nt, Homo sapiens
caguagccacagagacuuu

SEQ ID NO: 1486431 - RNA, 19 nt, Homo sapiens
uccaggcccaggagaauuu

SEQ ID NO: 1486432 - RNA, 19 nt, Homo sapiens
gaaaguggcuauuacaauu

SEQ ID NO: 1486433 - RNA, 19 nt, Homo sapiens
ggaaauagaggcugaguua

SEQ ID NO: 1486434 - RNA, 19 nt, Homo sapiens
gaagguaucuacucugaaa

SEQ ID NO: 1486435 - RNA, 19 nt, Homo sapiens
gaacgaagacgcacacaaa

SEQ ID NO: 1486436 - RNA, 19 nt, Homo sapiens
gaaagacaaucccaaacaa

SEQ ID NO: 1486437 - RNA, 19 nt, Homo sapiens
gaagucaguucgaugauau

SEQ ID NO: 1486438 - RNA, 19 nt, Homo sapiens
gaaauccugucagaugaua

SEQ ID NO: 1486439 - RNA, 19 nt, Homo sapiens
caaaugacccuacagguuu

SEQ ID NO: 1486440 - RNA, 19 nt, Homo sapiens
cacagcagauuaccauuua

SEQ ID NO: 1486441 - RNA, 19 nt, Homo sapiens
gaguaacccuuguaauuug

SEQ ID NO: 1486442 - RNA, 19 nt, Homo sapiens
gcacuaacaugcuguccuu

SEQ ID NO: 1486443 - RNA, 19 nt, Homo sapiens
agagguagaugaugaauug

SEQ ID NO: 1486444 - RNA, 19 nt, Homo sapiens
uaacagguaucauuccuau

SEQ ID NO: 1486445 - RNA, 19 nt, Homo sapiens
ggacuucacuggaggaaca

SEQ ID NO: 1486446 - RNA, 19 nt, Homo sapiens
gggcauauauacuaguaaa

SEQ ID NO: 1486447 - RNA, 19 nt, Homo sapiens
gaugaugaauuggacauuu

SEQ ID NO: 1486448 - RNA, 19 nt, Homo sapiens
ggaauaacauaugaacaga

SEQ ID NO: 1486449 - RNA, 19 nt, Homo sapiens
cagaguaacccuuguaauu

SEQ ID NO: 1486450 - RNA, 19 nt, Homo sapiens
ggagaaagacaaucccaaa

SEQ ID NO: 1486451 - RNA, 19 nt, Homo sapiens
gcaagaugcccaaggauug

SEQ ID NO: 1486452 - RNA, 19 nt, Homo sapiens
ggaacaggaucaagaccaa

SEQ ID NO: 1486453 - RNA, 19 nt, Homo sapiens
gaauuugccacaccugaua

SEQ ID NO: 1486454 - RNA, 19 nt, Homo sapiens
gaaggguuauagagagauu

SEQ ID NO: 1486455 - RNA, 19 nt, Homo sapiens
gaauuggacauuucggaua

SEQ ID NO: 1486456 - RNA, 19 nt, Homo sapiens
gcaagcaucagcaggaauu

SEQ ID NO: 1486457 - RNA, 19 nt, Homo sapiens
ggaaaguggcuauuacaau

SEQ ID NO: 1486458 - RNA, 19 nt, Homo sapiens
aaaugacccuacagguuua

SEQ ID NO: 1486459 - RNA, 19 nt, Homo sapiens
cucaauagaucaccaaaga

SEQ ID NO: 1486460 - RNA, 19 nt, Homo sapiens
ggaacaccgucacauguca

SEQ ID NO: 1486461 - RNA, 19 nt, Homo sapiens
ucaguucgaugauaucaga

SEQ ID NO: 1486462 - RNA, 19 nt, Homo sapiens
ccaaaugacccuacagguu

SEQ ID NO: 1486463 - RNA, 19 nt, Homo sapiens
gaaagugcgucagaucagu

SEQ ID NO: 1486464 - RNA, 19 nt, Homo sapiens
gagaaggcaaguuugagua

SEQ ID NO: 1486465 - RNA, 19 nt, Homo sapiens
ugaauuggaggaaggaaua

SEQ ID NO: 1486466 - RNA, 19 nt, Homo sapiens
guagaagucaguucgauga

SEQ ID NO: 1486467 - RNA, 19 nt, Homo sapiens
ggaagcucguccagauauu

SEQ ID NO: 1486468 - RNA, 19 nt, Homo sapiens
ggaggaaggaauaacauau

SEQ ID NO: 1486469 - RNA, 19 nt, Homo sapiens
agauacauauucagaggua

SEQ ID NO: 1486470 - RNA, 19 nt, Homo sapiens
gacgaaauccugucagaug

SEQ ID NO: 1486471 - RNA, 19 nt, Homo sapiens
caauagaucaccaaagaau

SEQ ID NO: 1486472 - RNA, 19 nt, Homo sapiens
cacaagggcauauauacua

SEQ ID NO: 1486473 - RNA, 19 nt, Homo sapiens
agaagucaguucgaugaua

SEQ ID NO: 1486474 - RNA, 19 nt, Homo sapiens
gagaaaaugcugcaaaauu

SEQ ID NO: 1486475 - RNA, 19 nt, Homo sapiens
caaccagcauugaauugga

SEQ ID NO: 1486476 - RNA, 19 nt, Homo sapiens
agaguaacccuuguaauuu

SEQ ID NO: 1486477 - RNA, 19 nt, Homo sapiens
gaagacgcacacaaaggua

SEQ ID NO: 1486478 - RNA, 19 nt, Homo sapiens
guccugugcuggaguauau

SEQ ID NO: 1486479 - RNA, 19 nt, Homo sapiens
cuacacaagggcauauaua

SEQ ID NO: 1486480 - RNA, 19 nt, Homo sapiens
ucacagcagauuaccauuu

SEQ ID NO: 1486481 - RNA, 19 nt, Homo sapiens
cagcuuugcaccacaauuu

SEQ ID NO: 1486482 - RNA, 19 nt, Homo sapiens
aauuggacauuucggauaa

SEQ ID NO: 1486483 - RNA, 19 nt, Homo sapiens
uuuaucagauggcgacuuu

SEQ ID NO: 1486484 - RNA, 19 nt, Homo sapiens
ugccagaacacauuauaua

SEQ ID NO: 1486485 - RNA, 19 nt, Homo sapiens
gaggaaggaauaacauaug

SEQ ID NO: 1486486 - RNA, 19 nt, Homo sapiens
cagaacacauuauauacag

SEQ ID NO: 1486487 - RNA, 19 nt, Homo sapiens
aggaaggaauaacauauga

SEQ ID NO: 1486488 - RNA, 19 nt, Homo sapiens
ggccacagaugggcacauu

SEQ ID NO: 1486489 - RNA, 19 nt, Homo sapiens
ugccacaccugauauauag

SEQ ID NO: 1486490 - RNA, 19 nt, Homo sapiens
guccagauauuguagaagu

SEQ ID NO: 1486491 - RNA, 19 nt, Homo sapiens
agaagcaaaugccaucaug

SEQ ID NO: 1486492 - RNA, 19 nt, Homo sapiens
gaaggaauaacauaugaac

SEQ ID NO: 1486493 - RNA, 19 nt, Homo sapiens
gcucagggcccacauuaag

SEQ ID NO: 1486494 - RNA, 19 nt, Homo sapiens
auucagagguagaugauga

SEQ ID NO: 1486495 - RNA, 19 nt, Homo sapiens
ggaaaaugcugagaaagau

SEQ ID NO: 1486496 - RNA, 19 nt, Homo sapiens
ugagcuggcuguucuaucu

SEQ ID NO: 1486497 - RNA, 19 nt, Homo sapiens
agaaaaugcugcaaaauuc

SEQ ID NO: 1486498 - RNA, 19 nt, Homo sapiens
uaugacagcugcgguacuu

SEQ ID NO: 1486499 - RNA, 19 nt, Homo sapiens
aaaguuaucucagggaucu

SEQ ID NO: 1486500 - RNA, 19 nt, Homo sapiens
gaaccagugccagaaggua

SEQ ID NO: 1486501 - RNA, 19 nt, Homo sapiens
gggagaaaaugcugcaaaa

SEQ ID NO: 1486502 - RNA, 19 nt, Homo sapiens
ccaagaaucacccaaccaa

SEQ ID NO: 1486503 - RNA, 19 nt, Homo sapiens
ugaggaaaguggcuauuac

SEQ ID NO: 1486504 - RNA, 19 nt, Homo sapiens
gaugcagacugugauugaa

SEQ ID NO: 1486505 - RNA, 19 nt, Homo sapiens
ggaaggaauaacauaugaa

SEQ ID NO: 1486506 - RNA, 19 nt, Homo sapiens
acgaaauccugucagauga

SEQ ID NO: 1486507 - RNA, 19 nt, Homo sapiens
aauagaggcugaguuagug

SEQ ID NO: 1486508 - RNA, 19 nt, Homo sapiens
ccugucagaugauaacuuc

SEQ ID NO: 1486509 - RNA, 19 nt, Homo sapiens
ccgagguacugaagaguga

SEQ ID NO: 1486510 - RNA, 19 nt, Homo sapiens
aagggcauauauacuagua

SEQ ID NO: 1486511 - RNA, 19 nt, Homo sapiens
cagcagauuaccauuuauu

SEQ ID NO: 1486512 - RNA, 19 nt, Homo sapiens
gaagcucguccagauauug

SEQ ID NO: 1486513 - RNA, 19 nt, Homo sapiens
gcugaugucugggcaguag

SEQ ID NO: 1486514 - RNA, 19 nt, Homo sapiens
guacuugagggcuucauug

SEQ ID NO: 1486515 - RNA, 19 nt, Homo sapiens
uaauucagcugcacaaaau

SEQ ID NO: 1486516 - RNA, 19 nt, Homo sapiens
caagcccucugaaagaauc

SEQ ID NO: 1486517 - RNA, 19 nt, Homo sapiens
gcugagaaagauacauauu

SEQ ID NO: 1486518 - RNA, 19 nt, Homo sapiens
gccagaagguaucuacucu

SEQ ID NO: 1486519 - RNA, 19 nt, Homo sapiens
uaucagauggcgacuuuga

SEQ ID NO: 1486520 - RNA, 19 nt, Homo sapiens
ccagaacacauuauauaca

SEQ ID NO: 1486521 - RNA, 19 nt, Homo sapiens
gcagauuaccauuuauuac

SEQ ID NO: 1486522 - RNA, 19 nt, Homo sapiens
gggcccacauuaaggaaau

SEQ ID NO: 1486523 - RNA, 19 nt, Homo sapiens
cuccugcucuggccacaua

SEQ ID NO: 1486524 - RNA, 19 nt, Homo sapiens
ccacaccugauauauagaa

SEQ ID NO: 1486525 - RNA, 19 nt, Homo sapiens
gaggaaaguggcuauuaca

SEQ ID NO: 1486526 - RNA, 19 nt, Homo sapiens
aagaaggguuauagagaga

SEQ ID NO: 1486527 - RNA, 19 nt, Homo sapiens
caagaaucacccaaccaaa

SEQ ID NO: 1486528 - RNA, 19 nt, Homo sapiens
caucaugguuccuguacag

SEQ ID NO: 1486529 - RNA, 19 nt, Homo sapiens
agaaagacaaucccaaaca

SEQ ID NO: 1486530 - RNA, 19 nt, Homo sapiens
gaaaaugcugagaaagaua

SEQ ID NO: 1486531 - RNA, 19 nt, Homo sapiens
uuccaggccuccuauggua

SEQ ID NO: 1486532 - RNA, 19 nt, Homo sapiens
gaagaaggaugaggacaua

SEQ ID NO: 1486533 - RNA, 19 nt, Homo sapiens
gaaagaagcuguaucuacu

SEQ ID NO: 1486534 - RNA, 19 nt, Homo sapiens
caacaagacugugaaauug

SEQ ID NO: 1486535 - RNA, 19 nt, Homo sapiens
ucaaguagcucaagaugaa

SEQ ID NO: 1486536 - RNA, 19 nt, Homo sapiens
ggacauagcucgccuuuug

SEQ ID NO: 1486537 - RNA, 19 nt, Homo sapiens
ggaaugaagccaagaguga

SEQ ID NO: 1486538 - RNA, 19 nt, Homo sapiens
acaaagaccuugaacaaca

SEQ ID NO: 1486539 - RNA, 19 nt, Homo sapiens
cuaggaaucugccuugaaa

SEQ ID NO: 1486540 - RNA, 19 nt, Homo sapiens
ggaaugguaugaugcugaa

SEQ ID NO: 1486541 - RNA, 19 nt, Homo sapiens
gcagagagacgacgcauuc

SEQ ID NO: 1486542 - RNA, 19 nt, Homo sapiens
gaacaacaagacugugaaa

SEQ ID NO: 1486543 - RNA, 19 nt, Homo sapiens
aggagaagcuggcuauuga

SEQ ID NO: 1486544 - RNA, 19 nt, Homo sapiens
gaaccucaccauucuaaga

SEQ ID NO: 1486545 - RNA, 19 nt, Homo sapiens
caaagaccuugaacaacaa

SEQ ID NO: 1486546 - RNA, 19 nt, Homo sapiens
cuacaaagaccuugaacaa

SEQ ID NO: 1486547 - RNA, 19 nt, Homo sapiens
gaaaucgcucgacuucuaa

SEQ ID NO: 1486548 - RNA, 19 nt, Homo sapiens
gaaaauggacucacuauag

SEQ ID NO: 1486549 - RNA, 19 nt, Homo sapiens
ggaguuacaggaagagaaa

SEQ ID NO: 1486550 - RNA, 19 nt, Homo sapiens
aacaagagauugagcauca

SEQ ID NO: 1486551 - RNA, 19 nt, Homo sapiens
caugacagauggugaagau

SEQ ID NO: 1486552 - RNA, 19 nt, Homo sapiens
acaacaagacugugaaauu

SEQ ID NO: 1486553 - RNA, 19 nt, Homo sapiens
ccacacggcauuucucaaa

SEQ ID NO: 1486554 - RNA, 19 nt, Homo sapiens
gugcuuaugcagauaguua

SEQ ID NO: 1486555 - RNA, 19 nt, Homo sapiens
ccaaggagcgggagaaauc

SEQ ID NO: 1486556 - RNA, 19 nt, Homo sapiens
gaugaaagaagcuguaucu

SEQ ID NO: 1486557 - RNA, 19 nt, Homo sapiens
ccagaaaacugcaagaaga

SEQ ID NO: 1486558 - RNA, 19 nt, Homo sapiens
ccacagggaucaggaaugg

SEQ ID NO: 1486559 - RNA, 19 nt, Homo sapiens
ggacucacuauagcaaaua

SEQ ID NO: 1486560 - RNA, 19 nt, Homo sapiens
cagcaaauuccaagucaaa

SEQ ID NO: 1486561 - RNA, 19 nt, Homo sapiens
gcauuucugaccauaagua

SEQ ID NO: 1486562 - RNA, 19 nt, Homo sapiens
ggaaguaugccgagauuuu

SEQ ID NO: 1486563 - RNA, 19 nt, Homo sapiens
gaagcuguaucuacuccau

SEQ ID NO: 1486564 - RNA, 19 nt, Homo sapiens
ccaagaggaagaucugaaa

SEQ ID NO: 1486565 - RNA, 19 nt, Homo sapiens
caaauauuacugggugaua

SEQ ID NO: 1486566 - RNA, 19 nt, Homo sapiens
uuaugaagauggaggaaug

SEQ ID NO: 1486567 - RNA, 19 nt, Homo sapiens
gcagcaaauuccaagucaa

SEQ ID NO: 1486568 - RNA, 19 nt, Homo sapiens
gcaagaagaagaacuuuug

SEQ ID NO: 1486569 - RNA, 19 nt, Homo sapiens
ugaaagaagcuguaucuac

SEQ ID NO: 1486570 - RNA, 19 nt, Homo sapiens
uuacaaaccagcagaguuc

SEQ ID NO: 1486571 - RNA, 19 nt, Homo sapiens
ugaugaaccucaccauucu

SEQ ID NO: 1486572 - RNA, 19 nt, Homo sapiens
aaggaaguaugccgagauu

SEQ ID NO: 1486573 - RNA, 19 nt, Homo sapiens
gugcauuucugaccauaag

SEQ ID NO: 1486574 - RNA, 19 nt, Homo sapiens
caagcugccuggagucaag

SEQ ID NO: 1486575 - RNA, 19 nt, Homo sapiens
caagagauugagcaucauu

SEQ ID NO: 1486576 - RNA, 19 nt, Homo sapiens
ccaccuaucaugacagaug

SEQ ID NO: 1486577 - RNA, 19 nt, Homo sapiens
acagggaucaggaauggua

SEQ ID NO: 1486578 - RNA, 19 nt, Homo sapiens
gacgacgcauucaggagaa

SEQ ID NO: 1486579 - RNA, 19 nt, Homo sapiens
cgggagaaaucaucuuugg

SEQ ID NO: 1486580 - RNA, 19 nt, Homo sapiens
gaggacauagcucgccuuu

SEQ ID NO: 1486581 - RNA, 19 nt, Homo sapiens
augcugaaauugccagaaa

SEQ ID NO: 1486582 - RNA, 19 nt, Homo sapiens
cagcuaaagcagcaaauuc

SEQ ID NO: 1486583 - RNA, 19 nt, Homo sapiens
caccaccuaucaugacaga

SEQ ID NO: 1486584 - RNA, 19 nt, Homo sapiens
gcauucaggagaagaagga

SEQ ID NO: 1486585 - RNA, 19 nt, Homo sapiens
ggauuacacucauuuuaca

SEQ ID NO: 1486586 - RNA, 19 nt, Homo sapiens
gcucaaguagcucaagaug

SEQ ID NO: 1486587 - RNA, 19 nt, Homo sapiens
gaaugaagccaagagugau

SEQ ID NO: 1486588 - RNA, 19 nt, Homo sapiens
caagugcauuucugaccau

SEQ ID NO: 1486589 - RNA, 19 nt, Homo sapiens
gaugcggauuacacucauu

SEQ ID NO: 1486590 - RNA, 19 nt, Homo sapiens
gagcaucauuuggcaucga

SEQ ID NO: 1486591 - RNA, 19 nt, Homo sapiens
agccaagagugaugaaaga

SEQ ID NO: 1486592 - RNA, 19 nt, Homo sapiens
caggagaagcuggcuauug

SEQ ID NO: 1486593 - RNA, 19 nt, Homo sapiens
gaaucugccuugaaaaugg

SEQ ID NO: 1486594 - RNA, 19 nt, Homo sapiens
ccaccaccaccuaucauga

SEQ ID NO: 1486595 - RNA, 19 nt, Homo sapiens
gauuuauccucaagugcau

SEQ ID NO: 1486596 - RNA, 19 nt, Homo sapiens
gacucacuauagcaaauau

SEQ ID NO: 1486597 - RNA, 19 nt, Homo sapiens
uggcuaagcagcuccaaga

SEQ ID NO: 1486598 - RNA, 19 nt, Homo sapiens
ucuaauggcugaagaaaag

SEQ ID NO: 1486599 - RNA, 19 nt, Homo sapiens
cucaggaaauucaggagaa

SEQ ID NO: 1486600 - RNA, 19 nt, Homo sapiens
uccagaagcgcuacaaaga

SEQ ID NO: 1486601 - RNA, 19 nt, Homo sapiens
uaucaugacagauggugaa

SEQ ID NO: 1486602 - RNA, 19 nt, Homo sapiens
gguaugaugcugaaauugc

SEQ ID NO: 1486603 - RNA, 19 nt, Homo sapiens
gaugaaccucaccauucua

SEQ ID NO: 1486604 - RNA, 19 nt, Homo sapiens
gaagccaagagugaugaaa

SEQ ID NO: 1486605 - RNA, 19 nt, Homo sapiens
ggaacaagagauugagcau

SEQ ID NO: 1486606 - RNA, 19 nt, Homo sapiens
aaacagcuaaagcagcaaa

SEQ ID NO: 1486607 - RNA, 19 nt, Homo sapiens
aaaaggaguuacaggaaga

SEQ ID NO: 1486608 - RNA, 19 nt, Homo sapiens
caaggaaguaugccgagau

SEQ ID NO: 1486609 - RNA, 19 nt, Homo sapiens
gcaaauauuacugggugau

SEQ ID NO: 1486610 - RNA, 19 nt, Homo sapiens
ugaagaaaucgcucgacuu

SEQ ID NO: 1486611 - RNA, 19 nt, Homo sapiens
agaaaucaucuuuggacaa

SEQ ID NO: 1486612 - RNA, 19 nt, Homo sapiens
ccgcucaaguagcucaaga

SEQ ID NO: 1486613 - RNA, 19 nt, Homo sapiens
aaauauuacugggugauac

SEQ ID NO: 1486614 - RNA, 19 nt, Homo sapiens
gagauugagcaucauuugg

SEQ ID NO: 1486615 - RNA, 19 nt, Homo sapiens
gcgcuacaaagaccuugaa

SEQ ID NO: 1486616 - RNA, 19 nt, Homo sapiens
agagauugagcaucauuug

SEQ ID NO: 1486617 - RNA, 19 nt, Homo sapiens
gaagcgcuacaaagaccuu

SEQ ID NO: 1486618 - RNA, 19 nt, Homo sapiens
gaaguaugccgagauuuug

SEQ ID NO: 1486619 - RNA, 19 nt, Homo sapiens
uggacucacuauagcaaau

SEQ ID NO: 1486620 - RNA, 19 nt, Homo sapiens
cuaaagcagcaaauuccaa

SEQ ID NO: 1486621 - RNA, 19 nt, Homo sapiens
gaaaacugcaagaagaaga

SEQ ID NO: 1486622 - RNA, 19 nt, Homo sapiens
augguaugaugcugaaauu

SEQ ID NO: 1486623 - RNA, 19 nt, Homo sapiens
gggaucaggaaugguauga

SEQ ID NO: 1486624 - RNA, 19 nt, Homo sapiens
gcggauuacacucauuuua

SEQ ID NO: 1486625 - RNA, 19 nt, Homo sapiens
acaagacugugaaauugcu

SEQ ID NO: 1486626 - RNA, 19 nt, Homo sapiens
gaauggcccacagggauca

SEQ ID NO: 1486627 - RNA, 19 nt, Homo sapiens
caaauuccaagucaaaaga

SEQ ID NO: 1486628 - RNA, 19 nt, Homo sapiens
gggagaaaucaucuuugga

SEQ ID NO: 1486629 - RNA, 19 nt, Homo sapiens
ggaggaaugaagccaagag

SEQ ID NO: 1486630 - RNA, 19 nt, Homo sapiens
gaaggaugaggacauagcu

SEQ ID NO: 1486631 - RNA, 19 nt, Homo sapiens
uugcauuccugggauuuau

SEQ ID NO: 1486632 - RNA, 19 nt, Homo sapiens
gagaagaccuuaccuauug

SEQ ID NO: 1486633 - RNA, 19 nt, Homo sapiens
ggagaaaucugaucaucua

SEQ ID NO: 1486634 - RNA, 19 nt, Homo sapiens
acaaagauccugugaauua

SEQ ID NO: 1486635 - RNA, 19 nt, Homo sapiens
gagcaaagauugagaaaca

SEQ ID NO: 1486636 - RNA, 19 nt, Homo sapiens
gcagaaaccagaaacuuua

SEQ ID NO: 1486637 - RNA, 19 nt, Homo sapiens
gaagaagaaggaacuguua

SEQ ID NO: 1486638 - RNA, 19 nt, Homo sapiens
gcacaggguuuccaaaugu

SEQ ID NO: 1486639 - RNA, 19 nt, Homo sapiens
ugaaggagauucuuucuga

SEQ ID NO: 1486640 - RNA, 19 nt, Homo sapiens
gaaugaaacuuugacugua

SEQ ID NO: 1486641 - RNA, 19 nt, Homo sapiens
uaagaacuguccugugaua

SEQ ID NO: 1486642 - RNA, 19 nt, Homo sapiens
gaagaaggaacuguuaaua

SEQ ID NO: 1486643 - RNA, 19 nt, Homo sapiens
gagaggaaguggcugaauu

SEQ ID NO: 1486644 - RNA, 19 nt, Homo sapiens
gaaagacaccgaaaguaaa

SEQ ID NO: 1486645 - RNA, 19 nt, Homo sapiens
gagaagauuuggagaacaa

SEQ ID NO: 1486646 - RNA, 19 nt, Homo sapiens
ggaaauaauugagaaggaa

SEQ ID NO: 1486647 - RNA, 19 nt, Homo sapiens
ucacugaguuuguucuuaa

SEQ ID NO: 1486648 - RNA, 19 nt, Homo sapiens
cuacaaagauccugugaau

SEQ ID NO: 1486649 - RNA, 19 nt, Homo sapiens
gcaacccagucacaaauaa

SEQ ID NO: 1486650 - RNA, 19 nt, Homo sapiens
ccagaaacuuuaaaucuug

SEQ ID NO: 1486651 - RNA, 19 nt, Homo sapiens
gaacuaauuugcuuugcau

SEQ ID NO: 1486652 - RNA, 19 nt, Homo sapiens
ccagaaagcucaaaaugua

SEQ ID NO: 1486653 - RNA, 19 nt, Homo sapiens
gaacuguccugugauaaau

SEQ ID NO: 1486654 - RNA, 19 nt, Homo sapiens
gaacaaguauuaggugauc

SEQ ID NO: 1486655 - RNA, 19 nt, Homo sapiens
gagcaaagaggacaauuga

SEQ ID NO: 1486656 - RNA, 19 nt, Homo sapiens
gagaaggacuguucaaacu

SEQ ID NO: 1486657 - RNA, 19 nt, Homo sapiens
caaccuggauguccucaaa

SEQ ID NO: 1486658 - RNA, 19 nt, Homo sapiens
gaauugaaucgacaaagua

SEQ ID NO: 1486659 - RNA, 19 nt, Homo sapiens
cacaaccucugcagacuua

SEQ ID NO: 1486660 - RNA, 19 nt, Homo sapiens
gauuugacauugcagaauu

SEQ ID NO: 1486661 - RNA, 19 nt, Homo sapiens
gaagagaagaccuuaccua

SEQ ID NO: 1486662 - RNA, 19 nt, Homo sapiens
gaacggugguggcaucugu

SEQ ID NO: 1486663 - RNA, 19 nt, Homo sapiens
aaugucaccuguucaguua

SEQ ID NO: 1486664 - RNA, 19 nt, Homo sapiens
ugacacgaauugcugauuu

SEQ ID NO: 1486665 - RNA, 19 nt, Homo sapiens
ggauaacucucuaaacucu

SEQ ID NO: 1486666 - RNA, 19 nt, Homo sapiens
gguacgccgucaugaaaua

SEQ ID NO: 1486667 - RNA, 19 nt, Homo sapiens
uaagagugguugcauuuau

SEQ ID NO: 1486668 - RNA, 19 nt, Homo sapiens
ggaacggauugcagaauug

SEQ ID NO: 1486669 - RNA, 19 nt, Homo sapiens
gaaauucaggcaucagaaa

SEQ ID NO: 1486670 - RNA, 19 nt, Homo sapiens
gcugaaauucuucgucuua

SEQ ID NO: 1486671 - RNA, 19 nt, Homo sapiens
aaagagcuguuuccucgua

SEQ ID NO: 1486672 - RNA, 19 nt, Homo sapiens
gaagaauagagcauuagua

SEQ ID NO: 1486673 - RNA, 19 nt, Homo sapiens
uaagugaagucaagucuca

SEQ ID NO: 1486674 - RNA, 19 nt, Homo sapiens
guaaagaaguagagacaag

SEQ ID NO: 1486675 - RNA, 19 nt, Homo sapiens
ugauguagauggugaagaa

SEQ ID NO: 1486676 - RNA, 19 nt, Homo sapiens
gaaugaagaaggcugguuu

SEQ ID NO: 1486677 - RNA, 19 nt, Homo sapiens
gaaauacacaaaucgaaga

SEQ ID NO: 1486678 - RNA, 19 nt, Homo sapiens
agaaagacaccgaaaguaa

SEQ ID NO: 1486679 - RNA, 19 nt, Homo sapiens
ucaaggcacauaugaauaa

SEQ ID NO: 1486680 - RNA, 19 nt, Homo sapiens
ugagccagcuguguuguua

SEQ ID NO: 1486681 - RNA, 19 nt, Homo sapiens
caggaagaguugcccguua

SEQ ID NO: 1486682 - RNA, 19 nt, Homo sapiens
gguaagagugguugcauuu

SEQ ID NO: 1486683 - RNA, 19 nt, Homo sapiens
gaagaacuaauuugcuuug

SEQ ID NO: 1486684 - RNA, 19 nt, Homo sapiens
caaagaaaggacauaauga

SEQ ID NO: 1486685 - RNA, 19 nt, Homo sapiens
gaccuuaccuauugauaca

SEQ ID NO: 1486686 - RNA, 19 nt, Homo sapiens
cccaaucuaucuuuaauga

SEQ ID NO: 1486687 - RNA, 19 nt, Homo sapiens
gauaauaccgugacugauc

SEQ ID NO: 1486688 - RNA, 19 nt, Homo sapiens
gggaguguuuguuuauauu

SEQ ID NO: 1486689 - RNA, 19 nt, Homo sapiens
cuaauuugcuuugcaugua

SEQ ID NO: 1486690 - RNA, 19 nt, Homo sapiens
ccagcuacguaaagaagua

SEQ ID NO: 1486691 - RNA, 19 nt, Homo sapiens
gaaggcugguuugcucuuu

SEQ ID NO: 1486692 - RNA, 19 nt, Homo sapiens
auuaagaacuguccuguga

SEQ ID NO: 1486693 - RNA, 19 nt, Homo sapiens
caaauaggacuaauuccaa

SEQ ID NO: 1486694 - RNA, 19 nt, Homo sapiens
aaagugagaaugagaauga

SEQ ID NO: 1486695 - RNA, 19 nt, Homo sapiens
gaagauugucuaucaugaa

SEQ ID NO: 1486696 - RNA, 19 nt, Homo sapiens
uaucauaagugaagucaag

SEQ ID NO: 1486697 - RNA, 19 nt, Homo sapiens
acaugaaucuggccaagaa

SEQ ID NO: 1486698 - RNA, 19 nt, Homo sapiens
gaaagcggagccacaggua

SEQ ID NO: 1486699 - RNA, 19 nt, Homo sapiens
ggacauaaugacacgaauu

SEQ ID NO: 1486700 - RNA, 19 nt, Homo sapiens
cagaagagcucccaguacu

SEQ ID NO: 1486701 - RNA, 19 nt, Homo sapiens
aggcaagacuucagcagua

SEQ ID NO: 1486702 - RNA, 19 nt, Homo sapiens
gcaacaacuggaacaagua

SEQ ID NO: 1486703 - RNA, 19 nt, Homo sapiens
ucucuaaacucucagucua

SEQ ID NO: 1486704 - RNA, 19 nt, Homo sapiens
ugacugaucuaaccguuca

SEQ ID NO: 1486705 - RNA, 19 nt, Homo sapiens
caaggcagguugagaugau

SEQ ID NO: 1486706 - RNA, 19 nt, Homo sapiens
ucacacaugcuauuaagaa

SEQ ID NO: 1486707 - RNA, 19 nt, Homo sapiens
aaauuccucugugugauua

SEQ ID NO: 1486708 - RNA, 19 nt, Homo sapiens
ccaccaaugucaccuguuc

SEQ ID NO: 1486709 - RNA, 19 nt, Homo sapiens
gaaucuuucuccaccaaug

SEQ ID NO: 1486710 - RNA, 19 nt, Homo sapiens
ugacaugacuucuacuuuu

SEQ ID NO: 1486711 - RNA, 19 nt, Homo sapiens
acaacuggaacaaguauua

SEQ ID NO: 1486712 - RNA, 19 nt, Homo sapiens
ucugcagacuuaccaaaua

SEQ ID NO: 1486713 - RNA, 19 nt, Homo sapiens
gaauagagcauuaguacac

SEQ ID NO: 1486714 - RNA, 19 nt, Homo sapiens
agugaaauauacagccuua

SEQ ID NO: 1486715 - RNA, 19 nt, Homo sapiens
gauaaaaccuacaaagauc

SEQ ID NO: 1486716 - RNA, 19 nt, Homo sapiens
gacauaaugacacgaauug

SEQ ID NO: 1486717 - RNA, 19 nt, Homo sapiens
gggauaauaccgugacuga

SEQ ID NO: 1486718 - RNA, 19 nt, Homo sapiens
ggcaacaacuggaacaagu

SEQ ID NO: 1486719 - RNA, 19 nt, Homo sapiens
gccaucaucugcucuuuca

SEQ ID NO: 1486720 - RNA, 19 nt, Homo sapiens
ucuaauagcugcagcaaaa

SEQ ID NO: 1486721 - RNA, 19 nt, Homo sapiens
caagauguguuggagaaau

SEQ ID NO: 1486722 - RNA, 19 nt, Homo sapiens
caaagauccugugaauuag

SEQ ID NO: 1486723 - RNA, 19 nt, Homo sapiens
gacacgaauugcugauuug

SEQ ID NO: 1486724 - RNA, 19 nt, Homo sapiens
gaacaaaauugggaagaga

SEQ ID NO: 1486725 - RNA, 19 nt, Homo sapiens
gaaaauagcaacccaguca

SEQ ID NO: 1486726 - RNA, 19 nt, Homo sapiens
gaaggagauucuuucugau

SEQ ID NO: 1486727 - RNA, 19 nt, Homo sapiens
gcaaagauugagaaacaga

SEQ ID NO: 1486728 - RNA, 19 nt, Homo sapiens
aggaagaguugcccguuaa

SEQ ID NO: 1486729 - RNA, 19 nt, Homo sapiens
gcucauugaugcucugaca

SEQ ID NO: 1486730 - RNA, 19 nt, Homo sapiens
gaaacaagaaugggauaau

SEQ ID NO: 1486731 - RNA, 19 nt, Homo sapiens
gaacaugaaauggaagaau

SEQ ID NO: 1486732 - RNA, 19 nt, Homo sapiens
gaugaaagcucacagaaca

SEQ ID NO: 1486733 - RNA, 19 nt, Homo sapiens
gaaaugagcucagggaaac

SEQ ID NO: 1486734 - RNA, 19 nt, Homo sapiens
ggacagauuugccuucaca

SEQ ID NO: 1486735 - RNA, 19 nt, Homo sapiens
uguauaagcugcugaagga

SEQ ID NO: 1486736 - RNA, 19 nt, Homo sapiens
gggaaacgguggacgagaa

SEQ ID NO: 1486737 - RNA, 19 nt, Homo sapiens
gcacagaaggucuuucaga

SEQ ID NO: 1486738 - RNA, 19 nt, Homo sapiens
aagcagagcugacgaccaa

SEQ ID NO: 1486739 - RNA, 19 nt, Homo sapiens
gagaacgggcgauuguaua

SEQ ID NO: 1486740 - RNA, 19 nt, Homo sapiens
gaggagcccuuggagguuu

SEQ ID NO: 1486741 - RNA, 19 nt, Homo sapiens
gccaacaccugccuucuuc

SEQ ID NO: 1486742 - RNA, 19 nt, Homo sapiens
ugaagcagcugaccaaucg

SEQ ID NO: 1486743 - RNA, 19 nt, Homo sapiens
agaagagggugcuugaaga

SEQ ID NO: 1486744 - RNA, 19 nt, Homo sapiens
ugaauagguuacuugugua

SEQ ID NO: 1486745 - RNA, 19 nt, Homo sapiens
gccaccaacuugaagauga

SEQ ID NO: 1486746 - RNA, 19 nt, Homo sapiens
gcacaaacgguuacagaag

SEQ ID NO: 1486747 - RNA, 19 nt, Homo sapiens
agagggugcuugaagauga

SEQ ID NO: 1486748 - RNA, 19 nt, Homo sapiens
gaggacagauuugccuuca

SEQ ID NO: 1486749 - RNA, 19 nt, Homo sapiens
gaagagggugcuugaagau

SEQ ID NO: 1486750 - RNA, 19 nt, Homo sapiens
gagaagagggugcuugaag

SEQ ID NO: 1486751 - RNA, 19 nt, Homo sapiens
augaauagguuacuugugu

SEQ ID NO: 1486752 - RNA, 19 nt, Homo sapiens
uaaugucacccuuacuuaa

SEQ ID NO: 1486753 - RNA, 19 nt, Homo sapiens
gaugggagacagagcauug

SEQ ID NO: 1486754 - RNA, 19 nt, Homo sapiens
aauagaagaggacagauuu

SEQ ID NO: 1486755 - RNA, 19 nt, Homo sapiens
gaagggagaaguggagaga

SEQ ID NO: 1486756 - RNA, 19 nt, Homo sapiens
cgaaaugagcucagggaaa

SEQ ID NO: 1486757 - RNA, 19 nt, Homo sapiens
gcuugaagaugagauugaa

SEQ ID NO: 1486758 - RNA, 19 nt, Homo sapiens
ugaaaucaaacaccucaaa

SEQ ID NO: 1486759 - RNA, 19 nt, Homo sapiens
uugaacaccuucgaaauga

SEQ ID NO: 1486760 - RNA, 19 nt, Homo sapiens
gaauagguuacuuguguau

SEQ ID NO: 1486761 - RNA, 19 nt, Homo sapiens
gcagaugaaagcucacaga

SEQ ID NO: 1486762 - RNA, 19 nt, Homo sapiens
gauccugggucuccccuua

SEQ ID NO: 1486763 - RNA, 19 nt, Homo sapiens
gaaaauagaagaggacaga

SEQ ID NO: 1486764 - RNA, 19 nt, Homo sapiens
uuaaugucacccuuacuua

SEQ ID NO: 1486765 - RNA, 19 nt, Homo sapiens
cugcccagcucuagacuga

SEQ ID NO: 1486766 - RNA, 19 nt, Homo sapiens
agaacgggcgauuguauaa

SEQ ID NO: 1486767 - RNA, 19 nt, Homo sapiens
ucaaggcaaugcaggagau

SEQ ID NO: 1486768 - RNA, 19 nt, Homo sapiens
cuucuucucugcuaucugu

SEQ ID NO: 1486769 - RNA, 19 nt, Homo sapiens
aaauagaagaggacagauu

SEQ ID NO: 1486770 - RNA, 19 nt, Homo sapiens
cgagaacgggcgauuguau

SEQ ID NO: 1486771 - RNA, 19 nt, Homo sapiens
gcagagcugacgaccaaga

SEQ ID NO: 1486772 - RNA, 19 nt, Homo sapiens
gaaaucaaacaccucaaaa

SEQ ID NO: 1486773 - RNA, 19 nt, Homo sapiens
ggacgagaacgggcgauug

SEQ ID NO: 1486774 - RNA, 19 nt, Homo sapiens
gauugaacaccuucgaaau

SEQ ID NO: 1486775 - RNA, 19 nt, Homo sapiens
gagauugaacaccuucgaa

SEQ ID NO: 1486776 - RNA, 19 nt, Homo sapiens
cagcacaaacgguuacaga

SEQ ID NO: 1486777 - RNA, 19 nt, Homo sapiens
gcacaguggauuccuuucu

SEQ ID NO: 1486778 - RNA, 19 nt, Homo sapiens
caggauggcagcagaugaa

SEQ ID NO: 1486779 - RNA, 19 nt, Homo sapiens
uauaagcugcugaaggaaa

SEQ ID NO: 1486780 - RNA, 19 nt, Homo sapiens
gacgagaacgggcgauugu

SEQ ID NO: 1486781 - RNA, 19 nt, Homo sapiens
uacagaagcagauggagaa

SEQ ID NO: 1486782 - RNA, 19 nt, Homo sapiens
gcaggauggcagcagauga

SEQ ID NO: 1486783 - RNA, 19 nt, Homo sapiens
agggagaaguggagagaga

SEQ ID NO: 1486784 - RNA, 19 nt, Homo sapiens
cagaugaaagcucacagaa

SEQ ID NO: 1486785 - RNA, 19 nt, Homo sapiens
gaugcagcacaaacgguua

SEQ ID NO: 1486786 - RNA, 19 nt, Homo sapiens
cacccuuacuuaacuugaa

SEQ ID NO: 1486787 - RNA, 19 nt, Homo sapiens
cacaguggauuccuuucug

SEQ ID NO: 1486788 - RNA, 19 nt, Homo sapiens
gggcuggacuugggaagag

SEQ ID NO: 1486789 - RNA, 19 nt, Homo sapiens
ugagugaccuccgaaacca

SEQ ID NO: 1486790 - RNA, 19 nt, Homo sapiens
ccaccaacuugaagaugag

SEQ ID NO: 1486791 - RNA, 19 nt, Homo sapiens
gguuacuuguguauuaaag

SEQ ID NO: 1486792 - RNA, 19 nt, Homo sapiens
ccagggagaguccauuaag

SEQ ID NO: 1486793 - RNA, 19 nt, Homo sapiens
ccaacuugaagaugaguga

SEQ ID NO: 1486794 - RNA, 19 nt, Homo sapiens
acaaacgguuacagaagca

SEQ ID NO: 1486795 - RNA, 19 nt, Homo sapiens
gaacgggcgauuguauaag

SEQ ID NO: 1486796 - RNA, 19 nt, Homo sapiens
gauggcagcagaugaaagc

SEQ ID NO: 1486797 - RNA, 19 nt, Homo sapiens
gggugaagcagcugaccaa

SEQ ID NO: 1486798 - RNA, 19 nt, Homo sapiens
gauuguauaagcugcugaa

SEQ ID NO: 1486799 - RNA, 19 nt, Homo sapiens
agauugaacaccuucgaaa

SEQ ID NO: 1486800 - RNA, 19 nt, Homo sapiens
gaaagcucacagaacacuu

SEQ ID NO: 1486801 - RNA, 19 nt, Homo sapiens
gagggugcuugaagaugag

SEQ ID NO: 1486802 - RNA, 19 nt, Homo sapiens
cuuaaugucacccuuacuu

SEQ ID NO: 1486803 - RNA, 19 nt, Homo sapiens
auaagcugcugaaggaaag

SEQ ID NO: 1486804 - RNA, 19 nt, Homo sapiens
acccuuacuuaacuugaaa

SEQ ID NO: 1486805 - RNA, 19 nt, Homo sapiens
agccuucccugcacuacuu

SEQ ID NO: 1486806 - RNA, 19 nt, Homo sapiens
gugaagcagcugaccaauc

SEQ ID NO: 1486807 - RNA, 19 nt, Homo sapiens
acacuuugcggcuccaguu

SEQ ID NO: 1486808 - RNA, 19 nt, Homo sapiens
gagcugcggauggcacaga

SEQ ID NO: 1486809 - RNA, 19 nt, Homo sapiens
aaacauaggucaugccuua

SEQ ID NO: 1486810 - RNA, 19 nt, Homo sapiens
gcaagcaaauucaacuuua

SEQ ID NO: 1486811 - RNA, 19 nt, Homo sapiens
gaaaggacaugauuaaagu

SEQ ID NO: 1486812 - RNA, 19 nt, Homo sapiens
gaaagagggucacauuguu

SEQ ID NO: 1486813 - RNA, 19 nt, Homo sapiens
gaacuggucuacucaauuc

SEQ ID NO: 1486814 - RNA, 19 nt, Homo sapiens
gaaacucucugcagucuuc

SEQ ID NO: 1486815 - RNA, 19 nt, Homo sapiens
gcaauggccucaucucaga

SEQ ID NO: 1486816 - RNA, 19 nt, Homo sapiens
guaccuugcuguuaaguaa

SEQ ID NO: 1486817 - RNA, 19 nt, Homo sapiens
gaagaagacuuaguaugga

SEQ ID NO: 1486818 - RNA, 19 nt, Homo sapiens
ggaacacccucccagaauu

SEQ ID NO: 1486819 - RNA, 19 nt, Homo sapiens
acacuacccucaaaucuaa

SEQ ID NO: 1486820 - RNA, 19 nt, Homo sapiens
ggacuuguaugcugauaau

SEQ ID NO: 1486821 - RNA, 19 nt, Homo sapiens
gaaagugacugccuaaucc

SEQ ID NO: 1486822 - RNA, 19 nt, Homo sapiens
ugacaugguucuauccuuu

SEQ ID NO: 1486823 - RNA, 19 nt, Homo sapiens
ggucaugccuuaucuaugg

SEQ ID NO: 1486824 - RNA, 19 nt, Homo sapiens
gcaauccuaugauccacua

SEQ ID NO: 1486825 - RNA, 19 nt, Homo sapiens
gaacacccucccagaauuu

SEQ ID NO: 1486826 - RNA, 19 nt, Homo sapiens
guugauagcuuguguuagu

SEQ ID NO: 1486827 - RNA, 19 nt, Homo sapiens
uguaguaccuugcuguuaa

SEQ ID NO: 1486828 - RNA, 19 nt, Homo sapiens
caucaacacuacccucaaa

SEQ ID NO: 1486829 - RNA, 19 nt, Homo sapiens
ugaauaagcaauccuauga

SEQ ID NO: 1486830 - RNA, 19 nt, Homo sapiens
guucaucuacuuucacuua

SEQ ID NO: 1486831 - RNA, 19 nt, Homo sapiens
ggaaaggacaugauuaaag

SEQ ID NO: 1486832 - RNA, 19 nt, Homo sapiens
ggacuccgguuucugucua

SEQ ID NO: 1486833 - RNA, 19 nt, Homo sapiens
aaacauuucuacccuuuga

SEQ ID NO: 1486834 - RNA, 19 nt, Homo sapiens
ggcagaauauuuauacaug

SEQ ID NO: 1486835 - RNA, 19 nt, Homo sapiens
uggcugagcuguucuuaga

SEQ ID NO: 1486836 - RNA, 19 nt, Homo sapiens
caaaguaaauauggcagaa

SEQ ID NO: 1486837 - RNA, 19 nt, Homo sapiens
ggaagguuaucauugugaa

SEQ ID NO: 1486838 - RNA, 19 nt, Homo sapiens
ggagugacaugguucuauc

SEQ ID NO: 1486839 - RNA, 19 nt, Homo sapiens
caaguacagacuaguauaa

SEQ ID NO: 1486840 - RNA, 19 nt, Homo sapiens
caggaaaggacaugauuaa

SEQ ID NO: 1486841 - RNA, 19 nt, Homo sapiens
gcucaaaggacuccgguuu

SEQ ID NO: 1486842 - RNA, 19 nt, Homo sapiens
gaagaaguagcucaaagga

SEQ ID NO: 1486843 - RNA, 19 nt, Homo sapiens
cuuaagggcucaaguggaa

SEQ ID NO: 1486844 - RNA, 19 nt, Homo sapiens
gcuguucccuugaaguuau

SEQ ID NO: 1486845 - RNA, 19 nt, Homo sapiens
ggauuuggguggguaagaa

SEQ ID NO: 1486846 - RNA, 19 nt, Homo sapiens
ccacaaguacagacuagua

SEQ ID NO: 1486847 - RNA, 19 nt, Homo sapiens
gcugauaauucuagaccaa

SEQ ID NO: 1486848 - RNA, 19 nt, Homo sapiens
ccaagguuaucgaagauug

SEQ ID NO: 1486849 - RNA, 19 nt, Homo sapiens
gaugcucugucuucauauu

SEQ ID NO: 1486850 - RNA, 19 nt, Homo sapiens
ugagugauguuuaaguaug

SEQ ID NO: 1486851 - RNA, 19 nt, Homo sapiens
ucacaaagggcuuacgaaa

SEQ ID NO: 1486852 - RNA, 19 nt, Homo sapiens
guacaugaccaacuagaau

SEQ ID NO: 1486853 - RNA, 19 nt, Homo sapiens
gaagacuuaguauggauuu

SEQ ID NO: 1486854 - RNA, 19 nt, Homo sapiens
ugaagaagacuuaguaugg

SEQ ID NO: 1486855 - RNA, 19 nt, Homo sapiens
ccaugaagaagacuuagua

SEQ ID NO: 1486856 - RNA, 19 nt, Homo sapiens
gguaggauguggagugaca

SEQ ID NO: 1486857 - RNA, 19 nt, Homo sapiens
aaaauuaccuguagugaug

SEQ ID NO: 1486858 - RNA, 19 nt, Homo sapiens
cuaauugcccuacagcaua

SEQ ID NO: 1486859 - RNA, 19 nt, Homo sapiens
uaucgaagauuggaagguu

SEQ ID NO: 1486860 - RNA, 19 nt, Homo sapiens
acaaagggcuuacgaaaau

SEQ ID NO: 1486861 - RNA, 19 nt, Homo sapiens
uaauugcccuacagcauau

SEQ ID NO: 1486862 - RNA, 19 nt, Homo sapiens
guucuauccuuuacuuaug

SEQ ID NO: 1486863 - RNA, 19 nt, Homo sapiens
gaaccugccaucucccauu

SEQ ID NO: 1486864 - RNA, 19 nt, Homo sapiens
gcauauuacuuugcaaugg

SEQ ID NO: 1486865 - RNA, 19 nt, Homo sapiens
ccaggaaaggacaugauua

SEQ ID NO: 1486866 - RNA, 19 nt, Homo sapiens
gaccugcagucauucaugu

SEQ ID NO: 1486867 - RNA, 19 nt, Homo sapiens
uccaagagauuuagugcaa

SEQ ID NO: 1486868 - RNA, 19 nt, Homo sapiens
ugaaagagggucacauugu

SEQ ID NO: 1486869 - RNA, 19 nt, Homo sapiens
ggaaagccggaacucauga

SEQ ID NO: 1486870 - RNA, 19 nt, Homo sapiens
uugaguacaugaccaacua

SEQ ID NO: 1486871 - RNA, 19 nt, Homo sapiens
ugugaugucuccaugaaga

SEQ ID NO: 1486872 - RNA, 19 nt, Homo sapiens
gacaugguucuauccuuua

SEQ ID NO: 1486873 - RNA, 19 nt, Homo sapiens
augcagauguuaaggauug

SEQ ID NO: 1486874 - RNA, 19 nt, Homo sapiens
gcauuuaaacgcccaggaa

SEQ ID NO: 1486875 - RNA, 19 nt, Homo sapiens
gaguuaaccccaaauauaa

SEQ ID NO: 1486876 - RNA, 19 nt, Homo sapiens
aauaagcaauccuaugauc

SEQ ID NO: 1486877 - RNA, 19 nt, Homo sapiens
gugaagaaguagcucaaag

SEQ ID NO: 1486878 - RNA, 19 nt, Homo sapiens
ccuaugauccacuaauuug

SEQ ID NO: 1486879 - RNA, 19 nt, Homo sapiens
ggacaugauuaaaguugac

SEQ ID NO: 1486880 - RNA, 19 nt, Homo sapiens
gguaagaaagcauuuaaac

SEQ ID NO: 1486881 - RNA, 19 nt, Homo sapiens
cagaauuuaccugugauua

SEQ ID NO: 1486882 - RNA, 19 nt, Homo sapiens
gaauagaagggagagagaa

SEQ ID NO: 1486883 - RNA, 19 nt, Homo sapiens
uuaccugcgcugcauauua

SEQ ID NO: 1486884 - RNA, 19 nt, Homo sapiens
aaaugcagauguuaaggau

SEQ ID NO: 1486885 - RNA, 19 nt, Homo sapiens
ucccagaauuuaccuguga

SEQ ID NO: 1486886 - RNA, 19 nt, Homo sapiens
gauagucacaaagggcuua

SEQ ID NO: 1486887 - RNA, 19 nt, Homo sapiens
gaauuuaccugugauuacc

SEQ ID NO: 1486888 - RNA, 19 nt, Homo sapiens
ucaaaggacuccgguuucu

SEQ ID NO: 1486889 - RNA, 19 nt, Homo sapiens
ccacuauuguaucugcauu

SEQ ID NO: 1486890 - RNA, 19 nt, Homo sapiens
gaacagaauccggaaugca

SEQ ID NO: 1486891 - RNA, 19 nt, Homo sapiens
uaaaugcagauguuaagga

SEQ ID NO: 1486892 - RNA, 19 nt, Homo sapiens
gaauaagcaauccuaugau

SEQ ID NO: 1486893 - RNA, 19 nt, Homo sapiens
gauuggaagguuaucauug

SEQ ID NO: 1486894 - RNA, 19 nt, Homo sapiens
ucaaacugccagaauagaa

SEQ ID NO: 1486895 - RNA, 19 nt, Homo sapiens
caacacuacccucaaaucu

SEQ ID NO: 1486896 - RNA, 19 nt, Homo sapiens
uagcagagccguuuuaaga

SEQ ID NO: 1486897 - RNA, 19 nt, Homo sapiens
gauagcuuguguuaguuuc

SEQ ID NO: 1486898 - RNA, 19 nt, Homo sapiens
ugaguuaaccccaaauaua

SEQ ID NO: 1486899 - RNA, 19 nt, Homo sapiens
uacagcauauucuaucaug

SEQ ID NO: 1486900 - RNA, 19 nt, Homo sapiens
uaccugcgcugcauauuac

SEQ ID NO: 1486901 - RNA, 19 nt, Homo sapiens
ucuacucaauucacagaaa

SEQ ID NO: 1486902 - RNA, 19 nt, Homo sapiens
ccggaacucaugauucuuu

SEQ ID NO: 1486903 - RNA, 19 nt, Homo sapiens
ugaaagugacugccuaauc

SEQ ID NO: 1486904 - RNA, 19 nt, Homo sapiens
acaugaccaacuagaauua

SEQ ID NO: 1486905 - RNA, 19 nt, Homo sapiens
cacccuacacuauucauuu

SEQ ID NO: 1486906 - RNA, 19 nt, Homo sapiens
gaaaaugcaagcaaauuca

SEQ ID NO: 1486907 - RNA, 19 nt, Homo sapiens
gagauuaugcagcccacaa

SEQ ID NO: 1486908 - RNA, 19 nt, Homo sapiens
caucuacuuucacuuacau

SEQ ID NO: 1486909 - RNA, 19 nt, Homo sapiens
gcagacaucccacgcauaa

SEQ ID NO: 1486910 - RNA, 19 nt, Homo sapiens
caagauguguuaagaauac

SEQ ID NO: 1486911 - RNA, 19 nt, Homo sapiens
ggcaagauguguuaagaau

SEQ ID NO: 1486912 - RNA, 19 nt, Homo sapiens
ggccgaggcugcuugcuuu

SEQ ID NO: 1486913 - RNA, 19 nt, Homo sapiens
gcaagauguguuaagaaua

SEQ ID NO: 1486914 - RNA, 19 nt, Homo sapiens
gacugaaacucuugacaga

SEQ ID NO: 1486915 - RNA, 19 nt, Homo sapiens
ugugugagcugguugauag

SEQ ID NO: 1486916 - RNA, 19 nt, Homo sapiens
ugguauagcaggacaguua

SEQ ID NO: 1486917 - RNA, 19 nt, Homo sapiens
cugaaacucuugacagaug

SEQ ID NO: 1486918 - RNA, 19 nt, Homo sapiens
gcucuacaguggcaucaau

SEQ ID NO: 1486919 - RNA, 19 nt, Homo sapiens
guugaagucuugugauugg

SEQ ID NO: 1486920 - RNA, 19 nt, Homo sapiens
ggccuaugguaauaauaaa

SEQ ID NO: 1486921 - RNA, 19 nt, Homo sapiens
guaggccuaugguaauaau

SEQ ID NO: 1486922 - RNA, 19 nt, Homo sapiens
caggcaagauguguuaaga

SEQ ID NO: 1486923 - RNA, 19 nt, Homo sapiens
caaucugacugguauagca

SEQ ID NO: 1486924 - RNA, 19 nt, Homo sapiens
gacuguaggccuaugguaa

SEQ ID NO: 1486925 - RNA, 19 nt, Homo sapiens
cccuacagcugccaaauuc

SEQ ID NO: 1486926 - RNA, 19 nt, Homo sapiens
ugacagaugcugcucaauc

SEQ ID NO: 1486927 - RNA, 19 nt, Homo sapiens
agacaucccacgcauaaga

SEQ ID NO: 1486928 - RNA, 19 nt, Homo sapiens
ggacuguaggccuauggua

SEQ ID NO: 1486929 - RNA, 19 nt, Homo sapiens
ccguugaagucuugugauu

SEQ ID NO: 1486930 - RNA, 19 nt, Homo sapiens
ucucaggcaagauguguua

SEQ ID NO: 1486931 - RNA, 19 nt, Homo sapiens
uuaaaugugugagcugguu

SEQ ID NO: 1486932 - RNA, 19 nt, Homo sapiens
gcaugagugugauacuucu

SEQ ID NO: 1486933 - RNA, 19 nt, Homo sapiens
gguauagcaggacaguuaa

SEQ ID NO: 1486934 - RNA, 19 nt, Homo sapiens
gauaggcaugagugugaua

SEQ ID NO: 1486935 - RNA, 19 nt, Homo sapiens
ccagggacgauauggauga

SEQ ID NO: 1486936 - RNA, 19 nt, Homo sapiens
gcccuggcgcaaacauuua

SEQ ID NO: 1486937 - RNA, 19 nt, Homo sapiens
caagugggacugaaacucu

SEQ ID NO: 1486938 - RNA, 19 nt, Homo sapiens
ggcccuggcgcaaacauuu

SEQ ID NO: 1486939 - RNA, 19 nt, Homo sapiens
gggacgauauggaugaaaa

SEQ ID NO: 1486940 - RNA, 19 nt, Homo sapiens
cuguaggccuaugguaaua

SEQ ID NO: 1486941 - RNA, 19 nt, Homo sapiens
ccgcuccguugaagucuug

SEQ ID NO: 1486942 - RNA, 19 nt, Homo sapiens
aggccuaugguaauaauaa

SEQ ID NO: 1486943 - RNA, 19 nt, Homo sapiens
uauagcaggacaguuaauu

SEQ ID NO: 1486944 - RNA, 19 nt, Homo sapiens
ggcaugagugugauacuuc

SEQ ID NO: 1486945 - RNA, 19 nt, Homo sapiens
uugauaggcaugaguguga

SEQ ID NO: 1486946 - RNA, 19 nt, Homo sapiens
cgauauggaugaaaagaca

SEQ ID NO: 1486947 - RNA, 19 nt, Homo sapiens
cagggacgauauggaugaa

SEQ ID NO: 1486948 - RNA, 19 nt, Homo sapiens
aggcaugagugugauacuu

SEQ ID NO: 1486949 - RNA, 19 nt, Homo sapiens
guuaauuccagggacgaua

SEQ ID NO: 1486950 - RNA, 19 nt, Homo sapiens
gcaagugggacugaaacuc

SEQ ID NO: 1486951 - RNA, 19 nt, Homo sapiens
uuaauuccagggacgauau

SEQ ID NO: 1486952 - RNA, 19 nt, Homo sapiens
gcaaaguucucuacaccua

SEQ ID NO: 1486953 - RNA, 19 nt, Homo sapiens
gcacugacguuuaagaaga

SEQ ID NO: 1486954 - RNA, 19 nt, Homo sapiens
gaacugcuaucuucagaga

SEQ ID NO: 1486955 - RNA, 19 nt, Homo sapiens
ucacgaagcuguuugaaga

SEQ ID NO: 1486956 - RNA, 19 nt, Homo sapiens
gaagggaguuucugaagga

SEQ ID NO: 1486957 - RNA, 19 nt, Homo sapiens
ggaaggagcucugguuugu

SEQ ID NO: 1486958 - RNA, 19 nt, Homo sapiens
aagaagaagucauccuuua

SEQ ID NO: 1486959 - RNA, 19 nt, Homo sapiens
gaggaaaggcugucaaauu

SEQ ID NO: 1486960 - RNA, 19 nt, Homo sapiens
ccaagaagcccaucacaaa

SEQ ID NO: 1486961 - RNA, 19 nt, Homo sapiens
gcccuacgcucuaaagauu

SEQ ID NO: 1486962 - RNA, 19 nt, Homo sapiens
ggaaguaccggcugaagaa

SEQ ID NO: 1486963 - RNA, 19 nt, Homo sapiens
aggaaaggcugucaaauug

SEQ ID NO: 1486964 - RNA, 19 nt, Homo sapiens
gucaauaugugaaugcuuu

SEQ ID NO: 1486965 - RNA, 19 nt, Homo sapiens
ggaagaugcgaguguguua

SEQ ID NO: 1486966 - RNA, 19 nt, Homo sapiens
gccaacaucuucaugaaug

SEQ ID NO: 1486967 - RNA, 19 nt, Homo sapiens
gaaagugcccuacgcucua

SEQ ID NO: 1486968 - RNA, 19 nt, Homo sapiens
gaagaagaagucauccuuu

SEQ ID NO: 1486969 - RNA, 19 nt, Homo sapiens
acaaguacccgcugaagua

SEQ ID NO: 1486970 - RNA, 19 nt, Homo sapiens
gcaaugaggccugaccuuu

SEQ ID NO: 1486971 - RNA, 19 nt, Homo sapiens
ggaggacagugcuucaaga

SEQ ID NO: 1486972 - RNA, 19 nt, Homo sapiens
gaacugcggcugcgacuuc

SEQ ID NO: 1486973 - RNA, 19 nt, Homo sapiens
gaagaagacggagaacaaa

SEQ ID NO: 1486974 - RNA, 19 nt, Homo sapiens
acacagagcccuacaaagu

SEQ ID NO: 1486975 - RNA, 19 nt, Homo sapiens
gaacucggacuaugagaau

SEQ ID NO: 1486976 - RNA, 19 nt, Homo sapiens
ccacgggccuuccaggauu

SEQ ID NO: 1486977 - RNA, 19 nt, Homo sapiens
ccagggccuuuacuuuaua

SEQ ID NO: 1486978 - RNA, 19 nt, Homo sapiens
cacaggaacugcuaucuuc

SEQ ID NO: 1486979 - RNA, 19 nt, Homo sapiens
gaacaaauugcauguggau

SEQ ID NO: 1486980 - RNA, 19 nt, Homo sapiens
gaagacggagaacaaauug

SEQ ID NO: 1486981 - RNA, 19 nt, Homo sapiens
gaagaagucauccuuuaag

SEQ ID NO: 1486982 - RNA, 19 nt, Homo sapiens
gggcagcagugaaguagga

SEQ ID NO: 1486983 - RNA, 19 nt, Homo sapiens
gaagagggcagcagugaag

SEQ ID NO: 1486984 - RNA, 19 nt, Homo sapiens
ucaagaagcagaagaaagu

SEQ ID NO: 1486985 - RNA, 19 nt, Homo sapiens
ugaacgaugugcuccugua

SEQ ID NO: 1486986 - RNA, 19 nt, Homo sapiens
ccacucacauccugcaguu

SEQ ID NO: 1486987 - RNA, 19 nt, Homo sapiens
gcuccucacagacuauuua

SEQ ID NO: 1486988 - RNA, 19 nt, Homo sapiens
gcacaggaacugcuaucuu

SEQ ID NO: 1486989 - RNA, 19 nt, Homo sapiens
cagaaaccgucccugaaga

SEQ ID NO: 1486990 - RNA, 19 nt, Homo sapiens
cugcuaggcuucaccauug

SEQ ID NO: 1486991 - RNA, 19 nt, Homo sapiens
aaaguggccuuggagagua

SEQ ID NO: 1486992 - RNA, 19 nt, Homo sapiens
gaagggacgcugaugaaag

SEQ ID NO: 1486993 - RNA, 19 nt, Homo sapiens
acaccuacauggccaguga

SEQ ID NO: 1486994 - RNA, 19 nt, Homo sapiens
ggagaagccucagcaacuc

SEQ ID NO: 1486995 - RNA, 19 nt, Homo sapiens
uaucucagccgguguaaga

SEQ ID NO: 1486996 - RNA, 19 nt, Homo sapiens
gaaagcauacguggagaug

SEQ ID NO: 1486997 - RNA, 19 nt, Homo sapiens
caaauugcauguggaugug

SEQ ID NO: 1486998 - RNA, 19 nt, Homo sapiens
agaagaagacggagaacaa

SEQ ID NO: 1486999 - RNA, 19 nt, Homo sapiens
agaagaagucauccuuuaa

SEQ ID NO: 1487000 - RNA, 19 nt, Homo sapiens
caacucauccggacacaca

SEQ ID NO: 1487001 - RNA, 19 nt, Homo sapiens
ggaagggacgcugaugaaa

SEQ ID NO: 1487002 - RNA, 19 nt, Homo sapiens
uggaggagcuggaggaaag

SEQ ID NO: 1487003 - RNA, 19 nt, Homo sapiens
aaagugcccuacgcucuaa

SEQ ID NO: 1487004 - RNA, 19 nt, Homo sapiens
cggcaccuauuucugauga

SEQ ID NO: 1487005 - RNA, 19 nt, Homo sapiens
gaaaccgucccugaagaaa

SEQ ID NO: 1487006 - RNA, 19 nt, Homo sapiens
aaggagcucugguuuguca

SEQ ID NO: 1487007 - RNA, 19 nt, Homo sapiens
acaccuggauucagcaaug

SEQ ID NO: 1487008 - RNA, 19 nt, Homo sapiens
guaccuaggucugcucagu

SEQ ID NO: 1487009 - RNA, 19 nt, Homo sapiens
cuacacagagcccuacaaa

SEQ ID NO: 1487010 - RNA, 19 nt, Homo sapiens
agaagacggagaacaaauu

SEQ ID NO: 1487011 - RNA, 19 nt, Homo sapiens
ggacacacaccuggauuca

SEQ ID NO: 1487012 - RNA, 19 nt, Homo sapiens
gaacaaguacccgcugaag

SEQ ID NO: 1487013 - RNA, 19 nt, Homo sapiens
cccagggccuuuacuuuau

SEQ ID NO: 1487014 - RNA, 19 nt, Homo sapiens
aagggacgcugaugaaagu

SEQ ID NO: 1487015 - RNA, 19 nt, Homo sapiens
acugcuaucuucagagaaa

SEQ ID NO: 1487016 - RNA, 19 nt, Homo sapiens
gaacauuccagccaugaac

SEQ ID NO: 1487017 - RNA, 19 nt, Homo sapiens
uuggaugacuacaggauaa

SEQ ID NO: 1487018 - RNA, 19 nt, Homo sapiens
acaaguacaagaagaagaa

SEQ ID NO: 1487019 - RNA, 19 nt, Homo sapiens
gaugaaaguaacagggaaa

SEQ ID NO: 1487020 - RNA, 19 nt, Homo sapiens
gccaugaacucggacuaug

SEQ ID NO: 1487021 - RNA, 19 nt, Homo sapiens
gcuaagcuguggcucaacu

SEQ ID NO: 1487022 - RNA, 19 nt, Homo sapiens
ggaagagggcagcagugaa

SEQ ID NO: 1487023 - RNA, 19 nt, Homo sapiens
ccuacgcucuaaagauuga

SEQ ID NO: 1487024 - RNA, 19 nt, Homo sapiens
ucacagaccgugccaacga

SEQ ID NO: 1487025 - RNA, 19 nt, Homo sapiens
uacaaagucugucccaucu

SEQ ID NO: 1487026 - RNA, 19 nt, Homo sapiens
uagcaguuaucaagcaugu

SEQ ID NO: 1487027 - RNA, 19 nt, Homo sapiens
ggaucgaggccauggaaga

SEQ ID NO: 1487028 - RNA, 19 nt, Homo sapiens
caaaguggccuuggagagu

SEQ ID NO: 1487029 - RNA, 19 nt, Homo sapiens
ccagaaggaugggaaguac

SEQ ID NO: 1487030 - RNA, 19 nt, Homo sapiens
gcagaagcugguccacauu

SEQ ID NO: 1487031 - RNA, 19 nt, Homo sapiens
guccagagcccuugucauc

SEQ ID NO: 1487032 - RNA, 19 nt, Homo sapiens
cuuaagggauauuuaugga

SEQ ID NO: 1487033 - RNA, 19 nt, Homo sapiens
aagaugcgaguguguuaua

SEQ ID NO: 1487034 - RNA, 19 nt, Homo sapiens
agaagcugguccacauuga

SEQ ID NO: 1487035 - RNA, 19 nt, Homo sapiens
gugaacgugucuuccucua

SEQ ID NO: 1487036 - RNA, 19 nt, Homo sapiens
gaagaugcgaguguguuau

SEQ ID NO: 1487037 - RNA, 19 nt, Homo sapiens
gggaaguaccggcugaaga

SEQ ID NO: 1487038 - RNA, 19 nt, Homo sapiens
cgaagcuguuugaagauca

SEQ ID NO: 1487039 - RNA, 19 nt, Homo sapiens
uuaagaagaagacggagaa

SEQ ID NO: 1487040 - RNA, 19 nt, Homo sapiens
caagaagcccaucacaaag

SEQ ID NO: 1487041 - RNA, 19 nt, Homo sapiens
auucuuaggucaauaugug

SEQ ID NO: 1487042 - RNA, 19 nt, Homo sapiens
aaaguucucuacaccuaca

SEQ ID NO: 1487043 - RNA, 19 nt, Homo sapiens
ccaggaagggaguuucuga

SEQ ID NO: 1487044 - RNA, 19 nt, Homo sapiens
ggagagccagcagaaggua

SEQ ID NO: 1487045 - RNA, 19 nt, Homo sapiens
gagcagcuucaacgccuuu

SEQ ID NO: 1487046 - RNA, 19 nt, Homo sapiens
gagaacauuccagccauga

SEQ ID NO: 1487047 - RNA, 19 nt, Homo sapiens
gaguggaguccuuugaaga

SEQ ID NO: 1487048 - RNA, 19 nt, Homo sapiens
gcuccgggcuucugaaucc

SEQ ID NO: 1487049 - RNA, 19 nt, Homo sapiens
gaugacuacaggauaaaga

SEQ ID NO: 1487050 - RNA, 19 nt, Homo sapiens
cuucaugaauggaauccuu

SEQ ID NO: 1487051 - RNA, 19 nt, Homo sapiens
cgacaucccaccuccuuuc

SEQ ID NO: 1487052 - RNA, 19 nt, Homo sapiens
gaagacaucuguaauauga

SEQ ID NO: 1487053 - RNA, 19 nt, Homo sapiens
gaaaggaagggauauauua

SEQ ID NO: 1487054 - RNA, 19 nt, Homo sapiens
gaagggagcuuguugauca

SEQ ID NO: 1487055 - RNA, 19 nt, Homo sapiens
gaagauugcuccuauuuca

SEQ ID NO: 1487056 - RNA, 19 nt, Homo sapiens
gcaggaggaugcugguuua

SEQ ID NO: 1487057 - RNA, 19 nt, Homo sapiens
gauaaucgccgcuuuguuu

SEQ ID NO: 1487058 - RNA, 19 nt, Homo sapiens
gcaaauuacucguacaguu

SEQ ID NO: 1487059 - RNA, 19 nt, Homo sapiens
gcaaggaacacucaacaua

SEQ ID NO: 1487060 - RNA, 19 nt, Homo sapiens
ggaggaugcugguuuauau

SEQ ID NO: 1487061 - RNA, 19 nt, Homo sapiens
guacugcaaucauucauuu

SEQ ID NO: 1487062 - RNA, 19 nt, Homo sapiens
ccacuaauauugagaaaug

SEQ ID NO: 1487063 - RNA, 19 nt, Homo sapiens
gaaguuaaauggaacagau

SEQ ID NO: 1487064 - RNA, 19 nt, Homo sapiens
ggauucagcuggugauuug

SEQ ID NO: 1487065 - RNA, 19 nt, Homo sapiens
cagcaaaucugaacugguu

SEQ ID NO: 1487066 - RNA, 19 nt, Homo sapiens
gcgaagagcugauggaaag

SEQ ID NO: 1487067 - RNA, 19 nt, Homo sapiens
gaagugcaguucccagaaa

SEQ ID NO: 1487068 - RNA, 19 nt, Homo sapiens
gaacucaaauuugcuauag

SEQ ID NO: 1487069 - RNA, 19 nt, Homo sapiens
ggaaacaucauauggaauu

SEQ ID NO: 1487070 - RNA, 19 nt, Homo sapiens
caaagcaguuuacauaugu

SEQ ID NO: 1487071 - RNA, 19 nt, Homo sapiens
aaucagauguugggaauua

SEQ ID NO: 1487072 - RNA, 19 nt, Homo sapiens
gcaaugcacugaagacauc

SEQ ID NO: 1487073 - RNA, 19 nt, Homo sapiens
gauaaugagucggaaguaa

SEQ ID NO: 1487074 - RNA, 19 nt, Homo sapiens
gaaaucagacaucaacaaa

SEQ ID NO: 1487075 - RNA, 19 nt, Homo sapiens
ugaaggcccuggauaauga

SEQ ID NO: 1487076 - RNA, 19 nt, Homo sapiens
gcaacacaaucaugcaauu

SEQ ID NO: 1487077 - RNA, 19 nt, Homo sapiens
gaggugaaguugucauuga

SEQ ID NO: 1487078 - RNA, 19 nt, Homo sapiens
gaagcucaauugugaaguu

SEQ ID NO: 1487079 - RNA, 19 nt, Homo sapiens
guaauucucugucaaugga

SEQ ID NO: 1487080 - RNA, 19 nt, Homo sapiens
gaauuaccauuucugaaga

SEQ ID NO: 1487081 - RNA, 19 nt, Homo sapiens
caaccuaauuggauucaaa

SEQ ID NO: 1487082 - RNA, 19 nt, Homo sapiens
gcacugaagacaucuguaa

SEQ ID NO: 1487083 - RNA, 19 nt, Homo sapiens
ccaaagcaguuuacauaug

SEQ ID NO: 1487084 - RNA, 19 nt, Homo sapiens
cagcagcagugaacaaauu

SEQ ID NO: 1487085 - RNA, 19 nt, Homo sapiens
gaaacuugguagugaaaga

SEQ ID NO: 1487086 - RNA, 19 nt, Homo sapiens
gagaauaaacauggaguua

SEQ ID NO: 1487087 - RNA, 19 nt, Homo sapiens
gagaaaugauggagugaug

SEQ ID NO: 1487088 - RNA, 19 nt, Homo sapiens
gcacuugacauguacagua

SEQ ID NO: 1487089 - RNA, 19 nt, Homo sapiens
uuaaugcacuugacaugua

SEQ ID NO: 1487090 - RNA, 19 nt, Homo sapiens
caaauuacucguacaguuu

SEQ ID NO: 1487091 - RNA, 19 nt, Homo sapiens
cagcacaucugucauugaa

SEQ ID NO: 1487092 - RNA, 19 nt, Homo sapiens
gaagaaaggaagggauaua

SEQ ID NO: 1487093 - RNA, 19 nt, Homo sapiens
gaaauccaguaccaacuau

SEQ ID NO: 1487094 - RNA, 19 nt, Homo sapiens
cauaucagguggaaguuaa

SEQ ID NO: 1487095 - RNA, 19 nt, Homo sapiens
ggacuugcuguuuauaaua

SEQ ID NO: 1487096 - RNA, 19 nt, Homo sapiens
gacggucccugaggaauua

SEQ ID NO: 1487097 - RNA, 19 nt, Homo sapiens
gaagcaugcugggaaauau

SEQ ID NO: 1487098 - RNA, 19 nt, Homo sapiens
caaggaacacucaacauaa

SEQ ID NO: 1487099 - RNA, 19 nt, Homo sapiens
ggagcuuguugaucaauaa

SEQ ID NO: 1487100 - RNA, 19 nt, Homo sapiens
cugaaggacuugcuguuua

SEQ ID NO: 1487101 - RNA, 19 nt, Homo sapiens
gaauagaggacgaauacaa

SEQ ID NO: 1487102 - RNA, 19 nt, Homo sapiens
ggaaugcuuugcuuuagga

SEQ ID NO: 1487103 - RNA, 19 nt, Homo sapiens
ccagugaucuagcauaugu

SEQ ID NO: 1487104 - RNA, 19 nt, Homo sapiens
uaaacaugcugccaccuuu

SEQ ID NO: 1487105 - RNA, 19 nt, Homo sapiens
uaccaaagcaguuuacaua

SEQ ID NO: 1487106 - RNA, 19 nt, Homo sapiens
gcacaucugucauugaaac

SEQ ID NO: 1487107 - RNA, 19 nt, Homo sapiens
uaaaguaggugucuucaac

SEQ ID NO: 1487108 - RNA, 19 nt, Homo sapiens
ggaaauccaguaccaacua

SEQ ID NO: 1487109 - RNA, 19 nt, Homo sapiens
gcucaauugugaaguuaaa

SEQ ID NO: 1487110 - RNA, 19 nt, Homo sapiens
gucaauggauucguaauuu

SEQ ID NO: 1487111 - RNA, 19 nt, Homo sapiens
gaauugggaucaagugaag

SEQ ID NO: 1487112 - RNA, 19 nt, Homo sapiens
gauggaaaccucagaauca

SEQ ID NO: 1487113 - RNA, 19 nt, Homo sapiens
caaauggaauucuugagau

SEQ ID NO: 1487114 - RNA, 19 nt, Homo sapiens
gaaagccaauagcaaggaa

SEQ ID NO: 1487115 - RNA, 19 nt, Homo sapiens
gaggacgaauacaagguua

SEQ ID NO: 1487116 - RNA, 19 nt, Homo sapiens
gaagaauagaggacgaaua

SEQ ID NO: 1487117 - RNA, 19 nt, Homo sapiens
gcaauucuauucgcuuguu

SEQ ID NO: 1487118 - RNA, 19 nt, Homo sapiens
gagcuucccuaaaagauua

SEQ ID NO: 1487119 - RNA, 19 nt, Homo sapiens
aaacaucgguggagcuuuc

SEQ ID NO: 1487120 - RNA, 19 nt, Homo sapiens
ggaaauaugucugcauggu

SEQ ID NO: 1487121 - RNA, 19 nt, Homo sapiens
ucagagaacucaaauuugc

SEQ ID NO: 1487122 - RNA, 19 nt, Homo sapiens
acaauuguaugguuucuug

SEQ ID NO: 1487123 - RNA, 19 nt, Homo sapiens
guaguaacauagacccaaa

SEQ ID NO: 1487124 - RNA, 19 nt, Homo sapiens
caacacaaucaugcaauua

SEQ ID NO: 1487125 - RNA, 19 nt, Homo sapiens
ccacagauauugaaguuuu

SEQ ID NO: 1487126 - RNA, 19 nt, Homo sapiens
cuagauacguguucaggaa

SEQ ID NO: 1487127 - RNA, 19 nt, Homo sapiens
aagugaagcucaauuguga

SEQ ID NO: 1487128 - RNA, 19 nt, Homo sapiens
ugaaggacuugcuguuuau

SEQ ID NO: 1487129 - RNA, 19 nt, Homo sapiens
guaggugucuucaacaaca

SEQ ID NO: 1487130 - RNA, 19 nt, Homo sapiens
caucaacguuacuaaauca

SEQ ID NO: 1487131 - RNA, 19 nt, Homo sapiens
agacacaagucaaauggaa

SEQ ID NO: 1487132 - RNA, 19 nt, Homo sapiens
uagccuaguugcuuuauau

SEQ ID NO: 1487133 - RNA, 19 nt, Homo sapiens
ggaaaucagacaucaacaa

SEQ ID NO: 1487134 - RNA, 19 nt, Homo sapiens
gacaauagacgaaaucaca

SEQ ID NO: 1487135 - RNA, 19 nt, Homo sapiens
guguuuacuuggucauuua

SEQ ID NO: 1487136 - RNA, 19 nt, Homo sapiens
caagucaaauggaauucuu

SEQ ID NO: 1487137 - RNA, 19 nt, Homo sapiens
aauuauaccugugugguua

SEQ ID NO: 1487138 - RNA, 19 nt, Homo sapiens
gaaguuaaaggaaauccaa

SEQ ID NO: 1487139 - RNA, 19 nt, Homo sapiens
uagcaguacuggaaacuug

SEQ ID NO: 1487140 - RNA, 19 nt, Homo sapiens
gcuggaaugcuuugcuuua

SEQ ID NO: 1487141 - RNA, 19 nt, Homo sapiens
gcacagcgacaaacucguu

SEQ ID NO: 1487142 - RNA, 19 nt, Homo sapiens
aauaauagagcccuucuuu

SEQ ID NO: 1487143 - RNA, 19 nt, Homo sapiens
caaagcagcacaucuguca

SEQ ID NO: 1487144 - RNA, 19 nt, Homo sapiens
ggucgaggcuuugguuaug

SEQ ID NO: 1487145 - RNA, 19 nt, Homo sapiens
cagcugaugccucuagaua

SEQ ID NO: 1487146 - RNA, 19 nt, Homo sapiens
ggaaaccucagaaucauca

SEQ ID NO: 1487147 - RNA, 19 nt, Homo sapiens
gaagauggaaaccucagaa

SEQ ID NO: 1487148 - RNA, 19 nt, Homo sapiens
ggccuaagccuacauacaa

SEQ ID NO: 1487149 - RNA, 19 nt, Homo sapiens
gaauguaaagcaaauggaa

SEQ ID NO: 1487150 - RNA, 19 nt, Homo sapiens
caagaaccaaguccuguaa

SEQ ID NO: 1487151 - RNA, 19 nt, Homo sapiens
cauauauccuguaguaaca

SEQ ID NO: 1487152 - RNA, 19 nt, Homo sapiens
gaagacaucuguaauauga

SEQ ID NO: 1487153 - RNA, 19 nt, Homo sapiens
gaagauugcuccuauuuca

SEQ ID NO: 1487154 - RNA, 19 nt, Homo sapiens
gcaaauuacucguacaguu

SEQ ID NO: 1487155 - RNA, 19 nt, Homo sapiens
ggaagaagauuaguauuag

SEQ ID NO: 1487156 - RNA, 19 nt, Homo sapiens
gaacucaaauuugcuauag

SEQ ID NO: 1487157 - RNA, 19 nt, Homo sapiens
ggaaacaucauauggaauu

SEQ ID NO: 1487158 - RNA, 19 nt, Homo sapiens
caaagcaguuuacauaugu

SEQ ID NO: 1487159 - RNA, 19 nt, Homo sapiens
gcaaugcacugaagacauc

SEQ ID NO: 1487160 - RNA, 19 nt, Homo sapiens
gauaaugagucggaaguaa

SEQ ID NO: 1487161 - RNA, 19 nt, Homo sapiens
gaaaucagacaucaacaaa

SEQ ID NO: 1487162 - RNA, 19 nt, Homo sapiens
ugaaggcccuggauaauga

SEQ ID NO: 1487163 - RNA, 19 nt, Homo sapiens
gcaacacaaucaugcaauu

SEQ ID NO: 1487164 - RNA, 19 nt, Homo sapiens
guaauucucugucaaugga

SEQ ID NO: 1487165 - RNA, 19 nt, Homo sapiens
gcacugaagacaucuguaa

SEQ ID NO: 1487166 - RNA, 19 nt, Homo sapiens
ggagaaggauguagacaag

SEQ ID NO: 1487167 - RNA, 19 nt, Homo sapiens
gaggauacguguuggaaau

SEQ ID NO: 1487168 - RNA, 19 nt, Homo sapiens
ccaaagcaguuuacauaug

SEQ ID NO: 1487169 - RNA, 19 nt, Homo sapiens
cagcagcagugaacaaauu

SEQ ID NO: 1487170 - RNA, 19 nt, Homo sapiens
gcacuugacauguacagua

SEQ ID NO: 1487171 - RNA, 19 nt, Homo sapiens
uuaaugcacuugacaugua

SEQ ID NO: 1487172 - RNA, 19 nt, Homo sapiens
caaauuacucguacaguuu

SEQ ID NO: 1487173 - RNA, 19 nt, Homo sapiens
cagcacaucugucauugaa

SEQ ID NO: 1487174 - RNA, 19 nt, Homo sapiens
aaacuacugugauuucuga

SEQ ID NO: 1487175 - RNA, 19 nt, Homo sapiens
ggacuugcuguuuauaaua

SEQ ID NO: 1487176 - RNA, 19 nt, Homo sapiens
gacggucccugaggaauua

SEQ ID NO: 1487177 - RNA, 19 nt, Homo sapiens
uaagauggguggagaagga

SEQ ID NO: 1487178 - RNA, 19 nt, Homo sapiens
cugaaggacuugcuguuua

SEQ ID NO: 1487179 - RNA, 19 nt, Homo sapiens
gaauagaggacgaauacaa

SEQ ID NO: 1487180 - RNA, 19 nt, Homo sapiens
gagugaaacuacugugauu

SEQ ID NO: 1487181 - RNA, 19 nt, Homo sapiens
ccagugaucuagcauaugu

SEQ ID NO: 1487182 - RNA, 19 nt, Homo sapiens
uaaacaugcugccaccuuu

SEQ ID NO: 1487183 - RNA, 19 nt, Homo sapiens
uaccaaagcaguuuacaua

SEQ ID NO: 1487184 - RNA, 19 nt, Homo sapiens
gcacaucugucauugaaac

SEQ ID NO: 1487185 - RNA, 19 nt, Homo sapiens
uaaaguaggugucuucaac

SEQ ID NO: 1487186 - RNA, 19 nt, Homo sapiens
gucaauggauucguaauuu

SEQ ID NO: 1487187 - RNA, 19 nt, Homo sapiens
gaauugggaucaagugaag

SEQ ID NO: 1487188 - RNA, 19 nt, Homo sapiens
gaggacgaauacaagguua

SEQ ID NO: 1487189 - RNA, 19 nt, Homo sapiens
gaagaauagaggacgaaua

SEQ ID NO: 1487190 - RNA, 19 nt, Homo sapiens
aaacaucgguggagcuuuc

SEQ ID NO: 1487191 - RNA, 19 nt, Homo sapiens
ggagaccgauguccagugu

SEQ ID NO: 1487192 - RNA, 19 nt, Homo sapiens
ucagagaacucaaauuugc

SEQ ID NO: 1487193 - RNA, 19 nt, Homo sapiens
acaauuguaugguuucuug

SEQ ID NO: 1487194 - RNA, 19 nt, Homo sapiens
guaguaacauagacccaaa

SEQ ID NO: 1487195 - RNA, 19 nt, Homo sapiens
caacacaaucaugcaauua

SEQ ID NO: 1487196 - RNA, 19 nt, Homo sapiens
ccacagauauugaaguuuu

SEQ ID NO: 1487197 - RNA, 19 nt, Homo sapiens
cuagauacguguucaggaa

SEQ ID NO: 1487198 - RNA, 19 nt, Homo sapiens
gauguagacaagaauguua

SEQ ID NO: 1487199 - RNA, 19 nt, Homo sapiens
ugaaggacuugcuguuuau

SEQ ID NO: 1487200 - RNA, 19 nt, Homo sapiens
guaggugucuucaacaaca

SEQ ID NO: 1487201 - RNA, 19 nt, Homo sapiens
uagccuaguugcuuuauau

SEQ ID NO: 1487202 - RNA, 19 nt, Homo sapiens
ggaaaucagacaucaacaa

SEQ ID NO: 1487203 - RNA, 19 nt, Homo sapiens
uaagauagacugacugcaa

SEQ ID NO: 1487204 - RNA, 19 nt, Homo sapiens
agaccgauguccaguguuu

SEQ ID NO: 1487205 - RNA, 19 nt, Homo sapiens
agaaggauguagacaagaa

SEQ ID NO: 1487206 - RNA, 19 nt, Homo sapiens
aauaauagagcccuucuuu

SEQ ID NO: 1487207 - RNA, 19 nt, Homo sapiens
caaagcagcacaucuguca

SEQ ID NO: 1487208 - RNA, 19 nt, Homo sapiens
ggucgaggcuuugguuaug

SEQ ID NO: 1487209 - RNA, 19 nt, Homo sapiens
cauauauccuguaguaaca

SEQ ID NO: 1487210 - RNA, 19 nt, Homo sapiens
aggaauggcugcaaucuca

SEQ ID NO: 1487211 - RNA, 19 nt, Homo sapiens
ugagaugguuucaggaaug

SEQ ID NO: 1487212 - RNA, 19 nt, Homo sapiens
ccggaaacaucauauggaa

SEQ ID NO: 1487213 - RNA, 19 nt, Homo sapiens
aagcuguguuccuuucuua

SEQ ID NO: 1487214 - RNA, 19 nt, Homo sapiens
cagaacagcggaagacuug

SEQ ID NO: 1487215 - RNA, 19 nt, Homo sapiens
gaauucaucagacuccaaa

SEQ ID NO: 1487216 - RNA, 19 nt, Homo sapiens
aauacaagguuaugagguu

SEQ ID NO: 1487217 - RNA, 19 nt, Homo sapiens
gccaguaucuuugccagaa

SEQ ID NO: 1487218 - RNA, 19 nt, Homo sapiens
caucugucauugaaacaaa

SEQ ID NO: 1487219 - RNA, 19 nt, Homo sapiens
cugaagacaucuguaauau

SEQ ID NO: 1487220 - RNA, 19 nt, Homo sapiens
acagcuagguccaguuuau

SEQ ID NO: 1487221 - RNA, 19 nt, Homo sapiens
cuacugugauuucugaaga

SEQ ID NO: 1487222 - RNA, 19 nt, Homo sapiens
ucaauggauucguaauuuc

SEQ ID NO: 1487223 - RNA, 19 nt, Homo sapiens
caacccaacuugagauggu

SEQ ID NO: 1487224 - RNA, 19 nt, Homo sapiens
gaaacaucauauggaauuc

SEQ ID NO: 1487225 - RNA, 19 nt, Homo sapiens
caagugaaggcccuggaua

SEQ ID NO: 1487226 - RNA, 19 nt, Homo sapiens
acugcaagcccuaaauuua

SEQ ID NO: 1487227 - RNA, 19 nt, Homo sapiens
gaaagccaccaccaaguca

SEQ ID NO: 1487228 - RNA, 19 nt, Homo sapiens
acagaauggucgaggcuuu

SEQ ID NO: 1487229 - RNA, 19 nt, Homo sapiens
uaugguuacuucuauguug

SEQ ID NO: 1487230 - RNA, 19 nt, Homo sapiens
gacccaaaguuacuauagu

SEQ ID NO: 1487231 - RNA, 19 nt, Homo sapiens
ucaaggcuguuguaugcaa

SEQ ID NO: 1487232 - RNA, 19 nt, Homo sapiens
cugcaagcccuaaauuuaa

SEQ ID NO: 1487233 - RNA, 19 nt, Homo sapiens
gggauuccauuuguguaaa

SEQ ID NO: 1487234 - RNA, 19 nt, Homo sapiens
cauauggacuuuggaagau

SEQ ID NO: 1487235 - RNA, 19 nt, Homo sapiens
caaaguuacuauagucaac

SEQ ID NO: 1487236 - RNA, 19 nt, Homo sapiens
gaguuagcauugucuuugu

SEQ ID NO: 1487237 - RNA, 19 nt, Homo sapiens
ugcaagcccuaaauuuaaa

SEQ ID NO: 1487238 - RNA, 19 nt, Homo sapiens
uaugcaaacuacucuucua

SEQ ID NO: 1487239 - RNA, 19 nt, Homo sapiens
ugaaacucaucuugguaaa

SEQ ID NO: 1487240 - RNA, 19 nt, Homo sapiens
caauggaagaagauuagua

SEQ ID NO: 1487241 - RNA, 19 nt, Homo sapiens
gaagacacccaguacuaag

SEQ ID NO: 1487242 - RNA, 19 nt, Homo sapiens
ugaagacacccaguacuaa

SEQ ID NO: 1487243 - RNA, 19 nt, Homo sapiens
uaccagugaucuagcauau

SEQ ID NO: 1487244 - RNA, 19 nt, Homo sapiens
gauauuuaccagugaucua

SEQ ID NO: 1487245 - RNA, 19 nt, Homo sapiens
gcauuguacaggaagauuu

SEQ ID NO: 1487246 - RNA, 19 nt, Homo sapiens
acucaaggcuguuguaugc

SEQ ID NO: 1487247 - RNA, 19 nt, Homo sapiens
acaaucauuuccaaccauu

SEQ ID NO: 1487248 - RNA, 19 nt, Homo sapiens
gaaggacuugcuguuuaua

SEQ ID NO: 1487249 - RNA, 19 nt, Homo sapiens
ucacagcuagguccaguuu

SEQ ID NO: 1487250 - RNA, 19 nt, Homo sapiens
ggagacaugaagacaaaga

SEQ ID NO: 1487251 - RNA, 19 nt, Homo sapiens
uuggagacaugaagacaaa

SEQ ID NO: 1487252 - RNA, 19 nt, Homo sapiens
gaaaggaagggauauauua

SEQ ID NO: 1487253 - RNA, 19 nt, Homo sapiens
gcaaggaacacucaacaua

SEQ ID NO: 1487254 - RNA, 19 nt, Homo sapiens
ggauucagcuggugauuug

SEQ ID NO: 1487255 - RNA, 19 nt, Homo sapiens
cagcaaaucugaacugguu

SEQ ID NO: 1487256 - RNA, 19 nt, Homo sapiens
ggaaacaucauauggaauu

SEQ ID NO: 1487257 - RNA, 19 nt, Homo sapiens
gauaaugagucggaaguaa

SEQ ID NO: 1487258 - RNA, 19 nt, Homo sapiens
gaaaucagacaucaacaaa

SEQ ID NO: 1487259 - RNA, 19 nt, Homo sapiens
ugaaggcccuggauaauga

SEQ ID NO: 1487260 - RNA, 19 nt, Homo sapiens
gaggugaaguugucauuga

SEQ ID NO: 1487261 - RNA, 19 nt, Homo sapiens
gaauuaccauuucugaaga

SEQ ID NO: 1487262 - RNA, 19 nt, Homo sapiens
caaccuaauuggauucaaa

SEQ ID NO: 1487263 - RNA, 19 nt, Homo sapiens
cagcagcagugaacaaauu

SEQ ID NO: 1487264 - RNA, 19 nt, Homo sapiens
gaaacuugguagugaaaga

SEQ ID NO: 1487265 - RNA, 19 nt, Homo sapiens
gagaauaaacauggaguua

SEQ ID NO: 1487266 - RNA, 19 nt, Homo sapiens
cagcacaucugucauugaa

SEQ ID NO: 1487267 - RNA, 19 nt, Homo sapiens
gaagaaaggaagggauaua

SEQ ID NO: 1487268 - RNA, 19 nt, Homo sapiens
ggacuugcuguuuauaaua

SEQ ID NO: 1487269 - RNA, 19 nt, Homo sapiens
gacggucccugaggaauua

SEQ ID NO: 1487270 - RNA, 19 nt, Homo sapiens
gaagcaugcugggaaauau

SEQ ID NO: 1487271 - RNA, 19 nt, Homo sapiens
caaggaacacucaacauaa

SEQ ID NO: 1487272 - RNA, 19 nt, Homo sapiens
cugaaggacuugcuguuua

SEQ ID NO: 1487273 - RNA, 19 nt, Homo sapiens
gaauagaggacgaauacaa

SEQ ID NO: 1487274 - RNA, 19 nt, Homo sapiens
gcacaucugucauugaaac

SEQ ID NO: 1487275 - RNA, 19 nt, Homo sapiens
uaaaguaggugucuucaac

SEQ ID NO: 1487276 - RNA, 19 nt, Homo sapiens
gaauugggaucaagugaag

SEQ ID NO: 1487277 - RNA, 19 nt, Homo sapiens
gauggaaaccucagaauca

SEQ ID NO: 1487278 - RNA, 19 nt, Homo sapiens
gaggacgaauacaagguua

SEQ ID NO: 1487279 - RNA, 19 nt, Homo sapiens
gaagaauagaggacgaaua

SEQ ID NO: 1487280 - RNA, 19 nt, Homo sapiens
aaacaucgguggagcuuuc

SEQ ID NO: 1487281 - RNA, 19 nt, Homo sapiens
ggaaauaugucugcauggu

SEQ ID NO: 1487282 - RNA, 19 nt, Homo sapiens
ccacagauauugaaguuuu

SEQ ID NO: 1487283 - RNA, 19 nt, Homo sapiens
cuagauacguguucaggaa

SEQ ID NO: 1487284 - RNA, 19 nt, Homo sapiens
ugaaggacuugcuguuuau

SEQ ID NO: 1487285 - RNA, 19 nt, Homo sapiens
guaggugucuucaacaaca

SEQ ID NO: 1487286 - RNA, 19 nt, Homo sapiens
caucaacguuacuaaauca

SEQ ID NO: 1487287 - RNA, 19 nt, Homo sapiens
ggaaaucagacaucaacaa

SEQ ID NO: 1487288 - RNA, 19 nt, Homo sapiens
gacaauagacgaaaucaca

SEQ ID NO: 1487289 - RNA, 19 nt, Homo sapiens
guguuuacuuggucauuua

SEQ ID NO: 1487290 - RNA, 19 nt, Homo sapiens
uagcaguacuggaaacuug

SEQ ID NO: 1487291 - RNA, 19 nt, Homo sapiens
caaagcagcacaucuguca

SEQ ID NO: 1487292 - RNA, 19 nt, Homo sapiens
ggucgaggcuuugguuaug

SEQ ID NO: 1487293 - RNA, 19 nt, Homo sapiens
cagcugaugccucuagaua

SEQ ID NO: 1487294 - RNA, 19 nt, Homo sapiens
ggccuaagccuacauacaa

SEQ ID NO: 1487295 - RNA, 19 nt, Homo sapiens
gaauguaaagcaaauggaa

SEQ ID NO: 1487296 - RNA, 19 nt, Homo sapiens
ggaaaccucagaaucauca

SEQ ID NO: 1487297 - RNA, 19 nt, Homo sapiens
gaagauggaaaccucagaa

SEQ ID NO: 1487298 - RNA, 19 nt, Homo sapiens
ccggaaacaucauauggaa

SEQ ID NO: 1487299 - RNA, 19 nt, Homo sapiens
gaauucaucagacuccaaa

SEQ ID NO: 1487300 - RNA, 19 nt, Homo sapiens
aauacaagguuaugagguu

SEQ ID NO: 1487301 - RNA, 19 nt, Homo sapiens
gccaguaucuuugccagaa

SEQ ID NO: 1487302 - RNA, 19 nt, Homo sapiens
caaagugggaggugaaguu

SEQ ID NO: 1487303 - RNA, 19 nt, Homo sapiens
caucugucauugaaacaaa

SEQ ID NO: 1487304 - RNA, 19 nt, Homo sapiens
guauagccacuaaccauuu

SEQ ID NO: 1487305 - RNA, 19 nt, Homo sapiens
gaaguugucauugagugua

SEQ ID NO: 1487306 - RNA, 19 nt, Homo sapiens
acagcuagguccaguuuau

SEQ ID NO: 1487307 - RNA, 19 nt, Homo sapiens
caugaucacucgcuagaca

SEQ ID NO: 1487308 - RNA, 19 nt, Homo sapiens
gcugggaguuauaccugua

SEQ ID NO: 1487309 - RNA, 19 nt, Homo sapiens
gaaacaucauauggaauuc

SEQ ID NO: 1487310 - RNA, 19 nt, Homo sapiens
cccagaggcugugacaaua

SEQ ID NO: 1487311 - RNA, 19 nt, Homo sapiens
gauagacuuugacagagau

SEQ ID NO: 1487312 - RNA, 19 nt, Homo sapiens
acgcagagcuuaguguuau

SEQ ID NO: 1487313 - RNA, 19 nt, Homo sapiens
caagugaaggcccuggaua

SEQ ID NO: 1487314 - RNA, 19 nt, Homo sapiens
gaaagccaccaccaaguca

SEQ ID NO: 1487315 - RNA, 19 nt, Homo sapiens
acagaauggucgaggcuuu

SEQ ID NO: 1487316 - RNA, 19 nt, Homo sapiens
ugauagacuuugacagaga

SEQ ID NO: 1487317 - RNA, 19 nt, Homo sapiens
caacauaacaauagugaac

SEQ ID NO: 1487318 - RNA, 19 nt, Homo sapiens
cagaggcugugacaauaga

SEQ ID NO: 1487319 - RNA, 19 nt, Homo sapiens
gugauuugaugauccgaaa

SEQ ID NO: 1487320 - RNA, 19 nt, Homo sapiens
aaucugaacugguuauaac

SEQ ID NO: 1487321 - RNA, 19 nt, Homo sapiens
gaagacacccaguacuaag

SEQ ID NO: 1487322 - RNA, 19 nt, Homo sapiens
ugaagacacccaguacuaa

SEQ ID NO: 1487323 - RNA, 19 nt, Homo sapiens
cagcgaccgugguggguuu

SEQ ID NO: 1487324 - RNA, 19 nt, Homo sapiens
ccagauggaggcuuugauu

SEQ ID NO: 1487325 - RNA, 19 nt, Homo sapiens
gaaggacuugcuguuuaua

SEQ ID NO: 1487326 - RNA, 19 nt, Homo sapiens
ucacagcuagguccaguuu

SEQ ID NO: 1487327 - RNA, 19 nt, Homo sapiens
ggagacaugaagacaaaga

SEQ ID NO: 1487328 - RNA, 19 nt, Homo sapiens
uuggagacaugaagacaaa

SEQ ID NO: 1487329 - RNA, 19 nt, Homo sapiens
auacaagguuaugagguua

SEQ ID NO: 1487330 - RNA, 19 nt, Homo sapiens
gaagaagaacccaccaaac

SEQ ID NO: 1487331 - RNA, 19 nt, Homo sapiens
gcaaaucugaacugguuau

SEQ ID NO: 1487332 - RNA, 19 nt, Homo sapiens
caccauguaugucauucaa

SEQ ID NO: 1487333 - RNA, 19 nt, Homo sapiens
gcagugaacaaauucgaau

SEQ ID NO: 1487334 - RNA, 19 nt, Homo sapiens
gccuuucgaugaagauuau

SEQ ID NO: 1487335 - RNA, 19 nt, Homo sapiens
gauggaggcuuugauuugc

SEQ ID NO: 1487336 - RNA, 19 nt, Homo sapiens
gagcaaggaacacucaaca

SEQ ID NO: 1487337 - RNA, 19 nt, Homo sapiens
gauacguguucaggaauga

SEQ ID NO: 1487338 - RNA, 19 nt, Homo sapiens
ugaagcaugcugggaaaua

SEQ ID NO: 1487339 - RNA, 19 nt, Homo sapiens
gaacacucaacauaacaau

SEQ ID NO: 1487340 - RNA, 19 nt, Homo sapiens
ccugauagacuuugacaga

SEQ ID NO: 1487341 - RNA, 19 nt, Homo sapiens
aaucagacgcugggaguua

SEQ ID NO: 1487342 - RNA, 19 nt, Homo sapiens
guacaucuuauuacuggaa

SEQ ID NO: 1487343 - RNA, 19 nt, Homo sapiens
uaagcaacauuuagcuagu

SEQ ID NO: 1487344 - RNA, 19 nt, Homo sapiens
ucaucagacuccaaaauua

SEQ ID NO: 1487345 - RNA, 19 nt, Homo sapiens
ccugaggaauuacagaaug

SEQ ID NO: 1487346 - RNA, 19 nt, Homo sapiens
gaaacggagaacagaagaa

SEQ ID NO: 1487347 - RNA, 19 nt, Homo sapiens
gcugcagaccugauuguaa

SEQ ID NO: 1487348 - RNA, 19 nt, Homo sapiens
guuguucaaguacaucuua

SEQ ID NO: 1487349 - RNA, 19 nt, Homo sapiens
ucagccaucaguacaauaa

SEQ ID NO: 1487350 - RNA, 19 nt, Homo sapiens
gcaaauggaaggccuaagc

SEQ ID NO: 1487351 - RNA, 19 nt, Homo sapiens
gacaugaagacaaagaaga

SEQ ID NO: 1487352 - RNA, 19 nt, Homo sapiens
gaaauguuguguucagaaa

SEQ ID NO: 1487353 - RNA, 19 nt, Homo sapiens
caacaaccuuccagacaua

SEQ ID NO: 1487354 - RNA, 19 nt, Homo sapiens
ggacugaaaugcuccauca

SEQ ID NO: 1487355 - RNA, 19 nt, Homo sapiens
uaaauggaaugcccucaua

SEQ ID NO: 1487356 - RNA, 19 nt, Homo sapiens
gaaagaaacacuuccuuau

SEQ ID NO: 1487357 - RNA, 19 nt, Homo sapiens
caacauaccauccauuuau

SEQ ID NO: 1487358 - RNA, 19 nt, Homo sapiens
caacuuaccuuugggagaa

SEQ ID NO: 1487359 - RNA, 19 nt, Homo sapiens
ccaaagauguccugggauu

SEQ ID NO: 1487360 - RNA, 19 nt, Homo sapiens
ggaacgaauuggugcagua

SEQ ID NO: 1487361 - RNA, 19 nt, Homo sapiens
ggaggaagaagaagaaauu

SEQ ID NO: 1487362 - RNA, 19 nt, Homo sapiens
gaacaucagugcccugucu

SEQ ID NO: 1487363 - RNA, 19 nt, Homo sapiens
cuucaugccuaacuuaaua

SEQ ID NO: 1487364 - RNA, 19 nt, Homo sapiens
acacuaaccucuuccaaug

SEQ ID NO: 1487365 - RNA, 19 nt, Homo sapiens
ccaaagcauuucacacuga

SEQ ID NO: 1487366 - RNA, 19 nt, Homo sapiens
gaagaagaaauuccuaaug

SEQ ID NO: 1487367 - RNA, 19 nt, Homo sapiens
acuaauagcuggagccauu

SEQ ID NO: 1487368 - RNA, 19 nt, Homo sapiens
caggaacauuggacuaaua

SEQ ID NO: 1487369 - RNA, 19 nt, Homo sapiens
caagauggccgaauaggaa

SEQ ID NO: 1487370 - RNA, 19 nt, Homo sapiens
ucagaugaauggauaaaga

SEQ ID NO: 1487371 - RNA, 19 nt, Homo sapiens
gcuguuacuuggccacuaa

SEQ ID NO: 1487372 - RNA, 19 nt, Homo sapiens
caaguguucuucugccaaa

SEQ ID NO: 1487373 - RNA, 19 nt, Homo sapiens
gcaagaagaauaaaugucu

SEQ ID NO: 1487374 - RNA, 19 nt, Homo sapiens
cagaugggcuuguucuuca

SEQ ID NO: 1487375 - RNA, 19 nt, Homo sapiens
gagcagaauaguacuuaaa

SEQ ID NO: 1487376 - RNA, 19 nt, Homo sapiens
gggccaaucuuucucuuuc

SEQ ID NO: 1487377 - RNA, 19 nt, Homo sapiens
gcaccugucuucuggaucu

SEQ ID NO: 1487378 - RNA, 19 nt, Homo sapiens
ucucucagaugaauggaua

SEQ ID NO: 1487379 - RNA, 19 nt, Homo sapiens
uaccagcgcugcccucauu

SEQ ID NO: 1487380 - RNA, 19 nt, Homo sapiens
gaacagcuccggucuacag

SEQ ID NO: 1487381 - RNA, 19 nt, Homo sapiens
gaagaagaagaaauuccua

SEQ ID NO: 1487382 - RNA, 19 nt, Homo sapiens
gaaaugcuccaucaugaag

SEQ ID NO: 1487383 - RNA, 19 nt, Homo sapiens
cugaaaugcuccaucauga

SEQ ID NO: 1487384 - RNA, 19 nt, Homo sapiens
uaccauccauuuaugcuaa

SEQ ID NO: 1487385 - RNA, 19 nt, Homo sapiens
gacaauacccucaaacuac

SEQ ID NO: 1487386 - RNA, 19 nt, Homo sapiens
uaaagaggaggaagaagaa

SEQ ID NO: 1487387 - RNA, 19 nt, Homo sapiens
gggagaaguuagacaauac

SEQ ID NO: 1487388 - RNA, 19 nt, Homo sapiens
gagcaacaauccaaaaguu

SEQ ID NO: 1487389 - RNA, 19 nt, Homo sapiens
gacaggugauuucugcauu

SEQ ID NO: 1487390 - RNA, 19 nt, Homo sapiens
ucagagagcccugggagua

SEQ ID NO: 1487391 - RNA, 19 nt, Homo sapiens
ggaaauguuguguucagaa

SEQ ID NO: 1487392 - RNA, 19 nt, Homo sapiens
gaggaaauguuguguucag

SEQ ID NO: 1487393 - RNA, 19 nt, Homo sapiens
ugggagaaguuagacaaua

SEQ ID NO: 1487394 - RNA, 19 nt, Homo sapiens
gccaacauaccauccauuu

SEQ ID NO: 1487395 - RNA, 19 nt, Homo sapiens
gagauuaaagugccagaug

SEQ ID NO: 1487396 - RNA, 19 nt, Homo sapiens
uauaggacaugaggaaaug

SEQ ID NO: 1487397 - RNA, 19 nt, Homo sapiens
ggaaccagcaccugucuuc

SEQ ID NO: 1487398 - RNA, 19 nt, Homo sapiens
agacaauacccucaaacua

SEQ ID NO: 1487399 - RNA, 19 nt, Homo sapiens
gaaauaagagaggaugauc

SEQ ID NO: 1487400 - RNA, 19 nt, Homo sapiens
ucaacaaccuuccagacau

SEQ ID NO: 1487401 - RNA, 19 nt, Homo sapiens
gaggcaagaagaauaaaug

SEQ ID NO: 1487402 - RNA, 19 nt, Homo sapiens
ccaacauaccauccauuua

SEQ ID NO: 1487403 - RNA, 19 nt, Homo sapiens
guuagacaauacccucaaa

SEQ ID NO: 1487404 - RNA, 19 nt, Homo sapiens
acaggugauuucugcauuu

SEQ ID NO: 1487405 - RNA, 19 nt, Homo sapiens
auaaaugucucugguggaa

SEQ ID NO: 1487406 - RNA, 19 nt, Homo sapiens
uaaagugccagauggaguu

SEQ ID NO: 1487407 - RNA, 19 nt, Homo sapiens
gaacauuggacuaauagcu

SEQ ID NO: 1487408 - RNA, 19 nt, Homo sapiens
cuaccaaugucucuaucuu

SEQ ID NO: 1487409 - RNA, 19 nt, Homo sapiens
ccacuaagauguguaaaau

SEQ ID NO: 1487410 - RNA, 19 nt, Homo sapiens
gcauuucacacugagauuu

SEQ ID NO: 1487411 - RNA, 19 nt, Homo sapiens
gcauuccucgaccaacuua

SEQ ID NO: 1487412 - RNA, 19 nt, Homo sapiens
aauguuguguucagaaaug

SEQ ID NO: 1487413 - RNA, 19 nt, Homo sapiens
agcaauggcucagucagua

SEQ ID NO: 1487414 - RNA, 19 nt, Homo sapiens
ucaccggucucacaguguu

SEQ ID NO: 1487415 - RNA, 19 nt, Homo sapiens
ggauucugcuggaucucaa

SEQ ID NO: 1487416 - RNA, 19 nt, Homo sapiens
gcuccaucaugaagacuug

SEQ ID NO: 1487417 - RNA, 19 nt, Homo sapiens
auaaagaggaggaagaaga

SEQ ID NO: 1487418 - RNA, 19 nt, Homo sapiens
gauauuggcagcgauguca

SEQ ID NO: 1487419 - RNA, 19 nt, Homo sapiens
guaucaggguggacagaug

SEQ ID NO: 1487420 - RNA, 19 nt, Homo sapiens
auacaagagcagaauagua

SEQ ID NO: 1487421 - RNA, 19 nt, Homo sapiens
gcaacacuggaacgaauug

SEQ ID NO: 1487422 - RNA, 19 nt, Homo sapiens
acaacacacuaaccucuuc

SEQ ID NO: 1487423 - RNA, 19 nt, Homo sapiens
ucacuccucucuccaaugc

SEQ ID NO: 1487424 - RNA, 19 nt, Homo sapiens
ggucacuccucucuccaau

SEQ ID NO: 1487425 - RNA, 19 nt, Homo sapiens
cagaugaauggauaaagaa

SEQ ID NO: 1487426 - RNA, 19 nt, Homo sapiens
guucuucaugccuaacuua

SEQ ID NO: 1487427 - RNA, 19 nt, Homo sapiens
ccaggaacauuggacuaau

SEQ ID NO: 1487428 - RNA, 19 nt, Homo sapiens
uacaagagcagaauaguac

SEQ ID NO: 1487429 - RNA, 19 nt, Homo sapiens
ugaaaugcuccaucaugaa

SEQ ID NO: 1487430 - RNA, 19 nt, Homo sapiens
guauaggacaugaggaaau

SEQ ID NO: 1487431 - RNA, 19 nt, Homo sapiens
gaucuuccacccaaguguu

SEQ ID NO: 1487432 - RNA, 19 nt, Homo sapiens
aaauaaagaggaggaagaa

SEQ ID NO: 1487433 - RNA, 19 nt, Homo sapiens
guccugcccugcacuuuca

SEQ ID NO: 1487434 - RNA, 19 nt, Homo sapiens
acgcaacacuggaacgaau

SEQ ID NO: 1487435 - RNA, 19 nt, Homo sapiens
gguagugacagccaacaga

SEQ ID NO: 1487436 - RNA, 19 nt, Homo sapiens
gaaggcauuccucgaccaa

SEQ ID NO: 1487437 - RNA, 19 nt, Homo sapiens
aagagcagaauaguacuua

SEQ ID NO: 1487438 - RNA, 19 nt, Homo sapiens
cauaagacucugguaguga

SEQ ID NO: 1487439 - RNA, 19 nt, Homo sapiens
acauaagacucugguagug

SEQ ID NO: 1487440 - RNA, 19 nt, Homo sapiens
gugcguggcuucuaaugcu

SEQ ID NO: 1487441 - RNA, 19 nt, Homo sapiens
ggugauuucugcauuucca

SEQ ID NO: 1487442 - RNA, 19 nt, Homo sapiens
agugccagauggaguuuaa

SEQ ID NO: 1487443 - RNA, 19 nt, Homo sapiens
uuacuuggccacuaagaug

SEQ ID NO: 1487444 - RNA, 19 nt, Homo sapiens
ccaagauggccgaauagga

SEQ ID NO: 1487445 - RNA, 19 nt, Homo sapiens
accaaugucucuaucuuca

SEQ ID NO: 1487446 - RNA, 19 nt, Homo sapiens
gcgcugcccucauuaaccu

SEQ ID NO: 1487447 - RNA, 19 nt, Homo sapiens
gauuaaagugccagaugga

SEQ ID NO: 1487448 - RNA, 19 nt, Homo sapiens
agagcagaauaguacuuaa

SEQ ID NO: 1487449 - RNA, 19 nt, Homo sapiens
caagagcagaauaguacuu

SEQ ID NO: 1487450 - RNA, 19 nt, Homo sapiens
cagcaccugucuucuggau

SEQ ID NO: 1487451 - RNA, 19 nt, Homo sapiens
gaaaaugcaggacauaugg

SEQ ID NO: 1487452 - RNA, 19 nt, Homo sapiens
guacaacucugaauucuua

SEQ ID NO: 1487453 - RNA, 19 nt, Homo sapiens
guacaacccugcaaauuug

SEQ ID NO: 1487454 - RNA, 19 nt, Homo sapiens
gaaguaaacauaccuguaa

SEQ ID NO: 1487455 - RNA, 19 nt, Homo sapiens
caaagaggcugacuacaga

SEQ ID NO: 1487456 - RNA, 19 nt, Homo sapiens
ggaaagaacugcugaacag

SEQ ID NO: 1487457 - RNA, 19 nt, Homo sapiens
gaagauccuuaccaaguuu

SEQ ID NO: 1487458 - RNA, 19 nt, Homo sapiens
ccacacugcucacagaaua

SEQ ID NO: 1487459 - RNA, 19 nt, Homo sapiens
ugaccagacugaccacuua

SEQ ID NO: 1487460 - RNA, 19 nt, Homo sapiens
gcagauuacugaaaacuua

SEQ ID NO: 1487461 - RNA, 19 nt, Homo sapiens
gcagauuacacacagauua

SEQ ID NO: 1487462 - RNA, 19 nt, Homo sapiens
ggaaaggguuaucauauac

SEQ ID NO: 1487463 - RNA, 19 nt, Homo sapiens
cagacaagcuaaucauaaa

SEQ ID NO: 1487464 - RNA, 19 nt, Homo sapiens
caaacuaucugagagaaga

SEQ ID NO: 1487465 - RNA, 19 nt, Homo sapiens
caaauauuccagcagauua

SEQ ID NO: 1487466 - RNA, 19 nt, Homo sapiens
aggaaaggguuaucauaua

SEQ ID NO: 1487467 - RNA, 19 nt, Homo sapiens
ccaaagaccuuccguacag

SEQ ID NO: 1487468 - RNA, 19 nt, Homo sapiens
cagaauagcugaccagacu

SEQ ID NO: 1487469 - RNA, 19 nt, Homo sapiens
ugaccaagcucauaguaau

SEQ ID NO: 1487470 - RNA, 19 nt, Homo sapiens
ugagaagacugacuacaga

SEQ ID NO: 1487471 - RNA, 19 nt, Homo sapiens
gcugaacccuugaaacaug

SEQ ID NO: 1487472 - RNA, 19 nt, Homo sapiens
gaugccagauucaccagua

SEQ ID NO: 1487473 - RNA, 19 nt, Homo sapiens
ggucauccgucccaucuga

SEQ ID NO: 1487474 - RNA, 19 nt, Homo sapiens
caaggaaaggguuaucaua

SEQ ID NO: 1487475 - RNA, 19 nt, Homo sapiens
cuaauaauguacagcauga

SEQ ID NO: 1487476 - RNA, 19 nt, Homo sapiens
gagcagaugaucagguuaa

SEQ ID NO: 1487477 - RNA, 19 nt, Homo sapiens
ugaagauccuuaccaaguu

SEQ ID NO: 1487478 - RNA, 19 nt, Homo sapiens
gcaaauauuccagcagauu

SEQ ID NO: 1487479 - RNA, 19 nt, Homo sapiens
ccacugaacuagcugaaca

SEQ ID NO: 1487480 - RNA, 19 nt, Homo sapiens
ggacaaagaggcugacuac

SEQ ID NO: 1487481 - RNA, 19 nt, Homo sapiens
ggaagaagacgaccagaag

SEQ ID NO: 1487482 - RNA, 19 nt, Homo sapiens
gaaauggaaacucagaaug

SEQ ID NO: 1487483 - RNA, 19 nt, Homo sapiens
aaacaucuguaaagacuca

SEQ ID NO: 1487484 - RNA, 19 nt, Homo sapiens
gaagacugacuacagauug

SEQ ID NO: 1487485 - RNA, 19 nt, Homo sapiens
gaacaaaguacguacaacu

SEQ ID NO: 1487486 - RNA, 19 nt, Homo sapiens
gaucguccguaccaucuga

SEQ ID NO: 1487487 - RNA, 19 nt, Homo sapiens
ugaccaaaguccuucugua

SEQ ID NO: 1487488 - RNA, 19 nt, Homo sapiens
cagaauauuuccccaguua

SEQ ID NO: 1487489 - RNA, 19 nt, Homo sapiens
gcagauggaccgcagaaug

SEQ ID NO: 1487490 - RNA, 19 nt, Homo sapiens
guaaacauaccuguaacua

SEQ ID NO: 1487491 - RNA, 19 nt, Homo sapiens
guacguacaacucugaauu

SEQ ID NO: 1487492 - RNA, 19 nt, Homo sapiens
gaagaagacgaccagaaga

SEQ ID NO: 1487493 - RNA, 19 nt, Homo sapiens
ugaacagacugaacgaaga

SEQ ID NO: 1487494 - RNA, 19 nt, Homo sapiens
gaacaaaaugggcauagua

SEQ ID NO: 1487495 - RNA, 19 nt, Homo sapiens
ugaccagacugcccuaaga

SEQ ID NO: 1487496 - RNA, 19 nt, Homo sapiens
caaaguguauagaacaaag

SEQ ID NO: 1487497 - RNA, 19 nt, Homo sapiens
ccaguaacuuccaagcaaa

SEQ ID NO: 1487498 - RNA, 19 nt, Homo sapiens
ccagcugucuuacuaugaa

SEQ ID NO: 1487499 - RNA, 19 nt, Homo sapiens
gaccagcugucuuacuaug

SEQ ID NO: 1487500 - RNA, 19 nt, Homo sapiens
ccacuuagcagacagacaa

SEQ ID NO: 1487501 - RNA, 19 nt, Homo sapiens
gcaaucaaacuuauagaag

SEQ ID NO: 1487502 - RNA, 19 nt, Homo sapiens
uagagcagaugaucagguu

SEQ ID NO: 1487503 - RNA, 19 nt, Homo sapiens
gcugauguuucugaccuua

SEQ ID NO: 1487504 - RNA, 19 nt, Homo sapiens
gcacacauacagcaaagug

SEQ ID NO: 1487505 - RNA, 19 nt, Homo sapiens
gaacagacugaacgaagau

SEQ ID NO: 1487506 - RNA, 19 nt, Homo sapiens
ugacaaugcucacuacacu

SEQ ID NO: 1487507 - RNA, 19 nt, Homo sapiens
aaaguuaggagaagaaguu

SEQ ID NO: 1487508 - RNA, 19 nt, Homo sapiens
acacacagauuauccaaac

SEQ ID NO: 1487509 - RNA, 19 nt, Homo sapiens
ggaagagccuccgcaagag

SEQ ID NO: 1487510 - RNA, 19 nt, Homo sapiens
gaacugcugaacagacuga

SEQ ID NO: 1487511 - RNA, 19 nt, Homo sapiens
gaccuuccguacagauuga

SEQ ID NO: 1487512 - RNA, 19 nt, Homo sapiens
gacaagcuaaucauaaaga

SEQ ID NO: 1487513 - RNA, 19 nt, Homo sapiens
acagacaagcuaaucauaa

SEQ ID NO: 1487514 - RNA, 19 nt, Homo sapiens
gacagacaagcuaaucaua

SEQ ID NO: 1487515 - RNA, 19 nt, Homo sapiens
uguaaagacucaccaccaa

SEQ ID NO: 1487516 - RNA, 19 nt, Homo sapiens
caacucugaauucuuauga

SEQ ID NO: 1487517 - RNA, 19 nt, Homo sapiens
cagauuguauggccucguu

SEQ ID NO: 1487518 - RNA, 19 nt, Homo sapiens
cguaccaucugaccaaaga

SEQ ID NO: 1487519 - RNA, 19 nt, Homo sapiens
ccaaaguccuucuguacag

SEQ ID NO: 1487520 - RNA, 19 nt, Homo sapiens
caacggaguagcugaacaa

SEQ ID NO: 1487521 - RNA, 19 nt, Homo sapiens
uggaagagccuccgcaaga

SEQ ID NO: 1487522 - RNA, 19 nt, Homo sapiens
aaguagaccucaauuccaa

SEQ ID NO: 1487523 - RNA, 19 nt, Homo sapiens
gaguacaacccugcaaauu

SEQ ID NO: 1487524 - RNA, 19 nt, Homo sapiens
cagagagguuccagacaga

SEQ ID NO: 1487525 - RNA, 19 nt, Homo sapiens
ugaaguaaacauaccugua

SEQ ID NO: 1487526 - RNA, 19 nt, Homo sapiens
cggaguagcugaacaaaau

SEQ ID NO: 1487527 - RNA, 19 nt, Homo sapiens
caaaacaucuguaaagacu

SEQ ID NO: 1487528 - RNA, 19 nt, Homo sapiens
acacagauuauccaaacua

SEQ ID NO: 1487529 - RNA, 19 nt, Homo sapiens
gaaagaacugcugaacaga

SEQ ID NO: 1487530 - RNA, 19 nt, Homo sapiens
uuaugaagauccuuaccaa

SEQ ID NO: 1487531 - RNA, 19 nt, Homo sapiens
aguacaacccugcaaauuu

SEQ ID NO: 1487532 - RNA, 19 nt, Homo sapiens
ugaaacacguggccagucu

SEQ ID NO: 1487533 - RNA, 19 nt, Homo sapiens
caaagaccuuccguacaga

SEQ ID NO: 1487534 - RNA, 19 nt, Homo sapiens
gcaaaguguauagaacaaa

SEQ ID NO: 1487535 - RNA, 19 nt, Homo sapiens
guaaccaaaucugaugaau

SEQ ID NO: 1487536 - RNA, 19 nt, Homo sapiens
gcuauugaccaagcucaua

SEQ ID NO: 1487537 - RNA, 19 nt, Homo sapiens
cagauugaccgcagaaugu

SEQ ID NO: 1487538 - RNA, 19 nt, Homo sapiens
gaaauugaccaaggaaagg

SEQ ID NO: 1487539 - RNA, 19 nt, Homo sapiens
caacagcaaagaggacaaa

SEQ ID NO: 1487540 - RNA, 19 nt, Homo sapiens
gaccaaaguccuucuguac

SEQ ID NO: 1487541 - RNA, 19 nt, Homo sapiens
guauagaacaaaguacgua

SEQ ID NO: 1487542 - RNA, 19 nt, Homo sapiens
acaccacauucugcaaaua

SEQ ID NO: 1487543 - RNA, 19 nt, Homo sapiens
aaacaccacauucugcaaa

SEQ ID NO: 1487544 - RNA, 19 nt, Homo sapiens
gaacuauaccagcagucaa

SEQ ID NO: 1487545 - RNA, 19 nt, Homo sapiens
ccaguuaggcaacagcaaa

SEQ ID NO: 1487546 - RNA, 19 nt, Homo sapiens
caacccugcugauguuucu

SEQ ID NO: 1487547 - RNA, 19 nt, Homo sapiens
uuaccaaguuucacuccaa

SEQ ID NO: 1487548 - RNA, 19 nt, Homo sapiens
cagauuacacacagauuau

SEQ ID NO: 1487549 - RNA, 19 nt, Homo sapiens
cagauggaccgcagaaugu

SEQ ID NO: 1487550 - RNA, 19 nt, Homo sapiens
ggacgcggcaggaaaugga

SEQ ID NO: 1487551 - RNA, 19 nt, Homo sapiens
aaggaaaggguuaucauau

SEQ ID NO: 1487552 - RNA, 19 nt, Homo sapiens
uaacagaccucuuaaauug

SEQ ID NO: 1487553 - RNA, 19 nt, Homo sapiens
gaaagaaugccacaaagua

SEQ ID NO: 1487554 - RNA, 19 nt, Homo sapiens
aaacuuagauguccuugua

SEQ ID NO: 1487555 - RNA, 19 nt, Homo sapiens
ggucauagaugcaaagaga

SEQ ID NO: 1487556 - RNA, 19 nt, Homo sapiens
gaaguuggcauguuucgua

SEQ ID NO: 1487557 - RNA, 19 nt, Homo sapiens
guaagaagcuuuuaacuga

SEQ ID NO: 1487558 - RNA, 19 nt, Homo sapiens
ggacagaauguuaaacuuu

SEQ ID NO: 1487559 - RNA, 19 nt, Homo sapiens
gagaugaaguggcaguuga

SEQ ID NO: 1487560 - RNA, 19 nt, Homo sapiens
gugcugauuuccuuuauuu

SEQ ID NO: 1487561 - RNA, 19 nt, Homo sapiens
guucagaugcuuagaauaa

SEQ ID NO: 1487562 - RNA, 19 nt, Homo sapiens
ggaagaugaguauuuauga

SEQ ID NO: 1487563 - RNA, 19 nt, Homo sapiens
acaacaggcugaacuagaa

SEQ ID NO: 1487564 - RNA, 19 nt, Homo sapiens
gaaaagaaccuccucaguu

SEQ ID NO: 1487565 - RNA, 19 nt, Homo sapiens
acacauguaugaaagaaug

SEQ ID NO: 1487566 - RNA, 19 nt, Homo sapiens
uagaaagggcaguauaaua

SEQ ID NO: 1487567 - RNA, 19 nt, Homo sapiens
aaccacagcugauguaaau

SEQ ID NO: 1487568 - RNA, 19 nt, Homo sapiens
cagaugagacugagccaua

SEQ ID NO: 1487569 - RNA, 19 nt, Homo sapiens
cagaaucacacauguauga

SEQ ID NO: 1487570 - RNA, 19 nt, Homo sapiens
gaaaugaagcggaaagcau

SEQ ID NO: 1487571 - RNA, 19 nt, Homo sapiens
gagcuuccuuguggucaua

SEQ ID NO: 1487572 - RNA, 19 nt, Homo sapiens
uaaaagaguuuguggaaga

SEQ ID NO: 1487573 - RNA, 19 nt, Homo sapiens
ccucuuaaauugugacaug

SEQ ID NO: 1487574 - RNA, 19 nt, Homo sapiens
agccauaucugcaguaaga

SEQ ID NO: 1487575 - RNA, 19 nt, Homo sapiens
ucucucagcuguuguuaga

SEQ ID NO: 1487576 - RNA, 19 nt, Homo sapiens
gaggaagggugcuccaagu

SEQ ID NO: 1487577 - RNA, 19 nt, Homo sapiens
agccaaagcugcucuugaa

SEQ ID NO: 1487578 - RNA, 19 nt, Homo sapiens
ccacagcugauguaaauga

SEQ ID NO: 1487579 - RNA, 19 nt, Homo sapiens
aaagaaugccacaaaguaa

SEQ ID NO: 1487580 - RNA, 19 nt, Homo sapiens
gacacaacgugcaaggaaa

SEQ ID NO: 1487581 - RNA, 19 nt, Homo sapiens
aaaagaaccuccucaguug

SEQ ID NO: 1487582 - RNA, 19 nt, Homo sapiens
aaaugucacuguaagauca

SEQ ID NO: 1487583 - RNA, 19 nt, Homo sapiens
uuagaaggacagaauguua

SEQ ID NO: 1487584 - RNA, 19 nt, Homo sapiens
aggcaugacugaaacuaaa

SEQ ID NO: 1487585 - RNA, 19 nt, Homo sapiens
gaaucacacauguaugaaa

SEQ ID NO: 1487586 - RNA, 19 nt, Homo sapiens
gcaguugagcuaucacuau

SEQ ID NO: 1487587 - RNA, 19 nt, Homo sapiens
ucacacauguaugaaagaa

SEQ ID NO: 1487588 - RNA, 19 nt, Homo sapiens
guggcuauuucuuauguaa

SEQ ID NO: 1487589 - RNA, 19 nt, Homo sapiens
cuaacagaccucuuaaauu

SEQ ID NO: 1487590 - RNA, 19 nt, Homo sapiens
gagaauguccaccuugugu

SEQ ID NO: 1487591 - RNA, 19 nt, Homo sapiens
ugucuucacccauguauuu

SEQ ID NO: 1487592 - RNA, 19 nt, Homo sapiens
ucacccaugaugucaauua

SEQ ID NO: 1487593 - RNA, 19 nt, Homo sapiens
ccuggugaaugucccuuua

SEQ ID NO: 1487594 - RNA, 19 nt, Homo sapiens
gaggcagaguaacguguuu

SEQ ID NO: 1487595 - RNA, 19 nt, Homo sapiens
uagaaggacagaauguuaa

SEQ ID NO: 1487596 - RNA, 19 nt, Homo sapiens
uaugaaagaaugccacaaa

SEQ ID NO: 1487597 - RNA, 19 nt, Homo sapiens
aggcugaacuagaagcuuu

SEQ ID NO: 1487598 - RNA, 19 nt, Homo sapiens
ccucacauguggcuauuuc

SEQ ID NO: 1487599 - RNA, 19 nt, Homo sapiens
ccugguacaucacccauga

SEQ ID NO: 1487600 - RNA, 19 nt, Homo sapiens
ugaaguggcaguugagcua

SEQ ID NO: 1487601 - RNA, 19 nt, Homo sapiens
ggaagggugcuccaaguca

SEQ ID NO: 1487602 - RNA, 19 nt, Homo sapiens
cacauguggcuauuucuua

SEQ ID NO: 1487603 - RNA, 19 nt, Homo sapiens
caguugagcuaucacuaug

SEQ ID NO: 1487604 - RNA, 19 nt, Homo sapiens
uuaaucucguuucuccuua

SEQ ID NO: 1487605 - RNA, 19 nt, Homo sapiens
ugaagaauaugugcugaca

SEQ ID NO: 1487606 - RNA, 19 nt, Homo sapiens
aaacuugcgugucuuuuaa

SEQ ID NO: 1487607 - RNA, 19 nt, Homo sapiens
acaaaugccaggcuagauu

SEQ ID NO: 1487608 - RNA, 19 nt, Homo sapiens
caacaaaugccaggcuaga

SEQ ID NO: 1487609 - RNA, 19 nt, Homo sapiens
acagaccucuuaaauugug

SEQ ID NO: 1487610 - RNA, 19 nt, Homo sapiens
acugauggcugcacuggaa

SEQ ID NO: 1487611 - RNA, 19 nt, Homo sapiens
gugcugugcugauuuccuu

SEQ ID NO: 1487612 - RNA, 19 nt, Homo sapiens
gacaacaggcugaacuaga

SEQ ID NO: 1487613 - RNA, 19 nt, Homo sapiens
gaagacaacaggcugaacu

SEQ ID NO: 1487614 - RNA, 19 nt, Homo sapiens
gaaggcaugacugaaacua

SEQ ID NO: 1487615 - RNA, 19 nt, Homo sapiens
cacccaugaugucaauuaa

SEQ ID NO: 1487616 - RNA, 19 nt, Homo sapiens
ugacacaacgugcaaggaa

SEQ ID NO: 1487617 - RNA, 19 nt, Homo sapiens
gaauguccaccuuguguuc

SEQ ID NO: 1487618 - RNA, 19 nt, Homo sapiens
agagaaauaucaguaaguc

SEQ ID NO: 1487619 - RNA, 19 nt, Homo sapiens
ucauugggcuuccuuguac

SEQ ID NO: 1487620 - RNA, 19 nt, Homo sapiens
aagaauaugugcugacaac

SEQ ID NO: 1487621 - RNA, 19 nt, Homo sapiens
acauguggcuauuucuuau

SEQ ID NO: 1487622 - RNA, 19 nt, Homo sapiens
ucuaacagaccucuuaaau

SEQ ID NO: 1487623 - RNA, 19 nt, Homo sapiens
aaucacacauguaugaaag

SEQ ID NO: 1487624 - RNA, 19 nt, Homo sapiens
caacgugcaaggaaaugaa

SEQ ID NO: 1487625 - RNA, 19 nt, Homo sapiens
uaagaucacaagccuguau

SEQ ID NO: 1487626 - RNA, 19 nt, Homo sapiens
gggcuuaugaggucuaugu

SEQ ID NO: 1487627 - RNA, 19 nt, Homo sapiens
uguauucucucagcuguug

SEQ ID NO: 1487628 - RNA, 19 nt, Homo sapiens
uaauguaacucagauuggu

SEQ ID NO: 1487629 - RNA, 19 nt, Homo sapiens
gaacuagaagcuuuugaaa

SEQ ID NO: 1487630 - RNA, 19 nt, Homo sapiens
uaacugcaaccagaaggua

SEQ ID NO: 1487631 - RNA, 19 nt, Homo sapiens
gugaaugucccuuuaacug

SEQ ID NO: 1487632 - RNA, 19 nt, Homo sapiens
caaaugccaggcuagauuc

SEQ ID NO: 1487633 - RNA, 19 nt, Homo sapiens
aaagugaaggcaugacuga

SEQ ID NO: 1487634 - RNA, 19 nt, Homo sapiens
gcugugcugauuuccuuua

SEQ ID NO: 1487635 - RNA, 19 nt, Homo sapiens
gaauaugugcugacaacag

SEQ ID NO: 1487636 - RNA, 19 nt, Homo sapiens
gaguugugguuguaguguu

SEQ ID NO: 1487637 - RNA, 19 nt, Homo sapiens
ggacccuacucuuguaaaa

SEQ ID NO: 1487638 - RNA, 19 nt, Homo sapiens
aaagugauucucuaacaga

SEQ ID NO: 1487639 - RNA, 19 nt, Homo sapiens
caacaaaguacgugaaaau

SEQ ID NO: 1487640 - RNA, 19 nt, Homo sapiens
ucagugcccuaaagagcuu

SEQ ID NO: 1487641 - RNA, 19 nt, Homo sapiens
guguucagaugcuuagaau

SEQ ID NO: 1487642 - RNA, 19 nt, Homo sapiens
ugagccauaucugcaguaa

SEQ ID NO: 1487643 - RNA, 19 nt, Homo sapiens
uaaggugaguccacuacca

SEQ ID NO: 1487644 - RNA, 19 nt, Homo sapiens
acuagaaagggcaguauaa

SEQ ID NO: 1487645 - RNA, 19 nt, Homo sapiens
guguuugccugguacauca

SEQ ID NO: 1487646 - RNA, 19 nt, Homo sapiens
gagcuaucacuauggcaaa

SEQ ID NO: 1487647 - RNA, 19 nt, Homo sapiens
gucagaaucacacauguau

SEQ ID NO: 1487648 - RNA, 19 nt, Homo sapiens
acuuagauguccuuguaaa

SEQ ID NO: 1487649 - RNA, 19 nt, Homo sapiens
uaaccacagcugauguaaa

SEQ ID NO: 1487650 - RNA, 19 nt, Homo sapiens
gggcuuccuuguacuuagu

SEQ ID NO: 1487651 - RNA, 19 nt, Homo sapiens
ugaaagaaugccacaaagu

SEQ ID NO: 1487652 - RNA, 19 nt, Homo sapiens
caaaugaugugaugguuaa

SEQ ID NO: 1487653 - RNA, 19 nt, Homo sapiens
ccucaaagcucuaaugaau

SEQ ID NO: 1487654 - RNA, 19 nt, Homo sapiens
gacugggacucuucaauua

SEQ ID NO: 1487655 - RNA, 19 nt, Homo sapiens
gcaaagaacaggaagaaga

SEQ ID NO: 1487656 - RNA, 19 nt, Homo sapiens
cugcggaucuggccaauua

SEQ ID NO: 1487657 - RNA, 19 nt, Homo sapiens
ucaaagcucuaaugaauca

SEQ ID NO: 1487658 - RNA, 19 nt, Homo sapiens
ggagacaacuuaguagaga

SEQ ID NO: 1487659 - RNA, 19 nt, Homo sapiens
gaugugcaccuccuuaaua

SEQ ID NO: 1487660 - RNA, 19 nt, Homo sapiens
gaagaucauuucagcacuu

SEQ ID NO: 1487661 - RNA, 19 nt, Homo sapiens
gcacaaagaggcagugaug

SEQ ID NO: 1487662 - RNA, 19 nt, Homo sapiens
ucacugcacuccauacuga

SEQ ID NO: 1487663 - RNA, 19 nt, Homo sapiens
ugaagggucuugauaccua

SEQ ID NO: 1487664 - RNA, 19 nt, Homo sapiens
ggacugggacucuucaauu

SEQ ID NO: 1487665 - RNA, 19 nt, Homo sapiens
gcagucacuuccaguauug

SEQ ID NO: 1487666 - RNA, 19 nt, Homo sapiens
ggauugcugugauucuuaa

SEQ ID NO: 1487667 - RNA, 19 nt, Homo sapiens
gauaagaccuacucaagcu

SEQ ID NO: 1487668 - RNA, 19 nt, Homo sapiens
gguguuccaugucccguua

SEQ ID NO: 1487669 - RNA, 19 nt, Homo sapiens
cagauuccguugauauuga

SEQ ID NO: 1487670 - RNA, 19 nt, Homo sapiens
gcugauccuucucauauau

SEQ ID NO: 1487671 - RNA, 19 nt, Homo sapiens
gaucagaugccuaguguca

SEQ ID NO: 1487672 - RNA, 19 nt, Homo sapiens
gaagcaaguuguggaggaa

SEQ ID NO: 1487673 - RNA, 19 nt, Homo sapiens
uggaugaacucuuuacuuc

SEQ ID NO: 1487674 - RNA, 19 nt, Homo sapiens
caauguccguuguguuaaa

SEQ ID NO: 1487675 - RNA, 19 nt, Homo sapiens
cacagucucugaagugaaa

SEQ ID NO: 1487676 - RNA, 19 nt, Homo sapiens
gagaaaaccugccaaucaa

SEQ ID NO: 1487677 - RNA, 19 nt, Homo sapiens
cagcucauguccuauauuc

SEQ ID NO: 1487678 - RNA, 19 nt, Homo sapiens
aagcuuuacugaacacuaa

SEQ ID NO: 1487679 - RNA, 19 nt, Homo sapiens
gaagauaagaccuacucaa

SEQ ID NO: 1487680 - RNA, 19 nt, Homo sapiens
gcuaagaagauaagaccua

SEQ ID NO: 1487681 - RNA, 19 nt, Homo sapiens
cagaucagaugccuagugu

SEQ ID NO: 1487682 - RNA, 19 nt, Homo sapiens
gaauggaugggcaacauga

SEQ ID NO: 1487683 - RNA, 19 nt, Homo sapiens
gaccuuggcuucugagcau

SEQ ID NO: 1487684 - RNA, 19 nt, Homo sapiens
gggacaacuuucuggcuuu

SEQ ID NO: 1487685 - RNA, 19 nt, Homo sapiens
gugugaacauuuaggagua

SEQ ID NO: 1487686 - RNA, 19 nt, Homo sapiens
gaacugcugauccuucuca

SEQ ID NO: 1487687 - RNA, 19 nt, Homo sapiens
cuugauaccuacucaguga

SEQ ID NO: 1487688 - RNA, 19 nt, Homo sapiens
gaacaaccucaaagcucua

SEQ ID NO: 1487689 - RNA, 19 nt, Homo sapiens
gaaguucggagacaucuag

SEQ ID NO: 1487690 - RNA, 19 nt, Homo sapiens
gagacaacuuaguagagaa

SEQ ID NO: 1487691 - RNA, 19 nt, Homo sapiens
gagaagcugugugaaugga

SEQ ID NO: 1487692 - RNA, 19 nt, Homo sapiens
cuggagagcucacaguaga

SEQ ID NO: 1487693 - RNA, 19 nt, Homo sapiens
gaggagaagcugugugaau

SEQ ID NO: 1487694 - RNA, 19 nt, Homo sapiens
gagguacuuugcuuggauu

SEQ ID NO: 1487695 - RNA, 19 nt, Homo sapiens
ggacuacagcccugaggaa

SEQ ID NO: 1487696 - RNA, 19 nt, Homo sapiens
ugugaugguuaacaugaua

SEQ ID NO: 1487697 - RNA, 19 nt, Homo sapiens
ucagugagguacuuugcuu

SEQ ID NO: 1487698 - RNA, 19 nt, Homo sapiens
gagcauccgcuaagaagau

SEQ ID NO: 1487699 - RNA, 19 nt, Homo sapiens
ucgagcagcuggaggagaa

SEQ ID NO: 1487700 - RNA, 19 nt, Homo sapiens
uggcucaggucuucuguga

SEQ ID NO: 1487701 - RNA, 19 nt, Homo sapiens
ggaggaaaauuauaaugug

SEQ ID NO: 1487702 - RNA, 19 nt, Homo sapiens
gcaaguuguggaggaaaua

SEQ ID NO: 1487703 - RNA, 19 nt, Homo sapiens
uuacuucacuucgggauau

SEQ ID NO: 1487704 - RNA, 19 nt, Homo sapiens
gcaccaggcugucuuucac

SEQ ID NO: 1487705 - RNA, 19 nt, Homo sapiens
ucauggagacaacuuagua

SEQ ID NO: 1487706 - RNA, 19 nt, Homo sapiens
ggucaucgcugcggaucug

SEQ ID NO: 1487707 - RNA, 19 nt, Homo sapiens
ucacuaauugcgagaauga

SEQ ID NO: 1487708 - RNA, 19 nt, Homo sapiens
cagcgucccugucacuaau

SEQ ID NO: 1487709 - RNA, 19 nt, Homo sapiens
cggaagcggugaguucuga

SEQ ID NO: 1487710 - RNA, 19 nt, Homo sapiens
ugccguggaugaacucuuu

SEQ ID NO: 1487711 - RNA, 19 nt, Homo sapiens
caaagaggcagugauggaa

SEQ ID NO: 1487712 - RNA, 19 nt, Homo sapiens
ccucacugaucuccuuaaa

SEQ ID NO: 1487713 - RNA, 19 nt, Homo sapiens
agcaauguccguuguguua

SEQ ID NO: 1487714 - RNA, 19 nt, Homo sapiens
ucggagacaucuaguggaa

SEQ ID NO: 1487715 - RNA, 19 nt, Homo sapiens
acaaaugaugugaugguua

SEQ ID NO: 1487716 - RNA, 19 nt, Homo sapiens
ccucacagcuaaucauguc

SEQ ID NO: 1487717 - RNA, 19 nt, Homo sapiens
gacaaagaccugugugaag

SEQ ID NO: 1487718 - RNA, 19 nt, Homo sapiens
ggacuggccacagcucaaa

SEQ ID NO: 1487719 - RNA, 19 nt, Homo sapiens
aggagaagcugugugaaug

SEQ ID NO: 1487720 - RNA, 19 nt, Homo sapiens
gaagcuuuacugaacacua

SEQ ID NO: 1487721 - RNA, 19 nt, Homo sapiens
ggacagaacccuggaucuc

SEQ ID NO: 1487722 - RNA, 19 nt, Homo sapiens
gaagcggugaguucugaaa

SEQ ID NO: 1487723 - RNA, 19 nt, Homo sapiens
gcagaucagaugccuagug

SEQ ID NO: 1487724 - RNA, 19 nt, Homo sapiens
ggucacagucucugaagug

SEQ ID NO: 1487725 - RNA, 19 nt, Homo sapiens
gcaauguccguuguguuaa

SEQ ID NO: 1487726 - RNA, 19 nt, Homo sapiens
gaggccagauuccguugau

SEQ ID NO: 1487727 - RNA, 19 nt, Homo sapiens
ggaagcggcaagcagagaa

SEQ ID NO: 1487728 - RNA, 19 nt, Homo sapiens
gcuguagguuccuuaaguc

SEQ ID NO: 1487729 - RNA, 19 nt, Homo sapiens
cgcagucacuuccaguauu

SEQ ID NO: 1487730 - RNA, 19 nt, Homo sapiens
uggaaaugccgaugcaauu

SEQ ID NO: 1487731 - RNA, 19 nt, Homo sapiens
gaagccaggaacccaggua

SEQ ID NO: 1487732 - RNA, 19 nt, Homo sapiens
cuuauaagccauuguugaa

SEQ ID NO: 1487733 - RNA, 19 nt, Homo sapiens
cuacagcccugaggaacug

SEQ ID NO: 1487734 - RNA, 19 nt, Homo sapiens
gaagcggcaagcagagaaa

SEQ ID NO: 1487735 - RNA, 19 nt, Homo sapiens
ggaggaguguuuugcugua

SEQ ID NO: 1487736 - RNA, 19 nt, Homo sapiens
gcaccguaguuucccaagu

SEQ ID NO: 1487737 - RNA, 19 nt, Homo sapiens
caccguaguuucccaaguc

SEQ ID NO: 1487738 - RNA, 19 nt, Homo sapiens
aaacuggauuuagcauguu

SEQ ID NO: 1487739 - RNA, 19 nt, Homo sapiens
ggccagauuccguugauau

SEQ ID NO: 1487740 - RNA, 19 nt, Homo sapiens
caucuuauaagccauuguu

SEQ ID NO: 1487741 - RNA, 19 nt, Homo sapiens
ugagguacuuugcuuggau

SEQ ID NO: 1487742 - RNA, 19 nt, Homo sapiens
ccugagcuguuauuugcaa

SEQ ID NO: 1487743 - RNA, 19 nt, Homo sapiens
gaucuuguggcaucguuga

SEQ ID NO: 1487744 - RNA, 19 nt, Homo sapiens
ucacugaucuccuuaaaac

SEQ ID NO: 1487745 - RNA, 19 nt, Homo sapiens
cugcugauccuucucauau

SEQ ID NO: 1487746 - RNA, 19 nt, Homo sapiens
ggacaacuuucuggcuuuu

SEQ ID NO: 1487747 - RNA, 19 nt, Homo sapiens
caaccucaaagcucuaaug

SEQ ID NO: 1487748 - RNA, 19 nt, Homo sapiens
acaaagaggcagugaugga

SEQ ID NO: 1487749 - RNA, 19 nt, Homo sapiens
gacagaacccuggaucuca

SEQ ID NO: 1487750 - RNA, 19 nt, Homo sapiens
cggccgagguguuccaugu

SEQ ID NO: 1487751 - RNA, 19 nt, Homo sapiens
ggaugggcaacaugaacua

SEQ ID NO: 1487752 - RNA, 19 nt, Homo sapiens
caauuaaucucucacacua

SEQ ID NO: 1487753 - RNA, 19 nt, Homo sapiens
gagauucgcuacuguguga

SEQ ID NO: 1487754 - RNA, 19 nt, Homo sapiens
gaauugcgguguacuaaca

SEQ ID NO: 1487755 - RNA, 19 nt, Homo sapiens
gagcgaaugugcguuguuu

SEQ ID NO: 1487756 - RNA, 19 nt, Homo sapiens
gaugggaccugccuacaau

SEQ ID NO: 1487757 - RNA, 19 nt, Homo sapiens
ggaccugccuacaauuaau

SEQ ID NO: 1487758 - RNA, 19 nt, Homo sapiens
gaaggagauucgcuacugu

SEQ ID NO: 1487759 - RNA, 19 nt, Homo sapiens
ggacguucccuguugcaua

SEQ ID NO: 1487760 - RNA, 19 nt, Homo sapiens
ggugugaagucguuuaauc

SEQ ID NO: 1487761 - RNA, 19 nt, Homo sapiens
ccaaaccaaaccauucuua

SEQ ID NO: 1487762 - RNA, 19 nt, Homo sapiens
gcgugaagcggaaacuuua

SEQ ID NO: 1487763 - RNA, 19 nt, Homo sapiens
gcaccaaaccaaaccauuc

SEQ ID NO: 1487764 - RNA, 19 nt, Homo sapiens
gcuaaugcguaaggacuuu

SEQ ID NO: 1487765 - RNA, 19 nt, Homo sapiens
gaacguuugaauacuguaa

SEQ ID NO: 1487766 - RNA, 19 nt, Homo sapiens
caaccucuuucgucuucua

SEQ ID NO: 1487767 - RNA, 19 nt, Homo sapiens
guacuaacaacaucauuca

SEQ ID NO: 1487768 - RNA, 19 nt, Homo sapiens
gaagucgcgugaaggagau

SEQ ID NO: 1487769 - RNA, 19 nt, Homo sapiens
gacguucccuguugcauag

SEQ ID NO: 1487770 - RNA, 19 nt, Homo sapiens
aagucaagcuucucuaguu

SEQ ID NO: 1487771 - RNA, 19 nt, Homo sapiens
ugaaggagauucgcuacug

SEQ ID NO: 1487772 - RNA, 19 nt, Homo sapiens
caacaucauucagcaccaa

SEQ ID NO: 1487773 - RNA, 19 nt, Homo sapiens
gucuuaagguugaacguuu

SEQ ID NO: 1487774 - RNA, 19 nt, Homo sapiens
aaaccuugcuuccuagcuu

SEQ ID NO: 1487775 - RNA, 19 nt, Homo sapiens
gaggugaucacacaaguca

SEQ ID NO: 1487776 - RNA, 19 nt, Homo sapiens
ccaaacaacuugaaaacau

SEQ ID NO: 1487777 - RNA, 19 nt, Homo sapiens
gucaucuucuucuggguua

SEQ ID NO: 1487778 - RNA, 19 nt, Homo sapiens
guugaacguuugaauacug

SEQ ID NO: 1487779 - RNA, 19 nt, Homo sapiens
ucacacaagucaagcuucu

SEQ ID NO: 1487780 - RNA, 19 nt, Homo sapiens
ggucguguuugcccuuaga

SEQ ID NO: 1487781 - RNA, 19 nt, Homo sapiens
caaaccaaaccauucuuau

SEQ ID NO: 1487782 - RNA, 19 nt, Homo sapiens
cggcgaauuugcccgcuuu

SEQ ID NO: 1487783 - RNA, 19 nt, Homo sapiens
gaggaagucgcgugaagga

SEQ ID NO: 1487784 - RNA, 19 nt, Homo sapiens
gcuuugcgcuuggugaaga

SEQ ID NO: 1487785 - RNA, 19 nt, Homo sapiens
guuuaauccugcccgcuaa

SEQ ID NO: 1487786 - RNA, 19 nt, Homo sapiens
auuuaaaccuugcuuccua

SEQ ID NO: 1487787 - RNA, 19 nt, Homo sapiens
gaucacacaagucaagcuu

SEQ ID NO: 1487788 - RNA, 19 nt, Homo sapiens
ggcgugaagcggaaacuuu

SEQ ID NO: 1487789 - RNA, 19 nt, Homo sapiens
gcaaccuucucaaccucuu

SEQ ID NO: 1487790 - RNA, 19 nt, Homo sapiens
aaccuugcuuccuagcuua

SEQ ID NO: 1487791 - RNA, 19 nt, Homo sapiens
gggaccugccuacaauuaa

SEQ ID NO: 1487792 - RNA, 19 nt, Homo sapiens
ggaaaggggucguguuugc

SEQ ID NO: 1487793 - RNA, 19 nt, Homo sapiens
ggccaaacgccgagagguu

SEQ ID NO: 1487794 - RNA, 19 nt, Homo sapiens
gugaagcggaaacuuuaaa

SEQ ID NO: 1487795 - RNA, 19 nt, Homo sapiens
gaggaaaggggucguguuu

SEQ ID NO: 1487796 - RNA, 19 nt, Homo sapiens
ucgaugaccucggcugaga

SEQ ID NO: 1487797 - RNA, 19 nt, Homo sapiens
gccgagagguuuuagaguu

SEQ ID NO: 1487798 - RNA, 19 nt, Homo sapiens
gcauagccaacacuugaau

SEQ ID NO: 1487799 - RNA, 19 nt, Homo sapiens
ucacacuacugagcgaaug

SEQ ID NO: 1487800 - RNA, 19 nt, Homo sapiens
ugggaccugccuacaauua

SEQ ID NO: 1487801 - RNA, 19 nt, Homo sapiens
aagguugaacguuugaaua

SEQ ID NO: 1487802 - RNA, 19 nt, Homo sapiens
ccuguugcauaggcauuua

SEQ ID NO: 1487803 - RNA, 19 nt, Homo sapiens
ccaaaugcauagccaacac

SEQ ID NO: 1487804 - RNA, 19 nt, Homo sapiens
cugagcagcuucuuuuaaa

SEQ ID NO: 1487805 - RNA, 19 nt, Homo sapiens
gaaugugcguuguuuugga

SEQ ID NO: 1487806 - RNA, 19 nt, Homo sapiens
gcgguguacuaacaacauc

SEQ ID NO: 1487807 - RNA, 19 nt, Homo sapiens
augcauagccaacacuuga

SEQ ID NO: 1487808 - RNA, 19 nt, Homo sapiens
ucuuaagguugaacguuug

SEQ ID NO: 1487809 - RNA, 19 nt, Homo sapiens
agucaagcuucucuaguuc

SEQ ID NO: 1487810 - RNA, 19 nt, Homo sapiens
gggcaucugcggccaaucu

SEQ ID NO: 1487811 - RNA, 19 nt, Homo sapiens
uaaucucucacacuacuga

SEQ ID NO: 1487812 - RNA, 19 nt, Homo sapiens
cucaaccucuuucgucuuc

SEQ ID NO: 1487813 - RNA, 19 nt, Homo sapiens
ggugaucacacaagucaag

SEQ ID NO: 1487814 - RNA, 19 nt, Homo sapiens
ggucuuaagguugaacguu

SEQ ID NO: 1487815 - RNA, 19 nt, Homo sapiens
gagaggcucaggguuggaa

SEQ ID NO: 1487816 - RNA, 19 nt, Homo sapiens
gguggggucuuaagguuga

SEQ ID NO: 1487817 - RNA, 19 nt, Homo sapiens
ccgagagguuuuagaguuu

SEQ ID NO: 1487818 - RNA, 19 nt, Homo sapiens
gcuuauuuauuucccaaac

SEQ ID NO: 1487819 - RNA, 19 nt, Homo sapiens
cuugcuuccuagcuuauuu

SEQ ID NO: 1487820 - RNA, 19 nt, Homo sapiens
uaagguugaacguuugaau

SEQ ID NO: 1487821 - RNA, 19 nt, Homo sapiens
caagucaagcuucucuagu

SEQ ID NO: 1487822 - RNA, 19 nt, Homo sapiens
ccugcccgcuaaugcguaa

SEQ ID NO: 1487823 - RNA, 19 nt, Homo sapiens
gagcagcuucuuuuaaaau

SEQ ID NO: 1487824 - RNA, 19 nt, Homo sapiens
uuacugagcagcuucuuuu

SEQ ID NO: 1487825 - RNA, 19 nt, Homo sapiens
aaacuuuaaaccaccagaa

SEQ ID NO: 1487826 - RNA, 19 nt, Homo sapiens
ucauucagcaccaaaccaa

SEQ ID NO: 1487827 - RNA, 19 nt, Homo sapiens
caaccuucucaaccucuuu

SEQ ID NO: 1487828 - RNA, 19 nt, Homo sapiens
gcgaauuugcccgcuuuga

SEQ ID NO: 1487829 - RNA, 19 nt, Homo sapiens
gaaggcacccacggcgaau

SEQ ID NO: 1487830 - RNA, 19 nt, Homo sapiens
ggacggggaagauugcaaa

SEQ ID NO: 1487831 - RNA, 19 nt, Homo sapiens
cggaagggguccuagaaga

SEQ ID NO: 1487832 - RNA, 19 nt, Homo sapiens
gggaugagguuuaaucuua

SEQ ID NO: 1487833 - RNA, 19 nt, Homo sapiens
ccacuuaggugcuauaauu

SEQ ID NO: 1487834 - RNA, 19 nt, Homo sapiens
cgaagauagucgaauauua

SEQ ID NO: 1487835 - RNA, 19 nt, Homo sapiens
gaugaaagaugguauuaca

SEQ ID NO: 1487836 - RNA, 19 nt, Homo sapiens
guagagagcuauuaguuca

SEQ ID NO: 1487837 - RNA, 19 nt, Homo sapiens
uaagugagauagcagagua

SEQ ID NO: 1487838 - RNA, 19 nt, Homo sapiens
gaagauagucgaauauuag

SEQ ID NO: 1487839 - RNA, 19 nt, Homo sapiens
guaagacccaguaauguua

SEQ ID NO: 1487840 - RNA, 19 nt, Homo sapiens
gguuuaaucuuaugacuug

SEQ ID NO: 1487841 - RNA, 19 nt, Homo sapiens
cuuauaaccuguacaguaa

SEQ ID NO: 1487842 - RNA, 19 nt, Homo sapiens
caauaggauucaugcuuua

SEQ ID NO: 1487843 - RNA, 19 nt, Homo sapiens
ccagugaccuugcuauuuc

SEQ ID NO: 1487844 - RNA, 19 nt, Homo sapiens
acaauaggauucaugcuuu

SEQ ID NO: 1487845 - RNA, 19 nt, Homo sapiens
gacaaggacuagaggguuu

SEQ ID NO: 1487846 - RNA, 19 nt, Homo sapiens
uaccgaagauagucgaaua

SEQ ID NO: 1487847 - RNA, 19 nt, Homo sapiens
ggacaucugacaucugaaa

SEQ ID NO: 1487848 - RNA, 19 nt, Homo sapiens
gggcucaccuguccuauag

SEQ ID NO: 1487849 - RNA, 19 nt, Homo sapiens
ugaauaagaugcaguucug

SEQ ID NO: 1487850 - RNA, 19 nt, Homo sapiens
gaggagcucuucaauucug

SEQ ID NO: 1487851 - RNA, 19 nt, Homo sapiens
ggaugagguuuaaucuuau

SEQ ID NO: 1487852 - RNA, 19 nt, Homo sapiens
gaugaugauucuagacuuc

SEQ ID NO: 1487853 - RNA, 19 nt, Homo sapiens
ugccaggucugaaaucuuu

SEQ ID NO: 1487854 - RNA, 19 nt, Homo sapiens
ccaguaauguuaggauuug

SEQ ID NO: 1487855 - RNA, 19 nt, Homo sapiens
acagaggcaugauuuauuc

SEQ ID NO: 1487856 - RNA, 19 nt, Homo sapiens
aaaguaagacccaguaaug

SEQ ID NO: 1487857 - RNA, 19 nt, Homo sapiens
caacaaaacaggcuuauau

SEQ ID NO: 1487858 - RNA, 19 nt, Homo sapiens
ggauuaauacguucauaug

SEQ ID NO: 1487859 - RNA, 19 nt, Homo sapiens
uaacaagggaugaugauuc

SEQ ID NO: 1487860 - RNA, 19 nt, Homo sapiens
gauaugauacgcacacuag

SEQ ID NO: 1487861 - RNA, 19 nt, Homo sapiens
cuaaaccaaucguuauguu

SEQ ID NO: 1487862 - RNA, 19 nt, Homo sapiens
uuaaacagaggcaugauuu

SEQ ID NO: 1487863 - RNA, 19 nt, Homo sapiens
gagauguaaugggaauaaa

SEQ ID NO: 1487864 - RNA, 19 nt, Homo sapiens
gaugagguuuaaucuuaug

SEQ ID NO: 1487865 - RNA, 19 nt, Homo sapiens
guaauuacacuacauagag

SEQ ID NO: 1487866 - RNA, 19 nt, Homo sapiens
gucauaaucuuguaucucu

SEQ ID NO: 1487867 - RNA, 19 nt, Homo sapiens
acaccaaauuccuguuaaa

SEQ ID NO: 1487868 - RNA, 19 nt, Homo sapiens
ggaugaugauucuagacuu

SEQ ID NO: 1487869 - RNA, 19 nt, Homo sapiens
ccacuuacaagcagaagaa

SEQ ID NO: 1487870 - RNA, 19 nt, Homo sapiens
gauagaauacagugcgauu

SEQ ID NO: 1487871 - RNA, 19 nt, Homo sapiens
guucacagcugagccacuu

SEQ ID NO: 1487872 - RNA, 19 nt, Homo sapiens
aaacagaggcaugauuuau

SEQ ID NO: 1487873 - RNA, 19 nt, Homo sapiens
gaaaugccuacucuucaga

SEQ ID NO: 1487874 - RNA, 19 nt, Homo sapiens
ugaauugucugccacuuac

SEQ ID NO: 1487875 - RNA, 19 nt, Homo sapiens
cuacuuaggcuguguuuca

SEQ ID NO: 1487876 - RNA, 19 nt, Homo sapiens
gaaacuacuuaggcugugu

SEQ ID NO: 1487877 - RNA, 19 nt, Homo sapiens
ccaaaguaauuacacuaca

SEQ ID NO: 1487878 - RNA, 19 nt, Homo sapiens
gaaacagcaagucauaauc

SEQ ID NO: 1487879 - RNA, 19 nt, Homo sapiens
gacucuagauucugaaaca

SEQ ID NO: 1487880 - RNA, 19 nt, Homo sapiens
cuacaccaaauuccuguua

SEQ ID NO: 1487881 - RNA, 19 nt, Homo sapiens
cuucccacauuaugaauuu

SEQ ID NO: 1487882 - RNA, 19 nt, Homo sapiens
ucagagauguaaugggaau

SEQ ID NO: 1487883 - RNA, 19 nt, Homo sapiens
gaguggcaaucguucuauu

SEQ ID NO: 1487884 - RNA, 19 nt, Homo sapiens
gaaagaggacaaaaucaaa

SEQ ID NO: 1487885 - RNA, 19 nt, Homo sapiens
uaacugauauaaggguaug

SEQ ID NO: 1487886 - RNA, 19 nt, Homo sapiens
agagagcuauuaguucauu

SEQ ID NO: 1487887 - RNA, 19 nt, Homo sapiens
gauuaaggcuguuauuacc

SEQ ID NO: 1487888 - RNA, 19 nt, Homo sapiens
ucuuauaaccuguacagua

SEQ ID NO: 1487889 - RNA, 19 nt, Homo sapiens
ggcaaucguucuauuaaaa

SEQ ID NO: 1487890 - RNA, 19 nt, Homo sapiens
ugaaacagcaagucauaau

SEQ ID NO: 1487891 - RNA, 19 nt, Homo sapiens
caugaaugcuaccgaagau

SEQ ID NO: 1487892 - RNA, 19 nt, Homo sapiens
uggcaaucguucuauuaaa

SEQ ID NO: 1487893 - RNA, 19 nt, Homo sapiens
uaggauucaugcuuuaguu

SEQ ID NO: 1487894 - RNA, 19 nt, Homo sapiens
uagaauacagugcgauuug

SEQ ID NO: 1487895 - RNA, 19 nt, Homo sapiens
ugaaagaugguauuacaca

SEQ ID NO: 1487896 - RNA, 19 nt, Homo sapiens
acagugcgauuuggaaaga

SEQ ID NO: 1487897 - RNA, 19 nt, Homo sapiens
gagauagcagaguaaacua

SEQ ID NO: 1487898 - RNA, 19 nt, Homo sapiens
ggaagagaaagaggacaaa

SEQ ID NO: 1487899 - RNA, 19 nt, Homo sapiens
guuauuaccaggaggaaga

SEQ ID NO: 1487900 - RNA, 19 nt, Homo sapiens
gaauacagugcgauuugga

SEQ ID NO: 1487901 - RNA, 19 nt, Homo sapiens
ggggacaucugacaucuga

SEQ ID NO: 1487902 - RNA, 19 nt, Homo sapiens
gcacauacucuaucuuucc

SEQ ID NO: 1487903 - RNA, 19 nt, Homo sapiens
gcuauuucuucauaacugu

SEQ ID NO: 1487904 - RNA, 19 nt, Homo sapiens
cacuggguaugauuucuaa

SEQ ID NO: 1487905 - RNA, 19 nt, Homo sapiens
caagggaugaugauucuag

SEQ ID NO: 1487906 - RNA, 19 nt, Homo sapiens
gcucaccuguccuauagag

SEQ ID NO: 1487907 - RNA, 19 nt, Homo sapiens
ucagaaggaccaccaggaa

SEQ ID NO: 1487908 - RNA, 19 nt, Homo sapiens
guggcaaucguucuauuaa

SEQ ID NO: 1487909 - RNA, 19 nt, Homo sapiens
ucugaaacagcaagucaua

SEQ ID NO: 1487910 - RNA, 19 nt, Homo sapiens
caacauuauggucgacaaa

SEQ ID NO: 1487911 - RNA, 19 nt, Homo sapiens
gauacgcacacuagaugaa

SEQ ID NO: 1487912 - RNA, 19 nt, Homo sapiens
uauuagaaaugccuacucu

SEQ ID NO: 1487913 - RNA, 19 nt, Homo sapiens
ucuaauaagugagauagca

SEQ ID NO: 1487914 - RNA, 19 nt, Homo sapiens
ggaaaagucaggaagagaa

SEQ ID NO: 1487915 - RNA, 19 nt, Homo sapiens
ugaccuugcuauuucuuca

SEQ ID NO: 1487916 - RNA, 19 nt, Homo sapiens
uacaccaaauuccuguuaa

SEQ ID NO: 1487917 - RNA, 19 nt, Homo sapiens
cacagucaauaauucaaug

SEQ ID NO: 1487918 - RNA, 19 nt, Homo sapiens
gaagguguggcgcgacguu

SEQ ID NO: 1487919 - RNA, 19 nt, Homo sapiens
uuagaaaugccuacucuuc

SEQ ID NO: 1487920 - RNA, 19 nt, Homo sapiens
aaaagacgccaucacaaua

SEQ ID NO: 1487921 - RNA, 19 nt, Homo sapiens
cuggauagauauaauagag

SEQ ID NO: 1487922 - RNA, 19 nt, Homo sapiens
aaacagcaagucauaaucu

SEQ ID NO: 1487923 - RNA, 19 nt, Homo sapiens
ccauggcagugucucuuug

SEQ ID NO: 1487924 - RNA, 19 nt, Homo sapiens
guuaaacagaggcaugauu

SEQ ID NO: 1487925 - RNA, 19 nt, Homo sapiens
uagaaaugccuacucuuca

SEQ ID NO: 1487926 - RNA, 19 nt, Homo sapiens
gggcuucgggucucccuaa

SEQ ID NO: 1487927 - RNA, 19 nt, Homo sapiens
cacaauaggauucaugcuu

SEQ ID NO: 1487928 - RNA, 19 nt, Homo sapiens
cagaaggaccaccaggaaa

SEQ ID NO: 1487929 - RNA, 19 nt, Homo sapiens
ucugaaacagcaaguguaa

SEQ ID NO: 1487930 - RNA, 19 nt, Homo sapiens
aggcacauacucuaucuuu

SEQ ID NO: 1487931 - RNA, 19 nt, Homo sapiens
agacuucugccacaacauu

SEQ ID NO: 1487932 - RNA, 19 nt, Homo sapiens
ggauaaaucuggcugcauu

SEQ ID NO: 1487933 - RNA, 19 nt, Homo sapiens
cagcuaacccacagaauua

SEQ ID NO: 1487934 - RNA, 19 nt, Homo sapiens
gaauuaggcucuacgucuu

SEQ ID NO: 1487935 - RNA, 19 nt, Homo sapiens
gaaugugugccaugaauuu

SEQ ID NO: 1487936 - RNA, 19 nt, Homo sapiens
gcagcaauauauagcauuc

SEQ ID NO: 1487937 - RNA, 19 nt, Homo sapiens
gaaaauugaucgacaaaag

SEQ ID NO: 1487938 - RNA, 19 nt, Homo sapiens
gaaacggaauuaggcucua

SEQ ID NO: 1487939 - RNA, 19 nt, Homo sapiens
gagauacugugacgguuuc

SEQ ID NO: 1487940 - RNA, 19 nt, Homo sapiens
ggucacugcuuuguacuga

SEQ ID NO: 1487941 - RNA, 19 nt, Homo sapiens
ggagauacugugacgguuu

SEQ ID NO: 1487942 - RNA, 19 nt, Homo sapiens
gaaaaggccucaucgacau

SEQ ID NO: 1487943 - RNA, 19 nt, Homo sapiens
gaauuuagaccuauuucuc

SEQ ID NO: 1487944 - RNA, 19 nt, Homo sapiens
guaugaaugugugccauga

SEQ ID NO: 1487945 - RNA, 19 nt, Homo sapiens
ccagcuaacccacagaauu

SEQ ID NO: 1487946 - RNA, 19 nt, Homo sapiens
gaccuucggugcacacaca

SEQ ID NO: 1487947 - RNA, 19 nt, Homo sapiens
gaccgucuuugaccuucua

SEQ ID NO: 1487948 - RNA, 19 nt, Homo sapiens
gcacaugaguaggagauac

SEQ ID NO: 1487949 - RNA, 19 nt, Homo sapiens
guacugaggaaacaaagug

SEQ ID NO: 1487950 - RNA, 19 nt, Homo sapiens
gcucagccgccuuugauga

SEQ ID NO: 1487951 - RNA, 19 nt, Homo sapiens
gaagcucagccgccuuuga

SEQ ID NO: 1487952 - RNA, 19 nt, Homo sapiens
ccauuguacugccuucuau

SEQ ID NO: 1487953 - RNA, 19 nt, Homo sapiens
gacgccacaugaagaagaa

SEQ ID NO: 1487954 - RNA, 19 nt, Homo sapiens
cacauguggucacugcuuu

SEQ ID NO: 1487955 - RNA, 19 nt, Homo sapiens
gaugagacgccacaugaag

SEQ ID NO: 1487956 - RNA, 19 nt, Homo sapiens
ugccaugaauuuagaccua

SEQ ID NO: 1487957 - RNA, 19 nt, Homo sapiens
cuaggcagcauccauugua

SEQ ID NO: 1487958 - RNA, 19 nt, Homo sapiens
cagaagcucagccgccuuu

SEQ ID NO: 1487959 - RNA, 19 nt, Homo sapiens
guaccaccuuccagagaug

SEQ ID NO: 1487960 - RNA, 19 nt, Homo sapiens
gcacaccugaaucugcuuu

SEQ ID NO: 1487961 - RNA, 19 nt, Homo sapiens
ccacagaauuaugagagau

SEQ ID NO: 1487962 - RNA, 19 nt, Homo sapiens
ccaugaauuuagaccuauu

SEQ ID NO: 1487963 - RNA, 19 nt, Homo sapiens
agucuguuaugcagcaaua

SEQ ID NO: 1487964 - RNA, 19 nt, Homo sapiens
ccacuaagucuguuaugca

SEQ ID NO: 1487965 - RNA, 19 nt, Homo sapiens
cacagaauuaugagagaua

SEQ ID NO: 1487966 - RNA, 19 nt, Homo sapiens
cagcugcuuucccugaaug

SEQ ID NO: 1487967 - RNA, 19 nt, Homo sapiens
agaaagaagacgccacaga

SEQ ID NO: 1487968 - RNA, 19 nt, Homo sapiens
ggaugagacgccacaugaa

SEQ ID NO: 1487969 - RNA, 19 nt, Homo sapiens
cugugacgguuucaucuuu

SEQ ID NO: 1487970 - RNA, 19 nt, Homo sapiens
gccaugaauuuagaccuau

SEQ ID NO: 1487971 - RNA, 19 nt, Homo sapiens
caccugcauuggaggauga

SEQ ID NO: 1487972 - RNA, 19 nt, Homo sapiens
cgccuuugaugaccuagaa

SEQ ID NO: 1487973 - RNA, 19 nt, Homo sapiens
gaagcuaggcagcauccau

SEQ ID NO: 1487974 - RNA, 19 nt, Homo sapiens
ccaaaccugccuugacuca

SEQ ID NO: 1487975 - RNA, 19 nt, Homo sapiens
aggaugagacgccacauga

SEQ ID NO: 1487976 - RNA, 19 nt, Homo sapiens
ggccuccuguguaugaaug

SEQ ID NO: 1487977 - RNA, 19 nt, Homo sapiens
ucuguuaugcagcaauaua

SEQ ID NO: 1487978 - RNA, 19 nt, Homo sapiens
ugagacgccacaugaagaa

SEQ ID NO: 1487979 - RNA, 19 nt, Homo sapiens
ugugugccaugaauuuaga

SEQ ID NO: 1487980 - RNA, 19 nt, Homo sapiens
cuaacccacagaauuauga

SEQ ID NO: 1487981 - RNA, 19 nt, Homo sapiens
gcaaaggaccaagaaagcu

SEQ ID NO: 1487982 - RNA, 19 nt, Homo sapiens
ucccaaaccugccuugacu

SEQ ID NO: 1487983 - RNA, 19 nt, Homo sapiens
aaagaagacgccacagaca

SEQ ID NO: 1487984 - RNA, 19 nt, Homo sapiens
gaggaugagacgccacaug

SEQ ID NO: 1487985 - RNA, 19 nt, Homo sapiens
ugagugugaccgucuuuga

SEQ ID NO: 1487986 - RNA, 19 nt, Homo sapiens
acaugaagaagaaagaaga

SEQ ID NO: 1487987 - RNA, 19 nt, Homo sapiens
ccacaugaagaagaaagaa

SEQ ID NO: 1487988 - RNA, 19 nt, Homo sapiens
ccaucuagcacaccugaau

SEQ ID NO: 1487989 - RNA, 19 nt, Homo sapiens
ucaaggaaacggaauuagg

SEQ ID NO: 1487990 - RNA, 19 nt, Homo sapiens
acucaaggaaacggaauua

SEQ ID NO: 1487991 - RNA, 19 nt, Homo sapiens
guuaugcagcaauauauag

SEQ ID NO: 1487992 - RNA, 19 nt, Homo sapiens
aagcuaggcagcauccauu

SEQ ID NO: 1487993 - RNA, 19 nt, Homo sapiens
aagcaaaggaccaagaaag

SEQ ID NO: 1487994 - RNA, 19 nt, Homo sapiens
gcuaacccacagaauuaug

SEQ ID NO: 1487995 - RNA, 19 nt, Homo sapiens
augaaugugugccaugaau

SEQ ID NO: 1487996 - RNA, 19 nt, Homo sapiens
acucggacuucacguggaa

SEQ ID NO: 1487997 - RNA, 19 nt, Homo sapiens
uguggucacugcuuuguac

SEQ ID NO: 1487998 - RNA, 19 nt, Homo sapiens
ugugacgguuucaucuuug

SEQ ID NO: 1487999 - RNA, 19 nt, Homo sapiens
uggaagcacaugaguagga

SEQ ID NO: 1488000 - RNA, 19 nt, Homo sapiens
uaagccacuaagucuguua

SEQ ID NO: 1488001 - RNA, 19 nt, Homo sapiens
cccacagaauuaugagaga

SEQ ID NO: 1488002 - RNA, 19 nt, Homo sapiens
ccagcugcuuucccugaau

SEQ ID NO: 1488003 - RNA, 19 nt, Homo sapiens
aaugugugccaugaauuua

SEQ ID NO: 1488004 - RNA, 19 nt, Homo sapiens
ugaaugugugccaugaauu

SEQ ID NO: 1488005 - RNA, 19 nt, Homo sapiens
ucuggaagcacaugaguag

SEQ ID NO: 1488006 - RNA, 19 nt, Homo sapiens
aaacggaauuaggcucuac

SEQ ID NO: 1488007 - RNA, 19 nt, Homo sapiens
gcuuuguacugaggaaaca

SEQ ID NO: 1488008 - RNA, 19 nt, Homo sapiens
uucuauggguugugaguga

SEQ ID NO: 1488009 - RNA, 19 nt, Homo sapiens
aagcucagccgccuuugau

SEQ ID NO: 1488010 - RNA, 19 nt, Homo sapiens
gaaguucuggaagcacaug

SEQ ID NO: 1488011 - RNA, 19 nt, Homo sapiens
gagcagacauucucuuuga

SEQ ID NO: 1488012 - RNA, 19 nt, Homo sapiens
guaaagcucucagauguuu

SEQ ID NO: 1488013 - RNA, 19 nt, Homo sapiens
agaacgagcuguuagaauu

SEQ ID NO: 1488014 - RNA, 19 nt, Homo sapiens
ggaaugaacugcugaaacg

SEQ ID NO: 1488015 - RNA, 19 nt, Homo sapiens
gaagagaaccagcugaaga

SEQ ID NO: 1488016 - RNA, 19 nt, Homo sapiens
agaaccagcugaagaauga

SEQ ID NO: 1488017 - RNA, 19 nt, Homo sapiens
ccaagucuauggacaugua

SEQ ID NO: 1488018 - RNA, 19 nt, Homo sapiens
gugaggcgauuucaacuaa

SEQ ID NO: 1488019 - RNA, 19 nt, Homo sapiens
ccaaguggguugaagagaa

SEQ ID NO: 1488020 - RNA, 19 nt, Homo sapiens
uaauuucacugccuuaaug

SEQ ID NO: 1488021 - RNA, 19 nt, Homo sapiens
cggcauaccuccuugaaug

SEQ ID NO: 1488022 - RNA, 19 nt, Homo sapiens
ucagaaacguuguccgaaa

SEQ ID NO: 1488023 - RNA, 19 nt, Homo sapiens
ggaagcaugucgaagaaag

SEQ ID NO: 1488024 - RNA, 19 nt, Homo sapiens
gagaagaacaagcggauga

SEQ ID NO: 1488025 - RNA, 19 nt, Homo sapiens
ggaaagaccgugugauucu

SEQ ID NO: 1488026 - RNA, 19 nt, Homo sapiens
gaagaaugaggaucuguug

SEQ ID NO: 1488027 - RNA, 19 nt, Homo sapiens
gagacucuaucuguuguaa

SEQ ID NO: 1488028 - RNA, 19 nt, Homo sapiens
ggaugaacaagaagaauga

SEQ ID NO: 1488029 - RNA, 19 nt, Homo sapiens
ggacauguaccagagcuaa

SEQ ID NO: 1488030 - RNA, 19 nt, Homo sapiens
cagaggaggcgcucaguaa

SEQ ID NO: 1488031 - RNA, 19 nt, Homo sapiens
gcugaagaaugaaaugcaa

SEQ ID NO: 1488032 - RNA, 19 nt, Homo sapiens
cugaaacgcucacgagaga

SEQ ID NO: 1488033 - RNA, 19 nt, Homo sapiens
ccacaguaguccaaagaga

SEQ ID NO: 1488034 - RNA, 19 nt, Homo sapiens
gaacgagcuguuagaauuc

SEQ ID NO: 1488035 - RNA, 19 nt, Homo sapiens
ucgaagauuuggagaaguu

SEQ ID NO: 1488036 - RNA, 19 nt, Homo sapiens
acaagcggaugaacaagaa

SEQ ID NO: 1488037 - RNA, 19 nt, Homo sapiens
cgaaacauccuacaacaca

SEQ ID NO: 1488038 - RNA, 19 nt, Homo sapiens
gaaagaccgugugauucug

SEQ ID NO: 1488039 - RNA, 19 nt, Homo sapiens
agaaguuacugguugagaa

SEQ ID NO: 1488040 - RNA, 19 nt, Homo sapiens
cgagcaggaucccaaguga

SEQ ID NO: 1488041 - RNA, 19 nt, Homo sapiens
ggagagagaacggcuguug

SEQ ID NO: 1488042 - RNA, 19 nt, Homo sapiens
gcgagaagcccgagaugga

SEQ ID NO: 1488043 - RNA, 19 nt, Homo sapiens
gacuggaaauggaagagaa

SEQ ID NO: 1488044 - RNA, 19 nt, Homo sapiens
gaauaauuucacugccuua

SEQ ID NO: 1488045 - RNA, 19 nt, Homo sapiens
caaguggguugaagagaag

SEQ ID NO: 1488046 - RNA, 19 nt, Homo sapiens
gaacaagaagaaugaggau

SEQ ID NO: 1488047 - RNA, 19 nt, Homo sapiens
gcagaggaggcgcucagua

SEQ ID NO: 1488048 - RNA, 19 nt, Homo sapiens
guaccagagcuaauauauu

SEQ ID NO: 1488049 - RNA, 19 nt, Homo sapiens
gcuagaacucgaaguaaga

SEQ ID NO: 1488050 - RNA, 19 nt, Homo sapiens
gcacacggccuacauuucg

SEQ ID NO: 1488051 - RNA, 19 nt, Homo sapiens
gggaaaacguggaaaugaa

SEQ ID NO: 1488052 - RNA, 19 nt, Homo sapiens
gaucagaacgagcuguuag

SEQ ID NO: 1488053 - RNA, 19 nt, Homo sapiens
caaaaggcaucgagggaaa

SEQ ID NO: 1488054 - RNA, 19 nt, Homo sapiens
guaaaggggacauguuaua

SEQ ID NO: 1488055 - RNA, 19 nt, Homo sapiens
gaagcuggaagacagaaau

SEQ ID NO: 1488056 - RNA, 19 nt, Homo sapiens
gagaaccagcugaagaaug

SEQ ID NO: 1488057 - RNA, 19 nt, Homo sapiens
gcauucagaucgaguucca

SEQ ID NO: 1488058 - RNA, 19 nt, Homo sapiens
gacucuaucuguuguaaac

SEQ ID NO: 1488059 - RNA, 19 nt, Homo sapiens
caagaagaaugaggaucug

SEQ ID NO: 1488060 - RNA, 19 nt, Homo sapiens
agaacaagcggaugaacaa

SEQ ID NO: 1488061 - RNA, 19 nt, Homo sapiens
gaaguuacugguugagaag

SEQ ID NO: 1488062 - RNA, 19 nt, Homo sapiens
gcaccacaguaguccaaag

SEQ ID NO: 1488063 - RNA, 19 nt, Homo sapiens
auguaaagcucucagaugu

SEQ ID NO: 1488064 - RNA, 19 nt, Homo sapiens
cgacugccauccuccucaa

SEQ ID NO: 1488065 - RNA, 19 nt, Homo sapiens
cagaaacguuguccgaaac

SEQ ID NO: 1488066 - RNA, 19 nt, Homo sapiens
ugaaaccgcccaagaagca

SEQ ID NO: 1488067 - RNA, 19 nt, Homo sapiens
gcaggcugauggaugagau

SEQ ID NO: 1488068 - RNA, 19 nt, Homo sapiens
ggagcagacauucucuuug

SEQ ID NO: 1488069 - RNA, 19 nt, Homo sapiens
aagagaaccagcugaagaa

SEQ ID NO: 1488070 - RNA, 19 nt, Homo sapiens
gggaugagcaggagaucga

SEQ ID NO: 1488071 - RNA, 19 nt, Homo sapiens
gaugugaggcgauuucaac

SEQ ID NO: 1488072 - RNA, 19 nt, Homo sapiens
cguccaggaucaacauaug

SEQ ID NO: 1488073 - RNA, 19 nt, Homo sapiens
gggaaagaccgugugauuc

SEQ ID NO: 1488074 - RNA, 19 nt, Homo sapiens
uggagaaguuacugguuga

SEQ ID NO: 1488075 - RNA, 19 nt, Homo sapiens
gaaacguuguccgaaacau

SEQ ID NO: 1488076 - RNA, 19 nt, Homo sapiens
ggaaaacguggaaaugaaa

SEQ ID NO: 1488077 - RNA, 19 nt, Homo sapiens
ggaucagaacgagcuguua

SEQ ID NO: 1488078 - RNA, 19 nt, Homo sapiens
acauguaccagagcuaaua

SEQ ID NO: 1488079 - RNA, 19 nt, Homo sapiens
ucacugccuuaauguguuc

SEQ ID NO: 1488080 - RNA, 19 nt, Homo sapiens
gaggcgauuucaacuaaaa

SEQ ID NO: 1488081 - RNA, 19 nt, Homo sapiens
cauguaaagcucucagaug

SEQ ID NO: 1488082 - RNA, 19 nt, Homo sapiens
aaacggagcagacauucuc

SEQ ID NO: 1488083 - RNA, 19 nt, Homo sapiens
cgaagaagacuuggacgau

SEQ ID NO: 1488084 - RNA, 19 nt, Homo sapiens
gcucaugggcguccaggau

SEQ ID NO: 1488085 - RNA, 19 nt, Homo sapiens
cggagcagacauucucuuu

SEQ ID NO: 1488086 - RNA, 19 nt, Homo sapiens
ugaagaaugaaaugcaaga

SEQ ID NO: 1488087 - RNA, 19 nt, Homo sapiens
agggaaagaccgugugauu

SEQ ID NO: 1488088 - RNA, 19 nt, Homo sapiens
uauugccuauggcuuguuu

SEQ ID NO: 1488089 - RNA, 19 nt, Homo sapiens
ggacauguuauaguuucuu

SEQ ID NO: 1488090 - RNA, 19 nt, Homo sapiens
gcagacauucucuuugaac

SEQ ID NO: 1488091 - RNA, 19 nt, Homo sapiens
gaauucagagugcuagaac

SEQ ID NO: 1488092 - RNA, 19 nt, Homo sapiens
cagcugcucaucagaacaa

SEQ ID NO: 1488093 - RNA, 19 nt, Homo sapiens
cagccacgcccgaagaaga

SEQ ID NO: 1488094 - RNA, 19 nt, Homo sapiens
aaacauccuacaacacaga

SEQ ID NO: 1488095 - RNA, 19 nt, Homo sapiens
ggcauaccuccuugaauga

SEQ ID NO: 1488096 - RNA, 19 nt, Homo sapiens
gagaaguuacugguugaga

SEQ ID NO: 1488097 - RNA, 19 nt, Homo sapiens
acaagaagaaugaggaucu

SEQ ID NO: 1488098 - RNA, 19 nt, Homo sapiens
gcaccgccaagaucaagga

SEQ ID NO: 1488099 - RNA, 19 nt, Homo sapiens
ugaggcgauuucaacuaaa

SEQ ID NO: 1488100 - RNA, 19 nt, Homo sapiens
ggggaagcaugucgaagaa

SEQ ID NO: 1488101 - RNA, 19 nt, Homo sapiens
ucagaacgagcuguuagaa

SEQ ID NO: 1488102 - RNA, 19 nt, Homo sapiens
uuacagacuggaaauggaa

SEQ ID NO: 1488103 - RNA, 19 nt, Homo sapiens
gaagcauguuguggagaca

SEQ ID NO: 1488104 - RNA, 19 nt, Homo sapiens
gagcagcagcacgucauug

SEQ ID NO: 1488105 - RNA, 19 nt, Homo sapiens
ggaagcuggaagacagaaa

SEQ ID NO: 1488106 - RNA, 19 nt, Homo sapiens
gagcggcaccacaguaguc

SEQ ID NO: 1488107 - RNA, 19 nt, Homo sapiens
cggcacacggccuacauuu

SEQ ID NO: 1488108 - RNA, 19 nt, Homo sapiens
gaacucgaaguaagagacu

SEQ ID NO: 1488109 - RNA, 19 nt, Homo sapiens
gugcuagaacucgaaguaa

SEQ ID NO: 1488110 - RNA, 19 nt, Homo sapiens
uccgaaacauccuacaaca

SEQ ID NO: 1488111 - RNA, 19 nt, Homo sapiens
ugacagaucugaacacuuu

SEQ ID NO: 1488112 - RNA, 19 nt, Homo sapiens
caaauagacuggacacuuu

SEQ ID NO: 1488113 - RNA, 19 nt, Homo sapiens
ucacagagcuaaagaaaug

SEQ ID NO: 1488114 - RNA, 19 nt, Homo sapiens
ggaaaucacugaggccaua

SEQ ID NO: 1488115 - RNA, 19 nt, Homo sapiens
ggacugacauuucacguau

SEQ ID NO: 1488116 - RNA, 19 nt, Homo sapiens
caacugaaauugagaguca

SEQ ID NO: 1488117 - RNA, 19 nt, Homo sapiens
gaacaggacuauauuucau

SEQ ID NO: 1488118 - RNA, 19 nt, Homo sapiens
gaaagucuacggaauguuu

SEQ ID NO: 1488119 - RNA, 19 nt, Homo sapiens
caaagcaacacucuacuua

SEQ ID NO: 1488120 - RNA, 19 nt, Homo sapiens
ggacacuucuccagauauu

SEQ ID NO: 1488121 - RNA, 19 nt, Homo sapiens
agucauaccuucuaucuuu

SEQ ID NO: 1488122 - RNA, 19 nt, Homo sapiens
ccaaagaaacuuaagcaua

SEQ ID NO: 1488123 - RNA, 19 nt, Homo sapiens
gaagugcuccaaauauuaa

SEQ ID NO: 1488124 - RNA, 19 nt, Homo sapiens
ggaaauggguauuagcaau

SEQ ID NO: 1488125 - RNA, 19 nt, Homo sapiens
guuaagauauggucacuug

SEQ ID NO: 1488126 - RNA, 19 nt, Homo sapiens
cagaagugcuccaaauauu

SEQ ID NO: 1488127 - RNA, 19 nt, Homo sapiens
gauauggucacuugaauuu

SEQ ID NO: 1488128 - RNA, 19 nt, Homo sapiens
gcucaguuguuuauuguaa

SEQ ID NO: 1488129 - RNA, 19 nt, Homo sapiens
cuacaaagcacaauucauu

SEQ ID NO: 1488130 - RNA, 19 nt, Homo sapiens
uggauucucuggagcauua

SEQ ID NO: 1488131 - RNA, 19 nt, Homo sapiens
uaucagccauuucauugua

SEQ ID NO: 1488132 - RNA, 19 nt, Homo sapiens
gcaguuagaauuugaguau

SEQ ID NO: 1488133 - RNA, 19 nt, Homo sapiens
aaacagcagcuuuagaaua

SEQ ID NO: 1488134 - RNA, 19 nt, Homo sapiens
ggaauuaaaggaugaaugu

SEQ ID NO: 1488135 - RNA, 19 nt, Homo sapiens
ggaagacaaucagggaauu

SEQ ID NO: 1488136 - RNA, 19 nt, Homo sapiens
acugaaaccuggagucaua

SEQ ID NO: 1488137 - RNA, 19 nt, Homo sapiens
ugacagaagugcuccaaau

SEQ ID NO: 1488138 - RNA, 19 nt, Homo sapiens
ucacugaggccauaucuuu

SEQ ID NO: 1488139 - RNA, 19 nt, Homo sapiens
gagaucagcguuaugcuaa

SEQ ID NO: 1488140 - RNA, 19 nt, Homo sapiens
gagaauaacacauagugaa

SEQ ID NO: 1488141 - RNA, 19 nt, Homo sapiens
gaagacagauuuugacaga

SEQ ID NO: 1488142 - RNA, 19 nt, Homo sapiens
gugaagaucugugggcuuu

SEQ ID NO: 1488143 - RNA, 19 nt, Homo sapiens
gauccaagucucauaaauu

SEQ ID NO: 1488144 - RNA, 19 nt, Homo sapiens
gaagacaaucagggaauua

SEQ ID NO: 1488145 - RNA, 19 nt, Homo sapiens
gaaaagacuugaugugaau

SEQ ID NO: 1488146 - RNA, 19 nt, Homo sapiens
uuaaaugguugguugcuuu

SEQ ID NO: 1488147 - RNA, 19 nt, Homo sapiens
acacuuugcuucaugacua

SEQ ID NO: 1488148 - RNA, 19 nt, Homo sapiens
gaagaucugugggcuuuua

SEQ ID NO: 1488149 - RNA, 19 nt, Homo sapiens
gcaaauagacuggacacuu

SEQ ID NO: 1488150 - RNA, 19 nt, Homo sapiens
ccucauguauugaagaauu

SEQ ID NO: 1488151 - RNA, 19 nt, Homo sapiens
gaaaacaacugaaauugag

SEQ ID NO: 1488152 - RNA, 19 nt, Homo sapiens
gagagaaaggauuagaaua

SEQ ID NO: 1488153 - RNA, 19 nt, Homo sapiens
gacagaagugcuccaaaua

SEQ ID NO: 1488154 - RNA, 19 nt, Homo sapiens
uaaauacuguggguuagaa

SEQ ID NO: 1488155 - RNA, 19 nt, Homo sapiens
ccaggucacuauuguaaga

SEQ ID NO: 1488156 - RNA, 19 nt, Homo sapiens
cauguuacguuccaccuaa

SEQ ID NO: 1488157 - RNA, 19 nt, Homo sapiens
uaacuacaaucaccaucuu

SEQ ID NO: 1488158 - RNA, 19 nt, Homo sapiens
ggagauguguuguguucga

SEQ ID NO: 1488159 - RNA, 19 nt, Homo sapiens
guacauacauggaccucau

SEQ ID NO: 1488160 - RNA, 19 nt, Homo sapiens
ucauaaauacuguggguua

SEQ ID NO: 1488161 - RNA, 19 nt, Homo sapiens
gaaauggguauuagcaaug

SEQ ID NO: 1488162 - RNA, 19 nt, Homo sapiens
uuccaaaccuucccucuaa

SEQ ID NO: 1488163 - RNA, 19 nt, Homo sapiens
ggagagaaaggauuagaau

SEQ ID NO: 1488164 - RNA, 19 nt, Homo sapiens
uaggagcacuuugauguaa

SEQ ID NO: 1488165 - RNA, 19 nt, Homo sapiens
gcuagaggauacaaaggaa

SEQ ID NO: 1488166 - RNA, 19 nt, Homo sapiens
gaucagcguuaugcuaaga

SEQ ID NO: 1488167 - RNA, 19 nt, Homo sapiens
uagagaaacggguaauuaa

SEQ ID NO: 1488168 - RNA, 19 nt, Homo sapiens
ccaagaaacagcaaauaga

SEQ ID NO: 1488169 - RNA, 19 nt, Homo sapiens
uuagagaaacggguaauua

SEQ ID NO: 1488170 - RNA, 19 nt, Homo sapiens
guucacagccaauuuaaga

SEQ ID NO: 1488171 - RNA, 19 nt, Homo sapiens
uacaugugcuuuaugguaa

SEQ ID NO: 1488172 - RNA, 19 nt, Homo sapiens
agaagugcuccaaauauua

SEQ ID NO: 1488173 - RNA, 19 nt, Homo sapiens
gcuaagaggaaaucacuga

SEQ ID NO: 1488174 - RNA, 19 nt, Homo sapiens
gaaauaggaauuggagaga

SEQ ID NO: 1488175 - RNA, 19 nt, Homo sapiens
uaaaaggacugacauuuca

SEQ ID NO: 1488176 - RNA, 19 nt, Homo sapiens
cuacuuagaagcacaugua

SEQ ID NO: 1488177 - RNA, 19 nt, Homo sapiens
aacagcagcuuuagaauag

SEQ ID NO: 1488178 - RNA, 19 nt, Homo sapiens
acauggaccucauucagaa

SEQ ID NO: 1488179 - RNA, 19 nt, Homo sapiens
aauaggaauuggagagaaa

SEQ ID NO: 1488180 - RNA, 19 nt, Homo sapiens
caucauuccuccucacuag

SEQ ID NO: 1488181 - RNA, 19 nt, Homo sapiens
ccaaggugcuuuagcuauc

SEQ ID NO: 1488182 - RNA, 19 nt, Homo sapiens
uaagauauggucacuugaa

SEQ ID NO: 1488183 - RNA, 19 nt, Homo sapiens
cagaaaucauugaggaaga

SEQ ID NO: 1488184 - RNA, 19 nt, Homo sapiens
aaaggaaagucuacggaau

SEQ ID NO: 1488185 - RNA, 19 nt, Homo sapiens
gaauaacacauagugaaga

SEQ ID NO: 1488186 - RNA, 19 nt, Homo sapiens
uuacaugugcuuuauggua

SEQ ID NO: 1488187 - RNA, 19 nt, Homo sapiens
ggugcuuccucauguauug

SEQ ID NO: 1488188 - RNA, 19 nt, Homo sapiens
gaauagcuucuuacugaau

SEQ ID NO: 1488189 - RNA, 19 nt, Homo sapiens
ucagggaauuaaaggauga

SEQ ID NO: 1488190 - RNA, 19 nt, Homo sapiens
gaauuccaaucccaguuca

SEQ ID NO: 1488191 - RNA, 19 nt, Homo sapiens
ucgaggcacuuuaagaaga

SEQ ID NO: 1488192 - RNA, 19 nt, Homo sapiens
aaggagauguguuguguuc

SEQ ID NO: 1488193 - RNA, 19 nt, Homo sapiens
uuauagaccuacacuagug

SEQ ID NO: 1488194 - RNA, 19 nt, Homo sapiens
gugcucaguuguuuauugu

SEQ ID NO: 1488195 - RNA, 19 nt, Homo sapiens
gaguaucagccauuucauu

SEQ ID NO: 1488196 - RNA, 19 nt, Homo sapiens
ccaagucucauaaauuuag

SEQ ID NO: 1488197 - RNA, 19 nt, Homo sapiens
ggaguagauuauuguccaa

SEQ ID NO: 1488198 - RNA, 19 nt, Homo sapiens
guucgaggcacuuuaagaa

SEQ ID NO: 1488199 - RNA, 19 nt, Homo sapiens
gagaaacggguaauuaaaa

SEQ ID NO: 1488200 - RNA, 19 nt, Homo sapiens
gacaguccaaagaaacuua

SEQ ID NO: 1488201 - RNA, 19 nt, Homo sapiens
aaauggguauuagcaauga

SEQ ID NO: 1488202 - RNA, 19 nt, Homo sapiens
acucugagaauaacacaua

SEQ ID NO: 1488203 - RNA, 19 nt, Homo sapiens
acaggacuauauuucauga

SEQ ID NO: 1488204 - RNA, 19 nt, Homo sapiens
ucucgcugcuugccaaauu

SEQ ID NO: 1488205 - RNA, 19 nt, Homo sapiens
cgagaucagcguuaugcua

SEQ ID NO: 1488206 - RNA, 19 nt, Homo sapiens
ugaaaagacuugaugugaa

SEQ ID NO: 1488207 - RNA, 19 nt, Homo sapiens
agagaaacggguaauuaaa

SEQ ID NO: 1488208 - RNA, 19 nt, Homo sapiens
uggcaguacuagcucuaua

SEQ ID NO: 1488209 - RNA, 19 nt, Homo sapiens
caaggugcuuuagcuauca

SEQ ID NO: 1488210 - RNA, 19 nt, Homo sapiens
ggagucauaccuucuaucu

SEQ ID NO: 1488211 - RNA, 19 nt, Homo sapiens
ugacagagcuuuacaauca

SEQ ID NO: 1488212 - RNA, 19 nt, Homo sapiens
gcaauaagguuagaugaaa

SEQ ID NO: 1488213 - RNA, 19 nt, Homo sapiens
caacaacccucgaaucuug

SEQ ID NO: 1488214 - RNA, 19 nt, Homo sapiens
gaucaaggcucacucgaaa

SEQ ID NO: 1488215 - RNA, 19 nt, Homo sapiens
caagagaguuguuagcuaa

SEQ ID NO: 1488216 - RNA, 19 nt, Homo sapiens
gaaauaaccacacgcuaua

SEQ ID NO: 1488217 - RNA, 19 nt, Homo sapiens
aagcauaccugauugauaa

SEQ ID NO: 1488218 - RNA, 19 nt, Homo sapiens
caaacuggcugaagagaaa

SEQ ID NO: 1488219 - RNA, 19 nt, Homo sapiens
ggauuaaacuggaauacaa

SEQ ID NO: 1488220 - RNA, 19 nt, Homo sapiens
gcaagagaguuguuagcua

SEQ ID NO: 1488221 - RNA, 19 nt, Homo sapiens
gaaugaaagucacccacua

SEQ ID NO: 1488222 - RNA, 19 nt, Homo sapiens
gagaagcgcugaacuggau

SEQ ID NO: 1488223 - RNA, 19 nt, Homo sapiens
guucuacucuuaucaauug

SEQ ID NO: 1488224 - RNA, 19 nt, Homo sapiens
gaagagcuauauggucuaa

SEQ ID NO: 1488225 - RNA, 19 nt, Homo sapiens
gaagaaaccacugauauuc

SEQ ID NO: 1488226 - RNA, 19 nt, Homo sapiens
caaaggcuauuaugcauuc

SEQ ID NO: 1488227 - RNA, 19 nt, Homo sapiens
caacacauaccauuaaaga

SEQ ID NO: 1488228 - RNA, 19 nt, Homo sapiens
ggacagggacauccaguuu

SEQ ID NO: 1488229 - RNA, 19 nt, Homo sapiens
aggcacagcugauuucuuu

SEQ ID NO: 1488230 - RNA, 19 nt, Homo sapiens
aaacagaucauacgagaaa

SEQ ID NO: 1488231 - RNA, 19 nt, Homo sapiens
gaaauacgaguguuugguu

SEQ ID NO: 1488232 - RNA, 19 nt, Homo sapiens
gaacuggauuaaacuggaa

SEQ ID NO: 1488233 - RNA, 19 nt, Homo sapiens
caaaaggucugcaguacua

SEQ ID NO: 1488234 - RNA, 19 nt, Homo sapiens
aaagucagcuguuucucua

SEQ ID NO: 1488235 - RNA, 19 nt, Homo sapiens
gcuaaauccucaauacaau

SEQ ID NO: 1488236 - RNA, 19 nt, Homo sapiens
gggaauacauugccuccaa

SEQ ID NO: 1488237 - RNA, 19 nt, Homo sapiens
agaaagagcggaaaccuaa

SEQ ID NO: 1488238 - RNA, 19 nt, Homo sapiens
agagugcacugucugcuua

SEQ ID NO: 1488239 - RNA, 19 nt, Homo sapiens
gcugaaagcauaccugauu

SEQ ID NO: 1488240 - RNA, 19 nt, Homo sapiens
gcagaagaaaccacugaua

SEQ ID NO: 1488241 - RNA, 19 nt, Homo sapiens
gcgcugaacuggauuaaac

SEQ ID NO: 1488242 - RNA, 19 nt, Homo sapiens
gcacacuacuacaaacaga

SEQ ID NO: 1488243 - RNA, 19 nt, Homo sapiens
gaagaaggauggaaaagga

SEQ ID NO: 1488244 - RNA, 19 nt, Homo sapiens
gcacgaaugguuccaguga

SEQ ID NO: 1488245 - RNA, 19 nt, Homo sapiens
aaauacgaguguuugguua

SEQ ID NO: 1488246 - RNA, 19 nt, Homo sapiens
ggacaaaauguuucacuua

SEQ ID NO: 1488247 - RNA, 19 nt, Homo sapiens
uagcuaaacugaucugucu

SEQ ID NO: 1488248 - RNA, 19 nt, Homo sapiens
cagaagaaaccacugauau

SEQ ID NO: 1488249 - RNA, 19 nt, Homo sapiens
guuguuagcuaaacugauc

SEQ ID NO: 1488250 - RNA, 19 nt, Homo sapiens
cgauggauauauucaaaug

SEQ ID NO: 1488251 - RNA, 19 nt, Homo sapiens
ggagagaagggaaauuuag

SEQ ID NO: 1488252 - RNA, 19 nt, Homo sapiens
cgugucaaauauuggauua

SEQ ID NO: 1488253 - RNA, 19 nt, Homo sapiens
gcagaagagaagaaaguuu

SEQ ID NO: 1488254 - RNA, 19 nt, Homo sapiens
ugucaacaauccaugguuu

SEQ ID NO: 1488255 - RNA, 19 nt, Homo sapiens
ugaaauaaccacacgcuau

SEQ ID NO: 1488256 - RNA, 19 nt, Homo sapiens
gauaaagucagaaucaaag

SEQ ID NO: 1488257 - RNA, 19 nt, Homo sapiens
cacgauggauauauucaaa

SEQ ID NO: 1488258 - RNA, 19 nt, Homo sapiens
aaaugaaagucagcuguuu

SEQ ID NO: 1488259 - RNA, 19 nt, Homo sapiens
cacccugguucuacucuua

SEQ ID NO: 1488260 - RNA, 19 nt, Homo sapiens
uauaugggaucauuucauc

SEQ ID NO: 1488261 - RNA, 19 nt, Homo sapiens
ggagauggaagagcuauau

SEQ ID NO: 1488262 - RNA, 19 nt, Homo sapiens
agaagaaaccacugauauu

SEQ ID NO: 1488263 - RNA, 19 nt, Homo sapiens
gaaguuguucuccguucua

SEQ ID NO: 1488264 - RNA, 19 nt, Homo sapiens
gauggaauaguaacaguug

SEQ ID NO: 1488265 - RNA, 19 nt, Homo sapiens
aaagcuaaauccucaauac

SEQ ID NO: 1488266 - RNA, 19 nt, Homo sapiens
gauguuggcaagaaugaaa

SEQ ID NO: 1488267 - RNA, 19 nt, Homo sapiens
gcacagauuuuguaaacau

SEQ ID NO: 1488268 - RNA, 19 nt, Homo sapiens
gagccaaaccggucggaaa

SEQ ID NO: 1488269 - RNA, 19 nt, Homo sapiens
ccacugggauuugccuuug

SEQ ID NO: 1488270 - RNA, 19 nt, Homo sapiens
ggcaggaucuccagggaau

SEQ ID NO: 1488271 - RNA, 19 nt, Homo sapiens
ucacugaaucuguucuuaa

SEQ ID NO: 1488272 - RNA, 19 nt, Homo sapiens
aagguuagaugaaauacga

SEQ ID NO: 1488273 - RNA, 19 nt, Homo sapiens
gaagcgcugaacuggauua

SEQ ID NO: 1488274 - RNA, 19 nt, Homo sapiens
gcuuauuccuugugcagaa

SEQ ID NO: 1488275 - RNA, 19 nt, Homo sapiens
gaauacaacaacccucgaa

SEQ ID NO: 1488276 - RNA, 19 nt, Homo sapiens
gcagagaagcaugagauga

SEQ ID NO: 1488277 - RNA, 19 nt, Homo sapiens
gggaccgugucaaauauug

SEQ ID NO: 1488278 - RNA, 19 nt, Homo sapiens
gaaaggcaagagaguuguu

SEQ ID NO: 1488279 - RNA, 19 nt, Homo sapiens
gaugaaauacgaguguuug

SEQ ID NO: 1488280 - RNA, 19 nt, Homo sapiens
uagcagcugucuacacugu

SEQ ID NO: 1488281 - RNA, 19 nt, Homo sapiens
ggaagggaguuggaagaag

SEQ ID NO: 1488282 - RNA, 19 nt, Homo sapiens
cuaugacacuuucccuaaa

SEQ ID NO: 1488283 - RNA, 19 nt, Homo sapiens
auacgaguguuugguuaua

SEQ ID NO: 1488284 - RNA, 19 nt, Homo sapiens
ucacaacccauaucuagug

SEQ ID NO: 1488285 - RNA, 19 nt, Homo sapiens
uacugaagcuuugauaaga

SEQ ID NO: 1488286 - RNA, 19 nt, Homo sapiens
guucagcgauccucaucug

SEQ ID NO: 1488287 - RNA, 19 nt, Homo sapiens
gcggaaaccuaagucuuca

SEQ ID NO: 1488288 - RNA, 19 nt, Homo sapiens
ccacggccaucuacaugau

SEQ ID NO: 1488289 - RNA, 19 nt, Homo sapiens
aaggcucacucgaaaguuu

SEQ ID NO: 1488290 - RNA, 19 nt, Homo sapiens
uaaaugaaagucagcuguu

SEQ ID NO: 1488291 - RNA, 19 nt, Homo sapiens
gaaagcauaccugauugau

SEQ ID NO: 1488292 - RNA, 19 nt, Homo sapiens
uugaauggcaggaugcuua

SEQ ID NO: 1488293 - RNA, 19 nt, Homo sapiens
uaagagaagcgcugaacug

SEQ ID NO: 1488294 - RNA, 19 nt, Homo sapiens
cagaaggguugguuaucga

SEQ ID NO: 1488295 - RNA, 19 nt, Homo sapiens
acucgaaaguuuggcauaa

SEQ ID NO: 1488296 - RNA, 19 nt, Homo sapiens
gaaauuuagcagcugucua

SEQ ID NO: 1488297 - RNA, 19 nt, Homo sapiens
cgacauggacauuuacauc

SEQ ID NO: 1488298 - RNA, 19 nt, Homo sapiens
acggcgacauggacauuua

SEQ ID NO: 1488299 - RNA, 19 nt, Homo sapiens
gagaggcacagcugauuuc

SEQ ID NO: 1488300 - RNA, 19 nt, Homo sapiens
aaagcauaccugauugaua

SEQ ID NO: 1488301 - RNA, 19 nt, Homo sapiens
gacauggacauuuacauca

SEQ ID NO: 1488302 - RNA, 19 nt, Homo sapiens
gagauguuggcaagaauga

SEQ ID NO: 1488303 - RNA, 19 nt, Homo sapiens
gggugucacugaaucuguu

SEQ ID NO: 1488304 - RNA, 19 nt, Homo sapiens
cagaaagagcggaaaccua

SEQ ID NO: 1488305 - RNA, 19 nt, Homo sapiens
cacauacuguuuccagaug

SEQ ID NO: 1488306 - RNA, 19 nt, Homo sapiens
uauugggacuggagcauug

SEQ ID NO: 1488307 - RNA, 19 nt, Homo sapiens
ccacuagguucgugaugca

SEQ ID NO: 1488308 - RNA, 19 nt, Homo sapiens
aaacacgacccgcucaaug

SEQ ID NO: 1488309 - RNA, 19 nt, Homo sapiens
gucacugaaucuguucuua

SEQ ID NO: 1488310 - RNA, 19 nt, Homo sapiens
gagcggaaaccuaagucuu

SEQ ID NO: 1488311 - RNA, 19 nt, Homo sapiens
agaagaggcucaaugaaua

SEQ ID NO: 1488312 - RNA, 19 nt, Homo sapiens
gcagacagucccaauauua

SEQ ID NO: 1488313 - RNA, 19 nt, Homo sapiens
gcucauaccuauaauccua

SEQ ID NO: 1488314 - RNA, 19 nt, Homo sapiens
gaagaagucucagaggaaa

SEQ ID NO: 1488315 - RNA, 19 nt, Homo sapiens
guacuuaguucaaagaaga

SEQ ID NO: 1488316 - RNA, 19 nt, Homo sapiens
ggagagcauugagaauuua

SEQ ID NO: 1488317 - RNA, 19 nt, Homo sapiens
aaguagagcuguuauguuu

SEQ ID NO: 1488318 - RNA, 19 nt, Homo sapiens
gcacuuggcugcacuguac

SEQ ID NO: 1488319 - RNA, 19 nt, Homo sapiens
gggagagcauugagaauuu

SEQ ID NO: 1488320 - RNA, 19 nt, Homo sapiens
caacauacaucacuuucug

SEQ ID NO: 1488321 - RNA, 19 nt, Homo sapiens
agacaaaccuggguaauau

SEQ ID NO: 1488322 - RNA, 19 nt, Homo sapiens
caaagaagaggcucaauga

SEQ ID NO: 1488323 - RNA, 19 nt, Homo sapiens
gaacucagaagguuauuug

SEQ ID NO: 1488324 - RNA, 19 nt, Homo sapiens
gaaaaguacuucucuaaug

SEQ ID NO: 1488325 - RNA, 19 nt, Homo sapiens
ucagaagguuauuugguua

SEQ ID NO: 1488326 - RNA, 19 nt, Homo sapiens
gagacaaaccuggguaaua

SEQ ID NO: 1488327 - RNA, 19 nt, Homo sapiens
gcuaaucucuugccuccuu

SEQ ID NO: 1488328 - RNA, 19 nt, Homo sapiens
ggaagaagucucagaggaa

SEQ ID NO: 1488329 - RNA, 19 nt, Homo sapiens
caucaacaccugcccuuua

SEQ ID NO: 1488330 - RNA, 19 nt, Homo sapiens
guacaacuaaaccacauua

SEQ ID NO: 1488331 - RNA, 19 nt, Homo sapiens
caaacuaacugcugaugca

SEQ ID NO: 1488332 - RNA, 19 nt, Homo sapiens
augcagagcugaagugaaa

SEQ ID NO: 1488333 - RNA, 19 nt, Homo sapiens
gaagcaacauacaucacuu

SEQ ID NO: 1488334 - RNA, 19 nt, Homo sapiens
gauaguagcauguuacaag

SEQ ID NO: 1488335 - RNA, 19 nt, Homo sapiens
caacuaaaccacauuaucu

SEQ ID NO: 1488336 - RNA, 19 nt, Homo sapiens
gaacagaaaggagcuaauc

SEQ ID NO: 1488337 - RNA, 19 nt, Homo sapiens
gguuaaggcuauagugaga

SEQ ID NO: 1488338 - RNA, 19 nt, Homo sapiens
ggcccuggcucugucauua

SEQ ID NO: 1488339 - RNA, 19 nt, Homo sapiens
gaagcaaugucuagugcau

SEQ ID NO: 1488340 - RNA, 19 nt, Homo sapiens
ggacacauuuaguagcaau

SEQ ID NO: 1488341 - RNA, 19 nt, Homo sapiens
gaagaggcucaaugaauau

SEQ ID NO: 1488342 - RNA, 19 nt, Homo sapiens
aaucauagggacacauuua

SEQ ID NO: 1488343 - RNA, 19 nt, Homo sapiens
ccuaggagguuaaggcuau

SEQ ID NO: 1488344 - RNA, 19 nt, Homo sapiens
caccugcccuuuaagcuuu

SEQ ID NO: 1488345 - RNA, 19 nt, Homo sapiens
gcauuugccuuuccuuucu

SEQ ID NO: 1488346 - RNA, 19 nt, Homo sapiens
uaucacauguacacuuuga

SEQ ID NO: 1488347 - RNA, 19 nt, Homo sapiens
guagcauguuacaagauua

SEQ ID NO: 1488348 - RNA, 19 nt, Homo sapiens
gcaccacaaucuccugcaa

SEQ ID NO: 1488349 - RNA, 19 nt, Homo sapiens
cauagggacacauuuagua

SEQ ID NO: 1488350 - RNA, 19 nt, Homo sapiens
gaaaagcgcaaaacacaaa

SEQ ID NO: 1488351 - RNA, 19 nt, Homo sapiens
caaccuucacguucuaaua

SEQ ID NO: 1488352 - RNA, 19 nt, Homo sapiens
guaccaaccuucacguucu

SEQ ID NO: 1488353 - RNA, 19 nt, Homo sapiens
aaagaugcuuguaaucaug

SEQ ID NO: 1488354 - RNA, 19 nt, Homo sapiens
caaaguagagcuguuaugu

SEQ ID NO: 1488355 - RNA, 19 nt, Homo sapiens
ccuauaauccuaacauguu

SEQ ID NO: 1488356 - RNA, 19 nt, Homo sapiens
gagguuaaggcuauaguga

SEQ ID NO: 1488357 - RNA, 19 nt, Homo sapiens
gggaggauugguuaugaua

SEQ ID NO: 1488358 - RNA, 19 nt, Homo sapiens
ugaguccaauuaucuuuga

SEQ ID NO: 1488359 - RNA, 19 nt, Homo sapiens
ccaauauuaugccuacugu

SEQ ID NO: 1488360 - RNA, 19 nt, Homo sapiens
agagaauccugguauuuca

SEQ ID NO: 1488361 - RNA, 19 nt, Homo sapiens
ggagguagggagagcauug

SEQ ID NO: 1488362 - RNA, 19 nt, Homo sapiens
auagagaagugcagaggaa

SEQ ID NO: 1488363 - RNA, 19 nt, Homo sapiens
guuaaagcauagagaagug

SEQ ID NO: 1488364 - RNA, 19 nt, Homo sapiens
guagggagagcauugagaa

SEQ ID NO: 1488365 - RNA, 19 nt, Homo sapiens
uuucuucccuuucuccuuu

SEQ ID NO: 1488366 - RNA, 19 nt, Homo sapiens
uugcuucucucuuuccuuu

SEQ ID NO: 1488367 - RNA, 19 nt, Homo sapiens
aagaagaggcucaaugaau

SEQ ID NO: 1488368 - RNA, 19 nt, Homo sapiens
gaaguucaauuuucucauc

SEQ ID NO: 1488369 - RNA, 19 nt, Homo sapiens
uagcagacagucccaauau

SEQ ID NO: 1488370 - RNA, 19 nt, Homo sapiens
ucaaagaagaggcucaaug

SEQ ID NO: 1488371 - RNA, 19 nt, Homo sapiens
cucagaagguuauuugguu

SEQ ID NO: 1488372 - RNA, 19 nt, Homo sapiens
gcaaaguagagcuguuaug

SEQ ID NO: 1488373 - RNA, 19 nt, Homo sapiens
gagcauugagaauuuaugu

SEQ ID NO: 1488374 - RNA, 19 nt, Homo sapiens
gcagaggaagcaaugucua

SEQ ID NO: 1488375 - RNA, 19 nt, Homo sapiens
gaagguuauuugguuaaag

SEQ ID NO: 1488376 - RNA, 19 nt, Homo sapiens
cuauaauccuaacauguug

SEQ ID NO: 1488377 - RNA, 19 nt, Homo sapiens
aguagcauguuacaagauu

SEQ ID NO: 1488378 - RNA, 19 nt, Homo sapiens
aucaacaccugcccuuuaa

SEQ ID NO: 1488379 - RNA, 19 nt, Homo sapiens
ugagagcagagacuaauga

SEQ ID NO: 1488380 - RNA, 19 nt, Homo sapiens
uguaguaacacaugaauca

SEQ ID NO: 1488381 - RNA, 19 nt, Homo sapiens
ggaagcaacauacaucacu

SEQ ID NO: 1488382 - RNA, 19 nt, Homo sapiens
cccucuaccuaaagcauua

SEQ ID NO: 1488383 - RNA, 19 nt, Homo sapiens
caacagcuggcccuugaau

SEQ ID NO: 1488384 - RNA, 19 nt, Homo sapiens
aagggaggauugguuauga

SEQ ID NO: 1488385 - RNA, 19 nt, Homo sapiens
augauuaacuugggaagaa

SEQ ID NO: 1488386 - RNA, 19 nt, Homo sapiens
cagacagucccaauauuau

SEQ ID NO: 1488387 - RNA, 19 nt, Homo sapiens
aaccuucacguucuaauaa

SEQ ID NO: 1488388 - RNA, 19 nt, Homo sapiens
gccucuugcuucucucuuu

SEQ ID NO: 1488389 - RNA, 19 nt, Homo sapiens
gaggcucaaugaauauucu

SEQ ID NO: 1488390 - RNA, 19 nt, Homo sapiens
gcauguuacaagauuauug

SEQ ID NO: 1488391 - RNA, 19 nt, Homo sapiens
acagcuggcccuugaauug

SEQ ID NO: 1488392 - RNA, 19 nt, Homo sapiens
acacaaccuguacaacuaa

SEQ ID NO: 1488393 - RNA, 19 nt, Homo sapiens
gcuggaacucagaagguua

SEQ ID NO: 1488394 - RNA, 19 nt, Homo sapiens
ucauugaaaggaaaggaua

SEQ ID NO: 1488395 - RNA, 19 nt, Homo sapiens
uuagagaauccugguauuu

SEQ ID NO: 1488396 - RNA, 19 nt, Homo sapiens
ugaaucauagggacacauu

SEQ ID NO: 1488397 - RNA, 19 nt, Homo sapiens
gaguucaggaagcaacaua

SEQ ID NO: 1488398 - RNA, 19 nt, Homo sapiens
gagcugaagugaaaaguac

SEQ ID NO: 1488399 - RNA, 19 nt, Homo sapiens
uaccaaccuucacguucua

SEQ ID NO: 1488400 - RNA, 19 nt, Homo sapiens
auaguagcauguuacaaga

SEQ ID NO: 1488401 - RNA, 19 nt, Homo sapiens
ggaacucagaagguuauuu

SEQ ID NO: 1488402 - RNA, 19 nt, Homo sapiens
uggccacacuguauugaga

SEQ ID NO: 1488403 - RNA, 19 nt, Homo sapiens
cuggcuauuuacaugauua

SEQ ID NO: 1488404 - RNA, 19 nt, Homo sapiens
ucauuaaagugggugaguu

SEQ ID NO: 1488405 - RNA, 19 nt, Homo sapiens
gugaacaaguuaaaguacu

SEQ ID NO: 1488406 - RNA, 19 nt, Homo sapiens
gaggaagcaaugucuagug

SEQ ID NO: 1488407 - RNA, 19 nt, Homo sapiens
gaagugcagaggaagcaau

SEQ ID NO: 1488408 - RNA, 19 nt, Homo sapiens
cagaagguuauuugguuaa

SEQ ID NO: 1488409 - RNA, 19 nt, Homo sapiens
aaaguagagcuguuauguu

SEQ ID NO: 1488410 - RNA, 19 nt, Homo sapiens
uagagaauccugguauuuc

SEQ ID NO: 1488411 - RNA, 19 nt, Homo sapiens
gaaaucaacuucucauuca

SEQ ID NO: 1488412 - RNA, 19 nt, Homo sapiens
ggagaaggcacucuuauuu

SEQ ID NO: 1488413 - RNA, 19 nt, Homo sapiens
guaaaccacuuagauagua

SEQ ID NO: 1488414 - RNA, 19 nt, Homo sapiens
gagaaggcacucuuauuua

SEQ ID NO: 1488415 - RNA, 19 nt, Homo sapiens
uaugugaucuccaaguuua

SEQ ID NO: 1488416 - RNA, 19 nt, Homo sapiens
ccagagacauuccauuauu

SEQ ID NO: 1488417 - RNA, 19 nt, Homo sapiens
gaaacccugucucuaguaa

SEQ ID NO: 1488418 - RNA, 19 nt, Homo sapiens
ccaugaagcugaccauuga

SEQ ID NO: 1488419 - RNA, 19 nt, Homo sapiens
gucaacagcugccuuaauu

SEQ ID NO: 1488420 - RNA, 19 nt, Homo sapiens
gagagugucacauuaauaa

SEQ ID NO: 1488421 - RNA, 19 nt, Homo sapiens
ucaagaaacugauaagauc

SEQ ID NO: 1488422 - RNA, 19 nt, Homo sapiens
caagaaguauuggagauuu

SEQ ID NO: 1488423 - RNA, 19 nt, Homo sapiens
ggagaaauguauuauggau

SEQ ID NO: 1488424 - RNA, 19 nt, Homo sapiens
uagcagaaccugaaacuaa

SEQ ID NO: 1488425 - RNA, 19 nt, Homo sapiens
gcaaggcaguggccgcuuu

SEQ ID NO: 1488426 - RNA, 19 nt, Homo sapiens
ggacguagccauccagaga

SEQ ID NO: 1488427 - RNA, 19 nt, Homo sapiens
gcuauggguuucuucuuaa

SEQ ID NO: 1488428 - RNA, 19 nt, Homo sapiens
aagaaaggaucaagaaaug

SEQ ID NO: 1488429 - RNA, 19 nt, Homo sapiens
gagaagaacuuggaaacuc

SEQ ID NO: 1488430 - RNA, 19 nt, Homo sapiens
ggaaagagcaaaugagaag

SEQ ID NO: 1488431 - RNA, 19 nt, Homo sapiens
gcagcugauuucugucaua

SEQ ID NO: 1488432 - RNA, 19 nt, Homo sapiens
cagaugagguccuguacuu

SEQ ID NO: 1488433 - RNA, 19 nt, Homo sapiens
gaugagagugucacauuaa

SEQ ID NO: 1488434 - RNA, 19 nt, Homo sapiens
gagaugagagugucacauu

SEQ ID NO: 1488435 - RNA, 19 nt, Homo sapiens
ucaagagauuugugacuuu

SEQ ID NO: 1488436 - RNA, 19 nt, Homo sapiens
gaaauguggugguuuugua

SEQ ID NO: 1488437 - RNA, 19 nt, Homo sapiens
ucacugagcaugucaagaa

SEQ ID NO: 1488438 - RNA, 19 nt, Homo sapiens
gaaaggaucaagaaaugug

SEQ ID NO: 1488439 - RNA, 19 nt, Homo sapiens
uaagaacucugaaaucaac

SEQ ID NO: 1488440 - RNA, 19 nt, Homo sapiens
gaacuuggaaacucuguug

SEQ ID NO: 1488441 - RNA, 19 nt, Homo sapiens
gaucugggauaaccgcauu

SEQ ID NO: 1488442 - RNA, 19 nt, Homo sapiens
caagagauuugugacuuug

SEQ ID NO: 1488443 - RNA, 19 nt, Homo sapiens
gcaaacggaaagagaauga

SEQ ID NO: 1488444 - RNA, 19 nt, Homo sapiens
ggauacacuugaugagaga

SEQ ID NO: 1488445 - RNA, 19 nt, Homo sapiens
gaaacuaagaggauuaagu

SEQ ID NO: 1488446 - RNA, 19 nt, Homo sapiens
caagaaauguggugguuuu

SEQ ID NO: 1488447 - RNA, 19 nt, Homo sapiens
ucgcucagcugacagauga

SEQ ID NO: 1488448 - RNA, 19 nt, Homo sapiens
cagagacauuccauuauug

SEQ ID NO: 1488449 - RNA, 19 nt, Homo sapiens
agaugagagugucacauua

SEQ ID NO: 1488450 - RNA, 19 nt, Homo sapiens
gacaagaaguauuggagau

SEQ ID NO: 1488451 - RNA, 19 nt, Homo sapiens
gggauaaccgcauugauga

SEQ ID NO: 1488452 - RNA, 19 nt, Homo sapiens
gagcaaaugagaagugguu

SEQ ID NO: 1488453 - RNA, 19 nt, Homo sapiens
cuaagaggauuaaguuaca

SEQ ID NO: 1488454 - RNA, 19 nt, Homo sapiens
guaaauggcaggcuugcaa

SEQ ID NO: 1488455 - RNA, 19 nt, Homo sapiens
gagcaugucaagaaacuga

SEQ ID NO: 1488456 - RNA, 19 nt, Homo sapiens
ggugaauagucaagagauu

SEQ ID NO: 1488457 - RNA, 19 nt, Homo sapiens
gaugagguccuguacuuug

SEQ ID NO: 1488458 - RNA, 19 nt, Homo sapiens
gaagcuacugugagucuuu

SEQ ID NO: 1488459 - RNA, 19 nt, Homo sapiens
gaccuuggcuuuucuagaa

SEQ ID NO: 1488460 - RNA, 19 nt, Homo sapiens
gaaggagagugcugcuaag

SEQ ID NO: 1488461 - RNA, 19 nt, Homo sapiens
agacuucccuaauccuaaa

SEQ ID NO: 1488462 - RNA, 19 nt, Homo sapiens
ccacuuagauaguaguuuu

SEQ ID NO: 1488463 - RNA, 19 nt, Homo sapiens
ggugaaacccugucucuag

SEQ ID NO: 1488464 - RNA, 19 nt, Homo sapiens
cagcugggacuuagaguuu

SEQ ID NO: 1488465 - RNA, 19 nt, Homo sapiens
agaaggcacucuuauuuac

SEQ ID NO: 1488466 - RNA, 19 nt, Homo sapiens
gaucagcgcacaagucagu

SEQ ID NO: 1488467 - RNA, 19 nt, Homo sapiens
ugaccauacuccagaaaga

SEQ ID NO: 1488468 - RNA, 19 nt, Homo sapiens
uaauaacuguaccaaggaa

SEQ ID NO: 1488469 - RNA, 19 nt, Homo sapiens
gcgcacaagucaguguaaa

SEQ ID NO: 1488470 - RNA, 19 nt, Homo sapiens
ugaaaucaacuucucauuc

SEQ ID NO: 1488471 - RNA, 19 nt, Homo sapiens
gagaagugguuuggauaca

SEQ ID NO: 1488472 - RNA, 19 nt, Homo sapiens
cuguacauguucaguauaa

SEQ ID NO: 1488473 - RNA, 19 nt, Homo sapiens
uggaaacucuguugaccuu

SEQ ID NO: 1488474 - RNA, 19 nt, Homo sapiens
cagcugccuuaauuacuuu

SEQ ID NO: 1488475 - RNA, 19 nt, Homo sapiens
aauaugugaucuccaaguu

SEQ ID NO: 1488476 - RNA, 19 nt, Homo sapiens
gaaugaagaucgguuugac

SEQ ID NO: 1488477 - RNA, 19 nt, Homo sapiens
guccuccguuagcuaauua

SEQ ID NO: 1488478 - RNA, 19 nt, Homo sapiens
caacagcugccuuaauuac

SEQ ID NO: 1488479 - RNA, 19 nt, Homo sapiens
gugaaacccugucucuagu

SEQ ID NO: 1488480 - RNA, 19 nt, Homo sapiens
agcuauggguuucuucuua

SEQ ID NO: 1488481 - RNA, 19 nt, Homo sapiens
aggauuaaguuacaucaug

SEQ ID NO: 1488482 - RNA, 19 nt, Homo sapiens
ugacuucgcucagcugaca

SEQ ID NO: 1488483 - RNA, 19 nt, Homo sapiens
agaaggagagugcugcuaa

SEQ ID NO: 1488484 - RNA, 19 nt, Homo sapiens
uaacuguaccaaggaauaa

SEQ ID NO: 1488485 - RNA, 19 nt, Homo sapiens
aagcuacugugagucuuua

SEQ ID NO: 1488486 - RNA, 19 nt, Homo sapiens
ccacagauggaauuaacuu

SEQ ID NO: 1488487 - RNA, 19 nt, Homo sapiens
gagcugaguuaugucaaca

SEQ ID NO: 1488488 - RNA, 19 nt, Homo sapiens
uaccaaggaauaaguauga

SEQ ID NO: 1488489 - RNA, 19 nt, Homo sapiens
acagcugccuuaauuacuu

SEQ ID NO: 1488490 - RNA, 19 nt, Homo sapiens
ugagagugucacauuaaua

SEQ ID NO: 1488491 - RNA, 19 nt, Homo sapiens
ggugaaagcaaccaugcaa

SEQ ID NO: 1488492 - RNA, 19 nt, Homo sapiens
aaugagaagugguuuggau

SEQ ID NO: 1488493 - RNA, 19 nt, Homo sapiens
gcaugucaagaaacugaua

SEQ ID NO: 1488494 - RNA, 19 nt, Homo sapiens
gugaauagucaagagauuu

SEQ ID NO: 1488495 - RNA, 19 nt, Homo sapiens
ucaacagcugccuuaauua

SEQ ID NO: 1488496 - RNA, 19 nt, Homo sapiens
guucucuguuaccauauuu

SEQ ID NO: 1488497 - RNA, 19 nt, Homo sapiens
ucuccuaacucacuagauc

SEQ ID NO: 1488498 - RNA, 19 nt, Homo sapiens
caccacagauggaauuaac

SEQ ID NO: 1488499 - RNA, 19 nt, Homo sapiens
ugucauagcagaaccugaa

SEQ ID NO: 1488500 - RNA, 19 nt, Homo sapiens
agaagaacuuggaaacucu

SEQ ID NO: 1488501 - RNA, 19 nt, Homo sapiens
uuauggauuugcuuccuaa

SEQ ID NO: 1488502 - RNA, 19 nt, Homo sapiens
auauuuauguuccgcugua

SEQ ID NO: 1488503 - RNA, 19 nt, Homo sapiens
ugaauagucaagagauuug

SEQ ID NO: 1488504 - RNA, 19 nt, Homo sapiens
cagauggaauuaacuucau

SEQ ID NO: 1488505 - RNA, 19 nt, Homo sapiens
gacggagaaggcacucuua

SEQ ID NO: 1488506 - RNA, 19 nt, Homo sapiens
gaccauacuccagaaagaa

SEQ ID NO: 1488507 - RNA, 19 nt, Homo sapiens
gccuagguguucucgguuu

SEQ ID NO: 1488508 - RNA, 19 nt, Homo sapiens
ggagcugaguuaugucaac

SEQ ID NO: 1488509 - RNA, 19 nt, Homo sapiens
gucaagaaacugauaagau

SEQ ID NO: 1488510 - RNA, 19 nt, Homo sapiens
ugacugaacaggcaauaca

SEQ ID NO: 1488511 - RNA, 19 nt, Homo sapiens
gagaguggcuuucauauca

SEQ ID NO: 1488512 - RNA, 19 nt, Homo sapiens
gaaauugguuggagaauac

SEQ ID NO: 1488513 - RNA, 19 nt, Homo sapiens
caaaugggcuauucuuguu

SEQ ID NO: 1488514 - RNA, 19 nt, Homo sapiens
gaaacugccuacuacugua

SEQ ID NO: 1488515 - RNA, 19 nt, Homo sapiens
ugaagaagccgaagaagaa

SEQ ID NO: 1488516 - RNA, 19 nt, Homo sapiens
cagacuacauaaaggauua

SEQ ID NO: 1488517 - RNA, 19 nt, Homo sapiens
guagcacgguuaagacuuu

SEQ ID NO: 1488518 - RNA, 19 nt, Homo sapiens
ugaaauugguuggagaaua

SEQ ID NO: 1488519 - RNA, 19 nt, Homo sapiens
agaguacgcuucagcuuaa

SEQ ID NO: 1488520 - RNA, 19 nt, Homo sapiens
cacaagugcuucucauauu

SEQ ID NO: 1488521 - RNA, 19 nt, Homo sapiens
gccaagagcuuccaaacca

SEQ ID NO: 1488522 - RNA, 19 nt, Homo sapiens
cagcuuaacugauuugaag

SEQ ID NO: 1488523 - RNA, 19 nt, Homo sapiens
ucagagaaauuccaaaugg

SEQ ID NO: 1488524 - RNA, 19 nt, Homo sapiens
cagcacaccuccuauguag

SEQ ID NO: 1488525 - RNA, 19 nt, Homo sapiens
cgaggacacugaucagaga

SEQ ID NO: 1488526 - RNA, 19 nt, Homo sapiens
gaucagagaaauuccaaau

SEQ ID NO: 1488527 - RNA, 19 nt, Homo sapiens
acaagugcuucucauauug

SEQ ID NO: 1488528 - RNA, 19 nt, Homo sapiens
guacgucggugaaauuggu

SEQ ID NO: 1488529 - RNA, 19 nt, Homo sapiens
ccacaagugcuucucauau

SEQ ID NO: 1488530 - RNA, 19 nt, Homo sapiens
ggacacugaucagagaaau

SEQ ID NO: 1488531 - RNA, 19 nt, Homo sapiens
gaagaacuaagucaagcuu

SEQ ID NO: 1488532 - RNA, 19 nt, Homo sapiens
aaggaaacauuaaccucua

SEQ ID NO: 1488533 - RNA, 19 nt, Homo sapiens
gaagaagccgaagaagaaa

SEQ ID NO: 1488534 - RNA, 19 nt, Homo sapiens
uaaguacgucggugaaauu

SEQ ID NO: 1488535 - RNA, 19 nt, Homo sapiens
ccaaaugggcuauucuugu

SEQ ID NO: 1488536 - RNA, 19 nt, Homo sapiens
aagaguacgcuucagcuua

SEQ ID NO: 1488537 - RNA, 19 nt, Homo sapiens
gcauaacucaaccugcuuu

SEQ ID NO: 1488538 - RNA, 19 nt, Homo sapiens
gagaaacugccuacuacug

SEQ ID NO: 1488539 - RNA, 19 nt, Homo sapiens
uggugcagcuuaacugauu

SEQ ID NO: 1488540 - RNA, 19 nt, Homo sapiens
uaaaucagcauaacucaac

SEQ ID NO: 1488541 - RNA, 19 nt, Homo sapiens
ggaaacauuaaccucuaaa

SEQ ID NO: 1488542 - RNA, 19 nt, Homo sapiens
ggagaguggcuuucauauc

SEQ ID NO: 1488543 - RNA, 19 nt, Homo sapiens
ucaauaacccacagauauc

SEQ ID NO: 1488544 - RNA, 19 nt, Homo sapiens
guuggagaauaccacagua

SEQ ID NO: 1488545 - RNA, 19 nt, Homo sapiens
aaggagaaacugccuacua

SEQ ID NO: 1488546 - RNA, 19 nt, Homo sapiens
aggaaacauuaaccucuaa

SEQ ID NO: 1488547 - RNA, 19 nt, Homo sapiens
agaacagcaucuggcguua

SEQ ID NO: 1488548 - RNA, 19 nt, Homo sapiens
ucauaauaauccacaagug

SEQ ID NO: 1488549 - RNA, 19 nt, Homo sapiens
aggagaaacugccuacuac

SEQ ID NO: 1488550 - RNA, 19 nt, Homo sapiens
uagcacgguuaagacuuua

SEQ ID NO: 1488551 - RNA, 19 nt, Homo sapiens
gcaguguaagucaucauug

SEQ ID NO: 1488552 - RNA, 19 nt, Homo sapiens
acacugaucagagaaauuc

SEQ ID NO: 1488553 - RNA, 19 nt, Homo sapiens
caauaacccacagauauca

SEQ ID NO: 1488554 - RNA, 19 nt, Homo sapiens
cagcaucuggcguuagaaa

SEQ ID NO: 1488555 - RNA, 19 nt, Homo sapiens
aacagcaucuggcguuaga

SEQ ID NO: 1488556 - RNA, 19 nt, Homo sapiens
gguccagacuacauaaagg

SEQ ID NO: 1488557 - RNA, 19 nt, Homo sapiens
ucagcacaccuccuaugua

SEQ ID NO: 1488558 - RNA, 19 nt, Homo sapiens
ggugcagcuuaacugauuu

SEQ ID NO: 1488559 - RNA, 19 nt, Homo sapiens
uucaauaacccacagauau

SEQ ID NO: 1488560 - RNA, 19 nt, Homo sapiens
gaacagcaucuggcguuag

SEQ ID NO: 1488561 - RNA, 19 nt, Homo sapiens
gaucauaauaauccacaag

SEQ ID NO: 1488562 - RNA, 19 nt, Homo sapiens
acauuaaccucuaaaucag

SEQ ID NO: 1488563 - RNA, 19 nt, Homo sapiens
gagcuuccaaaccaccuaa

SEQ ID NO: 1488564 - RNA, 19 nt, Homo sapiens
gcuuaacugauuugaagaa

SEQ ID NO: 1488565 - RNA, 19 nt, Homo sapiens
ggugaaauugguuggagaa

SEQ ID NO: 1488566 - RNA, 19 nt, Homo sapiens
caucuacuacugugggaaa

SEQ ID NO: 1488567 - RNA, 19 nt, Homo sapiens
ccauggcaucuguaucaua

SEQ ID NO: 1488568 - RNA, 19 nt, Homo sapiens
agaaacugccuacuacugu

SEQ ID NO: 1488569 - RNA, 19 nt, Homo sapiens
gaaauuccaaaugggcuau

SEQ ID NO: 1488570 - RNA, 19 nt, Homo sapiens
caaaagccaacaucuacua

SEQ ID NO: 1488571 - RNA, 19 nt, Homo sapiens
caaguaugaagaacuaagu

SEQ ID NO: 1488572 - RNA, 19 nt, Homo sapiens
auaaguacgucggugaaau

SEQ ID NO: 1488573 - RNA, 19 nt, Homo sapiens
caagaguacgcuucagcuu

SEQ ID NO: 1488574 - RNA, 19 nt, Homo sapiens
uaaccucuaaaucagcaua

SEQ ID NO: 1488575 - RNA, 19 nt, Homo sapiens
aaaugggcuauucuuguua

SEQ ID NO: 1488576 - RNA, 19 nt, Homo sapiens
aaccucauguccuggauau

SEQ ID NO: 1488577 - RNA, 19 nt, Homo sapiens
guaugaagaacuaagucaa

SEQ ID NO: 1488578 - RNA, 19 nt, Homo sapiens
aagccaacaucuacuacug

SEQ ID NO: 1488579 - RNA, 19 nt, Homo sapiens
gccuacuacuguauaacaa

SEQ ID NO: 1488580 - RNA, 19 nt, Homo sapiens
gcagcuuaacugauuugaa

SEQ ID NO: 1488581 - RNA, 19 nt, Homo sapiens
aaacagagucgcgcuucuu

SEQ ID NO: 1488582 - RNA, 19 nt, Homo sapiens
gaacuaagucaagcuucuc

SEQ ID NO: 1488583 - RNA, 19 nt, Homo sapiens
gaguacgcuucagcuuaaa

SEQ ID NO: 1488584 - RNA, 19 nt, Homo sapiens
gaguggcuuucauaucaag

SEQ ID NO: 1488585 - RNA, 19 nt, Homo sapiens
cuggagaguggcuuucaua

SEQ ID NO: 1488586 - RNA, 19 nt, Homo sapiens
caucagcacaccuccuaug

SEQ ID NO: 1488587 - RNA, 19 nt, Homo sapiens
caaaacccauggcaaccaa

SEQ ID NO: 1488588 - RNA, 19 nt, Homo sapiens
uaagucaucauugccaaga

SEQ ID NO: 1488589 - RNA, 19 nt, Homo sapiens
agaguggcuuucauaucaa

SEQ ID NO: 1488590 - RNA, 19 nt, Homo sapiens
cuuaaagcccaaauaaaca

SEQ ID NO: 1488591 - RNA, 19 nt, Homo sapiens
cgaagaagaaaauccagua

SEQ ID NO: 1488592 - RNA, 19 nt, Homo sapiens
caguguaagucaucauugc

SEQ ID NO: 1488593 - RNA, 19 nt, Homo sapiens
ggcaguguaagucaucauu

SEQ ID NO: 1488594 - RNA, 19 nt, Homo sapiens
aaacugccuacuacuguau

SEQ ID NO: 1488595 - RNA, 19 nt, Homo sapiens
ccuggcauaugagugcuuu

SEQ ID NO: 1488596 - RNA, 19 nt, Homo sapiens
ccagacuacauaaaggauu

SEQ ID NO: 1488597 - RNA, 19 nt, Homo sapiens
uugaagaagccgaagaaga

SEQ ID NO: 1488598 - RNA, 19 nt, Homo sapiens
cauaaguacgucggugaaa

SEQ ID NO: 1488599 - RNA, 19 nt, Homo sapiens
uaacucaaccugcuuuuag

SEQ ID NO: 1488600 - RNA, 19 nt, Homo sapiens
agaagaaaauccaguagca

SEQ ID NO: 1488601 - RNA, 19 nt, Homo sapiens
guuaggcaguguaagucau

SEQ ID NO: 1488602 - RNA, 19 nt, Homo sapiens
aaugggcuauucuuguuag

SEQ ID NO: 1488603 - RNA, 19 nt, Homo sapiens
gacacugaucagagaaauu

SEQ ID NO: 1488604 - RNA, 19 nt, Homo sapiens
uggcuuucauaucaaguau

SEQ ID NO: 1488605 - RNA, 19 nt, Homo sapiens
uaauaauccacaagugcuu

SEQ ID NO: 1488606 - RNA, 19 nt, Homo sapiens
cuaaaucagcauaacucaa

SEQ ID NO: 1488607 - RNA, 19 nt, Homo sapiens
uacagguccagacuacaua

SEQ ID NO: 1488608 - RNA, 19 nt, Homo sapiens
aacagagucgcgcuucuuu

SEQ ID NO: 1488609 - RNA, 19 nt, Homo sapiens
uuacagguccagacuacau

SEQ ID NO: 1488610 - RNA, 19 nt, Homo sapiens
agccauggcaucuguauca

SEQ ID NO: 1488611 - RNA, 19 nt, Homo sapiens
ggaaagcaauuaaacacaa

SEQ ID NO: 1488612 - RNA, 19 nt, Homo sapiens
gcacggauccuuacaaugu

SEQ ID NO: 1488613 - RNA, 19 nt, Homo sapiens
ggaauaccuugacuucauu

SEQ ID NO: 1488614 - RNA, 19 nt, Homo sapiens
ggacauguauggaccacaa

SEQ ID NO: 1488615 - RNA, 19 nt, Homo sapiens
gggaauaccuugacuucau

SEQ ID NO: 1488616 - RNA, 19 nt, Homo sapiens
cagagaagcuuccguggau

SEQ ID NO: 1488617 - RNA, 19 nt, Homo sapiens
gagcagggauccaccagau

SEQ ID NO: 1488618 - RNA, 19 nt, Homo sapiens
aaagaggacucaguacauu

SEQ ID NO: 1488619 - RNA, 19 nt, Homo sapiens
gaaagcaauuaaacacaag

SEQ ID NO: 1488620 - RNA, 19 nt, Homo sapiens
gcagggauccaccagauug

SEQ ID NO: 1488621 - RNA, 19 nt, Homo sapiens
gcagcaucuucauaucaua

SEQ ID NO: 1488622 - RNA, 19 nt, Homo sapiens
gaaccguauuucauaaaca

SEQ ID NO: 1488623 - RNA, 19 nt, Homo sapiens
gaagacugccucaggauuc

SEQ ID NO: 1488624 - RNA, 19 nt, Homo sapiens
gcaauuaaacacaagaagu

SEQ ID NO: 1488625 - RNA, 19 nt, Homo sapiens
gaggagacacuguggaaga

SEQ ID NO: 1488626 - RNA, 19 nt, Homo sapiens
ccaccuggcugggagcuuu

SEQ ID NO: 1488627 - RNA, 19 nt, Homo sapiens
gaacucacaccauggauac

SEQ ID NO: 1488628 - RNA, 19 nt, Homo sapiens
gagaggagacacuguggaa

SEQ ID NO: 1488629 - RNA, 19 nt, Homo sapiens
cgaaaugggaguuugaaga

SEQ ID NO: 1488630 - RNA, 19 nt, Homo sapiens
agaggaagaugcaaucaca

SEQ ID NO: 1488631 - RNA, 19 nt, Homo sapiens
gaaaugggaguuugaagac

SEQ ID NO: 1488632 - RNA, 19 nt, Homo sapiens
gagaagcuuccguggauga

SEQ ID NO: 1488633 - RNA, 19 nt, Homo sapiens
gggcuucaccuguggguuu

SEQ ID NO: 1488634 - RNA, 19 nt, Homo sapiens
gaauaccuugacuucauua

SEQ ID NO: 1488635 - RNA, 19 nt, Homo sapiens
gugcacggauccuuacaau

SEQ ID NO: 1488636 - RNA, 19 nt, Homo sapiens
gagacacuguggaagacaa

SEQ ID NO: 1488637 - RNA, 19 nt, Homo sapiens
gacccuggcuaccuggauu

SEQ ID NO: 1488638 - RNA, 19 nt, Homo sapiens
gagucugucucguuggaaa

SEQ ID NO: 1488639 - RNA, 19 nt, Homo sapiens
uaccuugacuucauuaaag

SEQ ID NO: 1488640 - RNA, 19 nt, Homo sapiens
aaacaucacacgccagaga

SEQ ID NO: 1488641 - RNA, 19 nt, Homo sapiens
gauugugcacggauccuua

SEQ ID NO: 1488642 - RNA, 19 nt, Homo sapiens
cgaggaagaagauuucaug

SEQ ID NO: 1488643 - RNA, 19 nt, Homo sapiens
gcaguacagcagcaagaaa

SEQ ID NO: 1488644 - RNA, 19 nt, Homo sapiens
gcagccaggucuuccuaca

SEQ ID NO: 1488645 - RNA, 19 nt, Homo sapiens
uuagaggcguaggcaaaua

SEQ ID NO: 1488646 - RNA, 19 nt, Homo sapiens
cagcaucuucauaucauaa

SEQ ID NO: 1488647 - RNA, 19 nt, Homo sapiens
guagcgaauuuacuguuag

SEQ ID NO: 1488648 - RNA, 19 nt, Homo sapiens
ggauugauguccgaagaag

SEQ ID NO: 1488649 - RNA, 19 nt, Homo sapiens
gcgcagcaucuucauauca

SEQ ID NO: 1488650 - RNA, 19 nt, Homo sapiens
cugacugccuggcuuguuu

SEQ ID NO: 1488651 - RNA, 19 nt, Homo sapiens
gaggaagaagauuucauga

SEQ ID NO: 1488652 - RNA, 19 nt, Homo sapiens
cuacaauugccgcuucuuu

SEQ ID NO: 1488653 - RNA, 19 nt, Homo sapiens
gaugaacucacaccaugga

SEQ ID NO: 1488654 - RNA, 19 nt, Homo sapiens
uaaccauucugaugaacuc

SEQ ID NO: 1488655 - RNA, 19 nt, Homo sapiens
ugucaggcuugcuauguug

SEQ ID NO: 1488656 - RNA, 19 nt, Homo sapiens
gugcgcagcaucuucauau

SEQ ID NO: 1488657 - RNA, 19 nt, Homo sapiens
gccagagaagccacaguua

SEQ ID NO: 1488658 - RNA, 19 nt, Homo sapiens
agaggacucaguacauuaa

SEQ ID NO: 1488659 - RNA, 19 nt, Homo sapiens
ggacucaguacauuaagag

SEQ ID NO: 1488660 - RNA, 19 nt, Homo sapiens
gaaaagaggacucaguaca

SEQ ID NO: 1488661 - RNA, 19 nt, Homo sapiens
caaaagagucugucucguu

SEQ ID NO: 1488662 - RNA, 19 nt, Homo sapiens
ugaacucacaccauggaua

SEQ ID NO: 1488663 - RNA, 19 nt, Homo sapiens
gaugcaaucacacccaaug

SEQ ID NO: 1488664 - RNA, 19 nt, Homo sapiens
ggauggggcuccucgagaa

SEQ ID NO: 1488665 - RNA, 19 nt, Homo sapiens
cugccuggcuuguuucaga

SEQ ID NO: 1488666 - RNA, 19 nt, Homo sapiens
aagaggacucaguacauua

SEQ ID NO: 1488667 - RNA, 19 nt, Homo sapiens
uaagcuggccaucguauca

SEQ ID NO: 1488668 - RNA, 19 nt, Homo sapiens
cgaagacugccucaggauu

SEQ ID NO: 1488669 - RNA, 19 nt, Homo sapiens
ucccugauguugauugguu

SEQ ID NO: 1488670 - RNA, 19 nt, Homo sapiens
gugucaggcuugcuauguu

SEQ ID NO: 1488671 - RNA, 19 nt, Homo sapiens
ggaguuugaagaccuggaa

SEQ ID NO: 1488672 - RNA, 19 nt, Homo sapiens
acuguuagguggaaagcaa

SEQ ID NO: 1488673 - RNA, 19 nt, Homo sapiens
gguuucacguggacgaaga

SEQ ID NO: 1488674 - RNA, 19 nt, Homo sapiens
ccaggucuuccuacaauug

SEQ ID NO: 1488675 - RNA, 19 nt, Homo sapiens
acagugaugaaccguauuu

SEQ ID NO: 1488676 - RNA, 19 nt, Homo sapiens
ucucugcucuggcuguguu

SEQ ID NO: 1488677 - RNA, 19 nt, Homo sapiens
ccugauggcugcgcucugu

SEQ ID NO: 1488678 - RNA, 19 nt, Homo sapiens
ccaagugguuuugcaagua

SEQ ID NO: 1488679 - RNA, 19 nt, Homo sapiens
gccagggucggguguguaa

SEQ ID NO: 1488680 - RNA, 19 nt, Homo sapiens
cagaugcagccgcuugaaa

SEQ ID NO: 1488681 - RNA, 19 nt, Homo sapiens
cgguaaccauucugaugaa

SEQ ID NO: 1488682 - RNA, 19 nt, Homo sapiens
aaaggugucaggcuugcua

SEQ ID NO: 1488683 - RNA, 19 nt, Homo sapiens
gguggaaagcaauuaaaca

SEQ ID NO: 1488684 - RNA, 19 nt, Homo sapiens
cugcuucuuugacuucauu

SEQ ID NO: 1488685 - RNA, 19 nt, Homo sapiens
agccaggucuuccuacaau

SEQ ID NO: 1488686 - RNA, 19 nt, Homo sapiens
uacaauugccgcuucuuug

SEQ ID NO: 1488687 - RNA, 19 nt, Homo sapiens
gcuaagcuggccaucguau

SEQ ID NO: 1488688 - RNA, 19 nt, Homo sapiens
aaagcaaccggaagcgaaa

SEQ ID NO: 1488689 - RNA, 19 nt, Homo sapiens
gccaggucuuccuacaauu

SEQ ID NO: 1488690 - RNA, 19 nt, Homo sapiens
cagagaagccacaguuacu

SEQ ID NO: 1488691 - RNA, 19 nt, Homo sapiens
ccagagaagccacaguuac

SEQ ID NO: 1488692 - RNA, 19 nt, Homo sapiens
aagagucugucucguugga

SEQ ID NO: 1488693 - RNA, 19 nt, Homo sapiens
ucgguaaccauucugauga

SEQ ID NO: 1488694 - RNA, 19 nt, Homo sapiens
gcaucuucauaucauaaag

SEQ ID NO: 1488695 - RNA, 19 nt, Homo sapiens
gaaugggagaguucacauc

SEQ ID NO: 1488696 - RNA, 19 nt, Homo sapiens
gaagcuuccguggaugaaa

SEQ ID NO: 1488697 - RNA, 19 nt, Homo sapiens
ggcuugcuauguugagguu

SEQ ID NO: 1488698 - RNA, 19 nt, Homo sapiens
gaaacgugcgcagcaucuu

SEQ ID NO: 1488699 - RNA, 19 nt, Homo sapiens
caaccggaagcgaaacaga

SEQ ID NO: 1488700 - RNA, 19 nt, Homo sapiens
ggaggcagaguaagaagac

SEQ ID NO: 1488701 - RNA, 19 nt, Homo sapiens
cgcagcaucuucauaucau

SEQ ID NO: 1488702 - RNA, 19 nt, Homo sapiens
ccaggcagagggauugaug

SEQ ID NO: 1488703 - RNA, 19 nt, Homo sapiens
gggauugauguccgaagaa

SEQ ID NO: 1488704 - RNA, 19 nt, Homo sapiens
cagcguuucucaccacacu

SEQ ID NO: 1488705 - RNA, 19 nt, Homo sapiens
gcugguucuucaugcauca

SEQ ID NO: 1488706 - RNA, 19 nt, Homo sapiens
uuagguggaaagcaauuaa

SEQ ID NO: 1488707 - RNA, 19 nt, Homo sapiens
guuagguggaaagcaauua

SEQ ID NO: 1488708 - RNA, 19 nt, Homo sapiens
aggcugagcgugugaggaa

SEQ ID NO: 1488709 - RNA, 19 nt, Homo sapiens
gcaggccaucaguacagua

SEQ ID NO: 1488710 - RNA, 19 nt, Homo sapiens
agggauugauguccgaaga

SEQ ID NO: 1488711 - RNA, 19 nt, Homo sapiens
gaaagaauguccagcaaau

SEQ ID NO: 1488712 - RNA, 19 nt, Homo sapiens
gagcaagaaugauugagua

SEQ ID NO: 1488713 - RNA, 19 nt, Homo sapiens
gaagcugacugcagacuuu

SEQ ID NO: 1488714 - RNA, 19 nt, Homo sapiens
gauaaucucugguaugaau

SEQ ID NO: 1488715 - RNA, 19 nt, Homo sapiens
gagcagacauacagaaaga

SEQ ID NO: 1488716 - RNA, 19 nt, Homo sapiens
gcgauaaucucugguauga

SEQ ID NO: 1488717 - RNA, 19 nt, Homo sapiens
gaagaaaacacgaaacuua

SEQ ID NO: 1488718 - RNA, 19 nt, Homo sapiens
ugaagacacuugagaaaga

SEQ ID NO: 1488719 - RNA, 19 nt, Homo sapiens
uaaugaagcucaacacugu

SEQ ID NO: 1488720 - RNA, 19 nt, Homo sapiens
gaagacacuugagaaagaa

SEQ ID NO: 1488721 - RNA, 19 nt, Homo sapiens
gauaagaaccagaugagaa

SEQ ID NO: 1488722 - RNA, 19 nt, Homo sapiens
aaccuuagcucaaccagua

SEQ ID NO: 1488723 - RNA, 19 nt, Homo sapiens
ugaagaugcucucuacuug

SEQ ID NO: 1488724 - RNA, 19 nt, Homo sapiens
ugaagacccugcagucauu

SEQ ID NO: 1488725 - RNA, 19 nt, Homo sapiens
uggagaggcucaauuauau

SEQ ID NO: 1488726 - RNA, 19 nt, Homo sapiens
uaagugauccugauaguga

SEQ ID NO: 1488727 - RNA, 19 nt, Homo sapiens
ccaaacaagugagugaauu

SEQ ID NO: 1488728 - RNA, 19 nt, Homo sapiens
gaugaaagaaugaugagaa

SEQ ID NO: 1488729 - RNA, 19 nt, Homo sapiens
gagaaagaauccucuaaaa

SEQ ID NO: 1488730 - RNA, 19 nt, Homo sapiens
ccaauggccaugucaauuu

SEQ ID NO: 1488731 - RNA, 19 nt, Homo sapiens
cuuagaagcuuacguggaa

SEQ ID NO: 1488732 - RNA, 19 nt, Homo sapiens
gaacuggccaaacaaguga

SEQ ID NO: 1488733 - RNA, 19 nt, Homo sapiens
gagcuaauggccaaaguuu

SEQ ID NO: 1488734 - RNA, 19 nt, Homo sapiens
gaaaucuguaugccuguua

SEQ ID NO: 1488735 - RNA, 19 nt, Homo sapiens
aaagggauaucauuacugu

SEQ ID NO: 1488736 - RNA, 19 nt, Homo sapiens
ccagauagaacauacauau

SEQ ID NO: 1488737 - RNA, 19 nt, Homo sapiens
cacacaagcucacucaaga

SEQ ID NO: 1488738 - RNA, 19 nt, Homo sapiens
gaaagaaugaugagaaacu

SEQ ID NO: 1488739 - RNA, 19 nt, Homo sapiens
gcucaacacugugguagga

SEQ ID NO: 1488740 - RNA, 19 nt, Homo sapiens
gcucauaguaguagagaaa

SEQ ID NO: 1488741 - RNA, 19 nt, Homo sapiens
ugacguagcucgggagugu

SEQ ID NO: 1488742 - RNA, 19 nt, Homo sapiens
caaaugaugcagugucuga

SEQ ID NO: 1488743 - RNA, 19 nt, Homo sapiens
ugacagcagugguuacaau

SEQ ID NO: 1488744 - RNA, 19 nt, Homo sapiens
caaccaguauugccagaga

SEQ ID NO: 1488745 - RNA, 19 nt, Homo sapiens
caaacaagugagugaauuu

SEQ ID NO: 1488746 - RNA, 19 nt, Homo sapiens
gaagagcagacauacagaa

SEQ ID NO: 1488747 - RNA, 19 nt, Homo sapiens
gauggacccuucaagcaau

SEQ ID NO: 1488748 - RNA, 19 nt, Homo sapiens
gcagcugacucauauagag

SEQ ID NO: 1488749 - RNA, 19 nt, Homo sapiens
ccagauggagaacuuauuu

SEQ ID NO: 1488750 - RNA, 19 nt, Homo sapiens
cggaagaucuugcaguauc

SEQ ID NO: 1488751 - RNA, 19 nt, Homo sapiens
ggaguucaccugcaggaaa

SEQ ID NO: 1488752 - RNA, 19 nt, Homo sapiens
ucacaguucucaagaccaa

SEQ ID NO: 1488753 - RNA, 19 nt, Homo sapiens
caagugagugaauuuauga

SEQ ID NO: 1488754 - RNA, 19 nt, Homo sapiens
agaucuggcucaccgaaua

SEQ ID NO: 1488755 - RNA, 19 nt, Homo sapiens
cuacuuggcuucuuaugag

SEQ ID NO: 1488756 - RNA, 19 nt, Homo sapiens
ugagugaauuuaugacaug

SEQ ID NO: 1488757 - RNA, 19 nt, Homo sapiens
acaagugagugaauuuaug

SEQ ID NO: 1488758 - RNA, 19 nt, Homo sapiens
cacgaaacuuagaagcuua

SEQ ID NO: 1488759 - RNA, 19 nt, Homo sapiens
cagaaagaauguccagcaa

SEQ ID NO: 1488760 - RNA, 19 nt, Homo sapiens
ugacaagaguugcuacagu

SEQ ID NO: 1488761 - RNA, 19 nt, Homo sapiens
ugagaaagaauccucuaaa

SEQ ID NO: 1488762 - RNA, 19 nt, Homo sapiens
ggaacuggccaaacaagug

SEQ ID NO: 1488763 - RNA, 19 nt, Homo sapiens
cuacuugguugcuacagaa

SEQ ID NO: 1488764 - RNA, 19 nt, Homo sapiens
acacgaaacuuagaagcuu

SEQ ID NO: 1488765 - RNA, 19 nt, Homo sapiens
ugaguuggcugcugguuag

SEQ ID NO: 1488766 - RNA, 19 nt, Homo sapiens
gugaauuuaugacauggaa

SEQ ID NO: 1488767 - RNA, 19 nt, Homo sapiens
aaacaccgagcaagaauga

SEQ ID NO: 1488768 - RNA, 19 nt, Homo sapiens
gcuguggaggguuguauua

SEQ ID NO: 1488769 - RNA, 19 nt, Homo sapiens
cuuaguaugugcuguguug

SEQ ID NO: 1488770 - RNA, 19 nt, Homo sapiens
guugaacauuugcugcuaa

SEQ ID NO: 1488771 - RNA, 19 nt, Homo sapiens
gcacacaagcucacucaag

SEQ ID NO: 1488772 - RNA, 19 nt, Homo sapiens
gcaagaaugauugaguauu

SEQ ID NO: 1488773 - RNA, 19 nt, Homo sapiens
gagacuaagugauccugau

SEQ ID NO: 1488774 - RNA, 19 nt, Homo sapiens
aggcagaguuuaacacaug

SEQ ID NO: 1488775 - RNA, 19 nt, Homo sapiens
aagcuuacguggaaugguu

SEQ ID NO: 1488776 - RNA, 19 nt, Homo sapiens
cuggagaggcucaauuaua

SEQ ID NO: 1488777 - RNA, 19 nt, Homo sapiens
ccuacucaguucucgguua

SEQ ID NO: 1488778 - RNA, 19 nt, Homo sapiens
ccacgaacgcucaugaaga

SEQ ID NO: 1488779 - RNA, 19 nt, Homo sapiens
gagaaagacagauggaagu

SEQ ID NO: 1488780 - RNA, 19 nt, Homo sapiens
ggagaggcucaauuauauu

SEQ ID NO: 1488781 - RNA, 19 nt, Homo sapiens
acgaagaaguccuggcaaa

SEQ ID NO: 1488782 - RNA, 19 nt, Homo sapiens
gcagacauacagaaagaau

SEQ ID NO: 1488783 - RNA, 19 nt, Homo sapiens
cuacucaguucucgguuau

SEQ ID NO: 1488784 - RNA, 19 nt, Homo sapiens
ucaacacugugguaggaaa

SEQ ID NO: 1488785 - RNA, 19 nt, Homo sapiens
gaagcucaacacuguggua

SEQ ID NO: 1488786 - RNA, 19 nt, Homo sapiens
gugaagaugcucucuacuu

SEQ ID NO: 1488787 - RNA, 19 nt, Homo sapiens
aagaauguccagcaaauga

SEQ ID NO: 1488788 - RNA, 19 nt, Homo sapiens
gcgaagagcagacauacag

SEQ ID NO: 1488789 - RNA, 19 nt, Homo sapiens
acucaguucucgguuauuu

SEQ ID NO: 1488790 - RNA, 19 nt, Homo sapiens
auauuuaccuuccuacuca

SEQ ID NO: 1488791 - RNA, 19 nt, Homo sapiens
uaugugcuguguuguaaau

SEQ ID NO: 1488792 - RNA, 19 nt, Homo sapiens
ugacagauagacucagauu

SEQ ID NO: 1488793 - RNA, 19 nt, Homo sapiens
ccacagaucggcucacagu

SEQ ID NO: 1488794 - RNA, 19 nt, Homo sapiens
ugugcuguguuguaaauuu

SEQ ID NO: 1488795 - RNA, 19 nt, Homo sapiens
gagagugaaggaccugaaa

SEQ ID NO: 1488796 - RNA, 19 nt, Homo sapiens
gaguucaccugcaggaaag

SEQ ID NO: 1488797 - RNA, 19 nt, Homo sapiens
cuguaugccuguuaagaaa

SEQ ID NO: 1488798 - RNA, 19 nt, Homo sapiens
gcuacuugguugcuacaga

SEQ ID NO: 1488799 - RNA, 19 nt, Homo sapiens
auaagaaccagaugagaaa

SEQ ID NO: 1488800 - RNA, 19 nt, Homo sapiens
gcacucauccagcacuuag

SEQ ID NO: 1488801 - RNA, 19 nt, Homo sapiens
aguaugugcuguguuguaa

SEQ ID NO: 1488802 - RNA, 19 nt, Homo sapiens
aaaucuguaugccuguuaa

SEQ ID NO: 1488803 - RNA, 19 nt, Homo sapiens
acaaagggauaucauuacu

SEQ ID NO: 1488804 - RNA, 19 nt, Homo sapiens
agacuaagugauccugaua

SEQ ID NO: 1488805 - RNA, 19 nt, Homo sapiens
gguugaacauuugcugcua

SEQ ID NO: 1488806 - RNA, 19 nt, Homo sapiens
gaauaugagcccagucucu

SEQ ID NO: 1488807 - RNA, 19 nt, Homo sapiens
cagcagugguuacaaucga

SEQ ID NO: 1488808 - RNA, 19 nt, Homo sapiens
gaccaagccacagucuaua

SEQ ID NO: 1488809 - RNA, 19 nt, Homo sapiens
gcucagccaguacgaagaa

SEQ ID NO: 1488810 - RNA, 19 nt, Homo sapiens
guugagcaccagagacuaa

SEQ ID NO: 1488811 - RNA, 19 nt, Homo sapiens
ccaagaagcuggaggagua

SEQ ID NO: 1488812 - RNA, 19 nt, Homo sapiens
ggaaacagccucucucuuu

SEQ ID NO: 1488813 - RNA, 19 nt, Homo sapiens
guaacuaucucaccuaaug

SEQ ID NO: 1488814 - RNA, 19 nt, Homo sapiens
ugaaagagaguaugcauua

SEQ ID NO: 1488815 - RNA, 19 nt, Homo sapiens
gcaagacuaucaacuccua

SEQ ID NO: 1488816 - RNA, 19 nt, Homo sapiens
gagcaaaggcccuggguaa

SEQ ID NO: 1488817 - RNA, 19 nt, Homo sapiens
guaauaauguacagaggaa

SEQ ID NO: 1488818 - RNA, 19 nt, Homo sapiens
gcacaucacuaaccacuac

SEQ ID NO: 1488819 - RNA, 19 nt, Homo sapiens
agaaggagcgcaacaguua

SEQ ID NO: 1488820 - RNA, 19 nt, Homo sapiens
gcucuaggcuguucuguag

SEQ ID NO: 1488821 - RNA, 19 nt, Homo sapiens
gagcuggccuucugcaaga

SEQ ID NO: 1488822 - RNA, 19 nt, Homo sapiens
ccauggagauguacaaaga

SEQ ID NO: 1488823 - RNA, 19 nt, Homo sapiens
caaaggcccuggguaagaa

SEQ ID NO: 1488824 - RNA, 19 nt, Homo sapiens
ccaaggccauugaggagua

SEQ ID NO: 1488825 - RNA, 19 nt, Homo sapiens
gcauuuguguguuggcuuu

SEQ ID NO: 1488826 - RNA, 19 nt, Homo sapiens
gggauaggcuaaggaguaa

SEQ ID NO: 1488827 - RNA, 19 nt, Homo sapiens
ggagauguacaaagaguuu

SEQ ID NO: 1488828 - RNA, 19 nt, Homo sapiens
aaugagaggucccaucuga

SEQ ID NO: 1488829 - RNA, 19 nt, Homo sapiens
gaaacagccucucucuuuu

SEQ ID NO: 1488830 - RNA, 19 nt, Homo sapiens
agaggaagcuguugguguu

SEQ ID NO: 1488831 - RNA, 19 nt, Homo sapiens
guguuugacuguaauguaa

SEQ ID NO: 1488832 - RNA, 19 nt, Homo sapiens
ggaaggggcuuuuagaugu

SEQ ID NO: 1488833 - RNA, 19 nt, Homo sapiens
gcaaaggcccuggguaaga

SEQ ID NO: 1488834 - RNA, 19 nt, Homo sapiens
ccaaacagaagaucauuga

SEQ ID NO: 1488835 - RNA, 19 nt, Homo sapiens
aggaagaacugaagaagga

SEQ ID NO: 1488836 - RNA, 19 nt, Homo sapiens
gagcaugaguggaccaaca

SEQ ID NO: 1488837 - RNA, 19 nt, Homo sapiens
gaaagagaguaugcauuag

SEQ ID NO: 1488838 - RNA, 19 nt, Homo sapiens
ggaagcuguugguguucua

SEQ ID NO: 1488839 - RNA, 19 nt, Homo sapiens
uacagacucuucacagauu

SEQ ID NO: 1488840 - RNA, 19 nt, Homo sapiens
gaacacaggggccuuuuaa

SEQ ID NO: 1488841 - RNA, 19 nt, Homo sapiens
ccaaaccuccugucaguga

SEQ ID NO: 1488842 - RNA, 19 nt, Homo sapiens
uaaauguucuugguguuug

SEQ ID NO: 1488843 - RNA, 19 nt, Homo sapiens
gcuuggcucuugaccauga

SEQ ID NO: 1488844 - RNA, 19 nt, Homo sapiens
guaaguaugugaaaaggaa

SEQ ID NO: 1488845 - RNA, 19 nt, Homo sapiens
ugcagaagauggugauuga

SEQ ID NO: 1488846 - RNA, 19 nt, Homo sapiens
aagagaguaugcauuagaa

SEQ ID NO: 1488847 - RNA, 19 nt, Homo sapiens
caugaacgcgcaguuguua

SEQ ID NO: 1488848 - RNA, 19 nt, Homo sapiens
gauggaaacugccaaaccu

SEQ ID NO: 1488849 - RNA, 19 nt, Homo sapiens
guaaauguucuugguguuu

SEQ ID NO: 1488850 - RNA, 19 nt, Homo sapiens
ggacaacgagcaccucauc

SEQ ID NO: 1488851 - RNA, 19 nt, Homo sapiens
gaagaaggagcgcaacagu

SEQ ID NO: 1488852 - RNA, 19 nt, Homo sapiens
uugcuuaacuuccauguuc

SEQ ID NO: 1488853 - RNA, 19 nt, Homo sapiens
agaagauggugauugagaa

SEQ ID NO: 1488854 - RNA, 19 nt, Homo sapiens
gagcauaguauccaaacug

SEQ ID NO: 1488855 - RNA, 19 nt, Homo sapiens
gaguaugcauuagaaacaa

SEQ ID NO: 1488856 - RNA, 19 nt, Homo sapiens
gaaggaccacgcagagaug

SEQ ID NO: 1488857 - RNA, 19 nt, Homo sapiens
cugcgaaucuccaccaaga

SEQ ID NO: 1488858 - RNA, 19 nt, Homo sapiens
ggacagcccagaacugaag

SEQ ID NO: 1488859 - RNA, 19 nt, Homo sapiens
ccaacgagccugaucuuca

SEQ ID NO: 1488860 - RNA, 19 nt, Homo sapiens
caucagcgccucccucuuc

SEQ ID NO: 1488861 - RNA, 19 nt, Homo sapiens
gaaggggcuuuuagaugua

SEQ ID NO: 1488862 - RNA, 19 nt, Homo sapiens
gcacugagcaccccaggua

SEQ ID NO: 1488863 - RNA, 19 nt, Homo sapiens
aggaagagguggucaucaa

SEQ ID NO: 1488864 - RNA, 19 nt, Homo sapiens
acagaggccugacugacuu

SEQ ID NO: 1488865 - RNA, 19 nt, Homo sapiens
ccuaaugguuguacauauc

SEQ ID NO: 1488866 - RNA, 19 nt, Homo sapiens
cgagagccuuauuuaccua

SEQ ID NO: 1488867 - RNA, 19 nt, Homo sapiens
gcucaagacggacaauguu

SEQ ID NO: 1488868 - RNA, 19 nt, Homo sapiens
ugcaauuucuguacauuug

SEQ ID NO: 1488869 - RNA, 19 nt, Homo sapiens
cagcugagcgggauaagug

SEQ ID NO: 1488870 - RNA, 19 nt, Homo sapiens
guacagacucuucacagau

SEQ ID NO: 1488871 - RNA, 19 nt, Homo sapiens
cugccaagcugggaaguuu

SEQ ID NO: 1488872 - RNA, 19 nt, Homo sapiens
aaagagaguaugcauuaga

SEQ ID NO: 1488873 - RNA, 19 nt, Homo sapiens
gagcucagccaagcagaaa

SEQ ID NO: 1488874 - RNA, 19 nt, Homo sapiens
caacgagcaccucaucuuc

SEQ ID NO: 1488875 - RNA, 19 nt, Homo sapiens
gaaucuagagaacaguauu

SEQ ID NO: 1488876 - RNA, 19 nt, Homo sapiens
cagaagauggugauugaga

SEQ ID NO: 1488877 - RNA, 19 nt, Homo sapiens
acaagaagaagaagaagga

SEQ ID NO: 1488878 - RNA, 19 nt, Homo sapiens
ucccaaggguuuuauuuua

SEQ ID NO: 1488879 - RNA, 19 nt, Homo sapiens
uuuccggucugauagauuu

SEQ ID NO: 1488880 - RNA, 19 nt, Homo sapiens
gguguuugacuguaaugua

SEQ ID NO: 1488881 - RNA, 19 nt, Homo sapiens
caguuaggcuagagacaga

SEQ ID NO: 1488882 - RNA, 19 nt, Homo sapiens
gccagacuguccagggaaa

SEQ ID NO: 1488883 - RNA, 19 nt, Homo sapiens
agaagcuggugcuggagua

SEQ ID NO: 1488884 - RNA, 19 nt, Homo sapiens
gcagagcauaguauccaaa

SEQ ID NO: 1488885 - RNA, 19 nt, Homo sapiens
gcaaggaggaauacauguc

SEQ ID NO: 1488886 - RNA, 19 nt, Homo sapiens
ugccaaaccuccugucagu

SEQ ID NO: 1488887 - RNA, 19 nt, Homo sapiens
gcgcacugcaugggaaaua

SEQ ID NO: 1488888 - RNA, 19 nt, Homo sapiens
gggauaaguggauggagaa

SEQ ID NO: 1488889 - RNA, 19 nt, Homo sapiens
ggaguugaaagagguguuu

SEQ ID NO: 1488890 - RNA, 19 nt, Homo sapiens
uaucucaccuaaugguugu

SEQ ID NO: 1488891 - RNA, 19 nt, Homo sapiens
uguacagacucuucacaga

SEQ ID NO: 1488892 - RNA, 19 nt, Homo sapiens
agggauaggcuaaggagua

SEQ ID NO: 1488893 - RNA, 19 nt, Homo sapiens
cagcaaggaggaauacaug

SEQ ID NO: 1488894 - RNA, 19 nt, Homo sapiens
gagcggugcaucccaacaa

SEQ ID NO: 1488895 - RNA, 19 nt, Homo sapiens
gaacgcgcaguuguuagaa

SEQ ID NO: 1488896 - RNA, 19 nt, Homo sapiens
ccgcuuggcucuugaccau

SEQ ID NO: 1488897 - RNA, 19 nt, Homo sapiens
gcacaagcagggcccuuca

SEQ ID NO: 1488898 - RNA, 19 nt, Homo sapiens
gagcagagcauaguaucca

SEQ ID NO: 1488899 - RNA, 19 nt, Homo sapiens
ucgccaaggucacccagaa

SEQ ID NO: 1488900 - RNA, 19 nt, Homo sapiens
caacuccuacugugucuuc

SEQ ID NO: 1488901 - RNA, 19 nt, Homo sapiens
agaacacacuggccaccaa

SEQ ID NO: 1488902 - RNA, 19 nt, Homo sapiens
gcacgggcaaggugaagga

SEQ ID NO: 1488903 - RNA, 19 nt, Homo sapiens
cuguguggcugugcaauuu

SEQ ID NO: 1488904 - RNA, 19 nt, Homo sapiens
uaugagacccuguucaagu

SEQ ID NO: 1488905 - RNA, 19 nt, Homo sapiens
gcccgcagcucgaguuacu

SEQ ID NO: 1488906 - RNA, 19 nt, Homo sapiens
caucugcccuggugcacau

SEQ ID NO: 1488907 - RNA, 19 nt, Homo sapiens
gcugugcaauuucuguaca

SEQ ID NO: 1488908 - RNA, 19 nt, Homo sapiens
gagccuuauuuaccuagug

SEQ ID NO: 1488909 - RNA, 19 nt, Homo sapiens
ccacagggauaggcuaagg

SEQ ID NO: 1488910 - RNA, 19 nt, Homo sapiens
gcgucggccucaccugauu

SEQ ID NO: 1488911 - RNA, 19 nt, Homo sapiens
ugaaauaccucaacuguuu

SEQ ID NO: 1488912 - RNA, 19 nt, Homo sapiens
gacaacagcucuaugauuu

SEQ ID NO: 1488913 - RNA, 19 nt, Homo sapiens
caagagcucucaugauauu

SEQ ID NO: 1488914 - RNA, 19 nt, Homo sapiens
gagauaagauuucaguuuc

SEQ ID NO: 1488915 - RNA, 19 nt, Homo sapiens
gaagagugcuauguguaua

SEQ ID NO: 1488916 - RNA, 19 nt, Homo sapiens
gauaaaaggugguggauuu

SEQ ID NO: 1488917 - RNA, 19 nt, Homo sapiens
ugagguagaucaugaaaga

SEQ ID NO: 1488918 - RNA, 19 nt, Homo sapiens
uucaagagcucucaugaua

SEQ ID NO: 1488919 - RNA, 19 nt, Homo sapiens
uaggagggaucauaagaua

SEQ ID NO: 1488920 - RNA, 19 nt, Homo sapiens
gaacaucuauacuaagcau

SEQ ID NO: 1488921 - RNA, 19 nt, Homo sapiens
ggagggaucauaagauauu

SEQ ID NO: 1488922 - RNA, 19 nt, Homo sapiens
ggacuggccuuuguauuca

SEQ ID NO: 1488923 - RNA, 19 nt, Homo sapiens
gaacaacaagaaacaagaa

SEQ ID NO: 1488924 - RNA, 19 nt, Homo sapiens
uggcaaauaugaauaguga

SEQ ID NO: 1488925 - RNA, 19 nt, Homo sapiens
caagagaauucauuacuac

SEQ ID NO: 1488926 - RNA, 19 nt, Homo sapiens
gggcguggcuaaccugauu

SEQ ID NO: 1488927 - RNA, 19 nt, Homo sapiens
ugacauggccuaaauuaau

SEQ ID NO: 1488928 - RNA, 19 nt, Homo sapiens
uggaaugugugucaucaua

SEQ ID NO: 1488929 - RNA, 19 nt, Homo sapiens
uuucaagucuccuucauuu

SEQ ID NO: 1488930 - RNA, 19 nt, Homo sapiens
gauccuggaccuaugaaua

SEQ ID NO: 1488931 - RNA, 19 nt, Homo sapiens
gaucauggccuguuucuac

SEQ ID NO: 1488932 - RNA, 19 nt, Homo sapiens
ccauugggcucugcuuaua

SEQ ID NO: 1488933 - RNA, 19 nt, Homo sapiens
aaacauaggagggaucaua

SEQ ID NO: 1488934 - RNA, 19 nt, Homo sapiens
uaucuucggugacauuuau

SEQ ID NO: 1488935 - RNA, 19 nt, Homo sapiens
ggagaaaccuacucaacac

SEQ ID NO: 1488936 - RNA, 19 nt, Homo sapiens
gacauggccuaaauuaauc

SEQ ID NO: 1488937 - RNA, 19 nt, Homo sapiens
gugagggacuugugcauug

SEQ ID NO: 1488938 - RNA, 19 nt, Homo sapiens
cacaggagcccaacaguuu

SEQ ID NO: 1488939 - RNA, 19 nt, Homo sapiens
agaaauguaugcccuagga

SEQ ID NO: 1488940 - RNA, 19 nt, Homo sapiens
gaaagcaagggaaauagug

SEQ ID NO: 1488941 - RNA, 19 nt, Homo sapiens
gggauuucauuuggaauuu

SEQ ID NO: 1488942 - RNA, 19 nt, Homo sapiens
uggcaucaguguuaauaaa

SEQ ID NO: 1488943 - RNA, 19 nt, Homo sapiens
uaauuucccuccaccaaga

SEQ ID NO: 1488944 - RNA, 19 nt, Homo sapiens
ugacauuuauccuagcauu

SEQ ID NO: 1488945 - RNA, 19 nt, Homo sapiens
aaaguuacacugaaggaua

SEQ ID NO: 1488946 - RNA, 19 nt, Homo sapiens
cagugucuguccuuuauuu

SEQ ID NO: 1488947 - RNA, 19 nt, Homo sapiens
gggcucugcuuauaaacuu

SEQ ID NO: 1488948 - RNA, 19 nt, Homo sapiens
ccagaagagugcuaugugu

SEQ ID NO: 1488949 - RNA, 19 nt, Homo sapiens
guauagagcccacaaacau

SEQ ID NO: 1488950 - RNA, 19 nt, Homo sapiens
cuaugaauauccaguuuga

SEQ ID NO: 1488951 - RNA, 19 nt, Homo sapiens
gaaugaucuuagugucuuu

SEQ ID NO: 1488952 - RNA, 19 nt, Homo sapiens
aaaugcugcuguuguguaa

SEQ ID NO: 1488953 - RNA, 19 nt, Homo sapiens
gacuguauacccacucuua

SEQ ID NO: 1488954 - RNA, 19 nt, Homo sapiens
uuucauggcaucaguguua

SEQ ID NO: 1488955 - RNA, 19 nt, Homo sapiens
cgucugacauggccuaaau

SEQ ID NO: 1488956 - RNA, 19 nt, Homo sapiens
ugacaacagcucuaugauu

SEQ ID NO: 1488957 - RNA, 19 nt, Homo sapiens
acccaucucucaucuauau

SEQ ID NO: 1488958 - RNA, 19 nt, Homo sapiens
gcaucaguguuaauaaagu

SEQ ID NO: 1488959 - RNA, 19 nt, Homo sapiens
uaaaugcugcuguugugua

SEQ ID NO: 1488960 - RNA, 19 nt, Homo sapiens
gggaacaucuauacuaagc

SEQ ID NO: 1488961 - RNA, 19 nt, Homo sapiens
gcagacaaggcacugauug

SEQ ID NO: 1488962 - RNA, 19 nt, Homo sapiens
gucuuuaccuuucucauau

SEQ ID NO: 1488963 - RNA, 19 nt, Homo sapiens
uggcuaaccugauuguuca

SEQ ID NO: 1488964 - RNA, 19 nt, Homo sapiens
ggccauaucuucggugaca

SEQ ID NO: 1488965 - RNA, 19 nt, Homo sapiens
cuuauaugcuggugacauu

SEQ ID NO: 1488966 - RNA, 19 nt, Homo sapiens
gcuguucgcuugggauuuc

SEQ ID NO: 1488967 - RNA, 19 nt, Homo sapiens
aauaauagcaacccuguga

SEQ ID NO: 1488968 - RNA, 19 nt, Homo sapiens
gaaugugugucaucauacu

SEQ ID NO: 1488969 - RNA, 19 nt, Homo sapiens
gaacaagagaauucauuac

SEQ ID NO: 1488970 - RNA, 19 nt, Homo sapiens
ccaccauuauccaaagauu

SEQ ID NO: 1488971 - RNA, 19 nt, Homo sapiens
uuggagcaaugauaguuua

SEQ ID NO: 1488972 - RNA, 19 nt, Homo sapiens
ccaggaucaugaaauguau

SEQ ID NO: 1488973 - RNA, 19 nt, Homo sapiens
uaacugagucuuaaucucu

SEQ ID NO: 1488974 - RNA, 19 nt, Homo sapiens
agaaugaucuuagugucuu

SEQ ID NO: 1488975 - RNA, 19 nt, Homo sapiens
gaagaacaacaagaaacaa

SEQ ID NO: 1488976 - RNA, 19 nt, Homo sapiens
caccaggacuaacuucuuc

SEQ ID NO: 1488977 - RNA, 19 nt, Homo sapiens
aaaggugguggauuuauuu

SEQ ID NO: 1488978 - RNA, 19 nt, Homo sapiens
gcuguuguguaauucuaaa

SEQ ID NO: 1488979 - RNA, 19 nt, Homo sapiens
aagaagagcgucugacaug

SEQ ID NO: 1488980 - RNA, 19 nt, Homo sapiens
gagugaucauggccuguuu

SEQ ID NO: 1488981 - RNA, 19 nt, Homo sapiens
uuagacaacuucccuagca

SEQ ID NO: 1488982 - RNA, 19 nt, Homo sapiens
gugcuuagagugugagaaa

SEQ ID NO: 1488983 - RNA, 19 nt, Homo sapiens
cagaagagugcuaugugua

SEQ ID NO: 1488984 - RNA, 19 nt, Homo sapiens
uguaaaugcugcuguugug

SEQ ID NO: 1488985 - RNA, 19 nt, Homo sapiens
aagauuguauugagcagaa

SEQ ID NO: 1488986 - RNA, 19 nt, Homo sapiens
gauaagauuucaguuucca

SEQ ID NO: 1488987 - RNA, 19 nt, Homo sapiens
uagcaacccugugauuugu

SEQ ID NO: 1488988 - RNA, 19 nt, Homo sapiens
uaaaguaggagaguuuguu

SEQ ID NO: 1488989 - RNA, 19 nt, Homo sapiens
aagaaaucaugcuggguuu

SEQ ID NO: 1488990 - RNA, 19 nt, Homo sapiens
auacccaucucucaucuau

SEQ ID NO: 1488991 - RNA, 19 nt, Homo sapiens
cauguggacuggccuuugu

SEQ ID NO: 1488992 - RNA, 19 nt, Homo sapiens
uccaugugcugauucuuaa

SEQ ID NO: 1488993 - RNA, 19 nt, Homo sapiens
gaccauuucugcaguuugc

SEQ ID NO: 1488994 - RNA, 19 nt, Homo sapiens
ugucaaauccugcuucugu

SEQ ID NO: 1488995 - RNA, 19 nt, Homo sapiens
ggacuugugcauugcuuau

SEQ ID NO: 1488996 - RNA, 19 nt, Homo sapiens
gaaagagauccuggaccua

SEQ ID NO: 1488997 - RNA, 19 nt, Homo sapiens
uaaugacacagacacuaua

SEQ ID NO: 1488998 - RNA, 19 nt, Homo sapiens
ucaaauccugcuucuguuu

SEQ ID NO: 1488999 - RNA, 19 nt, Homo sapiens
ugucagagcagcauauugu

SEQ ID NO: 1489000 - RNA, 19 nt, Homo sapiens
ucugacauggccuaaauua

SEQ ID NO: 1489001 - RNA, 19 nt, Homo sapiens
ccaucucucaucuauauaa

SEQ ID NO: 1489002 - RNA, 19 nt, Homo sapiens
ugugggagcuggagugauc

SEQ ID NO: 1489003 - RNA, 19 nt, Homo sapiens
uaauagcaacccugugauu

SEQ ID NO: 1489004 - RNA, 19 nt, Homo sapiens
aaagagauccuggaccuau

SEQ ID NO: 1489005 - RNA, 19 nt, Homo sapiens
ggaaauaguggccccuuaa

SEQ ID NO: 1489006 - RNA, 19 nt, Homo sapiens
uaccagagauaagauuuca

SEQ ID NO: 1489007 - RNA, 19 nt, Homo sapiens
gaaaaguggugggauaagu

SEQ ID NO: 1489008 - RNA, 19 nt, Homo sapiens
aaacaggcuggauuuacua

SEQ ID NO: 1489009 - RNA, 19 nt, Homo sapiens
augggaacaucuauacuaa

SEQ ID NO: 1489010 - RNA, 19 nt, Homo sapiens
gauuuggaauaccaugaug

SEQ ID NO: 1489011 - RNA, 19 nt, Homo sapiens
gcacagaucucuuagcaaa

SEQ ID NO: 1489012 - RNA, 19 nt, Homo sapiens
ggaaguauaugaagucuug

SEQ ID NO: 1489013 - RNA, 19 nt, Homo sapiens
gcucaagucugaugguuua

SEQ ID NO: 1489014 - RNA, 19 nt, Homo sapiens
gaaggagcauccauacaua

SEQ ID NO: 1489015 - RNA, 19 nt, Homo sapiens
gacaaauacuugcacauua

SEQ ID NO: 1489016 - RNA, 19 nt, Homo sapiens
gugaagaccuaacgaaaua

SEQ ID NO: 1489017 - RNA, 19 nt, Homo sapiens
gaaaucaucuucgaucuug

SEQ ID NO: 1489018 - RNA, 19 nt, Homo sapiens
gaauguaaguucaucguuu

SEQ ID NO: 1489019 - RNA, 19 nt, Homo sapiens
ggaaaggaauuuacaaaca

SEQ ID NO: 1489020 - RNA, 19 nt, Homo sapiens
ugaauaaggugauuaguga

SEQ ID NO: 1489021 - RNA, 19 nt, Homo sapiens
ucacagauguccuggauaa

SEQ ID NO: 1489022 - RNA, 19 nt, Homo sapiens
ggagagagcagcagucuuu

SEQ ID NO: 1489023 - RNA, 19 nt, Homo sapiens
gagcauaaaccaugauuaa

SEQ ID NO: 1489024 - RNA, 19 nt, Homo sapiens
guaaagaagucacggagaa

SEQ ID NO: 1489025 - RNA, 19 nt, Homo sapiens
ggaagaggauuaugaagau

SEQ ID NO: 1489026 - RNA, 19 nt, Homo sapiens
ugacaaggaugaugauauu

SEQ ID NO: 1489027 - RNA, 19 nt, Homo sapiens
gaagaaagcccaguaugaa

SEQ ID NO: 1489028 - RNA, 19 nt, Homo sapiens
cuaguucgcuuccauagua

SEQ ID NO: 1489029 - RNA, 19 nt, Homo sapiens
gcacacaaaucauggugaa

SEQ ID NO: 1489030 - RNA, 19 nt, Homo sapiens
gagaugaacuaccaacaga

SEQ ID NO: 1489031 - RNA, 19 nt, Homo sapiens
caagucugaugguuuaaua

SEQ ID NO: 1489032 - RNA, 19 nt, Homo sapiens
caccuuagcugaacuguga

SEQ ID NO: 1489033 - RNA, 19 nt, Homo sapiens
ccaauuaucuacagaagga

SEQ ID NO: 1489034 - RNA, 19 nt, Homo sapiens
ggaagaagacaaauacuug

SEQ ID NO: 1489035 - RNA, 19 nt, Homo sapiens
gagacaacuuucuuucuuu

SEQ ID NO: 1489036 - RNA, 19 nt, Homo sapiens
caaacuagcuucuucaaac

SEQ ID NO: 1489037 - RNA, 19 nt, Homo sapiens
gaacuucggaaacugaaua

SEQ ID NO: 1489038 - RNA, 19 nt, Homo sapiens
guauacagauagcucauaa

SEQ ID NO: 1489039 - RNA, 19 nt, Homo sapiens
gagcauccauacauacaaa

SEQ ID NO: 1489040 - RNA, 19 nt, Homo sapiens
uagaagaccugacuccaaa

SEQ ID NO: 1489041 - RNA, 19 nt, Homo sapiens
gagcacaauuauucucuuu

SEQ ID NO: 1489042 - RNA, 19 nt, Homo sapiens
uaacuguguucaagcuuua

SEQ ID NO: 1489043 - RNA, 19 nt, Homo sapiens
uugcacagcuuacaugaua

SEQ ID NO: 1489044 - RNA, 19 nt, Homo sapiens
acaaaugucugugcaagua

SEQ ID NO: 1489045 - RNA, 19 nt, Homo sapiens
ccauuaaucucacuuguau

SEQ ID NO: 1489046 - RNA, 19 nt, Homo sapiens
uagcauaagugaagcauga

SEQ ID NO: 1489047 - RNA, 19 nt, Homo sapiens
guaugaagcuaauaaagug

SEQ ID NO: 1489048 - RNA, 19 nt, Homo sapiens
ggaggugacuucaauaucu

SEQ ID NO: 1489049 - RNA, 19 nt, Homo sapiens
guacaucagucucagauuc

SEQ ID NO: 1489050 - RNA, 19 nt, Homo sapiens
gaugagcacagaucucuua

SEQ ID NO: 1489051 - RNA, 19 nt, Homo sapiens
gagugugucugguaaauug

SEQ ID NO: 1489052 - RNA, 19 nt, Homo sapiens
caacugauauggcaaacug

SEQ ID NO: 1489053 - RNA, 19 nt, Homo sapiens
uaaaugcaguccugaagaa

SEQ ID NO: 1489054 - RNA, 19 nt, Homo sapiens
gagcacagaucucuuagca

SEQ ID NO: 1489055 - RNA, 19 nt, Homo sapiens
ucagaaugcugcagcgaua

SEQ ID NO: 1489056 - RNA, 19 nt, Homo sapiens
gcaaugaacuucggaaacu

SEQ ID NO: 1489057 - RNA, 19 nt, Homo sapiens
gaauucaccucaaguaaac

SEQ ID NO: 1489058 - RNA, 19 nt, Homo sapiens
gaacuaaguagcauaagug

SEQ ID NO: 1489059 - RNA, 19 nt, Homo sapiens
uagcucaacuuaauaguga

SEQ ID NO: 1489060 - RNA, 19 nt, Homo sapiens
caucuucgaucuuggaauu

SEQ ID NO: 1489061 - RNA, 19 nt, Homo sapiens
guucaucguuuaaagcuuu

SEQ ID NO: 1489062 - RNA, 19 nt, Homo sapiens
uuccagagcuugucgguua

SEQ ID NO: 1489063 - RNA, 19 nt, Homo sapiens
agaccaacauguaucauaa

SEQ ID NO: 1489064 - RNA, 19 nt, Homo sapiens
gaagaccuaacgaaauaua

SEQ ID NO: 1489065 - RNA, 19 nt, Homo sapiens
guaaacccauuguuccaaa

SEQ ID NO: 1489066 - RNA, 19 nt, Homo sapiens
gaagagagguaaaagaaga

SEQ ID NO: 1489067 - RNA, 19 nt, Homo sapiens
gaaaacugguggcuuaaaa

SEQ ID NO: 1489068 - RNA, 19 nt, Homo sapiens
caaguauuguggcagauuu

SEQ ID NO: 1489069 - RNA, 19 nt, Homo sapiens
ggacuauguugaaauguag

SEQ ID NO: 1489070 - RNA, 19 nt, Homo sapiens
gaacaaaagaaguggauua

SEQ ID NO: 1489071 - RNA, 19 nt, Homo sapiens
cagauguccuggauaauga

SEQ ID NO: 1489072 - RNA, 19 nt, Homo sapiens
gcaaagacauugaaaaucu

SEQ ID NO: 1489073 - RNA, 19 nt, Homo sapiens
cagcgauacuugaucuaua

SEQ ID NO: 1489074 - RNA, 19 nt, Homo sapiens
gaaauguaccugguuugua

SEQ ID NO: 1489075 - RNA, 19 nt, Homo sapiens
ugucagagcucaagaugau

SEQ ID NO: 1489076 - RNA, 19 nt, Homo sapiens
uaaagaaacccaggaacua

SEQ ID NO: 1489077 - RNA, 19 nt, Homo sapiens
ggauccagauuucauguau

SEQ ID NO: 1489078 - RNA, 19 nt, Homo sapiens
gaaacugaauaaggugauu

SEQ ID NO: 1489079 - RNA, 19 nt, Homo sapiens
gagcaugaacugucugaaa

SEQ ID NO: 1489080 - RNA, 19 nt, Homo sapiens
gaugaagagguuauaagua

SEQ ID NO: 1489081 - RNA, 19 nt, Homo sapiens
aaguaaagcuggaaaggaa

SEQ ID NO: 1489082 - RNA, 19 nt, Homo sapiens
gugaaggcauugugaauuc

SEQ ID NO: 1489083 - RNA, 19 nt, Homo sapiens
uauaugaagucuugacaga

SEQ ID NO: 1489084 - RNA, 19 nt, Homo sapiens
gaacacccaguaacaaaug

SEQ ID NO: 1489085 - RNA, 19 nt, Homo sapiens
caaaggagaacaccugcua

SEQ ID NO: 1489086 - RNA, 19 nt, Homo sapiens
uguaugaacuggauagaga

SEQ ID NO: 1489087 - RNA, 19 nt, Homo sapiens
gggugaagaucauuagaga

SEQ ID NO: 1489088 - RNA, 19 nt, Homo sapiens
augauaagcucaagucuga

SEQ ID NO: 1489089 - RNA, 19 nt, Homo sapiens
caaggaggauuguaaggau

SEQ ID NO: 1489090 - RNA, 19 nt, Homo sapiens
auaaguugguggccauuua

SEQ ID NO: 1489091 - RNA, 19 nt, Homo sapiens
gagcucaagaugauauaua

SEQ ID NO: 1489092 - RNA, 19 nt, Homo sapiens
ggaccaugaugaaggauuc

SEQ ID NO: 1489093 - RNA, 19 nt, Homo sapiens
aagaagagcacaauuauuc

SEQ ID NO: 1489094 - RNA, 19 nt, Homo sapiens
gcaguaaaauguagaguga

SEQ ID NO: 1489095 - RNA, 19 nt, Homo sapiens
ugucaaggcagcauuauaa

SEQ ID NO: 1489096 - RNA, 19 nt, Homo sapiens
uaaaacagcuucauuaguc

SEQ ID NO: 1489097 - RNA, 19 nt, Homo sapiens
gaguauagugaacaacuua

SEQ ID NO: 1489098 - RNA, 19 nt, Homo sapiens
ggagaacaccugcuacugu

SEQ ID NO: 1489099 - RNA, 19 nt, Homo sapiens
gaagaucauuagagaagag

SEQ ID NO: 1489100 - RNA, 19 nt, Homo sapiens
gggacucuguggcauuuaa

SEQ ID NO: 1489101 - RNA, 19 nt, Homo sapiens
ggaaaugccucagccuagu

SEQ ID NO: 1489102 - RNA, 19 nt, Homo sapiens
cuuucuagcugcucuguua

SEQ ID NO: 1489103 - RNA, 19 nt, Homo sapiens
acggagaacugauguagaa

SEQ ID NO: 1489104 - RNA, 19 nt, Homo sapiens
ggaguauagugaacaacuu

SEQ ID NO: 1489105 - RNA, 19 nt, Homo sapiens
ucacacagaugcagcaaag

SEQ ID NO: 1489106 - RNA, 19 nt, Homo sapiens
uaaagaagaaagcccagua

SEQ ID NO: 1489107 - RNA, 19 nt, Homo sapiens
gagcuugucgguuaaagaa

SEQ ID NO: 1489108 - RNA, 19 nt, Homo sapiens
agagacaacuuucuuucuu

SEQ ID NO: 1489109 - RNA, 19 nt, Homo sapiens
gaucugggcuuggaaaugc

SEQ ID NO: 1489110 - RNA, 19 nt, Homo sapiens
gaucuuggaauugaaagua

SEQ ID NO: 1489111 - RNA, 19 nt, Homo sapiens
gaaagagaaucacuaguaa

SEQ ID NO: 1489112 - RNA, 19 nt, Homo sapiens
gaguauaucuugcacuuua

SEQ ID NO: 1489113 - RNA, 19 nt, Homo sapiens
gcacaaggaucaaauaaca

SEQ ID NO: 1489114 - RNA, 19 nt, Homo sapiens
ggaaggagaugcaagaaga

SEQ ID NO: 1489115 - RNA, 19 nt, Homo sapiens
gaaaugaauugaacagguu

SEQ ID NO: 1489116 - RNA, 19 nt, Homo sapiens
ucaaauggcucgucuuaaa

SEQ ID NO: 1489117 - RNA, 19 nt, Homo sapiens
ucacgaggaucgaauaaua

SEQ ID NO: 1489118 - RNA, 19 nt, Homo sapiens
gaacggguguguauaauca

SEQ ID NO: 1489119 - RNA, 19 nt, Homo sapiens
gagaaucacuaguaaagaa

SEQ ID NO: 1489120 - RNA, 19 nt, Homo sapiens
guacucauauccauucuuu

SEQ ID NO: 1489121 - RNA, 19 nt, Homo sapiens
agaaagaacuggcucauau

SEQ ID NO: 1489122 - RNA, 19 nt, Homo sapiens
ucaauagacuuaaggagua

SEQ ID NO: 1489123 - RNA, 19 nt, Homo sapiens
aaucagagcuucaaagaga

SEQ ID NO: 1489124 - RNA, 19 nt, Homo sapiens
gaagaagguuuggaugauu

SEQ ID NO: 1489125 - RNA, 19 nt, Homo sapiens
gcaaugccaguaauuaaua

SEQ ID NO: 1489126 - RNA, 19 nt, Homo sapiens
gaaagaacuugccagacuu

SEQ ID NO: 1489127 - RNA, 19 nt, Homo sapiens
aaagugaaguggaaaguuu

SEQ ID NO: 1489128 - RNA, 19 nt, Homo sapiens
ggaagugcagcuccuauua

SEQ ID NO: 1489129 - RNA, 19 nt, Homo sapiens
ggacuguauucaccaagua

SEQ ID NO: 1489130 - RNA, 19 nt, Homo sapiens
ggaagaagguuuggaugau

SEQ ID NO: 1489131 - RNA, 19 nt, Homo sapiens
agaaagagaaucacuagua

SEQ ID NO: 1489132 - RNA, 19 nt, Homo sapiens
gaaagaaaguuggaaucug

SEQ ID NO: 1489133 - RNA, 19 nt, Homo sapiens
agaaaugacugcgguaauu

SEQ ID NO: 1489134 - RNA, 19 nt, Homo sapiens
gaauccagcuuucuaacau

SEQ ID NO: 1489135 - RNA, 19 nt, Homo sapiens
aagaagguuuggaugauua

SEQ ID NO: 1489136 - RNA, 19 nt, Homo sapiens
ggagaugcaagaagauaua

SEQ ID NO: 1489137 - RNA, 19 nt, Homo sapiens
ggaaucagagcuucaaaga

SEQ ID NO: 1489138 - RNA, 19 nt, Homo sapiens
ucuagaagauuauggacua

SEQ ID NO: 1489139 - RNA, 19 nt, Homo sapiens
ggauagcagaucuuucuua

SEQ ID NO: 1489140 - RNA, 19 nt, Homo sapiens
ugaaagaacuugccagacu

SEQ ID NO: 1489141 - RNA, 19 nt, Homo sapiens
gaacuauggcacaaggaua

SEQ ID NO: 1489142 - RNA, 19 nt, Homo sapiens
caaagcagcacuugagcua

SEQ ID NO: 1489143 - RNA, 19 nt, Homo sapiens
cgacagaucagagagauuu

SEQ ID NO: 1489144 - RNA, 19 nt, Homo sapiens
cagugacucuagaagauua

SEQ ID NO: 1489145 - RNA, 19 nt, Homo sapiens
gauagcagaucuuucuuac

SEQ ID NO: 1489146 - RNA, 19 nt, Homo sapiens
gaugagaacggguguguau

SEQ ID NO: 1489147 - RNA, 19 nt, Homo sapiens
gcaagugacaaguuugaaa

SEQ ID NO: 1489148 - RNA, 19 nt, Homo sapiens
gaacucgaccgacagauca

SEQ ID NO: 1489149 - RNA, 19 nt, Homo sapiens
agaagauuauggacuagua

SEQ ID NO: 1489150 - RNA, 19 nt, Homo sapiens
gaagugcagcuccuauuau

SEQ ID NO: 1489151 - RNA, 19 nt, Homo sapiens
ccagcaacaucacaucauu

SEQ ID NO: 1489152 - RNA, 19 nt, Homo sapiens
gaccaauuguaaccaguuu

SEQ ID NO: 1489153 - RNA, 19 nt, Homo sapiens
cagcuccuauuaugacuaa

SEQ ID NO: 1489154 - RNA, 19 nt, Homo sapiens
agucuaaacugcauuacaa

SEQ ID NO: 1489155 - RNA, 19 nt, Homo sapiens
ggaaaagguugaacuugaa

SEQ ID NO: 1489156 - RNA, 19 nt, Homo sapiens
gaaagaacuggcucauaug

SEQ ID NO: 1489157 - RNA, 19 nt, Homo sapiens
cuucagagauccagacaga

SEQ ID NO: 1489158 - RNA, 19 nt, Homo sapiens
cauguugggugacagauug

SEQ ID NO: 1489159 - RNA, 19 nt, Homo sapiens
caagaucagugcagagaag

SEQ ID NO: 1489160 - RNA, 19 nt, Homo sapiens
ugagaacggguguguauaa

SEQ ID NO: 1489161 - RNA, 19 nt, Homo sapiens
uuauuugacucgccugaua

SEQ ID NO: 1489162 - RNA, 19 nt, Homo sapiens
gaacuugccagacuuaaac

SEQ ID NO: 1489163 - RNA, 19 nt, Homo sapiens
gaaaagggaccgagaaaga

SEQ ID NO: 1489164 - RNA, 19 nt, Homo sapiens
gaagauuauggacuaguaa

SEQ ID NO: 1489165 - RNA, 19 nt, Homo sapiens
gcgguaauuuccaguucua

SEQ ID NO: 1489166 - RNA, 19 nt, Homo sapiens
gagaacggguguguauaau

SEQ ID NO: 1489167 - RNA, 19 nt, Homo sapiens
gcagcacaaggaucaaaua

SEQ ID NO: 1489168 - RNA, 19 nt, Homo sapiens
gaaagugugccuguuauag

SEQ ID NO: 1489169 - RNA, 19 nt, Homo sapiens
gcagagaagccacaugaca

SEQ ID NO: 1489170 - RNA, 19 nt, Homo sapiens
ugacucgccugauagaaga

SEQ ID NO: 1489171 - RNA, 19 nt, Homo sapiens
aaacagagggagcaagaaa

SEQ ID NO: 1489172 - RNA, 19 nt, Homo sapiens
gcagaggaauggaagaaaa

SEQ ID NO: 1489173 - RNA, 19 nt, Homo sapiens
guggaaaguuuacaguaug

SEQ ID NO: 1489174 - RNA, 19 nt, Homo sapiens
ccaauuguaaccaguuuaa

SEQ ID NO: 1489175 - RNA, 19 nt, Homo sapiens
gguaauuuccaguucuaua

SEQ ID NO: 1489176 - RNA, 19 nt, Homo sapiens
cgucuacagucugaaauaa

SEQ ID NO: 1489177 - RNA, 19 nt, Homo sapiens
gaaagugaaguggaaaguu

SEQ ID NO: 1489178 - RNA, 19 nt, Homo sapiens
uagcagaucuuucuuacac

SEQ ID NO: 1489179 - RNA, 19 nt, Homo sapiens
cgucaaacuuacagugaaa

SEQ ID NO: 1489180 - RNA, 19 nt, Homo sapiens
gacuaauccuccuguagaa

SEQ ID NO: 1489181 - RNA, 19 nt, Homo sapiens
uggaaaagcuuuauagaga

SEQ ID NO: 1489182 - RNA, 19 nt, Homo sapiens
aaagcaaugccaguaauua

SEQ ID NO: 1489183 - RNA, 19 nt, Homo sapiens
gauaaggacaccaaaccaa

SEQ ID NO: 1489184 - RNA, 19 nt, Homo sapiens
aaaaggaacugcaaucaga

SEQ ID NO: 1489185 - RNA, 19 nt, Homo sapiens
gcagcuugcuaguguggaa

SEQ ID NO: 1489186 - RNA, 19 nt, Homo sapiens
aaagguggcugaauauacu

SEQ ID NO: 1489187 - RNA, 19 nt, Homo sapiens
gugaaacguuagaauacaa

SEQ ID NO: 1489188 - RNA, 19 nt, Homo sapiens
gugaaagugugccuguuau

SEQ ID NO: 1489189 - RNA, 19 nt, Homo sapiens
gaggaucgaauaauaagug

SEQ ID NO: 1489190 - RNA, 19 nt, Homo sapiens
ccagaaauccgucuacagu

SEQ ID NO: 1489191 - RNA, 19 nt, Homo sapiens
aaaaucagcugaagcagaa

SEQ ID NO: 1489192 - RNA, 19 nt, Homo sapiens
ugacuaauccuccuguaga

SEQ ID NO: 1489193 - RNA, 19 nt, Homo sapiens
ggagaaaugacugcgguaa

SEQ ID NO: 1489194 - RNA, 19 nt, Homo sapiens
uaaguuuguuguaggagaa

SEQ ID NO: 1489195 - RNA, 19 nt, Homo sapiens
auacaugccuuggagauug

SEQ ID NO: 1489196 - RNA, 19 nt, Homo sapiens
ggaccgagaaagagaauca

SEQ ID NO: 1489197 - RNA, 19 nt, Homo sapiens
gugcagagaagccacauga

SEQ ID NO: 1489198 - RNA, 19 nt, Homo sapiens
ucugauggcuaacuaacuu

SEQ ID NO: 1489199 - RNA, 19 nt, Homo sapiens
uaaaucuucucaccuugga

SEQ ID NO: 1489200 - RNA, 19 nt, Homo sapiens
aagcagcacuugagcuaga

SEQ ID NO: 1489201 - RNA, 19 nt, Homo sapiens
cacagugacucuagaagau

SEQ ID NO: 1489202 - RNA, 19 nt, Homo sapiens
ccaguucuauaauguuuca

SEQ ID NO: 1489203 - RNA, 19 nt, Homo sapiens
aaagaacuugccagacuua

SEQ ID NO: 1489204 - RNA, 19 nt, Homo sapiens
agguugaacuugaaagaaa

SEQ ID NO: 1489205 - RNA, 19 nt, Homo sapiens
gcacuugagcuagaaaugu

SEQ ID NO: 1489206 - RNA, 19 nt, Homo sapiens
gaucuuucuuacacaguga

SEQ ID NO: 1489207 - RNA, 19 nt, Homo sapiens
gcacaaggauaaaaugagu

SEQ ID NO: 1489208 - RNA, 19 nt, Homo sapiens
caauagacuuaaggaguau

SEQ ID NO: 1489209 - RNA, 19 nt, Homo sapiens
aaaccgagcgacaagaauu

SEQ ID NO: 1489210 - RNA, 19 nt, Homo sapiens
agucaaauggcucgucuua

SEQ ID NO: 1489211 - RNA, 19 nt, Homo sapiens
guacauugcucuucagaaa

SEQ ID NO: 1489212 - RNA, 19 nt, Homo sapiens
gaagaacaauuccuuaaag

SEQ ID NO: 1489213 - RNA, 19 nt, Homo sapiens
gaaagacgacuuaaagauu

SEQ ID NO: 1489214 - RNA, 19 nt, Homo sapiens
gaaguucgaagcauuaaua

SEQ ID NO: 1489215 - RNA, 19 nt, Homo sapiens
cagaagauguggcugauga

SEQ ID NO: 1489216 - RNA, 19 nt, Homo sapiens
gagaacaacuuacagaacu

SEQ ID NO: 1489217 - RNA, 19 nt, Homo sapiens
uaagguaccuacugauaug

SEQ ID NO: 1489218 - RNA, 19 nt, Homo sapiens
gagauuucaugaucagauu

SEQ ID NO: 1489219 - RNA, 19 nt, Homo sapiens
ggaaagacgacuuaaagau

SEQ ID NO: 1489220 - RNA, 19 nt, Homo sapiens
agauguggcugaugaaauu

SEQ ID NO: 1489221 - RNA, 19 nt, Homo sapiens
cguauaaguugaugcauga

SEQ ID NO: 1489222 - RNA, 19 nt, Homo sapiens
uaagaaguucgaagcauua

SEQ ID NO: 1489223 - RNA, 19 nt, Homo sapiens
gaggaaagacgacuuaaag

SEQ ID NO: 1489224 - RNA, 19 nt, Homo sapiens
aauauaagguaccuacuga

SEQ ID NO: 1489225 - RNA, 19 nt, Homo sapiens
gggaggaacagcugauuaa

SEQ ID NO: 1489226 - RNA, 19 nt, Homo sapiens
caagagagacuuagacaca

SEQ ID NO: 1489227 - RNA, 19 nt, Homo sapiens
caagauugacuuugaagaa

SEQ ID NO: 1489228 - RNA, 19 nt, Homo sapiens
aaaccugcaucaaaucgua

SEQ ID NO: 1489229 - RNA, 19 nt, Homo sapiens
caacgucugacaaauuuaa

SEQ ID NO: 1489230 - RNA, 19 nt, Homo sapiens
uuaagaaguucgaagcauu

SEQ ID NO: 1489231 - RNA, 19 nt, Homo sapiens
aaaagggacuugcuagaua

SEQ ID NO: 1489232 - RNA, 19 nt, Homo sapiens
aagccaagauugacuuuga

SEQ ID NO: 1489233 - RNA, 19 nt, Homo sapiens
ugcaacgucugacaaauuu

SEQ ID NO: 1489234 - RNA, 19 nt, Homo sapiens
uauaagguaccuacugaua

SEQ ID NO: 1489235 - RNA, 19 nt, Homo sapiens
caagagaacaacuuacaga

SEQ ID NO: 1489236 - RNA, 19 nt, Homo sapiens
gcuguuauaucaauuguac

SEQ ID NO: 1489237 - RNA, 19 nt, Homo sapiens
uuaagacacuaccugcuaa

SEQ ID NO: 1489238 - RNA, 19 nt, Homo sapiens
ucagauugcuguggaaaga

SEQ ID NO: 1489239 - RNA, 19 nt, Homo sapiens
guuaauagcccacgaagca

SEQ ID NO: 1489240 - RNA, 19 nt, Homo sapiens
ccaagcagcuauuauacag

SEQ ID NO: 1489241 - RNA, 19 nt, Homo sapiens
gaauauaagguaccuacug

SEQ ID NO: 1489242 - RNA, 19 nt, Homo sapiens
ggcagacuaucgaauguug

SEQ ID NO: 1489243 - RNA, 19 nt, Homo sapiens
aauccaagcagcuauuaua

SEQ ID NO: 1489244 - RNA, 19 nt, Homo sapiens
auaaacacgugaaagaaga

SEQ ID NO: 1489245 - RNA, 19 nt, Homo sapiens
aaaaggaucuccaagcaaa

SEQ ID NO: 1489246 - RNA, 19 nt, Homo sapiens
guuaagacacuaccugcua

SEQ ID NO: 1489247 - RNA, 19 nt, Homo sapiens
gaagcgccuugaagaagau

SEQ ID NO: 1489248 - RNA, 19 nt, Homo sapiens
gaagauguggcugaugaaa

SEQ ID NO: 1489249 - RNA, 19 nt, Homo sapiens
caaggaagagcaaagaugu

SEQ ID NO: 1489250 - RNA, 19 nt, Homo sapiens
gaaguucuacacaaguuug

SEQ ID NO: 1489251 - RNA, 19 nt, Homo sapiens
gcuauuauacagauuccua

SEQ ID NO: 1489252 - RNA, 19 nt, Homo sapiens
gaucuugcccauuugcauu

SEQ ID NO: 1489253 - RNA, 19 nt, Homo sapiens
gguaccuacugauaugaaa

SEQ ID NO: 1489254 - RNA, 19 nt, Homo sapiens
auaaguugaugcaugauug

SEQ ID NO: 1489255 - RNA, 19 nt, Homo sapiens
caugaggaaagacgacuua

SEQ ID NO: 1489256 - RNA, 19 nt, Homo sapiens
cggcggaaauuguuaaugg

SEQ ID NO: 1489257 - RNA, 19 nt, Homo sapiens
agaagcgccuugaagaaga

SEQ ID NO: 1489258 - RNA, 19 nt, Homo sapiens
gaguggagaugcaaaccau

SEQ ID NO: 1489259 - RNA, 19 nt, Homo sapiens
gaccgugagucccaaguca

SEQ ID NO: 1489260 - RNA, 19 nt, Homo sapiens
gcucaagcucguuaugaaa

SEQ ID NO: 1489261 - RNA, 19 nt, Homo sapiens
gauugacuuugaagaacaa

SEQ ID NO: 1489262 - RNA, 19 nt, Homo sapiens
uuaaacagaagacgacaaa

SEQ ID NO: 1489263 - RNA, 19 nt, Homo sapiens
gaagaaaaguggacugacu

SEQ ID NO: 1489264 - RNA, 19 nt, Homo sapiens
gcaguuugaucagaaugug

SEQ ID NO: 1489265 - RNA, 19 nt, Homo sapiens
uucaguaugugcagaaauu

SEQ ID NO: 1489266 - RNA, 19 nt, Homo sapiens
ccagaagcgccuugaagaa

SEQ ID NO: 1489267 - RNA, 19 nt, Homo sapiens
ccagacaaccaccgauuug

SEQ ID NO: 1489268 - RNA, 19 nt, Homo sapiens
aaagaaagugcauccaaga

SEQ ID NO: 1489269 - RNA, 19 nt, Homo sapiens
gcugaaccaugucggagau

SEQ ID NO: 1489270 - RNA, 19 nt, Homo sapiens
ccaggaugcucuugaucga

SEQ ID NO: 1489271 - RNA, 19 nt, Homo sapiens
aagcagcuauuauacagau

SEQ ID NO: 1489272 - RNA, 19 nt, Homo sapiens
uuacagaacuggagaaaag

SEQ ID NO: 1489273 - RNA, 19 nt, Homo sapiens
acaagccucuguuaagaca

SEQ ID NO: 1489274 - RNA, 19 nt, Homo sapiens
uaaaguggcagacuaucga

SEQ ID NO: 1489275 - RNA, 19 nt, Homo sapiens
ggacagcaggguuucaagu

SEQ ID NO: 1489276 - RNA, 19 nt, Homo sapiens
gaaaagacggcggaaauug

SEQ ID NO: 1489277 - RNA, 19 nt, Homo sapiens
uuacauacagguuucaaga

SEQ ID NO: 1489278 - RNA, 19 nt, Homo sapiens
caaccaccgauuuguuaaa

SEQ ID NO: 1489279 - RNA, 19 nt, Homo sapiens
uccaguggcuaucuacuug

SEQ ID NO: 1489280 - RNA, 19 nt, Homo sapiens
aaagggacuugcuagauac

SEQ ID NO: 1489281 - RNA, 19 nt, Homo sapiens
aaagagauuucaugaucag

SEQ ID NO: 1489282 - RNA, 19 nt, Homo sapiens
gauaccacgucaaacugau

SEQ ID NO: 1489283 - RNA, 19 nt, Homo sapiens
cacaugauaccacgucaaa

SEQ ID NO: 1489284 - RNA, 19 nt, Homo sapiens
agagagacuuagacacaug

SEQ ID NO: 1489285 - RNA, 19 nt, Homo sapiens
caaaacaagccaagauuga

SEQ ID NO: 1489286 - RNA, 19 nt, Homo sapiens
aaagacggcggaaauuguu

SEQ ID NO: 1489287 - RNA, 19 nt, Homo sapiens
ugcuagauaccaaugauua

SEQ ID NO: 1489288 - RNA, 19 nt, Homo sapiens
gggacuugcuagauaccaa

SEQ ID NO: 1489289 - RNA, 19 nt, Homo sapiens
gugcagaaauuuuggauca

SEQ ID NO: 1489290 - RNA, 19 nt, Homo sapiens
ugaggaaagacgacuuaaa

SEQ ID NO: 1489291 - RNA, 19 nt, Homo sapiens
gagaaaagacggcggaaau

SEQ ID NO: 1489292 - RNA, 19 nt, Homo sapiens
gagagacuuagacacauga

SEQ ID NO: 1489293 - RNA, 19 nt, Homo sapiens
gcuagauaccaaugauuau

SEQ ID NO: 1489294 - RNA, 19 nt, Homo sapiens
gccagacaaccaccgauuu

SEQ ID NO: 1489295 - RNA, 19 nt, Homo sapiens
uccuaaaccugcaucaaau

SEQ ID NO: 1489296 - RNA, 19 nt, Homo sapiens
gcaauacuuaaacagaaga

SEQ ID NO: 1489297 - RNA, 19 nt, Homo sapiens
ucaaggaagagcaaagaug

SEQ ID NO: 1489298 - RNA, 19 nt, Homo sapiens
cggauuacauacagguuuc

SEQ ID NO: 1489299 - RNA, 19 nt, Homo sapiens
gcggauuacauacagguuu

SEQ ID NO: 1489300 - RNA, 19 nt, Homo sapiens
gagacuuagacacaugaua

SEQ ID NO: 1489301 - RNA, 19 nt, Homo sapiens
gaucagauugcuguggaaa

SEQ ID NO: 1489302 - RNA, 19 nt, Homo sapiens
ugacuuugaagaacaauuc

SEQ ID NO: 1489303 - RNA, 19 nt, Homo sapiens
acuuaaagauuuccaggau

SEQ ID NO: 1489304 - RNA, 19 nt, Homo sapiens
cagcaggagcgcaggauug

SEQ ID NO: 1489305 - RNA, 19 nt, Homo sapiens
ggcggaaauuguuaaugga

SEQ ID NO: 1489306 - RNA, 19 nt, Homo sapiens
caaaccaugcaacgucuga

SEQ ID NO: 1489307 - RNA, 19 nt, Homo sapiens
gaaaagggacuugcuagau

SEQ ID NO: 1489308 - RNA, 19 nt, Homo sapiens
ugauuggaaggaacuauuu

SEQ ID NO: 1489309 - RNA, 19 nt, Homo sapiens
guugauuuguccacuaaag

SEQ ID NO: 1489310 - RNA, 19 nt, Homo sapiens
gcaaaacaagccaagauug

SEQ ID NO: 1489311 - RNA, 19 nt, Homo sapiens
ccugagagcugcagauguu

SEQ ID NO: 1489312 - RNA, 19 nt, Homo sapiens
gcuccucacugugcacuua

SEQ ID NO: 1489313 - RNA, 19 nt, Homo sapiens
cugcuaggcuggcaucaaa

SEQ ID NO: 1489314 - RNA, 19 nt, Homo sapiens
ccucaucucugcaugugaa

SEQ ID NO: 1489315 - RNA, 19 nt, Homo sapiens
gaacacaggaugacuacag

SEQ ID NO: 1489316 - RNA, 19 nt, Homo sapiens
ccucaggucugcagcaaau

SEQ ID NO: 1489317 - RNA, 19 nt, Homo sapiens
ugagaaguccugaccauga

SEQ ID NO: 1489318 - RNA, 19 nt, Homo sapiens
gcagauguuuggccuuugg

SEQ ID NO: 1489319 - RNA, 19 nt, Homo sapiens
gagaaguccugaccaugag

SEQ ID NO: 1489320 - RNA, 19 nt, Homo sapiens
ccagaaaccacccagagaa

SEQ ID NO: 1489321 - RNA, 19 nt, Homo sapiens
caggaugacuacaguguuc

SEQ ID NO: 1489322 - RNA, 19 nt, Homo sapiens
ccucaugagucacugauuc

SEQ ID NO: 1489323 - RNA, 19 nt, Homo sapiens
gaaacacccucagcugcau

SEQ ID NO: 1489324 - RNA, 19 nt, Homo sapiens
ugacguggcccuucugaug

SEQ ID NO: 1489325 - RNA, 19 nt, Homo sapiens
cuacaacuccgugguguuu

SEQ ID NO: 1489326 - RNA, 19 nt, Homo sapiens
gcugagaaguccugaccau

SEQ ID NO: 1489327 - RNA, 19 nt, Homo sapiens
cagaaaccacccagagaaa

SEQ ID NO: 1489328 - RNA, 19 nt, Homo sapiens
ggugaacacaggaugacua

SEQ ID NO: 1489329 - RNA, 19 nt, Homo sapiens
auuagugucuguugaguga

SEQ ID NO: 1489330 - RNA, 19 nt, Homo sapiens
ccagagaaacguugcuuca

SEQ ID NO: 1489331 - RNA, 19 nt, Homo sapiens
ggaggugaacacaggauga

SEQ ID NO: 1489332 - RNA, 19 nt, Homo sapiens
ugggaugccucaugaguca

SEQ ID NO: 1489333 - RNA, 19 nt, Homo sapiens
cugcagauguuuggccuuu

SEQ ID NO: 1489334 - RNA, 19 nt, Homo sapiens
gagaguauguucggcuucu

SEQ ID NO: 1489335 - RNA, 19 nt, Homo sapiens
ccuccagucucaaguaaca

SEQ ID NO: 1489336 - RNA, 19 nt, Homo sapiens
agagaaacguugcuucacu

SEQ ID NO: 1489337 - RNA, 19 nt, Homo sapiens
gcauugccgucuacaacuc

SEQ ID NO: 1489338 - RNA, 19 nt, Homo sapiens
ucaggucugcagcaaauaa

SEQ ID NO: 1489339 - RNA, 19 nt, Homo sapiens
ccaaguggacaucaauuag

SEQ ID NO: 1489340 - RNA, 19 nt, Homo sapiens
gccacucccuccagucuca

SEQ ID NO: 1489341 - RNA, 19 nt, Homo sapiens
ccguggaccucaucaagau

SEQ ID NO: 1489342 - RNA, 19 nt, Homo sapiens
ggucugcagcaaauaaaug

SEQ ID NO: 1489343 - RNA, 19 nt, Homo sapiens
uagugucuguugagugauu

SEQ ID NO: 1489344 - RNA, 19 nt, Homo sapiens
gaugcagacacaaccguuu

SEQ ID NO: 1489345 - RNA, 19 nt, Homo sapiens
ugccugggaugccucauga

SEQ ID NO: 1489346 - RNA, 19 nt, Homo sapiens
gauucaagcccuccaaggu

SEQ ID NO: 1489347 - RNA, 19 nt, Homo sapiens
ccucacugugcacuuauua

SEQ ID NO: 1489348 - RNA, 19 nt, Homo sapiens
gccagaaaccacccagaga

SEQ ID NO: 1489349 - RNA, 19 nt, Homo sapiens
gcuaggcuggcaucaaaga

SEQ ID NO: 1489350 - RNA, 19 nt, Homo sapiens
gaaaccacccagagaaacg

SEQ ID NO: 1489351 - RNA, 19 nt, Homo sapiens
acacugacguggcccuucu

SEQ ID NO: 1489352 - RNA, 19 nt, Homo sapiens
ggccucaucucugcaugug

SEQ ID NO: 1489353 - RNA, 19 nt, Homo sapiens
ggaggugcagccaguguca

SEQ ID NO: 1489354 - RNA, 19 nt, Homo sapiens
ucucagcaccgaccagguu

SEQ ID NO: 1489355 - RNA, 19 nt, Homo sapiens
ucccuccagucucaaguaa

SEQ ID NO: 1489356 - RNA, 19 nt, Homo sapiens
ucacugugcacuuauuagu

SEQ ID NO: 1489357 - RNA, 19 nt, Homo sapiens
cugcagcaaauaaaugaaa

SEQ ID NO: 1489358 - RNA, 19 nt, Homo sapiens
cagcauugccgucuacaac

SEQ ID NO: 1489359 - RNA, 19 nt, Homo sapiens
gaguauguucggcuucuuc

SEQ ID NO: 1489360 - RNA, 19 nt, Homo sapiens
aaguggacaucaauuagca

SEQ ID NO: 1489361 - RNA, 19 nt, Homo sapiens
ggcguuggcuacggaaaca

SEQ ID NO: 1489362 - RNA, 19 nt, Homo sapiens
gcuucacuccucugucuga

SEQ ID NO: 1489363 - RNA, 19 nt, Homo sapiens
gcagcaaauaaaugaaagu

SEQ ID NO: 1489364 - RNA, 19 nt, Homo sapiens
acaacuccgugguguuugg

SEQ ID NO: 1489365 - RNA, 19 nt, Homo sapiens
ugagagcugcagauguuug

SEQ ID NO: 1489366 - RNA, 19 nt, Homo sapiens
caagauccgguugcagaug

SEQ ID NO: 1489367 - RNA, 19 nt, Homo sapiens
ggaccaauguucuguauaa

SEQ ID NO: 1489368 - RNA, 19 nt, Homo sapiens
gcaguaugcuguauaguaa

SEQ ID NO: 1489369 - RNA, 19 nt, Homo sapiens
gaaaggauguuuaacucuu

SEQ ID NO: 1489370 - RNA, 19 nt, Homo sapiens
gaauguaguugccaucaga

SEQ ID NO: 1489371 - RNA, 19 nt, Homo sapiens
cagaugcuguucucuauuu

SEQ ID NO: 1489372 - RNA, 19 nt, Homo sapiens
ugagauaaauuuccagaug

SEQ ID NO: 1489373 - RNA, 19 nt, Homo sapiens
gaagaguccuuauguugca

SEQ ID NO: 1489374 - RNA, 19 nt, Homo sapiens
acuguaaucuugcugcuua

SEQ ID NO: 1489375 - RNA, 19 nt, Homo sapiens
gaacggaagaguccuuaug

SEQ ID NO: 1489376 - RNA, 19 nt, Homo sapiens
ucuauugacuguaaucuug

SEQ ID NO: 1489377 - RNA, 19 nt, Homo sapiens
guaacaaucaaccucagua

SEQ ID NO: 1489378 - RNA, 19 nt, Homo sapiens
gaccaauguucuguauaaa

SEQ ID NO: 1489379 - RNA, 19 nt, Homo sapiens
gcacauaguagaaaacaaa

SEQ ID NO: 1489380 - RNA, 19 nt, Homo sapiens
cugcaaauguuauucuguu

SEQ ID NO: 1489381 - RNA, 19 nt, Homo sapiens
auauguaccugugcuuaua

SEQ ID NO: 1489382 - RNA, 19 nt, Homo sapiens
aaacuggauuguuggguau

SEQ ID NO: 1489383 - RNA, 19 nt, Homo sapiens
uaaucuugcugcuuauaug

SEQ ID NO: 1489384 - RNA, 19 nt, Homo sapiens
guaguugccaucagauuug

SEQ ID NO: 1489385 - RNA, 19 nt, Homo sapiens
cggaagaguccuuauguug

SEQ ID NO: 1489386 - RNA, 19 nt, Homo sapiens
guacugucacuacaauauu

SEQ ID NO: 1489387 - RNA, 19 nt, Homo sapiens
ucaguacugucacuacaau

SEQ ID NO: 1489388 - RNA, 19 nt, Homo sapiens
caaucaaccucaguacugu

SEQ ID NO: 1489389 - RNA, 19 nt, Homo sapiens
gcaaauguuauucuguugu

SEQ ID NO: 1489390 - RNA, 19 nt, Homo sapiens
uggaaaggauguuuaacuc

SEQ ID NO: 1489391 - RNA, 19 nt, Homo sapiens
guccuuauguugcaguaug

SEQ ID NO: 1489392 - RNA, 19 nt, Homo sapiens
guaaucuugcugcuuauau

SEQ ID NO: 1489393 - RNA, 19 nt, Homo sapiens
ggaaaggauguuuaacucu

SEQ ID NO: 1489394 - RNA, 19 nt, Homo sapiens
gugcuuauauucgauccuu

SEQ ID NO: 1489395 - RNA, 19 nt, Homo sapiens
uccagaugcuguucucuau

SEQ ID NO: 1489396 - RNA, 19 nt, Homo sapiens
ugcaguaugcuguauagua

SEQ ID NO: 1489397 - RNA, 19 nt, Homo sapiens
gaagugugccagaauuggu

SEQ ID NO: 1489398 - RNA, 19 nt, Homo sapiens
acaaucaaccucaguacug

SEQ ID NO: 1489399 - RNA, 19 nt, Homo sapiens
gcuguucucuauuuuaaug

SEQ ID NO: 1489400 - RNA, 19 nt, Homo sapiens
ccucaguacugucacuaca

SEQ ID NO: 1489401 - RNA, 19 nt, Homo sapiens
uaaauuuccagaugcuguu

SEQ ID NO: 1489402 - RNA, 19 nt, Homo sapiens
aguaugcuguauaguaaug

SEQ ID NO: 1489403 - RNA, 19 nt, Homo sapiens
guugcaguaugcuguauag

SEQ ID NO: 1489404 - RNA, 19 nt, Homo sapiens
uaccugugcuuauauucga

SEQ ID NO: 1489405 - RNA, 19 nt, Homo sapiens
uguaguugccaucagauuu

SEQ ID NO: 1489406 - RNA, 19 nt, Homo sapiens
gaaaaugccagaauguagu

SEQ ID NO: 1489407 - RNA, 19 nt, Homo sapiens
ugucugccauuuucaauuu

SEQ ID NO: 1489408 - RNA, 19 nt, Homo sapiens
uuggaagugugccagaauu

SEQ ID NO: 1489409 - RNA, 19 nt, Homo sapiens
ggaaaaugccagaauguag

SEQ ID NO: 1489410 - RNA, 19 nt, Homo sapiens
cuaaggcacauaguagaaa

SEQ ID NO: 1489411 - RNA, 19 nt, Homo sapiens
ggacugacugcagaaaaua

SEQ ID NO: 1489412 - RNA, 19 nt, Homo sapiens
cuucagcauccucuucaua

SEQ ID NO: 1489413 - RNA, 19 nt, Homo sapiens
acggaagaguccuuauguu

SEQ ID NO: 1489414 - RNA, 19 nt, Homo sapiens
gcauccucuucauacagua

SEQ ID NO: 1489415 - RNA, 19 nt, Homo sapiens
guuaauuacucaaguuccu

SEQ ID NO: 1489416 - RNA, 19 nt, Homo sapiens
uaaggcacauaguagaaaa

SEQ ID NO: 1489417 - RNA, 19 nt, Homo sapiens
caaccucaguacugucacu

SEQ ID NO: 1489418 - RNA, 19 nt, Homo sapiens
gaguccuuauguugcagua

SEQ ID NO: 1489419 - RNA, 19 nt, Homo sapiens
gugaacggaagaguccuua

SEQ ID NO: 1489420 - RNA, 19 nt, Homo sapiens
ggaagugugccagaauugg

SEQ ID NO: 1489421 - RNA, 19 nt, Homo sapiens
ucagcauccucuucauaca

SEQ ID NO: 1489422 - RNA, 19 nt, Homo sapiens
uauauguaccugugcuuau

SEQ ID NO: 1489423 - RNA, 19 nt, Homo sapiens
ugcaaauguuauucuguug

SEQ ID NO: 1489424 - RNA, 19 nt, Homo sapiens
uggauuguuggguauauuu

SEQ ID NO: 1489425 - RNA, 19 nt, Homo sapiens
ccagaugcuguucucuauu

SEQ ID NO: 1489426 - RNA, 19 nt, Homo sapiens
uuauauguaccugugcuua

SEQ ID NO: 1489427 - RNA, 19 nt, Homo sapiens
ucucuaaggcacauaguag

SEQ ID NO: 1489428 - RNA, 19 nt, Homo sapiens
uaacaaucaaccucaguac

SEQ ID NO: 1489429 - RNA, 19 nt, Homo sapiens
caaggacugacugcagaaa

SEQ ID NO: 1489430 - RNA, 19 nt, Homo sapiens
gggaaaaugccagaaugua

SEQ ID NO: 1489431 - RNA, 19 nt, Homo sapiens
uaguugccaucagauuuga

SEQ ID NO: 1489432 - RNA, 19 nt, Homo sapiens
uacaguagcuggggaaaau

SEQ ID NO: 1489433 - RNA, 19 nt, Homo sapiens
aaagaaagcugcauaguua

SEQ ID NO: 1489434 - RNA, 19 nt, Homo sapiens
ggaaaugaauaucagcuua

SEQ ID NO: 1489435 - RNA, 19 nt, Homo sapiens
gcuaaagucucuucuguug

SEQ ID NO: 1489436 - RNA, 19 nt, Homo sapiens
ucacaugacucuaguuauu

SEQ ID NO: 1489437 - RNA, 19 nt, Homo sapiens
agagauagcuacuguauau

SEQ ID NO: 1489438 - RNA, 19 nt, Homo sapiens
guagucaccugcaagcuua

SEQ ID NO: 1489439 - RNA, 19 nt, Homo sapiens
gaagaaagcaaauacaaug

SEQ ID NO: 1489440 - RNA, 19 nt, Homo sapiens
caacagaaaggaagagaua

SEQ ID NO: 1489441 - RNA, 19 nt, Homo sapiens
ccaaaucacccuuuaaauu

SEQ ID NO: 1489442 - RNA, 19 nt, Homo sapiens
uaacugaagucuacuacaa

SEQ ID NO: 1489443 - RNA, 19 nt, Homo sapiens
gauccuaacuaguuccuuu

SEQ ID NO: 1489444 - RNA, 19 nt, Homo sapiens
gaagagauagcuacuguau

SEQ ID NO: 1489445 - RNA, 19 nt, Homo sapiens
agaacaaucuucaaacuga

SEQ ID NO: 1489446 - RNA, 19 nt, Homo sapiens
ccaauucuguuuacucuga

SEQ ID NO: 1489447 - RNA, 19 nt, Homo sapiens
uaaaauaucugugcccuua

SEQ ID NO: 1489448 - RNA, 19 nt, Homo sapiens
gauuauaccucacuauucu

SEQ ID NO: 1489449 - RNA, 19 nt, Homo sapiens
guuuggaccugccauauuu

SEQ ID NO: 1489450 - RNA, 19 nt, Homo sapiens
gcaccuuuauuuaugguuu

SEQ ID NO: 1489451 - RNA, 19 nt, Homo sapiens
gcaugaaucucaguuaaca

SEQ ID NO: 1489452 - RNA, 19 nt, Homo sapiens
gaaagcugcauaguuauuu

SEQ ID NO: 1489453 - RNA, 19 nt, Homo sapiens
uaaagaaagcugcauaguu

SEQ ID NO: 1489454 - RNA, 19 nt, Homo sapiens
ggagaugaauaugguuaaa

SEQ ID NO: 1489455 - RNA, 19 nt, Homo sapiens
gaaucuaucucuaccuuac

SEQ ID NO: 1489456 - RNA, 19 nt, Homo sapiens
ccugcaagcuuauuuaaau

SEQ ID NO: 1489457 - RNA, 19 nt, Homo sapiens
cugcgacucugguuaauaa

SEQ ID NO: 1489458 - RNA, 19 nt, Homo sapiens
gaaaguaagccauuaacca

SEQ ID NO: 1489459 - RNA, 19 nt, Homo sapiens
gggcuaaagucucuucugu

SEQ ID NO: 1489460 - RNA, 19 nt, Homo sapiens
caaagucaguuacagaagu

SEQ ID NO: 1489461 - RNA, 19 nt, Homo sapiens
aaugguggcucgagucuuu

SEQ ID NO: 1489462 - RNA, 19 nt, Homo sapiens
uaaagucucuucuguuggu

SEQ ID NO: 1489463 - RNA, 19 nt, Homo sapiens
aaauaucugugcccuuaaa

SEQ ID NO: 1489464 - RNA, 19 nt, Homo sapiens
gauauugaccuucaucuag

SEQ ID NO: 1489465 - RNA, 19 nt, Homo sapiens
guauacagcugguuguuac

SEQ ID NO: 1489466 - RNA, 19 nt, Homo sapiens
caaacugagccaugcuuua

SEQ ID NO: 1489467 - RNA, 19 nt, Homo sapiens
ugaaacaucucacaugacu

SEQ ID NO: 1489468 - RNA, 19 nt, Homo sapiens
aaagcaagguuuagaaucu

SEQ ID NO: 1489469 - RNA, 19 nt, Homo sapiens
gauugcugcuugccucuuu

SEQ ID NO: 1489470 - RNA, 19 nt, Homo sapiens
ggugaaagaucuguuugug

SEQ ID NO: 1489471 - RNA, 19 nt, Homo sapiens
gaaacaaagucaguuacag

SEQ ID NO: 1489472 - RNA, 19 nt, Homo sapiens
caauacugaucagacuuua

SEQ ID NO: 1489473 - RNA, 19 nt, Homo sapiens
cagaaucuaucucuaccuu

SEQ ID NO: 1489474 - RNA, 19 nt, Homo sapiens
uggaucagaugaagaaaga

SEQ ID NO: 1489475 - RNA, 19 nt, Homo sapiens
ucaaagcaauggcaguguu

SEQ ID NO: 1489476 - RNA, 19 nt, Homo sapiens
cacaguggcugcuacaguu

SEQ ID NO: 1489477 - RNA, 19 nt, Homo sapiens
uggcaugaaucucaguuaa

SEQ ID NO: 1489478 - RNA, 19 nt, Homo sapiens
ggacuucugucuuuucuga

SEQ ID NO: 1489479 - RNA, 19 nt, Homo sapiens
gauuacgacuggcucaaau

SEQ ID NO: 1489480 - RNA, 19 nt, Homo sapiens
gaaaugaauaucagcuuag

SEQ ID NO: 1489481 - RNA, 19 nt, Homo sapiens
uaauggagaugaauauggu

SEQ ID NO: 1489482 - RNA, 19 nt, Homo sapiens
agaagaugguggugaaaga

SEQ ID NO: 1489483 - RNA, 19 nt, Homo sapiens
aaacaaagucaguuacaga

SEQ ID NO: 1489484 - RNA, 19 nt, Homo sapiens
cuagaaacaaagucaguua

SEQ ID NO: 1489485 - RNA, 19 nt, Homo sapiens
ugagagggcuaucuacaag

SEQ ID NO: 1489486 - RNA, 19 nt, Homo sapiens
caccaaagacuacauuaug

SEQ ID NO: 1489487 - RNA, 19 nt, Homo sapiens
guaucaacauccuacagaa

SEQ ID NO: 1489488 - RNA, 19 nt, Homo sapiens
gauagcuacuguauauuac

SEQ ID NO: 1489489 - RNA, 19 nt, Homo sapiens
cuacaaggguaauauuucu

SEQ ID NO: 1489490 - RNA, 19 nt, Homo sapiens
gguaugagagggcuaucua

SEQ ID NO: 1489491 - RNA, 19 nt, Homo sapiens
uuucugaccugguggauug

SEQ ID NO: 1489492 - RNA, 19 nt, Homo sapiens
caacuucuuggcaccuuua

SEQ ID NO: 1489493 - RNA, 19 nt, Homo sapiens
ucuaguaacugaagucuac

SEQ ID NO: 1489494 - RNA, 19 nt, Homo sapiens
acaguuguguaucuaguaa

SEQ ID NO: 1489495 - RNA, 19 nt, Homo sapiens
ugcauuacuuuccagaaua

SEQ ID NO: 1489496 - RNA, 19 nt, Homo sapiens
ggauauugaccuucaucua

SEQ ID NO: 1489497 - RNA, 19 nt, Homo sapiens
ugacuugaaugagauguau

SEQ ID NO: 1489498 - RNA, 19 nt, Homo sapiens
cuaccuguauguauuguau

SEQ ID NO: 1489499 - RNA, 19 nt, Homo sapiens
gaaaggggcuaaagucucu

SEQ ID NO: 1489500 - RNA, 19 nt, Homo sapiens
gguauacagcugguuguua

SEQ ID NO: 1489501 - RNA, 19 nt, Homo sapiens
uuugaaacaucucacauga

SEQ ID NO: 1489502 - RNA, 19 nt, Homo sapiens
accaaagacuacauuauga

SEQ ID NO: 1489503 - RNA, 19 nt, Homo sapiens
gacauuuccuggauuacga

SEQ ID NO: 1489504 - RNA, 19 nt, Homo sapiens
cauugaaaguaagccauua

SEQ ID NO: 1489505 - RNA, 19 nt, Homo sapiens
cauaucagaaugucuugua

SEQ ID NO: 1489506 - RNA, 19 nt, Homo sapiens
cagaagaaagcaaauacaa

SEQ ID NO: 1489507 - RNA, 19 nt, Homo sapiens
ccaaagacuacauuaugaa

SEQ ID NO: 1489508 - RNA, 19 nt, Homo sapiens
gcauuacuuuccagaauac

SEQ ID NO: 1489509 - RNA, 19 nt, Homo sapiens
ucucuucuguugguaauuu

SEQ ID NO: 1489510 - RNA, 19 nt, Homo sapiens
cuucuuggcaccuuuauuu

SEQ ID NO: 1489511 - RNA, 19 nt, Homo sapiens
uuugacauuuccuggauua

SEQ ID NO: 1489512 - RNA, 19 nt, Homo sapiens
ggaauuuggacuugaaaca

SEQ ID NO: 1489513 - RNA, 19 nt, Homo sapiens
uaugaagccuacacaggaa

SEQ ID NO: 1489514 - RNA, 19 nt, Homo sapiens
cugacuaccuguauguauu

SEQ ID NO: 1489515 - RNA, 19 nt, Homo sapiens
ucaauacugaucagacuuu

SEQ ID NO: 1489516 - RNA, 19 nt, Homo sapiens
uauaacuacugcugcuuga

SEQ ID NO: 1489517 - RNA, 19 nt, Homo sapiens
ugacucuaguuauugauug

SEQ ID NO: 1489518 - RNA, 19 nt, Homo sapiens
gaaaccuccagcagucuuu

SEQ ID NO: 1489519 - RNA, 19 nt, Homo sapiens
cauuaaccauuccaaagga

SEQ ID NO: 1489520 - RNA, 19 nt, Homo sapiens
uaacuacugcugcuugaga

SEQ ID NO: 1489521 - RNA, 19 nt, Homo sapiens
gaagauuauaccucacuau

SEQ ID NO: 1489522 - RNA, 19 nt, Homo sapiens
aggaagagauagcuacugu

SEQ ID NO: 1489523 - RNA, 19 nt, Homo sapiens
acaugacucuaguuauuga

SEQ ID NO: 1489524 - RNA, 19 nt, Homo sapiens
ugaauuaccaucagcugaa

SEQ ID NO: 1489525 - RNA, 19 nt, Homo sapiens
gacagaagccacauucgau

SEQ ID NO: 1489526 - RNA, 19 nt, Homo sapiens
gacccucucuuucgcuguu

SEQ ID NO: 1489527 - RNA, 19 nt, Homo sapiens
cuacacaggaaaugaauau

SEQ ID NO: 1489528 - RNA, 19 nt, Homo sapiens
ggaagagauagcuacugua

SEQ ID NO: 1489529 - RNA, 19 nt, Homo sapiens
ucaacauccuacagaagaa

SEQ ID NO: 1489530 - RNA, 19 nt, Homo sapiens
ucucacaugacucuaguua

SEQ ID NO: 1489531 - RNA, 19 nt, Homo sapiens
ccacugggcaaagaaagua

SEQ ID NO: 1489532 - RNA, 19 nt, Homo sapiens
cucgauggcuacucuguaa

SEQ ID NO: 1489533 - RNA, 19 nt, Homo sapiens
gaaaugugcuucacugguu

SEQ ID NO: 1489534 - RNA, 19 nt, Homo sapiens
gaaaguaguugucauucuu

SEQ ID NO: 1489535 - RNA, 19 nt, Homo sapiens
gaagagaauucgaguuuua

SEQ ID NO: 1489536 - RNA, 19 nt, Homo sapiens
gcgaagaaaccaauacaua

SEQ ID NO: 1489537 - RNA, 19 nt, Homo sapiens
guacaagccuuuaaagaag

SEQ ID NO: 1489538 - RNA, 19 nt, Homo sapiens
gaaaagaacagcaaucuaa

SEQ ID NO: 1489539 - RNA, 19 nt, Homo sapiens
gaaaagaagugaagagaau

SEQ ID NO: 1489540 - RNA, 19 nt, Homo sapiens
cgaagaaaccaauacauaa

SEQ ID NO: 1489541 - RNA, 19 nt, Homo sapiens
uaaagaagauacaggugaa

SEQ ID NO: 1489542 - RNA, 19 nt, Homo sapiens
gauggaacauggaccuaaa

SEQ ID NO: 1489543 - RNA, 19 nt, Homo sapiens
ggaauugaaaccugacaua

SEQ ID NO: 1489544 - RNA, 19 nt, Homo sapiens
gcuauuacuuaaacucgua

SEQ ID NO: 1489545 - RNA, 19 nt, Homo sapiens
gcuaaaagcugcuguacaa

SEQ ID NO: 1489546 - RNA, 19 nt, Homo sapiens
gaacucugaaccucaauaa

SEQ ID NO: 1489547 - RNA, 19 nt, Homo sapiens
uaacagugauggcggagaa

SEQ ID NO: 1489548 - RNA, 19 nt, Homo sapiens
gaucauauuccuucaucua

SEQ ID NO: 1489549 - RNA, 19 nt, Homo sapiens
gaugauagcacagaagaaa

SEQ ID NO: 1489550 - RNA, 19 nt, Homo sapiens
gcucugcagcuauuacuua

SEQ ID NO: 1489551 - RNA, 19 nt, Homo sapiens
ggugacgacuucuucauug

SEQ ID NO: 1489552 - RNA, 19 nt, Homo sapiens
gugaagaggagaaggaaua

SEQ ID NO: 1489553 - RNA, 19 nt, Homo sapiens
auugaaaccugacauagua

SEQ ID NO: 1489554 - RNA, 19 nt, Homo sapiens
ggaaaguaguugucauucu

SEQ ID NO: 1489555 - RNA, 19 nt, Homo sapiens
uacugaagaugcacuguua

SEQ ID NO: 1489556 - RNA, 19 nt, Homo sapiens
gugaagagaauucgaguuu

SEQ ID NO: 1489557 - RNA, 19 nt, Homo sapiens
gaaagaaggaaaguaguug

SEQ ID NO: 1489558 - RNA, 19 nt, Homo sapiens
guaacuaaaucugcucuug

SEQ ID NO: 1489559 - RNA, 19 nt, Homo sapiens
gcacuaccaugcccagcuu

SEQ ID NO: 1489560 - RNA, 19 nt, Homo sapiens
ccagaucacccuuguuaaa

SEQ ID NO: 1489561 - RNA, 19 nt, Homo sapiens
guacagaaaccagaaaguu

SEQ ID NO: 1489562 - RNA, 19 nt, Homo sapiens
gaaaaggauucuguaguuu

SEQ ID NO: 1489563 - RNA, 19 nt, Homo sapiens
agacuagaguacaauauug

SEQ ID NO: 1489564 - RNA, 19 nt, Homo sapiens
ucaaagaacaggcuccaaa

SEQ ID NO: 1489565 - RNA, 19 nt, Homo sapiens
uacagaaaccagaaaguua

SEQ ID NO: 1489566 - RNA, 19 nt, Homo sapiens
aaacauaggaaaucagcua

SEQ ID NO: 1489567 - RNA, 19 nt, Homo sapiens
gcucuguuguuuccuuaaa

SEQ ID NO: 1489568 - RNA, 19 nt, Homo sapiens
aaacaagaucccuagauuu

SEQ ID NO: 1489569 - RNA, 19 nt, Homo sapiens
gaaggaaaguaguugucau

SEQ ID NO: 1489570 - RNA, 19 nt, Homo sapiens
ccagaaaguuagaaucagu

SEQ ID NO: 1489571 - RNA, 19 nt, Homo sapiens
aagaggagaaggaauauuu

SEQ ID NO: 1489572 - RNA, 19 nt, Homo sapiens
caucaaagaaugcuucaga

SEQ ID NO: 1489573 - RNA, 19 nt, Homo sapiens
aaccagaucacccuuguua

SEQ ID NO: 1489574 - RNA, 19 nt, Homo sapiens
gaagcuaucaggaagacuu

SEQ ID NO: 1489575 - RNA, 19 nt, Homo sapiens
uaaaccagaucacccuugu

SEQ ID NO: 1489576 - RNA, 19 nt, Homo sapiens
gaaguaauuuggggauuuu

SEQ ID NO: 1489577 - RNA, 19 nt, Homo sapiens
cgaaagaaggaaaguaguu

SEQ ID NO: 1489578 - RNA, 19 nt, Homo sapiens
ucacaaauccaauauguac

SEQ ID NO: 1489579 - RNA, 19 nt, Homo sapiens
guacaauauugcaaucaca

SEQ ID NO: 1489580 - RNA, 19 nt, Homo sapiens
caucaaagccuucagaaaa

SEQ ID NO: 1489581 - RNA, 19 nt, Homo sapiens
uguacaagccuuuaaagaa

SEQ ID NO: 1489582 - RNA, 19 nt, Homo sapiens
uauaagccuuucacaaauc

SEQ ID NO: 1489583 - RNA, 19 nt, Homo sapiens
uaacgagguugugaagaug

SEQ ID NO: 1489584 - RNA, 19 nt, Homo sapiens
cagcucuguuguuuccuua

SEQ ID NO: 1489585 - RNA, 19 nt, Homo sapiens
aaaacaagaucccuagauu

SEQ ID NO: 1489586 - RNA, 19 nt, Homo sapiens
gaaaccagaaaguuagaau

SEQ ID NO: 1489587 - RNA, 19 nt, Homo sapiens
ugauagcggugacgacuuc

SEQ ID NO: 1489588 - RNA, 19 nt, Homo sapiens
caagcagucuuccaugucu

SEQ ID NO: 1489589 - RNA, 19 nt, Homo sapiens
cagacuguuucccuuauga

SEQ ID NO: 1489590 - RNA, 19 nt, Homo sapiens
uaaaucugcucuuggugau

SEQ ID NO: 1489591 - RNA, 19 nt, Homo sapiens
aaacuugucaggaguguug

SEQ ID NO: 1489592 - RNA, 19 nt, Homo sapiens
cuguuucccuuaugaagua

SEQ ID NO: 1489593 - RNA, 19 nt, Homo sapiens
uaauaucccucagacuguu

SEQ ID NO: 1489594 - RNA, 19 nt, Homo sapiens
ggaacucugaaccucaaua

SEQ ID NO: 1489595 - RNA, 19 nt, Homo sapiens
gcaguacauccucuucuga

SEQ ID NO: 1489596 - RNA, 19 nt, Homo sapiens
auaacgagguugugaagau

SEQ ID NO: 1489597 - RNA, 19 nt, Homo sapiens
cagacuagaguacaauauu

SEQ ID NO: 1489598 - RNA, 19 nt, Homo sapiens
aauaagaagcuaucaggaa

SEQ ID NO: 1489599 - RNA, 19 nt, Homo sapiens
uagcacagaagaaagguuu

SEQ ID NO: 1489600 - RNA, 19 nt, Homo sapiens
aaucugcucuuggugauga

SEQ ID NO: 1489601 - RNA, 19 nt, Homo sapiens
gaauugaaaccugacauag

SEQ ID NO: 1489602 - RNA, 19 nt, Homo sapiens
cagugacuauugcaaauuc

SEQ ID NO: 1489603 - RNA, 19 nt, Homo sapiens
gcagugacuauugcaaauu

SEQ ID NO: 1489604 - RNA, 19 nt, Homo sapiens
ggauacaagaaaugacaaa

SEQ ID NO: 1489605 - RNA, 19 nt, Homo sapiens
cuaaagcagugacuauugc

SEQ ID NO: 1489606 - RNA, 19 nt, Homo sapiens
ccucagacuguuucccuua

SEQ ID NO: 1489607 - RNA, 19 nt, Homo sapiens
guacugaagaugcacuguu

SEQ ID NO: 1489608 - RNA, 19 nt, Homo sapiens
gagaaggaauauuuugaug

SEQ ID NO: 1489609 - RNA, 19 nt, Homo sapiens
gaagaggagaaggaauauu

SEQ ID NO: 1489610 - RNA, 19 nt, Homo sapiens
gaccuaaagcagugacuau

SEQ ID NO: 1489611 - RNA, 19 nt, Homo sapiens
cagauucuacugcaacuga

SEQ ID NO: 1489612 - RNA, 19 nt, Homo sapiens
ggauuuuagugaucucaua

SEQ ID NO: 1489613 - RNA, 19 nt, Homo sapiens
gaagauacaggugaaacuc

SEQ ID NO: 1489614 - RNA, 19 nt, Homo sapiens
uacaagcagucuuccaugu

SEQ ID NO: 1489615 - RNA, 19 nt, Homo sapiens
ggagaagaauuuugugaag

SEQ ID NO: 1489616 - RNA, 19 nt, Homo sapiens
gcacagaagaaagguuuua

SEQ ID NO: 1489617 - RNA, 19 nt, Homo sapiens
gagaagaauuuugugaaga

SEQ ID NO: 1489618 - RNA, 19 nt, Homo sapiens
auagcucacucucugguaa

SEQ ID NO: 1489619 - RNA, 19 nt, Homo sapiens
guucagcucuguuguuucc

SEQ ID NO: 1489620 - RNA, 19 nt, Homo sapiens
ugguucagcucuguuguuu

SEQ ID NO: 1489621 - RNA, 19 nt, Homo sapiens
gacaaaaucaagccaagua

SEQ ID NO: 1489622 - RNA, 19 nt, Homo sapiens
caaagauugcuugaagaaa

SEQ ID NO: 1489623 - RNA, 19 nt, Homo sapiens
ccuaaagcagugacuauug

SEQ ID NO: 1489624 - RNA, 19 nt, Homo sapiens
gacaaaauguugcugaagu

SEQ ID NO: 1489625 - RNA, 19 nt, Homo sapiens
aaagagcaauugccagacu

SEQ ID NO: 1489626 - RNA, 19 nt, Homo sapiens
gcaacugaaagagcaauug

SEQ ID NO: 1489627 - RNA, 19 nt, Homo sapiens
uuaaguacuugugaucaug

SEQ ID NO: 1489628 - RNA, 19 nt, Homo sapiens
gugcuuaucaugaaaugug

SEQ ID NO: 1489629 - RNA, 19 nt, Homo sapiens
cuuuagugcuuaucaugaa

SEQ ID NO: 1489630 - RNA, 19 nt, Homo sapiens
cagaucaagaaucaguuua

SEQ ID NO: 1489631 - RNA, 19 nt, Homo sapiens
ucagaucaagaaucaguuu

SEQ ID NO: 1489632 - RNA, 19 nt, Homo sapiens
aaagucagacggacacgaa

SEQ ID NO: 1489633 - RNA, 19 nt, Homo sapiens
gaacgaaauuaccuuugua

SEQ ID NO: 1489634 - RNA, 19 nt, Homo sapiens
gaccaucuguaucuuguua

SEQ ID NO: 1489635 - RNA, 19 nt, Homo sapiens
ucauggugcucuuaaauua

SEQ ID NO: 1489636 - RNA, 19 nt, Homo sapiens
gcucuuaaauuacauguca

SEQ ID NO: 1489637 - RNA, 19 nt, Homo sapiens
gggauaaaguccuacuaaa

SEQ ID NO: 1489638 - RNA, 19 nt, Homo sapiens
ugaauucccuugcgccuuu

SEQ ID NO: 1489639 - RNA, 19 nt, Homo sapiens
ucaaagaacaguuaacuug

SEQ ID NO: 1489640 - RNA, 19 nt, Homo sapiens
guaacaggaugaaacaguu

SEQ ID NO: 1489641 - RNA, 19 nt, Homo sapiens
aaugugcccuggugaaaua

SEQ ID NO: 1489642 - RNA, 19 nt, Homo sapiens
ucacauagguauccucagu

SEQ ID NO: 1489643 - RNA, 19 nt, Homo sapiens
ccacugggauaaaguccua

SEQ ID NO: 1489644 - RNA, 19 nt, Homo sapiens
agagagagcuauugaugau

SEQ ID NO: 1489645 - RNA, 19 nt, Homo sapiens
gaagacagacccucagaca

SEQ ID NO: 1489646 - RNA, 19 nt, Homo sapiens
gugauuaguuguugcuuau

SEQ ID NO: 1489647 - RNA, 19 nt, Homo sapiens
cagcauguuugacuugauu

SEQ ID NO: 1489648 - RNA, 19 nt, Homo sapiens
acaguuaacuuggugcuaa

SEQ ID NO: 1489649 - RNA, 19 nt, Homo sapiens
caaucagcauggaauguuu

SEQ ID NO: 1489650 - RNA, 19 nt, Homo sapiens
gagcuacauagacuacuua

SEQ ID NO: 1489651 - RNA, 19 nt, Homo sapiens
aauaucagcucauguucuu

SEQ ID NO: 1489652 - RNA, 19 nt, Homo sapiens
cagcccaagugccgucuua

SEQ ID NO: 1489653 - RNA, 19 nt, Homo sapiens
acauagguauccucaguaa

SEQ ID NO: 1489654 - RNA, 19 nt, Homo sapiens
auaaugugguacacuguua

SEQ ID NO: 1489655 - RNA, 19 nt, Homo sapiens
cagcucauguucuuauuuc

SEQ ID NO: 1489656 - RNA, 19 nt, Homo sapiens
uaacacuuguccuacauuc

SEQ ID NO: 1489657 - RNA, 19 nt, Homo sapiens
caugaugcccuauuccuaa

SEQ ID NO: 1489658 - RNA, 19 nt, Homo sapiens
agaacgaaauuaccuuugu

SEQ ID NO: 1489659 - RNA, 19 nt, Homo sapiens
ccagagagagcuauugaug

SEQ ID NO: 1489660 - RNA, 19 nt, Homo sapiens
gucagugcaucacauauau

SEQ ID NO: 1489661 - RNA, 19 nt, Homo sapiens
guaaauguacccuaaugau

SEQ ID NO: 1489662 - RNA, 19 nt, Homo sapiens
cgucuuagccauucaguga

SEQ ID NO: 1489663 - RNA, 19 nt, Homo sapiens
ugugauuaguuguugcuua

SEQ ID NO: 1489664 - RNA, 19 nt, Homo sapiens
gcuacaugaugcccuauuc

SEQ ID NO: 1489665 - RNA, 19 nt, Homo sapiens
gcacagaauguaacaggau

SEQ ID NO: 1489666 - RNA, 19 nt, Homo sapiens
gcaucagagugccuuucua

SEQ ID NO: 1489667 - RNA, 19 nt, Homo sapiens
aaacagcccauggguagua

SEQ ID NO: 1489668 - RNA, 19 nt, Homo sapiens
uaacacagaacgaaauuac

SEQ ID NO: 1489669 - RNA, 19 nt, Homo sapiens
ggauaaaguccuacuaaaa

SEQ ID NO: 1489670 - RNA, 19 nt, Homo sapiens
gauuaaaccccgugagaua

SEQ ID NO: 1489671 - RNA, 19 nt, Homo sapiens
aaguaagccuugaauugaa

SEQ ID NO: 1489672 - RNA, 19 nt, Homo sapiens
gaauguaacaggaugaaac

SEQ ID NO: 1489673 - RNA, 19 nt, Homo sapiens
aaagaacaguuaacuuggu

SEQ ID NO: 1489674 - RNA, 19 nt, Homo sapiens
ugugguacacuguuaauuu

SEQ ID NO: 1489675 - RNA, 19 nt, Homo sapiens
ugucagugcaucacauaua

SEQ ID NO: 1489676 - RNA, 19 nt, Homo sapiens
cgugagauacauaugauuu

SEQ ID NO: 1489677 - RNA, 19 nt, Homo sapiens
ggcaguuucuguggcauuu

SEQ ID NO: 1489678 - RNA, 19 nt, Homo sapiens
aguaagccuugaauugaaa

SEQ ID NO: 1489679 - RNA, 19 nt, Homo sapiens
ggacaaucagcauggaaug

SEQ ID NO: 1489680 - RNA, 19 nt, Homo sapiens
gguuugcuguggacaauca

SEQ ID NO: 1489681 - RNA, 19 nt, Homo sapiens
gugcaucacauauaucaug

SEQ ID NO: 1489682 - RNA, 19 nt, Homo sapiens
agagagcuauugaugauac

SEQ ID NO: 1489683 - RNA, 19 nt, Homo sapiens
acauaaauaucagcucaug

SEQ ID NO: 1489684 - RNA, 19 nt, Homo sapiens
aauaaaagaugggcaguuu

SEQ ID NO: 1489685 - RNA, 19 nt, Homo sapiens
cagagagagcuauugauga

SEQ ID NO: 1489686 - RNA, 19 nt, Homo sapiens
uuauugccauguuuccuaa

SEQ ID NO: 1489687 - RNA, 19 nt, Homo sapiens
guaacacagaacgaaauua

SEQ ID NO: 1489688 - RNA, 19 nt, Homo sapiens
uagaagaccagcccaagug

SEQ ID NO: 1489689 - RNA, 19 nt, Homo sapiens
gugguacacuguuaauuuu

SEQ ID NO: 1489690 - RNA, 19 nt, Homo sapiens
ugagcuacauagacuacuu

SEQ ID NO: 1489691 - RNA, 19 nt, Homo sapiens
gagccacgcacagaaugua

SEQ ID NO: 1489692 - RNA, 19 nt, Homo sapiens
gaagaggagggcagucagu

SEQ ID NO: 1489693 - RNA, 19 nt, Homo sapiens
uuucauagcacaucacaau

SEQ ID NO: 1489694 - RNA, 19 nt, Homo sapiens
gcucauguucuuauuucaa

SEQ ID NO: 1489695 - RNA, 19 nt, Homo sapiens
uaucagcucauguucuuau

SEQ ID NO: 1489696 - RNA, 19 nt, Homo sapiens
caucauggugcucuuaaau

SEQ ID NO: 1489697 - RNA, 19 nt, Homo sapiens
aaaaggaacgguaaaugua

SEQ ID NO: 1489698 - RNA, 19 nt, Homo sapiens
ugggauaaaguccuacuaa

SEQ ID NO: 1489699 - RNA, 19 nt, Homo sapiens
caucagagugccuuucuag

SEQ ID NO: 1489700 - RNA, 19 nt, Homo sapiens
ccuggaaacuaccauugug

SEQ ID NO: 1489701 - RNA, 19 nt, Homo sapiens
gauuucuuauuaccgacua

SEQ ID NO: 1489702 - RNA, 19 nt, Homo sapiens
ucacaauacugcugcuacu

SEQ ID NO: 1489703 - RNA, 19 nt, Homo sapiens
gcuaaugugcccuggugaa

SEQ ID NO: 1489704 - RNA, 19 nt, Homo sapiens
gagagagcuauugaugaua

SEQ ID NO: 1489705 - RNA, 19 nt, Homo sapiens
cauagcacaucacaauacu

SEQ ID NO: 1489706 - RNA, 19 nt, Homo sapiens
acucaguaauaauguggua

SEQ ID NO: 1489707 - RNA, 19 nt, Homo sapiens
aaagaugggcaguuucugu

SEQ ID NO: 1489708 - RNA, 19 nt, Homo sapiens
gcccuggugaaauaaauaa

SEQ ID NO: 1489709 - RNA, 19 nt, Homo sapiens
cuuguuaccugcuuucucu

SEQ ID NO: 1489710 - RNA, 19 nt, Homo sapiens
acagaacgaaauuaccuuu

SEQ ID NO: 1489711 - RNA, 19 nt, Homo sapiens
auagguauccucaguaaca

SEQ ID NO: 1489712 - RNA, 19 nt, Homo sapiens
uaccucaccuggaaacuac

SEQ ID NO: 1489713 - RNA, 19 nt, Homo sapiens
gaucugauuuucuccaaca

SEQ ID NO: 1489714 - RNA, 19 nt, Homo sapiens
ccuaacacuuguccuacau

SEQ ID NO: 1489715 - RNA, 19 nt, Homo sapiens
ucaguaacacagaacgaaa

SEQ ID NO: 1489716 - RNA, 19 nt, Homo sapiens
ggaaacugguacccuacac

SEQ ID NO: 1489717 - RNA, 19 nt, Homo sapiens
gagggagccacgcacagaa

SEQ ID NO: 1489718 - RNA, 19 nt, Homo sapiens
ucagagugccuuucuagag

SEQ ID NO: 1489719 - RNA, 19 nt, Homo sapiens
cagguuugcuguggacaau

SEQ ID NO: 1489720 - RNA, 19 nt, Homo sapiens
ugcaucacauauaucauga

SEQ ID NO: 1489721 - RNA, 19 nt, Homo sapiens
caacaccacaguucucaac

SEQ ID NO: 1489722 - RNA, 19 nt, Homo sapiens
uaaugugguacacuguuaa

SEQ ID NO: 1489723 - RNA, 19 nt, Homo sapiens
ccauuucauuaggaacuuu

SEQ ID NO: 1489724 - RNA, 19 nt, Homo sapiens
uaaauaucagcucauguuc

SEQ ID NO: 1489725 - RNA, 19 nt, Homo sapiens
caguuucuguggcauuuua

SEQ ID NO: 1489726 - RNA, 19 nt, Homo sapiens
cuaaugugcccuggugaaa

SEQ ID NO: 1489727 - RNA, 19 nt, Homo sapiens
gagagcuauugaugauaca

SEQ ID NO: 1489728 - RNA, 19 nt, Homo sapiens
aagccaaucuaaacaacuc

SEQ ID NO: 1489729 - RNA, 19 nt, Homo sapiens
uauccucaguaacacagaa

SEQ ID NO: 1489730 - RNA, 19 nt, Homo sapiens
uggcagaccuuccaaaagu

SEQ ID NO: 1489731 - RNA, 19 nt, Homo sapiens
acaaucagcauggaauguu

SEQ ID NO: 1489732 - RNA, 19 nt, Homo sapiens
ucuccugcuuguaaugaaa

SEQ ID NO: 1489733 - RNA, 19 nt, Homo sapiens
gaaagaaacaucagagaaa

SEQ ID NO: 1489734 - RNA, 19 nt, Homo sapiens
ggacaaagaugaauaugag

SEQ ID NO: 1489735 - RNA, 19 nt, Homo sapiens
ggaaaguucuuaagagugu

SEQ ID NO: 1489736 - RNA, 19 nt, Homo sapiens
gaggaggacuugacauuug

SEQ ID NO: 1489737 - RNA, 19 nt, Homo sapiens
gaaauuaaaugggaugagu

SEQ ID NO: 1489738 - RNA, 19 nt, Homo sapiens
gguccgagcuggaauccua

SEQ ID NO: 1489739 - RNA, 19 nt, Homo sapiens
gcagaaggauuaugauuuu

SEQ ID NO: 1489740 - RNA, 19 nt, Homo sapiens
gaaagugggacaaagauga

SEQ ID NO: 1489741 - RNA, 19 nt, Homo sapiens
cagcuucucuuguuucauu

SEQ ID NO: 1489742 - RNA, 19 nt, Homo sapiens
agaagaagauggaagagaa

SEQ ID NO: 1489743 - RNA, 19 nt, Homo sapiens
gaaggacuccaucaacuuu

SEQ ID NO: 1489744 - RNA, 19 nt, Homo sapiens
gcauguaacaggaaauuaa

SEQ ID NO: 1489745 - RNA, 19 nt, Homo sapiens
ggaaagaaacaucagagaa

SEQ ID NO: 1489746 - RNA, 19 nt, Homo sapiens
ccaccugaguucccaauaa

SEQ ID NO: 1489747 - RNA, 19 nt, Homo sapiens
ugaaggagcucagagaaga

SEQ ID NO: 1489748 - RNA, 19 nt, Homo sapiens
aagagaagcagaaggauua

SEQ ID NO: 1489749 - RNA, 19 nt, Homo sapiens
gaagagaagcagaaggauu

SEQ ID NO: 1489750 - RNA, 19 nt, Homo sapiens
gaagcuguuugacauguau

SEQ ID NO: 1489751 - RNA, 19 nt, Homo sapiens
ggccaaagcguacaagaaa

SEQ ID NO: 1489752 - RNA, 19 nt, Homo sapiens
agaagaggcucacggaaga

SEQ ID NO: 1489753 - RNA, 19 nt, Homo sapiens
uaaaugggaugaguguuug

SEQ ID NO: 1489754 - RNA, 19 nt, Homo sapiens
gaagaguuacugaggcuuu

SEQ ID NO: 1489755 - RNA, 19 nt, Homo sapiens
gggaggauauuacugcaau

SEQ ID NO: 1489756 - RNA, 19 nt, Homo sapiens
caccugaguucccaauaaa

SEQ ID NO: 1489757 - RNA, 19 nt, Homo sapiens
ggucuuagaagcuguuuga

SEQ ID NO: 1489758 - RNA, 19 nt, Homo sapiens
guuugugucugaugaguuu

SEQ ID NO: 1489759 - RNA, 19 nt, Homo sapiens
ggauauuacugcaaugucu

SEQ ID NO: 1489760 - RNA, 19 nt, Homo sapiens
gaacaucccaccuuuaucc

SEQ ID NO: 1489761 - RNA, 19 nt, Homo sapiens
uuaaaugggaugaguguuu

SEQ ID NO: 1489762 - RNA, 19 nt, Homo sapiens
gaccuaacuuugcgugugu

SEQ ID NO: 1489763 - RNA, 19 nt, Homo sapiens
gauugcauauccuugauca

SEQ ID NO: 1489764 - RNA, 19 nt, Homo sapiens
uaucccaccucuugucuga

SEQ ID NO: 1489765 - RNA, 19 nt, Homo sapiens
gcucaugguuucccucuac

SEQ ID NO: 1489766 - RNA, 19 nt, Homo sapiens
gguaaugggaaaguucuua

SEQ ID NO: 1489767 - RNA, 19 nt, Homo sapiens
gcacagauugcagagguaa

SEQ ID NO: 1489768 - RNA, 19 nt, Homo sapiens
guaaugggaaaguucuuaa

SEQ ID NO: 1489769 - RNA, 19 nt, Homo sapiens
cuuagaagcuguuugacau

SEQ ID NO: 1489770 - RNA, 19 nt, Homo sapiens
ggaugugugugcaugaauc

SEQ ID NO: 1489771 - RNA, 19 nt, Homo sapiens
ccaaagcguacaagaaaga

SEQ ID NO: 1489772 - RNA, 19 nt, Homo sapiens
gagcauguaacaggaaauu

SEQ ID NO: 1489773 - RNA, 19 nt, Homo sapiens
agaaacagaaggagaagaa

SEQ ID NO: 1489774 - RNA, 19 nt, Homo sapiens
gggacaaagaugaauauga

SEQ ID NO: 1489775 - RNA, 19 nt, Homo sapiens
uggaagaaccuguuugaug

SEQ ID NO: 1489776 - RNA, 19 nt, Homo sapiens
gaugaaggagcucagagaa

SEQ ID NO: 1489777 - RNA, 19 nt, Homo sapiens
agaagcagaaggauuauga

SEQ ID NO: 1489778 - RNA, 19 nt, Homo sapiens
gcaugcauguguauuucug

SEQ ID NO: 1489779 - RNA, 19 nt, Homo sapiens
caagaaagagaaacagaag

SEQ ID NO: 1489780 - RNA, 19 nt, Homo sapiens
ggaugaaggagcucagaga

SEQ ID NO: 1489781 - RNA, 19 nt, Homo sapiens
gugaaggacuccaucaacu

SEQ ID NO: 1489782 - RNA, 19 nt, Homo sapiens
ggucccaguuuccaguuga

SEQ ID NO: 1489783 - RNA, 19 nt, Homo sapiens
gggcuucucuggcuuuggu

SEQ ID NO: 1489784 - RNA, 19 nt, Homo sapiens
gaaacagaaggagaagaaa

SEQ ID NO: 1489785 - RNA, 19 nt, Homo sapiens
acaagaagaagauggaaga

SEQ ID NO: 1489786 - RNA, 19 nt, Homo sapiens
uggaucacauuaauggaaa

SEQ ID NO: 1489787 - RNA, 19 nt, Homo sapiens
cagagcauguaacaggaaa

SEQ ID NO: 1489788 - RNA, 19 nt, Homo sapiens
uauccuguguucugccuuu

SEQ ID NO: 1489789 - RNA, 19 nt, Homo sapiens
agaaagagaaacagaagga

SEQ ID NO: 1489790 - RNA, 19 nt, Homo sapiens
aaagaaacaucagagaaac

SEQ ID NO: 1489791 - RNA, 19 nt, Homo sapiens
uguuucagcuucucuuguu

SEQ ID NO: 1489792 - RNA, 19 nt, Homo sapiens
gugcaugcauguguauuuc

SEQ ID NO: 1489793 - RNA, 19 nt, Homo sapiens
uaacuuugcgugugugugu

SEQ ID NO: 1489794 - RNA, 19 nt, Homo sapiens
ugagauggcagcugugaug

SEQ ID NO: 1489795 - RNA, 19 nt, Homo sapiens
agaagcuguuugacaugua

SEQ ID NO: 1489796 - RNA, 19 nt, Homo sapiens
ugggaaaguucuuaagagu

SEQ ID NO: 1489797 - RNA, 19 nt, Homo sapiens
uagaagcuguuugacaugu

SEQ ID NO: 1489798 - RNA, 19 nt, Homo sapiens
acauucagguguagauugu

SEQ ID NO: 1489799 - RNA, 19 nt, Homo sapiens
acaauugucauuaccaaga

SEQ ID NO: 1489800 - RNA, 19 nt, Homo sapiens
aggaggacuugacauuuga

SEQ ID NO: 1489801 - RNA, 19 nt, Homo sapiens
gcucagagaagaggaggaa

SEQ ID NO: 1489802 - RNA, 19 nt, Homo sapiens
gaagaagauggaagagaag

SEQ ID NO: 1489803 - RNA, 19 nt, Homo sapiens
guagauuguuucagcuucu

SEQ ID NO: 1489804 - RNA, 19 nt, Homo sapiens
guguaucacuggagucaca

SEQ ID NO: 1489805 - RNA, 19 nt, Homo sapiens
gaugagauggcagcuguga

SEQ ID NO: 1489806 - RNA, 19 nt, Homo sapiens
acaagaaagagaaacagaa

SEQ ID NO: 1489807 - RNA, 19 nt, Homo sapiens
ggaggauauuacugcaaug

SEQ ID NO: 1489808 - RNA, 19 nt, Homo sapiens
auucagguguagauuguuu

SEQ ID NO: 1489809 - RNA, 19 nt, Homo sapiens
aaagaaagauggaaaacca

SEQ ID NO: 1489810 - RNA, 19 nt, Homo sapiens
ccaccuuuauccuguguuc

SEQ ID NO: 1489811 - RNA, 19 nt, Homo sapiens
caugguuucccucuacuuu

SEQ ID NO: 1489812 - RNA, 19 nt, Homo sapiens
gaucaggugaagaaacguu

SEQ ID NO: 1489813 - RNA, 19 nt, Homo sapiens
gcuggaauccuagagcauu

SEQ ID NO: 1489814 - RNA, 19 nt, Homo sapiens
ugaggaggacuugacauuu

SEQ ID NO: 1489815 - RNA, 19 nt, Homo sapiens
aagagaaacagaaggagaa

SEQ ID NO: 1489816 - RNA, 19 nt, Homo sapiens
agagaaaccugggcauguc

SEQ ID NO: 1489817 - RNA, 19 nt, Homo sapiens
ugaaggacuccaucaacuu

SEQ ID NO: 1489818 - RNA, 19 nt, Homo sapiens
cugaacaucccaccuuuau

SEQ ID NO: 1489819 - RNA, 19 nt, Homo sapiens
ggcacagauugcagaggua

SEQ ID NO: 1489820 - RNA, 19 nt, Homo sapiens
gaaaccugggcaugucuau

SEQ ID NO: 1489821 - RNA, 19 nt, Homo sapiens
gaagaaccuguuugaugca

SEQ ID NO: 1489822 - RNA, 19 nt, Homo sapiens
guuuccaguugauugcaua

SEQ ID NO: 1489823 - RNA, 19 nt, Homo sapiens
gucugaacaucccaccuuu

SEQ ID NO: 1489824 - RNA, 19 nt, Homo sapiens
guuccaccaagaagaguua

SEQ ID NO: 1489825 - RNA, 19 nt, Homo sapiens
ccaucaacuuucuggauca

SEQ ID NO: 1489826 - RNA, 19 nt, Homo sapiens
gccaaagcguacaagaaag

SEQ ID NO: 1489827 - RNA, 19 nt, Homo sapiens
uggaagagaagcagaagga

SEQ ID NO: 1489828 - RNA, 19 nt, Homo sapiens
gugacuguguggugaagga

SEQ ID NO: 1489829 - RNA, 19 nt, Homo sapiens
ucaucuaucccaccucuug

SEQ ID NO: 1489830 - RNA, 19 nt, Homo sapiens
gcaucuuuaucucuucauc

SEQ ID NO: 1489831 - RNA, 19 nt, Homo sapiens
ugaguucccaauaaagaaa

SEQ ID NO: 1489832 - RNA, 19 nt, Homo sapiens
gagaaaagaaagauggaaa

SEQ ID NO: 1489833 - RNA, 19 nt, Homo sapiens
gcaaugaucuuccuguuug

SEQ ID NO: 1489834 - RNA, 19 nt, Homo sapiens
caaagagacucagaaguua

SEQ ID NO: 1489835 - RNA, 19 nt, Homo sapiens
gagaauauauggaacaaca

SEQ ID NO: 1489836 - RNA, 19 nt, Homo sapiens
cauuacagcuucugacuaa

SEQ ID NO: 1489837 - RNA, 19 nt, Homo sapiens
gaauuaacguugccuuguu

SEQ ID NO: 1489838 - RNA, 19 nt, Homo sapiens
ucacaaaugucaaaugaug

SEQ ID NO: 1489839 - RNA, 19 nt, Homo sapiens
gcuuuggacuuuauucaua

SEQ ID NO: 1489840 - RNA, 19 nt, Homo sapiens
caagauaccaccauaagaa

SEQ ID NO: 1489841 - RNA, 19 nt, Homo sapiens
ggagauaaaugagccauca

SEQ ID NO: 1489842 - RNA, 19 nt, Homo sapiens
acagauagcugcaaugauc

SEQ ID NO: 1489843 - RNA, 19 nt, Homo sapiens
gugagaagguggaggagua

SEQ ID NO: 1489844 - RNA, 19 nt, Homo sapiens
ugaaugcacucccugguuu

SEQ ID NO: 1489845 - RNA, 19 nt, Homo sapiens
gcuacuauccguuauuuaa

SEQ ID NO: 1489846 - RNA, 19 nt, Homo sapiens
gggauaagccggugucuga

SEQ ID NO: 1489847 - RNA, 19 nt, Homo sapiens
caagcgaccugcccuauca

SEQ ID NO: 1489848 - RNA, 19 nt, Homo sapiens
uaucuuggcuuuggacuuu

SEQ ID NO: 1489849 - RNA, 19 nt, Homo sapiens
ccaaguagcugggauuaca

SEQ ID NO: 1489850 - RNA, 19 nt, Homo sapiens
acaaagagacucagaaguu

SEQ ID NO: 1489851 - RNA, 19 nt, Homo sapiens
gaacauacagugagaaggu

SEQ ID NO: 1489852 - RNA, 19 nt, Homo sapiens
gcagaagcuuagaaaguug

SEQ ID NO: 1489853 - RNA, 19 nt, Homo sapiens
gaacaacaggagauaaaug

SEQ ID NO: 1489854 - RNA, 19 nt, Homo sapiens
ggacagauagcugcaauga

SEQ ID NO: 1489855 - RNA, 19 nt, Homo sapiens
caacuuguuuggauauuca

SEQ ID NO: 1489856 - RNA, 19 nt, Homo sapiens
gguagaaggaggacagaua

SEQ ID NO: 1489857 - RNA, 19 nt, Homo sapiens
caacuucacuuucucuuuu

SEQ ID NO: 1489858 - RNA, 19 nt, Homo sapiens
cagcuuacauucacaagga

SEQ ID NO: 1489859 - RNA, 19 nt, Homo sapiens
uaauauagcugccauucag

SEQ ID NO: 1489860 - RNA, 19 nt, Homo sapiens
gauaagccggugucugaua

SEQ ID NO: 1489861 - RNA, 19 nt, Homo sapiens
acaauagacugccuuaaca

SEQ ID NO: 1489862 - RNA, 19 nt, Homo sapiens
uuaauuccauggcuuugua

SEQ ID NO: 1489863 - RNA, 19 nt, Homo sapiens
gacaggauuucacuauguu

SEQ ID NO: 1489864 - RNA, 19 nt, Homo sapiens
gagacaggauuucacuaug

SEQ ID NO: 1489865 - RNA, 19 nt, Homo sapiens
ggaguacagugguaugauc

SEQ ID NO: 1489866 - RNA, 19 nt, Homo sapiens
gaucaccaccauuauuauu

SEQ ID NO: 1489867 - RNA, 19 nt, Homo sapiens
aacguugccuuguuuauuu

SEQ ID NO: 1489868 - RNA, 19 nt, Homo sapiens
ggaggaguauaaccugaga

SEQ ID NO: 1489869 - RNA, 19 nt, Homo sapiens
aaugaaaccugaacuacug

SEQ ID NO: 1489870 - RNA, 19 nt, Homo sapiens
cacaaacaguucgaacaua

SEQ ID NO: 1489871 - RNA, 19 nt, Homo sapiens
ggagacauagagaauauau

SEQ ID NO: 1489872 - RNA, 19 nt, Homo sapiens
gcuuggaucaccaccauua

SEQ ID NO: 1489873 - RNA, 19 nt, Homo sapiens
agacaggauuucacuaugu

SEQ ID NO: 1489874 - RNA, 19 nt, Homo sapiens
guacagugguaugaucuug

SEQ ID NO: 1489875 - RNA, 19 nt, Homo sapiens
ucuauucccuuuggacaua

SEQ ID NO: 1489876 - RNA, 19 nt, Homo sapiens
gggaggcguugguggauug

SEQ ID NO: 1489877 - RNA, 19 nt, Homo sapiens
agaaaguuguggucacuga

SEQ ID NO: 1489878 - RNA, 19 nt, Homo sapiens
uuacagcuucugacuaaua

SEQ ID NO: 1489879 - RNA, 19 nt, Homo sapiens
gaggacagauagcugcaau

SEQ ID NO: 1489880 - RNA, 19 nt, Homo sapiens
uggaucaccaccauuauua

SEQ ID NO: 1489881 - RNA, 19 nt, Homo sapiens
guauugagcccuguguuaa

SEQ ID NO: 1489882 - RNA, 19 nt, Homo sapiens
cuacucaagugacacagaa

SEQ ID NO: 1489883 - RNA, 19 nt, Homo sapiens
acucgugguugcuggauua

SEQ ID NO: 1489884 - RNA, 19 nt, Homo sapiens
gagauggaguuucgcucuu

SEQ ID NO: 1489885 - RNA, 19 nt, Homo sapiens
acaaacaguucgaacauac

SEQ ID NO: 1489886 - RNA, 19 nt, Homo sapiens
gguaacaccuagggaaaca

SEQ ID NO: 1489887 - RNA, 19 nt, Homo sapiens
gaacaauagacugccuuaa

SEQ ID NO: 1489888 - RNA, 19 nt, Homo sapiens
agaauuaucuuggcuuugg

SEQ ID NO: 1489889 - RNA, 19 nt, Homo sapiens
ucggagacauagagaauau

SEQ ID NO: 1489890 - RNA, 19 nt, Homo sapiens
uaacguugccuuguuuauu

SEQ ID NO: 1489891 - RNA, 19 nt, Homo sapiens
gagauacuccuacaugaag

SEQ ID NO: 1489892 - RNA, 19 nt, Homo sapiens
guucgaacauacagugaga

SEQ ID NO: 1489893 - RNA, 19 nt, Homo sapiens
ccagaucucaaaccaguaa

SEQ ID NO: 1489894 - RNA, 19 nt, Homo sapiens
ucagugaaaucuuuaugca

SEQ ID NO: 1489895 - RNA, 19 nt, Homo sapiens
caccaugcccagcuaauuu

SEQ ID NO: 1489896 - RNA, 19 nt, Homo sapiens
aauuaacguugccuuguuu

SEQ ID NO: 1489897 - RNA, 19 nt, Homo sapiens
ggaacaacuucacuuucuc

SEQ ID NO: 1489898 - RNA, 19 nt, Homo sapiens
ggaauuaacguugccuugu

SEQ ID NO: 1489899 - RNA, 19 nt, Homo sapiens
ccauucuucuggacucuaa

SEQ ID NO: 1489900 - RNA, 19 nt, Homo sapiens
gaacaacuucacuuucucu

SEQ ID NO: 1489901 - RNA, 19 nt, Homo sapiens
uggaacaacuucacuuucu

SEQ ID NO: 1489902 - RNA, 19 nt, Homo sapiens
agcagaagcuuagaaaguu

SEQ ID NO: 1489903 - RNA, 19 nt, Homo sapiens
caaaaucguucuuguugga

SEQ ID NO: 1489904 - RNA, 19 nt, Homo sapiens
uagacugccuuaacaaagu

SEQ ID NO: 1489905 - RNA, 19 nt, Homo sapiens
ccaccagccucuccagcaa

SEQ ID NO: 1489906 - RNA, 19 nt, Homo sapiens
gcauuacagcuucugacua

SEQ ID NO: 1489907 - RNA, 19 nt, Homo sapiens
ccaccaccaugcccagcua

SEQ ID NO: 1489908 - RNA, 19 nt, Homo sapiens
gguaugaucuuggcucacu

SEQ ID NO: 1489909 - RNA, 19 nt, Homo sapiens
gagacucagaaguuaauuu

SEQ ID NO: 1489910 - RNA, 19 nt, Homo sapiens
auucccagguguagcauua

SEQ ID NO: 1489911 - RNA, 19 nt, Homo sapiens
gaauuaucuuggcuuugga

SEQ ID NO: 1489912 - RNA, 19 nt, Homo sapiens
cacagaagaaccagcuaua

SEQ ID NO: 1489913 - RNA, 19 nt, Homo sapiens
uguauugagcccuguguua

SEQ ID NO: 1489914 - RNA, 19 nt, Homo sapiens
cagcagcaucuaucaugua

SEQ ID NO: 1489915 - RNA, 19 nt, Homo sapiens
gcccagacuucuacucaag

SEQ ID NO: 1489916 - RNA, 19 nt, Homo sapiens
aaagagacucagaaguuaa

SEQ ID NO: 1489917 - RNA, 19 nt, Homo sapiens
gcucggagacauagagaau

SEQ ID NO: 1489918 - RNA, 19 nt, Homo sapiens
guagaaggaggacagauag

SEQ ID NO: 1489919 - RNA, 19 nt, Homo sapiens
gugaaaucuuuaugcauuc

SEQ ID NO: 1489920 - RNA, 19 nt, Homo sapiens
uagcugccauucagacaau

SEQ ID NO: 1489921 - RNA, 19 nt, Homo sapiens
ggaacaacaggagauaaau

SEQ ID NO: 1489922 - RNA, 19 nt, Homo sapiens
cugcuacuauccguuauuu

SEQ ID NO: 1489923 - RNA, 19 nt, Homo sapiens
ggauugggcaguauguaug

SEQ ID NO: 1489924 - RNA, 19 nt, Homo sapiens
gaaaguuguggucacugaa

SEQ ID NO: 1489925 - RNA, 19 nt, Homo sapiens
ucacuauguuggccagguu

SEQ ID NO: 1489926 - RNA, 19 nt, Homo sapiens
ccucugcuacuauccguua

SEQ ID NO: 1489927 - RNA, 19 nt, Homo sapiens
auaagccggugucugauau

SEQ ID NO: 1489928 - RNA, 19 nt, Homo sapiens
guugguggauugggcagua

SEQ ID NO: 1489929 - RNA, 19 nt, Homo sapiens
acaaggacagugaguggua

SEQ ID NO: 1489930 - RNA, 19 nt, Homo sapiens
ugagauacuccuacaugaa

SEQ ID NO: 1489931 - RNA, 19 nt, Homo sapiens
cugagauacuccuacauga

SEQ ID NO: 1489932 - RNA, 19 nt, Homo sapiens
ggaaacaugaggccccuua

SEQ ID NO: 1489933 - RNA, 19 nt, Homo sapiens
gguggaagauggauaaaua

SEQ ID NO: 1489934 - RNA, 19 nt, Homo sapiens
ggacucaucugccauuuca

SEQ ID NO: 1489935 - RNA, 19 nt, Homo sapiens
gcacagaugucaggguuga

SEQ ID NO: 1489936 - RNA, 19 nt, Homo sapiens
agacagagcuugguaagug

SEQ ID NO: 1489937 - RNA, 19 nt, Homo sapiens
ccaagacacuuuacagcaa

SEQ ID NO: 1489938 - RNA, 19 nt, Homo sapiens
ggaaacaucugugguuguc

SEQ ID NO: 1489939 - RNA, 19 nt, Homo sapiens
ccgccgagcuaauagauuu

SEQ ID NO: 1489940 - RNA, 19 nt, Homo sapiens
ggaagaucguucauaugga

SEQ ID NO: 1489941 - RNA, 19 nt, Homo sapiens
ggagucagaccuucaaugu

SEQ ID NO: 1489942 - RNA, 19 nt, Homo sapiens
gaccagcagucuugucuuc

SEQ ID NO: 1489943 - RNA, 19 nt, Homo sapiens
ccagauagcagacguguuc

SEQ ID NO: 1489944 - RNA, 19 nt, Homo sapiens
ccacgucuagggaaucuua

SEQ ID NO: 1489945 - RNA, 19 nt, Homo sapiens
gggaagaucguucauaugg

SEQ ID NO: 1489946 - RNA, 19 nt, Homo sapiens
caagacacuuuacagcaau

SEQ ID NO: 1489947 - RNA, 19 nt, Homo sapiens
gacagagcuugguaaguga

SEQ ID NO: 1489948 - RNA, 19 nt, Homo sapiens
gugccugccuccagaguuu

SEQ ID NO: 1489949 - RNA, 19 nt, Homo sapiens
gauagcagacguguucgua

SEQ ID NO: 1489950 - RNA, 19 nt, Homo sapiens
gagaaaagcugaggaagca

SEQ ID NO: 1489951 - RNA, 19 nt, Homo sapiens
uagcagggcugggcucaga

SEQ ID NO: 1489952 - RNA, 19 nt, Homo sapiens
gaaaccccgucucuucuaa

SEQ ID NO: 1489953 - RNA, 19 nt, Homo sapiens
uggaaaagcuucagacaga

SEQ ID NO: 1489954 - RNA, 19 nt, Homo sapiens
cgagaaaacagcccaguua

SEQ ID NO: 1489955 - RNA, 19 nt, Homo sapiens
gugcggaacggcugcauuu

SEQ ID NO: 1489956 - RNA, 19 nt, Homo sapiens
cauccagaaucuccucuug

SEQ ID NO: 1489957 - RNA, 19 nt, Homo sapiens
ggaagcaggcggagaagag

SEQ ID NO: 1489958 - RNA, 19 nt, Homo sapiens
ggaguucccgugccaccua

SEQ ID NO: 1489959 - RNA, 19 nt, Homo sapiens
cagcaaucaucacccuuug

SEQ ID NO: 1489960 - RNA, 19 nt, Homo sapiens
gagcuucacaucacacugu

SEQ ID NO: 1489961 - RNA, 19 nt, Homo sapiens
ucacccaucuguucugucu

SEQ ID NO: 1489962 - RNA, 19 nt, Homo sapiens
uaacguuuccgccgagcua

SEQ ID NO: 1489963 - RNA, 19 nt, Homo sapiens
gaucguucauauggacaaa

SEQ ID NO: 1489964 - RNA, 19 nt, Homo sapiens
ugaggaagcaggcggagaa

SEQ ID NO: 1489965 - RNA, 19 nt, Homo sapiens
cagcggagaagccgagaaa

SEQ ID NO: 1489966 - RNA, 19 nt, Homo sapiens
aaauggagauccgcugguu

SEQ ID NO: 1489967 - RNA, 19 nt, Homo sapiens
guggaagauggauaaauaa

SEQ ID NO: 1489968 - RNA, 19 nt, Homo sapiens
ggaggcuagugcacagaug

SEQ ID NO: 1489969 - RNA, 19 nt, Homo sapiens
gaagcaggcggagaagaga

SEQ ID NO: 1489970 - RNA, 19 nt, Homo sapiens
ccuguaaucccaguacuuu

SEQ ID NO: 1489971 - RNA, 19 nt, Homo sapiens
ggaccaagacacuuuacag

SEQ ID NO: 1489972 - RNA, 19 nt, Homo sapiens
gcgaagcucucugggaacu

SEQ ID NO: 1489973 - RNA, 19 nt, Homo sapiens
ggugcuaggcccugaguau

SEQ ID NO: 1489974 - RNA, 19 nt, Homo sapiens
ccucggagcuucacaucac

SEQ ID NO: 1489975 - RNA, 19 nt, Homo sapiens
gagcucaccaggacucauc

SEQ ID NO: 1489976 - RNA, 19 nt, Homo sapiens
ucacaucacacuguacaga

SEQ ID NO: 1489977 - RNA, 19 nt, Homo sapiens
caaggacgacaucgccuau

SEQ ID NO: 1489978 - RNA, 19 nt, Homo sapiens
uaggguggaagauggauaa

SEQ ID NO: 1489979 - RNA, 19 nt, Homo sapiens
cgggagcccucagcaaugu

SEQ ID NO: 1489980 - RNA, 19 nt, Homo sapiens
acagcaaucaucacccuuu

SEQ ID NO: 1489981 - RNA, 19 nt, Homo sapiens
ccaggacucaucugccauu

SEQ ID NO: 1489982 - RNA, 19 nt, Homo sapiens
uagggaaucuuagcaucug

SEQ ID NO: 1489983 - RNA, 19 nt, Homo sapiens
gaaaacagcccaguuacgu

SEQ ID NO: 1489984 - RNA, 19 nt, Homo sapiens
agaguuggugguccagaua

SEQ ID NO: 1489985 - RNA, 19 nt, Homo sapiens
uccagaaucuccucuugag

SEQ ID NO: 1489986 - RNA, 19 nt, Homo sapiens
gaguucccgugccaccuau

SEQ ID NO: 1489987 - RNA, 19 nt, Homo sapiens
guucacccaucuguucugu

SEQ ID NO: 1489988 - RNA, 19 nt, Homo sapiens
caggacucaucugccauuu

SEQ ID NO: 1489989 - RNA, 19 nt, Homo sapiens
gaccuguucagucuggaaa

SEQ ID NO: 1489990 - RNA, 19 nt, Homo sapiens
caguggcucacaccuguaa

SEQ ID NO: 1489991 - RNA, 19 nt, Homo sapiens
ccacugcugacgagagaug

SEQ ID NO: 1489992 - RNA, 19 nt, Homo sapiens
gaggcuccgacccugauuu

SEQ ID NO: 1489993 - RNA, 19 nt, Homo sapiens
gagagucuuuccccuuuuc

SEQ ID NO: 1489994 - RNA, 19 nt, Homo sapiens
gagccagaagaaagaguug

SEQ ID NO: 1489995 - RNA, 19 nt, Homo sapiens
ggaccuguucagucuggaa

SEQ ID NO: 1489996 - RNA, 19 nt, Homo sapiens
acccucaccucucccuuga

SEQ ID NO: 1489997 - RNA, 19 nt, Homo sapiens
gaggcuagugcacagaugu

SEQ ID NO: 1489998 - RNA, 19 nt, Homo sapiens
aagaguuggugguccagau

SEQ ID NO: 1489999 - RNA, 19 nt, Homo sapiens
gcaauguguccgucuccau

SEQ ID NO: 1490000 - RNA, 19 nt, Homo sapiens
caaggaaggaggcauucag

SEQ ID NO: 1490001 - RNA, 19 nt, Homo sapiens
ccucugacaagggcacaua

SEQ ID NO: 1490002 - RNA, 19 nt, Homo sapiens
gagcaaaccucgaauuuaa

SEQ ID NO: 1490003 - RNA, 19 nt, Homo sapiens
gaacaagccuuccgcauca

SEQ ID NO: 1490004 - RNA, 19 nt, Homo sapiens
cuacagaucuaguugaaua

SEQ ID NO: 1490005 - RNA, 19 nt, Homo sapiens
gaaauuacagcgcaagaua

SEQ ID NO: 1490006 - RNA, 19 nt, Homo sapiens
caaguaaucuguacgaaga

SEQ ID NO: 1490007 - RNA, 19 nt, Homo sapiens
gaagaaaguuacuaucucu

SEQ ID NO: 1490008 - RNA, 19 nt, Homo sapiens
caagcaaaguagagaauuu

SEQ ID NO: 1490009 - RNA, 19 nt, Homo sapiens
acgaagaaguugagaauaa

SEQ ID NO: 1490010 - RNA, 19 nt, Homo sapiens
gaacuaacuuugcaguaca

SEQ ID NO: 1490011 - RNA, 19 nt, Homo sapiens
gaagcuuucuggagacauu

SEQ ID NO: 1490012 - RNA, 19 nt, Homo sapiens
ccaauggagugauuuguug

SEQ ID NO: 1490013 - RNA, 19 nt, Homo sapiens
caagagcaccggcaaauug

SEQ ID NO: 1490014 - RNA, 19 nt, Homo sapiens
uaccauagcuuuccuucuu

SEQ ID NO: 1490015 - RNA, 19 nt, Homo sapiens
ccagagaggucagcuagaa

SEQ ID NO: 1490016 - RNA, 19 nt, Homo sapiens
caagaauucuacagaucua

SEQ ID NO: 1490017 - RNA, 19 nt, Homo sapiens
ugagaaagccauucaagaa

SEQ ID NO: 1490018 - RNA, 19 nt, Homo sapiens
ggagacgaauguaccagaa

SEQ ID NO: 1490019 - RNA, 19 nt, Homo sapiens
ggaacuaacuuugcaguac

SEQ ID NO: 1490020 - RNA, 19 nt, Homo sapiens
ggaaacacaacuaaguaaa

SEQ ID NO: 1490021 - RNA, 19 nt, Homo sapiens
acagaaagaccuaaagaaa

SEQ ID NO: 1490022 - RNA, 19 nt, Homo sapiens
uagagacaaugcagaauga

SEQ ID NO: 1490023 - RNA, 19 nt, Homo sapiens
ggaacuccaggaaguauaa

SEQ ID NO: 1490024 - RNA, 19 nt, Homo sapiens
agacaaugcagaaugaaua

SEQ ID NO: 1490025 - RNA, 19 nt, Homo sapiens
gaaacaggaaacacaacua

SEQ ID NO: 1490026 - RNA, 19 nt, Homo sapiens
cgaagaaguugagaauaau

SEQ ID NO: 1490027 - RNA, 19 nt, Homo sapiens
gaaacacaacuaaguaaag

SEQ ID NO: 1490028 - RNA, 19 nt, Homo sapiens
ugaugcagcucuuaggaaa

SEQ ID NO: 1490029 - RNA, 19 nt, Homo sapiens
guacagaaagaccuaaaga

SEQ ID NO: 1490030 - RNA, 19 nt, Homo sapiens
gcagaaugaauaucaauca

SEQ ID NO: 1490031 - RNA, 19 nt, Homo sapiens
aaacaggaaacacaacuaa

SEQ ID NO: 1490032 - RNA, 19 nt, Homo sapiens
guacgaagaaguugagaau

SEQ ID NO: 1490033 - RNA, 19 nt, Homo sapiens
uacauuggcuuccucagaa

SEQ ID NO: 1490034 - RNA, 19 nt, Homo sapiens
caaauaagagcucgagauc

SEQ ID NO: 1490035 - RNA, 19 nt, Homo sapiens
caaccaggcgcguaccaua

SEQ ID NO: 1490036 - RNA, 19 nt, Homo sapiens
caaccaagaauucuacaga

SEQ ID NO: 1490037 - RNA, 19 nt, Homo sapiens
cagaaagaccuaaagaaau

SEQ ID NO: 1490038 - RNA, 19 nt, Homo sapiens
caucaugaguucagauaca

SEQ ID NO: 1490039 - RNA, 19 nt, Homo sapiens
gauguuuacugcuucuaau

SEQ ID NO: 1490040 - RNA, 19 nt, Homo sapiens
caggaaacacaacuaagua

SEQ ID NO: 1490041 - RNA, 19 nt, Homo sapiens
gaaaugaaccuuuuggaau

SEQ ID NO: 1490042 - RNA, 19 nt, Homo sapiens
aauaagagcucgagaucag

SEQ ID NO: 1490043 - RNA, 19 nt, Homo sapiens
guauaaaccuuuucaguca

SEQ ID NO: 1490044 - RNA, 19 nt, Homo sapiens
cagaugugauucaagcauu

SEQ ID NO: 1490045 - RNA, 19 nt, Homo sapiens
caucaaacaccuacaagga

SEQ ID NO: 1490046 - RNA, 19 nt, Homo sapiens
ugagcaaaccucgaauuua

SEQ ID NO: 1490047 - RNA, 19 nt, Homo sapiens
cuggagacauucacuuauu

SEQ ID NO: 1490048 - RNA, 19 nt, Homo sapiens
gaggaagaguagccagaug

SEQ ID NO: 1490049 - RNA, 19 nt, Homo sapiens
acaaggaguuggagaucuu

SEQ ID NO: 1490050 - RNA, 19 nt, Homo sapiens
aggaaucgcucgccaggaa

SEQ ID NO: 1490051 - RNA, 19 nt, Homo sapiens
ggagugauuuguuggaaaa

SEQ ID NO: 1490052 - RNA, 19 nt, Homo sapiens
guacauuggcuuccucaga

SEQ ID NO: 1490053 - RNA, 19 nt, Homo sapiens
gcaagagcaccggcaaauu

SEQ ID NO: 1490054 - RNA, 19 nt, Homo sapiens
gcucagacaauaaccaaga

SEQ ID NO: 1490055 - RNA, 19 nt, Homo sapiens
gaagaagaaaguuacuauc

SEQ ID NO: 1490056 - RNA, 19 nt, Homo sapiens
gauuaucgccacgaaauga

SEQ ID NO: 1490057 - RNA, 19 nt, Homo sapiens
gcaaaccucgaauuuaaag

SEQ ID NO: 1490058 - RNA, 19 nt, Homo sapiens
gaaggugaugcagcucuua

SEQ ID NO: 1490059 - RNA, 19 nt, Homo sapiens
ggaagaccuuaguuaggau

SEQ ID NO: 1490060 - RNA, 19 nt, Homo sapiens
gcaaauugagaaagccauu

SEQ ID NO: 1490061 - RNA, 19 nt, Homo sapiens
gcagaucuggggugaauua

SEQ ID NO: 1490062 - RNA, 19 nt, Homo sapiens
aagcaagcaucaugaguuc

SEQ ID NO: 1490063 - RNA, 19 nt, Homo sapiens
gauaaacaucaaacaccua

SEQ ID NO: 1490064 - RNA, 19 nt, Homo sapiens
aggaagaccuuaguuagga

SEQ ID NO: 1490065 - RNA, 19 nt, Homo sapiens
ccaggaaguauaaaccuuu

SEQ ID NO: 1490066 - RNA, 19 nt, Homo sapiens
gcagaggaacagccaguug

SEQ ID NO: 1490067 - RNA, 19 nt, Homo sapiens
uaaaguacagaaagaccua

SEQ ID NO: 1490068 - RNA, 19 nt, Homo sapiens
caaagauggauuuagagaa

SEQ ID NO: 1490069 - RNA, 19 nt, Homo sapiens
gggauuaucgccacgaaau

SEQ ID NO: 1490070 - RNA, 19 nt, Homo sapiens
ggauguuuacugcuucuaa

SEQ ID NO: 1490071 - RNA, 19 nt, Homo sapiens
aaagauggaacaaauggaa

SEQ ID NO: 1490072 - RNA, 19 nt, Homo sapiens
gaaacaggaagaccuuagu

SEQ ID NO: 1490073 - RNA, 19 nt, Homo sapiens
gaagaguagccagauguga

SEQ ID NO: 1490074 - RNA, 19 nt, Homo sapiens
aaauaaagcuggaaaagca

SEQ ID NO: 1490075 - RNA, 19 nt, Homo sapiens
agaagaaaguuacuaucuc

SEQ ID NO: 1490076 - RNA, 19 nt, Homo sapiens
caaugcagaaugaauauca

SEQ ID NO: 1490077 - RNA, 19 nt, Homo sapiens
aaagcaagcaucaugaguu

SEQ ID NO: 1490078 - RNA, 19 nt, Homo sapiens
ccauagcuuuccuucuuga

SEQ ID NO: 1490079 - RNA, 19 nt, Homo sapiens
cuuccuggcucagacaaua

SEQ ID NO: 1490080 - RNA, 19 nt, Homo sapiens
gacaaugcagaaugaauau

SEQ ID NO: 1490081 - RNA, 19 nt, Homo sapiens
aaacaucaaacaccuacaa

SEQ ID NO: 1490082 - RNA, 19 nt, Homo sapiens
cuucuaaugucuccuuuua

SEQ ID NO: 1490083 - RNA, 19 nt, Homo sapiens
guuacuaucucugggaugu

SEQ ID NO: 1490084 - RNA, 19 nt, Homo sapiens
gaccaccugggccauauaa

SEQ ID NO: 1490085 - RNA, 19 nt, Homo sapiens
ccaaauaagagcucgagau

SEQ ID NO: 1490086 - RNA, 19 nt, Homo sapiens
ucagcucccuccaacaaau

SEQ ID NO: 1490087 - RNA, 19 nt, Homo sapiens
ccaccugggccauauaaau

SEQ ID NO: 1490088 - RNA, 19 nt, Homo sapiens
gcaguacacgagauaaaca

SEQ ID NO: 1490089 - RNA, 19 nt, Homo sapiens
cagaggaacagccaguuga

SEQ ID NO: 1490090 - RNA, 19 nt, Homo sapiens
uacaauuccuugguacauu

SEQ ID NO: 1490091 - RNA, 19 nt, Homo sapiens
gagcaccggcaaauugaga

SEQ ID NO: 1490092 - RNA, 19 nt, Homo sapiens
ggagacauucacuuauuca

SEQ ID NO: 1490093 - RNA, 19 nt, Homo sapiens
uugaauauguugacaagag

SEQ ID NO: 1490094 - RNA, 19 nt, Homo sapiens
gaauucuacagaucuaguu

SEQ ID NO: 1490095 - RNA, 19 nt, Homo sapiens
uagcuuuccuucuugaaca

SEQ ID NO: 1490096 - RNA, 19 nt, Homo sapiens
ugaauauguugacaagagu

SEQ ID NO: 1490097 - RNA, 19 nt, Homo sapiens
cagaucuaguugaauaugu

SEQ ID NO: 1490098 - RNA, 19 nt, Homo sapiens
gagacgaauguaccagaaa

SEQ ID NO: 1490099 - RNA, 19 nt, Homo sapiens
gccaaaaugucaaccaaga

SEQ ID NO: 1490100 - RNA, 19 nt, Homo sapiens
uacuaucucugggauguuu

SEQ ID NO: 1490101 - RNA, 19 nt, Homo sapiens
gccaauggagugauuuguu

SEQ ID NO: 1490102 - RNA, 19 nt, Homo sapiens
gagcaccacugaagaauuu

SEQ ID NO: 1490103 - RNA, 19 nt, Homo sapiens
cgaggaagcugcucagaua

SEQ ID NO: 1490104 - RNA, 19 nt, Homo sapiens
ugaaggagcugaaagaauu

SEQ ID NO: 1490105 - RNA, 19 nt, Homo sapiens
gcaaauacgaccucaaaua

SEQ ID NO: 1490106 - RNA, 19 nt, Homo sapiens
gaggaauggucuucuguua

SEQ ID NO: 1490107 - RNA, 19 nt, Homo sapiens
gaagaaggaacucuacaua

SEQ ID NO: 1490108 - RNA, 19 nt, Homo sapiens
caaauacgaccucaaauaa

SEQ ID NO: 1490109 - RNA, 19 nt, Homo sapiens
gcaaacagaugaguuguau

SEQ ID NO: 1490110 - RNA, 19 nt, Homo sapiens
gcaaauggcuuguccaaaa

SEQ ID NO: 1490111 - RNA, 19 nt, Homo sapiens
caagaaacaugcuacauca

SEQ ID NO: 1490112 - RNA, 19 nt, Homo sapiens
ggaauggucuucuguuauc

SEQ ID NO: 1490113 - RNA, 19 nt, Homo sapiens
uaaaggagguguuugugaa

SEQ ID NO: 1490114 - RNA, 19 nt, Homo sapiens
ggucuucuguuaucaaauu

SEQ ID NO: 1490115 - RNA, 19 nt, Homo sapiens
gggaugcuguugagauaua

SEQ ID NO: 1490116 - RNA, 19 nt, Homo sapiens
gaaccuagcucuggcauac

SEQ ID NO: 1490117 - RNA, 19 nt, Homo sapiens
gcagaaccguggcagagaa

SEQ ID NO: 1490118 - RNA, 19 nt, Homo sapiens
cagggaugcuguugagaua

SEQ ID NO: 1490119 - RNA, 19 nt, Homo sapiens
gaccaucacuggaaaugug

SEQ ID NO: 1490120 - RNA, 19 nt, Homo sapiens
gaaacuaaagcuaaagaga

SEQ ID NO: 1490121 - RNA, 19 nt, Homo sapiens
agaaggaacucuacauaca

SEQ ID NO: 1490122 - RNA, 19 nt, Homo sapiens
gaaggagcugaaagaauua

SEQ ID NO: 1490123 - RNA, 19 nt, Homo sapiens
gaagaggaaacuaaagcua

SEQ ID NO: 1490124 - RNA, 19 nt, Homo sapiens
caggauagccaacaauaaa

SEQ ID NO: 1490125 - RNA, 19 nt, Homo sapiens
gaaggaacucuacauacaa

SEQ ID NO: 1490126 - RNA, 19 nt, Homo sapiens
gaucccagcucaccagcaa

SEQ ID NO: 1490127 - RNA, 19 nt, Homo sapiens
gagaacgaccuaacacuug

SEQ ID NO: 1490128 - RNA, 19 nt, Homo sapiens
gcagagaagccuauuucaa

SEQ ID NO: 1490129 - RNA, 19 nt, Homo sapiens
ggagaaggccauagacugu

SEQ ID NO: 1490130 - RNA, 19 nt, Homo sapiens
caaaggcacagaagcauga

SEQ ID NO: 1490131 - RNA, 19 nt, Homo sapiens
agaggaaacuaaagcuaaa

SEQ ID NO: 1490132 - RNA, 19 nt, Homo sapiens
gcucuggcauacuuugaaa

SEQ ID NO: 1490133 - RNA, 19 nt, Homo sapiens
aaggaacucuacauacaaa

SEQ ID NO: 1490134 - RNA, 19 nt, Homo sapiens
gauuucugcuuccauaugu

SEQ ID NO: 1490135 - RNA, 19 nt, Homo sapiens
aggagguguuugugaauua

SEQ ID NO: 1490136 - RNA, 19 nt, Homo sapiens
cauaagaaguaucaaugca

SEQ ID NO: 1490137 - RNA, 19 nt, Homo sapiens
ggauagccaacaauaaaga

SEQ ID NO: 1490138 - RNA, 19 nt, Homo sapiens
ugagaggccucccaguuca

SEQ ID NO: 1490139 - RNA, 19 nt, Homo sapiens
aaagagaaauuagcccaau

SEQ ID NO: 1490140 - RNA, 19 nt, Homo sapiens
ccaagaaacaugcuacauc

SEQ ID NO: 1490141 - RNA, 19 nt, Homo sapiens
gaaaaccucuauacaggau

SEQ ID NO: 1490142 - RNA, 19 nt, Homo sapiens
ggaagaaggaacucuacau

SEQ ID NO: 1490143 - RNA, 19 nt, Homo sapiens
ugggauuucugcuuccaua

SEQ ID NO: 1490144 - RNA, 19 nt, Homo sapiens
uagagcagcugaggaggaa

SEQ ID NO: 1490145 - RNA, 19 nt, Homo sapiens
ggagcugaaagaauuauau

SEQ ID NO: 1490146 - RNA, 19 nt, Homo sapiens
gaaggcagagagaaacaug

SEQ ID NO: 1490147 - RNA, 19 nt, Homo sapiens
cagagaagccuauuucaac

SEQ ID NO: 1490148 - RNA, 19 nt, Homo sapiens
ggaagcugcucagauagag

SEQ ID NO: 1490149 - RNA, 19 nt, Homo sapiens
gagcugauucgauguguca

SEQ ID NO: 1490150 - RNA, 19 nt, Homo sapiens
gcaaacaaggagcugauuc

SEQ ID NO: 1490151 - RNA, 19 nt, Homo sapiens
gagaaggccauagacugua

SEQ ID NO: 1490152 - RNA, 19 nt, Homo sapiens
caaugcauaucgagcaaca

SEQ ID NO: 1490153 - RNA, 19 nt, Homo sapiens
ccucaaauaaggagaaaga

SEQ ID NO: 1490154 - RNA, 19 nt, Homo sapiens
aagaggaaacuaaagcuaa

SEQ ID NO: 1490155 - RNA, 19 nt, Homo sapiens
gagugaagaggaaacuaaa

SEQ ID NO: 1490156 - RNA, 19 nt, Homo sapiens
ggcaguguauggaggaaug

SEQ ID NO: 1490157 - RNA, 19 nt, Homo sapiens
gaccucaaauaaggagaaa

SEQ ID NO: 1490158 - RNA, 19 nt, Homo sapiens
aauacgaccucaaauaagg

SEQ ID NO: 1490159 - RNA, 19 nt, Homo sapiens
ggaggaauggucuucuguu

SEQ ID NO: 1490160 - RNA, 19 nt, Homo sapiens
cgaccuaacacuugcuuug

SEQ ID NO: 1490161 - RNA, 19 nt, Homo sapiens
agaaggccauagacuguau

SEQ ID NO: 1490162 - RNA, 19 nt, Homo sapiens
ccagcaaacagaugaguug

SEQ ID NO: 1490163 - RNA, 19 nt, Homo sapiens
gaauggucuucuguuauca

SEQ ID NO: 1490164 - RNA, 19 nt, Homo sapiens
ggcaauuggcgauguuauu

SEQ ID NO: 1490165 - RNA, 19 nt, Homo sapiens
gcucagcugauuaaggaaa

SEQ ID NO: 1490166 - RNA, 19 nt, Homo sapiens
agagugaagaggaaacuaa

SEQ ID NO: 1490167 - RNA, 19 nt, Homo sapiens
uaucccaacuguuagcaau

SEQ ID NO: 1490168 - RNA, 19 nt, Homo sapiens
ggauuucugcuuccauaug

SEQ ID NO: 1490169 - RNA, 19 nt, Homo sapiens
aaaggcaauuggcgauguu

SEQ ID NO: 1490170 - RNA, 19 nt, Homo sapiens
uacaggauagccaacaaua

SEQ ID NO: 1490171 - RNA, 19 nt, Homo sapiens
gcaggcucauucugucugu

SEQ ID NO: 1490172 - RNA, 19 nt, Homo sapiens
uuccauaugucacagcaaa

SEQ ID NO: 1490173 - RNA, 19 nt, Homo sapiens
ugagaacgaccuaacacuu

SEQ ID NO: 1490174 - RNA, 19 nt, Homo sapiens
gaaacaugaaggagcugaa

SEQ ID NO: 1490175 - RNA, 19 nt, Homo sapiens
guaugucucaucccaaaga

SEQ ID NO: 1490176 - RNA, 19 nt, Homo sapiens
caacaauaaagacaaccuu

SEQ ID NO: 1490177 - RNA, 19 nt, Homo sapiens
uauacaggauagccaacaa

SEQ ID NO: 1490178 - RNA, 19 nt, Homo sapiens
ggugauaggacgucagauc

SEQ ID NO: 1490179 - RNA, 19 nt, Homo sapiens
aggcaaauacgaccucaaa

SEQ ID NO: 1490180 - RNA, 19 nt, Homo sapiens
agaaggagaaggccauaga

SEQ ID NO: 1490181 - RNA, 19 nt, Homo sapiens
caaauggcuuguccaaaau

SEQ ID NO: 1490182 - RNA, 19 nt, Homo sapiens
gcauaucgagcaacauugg

SEQ ID NO: 1490183 - RNA, 19 nt, Homo sapiens
caaagcuuaugccaugucu

SEQ ID NO: 1490184 - RNA, 19 nt, Homo sapiens
agaaaugagugcguuacug

SEQ ID NO: 1490185 - RNA, 19 nt, Homo sapiens
ccccaaaacugcagaaaug

SEQ ID NO: 1490186 - RNA, 19 nt, Homo sapiens
uggccuggcuccugcagaa

SEQ ID NO: 1490187 - RNA, 19 nt, Homo sapiens
cuacaucagccaagaauac

SEQ ID NO: 1490188 - RNA, 19 nt, Homo sapiens
auccguaucccaacuguua

SEQ ID NO: 1490189 - RNA, 19 nt, Homo sapiens
acacugagcaccacugaag

SEQ ID NO: 1490190 - RNA, 19 nt, Homo sapiens
ggaugcuguugagauauau

SEQ ID NO: 1490191 - RNA, 19 nt, Homo sapiens
gaagucagccccaaaacug

SEQ ID NO: 1490192 - RNA, 19 nt, Homo sapiens
uggagagagugaagaggaa

SEQ ID NO: 1490193 - RNA, 19 nt, Homo sapiens
ggagguguuugugaauuac

SEQ ID NO: 1490194 - RNA, 19 nt, Homo sapiens
ucccaacuguuagcaauga

SEQ ID NO: 1490195 - RNA, 19 nt, Homo sapiens
ugacaucgacugggauuuc

SEQ ID NO: 1490196 - RNA, 19 nt, Homo sapiens
aacuaaagcuaaagagaag

SEQ ID NO: 1490197 - RNA, 19 nt, Homo sapiens
cuguaugucucaucccaaa

SEQ ID NO: 1490198 - RNA, 19 nt, Homo sapiens
ggacaaguagcaguucauc

SEQ ID NO: 1490199 - RNA, 19 nt, Homo sapiens
acauugggcucagaggauu

SEQ ID NO: 1490200 - RNA, 19 nt, Homo sapiens
acaaccaggccauccagua

SEQ ID NO: 1490201 - RNA, 19 nt, Homo sapiens
gaucagccuguacgaggaa

SEQ ID NO: 1490202 - RNA, 19 nt, Homo sapiens
gaaaugugcuucccaguua

SEQ ID NO: 1490203 - RNA, 19 nt, Homo sapiens
gaagagaagacaacuaaua

SEQ ID NO: 1490204 - RNA, 19 nt, Homo sapiens
gaaagaacaggaagaauuu

SEQ ID NO: 1490205 - RNA, 19 nt, Homo sapiens
gagcagagguugauauaug

SEQ ID NO: 1490206 - RNA, 19 nt, Homo sapiens
uaaagaaacuucagcauca

SEQ ID NO: 1490207 - RNA, 19 nt, Homo sapiens
cagaagagguacuagauuu

SEQ ID NO: 1490208 - RNA, 19 nt, Homo sapiens
gaacaaagaaagaaacaga

SEQ ID NO: 1490209 - RNA, 19 nt, Homo sapiens
caaaguuccuguagacaaa

SEQ ID NO: 1490210 - RNA, 19 nt, Homo sapiens
gcagagguguuuccaguga

SEQ ID NO: 1490211 - RNA, 19 nt, Homo sapiens
gaagacaacuaauaaugag

SEQ ID NO: 1490212 - RNA, 19 nt, Homo sapiens
gagagugacuaaccacauu

SEQ ID NO: 1490213 - RNA, 19 nt, Homo sapiens
gagaaaugauggaagaaau

SEQ ID NO: 1490214 - RNA, 19 nt, Homo sapiens
gaagaaagaacaggaagaa

SEQ ID NO: 1490215 - RNA, 19 nt, Homo sapiens
gaaacuucagcaucaauua

SEQ ID NO: 1490216 - RNA, 19 nt, Homo sapiens
ugacuaaccacauucuuua

SEQ ID NO: 1490217 - RNA, 19 nt, Homo sapiens
ucaaauugcuacucaguug

SEQ ID NO: 1490218 - RNA, 19 nt, Homo sapiens
aaacagaaauuggcaguug

SEQ ID NO: 1490219 - RNA, 19 nt, Homo sapiens
uauauguguuggccuauua

SEQ ID NO: 1490220 - RNA, 19 nt, Homo sapiens
gagaagacaacuaauaaug

SEQ ID NO: 1490221 - RNA, 19 nt, Homo sapiens
ucagagaaaugauggaaga

SEQ ID NO: 1490222 - RNA, 19 nt, Homo sapiens
guugauauaugaagagcua

SEQ ID NO: 1490223 - RNA, 19 nt, Homo sapiens
aaagggaagccaacauuua

SEQ ID NO: 1490224 - RNA, 19 nt, Homo sapiens
cagagaagaguaugagaua

SEQ ID NO: 1490225 - RNA, 19 nt, Homo sapiens
gaacgccagcgccaguuua

SEQ ID NO: 1490226 - RNA, 19 nt, Homo sapiens
gaaaugauggaagaaauug

SEQ ID NO: 1490227 - RNA, 19 nt, Homo sapiens
agaaagaacaggaagaauu

SEQ ID NO: 1490228 - RNA, 19 nt, Homo sapiens
caacauuuauggaagaagu

SEQ ID NO: 1490229 - RNA, 19 nt, Homo sapiens
gaauugagagguauuaagu

SEQ ID NO: 1490230 - RNA, 19 nt, Homo sapiens
gcagaaaguuaaucagacu

SEQ ID NO: 1490231 - RNA, 19 nt, Homo sapiens
gaagagcagagguugauau

SEQ ID NO: 1490232 - RNA, 19 nt, Homo sapiens
ugagagguauuaaguuuca

SEQ ID NO: 1490233 - RNA, 19 nt, Homo sapiens
gcuacucaguugauaagaa

SEQ ID NO: 1490234 - RNA, 19 nt, Homo sapiens
caaggugccugggaugauu

SEQ ID NO: 1490235 - RNA, 19 nt, Homo sapiens
gcaaaguuccuguagacaa

SEQ ID NO: 1490236 - RNA, 19 nt, Homo sapiens
gagaagaguaugagauaau

SEQ ID NO: 1490237 - RNA, 19 nt, Homo sapiens
gaaauuggcaguugaagcu

SEQ ID NO: 1490238 - RNA, 19 nt, Homo sapiens
aagaagagaagacaacuaa

SEQ ID NO: 1490239 - RNA, 19 nt, Homo sapiens
gagaagcucagagaaauga

SEQ ID NO: 1490240 - RNA, 19 nt, Homo sapiens
gacaaaguaacaccaagua

SEQ ID NO: 1490241 - RNA, 19 nt, Homo sapiens
uggcagcucuguuacugua

SEQ ID NO: 1490242 - RNA, 19 nt, Homo sapiens
gggacucugugcucaguaa

SEQ ID NO: 1490243 - RNA, 19 nt, Homo sapiens
aaagaagacuggcaaaauu

SEQ ID NO: 1490244 - RNA, 19 nt, Homo sapiens
caagcaaaguuccuguaga

SEQ ID NO: 1490245 - RNA, 19 nt, Homo sapiens
ggaagcagaaaguuaauca

SEQ ID NO: 1490246 - RNA, 19 nt, Homo sapiens
gcuauauugugaauugaga

SEQ ID NO: 1490247 - RNA, 19 nt, Homo sapiens
gagcuuuggacuaacguua

SEQ ID NO: 1490248 - RNA, 19 nt, Homo sapiens
gaagccaacauuuauggaa

SEQ ID NO: 1490249 - RNA, 19 nt, Homo sapiens
cuacucaguugauaagaau

SEQ ID NO: 1490250 - RNA, 19 nt, Homo sapiens
gaagagcuaauuaaagaag

SEQ ID NO: 1490251 - RNA, 19 nt, Homo sapiens
gaagaagaagagaaagaga

SEQ ID NO: 1490252 - RNA, 19 nt, Homo sapiens
uaaagggaagccaacauuu

SEQ ID NO: 1490253 - RNA, 19 nt, Homo sapiens
ggugagaaacaaacauaaa

SEQ ID NO: 1490254 - RNA, 19 nt, Homo sapiens
acacaugggcuuuggguaa

SEQ ID NO: 1490255 - RNA, 19 nt, Homo sapiens
ugaguugagugccauauca

SEQ ID NO: 1490256 - RNA, 19 nt, Homo sapiens
aagagucaauucagauuug

SEQ ID NO: 1490257 - RNA, 19 nt, Homo sapiens
gauaaacacagucauuucu

SEQ ID NO: 1490258 - RNA, 19 nt, Homo sapiens
cgacucacuuucuucucua

SEQ ID NO: 1490259 - RNA, 19 nt, Homo sapiens
gcagaagaaagaacaggaa

SEQ ID NO: 1490260 - RNA, 19 nt, Homo sapiens
ggaagaaacagaaaaguau

SEQ ID NO: 1490261 - RNA, 19 nt, Homo sapiens
ucagagcaaucucaagcaa

SEQ ID NO: 1490262 - RNA, 19 nt, Homo sapiens
uaaacacagucauuucuac

SEQ ID NO: 1490263 - RNA, 19 nt, Homo sapiens
ugugcuauauugugaauug

SEQ ID NO: 1490264 - RNA, 19 nt, Homo sapiens
ucaauagcuuagucagauu

SEQ ID NO: 1490265 - RNA, 19 nt, Homo sapiens
gaaaguuaaucagacuaag

SEQ ID NO: 1490266 - RNA, 19 nt, Homo sapiens
gaacacaaggagaaagaca

SEQ ID NO: 1490267 - RNA, 19 nt, Homo sapiens
ugagugccauaucaagaaa

SEQ ID NO: 1490268 - RNA, 19 nt, Homo sapiens
gaaaacagaaagagcaaaa

SEQ ID NO: 1490269 - RNA, 19 nt, Homo sapiens
gugacuaaccacauucuuu

SEQ ID NO: 1490270 - RNA, 19 nt, Homo sapiens
aaaugcugcugauggaauu

SEQ ID NO: 1490271 - RNA, 19 nt, Homo sapiens
agagaagaguaugagauaa

SEQ ID NO: 1490272 - RNA, 19 nt, Homo sapiens
gacaaggaauacagagaag

SEQ ID NO: 1490273 - RNA, 19 nt, Homo sapiens
gcgacucacuuucuucucu

SEQ ID NO: 1490274 - RNA, 19 nt, Homo sapiens
acaaggagaaagacaauau

SEQ ID NO: 1490275 - RNA, 19 nt, Homo sapiens
uauugugaauugagaggua

SEQ ID NO: 1490276 - RNA, 19 nt, Homo sapiens
ccagggagagagugacuaa

SEQ ID NO: 1490277 - RNA, 19 nt, Homo sapiens
aaaguuauacccagcagaa

SEQ ID NO: 1490278 - RNA, 19 nt, Homo sapiens
agaagaagagaaagagaaa

SEQ ID NO: 1490279 - RNA, 19 nt, Homo sapiens
ugaaaugugcuucccaguu

SEQ ID NO: 1490280 - RNA, 19 nt, Homo sapiens
gaaaugucaaugaaaugug

SEQ ID NO: 1490281 - RNA, 19 nt, Homo sapiens
gaucaccagaacuuuguaa

SEQ ID NO: 1490282 - RNA, 19 nt, Homo sapiens
gacuaagaaagcagaauuu

SEQ ID NO: 1490283 - RNA, 19 nt, Homo sapiens
ggccuauuauugauguaaa

SEQ ID NO: 1490284 - RNA, 19 nt, Homo sapiens
gaggcuuugucauuaguau

SEQ ID NO: 1490285 - RNA, 19 nt, Homo sapiens
cagauugauuauugugcua

SEQ ID NO: 1490286 - RNA, 19 nt, Homo sapiens
gggaacacaaggagaaaga

SEQ ID NO: 1490287 - RNA, 19 nt, Homo sapiens
aaaggaagaugaaaaguca

SEQ ID NO: 1490288 - RNA, 19 nt, Homo sapiens
aaagaaacuucagcaucaa

SEQ ID NO: 1490289 - RNA, 19 nt, Homo sapiens
caagagugauggcuguuuu

SEQ ID NO: 1490290 - RNA, 19 nt, Homo sapiens
agacaaggaauacagagaa

SEQ ID NO: 1490291 - RNA, 19 nt, Homo sapiens
agagcaaucucaagcaaag

SEQ ID NO: 1490292 - RNA, 19 nt, Homo sapiens
cagaaacagagaaagcuuu

SEQ ID NO: 1490293 - RNA, 19 nt, Homo sapiens
agacuaagaaagcagaauu

SEQ ID NO: 1490294 - RNA, 19 nt, Homo sapiens
gguggcagcucuguuacug

SEQ ID NO: 1490295 - RNA, 19 nt, Homo sapiens
aaagaggaacaaagaaaga

SEQ ID NO: 1490296 - RNA, 19 nt, Homo sapiens
gcuuuggacuaacguuaug

SEQ ID NO: 1490297 - RNA, 19 nt, Homo sapiens
ccagaagagguacuagauu

SEQ ID NO: 1490298 - RNA, 19 nt, Homo sapiens
agugauggcuguuuuagua

SEQ ID NO: 1490299 - RNA, 19 nt, Homo sapiens
uguguuggccuauuauuga

SEQ ID NO: 1490300 - RNA, 19 nt, Homo sapiens
agaagaguaugagauaauc

SEQ ID NO: 1490301 - RNA, 19 nt, Homo sapiens
aaaugugcuucccaguuaa

SEQ ID NO: 1490302 - RNA, 19 nt, Homo sapiens
guagggagaugggcaguua

SEQ ID NO: 1490303 - RNA, 19 nt, Homo sapiens
gcugaagucuggaaugaaa

SEQ ID NO: 1490304 - RNA, 19 nt, Homo sapiens
gaacagauguggcaauagc

SEQ ID NO: 1490305 - RNA, 19 nt, Homo sapiens
gauggaagccagaaaguuu

SEQ ID NO: 1490306 - RNA, 19 nt, Homo sapiens
gcaccaauguucgagagua

SEQ ID NO: 1490307 - RNA, 19 nt, Homo sapiens
gagcauagcaacaaccaaa

SEQ ID NO: 1490308 - RNA, 19 nt, Homo sapiens
uagaacagauguggcaaua

SEQ ID NO: 1490309 - RNA, 19 nt, Homo sapiens
gagcaaugaaucuuguuua

SEQ ID NO: 1490310 - RNA, 19 nt, Homo sapiens
aaacaagggucacaucaca

SEQ ID NO: 1490311 - RNA, 19 nt, Homo sapiens
caacgacaauuguacaaca

SEQ ID NO: 1490312 - RNA, 19 nt, Homo sapiens
cugcagagcuccacagaga

SEQ ID NO: 1490313 - RNA, 19 nt, Homo sapiens
gagaacaacucaggaacug

SEQ ID NO: 1490314 - RNA, 19 nt, Homo sapiens
uaaaggaaaucguacaacu

SEQ ID NO: 1490315 - RNA, 19 nt, Homo sapiens
gcaaagcgaaggcuacaug

SEQ ID NO: 1490316 - RNA, 19 nt, Homo sapiens
cauccacgaucaugagaaa

SEQ ID NO: 1490317 - RNA, 19 nt, Homo sapiens
aaacauagaggccaaagug

SEQ ID NO: 1490318 - RNA, 19 nt, Homo sapiens
gaaaaugaauccagcaagu

SEQ ID NO: 1490319 - RNA, 19 nt, Homo sapiens
gugcugaagucuggaauga

SEQ ID NO: 1490320 - RNA, 19 nt, Homo sapiens
cagcaagugugcagcagaa

SEQ ID NO: 1490321 - RNA, 19 nt, Homo sapiens
ggccaccaguagagaguua

SEQ ID NO: 1490322 - RNA, 19 nt, Homo sapiens
aaagaaagccaguaagauc

SEQ ID NO: 1490323 - RNA, 19 nt, Homo sapiens
caacaggaccuagaacaga

SEQ ID NO: 1490324 - RNA, 19 nt, Homo sapiens
gaagaucuccauccacgau

SEQ ID NO: 1490325 - RNA, 19 nt, Homo sapiens
cgagacugcuucccuugaa

SEQ ID NO: 1490326 - RNA, 19 nt, Homo sapiens
gcccacagcuacucuucaa

SEQ ID NO: 1490327 - RNA, 19 nt, Homo sapiens
guagauaucguggcuaaga

SEQ ID NO: 1490328 - RNA, 19 nt, Homo sapiens
caaugaaucuuguuuaccu

SEQ ID NO: 1490329 - RNA, 19 nt, Homo sapiens
gaagagaaccaugagcaau

SEQ ID NO: 1490330 - RNA, 19 nt, Homo sapiens
ggagagggaauccaacaug

SEQ ID NO: 1490331 - RNA, 19 nt, Homo sapiens
gagacugcuucccuugaaa

SEQ ID NO: 1490332 - RNA, 19 nt, Homo sapiens
caccaauguucgagaguaa

SEQ ID NO: 1490333 - RNA, 19 nt, Homo sapiens
ggaaaucguacaacuccaa

SEQ ID NO: 1490334 - RNA, 19 nt, Homo sapiens
gaaaucguacaacuccaaa

SEQ ID NO: 1490335 - RNA, 19 nt, Homo sapiens
cugcuucccuugaaauuug

SEQ ID NO: 1490336 - RNA, 19 nt, Homo sapiens
cagaggagaguacaacauu

SEQ ID NO: 1490337 - RNA, 19 nt, Homo sapiens
guccgcaucuggccauaaa

SEQ ID NO: 1490338 - RNA, 19 nt, Homo sapiens
cuacaugagugaacgagau

SEQ ID NO: 1490339 - RNA, 19 nt, Homo sapiens
gagaggugauugauguaca

SEQ ID NO: 1490340 - RNA, 19 nt, Homo sapiens
agagaaccaugagcaauga

SEQ ID NO: 1490341 - RNA, 19 nt, Homo sapiens
ccacagcuacucuucaaug

SEQ ID NO: 1490342 - RNA, 19 nt, Homo sapiens
gcccaucccagcuuucuuu

SEQ ID NO: 1490343 - RNA, 19 nt, Homo sapiens
ugacagagagguagauauc

SEQ ID NO: 1490344 - RNA, 19 nt, Homo sapiens
ucacaucacaugacagaga

SEQ ID NO: 1490345 - RNA, 19 nt, Homo sapiens
agaggagaguacaacauuu

SEQ ID NO: 1490346 - RNA, 19 nt, Homo sapiens
cuaagacgguggagaagca

SEQ ID NO: 1490347 - RNA, 19 nt, Homo sapiens
caagugugcagcagaaaga

SEQ ID NO: 1490348 - RNA, 19 nt, Homo sapiens
uaaacgaagagaaccauga

SEQ ID NO: 1490349 - RNA, 19 nt, Homo sapiens
ggaccugcaacgacaauug

SEQ ID NO: 1490350 - RNA, 19 nt, Homo sapiens
gaagaaccaaucugcaucu

SEQ ID NO: 1490351 - RNA, 19 nt, Homo sapiens
gugaacagcaugucagaug

SEQ ID NO: 1490352 - RNA, 19 nt, Homo sapiens
caugagcaaugaaucuugu

SEQ ID NO: 1490353 - RNA, 19 nt, Homo sapiens
cacagcuacucuucaauga

SEQ ID NO: 1490354 - RNA, 19 nt, Homo sapiens
gcaguugugucccucuucu

SEQ ID NO: 1490355 - RNA, 19 nt, Homo sapiens
agggagaggugauugaugu

SEQ ID NO: 1490356 - RNA, 19 nt, Homo sapiens
ggagaugggcaguuaccuu

SEQ ID NO: 1490357 - RNA, 19 nt, Homo sapiens
gcacuaugacauccgagaa

SEQ ID NO: 1490358 - RNA, 19 nt, Homo sapiens
gcacaggagcuuuacaaaa

SEQ ID NO: 1490359 - RNA, 19 nt, Homo sapiens
gcaaggcaggugaaaguca

SEQ ID NO: 1490360 - RNA, 19 nt, Homo sapiens
aaacaaggaaagaagagaa

SEQ ID NO: 1490361 - RNA, 19 nt, Homo sapiens
caucccagcuuucuuuacu

SEQ ID NO: 1490362 - RNA, 19 nt, Homo sapiens
caaguaugcaccaauguuc

SEQ ID NO: 1490363 - RNA, 19 nt, Homo sapiens
caaaagaaagccaguaaga

SEQ ID NO: 1490364 - RNA, 19 nt, Homo sapiens
gcguuugcaggcaguauua

SEQ ID NO: 1490365 - RNA, 19 nt, Homo sapiens
ggcgggagcagcuaucaaa

SEQ ID NO: 1490366 - RNA, 19 nt, Homo sapiens
gcagagcuccacagagaag

SEQ ID NO: 1490367 - RNA, 19 nt, Homo sapiens
guacaacuccaaaagaaaa

SEQ ID NO: 1490368 - RNA, 19 nt, Homo sapiens
guggagcugucuuaaacga

SEQ ID NO: 1490369 - RNA, 19 nt, Homo sapiens
agguagauaucguggcuaa

SEQ ID NO: 1490370 - RNA, 19 nt, Homo sapiens
gggaagaaccaaucugcau

SEQ ID NO: 1490371 - RNA, 19 nt, Homo sapiens
ggugauugauguacacaac

SEQ ID NO: 1490372 - RNA, 19 nt, Homo sapiens
ccaauguucgagaguaauu

SEQ ID NO: 1490373 - RNA, 19 nt, Homo sapiens
gaaccaugagcaaugaauc

SEQ ID NO: 1490374 - RNA, 19 nt, Homo sapiens
caaagcgaaggcuacauga

SEQ ID NO: 1490375 - RNA, 19 nt, Homo sapiens
ucaaguaugcaccaauguu

SEQ ID NO: 1490376 - RNA, 19 nt, Homo sapiens
gcaguucaaauaauaaagg

SEQ ID NO: 1490377 - RNA, 19 nt, Homo sapiens
aaacacgagagaugacaaa

SEQ ID NO: 1490378 - RNA, 19 nt, Homo sapiens
gaaguccuguagggagaug

SEQ ID NO: 1490379 - RNA, 19 nt, Homo sapiens
gcauagcaacaaccaaauc

SEQ ID NO: 1490380 - RNA, 19 nt, Homo sapiens
gaaggaggagcagcaagga

SEQ ID NO: 1490381 - RNA, 19 nt, Homo sapiens
uuucaaguaugcaccaaug

SEQ ID NO: 1490382 - RNA, 19 nt, Homo sapiens
cagcuugagugcggcguuu

SEQ ID NO: 1490383 - RNA, 19 nt, Homo sapiens
ugaaauuugugaagaucuc

SEQ ID NO: 1490384 - RNA, 19 nt, Homo sapiens
ugguggagcugucuuaaac

SEQ ID NO: 1490385 - RNA, 19 nt, Homo sapiens
gcaggcccgucaagacucu

SEQ ID NO: 1490386 - RNA, 19 nt, Homo sapiens
caacagaggagaguacaac

SEQ ID NO: 1490387 - RNA, 19 nt, Homo sapiens
acagagagguagauaucgu

SEQ ID NO: 1490388 - RNA, 19 nt, Homo sapiens
uagcacaggagcuuuacaa

SEQ ID NO: 1490389 - RNA, 19 nt, Homo sapiens
cgaagagaaccaugagcaa

SEQ ID NO: 1490390 - RNA, 19 nt, Homo sapiens
ccgccagucucucccaaga

SEQ ID NO: 1490391 - RNA, 19 nt, Homo sapiens
gcaacaggaccuagaacag

SEQ ID NO: 1490392 - RNA, 19 nt, Homo sapiens
caacuaaaaucugugaaca

SEQ ID NO: 1490393 - RNA, 19 nt, Homo sapiens
guucuggcccaaccaacua

SEQ ID NO: 1490394 - RNA, 19 nt, Homo sapiens
gaggagaguacaacauuuu

SEQ ID NO: 1490395 - RNA, 19 nt, Homo sapiens
gagauggaagccagaaagu

SEQ ID NO: 1490396 - RNA, 19 nt, Homo sapiens
uggcuaagacgguggagaa

SEQ ID NO: 1490397 - RNA, 19 nt, Homo sapiens
aagaaagccaguaagauca

SEQ ID NO: 1490398 - RNA, 19 nt, Homo sapiens
gaugggcaguuaccuucuc

SEQ ID NO: 1490399 - RNA, 19 nt, Homo sapiens
gcgaaggcuacaugaguga

SEQ ID NO: 1490400 - RNA, 19 nt, Homo sapiens
gcaagugugcagcagaaag

SEQ ID NO: 1490401 - RNA, 19 nt, Homo sapiens
aagagaaccaugagcaaug

SEQ ID NO: 1490402 - RNA, 19 nt, Homo sapiens
gaaaguaccuaauauccaa

SEQ ID NO: 1490403 - RNA, 19 nt, Homo sapiens
ggacagaguucauucaaag

SEQ ID NO: 1490404 - RNA, 19 nt, Homo sapiens
ggacagaguucauucaaag

SEQ ID NO: 1490405 - RNA, 19 nt, Homo sapiens
gaauacagguuugaggaua

SEQ ID NO: 1490406 - RNA, 19 nt, Homo sapiens
gaauacagguuugaggaua

SEQ ID NO: 1490407 - RNA, 19 nt, Homo sapiens
agacacaguuucuggaaua

SEQ ID NO: 1490408 - RNA, 19 nt, Homo sapiens
agacacaguuucuggaaua

SEQ ID NO: 1490409 - RNA, 19 nt, Homo sapiens
gaagggaauuagaaucaug

SEQ ID NO: 1490410 - RNA, 19 nt, Homo sapiens
gaagggaauuagaaucaug

SEQ ID NO: 1490411 - RNA, 19 nt, Homo sapiens
gcacaucacagacacaguu

SEQ ID NO: 1490412 - RNA, 19 nt, Homo sapiens
gcacaucacagacacaguu

SEQ ID NO: 1490413 - RNA, 19 nt, Homo sapiens
gaauuagaaucauggagau

SEQ ID NO: 1490414 - RNA, 19 nt, Homo sapiens
gaauuagaaucauggagau

SEQ ID NO: 1490415 - RNA, 19 nt, Homo sapiens
ggaaagaaacauggccaua

SEQ ID NO: 1490416 - RNA, 19 nt, Homo sapiens
ucauggagaugcugcuaaa

SEQ ID NO: 1490417 - RNA, 19 nt, Homo sapiens
ucauggagaugcugcuaaa

SEQ ID NO: 1490418 - RNA, 19 nt, Homo sapiens
caaagaggcaggauuucaa

SEQ ID NO: 1490419 - RNA, 19 nt, Homo sapiens
caaagaggcaggauuucaa

SEQ ID NO: 1490420 - RNA, 19 nt, Homo sapiens
gaaagaaacauggccauac

SEQ ID NO: 1490421 - RNA, 19 nt, Homo sapiens
gcucaauccucgggaaaga

SEQ ID NO: 1490422 - RNA, 19 nt, Homo sapiens
ggagagaaacauggccaua

SEQ ID NO: 1490423 - RNA, 19 nt, Homo sapiens
cagaagggaauuagaauca

SEQ ID NO: 1490424 - RNA, 19 nt, Homo sapiens
cagaagggaauuagaauca

SEQ ID NO: 1490425 - RNA, 19 nt, Homo sapiens
ggauuucucaacuguguuu

SEQ ID NO: 1490426 - RNA, 19 nt, Homo sapiens
ggauuucucaacuguguuu

SEQ ID NO: 1490427 - RNA, 19 nt, Homo sapiens
gcagguggucgccagcuuu

SEQ ID NO: 1490428 - RNA, 19 nt, Homo sapiens
uaaggaaggugagcauuuu

SEQ ID NO: 1490429 - RNA, 19 nt, Homo sapiens
gcccagaagggaauuagaa

SEQ ID NO: 1490430 - RNA, 19 nt, Homo sapiens
gcccagaagggaauuagaa

SEQ ID NO: 1490431 - RNA, 19 nt, Homo sapiens
uggagaugcugcuaaagga

SEQ ID NO: 1490432 - RNA, 19 nt, Homo sapiens
uggagaugcugcuaaagga

SEQ ID NO: 1490433 - RNA, 19 nt, Homo sapiens
uuaaggaaggugagcauuu

SEQ ID NO: 1490434 - RNA, 19 nt, Homo sapiens
gagccugcuucgaauagug

SEQ ID NO: 1490435 - RNA, 19 nt, Homo sapiens
gagccugcuucgaauagug

SEQ ID NO: 1490436 - RNA, 19 nt, Homo sapiens
gaggagucauggcucaauc

SEQ ID NO: 1490437 - RNA, 19 nt, Homo sapiens
ggccacagcacaucacaga

SEQ ID NO: 1490438 - RNA, 19 nt, Homo sapiens
ccccuuagcugaauaaaga

SEQ ID NO: 1490439 - RNA, 19 nt, Homo sapiens
ggacucagggagagaaaca

SEQ ID NO: 1490440 - RNA, 19 nt, Homo sapiens
ggccacagcacaucacaga

SEQ ID NO: 1490441 - RNA, 19 nt, Homo sapiens
ccccuuagcugaauaaaga

SEQ ID NO: 1490442 - RNA, 19 nt, Homo sapiens
aaagaaacauggccauacg

SEQ ID NO: 1490443 - RNA, 19 nt, Homo sapiens
ggaauacagguuugaggau

SEQ ID NO: 1490444 - RNA, 19 nt, Homo sapiens
ggaauacagguuugaggau

SEQ ID NO: 1490445 - RNA, 19 nt, Homo sapiens
gccaggacauaaaaugaua

SEQ ID NO: 1490446 - RNA, 19 nt, Homo sapiens
ccacagcacaucacagaca

SEQ ID NO: 1490447 - RNA, 19 nt, Homo sapiens
ggagaugcugcuaaaggaa

SEQ ID NO: 1490448 - RNA, 19 nt, Homo sapiens
gccaggacauaaaaugaua

SEQ ID NO: 1490449 - RNA, 19 nt, Homo sapiens
ccacagcacaucacagaca

SEQ ID NO: 1490450 - RNA, 19 nt, Homo sapiens
ggagaugcugcuaaaggaa

SEQ ID NO: 1490451 - RNA, 19 nt, Homo sapiens
ccaauuagaagaggaguca

SEQ ID NO: 1490452 - RNA, 19 nt, Homo sapiens
ucaaagaggcaggauuuca

SEQ ID NO: 1490453 - RNA, 19 nt, Homo sapiens
uggacagaguucauucaaa

SEQ ID NO: 1490454 - RNA, 19 nt, Homo sapiens
ggacacaguaugcauccau

SEQ ID NO: 1490455 - RNA, 19 nt, Homo sapiens
ucaaagaggcaggauuuca

SEQ ID NO: 1490456 - RNA, 19 nt, Homo sapiens
uggacagaguucauucaaa

SEQ ID NO: 1490457 - RNA, 19 nt, Homo sapiens
ggacacaguaugcauccau

SEQ ID NO: 1490458 - RNA, 19 nt, Homo sapiens
guuugaggauacaguguug

SEQ ID NO: 1490459 - RNA, 19 nt, Homo sapiens
auucaaagaggcaggauuu

SEQ ID NO: 1490460 - RNA, 19 nt, Homo sapiens
guuugaggauacaguguug

SEQ ID NO: 1490461 - RNA, 19 nt, Homo sapiens
auucaaagaggcaggauuu

SEQ ID NO: 1490462 - RNA, 19 nt, Homo sapiens
ucaauccucgggaaagaaa

SEQ ID NO: 1490463 - RNA, 19 nt, Homo sapiens
caaauuggacagaguucau

SEQ ID NO: 1490464 - RNA, 19 nt, Homo sapiens
caaauuggacagaguucau

SEQ ID NO: 1490465 - RNA, 19 nt, Homo sapiens
auacggagucacugccuua

SEQ ID NO: 1490466 - RNA, 19 nt, Homo sapiens
acagaaagaggauugcaau

SEQ ID NO: 1490467 - RNA, 19 nt, Homo sapiens
caacaggggucaucuacag

SEQ ID NO: 1490468 - RNA, 19 nt, Homo sapiens
auacggagucacugccuua

SEQ ID NO: 1490469 - RNA, 19 nt, Homo sapiens
gauacaguguuggcagcuu

SEQ ID NO: 1490470 - RNA, 19 nt, Homo sapiens
gagagaaacauggccauac

SEQ ID NO: 1490471 - RNA, 19 nt, Homo sapiens
gauacaguguuggcagcuu

SEQ ID NO: 1490472 - RNA, 19 nt, Homo sapiens
ucugggagccugcuucgaa

SEQ ID NO: 1490473 - RNA, 19 nt, Homo sapiens
ucugggagccugcuucgaa

SEQ ID NO: 1490474 - RNA, 19 nt, Homo sapiens
agaccuucuugcuggauuu

SEQ ID NO: 1490475 - RNA, 19 nt, Homo sapiens
agagaaacauggccauacg

SEQ ID NO: 1490476 - RNA, 19 nt, Homo sapiens
aaagaggcaggauuucaau

SEQ ID NO: 1490477 - RNA, 19 nt, Homo sapiens
gacagaguucauucaaaga

SEQ ID NO: 1490478 - RNA, 19 nt, Homo sapiens
augcauccaugaaggaaga

SEQ ID NO: 1490479 - RNA, 19 nt, Homo sapiens
cggagucacugccuuacgu

SEQ ID NO: 1490480 - RNA, 19 nt, Homo sapiens
aaagaggcaggauuucaau

SEQ ID NO: 1490481 - RNA, 19 nt, Homo sapiens
gacagaguucauucaaaga

SEQ ID NO: 1490482 - RNA, 19 nt, Homo sapiens
augcauccaugaaggaaga

SEQ ID NO: 1490483 - RNA, 19 nt, Homo sapiens
cggagucacugccuuacgu

SEQ ID NO: 1490484 - RNA, 19 nt, Homo sapiens
agaaucaucaaaucacuuc

SEQ ID NO: 1490485 - RNA, 19 nt, Homo sapiens
ucucaacuguguuuuagaa

SEQ ID NO: 1490486 - RNA, 19 nt, Homo sapiens
gaaggugagcauuuugaaa

SEQ ID NO: 1490487 - RNA, 19 nt, Homo sapiens
agaaucaucaaaucacuuc

SEQ ID NO: 1490488 - RNA, 19 nt, Homo sapiens
ucucaacuguguuuuagaa

SEQ ID NO: 1490489 - RNA, 19 nt, Homo sapiens
caucacagacacaguuucu

SEQ ID NO: 1490490 - RNA, 19 nt, Homo sapiens
caucacagacacaguuucu

SEQ ID NO: 1490491 - RNA, 19 nt, Homo sapiens
ugaaaguaccuaauaucca

SEQ ID NO: 1490492 - RNA, 19 nt, Homo sapiens
ggacucagggagauaagac

SEQ ID NO: 1490493 - RNA, 19 nt, Homo sapiens
ggagccugcuucgaauagu

SEQ ID NO: 1490494 - RNA, 19 nt, Homo sapiens
ccagaagggaauuagaauc

SEQ ID NO: 1490495 - RNA, 19 nt, Homo sapiens
ggugagcauuuugaaagua

SEQ ID NO: 1490496 - RNA, 19 nt, Homo sapiens
ggagccugcuucgaauagu

SEQ ID NO: 1490497 - RNA, 19 nt, Homo sapiens
ggggucaucuacagaaaga

SEQ ID NO: 1490498 - RNA, 19 nt, Homo sapiens
ccagaagggaauuagaauc

SEQ ID NO: 1490499 - RNA, 19 nt, Homo sapiens
gguuugaggauacaguguu

SEQ ID NO: 1490500 - RNA, 19 nt, Homo sapiens
uuggauuucucaacugugu

SEQ ID NO: 1490501 - RNA, 19 nt, Homo sapiens
gguuugaggauacaguguu

SEQ ID NO: 1490502 - RNA, 19 nt, Homo sapiens
gaacaaaggucgccaguca

SEQ ID NO: 1490503 - RNA, 19 nt, Homo sapiens
ggagacagcuugaugagaa

SEQ ID NO: 1490504 - RNA, 19 nt, Homo sapiens
gcaaagccgucccuucaaa

SEQ ID NO: 1490505 - RNA, 19 nt, Homo sapiens
ggugugagguggauacuuu

SEQ ID NO: 1490506 - RNA, 19 nt, Homo sapiens
gaaggcaaguuaggagaua

SEQ ID NO: 1490507 - RNA, 19 nt, Homo sapiens
caaguuaggagauaaagua

SEQ ID NO: 1490508 - RNA, 19 nt, Homo sapiens
gaauuucuaugguguccua

SEQ ID NO: 1490509 - RNA, 19 nt, Homo sapiens
gcaaaggccuuaugcaacu

SEQ ID NO: 1490510 - RNA, 19 nt, Homo sapiens
gcggccagcucccucauua

SEQ ID NO: 1490511 - RNA, 19 nt, Homo sapiens
gaggugaauugcauuuaaa

SEQ ID NO: 1490512 - RNA, 19 nt, Homo sapiens
ccaaagaggugaauugcau

SEQ ID NO: 1490513 - RNA, 19 nt, Homo sapiens
ucagaaagaccucuaguuu

SEQ ID NO: 1490514 - RNA, 19 nt, Homo sapiens
gcagggcccucuacaacuu

SEQ ID NO: 1490515 - RNA, 19 nt, Homo sapiens
caucuucccuaucuuguuu

SEQ ID NO: 1490516 - RNA, 19 nt, Homo sapiens
gagcaaaggccuuaugcaa

SEQ ID NO: 1490517 - RNA, 19 nt, Homo sapiens
agacagaccuccggagaaa

SEQ ID NO: 1490518 - RNA, 19 nt, Homo sapiens
ggagugcccugugugcuuu

SEQ ID NO: 1490519 - RNA, 19 nt, Homo sapiens
ccagaaaacucaagaaaug

SEQ ID NO: 1490520 - RNA, 19 nt, Homo sapiens
agaggugaauugcauuuaa

SEQ ID NO: 1490521 - RNA, 19 nt, Homo sapiens
gagcauggguccuuguucu

SEQ ID NO: 1490522 - RNA, 19 nt, Homo sapiens
caacugacccuaccaugug

SEQ ID NO: 1490523 - RNA, 19 nt, Homo sapiens
acaagggucucuucggaaa

SEQ ID NO: 1490524 - RNA, 19 nt, Homo sapiens
gaugagaacugggcagaag

SEQ ID NO: 1490525 - RNA, 19 nt, Homo sapiens
gcuagugccuaaugucaga

SEQ ID NO: 1490526 - RNA, 19 nt, Homo sapiens
gaacaacuucugccaucuu

SEQ ID NO: 1490527 - RNA, 19 nt, Homo sapiens
acuaguagcugccauaucu

SEQ ID NO: 1490528 - RNA, 19 nt, Homo sapiens
guguuacuguguagaauuu

SEQ ID NO: 1490529 - RNA, 19 nt, Homo sapiens
gauuugacguuacuugauc

SEQ ID NO: 1490530 - RNA, 19 nt, Homo sapiens
caagacaccuuuuagagaa

SEQ ID NO: 1490531 - RNA, 19 nt, Homo sapiens
ggacaggucagcacuuauc

SEQ ID NO: 1490532 - RNA, 19 nt, Homo sapiens
caacagccuugaacacucu

SEQ ID NO: 1490533 - RNA, 19 nt, Homo sapiens
ucaacaagcauuagaacaa

SEQ ID NO: 1490534 - RNA, 19 nt, Homo sapiens
guggauacuuugaacauuc

SEQ ID NO: 1490535 - RNA, 19 nt, Homo sapiens
gcaucuucccaaacaauua

SEQ ID NO: 1490536 - RNA, 19 nt, Homo sapiens
gcagaaucccggugaccua

SEQ ID NO: 1490537 - RNA, 19 nt, Homo sapiens
caacaccucucagcgaaca

SEQ ID NO: 1490538 - RNA, 19 nt, Homo sapiens
caacaagcauuagaacaac

SEQ ID NO: 1490539 - RNA, 19 nt, Homo sapiens
ccgugagauuucagaauua

SEQ ID NO: 1490540 - RNA, 19 nt, Homo sapiens
gaauggaucccugcagaga

SEQ ID NO: 1490541 - RNA, 19 nt, Homo sapiens
gggcggagcagcaugagaa

SEQ ID NO: 1490542 - RNA, 19 nt, Homo sapiens
cuacaccacaugaacguua

SEQ ID NO: 1490543 - RNA, 19 nt, Homo sapiens
ugggacaggucagcacuua

SEQ ID NO: 1490544 - RNA, 19 nt, Homo sapiens
ggagcagcaugagaaagaa

SEQ ID NO: 1490545 - RNA, 19 nt, Homo sapiens
uggaguauguggccucuug

SEQ ID NO: 1490546 - RNA, 19 nt, Homo sapiens
cagcacaccuucugcaaac

SEQ ID NO: 1490547 - RNA, 19 nt, Homo sapiens
gaaauggcaucgaaaagca

SEQ ID NO: 1490548 - RNA, 19 nt, Homo sapiens
caaaggccuuaugcaacua

SEQ ID NO: 1490549 - RNA, 19 nt, Homo sapiens
gguggauacuuugaacauu

SEQ ID NO: 1490550 - RNA, 19 nt, Homo sapiens
ucauaauccuggcugcaaa

SEQ ID NO: 1490551 - RNA, 19 nt, Homo sapiens
gaaggugauccacggcaaa

SEQ ID NO: 1490552 - RNA, 19 nt, Homo sapiens
gagacagcuugaugagaau

SEQ ID NO: 1490553 - RNA, 19 nt, Homo sapiens
acaauauccucaacaagca

SEQ ID NO: 1490554 - RNA, 19 nt, Homo sapiens
gcguggccuuccaaacaua

SEQ ID NO: 1490555 - RNA, 19 nt, Homo sapiens
gaccguguuucccagcaaa

SEQ ID NO: 1490556 - RNA, 19 nt, Homo sapiens
ccagcucccucauuaugga

SEQ ID NO: 1490557 - RNA, 19 nt, Homo sapiens
gcaaggacaagagugagaa

SEQ ID NO: 1490558 - RNA, 19 nt, Homo sapiens
cucaagaaauggcaucgaa

SEQ ID NO: 1490559 - RNA, 19 nt, Homo sapiens
caaggacgauaucaucacu

SEQ ID NO: 1490560 - RNA, 19 nt, Homo sapiens
gaggcaaggacaagaguga

SEQ ID NO: 1490561 - RNA, 19 nt, Homo sapiens
cggagaaagucagcucuug

SEQ ID NO: 1490562 - RNA, 19 nt, Homo sapiens
accgugagauuucagaauu

SEQ ID NO: 1490563 - RNA, 19 nt, Homo sapiens
ggccucagcaguuccaauu

SEQ ID NO: 1490564 - RNA, 19 nt, Homo sapiens
caaggcagcauuucagaag

SEQ ID NO: 1490565 - RNA, 19 nt, Homo sapiens
aaauugucgugcccacuuu

SEQ ID NO: 1490566 - RNA, 19 nt, Homo sapiens
ggagaaagcagacguuccu

SEQ ID NO: 1490567 - RNA, 19 nt, Homo sapiens
gcaagacaccuuuuagaga

SEQ ID NO: 1490568 - RNA, 19 nt, Homo sapiens
cuuacaauauccucaacaa

SEQ ID NO: 1490569 - RNA, 19 nt, Homo sapiens
ggccagcucccucauuaug

SEQ ID NO: 1490570 - RNA, 19 nt, Homo sapiens
ucuuugaccuuacaauauc

SEQ ID NO: 1490571 - RNA, 19 nt, Homo sapiens
uauguggccucuugucauc

SEQ ID NO: 1490572 - RNA, 19 nt, Homo sapiens
aauggaugauuugacguua

SEQ ID NO: 1490573 - RNA, 19 nt, Homo sapiens
aaagaggugaauugcauuu

SEQ ID NO: 1490574 - RNA, 19 nt, Homo sapiens
ucacccagcccauggagaa

SEQ ID NO: 1490575 - RNA, 19 nt, Homo sapiens
ugacguuacuugaucuucu

SEQ ID NO: 1490576 - RNA, 19 nt, Homo sapiens
cggagcagcaugagaaaga

SEQ ID NO: 1490577 - RNA, 19 nt, Homo sapiens
ccucucagcgaacauguuu

SEQ ID NO: 1490578 - RNA, 19 nt, Homo sapiens
gaaucccggugaccuaagg

SEQ ID NO: 1490579 - RNA, 19 nt, Homo sapiens
gaugauuugacguuacuug

SEQ ID NO: 1490580 - RNA, 19 nt, Homo sapiens
gacguuacuugaucuucug

SEQ ID NO: 1490581 - RNA, 19 nt, Homo sapiens
gguccuuguucuuccuauu

SEQ ID NO: 1490582 - RNA, 19 nt, Homo sapiens
caaagaggugaauugcauu

SEQ ID NO: 1490583 - RNA, 19 nt, Homo sapiens
cauuauggaagacaaagaa

SEQ ID NO: 1490584 - RNA, 19 nt, Homo sapiens
ccucagcaguuccaauucu

SEQ ID NO: 1490585 - RNA, 19 nt, Homo sapiens
ugcaaaccaugucuacaga

SEQ ID NO: 1490586 - RNA, 19 nt, Homo sapiens
agagugagaaccaggauug

SEQ ID NO: 1490587 - RNA, 19 nt, Homo sapiens
ccuguacacuggccacuag

SEQ ID NO: 1490588 - RNA, 19 nt, Homo sapiens
ggaaagggcggagcagcau

SEQ ID NO: 1490589 - RNA, 19 nt, Homo sapiens
cccaaacaauuacgucauc

SEQ ID NO: 1490590 - RNA, 19 nt, Homo sapiens
caacuucugccaucuucug

SEQ ID NO: 1490591 - RNA, 19 nt, Homo sapiens
cuucuuugaccuuacaaua

SEQ ID NO: 1490592 - RNA, 19 nt, Homo sapiens
caaagccgucccuucaaau

SEQ ID NO: 1490593 - RNA, 19 nt, Homo sapiens
gagucggcaucuucccaaa

SEQ ID NO: 1490594 - RNA, 19 nt, Homo sapiens
gcagaaguuacaugcacaa

SEQ ID NO: 1490595 - RNA, 19 nt, Homo sapiens
guacacuggccacuaguag

SEQ ID NO: 1490596 - RNA, 19 nt, Homo sapiens
caagaaauggcaucgaaaa

SEQ ID NO: 1490597 - RNA, 19 nt, Homo sapiens
ucaagaaauggcaucgaaa

SEQ ID NO: 1490598 - RNA, 19 nt, Homo sapiens
aaagaaauccccaucaaga

SEQ ID NO: 1490599 - RNA, 19 nt, Homo sapiens
acaaagaaauccccaucaa

SEQ ID NO: 1490600 - RNA, 19 nt, Homo sapiens
gucggcaucuucccaaaca

SEQ ID NO: 1490601 - RNA, 19 nt, Homo sapiens
uaguagcugccauaucuuu

SEQ ID NO: 1490602 - RNA, 19 nt, Homo sapiens
gcacugaaaugaaaucaaa

SEQ ID NO: 1490603 - RNA, 19 nt, Homo sapiens
gaaguagccuuaguaauaa

SEQ ID NO: 1490604 - RNA, 19 nt, Homo sapiens
guacagcacugaaaugaaa

SEQ ID NO: 1490605 - RNA, 19 nt, Homo sapiens
gaaguuaacucaagaugga

SEQ ID NO: 1490606 - RNA, 19 nt, Homo sapiens
gaagaagcauugauuguau

SEQ ID NO: 1490607 - RNA, 19 nt, Homo sapiens
agaaguagccuuaguaaua

SEQ ID NO: 1490608 - RNA, 19 nt, Homo sapiens
acaaggaugugucauauuu

SEQ ID NO: 1490609 - RNA, 19 nt, Homo sapiens
gaagcacgcucauacuuug

SEQ ID NO: 1490610 - RNA, 19 nt, Homo sapiens
gauuggaaguucucuauuu

SEQ ID NO: 1490611 - RNA, 19 nt, Homo sapiens
gacggagucuucaauauuu

SEQ ID NO: 1490612 - RNA, 19 nt, Homo sapiens
cagaauugcuaguaguuua

SEQ ID NO: 1490613 - RNA, 19 nt, Homo sapiens
gaauucauguucugauuug

SEQ ID NO: 1490614 - RNA, 19 nt, Homo sapiens
gaaccucucucuaugaauc

SEQ ID NO: 1490615 - RNA, 19 nt, Homo sapiens
gcagggaugcugugaauaa

SEQ ID NO: 1490616 - RNA, 19 nt, Homo sapiens
caaagaauauccucacagu

SEQ ID NO: 1490617 - RNA, 19 nt, Homo sapiens
caaagaaguagccuuagua

SEQ ID NO: 1490618 - RNA, 19 nt, Homo sapiens
gaaaagagccaguggaaaa

SEQ ID NO: 1490619 - RNA, 19 nt, Homo sapiens
ugucguagcuucuauccua

SEQ ID NO: 1490620 - RNA, 19 nt, Homo sapiens
cgaaagagcagcuugagaa

SEQ ID NO: 1490621 - RNA, 19 nt, Homo sapiens
caggaaugaugcuuugaua

SEQ ID NO: 1490622 - RNA, 19 nt, Homo sapiens
gguauucccugcuuauaug

SEQ ID NO: 1490623 - RNA, 19 nt, Homo sapiens
cagcagauccaaagaagua

SEQ ID NO: 1490624 - RNA, 19 nt, Homo sapiens
uaauagacuuugcaccuuu

SEQ ID NO: 1490625 - RNA, 19 nt, Homo sapiens
gaggagaaguuaacucaag

SEQ ID NO: 1490626 - RNA, 19 nt, Homo sapiens
gaugagaaaccacagaauu

SEQ ID NO: 1490627 - RNA, 19 nt, Homo sapiens
gcuguaagccuuuguuuau

SEQ ID NO: 1490628 - RNA, 19 nt, Homo sapiens
ucagucaggugauuauuga

SEQ ID NO: 1490629 - RNA, 19 nt, Homo sapiens
caugaaaucugcugugauc

SEQ ID NO: 1490630 - RNA, 19 nt, Homo sapiens
gaaugucccuguggaauca

SEQ ID NO: 1490631 - RNA, 19 nt, Homo sapiens
gaaagagcagcuugagaaa

SEQ ID NO: 1490632 - RNA, 19 nt, Homo sapiens
ucaauccuguguaauguuu

SEQ ID NO: 1490633 - RNA, 19 nt, Homo sapiens
cugagacucuugaacuuua

SEQ ID NO: 1490634 - RNA, 19 nt, Homo sapiens
aaucaaagaugaagaagca

SEQ ID NO: 1490635 - RNA, 19 nt, Homo sapiens
uaucaagucugaauagcaa

SEQ ID NO: 1490636 - RNA, 19 nt, Homo sapiens
gaaggaggcagaaguggaa

SEQ ID NO: 1490637 - RNA, 19 nt, Homo sapiens
ggagaaauuuugcaaugua

SEQ ID NO: 1490638 - RNA, 19 nt, Homo sapiens
gaaauugcagauccuauug

SEQ ID NO: 1490639 - RNA, 19 nt, Homo sapiens
ggagacaauuguuaucauc

SEQ ID NO: 1490640 - RNA, 19 nt, Homo sapiens
ugacagacauagcugaaug

SEQ ID NO: 1490641 - RNA, 19 nt, Homo sapiens
aaacucugaugaacacuuu

SEQ ID NO: 1490642 - RNA, 19 nt, Homo sapiens
gaaagaaggaggcagaagu

SEQ ID NO: 1490643 - RNA, 19 nt, Homo sapiens
ugacaaguauugcggaaug

SEQ ID NO: 1490644 - RNA, 19 nt, Homo sapiens
aaauuuggauguagacuga

SEQ ID NO: 1490645 - RNA, 19 nt, Homo sapiens
acaauaggcuuggcucaaa

SEQ ID NO: 1490646 - RNA, 19 nt, Homo sapiens
gaaugauccugccaugaau

SEQ ID NO: 1490647 - RNA, 19 nt, Homo sapiens
gacaugaaaucugcuguga

SEQ ID NO: 1490648 - RNA, 19 nt, Homo sapiens
gaaguucucuauuuucuug

SEQ ID NO: 1490649 - RNA, 19 nt, Homo sapiens
aaacugacauuccaaggau

SEQ ID NO: 1490650 - RNA, 19 nt, Homo sapiens
ggaauucauguucugauuu

SEQ ID NO: 1490651 - RNA, 19 nt, Homo sapiens
ggaaugaguacauaacugu

SEQ ID NO: 1490652 - RNA, 19 nt, Homo sapiens
ugaagaagcauugauugua

SEQ ID NO: 1490653 - RNA, 19 nt, Homo sapiens
gaaacugacauuccaagga

SEQ ID NO: 1490654 - RNA, 19 nt, Homo sapiens
cuuauaaccuugcuaaauc

SEQ ID NO: 1490655 - RNA, 19 nt, Homo sapiens
ccaaagaaguagccuuagu

SEQ ID NO: 1490656 - RNA, 19 nt, Homo sapiens
uauagagguuugugaagaa

SEQ ID NO: 1490657 - RNA, 19 nt, Homo sapiens
gagaugaucaggcaggaaa

SEQ ID NO: 1490658 - RNA, 19 nt, Homo sapiens
caugcaggcugucuuaaga

SEQ ID NO: 1490659 - RNA, 19 nt, Homo sapiens
ggacagugaugggcucaau

SEQ ID NO: 1490660 - RNA, 19 nt, Homo sapiens
aagagcagcuugagaaaca

SEQ ID NO: 1490661 - RNA, 19 nt, Homo sapiens
ugaaugauccugccaugaa

SEQ ID NO: 1490662 - RNA, 19 nt, Homo sapiens
ugacugcucugcuccucua

SEQ ID NO: 1490663 - RNA, 19 nt, Homo sapiens
gaaucagccuagaggagaa

SEQ ID NO: 1490664 - RNA, 19 nt, Homo sapiens
ugauagaacugcagguugu

SEQ ID NO: 1490665 - RNA, 19 nt, Homo sapiens
gguuuggucuucacgguuu

SEQ ID NO: 1490666 - RNA, 19 nt, Homo sapiens
gugcauucauguaaucuga

SEQ ID NO: 1490667 - RNA, 19 nt, Homo sapiens
ugaagcacauccuguugaa

SEQ ID NO: 1490668 - RNA, 19 nt, Homo sapiens
gggaugcugugaauaagau

SEQ ID NO: 1490669 - RNA, 19 nt, Homo sapiens
cagauuuacuccuauuuca

SEQ ID NO: 1490670 - RNA, 19 nt, Homo sapiens
gagaauugguucagguagu

SEQ ID NO: 1490671 - RNA, 19 nt, Homo sapiens
ucacaugcuuccucugcua

SEQ ID NO: 1490672 - RNA, 19 nt, Homo sapiens
ugguucagcuuuaucuaua

SEQ ID NO: 1490673 - RNA, 19 nt, Homo sapiens
uagcaaauuuggauguaga

SEQ ID NO: 1490674 - RNA, 19 nt, Homo sapiens
ggagucugcuuuagugaag

SEQ ID NO: 1490675 - RNA, 19 nt, Homo sapiens
ugacggagucuucaauauu

SEQ ID NO: 1490676 - RNA, 19 nt, Homo sapiens
caagauggaauucauguuc

SEQ ID NO: 1490677 - RNA, 19 nt, Homo sapiens
ccacagaauugcuaguagu

SEQ ID NO: 1490678 - RNA, 19 nt, Homo sapiens
uuucuugggucuaaucuuu

SEQ ID NO: 1490679 - RNA, 19 nt, Homo sapiens
gcauucauguaaucugaga

SEQ ID NO: 1490680 - RNA, 19 nt, Homo sapiens
cuuauuugcucuucagauu

SEQ ID NO: 1490681 - RNA, 19 nt, Homo sapiens
ggaccaauguauuuagaac

SEQ ID NO: 1490682 - RNA, 19 nt, Homo sapiens
caaggaugugucauauuua

SEQ ID NO: 1490683 - RNA, 19 nt, Homo sapiens
gaugaacacuuuggagucu

SEQ ID NO: 1490684 - RNA, 19 nt, Homo sapiens
guucugauuugaggaauga

SEQ ID NO: 1490685 - RNA, 19 nt, Homo sapiens
ggagguauauggccuucuc

SEQ ID NO: 1490686 - RNA, 19 nt, Homo sapiens
guuuaauucuugcaacuga

SEQ ID NO: 1490687 - RNA, 19 nt, Homo sapiens
ggaaugaugcuuugauacu

SEQ ID NO: 1490688 - RNA, 19 nt, Homo sapiens
caggcugucuuaagaaaug

SEQ ID NO: 1490689 - RNA, 19 nt, Homo sapiens
gcauucuugcucaguauua

SEQ ID NO: 1490690 - RNA, 19 nt, Homo sapiens
gggaaugaguacauaacug

SEQ ID NO: 1490691 - RNA, 19 nt, Homo sapiens
gaugaagaagcauugauug

SEQ ID NO: 1490692 - RNA, 19 nt, Homo sapiens
uauguucucugcugauguu

SEQ ID NO: 1490693 - RNA, 19 nt, Homo sapiens
gaaugaugcuuugauacuc

SEQ ID NO: 1490694 - RNA, 19 nt, Homo sapiens
gagaccaucuuuggagaau

SEQ ID NO: 1490695 - RNA, 19 nt, Homo sapiens
aaagaaguagccuuaguaa

SEQ ID NO: 1490696 - RNA, 19 nt, Homo sapiens
gauagaggcccugggugua

SEQ ID NO: 1490697 - RNA, 19 nt, Homo sapiens
ugaagcacgcucauacuuu

SEQ ID NO: 1490698 - RNA, 19 nt, Homo sapiens
caaagaugaagaagcauug

SEQ ID NO: 1490699 - RNA, 19 nt, Homo sapiens
gaggacagcauggaaagaa

SEQ ID NO: 1490700 - RNA, 19 nt, Homo sapiens
ggauguagacugacagaca

SEQ ID NO: 1490701 - RNA, 19 nt, Homo sapiens
gaagguuccagggacaaua

SEQ ID NO: 1490702 - RNA, 19 nt, Homo sapiens
ggaaagacagugauuguua

SEQ ID NO: 1490703 - RNA, 19 nt, Homo sapiens
ggaaagagcuacugauuuu

SEQ ID NO: 1490704 - RNA, 19 nt, Homo sapiens
guaaugaagucuagaaaga

SEQ ID NO: 1490705 - RNA, 19 nt, Homo sapiens
gaaagacaccauagucaua

SEQ ID NO: 1490706 - RNA, 19 nt, Homo sapiens
gaaagacagugauuguuau

SEQ ID NO: 1490707 - RNA, 19 nt, Homo sapiens
caugggaucugucuuuaua

SEQ ID NO: 1490708 - RNA, 19 nt, Homo sapiens
gauauaacauucaggauag

SEQ ID NO: 1490709 - RNA, 19 nt, Homo sapiens
gaagaacucagcaaucauu

SEQ ID NO: 1490710 - RNA, 19 nt, Homo sapiens
ggauauaacauucaggaua

SEQ ID NO: 1490711 - RNA, 19 nt, Homo sapiens
ucacaaugcuucauguauu

SEQ ID NO: 1490712 - RNA, 19 nt, Homo sapiens
gaagaaaggcgaucagcuu

SEQ ID NO: 1490713 - RNA, 19 nt, Homo sapiens
caaagcacauggcaucuug

SEQ ID NO: 1490714 - RNA, 19 nt, Homo sapiens
gcucuccucuuaauaugua

SEQ ID NO: 1490715 - RNA, 19 nt, Homo sapiens
gcgaucagcuucaguagau

SEQ ID NO: 1490716 - RNA, 19 nt, Homo sapiens
gagguuagacuuuaucaaa

SEQ ID NO: 1490717 - RNA, 19 nt, Homo sapiens
cuuaauaccugucacauau

SEQ ID NO: 1490718 - RNA, 19 nt, Homo sapiens
ggaauuaggcuuaucaaag

SEQ ID NO: 1490719 - RNA, 19 nt, Homo sapiens
guaucagucuucaucauaa

SEQ ID NO: 1490720 - RNA, 19 nt, Homo sapiens
gggcacugcuauuaacuuu

SEQ ID NO: 1490721 - RNA, 19 nt, Homo sapiens
gaaccugaauguacuccuu

SEQ ID NO: 1490722 - RNA, 19 nt, Homo sapiens
gcacauggcaucuuguaga

SEQ ID NO: 1490723 - RNA, 19 nt, Homo sapiens
gaauagcaaacauccauaa

SEQ ID NO: 1490724 - RNA, 19 nt, Homo sapiens
gcacacgugggauauauuu

SEQ ID NO: 1490725 - RNA, 19 nt, Homo sapiens
agaagaggaugaaauguau

SEQ ID NO: 1490726 - RNA, 19 nt, Homo sapiens
ggacucacaauuccagaua

SEQ ID NO: 1490727 - RNA, 19 nt, Homo sapiens
uagcaaacauccauaauac

SEQ ID NO: 1490728 - RNA, 19 nt, Homo sapiens
caaagggacuguaaugcau

SEQ ID NO: 1490729 - RNA, 19 nt, Homo sapiens
uagcucauguucuuuguuu

SEQ ID NO: 1490730 - RNA, 19 nt, Homo sapiens
aggcaaagguuuauaugaa

SEQ ID NO: 1490731 - RNA, 19 nt, Homo sapiens
aaccaugaguacacuauua

SEQ ID NO: 1490732 - RNA, 19 nt, Homo sapiens
gcagaaguacgagauuaua

SEQ ID NO: 1490733 - RNA, 19 nt, Homo sapiens
gaaguuccuuugaaucaca

SEQ ID NO: 1490734 - RNA, 19 nt, Homo sapiens
ggaccuagauagucuggau

SEQ ID NO: 1490735 - RNA, 19 nt, Homo sapiens
gaugauuugcuuccuauaa

SEQ ID NO: 1490736 - RNA, 19 nt, Homo sapiens
gcaaacauccauaauacau

SEQ ID NO: 1490737 - RNA, 19 nt, Homo sapiens
ggaucugucuuuauauugu

SEQ ID NO: 1490738 - RNA, 19 nt, Homo sapiens
cacugcagcucuccucuua

SEQ ID NO: 1490739 - RNA, 19 nt, Homo sapiens
gcugaguguucacgacaua

SEQ ID NO: 1490740 - RNA, 19 nt, Homo sapiens
ggaugaaguugugauaugu

SEQ ID NO: 1490741 - RNA, 19 nt, Homo sapiens
gugaggaggugugggauuu

SEQ ID NO: 1490742 - RNA, 19 nt, Homo sapiens
gcagcucuccucuuaauau

SEQ ID NO: 1490743 - RNA, 19 nt, Homo sapiens
gcgcucugauucucaaauu

SEQ ID NO: 1490744 - RNA, 19 nt, Homo sapiens
ggauuucugcuacuuaauu

SEQ ID NO: 1490745 - RNA, 19 nt, Homo sapiens
ugaaccaguuacuacuuua

SEQ ID NO: 1490746 - RNA, 19 nt, Homo sapiens
ggaauuaggaaccugaaug

SEQ ID NO: 1490747 - RNA, 19 nt, Homo sapiens
ugaauaaggacucacaauu

SEQ ID NO: 1490748 - RNA, 19 nt, Homo sapiens
uggaagaacucagcaauca

SEQ ID NO: 1490749 - RNA, 19 nt, Homo sapiens
gaaaaugggcuauaccaaa

SEQ ID NO: 1490750 - RNA, 19 nt, Homo sapiens
guaaauaugcuucaaacca

SEQ ID NO: 1490751 - RNA, 19 nt, Homo sapiens
gcaagaagagcaagagaag

SEQ ID NO: 1490752 - RNA, 19 nt, Homo sapiens
gaagacgccaguccuauag

SEQ ID NO: 1490753 - RNA, 19 nt, Homo sapiens
ucacaugccuaaaucaucu

SEQ ID NO: 1490754 - RNA, 19 nt, Homo sapiens
uggcagaaguacgagauua

SEQ ID NO: 1490755 - RNA, 19 nt, Homo sapiens
ggaggaugaaguugugaua

SEQ ID NO: 1490756 - RNA, 19 nt, Homo sapiens
guauaaagaggaauuagga

SEQ ID NO: 1490757 - RNA, 19 nt, Homo sapiens
aggaggagcugaacgaguu

SEQ ID NO: 1490758 - RNA, 19 nt, Homo sapiens
gaagaggaugaaauguaua

SEQ ID NO: 1490759 - RNA, 19 nt, Homo sapiens
gaguagaagcccacauaaa

SEQ ID NO: 1490760 - RNA, 19 nt, Homo sapiens
uuuaguagcucauguucuu

SEQ ID NO: 1490761 - RNA, 19 nt, Homo sapiens
guuaaaccauggccucaga

SEQ ID NO: 1490762 - RNA, 19 nt, Homo sapiens
gaauuaggaaccugaaugu

SEQ ID NO: 1490763 - RNA, 19 nt, Homo sapiens
aagaagaggaugaaaugua

SEQ ID NO: 1490764 - RNA, 19 nt, Homo sapiens
ggaguagaagcccacauaa

SEQ ID NO: 1490765 - RNA, 19 nt, Homo sapiens
gagaauagcaaacauccau

SEQ ID NO: 1490766 - RNA, 19 nt, Homo sapiens
ccaaucaucacaugccuaa

SEQ ID NO: 1490767 - RNA, 19 nt, Homo sapiens
ggaaagacaccauagucau

SEQ ID NO: 1490768 - RNA, 19 nt, Homo sapiens
gauucgagaugugauaaau

SEQ ID NO: 1490769 - RNA, 19 nt, Homo sapiens
ucacauaaccaagaaauca

SEQ ID NO: 1490770 - RNA, 19 nt, Homo sapiens
gagcaaauugucucuuaug

SEQ ID NO: 1490771 - RNA, 19 nt, Homo sapiens
ucaaaggaauuaggcuuau

SEQ ID NO: 1490772 - RNA, 19 nt, Homo sapiens
gaaaggcgaucagcuucag

SEQ ID NO: 1490773 - RNA, 19 nt, Homo sapiens
caaagaagaagaggaugaa

SEQ ID NO: 1490774 - RNA, 19 nt, Homo sapiens
agaagaagaggaugaaaug

SEQ ID NO: 1490775 - RNA, 19 nt, Homo sapiens
ccucuaugauuucguaguu

SEQ ID NO: 1490776 - RNA, 19 nt, Homo sapiens
ggauagaauuguuugucau

SEQ ID NO: 1490777 - RNA, 19 nt, Homo sapiens
ccaaagaagaagaggauga

SEQ ID NO: 1490778 - RNA, 19 nt, Homo sapiens
ggcaaagguuuauaugaag

SEQ ID NO: 1490779 - RNA, 19 nt, Homo sapiens
aauaacaggcaaagguuua

SEQ ID NO: 1490780 - RNA, 19 nt, Homo sapiens
uaccuucgauuacuuugaa

SEQ ID NO: 1490781 - RNA, 19 nt, Homo sapiens
uagaugauuugcuuccuau

SEQ ID NO: 1490782 - RNA, 19 nt, Homo sapiens
gcucugauucucaaauuau

SEQ ID NO: 1490783 - RNA, 19 nt, Homo sapiens
gcaaauugucucuuaugau

SEQ ID NO: 1490784 - RNA, 19 nt, Homo sapiens
ggaaaagcauaucaacaga

SEQ ID NO: 1490785 - RNA, 19 nt, Homo sapiens
ccaagaaaucauauacuga

SEQ ID NO: 1490786 - RNA, 19 nt, Homo sapiens
cagaaguacgagauuauaa

SEQ ID NO: 1490787 - RNA, 19 nt, Homo sapiens
ugggaucugucuuuauauu

SEQ ID NO: 1490788 - RNA, 19 nt, Homo sapiens
caacagauaccuacuuuug

SEQ ID NO: 1490789 - RNA, 19 nt, Homo sapiens
gcagucugguggaagcuau

SEQ ID NO: 1490790 - RNA, 19 nt, Homo sapiens
agaagacgccaguccuaua

SEQ ID NO: 1490791 - RNA, 19 nt, Homo sapiens
cugaauguacuccuuauuu

SEQ ID NO: 1490792 - RNA, 19 nt, Homo sapiens
aaagacaccauagucauaa

SEQ ID NO: 1490793 - RNA, 19 nt, Homo sapiens
gggaaagacaccauaguca

SEQ ID NO: 1490794 - RNA, 19 nt, Homo sapiens
acagauaccuacuuuugua

SEQ ID NO: 1490795 - RNA, 19 nt, Homo sapiens
ugggauuucugcuacuuaa

SEQ ID NO: 1490796 - RNA, 19 nt, Homo sapiens
agacaaguaguaccucuuu

SEQ ID NO: 1490797 - RNA, 19 nt, Homo sapiens
gacucacaauuccagauaa

SEQ ID NO: 1490798 - RNA, 19 nt, Homo sapiens
uuagaugauuugcuuccua

SEQ ID NO: 1490799 - RNA, 19 nt, Homo sapiens
cauagaagggauaggagua

SEQ ID NO: 1490800 - RNA, 19 nt, Homo sapiens
cgacauagaagggauagga

SEQ ID NO: 1490801 - RNA, 19 nt, Homo sapiens
ucuaugauuucguaguuga

SEQ ID NO: 1490802 - RNA, 19 nt, Homo sapiens
guacacaguuugcuaauua

SEQ ID NO: 1490803 - RNA, 19 nt, Homo sapiens
ggaguuguguuacugcuua

SEQ ID NO: 1490804 - RNA, 19 nt, Homo sapiens
guagggaccuuaugcaauu

SEQ ID NO: 1490805 - RNA, 19 nt, Homo sapiens
gcagacagaucucagaaga

SEQ ID NO: 1490806 - RNA, 19 nt, Homo sapiens
gaugaaagauacaugaguu

SEQ ID NO: 1490807 - RNA, 19 nt, Homo sapiens
gcaauaacguggcagguau

SEQ ID NO: 1490808 - RNA, 19 nt, Homo sapiens
ccagaaggauugcuuugua

SEQ ID NO: 1490809 - RNA, 19 nt, Homo sapiens
caacuagcaucagguauuu

SEQ ID NO: 1490810 - RNA, 19 nt, Homo sapiens
ggaaauggaggauaaaguu

SEQ ID NO: 1490811 - RNA, 19 nt, Homo sapiens
guacagaaauacaugaaca

SEQ ID NO: 1490812 - RNA, 19 nt, Homo sapiens
cgaagucacucaaguuaau

SEQ ID NO: 1490813 - RNA, 19 nt, Homo sapiens
gagagcaucuucccacaau

SEQ ID NO: 1490814 - RNA, 19 nt, Homo sapiens
gccaaaguaucauuuagaa

SEQ ID NO: 1490815 - RNA, 19 nt, Homo sapiens
gugaagaaauugagagaga

SEQ ID NO: 1490816 - RNA, 19 nt, Homo sapiens
uagcggaaauggaggauaa

SEQ ID NO: 1490817 - RNA, 19 nt, Homo sapiens
gaaauggaggauaaaguuu

SEQ ID NO: 1490818 - RNA, 19 nt, Homo sapiens
ccucgaaacugauaauaug

SEQ ID NO: 1490819 - RNA, 19 nt, Homo sapiens
gcaacaauauguccacaag

SEQ ID NO: 1490820 - RNA, 19 nt, Homo sapiens
gagcaucuucccacaauuu

SEQ ID NO: 1490821 - RNA, 19 nt, Homo sapiens
gaaaacgugugucuggaua

SEQ ID NO: 1490822 - RNA, 19 nt, Homo sapiens
gacgaagucacucaaguua

SEQ ID NO: 1490823 - RNA, 19 nt, Homo sapiens
caccgggucuuucaacuuu

SEQ ID NO: 1490824 - RNA, 19 nt, Homo sapiens
gauuuagguugaugaaaga

SEQ ID NO: 1490825 - RNA, 19 nt, Homo sapiens
aggcagagguuuaagugua

SEQ ID NO: 1490826 - RNA, 19 nt, Homo sapiens
gggaaggccugggcaugua

SEQ ID NO: 1490827 - RNA, 19 nt, Homo sapiens
caguauagaucaguuggua

SEQ ID NO: 1490828 - RNA, 19 nt, Homo sapiens
ugauagggcuuauuucaca

SEQ ID NO: 1490829 - RNA, 19 nt, Homo sapiens
uaacguggcagguaucuga

SEQ ID NO: 1490830 - RNA, 19 nt, Homo sapiens
uaucugauuucuccuuuga

SEQ ID NO: 1490831 - RNA, 19 nt, Homo sapiens
gaagacacgcgcuagaaau

SEQ ID NO: 1490832 - RNA, 19 nt, Homo sapiens
aacaauauguccacaaguu

SEQ ID NO: 1490833 - RNA, 19 nt, Homo sapiens
ggacagccucuucucguuu

SEQ ID NO: 1490834 - RNA, 19 nt, Homo sapiens
gggaacaaauucagaggau

SEQ ID NO: 1490835 - RNA, 19 nt, Homo sapiens
gaccuuaugcaauuucuuu

SEQ ID NO: 1490836 - RNA, 19 nt, Homo sapiens
cguuucagccucaguauua

SEQ ID NO: 1490837 - RNA, 19 nt, Homo sapiens
ccugaaagcacuauggaua

SEQ ID NO: 1490838 - RNA, 19 nt, Homo sapiens
ccacuacaguccagaagga

SEQ ID NO: 1490839 - RNA, 19 nt, Homo sapiens
gcaggcagcagcacuuuau

SEQ ID NO: 1490840 - RNA, 19 nt, Homo sapiens
gcuauaagauucgcugaca

SEQ ID NO: 1490841 - RNA, 19 nt, Homo sapiens
gguaucugauuucuccuuu

SEQ ID NO: 1490842 - RNA, 19 nt, Homo sapiens
gaacaaauucagaggaucu

SEQ ID NO: 1490843 - RNA, 19 nt, Homo sapiens
gaccuucucugugcacuga

SEQ ID NO: 1490844 - RNA, 19 nt, Homo sapiens
ccaacauucugcccacaaa

SEQ ID NO: 1490845 - RNA, 19 nt, Homo sapiens
caggaaagccggagacgaa

SEQ ID NO: 1490846 - RNA, 19 nt, Homo sapiens
gaagccaccucuuguacag

SEQ ID NO: 1490847 - RNA, 19 nt, Homo sapiens
gcauguacaucaaaucaac

SEQ ID NO: 1490848 - RNA, 19 nt, Homo sapiens
acacuuguuugauaccuuu

SEQ ID NO: 1490849 - RNA, 19 nt, Homo sapiens
gguagagccuguuugucuu

SEQ ID NO: 1490850 - RNA, 19 nt, Homo sapiens
gagaauggcaguuuuguuu

SEQ ID NO: 1490851 - RNA, 19 nt, Homo sapiens
gaacaaaauuauccagcuu

SEQ ID NO: 1490852 - RNA, 19 nt, Homo sapiens
guacacuucuucaaaauug

SEQ ID NO: 1490853 - RNA, 19 nt, Homo sapiens
ggacuagaggguuggauga

SEQ ID NO: 1490854 - RNA, 19 nt, Homo sapiens
ggaccgggcuccguuuaca

SEQ ID NO: 1490855 - RNA, 19 nt, Homo sapiens
aaacgugugucuggauauu

SEQ ID NO: 1490856 - RNA, 19 nt, Homo sapiens
gaagaaauugagagagaau

SEQ ID NO: 1490857 - RNA, 19 nt, Homo sapiens
gugcaugucuggaggaagu

SEQ ID NO: 1490858 - RNA, 19 nt, Homo sapiens
gggcuuauuucacacaaag

SEQ ID NO: 1490859 - RNA, 19 nt, Homo sapiens
ucaugacagucucaguaua

SEQ ID NO: 1490860 - RNA, 19 nt, Homo sapiens
cagcuuugacuuugcaaua

SEQ ID NO: 1490861 - RNA, 19 nt, Homo sapiens
gugagggacugguggcauu

SEQ ID NO: 1490862 - RNA, 19 nt, Homo sapiens
aaaucuggcuccucagcua

SEQ ID NO: 1490863 - RNA, 19 nt, Homo sapiens
ucaacuagcaucagguauu

SEQ ID NO: 1490864 - RNA, 19 nt, Homo sapiens
uagaucaguugguacagaa

SEQ ID NO: 1490865 - RNA, 19 nt, Homo sapiens
cuguuacacuuguuugaua

SEQ ID NO: 1490866 - RNA, 19 nt, Homo sapiens
ggugcuacaucaacucaga

SEQ ID NO: 1490867 - RNA, 19 nt, Homo sapiens
ugaagaaauugagagagaa

SEQ ID NO: 1490868 - RNA, 19 nt, Homo sapiens
guacaucaaaucaaccuau

SEQ ID NO: 1490869 - RNA, 19 nt, Homo sapiens
gagauagaaugugaagaca

SEQ ID NO: 1490870 - RNA, 19 nt, Homo sapiens
cagaaggauugcuuuguag

SEQ ID NO: 1490871 - RNA, 19 nt, Homo sapiens
gauuggaugggaacaaauu

SEQ ID NO: 1490872 - RNA, 19 nt, Homo sapiens
gaaguuugcaggauuggau

SEQ ID NO: 1490873 - RNA, 19 nt, Homo sapiens
gauacaugaguuugcauuu

SEQ ID NO: 1490874 - RNA, 19 nt, Homo sapiens
agauuuagguugaugaaag

SEQ ID NO: 1490875 - RNA, 19 nt, Homo sapiens
gaagcgguuuaccauggaa

SEQ ID NO: 1490876 - RNA, 19 nt, Homo sapiens
gaaguccucguccacagaa

SEQ ID NO: 1490877 - RNA, 19 nt, Homo sapiens
gguacucgguggaaaccaa

SEQ ID NO: 1490878 - RNA, 19 nt, Homo sapiens
gaaagccggagacgaagau

SEQ ID NO: 1490879 - RNA, 19 nt, Homo sapiens
gggaugagaauggcaguuu

SEQ ID NO: 1490880 - RNA, 19 nt, Homo sapiens
uaaauggcaucugugacaa

SEQ ID NO: 1490881 - RNA, 19 nt, Homo sapiens
gaaagccucauggucacua

SEQ ID NO: 1490882 - RNA, 19 nt, Homo sapiens
caauauguccacaaguuug

SEQ ID NO: 1490883 - RNA, 19 nt, Homo sapiens
cguggcagguaucugauuu

SEQ ID NO: 1490884 - RNA, 19 nt, Homo sapiens
ccagagacguuauggucau

SEQ ID NO: 1490885 - RNA, 19 nt, Homo sapiens
gacagccucuucucguuuc

SEQ ID NO: 1490886 - RNA, 19 nt, Homo sapiens
ggauuccuccgaucauuga

SEQ ID NO: 1490887 - RNA, 19 nt, Homo sapiens
gagagaaaacaccaucuua

SEQ ID NO: 1490888 - RNA, 19 nt, Homo sapiens
gaauggcaguuuuguuuau

SEQ ID NO: 1490889 - RNA, 19 nt, Homo sapiens
gauucaugcuggugacgaa

SEQ ID NO: 1490890 - RNA, 19 nt, Homo sapiens
guucacuuaccaaacauua

SEQ ID NO: 1490891 - RNA, 19 nt, Homo sapiens
aaagauacaugaguuugca

SEQ ID NO: 1490892 - RNA, 19 nt, Homo sapiens
ccaacuucuuuaucugaaa

SEQ ID NO: 1490893 - RNA, 19 nt, Homo sapiens
ggcagagguuuaaguguag

SEQ ID NO: 1490894 - RNA, 19 nt, Homo sapiens
uguagcagcuuugacuuug

SEQ ID NO: 1490895 - RNA, 19 nt, Homo sapiens
ugaagacacgcgcuagaaa

SEQ ID NO: 1490896 - RNA, 19 nt, Homo sapiens
gggcauguacaucaaauca

SEQ ID NO: 1490897 - RNA, 19 nt, Homo sapiens
gcuuggaccugaccacuac

SEQ ID NO: 1490898 - RNA, 19 nt, Homo sapiens
cgaaacugauaauaugaag

SEQ ID NO: 1490899 - RNA, 19 nt, Homo sapiens
gaaagauacaugaguuugc

SEQ ID NO: 1490900 - RNA, 19 nt, Homo sapiens
gaagcaacaagauuuaggu

SEQ ID NO: 1490901 - RNA, 19 nt, Homo sapiens
aaagugaagcaacaagauu

SEQ ID NO: 1490902 - RNA, 19 nt, Homo sapiens
gcacagaacccaguacuga

SEQ ID NO: 1490903 - RNA, 19 nt, Homo sapiens
ggacauacuuacagagcaa

SEQ ID NO: 1490904 - RNA, 19 nt, Homo sapiens
ccagaaagaugaaagaaaa

SEQ ID NO: 1490905 - RNA, 19 nt, Homo sapiens
gaucuuggcaguucaguau

SEQ ID NO: 1490906 - RNA, 19 nt, Homo sapiens
gagaagagaauguggacaa

SEQ ID NO: 1490907 - RNA, 19 nt, Homo sapiens
gggaagaaacuaaauguca

SEQ ID NO: 1490908 - RNA, 19 nt, Homo sapiens
gaaagcacagaacccagua

SEQ ID NO: 1490909 - RNA, 19 nt, Homo sapiens
uaggauggcuugaggacuu

SEQ ID NO: 1490910 - RNA, 19 nt, Homo sapiens
ccaccacccucauccuuug

SEQ ID NO: 1490911 - RNA, 19 nt, Homo sapiens
cauccucccuggcaucuga

SEQ ID NO: 1490912 - RNA, 19 nt, Homo sapiens
gaauuacacacccaaggaa

SEQ ID NO: 1490913 - RNA, 19 nt, Homo sapiens
ugagagaggugguggacau

SEQ ID NO: 1490914 - RNA, 19 nt, Homo sapiens
gagcaccacucgccauguc

SEQ ID NO: 1490915 - RNA, 19 nt, Homo sapiens
gcaguucaguaucgaugga

SEQ ID NO: 1490916 - RNA, 19 nt, Homo sapiens
ggacacagcaguggaucuu

SEQ ID NO: 1490917 - RNA, 19 nt, Homo sapiens
gaagaaacuaaaugucaca

SEQ ID NO: 1490918 - RNA, 19 nt, Homo sapiens
gaaggacacagcaguggau

SEQ ID NO: 1490919 - RNA, 19 nt, Homo sapiens
gaggugguggacauacuua

SEQ ID NO: 1490920 - RNA, 19 nt, Homo sapiens
gccagaaagaugaaagaaa

SEQ ID NO: 1490921 - RNA, 19 nt, Homo sapiens
agacgacccucacucucuu

SEQ ID NO: 1490922 - RNA, 19 nt, Homo sapiens
acaaggauguggccauguc

SEQ ID NO: 1490923 - RNA, 19 nt, Homo sapiens
gagaggugguggacauacu

SEQ ID NO: 1490924 - RNA, 19 nt, Homo sapiens
agacuuuucuucacuauga

SEQ ID NO: 1490925 - RNA, 19 nt, Homo sapiens
guccuuccauuacaucuca

SEQ ID NO: 1490926 - RNA, 19 nt, Homo sapiens
gagagaggugguggacaua

SEQ ID NO: 1490927 - RNA, 19 nt, Homo sapiens
cagccgccaucccagcuuu

SEQ ID NO: 1490928 - RNA, 19 nt, Homo sapiens
cgucaucccuaaguucaga

SEQ ID NO: 1490929 - RNA, 19 nt, Homo sapiens
gccauguccuuccauuaca

SEQ ID NO: 1490930 - RNA, 19 nt, Homo sapiens
gagccagaaagaugaaaga

SEQ ID NO: 1490931 - RNA, 19 nt, Homo sapiens
gaauguggacaacgguuca

SEQ ID NO: 1490932 - RNA, 19 nt, Homo sapiens
ucaccgucaucccuaaguu

SEQ ID NO: 1490933 - RNA, 19 nt, Homo sapiens
gggagaaugacaaggaugu

SEQ ID NO: 1490934 - RNA, 19 nt, Homo sapiens
caguggaucuuggcaguuc

SEQ ID NO: 1490935 - RNA, 19 nt, Homo sapiens
ggccauguccuuccauuac

SEQ ID NO: 1490936 - RNA, 19 nt, Homo sapiens
agaauuacacacccaagga

SEQ ID NO: 1490937 - RNA, 19 nt, Homo sapiens
gcaacugcuugacauucag

SEQ ID NO: 1490938 - RNA, 19 nt, Homo sapiens
gaugucuugugagcagaaa

SEQ ID NO: 1490939 - RNA, 19 nt, Homo sapiens
acagaacccaguacugaga

SEQ ID NO: 1490940 - RNA, 19 nt, Homo sapiens
gccaccacccucauccuuu

SEQ ID NO: 1490941 - RNA, 19 nt, Homo sapiens
aaugggagacugcauagga

SEQ ID NO: 1490942 - RNA, 19 nt, Homo sapiens
gcuugaggacuucuugaug

SEQ ID NO: 1490943 - RNA, 19 nt, Homo sapiens
caucccagcuuugcuucug

SEQ ID NO: 1490944 - RNA, 19 nt, Homo sapiens
gugggagaaugacaaggau

SEQ ID NO: 1490945 - RNA, 19 nt, Homo sapiens
aaagaaaagugggagaaug

SEQ ID NO: 1490946 - RNA, 19 nt, Homo sapiens
acaucaccgucaucccuaa

SEQ ID NO: 1490947 - RNA, 19 nt, Homo sapiens
gacccucacucucuuugcu

SEQ ID NO: 1490948 - RNA, 19 nt, Homo sapiens
ggaucuuggcaguucagua

SEQ ID NO: 1490949 - RNA, 19 nt, Homo sapiens
gcgagacgacccucacucu

SEQ ID NO: 1490950 - RNA, 19 nt, Homo sapiens
guggccauguccuuccauu

SEQ ID NO: 1490951 - RNA, 19 nt, Homo sapiens
cucacucucuuugcuauga

SEQ ID NO: 1490952 - RNA, 19 nt, Homo sapiens
ugucacaacggccuggaaa

SEQ ID NO: 1490953 - RNA, 19 nt, Homo sapiens
gaaagaaaagugggagaau

SEQ ID NO: 1490954 - RNA, 19 nt, Homo sapiens
ucucuuugcuaugacauca

SEQ ID NO: 1490955 - RNA, 19 nt, Homo sapiens
gaaacaaauucuagcaaga

SEQ ID NO: 1490956 - RNA, 19 nt, Homo sapiens
gaucacagcaugaggauaa

SEQ ID NO: 1490957 - RNA, 19 nt, Homo sapiens
ggauaaggaucauugaguu

SEQ ID NO: 1490958 - RNA, 19 nt, Homo sapiens
gcaccaggcuguucugaug

SEQ ID NO: 1490959 - RNA, 19 nt, Homo sapiens
gagaagaaaugugaaacaa

SEQ ID NO: 1490960 - RNA, 19 nt, Homo sapiens
caaagaguauugaaacaga

SEQ ID NO: 1490961 - RNA, 19 nt, Homo sapiens
gaacuguaccuaagaauag

SEQ ID NO: 1490962 - RNA, 19 nt, Homo sapiens
aaacagagaagaaauguga

SEQ ID NO: 1490963 - RNA, 19 nt, Homo sapiens
gcacccagcaguacaauga

SEQ ID NO: 1490964 - RNA, 19 nt, Homo sapiens
uaccagaguuucccuauga

SEQ ID NO: 1490965 - RNA, 19 nt, Homo sapiens
gcaguacaaugacgugguu

SEQ ID NO: 1490966 - RNA, 19 nt, Homo sapiens
gaggaugggauuauucuaa

SEQ ID NO: 1490967 - RNA, 19 nt, Homo sapiens
gcaguugguugguggagaa

SEQ ID NO: 1490968 - RNA, 19 nt, Homo sapiens
uaggagagcuaguucauag

SEQ ID NO: 1490969 - RNA, 19 nt, Homo sapiens
gagauuacagggauaaaga

SEQ ID NO: 1490970 - RNA, 19 nt, Homo sapiens
agagcuaguucauagauuu

SEQ ID NO: 1490971 - RNA, 19 nt, Homo sapiens
gauaaggaucauugaguuu

SEQ ID NO: 1490972 - RNA, 19 nt, Homo sapiens
agaagcagcucgagauuac

SEQ ID NO: 1490973 - RNA, 19 nt, Homo sapiens
uggcuucgcuggaguauag

SEQ ID NO: 1490974 - RNA, 19 nt, Homo sapiens
gagagcuaguucauagauu

SEQ ID NO: 1490975 - RNA, 19 nt, Homo sapiens
ucauagauuucaagaggaa

SEQ ID NO: 1490976 - RNA, 19 nt, Homo sapiens
gaugucaaaugcauguuag

SEQ ID NO: 1490977 - RNA, 19 nt, Homo sapiens
guacaaccacggcugagaa

SEQ ID NO: 1490978 - RNA, 19 nt, Homo sapiens
aagcucugguugcacauua

SEQ ID NO: 1490979 - RNA, 19 nt, Homo sapiens
ugaacuguaccuaagaaua

SEQ ID NO: 1490980 - RNA, 19 nt, Homo sapiens
acaaugacgugguuaaugc

SEQ ID NO: 1490981 - RNA, 19 nt, Homo sapiens
gcucgagauuacagggaua

SEQ ID NO: 1490982 - RNA, 19 nt, Homo sapiens
cagaagcagcucgagauua

SEQ ID NO: 1490983 - RNA, 19 nt, Homo sapiens
gcugacguuucaacacaaa

SEQ ID NO: 1490984 - RNA, 19 nt, Homo sapiens
ggagagcuaguucauagau

SEQ ID NO: 1490985 - RNA, 19 nt, Homo sapiens
uccuagagauucagauuga

SEQ ID NO: 1490986 - RNA, 19 nt, Homo sapiens
guucuaagcucugguugca

SEQ ID NO: 1490987 - RNA, 19 nt, Homo sapiens
gcauuacaguggacgaagu

SEQ ID NO: 1490988 - RNA, 19 nt, Homo sapiens
aggccgacaugacuaagua

SEQ ID NO: 1490989 - RNA, 19 nt, Homo sapiens
auggaaaccuggucaguug

SEQ ID NO: 1490990 - RNA, 19 nt, Homo sapiens
gacgaaguccuauguuuua

SEQ ID NO: 1490991 - RNA, 19 nt, Homo sapiens
gcaagaagcaaagcauuac

SEQ ID NO: 1490992 - RNA, 19 nt, Homo sapiens
aaaccuugauaauggacua

SEQ ID NO: 1490993 - RNA, 19 nt, Homo sapiens
cgacaugacuaaguaucug

SEQ ID NO: 1490994 - RNA, 19 nt, Homo sapiens
gaccaaagaguauugaaac

SEQ ID NO: 1490995 - RNA, 19 nt, Homo sapiens
aggcuguucugauggauuu

SEQ ID NO: 1490996 - RNA, 19 nt, Homo sapiens
guauugaaacagagaagaa

SEQ ID NO: 1490997 - RNA, 19 nt, Homo sapiens
cuaauugaccaaagaguau

SEQ ID NO: 1490998 - RNA, 19 nt, Homo sapiens
cugccugucuccuggauuu

SEQ ID NO: 1490999 - RNA, 19 nt, Homo sapiens
cuauugaacuguaccuaag

SEQ ID NO: 1491000 - RNA, 19 nt, Homo sapiens
caacacuauugaacuguac

SEQ ID NO: 1491001 - RNA, 19 nt, Homo sapiens
ccgcugacguuucaacaca

SEQ ID NO: 1491002 - RNA, 19 nt, Homo sapiens
ccuaugaugucaaaugcau

SEQ ID NO: 1491003 - RNA, 19 nt, Homo sapiens
ugaccaaagaguauugaaa

SEQ ID NO: 1491004 - RNA, 19 nt, Homo sapiens
ugaugucaaaugcauguua

SEQ ID NO: 1491005 - RNA, 19 nt, Homo sapiens
gcaguucuaagcucugguu

SEQ ID NO: 1491006 - RNA, 19 nt, Homo sapiens
uggacuaauugaccaaaga

SEQ ID NO: 1491007 - RNA, 19 nt, Homo sapiens
ccgcucuucuugcacuuaa

SEQ ID NO: 1491008 - RNA, 19 nt, Homo sapiens
agcaagaagcaaagcauua

SEQ ID NO: 1491009 - RNA, 19 nt, Homo sapiens
uucagcaacugguaaagaa

SEQ ID NO: 1491010 - RNA, 19 nt, Homo sapiens
gcuaguucauagauuucaa

SEQ ID NO: 1491011 - RNA, 19 nt, Homo sapiens
guacaaugacgugguuaau

SEQ ID NO: 1491012 - RNA, 19 nt, Homo sapiens
uaaggaucauugaguuucu

SEQ ID NO: 1491013 - RNA, 19 nt, Homo sapiens
gaguuucccuaugauguca

SEQ ID NO: 1491014 - RNA, 19 nt, Homo sapiens
ucaagaggaagaaguaagu

SEQ ID NO: 1491015 - RNA, 19 nt, Homo sapiens
acagagaagaaaugugaaa

SEQ ID NO: 1491016 - RNA, 19 nt, Homo sapiens
acuaauugaccaaagagua

SEQ ID NO: 1491017 - RNA, 19 nt, Homo sapiens
uuaaugaucggaugguuca

SEQ ID NO: 1491018 - RNA, 19 nt, Homo sapiens
gaaacagagaagaaaugug

SEQ ID NO: 1491019 - RNA, 19 nt, Homo sapiens
aauacaagcagaacacuca

SEQ ID NO: 1491020 - RNA, 19 nt, Homo sapiens
caggagacagcaauggaaa

SEQ ID NO: 1491021 - RNA, 19 nt, Homo sapiens
ccuugauaauggacuaauu

SEQ ID NO: 1491022 - RNA, 19 nt, Homo sapiens
cugaaaaccuugauaaugg

SEQ ID NO: 1491023 - RNA, 19 nt, Homo sapiens
ugucuucauugcacaacaa

SEQ ID NO: 1491024 - RNA, 19 nt, Homo sapiens
ggacuaauugaccaaagag

SEQ ID NO: 1491025 - RNA, 19 nt, Homo sapiens
gagcuaguucauagauuuc

SEQ ID NO: 1491026 - RNA, 19 nt, Homo sapiens
ugaaacagagaagaaaugu

SEQ ID NO: 1491027 - RNA, 19 nt, Homo sapiens
guucagcaacugguaaaga

SEQ ID NO: 1491028 - RNA, 19 nt, Homo sapiens
gaacacucaaggacugaag

SEQ ID NO: 1491029 - RNA, 19 nt, Homo sapiens
gcucuucuugcacuuaaug

SEQ ID NO: 1491030 - RNA, 19 nt, Homo sapiens
cagaguuucccuaugaugu

SEQ ID NO: 1491031 - RNA, 19 nt, Homo sapiens
uagcaagaagcaaagcauu

SEQ ID NO: 1491032 - RNA, 19 nt, Homo sapiens
ggauuucaaagaccacugu

SEQ ID NO: 1491033 - RNA, 19 nt, Homo sapiens
ggcccacccuuuccuggau

SEQ ID NO: 1491034 - RNA, 19 nt, Homo sapiens
gaugguucagcaacuggua

SEQ ID NO: 1491035 - RNA, 19 nt, Homo sapiens
gugaaacaaauucuagcaa

SEQ ID NO: 1491036 - RNA, 19 nt, Homo sapiens
aaauuuaggagagcuaguu

SEQ ID NO: 1491037 - RNA, 19 nt, Homo sapiens
ccuccuggguucaagcaau

SEQ ID NO: 1491038 - RNA, 19 nt, Homo sapiens
uuaccagaguuucccuaug

SEQ ID NO: 1491039 - RNA, 19 nt, Homo sapiens
aaaggcagcccuggucaug

SEQ ID NO: 1491040 - RNA, 19 nt, Homo sapiens
acuauugaacuguaccuaa

SEQ ID NO: 1491041 - RNA, 19 nt, Homo sapiens
caaccacggcugagaacca

SEQ ID NO: 1491042 - RNA, 19 nt, Homo sapiens
cuccuggguucaagcaauu

SEQ ID NO: 1491043 - RNA, 19 nt, Homo sapiens
caagaagcaaagcauuaca

SEQ ID NO: 1491044 - RNA, 19 nt, Homo sapiens
cuugauaauggacuaauug

SEQ ID NO: 1491045 - RNA, 19 nt, Homo sapiens
gcugaaaaccuugauaaug

SEQ ID NO: 1491046 - RNA, 19 nt, Homo sapiens
ggaaaccuggucaguugag

SEQ ID NO: 1491047 - RNA, 19 nt, Homo sapiens
gaaguccuauguuuuacca

SEQ ID NO: 1491048 - RNA, 19 nt, Homo sapiens
agagaagaaaugugaaaca

SEQ ID NO: 1491049 - RNA, 19 nt, Homo sapiens
gcuguucugauggauuuaa

SEQ ID NO: 1491050 - RNA, 19 nt, Homo sapiens
acagaagcagcucgagauu

SEQ ID NO: 1491051 - RNA, 19 nt, Homo sapiens
ccacugccgcugacguuuc

SEQ ID NO: 1491052 - RNA, 19 nt, Homo sapiens
ccaaagaguauugaaacag

SEQ ID NO: 1491053 - RNA, 19 nt, Homo sapiens
ugaaaaccuugauaaugga

SEQ ID NO: 1491054 - RNA, 19 nt, Homo sapiens
auugaacuguaccuaagaa

SEQ ID NO: 1491055 - RNA, 19 nt, Homo sapiens
uaacuuaccucagcuuuaa

SEQ ID NO: 1491056 - RNA, 19 nt, Homo sapiens
caagaaagaccucaaguaa

SEQ ID NO: 1491057 - RNA, 19 nt, Homo sapiens
uaagaacacuugugaagaa

SEQ ID NO: 1491058 - RNA, 19 nt, Homo sapiens
uaagagugaugcuauagua

SEQ ID NO: 1491059 - RNA, 19 nt, Homo sapiens
caacucaaauucacuagaa

SEQ ID NO: 1491060 - RNA, 19 nt, Homo sapiens
cuagaaaccuuguacauga

SEQ ID NO: 1491061 - RNA, 19 nt, Homo sapiens
gauguuaccuguuaaaucu

SEQ ID NO: 1491062 - RNA, 19 nt, Homo sapiens
ucacauguaugccaaauga

SEQ ID NO: 1491063 - RNA, 19 nt, Homo sapiens
uaaccgaccuugcacaauu

SEQ ID NO: 1491064 - RNA, 19 nt, Homo sapiens
agaaagaccucaaguaaca

SEQ ID NO: 1491065 - RNA, 19 nt, Homo sapiens
ugacuuaucuuuaggaugu

SEQ ID NO: 1491066 - RNA, 19 nt, Homo sapiens
caagacaaguggcuagaaa

SEQ ID NO: 1491067 - RNA, 19 nt, Homo sapiens
gcauggcacuaucuacaua

SEQ ID NO: 1491068 - RNA, 19 nt, Homo sapiens
gaaaugaggagguaacaga

SEQ ID NO: 1491069 - RNA, 19 nt, Homo sapiens
gaaagaagccagccaucaa

SEQ ID NO: 1491070 - RNA, 19 nt, Homo sapiens
caacagcauuccagaaguu

SEQ ID NO: 1491071 - RNA, 19 nt, Homo sapiens
guguaaaucuguaccuuaa

SEQ ID NO: 1491072 - RNA, 19 nt, Homo sapiens
caaaggaagaucuuacuaa

SEQ ID NO: 1491073 - RNA, 19 nt, Homo sapiens
cagaagagcagucaauaaa

SEQ ID NO: 1491074 - RNA, 19 nt, Homo sapiens
cauccuagcuuucccagaa

SEQ ID NO: 1491075 - RNA, 19 nt, Homo sapiens
ucaaauacauuccauaugc

SEQ ID NO: 1491076 - RNA, 19 nt, Homo sapiens
aaacauacgcuaagugaaa

SEQ ID NO: 1491077 - RNA, 19 nt, Homo sapiens
caucaugcaucuugacuga

SEQ ID NO: 1491078 - RNA, 19 nt, Homo sapiens
gcaagagguuucuggugaa

SEQ ID NO: 1491079 - RNA, 19 nt, Homo sapiens
gcuaguaacuccuucaucu

SEQ ID NO: 1491080 - RNA, 19 nt, Homo sapiens
ggaauucugugagcuucua

SEQ ID NO: 1491081 - RNA, 19 nt, Homo sapiens
caagguagagagcaaauuu

SEQ ID NO: 1491082 - RNA, 19 nt, Homo sapiens
ccauaagagugaugcuaua

SEQ ID NO: 1491083 - RNA, 19 nt, Homo sapiens
gaaaugaaaccauauaagc

SEQ ID NO: 1491084 - RNA, 19 nt, Homo sapiens
gcagugagcugugauugca

SEQ ID NO: 1491085 - RNA, 19 nt, Homo sapiens
caucacaauuggcauuaaa

SEQ ID NO: 1491086 - RNA, 19 nt, Homo sapiens
caucaaggaccacaaauug

SEQ ID NO: 1491087 - RNA, 19 nt, Homo sapiens
gugucucccuuuauauuua

SEQ ID NO: 1491088 - RNA, 19 nt, Homo sapiens
ccaacugguucaaauaaau

SEQ ID NO: 1491089 - RNA, 19 nt, Homo sapiens
ucagaucccuuguuuccaa

SEQ ID NO: 1491090 - RNA, 19 nt, Homo sapiens
caugcacgcucacuuuaaa

SEQ ID NO: 1491091 - RNA, 19 nt, Homo sapiens
uaccagagcuccagacauc

SEQ ID NO: 1491092 - RNA, 19 nt, Homo sapiens
ucaugcaucuugacugaaa

SEQ ID NO: 1491093 - RNA, 19 nt, Homo sapiens
caaccgaaaugcccaccaa

SEQ ID NO: 1491094 - RNA, 19 nt, Homo sapiens
ggcacuaucuacauaauca

SEQ ID NO: 1491095 - RNA, 19 nt, Homo sapiens
ccuaggaaguuauagagaa

SEQ ID NO: 1491096 - RNA, 19 nt, Homo sapiens
cccaagaaauucaaauguu

SEQ ID NO: 1491097 - RNA, 19 nt, Homo sapiens
gagugaugcuauaguagaa

SEQ ID NO: 1491098 - RNA, 19 nt, Homo sapiens
guaaaucuguaccuuaacu

SEQ ID NO: 1491099 - RNA, 19 nt, Homo sapiens
cuaggaaguuauagagaaa

SEQ ID NO: 1491100 - RNA, 19 nt, Homo sapiens
uaaauaacauaggccaaga

SEQ ID NO: 1491101 - RNA, 19 nt, Homo sapiens
gagaaaauccaaucaguuu

SEQ ID NO: 1491102 - RNA, 19 nt, Homo sapiens
gggaugagaacgaaugauu

SEQ ID NO: 1491103 - RNA, 19 nt, Homo sapiens
gcauucauauaaagugguu

SEQ ID NO: 1491104 - RNA, 19 nt, Homo sapiens
aaaccuaccugacacucuu

SEQ ID NO: 1491105 - RNA, 19 nt, Homo sapiens
gaaaugugguagaucuuuu

SEQ ID NO: 1491106 - RNA, 19 nt, Homo sapiens
gcuccaaaccucugaaaug

SEQ ID NO: 1491107 - RNA, 19 nt, Homo sapiens
cccagaaccuagacaauau

SEQ ID NO: 1491108 - RNA, 19 nt, Homo sapiens
gaagagcagucaauaaaag

SEQ ID NO: 1491109 - RNA, 19 nt, Homo sapiens
cgaaaugcccaccaacuga

SEQ ID NO: 1491110 - RNA, 19 nt, Homo sapiens
cacagcagcauuauucaua

SEQ ID NO: 1491111 - RNA, 19 nt, Homo sapiens
guucacagcagcauuauuc

SEQ ID NO: 1491112 - RNA, 19 nt, Homo sapiens
ccacaccuccucugaaaga

SEQ ID NO: 1491113 - RNA, 19 nt, Homo sapiens
cugagacaguuacaaagua

SEQ ID NO: 1491114 - RNA, 19 nt, Homo sapiens
gaugguacuucuuagagau

SEQ ID NO: 1491115 - RNA, 19 nt, Homo sapiens
uaacagaagagcagucaau

SEQ ID NO: 1491116 - RNA, 19 nt, Homo sapiens
acaaguggcuagaaaccuu

SEQ ID NO: 1491117 - RNA, 19 nt, Homo sapiens
gccaagcacucacgcaauc

SEQ ID NO: 1491118 - RNA, 19 nt, Homo sapiens
gggcaugcacgcucacuuu

SEQ ID NO: 1491119 - RNA, 19 nt, Homo sapiens
uguuaaaucuuccuaguag

SEQ ID NO: 1491120 - RNA, 19 nt, Homo sapiens
aagugugucucccuuuaua

SEQ ID NO: 1491121 - RNA, 19 nt, Homo sapiens
cuuacuaacucucagugua

SEQ ID NO: 1491122 - RNA, 19 nt, Homo sapiens
acaagaaagaccucaagua

SEQ ID NO: 1491123 - RNA, 19 nt, Homo sapiens
uaacauaggccaagaucuc

SEQ ID NO: 1491124 - RNA, 19 nt, Homo sapiens
uagaaaccuuguacaugaa

SEQ ID NO: 1491125 - RNA, 19 nt, Homo sapiens
aaaggaagaucuuacuaac

SEQ ID NO: 1491126 - RNA, 19 nt, Homo sapiens
aaccgaccuugcacaauua

SEQ ID NO: 1491127 - RNA, 19 nt, Homo sapiens
cuacuuaauuuccuacaca

SEQ ID NO: 1491128 - RNA, 19 nt, Homo sapiens
gcaugcacgcucacuuuaa

SEQ ID NO: 1491129 - RNA, 19 nt, Homo sapiens
aggaagaucuuacuaacuc

SEQ ID NO: 1491130 - RNA, 19 nt, Homo sapiens
gagaggagaauaggaguga

SEQ ID NO: 1491131 - RNA, 19 nt, Homo sapiens
caacugaugcaugaauaaa

SEQ ID NO: 1491132 - RNA, 19 nt, Homo sapiens
gaacacuugugaagaaaau

SEQ ID NO: 1491133 - RNA, 19 nt, Homo sapiens
auagagaaaugaggaggua

SEQ ID NO: 1491134 - RNA, 19 nt, Homo sapiens
gcacaauuaaaccaucaaa

SEQ ID NO: 1491135 - RNA, 19 nt, Homo sapiens
gaaaugcccaccaacugau

SEQ ID NO: 1491136 - RNA, 19 nt, Homo sapiens
gcuagaaaccuuguacaug

SEQ ID NO: 1491137 - RNA, 19 nt, Homo sapiens
ccaucugcauucauauaaa

SEQ ID NO: 1491138 - RNA, 19 nt, Homo sapiens
aaacccaucucuaaauaac

SEQ ID NO: 1491139 - RNA, 19 nt, Homo sapiens
ccaaaggaagaucuuacua

SEQ ID NO: 1491140 - RNA, 19 nt, Homo sapiens
caucugcauucauauaaag

SEQ ID NO: 1491141 - RNA, 19 nt, Homo sapiens
agacagagccaggcagaaa

SEQ ID NO: 1491142 - RNA, 19 nt, Homo sapiens
cagggaaguuggaaguaga

SEQ ID NO: 1491143 - RNA, 19 nt, Homo sapiens
gaggcaccauuaccuacuu

SEQ ID NO: 1491144 - RNA, 19 nt, Homo sapiens
aaacuuggguuagaauucu

SEQ ID NO: 1491145 - RNA, 19 nt, Homo sapiens
gaagaaccaccuaaaauuc

SEQ ID NO: 1491146 - RNA, 19 nt, Homo sapiens
cuaagaagaaccaccuaaa

SEQ ID NO: 1491147 - RNA, 19 nt, Homo sapiens
ggccaucugcauucauaua

SEQ ID NO: 1491148 - RNA, 19 nt, Homo sapiens
cgaugguacuucuuagaga

SEQ ID NO: 1491149 - RNA, 19 nt, Homo sapiens
ggcaugcacgcucacuuua

SEQ ID NO: 1491150 - RNA, 19 nt, Homo sapiens
ucauggauaauucaccuua

SEQ ID NO: 1491151 - RNA, 19 nt, Homo sapiens
acagaagagcagucaauaa

SEQ ID NO: 1491152 - RNA, 19 nt, Homo sapiens
agagagaccucgaaaauag

SEQ ID NO: 1491153 - RNA, 19 nt, Homo sapiens
gcacgcucacuuuaaagaa

SEQ ID NO: 1491154 - RNA, 19 nt, Homo sapiens
gccaucugcauucauauaa

SEQ ID NO: 1491155 - RNA, 19 nt, Homo sapiens
gagacacucugaaaugaua

SEQ ID NO: 1491156 - RNA, 19 nt, Homo sapiens
gaaaugauguggauaagag

SEQ ID NO: 1491157 - RNA, 19 nt, Homo sapiens
guuacuggcugguuuaaua

SEQ ID NO: 1491158 - RNA, 19 nt, Homo sapiens
gaucaaauccucccugaaa

SEQ ID NO: 1491159 - RNA, 19 nt, Homo sapiens
ugaaugagcugaugauugu

SEQ ID NO: 1491160 - RNA, 19 nt, Homo sapiens
gguacaagguccuaaguga

SEQ ID NO: 1491161 - RNA, 19 nt, Homo sapiens
gaagucaguuggauuucaa

SEQ ID NO: 1491162 - RNA, 19 nt, Homo sapiens
guggacaacugcccauaua

SEQ ID NO: 1491163 - RNA, 19 nt, Homo sapiens
gguccuaagugaucucuuu

SEQ ID NO: 1491164 - RNA, 19 nt, Homo sapiens
caacaacaauacucucaga

SEQ ID NO: 1491165 - RNA, 19 nt, Homo sapiens
ggacaacugcccauauauu

SEQ ID NO: 1491166 - RNA, 19 nt, Homo sapiens
gacuguaacugaucuuauu

SEQ ID NO: 1491167 - RNA, 19 nt, Homo sapiens
ggacaugaggguacaguuu

SEQ ID NO: 1491168 - RNA, 19 nt, Homo sapiens
gccagucgcagcuuuauua

SEQ ID NO: 1491169 - RNA, 19 nt, Homo sapiens
gcccauauauucuaucuag

SEQ ID NO: 1491170 - RNA, 19 nt, Homo sapiens
ggaaaccugucaaccaaca

SEQ ID NO: 1491171 - RNA, 19 nt, Homo sapiens
ucacagagcagccuuugaa

SEQ ID NO: 1491172 - RNA, 19 nt, Homo sapiens
ggaugagucugugauuuau

SEQ ID NO: 1491173 - RNA, 19 nt, Homo sapiens
gauuaagccacacugaaua

SEQ ID NO: 1491174 - RNA, 19 nt, Homo sapiens
caacugcccauauauucua

SEQ ID NO: 1491175 - RNA, 19 nt, Homo sapiens
cgacuccugugcucucuuu

SEQ ID NO: 1491176 - RNA, 19 nt, Homo sapiens
ugggugugcuuuauauaua

SEQ ID NO: 1491177 - RNA, 19 nt, Homo sapiens
uuagccagcuugcuuguuu

SEQ ID NO: 1491178 - RNA, 19 nt, Homo sapiens
gcuaaaugcuggauuaagc

SEQ ID NO: 1491179 - RNA, 19 nt, Homo sapiens
caucguaaaucucaacauc

SEQ ID NO: 1491180 - RNA, 19 nt, Homo sapiens
guacauguuuggucuugug

SEQ ID NO: 1491181 - RNA, 19 nt, Homo sapiens
aaagguagaugagguacaa

SEQ ID NO: 1491182 - RNA, 19 nt, Homo sapiens
ugagaaaugauguggauaa

SEQ ID NO: 1491183 - RNA, 19 nt, Homo sapiens
ugaaauggcuguccuuagc

SEQ ID NO: 1491184 - RNA, 19 nt, Homo sapiens
ggauuaagccacacugaau

SEQ ID NO: 1491185 - RNA, 19 nt, Homo sapiens
ggaagaaggacagcaauca

SEQ ID NO: 1491186 - RNA, 19 nt, Homo sapiens
ccagcuugcuuguuuaugu

SEQ ID NO: 1491187 - RNA, 19 nt, Homo sapiens
gcaaucaucuugucauccu

SEQ ID NO: 1491188 - RNA, 19 nt, Homo sapiens
ggaggccagucgcagcuuu

SEQ ID NO: 1491189 - RNA, 19 nt, Homo sapiens
ugagcaggauaucagguua

SEQ ID NO: 1491190 - RNA, 19 nt, Homo sapiens
gggcaucaaucuccucauc

SEQ ID NO: 1491191 - RNA, 19 nt, Homo sapiens
uggaugagucugugauuua

SEQ ID NO: 1491192 - RNA, 19 nt, Homo sapiens
cagagcagccuuugaauag

SEQ ID NO: 1491193 - RNA, 19 nt, Homo sapiens
gggaugcucuuuggaacaa

SEQ ID NO: 1491194 - RNA, 19 nt, Homo sapiens
ccaugggugugcuuuauau

SEQ ID NO: 1491195 - RNA, 19 nt, Homo sapiens
gcuuuaacuucuagcauga

SEQ ID NO: 1491196 - RNA, 19 nt, Homo sapiens
gagaggcugcggcauguuu

SEQ ID NO: 1491197 - RNA, 19 nt, Homo sapiens
cuaauggccucaacaccuu

SEQ ID NO: 1491198 - RNA, 19 nt, Homo sapiens
cuugcuaaaugcuggauua

SEQ ID NO: 1491199 - RNA, 19 nt, Homo sapiens
caacaugcggacccgaaua

SEQ ID NO: 1491200 - RNA, 19 nt, Homo sapiens
ucaguuggauuucaaagca

SEQ ID NO: 1491201 - RNA, 19 nt, Homo sapiens
gacaacugcccauauauuc

SEQ ID NO: 1491202 - RNA, 19 nt, Homo sapiens
caaguggucuggacaugag

SEQ ID NO: 1491203 - RNA, 19 nt, Homo sapiens
gagaaaugauguggauaag

SEQ ID NO: 1491204 - RNA, 19 nt, Homo sapiens
acaaaucacuggccaacca

SEQ ID NO: 1491205 - RNA, 19 nt, Homo sapiens
cgaauaaugauaggacuaa

SEQ ID NO: 1491206 - RNA, 19 nt, Homo sapiens
gaaagaugaauaucaguac

SEQ ID NO: 1491207 - RNA, 19 nt, Homo sapiens
cauguuuggucuugugauu

SEQ ID NO: 1491208 - RNA, 19 nt, Homo sapiens
cuaguuacauucaacaagu

SEQ ID NO: 1491209 - RNA, 19 nt, Homo sapiens
ugcauuggcuccucuguga

SEQ ID NO: 1491210 - RNA, 19 nt, Homo sapiens
cuacacgguucuuauagug

SEQ ID NO: 1491211 - RNA, 19 nt, Homo sapiens
aauccucccugaaagauga

SEQ ID NO: 1491212 - RNA, 19 nt, Homo sapiens
gcacuggaucuuacgcaaa

SEQ ID NO: 1491213 - RNA, 19 nt, Homo sapiens
acagagcagccuuugaaua

SEQ ID NO: 1491214 - RNA, 19 nt, Homo sapiens
gaagaaggacagcaaucau

SEQ ID NO: 1491215 - RNA, 19 nt, Homo sapiens
gagcagccuuugaauagac

SEQ ID NO: 1491216 - RNA, 19 nt, Homo sapiens
gcaucaaucuccucaucuc

SEQ ID NO: 1491217 - RNA, 19 nt, Homo sapiens
ccacacugaauaccagaua

SEQ ID NO: 1491218 - RNA, 19 nt, Homo sapiens
uagugguaauuccuaguua

SEQ ID NO: 1491219 - RNA, 19 nt, Homo sapiens
gagcaggauaucagguuaa

SEQ ID NO: 1491220 - RNA, 19 nt, Homo sapiens
aagaagaauuagugccaaa

SEQ ID NO: 1491221 - RNA, 19 nt, Homo sapiens
cagcuugcuuguuuauguu

SEQ ID NO: 1491222 - RNA, 19 nt, Homo sapiens
ccugagaaaugauguggau

SEQ ID NO: 1491223 - RNA, 19 nt, Homo sapiens
gaccaugggcaucguaaau

SEQ ID NO: 1491224 - RNA, 19 nt, Homo sapiens
aaaguuacuggcugguuua

SEQ ID NO: 1491225 - RNA, 19 nt, Homo sapiens
gccauggcuuuaacuucua

SEQ ID NO: 1491226 - RNA, 19 nt, Homo sapiens
uagccagcuugcuuguuua

SEQ ID NO: 1491227 - RNA, 19 nt, Homo sapiens
gcaccauccugccacucuu

SEQ ID NO: 1491228 - RNA, 19 nt, Homo sapiens
gauagacagauauggaaga

SEQ ID NO: 1491229 - RNA, 19 nt, Homo sapiens
cuacuugcacuggaucuua

SEQ ID NO: 1491230 - RNA, 19 nt, Homo sapiens
uagcaaaagugaacuaugu

SEQ ID NO: 1491231 - RNA, 19 nt, Homo sapiens
ucaaauccucccugaaaga

SEQ ID NO: 1491232 - RNA, 19 nt, Homo sapiens
agucgcagcuuuauuaugc

SEQ ID NO: 1491233 - RNA, 19 nt, Homo sapiens
uagcagaagcucacucaug

SEQ ID NO: 1491234 - RNA, 19 nt, Homo sapiens
ccugguggguuaugaacuu

SEQ ID NO: 1491235 - RNA, 19 nt, Homo sapiens
ucucuuccauugccacuug

SEQ ID NO: 1491236 - RNA, 19 nt, Homo sapiens
cagcaaucaucuugucauc

SEQ ID NO: 1491237 - RNA, 19 nt, Homo sapiens
cuuaagcuauguauguaug

SEQ ID NO: 1491238 - RNA, 19 nt, Homo sapiens
aaacauuccucugcauugg

SEQ ID NO: 1491239 - RNA, 19 nt, Homo sapiens
aaugauaggacuaacacua

SEQ ID NO: 1491240 - RNA, 19 nt, Homo sapiens
gaaggacagcaaucaucuu

SEQ ID NO: 1491241 - RNA, 19 nt, Homo sapiens
gacaugaggguacaguuuc

SEQ ID NO: 1491242 - RNA, 19 nt, Homo sapiens
ucaccaagaagaauuagug

SEQ ID NO: 1491243 - RNA, 19 nt, Homo sapiens
ggagucgucaaggucauua

SEQ ID NO: 1491244 - RNA, 19 nt, Homo sapiens
ggacaagagggagcugcua

SEQ ID NO: 1491245 - RNA, 19 nt, Homo sapiens
gaggccagucgcagcuuua

SEQ ID NO: 1491246 - RNA, 19 nt, Homo sapiens
guacaagguccuaagugau

SEQ ID NO: 1491247 - RNA, 19 nt, Homo sapiens
caauggagcuagcaaaagu

SEQ ID NO: 1491248 - RNA, 19 nt, Homo sapiens
guuuauaccugagacaaag

SEQ ID NO: 1491249 - RNA, 19 nt, Homo sapiens
gggcucuucuucagaucaa

SEQ ID NO: 1491250 - RNA, 19 nt, Homo sapiens
gggagcugcuagcaagguu

SEQ ID NO: 1491251 - RNA, 19 nt, Homo sapiens
gagcaggaaaugguuguga

SEQ ID NO: 1491252 - RNA, 19 nt, Homo sapiens
uguaacaagcuguguggua

SEQ ID NO: 1491253 - RNA, 19 nt, Homo sapiens
aaaaguuacuggcugguuu

SEQ ID NO: 1491254 - RNA, 19 nt, Homo sapiens
uuaggagggugucuuugga

SEQ ID NO: 1491255 - RNA, 19 nt, Homo sapiens
gaaggaaacuugguauuaa

SEQ ID NO: 1491256 - RNA, 19 nt, Homo sapiens
gaauauacaucuuccacua

SEQ ID NO: 1491257 - RNA, 19 nt, Homo sapiens
ccucaaagcccaaguauua

SEQ ID NO: 1491258 - RNA, 19 nt, Homo sapiens
uaaaguauaugcugcaaug

SEQ ID NO: 1491259 - RNA, 19 nt, Homo sapiens
gcaaugggauaucuuacaa

SEQ ID NO: 1491260 - RNA, 19 nt, Homo sapiens
cauaauaacuacacucaga

SEQ ID NO: 1491261 - RNA, 19 nt, Homo sapiens
gguauuaaauguuguggaa

SEQ ID NO: 1491262 - RNA, 19 nt, Homo sapiens
aagcagacauugaaaguuu

SEQ ID NO: 1491263 - RNA, 19 nt, Homo sapiens
cagaauauacucagucaua

SEQ ID NO: 1491264 - RNA, 19 nt, Homo sapiens
gcagaacguucgaaagaug

SEQ ID NO: 1491265 - RNA, 19 nt, Homo sapiens
gcagagggaucaugguuuc

SEQ ID NO: 1491266 - RNA, 19 nt, Homo sapiens
gaauaacgcagcuggcuuu

SEQ ID NO: 1491267 - RNA, 19 nt, Homo sapiens
gaagacuugucacagguuu

SEQ ID NO: 1491268 - RNA, 19 nt, Homo sapiens
ggaagcauauacacaugaa

SEQ ID NO: 1491269 - RNA, 19 nt, Homo sapiens
gaacaacaucgacuugcua

SEQ ID NO: 1491270 - RNA, 19 nt, Homo sapiens
gcuaguguauccaauauuc

SEQ ID NO: 1491271 - RNA, 19 nt, Homo sapiens
cuacuuauauguugucaug

SEQ ID NO: 1491272 - RNA, 19 nt, Homo sapiens
guaacaauuucaaggacua

SEQ ID NO: 1491273 - RNA, 19 nt, Homo sapiens
gaucugcuuucgaaccuaa

SEQ ID NO: 1491274 - RNA, 19 nt, Homo sapiens
ccagguucaugauggauua

SEQ ID NO: 1491275 - RNA, 19 nt, Homo sapiens
gagaaauucagcuuuguuu

SEQ ID NO: 1491276 - RNA, 19 nt, Homo sapiens
gagaagacacccaaauguu

SEQ ID NO: 1491277 - RNA, 19 nt, Homo sapiens
cuacagacauuacuuccuu

SEQ ID NO: 1491278 - RNA, 19 nt, Homo sapiens
ucgaagagcugaagaccuu

SEQ ID NO: 1491279 - RNA, 19 nt, Homo sapiens
ggagacuucuauuggguaa

SEQ ID NO: 1491280 - RNA, 19 nt, Homo sapiens
gaaagcagacauugaaagu

SEQ ID NO: 1491281 - RNA, 19 nt, Homo sapiens
gcucgacucugcuacuuau

SEQ ID NO: 1491282 - RNA, 19 nt, Homo sapiens
agaaggaaacuugguauua

SEQ ID NO: 1491283 - RNA, 19 nt, Homo sapiens
ucacagguuucucaaauca

SEQ ID NO: 1491284 - RNA, 19 nt, Homo sapiens
ugucauagcugguccuugu

SEQ ID NO: 1491285 - RNA, 19 nt, Homo sapiens
gaaccgaccaucagcuuau

SEQ ID NO: 1491286 - RNA, 19 nt, Homo sapiens
gacauuacuuccuuucuuc

SEQ ID NO: 1491287 - RNA, 19 nt, Homo sapiens
cagaaagucuccuguacau

SEQ ID NO: 1491288 - RNA, 19 nt, Homo sapiens
gaaccuaaacaucuggaaa

SEQ ID NO: 1491289 - RNA, 19 nt, Homo sapiens
ggaauucucacuacggauu

SEQ ID NO: 1491290 - RNA, 19 nt, Homo sapiens
gagagaaggaaacuuggua

SEQ ID NO: 1491291 - RNA, 19 nt, Homo sapiens
guaagaagaagcaguuguu

SEQ ID NO: 1491292 - RNA, 19 nt, Homo sapiens
gaagacacccaaauguuca

SEQ ID NO: 1491293 - RNA, 19 nt, Homo sapiens
cuaaacaucuggaaaauug

SEQ ID NO: 1491294 - RNA, 19 nt, Homo sapiens
guugggaucugcuuucgaa

SEQ ID NO: 1491295 - RNA, 19 nt, Homo sapiens
caacaucgacuugcuauca

SEQ ID NO: 1491296 - RNA, 19 nt, Homo sapiens
uaaagugcagggaguauuu

SEQ ID NO: 1491297 - RNA, 19 nt, Homo sapiens
ucaccugccuuguggauga

SEQ ID NO: 1491298 - RNA, 19 nt, Homo sapiens
guagcaaugggauaucuua

SEQ ID NO: 1491299 - RNA, 19 nt, Homo sapiens
ucauaagucuccugauaau

SEQ ID NO: 1491300 - RNA, 19 nt, Homo sapiens
uaaagugugugugcuauca

SEQ ID NO: 1491301 - RNA, 19 nt, Homo sapiens
gguaauauucuaugugaga

SEQ ID NO: 1491302 - RNA, 19 nt, Homo sapiens
gaacaacuacagacauuac

SEQ ID NO: 1491303 - RNA, 19 nt, Homo sapiens
acgaagaccuuuccuguca

SEQ ID NO: 1491304 - RNA, 19 nt, Homo sapiens
uuacugguuugcagacaua

SEQ ID NO: 1491305 - RNA, 19 nt, Homo sapiens
ggauaagaaugggaauuuc

SEQ ID NO: 1491306 - RNA, 19 nt, Homo sapiens
ugacugguuuguccauaaa

SEQ ID NO: 1491307 - RNA, 19 nt, Homo sapiens
gcaaugguguacugccaau

SEQ ID NO: 1491308 - RNA, 19 nt, Homo sapiens
agacauuacuuccuuucuu

SEQ ID NO: 1491309 - RNA, 19 nt, Homo sapiens
uggaauucuugucacauua

SEQ ID NO: 1491310 - RNA, 19 nt, Homo sapiens
ugaaguugcuggaggugaa

SEQ ID NO: 1491311 - RNA, 19 nt, Homo sapiens
gcagccaccucccgaagau

SEQ ID NO: 1491312 - RNA, 19 nt, Homo sapiens
uggguaauauucuauguga

SEQ ID NO: 1491313 - RNA, 19 nt, Homo sapiens
ugucacagguuucucaaau

SEQ ID NO: 1491314 - RNA, 19 nt, Homo sapiens
ggaacaacuacagacauua

SEQ ID NO: 1491315 - RNA, 19 nt, Homo sapiens
cuacauagccuucauugag

SEQ ID NO: 1491316 - RNA, 19 nt, Homo sapiens
ccaaagugcugggauuaca

SEQ ID NO: 1491317 - RNA, 19 nt, Homo sapiens
cuucuuaacuggaauucuu

SEQ ID NO: 1491318 - RNA, 19 nt, Homo sapiens
gcauggacauuagcugaug

SEQ ID NO: 1491319 - RNA, 19 nt, Homo sapiens
ugucuacccuggauacuau

SEQ ID NO: 1491320 - RNA, 19 nt, Homo sapiens
gaugacugguuuguccaua

SEQ ID NO: 1491321 - RNA, 19 nt, Homo sapiens
gcaaucauggucacugcua

SEQ ID NO: 1491322 - RNA, 19 nt, Homo sapiens
gcuaaagugugugugcuau

SEQ ID NO: 1491323 - RNA, 19 nt, Homo sapiens
gaucacaaccuuggcauuc

SEQ ID NO: 1491324 - RNA, 19 nt, Homo sapiens
gagaaggaaacuugguauu

SEQ ID NO: 1491325 - RNA, 19 nt, Homo sapiens
aggaacaacuacagacauu

SEQ ID NO: 1491326 - RNA, 19 nt, Homo sapiens
uagcugaugcagugaauaa

SEQ ID NO: 1491327 - RNA, 19 nt, Homo sapiens
cgacucugcuacuuauaug

SEQ ID NO: 1491328 - RNA, 19 nt, Homo sapiens
ggaaacuugguauuaaaug

SEQ ID NO: 1491329 - RNA, 19 nt, Homo sapiens
ucaggcaugcccucaaaua

SEQ ID NO: 1491330 - RNA, 19 nt, Homo sapiens
gaaggcgagugcugagaag

SEQ ID NO: 1491331 - RNA, 19 nt, Homo sapiens
ugccagagcugcagagaca

SEQ ID NO: 1491332 - RNA, 19 nt, Homo sapiens
gcagcuggcuuuggguuca

SEQ ID NO: 1491333 - RNA, 19 nt, Homo sapiens
caauuucaaggacuacaua

SEQ ID NO: 1491334 - RNA, 19 nt, Homo sapiens
caugauggauuaggucgaa

SEQ ID NO: 1491335 - RNA, 19 nt, Homo sapiens
ggaaagcagacauugaaag

SEQ ID NO: 1491336 - RNA, 19 nt, Homo sapiens
ccacaaguuucaaaaugua

SEQ ID NO: 1491337 - RNA, 19 nt, Homo sapiens
ggacuacauagccuucauu

SEQ ID NO: 1491338 - RNA, 19 nt, Homo sapiens
cagaaugccuuuuaggaaa

SEQ ID NO: 1491339 - RNA, 19 nt, Homo sapiens
gaagaggggcugcuguuuu

SEQ ID NO: 1491340 - RNA, 19 nt, Homo sapiens
cuugugacauuacugguuu

SEQ ID NO: 1491341 - RNA, 19 nt, Homo sapiens
auugauaccuccaagagaa

SEQ ID NO: 1491342 - RNA, 19 nt, Homo sapiens
gguagcacccuuugugaug

SEQ ID NO: 1491343 - RNA, 19 nt, Homo sapiens
caacuacagacauuacuuc

SEQ ID NO: 1491344 - RNA, 19 nt, Homo sapiens
aaacuggaauauucagaca

SEQ ID NO: 1491345 - RNA, 19 nt, Homo sapiens
gacauaauaacuacacuca

SEQ ID NO: 1491346 - RNA, 19 nt, Homo sapiens
acagguuucucaaaucaga

SEQ ID NO: 1491347 - RNA, 19 nt, Homo sapiens
gagaagcggaacaagcaaa

SEQ ID NO: 1491348 - RNA, 19 nt, Homo sapiens
gcauauacacaugaaguug

SEQ ID NO: 1491349 - RNA, 19 nt, Homo sapiens
ccacaucagccgaauauac

SEQ ID NO: 1491350 - RNA, 19 nt, Homo sapiens
gaaguuugguaagaagaag

SEQ ID NO: 1491351 - RNA, 19 nt, Homo sapiens
gcaguugaaccgaccauca

SEQ ID NO: 1491352 - RNA, 19 nt, Homo sapiens
uaucagcggguucauggua

SEQ ID NO: 1491353 - RNA, 19 nt, Homo sapiens
cuacuuacguccugguaca

SEQ ID NO: 1491354 - RNA, 19 nt, Homo sapiens
ccagcuuguugcucuguuu

SEQ ID NO: 1491355 - RNA, 19 nt, Homo sapiens
guauguagcucacugauaa

SEQ ID NO: 1491356 - RNA, 19 nt, Homo sapiens
ugaaaggccuggcagauaa

SEQ ID NO: 1491357 - RNA, 19 nt, Homo sapiens
caacaggucuaguauguag

SEQ ID NO: 1491358 - RNA, 19 nt, Homo sapiens
gaaguuccaagaagaauuu

SEQ ID NO: 1491359 - RNA, 19 nt, Homo sapiens
gaaccucugcuuaggaaua

SEQ ID NO: 1491360 - RNA, 19 nt, Homo sapiens
gaucugagaaccaaccaua

SEQ ID NO: 1491361 - RNA, 19 nt, Homo sapiens
ggcccuagcuuucccauug

SEQ ID NO: 1491362 - RNA, 19 nt, Homo sapiens
guagcucacugauaacaga

SEQ ID NO: 1491363 - RNA, 19 nt, Homo sapiens
aaacuuaacuuugcccaau

SEQ ID NO: 1491364 - RNA, 19 nt, Homo sapiens
ugugagaucugaaaacuua

SEQ ID NO: 1491365 - RNA, 19 nt, Homo sapiens
gaaccaaccauagaauguu

SEQ ID NO: 1491366 - RNA, 19 nt, Homo sapiens
cuucagacauuuagggaaa

SEQ ID NO: 1491367 - RNA, 19 nt, Homo sapiens
gugaaaggccuggcagaua

SEQ ID NO: 1491368 - RNA, 19 nt, Homo sapiens
gaauauggguaggagugaa

SEQ ID NO: 1491369 - RNA, 19 nt, Homo sapiens
gaaaggccuggcagauaaa

SEQ ID NO: 1491370 - RNA, 19 nt, Homo sapiens
gauaacagaggaagaugug

SEQ ID NO: 1491371 - RNA, 19 nt, Homo sapiens
ucacucaggcguagaagaa

SEQ ID NO: 1491372 - RNA, 19 nt, Homo sapiens
ccugguguuugccaaguua

SEQ ID NO: 1491373 - RNA, 19 nt, Homo sapiens
cuccaucuauugucucuuu

SEQ ID NO: 1491374 - RNA, 19 nt, Homo sapiens
ucccauugcuguuccauug

SEQ ID NO: 1491375 - RNA, 19 nt, Homo sapiens
aaccaaccauagaauguuu

SEQ ID NO: 1491376 - RNA, 19 nt, Homo sapiens
gagaaccaaccauagaaug

SEQ ID NO: 1491377 - RNA, 19 nt, Homo sapiens
ccugccagcuucagacauu

SEQ ID NO: 1491378 - RNA, 19 nt, Homo sapiens
gaugagcagucuucaagcu

SEQ ID NO: 1491379 - RNA, 19 nt, Homo sapiens
gggaugagcagucuucaag

SEQ ID NO: 1491380 - RNA, 19 nt, Homo sapiens
cauuaugaaccucugcuua

SEQ ID NO: 1491381 - RNA, 19 nt, Homo sapiens
ccaaguuguuugugagauc

SEQ ID NO: 1491382 - RNA, 19 nt, Homo sapiens
gaauguuucaguucuagga

SEQ ID NO: 1491383 - RNA, 19 nt, Homo sapiens
ugacugcaguuucggaagu

SEQ ID NO: 1491384 - RNA, 19 nt, Homo sapiens
cacccuaccgucauauaua

SEQ ID NO: 1491385 - RNA, 19 nt, Homo sapiens
gcaggagagcgacaucuuc

SEQ ID NO: 1491386 - RNA, 19 nt, Homo sapiens
uaccagcguuuccagaaga

SEQ ID NO: 1491387 - RNA, 19 nt, Homo sapiens
gcuuccaaguuguuuguga

SEQ ID NO: 1491388 - RNA, 19 nt, Homo sapiens
ugugggaaaucgagaacaa

SEQ ID NO: 1491389 - RNA, 19 nt, Homo sapiens
guagucaggcuuugcuguu

SEQ ID NO: 1491390 - RNA, 19 nt, Homo sapiens
gagaaauaucugucccauu

SEQ ID NO: 1491391 - RNA, 19 nt, Homo sapiens
ggaauauggguaggaguga

SEQ ID NO: 1491392 - RNA, 19 nt, Homo sapiens
gggaugcccugggaagauc

SEQ ID NO: 1491393 - RNA, 19 nt, Homo sapiens
gcaaacugggacugccuuu

SEQ ID NO: 1491394 - RNA, 19 nt, Homo sapiens
aacuuaacuuugcccaaua

SEQ ID NO: 1491395 - RNA, 19 nt, Homo sapiens
ggccuccuacugcccauua

SEQ ID NO: 1491396 - RNA, 19 nt, Homo sapiens
caaccgcuaccagguguuu

SEQ ID NO: 1491397 - RNA, 19 nt, Homo sapiens
uuucggaaguuugaucuga

SEQ ID NO: 1491398 - RNA, 19 nt, Homo sapiens
aucaacaggucuaguaugu

SEQ ID NO: 1491399 - RNA, 19 nt, Homo sapiens
acccuaccgucauauauau

SEQ ID NO: 1491400 - RNA, 19 nt, Homo sapiens
gauccuuggcugccgcuuu

SEQ ID NO: 1491401 - RNA, 19 nt, Homo sapiens
ggaaauaaaaccaguugau

SEQ ID NO: 1491402 - RNA, 19 nt, Homo sapiens
gcccacucguugccugauu

SEQ ID NO: 1491403 - RNA, 19 nt, Homo sapiens
cgagacggccuuccugagu

SEQ ID NO: 1491404 - RNA, 19 nt, Homo sapiens
cccaucaacaggucuagua

SEQ ID NO: 1491405 - RNA, 19 nt, Homo sapiens
ucuucaagcugugguaguu

SEQ ID NO: 1491406 - RNA, 19 nt, Homo sapiens
ugauuccguuuccgacuug

SEQ ID NO: 1491407 - RNA, 19 nt, Homo sapiens
guucgucacagugucauuu

SEQ ID NO: 1491408 - RNA, 19 nt, Homo sapiens
aggccacccuaccgucaua

SEQ ID NO: 1491409 - RNA, 19 nt, Homo sapiens
caaguuguuugugagaucu

SEQ ID NO: 1491410 - RNA, 19 nt, Homo sapiens
acaaggagugcaaggagaa

SEQ ID NO: 1491411 - RNA, 19 nt, Homo sapiens
augaaccucugcuuaggaa

SEQ ID NO: 1491412 - RNA, 19 nt, Homo sapiens
ggaagccggacgacgacaa

SEQ ID NO: 1491413 - RNA, 19 nt, Homo sapiens
ccauagaauguuucaguuc

SEQ ID NO: 1491414 - RNA, 19 nt, Homo sapiens
ucugagaaccaaccauaga

SEQ ID NO: 1491415 - RNA, 19 nt, Homo sapiens
ucggaaguuugaucugaga

SEQ ID NO: 1491416 - RNA, 19 nt, Homo sapiens
cccauuagccucagagaag

SEQ ID NO: 1491417 - RNA, 19 nt, Homo sapiens
guuaccagcguuuccagaa

SEQ ID NO: 1491418 - RNA, 19 nt, Homo sapiens
gacugcaguuucggaaguu

SEQ ID NO: 1491419 - RNA, 19 nt, Homo sapiens
ccacccuaccgucauauau

SEQ ID NO: 1491420 - RNA, 19 nt, Homo sapiens
accauagaauguuucaguu

SEQ ID NO: 1491421 - RNA, 19 nt, Homo sapiens
agaaccaaccauagaaugu

SEQ ID NO: 1491422 - RNA, 19 nt, Homo sapiens
gaccugguguuugccaagu

SEQ ID NO: 1491423 - RNA, 19 nt, Homo sapiens
acuuaacuuugcccaauau

SEQ ID NO: 1491424 - RNA, 19 nt, Homo sapiens
ugagaaccaaccauagaau

SEQ ID NO: 1491425 - RNA, 19 nt, Homo sapiens
caucaacaggucuaguaug

SEQ ID NO: 1491426 - RNA, 19 nt, Homo sapiens
aaacgccuguucccguaca

SEQ ID NO: 1491427 - RNA, 19 nt, Homo sapiens
ccucccacccucuuccuaa

SEQ ID NO: 1491428 - RNA, 19 nt, Homo sapiens
ucaacaggucuaguaugua

SEQ ID NO: 1491429 - RNA, 19 nt, Homo sapiens
ccacgcuggcccuagcuuu

SEQ ID NO: 1491430 - RNA, 19 nt, Homo sapiens
aaccucugcuuaggaauau

SEQ ID NO: 1491431 - RNA, 19 nt, Homo sapiens
gaagccggacgacgacaag

SEQ ID NO: 1491432 - RNA, 19 nt, Homo sapiens
aaccauagaauguuucagu

SEQ ID NO: 1491433 - RNA, 19 nt, Homo sapiens
gggcuuccaaguuguuugu

SEQ ID NO: 1491434 - RNA, 19 nt, Homo sapiens
ggcaggagagcgacaucuu

SEQ ID NO: 1491435 - RNA, 19 nt, Homo sapiens
cugagaaccaaccauagaa

SEQ ID NO: 1491436 - RNA, 19 nt, Homo sapiens
cccuugggcucugaugaaa

SEQ ID NO: 1491437 - RNA, 19 nt, Homo sapiens
uuccugagcuccuguccau

SEQ ID NO: 1491438 - RNA, 19 nt, Homo sapiens
cugauuccguuuccgacuu

SEQ ID NO: 1491439 - RNA, 19 nt, Homo sapiens
ggacggugcugaaagauga

SEQ ID NO: 1491440 - RNA, 19 nt, Homo sapiens
ucaacacucucaaugauaa

SEQ ID NO: 1491441 - RNA, 19 nt, Homo sapiens
gaaauucugucaacacucu

SEQ ID NO: 1491442 - RNA, 19 nt, Homo sapiens
caguauggcuucaacuaua

SEQ ID NO: 1491443 - RNA, 19 nt, Homo sapiens
gcaagucuaccauaaguuu

SEQ ID NO: 1491444 - RNA, 19 nt, Homo sapiens
gagcaggugugagaaauau

SEQ ID NO: 1491445 - RNA, 19 nt, Homo sapiens
gaaagugaguaaacaacau

SEQ ID NO: 1491446 - RNA, 19 nt, Homo sapiens
guucgcagcucuccggaua

SEQ ID NO: 1491447 - RNA, 19 nt, Homo sapiens
uaacaaaggauaucuggaa

SEQ ID NO: 1491448 - RNA, 19 nt, Homo sapiens
caaaggauaucuggaagga

SEQ ID NO: 1491449 - RNA, 19 nt, Homo sapiens
gaaagcuacgaucaauuua

SEQ ID NO: 1491450 - RNA, 19 nt, Homo sapiens
gaggagugcuggcgauguu

SEQ ID NO: 1491451 - RNA, 19 nt, Homo sapiens
ccagaaagcuacgaucaau

SEQ ID NO: 1491452 - RNA, 19 nt, Homo sapiens
gaagaaagugaguaaacaa

SEQ ID NO: 1491453 - RNA, 19 nt, Homo sapiens
ugagaaauauguugagaca

SEQ ID NO: 1491454 - RNA, 19 nt, Homo sapiens
agaaagcuacgaucaauuu

SEQ ID NO: 1491455 - RNA, 19 nt, Homo sapiens
gaacaggagaagaaaauua

SEQ ID NO: 1491456 - RNA, 19 nt, Homo sapiens
ggauaaagaccaaaucaag

SEQ ID NO: 1491457 - RNA, 19 nt, Homo sapiens
ggaaucccauauaugaaug

SEQ ID NO: 1491458 - RNA, 19 nt, Homo sapiens
guauauagcccauucuugu

SEQ ID NO: 1491459 - RNA, 19 nt, Homo sapiens
ucacgggccuucguucuaa

SEQ ID NO: 1491460 - RNA, 19 nt, Homo sapiens
cagcaagucuaccauaagu

SEQ ID NO: 1491461 - RNA, 19 nt, Homo sapiens
cugcagaucuacaguguga

SEQ ID NO: 1491462 - RNA, 19 nt, Homo sapiens
ccaagucuguggcauagug

SEQ ID NO: 1491463 - RNA, 19 nt, Homo sapiens
gagcagcaagucuaccaua

SEQ ID NO: 1491464 - RNA, 19 nt, Homo sapiens
gaaauauguugagacaaag

SEQ ID NO: 1491465 - RNA, 19 nt, Homo sapiens
ugaagaaagugaguaaaca

SEQ ID NO: 1491466 - RNA, 19 nt, Homo sapiens
ccaagaguguaacaaagga

SEQ ID NO: 1491467 - RNA, 19 nt, Homo sapiens
uaccauaaguuucagaauc

SEQ ID NO: 1491468 - RNA, 19 nt, Homo sapiens
ccuauuuccuguucucauu

SEQ ID NO: 1491469 - RNA, 19 nt, Homo sapiens
gcagcucuccggauaaaga

SEQ ID NO: 1491470 - RNA, 19 nt, Homo sapiens
ucccauauaugaaugaaga

SEQ ID NO: 1491471 - RNA, 19 nt, Homo sapiens
acaaguauauagcccauuc

SEQ ID NO: 1491472 - RNA, 19 nt, Homo sapiens
ccgagggugucgaaucuuu

SEQ ID NO: 1491473 - RNA, 19 nt, Homo sapiens
gagaggcaaacaaguauau

SEQ ID NO: 1491474 - RNA, 19 nt, Homo sapiens
ucagaguguucagcaauuu

SEQ ID NO: 1491475 - RNA, 19 nt, Homo sapiens
uggcaggucuggacauaga

SEQ ID NO: 1491476 - RNA, 19 nt, Homo sapiens
cagaauauccacagccuau

SEQ ID NO: 1491477 - RNA, 19 nt, Homo sapiens
ggagaggcaaacaaguaua

SEQ ID NO: 1491478 - RNA, 19 nt, Homo sapiens
ugucaacacucucaaugau

SEQ ID NO: 1491479 - RNA, 19 nt, Homo sapiens
aguauggcuucaacuauaa

SEQ ID NO: 1491480 - RNA, 19 nt, Homo sapiens
gaacgugaaauucugucaa

SEQ ID NO: 1491481 - RNA, 19 nt, Homo sapiens
gcaccuccaugagaaguuc

SEQ ID NO: 1491482 - RNA, 19 nt, Homo sapiens
guucagcaauuuacagucu

SEQ ID NO: 1491483 - RNA, 19 nt, Homo sapiens
aaggagaggcaaacaagua

SEQ ID NO: 1491484 - RNA, 19 nt, Homo sapiens
gaagaucugguaccugagu

SEQ ID NO: 1491485 - RNA, 19 nt, Homo sapiens
gcuccaagucuguggcaua

SEQ ID NO: 1491486 - RNA, 19 nt, Homo sapiens
ccaucggagugguaucuaa

SEQ ID NO: 1491487 - RNA, 19 nt, Homo sapiens
ucucuucccuacaacguuu

SEQ ID NO: 1491488 - RNA, 19 nt, Homo sapiens
gcaggugugagaaauaugu

SEQ ID NO: 1491489 - RNA, 19 nt, Homo sapiens
gcgagcaggugugagaaau

SEQ ID NO: 1491490 - RNA, 19 nt, Homo sapiens
gucagaguguucagcaauu

SEQ ID NO: 1491491 - RNA, 19 nt, Homo sapiens
aagcuacgaucaauuuaag

SEQ ID NO: 1491492 - RNA, 19 nt, Homo sapiens
gagagcuguuggaaggaaa

SEQ ID NO: 1491493 - RNA, 19 nt, Homo sapiens
ccuacaacguuugggauuu

SEQ ID NO: 1491494 - RNA, 19 nt, Homo sapiens
uauauagcccauucuugua

SEQ ID NO: 1491495 - RNA, 19 nt, Homo sapiens
gcacacuugcuucuacaga

SEQ ID NO: 1491496 - RNA, 19 nt, Homo sapiens
ucuggaaggagaugaauuu

SEQ ID NO: 1491497 - RNA, 19 nt, Homo sapiens
ucgcagcucuccggauaaa

SEQ ID NO: 1491498 - RNA, 19 nt, Homo sapiens
gaagaaaauuagacacgau

SEQ ID NO: 1491499 - RNA, 19 nt, Homo sapiens
guuauguccugaacgugaa

SEQ ID NO: 1491500 - RNA, 19 nt, Homo sapiens
agucauccuuuccucagua

SEQ ID NO: 1491501 - RNA, 19 nt, Homo sapiens
uaaagacccgucagagugu

SEQ ID NO: 1491502 - RNA, 19 nt, Homo sapiens
aaacggaaucccauauaug

SEQ ID NO: 1491503 - RNA, 19 nt, Homo sapiens
ucaacugccugcuccaagu

SEQ ID NO: 1491504 - RNA, 19 nt, Homo sapiens
ccugaacagugacuugaau

SEQ ID NO: 1491505 - RNA, 19 nt, Homo sapiens
caucguugguaucuucaga

SEQ ID NO: 1491506 - RNA, 19 nt, Homo sapiens
cagaguguucagcaauuua

SEQ ID NO: 1491507 - RNA, 19 nt, Homo sapiens
aacggaaucccauauauga

SEQ ID NO: 1491508 - RNA, 19 nt, Homo sapiens
gaaucaguauggcuucaac

SEQ ID NO: 1491509 - RNA, 19 nt, Homo sapiens
gugaaauucugucaacacu

SEQ ID NO: 1491510 - RNA, 19 nt, Homo sapiens
ucuuacuccugaccaauaa

SEQ ID NO: 1491511 - RNA, 19 nt, Homo sapiens
ccacgaagccgcguaugau

SEQ ID NO: 1491512 - RNA, 19 nt, Homo sapiens
ggaaaauauucuucucuca

SEQ ID NO: 1491513 - RNA, 19 nt, Homo sapiens
gauuggauugucuguguuu

SEQ ID NO: 1491514 - RNA, 19 nt, Homo sapiens
ucuggacggugcugaaaga

SEQ ID NO: 1491515 - RNA, 19 nt, Homo sapiens
gauaaaucaguccuuagau

SEQ ID NO: 1491516 - RNA, 19 nt, Homo sapiens
gucaacacucucaaugaua

SEQ ID NO: 1491517 - RNA, 19 nt, Homo sapiens
gguccagauuaucccagua

SEQ ID NO: 1491518 - RNA, 19 nt, Homo sapiens
gaaccaagugaaccucauc

SEQ ID NO: 1491519 - RNA, 19 nt, Homo sapiens
gaggcaaacaaguauauag

SEQ ID NO: 1491520 - RNA, 19 nt, Homo sapiens
gaggugugcuggguguguu

SEQ ID NO: 1491521 - RNA, 19 nt, Homo sapiens
gaugucaggcgacucacaa

SEQ ID NO: 1491522 - RNA, 19 nt, Homo sapiens
gaaggagaggcaaacaagu

SEQ ID NO: 1491523 - RNA, 19 nt, Homo sapiens
cgagcaggugugagaaaua

SEQ ID NO: 1491524 - RNA, 19 nt, Homo sapiens
guugguaucuucagaacac

SEQ ID NO: 1491525 - RNA, 19 nt, Homo sapiens
gcagcaagucuaccauaag

SEQ ID NO: 1491526 - RNA, 19 nt, Homo sapiens
uugacgugcuggcuccuua

SEQ ID NO: 1491527 - RNA, 19 nt, Homo sapiens
ggugugagaaauauguuga

SEQ ID NO: 1491528 - RNA, 19 nt, Homo sapiens
uaccaagaguguaacaaag

SEQ ID NO: 1491529 - RNA, 19 nt, Homo sapiens
gaaagcccagaagcccuua

SEQ ID NO: 1491530 - RNA, 19 nt, Homo sapiens
gguggugauugacgaagug

SEQ ID NO: 1491531 - RNA, 19 nt, Homo sapiens
guucauccuuggaagaucu

SEQ ID NO: 1491532 - RNA, 19 nt, Homo sapiens
agcagcaagucuaccauaa

SEQ ID NO: 1491533 - RNA, 19 nt, Homo sapiens
augaaguccugaacaguga

SEQ ID NO: 1491534 - RNA, 19 nt, Homo sapiens
gaaucuuucggaagucuau

SEQ ID NO: 1491535 - RNA, 19 nt, Homo sapiens
caucggagugguaucuaaa

SEQ ID NO: 1491536 - RNA, 19 nt, Homo sapiens
ugaaggagaggcaaacaag

SEQ ID NO: 1491537 - RNA, 19 nt, Homo sapiens
ugaccaauaaguuuaagga

SEQ ID NO: 1491538 - RNA, 19 nt, Homo sapiens
ugaagaacaggagaagaaa

SEQ ID NO: 1491539 - RNA, 19 nt, Homo sapiens
guuaauagcugaaguccua

SEQ ID NO: 1491540 - RNA, 19 nt, Homo sapiens
gaacuuggccguauugauu

SEQ ID NO: 1491541 - RNA, 19 nt, Homo sapiens
ggacagguaugcacuggua

SEQ ID NO: 1491542 - RNA, 19 nt, Homo sapiens
gcacuugaguaaagauaaa

SEQ ID NO: 1491543 - RNA, 19 nt, Homo sapiens
gaagauaagaguucacuga

SEQ ID NO: 1491544 - RNA, 19 nt, Homo sapiens
caucaaaccucaguauauu

SEQ ID NO: 1491545 - RNA, 19 nt, Homo sapiens
gaaauauggucaggacaaa

SEQ ID NO: 1491546 - RNA, 19 nt, Homo sapiens
ggauuuauguccucacuug

SEQ ID NO: 1491547 - RNA, 19 nt, Homo sapiens
ccagagagaccucauuuaa

SEQ ID NO: 1491548 - RNA, 19 nt, Homo sapiens
uuaaagcucuguugacauu

SEQ ID NO: 1491549 - RNA, 19 nt, Homo sapiens
ggaaucaaacccaacauuu

SEQ ID NO: 1491550 - RNA, 19 nt, Homo sapiens
gaaugcaccuauuauaauc

SEQ ID NO: 1491551 - RNA, 19 nt, Homo sapiens
uaucauaacucugaccuuu

SEQ ID NO: 1491552 - RNA, 19 nt, Homo sapiens
gagccugagugaugguuua

SEQ ID NO: 1491553 - RNA, 19 nt, Homo sapiens
gggaaugagugaaacuaaa

SEQ ID NO: 1491554 - RNA, 19 nt, Homo sapiens
cauaugaccugcucacaau

SEQ ID NO: 1491555 - RNA, 19 nt, Homo sapiens
gaguaaagauaaagaguag

SEQ ID NO: 1491556 - RNA, 19 nt, Homo sapiens
gagcacgccucuucugaga

SEQ ID NO: 1491557 - RNA, 19 nt, Homo sapiens
gguaugcacugguaacaug

SEQ ID NO: 1491558 - RNA, 19 nt, Homo sapiens
gaauuuagagccugaguga

SEQ ID NO: 1491559 - RNA, 19 nt, Homo sapiens
uaagguagagagugaaaua

SEQ ID NO: 1491560 - RNA, 19 nt, Homo sapiens
acacaaacaugagaagauu

SEQ ID NO: 1491561 - RNA, 19 nt, Homo sapiens
ccaguuauccuaagaauuc

SEQ ID NO: 1491562 - RNA, 19 nt, Homo sapiens
uaagugauaugcuauacug

SEQ ID NO: 1491563 - RNA, 19 nt, Homo sapiens
ugaaggaugugaccauaug

SEQ ID NO: 1491564 - RNA, 19 nt, Homo sapiens
gaucagaaagcaaauacaa

SEQ ID NO: 1491565 - RNA, 19 nt, Homo sapiens
gaaucaaagcuguuguaua

SEQ ID NO: 1491566 - RNA, 19 nt, Homo sapiens
ucacugaaugcaccuauua

SEQ ID NO: 1491567 - RNA, 19 nt, Homo sapiens
gcaagcacuuuacaaccuu

SEQ ID NO: 1491568 - RNA, 19 nt, Homo sapiens
caacaagcaaggccacuuu

SEQ ID NO: 1491569 - RNA, 19 nt, Homo sapiens
guuguuaagugauaugcua

SEQ ID NO: 1491570 - RNA, 19 nt, Homo sapiens
agagagaccucauuuaagg

SEQ ID NO: 1491571 - RNA, 19 nt, Homo sapiens
gagaaucaaagcuguugua

SEQ ID NO: 1491572 - RNA, 19 nt, Homo sapiens
gguagaaccaggaaucaaa

SEQ ID NO: 1491573 - RNA, 19 nt, Homo sapiens
gaagacuccaucaaguaua

SEQ ID NO: 1491574 - RNA, 19 nt, Homo sapiens
ggaaugagugaaacuaaau

SEQ ID NO: 1491575 - RNA, 19 nt, Homo sapiens
gcagaggaaugcccagaag

SEQ ID NO: 1491576 - RNA, 19 nt, Homo sapiens
gcccagaaguguccaaagu

SEQ ID NO: 1491577 - RNA, 19 nt, Homo sapiens
gcauauacaguguccauug

SEQ ID NO: 1491578 - RNA, 19 nt, Homo sapiens
gguagagagugaaauaugg

SEQ ID NO: 1491579 - RNA, 19 nt, Homo sapiens
ccagcgaacugaaggaugu

SEQ ID NO: 1491580 - RNA, 19 nt, Homo sapiens
uguguaaccugaagcauau

SEQ ID NO: 1491581 - RNA, 19 nt, Homo sapiens
ucauaacucugaccuuugu

SEQ ID NO: 1491582 - RNA, 19 nt, Homo sapiens
aagacuccaucaaguauaa

SEQ ID NO: 1491583 - RNA, 19 nt, Homo sapiens
ccauaaaccaguucaagaa

SEQ ID NO: 1491584 - RNA, 19 nt, Homo sapiens
gguaacaugcagaugauuu

SEQ ID NO: 1491585 - RNA, 19 nt, Homo sapiens
gaaaucaaaugccccauca

SEQ ID NO: 1491586 - RNA, 19 nt, Homo sapiens
ccacaaugccucuagcuau

SEQ ID NO: 1491587 - RNA, 19 nt, Homo sapiens
ggccauagcgguuguaauc

SEQ ID NO: 1491588 - RNA, 19 nt, Homo sapiens
caugaagacuccaucaagu

SEQ ID NO: 1491589 - RNA, 19 nt, Homo sapiens
guaaagauaaagaguagga

SEQ ID NO: 1491590 - RNA, 19 nt, Homo sapiens
uagcugaaguccuaucugu

SEQ ID NO: 1491591 - RNA, 19 nt, Homo sapiens
uguccucacuugucacuaa

SEQ ID NO: 1491592 - RNA, 19 nt, Homo sapiens
cacaaugccucuagcuaug

SEQ ID NO: 1491593 - RNA, 19 nt, Homo sapiens
agauuaagguagagaguga

SEQ ID NO: 1491594 - RNA, 19 nt, Homo sapiens
agaaagggaugaagguaca

SEQ ID NO: 1491595 - RNA, 19 nt, Homo sapiens
ucacuugucacuaaugaaa

SEQ ID NO: 1491596 - RNA, 19 nt, Homo sapiens
uaagaaccaguuauccuaa

SEQ ID NO: 1491597 - RNA, 19 nt, Homo sapiens
gagaggaaccuucuaccau

SEQ ID NO: 1491598 - RNA, 19 nt, Homo sapiens
uguaaucguugaggaaauu

SEQ ID NO: 1491599 - RNA, 19 nt, Homo sapiens
gcaccucuaauuaugguuu

SEQ ID NO: 1491600 - RNA, 19 nt, Homo sapiens
caauucgucugguguuuua

SEQ ID NO: 1491601 - RNA, 19 nt, Homo sapiens
caagaaagggaugaaggua

SEQ ID NO: 1491602 - RNA, 19 nt, Homo sapiens
cugaaugcaccuauuauaa

SEQ ID NO: 1491603 - RNA, 19 nt, Homo sapiens
gaaccaguuauccuaagaa

SEQ ID NO: 1491604 - RNA, 19 nt, Homo sapiens
gcucacaauguaacacuaa

SEQ ID NO: 1491605 - RNA, 19 nt, Homo sapiens
gaaguccuaucuguaccaa

SEQ ID NO: 1491606 - RNA, 19 nt, Homo sapiens
uuaagaaccaguuauccua

SEQ ID NO: 1491607 - RNA, 19 nt, Homo sapiens
cauugcaccucuaauuaug

SEQ ID NO: 1491608 - RNA, 19 nt, Homo sapiens
ccacacccauaaaccaguu

SEQ ID NO: 1491609 - RNA, 19 nt, Homo sapiens
gcuguuguauaauuaguuc

SEQ ID NO: 1491610 - RNA, 19 nt, Homo sapiens
gauaaagaguaggagaauc

SEQ ID NO: 1491611 - RNA, 19 nt, Homo sapiens
gagcaugggcagaggaaug

SEQ ID NO: 1491612 - RNA, 19 nt, Homo sapiens
gcaugaagacuccaucaag

SEQ ID NO: 1491613 - RNA, 19 nt, Homo sapiens
gggaugaagguacaacuug

SEQ ID NO: 1491614 - RNA, 19 nt, Homo sapiens
uaaaccaguucaagaaagg

SEQ ID NO: 1491615 - RNA, 19 nt, Homo sapiens
cauaaaccaguucaagaaa

SEQ ID NO: 1491616 - RNA, 19 nt, Homo sapiens
gugaugguuuaguggauuu

SEQ ID NO: 1491617 - RNA, 19 nt, Homo sapiens
acaaauugcugcugcuuuu

SEQ ID NO: 1491618 - RNA, 19 nt, Homo sapiens
ccuguguuguuaagugaua

SEQ ID NO: 1491619 - RNA, 19 nt, Homo sapiens
gcuggaaaauuauucauug

SEQ ID NO: 1491620 - RNA, 19 nt, Homo sapiens
guauaaguacuucuuggaa

SEQ ID NO: 1491621 - RNA, 19 nt, Homo sapiens
ccucacuugucacuaauga

SEQ ID NO: 1491622 - RNA, 19 nt, Homo sapiens
ggacacaaacaugagaaga

SEQ ID NO: 1491623 - RNA, 19 nt, Homo sapiens
caucucaucucccagugau

SEQ ID NO: 1491624 - RNA, 19 nt, Homo sapiens
gaggaaccuucuaccaucu

SEQ ID NO: 1491625 - RNA, 19 nt, Homo sapiens
uaagcugguuggaguagga

SEQ ID NO: 1491626 - RNA, 19 nt, Homo sapiens
ugaaauauggucaggacaa

SEQ ID NO: 1491627 - RNA, 19 nt, Homo sapiens
aauuaaagcucuguugaca

SEQ ID NO: 1491628 - RNA, 19 nt, Homo sapiens
ugaagacuccaucaaguau

SEQ ID NO: 1491629 - RNA, 19 nt, Homo sapiens
uaacuuaacgcaugaagac

SEQ ID NO: 1491630 - RNA, 19 nt, Homo sapiens
ggaaccuucuaccaucuca

SEQ ID NO: 1491631 - RNA, 19 nt, Homo sapiens
cauagcgguuguaaucguu

SEQ ID NO: 1491632 - RNA, 19 nt, Homo sapiens
agucugugcuggaaaauua

SEQ ID NO: 1491633 - RNA, 19 nt, Homo sapiens
uuaccgauguggugagaga

SEQ ID NO: 1491634 - RNA, 19 nt, Homo sapiens
gaaggaugugaccauauga

SEQ ID NO: 1491635 - RNA, 19 nt, Homo sapiens
ucuauaacuuaacgcauga

SEQ ID NO: 1491636 - RNA, 19 nt, Homo sapiens
gccaauucgucugguguuu

SEQ ID NO: 1491637 - RNA, 19 nt, Homo sapiens
ggaggacacaaacaugaga

SEQ ID NO: 1491638 - RNA, 19 nt, Homo sapiens
uuuccuaucuauugccuuu

SEQ ID NO: 1491639 - RNA, 19 nt, Homo sapiens
gaagacaucucauuuacaa

SEQ ID NO: 1491640 - RNA, 19 nt, Homo sapiens
gaacaaagaguuaucauug

SEQ ID NO: 1491641 - RNA, 19 nt, Homo sapiens
ggacagcuuugauuucaua

SEQ ID NO: 1491642 - RNA, 19 nt, Homo sapiens
ggauacaccugagacauua

SEQ ID NO: 1491643 - RNA, 19 nt, Homo sapiens
ggaauauucugaacuccua

SEQ ID NO: 1491644 - RNA, 19 nt, Homo sapiens
aaacugugcuguuaacgua

SEQ ID NO: 1491645 - RNA, 19 nt, Homo sapiens
uuucaacccuccuguauua

SEQ ID NO: 1491646 - RNA, 19 nt, Homo sapiens
gcaacaagaugccuuugga

SEQ ID NO: 1491647 - RNA, 19 nt, Homo sapiens
gaagaggacagcuuugauu

SEQ ID NO: 1491648 - RNA, 19 nt, Homo sapiens
cuacuaaacucacuaaucu

SEQ ID NO: 1491649 - RNA, 19 nt, Homo sapiens
auauagaccucguuacaua

SEQ ID NO: 1491650 - RNA, 19 nt, Homo sapiens
caacagaggccaacugaau

SEQ ID NO: 1491651 - RNA, 19 nt, Homo sapiens
aaacagcuguggauuucua

SEQ ID NO: 1491652 - RNA, 19 nt, Homo sapiens
uggcuuaacucgcugauuu

SEQ ID NO: 1491653 - RNA, 19 nt, Homo sapiens
gaggacagcuuugauuuca

SEQ ID NO: 1491654 - RNA, 19 nt, Homo sapiens
gaggccaacugaauaugua

SEQ ID NO: 1491655 - RNA, 19 nt, Homo sapiens
gaugcgauuucaccuuaua

SEQ ID NO: 1491656 - RNA, 19 nt, Homo sapiens
gcauggaugucuguaauau

SEQ ID NO: 1491657 - RNA, 19 nt, Homo sapiens
ucagaagacaucucauuua

SEQ ID NO: 1491658 - RNA, 19 nt, Homo sapiens
acagaugacuucaguaugu

SEQ ID NO: 1491659 - RNA, 19 nt, Homo sapiens
gaucauuagguuucucuua

SEQ ID NO: 1491660 - RNA, 19 nt, Homo sapiens
uaacuucaguguacaagau

SEQ ID NO: 1491661 - RNA, 19 nt, Homo sapiens
gcagauuguuugcccuaaa

SEQ ID NO: 1491662 - RNA, 19 nt, Homo sapiens
caaggaacaagacugaaua

SEQ ID NO: 1491663 - RNA, 19 nt, Homo sapiens
gcuaacacacugcuauuaa

SEQ ID NO: 1491664 - RNA, 19 nt, Homo sapiens
gcaccuauccuggcaaauu

SEQ ID NO: 1491665 - RNA, 19 nt, Homo sapiens
ggugcacgcuuaucuuuau

SEQ ID NO: 1491666 - RNA, 19 nt, Homo sapiens
guacauucaugcugugaug

SEQ ID NO: 1491667 - RNA, 19 nt, Homo sapiens
caacccuccuguauuauug

SEQ ID NO: 1491668 - RNA, 19 nt, Homo sapiens
cgaaauggcagauuguuug

SEQ ID NO: 1491669 - RNA, 19 nt, Homo sapiens
cagaagacaucucauuuac

SEQ ID NO: 1491670 - RNA, 19 nt, Homo sapiens
ggaacaaagaguuaucauu

SEQ ID NO: 1491671 - RNA, 19 nt, Homo sapiens
gcaugcaacugguacugaa

SEQ ID NO: 1491672 - RNA, 19 nt, Homo sapiens
caccuauccuggcaaauuu

SEQ ID NO: 1491673 - RNA, 19 nt, Homo sapiens
acacacacauauacauuug

SEQ ID NO: 1491674 - RNA, 19 nt, Homo sapiens
cuacuuaggcaauguaauu

SEQ ID NO: 1491675 - RNA, 19 nt, Homo sapiens
uaauacagaugacuucagu

SEQ ID NO: 1491676 - RNA, 19 nt, Homo sapiens
gagaauggaccaggaugua

SEQ ID NO: 1491677 - RNA, 19 nt, Homo sapiens
acaaagaguuaucauugga

SEQ ID NO: 1491678 - RNA, 19 nt, Homo sapiens
aauaguaggucaauguguu

SEQ ID NO: 1491679 - RNA, 19 nt, Homo sapiens
gcaaagccucuacauacaa

SEQ ID NO: 1491680 - RNA, 19 nt, Homo sapiens
aaaaugagguuucacugua

SEQ ID NO: 1491681 - RNA, 19 nt, Homo sapiens
gcuccagugugucuguaua

SEQ ID NO: 1491682 - RNA, 19 nt, Homo sapiens
ucagugaaaccucauauga

SEQ ID NO: 1491683 - RNA, 19 nt, Homo sapiens
cagugugucuguauaagaa

SEQ ID NO: 1491684 - RNA, 19 nt, Homo sapiens
ccuguuauguugugaaaug

SEQ ID NO: 1491685 - RNA, 19 nt, Homo sapiens
gaccuuauccugacuuuua

SEQ ID NO: 1491686 - RNA, 19 nt, Homo sapiens
gggaaaacaucuacaguug

SEQ ID NO: 1491687 - RNA, 19 nt, Homo sapiens
gcaaacaugucagugaaac

SEQ ID NO: 1491688 - RNA, 19 nt, Homo sapiens
caagaugccuuuggaaacu

SEQ ID NO: 1491689 - RNA, 19 nt, Homo sapiens
cagaaacagcuguggauuu

SEQ ID NO: 1491690 - RNA, 19 nt, Homo sapiens
agaaggagauguguugaug

SEQ ID NO: 1491691 - RNA, 19 nt, Homo sapiens
ugaagaagaggacagcuuu

SEQ ID NO: 1491692 - RNA, 19 nt, Homo sapiens
ggaauguguuuguuaucug

SEQ ID NO: 1491693 - RNA, 19 nt, Homo sapiens
caauauagaccucguuaca

SEQ ID NO: 1491694 - RNA, 19 nt, Homo sapiens
ucaguggacaggucauuua

SEQ ID NO: 1491695 - RNA, 19 nt, Homo sapiens
uaaacucacuaaucuacug

SEQ ID NO: 1491696 - RNA, 19 nt, Homo sapiens
cuaacacacugcuauuaau

SEQ ID NO: 1491697 - RNA, 19 nt, Homo sapiens
caacuaucaucaccaccaa

SEQ ID NO: 1491698 - RNA, 19 nt, Homo sapiens
ccaaggcacauuaguuuga

SEQ ID NO: 1491699 - RNA, 19 nt, Homo sapiens
uagguggcuuugacucuua

SEQ ID NO: 1491700 - RNA, 19 nt, Homo sapiens
caucuacgccuguuauguu

SEQ ID NO: 1491701 - RNA, 19 nt, Homo sapiens
gauguacggugacgucagu

SEQ ID NO: 1491702 - RNA, 19 nt, Homo sapiens
guggacaggucauuuaugg

SEQ ID NO: 1491703 - RNA, 19 nt, Homo sapiens
caccaaaucacaacuauca

SEQ ID NO: 1491704 - RNA, 19 nt, Homo sapiens
gauuucaccuuauaguaca

SEQ ID NO: 1491705 - RNA, 19 nt, Homo sapiens
ggauaucagugggcaccua

SEQ ID NO: 1491706 - RNA, 19 nt, Homo sapiens
gauagaggaacaaagaguu

SEQ ID NO: 1491707 - RNA, 19 nt, Homo sapiens
uaacccaccuacauugugu

SEQ ID NO: 1491708 - RNA, 19 nt, Homo sapiens
gacaucucauuuacaacua

SEQ ID NO: 1491709 - RNA, 19 nt, Homo sapiens
aggcugagcuuuuguuaua

SEQ ID NO: 1491710 - RNA, 19 nt, Homo sapiens
cauaauuagcucaggcuua

SEQ ID NO: 1491711 - RNA, 19 nt, Homo sapiens
ggggaucuguuguguguua

SEQ ID NO: 1491712 - RNA, 19 nt, Homo sapiens
gggcaccuauccuggcaaa

SEQ ID NO: 1491713 - RNA, 19 nt, Homo sapiens
acauacaccaguuccauua

SEQ ID NO: 1491714 - RNA, 19 nt, Homo sapiens
ggaucuacauacaccaguu

SEQ ID NO: 1491715 - RNA, 19 nt, Homo sapiens
uaacacaccauucuuuagu

SEQ ID NO: 1491716 - RNA, 19 nt, Homo sapiens
ggugaaauauuugagaucu

SEQ ID NO: 1491717 - RNA, 19 nt, Homo sapiens
guacauacuugccuuaacc

SEQ ID NO: 1491718 - RNA, 19 nt, Homo sapiens
acacgcccaucuuggauuu

SEQ ID NO: 1491719 - RNA, 19 nt, Homo sapiens
guugugaaauguauaacug

SEQ ID NO: 1491720 - RNA, 19 nt, Homo sapiens
gcgauuucaccuuauagua

SEQ ID NO: 1491721 - RNA, 19 nt, Homo sapiens
ggaacaagacugaauagcu

SEQ ID NO: 1491722 - RNA, 19 nt, Homo sapiens
gcaggacacgcccaucuug

SEQ ID NO: 1491723 - RNA, 19 nt, Homo sapiens
gaccuccucuuucuaacug

SEQ ID NO: 1491724 - RNA, 19 nt, Homo sapiens
acacaccaauuccacuuga

SEQ ID NO: 1491725 - RNA, 19 nt, Homo sapiens
gcacacaccaauuccacuu

SEQ ID NO: 1491726 - RNA, 19 nt, Homo sapiens
caaaucacaacuaucauca

SEQ ID NO: 1491727 - RNA, 19 nt, Homo sapiens
cgucauucuugguuuguuu

SEQ ID NO: 1491728 - RNA, 19 nt, Homo sapiens
ucaguggguuguauguuug

SEQ ID NO: 1491729 - RNA, 19 nt, Homo sapiens
uaguuaccuuggugaaaua

SEQ ID NO: 1491730 - RNA, 19 nt, Homo sapiens
ucauauuccugcuuuaagu

SEQ ID NO: 1491731 - RNA, 19 nt, Homo sapiens
gaguuaucauuggaacaua

SEQ ID NO: 1491732 - RNA, 19 nt, Homo sapiens
guaggucaauguguuuaug

SEQ ID NO: 1491733 - RNA, 19 nt, Homo sapiens
gagcaauaguuaccuuggu

SEQ ID NO: 1491734 - RNA, 19 nt, Homo sapiens
ggacagaguaaaacauuaa

SEQ ID NO: 1491735 - RNA, 19 nt, Homo sapiens
ggaaaguucagaaggagau

SEQ ID NO: 1491736 - RNA, 19 nt, Homo sapiens
acauagaaguggcucauag

SEQ ID NO: 1491737 - RNA, 19 nt, Homo sapiens
cucaguggguuguauguuu

SEQ ID NO: 1491738 - RNA, 19 nt, Homo sapiens
auucugaacuccuaggaaa

SEQ ID NO: 1491739 - RNA, 19 nt, Homo sapiens
uagaagaucuccugaaaua

SEQ ID NO: 1491740 - RNA, 19 nt, Homo sapiens
ggucagacauucaagguua

SEQ ID NO: 1491741 - RNA, 19 nt, Homo sapiens
ggacggacccuguuacuuu

SEQ ID NO: 1491742 - RNA, 19 nt, Homo sapiens
ggaauuucauccuuucuuu

SEQ ID NO: 1491743 - RNA, 19 nt, Homo sapiens
gaaacuggcacauucauaa

SEQ ID NO: 1491744 - RNA, 19 nt, Homo sapiens
gaaagaaaccaaucuggaa

SEQ ID NO: 1491745 - RNA, 19 nt, Homo sapiens
gaaaccaucucccgucaga

SEQ ID NO: 1491746 - RNA, 19 nt, Homo sapiens
ggagggauguggaaucuau

SEQ ID NO: 1491747 - RNA, 19 nt, Homo sapiens
ggugaaggcucaguacuuu

SEQ ID NO: 1491748 - RNA, 19 nt, Homo sapiens
caucagcugugacaaauga

SEQ ID NO: 1491749 - RNA, 19 nt, Homo sapiens
gacggacccuguuacuuua

SEQ ID NO: 1491750 - RNA, 19 nt, Homo sapiens
ccuagaaacuucccagaaa

SEQ ID NO: 1491751 - RNA, 19 nt, Homo sapiens
gcugacagaugcaagguuu

SEQ ID NO: 1491752 - RNA, 19 nt, Homo sapiens
ggacauagaagaaucaaca

SEQ ID NO: 1491753 - RNA, 19 nt, Homo sapiens
ccauugaaccguacacuua

SEQ ID NO: 1491754 - RNA, 19 nt, Homo sapiens
gaaaagaguucuggaggua

SEQ ID NO: 1491755 - RNA, 19 nt, Homo sapiens
gaaaguagcagguauuggu

SEQ ID NO: 1491756 - RNA, 19 nt, Homo sapiens
gaagaucuccugaaauaag

SEQ ID NO: 1491757 - RNA, 19 nt, Homo sapiens
gcuaauuucucagcuguaa

SEQ ID NO: 1491758 - RNA, 19 nt, Homo sapiens
gagcugggaugaagacuca

SEQ ID NO: 1491759 - RNA, 19 nt, Homo sapiens
gaaaugugcggccugauga

SEQ ID NO: 1491760 - RNA, 19 nt, Homo sapiens
ggucacggccgacuuagua

SEQ ID NO: 1491761 - RNA, 19 nt, Homo sapiens
ggagaaagggcauuugaug

SEQ ID NO: 1491762 - RNA, 19 nt, Homo sapiens
ggagguagauggaggugau

SEQ ID NO: 1491763 - RNA, 19 nt, Homo sapiens
cuacaucugugugauagua

SEQ ID NO: 1491764 - RNA, 19 nt, Homo sapiens
cgacuuaguaauucacuua

SEQ ID NO: 1491765 - RNA, 19 nt, Homo sapiens
cuuagaagaucuccugaaa

SEQ ID NO: 1491766 - RNA, 19 nt, Homo sapiens
guaauucacuuagaagauc

SEQ ID NO: 1491767 - RNA, 19 nt, Homo sapiens
gaaagggacaaauaagguu

SEQ ID NO: 1491768 - RNA, 19 nt, Homo sapiens
gaacccugcuauaaacugu

SEQ ID NO: 1491769 - RNA, 19 nt, Homo sapiens
agagggagauuagcaauga

SEQ ID NO: 1491770 - RNA, 19 nt, Homo sapiens
aaaccaaucuggaaagucu

SEQ ID NO: 1491771 - RNA, 19 nt, Homo sapiens
guacagaugaagaaauuga

SEQ ID NO: 1491772 - RNA, 19 nt, Homo sapiens
agugugagcugaaguguga

SEQ ID NO: 1491773 - RNA, 19 nt, Homo sapiens
gcaaauggucaaagggaaa

SEQ ID NO: 1491774 - RNA, 19 nt, Homo sapiens
gacaccagguugcuucuug

SEQ ID NO: 1491775 - RNA, 19 nt, Homo sapiens
guucagacggcuaacuuua

SEQ ID NO: 1491776 - RNA, 19 nt, Homo sapiens
guagauggaggugauauuu

SEQ ID NO: 1491777 - RNA, 19 nt, Homo sapiens
ggaaagggacaaauaaggu

SEQ ID NO: 1491778 - RNA, 19 nt, Homo sapiens
ucagacggcuaacuuuaug

SEQ ID NO: 1491779 - RNA, 19 nt, Homo sapiens
gaucaugaugugucaauau

SEQ ID NO: 1491780 - RNA, 19 nt, Homo sapiens
cgcaaucacuaaguaauuu

SEQ ID NO: 1491781 - RNA, 19 nt, Homo sapiens
gaauagagaggcaguaaaa

SEQ ID NO: 1491782 - RNA, 19 nt, Homo sapiens
gauuagcaaugaagcuuuc

SEQ ID NO: 1491783 - RNA, 19 nt, Homo sapiens
cauaauggacauagaagaa

SEQ ID NO: 1491784 - RNA, 19 nt, Homo sapiens
gggaggcugugcauauguu

SEQ ID NO: 1491785 - RNA, 19 nt, Homo sapiens
gggcagacacuaaugguau

SEQ ID NO: 1491786 - RNA, 19 nt, Homo sapiens
gagcugaagugugaagaca

SEQ ID NO: 1491787 - RNA, 19 nt, Homo sapiens
uaaaagcucuggaaacugu

SEQ ID NO: 1491788 - RNA, 19 nt, Homo sapiens
ugucgggccuggagcauuu

SEQ ID NO: 1491789 - RNA, 19 nt, Homo sapiens
gaacggacaacaccaagag

SEQ ID NO: 1491790 - RNA, 19 nt, Homo sapiens
gaagacagggcagacacua

SEQ ID NO: 1491791 - RNA, 19 nt, Homo sapiens
gaagaugucgucccugucu

SEQ ID NO: 1491792 - RNA, 19 nt, Homo sapiens
gaagcuuucugacgucucu

SEQ ID NO: 1491793 - RNA, 19 nt, Homo sapiens
caacagcccaugaagacuu

SEQ ID NO: 1491794 - RNA, 19 nt, Homo sapiens
gugaauacuuagugccauu

SEQ ID NO: 1491795 - RNA, 19 nt, Homo sapiens
cuguacagaugaagaaauu

SEQ ID NO: 1491796 - RNA, 19 nt, Homo sapiens
aaagaguucuggagguaga

SEQ ID NO: 1491797 - RNA, 19 nt, Homo sapiens
acuuuaaucuugggaguua

SEQ ID NO: 1491798 - RNA, 19 nt, Homo sapiens
uauaaacuguggccucugu

SEQ ID NO: 1491799 - RNA, 19 nt, Homo sapiens
uaagaaaguagcagguauu

SEQ ID NO: 1491800 - RNA, 19 nt, Homo sapiens
acaacaaccuagcaaagug

SEQ ID NO: 1491801 - RNA, 19 nt, Homo sapiens
agauggaggugauauuugu

SEQ ID NO: 1491802 - RNA, 19 nt, Homo sapiens
uaccuucugcccaauauua

SEQ ID NO: 1491803 - RNA, 19 nt, Homo sapiens
ggaacucucuauaccuucu

SEQ ID NO: 1491804 - RNA, 19 nt, Homo sapiens
ggcagacacuaaugguauu

SEQ ID NO: 1491805 - RNA, 19 nt, Homo sapiens
ugcaugaucugagcuaauu

SEQ ID NO: 1491806 - RNA, 19 nt, Homo sapiens
aaagaucagcaaagaguaa

SEQ ID NO: 1491807 - RNA, 19 nt, Homo sapiens
aaagaaaccaaucuggaaa

SEQ ID NO: 1491808 - RNA, 19 nt, Homo sapiens
guacaacaaugugaauacu

SEQ ID NO: 1491809 - RNA, 19 nt, Homo sapiens
guggguacauggcauuaug

SEQ ID NO: 1491810 - RNA, 19 nt, Homo sapiens
gccacucccugccaucuga

SEQ ID NO: 1491811 - RNA, 19 nt, Homo sapiens
gacggucacggccgacuua

SEQ ID NO: 1491812 - RNA, 19 nt, Homo sapiens
gcucaguacuuuuccuuuu

SEQ ID NO: 1491813 - RNA, 19 nt, Homo sapiens
ccaugccuuugauaagaua

SEQ ID NO: 1491814 - RNA, 19 nt, Homo sapiens
guucaucagcugugacaaa

SEQ ID NO: 1491815 - RNA, 19 nt, Homo sapiens
gggaaaggaagaagacuca

SEQ ID NO: 1491816 - RNA, 19 nt, Homo sapiens
guaccaggcucaaaaggaa

SEQ ID NO: 1491817 - RNA, 19 nt, Homo sapiens
gcauuuccuccuucacuuu

SEQ ID NO: 1491818 - RNA, 19 nt, Homo sapiens
uaauggacauagaagaauc

SEQ ID NO: 1491819 - RNA, 19 nt, Homo sapiens
gaaauugaaggucagacau

SEQ ID NO: 1491820 - RNA, 19 nt, Homo sapiens
ggagacuacaucuguguga

SEQ ID NO: 1491821 - RNA, 19 nt, Homo sapiens
ccuucaagaucaacaguga

SEQ ID NO: 1491822 - RNA, 19 nt, Homo sapiens
cacuugaccucuucaggaa

SEQ ID NO: 1491823 - RNA, 19 nt, Homo sapiens
cauaagaaaguagcaggua

SEQ ID NO: 1491824 - RNA, 19 nt, Homo sapiens
aacagcccaugaagacuua

SEQ ID NO: 1491825 - RNA, 19 nt, Homo sapiens
ggccuacaguggcuuacaa

SEQ ID NO: 1491826 - RNA, 19 nt, Homo sapiens
ucuugggaguuauuguuua

SEQ ID NO: 1491827 - RNA, 19 nt, Homo sapiens
guaauuuucucauccuuga

SEQ ID NO: 1491828 - RNA, 19 nt, Homo sapiens
cauccuuucuuuccauuca

SEQ ID NO: 1491829 - RNA, 19 nt, Homo sapiens
gaggugauauuuguacaac

SEQ ID NO: 1491830 - RNA, 19 nt, Homo sapiens
gaucaucuucaccacugua

SEQ ID NO: 1491831 - RNA, 19 nt, Homo sapiens
ugggaacucucuauaccuu

SEQ ID NO: 1491832 - RNA, 19 nt, Homo sapiens
gacuacaucugugugauag

SEQ ID NO: 1491833 - RNA, 19 nt, Homo sapiens
agacuacaucugugugaua

SEQ ID NO: 1491834 - RNA, 19 nt, Homo sapiens
gagauuagcaaugaagcuu

SEQ ID NO: 1491835 - RNA, 19 nt, Homo sapiens
ccacacccuucaagaucaa

SEQ ID NO: 1491836 - RNA, 19 nt, Homo sapiens
auaagaaaguagcagguau

SEQ ID NO: 1491837 - RNA, 19 nt, Homo sapiens
ggugauaugugggaacucu

SEQ ID NO: 1491838 - RNA, 19 nt, Homo sapiens
ccagcuauaugacauucug

SEQ ID NO: 1491839 - RNA, 19 nt, Homo sapiens
gaaaggaggccuagcaugu

SEQ ID NO: 1491840 - RNA, 19 nt, Homo sapiens
gagagucaauucacaaugu

SEQ ID NO: 1491841 - RNA, 19 nt, Homo sapiens
gaauagcucauuacaggua

SEQ ID NO: 1491842 - RNA, 19 nt, Homo sapiens
gcacuggucuugguguuug

SEQ ID NO: 1491843 - RNA, 19 nt, Homo sapiens
ugacucaauugcugauaua

SEQ ID NO: 1491844 - RNA, 19 nt, Homo sapiens
ggaggcauauacacagauu

SEQ ID NO: 1491845 - RNA, 19 nt, Homo sapiens
ggucgcagcuaaacacgaa

SEQ ID NO: 1491846 - RNA, 19 nt, Homo sapiens
gauaaaguauucucucacu

SEQ ID NO: 1491847 - RNA, 19 nt, Homo sapiens
cagcagauacuaacagaaa

SEQ ID NO: 1491848 - RNA, 19 nt, Homo sapiens
aaacuaaaguccagcagau

SEQ ID NO: 1491849 - RNA, 19 nt, Homo sapiens
gaaauuccaagcucauuca

SEQ ID NO: 1491850 - RNA, 19 nt, Homo sapiens
ugauauagguaaagaaugg

SEQ ID NO: 1491851 - RNA, 19 nt, Homo sapiens
guaccaccguuauaaguuc

SEQ ID NO: 1491852 - RNA, 19 nt, Homo sapiens
ugaauuggcagaccgcaua

SEQ ID NO: 1491853 - RNA, 19 nt, Homo sapiens
ucacuugucacuugaauug

SEQ ID NO: 1491854 - RNA, 19 nt, Homo sapiens
auuccaagcucauucagua

SEQ ID NO: 1491855 - RNA, 19 nt, Homo sapiens
uguuugcccuuuauuauga

SEQ ID NO: 1491856 - RNA, 19 nt, Homo sapiens
ccaagcucauucaguagaa

SEQ ID NO: 1491857 - RNA, 19 nt, Homo sapiens
gaagaaauuccaagcucau

SEQ ID NO: 1491858 - RNA, 19 nt, Homo sapiens
gguguuugcccuuuauuau

SEQ ID NO: 1491859 - RNA, 19 nt, Homo sapiens
gagaacagagcgagaugga

SEQ ID NO: 1491860 - RNA, 19 nt, Homo sapiens
guuagcagucaaagaauuu

SEQ ID NO: 1491861 - RNA, 19 nt, Homo sapiens
aguauucucucacuuguca

SEQ ID NO: 1491862 - RNA, 19 nt, Homo sapiens
gcugauauagguaaagaau

SEQ ID NO: 1491863 - RNA, 19 nt, Homo sapiens
ggccuagcauguucgagaa

SEQ ID NO: 1491864 - RNA, 19 nt, Homo sapiens
uuacagguacuaaggauug

SEQ ID NO: 1491865 - RNA, 19 nt, Homo sapiens
gcagaccgcauacuguuag

SEQ ID NO: 1491866 - RNA, 19 nt, Homo sapiens
aaagacuggccaagcaaua

SEQ ID NO: 1491867 - RNA, 19 nt, Homo sapiens
gauacuaacagaaagucuu

SEQ ID NO: 1491868 - RNA, 19 nt, Homo sapiens
caauucacaauguucagua

SEQ ID NO: 1491869 - RNA, 19 nt, Homo sapiens
gggacuggcuagggcguuu

SEQ ID NO: 1491870 - RNA, 19 nt, Homo sapiens
uaagagaaagacugagaga

SEQ ID NO: 1491871 - RNA, 19 nt, Homo sapiens
gguaccaccguuauaaguu

SEQ ID NO: 1491872 - RNA, 19 nt, Homo sapiens
uguuagcagucaaagaauu

SEQ ID NO: 1491873 - RNA, 19 nt, Homo sapiens
gcagauacuaacagaaagu

SEQ ID NO: 1491874 - RNA, 19 nt, Homo sapiens
caagcucauucaguagaaa

SEQ ID NO: 1491875 - RNA, 19 nt, Homo sapiens
gagagagucaauucacaau

SEQ ID NO: 1491876 - RNA, 19 nt, Homo sapiens
agagaaagacugagagagu

SEQ ID NO: 1491877 - RNA, 19 nt, Homo sapiens
ggcagaccgcauacuguua

SEQ ID NO: 1491878 - RNA, 19 nt, Homo sapiens
caauugcugauauagguaa

SEQ ID NO: 1491879 - RNA, 19 nt, Homo sapiens
aaagaaaggaggccuagca

SEQ ID NO: 1491880 - RNA, 19 nt, Homo sapiens
ggugacgccuaggaaagaa

SEQ ID NO: 1491881 - RNA, 19 nt, Homo sapiens
agagucaauucacaauguu

SEQ ID NO: 1491882 - RNA, 19 nt, Homo sapiens
acuaaggauuguuuacuuc

SEQ ID NO: 1491883 - RNA, 19 nt, Homo sapiens
uaaaguccagcagauacua

SEQ ID NO: 1491884 - RNA, 19 nt, Homo sapiens
cauuacagguacuaaggau

SEQ ID NO: 1491885 - RNA, 19 nt, Homo sapiens
aaggaggccuagcauguuc

SEQ ID NO: 1491886 - RNA, 19 nt, Homo sapiens
ucaaaagacuggccaagca

SEQ ID NO: 1491887 - RNA, 19 nt, Homo sapiens
cucauucaguagaaacuaa

SEQ ID NO: 1491888 - RNA, 19 nt, Homo sapiens
uggagccauugaagaaauu

SEQ ID NO: 1491889 - RNA, 19 nt, Homo sapiens
ugagagagucaauucacaa

SEQ ID NO: 1491890 - RNA, 19 nt, Homo sapiens
cagguacuaaggauuguuu

SEQ ID NO: 1491891 - RNA, 19 nt, Homo sapiens
cgagaaggaggcauauaca

SEQ ID NO: 1491892 - RNA, 19 nt, Homo sapiens
aaaggaggccuagcauguu

SEQ ID NO: 1491893 - RNA, 19 nt, Homo sapiens
cucaauugcugauauaggu

SEQ ID NO: 1491894 - RNA, 19 nt, Homo sapiens
agaaggaggcauauacaca

SEQ ID NO: 1491895 - RNA, 19 nt, Homo sapiens
aaggaggcauauacacaga

SEQ ID NO: 1491896 - RNA, 19 nt, Homo sapiens
guacuaaggauuguuuacu

SEQ ID NO: 1491897 - RNA, 19 nt, Homo sapiens
ucucucacuugucacuuga

SEQ ID NO: 1491898 - RNA, 19 nt, Homo sapiens
agacuggccaagcaauaaa

SEQ ID NO: 1491899 - RNA, 19 nt, Homo sapiens
cuacguggcacuggucuug

SEQ ID NO: 1491900 - RNA, 19 nt, Homo sapiens
uccagcagauacuaacaga

SEQ ID NO: 1491901 - RNA, 19 nt, Homo sapiens
aaaguccagcagauacuaa

SEQ ID NO: 1491902 - RNA, 19 nt, Homo sapiens
gcucauucaguagaaacua

SEQ ID NO: 1491903 - RNA, 19 nt, Homo sapiens
aagacuggccaagcaauaa

SEQ ID NO: 1491904 - RNA, 19 nt, Homo sapiens
uggcagaccgcauacuguu

SEQ ID NO: 1491905 - RNA, 19 nt, Homo sapiens
ucaauugcugauauaggua

SEQ ID NO: 1491906 - RNA, 19 nt, Homo sapiens
ccaccguuauaaguucauu

SEQ ID NO: 1491907 - RNA, 19 nt, Homo sapiens
uucacaauguucaguaugu

SEQ ID NO: 1491908 - RNA, 19 nt, Homo sapiens
cugagagagucaauucaca

SEQ ID NO: 1491909 - RNA, 19 nt, Homo sapiens
uugcugauauagguaaaga

SEQ ID NO: 1491910 - RNA, 19 nt, Homo sapiens
guguuugcccuuuauuaug

SEQ ID NO: 1491911 - RNA, 19 nt, Homo sapiens
ucuugguguuugcccuuua

SEQ ID NO: 1491912 - RNA, 19 nt, Homo sapiens
ggguaccaccguuauaagu

SEQ ID NO: 1491913 - RNA, 19 nt, Homo sapiens
gcuaaacacgaagcagaau

SEQ ID NO: 1491914 - RNA, 19 nt, Homo sapiens
gaugacucaauugcugaua

SEQ ID NO: 1491915 - RNA, 19 nt, Homo sapiens
ggaagauacucccucauua

SEQ ID NO: 1491916 - RNA, 19 nt, Homo sapiens
gggaagaccuuugaaauuu

SEQ ID NO: 1491917 - RNA, 19 nt, Homo sapiens
guacaugucugaaauucua

SEQ ID NO: 1491918 - RNA, 19 nt, Homo sapiens
gaaguuagccuuucucaga

SEQ ID NO: 1491919 - RNA, 19 nt, Homo sapiens
ugacugugcuaaagaauaa

SEQ ID NO: 1491920 - RNA, 19 nt, Homo sapiens
gauaagagauuuugaguga

SEQ ID NO: 1491921 - RNA, 19 nt, Homo sapiens
gagacugacuucaagguuu

SEQ ID NO: 1491922 - RNA, 19 nt, Homo sapiens
gauacucccucauuacuug

SEQ ID NO: 1491923 - RNA, 19 nt, Homo sapiens
ugaaguauauccaaaguuc

SEQ ID NO: 1491924 - RNA, 19 nt, Homo sapiens
ucaaagauccgccaaauca

SEQ ID NO: 1491925 - RNA, 19 nt, Homo sapiens
aaagagauuucccaaaguu

SEQ ID NO: 1491926 - RNA, 19 nt, Homo sapiens
ccaaaucauucauagcaaa

SEQ ID NO: 1491927 - RNA, 19 nt, Homo sapiens
ggagaaggaacaauuagaa

SEQ ID NO: 1491928 - RNA, 19 nt, Homo sapiens
cagaguggcuugccggaaa

SEQ ID NO: 1491929 - RNA, 19 nt, Homo sapiens
gauuuaagaucgagacaag

SEQ ID NO: 1491930 - RNA, 19 nt, Homo sapiens
gcaauugucuugggugaag

SEQ ID NO: 1491931 - RNA, 19 nt, Homo sapiens
gauuucaguuucugccuaa

SEQ ID NO: 1491932 - RNA, 19 nt, Homo sapiens
gagagaaccaacuaucuga

SEQ ID NO: 1491933 - RNA, 19 nt, Homo sapiens
gcgagucccugcugucuuc

SEQ ID NO: 1491934 - RNA, 19 nt, Homo sapiens
caacaaguguaagagaguu

SEQ ID NO: 1491935 - RNA, 19 nt, Homo sapiens
uuaugaagauggagcaauu

SEQ ID NO: 1491936 - RNA, 19 nt, Homo sapiens
ggaagaccuuugaaauuuu

SEQ ID NO: 1491937 - RNA, 19 nt, Homo sapiens
gaagauacucccucauuac

SEQ ID NO: 1491938 - RNA, 19 nt, Homo sapiens
uaaaagagauuucccaaag

SEQ ID NO: 1491939 - RNA, 19 nt, Homo sapiens
cagagacuccagagacuua

SEQ ID NO: 1491940 - RNA, 19 nt, Homo sapiens
gcaaguuacaagucucuaa

SEQ ID NO: 1491941 - RNA, 19 nt, Homo sapiens
gaaagcaguacuccagaga

SEQ ID NO: 1491942 - RNA, 19 nt, Homo sapiens
gaagauggagcaauugucu

SEQ ID NO: 1491943 - RNA, 19 nt, Homo sapiens
gaaaaugucaguucuucua

SEQ ID NO: 1491944 - RNA, 19 nt, Homo sapiens
aauaaacagugguaugaga

SEQ ID NO: 1491945 - RNA, 19 nt, Homo sapiens
ccaguuaucagcagaaguu

SEQ ID NO: 1491946 - RNA, 19 nt, Homo sapiens
aauuguaucugcagcauug

SEQ ID NO: 1491947 - RNA, 19 nt, Homo sapiens
gcaguacuccagagaaugu

SEQ ID NO: 1491948 - RNA, 19 nt, Homo sapiens
gacuauacaccauauuuga

SEQ ID NO: 1491949 - RNA, 19 nt, Homo sapiens
auacguugcuuuaccgaaa

SEQ ID NO: 1491950 - RNA, 19 nt, Homo sapiens
ccuccaggcuccuuuccua

SEQ ID NO: 1491951 - RNA, 19 nt, Homo sapiens
gcuggcucaucuccaaaua

SEQ ID NO: 1491952 - RNA, 19 nt, Homo sapiens
gacaauugaugauucuucu

SEQ ID NO: 1491953 - RNA, 19 nt, Homo sapiens
gagaauccccuccagauaa

SEQ ID NO: 1491954 - RNA, 19 nt, Homo sapiens
acaauaaacagugguauga

SEQ ID NO: 1491955 - RNA, 19 nt, Homo sapiens
gagaaggaacaauuagaau

SEQ ID NO: 1491956 - RNA, 19 nt, Homo sapiens
gugaagacccugauugauc

SEQ ID NO: 1491957 - RNA, 19 nt, Homo sapiens
aaagauccgccaaaucauu

SEQ ID NO: 1491958 - RNA, 19 nt, Homo sapiens
aggaggagcuaaggacuuu

SEQ ID NO: 1491959 - RNA, 19 nt, Homo sapiens
acaagucucuaacaagcuu

SEQ ID NO: 1491960 - RNA, 19 nt, Homo sapiens
cagcagaaguuagccuuuc

SEQ ID NO: 1491961 - RNA, 19 nt, Homo sapiens
ucaaugcuguugccuugga

SEQ ID NO: 1491962 - RNA, 19 nt, Homo sapiens
gagaaugucggaccuccuu

SEQ ID NO: 1491963 - RNA, 19 nt, Homo sapiens
cucauaaacuggagaagga

SEQ ID NO: 1491964 - RNA, 19 nt, Homo sapiens
auuccgaucuggcucauaa

SEQ ID NO: 1491965 - RNA, 19 nt, Homo sapiens
gaaccaacuaucugaaucu

SEQ ID NO: 1491966 - RNA, 19 nt, Homo sapiens
gagaaccaacuaucugaau

SEQ ID NO: 1491967 - RNA, 19 nt, Homo sapiens
ggaagcagugguagcgaaa

SEQ ID NO: 1491968 - RNA, 19 nt, Homo sapiens
gccagagacugacuucaag

SEQ ID NO: 1491969 - RNA, 19 nt, Homo sapiens
ggccagagacugacuucaa

SEQ ID NO: 1491970 - RNA, 19 nt, Homo sapiens
ugggaagaccuuugaaauu

SEQ ID NO: 1491971 - RNA, 19 nt, Homo sapiens
gagaaaaguuaucaaaguc

SEQ ID NO: 1491972 - RNA, 19 nt, Homo sapiens
caggagcucuggaugucaa

SEQ ID NO: 1491973 - RNA, 19 nt, Homo sapiens
cgaucuggcucauaaacug

SEQ ID NO: 1491974 - RNA, 19 nt, Homo sapiens
gaucggucuugcuuugaga

SEQ ID NO: 1491975 - RNA, 19 nt, Homo sapiens
ucuaaugacuaccuugcaa

SEQ ID NO: 1491976 - RNA, 19 nt, Homo sapiens
gcuauugauuucaguuucu

SEQ ID NO: 1491977 - RNA, 19 nt, Homo sapiens
gccaaaucauucauagcaa

SEQ ID NO: 1491978 - RNA, 19 nt, Homo sapiens
aagcaguacuccagagaau

SEQ ID NO: 1491979 - RNA, 19 nt, Homo sapiens
gcuuugagacaauugauga

SEQ ID NO: 1491980 - RNA, 19 nt, Homo sapiens
agaaggagauggaaaacaa

SEQ ID NO: 1491981 - RNA, 19 nt, Homo sapiens
gagaggaggaaccugauca

SEQ ID NO: 1491982 - RNA, 19 nt, Homo sapiens
gagugaagguaaggaagau

SEQ ID NO: 1491983 - RNA, 19 nt, Homo sapiens
cuccagagacuuaagcuaa

SEQ ID NO: 1491984 - RNA, 19 nt, Homo sapiens
ucucagacuucacuagauc

SEQ ID NO: 1491985 - RNA, 19 nt, Homo sapiens
uaaacagugguaugagaaa

SEQ ID NO: 1491986 - RNA, 19 nt, Homo sapiens
gaucaccgugugcagguuu

SEQ ID NO: 1491987 - RNA, 19 nt, Homo sapiens
aaaugucaguucuucuaga

SEQ ID NO: 1491988 - RNA, 19 nt, Homo sapiens
ugagacaauugaugauucu

SEQ ID NO: 1491989 - RNA, 19 nt, Homo sapiens
uuucaaagauccgccaaau

SEQ ID NO: 1491990 - RNA, 19 nt, Homo sapiens
caaaauggaauaggcuuua

SEQ ID NO: 1491991 - RNA, 19 nt, Homo sapiens
ucugguacaugucugaaau

SEQ ID NO: 1491992 - RNA, 19 nt, Homo sapiens
gcaaguccuacaacagaga

SEQ ID NO: 1491993 - RNA, 19 nt, Homo sapiens
agaguuaacugcccaucuc

SEQ ID NO: 1491994 - RNA, 19 nt, Homo sapiens
uaagaucgagacaagaguu

SEQ ID NO: 1491995 - RNA, 19 nt, Homo sapiens
gaucagcugacugugcuaa

SEQ ID NO: 1491996 - RNA, 19 nt, Homo sapiens
ggguagagccuggaucaga

SEQ ID NO: 1491997 - RNA, 19 nt, Homo sapiens
gcugggaagaccuuugaaa

SEQ ID NO: 1491998 - RNA, 19 nt, Homo sapiens
ggaaaacaagacacauuaa

SEQ ID NO: 1491999 - RNA, 19 nt, Homo sapiens
uaacugcccaucucaccaa

SEQ ID NO: 1492000 - RNA, 19 nt, Homo sapiens
uuguggagcuucaagauca

SEQ ID NO: 1492001 - RNA, 19 nt, Homo sapiens
cgagagaaccaacuaucug

SEQ ID NO: 1492002 - RNA, 19 nt, Homo sapiens
auccaaaguucugauagua

SEQ ID NO: 1492003 - RNA, 19 nt, Homo sapiens
guggaucucuaacgucagu

SEQ ID NO: 1492004 - RNA, 19 nt, Homo sapiens
aggaagauacucccucauu

SEQ ID NO: 1492005 - RNA, 19 nt, Homo sapiens
agaaccaacuaucugaauc

SEQ ID NO: 1492006 - RNA, 19 nt, Homo sapiens
ugagaaaguucaaaaugga

SEQ ID NO: 1492007 - RNA, 19 nt, Homo sapiens
cagcuuacccuggaacaga

SEQ ID NO: 1492008 - RNA, 19 nt, Homo sapiens
gaaugucggaccuccuuuc

SEQ ID NO: 1492009 - RNA, 19 nt, Homo sapiens
gaggaggagcuaaggacuu

SEQ ID NO: 1492010 - RNA, 19 nt, Homo sapiens
gaaaguccucguagcuucu

SEQ ID NO: 1492011 - RNA, 19 nt, Homo sapiens
ccuuggauacguugcuuua

SEQ ID NO: 1492012 - RNA, 19 nt, Homo sapiens
cauauuguucagcugauuu

SEQ ID NO: 1492013 - RNA, 19 nt, Homo sapiens
ugaugauucuucuccugaa

SEQ ID NO: 1492014 - RNA, 19 nt, Homo sapiens
guucaacaaguguaagaga

SEQ ID NO: 1492015 - RNA, 19 nt, Homo sapiens
ugaaacaccuuacaacuuu

SEQ ID NO: 1492016 - RNA, 19 nt, Homo sapiens
aagaacagcugacuaauuu

SEQ ID NO: 1492017 - RNA, 19 nt, Homo sapiens
uaacuuagcuggaaauucu

SEQ ID NO: 1492018 - RNA, 19 nt, Homo sapiens
gcagacagcucacauucuu

SEQ ID NO: 1492019 - RNA, 19 nt, Homo sapiens
gcuuggaacuuaaaugaua

SEQ ID NO: 1492020 - RNA, 19 nt, Homo sapiens
ggaaauaacuaggaaagug

SEQ ID NO: 1492021 - RNA, 19 nt, Homo sapiens
gcucaugucuucuuccuuu

SEQ ID NO: 1492022 - RNA, 19 nt, Homo sapiens
gaagaaaccuaaauuugag

SEQ ID NO: 1492023 - RNA, 19 nt, Homo sapiens
caauagaaaugucagauga

SEQ ID NO: 1492024 - RNA, 19 nt, Homo sapiens
ggaaaggacaguacaauug

SEQ ID NO: 1492025 - RNA, 19 nt, Homo sapiens
gaaaguggucugcauaauu

SEQ ID NO: 1492026 - RNA, 19 nt, Homo sapiens
gaggauuacuccagaauga

SEQ ID NO: 1492027 - RNA, 19 nt, Homo sapiens
cauaguagauuucacagaa

SEQ ID NO: 1492028 - RNA, 19 nt, Homo sapiens
gaaaggacaguacaauuga

SEQ ID NO: 1492029 - RNA, 19 nt, Homo sapiens
ugaaagcugugcagaaauu

SEQ ID NO: 1492030 - RNA, 19 nt, Homo sapiens
gagaagaaaccuaaauuug

SEQ ID NO: 1492031 - RNA, 19 nt, Homo sapiens
gcuaagagaagcaauagua

SEQ ID NO: 1492032 - RNA, 19 nt, Homo sapiens
ccacaaagauguuauugca

SEQ ID NO: 1492033 - RNA, 19 nt, Homo sapiens
cauaagauauuaccguuug

SEQ ID NO: 1492034 - RNA, 19 nt, Homo sapiens
gcaauuccauuuaucacuu

SEQ ID NO: 1492035 - RNA, 19 nt, Homo sapiens
gauacugaccuucaaauaa

SEQ ID NO: 1492036 - RNA, 19 nt, Homo sapiens
ugaaagaccuaacccaaga

SEQ ID NO: 1492037 - RNA, 19 nt, Homo sapiens
gaauggaaauaacuaggaa

SEQ ID NO: 1492038 - RNA, 19 nt, Homo sapiens
ugugggaacuggcaauuua

SEQ ID NO: 1492039 - RNA, 19 nt, Homo sapiens
cagaugaaauuccuaauca

SEQ ID NO: 1492040 - RNA, 19 nt, Homo sapiens
gaagaacuauggcccaagu

SEQ ID NO: 1492041 - RNA, 19 nt, Homo sapiens
ccaguauacuugaucauuu

SEQ ID NO: 1492042 - RNA, 19 nt, Homo sapiens
caacuuaacaacagacuuu

SEQ ID NO: 1492043 - RNA, 19 nt, Homo sapiens
ucacuuagcuaguuaccuu

SEQ ID NO: 1492044 - RNA, 19 nt, Homo sapiens
uaaauucucugcuugaagu

SEQ ID NO: 1492045 - RNA, 19 nt, Homo sapiens
aaaguggucugcauaauuc

SEQ ID NO: 1492046 - RNA, 19 nt, Homo sapiens
ucagauaagccagauauua

SEQ ID NO: 1492047 - RNA, 19 nt, Homo sapiens
guguaaaccuaauggauuu

SEQ ID NO: 1492048 - RNA, 19 nt, Homo sapiens
cagaggauguuacguauuc

SEQ ID NO: 1492049 - RNA, 19 nt, Homo sapiens
aaccuuaucuugaaccaua

SEQ ID NO: 1492050 - RNA, 19 nt, Homo sapiens
caagaacagcugacuaauu

SEQ ID NO: 1492051 - RNA, 19 nt, Homo sapiens
caacugaagauauagcuuu

SEQ ID NO: 1492052 - RNA, 19 nt, Homo sapiens
gaaaugaacaaaggaauca

SEQ ID NO: 1492053 - RNA, 19 nt, Homo sapiens
ucacagaggauguuacgua

SEQ ID NO: 1492054 - RNA, 19 nt, Homo sapiens
ugagaagcauaguagauuu

SEQ ID NO: 1492055 - RNA, 19 nt, Homo sapiens
gaagauauagcuuuguuag

SEQ ID NO: 1492056 - RNA, 19 nt, Homo sapiens
cagguuauaugcaagcuuu

SEQ ID NO: 1492057 - RNA, 19 nt, Homo sapiens
uaucucuucugcugaaaua

SEQ ID NO: 1492058 - RNA, 19 nt, Homo sapiens
ggaaaguggucugcauaau

SEQ ID NO: 1492059 - RNA, 19 nt, Homo sapiens
aaugaaagcucccgaaugg

SEQ ID NO: 1492060 - RNA, 19 nt, Homo sapiens
gaaaggaugcauuguaugg

SEQ ID NO: 1492061 - RNA, 19 nt, Homo sapiens
ggauuacuccagaaugaua

SEQ ID NO: 1492062 - RNA, 19 nt, Homo sapiens
uaaauucaauggcucuuca

SEQ ID NO: 1492063 - RNA, 19 nt, Homo sapiens
ugucacagguagcaguuua

SEQ ID NO: 1492064 - RNA, 19 nt, Homo sapiens
cgcauaaucuacucucuuu

SEQ ID NO: 1492065 - RNA, 19 nt, Homo sapiens
uagcaucucugaacucugu

SEQ ID NO: 1492066 - RNA, 19 nt, Homo sapiens
guuaacauuucucuuguga

SEQ ID NO: 1492067 - RNA, 19 nt, Homo sapiens
ggaugaguaucaacaacuu

SEQ ID NO: 1492068 - RNA, 19 nt, Homo sapiens
caaguaaggaugaguauca

SEQ ID NO: 1492069 - RNA, 19 nt, Homo sapiens
ugugaaagcugugcagaaa

SEQ ID NO: 1492070 - RNA, 19 nt, Homo sapiens
gaaggaauuucagaagcuu

SEQ ID NO: 1492071 - RNA, 19 nt, Homo sapiens
uaucaucacugagcuaaga

SEQ ID NO: 1492072 - RNA, 19 nt, Homo sapiens
gcagagaugaggugaguau

SEQ ID NO: 1492073 - RNA, 19 nt, Homo sapiens
gaaacaccuuacaacuuug

SEQ ID NO: 1492074 - RNA, 19 nt, Homo sapiens
ggaaggaauuucagaagcu

SEQ ID NO: 1492075 - RNA, 19 nt, Homo sapiens
aaauaucucuucugcugaa

SEQ ID NO: 1492076 - RNA, 19 nt, Homo sapiens
aaaguuacaucaggugaaa

SEQ ID NO: 1492077 - RNA, 19 nt, Homo sapiens
ucaaggaugucuacagcuu

SEQ ID NO: 1492078 - RNA, 19 nt, Homo sapiens
gaaagcagacauagaccuu

SEQ ID NO: 1492079 - RNA, 19 nt, Homo sapiens
aaaacuggcuucaggaaua

SEQ ID NO: 1492080 - RNA, 19 nt, Homo sapiens
ccuaauggauuucuuuaag

SEQ ID NO: 1492081 - RNA, 19 nt, Homo sapiens
cugaaaggaugcauuguau

SEQ ID NO: 1492082 - RNA, 19 nt, Homo sapiens
gaugaggugaguauacuuu

SEQ ID NO: 1492083 - RNA, 19 nt, Homo sapiens
gaacagcugacuaauuucu

SEQ ID NO: 1492084 - RNA, 19 nt, Homo sapiens
cuacaggucuugguauuca

SEQ ID NO: 1492085 - RNA, 19 nt, Homo sapiens
cgauauaucucaaacuacu

SEQ ID NO: 1492086 - RNA, 19 nt, Homo sapiens
ugcgauauaucucaaacua

SEQ ID NO: 1492087 - RNA, 19 nt, Homo sapiens
gucagaaacuaguaggaaa

SEQ ID NO: 1492088 - RNA, 19 nt, Homo sapiens
ucaauaacuuagcuggaaa

SEQ ID NO: 1492089 - RNA, 19 nt, Homo sapiens
uuacccaucugcuaaauca

SEQ ID NO: 1492090 - RNA, 19 nt, Homo sapiens
uuaguggacuggaauucua

SEQ ID NO: 1492091 - RNA, 19 nt, Homo sapiens
gaaagcucccgaauggaaa

SEQ ID NO: 1492092 - RNA, 19 nt, Homo sapiens
ugaaagcucccgaauggaa

SEQ ID NO: 1492093 - RNA, 19 nt, Homo sapiens
gauaagggauguguucaac

SEQ ID NO: 1492094 - RNA, 19 nt, Homo sapiens
gagaugaggugaguauacu

SEQ ID NO: 1492095 - RNA, 19 nt, Homo sapiens
uaaaugauacugaccuuca

SEQ ID NO: 1492096 - RNA, 19 nt, Homo sapiens
ugacuaauuucucaguugu

SEQ ID NO: 1492097 - RNA, 19 nt, Homo sapiens
gauagcaucucugaacucu

SEQ ID NO: 1492098 - RNA, 19 nt, Homo sapiens
ccacaaagcaaguaaggau

SEQ ID NO: 1492099 - RNA, 19 nt, Homo sapiens
cauaugcagucagaaacua

SEQ ID NO: 1492100 - RNA, 19 nt, Homo sapiens
agacuucgcaauugugaua

SEQ ID NO: 1492101 - RNA, 19 nt, Homo sapiens
uuucaaauaucaccaagga

SEQ ID NO: 1492102 - RNA, 19 nt, Homo sapiens
ucucacgccuguuuccuaa

SEQ ID NO: 1492103 - RNA, 19 nt, Homo sapiens
uaagaaagcagacauagac

SEQ ID NO: 1492104 - RNA, 19 nt, Homo sapiens
uaagggauguguucaacuc

SEQ ID NO: 1492105 - RNA, 19 nt, Homo sapiens
cagcuuggaacuuaaauga

SEQ ID NO: 1492106 - RNA, 19 nt, Homo sapiens
gugaaacaccuuacaacuu

SEQ ID NO: 1492107 - RNA, 19 nt, Homo sapiens
gugcagaaauuuuggcaua

SEQ ID NO: 1492108 - RNA, 19 nt, Homo sapiens
gaagauucaccauguucaa

SEQ ID NO: 1492109 - RNA, 19 nt, Homo sapiens
cggcagaauucaaagauag

SEQ ID NO: 1492110 - RNA, 19 nt, Homo sapiens
gaauuucagaagcuuguaa

SEQ ID NO: 1492111 - RNA, 19 nt, Homo sapiens
cacagaggauguuacguau

SEQ ID NO: 1492112 - RNA, 19 nt, Homo sapiens
gaagacuggagccuagaaa

SEQ ID NO: 1492113 - RNA, 19 nt, Homo sapiens
ggacaguacaauugauuuc

SEQ ID NO: 1492114 - RNA, 19 nt, Homo sapiens
gauucaccauguucaaaug

SEQ ID NO: 1492115 - RNA, 19 nt, Homo sapiens
gaaagcccaugaacuguua

SEQ ID NO: 1492116 - RNA, 19 nt, Homo sapiens
gaacuacccaggaauguua

SEQ ID NO: 1492117 - RNA, 19 nt, Homo sapiens
gaucagauauagaagauga

SEQ ID NO: 1492118 - RNA, 19 nt, Homo sapiens
gaagagaguuuauguucug

SEQ ID NO: 1492119 - RNA, 19 nt, Homo sapiens
gaaaagcacuugagaaaga

SEQ ID NO: 1492120 - RNA, 19 nt, Homo sapiens
guagaaagcuguagauugc

SEQ ID NO: 1492121 - RNA, 19 nt, Homo sapiens
gagcuguacuugccacuaa

SEQ ID NO: 1492122 - RNA, 19 nt, Homo sapiens
gauaagaucuggcgagaac

SEQ ID NO: 1492123 - RNA, 19 nt, Homo sapiens
uaaaugccuuucuguguuu

SEQ ID NO: 1492124 - RNA, 19 nt, Homo sapiens
gggcgaaggucguauugaa

SEQ ID NO: 1492125 - RNA, 19 nt, Homo sapiens
gcagagguuuacagaguuu

SEQ ID NO: 1492126 - RNA, 19 nt, Homo sapiens
caagaaagcccaugaacug

SEQ ID NO: 1492127 - RNA, 19 nt, Homo sapiens
gcuggaagauugcuauaga

SEQ ID NO: 1492128 - RNA, 19 nt, Homo sapiens
gcacuucuuuacucuggua

SEQ ID NO: 1492129 - RNA, 19 nt, Homo sapiens
gaacaacuagcauaugguu

SEQ ID NO: 1492130 - RNA, 19 nt, Homo sapiens
gcacuacaaguuucaaauu

SEQ ID NO: 1492131 - RNA, 19 nt, Homo sapiens
gcacuuugaugacucacaa

SEQ ID NO: 1492132 - RNA, 19 nt, Homo sapiens
gaaaggguuugcacuugga

SEQ ID NO: 1492133 - RNA, 19 nt, Homo sapiens
uuugaugacucacaaguua

SEQ ID NO: 1492134 - RNA, 19 nt, Homo sapiens
aaacaccauugccaaagua

SEQ ID NO: 1492135 - RNA, 19 nt, Homo sapiens
gaguuuauguucuguugaa

SEQ ID NO: 1492136 - RNA, 19 nt, Homo sapiens
gagaguuuauguucuguug

SEQ ID NO: 1492137 - RNA, 19 nt, Homo sapiens
gauguuggcagcugcuuua

SEQ ID NO: 1492138 - RNA, 19 nt, Homo sapiens
gaauugccguaguaccuuu

SEQ ID NO: 1492139 - RNA, 19 nt, Homo sapiens
gaacauuuaguccacauug

SEQ ID NO: 1492140 - RNA, 19 nt, Homo sapiens
gagagugucuauaaaugug

SEQ ID NO: 1492141 - RNA, 19 nt, Homo sapiens
gaaguauauuuaccugaga

SEQ ID NO: 1492142 - RNA, 19 nt, Homo sapiens
caucagaaccgucaugcua

SEQ ID NO: 1492143 - RNA, 19 nt, Homo sapiens
caagccagcucuauuccuu

SEQ ID NO: 1492144 - RNA, 19 nt, Homo sapiens
gaacuuacagcuucagcaa

SEQ ID NO: 1492145 - RNA, 19 nt, Homo sapiens
caacuugaaggucauuuaa

SEQ ID NO: 1492146 - RNA, 19 nt, Homo sapiens
ugaaugguguuguagugua

SEQ ID NO: 1492147 - RNA, 19 nt, Homo sapiens
ggaagagaguuuauguucu

SEQ ID NO: 1492148 - RNA, 19 nt, Homo sapiens
gcacuuggaagagaguuua

SEQ ID NO: 1492149 - RNA, 19 nt, Homo sapiens
aaagaaaugcagagguuua

SEQ ID NO: 1492150 - RNA, 19 nt, Homo sapiens
guauagaagaugaggaaua

SEQ ID NO: 1492151 - RNA, 19 nt, Homo sapiens
gaaugguguuguaguguau

SEQ ID NO: 1492152 - RNA, 19 nt, Homo sapiens
ggaacaauguaauacucaa

SEQ ID NO: 1492153 - RNA, 19 nt, Homo sapiens
cagaaacuacuguuacuuu

SEQ ID NO: 1492154 - RNA, 19 nt, Homo sapiens
cccaaaguguguauucuaa

SEQ ID NO: 1492155 - RNA, 19 nt, Homo sapiens
gcuagaagaccccauauua

SEQ ID NO: 1492156 - RNA, 19 nt, Homo sapiens
gaauaugccguugcaauga

SEQ ID NO: 1492157 - RNA, 19 nt, Homo sapiens
uaucacaguuucagauuuc

SEQ ID NO: 1492158 - RNA, 19 nt, Homo sapiens
cuccuaaacuaauugcuua

SEQ ID NO: 1492159 - RNA, 19 nt, Homo sapiens
gaacuguuaguguuaaaug

SEQ ID NO: 1492160 - RNA, 19 nt, Homo sapiens
aaacugcacuucuuuacuc

SEQ ID NO: 1492161 - RNA, 19 nt, Homo sapiens
guagauugcacuuugauga

SEQ ID NO: 1492162 - RNA, 19 nt, Homo sapiens
uaaaagaaaugcagagguu

SEQ ID NO: 1492163 - RNA, 19 nt, Homo sapiens
gaaacucuuugugaauaug

SEQ ID NO: 1492164 - RNA, 19 nt, Homo sapiens
gaagaugaggaauauucua

SEQ ID NO: 1492165 - RNA, 19 nt, Homo sapiens
ccucaagauuucaacagua

SEQ ID NO: 1492166 - RNA, 19 nt, Homo sapiens
gagaaaagcacuugagaaa

SEQ ID NO: 1492167 - RNA, 19 nt, Homo sapiens
cguauugaaugguguugua

SEQ ID NO: 1492168 - RNA, 19 nt, Homo sapiens
auaaaugccuuucuguguu

SEQ ID NO: 1492169 - RNA, 19 nt, Homo sapiens
gauccaauauuuacugaac

SEQ ID NO: 1492170 - RNA, 19 nt, Homo sapiens
gcucuauuccuuucuauga

SEQ ID NO: 1492171 - RNA, 19 nt, Homo sapiens
gcuuuaaacgcuucaagua

SEQ ID NO: 1492172 - RNA, 19 nt, Homo sapiens
guccucaccuuuccguuaa

SEQ ID NO: 1492173 - RNA, 19 nt, Homo sapiens
gguccucaccuuuccguua

SEQ ID NO: 1492174 - RNA, 19 nt, Homo sapiens
ucucucuccuucuuucuua

SEQ ID NO: 1492175 - RNA, 19 nt, Homo sapiens
gaguguauguacccaguau

SEQ ID NO: 1492176 - RNA, 19 nt, Homo sapiens
aaacuuaggcuucauuuac

SEQ ID NO: 1492177 - RNA, 19 nt, Homo sapiens
uaaacaccauugccaaagu

SEQ ID NO: 1492178 - RNA, 19 nt, Homo sapiens
auagaucgguuaguuguuu

SEQ ID NO: 1492179 - RNA, 19 nt, Homo sapiens
gaaagucaagccagcucua

SEQ ID NO: 1492180 - RNA, 19 nt, Homo sapiens
uagagucccugggcuuuaa

SEQ ID NO: 1492181 - RNA, 19 nt, Homo sapiens
guaguaccuuugaauguca

SEQ ID NO: 1492182 - RNA, 19 nt, Homo sapiens
gaaacuacuguuacuuuag

SEQ ID NO: 1492183 - RNA, 19 nt, Homo sapiens
caugaacuguuaguguuaa

SEQ ID NO: 1492184 - RNA, 19 nt, Homo sapiens
gcaauugucauggaagcua

SEQ ID NO: 1492185 - RNA, 19 nt, Homo sapiens
gcauaugguuucacagaac

SEQ ID NO: 1492186 - RNA, 19 nt, Homo sapiens
cagauuucaugguuaaugu

SEQ ID NO: 1492187 - RNA, 19 nt, Homo sapiens
gcuguagauugcacuuuga

SEQ ID NO: 1492188 - RNA, 19 nt, Homo sapiens
gaaauacuaacaugaacuc

SEQ ID NO: 1492189 - RNA, 19 nt, Homo sapiens
ucaacaguauagaagauga

SEQ ID NO: 1492190 - RNA, 19 nt, Homo sapiens
uaacccauuucugaaguuu

SEQ ID NO: 1492191 - RNA, 19 nt, Homo sapiens
uaaccaaccucagcuuuac

SEQ ID NO: 1492192 - RNA, 19 nt, Homo sapiens
uaaauaugcaugagucuuc

SEQ ID NO: 1492193 - RNA, 19 nt, Homo sapiens
gcgaaggucguauugaaug

SEQ ID NO: 1492194 - RNA, 19 nt, Homo sapiens
uuaguuggcugugggaauu

SEQ ID NO: 1492195 - RNA, 19 nt, Homo sapiens
caagaaguaccgagaagug

SEQ ID NO: 1492196 - RNA, 19 nt, Homo sapiens
aaaguuucaugcagaguga

SEQ ID NO: 1492197 - RNA, 19 nt, Homo sapiens
uaacaugaacucaguacug

SEQ ID NO: 1492198 - RNA, 19 nt, Homo sapiens
aguccaggcuccuaaacua

SEQ ID NO: 1492199 - RNA, 19 nt, Homo sapiens
cccaugaacuguuaguguu

SEQ ID NO: 1492200 - RNA, 19 nt, Homo sapiens
caaguuaaaugugauacag

SEQ ID NO: 1492201 - RNA, 19 nt, Homo sapiens
ccagcucuauuccuuucua

SEQ ID NO: 1492202 - RNA, 19 nt, Homo sapiens
caacuagcauaugguuuca

SEQ ID NO: 1492203 - RNA, 19 nt, Homo sapiens
uagaagaugaggaauauuc

SEQ ID NO: 1492204 - RNA, 19 nt, Homo sapiens
gcagcugcuuuaacccauu

SEQ ID NO: 1492205 - RNA, 19 nt, Homo sapiens
guacccaguauuucuaauu

SEQ ID NO: 1492206 - RNA, 19 nt, Homo sapiens
gugcguauguuuguauguu

SEQ ID NO: 1492207 - RNA, 19 nt, Homo sapiens
gauaggguccucaccuuuc

SEQ ID NO: 1492208 - RNA, 19 nt, Homo sapiens
uaagcaaggaacaauguaa

SEQ ID NO: 1492209 - RNA, 19 nt, Homo sapiens
caccauugccaaaguagua

SEQ ID NO: 1492210 - RNA, 19 nt, Homo sapiens
gcaagaaagcccaugaacu

SEQ ID NO: 1492211 - RNA, 19 nt, Homo sapiens
cagcugcuuuaacccauuu

SEQ ID NO: 1492212 - RNA, 19 nt, Homo sapiens
uuaaccaaccucagcuuua

SEQ ID NO: 1492213 - RNA, 19 nt, Homo sapiens
gcaaggaacaauguaauac

SEQ ID NO: 1492214 - RNA, 19 nt, Homo sapiens
ccaggcuccuaaacuaauu

SEQ ID NO: 1492215 - RNA, 19 nt, Homo sapiens
ggauuacucugaacaauga

SEQ ID NO: 1492216 - RNA, 19 nt, Homo sapiens
aaauaacccuguucucaaa

SEQ ID NO: 1492217 - RNA, 19 nt, Homo sapiens
acaccaaggucuacaacua

SEQ ID NO: 1492218 - RNA, 19 nt, Homo sapiens
gagaaggccuggagucuac

SEQ ID NO: 1492219 - RNA, 19 nt, Homo sapiens
ccagcaagauguucugugu

SEQ ID NO: 1492220 - RNA, 19 nt, Homo sapiens
uaccagguguccuugaauu

SEQ ID NO: 1492221 - RNA, 19 nt, Homo sapiens
ugcagucucuauaccaaua

SEQ ID NO: 1492222 - RNA, 19 nt, Homo sapiens
ggucugcaauggacagcuu

SEQ ID NO: 1492223 - RNA, 19 nt, Homo sapiens
ugacccaggcuaaguguaa

SEQ ID NO: 1492224 - RNA, 19 nt, Homo sapiens
ugaugaugaugacaagauu

SEQ ID NO: 1492225 - RNA, 19 nt, Homo sapiens
acaacaggauuacucugaa

SEQ ID NO: 1492226 - RNA, 19 nt, Homo sapiens
ggacagcuucaaggaauug

SEQ ID NO: 1492227 - RNA, 19 nt, Homo sapiens
cuccuacccuuuaaagauu

SEQ ID NO: 1492228 - RNA, 19 nt, Homo sapiens
cuuuaaagauuaccagcaa

SEQ ID NO: 1492229 - RNA, 19 nt, Homo sapiens
caacaggauuacucugaac

SEQ ID NO: 1492230 - RNA, 19 nt, Homo sapiens
gacccaggcuaaguguaaa

SEQ ID NO: 1492231 - RNA, 19 nt, Homo sapiens
acaacuauguggacuggau

SEQ ID NO: 1492232 - RNA, 19 nt, Homo sapiens
cgucaucaaugcccaugug

SEQ ID NO: 1492233 - RNA, 19 nt, Homo sapiens
ugugguggcucccucauca

SEQ ID NO: 1492234 - RNA, 19 nt, Homo sapiens
uauguggacuggauuaagg

SEQ ID NO: 1492235 - RNA, 19 nt, Homo sapiens
ccuaccagguguccuugaa

SEQ ID NO: 1492236 - RNA, 19 nt, Homo sapiens
gcccauguguccacgaucu

SEQ ID NO: 1492237 - RNA, 19 nt, Homo sapiens
ucacagacaccuccucucu

SEQ ID NO: 1492238 - RNA, 19 nt, Homo sapiens
caggauuacucugaacaau

SEQ ID NO: 1492239 - RNA, 19 nt, Homo sapiens
uacaacaggauuacucuga

SEQ ID NO: 1492240 - RNA, 19 nt, Homo sapiens
agacugggagagcacaaua

SEQ ID NO: 1492241 - RNA, 19 nt, Homo sapiens
uaaaauaacccuguucuca

SEQ ID NO: 1492242 - RNA, 19 nt, Homo sapiens
caccaaggucuacaacuau

SEQ ID NO: 1492243 - RNA, 19 nt, Homo sapiens
ggccuggagucuacaccaa

SEQ ID NO: 1492244 - RNA, 19 nt, Homo sapiens
gcagucucuauaccaauaa

SEQ ID NO: 1492245 - RNA, 19 nt, Homo sapiens
caauggacagcuucaagga

SEQ ID NO: 1492246 - RNA, 19 nt, Homo sapiens
aagauuaccagcaagaugu

SEQ ID NO: 1492247 - RNA, 19 nt, Homo sapiens
uuaaagauuaccagcaaga

SEQ ID NO: 1492248 - RNA, 19 nt, Homo sapiens
ccuccuacccuuuaaagau

SEQ ID NO: 1492249 - RNA, 19 nt, Homo sapiens
ccaauaaaauaacccuguu

SEQ ID NO: 1492250 - RNA, 19 nt, Homo sapiens
caacuauguggacuggauu

SEQ ID NO: 1492251 - RNA, 19 nt, Homo sapiens
gaugaugaugacaagauug

SEQ ID NO: 1492252 - RNA, 19 nt, Homo sapiens
auggacagcuucaaggaau

SEQ ID NO: 1492253 - RNA, 19 nt, Homo sapiens
aaagauuaccagcaagaug

SEQ ID NO: 1492254 - RNA, 19 nt, Homo sapiens
ccagacaggcgcacucuac

SEQ ID NO: 1492255 - RNA, 19 nt, Homo sapiens
gcacucuaccaccaugaau

SEQ ID NO: 1492256 - RNA, 19 nt, Homo sapiens
ccaaauacaacaggauuac

SEQ ID NO: 1492257 - RNA, 19 nt, Homo sapiens
cccaaauacaacaggauua

SEQ ID NO: 1492258 - RNA, 19 nt, Homo sapiens
caucaaugcagccaagauc

SEQ ID NO: 1492259 - RNA, 19 nt, Homo sapiens
gagagcacaauaucgaagu

SEQ ID NO: 1492260 - RNA, 19 nt, Homo sapiens
gaauucuggcucccacuuc

SEQ ID NO: 1492261 - RNA, 19 nt, Homo sapiens
uccuacccuuuaaagauua

SEQ ID NO: 1492262 - RNA, 19 nt, Homo sapiens
gggagagcacaauaucgaa

SEQ ID NO: 1492263 - RNA, 19 nt, Homo sapiens
agagaaggccuggagucua

SEQ ID NO: 1492264 - RNA, 19 nt, Homo sapiens
cagucucuauaccaauaaa

SEQ ID NO: 1492265 - RNA, 19 nt, Homo sapiens
caaggucuacaacuaugug

SEQ ID NO: 1492266 - RNA, 19 nt, Homo sapiens
gauccuccagagcuauaaa

SEQ ID NO: 1492267 - RNA, 19 nt, Homo sapiens
cagguguccuugaauucug

SEQ ID NO: 1492268 - RNA, 19 nt, Homo sapiens
ccacaccugccgucaucaa

SEQ ID NO: 1492269 - RNA, 19 nt, Homo sapiens
ucugcagucucuauaccaa

SEQ ID NO: 1492270 - RNA, 19 nt, Homo sapiens
gagucuacaccaaggucua

SEQ ID NO: 1492271 - RNA, 19 nt, Homo sapiens
uggacagcuucaaggaauu

SEQ ID NO: 1492272 - RNA, 19 nt, Homo sapiens
ugugggagcugcuguugcu

SEQ ID NO: 1492273 - RNA, 19 nt, Homo sapiens
agacaccuccucucuggau

SEQ ID NO: 1492274 - RNA, 19 nt, Homo sapiens
ggauuaaggacaccauagc

SEQ ID NO: 1492275 - RNA, 19 nt, Homo sapiens
accaaggucuacaacuaug

SEQ ID NO: 1492276 - RNA, 19 nt, Homo sapiens
caccugccgucaucaaugc

SEQ ID NO: 1492277 - RNA, 19 nt, Homo sapiens
cuccacaccugccgucauc

SEQ ID NO: 1492278 - RNA, 19 nt, Homo sapiens
ugggagagcacaauaucga

SEQ ID NO: 1492279 - RNA, 19 nt, Homo sapiens
gaagauagauacagccuuu

SEQ ID NO: 1492280 - RNA, 19 nt, Homo sapiens
gaguaggccugauauauua

SEQ ID NO: 1492281 - RNA, 19 nt, Homo sapiens
caacacagcuaaccauuau

SEQ ID NO: 1492282 - RNA, 19 nt, Homo sapiens
gaacacagcuugcuugcau

SEQ ID NO: 1492283 - RNA, 19 nt, Homo sapiens
gcagauggcuagagaagaa

SEQ ID NO: 1492284 - RNA, 19 nt, Homo sapiens
gcacuaacuuugaucaauu

SEQ ID NO: 1492285 - RNA, 19 nt, Homo sapiens
gcagauagcaucauuaaga

SEQ ID NO: 1492286 - RNA, 19 nt, Homo sapiens
ccaaucagcuuaguguuua

SEQ ID NO: 1492287 - RNA, 19 nt, Homo sapiens
cagaagaucuccacuaguu

SEQ ID NO: 1492288 - RNA, 19 nt, Homo sapiens
gggaauauguaucuuguaa

SEQ ID NO: 1492289 - RNA, 19 nt, Homo sapiens
ccaauacucuggaaagaaa

SEQ ID NO: 1492290 - RNA, 19 nt, Homo sapiens
gaacuggaaucccugagaa

SEQ ID NO: 1492291 - RNA, 19 nt, Homo sapiens
caacauagagucacauaaa

SEQ ID NO: 1492292 - RNA, 19 nt, Homo sapiens
gcagagaauuuauccuuug

SEQ ID NO: 1492293 - RNA, 19 nt, Homo sapiens
gaaaccagauuaauagaag

SEQ ID NO: 1492294 - RNA, 19 nt, Homo sapiens
gcuacacagucuccuauua

SEQ ID NO: 1492295 - RNA, 19 nt, Homo sapiens
ugaacaaacugauugauug

SEQ ID NO: 1492296 - RNA, 19 nt, Homo sapiens
cuaauuaucuuccaaagga

SEQ ID NO: 1492297 - RNA, 19 nt, Homo sapiens
ccaccaacguuucagaaua

SEQ ID NO: 1492298 - RNA, 19 nt, Homo sapiens
ggagaagccuauucagcua

SEQ ID NO: 1492299 - RNA, 19 nt, Homo sapiens
gguggaauaucucaucuaa

SEQ ID NO: 1492300 - RNA, 19 nt, Homo sapiens
gaggaaggaucuuuguuga

SEQ ID NO: 1492301 - RNA, 19 nt, Homo sapiens
ucuaaucggucucuuuaua

SEQ ID NO: 1492302 - RNA, 19 nt, Homo sapiens
ggaaggaucuuuguugaca

SEQ ID NO: 1492303 - RNA, 19 nt, Homo sapiens
gaagaagaguaugucagua

SEQ ID NO: 1492304 - RNA, 19 nt, Homo sapiens
guucuucucuguucaguuu

SEQ ID NO: 1492305 - RNA, 19 nt, Homo sapiens
caggagagcuacuuucuau

SEQ ID NO: 1492306 - RNA, 19 nt, Homo sapiens
uauaugcucuggaguaauu

SEQ ID NO: 1492307 - RNA, 19 nt, Homo sapiens
caaagugggagcagaaaua

SEQ ID NO: 1492308 - RNA, 19 nt, Homo sapiens
acacauuaguccucaguua

SEQ ID NO: 1492309 - RNA, 19 nt, Homo sapiens
ucauguaucuugauuguug

SEQ ID NO: 1492310 - RNA, 19 nt, Homo sapiens
gcucuaaucggucucuuua

SEQ ID NO: 1492311 - RNA, 19 nt, Homo sapiens
gacagaggcuuuauuugug

SEQ ID NO: 1492312 - RNA, 19 nt, Homo sapiens
gagaguacauuaacugagu

SEQ ID NO: 1492313 - RNA, 19 nt, Homo sapiens
gagaauuuauccuuugguu

SEQ ID NO: 1492314 - RNA, 19 nt, Homo sapiens
gcucuaaagcuuauuguuu

SEQ ID NO: 1492315 - RNA, 19 nt, Homo sapiens
gggaguaccucuaaagaca

SEQ ID NO: 1492316 - RNA, 19 nt, Homo sapiens
aagaaucgccuuugguuua

SEQ ID NO: 1492317 - RNA, 19 nt, Homo sapiens
gguaucagcugugggcuaa

SEQ ID NO: 1492318 - RNA, 19 nt, Homo sapiens
gcuacuuucuauccaaaua

SEQ ID NO: 1492319 - RNA, 19 nt, Homo sapiens
ggagguucauacauucaua

SEQ ID NO: 1492320 - RNA, 19 nt, Homo sapiens
cgacagaggcuuuauuugu

SEQ ID NO: 1492321 - RNA, 19 nt, Homo sapiens
gcagcaguauccucaacua

SEQ ID NO: 1492322 - RNA, 19 nt, Homo sapiens
ccacaucguuugucuauac

SEQ ID NO: 1492323 - RNA, 19 nt, Homo sapiens
gaaagaggaggaagaaauc

SEQ ID NO: 1492324 - RNA, 19 nt, Homo sapiens
gaauuuauccuuugguuag

SEQ ID NO: 1492325 - RNA, 19 nt, Homo sapiens
ggaaaaugcuuugguguuu

SEQ ID NO: 1492326 - RNA, 19 nt, Homo sapiens
agaagaguaugucaguaua

SEQ ID NO: 1492327 - RNA, 19 nt, Homo sapiens
ugucauacauuccacauug

SEQ ID NO: 1492328 - RNA, 19 nt, Homo sapiens
aaaccaaucccacuucuuu

SEQ ID NO: 1492329 - RNA, 19 nt, Homo sapiens
gagacuaccgugcugaaua

SEQ ID NO: 1492330 - RNA, 19 nt, Homo sapiens
agaaauauuuggaggagaa

SEQ ID NO: 1492331 - RNA, 19 nt, Homo sapiens
ccuauuaucucaauugcuu

SEQ ID NO: 1492332 - RNA, 19 nt, Homo sapiens
aaaggagggugaugugauu

SEQ ID NO: 1492333 - RNA, 19 nt, Homo sapiens
ccaaucauuugcaaaguga

SEQ ID NO: 1492334 - RNA, 19 nt, Homo sapiens
augcagagaugguggaaua

SEQ ID NO: 1492335 - RNA, 19 nt, Homo sapiens
gaaaaugcuuugguguuua

SEQ ID NO: 1492336 - RNA, 19 nt, Homo sapiens
gucgggaguuuguuuauuu

SEQ ID NO: 1492337 - RNA, 19 nt, Homo sapiens
gagcuacuuucuauccaaa

SEQ ID NO: 1492338 - RNA, 19 nt, Homo sapiens
gaagaguaggccugauaua

SEQ ID NO: 1492339 - RNA, 19 nt, Homo sapiens
gaaggguacuggagcuaau

SEQ ID NO: 1492340 - RNA, 19 nt, Homo sapiens
gaagaaucgccuuugguuu

SEQ ID NO: 1492341 - RNA, 19 nt, Homo sapiens
uaaaacgugugcauucuua

SEQ ID NO: 1492342 - RNA, 19 nt, Homo sapiens
uaaaauaucugccaucauc

SEQ ID NO: 1492343 - RNA, 19 nt, Homo sapiens
ucagggagcugcuaagaag

SEQ ID NO: 1492344 - RNA, 19 nt, Homo sapiens
uggaauaucucaucuaaac

SEQ ID NO: 1492345 - RNA, 19 nt, Homo sapiens
gaccugcaauccagacaaa

SEQ ID NO: 1492346 - RNA, 19 nt, Homo sapiens
gaaggaaggcugagaaacu

SEQ ID NO: 1492347 - RNA, 19 nt, Homo sapiens
gggaaacucuuuaucuuuu

SEQ ID NO: 1492348 - RNA, 19 nt, Homo sapiens
ugagaaacccaaaguacua

SEQ ID NO: 1492349 - RNA, 19 nt, Homo sapiens
ggugacuacuuugaaauaa

SEQ ID NO: 1492350 - RNA, 19 nt, Homo sapiens
gaaugugcucuaaagcuua

SEQ ID NO: 1492351 - RNA, 19 nt, Homo sapiens
gaauuugcauuugcuugaa

SEQ ID NO: 1492352 - RNA, 19 nt, Homo sapiens
ccacgauucuuggaaauau

SEQ ID NO: 1492353 - RNA, 19 nt, Homo sapiens
ggaagaagaguaugucagu

SEQ ID NO: 1492354 - RNA, 19 nt, Homo sapiens
ggucuccagucucaaauug

SEQ ID NO: 1492355 - RNA, 19 nt, Homo sapiens
uauauaugcucuggaguaa

SEQ ID NO: 1492356 - RNA, 19 nt, Homo sapiens
ggucagaggacaccagaaa

SEQ ID NO: 1492357 - RNA, 19 nt, Homo sapiens
caagugccauccaucauca

SEQ ID NO: 1492358 - RNA, 19 nt, Homo sapiens
gaucugcauuucaacauag

SEQ ID NO: 1492359 - RNA, 19 nt, Homo sapiens
ggaguaauuuaugcauuug

SEQ ID NO: 1492360 - RNA, 19 nt, Homo sapiens
ggaauuguguuugucuuca

SEQ ID NO: 1492361 - RNA, 19 nt, Homo sapiens
agacuaccgugcugaauau

SEQ ID NO: 1492362 - RNA, 19 nt, Homo sapiens
ugguaaagcuggaagaaga

SEQ ID NO: 1492363 - RNA, 19 nt, Homo sapiens
ggacaucucauugccauug

SEQ ID NO: 1492364 - RNA, 19 nt, Homo sapiens
gaaauaugucuuccaagug

SEQ ID NO: 1492365 - RNA, 19 nt, Homo sapiens
guucuuggcugaguacuau

SEQ ID NO: 1492366 - RNA, 19 nt, Homo sapiens
gcaguuguguuaagacucu

SEQ ID NO: 1492367 - RNA, 19 nt, Homo sapiens
ccagauuaauagaagagua

SEQ ID NO: 1492368 - RNA, 19 nt, Homo sapiens
gguugaaugcuuugaauuu

SEQ ID NO: 1492369 - RNA, 19 nt, Homo sapiens
ggaagcagcaggaaaugug

SEQ ID NO: 1492370 - RNA, 19 nt, Homo sapiens
guuaacagguggcuauaca

SEQ ID NO: 1492371 - RNA, 19 nt, Homo sapiens
acacaacagucaucaguca

SEQ ID NO: 1492372 - RNA, 19 nt, Homo sapiens
aaagaaagccagcgugaga

SEQ ID NO: 1492373 - RNA, 19 nt, Homo sapiens
gagaaagccaugagaaaca

SEQ ID NO: 1492374 - RNA, 19 nt, Homo sapiens
uaggaaagauacccagaga

SEQ ID NO: 1492375 - RNA, 19 nt, Homo sapiens
gccaucaucugccauagga

SEQ ID NO: 1492376 - RNA, 19 nt, Homo sapiens
gucaguauauuaugcagaa

SEQ ID NO: 1492377 - RNA, 19 nt, Homo sapiens
cuaagaaggacaaauaaga

SEQ ID NO: 1492378 - RNA, 19 nt, Homo sapiens
ucugagaacuggagagguu

SEQ ID NO: 1492379 - RNA, 19 nt, Homo sapiens
uggaaaggaugguguauua

SEQ ID NO: 1492380 - RNA, 19 nt, Homo sapiens
gaacuuccuucuucucauu

SEQ ID NO: 1492381 - RNA, 19 nt, Homo sapiens
gaaaggaugguguauuaaa

SEQ ID NO: 1492382 - RNA, 19 nt, Homo sapiens
caacagacacuuucccuaa

SEQ ID NO: 1492383 - RNA, 19 nt, Homo sapiens
caacuagaauccauuugug

SEQ ID NO: 1492384 - RNA, 19 nt, Homo sapiens
gugcugaacuuccuucuuc

SEQ ID NO: 1492385 - RNA, 19 nt, Homo sapiens
ggucgaggauuuggucuuu

SEQ ID NO: 1492386 - RNA, 19 nt, Homo sapiens
uaacaaaugugaucaugac

SEQ ID NO: 1492387 - RNA, 19 nt, Homo sapiens
cuaagaaucucaaacugau

SEQ ID NO: 1492388 - RNA, 19 nt, Homo sapiens
gccgauggauuuaaacaug

SEQ ID NO: 1492389 - RNA, 19 nt, Homo sapiens
gaauccugcucuccaucua

SEQ ID NO: 1492390 - RNA, 19 nt, Homo sapiens
aacagugucuuuggacuua

SEQ ID NO: 1492391 - RNA, 19 nt, Homo sapiens
cgauggauuuaaacaugua

SEQ ID NO: 1492392 - RNA, 19 nt, Homo sapiens
guaaagugagcaaccauug

SEQ ID NO: 1492393 - RNA, 19 nt, Homo sapiens
ggaaaggaugguguauuaa

SEQ ID NO: 1492394 - RNA, 19 nt, Homo sapiens
acauguagauucaacuaga

SEQ ID NO: 1492395 - RNA, 19 nt, Homo sapiens
cauguagauucaacuagaa

SEQ ID NO: 1492396 - RNA, 19 nt, Homo sapiens
gcccucaauuguaaaguga

SEQ ID NO: 1492397 - RNA, 19 nt, Homo sapiens
acagacacuuucccuaaga

SEQ ID NO: 1492398 - RNA, 19 nt, Homo sapiens
cuagaauccauuugugaua

SEQ ID NO: 1492399 - RNA, 19 nt, Homo sapiens
ccuaagaaucucaaacuga

SEQ ID NO: 1492400 - RNA, 19 nt, Homo sapiens
ccgacagacuccacccuaa

SEQ ID NO: 1492401 - RNA, 19 nt, Homo sapiens
guuauuacuuggcaugaca

SEQ ID NO: 1492402 - RNA, 19 nt, Homo sapiens
cagugucuuuggacuuaua

SEQ ID NO: 1492403 - RNA, 19 nt, Homo sapiens
ucagguauaacaaauguga

SEQ ID NO: 1492404 - RNA, 19 nt, Homo sapiens
agacaagcuuuaacuuuac

SEQ ID NO: 1492405 - RNA, 19 nt, Homo sapiens
uaaaccagccaaacagugu

SEQ ID NO: 1492406 - RNA, 19 nt, Homo sapiens
guauuaaaccagccaaaca

SEQ ID NO: 1492407 - RNA, 19 nt, Homo sapiens
aaaggaugguguauuaaac

SEQ ID NO: 1492408 - RNA, 19 nt, Homo sapiens
cagacacuuucccuaagaa

SEQ ID NO: 1492409 - RNA, 19 nt, Homo sapiens
gaaggaguucugcaucauc

SEQ ID NO: 1492410 - RNA, 19 nt, Homo sapiens
ucaacuagaauccauuugu

SEQ ID NO: 1492411 - RNA, 19 nt, Homo sapiens
cagauggggucgaggauuu

SEQ ID NO: 1492412 - RNA, 19 nt, Homo sapiens
cugaaggaguucugcauca

SEQ ID NO: 1492413 - RNA, 19 nt, Homo sapiens
guaccuggccuacauucug

SEQ ID NO: 1492414 - RNA, 19 nt, Homo sapiens
ccauugcuaguaauucuuu

SEQ ID NO: 1492415 - RNA, 19 nt, Homo sapiens
ccgauggauuuaaacaugu

SEQ ID NO: 1492416 - RNA, 19 nt, Homo sapiens
ucaucugcaucgucacgua

SEQ ID NO: 1492417 - RNA, 19 nt, Homo sapiens
uaucaacuacaaacgacua

SEQ ID NO: 1492418 - RNA, 19 nt, Homo sapiens
ugaaggaguucugcaucau

SEQ ID NO: 1492419 - RNA, 19 nt, Homo sapiens
gacaagcuuuaacuuuacu

SEQ ID NO: 1492420 - RNA, 19 nt, Homo sapiens
gacagacuccacccuaaca

SEQ ID NO: 1492421 - RNA, 19 nt, Homo sapiens
ggaauccugcucuccaucu

SEQ ID NO: 1492422 - RNA, 19 nt, Homo sapiens
uaccuggccuacauucugu

SEQ ID NO: 1492423 - RNA, 19 nt, Homo sapiens
uuacuuggcaugacagcaa

SEQ ID NO: 1492424 - RNA, 19 nt, Homo sapiens
aaacagugucuuuggacuu

SEQ ID NO: 1492425 - RNA, 19 nt, Homo sapiens
aaccauugcuaguaauucu

SEQ ID NO: 1492426 - RNA, 19 nt, Homo sapiens
ggauacgccgagccaauca

SEQ ID NO: 1492427 - RNA, 19 nt, Homo sapiens
acacuuucccuaagaaucu

SEQ ID NO: 1492428 - RNA, 19 nt, Homo sapiens
aaggaguucugcaucaucu

SEQ ID NO: 1492429 - RNA, 19 nt, Homo sapiens
cucaugacguccuccauca

SEQ ID NO: 1492430 - RNA, 19 nt, Homo sapiens
ugccauguuuacaauaugu

SEQ ID NO: 1492431 - RNA, 19 nt, Homo sapiens
ccagccaaacagugucuuu

SEQ ID NO: 1492432 - RNA, 19 nt, Homo sapiens
ccgagccaaucaaagacaa

SEQ ID NO: 1492433 - RNA, 19 nt, Homo sapiens
caaccauugcuaguaauuc

SEQ ID NO: 1492434 - RNA, 19 nt, Homo sapiens
agugugcgcugccggaauc

SEQ ID NO: 1492435 - RNA, 19 nt, Homo sapiens
ccccugcccucaauuguaa

SEQ ID NO: 1492436 - RNA, 19 nt, Homo sapiens
acgccgagccaaucaaaga

SEQ ID NO: 1492437 - RNA, 19 nt, Homo sapiens
aacagacacuuucccuaag

SEQ ID NO: 1492438 - RNA, 19 nt, Homo sapiens
cauuaucaacuacaaacga

SEQ ID NO: 1492439 - RNA, 19 nt, Homo sapiens
ugaacuuccuucuucucau

SEQ ID NO: 1492440 - RNA, 19 nt, Homo sapiens
ggaaugauuugaacugaua

SEQ ID NO: 1492441 - RNA, 19 nt, Homo sapiens
ggaaagggcuucaaaguag

SEQ ID NO: 1492442 - RNA, 19 nt, Homo sapiens
ggaauuaggucacaaaugg

SEQ ID NO: 1492443 - RNA, 19 nt, Homo sapiens
gaagacagcuggaguacug

SEQ ID NO: 1492444 - RNA, 19 nt, Homo sapiens
ggacuuggcuggagagaga

SEQ ID NO: 1492445 - RNA, 19 nt, Homo sapiens
gcaagcauauguugagaaa

SEQ ID NO: 1492446 - RNA, 19 nt, Homo sapiens
gaaaguuggucuucaccua

SEQ ID NO: 1492447 - RNA, 19 nt, Homo sapiens
cuaauuaccuguuugguuu

SEQ ID NO: 1492448 - RNA, 19 nt, Homo sapiens
gaagaggaguuacgagaga

SEQ ID NO: 1492449 - RNA, 19 nt, Homo sapiens
ggaaauaaaucagaagcaa

SEQ ID NO: 1492450 - RNA, 19 nt, Homo sapiens
agagaaagaugcuaugauu

SEQ ID NO: 1492451 - RNA, 19 nt, Homo sapiens
gaagaggcguguagguuug

SEQ ID NO: 1492452 - RNA, 19 nt, Homo sapiens
gugcaaauaugacucaauu

SEQ ID NO: 1492453 - RNA, 19 nt, Homo sapiens
guucagagccugcaaauga

SEQ ID NO: 1492454 - RNA, 19 nt, Homo sapiens
gcaaaugguggagauauua

SEQ ID NO: 1492455 - RNA, 19 nt, Homo sapiens
ggucacaaaugggaaauaa

SEQ ID NO: 1492456 - RNA, 19 nt, Homo sapiens
aaacaacccugggcaagua

SEQ ID NO: 1492457 - RNA, 19 nt, Homo sapiens
ggacugaacuagccaugau

SEQ ID NO: 1492458 - RNA, 19 nt, Homo sapiens
cuacaugacugaagauaga

SEQ ID NO: 1492459 - RNA, 19 nt, Homo sapiens
gcaaauaugacucaauuca

SEQ ID NO: 1492460 - RNA, 19 nt, Homo sapiens
gauaaagauuucagacuca

SEQ ID NO: 1492461 - RNA, 19 nt, Homo sapiens
gaagucgccugaccacaga

SEQ ID NO: 1492462 - RNA, 19 nt, Homo sapiens
acgaggaacugcccacuua

SEQ ID NO: 1492463 - RNA, 19 nt, Homo sapiens
gcaguucuuuguagucauu

SEQ ID NO: 1492464 - RNA, 19 nt, Homo sapiens
gcauuuguguuuaggguuu

SEQ ID NO: 1492465 - RNA, 19 nt, Homo sapiens
gaugggaaaucaggaauga

SEQ ID NO: 1492466 - RNA, 19 nt, Homo sapiens
gagaaagaugcuaugauua

SEQ ID NO: 1492467 - RNA, 19 nt, Homo sapiens
caaauaaggagaaaggaaa

SEQ ID NO: 1492468 - RNA, 19 nt, Homo sapiens
uagcagaauuccuuaggua

SEQ ID NO: 1492469 - RNA, 19 nt, Homo sapiens
ggaaagcggcagagaaaga

SEQ ID NO: 1492470 - RNA, 19 nt, Homo sapiens
cgaagggcaugaagacaaa

SEQ ID NO: 1492471 - RNA, 19 nt, Homo sapiens
caucauuccuacuguguuu

SEQ ID NO: 1492472 - RNA, 19 nt, Homo sapiens
uaccugaacugucaucauu

SEQ ID NO: 1492473 - RNA, 19 nt, Homo sapiens
gagaugauugggcuucuua

SEQ ID NO: 1492474 - RNA, 19 nt, Homo sapiens
caaagugggagcagaagua

SEQ ID NO: 1492475 - RNA, 19 nt, Homo sapiens
gaaagaugcuaugauuaag

SEQ ID NO: 1492476 - RNA, 19 nt, Homo sapiens
ccgacaagcuccacaaguu

SEQ ID NO: 1492477 - RNA, 19 nt, Homo sapiens
ccugugacauauugcauua

SEQ ID NO: 1492478 - RNA, 19 nt, Homo sapiens
gaaagaagaaagaccuaga

SEQ ID NO: 1492479 - RNA, 19 nt, Homo sapiens
acagaacacugacaaacaa

SEQ ID NO: 1492480 - RNA, 19 nt, Homo sapiens
caaagggaccgcagagaaa

SEQ ID NO: 1492481 - RNA, 19 nt, Homo sapiens
cagccaacaugccggaaua

SEQ ID NO: 1492482 - RNA, 19 nt, Homo sapiens
aaaguucuguguugucaaa

SEQ ID NO: 1492483 - RNA, 19 nt, Homo sapiens
acacuggccuccauucuga

SEQ ID NO: 1492484 - RNA, 19 nt, Homo sapiens
gagagccugucuuggcaua

SEQ ID NO: 1492485 - RNA, 19 nt, Homo sapiens
gagagaagcaagcauaugu

SEQ ID NO: 1492486 - RNA, 19 nt, Homo sapiens
caacagagaccuccgagau

SEQ ID NO: 1492487 - RNA, 19 nt, Homo sapiens
ucugaauucugcaguauuu

SEQ ID NO: 1492488 - RNA, 19 nt, Homo sapiens
ucaagaagacccacaaaug

SEQ ID NO: 1492489 - RNA, 19 nt, Homo sapiens
guaugacccuuccgaguug

SEQ ID NO: 1492490 - RNA, 19 nt, Homo sapiens
ggaaggagucacacgguaa

SEQ ID NO: 1492491 - RNA, 19 nt, Homo sapiens
ccagaugccuuugcgauug

SEQ ID NO: 1492492 - RNA, 19 nt, Homo sapiens
caacuuccguucccaucaa

SEQ ID NO: 1492493 - RNA, 19 nt, Homo sapiens
gaagagaaugcgauggauu

SEQ ID NO: 1492494 - RNA, 19 nt, Homo sapiens
gcacacagacugacaagag

SEQ ID NO: 1492495 - RNA, 19 nt, Homo sapiens
cagcagcgaucucguaaag

SEQ ID NO: 1492496 - RNA, 19 nt, Homo sapiens
aagcauauguugagaaagu

SEQ ID NO: 1492497 - RNA, 19 nt, Homo sapiens
acaauacggugauggagaa

SEQ ID NO: 1492498 - RNA, 19 nt, Homo sapiens
caggaugacuccaggaaga

SEQ ID NO: 1492499 - RNA, 19 nt, Homo sapiens
caacaugccggaauacaau

SEQ ID NO: 1492500 - RNA, 19 nt, Homo sapiens
caugaaacaucugcuuuga

SEQ ID NO: 1492501 - RNA, 19 nt, Homo sapiens
ucaggaaccacaagagaua

SEQ ID NO: 1492502 - RNA, 19 nt, Homo sapiens
gaaggagucacacgguaaa

SEQ ID NO: 1492503 - RNA, 19 nt, Homo sapiens
cccauucucugauuauaaa

SEQ ID NO: 1492504 - RNA, 19 nt, Homo sapiens
gaaagcggcagagaaagaa

SEQ ID NO: 1492505 - RNA, 19 nt, Homo sapiens
caaauuggaaggcgagauu

SEQ ID NO: 1492506 - RNA, 19 nt, Homo sapiens
accaggaacuucaggguua

SEQ ID NO: 1492507 - RNA, 19 nt, Homo sapiens
gaauggaaagggcuucaaa

SEQ ID NO: 1492508 - RNA, 19 nt, Homo sapiens
gauaaggaauuaggucaca

SEQ ID NO: 1492509 - RNA, 19 nt, Homo sapiens
guacugcauuuguguuuag

SEQ ID NO: 1492510 - RNA, 19 nt, Homo sapiens
cagagaaacuggagaacuc

SEQ ID NO: 1492511 - RNA, 19 nt, Homo sapiens
caagaagacccacaaaugg

SEQ ID NO: 1492512 - RNA, 19 nt, Homo sapiens
gaagcuuucugucauaaaa

SEQ ID NO: 1492513 - RNA, 19 nt, Homo sapiens
ccaguaaucaucaguguga

SEQ ID NO: 1492514 - RNA, 19 nt, Homo sapiens
gaugggagcuguuuuguca

SEQ ID NO: 1492515 - RNA, 19 nt, Homo sapiens
agacauagcagaauuccuu

SEQ ID NO: 1492516 - RNA, 19 nt, Homo sapiens
ccucuuagcauguuugauu

SEQ ID NO: 1492517 - RNA, 19 nt, Homo sapiens
gagaagaggcguguagguu

SEQ ID NO: 1492518 - RNA, 19 nt, Homo sapiens
gagaagcaagcauauguug

SEQ ID NO: 1492519 - RNA, 19 nt, Homo sapiens
gaaagucuggucaagucua

SEQ ID NO: 1492520 - RNA, 19 nt, Homo sapiens
gcgcaggcccaucgugaua

SEQ ID NO: 1492521 - RNA, 19 nt, Homo sapiens
gagagugguuccugcuguu

SEQ ID NO: 1492522 - RNA, 19 nt, Homo sapiens
ccauucuccuugccucuua

SEQ ID NO: 1492523 - RNA, 19 nt, Homo sapiens
gaagcaaugaaauuccuuu

SEQ ID NO: 1492524 - RNA, 19 nt, Homo sapiens
cagcuggaguacugcauuu

SEQ ID NO: 1492525 - RNA, 19 nt, Homo sapiens
gcaugaaacaucugcuuug

SEQ ID NO: 1492526 - RNA, 19 nt, Homo sapiens
gacugaagauagaagagaa

SEQ ID NO: 1492527 - RNA, 19 nt, Homo sapiens
gauuucagacucauaagaa

SEQ ID NO: 1492528 - RNA, 19 nt, Homo sapiens
gaacacugacaaacaagga

SEQ ID NO: 1492529 - RNA, 19 nt, Homo sapiens
ccaaagggaccgcagagaa

SEQ ID NO: 1492530 - RNA, 19 nt, Homo sapiens
gaagcaagcauauguugag

SEQ ID NO: 1492531 - RNA, 19 nt, Homo sapiens
gaaggaaaaggagaaauua

SEQ ID NO: 1492532 - RNA, 19 nt, Homo sapiens
gaauuucggaagccuauga

SEQ ID NO: 1492533 - RNA, 19 nt, Homo sapiens
cgacaagcuccacaaguuu

SEQ ID NO: 1492534 - RNA, 19 nt, Homo sapiens
caaaugguggagauauuaa

SEQ ID NO: 1492535 - RNA, 19 nt, Homo sapiens
uggaaagggcuucaaagua

SEQ ID NO: 1492536 - RNA, 19 nt, Homo sapiens
ccacgcagccucagcagaa

SEQ ID NO: 1492537 - RNA, 19 nt, Homo sapiens
gugccuggguguccacuuu

SEQ ID NO: 1492538 - RNA, 19 nt, Homo sapiens
gguuguagaugggaaauca

SEQ ID NO: 1492539 - RNA, 19 nt, Homo sapiens
cuacuguguuugauaguga

SEQ ID NO: 1492540 - RNA, 19 nt, Homo sapiens
gcugcuaucucauguguua

SEQ ID NO: 1492541 - RNA, 19 nt, Homo sapiens
gaucuucuguuaucuuuga

SEQ ID NO: 1492542 - RNA, 19 nt, Homo sapiens
ggacaugcaucuccuaaag

SEQ ID NO: 1492543 - RNA, 19 nt, Homo sapiens
gcacacaccuguaguacca

SEQ ID NO: 1492544 - RNA, 19 nt, Homo sapiens
ucacagggcuggaaugcaa

SEQ ID NO: 1492545 - RNA, 19 nt, Homo sapiens
gauuaagacuguaguauac

SEQ ID NO: 1492546 - RNA, 19 nt, Homo sapiens
aagaauaguugcccacauu

SEQ ID NO: 1492547 - RNA, 19 nt, Homo sapiens
acacacagcuauccuagga

SEQ ID NO: 1492548 - RNA, 19 nt, Homo sapiens
acaaagaggcccaguacua

SEQ ID NO: 1492549 - RNA, 19 nt, Homo sapiens
gcugauagcuagggcuuga

SEQ ID NO: 1492550 - RNA, 19 nt, Homo sapiens
gcacccaguuggccuuaga

SEQ ID NO: 1492551 - RNA, 19 nt, Homo sapiens
uuggagaugugcugaauuu

SEQ ID NO: 1492552 - RNA, 19 nt, Homo sapiens
ccaaggaucuguuacuacu

SEQ ID NO: 1492553 - RNA, 19 nt, Homo sapiens
caaagaggcccaguacuau

SEQ ID NO: 1492554 - RNA, 19 nt, Homo sapiens
augccuagaucuucuguua

SEQ ID NO: 1492555 - RNA, 19 nt, Homo sapiens
gaaggugcgccaagcguuu

SEQ ID NO: 1492556 - RNA, 19 nt, Homo sapiens
gcacacacuuuggagaugu

SEQ ID NO: 1492557 - RNA, 19 nt, Homo sapiens
gggcuggaaugcaaauuuc

SEQ ID NO: 1492558 - RNA, 19 nt, Homo sapiens
gggugucucucucuaauca

SEQ ID NO: 1492559 - RNA, 19 nt, Homo sapiens
gauguaggccuaaucacuu

SEQ ID NO: 1492560 - RNA, 19 nt, Homo sapiens
gccuagaucuucuguuauc

SEQ ID NO: 1492561 - RNA, 19 nt, Homo sapiens
acuccucacuccucuauuu

SEQ ID NO: 1492562 - RNA, 19 nt, Homo sapiens
gaauccaguuuguggugaa

SEQ ID NO: 1492563 - RNA, 19 nt, Homo sapiens
ggcuguggcugauguuuau

SEQ ID NO: 1492564 - RNA, 19 nt, Homo sapiens
gaacaugcagccacugaag

SEQ ID NO: 1492565 - RNA, 19 nt, Homo sapiens
ggaguuuccugagguuguu

SEQ ID NO: 1492566 - RNA, 19 nt, Homo sapiens
gaacuguguagcaccauug

SEQ ID NO: 1492567 - RNA, 19 nt, Homo sapiens
cuacugcauuuccuucuug

SEQ ID NO: 1492568 - RNA, 19 nt, Homo sapiens
gagagugacgggcagcuuu

SEQ ID NO: 1492569 - RNA, 19 nt, Homo sapiens
caaggucugugucuucaag

SEQ ID NO: 1492570 - RNA, 19 nt, Homo sapiens
ggagauuaagacuguagua

SEQ ID NO: 1492571 - RNA, 19 nt, Homo sapiens
gagaguuucugcccauuuu

SEQ ID NO: 1492572 - RNA, 19 nt, Homo sapiens
gagaacaugcagccacuga

SEQ ID NO: 1492573 - RNA, 19 nt, Homo sapiens
cgagauggcacacacuuug

SEQ ID NO: 1492574 - RNA, 19 nt, Homo sapiens
cccaggagauuaagacugu

SEQ ID NO: 1492575 - RNA, 19 nt, Homo sapiens
ccucuguccugguaacauu

SEQ ID NO: 1492576 - RNA, 19 nt, Homo sapiens
gcaggguuaucuucucaca

SEQ ID NO: 1492577 - RNA, 19 nt, Homo sapiens
ggacucaugcccuauuaca

SEQ ID NO: 1492578 - RNA, 19 nt, Homo sapiens
ccagagggauggugguagu

SEQ ID NO: 1492579 - RNA, 19 nt, Homo sapiens
cuacgaagacaccauguug

SEQ ID NO: 1492580 - RNA, 19 nt, Homo sapiens
gagauuaagacuguaguau

SEQ ID NO: 1492581 - RNA, 19 nt, Homo sapiens
ccaggaacaugucuguagu

SEQ ID NO: 1492582 - RNA, 19 nt, Homo sapiens
uaucucauguguuagaauc

SEQ ID NO: 1492583 - RNA, 19 nt, Homo sapiens
caggaagucccgagaaguu

SEQ ID NO: 1492584 - RNA, 19 nt, Homo sapiens
gggaggcuguggcugaugu

SEQ ID NO: 1492585 - RNA, 19 nt, Homo sapiens
guagcaccauugaucacaa

SEQ ID NO: 1492586 - RNA, 19 nt, Homo sapiens
uuacuccucuauuucagaa

SEQ ID NO: 1492587 - RNA, 19 nt, Homo sapiens
gcuagggcuugaccaggaa

SEQ ID NO: 1492588 - RNA, 19 nt, Homo sapiens
gcucaaggucugugucuuc

SEQ ID NO: 1492589 - RNA, 19 nt, Homo sapiens
ugggacucaugcccuauua

SEQ ID NO: 1492590 - RNA, 19 nt, Homo sapiens
gagaugugcugaauuuccu

SEQ ID NO: 1492591 - RNA, 19 nt, Homo sapiens
uuaagggugucucucucua

SEQ ID NO: 1492592 - RNA, 19 nt, Homo sapiens
acuccucacuccuguauau

SEQ ID NO: 1492593 - RNA, 19 nt, Homo sapiens
gagacacacagcuauccua

SEQ ID NO: 1492594 - RNA, 19 nt, Homo sapiens
caagaauaguugcccacau

SEQ ID NO: 1492595 - RNA, 19 nt, Homo sapiens
acucaugcccuauuacaaa

SEQ ID NO: 1492596 - RNA, 19 nt, Homo sapiens
guggugaaccucuuuggaa

SEQ ID NO: 1492597 - RNA, 19 nt, Homo sapiens
uggagcagcuggagaacau

SEQ ID NO: 1492598 - RNA, 19 nt, Homo sapiens
gaucuguuacuacugcauu

SEQ ID NO: 1492599 - RNA, 19 nt, Homo sapiens
ucuguuaucuuugacaugu

SEQ ID NO: 1492600 - RNA, 19 nt, Homo sapiens
acaagcaccucgugaacca

SEQ ID NO: 1492601 - RNA, 19 nt, Homo sapiens
cgagcacacaccuguagua

SEQ ID NO: 1492602 - RNA, 19 nt, Homo sapiens
uaagggugucucucucuaa

SEQ ID NO: 1492603 - RNA, 19 nt, Homo sapiens
gugaaguggaugugucuuu

SEQ ID NO: 1492604 - RNA, 19 nt, Homo sapiens
cagggaggauguccaccuu

SEQ ID NO: 1492605 - RNA, 19 nt, Homo sapiens
ccucaacucccugcgauuu

SEQ ID NO: 1492606 - RNA, 19 nt, Homo sapiens
gcauuaagggugucucucu

SEQ ID NO: 1492607 - RNA, 19 nt, Homo sapiens
gguaacauucuccuucuag

SEQ ID NO: 1492608 - RNA, 19 nt, Homo sapiens
cuccuuggcugcuaucuca

SEQ ID NO: 1492609 - RNA, 19 nt, Homo sapiens
caugguagucuuuccuuga

SEQ ID NO: 1492610 - RNA, 19 nt, Homo sapiens
gaggauguccaccuugcuu

SEQ ID NO: 1492611 - RNA, 19 nt, Homo sapiens
uaaaggaagaacuguguag

SEQ ID NO: 1492612 - RNA, 19 nt, Homo sapiens
caccuggccuuuccucaag

SEQ ID NO: 1492613 - RNA, 19 nt, Homo sapiens
gccaggaacaugucuguag

SEQ ID NO: 1492614 - RNA, 19 nt, Homo sapiens
gcuaucucauguguuagaa

SEQ ID NO: 1492615 - RNA, 19 nt, Homo sapiens
ugacgccgaagacgacuuu

SEQ ID NO: 1492616 - RNA, 19 nt, Homo sapiens
cuugguggcucugggagua

SEQ ID NO: 1492617 - RNA, 19 nt, Homo sapiens
cuacacgccuguccacacu

SEQ ID NO: 1492618 - RNA, 19 nt, Homo sapiens
ucaaggcaugguagucuuu

SEQ ID NO: 1492619 - RNA, 19 nt, Homo sapiens
uguucgagcuguguacaaa

SEQ ID NO: 1492620 - RNA, 19 nt, Homo sapiens
gugucucucucuaaucaug

SEQ ID NO: 1492621 - RNA, 19 nt, Homo sapiens
aagggugucucucucuaau

SEQ ID NO: 1492622 - RNA, 19 nt, Homo sapiens
uuacuuacuccucuauuuc

SEQ ID NO: 1492623 - RNA, 19 nt, Homo sapiens
uggcugcuaucucaugugu

SEQ ID NO: 1492624 - RNA, 19 nt, Homo sapiens
ccuaaaggaagaacugugu

SEQ ID NO: 1492625 - RNA, 19 nt, Homo sapiens
ggcacacacuuuggagaug

SEQ ID NO: 1492626 - RNA, 19 nt, Homo sapiens
aaauuucagaggcuucuuu

SEQ ID NO: 1492627 - RNA, 19 nt, Homo sapiens
cggcuucucuuaucuucca

SEQ ID NO: 1492628 - RNA, 19 nt, Homo sapiens
gaccaggaagucccgagaa

SEQ ID NO: 1492629 - RNA, 19 nt, Homo sapiens
gaggcaggaggaucacuug

SEQ ID NO: 1492630 - RNA, 19 nt, Homo sapiens
aaagaggcccaguacuaug

SEQ ID NO: 1492631 - RNA, 19 nt, Homo sapiens
gagccaggaacaugucugu

SEQ ID NO: 1492632 - RNA, 19 nt, Homo sapiens
agaacuguguagcaccauu

SEQ ID NO: 1492633 - RNA, 19 nt, Homo sapiens
cuaaaggaagaacugugua

SEQ ID NO: 1492634 - RNA, 19 nt, Homo sapiens
guguuagaauccaguuugu

SEQ ID NO: 1492635 - RNA, 19 nt, Homo sapiens
ggagaugugcugaauuucc

SEQ ID NO: 1492636 - RNA, 19 nt, Homo sapiens
ugaaguggaugugucuuuu

SEQ ID NO: 1492637 - RNA, 19 nt, Homo sapiens
ugaccuugcaagagaguuu

SEQ ID NO: 1492638 - RNA, 19 nt, Homo sapiens
gugacaagcaccucgugaa

SEQ ID NO: 1492639 - RNA, 19 nt, Homo sapiens
gcuacgaagacaccauguu

SEQ ID NO: 1492640 - RNA, 19 nt, Homo sapiens
ucagagaacuccaauaaua

SEQ ID NO: 1492641 - RNA, 19 nt, Homo sapiens
gagcagacuuuacgaaaua

SEQ ID NO: 1492642 - RNA, 19 nt, Homo sapiens
gcaaaguucuguaauucua

SEQ ID NO: 1492643 - RNA, 19 nt, Homo sapiens
uaacaaaccugugcaugua

SEQ ID NO: 1492644 - RNA, 19 nt, Homo sapiens
uaagauagauacaggguaa

SEQ ID NO: 1492645 - RNA, 19 nt, Homo sapiens
gauaauaagugguagaauc

SEQ ID NO: 1492646 - RNA, 19 nt, Homo sapiens
uaacaaaggucaaugaucu

SEQ ID NO: 1492647 - RNA, 19 nt, Homo sapiens
gaaugaagcugcaucucaa

SEQ ID NO: 1492648 - RNA, 19 nt, Homo sapiens
cagagaaucuugcaaaguu

SEQ ID NO: 1492649 - RNA, 19 nt, Homo sapiens
gaagaacucagauaacaaa

SEQ ID NO: 1492650 - RNA, 19 nt, Homo sapiens
cgaauuugcuucuugguuu

SEQ ID NO: 1492651 - RNA, 19 nt, Homo sapiens
gaacauugacucagaaguu

SEQ ID NO: 1492652 - RNA, 19 nt, Homo sapiens
uaaagaacauugacucaga

SEQ ID NO: 1492653 - RNA, 19 nt, Homo sapiens
gcaggagggugaagauuga

SEQ ID NO: 1492654 - RNA, 19 nt, Homo sapiens
gaacagaaauuagaagcau

SEQ ID NO: 1492655 - RNA, 19 nt, Homo sapiens
caauaaagcucucuauggu

SEQ ID NO: 1492656 - RNA, 19 nt, Homo sapiens
gaauauagauagucguaca

SEQ ID NO: 1492657 - RNA, 19 nt, Homo sapiens
guagauacaggauaagaua

SEQ ID NO: 1492658 - RNA, 19 nt, Homo sapiens
ggaggacccuaucauguga

SEQ ID NO: 1492659 - RNA, 19 nt, Homo sapiens
gcaguugguucaagacuau

SEQ ID NO: 1492660 - RNA, 19 nt, Homo sapiens
ggaagguugugguaauuga

SEQ ID NO: 1492661 - RNA, 19 nt, Homo sapiens
gaacgucagcaaacuaauu

SEQ ID NO: 1492662 - RNA, 19 nt, Homo sapiens
ggaucuagauacguucuua

SEQ ID NO: 1492663 - RNA, 19 nt, Homo sapiens
aaagaaacccugaacauug

SEQ ID NO: 1492664 - RNA, 19 nt, Homo sapiens
gcacaucauuauugucuuc

SEQ ID NO: 1492665 - RNA, 19 nt, Homo sapiens
acacacaacuuacucaugu

SEQ ID NO: 1492666 - RNA, 19 nt, Homo sapiens
ccggacaucucaucuuuaa

SEQ ID NO: 1492667 - RNA, 19 nt, Homo sapiens
gaaacuggaggccaucuuu

SEQ ID NO: 1492668 - RNA, 19 nt, Homo sapiens
ggacaucucaucuuuaaag

SEQ ID NO: 1492669 - RNA, 19 nt, Homo sapiens
ggaaacagguuaaaacuca

SEQ ID NO: 1492670 - RNA, 19 nt, Homo sapiens
ggagcagacuuuacgaaau

SEQ ID NO: 1492671 - RNA, 19 nt, Homo sapiens
gcucugcucuugguaauug

SEQ ID NO: 1492672 - RNA, 19 nt, Homo sapiens
gagaauauagauagucgua

SEQ ID NO: 1492673 - RNA, 19 nt, Homo sapiens
gcaauaaagcucucuaugg

SEQ ID NO: 1492674 - RNA, 19 nt, Homo sapiens
ggaggcacaucauuauugu

SEQ ID NO: 1492675 - RNA, 19 nt, Homo sapiens
gcagcagguuucaagauug

SEQ ID NO: 1492676 - RNA, 19 nt, Homo sapiens
gacauagacuagaacagaa

SEQ ID NO: 1492677 - RNA, 19 nt, Homo sapiens
gagaacgucagcaaacuaa

SEQ ID NO: 1492678 - RNA, 19 nt, Homo sapiens
gaacaagcauugcguuuuc

SEQ ID NO: 1492679 - RNA, 19 nt, Homo sapiens
gaaaggaagguugugguaa

SEQ ID NO: 1492680 - RNA, 19 nt, Homo sapiens
ucaggaagccgaggaauaa

SEQ ID NO: 1492681 - RNA, 19 nt, Homo sapiens
ggaaaugccgcucgggaaa

SEQ ID NO: 1492682 - RNA, 19 nt, Homo sapiens
ggcagcagguuucaagauu

SEQ ID NO: 1492683 - RNA, 19 nt, Homo sapiens
cagagaacuccaauaauaa

SEQ ID NO: 1492684 - RNA, 19 nt, Homo sapiens
ccacagggcccaagggaaa

SEQ ID NO: 1492685 - RNA, 19 nt, Homo sapiens
aaaggaagguugugguaau

SEQ ID NO: 1492686 - RNA, 19 nt, Homo sapiens
acaacaagaccaauaguaa

SEQ ID NO: 1492687 - RNA, 19 nt, Homo sapiens
gagguuaggaaacagguua

SEQ ID NO: 1492688 - RNA, 19 nt, Homo sapiens
acaaaccucucaagcaguu

SEQ ID NO: 1492689 - RNA, 19 nt, Homo sapiens
gagcucuccugucuccuuu

SEQ ID NO: 1492690 - RNA, 19 nt, Homo sapiens
agaaucaccucacuugugu

SEQ ID NO: 1492691 - RNA, 19 nt, Homo sapiens
gacaggagguggugguugu

SEQ ID NO: 1492692 - RNA, 19 nt, Homo sapiens
aagaaacccugaacauugu

SEQ ID NO: 1492693 - RNA, 19 nt, Homo sapiens
gccaggaggcacaucauua

SEQ ID NO: 1492694 - RNA, 19 nt, Homo sapiens
ggugauaugugagagagaa

SEQ ID NO: 1492695 - RNA, 19 nt, Homo sapiens
ggacauagucuuccauugc

SEQ ID NO: 1492696 - RNA, 19 nt, Homo sapiens
aacauugacucagaaguua

SEQ ID NO: 1492697 - RNA, 19 nt, Homo sapiens
ucaagcaguugguucaaga

SEQ ID NO: 1492698 - RNA, 19 nt, Homo sapiens
guaacaaaccugugcaugu

SEQ ID NO: 1492699 - RNA, 19 nt, Homo sapiens
caaagaagggaacaauaga

SEQ ID NO: 1492700 - RNA, 19 nt, Homo sapiens
ccuagacaauaucagguua

SEQ ID NO: 1492701 - RNA, 19 nt, Homo sapiens
agaggugggugauauguga

SEQ ID NO: 1492702 - RNA, 19 nt, Homo sapiens
ggagaacgucagcaaacua

SEQ ID NO: 1492703 - RNA, 19 nt, Homo sapiens
aaagaacauugacucagaa

SEQ ID NO: 1492704 - RNA, 19 nt, Homo sapiens
gaaacgcggugcuggaaaa

SEQ ID NO: 1492705 - RNA, 19 nt, Homo sapiens
gagggccgauacugcauuu

SEQ ID NO: 1492706 - RNA, 19 nt, Homo sapiens
cucaauagcuugugcugaa

SEQ ID NO: 1492707 - RNA, 19 nt, Homo sapiens
cauauaacccuuaacacaa

SEQ ID NO: 1492708 - RNA, 19 nt, Homo sapiens
cauaaucuuugucaucugu

SEQ ID NO: 1492709 - RNA, 19 nt, Homo sapiens
gaauuugcuucuugguuuc

SEQ ID NO: 1492710 - RNA, 19 nt, Homo sapiens
gaacuccaauaauaauggu

SEQ ID NO: 1492711 - RNA, 19 nt, Homo sapiens
gauagacacugugaucaag

SEQ ID NO: 1492712 - RNA, 19 nt, Homo sapiens
caaguucagugaucagaca

SEQ ID NO: 1492713 - RNA, 19 nt, Homo sapiens
gagcauaaucuuugucauc

SEQ ID NO: 1492714 - RNA, 19 nt, Homo sapiens
acucagagaacuccaauaa

SEQ ID NO: 1492715 - RNA, 19 nt, Homo sapiens
ugacauagacuagaacaga

SEQ ID NO: 1492716 - RNA, 19 nt, Homo sapiens
caccugggaugagaauaua

SEQ ID NO: 1492717 - RNA, 19 nt, Homo sapiens
gaaucaggauagacacugu

SEQ ID NO: 1492718 - RNA, 19 nt, Homo sapiens
aaaggucaaugaucugaga

SEQ ID NO: 1492719 - RNA, 19 nt, Homo sapiens
ccacugggcuuuuacacua

SEQ ID NO: 1492720 - RNA, 19 nt, Homo sapiens
gaaggcagcagguuucaag

SEQ ID NO: 1492721 - RNA, 19 nt, Homo sapiens
cgucaacauuaauccauuu

SEQ ID NO: 1492722 - RNA, 19 nt, Homo sapiens
guuauuagaaucuccauug

SEQ ID NO: 1492723 - RNA, 19 nt, Homo sapiens
uggagguucugaaugauuu

SEQ ID NO: 1492724 - RNA, 19 nt, Homo sapiens
ucuuggagguucugaauga

SEQ ID NO: 1492725 - RNA, 19 nt, Homo sapiens
caaaacagcuguggcgaaa

SEQ ID NO: 1492726 - RNA, 19 nt, Homo sapiens
gaacggaggacccuaucau

SEQ ID NO: 1492727 - RNA, 19 nt, Homo sapiens
acagugacauagacuagaa

SEQ ID NO: 1492728 - RNA, 19 nt, Homo sapiens
ggauagacacugugaucaa

SEQ ID NO: 1492729 - RNA, 19 nt, Homo sapiens
agaaucaagucacaagaau

SEQ ID NO: 1492730 - RNA, 19 nt, Homo sapiens
ggacacuccuuccuucaac

SEQ ID NO: 1492731 - RNA, 19 nt, Homo sapiens
ccacaggacccgagcagaa

SEQ ID NO: 1492732 - RNA, 19 nt, Homo sapiens
gggaugagaauauagauag

SEQ ID NO: 1492733 - RNA, 19 nt, Homo sapiens
ccauauaacccuuaacaca

SEQ ID NO: 1492734 - RNA, 19 nt, Homo sapiens
aaacagcuguggcgaaacu

SEQ ID NO: 1492735 - RNA, 19 nt, Homo sapiens
ucuauggucucauccagaa

SEQ ID NO: 1492736 - RNA, 19 nt, Homo sapiens
cuggguagauacaggauaa

SEQ ID NO: 1492737 - RNA, 19 nt, Homo sapiens
ucaugaagaacucagauaa

SEQ ID NO: 1492738 - RNA, 19 nt, Homo sapiens
caauagacaccaggguaua

SEQ ID NO: 1492739 - RNA, 19 nt, Homo sapiens
cuagagaagguuauuagaa

SEQ ID NO: 1492740 - RNA, 19 nt, Homo sapiens
gaagaucacucucuaugaa

SEQ ID NO: 1492741 - RNA, 19 nt, Homo sapiens
gcagcucucuucaaucaga

SEQ ID NO: 1492742 - RNA, 19 nt, Homo sapiens
ggaaccgauugacauguaa

SEQ ID NO: 1492743 - RNA, 19 nt, Homo sapiens
caacaacccagccaccuuu

SEQ ID NO: 1492744 - RNA, 19 nt, Homo sapiens
ggaagaucacucucuauga

SEQ ID NO: 1492745 - RNA, 19 nt, Homo sapiens
ccgggagaguguuuacuua

SEQ ID NO: 1492746 - RNA, 19 nt, Homo sapiens
ggcagaagcuggaggucuu

SEQ ID NO: 1492747 - RNA, 19 nt, Homo sapiens
uggaaccgauugacaugua

SEQ ID NO: 1492748 - RNA, 19 nt, Homo sapiens
gggaagaucacucucuaug

SEQ ID NO: 1492749 - RNA, 19 nt, Homo sapiens
cggaagaggccaccacaaa

SEQ ID NO: 1492750 - RNA, 19 nt, Homo sapiens
gcaccugcaccguuucuga

SEQ ID NO: 1492751 - RNA, 19 nt, Homo sapiens
gucaagaacugugugaaca

SEQ ID NO: 1492752 - RNA, 19 nt, Homo sapiens
gcaacaacccagccaccuu

SEQ ID NO: 1492753 - RNA, 19 nt, Homo sapiens
gagaacauuuccgccuaga

SEQ ID NO: 1492754 - RNA, 19 nt, Homo sapiens
cgauugacauguaaaugca

SEQ ID NO: 1492755 - RNA, 19 nt, Homo sapiens
gaaccgauugacauguaaa

SEQ ID NO: 1492756 - RNA, 19 nt, Homo sapiens
gcauggagcccuagaagcu

SEQ ID NO: 1492757 - RNA, 19 nt, Homo sapiens
cuucggagcugaggacuuc

SEQ ID NO: 1492758 - RNA, 19 nt, Homo sapiens
caccuuuccugacugcaaa

SEQ ID NO: 1492759 - RNA, 19 nt, Homo sapiens
ggaagaggccaccacaaaa

SEQ ID NO: 1492760 - RNA, 19 nt, Homo sapiens
gccagcaguucaucuugga

SEQ ID NO: 1492761 - RNA, 19 nt, Homo sapiens
cuucgaggguugcaacuuc

SEQ ID NO: 1492762 - RNA, 19 nt, Homo sapiens
gagccugggucugcuucaa

SEQ ID NO: 1492763 - RNA, 19 nt, Homo sapiens
cgggagaguguuuacuuaa

SEQ ID NO: 1492764 - RNA, 19 nt, Homo sapiens
cagccacagugaccacaug

SEQ ID NO: 1492765 - RNA, 19 nt, Homo sapiens
ggucaagaacugugugaac

SEQ ID NO: 1492766 - RNA, 19 nt, Homo sapiens
ccagccaccuuuccugacu

SEQ ID NO: 1492767 - RNA, 19 nt, Homo sapiens
gccgggagaguguuuacuu

SEQ ID NO: 1492768 - RNA, 19 nt, Homo sapiens
gcagcauggagcccuagaa

SEQ ID NO: 1492769 - RNA, 19 nt, Homo sapiens
gccugggucugcuucaauc

SEQ ID NO: 1492770 - RNA, 19 nt, Homo sapiens
uuaaaaucaugcccucaaa

SEQ ID NO: 1492771 - RNA, 19 nt, Homo sapiens
cagcauggagcccuagaag

SEQ ID NO: 1492772 - RNA, 19 nt, Homo sapiens
gaacagagauuuccagguu

SEQ ID NO: 1492773 - RNA, 19 nt, Homo sapiens
gaugaucacuggagaaaga

SEQ ID NO: 1492774 - RNA, 19 nt, Homo sapiens
caaaggaacuucugcuugu

SEQ ID NO: 1492775 - RNA, 19 nt, Homo sapiens
aaacagaaguccaggaaga

SEQ ID NO: 1492776 - RNA, 19 nt, Homo sapiens
caaguagaauucucuguga

SEQ ID NO: 1492777 - RNA, 19 nt, Homo sapiens
ggacagcugccaccucuaa

SEQ ID NO: 1492778 - RNA, 19 nt, Homo sapiens
gcgauagacuaguuaagaa

SEQ ID NO: 1492779 - RNA, 19 nt, Homo sapiens
gcaucucauuugaucauua

SEQ ID NO: 1492780 - RNA, 19 nt, Homo sapiens
gggaguagcgguugcauuu

SEQ ID NO: 1492781 - RNA, 19 nt, Homo sapiens
caacgaacccuguaaauac

SEQ ID NO: 1492782 - RNA, 19 nt, Homo sapiens
cagcuugccucuccugaaa

SEQ ID NO: 1492783 - RNA, 19 nt, Homo sapiens
gggcccagauuucuugauu

SEQ ID NO: 1492784 - RNA, 19 nt, Homo sapiens
ggacaugggugagcucagu

SEQ ID NO: 1492785 - RNA, 19 nt, Homo sapiens
caaauauccauuccuguuu

SEQ ID NO: 1492786 - RNA, 19 nt, Homo sapiens
caacggagaggccaucuug

SEQ ID NO: 1492787 - RNA, 19 nt, Homo sapiens
ucaacgaacccuguaaaua

SEQ ID NO: 1492788 - RNA, 19 nt, Homo sapiens
caucuaacaucauaaaggu

SEQ ID NO: 1492789 - RNA, 19 nt, Homo sapiens
gugacucccuggccucaua

SEQ ID NO: 1492790 - RNA, 19 nt, Homo sapiens
gaaccaaauguccaaguug

SEQ ID NO: 1492791 - RNA, 19 nt, Homo sapiens
cuuaauaugugcacucuca

SEQ ID NO: 1492792 - RNA, 19 nt, Homo sapiens
gauaguguguuggaagguu

SEQ ID NO: 1492793 - RNA, 19 nt, Homo sapiens
guagaauucucugugaaau

SEQ ID NO: 1492794 - RNA, 19 nt, Homo sapiens
gcaggacagggauuucuuu

SEQ ID NO: 1492795 - RNA, 19 nt, Homo sapiens
gaaaugggagcgccguaga

SEQ ID NO: 1492796 - RNA, 19 nt, Homo sapiens
ugggagcgccguagaauuu

SEQ ID NO: 1492797 - RNA, 19 nt, Homo sapiens
ugacagugcccauucauuc

SEQ ID NO: 1492798 - RNA, 19 nt, Homo sapiens
aaaggaacuucugcuugua

SEQ ID NO: 1492799 - RNA, 19 nt, Homo sapiens
acaaauauccauuccuguu

SEQ ID NO: 1492800 - RNA, 19 nt, Homo sapiens
uccagcaucuaacaucaua

SEQ ID NO: 1492801 - RNA, 19 nt, Homo sapiens
agaaccaaauguccaaguu

SEQ ID NO: 1492802 - RNA, 19 nt, Homo sapiens
agaauucucugugaaaugg

SEQ ID NO: 1492803 - RNA, 19 nt, Homo sapiens
ggaaggagccugggaaagc

SEQ ID NO: 1492804 - RNA, 19 nt, Homo sapiens
cagcaucuaacaucauaaa

SEQ ID NO: 1492805 - RNA, 19 nt, Homo sapiens
cgagaugccucauucuacu

SEQ ID NO: 1492806 - RNA, 19 nt, Homo sapiens
guaccuguuuacacuucua

SEQ ID NO: 1492807 - RNA, 19 nt, Homo sapiens
guuccuaccacacaaauau

SEQ ID NO: 1492808 - RNA, 19 nt, Homo sapiens
uaaaggugggcccagauuu

SEQ ID NO: 1492809 - RNA, 19 nt, Homo sapiens
gugugguaguuucuuauuu

SEQ ID NO: 1492810 - RNA, 19 nt, Homo sapiens
ggcgauagacuaguuaaga

SEQ ID NO: 1492811 - RNA, 19 nt, Homo sapiens
ccacugguccucuuguuuc

SEQ ID NO: 1492812 - RNA, 19 nt, Homo sapiens
ucaccaggccucaaaggaa

SEQ ID NO: 1492813 - RNA, 19 nt, Homo sapiens
cauuugaucauuacuguga

SEQ ID NO: 1492814 - RNA, 19 nt, Homo sapiens
gugcauuucugucacuauc

SEQ ID NO: 1492815 - RNA, 19 nt, Homo sapiens
gcugccaccucuaaaccaa

SEQ ID NO: 1492816 - RNA, 19 nt, Homo sapiens
ggagaaagagaaacuaucc

SEQ ID NO: 1492817 - RNA, 19 nt, Homo sapiens
cagaaguccaggaagagua

SEQ ID NO: 1492818 - RNA, 19 nt, Homo sapiens
ggagauggagaagcugaaa

SEQ ID NO: 1492819 - RNA, 19 nt, Homo sapiens
guuggaagguuggccaguu

SEQ ID NO: 1492820 - RNA, 19 nt, Homo sapiens
ggagcgccguagaauuuua

SEQ ID NO: 1492821 - RNA, 19 nt, Homo sapiens
cgauagacuaguuaagaaa

SEQ ID NO: 1492822 - RNA, 19 nt, Homo sapiens
caucucauuugaucauuac

SEQ ID NO: 1492823 - RNA, 19 nt, Homo sapiens
gcauuucugucacuaucuc

SEQ ID NO: 1492824 - RNA, 19 nt, Homo sapiens
ccaagcucaucgaccacua

SEQ ID NO: 1492825 - RNA, 19 nt, Homo sapiens
ggcgagaugccucauucua

SEQ ID NO: 1492826 - RNA, 19 nt, Homo sapiens
ggacgaguugucugaaauc

SEQ ID NO: 1492827 - RNA, 19 nt, Homo sapiens
ccuguuuacacuucuaaua

SEQ ID NO: 1492828 - RNA, 19 nt, Homo sapiens
uuuauuaggcgauagacua

SEQ ID NO: 1492829 - RNA, 19 nt, Homo sapiens
gcccagauuucuugauucg

SEQ ID NO: 1492830 - RNA, 19 nt, Homo sapiens
aaggacgaguugucugaaa

SEQ ID NO: 1492831 - RNA, 19 nt, Homo sapiens
gcaucuaacaucauaaagg

SEQ ID NO: 1492832 - RNA, 19 nt, Homo sapiens
ccagucaccaggccucaaa

SEQ ID NO: 1492833 - RNA, 19 nt, Homo sapiens
uuugugugguaguuucuua

SEQ ID NO: 1492834 - RNA, 19 nt, Homo sapiens
caacuuuucucuauuuugg

SEQ ID NO: 1492835 - RNA, 19 nt, Homo sapiens
acacgguucuucccuaguc

SEQ ID NO: 1492836 - RNA, 19 nt, Homo sapiens
gaucacuggagaaagagaa

SEQ ID NO: 1492837 - RNA, 19 nt, Homo sapiens
gacagugcccauucauuca

SEQ ID NO: 1492838 - RNA, 19 nt, Homo sapiens
ccacacaaauauccauucc

SEQ ID NO: 1492839 - RNA, 19 nt, Homo sapiens
gaguagcgguugcauuucc

SEQ ID NO: 1492840 - RNA, 19 nt, Homo sapiens
gggagaaccaaauguccaa

SEQ ID NO: 1492841 - RNA, 19 nt, Homo sapiens
ggugggcccagauuucuug

SEQ ID NO: 1492842 - RNA, 19 nt, Homo sapiens
aaaggugggcccagauuuc

SEQ ID NO: 1492843 - RNA, 19 nt, Homo sapiens
gcgagaugccucauucuac

SEQ ID NO: 1492844 - RNA, 19 nt, Homo sapiens
gaccugacagugcccauuc

SEQ ID NO: 1492845 - RNA, 19 nt, Homo sapiens
caccucagccucucacugu

SEQ ID NO: 1492846 - RNA, 19 nt, Homo sapiens
ucugucuccuguucacuuu

SEQ ID NO: 1492847 - RNA, 19 nt, Homo sapiens
ugagucugauaguguguug

SEQ ID NO: 1492848 - RNA, 19 nt, Homo sapiens
gccguagaauuuuaaguaa

SEQ ID NO: 1492849 - RNA, 19 nt, Homo sapiens
aacagagauuuccagguuu

SEQ ID NO: 1492850 - RNA, 19 nt, Homo sapiens
aaguagaauucucugugaa

SEQ ID NO: 1492851 - RNA, 19 nt, Homo sapiens
acagagauuuccagguuuu

SEQ ID NO: 1492852 - RNA, 19 nt, Homo sapiens
auuaggcgauagacuaguu

SEQ ID NO: 1492853 - RNA, 19 nt, Homo sapiens
uaauaugugcacucucaga

SEQ ID NO: 1492854 - RNA, 19 nt, Homo sapiens
ucauucuacuggaacauca

SEQ ID NO: 1492855 - RNA, 19 nt, Homo sapiens
auaaggacgaguugucuga

SEQ ID NO: 1492856 - RNA, 19 nt, Homo sapiens
uaaaccaaguagaauucuc

SEQ ID NO: 1492857 - RNA, 19 nt, Homo sapiens
ggaccugacagugcccauu

SEQ ID NO: 1492858 - RNA, 19 nt, Homo sapiens
gccacugguccucuuguuu

SEQ ID NO: 1492859 - RNA, 19 nt, Homo sapiens
ggcccagauuucuugauuc

SEQ ID NO: 1492860 - RNA, 19 nt, Homo sapiens
gaccuuuggccuccacaga

SEQ ID NO: 1492861 - RNA, 19 nt, Homo sapiens
aggacgaguugucugaaau

SEQ ID NO: 1492862 - RNA, 19 nt, Homo sapiens
uuggaagguuggccaguug

SEQ ID NO: 1492863 - RNA, 19 nt, Homo sapiens
gagaaccaaauguccaagu

SEQ ID NO: 1492864 - RNA, 19 nt, Homo sapiens
gaagagcaacaggcgagau

SEQ ID NO: 1492865 - RNA, 19 nt, Homo sapiens
gcucacgggacccuguuug

SEQ ID NO: 1492866 - RNA, 19 nt, Homo sapiens
aguagaauucucugugaaa

SEQ ID NO: 1492867 - RNA, 19 nt, Homo sapiens
ccccaacuuuucucuauuu

SEQ ID NO: 1492868 - RNA, 19 nt, Homo sapiens
uagaauucucugugaaaug

SEQ ID NO: 1492869 - RNA, 19 nt, Homo sapiens
cguacauccuacugaccua

SEQ ID NO: 1492870 - RNA, 19 nt, Homo sapiens
ccucaugcauacuuuuauu

SEQ ID NO: 1492871 - RNA, 19 nt, Homo sapiens
ccagccuccuuaauaugug

SEQ ID NO: 1492872 - RNA, 19 nt, Homo sapiens
gaaaugcccugccuauuaa

SEQ ID NO: 1492873 - RNA, 19 nt, Homo sapiens
agaaaugcccugccuauua

SEQ ID NO: 1492874 - RNA, 19 nt, Homo sapiens
uaaaugagcucccagaaaa

SEQ ID NO: 1492875 - RNA, 19 nt, Homo sapiens
gauagucggugcccucagu

SEQ ID NO: 1492876 - RNA, 19 nt, Homo sapiens
ggaaggcgacccagguuga

SEQ ID NO: 1492877 - RNA, 19 nt, Homo sapiens
cguccaaccuucaauacaa

SEQ ID NO: 1492878 - RNA, 19 nt, Homo sapiens
cccaaaagcuccauuucua

SEQ ID NO: 1492879 - RNA, 19 nt, Homo sapiens
uuaaaugagcucccagaaa

SEQ ID NO: 1492880 - RNA, 19 nt, Homo sapiens
cgacccagguugaggaagu

SEQ ID NO: 1492881 - RNA, 19 nt, Homo sapiens
ucagaaaugcccugccuau

SEQ ID NO: 1492882 - RNA, 19 nt, Homo sapiens
caggugggcuggugugucu

SEQ ID NO: 1492883 - RNA, 19 nt, Homo sapiens
ggacuacgaccaggaugug

SEQ ID NO: 1492884 - RNA, 19 nt, Homo sapiens
gaccaacucguccaaccuu

SEQ ID NO: 1492885 - RNA, 19 nt, Homo sapiens
ugcccugccuauuaaauga

SEQ ID NO: 1492886 - RNA, 19 nt, Homo sapiens
ggugguauccggcaucucu

SEQ ID NO: 1492887 - RNA, 19 nt, Homo sapiens
caacucguccaaccuucaa

SEQ ID NO: 1492888 - RNA, 19 nt, Homo sapiens
cagaaaugcccugccuauu

SEQ ID NO: 1492889 - RNA, 19 nt, Homo sapiens
guccaaccuucaauacaag

SEQ ID NO: 1492890 - RNA, 19 nt, Homo sapiens
caaaagcuccauuucuaug

SEQ ID NO: 1492891 - RNA, 19 nt, Homo sapiens
aaugggaccuccgaaccaa

SEQ ID NO: 1492892 - RNA, 19 nt, Homo sapiens
ggcuucaucuccggcauug

SEQ ID NO: 1492893 - RNA, 19 nt, Homo sapiens
gacccagguugaggaagug

SEQ ID NO: 1492894 - RNA, 19 nt, Homo sapiens
gaggugguauccggcaucu

SEQ ID NO: 1492895 - RNA, 19 nt, Homo sapiens
gaaagaccauucuguauuu

SEQ ID NO: 1492896 - RNA, 19 nt, Homo sapiens
ggaaagaccauucuguauu

SEQ ID NO: 1492897 - RNA, 19 nt, Homo sapiens
gcagguccuugucuuugua

SEQ ID NO: 1492898 - RNA, 19 nt, Homo sapiens
caauaaaugugaugaugag

SEQ ID NO: 1492899 - RNA, 19 nt, Homo sapiens
uaaaugugaugaugaggau

SEQ ID NO: 1492900 - RNA, 19 nt, Homo sapiens
caggaaagaccauucugua

SEQ ID NO: 1492901 - RNA, 19 nt, Homo sapiens
gucaauaaaugugaugaug

SEQ ID NO: 1492902 - RNA, 19 nt, Homo sapiens
gagggcagguccuugucuu

SEQ ID NO: 1492903 - RNA, 19 nt, Homo sapiens
gcugcaggcugagcuagaa

SEQ ID NO: 1492904 - RNA, 19 nt, Homo sapiens
ggcagguccuugucuuugu

SEQ ID NO: 1492905 - RNA, 19 nt, Homo sapiens
gggcagguccuugucuuug

SEQ ID NO: 1492906 - RNA, 19 nt, Homo sapiens
guccuugucuuuguacguu

SEQ ID NO: 1492907 - RNA, 19 nt, Homo sapiens
cugaagacacccugccuuu

SEQ ID NO: 1492908 - RNA, 19 nt, Homo sapiens
gucccugucuccuuagaau

SEQ ID NO: 1492909 - RNA, 19 nt, Homo sapiens
acuacgcgcuggccaagga

SEQ ID NO: 1492910 - RNA, 19 nt, Homo sapiens
ccaggaaagaccauucugu

SEQ ID NO: 1492911 - RNA, 19 nt, Homo sapiens
caucaaauaccaggagcuu

SEQ ID NO: 1492912 - RNA, 19 nt, Homo sapiens
gaccagccccguuaaagaa

SEQ ID NO: 1492913 - RNA, 19 nt, Homo sapiens
aggaaagaccauucuguau

SEQ ID NO: 1492914 - RNA, 19 nt, Homo sapiens
cguuaaagaacuugacuca

SEQ ID NO: 1492915 - RNA, 19 nt, Homo sapiens
ggaccagccccguuaaaga

SEQ ID NO: 1492916 - RNA, 19 nt, Homo sapiens
ggacgcaggcagagaagcu

SEQ ID NO: 1492917 - RNA, 19 nt, Homo sapiens
gggccuagacaaacuugau

SEQ ID NO: 1492918 - RNA, 19 nt, Homo sapiens
ggaggcagaggagcagaug

SEQ ID NO: 1492919 - RNA, 19 nt, Homo sapiens
aaugugaugaugaggauga

SEQ ID NO: 1492920 - RNA, 19 nt, Homo sapiens
uucugucccugucuccuua

SEQ ID NO: 1492921 - RNA, 19 nt, Homo sapiens
caggugagagugggccaua

SEQ ID NO: 1492922 - RNA, 19 nt, Homo sapiens
ccaggaguguuuuacauca

SEQ ID NO: 1492923 - RNA, 19 nt, Homo sapiens
gggaagaucuuugccuuug

SEQ ID NO: 1492924 - RNA, 19 nt, Homo sapiens
caagggugcuaguguauga

SEQ ID NO: 1492925 - RNA, 19 nt, Homo sapiens
gcacaccgccuugcacaua

SEQ ID NO: 1492926 - RNA, 19 nt, Homo sapiens
agacagaucugcaugaaca

SEQ ID NO: 1492927 - RNA, 19 nt, Homo sapiens
ggaagaucuuugccuuuga

SEQ ID NO: 1492928 - RNA, 19 nt, Homo sapiens
gacaagguuucuccuauca

SEQ ID NO: 1492929 - RNA, 19 nt, Homo sapiens
ggccaagggugcuagugua

SEQ ID NO: 1492930 - RNA, 19 nt, Homo sapiens
aguguugccugcagaaaua

SEQ ID NO: 1492931 - RNA, 19 nt, Homo sapiens
gaaagaagagacagcaaag

SEQ ID NO: 1492932 - RNA, 19 nt, Homo sapiens
guaguuauuucaagagaca

SEQ ID NO: 1492933 - RNA, 19 nt, Homo sapiens
gaaccaagggaagaucuuu

SEQ ID NO: 1492934 - RNA, 19 nt, Homo sapiens
gcaauaagaccagucacuu

SEQ ID NO: 1492935 - RNA, 19 nt, Homo sapiens
gaccugcuccguuuaugua

SEQ ID NO: 1492936 - RNA, 19 nt, Homo sapiens
ucacuuggcugcucuucug

SEQ ID NO: 1492937 - RNA, 19 nt, Homo sapiens
gaaauaaaaugcagaacgu

SEQ ID NO: 1492938 - RNA, 19 nt, Homo sapiens
cucaagaccugcuccguuu

SEQ ID NO: 1492939 - RNA, 19 nt, Homo sapiens
gaagaucuuugccuuugac

SEQ ID NO: 1492940 - RNA, 19 nt, Homo sapiens
gcuaguguaugaguuguug

SEQ ID NO: 1492941 - RNA, 19 nt, Homo sapiens
caaagcaucagcaccagaa

SEQ ID NO: 1492942 - RNA, 19 nt, Homo sapiens
caggcgagguguugaguug

SEQ ID NO: 1492943 - RNA, 19 nt, Homo sapiens
uguaugaguuguugggaaa

SEQ ID NO: 1492944 - RNA, 19 nt, Homo sapiens
caauaagaccagucacuug

SEQ ID NO: 1492945 - RNA, 19 nt, Homo sapiens
cuucuucguugcuguaauu

SEQ ID NO: 1492946 - RNA, 19 nt, Homo sapiens
gagcagcugggauuaugaa

SEQ ID NO: 1492947 - RNA, 19 nt, Homo sapiens
cuucguugcuguaauugaa

SEQ ID NO: 1492948 - RNA, 19 nt, Homo sapiens
agaaagaagagacagcaaa

SEQ ID NO: 1492949 - RNA, 19 nt, Homo sapiens
ccaagcggcuggcauccau

SEQ ID NO: 1492950 - RNA, 19 nt, Homo sapiens
agacaagguuucuccuauc

SEQ ID NO: 1492951 - RNA, 19 nt, Homo sapiens
ccucccagcugccucgauu

SEQ ID NO: 1492952 - RNA, 19 nt, Homo sapiens
caagaccugcuccguuuau

SEQ ID NO: 1492953 - RNA, 19 nt, Homo sapiens
cagccuugaugacuuacaa

SEQ ID NO: 1492954 - RNA, 19 nt, Homo sapiens
ccagcugccucgauuugug

SEQ ID NO: 1492955 - RNA, 19 nt, Homo sapiens
ugccggagcugcugguguu

SEQ ID NO: 1492956 - RNA, 19 nt, Homo sapiens
caaagagaaagaagagaca

SEQ ID NO: 1492957 - RNA, 19 nt, Homo sapiens
ccaauggaaggcucuguug

SEQ ID NO: 1492958 - RNA, 19 nt, Homo sapiens
gccaggaggagaaugaaga

SEQ ID NO: 1492959 - RNA, 19 nt, Homo sapiens
gcaugaacacccacuguac

SEQ ID NO: 1492960 - RNA, 19 nt, Homo sapiens
gaagaaccaagggaagauc

SEQ ID NO: 1492961 - RNA, 19 nt, Homo sapiens
ucaagaccugcuccguuua

SEQ ID NO: 1492962 - RNA, 19 nt, Homo sapiens
gagaaagaagagacagcaa

SEQ ID NO: 1492963 - RNA, 19 nt, Homo sapiens
gauaucucaucagccuuga

SEQ ID NO: 1492964 - RNA, 19 nt, Homo sapiens
cugagcagcugggauuaug

SEQ ID NO: 1492965 - RNA, 19 nt, Homo sapiens
ccguuuauguaguuauuuc

SEQ ID NO: 1492966 - RNA, 19 nt, Homo sapiens
gcaugaggaccuguuggaa

SEQ ID NO: 1492967 - RNA, 19 nt, Homo sapiens
uaauugaacgggucgagau

SEQ ID NO: 1492968 - RNA, 19 nt, Homo sapiens
cuucugagcagcugggauu

SEQ ID NO: 1492969 - RNA, 19 nt, Homo sapiens
cugcuccguuuauguaguu

SEQ ID NO: 1492970 - RNA, 19 nt, Homo sapiens
gaacgugaagcagcuguac

SEQ ID NO: 1492971 - RNA, 19 nt, Homo sapiens
ggugcuaguguaugaguug

SEQ ID NO: 1492972 - RNA, 19 nt, Homo sapiens
augaggaccuguuggaagu

SEQ ID NO: 1492973 - RNA, 19 nt, Homo sapiens
aagaagagacagcaaagag

SEQ ID NO: 1492974 - RNA, 19 nt, Homo sapiens
gccaagggugcuaguguau

SEQ ID NO: 1492975 - RNA, 19 nt, Homo sapiens
ucugugggauaucucauca

SEQ ID NO: 1492976 - RNA, 19 nt, Homo sapiens
gcagaaauaaaaugcagaa

SEQ ID NO: 1492977 - RNA, 19 nt, Homo sapiens
aaagaagagacagcaaaga

SEQ ID NO: 1492978 - RNA, 19 nt, Homo sapiens
gccaauggaaggcucuguu

SEQ ID NO: 1492979 - RNA, 19 nt, Homo sapiens
gagcagacagcuggaggau

SEQ ID NO: 1492980 - RNA, 19 nt, Homo sapiens
ggcaugaggaccuguugga

SEQ ID NO: 1492981 - RNA, 19 nt, Homo sapiens
uggcucgggugagauggua

SEQ ID NO: 1492982 - RNA, 19 nt, Homo sapiens
ugacuuacaagcccucaag

SEQ ID NO: 1492983 - RNA, 19 nt, Homo sapiens
gaagaaagcauuaagacuu

SEQ ID NO: 1492984 - RNA, 19 nt, Homo sapiens
ugacauagcuggaagauac

SEQ ID NO: 1492985 - RNA, 19 nt, Homo sapiens
gguacaaacuuaugaagaa

SEQ ID NO: 1492986 - RNA, 19 nt, Homo sapiens
ucacuuggguacaaacuua

SEQ ID NO: 1492987 - RNA, 19 nt, Homo sapiens
gaagauacucuaacagauu

SEQ ID NO: 1492988 - RNA, 19 nt, Homo sapiens
gaagucaaauuucaugaag

SEQ ID NO: 1492989 - RNA, 19 nt, Homo sapiens
caagaaauggcucagaaua

SEQ ID NO: 1492990 - RNA, 19 nt, Homo sapiens
ucaauacucucaagcacua

SEQ ID NO: 1492991 - RNA, 19 nt, Homo sapiens
ggaagauacucuaacagau

SEQ ID NO: 1492992 - RNA, 19 nt, Homo sapiens
gaaaaccucuggcacauug

SEQ ID NO: 1492993 - RNA, 19 nt, Homo sapiens
ugaaaccacugauaagaau

SEQ ID NO: 1492994 - RNA, 19 nt, Homo sapiens
ugacaucacuuggguacaa

SEQ ID NO: 1492995 - RNA, 19 nt, Homo sapiens
cauaugagccucgggauuu

SEQ ID NO: 1492996 - RNA, 19 nt, Homo sapiens
gcuggaagauacucuaaca

SEQ ID NO: 1492997 - RNA, 19 nt, Homo sapiens
uacaagaaauggcucagaa

SEQ ID NO: 1492998 - RNA, 19 nt, Homo sapiens
ucuggcacauugacaaaua

SEQ ID NO: 1492999 - RNA, 19 nt, Homo sapiens
cuaacagauuguacacaua

SEQ ID NO: 1493000 - RNA, 19 nt, Homo sapiens
agaaauggcucagaauaag

SEQ ID NO: 1493001 - RNA, 19 nt, Homo sapiens
gaagaaauacaagaaaugg

SEQ ID NO: 1493002 - RNA, 19 nt, Homo sapiens
aagauacucuaacagauug

SEQ ID NO: 1493003 - RNA, 19 nt, Homo sapiens
agucagagcuauaagagau

SEQ ID NO: 1493004 - RNA, 19 nt, Homo sapiens
ggauuuaccccuauugaua

SEQ ID NO: 1493005 - RNA, 19 nt, Homo sapiens
uagaagacaugaugcuaca

SEQ ID NO: 1493006 - RNA, 19 nt, Homo sapiens
aagaaauggcucagaauaa

SEQ ID NO: 1493007 - RNA, 19 nt, Homo sapiens
guuuguagacccuucuuua

SEQ ID NO: 1493008 - RNA, 19 nt, Homo sapiens
uguagacccuucuuuaaca

SEQ ID NO: 1493009 - RNA, 19 nt, Homo sapiens
caauaugugccuagaauca

SEQ ID NO: 1493010 - RNA, 19 nt, Homo sapiens
ugcuaaaccuuaugcauga

SEQ ID NO: 1493011 - RNA, 19 nt, Homo sapiens
gaauaaguucaucaugcua

SEQ ID NO: 1493012 - RNA, 19 nt, Homo sapiens
gcacuaaagaaaguauuug

SEQ ID NO: 1493013 - RNA, 19 nt, Homo sapiens
guacaaacuuaugaagaag

SEQ ID NO: 1493014 - RNA, 19 nt, Homo sapiens
gaaauggcucagaauaagu

SEQ ID NO: 1493015 - RNA, 19 nt, Homo sapiens
ucuaacagauuguacacau

SEQ ID NO: 1493016 - RNA, 19 nt, Homo sapiens
ucagagcuauaagagauga

SEQ ID NO: 1493017 - RNA, 19 nt, Homo sapiens
gaaaccacugauaagaauu

SEQ ID NO: 1493018 - RNA, 19 nt, Homo sapiens
caugaaaccacugauaaga

SEQ ID NO: 1493019 - RNA, 19 nt, Homo sapiens
gacaucacuuggguacaaa

SEQ ID NO: 1493020 - RNA, 19 nt, Homo sapiens
auaugagccucgggauuua

SEQ ID NO: 1493021 - RNA, 19 nt, Homo sapiens
uggaagauacucuaacaga

SEQ ID NO: 1493022 - RNA, 19 nt, Homo sapiens
gcaugaaaccacugauaag

SEQ ID NO: 1493023 - RNA, 19 nt, Homo sapiens
cuagaaucauguuuguaga

SEQ ID NO: 1493024 - RNA, 19 nt, Homo sapiens
agaauaaguucaucaugcu

SEQ ID NO: 1493025 - RNA, 19 nt, Homo sapiens
gaagacaugaugcuacacu

SEQ ID NO: 1493026 - RNA, 19 nt, Homo sapiens
caugaagaaagcauuaaga

SEQ ID NO: 1493027 - RNA, 19 nt, Homo sapiens
ccuagaaucauguuuguag

SEQ ID NO: 1493028 - RNA, 19 nt, Homo sapiens
gaugcuacacucagcuuug

SEQ ID NO: 1493029 - RNA, 19 nt, Homo sapiens
gcuaaaccuuaugcaugaa

SEQ ID NO: 1493030 - RNA, 19 nt, Homo sapiens
ugcaugaaaccacugauaa

SEQ ID NO: 1493031 - RNA, 19 nt, Homo sapiens
aaauggcucagaauaaguu

SEQ ID NO: 1493032 - RNA, 19 nt, Homo sapiens
cacaguuucuuccaaccuu

SEQ ID NO: 1493033 - RNA, 19 nt, Homo sapiens
ggguacaaacuuaugaaga

SEQ ID NO: 1493034 - RNA, 19 nt, Homo sapiens
gcucagaauaaguucauca

SEQ ID NO: 1493035 - RNA, 19 nt, Homo sapiens
gauacucuaacagauugua

SEQ ID NO: 1493036 - RNA, 19 nt, Homo sapiens
agacccuucuuuaacaguu

SEQ ID NO: 1493037 - RNA, 19 nt, Homo sapiens
gcaauaugugccuagaauc

SEQ ID NO: 1493038 - RNA, 19 nt, Homo sapiens
cucaagcacuaaagaaagu

SEQ ID NO: 1493039 - RNA, 19 nt, Homo sapiens
uucaucaccuggaggauug

SEQ ID NO: 1493040 - RNA, 19 nt, Homo sapiens
acaaacuuaugaagaaggu

SEQ ID NO: 1493041 - RNA, 19 nt, Homo sapiens
guagacccuucuuuaacag

SEQ ID NO: 1493042 - RNA, 19 nt, Homo sapiens
acagauuguacacauauga

SEQ ID NO: 1493043 - RNA, 19 nt, Homo sapiens
uuuguagacccuucuuuaa

SEQ ID NO: 1493044 - RNA, 19 nt, Homo sapiens
gugccuagaaucauguuug

SEQ ID NO: 1493045 - RNA, 19 nt, Homo sapiens
ucaucaugcuaaaccuuau

SEQ ID NO: 1493046 - RNA, 19 nt, Homo sapiens
ugccuagaaucauguuugu

SEQ ID NO: 1493047 - RNA, 19 nt, Homo sapiens
ugcccaaaaugaagaaaua

SEQ ID NO: 1493048 - RNA, 19 nt, Homo sapiens
uagcuggaagauacucuaa

SEQ ID NO: 1493049 - RNA, 19 nt, Homo sapiens
caccugaugggcaauaugu

SEQ ID NO: 1493050 - RNA, 19 nt, Homo sapiens
cuaaaccuuaugcaugaaa

SEQ ID NO: 1493051 - RNA, 19 nt, Homo sapiens
auaugugccuagaaucaug

SEQ ID NO: 1493052 - RNA, 19 nt, Homo sapiens
ccucuuacucgucacaguu

SEQ ID NO: 1493053 - RNA, 19 nt, Homo sapiens
ugaagaaagcauuaagacu

SEQ ID NO: 1493054 - RNA, 19 nt, Homo sapiens
caagcacuaaagaaaguau

SEQ ID NO: 1493055 - RNA, 19 nt, Homo sapiens
gcaaacagguuggauagaa

SEQ ID NO: 1493056 - RNA, 19 nt, Homo sapiens
ugaaaugagugacugcuuu

SEQ ID NO: 1493057 - RNA, 19 nt, Homo sapiens
gaguaaagcaggccuguaa

SEQ ID NO: 1493058 - RNA, 19 nt, Homo sapiens
gcaggauucugaggaguaa

SEQ ID NO: 1493059 - RNA, 19 nt, Homo sapiens
auacaucccuccucuggua

SEQ ID NO: 1493060 - RNA, 19 nt, Homo sapiens
gcacugaaccaucucaugu

SEQ ID NO: 1493061 - RNA, 19 nt, Homo sapiens
ccagagaacaugaaauuau

SEQ ID NO: 1493062 - RNA, 19 nt, Homo sapiens
guagucugguugugucaua

SEQ ID NO: 1493063 - RNA, 19 nt, Homo sapiens
ccauauccauuccaugaaa

SEQ ID NO: 1493064 - RNA, 19 nt, Homo sapiens
ggauagcaguggagagguu

SEQ ID NO: 1493065 - RNA, 19 nt, Homo sapiens
cagagaacaugaaauuauc

SEQ ID NO: 1493066 - RNA, 19 nt, Homo sapiens
gcgcaacuuucuaauaaca

SEQ ID NO: 1493067 - RNA, 19 nt, Homo sapiens
gaaaugagugacugcuuug

SEQ ID NO: 1493068 - RNA, 19 nt, Homo sapiens
aaagcaggccuguaaagua

SEQ ID NO: 1493069 - RNA, 19 nt, Homo sapiens
augcgcaacuuucuaauaa

SEQ ID NO: 1493070 - RNA, 19 nt, Homo sapiens
gaugcgcaacuuucuaaua

SEQ ID NO: 1493071 - RNA, 19 nt, Homo sapiens
gaaagugcccagacauaca

SEQ ID NO: 1493072 - RNA, 19 nt, Homo sapiens
ugacugcuuuguugaauca

SEQ ID NO: 1493073 - RNA, 19 nt, Homo sapiens
gcccauauccauuccauga

SEQ ID NO: 1493074 - RNA, 19 nt, Homo sapiens
uaacagcccauauccauuc

SEQ ID NO: 1493075 - RNA, 19 nt, Homo sapiens
uaucaugguugaauugcaa

SEQ ID NO: 1493076 - RNA, 19 nt, Homo sapiens
ccaaagugcugggauuaca

SEQ ID NO: 1493077 - RNA, 19 nt, Homo sapiens
ggauagaagagucagcaaa

SEQ ID NO: 1493078 - RNA, 19 nt, Homo sapiens
caaacagguuggauagaag

SEQ ID NO: 1493079 - RNA, 19 nt, Homo sapiens
caacaaaagcauucuguaa

SEQ ID NO: 1493080 - RNA, 19 nt, Homo sapiens
ggccaucaguugccagaga

SEQ ID NO: 1493081 - RNA, 19 nt, Homo sapiens
caaguggcccugggaagua

SEQ ID NO: 1493082 - RNA, 19 nt, Homo sapiens
ucaaugggguggaaacuuu

SEQ ID NO: 1493083 - RNA, 19 nt, Homo sapiens
aagcaggccuguaaaguac

SEQ ID NO: 1493084 - RNA, 19 nt, Homo sapiens
gugaugcgcaacuuucuaa

SEQ ID NO: 1493085 - RNA, 19 nt, Homo sapiens
ugaaccaucucaugugucu

SEQ ID NO: 1493086 - RNA, 19 nt, Homo sapiens
gccaucaguugccagagaa

SEQ ID NO: 1493087 - RNA, 19 nt, Homo sapiens
caaaccagcaagauggaaa

SEQ ID NO: 1493088 - RNA, 19 nt, Homo sapiens
ccacccagaugguacucaa

SEQ ID NO: 1493089 - RNA, 19 nt, Homo sapiens
gcaaguggcccugggaagu

SEQ ID NO: 1493090 - RNA, 19 nt, Homo sapiens
gagagguaaugccacaaag

SEQ ID NO: 1493091 - RNA, 19 nt, Homo sapiens
ugccagagaacaugaaauu

SEQ ID NO: 1493092 - RNA, 19 nt, Homo sapiens
guaaagcaggccuguaaag

SEQ ID NO: 1493093 - RNA, 19 nt, Homo sapiens
gauagaagagucagcaaaa

SEQ ID NO: 1493094 - RNA, 19 nt, Homo sapiens
ucagaagggugaguuagca

SEQ ID NO: 1493095 - RNA, 19 nt, Homo sapiens
ggaaguacaugccccaucu

SEQ ID NO: 1493096 - RNA, 19 nt, Homo sapiens
gccagagaacaugaaauua

SEQ ID NO: 1493097 - RNA, 19 nt, Homo sapiens
gucauaucaugguugaauu

SEQ ID NO: 1493098 - RNA, 19 nt, Homo sapiens
augagugacugcuuuguug

SEQ ID NO: 1493099 - RNA, 19 nt, Homo sapiens
guaacagcccauauccauu

SEQ ID NO: 1493100 - RNA, 19 nt, Homo sapiens
aaccaucucaugugucuuu

SEQ ID NO: 1493101 - RNA, 19 nt, Homo sapiens
cauauccauuccaugaaau

SEQ ID NO: 1493102 - RNA, 19 nt, Homo sapiens
ccuguaaaguacucuaaag

SEQ ID NO: 1493103 - RNA, 19 nt, Homo sapiens
uaaagcaggccuguaaagu

SEQ ID NO: 1493104 - RNA, 19 nt, Homo sapiens
ucaccaaaccagcaagaug

SEQ ID NO: 1493105 - RNA, 19 nt, Homo sapiens
ggaguaaagcaggccugua

SEQ ID NO: 1493106 - RNA, 19 nt, Homo sapiens
aaacagguuggauagaaga

SEQ ID NO: 1493107 - RNA, 19 nt, Homo sapiens
ugugucauaucaugguuga

SEQ ID NO: 1493108 - RNA, 19 nt, Homo sapiens
uugaaagugcccagacaua

SEQ ID NO: 1493109 - RNA, 19 nt, Homo sapiens
gagugacugcuuuguugaa

SEQ ID NO: 1493110 - RNA, 19 nt, Homo sapiens
gauagcaguggagagguuu

SEQ ID NO: 1493111 - RNA, 19 nt, Homo sapiens
guacuucagagagguaaug

SEQ ID NO: 1493112 - RNA, 19 nt, Homo sapiens
ucaugugucuuuucacuga

SEQ ID NO: 1493113 - RNA, 19 nt, Homo sapiens
gcaggccuguaaaguacuc

SEQ ID NO: 1493114 - RNA, 19 nt, Homo sapiens
ucauaucaugguugaauug

SEQ ID NO: 1493115 - RNA, 19 nt, Homo sapiens
acugaaccaucucaugugu

SEQ ID NO: 1493116 - RNA, 19 nt, Homo sapiens
ccccaucucugucaggaua

SEQ ID NO: 1493117 - RNA, 19 nt, Homo sapiens
agagagguaaugccacaaa

SEQ ID NO: 1493118 - RNA, 19 nt, Homo sapiens
guacaugccccaucucugu

SEQ ID NO: 1493119 - RNA, 19 nt, Homo sapiens
ugucauaucaugguugaau

SEQ ID NO: 1493120 - RNA, 19 nt, Homo sapiens
cugguugugucauaucaug

SEQ ID NO: 1493121 - RNA, 19 nt, Homo sapiens
ugaaagugcccagacauac

SEQ ID NO: 1493122 - RNA, 19 nt, Homo sapiens
aaaguacuucagagaggua

SEQ ID NO: 1493123 - RNA, 19 nt, Homo sapiens
aguaacagcccauauccau

SEQ ID NO: 1493124 - RNA, 19 nt, Homo sapiens
caucucaugugucuuuuca

SEQ ID NO: 1493125 - RNA, 19 nt, Homo sapiens
acuccaagccugucaaugg

SEQ ID NO: 1493126 - RNA, 19 nt, Homo sapiens
ggccuguaaaguacucuaa

SEQ ID NO: 1493127 - RNA, 19 nt, Homo sapiens
gcaguuccauuucauuauu

SEQ ID NO: 1493128 - RNA, 19 nt, Homo sapiens
uagaagagcucaggaguga

SEQ ID NO: 1493129 - RNA, 19 nt, Homo sapiens
gcagcuggcuuguagaaga

SEQ ID NO: 1493130 - RNA, 19 nt, Homo sapiens
ggaugcagcuggcuuguag

SEQ ID NO: 1493131 - RNA, 19 nt, Homo sapiens
cuacuuggcaguuccauuu

SEQ ID NO: 1493132 - RNA, 19 nt, Homo sapiens
gcagugcuuugcuggagaa

SEQ ID NO: 1493133 - RNA, 19 nt, Homo sapiens
gguucugugucuacuguua

SEQ ID NO: 1493134 - RNA, 19 nt, Homo sapiens
cauauuggaugucauaagg

SEQ ID NO: 1493135 - RNA, 19 nt, Homo sapiens
cgugguagguaauccauau

SEQ ID NO: 1493136 - RNA, 19 nt, Homo sapiens
gagcaaaggccugcguguu

SEQ ID NO: 1493137 - RNA, 19 nt, Homo sapiens
uggcaguuccauuucauua

SEQ ID NO: 1493138 - RNA, 19 nt, Homo sapiens
gauccaggucuuugcguuu

SEQ ID NO: 1493139 - RNA, 19 nt, Homo sapiens
cgacuugguucugugucua

SEQ ID NO: 1493140 - RNA, 19 nt, Homo sapiens
gacgagggacucuuuguca

SEQ ID NO: 1493141 - RNA, 19 nt, Homo sapiens
gugauccgcgucugccuua

SEQ ID NO: 1493142 - RNA, 19 nt, Homo sapiens
gcacgguguguucugcuuu

SEQ ID NO: 1493143 - RNA, 19 nt, Homo sapiens
ggugggaguugggagcaaa

SEQ ID NO: 1493144 - RNA, 19 nt, Homo sapiens
acgcacgccugccaucaaa

SEQ ID NO: 1493145 - RNA, 19 nt, Homo sapiens
gcagagagaguggcucaca

SEQ ID NO: 1493146 - RNA, 19 nt, Homo sapiens
gguagguaauccauauugg

SEQ ID NO: 1493147 - RNA, 19 nt, Homo sapiens
cugcugcugugacugcuuu

SEQ ID NO: 1493148 - RNA, 19 nt, Homo sapiens
gggcuuggcacuccaccuu

SEQ ID NO: 1493149 - RNA, 19 nt, Homo sapiens
ccgguucugucccgucuug

SEQ ID NO: 1493150 - RNA, 19 nt, Homo sapiens
gcgacuugguucugugucu

SEQ ID NO: 1493151 - RNA, 19 nt, Homo sapiens
ggaacgaggaggucuuuug

SEQ ID NO: 1493152 - RNA, 19 nt, Homo sapiens
ggaagcacgguguguucug

SEQ ID NO: 1493153 - RNA, 19 nt, Homo sapiens
guaacaaucuuucuuuucc

SEQ ID NO: 1493154 - RNA, 19 nt, Homo sapiens
cagcuggcuuguagaagag

SEQ ID NO: 1493155 - RNA, 19 nt, Homo sapiens
ugacugcuuuuguaccuuu

SEQ ID NO: 1493156 - RNA, 19 nt, Homo sapiens
gccuccggcuucccaaaga

SEQ ID NO: 1493157 - RNA, 19 nt, Homo sapiens
ggcaguuccauuucauuau

SEQ ID NO: 1493158 - RNA, 19 nt, Homo sapiens
guccucacccggagccuuu

SEQ ID NO: 1493159 - RNA, 19 nt, Homo sapiens
ggggauauuuaaagagaga

SEQ ID NO: 1493160 - RNA, 19 nt, Homo sapiens
gacauuggcugguaacaga

SEQ ID NO: 1493161 - RNA, 19 nt, Homo sapiens
gcaagguuguuccugauug

SEQ ID NO: 1493162 - RNA, 19 nt, Homo sapiens
gaacauuggcugcaagguu

SEQ ID NO: 1493163 - RNA, 19 nt, Homo sapiens
gcaagcacccaguucauga

SEQ ID NO: 1493164 - RNA, 19 nt, Homo sapiens
gaagcaagcacccaguuca

SEQ ID NO: 1493165 - RNA, 19 nt, Homo sapiens
caaccuauauccuggugau

SEQ ID NO: 1493166 - RNA, 19 nt, Homo sapiens
ggauggagccgauagucaa

SEQ ID NO: 1493167 - RNA, 19 nt, Homo sapiens
gcuaccaguucuuugucua

SEQ ID NO: 1493168 - RNA, 19 nt, Homo sapiens
caagguuguuccugauugu

SEQ ID NO: 1493169 - RNA, 19 nt, Homo sapiens
gcagaacccagacagagau

SEQ ID NO: 1493170 - RNA, 19 nt, Homo sapiens
guuacugggucucaugaug

SEQ ID NO: 1493171 - RNA, 19 nt, Homo sapiens
gcccauggguuggacaaug

SEQ ID NO: 1493172 - RNA, 19 nt, Homo sapiens
ggacggcgcaaccuauauc

SEQ ID NO: 1493173 - RNA, 19 nt, Homo sapiens
cccauggguuggacaauga

SEQ ID NO: 1493174 - RNA, 19 nt, Homo sapiens
ccaguucuuugucuaucuu

SEQ ID NO: 1493175 - RNA, 19 nt, Homo sapiens
gaacccagacagagauucu

SEQ ID NO: 1493176 - RNA, 19 nt, Homo sapiens
ccagcgagcccaagcacaa

SEQ ID NO: 1493177 - RNA, 19 nt, Homo sapiens
uaacaacuacagacagaag

SEQ ID NO: 1493178 - RNA, 19 nt, Homo sapiens
gcugguaacagauaucaag

SEQ ID NO: 1493179 - RNA, 19 nt, Homo sapiens
cuggagacauuggcuggua

SEQ ID NO: 1493180 - RNA, 19 nt, Homo sapiens
gauucagggccaggaguua

SEQ ID NO: 1493181 - RNA, 19 nt, Homo sapiens
uggagacauuggcugguaa

SEQ ID NO: 1493182 - RNA, 19 nt, Homo sapiens
guggacggcgcaaccuaua

SEQ ID NO: 1493183 - RNA, 19 nt, Homo sapiens
ggacaaugaggcugguuac

SEQ ID NO: 1493184 - RNA, 19 nt, Homo sapiens
gcucaccaccgacgaugug

SEQ ID NO: 1493185 - RNA, 19 nt, Homo sapiens
gccagggccuugaaguuuu

SEQ ID NO: 1493186 - RNA, 19 nt, Homo sapiens
uggagccgauagucaaguu

SEQ ID NO: 1493187 - RNA, 19 nt, Homo sapiens
ugccagggccuugaaguuu

SEQ ID NO: 1493188 - RNA, 19 nt, Homo sapiens
ucacuggagacgaggauga

SEQ ID NO: 1493189 - RNA, 19 nt, Homo sapiens
ccccuucuuuuccaaauua

SEQ ID NO: 1493190 - RNA, 19 nt, Homo sapiens
guccuucucccugugcuua

SEQ ID NO: 1493191 - RNA, 19 nt, Homo sapiens
gugguggacuggauuagcu

SEQ ID NO: 1493192 - RNA, 19 nt, Homo sapiens
gaaguuuucuacccagagu

SEQ ID NO: 1493193 - RNA, 19 nt, Homo sapiens
acucgaggcucuuggaaaa

SEQ ID NO: 1493194 - RNA, 19 nt, Homo sapiens
gcacuguuacugggucuca

SEQ ID NO: 1493195 - RNA, 19 nt, Homo sapiens
gagacgaggaugagaacag

SEQ ID NO: 1493196 - RNA, 19 nt, Homo sapiens
ccaccugggcgaaccugaa

SEQ ID NO: 1493197 - RNA, 19 nt, Homo sapiens
cauuggcugguaacagaua

SEQ ID NO: 1493198 - RNA, 19 nt, Homo sapiens
uggacaaugaggcugguua

SEQ ID NO: 1493199 - RNA, 19 nt, Homo sapiens
ccuauauccuggugauggu

SEQ ID NO: 1493200 - RNA, 19 nt, Homo sapiens
gaaaugaucugucuaguuc

SEQ ID NO: 1493201 - RNA, 19 nt, Homo sapiens
ggagaugucuuaauugaaa

SEQ ID NO: 1493202 - RNA, 19 nt, Homo sapiens
gggcagcucuguagaaauu

SEQ ID NO: 1493203 - RNA, 19 nt, Homo sapiens
aaagagacauugcuucuaa

SEQ ID NO: 1493204 - RNA, 19 nt, Homo sapiens
gcaaugcaaucguuuaaug

SEQ ID NO: 1493205 - RNA, 19 nt, Homo sapiens
gcagcagggucaagaauuu

SEQ ID NO: 1493206 - RNA, 19 nt, Homo sapiens
gaaaguagcaguguuguga

SEQ ID NO: 1493207 - RNA, 19 nt, Homo sapiens
gaaagaaagcaguaauuga

SEQ ID NO: 1493208 - RNA, 19 nt, Homo sapiens
gcacgaggcuacagaagga

SEQ ID NO: 1493209 - RNA, 19 nt, Homo sapiens
gaaaggaaagggaaagaaa

SEQ ID NO: 1493210 - RNA, 19 nt, Homo sapiens
ggaaaggauugaacauaau

SEQ ID NO: 1493211 - RNA, 19 nt, Homo sapiens
uggaaaggauugaacauaa

SEQ ID NO: 1493212 - RNA, 19 nt, Homo sapiens
aaacgaaggucuuguaugg

SEQ ID NO: 1493213 - RNA, 19 nt, Homo sapiens
gcagaaagaagaaaggaaa

SEQ ID NO: 1493214 - RNA, 19 nt, Homo sapiens
gaacguguggcaucagaua

SEQ ID NO: 1493215 - RNA, 19 nt, Homo sapiens
gaagacguuccauguguua

SEQ ID NO: 1493216 - RNA, 19 nt, Homo sapiens
uaggagaugucuuaauuga

SEQ ID NO: 1493217 - RNA, 19 nt, Homo sapiens
gaacauaauggagaaagaa

SEQ ID NO: 1493218 - RNA, 19 nt, Homo sapiens
gcaguggauuugaaaguau

SEQ ID NO: 1493219 - RNA, 19 nt, Homo sapiens
gcaaugcuacuucugauga

SEQ ID NO: 1493220 - RNA, 19 nt, Homo sapiens
gagaaagaaagcaguaauu

SEQ ID NO: 1493221 - RNA, 19 nt, Homo sapiens
gauagaagacguuccaugu

SEQ ID NO: 1493222 - RNA, 19 nt, Homo sapiens
gcauaugcaucaaggcuau

SEQ ID NO: 1493223 - RNA, 19 nt, Homo sapiens
ugacagcaguggauuugaa

SEQ ID NO: 1493224 - RNA, 19 nt, Homo sapiens
gagggaaaguaaccaucua

SEQ ID NO: 1493225 - RNA, 19 nt, Homo sapiens
gaaaggauugaacauaaug

SEQ ID NO: 1493226 - RNA, 19 nt, Homo sapiens
uaaagccacuucccaguuc

SEQ ID NO: 1493227 - RNA, 19 nt, Homo sapiens
uagaagacguuccaugugu

SEQ ID NO: 1493228 - RNA, 19 nt, Homo sapiens
gaagacuggguucagguua

SEQ ID NO: 1493229 - RNA, 19 nt, Homo sapiens
gaaagagacauugcuucua

SEQ ID NO: 1493230 - RNA, 19 nt, Homo sapiens
gaaagcaguaauugacauu

SEQ ID NO: 1493231 - RNA, 19 nt, Homo sapiens
ggucgaaguuuacauuugg

SEQ ID NO: 1493232 - RNA, 19 nt, Homo sapiens
gcaaucguuuaaugccuaa

SEQ ID NO: 1493233 - RNA, 19 nt, Homo sapiens
uaucuacacuugcaaauac

SEQ ID NO: 1493234 - RNA, 19 nt, Homo sapiens
cuuaggagcugcagaagga

SEQ ID NO: 1493235 - RNA, 19 nt, Homo sapiens
ucugaauucugcucuuaua

SEQ ID NO: 1493236 - RNA, 19 nt, Homo sapiens
gauggcaccucccgucuca

SEQ ID NO: 1493237 - RNA, 19 nt, Homo sapiens
gaaggucuuguauggauuu

SEQ ID NO: 1493238 - RNA, 19 nt, Homo sapiens
caucuaugcugaaaugauc

SEQ ID NO: 1493239 - RNA, 19 nt, Homo sapiens
ggaaagagacauugcuucu

SEQ ID NO: 1493240 - RNA, 19 nt, Homo sapiens
gauugaacauaauggagaa

SEQ ID NO: 1493241 - RNA, 19 nt, Homo sapiens
gaaaccaaagugcgacgua

SEQ ID NO: 1493242 - RNA, 19 nt, Homo sapiens
cauaaagugugaaagaaag

SEQ ID NO: 1493243 - RNA, 19 nt, Homo sapiens
gagaugacaccuuccauuc

SEQ ID NO: 1493244 - RNA, 19 nt, Homo sapiens
gaaaguaaccaucuaugcu

SEQ ID NO: 1493245 - RNA, 19 nt, Homo sapiens
aggaagagcuuuuguauau

SEQ ID NO: 1493246 - RNA, 19 nt, Homo sapiens
gcagagacaggaaagauag

SEQ ID NO: 1493247 - RNA, 19 nt, Homo sapiens
guaaccaucuaugcugaaa

SEQ ID NO: 1493248 - RNA, 19 nt, Homo sapiens
ugaugaagauccaaauaca

SEQ ID NO: 1493249 - RNA, 19 nt, Homo sapiens
guagcaguguugugaguug

SEQ ID NO: 1493250 - RNA, 19 nt, Homo sapiens
ucucugaauucugcucuua

SEQ ID NO: 1493251 - RNA, 19 nt, Homo sapiens
gaagaagugaagacuccua

SEQ ID NO: 1493252 - RNA, 19 nt, Homo sapiens
ggagaaagaaagcaguaau

SEQ ID NO: 1493253 - RNA, 19 nt, Homo sapiens
gaaaacccauggaaaguag

SEQ ID NO: 1493254 - RNA, 19 nt, Homo sapiens
gaaaggaugacuucuuagg

SEQ ID NO: 1493255 - RNA, 19 nt, Homo sapiens
gauggucgaaguuuacauu

SEQ ID NO: 1493256 - RNA, 19 nt, Homo sapiens
ugaaagaaaggaugacuuc

SEQ ID NO: 1493257 - RNA, 19 nt, Homo sapiens
ugaaaugaucugucuaguu

SEQ ID NO: 1493258 - RNA, 19 nt, Homo sapiens
gugggcagcucuguagaaa

SEQ ID NO: 1493259 - RNA, 19 nt, Homo sapiens
gaagaaaacccauggaaag

SEQ ID NO: 1493260 - RNA, 19 nt, Homo sapiens
ugaagaacguguggcauca

SEQ ID NO: 1493261 - RNA, 19 nt, Homo sapiens
aaccaucuaugcugaaaug

SEQ ID NO: 1493262 - RNA, 19 nt, Homo sapiens
ugaacauaauggagaaaga

SEQ ID NO: 1493263 - RNA, 19 nt, Homo sapiens
gaagagcuuuuguauaucu

SEQ ID NO: 1493264 - RNA, 19 nt, Homo sapiens
ggcaucagauagucccaaa

SEQ ID NO: 1493265 - RNA, 19 nt, Homo sapiens
agaaagaaagcaguaauug

SEQ ID NO: 1493266 - RNA, 19 nt, Homo sapiens
gaaagaaaaguguucagaa

SEQ ID NO: 1493267 - RNA, 19 nt, Homo sapiens
cuacagaaggauuuagaaa

SEQ ID NO: 1493268 - RNA, 19 nt, Homo sapiens
agauuugucugaugccauu

SEQ ID NO: 1493269 - RNA, 19 nt, Homo sapiens
gcagcucuguagaaauuag

SEQ ID NO: 1493270 - RNA, 19 nt, Homo sapiens
gaugaagauccaaauacaa

SEQ ID NO: 1493271 - RNA, 19 nt, Homo sapiens
gaagugaagacuccuaaaa

SEQ ID NO: 1493272 - RNA, 19 nt, Homo sapiens
ggaaaguaaccaucuaugc

SEQ ID NO: 1493273 - RNA, 19 nt, Homo sapiens
caaugcuacuucugaugaa

SEQ ID NO: 1493274 - RNA, 19 nt, Homo sapiens
cagguuauuucaguucaaa

SEQ ID NO: 1493275 - RNA, 19 nt, Homo sapiens
agaagacguuccauguguu

SEQ ID NO: 1493276 - RNA, 19 nt, Homo sapiens
gaagaaaggaaagggaaag

SEQ ID NO: 1493277 - RNA, 19 nt, Homo sapiens
gugaggauuugggaagaaa

SEQ ID NO: 1493278 - RNA, 19 nt, Homo sapiens
gagugaggauuugggaaga

SEQ ID NO: 1493279 - RNA, 19 nt, Homo sapiens
gacauuuccugcagagucu

SEQ ID NO: 1493280 - RNA, 19 nt, Homo sapiens
aaagaaagcaguaauugac

SEQ ID NO: 1493281 - RNA, 19 nt, Homo sapiens
cgaaggucuuguauggauu

SEQ ID NO: 1493282 - RNA, 19 nt, Homo sapiens
gacguuccauguguuauuc

SEQ ID NO: 1493283 - RNA, 19 nt, Homo sapiens
agacugucauuguuuagga

SEQ ID NO: 1493284 - RNA, 19 nt, Homo sapiens
ugaagucccugagaugaca

SEQ ID NO: 1493285 - RNA, 19 nt, Homo sapiens
caaccucaguguuucaaaa

SEQ ID NO: 1493286 - RNA, 19 nt, Homo sapiens
aagcaguaauugacauuuc

SEQ ID NO: 1493287 - RNA, 19 nt, Homo sapiens
agacuggguucagguuauu

SEQ ID NO: 1493288 - RNA, 19 nt, Homo sapiens
acgaaggucuuguauggau

SEQ ID NO: 1493289 - RNA, 19 nt, Homo sapiens
aaaccuuugucaguucuuu

SEQ ID NO: 1493290 - RNA, 19 nt, Homo sapiens
cagaaaaccuuugucaguu

SEQ ID NO: 1493291 - RNA, 19 nt, Homo sapiens
ggguucagguuauuucagu

SEQ ID NO: 1493292 - RNA, 19 nt, Homo sapiens
guugugaguugcagagaca

SEQ ID NO: 1493293 - RNA, 19 nt, Homo sapiens
ggaagaaaacccauggaaa

SEQ ID NO: 1493294 - RNA, 19 nt, Homo sapiens
gcagaaaaccuuugucagu

SEQ ID NO: 1493295 - RNA, 19 nt, Homo sapiens
ccucaucgcuuggcaaugc

SEQ ID NO: 1493296 - RNA, 19 nt, Homo sapiens
ugacccagauuugcauaug

SEQ ID NO: 1493297 - RNA, 19 nt, Homo sapiens
gcugaaaugaucugucuag

SEQ ID NO: 1493298 - RNA, 19 nt, Homo sapiens
guaagaggaggaagagcuu

SEQ ID NO: 1493299 - RNA, 19 nt, Homo sapiens
ugagaugacaccuuccauu

SEQ ID NO: 1493300 - RNA, 19 nt, Homo sapiens
cuacgaugcuggagauuaa

SEQ ID NO: 1493301 - RNA, 19 nt, Homo sapiens
gcacacuucuggaccacua

SEQ ID NO: 1493302 - RNA, 19 nt, Homo sapiens
gaagagcauccuaccauuu

SEQ ID NO: 1493303 - RNA, 19 nt, Homo sapiens
gaaagcaagccacaaacaa

SEQ ID NO: 1493304 - RNA, 19 nt, Homo sapiens
ucucaguccuggucaauaa

SEQ ID NO: 1493305 - RNA, 19 nt, Homo sapiens
gcaaggagguuggcgaagu

SEQ ID NO: 1493306 - RNA, 19 nt, Homo sapiens
gguuugcccuuaucuugua

SEQ ID NO: 1493307 - RNA, 19 nt, Homo sapiens
gaacuaaaggcugcugaaa

SEQ ID NO: 1493308 - RNA, 19 nt, Homo sapiens
aaagaaagcaagccacaaa

SEQ ID NO: 1493309 - RNA, 19 nt, Homo sapiens
ugaaggccauccucacuga

SEQ ID NO: 1493310 - RNA, 19 nt, Homo sapiens
ugaagagcauccuaccauu

SEQ ID NO: 1493311 - RNA, 19 nt, Homo sapiens
ggcaucaccuucuggaaug

SEQ ID NO: 1493312 - RNA, 19 nt, Homo sapiens
gaagaugaucaagauguuu

SEQ ID NO: 1493313 - RNA, 19 nt, Homo sapiens
gcaguugugugcauguauc

SEQ ID NO: 1493314 - RNA, 19 nt, Homo sapiens
gccaguaaauuuggaguug

SEQ ID NO: 1493315 - RNA, 19 nt, Homo sapiens
cacuguaacuugcagguuu

SEQ ID NO: 1493316 - RNA, 19 nt, Homo sapiens
gaauggugaggaagaaauu

SEQ ID NO: 1493317 - RNA, 19 nt, Homo sapiens
agaagaugaucaagauguu

SEQ ID NO: 1493318 - RNA, 19 nt, Homo sapiens
aagcaagccacaaacaaua

SEQ ID NO: 1493319 - RNA, 19 nt, Homo sapiens
guucaguacugccggaguu

SEQ ID NO: 1493320 - RNA, 19 nt, Homo sapiens
caauugccaugcacacuuc

SEQ ID NO: 1493321 - RNA, 19 nt, Homo sapiens
ggaagagggagaacgucua

SEQ ID NO: 1493322 - RNA, 19 nt, Homo sapiens
gagauuaaucauggucaua

SEQ ID NO: 1493323 - RNA, 19 nt, Homo sapiens
caaggagguuggcgaaguc

SEQ ID NO: 1493324 - RNA, 19 nt, Homo sapiens
ucugaagccugauuacugu

SEQ ID NO: 1493325 - RNA, 19 nt, Homo sapiens
uguagacacuggcauguuc

SEQ ID NO: 1493326 - RNA, 19 nt, Homo sapiens
ggaauggugaggaagaaau

SEQ ID NO: 1493327 - RNA, 19 nt, Homo sapiens
ggccaggugugccucauca

SEQ ID NO: 1493328 - RNA, 19 nt, Homo sapiens
ggagauuaaucauggucau

SEQ ID NO: 1493329 - RNA, 19 nt, Homo sapiens
gugcauguaucgguuccua

SEQ ID NO: 1493330 - RNA, 19 nt, Homo sapiens
gggcaucaccuucuggaau

SEQ ID NO: 1493331 - RNA, 19 nt, Homo sapiens
cagaagaugaucaagaugu

SEQ ID NO: 1493332 - RNA, 19 nt, Homo sapiens
gagcggacaaguguaugua

SEQ ID NO: 1493333 - RNA, 19 nt, Homo sapiens
gaaucaggaaagaaauuga

SEQ ID NO: 1493334 - RNA, 19 nt, Homo sapiens
cugccggaguugaggauua

SEQ ID NO: 1493335 - RNA, 19 nt, Homo sapiens
gaagagggagaacgucuac

SEQ ID NO: 1493336 - RNA, 19 nt, Homo sapiens
ucauguacaucgugaccuu

SEQ ID NO: 1493337 - RNA, 19 nt, Homo sapiens
guucagaggcugccgaauc

SEQ ID NO: 1493338 - RNA, 19 nt, Homo sapiens
aaagcaagccacaaacaau

SEQ ID NO: 1493339 - RNA, 19 nt, Homo sapiens
caguaaauuuggaguugug

SEQ ID NO: 1493340 - RNA, 19 nt, Homo sapiens
ccagugcacaucagcauug

SEQ ID NO: 1493341 - RNA, 19 nt, Homo sapiens
cacaaacaauaaugaagca

SEQ ID NO: 1493342 - RNA, 19 nt, Homo sapiens
gcaagccacaaacaauaau

SEQ ID NO: 1493343 - RNA, 19 nt, Homo sapiens
gagcauccuaccauuugaa

SEQ ID NO: 1493344 - RNA, 19 nt, Homo sapiens
aagagcauccuaccauuug

SEQ ID NO: 1493345 - RNA, 19 nt, Homo sapiens
ccugagccaugaacuaaag

SEQ ID NO: 1493346 - RNA, 19 nt, Homo sapiens
ggagguuggcgaagucuca

SEQ ID NO: 1493347 - RNA, 19 nt, Homo sapiens
gaaauucugccccacugua

SEQ ID NO: 1493348 - RNA, 19 nt, Homo sapiens
ccuaggagcggacaagugu

SEQ ID NO: 1493349 - RNA, 19 nt, Homo sapiens
cgaaucaggaaagaaauug

SEQ ID NO: 1493350 - RNA, 19 nt, Homo sapiens
uucagaggcugccgaauca

SEQ ID NO: 1493351 - RNA, 19 nt, Homo sapiens
guacaucgugaccuucaug

SEQ ID NO: 1493352 - RNA, 19 nt, Homo sapiens
gcauggugcgccacaucua

SEQ ID NO: 1493353 - RNA, 19 nt, Homo sapiens
ccaguaaauuuggaguugu

SEQ ID NO: 1493354 - RNA, 19 nt, Homo sapiens
aaucauggucauauuguga

SEQ ID NO: 1493355 - RNA, 19 nt, Homo sapiens
ccuacgaugcuggagauua

SEQ ID NO: 1493356 - RNA, 19 nt, Homo sapiens
gcugcaagcugggaauggu

SEQ ID NO: 1493357 - RNA, 19 nt, Homo sapiens
caaagaaagcaagccacaa

SEQ ID NO: 1493358 - RNA, 19 nt, Homo sapiens
aagcaguugugugcaugua

SEQ ID NO: 1493359 - RNA, 19 nt, Homo sapiens
ucacugaccagcccaugau

SEQ ID NO: 1493360 - RNA, 19 nt, Homo sapiens
aauuuggaguuguggguuu

SEQ ID NO: 1493361 - RNA, 19 nt, Homo sapiens
uaaucauggucauauugug

SEQ ID NO: 1493362 - RNA, 19 nt, Homo sapiens
ucaauugccaugcacacuu

SEQ ID NO: 1493363 - RNA, 19 nt, Homo sapiens
ccgaaucaggaaagaaauu

SEQ ID NO: 1493364 - RNA, 19 nt, Homo sapiens
augaaucccugagccauga

SEQ ID NO: 1493365 - RNA, 19 nt, Homo sapiens
ugaacaucgugguggaguu

SEQ ID NO: 1493366 - RNA, 19 nt, Homo sapiens
cuucuggaauguccugaug

SEQ ID NO: 1493367 - RNA, 19 nt, Homo sapiens
ggagcggacaaguguaugu

SEQ ID NO: 1493368 - RNA, 19 nt, Homo sapiens
uccuugggauuguucagua

SEQ ID NO: 1493369 - RNA, 19 nt, Homo sapiens
gacaucaacacgcaaagca

SEQ ID NO: 1493370 - RNA, 19 nt, Homo sapiens
ggaauauuacuucuaucag

SEQ ID NO: 1493371 - RNA, 19 nt, Homo sapiens
agaaagcaagccacaaaca

SEQ ID NO: 1493372 - RNA, 19 nt, Homo sapiens
cauccuaccauuugaagca

SEQ ID NO: 1493373 - RNA, 19 nt, Homo sapiens
agagcauccuaccauuuga

SEQ ID NO: 1493374 - RNA, 19 nt, Homo sapiens
ugccgaaucaggaaagaaa

SEQ ID NO: 1493375 - RNA, 19 nt, Homo sapiens
uaggagcggacaaguguau

SEQ ID NO: 1493376 - RNA, 19 nt, Homo sapiens
gugugaagcaggccaugaa

SEQ ID NO: 1493377 - RNA, 19 nt, Homo sapiens
cuaccugacggcugaaaga

SEQ ID NO: 1493378 - RNA, 19 nt, Homo sapiens
gcaucaccuucuggaaugu

SEQ ID NO: 1493379 - RNA, 19 nt, Homo sapiens
uauggauucuaaacuugug

SEQ ID NO: 1493380 - RNA, 19 nt, Homo sapiens
gaagcaguugugugcaugu

SEQ ID NO: 1493381 - RNA, 19 nt, Homo sapiens
ccuaccauuugaagcaguu

SEQ ID NO: 1493382 - RNA, 19 nt, Homo sapiens
acuaaaggcugcugaaaag

SEQ ID NO: 1493383 - RNA, 19 nt, Homo sapiens
ucccugagccaugaacuaa

SEQ ID NO: 1493384 - RNA, 19 nt, Homo sapiens
ugggaauggugaggaagaa

SEQ ID NO: 1493385 - RNA, 19 nt, Homo sapiens
gcugacauuuuauggauuc

SEQ ID NO: 1493386 - RNA, 19 nt, Homo sapiens
caagccacaaacaauaaug

SEQ ID NO: 1493387 - RNA, 19 nt, Homo sapiens
agcaagccacaaacaauaa

SEQ ID NO: 1493388 - RNA, 19 nt, Homo sapiens
caacagauaucauucguuu

SEQ ID NO: 1493389 - RNA, 19 nt, Homo sapiens
ggacagaacuaggcuaaga

SEQ ID NO: 1493390 - RNA, 19 nt, Homo sapiens
gauaagcacccaacagaua

SEQ ID NO: 1493391 - RNA, 19 nt, Homo sapiens
ggaagaagcacuauauuca

SEQ ID NO: 1493392 - RNA, 19 nt, Homo sapiens
gcugaaauguuuacgguuu

SEQ ID NO: 1493393 - RNA, 19 nt, Homo sapiens
aaacacagauggucccaaa

SEQ ID NO: 1493394 - RNA, 19 nt, Homo sapiens
agaaaucccuucccacuau

SEQ ID NO: 1493395 - RNA, 19 nt, Homo sapiens
gguguuaucuuuauacauc

SEQ ID NO: 1493396 - RNA, 19 nt, Homo sapiens
gaaaugacaagaugcuuug

SEQ ID NO: 1493397 - RNA, 19 nt, Homo sapiens
gaagcacuauauucaaaug

SEQ ID NO: 1493398 - RNA, 19 nt, Homo sapiens
gacagacucucaaagaaga

SEQ ID NO: 1493399 - RNA, 19 nt, Homo sapiens
ccaaggguguuaucuuuau

SEQ ID NO: 1493400 - RNA, 19 nt, Homo sapiens
ucaaugaugucgaggagaa

SEQ ID NO: 1493401 - RNA, 19 nt, Homo sapiens
gcagaagcccuggacuuua

SEQ ID NO: 1493402 - RNA, 19 nt, Homo sapiens
gaagaagcacuauauucaa

SEQ ID NO: 1493403 - RNA, 19 nt, Homo sapiens
uuacuuggcucccauuaga

SEQ ID NO: 1493404 - RNA, 19 nt, Homo sapiens
caaggguguuaucuuuaua

SEQ ID NO: 1493405 - RNA, 19 nt, Homo sapiens
gaagagggagacaagcuaa

SEQ ID NO: 1493406 - RNA, 19 nt, Homo sapiens
gauauccaguuguuucaug

SEQ ID NO: 1493407 - RNA, 19 nt, Homo sapiens
gaaagaacuucauauuacc

SEQ ID NO: 1493408 - RNA, 19 nt, Homo sapiens
guggagagcugaauuuacu

SEQ ID NO: 1493409 - RNA, 19 nt, Homo sapiens
uguaaucgcugacguucaa

SEQ ID NO: 1493410 - RNA, 19 nt, Homo sapiens
gaaaucccuucccacuaug

SEQ ID NO: 1493411 - RNA, 19 nt, Homo sapiens
gagaaaucccuucccacua

SEQ ID NO: 1493412 - RNA, 19 nt, Homo sapiens
gcacccaacagauaucauu

SEQ ID NO: 1493413 - RNA, 19 nt, Homo sapiens
ugaaugaccggguauuuga

SEQ ID NO: 1493414 - RNA, 19 nt, Homo sapiens
aaaguggacugaacaugga

SEQ ID NO: 1493415 - RNA, 19 nt, Homo sapiens
acagucacaugauaagaaa

SEQ ID NO: 1493416 - RNA, 19 nt, Homo sapiens
cagaagcccuggacuuuac

SEQ ID NO: 1493417 - RNA, 19 nt, Homo sapiens
ggacagacucucaaagaag

SEQ ID NO: 1493418 - RNA, 19 nt, Homo sapiens
ucuggaugcugaaauguuu

SEQ ID NO: 1493419 - RNA, 19 nt, Homo sapiens
cugaaauguuuacgguuua

SEQ ID NO: 1493420 - RNA, 19 nt, Homo sapiens
gaggauauccaguuguuuc

SEQ ID NO: 1493421 - RNA, 19 nt, Homo sapiens
ccuaaaccaucagcuauug

SEQ ID NO: 1493422 - RNA, 19 nt, Homo sapiens
aagaggauauccaguuguu

SEQ ID NO: 1493423 - RNA, 19 nt, Homo sapiens
gacagucacaugauaagaa

SEQ ID NO: 1493424 - RNA, 19 nt, Homo sapiens
gaccggguauuugaagaaa

SEQ ID NO: 1493425 - RNA, 19 nt, Homo sapiens
uuccaaggguguuaucuuu

SEQ ID NO: 1493426 - RNA, 19 nt, Homo sapiens
guccuacgguauuucagua

SEQ ID NO: 1493427 - RNA, 19 nt, Homo sapiens
accaucagcuauugaauga

SEQ ID NO: 1493428 - RNA, 19 nt, Homo sapiens
cagcugaaauucucaugca

SEQ ID NO: 1493429 - RNA, 19 nt, Homo sapiens
aagcaauucuccagaggaa

SEQ ID NO: 1493430 - RNA, 19 nt, Homo sapiens
ggagagcugaauuuacuug

SEQ ID NO: 1493431 - RNA, 19 nt, Homo sapiens
caccacagcugaaauucuc

SEQ ID NO: 1493432 - RNA, 19 nt, Homo sapiens
cgguuuaacugguacauca

SEQ ID NO: 1493433 - RNA, 19 nt, Homo sapiens
ccucggagccuuugucguu

SEQ ID NO: 1493434 - RNA, 19 nt, Homo sapiens
caacuaguuacaagcaauu

SEQ ID NO: 1493435 - RNA, 19 nt, Homo sapiens
cauauuaccaagccuaaga

SEQ ID NO: 1493436 - RNA, 19 nt, Homo sapiens
uggacagacucucaaagaa

SEQ ID NO: 1493437 - RNA, 19 nt, Homo sapiens
ucuuucagcuuaaguacuu

SEQ ID NO: 1493438 - RNA, 19 nt, Homo sapiens
gagccaaaguggacugaac

SEQ ID NO: 1493439 - RNA, 19 nt, Homo sapiens
ucgguccucuuccucuuua

SEQ ID NO: 1493440 - RNA, 19 nt, Homo sapiens
ccggguauuugaagaaaga

SEQ ID NO: 1493441 - RNA, 19 nt, Homo sapiens
agaaaugacaagaugcuuu

SEQ ID NO: 1493442 - RNA, 19 nt, Homo sapiens
guuuacgguuuaacuggua

SEQ ID NO: 1493443 - RNA, 19 nt, Homo sapiens
uaaaccaucagcuauugaa

SEQ ID NO: 1493444 - RNA, 19 nt, Homo sapiens
ucaacuaguuacaagcaau

SEQ ID NO: 1493445 - RNA, 19 nt, Homo sapiens
aagcugaccuaaugaaacu

SEQ ID NO: 1493446 - RNA, 19 nt, Homo sapiens
caaauggacagacucucaa

SEQ ID NO: 1493447 - RNA, 19 nt, Homo sapiens
gaaugaccggguauuugaa

SEQ ID NO: 1493448 - RNA, 19 nt, Homo sapiens
uaacugguacaucaauuuc

SEQ ID NO: 1493449 - RNA, 19 nt, Homo sapiens
gcccuggacuuuacaacca

SEQ ID NO: 1493450 - RNA, 19 nt, Homo sapiens
ggacaccccuaaaccauca

SEQ ID NO: 1493451 - RNA, 19 nt, Homo sapiens
caggacagaacuaggcuaa

SEQ ID NO: 1493452 - RNA, 19 nt, Homo sapiens
uaaaagaggauauccaguu

SEQ ID NO: 1493453 - RNA, 19 nt, Homo sapiens
gagcccugcuuggcaaaug

SEQ ID NO: 1493454 - RNA, 19 nt, Homo sapiens
ccuacgguauuucaguaaa

SEQ ID NO: 1493455 - RNA, 19 nt, Homo sapiens
guacuuauugugguaguga

SEQ ID NO: 1493456 - RNA, 19 nt, Homo sapiens
gacagaacuaggcuaagaa

SEQ ID NO: 1493457 - RNA, 19 nt, Homo sapiens
caggugugcuggcauugga

SEQ ID NO: 1493458 - RNA, 19 nt, Homo sapiens
ugaagagggagacaagcua

SEQ ID NO: 1493459 - RNA, 19 nt, Homo sapiens
ggacugaacauggaaagac

SEQ ID NO: 1493460 - RNA, 19 nt, Homo sapiens
cccuggcgaucuucugaua

SEQ ID NO: 1493461 - RNA, 19 nt, Homo sapiens
gcaauucuccagaggaaaa

SEQ ID NO: 1493462 - RNA, 19 nt, Homo sapiens
aaaagaggauauccaguug

SEQ ID NO: 1493463 - RNA, 19 nt, Homo sapiens
acaaauggacagacucuca

SEQ ID NO: 1493464 - RNA, 19 nt, Homo sapiens
caguggagagcugaauuua

SEQ ID NO: 1493465 - RNA, 19 nt, Homo sapiens
agccgacagucacaugaua

SEQ ID NO: 1493466 - RNA, 19 nt, Homo sapiens
gcugacguucaacuaguua

SEQ ID NO: 1493467 - RNA, 19 nt, Homo sapiens
uggaagaagcacuauauuc

SEQ ID NO: 1493468 - RNA, 19 nt, Homo sapiens
cagcagaagcccuggacuu

SEQ ID NO: 1493469 - RNA, 19 nt, Homo sapiens
gguauuugaagaaagaaga

SEQ ID NO: 1493470 - RNA, 19 nt, Homo sapiens
gaacuaggcuaagaaaagc

SEQ ID NO: 1493471 - RNA, 19 nt, Homo sapiens
gagacuguccagcaaggaa

SEQ ID NO: 1493472 - RNA, 19 nt, Homo sapiens
acaagaugcuuugcacagu

SEQ ID NO: 1493473 - RNA, 19 nt, Homo sapiens
cugauaagcacccaacaga

SEQ ID NO: 1493474 - RNA, 19 nt, Homo sapiens
acaguggagagcugaauuu

SEQ ID NO: 1493475 - RNA, 19 nt, Homo sapiens
acagaacuaggcuaagaaa

SEQ ID NO: 1493476 - RNA, 19 nt, Homo sapiens
ucuggaagaagcacuauau

SEQ ID NO: 1493477 - RNA, 19 nt, Homo sapiens
gccgacagucacaugauaa

SEQ ID NO: 1493478 - RNA, 19 nt, Homo sapiens
guuguuucaugauggcauu

SEQ ID NO: 1493479 - RNA, 19 nt, Homo sapiens
ucaaauggugaaagaacuu

SEQ ID NO: 1493480 - RNA, 19 nt, Homo sapiens
ggaucuggaagaagcacua

SEQ ID NO: 1493481 - RNA, 19 nt, Homo sapiens
ggacuuuacaaccaagcuu

SEQ ID NO: 1493482 - RNA, 19 nt, Homo sapiens
gcacaguggagagcugaau

SEQ ID NO: 1493483 - RNA, 19 nt, Homo sapiens
gacugaacauggaaagacu

SEQ ID NO: 1493484 - RNA, 19 nt, Homo sapiens
agaaagaagagcccugcuu

SEQ ID NO: 1493485 - RNA, 19 nt, Homo sapiens
uccaaggguguuaucuuua

SEQ ID NO: 1493486 - RNA, 19 nt, Homo sapiens
gcuaagaaaagcacaauca

SEQ ID NO: 1493487 - RNA, 19 nt, Homo sapiens
ucgcugacguucaacuagu

SEQ ID NO: 1493488 - RNA, 19 nt, Homo sapiens
gcaaccagguggagaaauu

SEQ ID NO: 1493489 - RNA, 19 nt, Homo sapiens
gaaaagaguuggugaaaug

SEQ ID NO: 1493490 - RNA, 19 nt, Homo sapiens
gaaauugacccaccuaagu

SEQ ID NO: 1493491 - RNA, 19 nt, Homo sapiens
gaaugcaucuaccagaaga

SEQ ID NO: 1493492 - RNA, 19 nt, Homo sapiens
ggagcaaacuguggacuug

SEQ ID NO: 1493493 - RNA, 19 nt, Homo sapiens
gcaaaugacccuggaguug

SEQ ID NO: 1493494 - RNA, 19 nt, Homo sapiens
ccaccuaaguuacaaggaa

SEQ ID NO: 1493495 - RNA, 19 nt, Homo sapiens
gcacuuaaaccuugguaga

SEQ ID NO: 1493496 - RNA, 19 nt, Homo sapiens
gcacugggccguauaugug

SEQ ID NO: 1493497 - RNA, 19 nt, Homo sapiens
guaggaaacacuuguaguu

SEQ ID NO: 1493498 - RNA, 19 nt, Homo sapiens
ccgagaaccugcucaacaa

SEQ ID NO: 1493499 - RNA, 19 nt, Homo sapiens
uagaggaccugaucaugga

SEQ ID NO: 1493500 - RNA, 19 nt, Homo sapiens
uauaaucggccauucuuaa

SEQ ID NO: 1493501 - RNA, 19 nt, Homo sapiens
ggacaaaccccaacuuuuc

SEQ ID NO: 1493502 - RNA, 19 nt, Homo sapiens
ugguagaucuggguuuaua

SEQ ID NO: 1493503 - RNA, 19 nt, Homo sapiens
caaacucgcccuagaaguc

SEQ ID NO: 1493504 - RNA, 19 nt, Homo sapiens
cuugguagaucuggguuua

SEQ ID NO: 1493505 - RNA, 19 nt, Homo sapiens
gagaaauugacccaccuaa

SEQ ID NO: 1493506 - RNA, 19 nt, Homo sapiens
ggaaagacaugccccuagu

SEQ ID NO: 1493507 - RNA, 19 nt, Homo sapiens
ggagaaauugacccaccua

SEQ ID NO: 1493508 - RNA, 19 nt, Homo sapiens
guagaucuggguuuauaau

SEQ ID NO: 1493509 - RNA, 19 nt, Homo sapiens
ggaaaagaguuggugaaau

SEQ ID NO: 1493510 - RNA, 19 nt, Homo sapiens
acgaaugcaucuaccagaa

SEQ ID NO: 1493511 - RNA, 19 nt, Homo sapiens
aaauugacccaccuaaguu

SEQ ID NO: 1493512 - RNA, 19 nt, Homo sapiens
ggaggaagcgcggugugaa

SEQ ID NO: 1493513 - RNA, 19 nt, Homo sapiens
guaccuacacgcccgagaa

SEQ ID NO: 1493514 - RNA, 19 nt, Homo sapiens
ggaaugcuccguguucuac

SEQ ID NO: 1493515 - RNA, 19 nt, Homo sapiens
ggaguugguuucgcuuucu

SEQ ID NO: 1493516 - RNA, 19 nt, Homo sapiens
gagcagguaggaaacacuu

SEQ ID NO: 1493517 - RNA, 19 nt, Homo sapiens
agagggagcagguaggaaa

SEQ ID NO: 1493518 - RNA, 19 nt, Homo sapiens
gcagguaggaaacacuugu

SEQ ID NO: 1493519 - RNA, 19 nt, Homo sapiens
cgggcgaucugguggaguu

SEQ ID NO: 1493520 - RNA, 19 nt, Homo sapiens
gguagaucuggguuuauaa

SEQ ID NO: 1493521 - RNA, 19 nt, Homo sapiens
agaaccugcucaacaagug

SEQ ID NO: 1493522 - RNA, 19 nt, Homo sapiens
ccuaccggcugcagauuca

SEQ ID NO: 1493523 - RNA, 19 nt, Homo sapiens
uuaacagcuuccugacuga

SEQ ID NO: 1493524 - RNA, 19 nt, Homo sapiens
gagaaccugcucaacaagu

SEQ ID NO: 1493525 - RNA, 19 nt, Homo sapiens
gguggaaugcuccguguuc

SEQ ID NO: 1493526 - RNA, 19 nt, Homo sapiens
uaggaaacacuuguaguug

SEQ ID NO: 1493527 - RNA, 19 nt, Homo sapiens
gagccuacaccuucaaacu

SEQ ID NO: 1493528 - RNA, 19 nt, Homo sapiens
ggcaagcgcgaguucaaga

SEQ ID NO: 1493529 - RNA, 19 nt, Homo sapiens
gcaucuaccagaagagcuu

SEQ ID NO: 1493530 - RNA, 19 nt, Homo sapiens
ugacccaccuaaguuacaa

SEQ ID NO: 1493531 - RNA, 19 nt, Homo sapiens
aaucggccauucuuaagca

SEQ ID NO: 1493532 - RNA, 19 nt, Homo sapiens
aauugacccaccuaaguua

SEQ ID NO: 1493533 - RNA, 19 nt, Homo sapiens
aaaguucggaguacccauu

SEQ ID NO: 1493534 - RNA, 19 nt, Homo sapiens
aaaugacccuggaguuggu

SEQ ID NO: 1493535 - RNA, 19 nt, Homo sapiens
caaccagguggagaaauug

SEQ ID NO: 1493536 - RNA, 19 nt, Homo sapiens
gcaagcgcgaguucaagau

SEQ ID NO: 1493537 - RNA, 19 nt, Homo sapiens
ccguauauguggguaacuu

SEQ ID NO: 1493538 - RNA, 19 nt, Homo sapiens
gcagccacacgcucgaguu

SEQ ID NO: 1493539 - RNA, 19 nt, Homo sapiens
cuucaaacucgcccuagaa

SEQ ID NO: 1493540 - RNA, 19 nt, Homo sapiens
uggaggugauuaacagcuu

SEQ ID NO: 1493541 - RNA, 19 nt, Homo sapiens
ggcuggaggugauuaacag

SEQ ID NO: 1493542 - RNA, 19 nt, Homo sapiens
uuauaaucggccauucuua

SEQ ID NO: 1493543 - RNA, 19 nt, Homo sapiens
cagguaggaaacacuugua

SEQ ID NO: 1493544 - RNA, 19 nt, Homo sapiens
gccacacgcucgaguucca

SEQ ID NO: 1493545 - RNA, 19 nt, Homo sapiens
ccuucaaacucgcccuaga

SEQ ID NO: 1493546 - RNA, 19 nt, Homo sapiens
gggacaaaccccaacuuuu

SEQ ID NO: 1493547 - RNA, 19 nt, Homo sapiens
gggcaaccagguggagaaa

SEQ ID NO: 1493548 - RNA, 19 nt, Homo sapiens
acuuaaaccuugguagauc

SEQ ID NO: 1493549 - RNA, 19 nt, Homo sapiens
uggaguugguuucgcuuuc

SEQ ID NO: 1493550 - RNA, 19 nt, Homo sapiens
cuuaaaccuugguagaucu

SEQ ID NO: 1493551 - RNA, 19 nt, Homo sapiens
gguaggaaacacuuguagu

SEQ ID NO: 1493552 - RNA, 19 nt, Homo sapiens
caaaauggcucacauauua

SEQ ID NO: 1493553 - RNA, 19 nt, Homo sapiens
ggacugacgucuuuggauu

SEQ ID NO: 1493554 - RNA, 19 nt, Homo sapiens
cugauaaccugcuucauua

SEQ ID NO: 1493555 - RNA, 19 nt, Homo sapiens
uauguacacugcuaucuua

SEQ ID NO: 1493556 - RNA, 19 nt, Homo sapiens
gaaaagaacucaaguaacu

SEQ ID NO: 1493557 - RNA, 19 nt, Homo sapiens
caaaguuggucucaucuug

SEQ ID NO: 1493558 - RNA, 19 nt, Homo sapiens
guacacugcuaucuuaaga

SEQ ID NO: 1493559 - RNA, 19 nt, Homo sapiens
guauagagauugggucuug

SEQ ID NO: 1493560 - RNA, 19 nt, Homo sapiens
gagauugggucuugcuaug

SEQ ID NO: 1493561 - RNA, 19 nt, Homo sapiens
gaaaucuuccuaaguauag

SEQ ID NO: 1493562 - RNA, 19 nt, Homo sapiens
gauugggucuugcuauguu

SEQ ID NO: 1493563 - RNA, 19 nt, Homo sapiens
ggucucaucuuggaaaugu

SEQ ID NO: 1493564 - RNA, 19 nt, Homo sapiens
uaucaaaguuggucucauc

SEQ ID NO: 1493565 - RNA, 19 nt, Homo sapiens
aggcaggacugacgucuuu

SEQ ID NO: 1493566 - RNA, 19 nt, Homo sapiens
uuacucaaccuucugauaa

SEQ ID NO: 1493567 - RNA, 19 nt, Homo sapiens
gccuggcccuuuauaaauu

SEQ ID NO: 1493568 - RNA, 19 nt, Homo sapiens
ccgcagugauugaagcuuu

SEQ ID NO: 1493569 - RNA, 19 nt, Homo sapiens
cugcuuaccuguaccaguu

SEQ ID NO: 1493570 - RNA, 19 nt, Homo sapiens
ccuggcccuuuauaaauua

SEQ ID NO: 1493571 - RNA, 19 nt, Homo sapiens
uuccaaaucucacaauuca

SEQ ID NO: 1493572 - RNA, 19 nt, Homo sapiens
aauguaugcugaacaguug

SEQ ID NO: 1493573 - RNA, 19 nt, Homo sapiens
gaacuccuggccucaaaug

SEQ ID NO: 1493574 - RNA, 19 nt, Homo sapiens
cuacaaacuuccagucucu

SEQ ID NO: 1493575 - RNA, 19 nt, Homo sapiens
ucugauaaccugcuucauu

SEQ ID NO: 1493576 - RNA, 19 nt, Homo sapiens
uaccaguuauucccucuuu

SEQ ID NO: 1493577 - RNA, 19 nt, Homo sapiens
caugaauacuacaaacuuc

SEQ ID NO: 1493578 - RNA, 19 nt, Homo sapiens
ccaaaucucacaauucaag

SEQ ID NO: 1493579 - RNA, 19 nt, Homo sapiens
uaaccugcuucauuauugu

SEQ ID NO: 1493580 - RNA, 19 nt, Homo sapiens
caauguaugcugaacaguu

SEQ ID NO: 1493581 - RNA, 19 nt, Homo sapiens
gaacuuccaaaucucacaa

SEQ ID NO: 1493582 - RNA, 19 nt, Homo sapiens
cacugugccuggcccuuua

SEQ ID NO: 1493583 - RNA, 19 nt, Homo sapiens
gccauccauucgaauauug

SEQ ID NO: 1493584 - RNA, 19 nt, Homo sapiens
gugccuggcccuuuauaaa

SEQ ID NO: 1493585 - RNA, 19 nt, Homo sapiens
gcaagcaauauaucaaagu

SEQ ID NO: 1493586 - RNA, 19 nt, Homo sapiens
gugauugaagcuuugauaa

SEQ ID NO: 1493587 - RNA, 19 nt, Homo sapiens
guaacuucaugaauacuac

SEQ ID NO: 1493588 - RNA, 19 nt, Homo sapiens
ggauugcaguggaucuuac

SEQ ID NO: 1493589 - RNA, 19 nt, Homo sapiens
cauguggucagcagccuua

SEQ ID NO: 1493590 - RNA, 19 nt, Homo sapiens
gagcacagacacuucucuu

SEQ ID NO: 1493591 - RNA, 19 nt, Homo sapiens
gccaauguaugcugaacag

SEQ ID NO: 1493592 - RNA, 19 nt, Homo sapiens
cuuccuaaguauagagauu

SEQ ID NO: 1493593 - RNA, 19 nt, Homo sapiens
cacagacacuucucuugca

SEQ ID NO: 1493594 - RNA, 19 nt, Homo sapiens
cugaacaguuggugcaugu

SEQ ID NO: 1493595 - RNA, 19 nt, Homo sapiens
ccagguugaucuugaacuc

SEQ ID NO: 1493596 - RNA, 19 nt, Homo sapiens
acagacacuucucuugcaa

SEQ ID NO: 1493597 - RNA, 19 nt, Homo sapiens
ccaguuauucccucuuuca

SEQ ID NO: 1493598 - RNA, 19 nt, Homo sapiens
auucgaauauugguggaua

SEQ ID NO: 1493599 - RNA, 19 nt, Homo sapiens
ccacugugccuggcccuuu

SEQ ID NO: 1493600 - RNA, 19 nt, Homo sapiens
gcucuuccgcagugauuga

SEQ ID NO: 1493601 - RNA, 19 nt, Homo sapiens
caagagcacagacacuucu

SEQ ID NO: 1493602 - RNA, 19 nt, Homo sapiens
ugccauccauucgaauauu

SEQ ID NO: 1493603 - RNA, 19 nt, Homo sapiens
ggucagcagccuuacucaa

SEQ ID NO: 1493604 - RNA, 19 nt, Homo sapiens
gcagugauugaagcuuuga

SEQ ID NO: 1493605 - RNA, 19 nt, Homo sapiens
aaguuggucucaucuugga

SEQ ID NO: 1493606 - RNA, 19 nt, Homo sapiens
uccagucucuucggccuuu

SEQ ID NO: 1493607 - RNA, 19 nt, Homo sapiens
gcuuaccuguaccaguuau

SEQ ID NO: 1493608 - RNA, 19 nt, Homo sapiens
ccuuugccauccauucgaa

SEQ ID NO: 1493609 - RNA, 19 nt, Homo sapiens
cuccugaagugccgggauu

SEQ ID NO: 1493610 - RNA, 19 nt, Homo sapiens
guuggucucaucuuggaaa

SEQ ID NO: 1493611 - RNA, 19 nt, Homo sapiens
uacaagagcacagacacuu

SEQ ID NO: 1493612 - RNA, 19 nt, Homo sapiens
ucucacaauucaagcuaca

SEQ ID NO: 1493613 - RNA, 19 nt, Homo sapiens
gacugacgucuuuggauug

SEQ ID NO: 1493614 - RNA, 19 nt, Homo sapiens
cuuacucaaccuucugaua

SEQ ID NO: 1493615 - RNA, 19 nt, Homo sapiens
uugcccagguugaucuuga

SEQ ID NO: 1493616 - RNA, 19 nt, Homo sapiens
gcuauguugcccagguuga

SEQ ID NO: 1493617 - RNA, 19 nt, Homo sapiens
agugauugaagcuuugaua

SEQ ID NO: 1493618 - RNA, 19 nt, Homo sapiens
augggaaacuucugaaacu

SEQ ID NO: 1493619 - RNA, 19 nt, Homo sapiens
ggaacuaacuuacgauuaa

SEQ ID NO: 1493620 - RNA, 19 nt, Homo sapiens
gugcagggauuguacauuu

SEQ ID NO: 1493621 - RNA, 19 nt, Homo sapiens
caaaggaacuaacuuacga

SEQ ID NO: 1493622 - RNA, 19 nt, Homo sapiens
gaugaaucuuccaaaguua

SEQ ID NO: 1493623 - RNA, 19 nt, Homo sapiens
gcagaaauauucaccuauc

SEQ ID NO: 1493624 - RNA, 19 nt, Homo sapiens
ggaccucuguuucuuuauu

SEQ ID NO: 1493625 - RNA, 19 nt, Homo sapiens
ggaauagcuucuuguaugu

SEQ ID NO: 1493626 - RNA, 19 nt, Homo sapiens
aggaauagcuucuuguaug

SEQ ID NO: 1493627 - RNA, 19 nt, Homo sapiens
gugaggacgucguucagua

SEQ ID NO: 1493628 - RNA, 19 nt, Homo sapiens
ggagcaaguuuccgagguu

SEQ ID NO: 1493629 - RNA, 19 nt, Homo sapiens
ggaggaauagcuucuugua

SEQ ID NO: 1493630 - RNA, 19 nt, Homo sapiens
guaaugauuugcaguuucu

SEQ ID NO: 1493631 - RNA, 19 nt, Homo sapiens
gaccucuguuucuuuauuu

SEQ ID NO: 1493632 - RNA, 19 nt, Homo sapiens
guaaaucucccaaguccaa

SEQ ID NO: 1493633 - RNA, 19 nt, Homo sapiens
guauguagcacguauaaau

SEQ ID NO: 1493634 - RNA, 19 nt, Homo sapiens
augaugcucucccauaaua

SEQ ID NO: 1493635 - RNA, 19 nt, Homo sapiens
gccaagggcucgaccaagu

SEQ ID NO: 1493636 - RNA, 19 nt, Homo sapiens
gcaguaaugauuugcaguu

SEQ ID NO: 1493637 - RNA, 19 nt, Homo sapiens
aaacuggagaugugaauuu

SEQ ID NO: 1493638 - RNA, 19 nt, Homo sapiens
guccaaaggaacuaacuua

SEQ ID NO: 1493639 - RNA, 19 nt, Homo sapiens
aagcuuauauuugggagua

SEQ ID NO: 1493640 - RNA, 19 nt, Homo sapiens
gaaauauucaccuaucagu

SEQ ID NO: 1493641 - RNA, 19 nt, Homo sapiens
gauauuuggaccucuguuu

SEQ ID NO: 1493642 - RNA, 19 nt, Homo sapiens
guaaaggccaccugacaga

SEQ ID NO: 1493643 - RNA, 19 nt, Homo sapiens
gaaaauuagucaggaggua

SEQ ID NO: 1493644 - RNA, 19 nt, Homo sapiens
cagaaauauucaccuauca

SEQ ID NO: 1493645 - RNA, 19 nt, Homo sapiens
gcagggauuguacauuuga

SEQ ID NO: 1493646 - RNA, 19 nt, Homo sapiens
gugaacacgugcagggauu

SEQ ID NO: 1493647 - RNA, 19 nt, Homo sapiens
cauaauacagcaguaauga

SEQ ID NO: 1493648 - RNA, 19 nt, Homo sapiens
auacagcaguaaugauuug

SEQ ID NO: 1493649 - RNA, 19 nt, Homo sapiens
uuggaccucuguuucuuua

SEQ ID NO: 1493650 - RNA, 19 nt, Homo sapiens
gauuugcaguuucucacaa

SEQ ID NO: 1493651 - RNA, 19 nt, Homo sapiens
cuggagaugugaauuuaug

SEQ ID NO: 1493652 - RNA, 19 nt, Homo sapiens
aacuggagaugugaauuua

SEQ ID NO: 1493653 - RNA, 19 nt, Homo sapiens
aaaggccaccugacagaua

SEQ ID NO: 1493654 - RNA, 19 nt, Homo sapiens
gcugcucuguguuguaguu

SEQ ID NO: 1493655 - RNA, 19 nt, Homo sapiens
caguaaugauuugcaguuu

SEQ ID NO: 1493656 - RNA, 19 nt, Homo sapiens
uugcagaaauauucaccua

SEQ ID NO: 1493657 - RNA, 19 nt, Homo sapiens
gaguauaccauguaguugu

SEQ ID NO: 1493658 - RNA, 19 nt, Homo sapiens
gaguaaaggccaccugaca

SEQ ID NO: 1493659 - RNA, 19 nt, Homo sapiens
gaggaauagcuucuuguau

SEQ ID NO: 1493660 - RNA, 19 nt, Homo sapiens
gagcagcaucuccuggaaa

SEQ ID NO: 1493661 - RNA, 19 nt, Homo sapiens
gcuuauauuugggaguaaa

SEQ ID NO: 1493662 - RNA, 19 nt, Homo sapiens
gagaugugaauuuaugaug

SEQ ID NO: 1493663 - RNA, 19 nt, Homo sapiens
gaaacuggagaugugaauu

SEQ ID NO: 1493664 - RNA, 19 nt, Homo sapiens
gcagaaacuggagauguga

SEQ ID NO: 1493665 - RNA, 19 nt, Homo sapiens
ccauguaguuguugagucu

SEQ ID NO: 1493666 - RNA, 19 nt, Homo sapiens
ccaagggcucgaccaagua

SEQ ID NO: 1493667 - RNA, 19 nt, Homo sapiens
gauaguaacagugguucuu

SEQ ID NO: 1493668 - RNA, 19 nt, Homo sapiens
gggaguaaaauguaucuua

SEQ ID NO: 1493669 - RNA, 19 nt, Homo sapiens
acauuugauugccuuauug

SEQ ID NO: 1493670 - RNA, 19 nt, Homo sapiens
gaugugaauuuaugaugcu

SEQ ID NO: 1493671 - RNA, 19 nt, Homo sapiens
gggauuguacauuugauug

SEQ ID NO: 1493672 - RNA, 19 nt, Homo sapiens
ugcagaaacuggagaugug

SEQ ID NO: 1493673 - RNA, 19 nt, Homo sapiens
ucaccuaucaguccauguu

SEQ ID NO: 1493674 - RNA, 19 nt, Homo sapiens
uagaaagaauagagagucu

SEQ ID NO: 1493675 - RNA, 19 nt, Homo sapiens
uauaaaugcagcugucaug

SEQ ID NO: 1493676 - RNA, 19 nt, Homo sapiens
aguauaccauguaguuguu

SEQ ID NO: 1493677 - RNA, 19 nt, Homo sapiens
caaagaugaugagcagcau

SEQ ID NO: 1493678 - RNA, 19 nt, Homo sapiens
cagggaggcuggugagcau

SEQ ID NO: 1493679 - RNA, 19 nt, Homo sapiens
ucagaacuuccguaccuuu

SEQ ID NO: 1493680 - RNA, 19 nt, Homo sapiens
ggagaugugaauuuaugau

SEQ ID NO: 1493681 - RNA, 19 nt, Homo sapiens
gauguaaaucucccaaguc

SEQ ID NO: 1493682 - RNA, 19 nt, Homo sapiens
guugaaggcagagaagaaa

SEQ ID NO: 1493683 - RNA, 19 nt, Homo sapiens
ccauaauacagcaguaaug

SEQ ID NO: 1493684 - RNA, 19 nt, Homo sapiens
gaugcucucccauaauaca

SEQ ID NO: 1493685 - RNA, 19 nt, Homo sapiens
uauaccauguaguuguuga

SEQ ID NO: 1493686 - RNA, 19 nt, Homo sapiens
ugagcagcaucuccuggaa

SEQ ID NO: 1493687 - RNA, 19 nt, Homo sapiens
gggacaauuugguuuuaaa

SEQ ID NO: 1493688 - RNA, 19 nt, Homo sapiens
cguaaacaaauacuggaaa

SEQ ID NO: 1493689 - RNA, 19 nt, Homo sapiens
gcaaguuuccgagguugga

SEQ ID NO: 1493690 - RNA, 19 nt, Homo sapiens
uauguagcacguauaaaug

SEQ ID NO: 1493691 - RNA, 19 nt, Homo sapiens
gcucuguguuguaguucug

SEQ ID NO: 1493692 - RNA, 19 nt, Homo sapiens
gaacacgugcagggauugu

SEQ ID NO: 1493693 - RNA, 19 nt, Homo sapiens
gaggacgucguucaguaga

SEQ ID NO: 1493694 - RNA, 19 nt, Homo sapiens
gucaggagguaagaugaau

SEQ ID NO: 1493695 - RNA, 19 nt, Homo sapiens
cagcugucaugcaguucuu

SEQ ID NO: 1493696 - RNA, 19 nt, Homo sapiens
uuucagaacuuccguaccu

SEQ ID NO: 1493697 - RNA, 19 nt, Homo sapiens
aguaaugauuugcaguuuc

SEQ ID NO: 1493698 - RNA, 19 nt, Homo sapiens
gaaggcagagaagaaaucu

SEQ ID NO: 1493699 - RNA, 19 nt, Homo sapiens
gcugagggaggaauagcuu

SEQ ID NO: 1493700 - RNA, 19 nt, Homo sapiens
aggaacuaacuuacgauua

SEQ ID NO: 1493701 - RNA, 19 nt, Homo sapiens
gaacucucacacacacugu

SEQ ID NO: 1493702 - RNA, 19 nt, Homo sapiens
gcauccgacggcagaguaa

SEQ ID NO: 1493703 - RNA, 19 nt, Homo sapiens
ggucaggcugggaggauga

SEQ ID NO: 1493704 - RNA, 19 nt, Homo sapiens
ucaugcaguucuuuucuuu

SEQ ID NO: 1493705 - RNA, 19 nt, Homo sapiens
ugaaggcagagaagaaauc

SEQ ID NO: 1493706 - RNA, 19 nt, Homo sapiens
agggaggaauagcuucuug

SEQ ID NO: 1493707 - RNA, 19 nt, Homo sapiens
ccaaaggaacuaacuuacg

SEQ ID NO: 1493708 - RNA, 19 nt, Homo sapiens
ucucccaaguccaaaggaa

SEQ ID NO: 1493709 - RNA, 19 nt, Homo sapiens
ugcagggauuguacauuug

SEQ ID NO: 1493710 - RNA, 19 nt, Homo sapiens
ccaaguccaaaggaacuaa

SEQ ID NO: 1493711 - RNA, 19 nt, Homo sapiens
augaguauaccauguaguu

SEQ ID NO: 1493712 - RNA, 19 nt, Homo sapiens
aaggccaccugacagauag

SEQ ID NO: 1493713 - RNA, 19 nt, Homo sapiens
ccagaugaaauugaagguu

SEQ ID NO: 1493714 - RNA, 19 nt, Homo sapiens
cuccaaaacuugcucuuga

SEQ ID NO: 1493715 - RNA, 19 nt, Homo sapiens
gaagaugacuugcuauuua

SEQ ID NO: 1493716 - RNA, 19 nt, Homo sapiens
gaacaacaauucccaaaug

SEQ ID NO: 1493717 - RNA, 19 nt, Homo sapiens
ccagauaucucucaccuua

SEQ ID NO: 1493718 - RNA, 19 nt, Homo sapiens
gaaauucucucuucagaug

SEQ ID NO: 1493719 - RNA, 19 nt, Homo sapiens
gcaauuaucuuaacaaguc

SEQ ID NO: 1493720 - RNA, 19 nt, Homo sapiens
ggaguaguguuccugauaa

SEQ ID NO: 1493721 - RNA, 19 nt, Homo sapiens
guagaacgauuucagaaug

SEQ ID NO: 1493722 - RNA, 19 nt, Homo sapiens
gacaguaccuggcuucaga

SEQ ID NO: 1493723 - RNA, 19 nt, Homo sapiens
agauaucucucaccuuaua

SEQ ID NO: 1493724 - RNA, 19 nt, Homo sapiens
gccaugacaucaacucuuu

SEQ ID NO: 1493725 - RNA, 19 nt, Homo sapiens
gguaaagucuccaaaugug

SEQ ID NO: 1493726 - RNA, 19 nt, Homo sapiens
ggaacccaaucuaucuaua

SEQ ID NO: 1493727 - RNA, 19 nt, Homo sapiens
guaccuggcuucagaguca

SEQ ID NO: 1493728 - RNA, 19 nt, Homo sapiens
ucccaaagcugccuaagaa

SEQ ID NO: 1493729 - RNA, 19 nt, Homo sapiens
ucaagagaguguuuggaua

SEQ ID NO: 1493730 - RNA, 19 nt, Homo sapiens
gggaaauucucucuucaga

SEQ ID NO: 1493731 - RNA, 19 nt, Homo sapiens
caguggagcucaauacuau

SEQ ID NO: 1493732 - RNA, 19 nt, Homo sapiens
gcaggaaaaucuagaaauu

SEQ ID NO: 1493733 - RNA, 19 nt, Homo sapiens
cagcugccuuugcuauuua

SEQ ID NO: 1493734 - RNA, 19 nt, Homo sapiens
gcaaccuucugauuucuau

SEQ ID NO: 1493735 - RNA, 19 nt, Homo sapiens
ccagggaaauucucucuuc

SEQ ID NO: 1493736 - RNA, 19 nt, Homo sapiens
guuaacauuuccuaucuga

SEQ ID NO: 1493737 - RNA, 19 nt, Homo sapiens
uaaaucaucgagaccaaua

SEQ ID NO: 1493738 - RNA, 19 nt, Homo sapiens
aaauacagcucaagagagu

SEQ ID NO: 1493739 - RNA, 19 nt, Homo sapiens
gagaagaugacuugcuauu

SEQ ID NO: 1493740 - RNA, 19 nt, Homo sapiens
uaucauuggugcaggaauu

SEQ ID NO: 1493741 - RNA, 19 nt, Homo sapiens
caagagaguguuuggauau

SEQ ID NO: 1493742 - RNA, 19 nt, Homo sapiens
ccagcugccuuugcuauuu

SEQ ID NO: 1493743 - RNA, 19 nt, Homo sapiens
gcaguggagcucaauacua

SEQ ID NO: 1493744 - RNA, 19 nt, Homo sapiens
ucugaugacuguaguuuau

SEQ ID NO: 1493745 - RNA, 19 nt, Homo sapiens
gaagaagcccagaacaaca

SEQ ID NO: 1493746 - RNA, 19 nt, Homo sapiens
cagagucacuaagaaauug

SEQ ID NO: 1493747 - RNA, 19 nt, Homo sapiens
caaagcugccuaagaaaug

SEQ ID NO: 1493748 - RNA, 19 nt, Homo sapiens
gacgugggcuugguuguga

SEQ ID NO: 1493749 - RNA, 19 nt, Homo sapiens
gggcaugcuuuacacuuau

SEQ ID NO: 1493750 - RNA, 19 nt, Homo sapiens
ggagaauguagaacgauuu

SEQ ID NO: 1493751 - RNA, 19 nt, Homo sapiens
ggugaaauuccuaugguaa

SEQ ID NO: 1493752 - RNA, 19 nt, Homo sapiens
uugagaagaugacuugcua

SEQ ID NO: 1493753 - RNA, 19 nt, Homo sapiens
caacuuccauucucucacu

SEQ ID NO: 1493754 - RNA, 19 nt, Homo sapiens
ugggaucccuugcaauuau

SEQ ID NO: 1493755 - RNA, 19 nt, Homo sapiens
gcuacuacuugucacuuug

SEQ ID NO: 1493756 - RNA, 19 nt, Homo sapiens
caagccaucuuccaaggau

SEQ ID NO: 1493757 - RNA, 19 nt, Homo sapiens
gaaaauacagcucaagaga

SEQ ID NO: 1493758 - RNA, 19 nt, Homo sapiens
uuagcaaccuucugauuuc

SEQ ID NO: 1493759 - RNA, 19 nt, Homo sapiens
ggcaugcuuuacacuuaua

SEQ ID NO: 1493760 - RNA, 19 nt, Homo sapiens
ggaagugcaaacucuuaaa

SEQ ID NO: 1493761 - RNA, 19 nt, Homo sapiens
aggaauagaugucggaagu

SEQ ID NO: 1493762 - RNA, 19 nt, Homo sapiens
ucucagcggauuacuauuu

SEQ ID NO: 1493763 - RNA, 19 nt, Homo sapiens
gacuguaguuuauuuacug

SEQ ID NO: 1493764 - RNA, 19 nt, Homo sapiens
ugacuuggcuucagauagc

SEQ ID NO: 1493765 - RNA, 19 nt, Homo sapiens
gagaguguuuggauauugg

SEQ ID NO: 1493766 - RNA, 19 nt, Homo sapiens
augcugaacuuccagauau

SEQ ID NO: 1493767 - RNA, 19 nt, Homo sapiens
gaugcugaacuuccagaua

SEQ ID NO: 1493768 - RNA, 19 nt, Homo sapiens
ccaaagcugccuaagaaau

SEQ ID NO: 1493769 - RNA, 19 nt, Homo sapiens
uugcguagcuugauagagu

SEQ ID NO: 1493770 - RNA, 19 nt, Homo sapiens
gaacccaaucuaucuauac

SEQ ID NO: 1493771 - RNA, 19 nt, Homo sapiens
aaaggagaauguagaacga

SEQ ID NO: 1493772 - RNA, 19 nt, Homo sapiens
guccauacuuagcuucauu

SEQ ID NO: 1493773 - RNA, 19 nt, Homo sapiens
aguauaagcuucccaugca

SEQ ID NO: 1493774 - RNA, 19 nt, Homo sapiens
gauuauacaacuuccauuc

SEQ ID NO: 1493775 - RNA, 19 nt, Homo sapiens
guagcuugauagagugauu

SEQ ID NO: 1493776 - RNA, 19 nt, Homo sapiens
aaauaagauuggcuugguu

SEQ ID NO: 1493777 - RNA, 19 nt, Homo sapiens
guucucagcggauuacuau

SEQ ID NO: 1493778 - RNA, 19 nt, Homo sapiens
uagucacucuucuccauuu

SEQ ID NO: 1493779 - RNA, 19 nt, Homo sapiens
caacaauucccaaaugcau

SEQ ID NO: 1493780 - RNA, 19 nt, Homo sapiens
cagcugcucugucccaaag

SEQ ID NO: 1493781 - RNA, 19 nt, Homo sapiens
gauuaugccuuuugcuauu

SEQ ID NO: 1493782 - RNA, 19 nt, Homo sapiens
augcauauuuacugcguua

SEQ ID NO: 1493783 - RNA, 19 nt, Homo sapiens
gcagagauaaguauaagcu

SEQ ID NO: 1493784 - RNA, 19 nt, Homo sapiens
ucagagucacuaagaaauu

SEQ ID NO: 1493785 - RNA, 19 nt, Homo sapiens
gugaaauuccuaugguaaa

SEQ ID NO: 1493786 - RNA, 19 nt, Homo sapiens
aaucaucgagaccaauaua

SEQ ID NO: 1493787 - RNA, 19 nt, Homo sapiens
gaauccaucaacauccuuu

SEQ ID NO: 1493788 - RNA, 19 nt, Homo sapiens
gcagcuacauaggcaggaa

SEQ ID NO: 1493789 - RNA, 19 nt, Homo sapiens
ggggcaugcuuuacacuua

SEQ ID NO: 1493790 - RNA, 19 nt, Homo sapiens
gagaauguagaacgauuuc

SEQ ID NO: 1493791 - RNA, 19 nt, Homo sapiens
guuguggauuguaggaauu

SEQ ID NO: 1493792 - RNA, 19 nt, Homo sapiens
ggcauacucuugcaugaac

SEQ ID NO: 1493793 - RNA, 19 nt, Homo sapiens
agagaguguuuggauauug

SEQ ID NO: 1493794 - RNA, 19 nt, Homo sapiens
gguuugagaagaugacuug

SEQ ID NO: 1493795 - RNA, 19 nt, Homo sapiens
agaccaauauaucuugcaa

SEQ ID NO: 1493796 - RNA, 19 nt, Homo sapiens
gguaguugcuggccaagcu

SEQ ID NO: 1493797 - RNA, 19 nt, Homo sapiens
gcuucagagucacuaagaa

SEQ ID NO: 1493798 - RNA, 19 nt, Homo sapiens
ccaaaucaagguuaaacau

SEQ ID NO: 1493799 - RNA, 19 nt, Homo sapiens
gaagugcaaacucuuaaaa

SEQ ID NO: 1493800 - RNA, 19 nt, Homo sapiens
agaagaugacuugcuauuu

SEQ ID NO: 1493801 - RNA, 19 nt, Homo sapiens
cccaaucuaucuauaccuu

SEQ ID NO: 1493802 - RNA, 19 nt, Homo sapiens
ggauagaggggagaaaaua

SEQ ID NO: 1493803 - RNA, 19 nt, Homo sapiens
ucacucuucuccauuuaca

SEQ ID NO: 1493804 - RNA, 19 nt, Homo sapiens
ggaaauucucucuucagau

SEQ ID NO: 1493805 - RNA, 19 nt, Homo sapiens
uaacauuuccuaucugacu

SEQ ID NO: 1493806 - RNA, 19 nt, Homo sapiens
ugaugugucugaggaauag

SEQ ID NO: 1493807 - RNA, 19 nt, Homo sapiens
uaagauuggcuugguuuga

SEQ ID NO: 1493808 - RNA, 19 nt, Homo sapiens
ccaggaacccaaucuaucu

SEQ ID NO: 1493809 - RNA, 19 nt, Homo sapiens
cagcugugcuacuacuugu

SEQ ID NO: 1493810 - RNA, 19 nt, Homo sapiens
uuuagcaaccuucugauuu

SEQ ID NO: 1493811 - RNA, 19 nt, Homo sapiens
cagggaaauucucucuuca

SEQ ID NO: 1493812 - RNA, 19 nt, Homo sapiens
cagaacaacaauucccaaa

SEQ ID NO: 1493813 - RNA, 19 nt, Homo sapiens
gaauguagaacgauuucag

SEQ ID NO: 1493814 - RNA, 19 nt, Homo sapiens
uggaguaguguuccugaua

SEQ ID NO: 1493815 - RNA, 19 nt, Homo sapiens
gaacuugucuaaacacauu

SEQ ID NO: 1493816 - RNA, 19 nt, Homo sapiens
caaggagccuacauuauuu

SEQ ID NO: 1493817 - RNA, 19 nt, Homo sapiens
ccaaggagccuacauuauu

SEQ ID NO: 1493818 - RNA, 19 nt, Homo sapiens
gaacuuugaugacagcaau

SEQ ID NO: 1493819 - RNA, 19 nt, Homo sapiens
ugucacaacuccaagguua

SEQ ID NO: 1493820 - RNA, 19 nt, Homo sapiens
gagccuacauuauuuggaa

SEQ ID NO: 1493821 - RNA, 19 nt, Homo sapiens
ccacaaagcauggcaaauu

SEQ ID NO: 1493822 - RNA, 19 nt, Homo sapiens
gcacgagacugcccaugau

SEQ ID NO: 1493823 - RNA, 19 nt, Homo sapiens
ggaaaggacagugugauuu

SEQ ID NO: 1493824 - RNA, 19 nt, Homo sapiens
cuaaacacauuccacagaa

SEQ ID NO: 1493825 - RNA, 19 nt, Homo sapiens
gaacugacucauuggacua

SEQ ID NO: 1493826 - RNA, 19 nt, Homo sapiens
gaaacacgacuuugaucuu

SEQ ID NO: 1493827 - RNA, 19 nt, Homo sapiens
cauccacgagucuuaauua

SEQ ID NO: 1493828 - RNA, 19 nt, Homo sapiens
caagccaacugaaagaauc

SEQ ID NO: 1493829 - RNA, 19 nt, Homo sapiens
cacaaagcauggcaaauuc

SEQ ID NO: 1493830 - RNA, 19 nt, Homo sapiens
ccacgagucuuaauuacag

SEQ ID NO: 1493831 - RNA, 19 nt, Homo sapiens
aaacacgacuuugaucuuc

SEQ ID NO: 1493832 - RNA, 19 nt, Homo sapiens
gcggaugguuggccgauga

SEQ ID NO: 1493833 - RNA, 19 nt, Homo sapiens
ucaagcacgugccggaauu

SEQ ID NO: 1493834 - RNA, 19 nt, Homo sapiens
ugacugccauguugaacuu

SEQ ID NO: 1493835 - RNA, 19 nt, Homo sapiens
caucauuaguuuccauuuc

SEQ ID NO: 1493836 - RNA, 19 nt, Homo sapiens
gaaaggacagugugauuuu

SEQ ID NO: 1493837 - RNA, 19 nt, Homo sapiens
guuggugacugccauguug

SEQ ID NO: 1493838 - RNA, 19 nt, Homo sapiens
ggauuggacaccugaauug

SEQ ID NO: 1493839 - RNA, 19 nt, Homo sapiens
guagaggccacagguauuu

SEQ ID NO: 1493840 - RNA, 19 nt, Homo sapiens
gacaaagaauggaguuaac

SEQ ID NO: 1493841 - RNA, 19 nt, Homo sapiens
ucacaacuccaagguuaua

SEQ ID NO: 1493842 - RNA, 19 nt, Homo sapiens
ggaaacgauucggaaagga

SEQ ID NO: 1493843 - RNA, 19 nt, Homo sapiens
gguggaaacacgacuuuga

SEQ ID NO: 1493844 - RNA, 19 nt, Homo sapiens
gaguagaggccacagguau

SEQ ID NO: 1493845 - RNA, 19 nt, Homo sapiens
agacaaagaauggaguuaa

SEQ ID NO: 1493846 - RNA, 19 nt, Homo sapiens
gaacugcuagacaaagaau

SEQ ID NO: 1493847 - RNA, 19 nt, Homo sapiens
caacugaaagaaucuggaa

SEQ ID NO: 1493848 - RNA, 19 nt, Homo sapiens
aaacuaugcaguccagauu

SEQ ID NO: 1493849 - RNA, 19 nt, Homo sapiens
gaaacuaugcaguccagau

SEQ ID NO: 1493850 - RNA, 19 nt, Homo sapiens
gcaggaagaauagaagaug

SEQ ID NO: 1493851 - RNA, 19 nt, Homo sapiens
ggaaacacgacuuugaucu

SEQ ID NO: 1493852 - RNA, 19 nt, Homo sapiens
aagaauagaagaugguuga

SEQ ID NO: 1493853 - RNA, 19 nt, Homo sapiens
cgagacugcccaugaugua

SEQ ID NO: 1493854 - RNA, 19 nt, Homo sapiens
gcuuaagucaucauuaguu

SEQ ID NO: 1493855 - RNA, 19 nt, Homo sapiens
aggaugaagugacuauuuc

SEQ ID NO: 1493856 - RNA, 19 nt, Homo sapiens
uaggaugaagugacuauuu

SEQ ID NO: 1493857 - RNA, 19 nt, Homo sapiens
caccugaauuggcuuugaa

SEQ ID NO: 1493858 - RNA, 19 nt, Homo sapiens
ccgaugaacuuugaugaca

SEQ ID NO: 1493859 - RNA, 19 nt, Homo sapiens
guuggccgaugaacuuuga

SEQ ID NO: 1493860 - RNA, 19 nt, Homo sapiens
gaaaagaaaaugcuguuca

SEQ ID NO: 1493861 - RNA, 19 nt, Homo sapiens
gggauuggacaccugaauu

SEQ ID NO: 1493862 - RNA, 19 nt, Homo sapiens
uaauuaggaugaagugacu

SEQ ID NO: 1493863 - RNA, 19 nt, Homo sapiens
auauugaacugcuagacaa

SEQ ID NO: 1493864 - RNA, 19 nt, Homo sapiens
ggacaccugaauuggcuuu

SEQ ID NO: 1493865 - RNA, 19 nt, Homo sapiens
uuuggcagcucauauugaa

SEQ ID NO: 1493866 - RNA, 19 nt, Homo sapiens
gcugagucccuuuccauga

SEQ ID NO: 1493867 - RNA, 19 nt, Homo sapiens
aggcuuaagucaucauuag

SEQ ID NO: 1493868 - RNA, 19 nt, Homo sapiens
cggaauuccagaucacaua

SEQ ID NO: 1493869 - RNA, 19 nt, Homo sapiens
ucagaauguuguagguaug

SEQ ID NO: 1493870 - RNA, 19 nt, Homo sapiens
ggaagaauagaagaugguu

SEQ ID NO: 1493871 - RNA, 19 nt, Homo sapiens
gaagaugguugaggggauu

SEQ ID NO: 1493872 - RNA, 19 nt, Homo sapiens
caaagaauggaguuaacau

SEQ ID NO: 1493873 - RNA, 19 nt, Homo sapiens
cuacauuauuuggaacuga

SEQ ID NO: 1493874 - RNA, 19 nt, Homo sapiens
gcucaugggagaaacuaug

SEQ ID NO: 1493875 - RNA, 19 nt, Homo sapiens
acaguggccugcauaacau

SEQ ID NO: 1493876 - RNA, 19 nt, Homo sapiens
ugccugaacuugucuaaac

SEQ ID NO: 1493877 - RNA, 19 nt, Homo sapiens
ugacucauuggacuaaauu

SEQ ID NO: 1493878 - RNA, 19 nt, Homo sapiens
acuuugaucuuccagaguu

SEQ ID NO: 1493879 - RNA, 19 nt, Homo sapiens
ccacagguauuugaaaaga

SEQ ID NO: 1493880 - RNA, 19 nt, Homo sapiens
gaucacauacaacguggau

SEQ ID NO: 1493881 - RNA, 19 nt, Homo sapiens
gaggaaacgauucggaaag

SEQ ID NO: 1493882 - RNA, 19 nt, Homo sapiens
gaccauccacgagucuuaa

SEQ ID NO: 1493883 - RNA, 19 nt, Homo sapiens
cacaguggccugcauaaca

SEQ ID NO: 1493884 - RNA, 19 nt, Homo sapiens
cggaaaggacagugugauu

SEQ ID NO: 1493885 - RNA, 19 nt, Homo sapiens
ccaagguuauagacuccaa

SEQ ID NO: 1493886 - RNA, 19 nt, Homo sapiens
ccaugaggaccuacaaugu

SEQ ID NO: 1493887 - RNA, 19 nt, Homo sapiens
auuuggaacugacucauug

SEQ ID NO: 1493888 - RNA, 19 nt, Homo sapiens
cuccaacucuggguucgua

SEQ ID NO: 1493889 - RNA, 19 nt, Homo sapiens
ggccacagguauuugaaaa

SEQ ID NO: 1493890 - RNA, 19 nt, Homo sapiens
gagcucaugggagaaacua

SEQ ID NO: 1493891 - RNA, 19 nt, Homo sapiens
ucuaaacacauuccacaga

SEQ ID NO: 1493892 - RNA, 19 nt, Homo sapiens
acaccugaauuggcuuuga

SEQ ID NO: 1493893 - RNA, 19 nt, Homo sapiens
uugaacugcuagacaaaga

SEQ ID NO: 1493894 - RNA, 19 nt, Homo sapiens
gagccacccuggaggucau

SEQ ID NO: 1493895 - RNA, 19 nt, Homo sapiens
ugggugcgcaggaagaaua

SEQ ID NO: 1493896 - RNA, 19 nt, Homo sapiens
ugaggaaacgauucggaaa

SEQ ID NO: 1493897 - RNA, 19 nt, Homo sapiens
gcccaagccaacugaaaga

SEQ ID NO: 1493898 - RNA, 19 nt, Homo sapiens
gugccggaauuccagauca

SEQ ID NO: 1493899 - RNA, 19 nt, Homo sapiens
ucaccugccuuuucuguug

SEQ ID NO: 1493900 - RNA, 19 nt, Homo sapiens
gccugaacuugucuaaaca

SEQ ID NO: 1493901 - RNA, 19 nt, Homo sapiens
agggagaacugucacaacu

SEQ ID NO: 1493902 - RNA, 19 nt, Homo sapiens
caagggagaacugucacaa

SEQ ID NO: 1493903 - RNA, 19 nt, Homo sapiens
ggaauuccagaucacauac

SEQ ID NO: 1493904 - RNA, 19 nt, Homo sapiens
augaggaccuacaauguca

SEQ ID NO: 1493905 - RNA, 19 nt, Homo sapiens
caaagcauggcaaauucga

SEQ ID NO: 1493906 - RNA, 19 nt, Homo sapiens
cggaacacaaucugcaauu

SEQ ID NO: 1493907 - RNA, 19 nt, Homo sapiens
ggaagcugggaguauguga

SEQ ID NO: 1493908 - RNA, 19 nt, Homo sapiens
uucagaauguuguagguau

SEQ ID NO: 1493909 - RNA, 19 nt, Homo sapiens
ccaagccaacugaaagaau

SEQ ID NO: 1493910 - RNA, 19 nt, Homo sapiens
ggaugucgcugcggaacac

SEQ ID NO: 1493911 - RNA, 19 nt, Homo sapiens
gaugaagugacuauuucug

SEQ ID NO: 1493912 - RNA, 19 nt, Homo sapiens
ggugggacuuuucaguuuu

SEQ ID NO: 1493913 - RNA, 19 nt, Homo sapiens
cauauugaacugcuagaca

SEQ ID NO: 1493914 - RNA, 19 nt, Homo sapiens
acucuggguucguaguuug

SEQ ID NO: 1493915 - RNA, 19 nt, Homo sapiens
caaaggugcuuauccauuu

SEQ ID NO: 1493916 - RNA, 19 nt, Homo sapiens
gaacuaagcacuaaucaau

SEQ ID NO: 1493917 - RNA, 19 nt, Homo sapiens
cugaagagcugaaggcuaa

SEQ ID NO: 1493918 - RNA, 19 nt, Homo sapiens
ccaagaggcugccauaucu

SEQ ID NO: 1493919 - RNA, 19 nt, Homo sapiens
ccagacaucuaaacaucua

SEQ ID NO: 1493920 - RNA, 19 nt, Homo sapiens
gugaauaucuugagagucu

SEQ ID NO: 1493921 - RNA, 19 nt, Homo sapiens
gcugaaggcuaauuaaucu

SEQ ID NO: 1493922 - RNA, 19 nt, Homo sapiens
gaaacagauuugccucuuc

SEQ ID NO: 1493923 - RNA, 19 nt, Homo sapiens
gaaggcuaauuaaucugua

SEQ ID NO: 1493924 - RNA, 19 nt, Homo sapiens
guaagaccaaugugaauuu

SEQ ID NO: 1493925 - RNA, 19 nt, Homo sapiens
gaaaagccauguaagaugu

SEQ ID NO: 1493926 - RNA, 19 nt, Homo sapiens
gaagucaaauuaguuacug

SEQ ID NO: 1493927 - RNA, 19 nt, Homo sapiens
gggcuuuccuuauuguaaa

SEQ ID NO: 1493928 - RNA, 19 nt, Homo sapiens
gcuaaucuacuuugugaaa

SEQ ID NO: 1493929 - RNA, 19 nt, Homo sapiens
ugacccagucuacaaauua

SEQ ID NO: 1493930 - RNA, 19 nt, Homo sapiens
ggccgaagcagaagacuuu

SEQ ID NO: 1493931 - RNA, 19 nt, Homo sapiens
gaauuuaaaccacaguguu

SEQ ID NO: 1493932 - RNA, 19 nt, Homo sapiens
acaguaggaucaauugcua

SEQ ID NO: 1493933 - RNA, 19 nt, Homo sapiens
agacaggccugagucauga

SEQ ID NO: 1493934 - RNA, 19 nt, Homo sapiens
gcacuaaucaauaauaagg

SEQ ID NO: 1493935 - RNA, 19 nt, Homo sapiens
gagcuccacuaccuugcua

SEQ ID NO: 1493936 - RNA, 19 nt, Homo sapiens
gaagaaaagccauguaaga

SEQ ID NO: 1493937 - RNA, 19 nt, Homo sapiens
ggaagaugcgcuugcugua

SEQ ID NO: 1493938 - RNA, 19 nt, Homo sapiens
auggaagggucuaaacuua

SEQ ID NO: 1493939 - RNA, 19 nt, Homo sapiens
cauccuguccugcuuguua

SEQ ID NO: 1493940 - RNA, 19 nt, Homo sapiens
gaacggaaagucuguaacu

SEQ ID NO: 1493941 - RNA, 19 nt, Homo sapiens
guaauuuggcuaaacacua

SEQ ID NO: 1493942 - RNA, 19 nt, Homo sapiens
ggcaaggcaugagacauuu

SEQ ID NO: 1493943 - RNA, 19 nt, Homo sapiens
gacccagucuacaaauuau

SEQ ID NO: 1493944 - RNA, 19 nt, Homo sapiens
ucagggaacaaccaaauaa

SEQ ID NO: 1493945 - RNA, 19 nt, Homo sapiens
gcuaaauuauccuucuugu

SEQ ID NO: 1493946 - RNA, 19 nt, Homo sapiens
uugcuaaucuacuuuguga

SEQ ID NO: 1493947 - RNA, 19 nt, Homo sapiens
ccacaccuauccuucugaa

SEQ ID NO: 1493948 - RNA, 19 nt, Homo sapiens
cgaaacagauuugccucuu

SEQ ID NO: 1493949 - RNA, 19 nt, Homo sapiens
caaaugaguggucccaaga

SEQ ID NO: 1493950 - RNA, 19 nt, Homo sapiens
gagcacuucccucauggua

SEQ ID NO: 1493951 - RNA, 19 nt, Homo sapiens
gauggaagggucuaaacuu

SEQ ID NO: 1493952 - RNA, 19 nt, Homo sapiens
gguuaucugugcucuugaa

SEQ ID NO: 1493953 - RNA, 19 nt, Homo sapiens
gagcugaaggcuaauuaau

SEQ ID NO: 1493954 - RNA, 19 nt, Homo sapiens
ggaggaugauacaaguuca

SEQ ID NO: 1493955 - RNA, 19 nt, Homo sapiens
gaaaaccaccaauagaauu

SEQ ID NO: 1493956 - RNA, 19 nt, Homo sapiens
gauuggcucuggugugcuu

SEQ ID NO: 1493957 - RNA, 19 nt, Homo sapiens
ucaaaggugcuuauccauu

SEQ ID NO: 1493958 - RNA, 19 nt, Homo sapiens
uaucugugcucuugaaguc

SEQ ID NO: 1493959 - RNA, 19 nt, Homo sapiens
cuaugugucuucuauuuag

SEQ ID NO: 1493960 - RNA, 19 nt, Homo sapiens
gauguugggcuuuccuuau

SEQ ID NO: 1493961 - RNA, 19 nt, Homo sapiens
uaggaucaauugcuaaucu

SEQ ID NO: 1493962 - RNA, 19 nt, Homo sapiens
uccacuaccuugcuaagaa

SEQ ID NO: 1493963 - RNA, 19 nt, Homo sapiens
gaagagcugaaggcuaauu

SEQ ID NO: 1493964 - RNA, 19 nt, Homo sapiens
ucacagugcaauuuauuug

SEQ ID NO: 1493965 - RNA, 19 nt, Homo sapiens
gcucuaucgucgaaacaga

SEQ ID NO: 1493966 - RNA, 19 nt, Homo sapiens
caucagcgccaucuuguuc

SEQ ID NO: 1493967 - RNA, 19 nt, Homo sapiens
ggauguugggcuuuccuua

SEQ ID NO: 1493968 - RNA, 19 nt, Homo sapiens
gauauuagccagggucaca

SEQ ID NO: 1493969 - RNA, 19 nt, Homo sapiens
gcuuacaucuaauucucaa

SEQ ID NO: 1493970 - RNA, 19 nt, Homo sapiens
cuaaugacccagucuacaa

SEQ ID NO: 1493971 - RNA, 19 nt, Homo sapiens
ucucaaaggugcuuaucca

SEQ ID NO: 1493972 - RNA, 19 nt, Homo sapiens
gaugauacaaguucagaag

SEQ ID NO: 1493973 - RNA, 19 nt, Homo sapiens
ggagcucgccaucagcaaa

SEQ ID NO: 1493974 - RNA, 19 nt, Homo sapiens
aagaugcgcuugcuguaca

SEQ ID NO: 1493975 - RNA, 19 nt, Homo sapiens
ucuuucaacuucaggauga

SEQ ID NO: 1493976 - RNA, 19 nt, Homo sapiens
aauaacagcggaacggaaa

SEQ ID NO: 1493977 - RNA, 19 nt, Homo sapiens
ccacuaccuugcuaagaag

SEQ ID NO: 1493978 - RNA, 19 nt, Homo sapiens
agaggaggaugauacaagu

SEQ ID NO: 1493979 - RNA, 19 nt, Homo sapiens
gccaggaauuagaaacuuc

SEQ ID NO: 1493980 - RNA, 19 nt, Homo sapiens
caagagcaaccgagaugga

SEQ ID NO: 1493981 - RNA, 19 nt, Homo sapiens
guuauucuuuggacacuag

SEQ ID NO: 1493982 - RNA, 19 nt, Homo sapiens
ccauguaagauguauaaga

SEQ ID NO: 1493983 - RNA, 19 nt, Homo sapiens
agaauugcagcuagacuuu

SEQ ID NO: 1493984 - RNA, 19 nt, Homo sapiens
acacacaguaggaucaauu

SEQ ID NO: 1493985 - RNA, 19 nt, Homo sapiens
uaaugacccagucuacaaa

SEQ ID NO: 1493986 - RNA, 19 nt, Homo sapiens
ccacaaccagccacaccua

SEQ ID NO: 1493987 - RNA, 19 nt, Homo sapiens
cucuaugugucuucuauuu

SEQ ID NO: 1493988 - RNA, 19 nt, Homo sapiens
gggaaaaccaccaauagaa

SEQ ID NO: 1493989 - RNA, 19 nt, Homo sapiens
caagaggcaaggcaugaga

SEQ ID NO: 1493990 - RNA, 19 nt, Homo sapiens
aaucuguaauggccaagaa

SEQ ID NO: 1493991 - RNA, 19 nt, Homo sapiens
gcaaaacucuaugguucuu

SEQ ID NO: 1493992 - RNA, 19 nt, Homo sapiens
cugguuaucugugcucuug

SEQ ID NO: 1493993 - RNA, 19 nt, Homo sapiens
gaagaugcgcuugcuguac

SEQ ID NO: 1493994 - RNA, 19 nt, Homo sapiens
ggagcucuaucgucgaaac

SEQ ID NO: 1493995 - RNA, 19 nt, Homo sapiens
gaggcugccauaucuuuga

SEQ ID NO: 1493996 - RNA, 19 nt, Homo sapiens
gagcuuggcugggaaaauc

SEQ ID NO: 1493997 - RNA, 19 nt, Homo sapiens
ggaaaaccaccaauagaau

SEQ ID NO: 1493998 - RNA, 19 nt, Homo sapiens
gguugugaauaucuugaga

SEQ ID NO: 1493999 - RNA, 19 nt, Homo sapiens
cuaugguucuuucaacuuc

SEQ ID NO: 1494000 - RNA, 19 nt, Homo sapiens
uaucugaagaggaggauga

SEQ ID NO: 1494001 - RNA, 19 nt, Homo sapiens
aacgagcacuucccucaug

SEQ ID NO: 1494002 - RNA, 19 nt, Homo sapiens
gcuuccagguaacaucuug

SEQ ID NO: 1494003 - RNA, 19 nt, Homo sapiens
aggcaaggcaugagacauu

SEQ ID NO: 1494004 - RNA, 19 nt, Homo sapiens
caucauacugguuaucugu

SEQ ID NO: 1494005 - RNA, 19 nt, Homo sapiens
aaagaacuaagcacuaauc

SEQ ID NO: 1494006 - RNA, 19 nt, Homo sapiens
gcagauacagcagccacaa

SEQ ID NO: 1494007 - RNA, 19 nt, Homo sapiens
gaagaggaggaugauacaa

SEQ ID NO: 1494008 - RNA, 19 nt, Homo sapiens
acaaaccaacagccaguaa

SEQ ID NO: 1494009 - RNA, 19 nt, Homo sapiens
gggaacaaccaaauaacag

SEQ ID NO: 1494010 - RNA, 19 nt, Homo sapiens
caguguuggugccagauau

SEQ ID NO: 1494011 - RNA, 19 nt, Homo sapiens
aggaucaauugcuaaucua

SEQ ID NO: 1494012 - RNA, 19 nt, Homo sapiens
aagagcugaaggcuaauua

SEQ ID NO: 1494013 - RNA, 19 nt, Homo sapiens
uagacaggccugagucaug

SEQ ID NO: 1494014 - RNA, 19 nt, Homo sapiens
uuccagacaucuaaacauc

SEQ ID NO: 1494015 - RNA, 19 nt, Homo sapiens
gaaaugcgcuguugauaag

SEQ ID NO: 1494016 - RNA, 19 nt, Homo sapiens
gauguugaaugaugcuuua

SEQ ID NO: 1494017 - RNA, 19 nt, Homo sapiens
gcacauggccuuugcagaa

SEQ ID NO: 1494018 - RNA, 19 nt, Homo sapiens
cagcagaguucuaaacaaa

SEQ ID NO: 1494019 - RNA, 19 nt, Homo sapiens
caaauguccuugagauuga

SEQ ID NO: 1494020 - RNA, 19 nt, Homo sapiens
ccagauauauuucagaguu

SEQ ID NO: 1494021 - RNA, 19 nt, Homo sapiens
caaaugugcucacgauguu

SEQ ID NO: 1494022 - RNA, 19 nt, Homo sapiens
uaagaaugcuguuucaaug

SEQ ID NO: 1494023 - RNA, 19 nt, Homo sapiens
gugaaagccuucuugguuu

SEQ ID NO: 1494024 - RNA, 19 nt, Homo sapiens
caacugacacugauacaaa

SEQ ID NO: 1494025 - RNA, 19 nt, Homo sapiens
gcaaauguccuugagauug

SEQ ID NO: 1494026 - RNA, 19 nt, Homo sapiens
gaaacucuacucuauaaga

SEQ ID NO: 1494027 - RNA, 19 nt, Homo sapiens
gcacuuugccugagaaaug

SEQ ID NO: 1494028 - RNA, 19 nt, Homo sapiens
ucaccuuccucacuucuua

SEQ ID NO: 1494029 - RNA, 19 nt, Homo sapiens
gagaagcacagagauauuu

SEQ ID NO: 1494030 - RNA, 19 nt, Homo sapiens
gcgcaucgcauuccuguuu

SEQ ID NO: 1494031 - RNA, 19 nt, Homo sapiens
gaaaagagagccuucaaaa

SEQ ID NO: 1494032 - RNA, 19 nt, Homo sapiens
agaaugcuguuucaaugua

SEQ ID NO: 1494033 - RNA, 19 nt, Homo sapiens
gagcugugcuuuggaauuc

SEQ ID NO: 1494034 - RNA, 19 nt, Homo sapiens
gaaugaugcuuuaacacau

SEQ ID NO: 1494035 - RNA, 19 nt, Homo sapiens
gaucaugcacuuacucuga

SEQ ID NO: 1494036 - RNA, 19 nt, Homo sapiens
gcucacacuuucugccuuu

SEQ ID NO: 1494037 - RNA, 19 nt, Homo sapiens
ugacauggguguuccacuu

SEQ ID NO: 1494038 - RNA, 19 nt, Homo sapiens
uaagaagggacaaguaauu

SEQ ID NO: 1494039 - RNA, 19 nt, Homo sapiens
gagaggagaaccugauuug

SEQ ID NO: 1494040 - RNA, 19 nt, Homo sapiens
ucagagcacuggugaagga

SEQ ID NO: 1494041 - RNA, 19 nt, Homo sapiens
caauaaagccaguggaaau

SEQ ID NO: 1494042 - RNA, 19 nt, Homo sapiens
gcacagagauauuuugauc

SEQ ID NO: 1494043 - RNA, 19 nt, Homo sapiens
gaagggacaaguaauuaau

SEQ ID NO: 1494044 - RNA, 19 nt, Homo sapiens
cauaagaagggacaaguaa

SEQ ID NO: 1494045 - RNA, 19 nt, Homo sapiens
ucaacucucuggaucacua

SEQ ID NO: 1494046 - RNA, 19 nt, Homo sapiens
gcagcagaguucuaaacaa

SEQ ID NO: 1494047 - RNA, 19 nt, Homo sapiens
gagaaaugcgcuguugaua

SEQ ID NO: 1494048 - RNA, 19 nt, Homo sapiens
guaagcagccugagucugu

SEQ ID NO: 1494049 - RNA, 19 nt, Homo sapiens
caacuucauucaucaugga

SEQ ID NO: 1494050 - RNA, 19 nt, Homo sapiens
uaacuuuguucacucauuc

SEQ ID NO: 1494051 - RNA, 19 nt, Homo sapiens
gcacuuacucugagaaaca

SEQ ID NO: 1494052 - RNA, 19 nt, Homo sapiens
gagcacuggugaaggagaa

SEQ ID NO: 1494053 - RNA, 19 nt, Homo sapiens
gaugagcacacaaauguug

SEQ ID NO: 1494054 - RNA, 19 nt, Homo sapiens
gaacagaguggacuuacag

SEQ ID NO: 1494055 - RNA, 19 nt, Homo sapiens
ucauaaagcauugcagaua

SEQ ID NO: 1494056 - RNA, 19 nt, Homo sapiens
cuggacagcuuucuuauag

SEQ ID NO: 1494057 - RNA, 19 nt, Homo sapiens
uaggcaaacucucagauga

SEQ ID NO: 1494058 - RNA, 19 nt, Homo sapiens
ggaacagaguggacuuaca

SEQ ID NO: 1494059 - RNA, 19 nt, Homo sapiens
gauuaaagaguaccuuaga

SEQ ID NO: 1494060 - RNA, 19 nt, Homo sapiens
agaaaugcgcuguugauaa

SEQ ID NO: 1494061 - RNA, 19 nt, Homo sapiens
aacguuagcuuuauagugu

SEQ ID NO: 1494062 - RNA, 19 nt, Homo sapiens
agucagcucugucugguuu

SEQ ID NO: 1494063 - RNA, 19 nt, Homo sapiens
ugaaagccuucuugguuug

SEQ ID NO: 1494064 - RNA, 19 nt, Homo sapiens
gaaugcuguuucaauguau

SEQ ID NO: 1494065 - RNA, 19 nt, Homo sapiens
cauaaagcauugcagauac

SEQ ID NO: 1494066 - RNA, 19 nt, Homo sapiens
gaguuaugaucgauugcua

SEQ ID NO: 1494067 - RNA, 19 nt, Homo sapiens
ucagaguuaugaucgauug

SEQ ID NO: 1494068 - RNA, 19 nt, Homo sapiens
gaaaacagcccgugaucuu

SEQ ID NO: 1494069 - RNA, 19 nt, Homo sapiens
ggagaagcacagagauauu

SEQ ID NO: 1494070 - RNA, 19 nt, Homo sapiens
ggacaaguaauuaauuugg

SEQ ID NO: 1494071 - RNA, 19 nt, Homo sapiens
uagaugagcacacaaaugu

SEQ ID NO: 1494072 - RNA, 19 nt, Homo sapiens
ccucacuucuuauugcuaa

SEQ ID NO: 1494073 - RNA, 19 nt, Homo sapiens
ggaucaacuucauucauca

SEQ ID NO: 1494074 - RNA, 19 nt, Homo sapiens
caauagaugagcacacaaa

SEQ ID NO: 1494075 - RNA, 19 nt, Homo sapiens
ggauaugucaccauguuga

SEQ ID NO: 1494076 - RNA, 19 nt, Homo sapiens
cuuacugccuucuuaauga

SEQ ID NO: 1494077 - RNA, 19 nt, Homo sapiens
cuguuugacuccacucuua

SEQ ID NO: 1494078 - RNA, 19 nt, Homo sapiens
gguuaagaaugcuguuuca

SEQ ID NO: 1494079 - RNA, 19 nt, Homo sapiens
gcaaggugauuauuuugaa

SEQ ID NO: 1494080 - RNA, 19 nt, Homo sapiens
guugaaugaugcuuuaaca

SEQ ID NO: 1494081 - RNA, 19 nt, Homo sapiens
ccucaaaugugcucacgau

SEQ ID NO: 1494082 - RNA, 19 nt, Homo sapiens
gaccagcuaucccagaagu

SEQ ID NO: 1494083 - RNA, 19 nt, Homo sapiens
cagauuaaagaguaccuua

SEQ ID NO: 1494084 - RNA, 19 nt, Homo sapiens
aagaagggacaaguaauua

SEQ ID NO: 1494085 - RNA, 19 nt, Homo sapiens
ccucuuacauuccaguaga

SEQ ID NO: 1494086 - RNA, 19 nt, Homo sapiens
cgaauuaaaccggaaaguu

SEQ ID NO: 1494087 - RNA, 19 nt, Homo sapiens
ggaguacagagucauuuga

SEQ ID NO: 1494088 - RNA, 19 nt, Homo sapiens
ugaaacagaacuacaagga

SEQ ID NO: 1494089 - RNA, 19 nt, Homo sapiens
ugugaaagccuucuugguu

SEQ ID NO: 1494090 - RNA, 19 nt, Homo sapiens
uuaucuggauguaccaaua

SEQ ID NO: 1494091 - RNA, 19 nt, Homo sapiens
guaccaauaucugaugaca

SEQ ID NO: 1494092 - RNA, 19 nt, Homo sapiens
acacgaagcgcaucgcauu

SEQ ID NO: 1494093 - RNA, 19 nt, Homo sapiens
guaaaugggaguacagagu

SEQ ID NO: 1494094 - RNA, 19 nt, Homo sapiens
uauuggauauucacacaga

SEQ ID NO: 1494095 - RNA, 19 nt, Homo sapiens
caguggaaauugccauaga

SEQ ID NO: 1494096 - RNA, 19 nt, Homo sapiens
ugaaugaugcuuuaacaca

SEQ ID NO: 1494097 - RNA, 19 nt, Homo sapiens
ugaaggagaagcacagaga

SEQ ID NO: 1494098 - RNA, 19 nt, Homo sapiens
ucucuggacagcuuucuua

SEQ ID NO: 1494099 - RNA, 19 nt, Homo sapiens
ugaaguaggcaaacucuca

SEQ ID NO: 1494100 - RNA, 19 nt, Homo sapiens
gcaucgcauuccuguuuga

SEQ ID NO: 1494101 - RNA, 19 nt, Homo sapiens
uaccuuagauccacagaag

SEQ ID NO: 1494102 - RNA, 19 nt, Homo sapiens
uggaucaacuucauucauc

SEQ ID NO: 1494103 - RNA, 19 nt, Homo sapiens
ggugcaggcuggcuauauc

SEQ ID NO: 1494104 - RNA, 19 nt, Homo sapiens
gagugcaaggugauuauuu

SEQ ID NO: 1494105 - RNA, 19 nt, Homo sapiens
ugacaguuguauagcaguu

SEQ ID NO: 1494106 - RNA, 19 nt, Homo sapiens
cacauggccuuugcagaaa

SEQ ID NO: 1494107 - RNA, 19 nt, Homo sapiens
gaaaacugccagauauauu

SEQ ID NO: 1494108 - RNA, 19 nt, Homo sapiens
gaaaagucaugcagucaca

SEQ ID NO: 1494109 - RNA, 19 nt, Homo sapiens
accaauaucugaugacagu

SEQ ID NO: 1494110 - RNA, 19 nt, Homo sapiens
gcuaaucuccauuugcaau

SEQ ID NO: 1494111 - RNA, 19 nt, Homo sapiens
gaguacagagucauuugaa

SEQ ID NO: 1494112 - RNA, 19 nt, Homo sapiens
gagagaggagaaccugauu

SEQ ID NO: 1494113 - RNA, 19 nt, Homo sapiens
ucaugauccuggaguaguu

SEQ ID NO: 1494114 - RNA, 19 nt, Homo sapiens
ccauaagaagggacaagua

SEQ ID NO: 1494115 - RNA, 19 nt, Homo sapiens
gaacuuuacugaugaggua

SEQ ID NO: 1494116 - RNA, 19 nt, Homo sapiens
ugaaugcccugcagucuua

SEQ ID NO: 1494117 - RNA, 19 nt, Homo sapiens
gguaucagaugaagaauug

SEQ ID NO: 1494118 - RNA, 19 nt, Homo sapiens
caagagaacuauguuggua

SEQ ID NO: 1494119 - RNA, 19 nt, Homo sapiens
ggaaauagugcuugucauu

SEQ ID NO: 1494120 - RNA, 19 nt, Homo sapiens
guacagaagcaaaguagua

SEQ ID NO: 1494121 - RNA, 19 nt, Homo sapiens
caacacauaucuuaucagu

SEQ ID NO: 1494122 - RNA, 19 nt, Homo sapiens
ccgcagagcugauggcauu

SEQ ID NO: 1494123 - RNA, 19 nt, Homo sapiens
agagaugccuuuaguugua

SEQ ID NO: 1494124 - RNA, 19 nt, Homo sapiens
ggauagaugucuuuguugu

SEQ ID NO: 1494125 - RNA, 19 nt, Homo sapiens
ugaagaacuuuacugauga

SEQ ID NO: 1494126 - RNA, 19 nt, Homo sapiens
guggauagaugucuuuguu

SEQ ID NO: 1494127 - RNA, 19 nt, Homo sapiens
ucacagauuugaggacuaa

SEQ ID NO: 1494128 - RNA, 19 nt, Homo sapiens
ggaaaagacugacugagaa

SEQ ID NO: 1494129 - RNA, 19 nt, Homo sapiens
gaaggcgucucccggaaga

SEQ ID NO: 1494130 - RNA, 19 nt, Homo sapiens
agaaggcacuguuguaguu

SEQ ID NO: 1494131 - RNA, 19 nt, Homo sapiens
uugcaaaccuuucugauga

SEQ ID NO: 1494132 - RNA, 19 nt, Homo sapiens
agaagcacaucaagacuuu

SEQ ID NO: 1494133 - RNA, 19 nt, Homo sapiens
ggacuaagaacuuucacuu

SEQ ID NO: 1494134 - RNA, 19 nt, Homo sapiens
gcagcgagauggaaauagu

SEQ ID NO: 1494135 - RNA, 19 nt, Homo sapiens
gaucagagacagagcagaa

SEQ ID NO: 1494136 - RNA, 19 nt, Homo sapiens
gauaauguguaauguggau

SEQ ID NO: 1494137 - RNA, 19 nt, Homo sapiens
gcaccaugaagauaaauuu

SEQ ID NO: 1494138 - RNA, 19 nt, Homo sapiens
acaccaaacuuccaacaga

SEQ ID NO: 1494139 - RNA, 19 nt, Homo sapiens
gaacaaggagacacacaau

SEQ ID NO: 1494140 - RNA, 19 nt, Homo sapiens
uugaagaacuuuacugaug

SEQ ID NO: 1494141 - RNA, 19 nt, Homo sapiens
agaaaucacucggguauca

SEQ ID NO: 1494142 - RNA, 19 nt, Homo sapiens
agacugagacuuugaagaa

SEQ ID NO: 1494143 - RNA, 19 nt, Homo sapiens
gagccgagccugaugcauu

SEQ ID NO: 1494144 - RNA, 19 nt, Homo sapiens
gcgacuuacucuaaucaaa

SEQ ID NO: 1494145 - RNA, 19 nt, Homo sapiens
ggauguugaugguacagaa

SEQ ID NO: 1494146 - RNA, 19 nt, Homo sapiens
agagagagaugccuuuagu

SEQ ID NO: 1494147 - RNA, 19 nt, Homo sapiens
uguagaggcuucagagaga

SEQ ID NO: 1494148 - RNA, 19 nt, Homo sapiens
gcaccaaccagacaccaaa

SEQ ID NO: 1494149 - RNA, 19 nt, Homo sapiens
ucaacuaccucaagcucaa

SEQ ID NO: 1494150 - RNA, 19 nt, Homo sapiens
gcaaaccuuucugaugaga

SEQ ID NO: 1494151 - RNA, 19 nt, Homo sapiens
caccaaacuuccaacagaa

SEQ ID NO: 1494152 - RNA, 19 nt, Homo sapiens
gaagaacuuuacugaugag

SEQ ID NO: 1494153 - RNA, 19 nt, Homo sapiens
gagaagcacaucaagacuu

SEQ ID NO: 1494154 - RNA, 19 nt, Homo sapiens
gaacggcaccaaccagaca

SEQ ID NO: 1494155 - RNA, 19 nt, Homo sapiens
ucacucggguaucagauga

SEQ ID NO: 1494156 - RNA, 19 nt, Homo sapiens
ggaacaaggagacacacaa

SEQ ID NO: 1494157 - RNA, 19 nt, Homo sapiens
uauagaaggcacuguugua

SEQ ID NO: 1494158 - RNA, 19 nt, Homo sapiens
ucaagcgacuuacucuaau

SEQ ID NO: 1494159 - RNA, 19 nt, Homo sapiens
gaacaucuucauaccaaag

SEQ ID NO: 1494160 - RNA, 19 nt, Homo sapiens
guacagacuuccagcucau

SEQ ID NO: 1494161 - RNA, 19 nt, Homo sapiens
gacuaagaacuuucacuuu

SEQ ID NO: 1494162 - RNA, 19 nt, Homo sapiens
uuacuaugcuuccuucaca

SEQ ID NO: 1494163 - RNA, 19 nt, Homo sapiens
gcacuugggaaacuaacuu

SEQ ID NO: 1494164 - RNA, 19 nt, Homo sapiens
agagagaugccuuuaguug

SEQ ID NO: 1494165 - RNA, 19 nt, Homo sapiens
ggacaaaagugcucuugca

SEQ ID NO: 1494166 - RNA, 19 nt, Homo sapiens
cagagcuggugauuguuaa

SEQ ID NO: 1494167 - RNA, 19 nt, Homo sapiens
gaagaugcagcgagaugga

SEQ ID NO: 1494168 - RNA, 19 nt, Homo sapiens
ggaggcagcagcuaagcaa

SEQ ID NO: 1494169 - RNA, 19 nt, Homo sapiens
gagagaugccuuuaguugu

SEQ ID NO: 1494170 - RNA, 19 nt, Homo sapiens
aaagcugcaucuuggauug

SEQ ID NO: 1494171 - RNA, 19 nt, Homo sapiens
aaucugagcuuuuggacua

SEQ ID NO: 1494172 - RNA, 19 nt, Homo sapiens
cugaugagacugagacuuu

SEQ ID NO: 1494173 - RNA, 19 nt, Homo sapiens
gcacuguuguaguuggaau

SEQ ID NO: 1494174 - RNA, 19 nt, Homo sapiens
aagacgagcagcagacaua

SEQ ID NO: 1494175 - RNA, 19 nt, Homo sapiens
gaacuccgcagagcugaug

SEQ ID NO: 1494176 - RNA, 19 nt, Homo sapiens
ggaaacuaacuuaagacuu

SEQ ID NO: 1494177 - RNA, 19 nt, Homo sapiens
gcagcuaagcaacacauau

SEQ ID NO: 1494178 - RNA, 19 nt, Homo sapiens
uugggaaacuaacuuaaga

SEQ ID NO: 1494179 - RNA, 19 nt, Homo sapiens
uguguaauguggauagaug

SEQ ID NO: 1494180 - RNA, 19 nt, Homo sapiens
caagcgacuuacucuaauc

SEQ ID NO: 1494181 - RNA, 19 nt, Homo sapiens
ugagaaaagucauaucaga

SEQ ID NO: 1494182 - RNA, 19 nt, Homo sapiens
uguuguaguuggaauaguu

SEQ ID NO: 1494183 - RNA, 19 nt, Homo sapiens
ccauuucucaagcgacuua

SEQ ID NO: 1494184 - RNA, 19 nt, Homo sapiens
agacagagcagaagaugca

SEQ ID NO: 1494185 - RNA, 19 nt, Homo sapiens
ucagagagagaugccuuua

SEQ ID NO: 1494186 - RNA, 19 nt, Homo sapiens
caaccagacaccaaacuuc

SEQ ID NO: 1494187 - RNA, 19 nt, Homo sapiens
gacacacaaucugagcuuu

SEQ ID NO: 1494188 - RNA, 19 nt, Homo sapiens
caaaagugcucuugcaaac

SEQ ID NO: 1494189 - RNA, 19 nt, Homo sapiens
acagaaaucacucggguau

SEQ ID NO: 1494190 - RNA, 19 nt, Homo sapiens
cugaugagguacagacuuc

SEQ ID NO: 1494191 - RNA, 19 nt, Homo sapiens
auagaugucuuuguugugu

SEQ ID NO: 1494192 - RNA, 19 nt, Homo sapiens
gaugagacugagacuuuga

SEQ ID NO: 1494193 - RNA, 19 nt, Homo sapiens
gagcugauggcauugagau

SEQ ID NO: 1494194 - RNA, 19 nt, Homo sapiens
gaaaagacugacugagaaa

SEQ ID NO: 1494195 - RNA, 19 nt, Homo sapiens
ucagaugaccccagaauaa

SEQ ID NO: 1494196 - RNA, 19 nt, Homo sapiens
uuacuggagucauuucuac

SEQ ID NO: 1494197 - RNA, 19 nt, Homo sapiens
gagagagaugccuuuaguu

SEQ ID NO: 1494198 - RNA, 19 nt, Homo sapiens
uaauguggauagaugucuu

SEQ ID NO: 1494199 - RNA, 19 nt, Homo sapiens
gcagagcugauggcauuga

SEQ ID NO: 1494200 - RNA, 19 nt, Homo sapiens
cagcuaagcaacacauauc

SEQ ID NO: 1494201 - RNA, 19 nt, Homo sapiens
uaugcuuccuucacagauu

SEQ ID NO: 1494202 - RNA, 19 nt, Homo sapiens
cucaagcgacuuacucuaa

SEQ ID NO: 1494203 - RNA, 19 nt, Homo sapiens
cagaagaugcagcgagaug

SEQ ID NO: 1494204 - RNA, 19 nt, Homo sapiens
uaucagugucccuauugua

SEQ ID NO: 1494205 - RNA, 19 nt, Homo sapiens
gaugaacuuuugaacagaa

SEQ ID NO: 1494206 - RNA, 19 nt, Homo sapiens
guuguaguuggaauaguua

SEQ ID NO: 1494207 - RNA, 19 nt, Homo sapiens
uagaugucuuuguugugua

SEQ ID NO: 1494208 - RNA, 19 nt, Homo sapiens
gcuggugauuguuaaugau

SEQ ID NO: 1494209 - RNA, 19 nt, Homo sapiens
ugaugagacugagacuuug

SEQ ID NO: 1494210 - RNA, 19 nt, Homo sapiens
aaagugcucuugcaaaccu

SEQ ID NO: 1494211 - RNA, 19 nt, Homo sapiens
gugcuugucauuuaccauu

SEQ ID NO: 1494212 - RNA, 19 nt, Homo sapiens
gagaugccuuuaguuguac

SEQ ID NO: 1494213 - RNA, 19 nt, Homo sapiens
caagagagaauagaugaac

SEQ ID NO: 1494214 - RNA, 19 nt, Homo sapiens
cagugucccuauuguaaca

SEQ ID NO: 1494215 - RNA, 19 nt, Homo sapiens
gaacaaagugcuuaaagaa

SEQ ID NO: 1494216 - RNA, 19 nt, Homo sapiens
ggaacaaagugcuuaaaga

SEQ ID NO: 1494217 - RNA, 19 nt, Homo sapiens
gaagauugccuggauauuu

SEQ ID NO: 1494218 - RNA, 19 nt, Homo sapiens
uaaagaagaugugcugauu

SEQ ID NO: 1494219 - RNA, 19 nt, Homo sapiens
aaacaucccucacauugaa

SEQ ID NO: 1494220 - RNA, 19 nt, Homo sapiens
gcagaagcaucacagugua

SEQ ID NO: 1494221 - RNA, 19 nt, Homo sapiens
uagacaggcuucugaauuu

SEQ ID NO: 1494222 - RNA, 19 nt, Homo sapiens
acaaggaacuggaagauug

SEQ ID NO: 1494223 - RNA, 19 nt, Homo sapiens
gaugaagcaugcccucuuu

SEQ ID NO: 1494224 - RNA, 19 nt, Homo sapiens
agacuuggcuucacacaaa

SEQ ID NO: 1494225 - RNA, 19 nt, Homo sapiens
ugacaacuauaaccaagua

SEQ ID NO: 1494226 - RNA, 19 nt, Homo sapiens
cgacugaacuuaaggaaca

SEQ ID NO: 1494227 - RNA, 19 nt, Homo sapiens
ggugguaucugcuuuauag

SEQ ID NO: 1494228 - RNA, 19 nt, Homo sapiens
gcaguuugauuccagcuaa

SEQ ID NO: 1494229 - RNA, 19 nt, Homo sapiens
ggaggcauuugguuuauug

SEQ ID NO: 1494230 - RNA, 19 nt, Homo sapiens
caucuagucucuacugaaa

SEQ ID NO: 1494231 - RNA, 19 nt, Homo sapiens
gauugcagccuuacuauuu

SEQ ID NO: 1494232 - RNA, 19 nt, Homo sapiens
acaaagugcuuaaagaaga

SEQ ID NO: 1494233 - RNA, 19 nt, Homo sapiens
acaaacugcugucuguaua

SEQ ID NO: 1494234 - RNA, 19 nt, Homo sapiens
gcaagucgcagaaucagaa

SEQ ID NO: 1494235 - RNA, 19 nt, Homo sapiens
ggauauugaucaacagaug

SEQ ID NO: 1494236 - RNA, 19 nt, Homo sapiens
gaaugacccauggcuauua

SEQ ID NO: 1494237 - RNA, 19 nt, Homo sapiens
gcagugcuuugcuagcuaa

SEQ ID NO: 1494238 - RNA, 19 nt, Homo sapiens
gagaugaaucagugaauaa

SEQ ID NO: 1494239 - RNA, 19 nt, Homo sapiens
gaacaaagccauuaauccu

SEQ ID NO: 1494240 - RNA, 19 nt, Homo sapiens
ucagauggauugcaguuug

SEQ ID NO: 1494241 - RNA, 19 nt, Homo sapiens
ggaauuccaaccuguguaa

SEQ ID NO: 1494242 - RNA, 19 nt, Homo sapiens
gaaacaucccucacauuga

SEQ ID NO: 1494243 - RNA, 19 nt, Homo sapiens
ugaaacaucccucacauug

SEQ ID NO: 1494244 - RNA, 19 nt, Homo sapiens
caacugaccguaacaagga

SEQ ID NO: 1494245 - RNA, 19 nt, Homo sapiens
guuauggucuugaucuuug

SEQ ID NO: 1494246 - RNA, 19 nt, Homo sapiens
gggaggauauugaucaaca

SEQ ID NO: 1494247 - RNA, 19 nt, Homo sapiens
ugaaauaauugccacaaag

SEQ ID NO: 1494248 - RNA, 19 nt, Homo sapiens
aaggagaaaugcacagaaa

SEQ ID NO: 1494249 - RNA, 19 nt, Homo sapiens
ggcauuugguuuauugauu

SEQ ID NO: 1494250 - RNA, 19 nt, Homo sapiens
agagaugaaucagugaaua

SEQ ID NO: 1494251 - RNA, 19 nt, Homo sapiens
uagaguacuuggugauaaa

SEQ ID NO: 1494252 - RNA, 19 nt, Homo sapiens
ucuagucucuacugaaauu

SEQ ID NO: 1494253 - RNA, 19 nt, Homo sapiens
ucaaggauauucuaacaac

SEQ ID NO: 1494254 - RNA, 19 nt, Homo sapiens
caaagugcuuaaagaagau

SEQ ID NO: 1494255 - RNA, 19 nt, Homo sapiens
ucuaacaaccagccauuua

SEQ ID NO: 1494256 - RNA, 19 nt, Homo sapiens
ggugauaaacaaauaguug

SEQ ID NO: 1494257 - RNA, 19 nt, Homo sapiens
gaaauaauugccacaaagg

SEQ ID NO: 1494258 - RNA, 19 nt, Homo sapiens
caauaucuuugcaucacaa

SEQ ID NO: 1494259 - RNA, 19 nt, Homo sapiens
cagauggauugcaguuuga

SEQ ID NO: 1494260 - RNA, 19 nt, Homo sapiens
ggacuuacaauuugcucaa

SEQ ID NO: 1494261 - RNA, 19 nt, Homo sapiens
uuagaguacuuggugauaa

SEQ ID NO: 1494262 - RNA, 19 nt, Homo sapiens
aaucaacacucuaauuggu

SEQ ID NO: 1494263 - RNA, 19 nt, Homo sapiens
aaacugcugucuguauaga

SEQ ID NO: 1494264 - RNA, 19 nt, Homo sapiens
gcaugugccuggugcuaca

SEQ ID NO: 1494265 - RNA, 19 nt, Homo sapiens
aagcaugcccucuuucaaa

SEQ ID NO: 1494266 - RNA, 19 nt, Homo sapiens
gaagcaugcccucuuucaa

SEQ ID NO: 1494267 - RNA, 19 nt, Homo sapiens
gugaguuuccacuugauua

SEQ ID NO: 1494268 - RNA, 19 nt, Homo sapiens
ucaggugucuccucuccuu

SEQ ID NO: 1494269 - RNA, 19 nt, Homo sapiens
ggaauuagugacaacuuca

SEQ ID NO: 1494270 - RNA, 19 nt, Homo sapiens
gaagcaaauagcauaacuu

SEQ ID NO: 1494271 - RNA, 19 nt, Homo sapiens
ggauuucaguauauaagag

SEQ ID NO: 1494272 - RNA, 19 nt, Homo sapiens
guacaucccaggaaagaag

SEQ ID NO: 1494273 - RNA, 19 nt, Homo sapiens
ugauugccaugacaacuau

SEQ ID NO: 1494274 - RNA, 19 nt, Homo sapiens
gauauugaucaacagauga

SEQ ID NO: 1494275 - RNA, 19 nt, Homo sapiens
aagugauacucuacucaua

SEQ ID NO: 1494276 - RNA, 19 nt, Homo sapiens
gcucaagcucuguuuguug

SEQ ID NO: 1494277 - RNA, 19 nt, Homo sapiens
ggaauugugauugccauga

SEQ ID NO: 1494278 - RNA, 19 nt, Homo sapiens
uaaucuaugugcaucuuca

SEQ ID NO: 1494279 - RNA, 19 nt, Homo sapiens
cugcaacgauaagaaauga

SEQ ID NO: 1494280 - RNA, 19 nt, Homo sapiens
caguguacaucccaggaaa

SEQ ID NO: 1494281 - RNA, 19 nt, Homo sapiens
guacuuggugauaaacaaa

SEQ ID NO: 1494282 - RNA, 19 nt, Homo sapiens
gugauugccaugacaacua

SEQ ID NO: 1494283 - RNA, 19 nt, Homo sapiens
aagaagaugugcugauugc

SEQ ID NO: 1494284 - RNA, 19 nt, Homo sapiens
gaauugugauugccaugac

SEQ ID NO: 1494285 - RNA, 19 nt, Homo sapiens
gauuccagcuaaccuugug

SEQ ID NO: 1494286 - RNA, 19 nt, Homo sapiens
agauaaacuugaacagcuu

SEQ ID NO: 1494287 - RNA, 19 nt, Homo sapiens
gaugcaaggaauugugauu

SEQ ID NO: 1494288 - RNA, 19 nt, Homo sapiens
gaaucugcaacgauaagaa

SEQ ID NO: 1494289 - RNA, 19 nt, Homo sapiens
gaguuuccacuugauuaua

SEQ ID NO: 1494290 - RNA, 19 nt, Homo sapiens
caaagccauuaauccugaa

SEQ ID NO: 1494291 - RNA, 19 nt, Homo sapiens
uguggaggcauuugguuua

SEQ ID NO: 1494292 - RNA, 19 nt, Homo sapiens
uaauuggucagauggauug

SEQ ID NO: 1494293 - RNA, 19 nt, Homo sapiens
ggcagugcuuugcuagcua

SEQ ID NO: 1494294 - RNA, 19 nt, Homo sapiens
cccacucuauccaggaaua

SEQ ID NO: 1494295 - RNA, 19 nt, Homo sapiens
aagauugccuggauauuuu

SEQ ID NO: 1494296 - RNA, 19 nt, Homo sapiens
guaacaaggaacuggaaga

SEQ ID NO: 1494297 - RNA, 19 nt, Homo sapiens
caagcucuguuuguugaug

SEQ ID NO: 1494298 - RNA, 19 nt, Homo sapiens
gcacgacugaacuuaagga

SEQ ID NO: 1494299 - RNA, 19 nt, Homo sapiens
ggucagauggauugcaguu

SEQ ID NO: 1494300 - RNA, 19 nt, Homo sapiens
gaaaugcacagaaaaucaa

SEQ ID NO: 1494301 - RNA, 19 nt, Homo sapiens
guggauucaucuucaagga

SEQ ID NO: 1494302 - RNA, 19 nt, Homo sapiens
auagacaggcuucugaauu

SEQ ID NO: 1494303 - RNA, 19 nt, Homo sapiens
ggaagauugccuggauauu

SEQ ID NO: 1494304 - RNA, 19 nt, Homo sapiens
uaacaaggaacuggaagau

SEQ ID NO: 1494305 - RNA, 19 nt, Homo sapiens
ugucuccucuccuuaacuu

SEQ ID NO: 1494306 - RNA, 19 nt, Homo sapiens
acccauggcuauuaucuag

SEQ ID NO: 1494307 - RNA, 19 nt, Homo sapiens
aagaaugacccauggcuau

SEQ ID NO: 1494308 - RNA, 19 nt, Homo sapiens
guggaggcauuugguuuau

SEQ ID NO: 1494309 - RNA, 19 nt, Homo sapiens
ccaauaucuuugcaucaca

SEQ ID NO: 1494310 - RNA, 19 nt, Homo sapiens
gucagcaucugcauuaaaa

SEQ ID NO: 1494311 - RNA, 19 nt, Homo sapiens
caaggagaaaugcacagaa

SEQ ID NO: 1494312 - RNA, 19 nt, Homo sapiens
gaggauauugaucaacaga

SEQ ID NO: 1494313 - RNA, 19 nt, Homo sapiens
uaggagacuuggcuucaca

SEQ ID NO: 1494314 - RNA, 19 nt, Homo sapiens
uaagagaugaaucagugaa

SEQ ID NO: 1494315 - RNA, 19 nt, Homo sapiens
gaaagaagacccucuauuu

SEQ ID NO: 1494316 - RNA, 19 nt, Homo sapiens
gaggacaccugcagaaaua

SEQ ID NO: 1494317 - RNA, 19 nt, Homo sapiens
ggaaagagauuauucaacu

SEQ ID NO: 1494318 - RNA, 19 nt, Homo sapiens
ccaguaauuuccauucuua

SEQ ID NO: 1494319 - RNA, 19 nt, Homo sapiens
aaacaagccuccaaacuga

SEQ ID NO: 1494320 - RNA, 19 nt, Homo sapiens
guauugcccuugucaguua

SEQ ID NO: 1494321 - RNA, 19 nt, Homo sapiens
gcuaauacacccugaauuu

SEQ ID NO: 1494322 - RNA, 19 nt, Homo sapiens
gaaccaaauucaacaagug

SEQ ID NO: 1494323 - RNA, 19 nt, Homo sapiens
gcccgaaccugccagaaua

SEQ ID NO: 1494324 - RNA, 19 nt, Homo sapiens
gaagacacauggacgugaa

SEQ ID NO: 1494325 - RNA, 19 nt, Homo sapiens
gacaaagacuugagagaug

SEQ ID NO: 1494326 - RNA, 19 nt, Homo sapiens
uuaaagauguggagaaaga

SEQ ID NO: 1494327 - RNA, 19 nt, Homo sapiens
ucaaacaacuguaucacaa

SEQ ID NO: 1494328 - RNA, 19 nt, Homo sapiens
caucaucucuuucucaaug

SEQ ID NO: 1494329 - RNA, 19 nt, Homo sapiens
agagaaagcucgccuggaa

SEQ ID NO: 1494330 - RNA, 19 nt, Homo sapiens
ggaccagucucucuucuuc

SEQ ID NO: 1494331 - RNA, 19 nt, Homo sapiens
cuaagagcauguucucaua

SEQ ID NO: 1494332 - RNA, 19 nt, Homo sapiens
acaaagcccugagacaaua

SEQ ID NO: 1494333 - RNA, 19 nt, Homo sapiens
gaaauacauucccaaagca

SEQ ID NO: 1494334 - RNA, 19 nt, Homo sapiens
gaggguaaauauucaauca

SEQ ID NO: 1494335 - RNA, 19 nt, Homo sapiens
ggcaauacuuagaaccuua

SEQ ID NO: 1494336 - RNA, 19 nt, Homo sapiens
acaauaguaucuccaguaa

SEQ ID NO: 1494337 - RNA, 19 nt, Homo sapiens
gaacucuuccuccuuauga

SEQ ID NO: 1494338 - RNA, 19 nt, Homo sapiens
ugggagaguuaauuuguua

SEQ ID NO: 1494339 - RNA, 19 nt, Homo sapiens
uuaagugcauuuccaagua

SEQ ID NO: 1494340 - RNA, 19 nt, Homo sapiens
gauucucccuccuuucaua

SEQ ID NO: 1494341 - RNA, 19 nt, Homo sapiens
uaagugcauuuccaaguaa

SEQ ID NO: 1494342 - RNA, 19 nt, Homo sapiens
guaauaccauuucuagcuu

SEQ ID NO: 1494343 - RNA, 19 nt, Homo sapiens
gaaagagauuauucaacug

SEQ ID NO: 1494344 - RNA, 19 nt, Homo sapiens
gacuagaaaugcaggauga

SEQ ID NO: 1494345 - RNA, 19 nt, Homo sapiens
ggguaaauauucaaucaug

SEQ ID NO: 1494346 - RNA, 19 nt, Homo sapiens
ugacauggguauuuauuag

SEQ ID NO: 1494347 - RNA, 19 nt, Homo sapiens
ggagaaagaccaugguugu

SEQ ID NO: 1494348 - RNA, 19 nt, Homo sapiens
ggaagcacaugcacaacug

SEQ ID NO: 1494349 - RNA, 19 nt, Homo sapiens
ggaugaacaccaccacaua

SEQ ID NO: 1494350 - RNA, 19 nt, Homo sapiens
gaaauaauucuaccaaugc

SEQ ID NO: 1494351 - RNA, 19 nt, Homo sapiens
gaaauggaguccccaacua

SEQ ID NO: 1494352 - RNA, 19 nt, Homo sapiens
gcagaaauacauucccaaa

SEQ ID NO: 1494353 - RNA, 19 nt, Homo sapiens
guacaaagcccugagacaa

SEQ ID NO: 1494354 - RNA, 19 nt, Homo sapiens
gaaaaugacuauacucaca

SEQ ID NO: 1494355 - RNA, 19 nt, Homo sapiens
guuacuacaugaacauuga

SEQ ID NO: 1494356 - RNA, 19 nt, Homo sapiens
guagugaccugauuuuaaa

SEQ ID NO: 1494357 - RNA, 19 nt, Homo sapiens
gacaauaguaucuccagua

SEQ ID NO: 1494358 - RNA, 19 nt, Homo sapiens
ggacaaagacuugagagau

SEQ ID NO: 1494359 - RNA, 19 nt, Homo sapiens
ggucugagcagccaaaguu

SEQ ID NO: 1494360 - RNA, 19 nt, Homo sapiens
caaacaagccuccaaacug

SEQ ID NO: 1494361 - RNA, 19 nt, Homo sapiens
cauuaaagauguggagaaa

SEQ ID NO: 1494362 - RNA, 19 nt, Homo sapiens
ccucgaaucuggagagaga

SEQ ID NO: 1494363 - RNA, 19 nt, Homo sapiens
cucaauggaucuaauguuu

SEQ ID NO: 1494364 - RNA, 19 nt, Homo sapiens
ugucaaguuucauguagua

SEQ ID NO: 1494365 - RNA, 19 nt, Homo sapiens
aaagaagacccucuauuug

SEQ ID NO: 1494366 - RNA, 19 nt, Homo sapiens
uaagagaagacuagaaaug

SEQ ID NO: 1494367 - RNA, 19 nt, Homo sapiens
gcugagaggguaaauauuc

SEQ ID NO: 1494368 - RNA, 19 nt, Homo sapiens
aaacagccuucaccagcua

SEQ ID NO: 1494369 - RNA, 19 nt, Homo sapiens
guagagaacaauaacagaa

SEQ ID NO: 1494370 - RNA, 19 nt, Homo sapiens
uaccuagucuccuuagaaa

SEQ ID NO: 1494371 - RNA, 19 nt, Homo sapiens
uggccaagaugacccauuu

SEQ ID NO: 1494372 - RNA, 19 nt, Homo sapiens
aaagugcuaucaaaccauu

SEQ ID NO: 1494373 - RNA, 19 nt, Homo sapiens
caucaagccauuucuuaaa

SEQ ID NO: 1494374 - RNA, 19 nt, Homo sapiens
gaugaucccggcauuaaga

SEQ ID NO: 1494375 - RNA, 19 nt, Homo sapiens
ccaagcggaugccuuuaga

SEQ ID NO: 1494376 - RNA, 19 nt, Homo sapiens
ccaagaccagugcauauuu

SEQ ID NO: 1494377 - RNA, 19 nt, Homo sapiens
gagcaugacccauauggau

SEQ ID NO: 1494378 - RNA, 19 nt, Homo sapiens
ggacgugaaauacgauuau

SEQ ID NO: 1494379 - RNA, 19 nt, Homo sapiens
cauagggccugaaugugaa

SEQ ID NO: 1494380 - RNA, 19 nt, Homo sapiens
agaaauacauucccaaagc

SEQ ID NO: 1494381 - RNA, 19 nt, Homo sapiens
gcagaugaucccggcauua

SEQ ID NO: 1494382 - RNA, 19 nt, Homo sapiens
auucacagcuuucuagaga

SEQ ID NO: 1494383 - RNA, 19 nt, Homo sapiens
ucaguuauuuccucuguuc

SEQ ID NO: 1494384 - RNA, 19 nt, Homo sapiens
gagaacaauaacagaagua

SEQ ID NO: 1494385 - RNA, 19 nt, Homo sapiens
acaugucagugauuaauga

SEQ ID NO: 1494386 - RNA, 19 nt, Homo sapiens
cagaugaucccggcauuaa

SEQ ID NO: 1494387 - RNA, 19 nt, Homo sapiens
cuacaugaacauugaauug

SEQ ID NO: 1494388 - RNA, 19 nt, Homo sapiens
caacaguaauaccauuucu

SEQ ID NO: 1494389 - RNA, 19 nt, Homo sapiens
gaaaagugcuaucaaacca

SEQ ID NO: 1494390 - RNA, 19 nt, Homo sapiens
ucucauaggucuggguauu

SEQ ID NO: 1494391 - RNA, 19 nt, Homo sapiens
gaauuuggaggaacucuuc

SEQ ID NO: 1494392 - RNA, 19 nt, Homo sapiens
guacauucaugcccucuac

SEQ ID NO: 1494393 - RNA, 19 nt, Homo sapiens
cagcuuuccugcccgcuuu

SEQ ID NO: 1494394 - RNA, 19 nt, Homo sapiens
gauccggagcuucagauaa

SEQ ID NO: 1494395 - RNA, 19 nt, Homo sapiens
ucaccaagcggaugccuuu

SEQ ID NO: 1494396 - RNA, 19 nt, Homo sapiens
ugaauuguauugcccuugu

SEQ ID NO: 1494397 - RNA, 19 nt, Homo sapiens
acacuuugcaacaguaaua

SEQ ID NO: 1494398 - RNA, 19 nt, Homo sapiens
aagaagacccucuauuugu

SEQ ID NO: 1494399 - RNA, 19 nt, Homo sapiens
ucauaggucuggguauuug

SEQ ID NO: 1494400 - RNA, 19 nt, Homo sapiens
acucacacauccuauaaug

SEQ ID NO: 1494401 - RNA, 19 nt, Homo sapiens
cauaugagaaccaaauuca

SEQ ID NO: 1494402 - RNA, 19 nt, Homo sapiens
uaaauuugauggacacacu

SEQ ID NO: 1494403 - RNA, 19 nt, Homo sapiens
aagcauacguccucgaauc

SEQ ID NO: 1494404 - RNA, 19 nt, Homo sapiens
ugaaagaagacccucuauu

SEQ ID NO: 1494405 - RNA, 19 nt, Homo sapiens
guccagagacuauagagaa

SEQ ID NO: 1494406 - RNA, 19 nt, Homo sapiens
aaugacgacuuauaguuug

SEQ ID NO: 1494407 - RNA, 19 nt, Homo sapiens
agaagacccucuauuuguc

SEQ ID NO: 1494408 - RNA, 19 nt, Homo sapiens
gacaacacuuugcaacagu

SEQ ID NO: 1494409 - RNA, 19 nt, Homo sapiens
auccggagcuucagauaaa

SEQ ID NO: 1494410 - RNA, 19 nt, Homo sapiens
caccaggccugacauugga

SEQ ID NO: 1494411 - RNA, 19 nt, Homo sapiens
agacauagauagguaagag

SEQ ID NO: 1494412 - RNA, 19 nt, Homo sapiens
caagaccagugcauauuuu

SEQ ID NO: 1494413 - RNA, 19 nt, Homo sapiens
gagaagggagagaaugaga

SEQ ID NO: 1494414 - RNA, 19 nt, Homo sapiens
caagaugacccauuuacag

SEQ ID NO: 1494415 - RNA, 19 nt, Homo sapiens
ggacaggcauccuagcuaa

SEQ ID NO: 1494416 - RNA, 19 nt, Homo sapiens
gcaccugggucuaggcuuu

SEQ ID NO: 1494417 - RNA, 19 nt, Homo sapiens
ggugagggcuggucuuaga

SEQ ID NO: 1494418 - RNA, 19 nt, Homo sapiens
ggccagagcugagcaccua

SEQ ID NO: 1494419 - RNA, 19 nt, Homo sapiens
gaaaggaagggcugggaaa

SEQ ID NO: 1494420 - RNA, 19 nt, Homo sapiens
ggacagaggacuaaaauga

SEQ ID NO: 1494421 - RNA, 19 nt, Homo sapiens
gaacgaggacgacgaguac

SEQ ID NO: 1494422 - RNA, 19 nt, Homo sapiens
gggcuggucuuagauagga

SEQ ID NO: 1494423 - RNA, 19 nt, Homo sapiens
gaaucacggcccuuccuuu

SEQ ID NO: 1494424 - RNA, 19 nt, Homo sapiens
ggacuucccaguggagaaa

SEQ ID NO: 1494425 - RNA, 19 nt, Homo sapiens
ccacugugauccagcuguu

SEQ ID NO: 1494426 - RNA, 19 nt, Homo sapiens
cauccucacuggcuuucaa

SEQ ID NO: 1494427 - RNA, 19 nt, Homo sapiens
ggacgacgaguacaacaag

SEQ ID NO: 1494428 - RNA, 19 nt, Homo sapiens
caaguggacagaggacuaa

SEQ ID NO: 1494429 - RNA, 19 nt, Homo sapiens
ucagaaguccagagucuug

SEQ ID NO: 1494430 - RNA, 19 nt, Homo sapiens
ggucuuagauaggaaugca

SEQ ID NO: 1494431 - RNA, 19 nt, Homo sapiens
uaacccaggcugcaggaaa

SEQ ID NO: 1494432 - RNA, 19 nt, Homo sapiens
cagaagggaccaagcacuu

SEQ ID NO: 1494433 - RNA, 19 nt, Homo sapiens
gagggcuggucuuagauag

SEQ ID NO: 1494434 - RNA, 19 nt, Homo sapiens
ggccuccuuucuccgauuu

SEQ ID NO: 1494435 - RNA, 19 nt, Homo sapiens
gggacaggcauccuagcua

SEQ ID NO: 1494436 - RNA, 19 nt, Homo sapiens
ccaaguggcggaagaagag

SEQ ID NO: 1494437 - RNA, 19 nt, Homo sapiens
agaacgaggacgacgagua

SEQ ID NO: 1494438 - RNA, 19 nt, Homo sapiens
ggaccaaguggcggaagaa

SEQ ID NO: 1494439 - RNA, 19 nt, Homo sapiens
ugagggcuggucuuagaua

SEQ ID NO: 1494440 - RNA, 19 nt, Homo sapiens
agucagaaguccagagucu

SEQ ID NO: 1494441 - RNA, 19 nt, Homo sapiens
ggagucagaaguccagagu

SEQ ID NO: 1494442 - RNA, 19 nt, Homo sapiens
ucccugagcugcggaaauc

SEQ ID NO: 1494443 - RNA, 19 nt, Homo sapiens
gcacuugcccauccucacu

SEQ ID NO: 1494444 - RNA, 19 nt, Homo sapiens
gcacuccugagaccuggaa

SEQ ID NO: 1494445 - RNA, 19 nt, Homo sapiens
ggcccuuccuuuccucaga

SEQ ID NO: 1494446 - RNA, 19 nt, Homo sapiens
acaaguggacagaggacua

SEQ ID NO: 1494447 - RNA, 19 nt, Homo sapiens
ggccaacagggugguauuu

SEQ ID NO: 1494448 - RNA, 19 nt, Homo sapiens
aacccaggcugcaggaaau

SEQ ID NO: 1494449 - RNA, 19 nt, Homo sapiens
ugccaguucugcagauuca

SEQ ID NO: 1494450 - RNA, 19 nt, Homo sapiens
gaacggcaccccuccaaca

SEQ ID NO: 1494451 - RNA, 19 nt, Homo sapiens
cgggugagggcuggucuua

SEQ ID NO: 1494452 - RNA, 19 nt, Homo sapiens
aaucacggcccuuccuuuc

SEQ ID NO: 1494453 - RNA, 19 nt, Homo sapiens
gcccuuccuuuccucagau

SEQ ID NO: 1494454 - RNA, 19 nt, Homo sapiens
ucacggcccuuccuuuccu

SEQ ID NO: 1494455 - RNA, 19 nt, Homo sapiens
cagaaccgcaggaccaagu

SEQ ID NO: 1494456 - RNA, 19 nt, Homo sapiens
aggcacagcacuccugaga

SEQ ID NO: 1494457 - RNA, 19 nt, Homo sapiens
gaacacagguccuuuauuu

SEQ ID NO: 1494458 - RNA, 19 nt, Homo sapiens
gaaaucagacucuccauug

SEQ ID NO: 1494459 - RNA, 19 nt, Homo sapiens
caagucauguucaauguuu

SEQ ID NO: 1494460 - RNA, 19 nt, Homo sapiens
gaaacuaugcuuaucauug

SEQ ID NO: 1494461 - RNA, 19 nt, Homo sapiens
caacuggaguccucucauu

SEQ ID NO: 1494462 - RNA, 19 nt, Homo sapiens
gaaacacuaggcugacuua

SEQ ID NO: 1494463 - RNA, 19 nt, Homo sapiens
auacaugucuguuugcuaa

SEQ ID NO: 1494464 - RNA, 19 nt, Homo sapiens
gaagugaaaggaucaaaug

SEQ ID NO: 1494465 - RNA, 19 nt, Homo sapiens
ggaagaacauggaaacacu

SEQ ID NO: 1494466 - RNA, 19 nt, Homo sapiens
ggacuuacaccagugauuu

SEQ ID NO: 1494467 - RNA, 19 nt, Homo sapiens
guauggaguuuaagacaga

SEQ ID NO: 1494468 - RNA, 19 nt, Homo sapiens
guuccugccuuuauaacua

SEQ ID NO: 1494469 - RNA, 19 nt, Homo sapiens
aaacuaugcuuaucauugg

SEQ ID NO: 1494470 - RNA, 19 nt, Homo sapiens
uaacucaguccgauuauug

SEQ ID NO: 1494471 - RNA, 19 nt, Homo sapiens
gagagaacacgacaagcua

SEQ ID NO: 1494472 - RNA, 19 nt, Homo sapiens
cauguucaauguuuccuaa

SEQ ID NO: 1494473 - RNA, 19 nt, Homo sapiens
ggaaaucagacucuccauu

SEQ ID NO: 1494474 - RNA, 19 nt, Homo sapiens
gcuugcagauggccuauug

SEQ ID NO: 1494475 - RNA, 19 nt, Homo sapiens
acacagaggaugcuggaua

SEQ ID NO: 1494476 - RNA, 19 nt, Homo sapiens
gaagaacauggaaacacua

SEQ ID NO: 1494477 - RNA, 19 nt, Homo sapiens
gaaauguugacaccaguga

SEQ ID NO: 1494478 - RNA, 19 nt, Homo sapiens
cuauguuccugccuuuaua

SEQ ID NO: 1494479 - RNA, 19 nt, Homo sapiens
gcugucggcuucccuacuu

SEQ ID NO: 1494480 - RNA, 19 nt, Homo sapiens
guaacucaguccgauuauu

SEQ ID NO: 1494481 - RNA, 19 nt, Homo sapiens
uaucauuggcugucaguaa

SEQ ID NO: 1494482 - RNA, 19 nt, Homo sapiens
gaaaggaucaaaugcucau

SEQ ID NO: 1494483 - RNA, 19 nt, Homo sapiens
cuuaaagccugaagcugaa

SEQ ID NO: 1494484 - RNA, 19 nt, Homo sapiens
ggacuccgauggaaaucag

SEQ ID NO: 1494485 - RNA, 19 nt, Homo sapiens
cauuggcugucaguaaaua

SEQ ID NO: 1494486 - RNA, 19 nt, Homo sapiens
ggaacacagguccuuuauu

SEQ ID NO: 1494487 - RNA, 19 nt, Homo sapiens
ggagagaacacgacaagcu

SEQ ID NO: 1494488 - RNA, 19 nt, Homo sapiens
gacgcugccugcccucaaa

SEQ ID NO: 1494489 - RNA, 19 nt, Homo sapiens
gauuauuggugacggaagu

SEQ ID NO: 1494490 - RNA, 19 nt, Homo sapiens
ggacugcgggcacaccuau

SEQ ID NO: 1494491 - RNA, 19 nt, Homo sapiens
agaggaugcuggauacugu

SEQ ID NO: 1494492 - RNA, 19 nt, Homo sapiens
ccacacuggucuacacaca

SEQ ID NO: 1494493 - RNA, 19 nt, Homo sapiens
gaucaucucgcccgugcuu

SEQ ID NO: 1494494 - RNA, 19 nt, Homo sapiens
ucucaggccuucagcaaca

SEQ ID NO: 1494495 - RNA, 19 nt, Homo sapiens
uaccaccauuugcaucuaa

SEQ ID NO: 1494496 - RNA, 19 nt, Homo sapiens
ggaguggccugugccucaa

SEQ ID NO: 1494497 - RNA, 19 nt, Homo sapiens
gaaccuugcagucuauuuu

SEQ ID NO: 1494498 - RNA, 19 nt, Homo sapiens
cgcuaagaaugcuuuguuu

SEQ ID NO: 1494499 - RNA, 19 nt, Homo sapiens
gaguagaccaguguucuug

SEQ ID NO: 1494500 - RNA, 19 nt, Homo sapiens
guccuugacuccucacugu

SEQ ID NO: 1494501 - RNA, 19 nt, Homo sapiens
guagaccaguguucuuguc

SEQ ID NO: 1494502 - RNA, 19 nt, Homo sapiens
acacuggucuacacacaca

SEQ ID NO: 1494503 - RNA, 19 nt, Homo sapiens
gcacacucuacacauauau

SEQ ID NO: 1494504 - RNA, 19 nt, Homo sapiens
gaauacaugucuguuugcu

SEQ ID NO: 1494505 - RNA, 19 nt, Homo sapiens
ucucccagccuacaucuuu

SEQ ID NO: 1494506 - RNA, 19 nt, Homo sapiens
ggaaacacuaggcugacuu

SEQ ID NO: 1494507 - RNA, 19 nt, Homo sapiens
ugcacacucuacacauaua

SEQ ID NO: 1494508 - RNA, 19 nt, Homo sapiens
gcuaagaaugcuuuguuuc

SEQ ID NO: 1494509 - RNA, 19 nt, Homo sapiens
caagcuacgucuccacacu

SEQ ID NO: 1494510 - RNA, 19 nt, Homo sapiens
gccugaagcugaauaaaau

SEQ ID NO: 1494511 - RNA, 19 nt, Homo sapiens
ugacaccagugaaugaaac

SEQ ID NO: 1494512 - RNA, 19 nt, Homo sapiens
ucugugagccuucguuguu

SEQ ID NO: 1494513 - RNA, 19 nt, Homo sapiens
auaacuaccucugcauuca

SEQ ID NO: 1494514 - RNA, 19 nt, Homo sapiens
uaaagccugaagcugaaua

SEQ ID NO: 1494515 - RNA, 19 nt, Homo sapiens
uuaaggggaucuauguuuu

SEQ ID NO: 1494516 - RNA, 19 nt, Homo sapiens
gcaagcaauugguaauccu

SEQ ID NO: 1494517 - RNA, 19 nt, Homo sapiens
ggccuggacuccgauggaa

SEQ ID NO: 1494518 - RNA, 19 nt, Homo sapiens
cacagaggaugcuggauac

SEQ ID NO: 1494519 - RNA, 19 nt, Homo sapiens
caaugggaguucuuuuaaa

SEQ ID NO: 1494520 - RNA, 19 nt, Homo sapiens
caccuauguuccugccuuu

SEQ ID NO: 1494521 - RNA, 19 nt, Homo sapiens
gcucucaggccuucagcaa

SEQ ID NO: 1494522 - RNA, 19 nt, Homo sapiens
gcacucuauuucugugucu

SEQ ID NO: 1494523 - RNA, 19 nt, Homo sapiens
agacucuguuuguggcuuu

SEQ ID NO: 1494524 - RNA, 19 nt, Homo sapiens
aucauuggcugucaguaaa

SEQ ID NO: 1494525 - RNA, 19 nt, Homo sapiens
ccucugcauucaacaagga

SEQ ID NO: 1494526 - RNA, 19 nt, Homo sapiens
gcccgugagacacagaaua

SEQ ID NO: 1494527 - RNA, 19 nt, Homo sapiens
gaggaugcuggauacugua

SEQ ID NO: 1494528 - RNA, 19 nt, Homo sapiens
aaacaucagacugcaaguu

SEQ ID NO: 1494529 - RNA, 19 nt, Homo sapiens
gguaugcacacucuacaca

SEQ ID NO: 1494530 - RNA, 19 nt, Homo sapiens
gugagacacagaauacaug

SEQ ID NO: 1494531 - RNA, 19 nt, Homo sapiens
ucucaagucauguucaaug

SEQ ID NO: 1494532 - RNA, 19 nt, Homo sapiens
uaacuaccucugcauucaa

SEQ ID NO: 1494533 - RNA, 19 nt, Homo sapiens
ugccugcccucaaacauca

SEQ ID NO: 1494534 - RNA, 19 nt, Homo sapiens
cuaccaccauuugcaucua

SEQ ID NO: 1494535 - RNA, 19 nt, Homo sapiens
cuguaacucaguccgauua

SEQ ID NO: 1494536 - RNA, 19 nt, Homo sapiens
ucgcuaagaaugcuuuguu

SEQ ID NO: 1494537 - RNA, 19 nt, Homo sapiens
aaaucagacucuccauugg

SEQ ID NO: 1494538 - RNA, 19 nt, Homo sapiens
ugacuagauggaugcagua

SEQ ID NO: 1494539 - RNA, 19 nt, Homo sapiens
gagcuggcugccuggagua

SEQ ID NO: 1494540 - RNA, 19 nt, Homo sapiens
cuuccuggcucuucagcuu

SEQ ID NO: 1494541 - RNA, 19 nt, Homo sapiens
gcaguggaagaacauggaa

SEQ ID NO: 1494542 - RNA, 19 nt, Homo sapiens
gaccagugcaagccuacaa

SEQ ID NO: 1494543 - RNA, 19 nt, Homo sapiens
uucuagugcugcuggguua

SEQ ID NO: 1494544 - RNA, 19 nt, Homo sapiens
gugucugucuuuaauucuu

SEQ ID NO: 1494545 - RNA, 19 nt, Homo sapiens
ccacucugcacucuauuuc

SEQ ID NO: 1494546 - RNA, 19 nt, Homo sapiens
ugaaaauucuaccaccauu

SEQ ID NO: 1494547 - RNA, 19 nt, Homo sapiens
acucugcacucuauuucug

SEQ ID NO: 1494548 - RNA, 19 nt, Homo sapiens
gauugucagccuccagcua

SEQ ID NO: 1494549 - RNA, 19 nt, Homo sapiens
uauguuccugccuuuauaa

SEQ ID NO: 1494550 - RNA, 19 nt, Homo sapiens
gacuuacaccagugauuug

SEQ ID NO: 1494551 - RNA, 19 nt, Homo sapiens
gucuuuaauucuucuagug

SEQ ID NO: 1494552 - RNA, 19 nt, Homo sapiens
ucaaugggaguucuuuuaa

SEQ ID NO: 1494553 - RNA, 19 nt, Homo sapiens
uauaacuaccucugcauuc

SEQ ID NO: 1494554 - RNA, 19 nt, Homo sapiens
ccuauguuccugccuuuau

SEQ ID NO: 1494555 - RNA, 19 nt, Homo sapiens
caucagacugcaaguucuu

SEQ ID NO: 1494556 - RNA, 19 nt, Homo sapiens
gccugugccucaacaacau

SEQ ID NO: 1494557 - RNA, 19 nt, Homo sapiens
aaacugcucuuccauauuu

SEQ ID NO: 1494558 - RNA, 19 nt, Homo sapiens
caaaguccauggguuauua

SEQ ID NO: 1494559 - RNA, 19 nt, Homo sapiens
gcacauguauauauaguug

SEQ ID NO: 1494560 - RNA, 19 nt, Homo sapiens
gaaauuaugucccuguugu

SEQ ID NO: 1494561 - RNA, 19 nt, Homo sapiens
ccaauugccucuacauuug

SEQ ID NO: 1494562 - RNA, 19 nt, Homo sapiens
ggccaacgcuugacacaaa

SEQ ID NO: 1494563 - RNA, 19 nt, Homo sapiens
caucaaguguuccauuaaa

SEQ ID NO: 1494564 - RNA, 19 nt, Homo sapiens
gaauucuacuggccuauug

SEQ ID NO: 1494565 - RNA, 19 nt, Homo sapiens
cacaucaaguguuccauua

SEQ ID NO: 1494566 - RNA, 19 nt, Homo sapiens
acacaaaguccauggguua

SEQ ID NO: 1494567 - RNA, 19 nt, Homo sapiens
gaauuguaguccaccuuaa

SEQ ID NO: 1494568 - RNA, 19 nt, Homo sapiens
cuuaaaagcuguucucaua

SEQ ID NO: 1494569 - RNA, 19 nt, Homo sapiens
ugaacaaguuauccaauug

SEQ ID NO: 1494570 - RNA, 19 nt, Homo sapiens
gcucagugaucuugaacaa

SEQ ID NO: 1494571 - RNA, 19 nt, Homo sapiens
acaaacugcucuuccauau

SEQ ID NO: 1494572 - RNA, 19 nt, Homo sapiens
gagaaauuaugucccuguu

SEQ ID NO: 1494573 - RNA, 19 nt, Homo sapiens
uaaccugucugcagauauc

SEQ ID NO: 1494574 - RNA, 19 nt, Homo sapiens
agggagugcuuguuugaua

SEQ ID NO: 1494575 - RNA, 19 nt, Homo sapiens
guccauggguuauuauuca

SEQ ID NO: 1494576 - RNA, 19 nt, Homo sapiens
agccggagcuccugaauug

SEQ ID NO: 1494577 - RNA, 19 nt, Homo sapiens
uaagacuucuggucauuuc

SEQ ID NO: 1494578 - RNA, 19 nt, Homo sapiens
gcaccucacuucucagacu

SEQ ID NO: 1494579 - RNA, 19 nt, Homo sapiens
gggagugcuuguuugauau

SEQ ID NO: 1494580 - RNA, 19 nt, Homo sapiens
aaacugugaucucgucuag

SEQ ID NO: 1494581 - RNA, 19 nt, Homo sapiens
gacagggagugcuuguuug

SEQ ID NO: 1494582 - RNA, 19 nt, Homo sapiens
gcuaacugucgucuacuua

SEQ ID NO: 1494583 - RNA, 19 nt, Homo sapiens
ccaguucuauaauuugguu

SEQ ID NO: 1494584 - RNA, 19 nt, Homo sapiens
uuauugaguugcuuucuug

SEQ ID NO: 1494585 - RNA, 19 nt, Homo sapiens
ggaagggagucucuaaaau

SEQ ID NO: 1494586 - RNA, 19 nt, Homo sapiens
ugaauuguaguccaccuua

SEQ ID NO: 1494587 - RNA, 19 nt, Homo sapiens
agacagggagugcuuguuu

SEQ ID NO: 1494588 - RNA, 19 nt, Homo sapiens
gcaguuugcucagugaucu

SEQ ID NO: 1494589 - RNA, 19 nt, Homo sapiens
guuaaaagcugauuauguc

SEQ ID NO: 1494590 - RNA, 19 nt, Homo sapiens
gggucucuauaaucaauaa

SEQ ID NO: 1494591 - RNA, 19 nt, Homo sapiens
ucuggucauuuccaacuua

SEQ ID NO: 1494592 - RNA, 19 nt, Homo sapiens
gaggaaaacuuugaacaau

SEQ ID NO: 1494593 - RNA, 19 nt, Homo sapiens
cugauuauguccuacaaug

SEQ ID NO: 1494594 - RNA, 19 nt, Homo sapiens
gaggaagggagucucuaaa

SEQ ID NO: 1494595 - RNA, 19 nt, Homo sapiens
ucagcuaacugucgucuac

SEQ ID NO: 1494596 - RNA, 19 nt, Homo sapiens
aauaaccugucugcagaua

SEQ ID NO: 1494597 - RNA, 19 nt, Homo sapiens
ccacaucaaguguuccauu

SEQ ID NO: 1494598 - RNA, 19 nt, Homo sapiens
ggucauuuccaacuuauag

SEQ ID NO: 1494599 - RNA, 19 nt, Homo sapiens
uaacugucgucuacuuaag

SEQ ID NO: 1494600 - RNA, 19 nt, Homo sapiens
gugcuuguuugauauuuca

SEQ ID NO: 1494601 - RNA, 19 nt, Homo sapiens
gaacaaguuauccaauugc

SEQ ID NO: 1494602 - RNA, 19 nt, Homo sapiens
ggagugcuuguuugauauu

SEQ ID NO: 1494603 - RNA, 19 nt, Homo sapiens
caaacugcucuuccauauu

SEQ ID NO: 1494604 - RNA, 19 nt, Homo sapiens
uccaauugccucuacauuu

SEQ ID NO: 1494605 - RNA, 19 nt, Homo sapiens
ccggagcuccugaauugua

SEQ ID NO: 1494606 - RNA, 19 nt, Homo sapiens
cauggguuauuauucaaga

SEQ ID NO: 1494607 - RNA, 19 nt, Homo sapiens
cuacuggccuauuguaaaa

SEQ ID NO: 1494608 - RNA, 19 nt, Homo sapiens
uacaaacugcucuuccaua

SEQ ID NO: 1494609 - RNA, 19 nt, Homo sapiens
ucuugggucucuauaauca

SEQ ID NO: 1494610 - RNA, 19 nt, Homo sapiens
gauuauguccuacaauguc

SEQ ID NO: 1494611 - RNA, 19 nt, Homo sapiens
gagugcuuguuugauauuu

SEQ ID NO: 1494612 - RNA, 19 nt, Homo sapiens
gaagggagucucuaaaauc

SEQ ID NO: 1494613 - RNA, 19 nt, Homo sapiens
cuuaagacuucuggucauu

SEQ ID NO: 1494614 - RNA, 19 nt, Homo sapiens
uaaaagcuguucucauaag

SEQ ID NO: 1494615 - RNA, 19 nt, Homo sapiens
uuucuugggucucuauaau

SEQ ID NO: 1494616 - RNA, 19 nt, Homo sapiens
caguuucucuagcugcaaa

SEQ ID NO: 1494617 - RNA, 19 nt, Homo sapiens
caaaauggggauaauacua

SEQ ID NO: 1494618 - RNA, 19 nt, Homo sapiens
cuaacugucgucuacuuaa

SEQ ID NO: 1494619 - RNA, 19 nt, Homo sapiens
caaugucaaagucagcuaa

SEQ ID NO: 1494620 - RNA, 19 nt, Homo sapiens
gacaagacagggagugcuu

SEQ ID NO: 1494621 - RNA, 19 nt, Homo sapiens
cauucugagugcaaacaaa

SEQ ID NO: 1494622 - RNA, 19 nt, Homo sapiens
ccucacuucucagacuuaa

SEQ ID NO: 1494623 - RNA, 19 nt, Homo sapiens
aaagagagaccuguauugg

SEQ ID NO: 1494624 - RNA, 19 nt, Homo sapiens
cccuuuaccaguucuauaa

SEQ ID NO: 1494625 - RNA, 19 nt, Homo sapiens
ucuacuggccuauuguaaa

SEQ ID NO: 1494626 - RNA, 19 nt, Homo sapiens
acugugaucucgucuagag

SEQ ID NO: 1494627 - RNA, 19 nt, Homo sapiens
guccuacaaugucaaaguc

SEQ ID NO: 1494628 - RNA, 19 nt, Homo sapiens
agagaccuguauuggagaa

SEQ ID NO: 1494629 - RNA, 19 nt, Homo sapiens
gggauaauacuauauaccu

SEQ ID NO: 1494630 - RNA, 19 nt, Homo sapiens
aaaagaagauaaggcauuc

SEQ ID NO: 1494631 - RNA, 19 nt, Homo sapiens
guuauccaauugccucuac

SEQ ID NO: 1494632 - RNA, 19 nt, Homo sapiens
uaccaguucuauaauuugg

SEQ ID NO: 1494633 - RNA, 19 nt, Homo sapiens
uaaaagagagaccuguauu

SEQ ID NO: 1494634 - RNA, 19 nt, Homo sapiens
acagggagugcuuguuuga

SEQ ID NO: 1494635 - RNA, 19 nt, Homo sapiens
ucacuucucagacuuaaaa

SEQ ID NO: 1494636 - RNA, 19 nt, Homo sapiens
cuacacaccagcagucagu

SEQ ID NO: 1494637 - RNA, 19 nt, Homo sapiens
gucaaagucagcuaacugu

SEQ ID NO: 1494638 - RNA, 19 nt, Homo sapiens
ccucuacauuugcaucagu

SEQ ID NO: 1494639 - RNA, 19 nt, Homo sapiens
aagagagaccuguauugga

SEQ ID NO: 1494640 - RNA, 19 nt, Homo sapiens
aaauuaugucccuguugua

SEQ ID NO: 1494641 - RNA, 19 nt, Homo sapiens
gacuuaaaauuccacauca

SEQ ID NO: 1494642 - RNA, 19 nt, Homo sapiens
aaaagcugauuauguccua

SEQ ID NO: 1494643 - RNA, 19 nt, Homo sapiens
aauuguaguccaccuuaaa

SEQ ID NO: 1494644 - RNA, 19 nt, Homo sapiens
cggagcuccugaauuguag

SEQ ID NO: 1494645 - RNA, 19 nt, Homo sapiens
ccauugaagugcuuaaaag

SEQ ID NO: 1494646 - RNA, 19 nt, Homo sapiens
acaucaaguguuccauuaa

SEQ ID NO: 1494647 - RNA, 19 nt, Homo sapiens
caccucacuucucagacuu

SEQ ID NO: 1494648 - RNA, 19 nt, Homo sapiens
ucucuaaaaucucuucuuc

SEQ ID NO: 1494649 - RNA, 19 nt, Homo sapiens
uaacaugucugaggacuaa

SEQ ID NO: 1494650 - RNA, 19 nt, Homo sapiens
ggcagucgcugaaaguuua

SEQ ID NO: 1494651 - RNA, 19 nt, Homo sapiens
cgaaaucucuguucucaug

SEQ ID NO: 1494652 - RNA, 19 nt, Homo sapiens
caaguuggccucauauuaa

SEQ ID NO: 1494653 - RNA, 19 nt, Homo sapiens
ggacuuugcugccugcauu

SEQ ID NO: 1494654 - RNA, 19 nt, Homo sapiens
gaacacgccuuucacugau

SEQ ID NO: 1494655 - RNA, 19 nt, Homo sapiens
gacuaaggcugguauucua

SEQ ID NO: 1494656 - RNA, 19 nt, Homo sapiens
ggucgacgcugccuggaaa

SEQ ID NO: 1494657 - RNA, 19 nt, Homo sapiens
uagagggucugcacaugua

SEQ ID NO: 1494658 - RNA, 19 nt, Homo sapiens
gagaggcuauuguguguca

SEQ ID NO: 1494659 - RNA, 19 nt, Homo sapiens
acaaguuggccucauauua

SEQ ID NO: 1494660 - RNA, 19 nt, Homo sapiens
gcauaagaaccucaagaaa

SEQ ID NO: 1494661 - RNA, 19 nt, Homo sapiens
cagagaggcuauugugugu

SEQ ID NO: 1494662 - RNA, 19 nt, Homo sapiens
ggcaacaccugcaucuuuc

SEQ ID NO: 1494663 - RNA, 19 nt, Homo sapiens
gggucugugucuauauaua

SEQ ID NO: 1494664 - RNA, 19 nt, Homo sapiens
guuccgagcugcacuuugg

SEQ ID NO: 1494665 - RNA, 19 nt, Homo sapiens
ccgggucugugucuauaua

SEQ ID NO: 1494666 - RNA, 19 nt, Homo sapiens
aauauaagccuguguucuu

SEQ ID NO: 1494667 - RNA, 19 nt, Homo sapiens
ggacuaaggcugguauucu

SEQ ID NO: 1494668 - RNA, 19 nt, Homo sapiens
agccaacacuuucagguuu

SEQ ID NO: 1494669 - RNA, 19 nt, Homo sapiens
gugugugcaugcauacaua

SEQ ID NO: 1494670 - RNA, 19 nt, Homo sapiens
ggagagagaaacucacaca

SEQ ID NO: 1494671 - RNA, 19 nt, Homo sapiens
ggcauaagaaccucaagaa

SEQ ID NO: 1494672 - RNA, 19 nt, Homo sapiens
guaugugccuggcuaugug

SEQ ID NO: 1494673 - RNA, 19 nt, Homo sapiens
gaaacucacacaaccaucu

SEQ ID NO: 1494674 - RNA, 19 nt, Homo sapiens
agaacacgccuuucacuga

SEQ ID NO: 1494675 - RNA, 19 nt, Homo sapiens
gcuagagggucugcacaug

SEQ ID NO: 1494676 - RNA, 19 nt, Homo sapiens
cauaagaaccucaagaaaa

SEQ ID NO: 1494677 - RNA, 19 nt, Homo sapiens
auauaagccuguguucuuu

SEQ ID NO: 1494678 - RNA, 19 nt, Homo sapiens
caagaaaagcaaaggaaua

SEQ ID NO: 1494679 - RNA, 19 nt, Homo sapiens
ggucugugucuauauauau

SEQ ID NO: 1494680 - RNA, 19 nt, Homo sapiens
uaaggcugguauucuagaa

SEQ ID NO: 1494681 - RNA, 19 nt, Homo sapiens
aggcaacaccugcaucuuu

SEQ ID NO: 1494682 - RNA, 19 nt, Homo sapiens
gcaugguggacauuaguuu

SEQ ID NO: 1494683 - RNA, 19 nt, Homo sapiens
gagaaacucacacaaccau

SEQ ID NO: 1494684 - RNA, 19 nt, Homo sapiens
auuacaaguuggccucaua

SEQ ID NO: 1494685 - RNA, 19 nt, Homo sapiens
ggaggugcgugaccacaac

SEQ ID NO: 1494686 - RNA, 19 nt, Homo sapiens
ccaccgaaaucucuguucu

SEQ ID NO: 1494687 - RNA, 19 nt, Homo sapiens
gccaacacuuucagguuuc

SEQ ID NO: 1494688 - RNA, 19 nt, Homo sapiens
ggaauauaagccuguguuc

SEQ ID NO: 1494689 - RNA, 19 nt, Homo sapiens
gugcagcucuggguaugug

SEQ ID NO: 1494690 - RNA, 19 nt, Homo sapiens
guuaggaacagacggauca

SEQ ID NO: 1494691 - RNA, 19 nt, Homo sapiens
gaauauaagccuguguucu

SEQ ID NO: 1494692 - RNA, 19 nt, Homo sapiens
gccuuucacugauuguguu

SEQ ID NO: 1494693 - RNA, 19 nt, Homo sapiens
ggccucauauuaacauguc

SEQ ID NO: 1494694 - RNA, 19 nt, Homo sapiens
gacgcugccuggaaaugga

SEQ ID NO: 1494695 - RNA, 19 nt, Homo sapiens
cagagacccuccuggaacu

SEQ ID NO: 1494696 - RNA, 19 nt, Homo sapiens
ugugucacuugcuggguua

SEQ ID NO: 1494697 - RNA, 19 nt, Homo sapiens
ccacacagagaggcuauug

SEQ ID NO: 1494698 - RNA, 19 nt, Homo sapiens
guuucuuucuucccuguuu

SEQ ID NO: 1494699 - RNA, 19 nt, Homo sapiens
caaugggguugguuucuuu

SEQ ID NO: 1494700 - RNA, 19 nt, Homo sapiens
acacgccuuucacugauug

SEQ ID NO: 1494701 - RNA, 19 nt, Homo sapiens
aaaucucccucccucucua

SEQ ID NO: 1494702 - RNA, 19 nt, Homo sapiens
gagagagaaacucacacaa

SEQ ID NO: 1494703 - RNA, 19 nt, Homo sapiens
ucagguuucugccauaaaa

SEQ ID NO: 1494704 - RNA, 19 nt, Homo sapiens
auaagaaccucaagaaaag

SEQ ID NO: 1494705 - RNA, 19 nt, Homo sapiens
cagccaacacuuucagguu

SEQ ID NO: 1494706 - RNA, 19 nt, Homo sapiens
gcgcugucuucuccaggaa

SEQ ID NO: 1494707 - RNA, 19 nt, Homo sapiens
gucauggucugugcacgaa

SEQ ID NO: 1494708 - RNA, 19 nt, Homo sapiens
gagucucucugcaugugau

SEQ ID NO: 1494709 - RNA, 19 nt, Homo sapiens
guacuugugggcauaugug

SEQ ID NO: 1494710 - RNA, 19 nt, Homo sapiens
cugcaucuuuccggcauaa

SEQ ID NO: 1494711 - RNA, 19 nt, Homo sapiens
gggcugccuugcuccuugu

SEQ ID NO: 1494712 - RNA, 19 nt, Homo sapiens
uuucagguuucugccauaa

SEQ ID NO: 1494713 - RNA, 19 nt, Homo sapiens
accgaaaucucuguucuca

SEQ ID NO: 1494714 - RNA, 19 nt, Homo sapiens
gucugugucuauauauaug

SEQ ID NO: 1494715 - RNA, 19 nt, Homo sapiens
gcagucgcugaaaguuuaa

SEQ ID NO: 1494716 - RNA, 19 nt, Homo sapiens
agacggaucagggcuucua

SEQ ID NO: 1494717 - RNA, 19 nt, Homo sapiens
ucucauggcagucgcugaa

SEQ ID NO: 1494718 - RNA, 19 nt, Homo sapiens
ccugcuccuucuccacuuu

SEQ ID NO: 1494719 - RNA, 19 nt, Homo sapiens
ccccaaagccccucaacua

SEQ ID NO: 1494720 - RNA, 19 nt, Homo sapiens
caugguggacauuaguuug

SEQ ID NO: 1494721 - RNA, 19 nt, Homo sapiens
uggcagucgcugaaaguuu

SEQ ID NO: 1494722 - RNA, 19 nt, Homo sapiens
aggcugguauucuagaaca

SEQ ID NO: 1494723 - RNA, 19 nt, Homo sapiens
ucuccaacccucacacaug

SEQ ID NO: 1494724 - RNA, 19 nt, Homo sapiens
guaggugugugugcaugca

SEQ ID NO: 1494725 - RNA, 19 nt, Homo sapiens
cuagagggucugcacaugu

SEQ ID NO: 1494726 - RNA, 19 nt, Homo sapiens
agagagaaacucacacaac

SEQ ID NO: 1494727 - RNA, 19 nt, Homo sapiens
gaugaugcagggccacaca

SEQ ID NO: 1494728 - RNA, 19 nt, Homo sapiens
guucaaaccugcacuauuu

SEQ ID NO: 1494729 - RNA, 19 nt, Homo sapiens
ggaauuggauggugaguug

SEQ ID NO: 1494730 - RNA, 19 nt, Homo sapiens
gcucuaaccugugcuauau

SEQ ID NO: 1494731 - RNA, 19 nt, Homo sapiens
caaccaaagcgaaguauuu

SEQ ID NO: 1494732 - RNA, 19 nt, Homo sapiens
aaacgcaacucuaauuuca

SEQ ID NO: 1494733 - RNA, 19 nt, Homo sapiens
gagcaagucuccgucuaaa

SEQ ID NO: 1494734 - RNA, 19 nt, Homo sapiens
ggaaggagccguuuaugag

SEQ ID NO: 1494735 - RNA, 19 nt, Homo sapiens
gaaaacaucguguaaaaug

SEQ ID NO: 1494736 - RNA, 19 nt, Homo sapiens
cagaaaacaucguguaaaa

SEQ ID NO: 1494737 - RNA, 19 nt, Homo sapiens
ccacucggcauuaugguua

SEQ ID NO: 1494738 - RNA, 19 nt, Homo sapiens
gaaggagccguuuaugaga

SEQ ID NO: 1494739 - RNA, 19 nt, Homo sapiens
guaaggcuagguguuauua

SEQ ID NO: 1494740 - RNA, 19 nt, Homo sapiens
cgucuuaccuguugaucuu

SEQ ID NO: 1494741 - RNA, 19 nt, Homo sapiens
caaaggaaggagccguuua

SEQ ID NO: 1494742 - RNA, 19 nt, Homo sapiens
gauagccacuagccacaug

SEQ ID NO: 1494743 - RNA, 19 nt, Homo sapiens
gcucagacuugccucaaag

SEQ ID NO: 1494744 - RNA, 19 nt, Homo sapiens
gccucaaacucaagauaaa

SEQ ID NO: 1494745 - RNA, 19 nt, Homo sapiens
gcccacugcuggaugugua

SEQ ID NO: 1494746 - RNA, 19 nt, Homo sapiens
cgagcacucuccauauaau

SEQ ID NO: 1494747 - RNA, 19 nt, Homo sapiens
ucuaaccugugcuauauau

SEQ ID NO: 1494748 - RNA, 19 nt, Homo sapiens
ucaaacgcaacucuaauuu

SEQ ID NO: 1494749 - RNA, 19 nt, Homo sapiens
ggaguucuguaaaucucaa

SEQ ID NO: 1494750 - RNA, 19 nt, Homo sapiens
acacuggaauuuaaagaca

SEQ ID NO: 1494751 - RNA, 19 nt, Homo sapiens
aaacaaccaaagcgaagua

SEQ ID NO: 1494752 - RNA, 19 nt, Homo sapiens
uuaccaacuugcucuuaaa

SEQ ID NO: 1494753 - RNA, 19 nt, Homo sapiens
cucgagcacucuccauaua

SEQ ID NO: 1494754 - RNA, 19 nt, Homo sapiens
cguguaaaaugucuuguua

SEQ ID NO: 1494755 - RNA, 19 nt, Homo sapiens
aggcggagcuugcagugaa

SEQ ID NO: 1494756 - RNA, 19 nt, Homo sapiens
ggccauuucuuuugguuua

SEQ ID NO: 1494757 - RNA, 19 nt, Homo sapiens
gaaaccccgucucuacuaa

SEQ ID NO: 1494758 - RNA, 19 nt, Homo sapiens
gcgguucgguggcuucuag

SEQ ID NO: 1494759 - RNA, 19 nt, Homo sapiens
ggccucaaacucaagauaa

SEQ ID NO: 1494760 - RNA, 19 nt, Homo sapiens
caagcaauaugcccaucau

SEQ ID NO: 1494761 - RNA, 19 nt, Homo sapiens
ucaaaccugcacuauuuaa

SEQ ID NO: 1494762 - RNA, 19 nt, Homo sapiens
cagagcaagucuccgucua

SEQ ID NO: 1494763 - RNA, 19 nt, Homo sapiens
ccugagacacuaaauaaau

SEQ ID NO: 1494764 - RNA, 19 nt, Homo sapiens
caaacgcaacucuaauuuc

SEQ ID NO: 1494765 - RNA, 19 nt, Homo sapiens
aaaggaaggagccguuuau

SEQ ID NO: 1494766 - RNA, 19 nt, Homo sapiens
guugauugcauguuaaaug

SEQ ID NO: 1494767 - RNA, 19 nt, Homo sapiens
ggcauuaugguuagucuga

SEQ ID NO: 1494768 - RNA, 19 nt, Homo sapiens
uuuaccaacuugcucuuaa

SEQ ID NO: 1494769 - RNA, 19 nt, Homo sapiens
caaccuggcgugaaugcuu

SEQ ID NO: 1494770 - RNA, 19 nt, Homo sapiens
caucauccuuccugagaca

SEQ ID NO: 1494771 - RNA, 19 nt, Homo sapiens
gcauuaugguuagucugaa

SEQ ID NO: 1494772 - RNA, 19 nt, Homo sapiens
ccagguuuauuucaguuuc

SEQ ID NO: 1494773 - RNA, 19 nt, Homo sapiens
guacacuggaauuuaaaga

SEQ ID NO: 1494774 - RNA, 19 nt, Homo sapiens
uaaccugugcuauauauac

SEQ ID NO: 1494775 - RNA, 19 nt, Homo sapiens
gcaagcaauaugcccauca

SEQ ID NO: 1494776 - RNA, 19 nt, Homo sapiens
cauccaaggaauaaacauu

SEQ ID NO: 1494777 - RNA, 19 nt, Homo sapiens
caauaugcccaucauccuu

SEQ ID NO: 1494778 - RNA, 19 nt, Homo sapiens
cauuaugguuagucugaau

SEQ ID NO: 1494779 - RNA, 19 nt, Homo sapiens
uuaauaugauagccacuag

SEQ ID NO: 1494780 - RNA, 19 nt, Homo sapiens
gucaggagaucgagaccau

SEQ ID NO: 1494781 - RNA, 19 nt, Homo sapiens
agagcaagucuccgucuaa

SEQ ID NO: 1494782 - RNA, 19 nt, Homo sapiens
aaccuggcgugaaugcuuu

SEQ ID NO: 1494783 - RNA, 19 nt, Homo sapiens
ccgcauuuccaccuucuaa

SEQ ID NO: 1494784 - RNA, 19 nt, Homo sapiens
gcaagucuccgucuaaaag

SEQ ID NO: 1494785 - RNA, 19 nt, Homo sapiens
uuccugagacacuaaauaa

SEQ ID NO: 1494786 - RNA, 19 nt, Homo sapiens
aaggcuagguguuauuaag

SEQ ID NO: 1494787 - RNA, 19 nt, Homo sapiens
uugcuggaguucuguaaau

SEQ ID NO: 1494788 - RNA, 19 nt, Homo sapiens
caaaccugcacuauuuaau

SEQ ID NO: 1494789 - RNA, 19 nt, Homo sapiens
ccugugaucccagcacuuu

SEQ ID NO: 1494790 - RNA, 19 nt, Homo sapiens
gagcacucuccauauaaug

SEQ ID NO: 1494791 - RNA, 19 nt, Homo sapiens
auuaaggguugacaccauu

SEQ ID NO: 1494792 - RNA, 19 nt, Homo sapiens
aggaaggagccguuuauga

SEQ ID NO: 1494793 - RNA, 19 nt, Homo sapiens
guccagguuuauuucaguu

SEQ ID NO: 1494794 - RNA, 19 nt, Homo sapiens
gcaauaugcccaucauccu

SEQ ID NO: 1494795 - RNA, 19 nt, Homo sapiens
uauuaaggguugacaccau

SEQ ID NO: 1494796 - RNA, 19 nt, Homo sapiens
guuaauuucaccuguuugu

SEQ ID NO: 1494797 - RNA, 19 nt, Homo sapiens
gcagaaaacaucguguaaa

SEQ ID NO: 1494798 - RNA, 19 nt, Homo sapiens
agccacaggccauuucuuu

SEQ ID NO: 1494799 - RNA, 19 nt, Homo sapiens
cagacuugccucaaaggaa

SEQ ID NO: 1494800 - RNA, 19 nt, Homo sapiens
ucgagcacucuccauauaa

SEQ ID NO: 1494801 - RNA, 19 nt, Homo sapiens
acugaggucugcuaagaag

SEQ ID NO: 1494802 - RNA, 19 nt, Homo sapiens
gcggcguucuugcgauuca

SEQ ID NO: 1494803 - RNA, 19 nt, Homo sapiens
cucaaacgcaacucuaauu

SEQ ID NO: 1494804 - RNA, 19 nt, Homo sapiens
ccccgucucuacuaaaaua

SEQ ID NO: 1494805 - RNA, 19 nt, Homo sapiens
gcugcguccagguuuauuu

SEQ ID NO: 1494806 - RNA, 19 nt, Homo sapiens
cauccuuccugagacacua

SEQ ID NO: 1494807 - RNA, 19 nt, Homo sapiens
cagguuuauuucaguuuca

SEQ ID NO: 1494808 - RNA, 19 nt, Homo sapiens
ccacaggccauuucuuuug

SEQ ID NO: 1494809 - RNA, 19 nt, Homo sapiens
ucaaaggaaggagccguuu

SEQ ID NO: 1494810 - RNA, 19 nt, Homo sapiens
gccucaaacgcaacucuaa

SEQ ID NO: 1494811 - RNA, 19 nt, Homo sapiens
ucagccacuucacuucuuc

SEQ ID NO: 1494812 - RNA, 19 nt, Homo sapiens
cagaaaagucccaguguug

SEQ ID NO: 1494813 - RNA, 19 nt, Homo sapiens
uaaggcuagguguuauuaa

SEQ ID NO: 1494814 - RNA, 19 nt, Homo sapiens
gacugaggucugcuaagaa

SEQ ID NO: 1494815 - RNA, 19 nt, Homo sapiens
cguccagguuuauuucagu

SEQ ID NO: 1494816 - RNA, 19 nt, Homo sapiens
aaaguuaguggaaucuauc

SEQ ID NO: 1494817 - RNA, 19 nt, Homo sapiens
cuauugaccacucggcauu

SEQ ID NO: 1494818 - RNA, 19 nt, Homo sapiens
ucagaaagcuguaucauga

SEQ ID NO: 1494819 - RNA, 19 nt, Homo sapiens
ggacaauuauucagcauuu

SEQ ID NO: 1494820 - RNA, 19 nt, Homo sapiens
ggagugugcucucaaauga

SEQ ID NO: 1494821 - RNA, 19 nt, Homo sapiens
gaaugcagcuuucaagguu

SEQ ID NO: 1494822 - RNA, 19 nt, Homo sapiens
gcauugaccuugaguaugu

SEQ ID NO: 1494823 - RNA, 19 nt, Homo sapiens
gacaguaggaggauaauua

SEQ ID NO: 1494824 - RNA, 19 nt, Homo sapiens
ggagugacauuaaccuuga

SEQ ID NO: 1494825 - RNA, 19 nt, Homo sapiens
ugaccaagguguagacuaa

SEQ ID NO: 1494826 - RNA, 19 nt, Homo sapiens
ggacaaugauuugguuuau

SEQ ID NO: 1494827 - RNA, 19 nt, Homo sapiens
gaacaggagugacauuaac

SEQ ID NO: 1494828 - RNA, 19 nt, Homo sapiens
ugaaacaccuagagauuga

SEQ ID NO: 1494829 - RNA, 19 nt, Homo sapiens
gcaccaaugccaauacuuu

SEQ ID NO: 1494830 - RNA, 19 nt, Homo sapiens
gagauagacuugagugaca

SEQ ID NO: 1494831 - RNA, 19 nt, Homo sapiens
caauguggguaaucaguaa

SEQ ID NO: 1494832 - RNA, 19 nt, Homo sapiens
cgucaacccugaagaauuc

SEQ ID NO: 1494833 - RNA, 19 nt, Homo sapiens
caggauaaaucaugaggaa

SEQ ID NO: 1494834 - RNA, 19 nt, Homo sapiens
gaaauaggguuaugaaaag

SEQ ID NO: 1494835 - RNA, 19 nt, Homo sapiens
ggaggauaauuaacaauag

SEQ ID NO: 1494836 - RNA, 19 nt, Homo sapiens
caaggagugugcucucaaa

SEQ ID NO: 1494837 - RNA, 19 nt, Homo sapiens
ucacauuacugucucuuug

SEQ ID NO: 1494838 - RNA, 19 nt, Homo sapiens
cuggaggucuugagcauua

SEQ ID NO: 1494839 - RNA, 19 nt, Homo sapiens
ugaagcaucucaauaucaa

SEQ ID NO: 1494840 - RNA, 19 nt, Homo sapiens
guaggaggauaauuaacaa

SEQ ID NO: 1494841 - RNA, 19 nt, Homo sapiens
ucaacaauaugccugugua

SEQ ID NO: 1494842 - RNA, 19 nt, Homo sapiens
uaacagcaguaccaacaga

SEQ ID NO: 1494843 - RNA, 19 nt, Homo sapiens
ggaacaggagugacauuaa

SEQ ID NO: 1494844 - RNA, 19 nt, Homo sapiens
gauaugaugccugccaaua

SEQ ID NO: 1494845 - RNA, 19 nt, Homo sapiens
aaaccaggauaaaucauga

SEQ ID NO: 1494846 - RNA, 19 nt, Homo sapiens
ggaaauaggguuaugaaaa

SEQ ID NO: 1494847 - RNA, 19 nt, Homo sapiens
ggagaaaugcaacuuaaca

SEQ ID NO: 1494848 - RNA, 19 nt, Homo sapiens
caauggugcuguuguggaa

SEQ ID NO: 1494849 - RNA, 19 nt, Homo sapiens
gguaaucaguaagacagua

SEQ ID NO: 1494850 - RNA, 19 nt, Homo sapiens
aaacaauacuggugucuac

SEQ ID NO: 1494851 - RNA, 19 nt, Homo sapiens
gaaaggauucgcuucagau

SEQ ID NO: 1494852 - RNA, 19 nt, Homo sapiens
gagaaagagcuaagagaga

SEQ ID NO: 1494853 - RNA, 19 nt, Homo sapiens
acaccaaucugucuacugu

SEQ ID NO: 1494854 - RNA, 19 nt, Homo sapiens
ucagugggcuucuuagcuu

SEQ ID NO: 1494855 - RNA, 19 nt, Homo sapiens
ggaauuaucaugaucaacu

SEQ ID NO: 1494856 - RNA, 19 nt, Homo sapiens
gcuaugggcugcuucacau

SEQ ID NO: 1494857 - RNA, 19 nt, Homo sapiens
ugagaggucuuucaaggau

SEQ ID NO: 1494858 - RNA, 19 nt, Homo sapiens
cccaggagguucaacauga

SEQ ID NO: 1494859 - RNA, 19 nt, Homo sapiens
gauugacuauuggccuuua

SEQ ID NO: 1494860 - RNA, 19 nt, Homo sapiens
gcauucaacaaucucuuua

SEQ ID NO: 1494861 - RNA, 19 nt, Homo sapiens
gagaagauguagggagugu

SEQ ID NO: 1494862 - RNA, 19 nt, Homo sapiens
gaagauguagggaguguuc

SEQ ID NO: 1494863 - RNA, 19 nt, Homo sapiens
gagcagagcaccgaaagug

SEQ ID NO: 1494864 - RNA, 19 nt, Homo sapiens
guacaugaccgacuccaau

SEQ ID NO: 1494865 - RNA, 19 nt, Homo sapiens
caucagcacuauugaagca

SEQ ID NO: 1494866 - RNA, 19 nt, Homo sapiens
caucugaagcaucucaaua

SEQ ID NO: 1494867 - RNA, 19 nt, Homo sapiens
cuggagaaaugcaacuuaa

SEQ ID NO: 1494868 - RNA, 19 nt, Homo sapiens
gcauucagugggcuucuua

SEQ ID NO: 1494869 - RNA, 19 nt, Homo sapiens
ucacaugagccuggaaaua

SEQ ID NO: 1494870 - RNA, 19 nt, Homo sapiens
ucacacucacggacaauua

SEQ ID NO: 1494871 - RNA, 19 nt, Homo sapiens
gcaaugcugcugggaauga

SEQ ID NO: 1494872 - RNA, 19 nt, Homo sapiens
aagcaggcauguucucuga

SEQ ID NO: 1494873 - RNA, 19 nt, Homo sapiens
ccugaagucucuagaagug

SEQ ID NO: 1494874 - RNA, 19 nt, Homo sapiens
gggucuggcugugguguua

SEQ ID NO: 1494875 - RNA, 19 nt, Homo sapiens
gaguaaaccaggauaaauc

SEQ ID NO: 1494876 - RNA, 19 nt, Homo sapiens
gcaguuugguggccagcaa

SEQ ID NO: 1494877 - RNA, 19 nt, Homo sapiens
gggacaaugauuugguuua

SEQ ID NO: 1494878 - RNA, 19 nt, Homo sapiens
cauauccucugcuggaaga

SEQ ID NO: 1494879 - RNA, 19 nt, Homo sapiens
ucaaacuggugaagugaga

SEQ ID NO: 1494880 - RNA, 19 nt, Homo sapiens
gaagagcccaacaauucaa

SEQ ID NO: 1494881 - RNA, 19 nt, Homo sapiens
agauacaaaugcaggaauu

SEQ ID NO: 1494882 - RNA, 19 nt, Homo sapiens
ucacacagugggauacuaa

SEQ ID NO: 1494883 - RNA, 19 nt, Homo sapiens
ucagagcccuucacacagu

SEQ ID NO: 1494884 - RNA, 19 nt, Homo sapiens
caagacagcgggauguaug

SEQ ID NO: 1494885 - RNA, 19 nt, Homo sapiens
agaaccugcuggaaacuuu

SEQ ID NO: 1494886 - RNA, 19 nt, Homo sapiens
caacuacccagcuuggauu

SEQ ID NO: 1494887 - RNA, 19 nt, Homo sapiens
uagacuacauguuccaaga

SEQ ID NO: 1494888 - RNA, 19 nt, Homo sapiens
acuaagaaguggagucaug

SEQ ID NO: 1494889 - RNA, 19 nt, Homo sapiens
gaaaugcucggagacucua

SEQ ID NO: 1494890 - RNA, 19 nt, Homo sapiens
agaggucuuucaaggauuu

SEQ ID NO: 1494891 - RNA, 19 nt, Homo sapiens
gaagagaaagagcuaagag

SEQ ID NO: 1494892 - RNA, 19 nt, Homo sapiens
caacuuaacagcaguacca

SEQ ID NO: 1494893 - RNA, 19 nt, Homo sapiens
gcaggaggacuuccaaugg

SEQ ID NO: 1494894 - RNA, 19 nt, Homo sapiens
uacauaaccugaagucucu

SEQ ID NO: 1494895 - RNA, 19 nt, Homo sapiens
gagaugcugcugcccauga

SEQ ID NO: 1494896 - RNA, 19 nt, Homo sapiens
agagagaggagcuuaaaga

SEQ ID NO: 1494897 - RNA, 19 nt, Homo sapiens
gagaggaacaggagugaca

SEQ ID NO: 1494898 - RNA, 19 nt, Homo sapiens
agacucuacuccuucauga

SEQ ID NO: 1494899 - RNA, 19 nt, Homo sapiens
gagaggucuuucaaggauu

SEQ ID NO: 1494900 - RNA, 19 nt, Homo sapiens
accuagagauugacuauug

SEQ ID NO: 1494901 - RNA, 19 nt, Homo sapiens
ucaacaaucucuuuaaccu

SEQ ID NO: 1494902 - RNA, 19 nt, Homo sapiens
gaaccaggagcauucaaca

SEQ ID NO: 1494903 - RNA, 19 nt, Homo sapiens
gcagacaguccagcuagaa

SEQ ID NO: 1494904 - RNA, 19 nt, Homo sapiens
acacaaacggguagaauca

SEQ ID NO: 1494905 - RNA, 19 nt, Homo sapiens
gcuggaaacuuuggaagag

SEQ ID NO: 1494906 - RNA, 19 nt, Homo sapiens
ucucagaaccugcuggaaa

SEQ ID NO: 1494907 - RNA, 19 nt, Homo sapiens
cauguucucugaccugauc

SEQ ID NO: 1494908 - RNA, 19 nt, Homo sapiens
acaaaucuguuagcuguca

SEQ ID NO: 1494909 - RNA, 19 nt, Homo sapiens
augaagagcccaacaauuc

SEQ ID NO: 1494910 - RNA, 19 nt, Homo sapiens
ugagcugccugcacuucua

SEQ ID NO: 1494911 - RNA, 19 nt, Homo sapiens
uggaagagccaccguguug

SEQ ID NO: 1494912 - RNA, 19 nt, Homo sapiens
ccauagcacugcccuuucu

SEQ ID NO: 1494913 - RNA, 19 nt, Homo sapiens
caaaugcaggaauugauga

SEQ ID NO: 1494914 - RNA, 19 nt, Homo sapiens
ccaggagcauucaacaauc

SEQ ID NO: 1494915 - RNA, 19 nt, Homo sapiens
gcaugaagagcccaacaau

SEQ ID NO: 1494916 - RNA, 19 nt, Homo sapiens
uugaguaugugcccagaaa

SEQ ID NO: 1494917 - RNA, 19 nt, Homo sapiens
gacauuagugagaauaaga

SEQ ID NO: 1494918 - RNA, 19 nt, Homo sapiens
gauaaaugcuugaggagaa

SEQ ID NO: 1494919 - RNA, 19 nt, Homo sapiens
caucacauguucucacuua

SEQ ID NO: 1494920 - RNA, 19 nt, Homo sapiens
ggaguacucuucagccauu

SEQ ID NO: 1494921 - RNA, 19 nt, Homo sapiens
gagaguagaagguugguua

SEQ ID NO: 1494922 - RNA, 19 nt, Homo sapiens
gaaauaagccaggcacaga

SEQ ID NO: 1494923 - RNA, 19 nt, Homo sapiens
gcgagucugugcucauuaa

SEQ ID NO: 1494924 - RNA, 19 nt, Homo sapiens
cacauguucucacuuauuu

SEQ ID NO: 1494925 - RNA, 19 nt, Homo sapiens
gcccuuaugugaagugaaa

SEQ ID NO: 1494926 - RNA, 19 nt, Homo sapiens
aaaggaagccaguauauug

SEQ ID NO: 1494927 - RNA, 19 nt, Homo sapiens
gagauucugucauuugcaa

SEQ ID NO: 1494928 - RNA, 19 nt, Homo sapiens
caaccuaaguguccaucaa

SEQ ID NO: 1494929 - RNA, 19 nt, Homo sapiens
acagaugaauggauaaaga

SEQ ID NO: 1494930 - RNA, 19 nt, Homo sapiens
gaaagacaaacaucacaug

SEQ ID NO: 1494931 - RNA, 19 nt, Homo sapiens
caauugaacucuuggacau

SEQ ID NO: 1494932 - RNA, 19 nt, Homo sapiens
caaaacaauugaacucuug

SEQ ID NO: 1494933 - RNA, 19 nt, Homo sapiens
gaccuaauauuugauagca

SEQ ID NO: 1494934 - RNA, 19 nt, Homo sapiens
gcacagaaagacaaacauc

SEQ ID NO: 1494935 - RNA, 19 nt, Homo sapiens
guauauacccgaaagaaag

SEQ ID NO: 1494936 - RNA, 19 nt, Homo sapiens
ucacaacagccaagauuug

SEQ ID NO: 1494937 - RNA, 19 nt, Homo sapiens
ggagugcaguggcgugauc

SEQ ID NO: 1494938 - RNA, 19 nt, Homo sapiens
ugggaaugguuaauaggua

SEQ ID NO: 1494939 - RNA, 19 nt, Homo sapiens
ggaggaaggugggaauggu

SEQ ID NO: 1494940 - RNA, 19 nt, Homo sapiens
caacagaugaauggauaaa

SEQ ID NO: 1494941 - RNA, 19 nt, Homo sapiens
gaaaaggaagccaguauau

SEQ ID NO: 1494942 - RNA, 19 nt, Homo sapiens
ccaguauauugaagaggua

SEQ ID NO: 1494943 - RNA, 19 nt, Homo sapiens
ggaagccaguauauugaag

SEQ ID NO: 1494944 - RNA, 19 nt, Homo sapiens
ucacauguucucacuuauu

SEQ ID NO: 1494945 - RNA, 19 nt, Homo sapiens
ggaaaaggaagccaguaua

SEQ ID NO: 1494946 - RNA, 19 nt, Homo sapiens
gauucugucauuugcaaua

SEQ ID NO: 1494947 - RNA, 19 nt, Homo sapiens
guucacaacagccaagauu

SEQ ID NO: 1494948 - RNA, 19 nt, Homo sapiens
gagggaaagauauugaaga

SEQ ID NO: 1494949 - RNA, 19 nt, Homo sapiens
aucaacagaugaauggaua

SEQ ID NO: 1494950 - RNA, 19 nt, Homo sapiens
uuagcucacugcaaccuuu

SEQ ID NO: 1494951 - RNA, 19 nt, Homo sapiens
acaaggugguggcacugua

SEQ ID NO: 1494952 - RNA, 19 nt, Homo sapiens
gaagccaguauauugaaga

SEQ ID NO: 1494953 - RNA, 19 nt, Homo sapiens
agucugugcucauuaacaa

SEQ ID NO: 1494954 - RNA, 19 nt, Homo sapiens
ggaaggugggaaugguuaa

SEQ ID NO: 1494955 - RNA, 19 nt, Homo sapiens
ugaauuacgugagggaaag

SEQ ID NO: 1494956 - RNA, 19 nt, Homo sapiens
aagugauucucuagccuua

SEQ ID NO: 1494957 - RNA, 19 nt, Homo sapiens
cagaugaauggauaaagaa

SEQ ID NO: 1494958 - RNA, 19 nt, Homo sapiens
ggguucaagugauucucua

SEQ ID NO: 1494959 - RNA, 19 nt, Homo sapiens
gugcaguggcgugaucuua

SEQ ID NO: 1494960 - RNA, 19 nt, Homo sapiens
acauauacacaauggagua

SEQ ID NO: 1494961 - RNA, 19 nt, Homo sapiens
gcugugaccaugugacuca

SEQ ID NO: 1494962 - RNA, 19 nt, Homo sapiens
auaaaugcuugaggagaaa

SEQ ID NO: 1494963 - RNA, 19 nt, Homo sapiens
uaugugaagugaaauaagc

SEQ ID NO: 1494964 - RNA, 19 nt, Homo sapiens
guacucuucagccauuaaa

SEQ ID NO: 1494965 - RNA, 19 nt, Homo sapiens
gaguacucuucagccauua

SEQ ID NO: 1494966 - RNA, 19 nt, Homo sapiens
aagaaaacgugguacauau

SEQ ID NO: 1494967 - RNA, 19 nt, Homo sapiens
gcaguggcgugaucuuagc

SEQ ID NO: 1494968 - RNA, 19 nt, Homo sapiens
cgugguacauauacacaau

SEQ ID NO: 1494969 - RNA, 19 nt, Homo sapiens
ggagaugcuggacuucaug

SEQ ID NO: 1494970 - RNA, 19 nt, Homo sapiens
caacggagucucgcucugu

SEQ ID NO: 1494971 - RNA, 19 nt, Homo sapiens
gaggaaggugggaaugguu

SEQ ID NO: 1494972 - RNA, 19 nt, Homo sapiens
cuaaguguccaucaacaga

SEQ ID NO: 1494973 - RNA, 19 nt, Homo sapiens
ucacuuauuugugggaucu

SEQ ID NO: 1494974 - RNA, 19 nt, Homo sapiens
agggaaagauauugaagag

SEQ ID NO: 1494975 - RNA, 19 nt, Homo sapiens
ggauaaagaaaacguggua

SEQ ID NO: 1494976 - RNA, 19 nt, Homo sapiens
aaggaagccaguauauuga

SEQ ID NO: 1494977 - RNA, 19 nt, Homo sapiens
aaauaagccaggcacagaa

SEQ ID NO: 1494978 - RNA, 19 nt, Homo sapiens
caauccugcugcuggguau

SEQ ID NO: 1494979 - RNA, 19 nt, Homo sapiens
aaagaaaacgugguacaua

SEQ ID NO: 1494980 - RNA, 19 nt, Homo sapiens
cugcgagucugugcucauu

SEQ ID NO: 1494981 - RNA, 19 nt, Homo sapiens
gaaggugggaaugguuaau

SEQ ID NO: 1494982 - RNA, 19 nt, Homo sapiens
cauguucucacuuauuugu

SEQ ID NO: 1494983 - RNA, 19 nt, Homo sapiens
uaagccaggcacagaaaga

SEQ ID NO: 1494984 - RNA, 19 nt, Homo sapiens
gugaauuacgugagggaaa

SEQ ID NO: 1494985 - RNA, 19 nt, Homo sapiens
uuugauagcacaacagugu

SEQ ID NO: 1494986 - RNA, 19 nt, Homo sapiens
cagaaagacaaacaucaca

SEQ ID NO: 1494987 - RNA, 19 nt, Homo sapiens
aggaaggugggaaugguua

SEQ ID NO: 1494988 - RNA, 19 nt, Homo sapiens
aauaagccaggcacagaaa

SEQ ID NO: 1494989 - RNA, 19 nt, Homo sapiens
cgaaagaaaggaaaaggaa

SEQ ID NO: 1494990 - RNA, 19 nt, Homo sapiens
gcgccaugguugacauucu

SEQ ID NO: 1494991 - RNA, 19 nt, Homo sapiens
ccauugcugugaauuacgu

SEQ ID NO: 1494992 - RNA, 19 nt, Homo sapiens
cacagaaagacaaacauca

SEQ ID NO: 1494993 - RNA, 19 nt, Homo sapiens
cuccuggguucaagugauu

SEQ ID NO: 1494994 - RNA, 19 nt, Homo sapiens
aggaggcccuuaugugaag

SEQ ID NO: 1494995 - RNA, 19 nt, Homo sapiens
acacaauggaguacucuuc

SEQ ID NO: 1494996 - RNA, 19 nt, Homo sapiens
gcaucuagggcaggucuug

SEQ ID NO: 1494997 - RNA, 19 nt, Homo sapiens
ccuuaugugaagugaaaua

SEQ ID NO: 1494998 - RNA, 19 nt, Homo sapiens
gaaaacgugguacauauac

SEQ ID NO: 1494999 - RNA, 19 nt, Homo sapiens
uugcagcacuguucacaac

SEQ ID NO: 1495000 - RNA, 19 nt, Homo sapiens
aaggugggaaugguuaaua

SEQ ID NO: 1495001 - RNA, 19 nt, Homo sapiens
cacaauggaguacucuuca

SEQ ID NO: 1495002 - RNA, 19 nt, Homo sapiens
uauacacaauggaguacuc

SEQ ID NO: 1495003 - RNA, 19 nt, Homo sapiens
gaccaugugacucagcaau

SEQ ID NO: 1495004 - RNA, 19 nt, Homo sapiens
caccauccguguccugcau

SEQ ID NO: 1495005 - RNA, 19 nt, Homo sapiens
agauuuggaagcaaccuaa

SEQ ID NO: 1495006 - RNA, 19 nt, Homo sapiens
gugagggaaagauauugaa

SEQ ID NO: 1495007 - RNA, 19 nt, Homo sapiens
uuacgugagggaaagauau

SEQ ID NO: 1495008 - RNA, 19 nt, Homo sapiens
gaauuacgugagggaaaga

SEQ ID NO: 1495009 - RNA, 19 nt, Homo sapiens
ggaaggaggugucauuguu

SEQ ID NO: 1495010 - RNA, 19 nt, Homo sapiens
gacaauaucuuggauguau

SEQ ID NO: 1495011 - RNA, 19 nt, Homo sapiens
gcaaauaucgaaucaauca

SEQ ID NO: 1495012 - RNA, 19 nt, Homo sapiens
ccacugcuguaccacauua

SEQ ID NO: 1495013 - RNA, 19 nt, Homo sapiens
caucaggucuucaucucua

SEQ ID NO: 1495014 - RNA, 19 nt, Homo sapiens
gaugagcaccuaaacguuu

SEQ ID NO: 1495015 - RNA, 19 nt, Homo sapiens
gggccaaucugcucagcua

SEQ ID NO: 1495016 - RNA, 19 nt, Homo sapiens
agacagcucucagcaguuu

SEQ ID NO: 1495017 - RNA, 19 nt, Homo sapiens
gaccauagcugcagaaacc

SEQ ID NO: 1495018 - RNA, 19 nt, Homo sapiens
gaaggaggugucauuguuu

SEQ ID NO: 1495019 - RNA, 19 nt, Homo sapiens
caugguagguugugaagga

SEQ ID NO: 1495020 - RNA, 19 nt, Homo sapiens
cauagacccuuccguugaa

SEQ ID NO: 1495021 - RNA, 19 nt, Homo sapiens
ggaugcaaauaucgaauca

SEQ ID NO: 1495022 - RNA, 19 nt, Homo sapiens
ggauguaucagauuaaaca

SEQ ID NO: 1495023 - RNA, 19 nt, Homo sapiens
gggaacaggugggcacuau

SEQ ID NO: 1495024 - RNA, 19 nt, Homo sapiens
caggaaacccgcugccuuu

SEQ ID NO: 1495025 - RNA, 19 nt, Homo sapiens
gaaggaugcaaauaucgaa

SEQ ID NO: 1495026 - RNA, 19 nt, Homo sapiens
ucuuggauguaucagauua

SEQ ID NO: 1495027 - RNA, 19 nt, Homo sapiens
ccauagacccuuccguuga

SEQ ID NO: 1495028 - RNA, 19 nt, Homo sapiens
ggucagcuccucccauuag

SEQ ID NO: 1495029 - RNA, 19 nt, Homo sapiens
ccucagggcagggauguua

SEQ ID NO: 1495030 - RNA, 19 nt, Homo sapiens
ccucuaggguccuccgaaa

SEQ ID NO: 1495031 - RNA, 19 nt, Homo sapiens
cgggucagcuccucccauu

SEQ ID NO: 1495032 - RNA, 19 nt, Homo sapiens
gcugggcucugaguguaaa

SEQ ID NO: 1495033 - RNA, 19 nt, Homo sapiens
ugugaaggaugcaaauauc

SEQ ID NO: 1495034 - RNA, 19 nt, Homo sapiens
ccaaucugcucagcuaaca

SEQ ID NO: 1495035 - RNA, 19 nt, Homo sapiens
uaagauagagcaagaugag

SEQ ID NO: 1495036 - RNA, 19 nt, Homo sapiens
gagacgcugugugcccuuu

SEQ ID NO: 1495037 - RNA, 19 nt, Homo sapiens
cagcuaacauuugccuuuc

SEQ ID NO: 1495038 - RNA, 19 nt, Homo sapiens
gaccacugcuguaccacau

SEQ ID NO: 1495039 - RNA, 19 nt, Homo sapiens
ggugggcacuauccucugu

SEQ ID NO: 1495040 - RNA, 19 nt, Homo sapiens
ucagcuaacauuugccuuu

SEQ ID NO: 1495041 - RNA, 19 nt, Homo sapiens
aaggaggugucauuguuug

SEQ ID NO: 1495042 - RNA, 19 nt, Homo sapiens
gaacaggugggcacuaucc

SEQ ID NO: 1495043 - RNA, 19 nt, Homo sapiens
cagcuuccuuagucucuga

SEQ ID NO: 1495044 - RNA, 19 nt, Homo sapiens
uauccucugugcccucauu

SEQ ID NO: 1495045 - RNA, 19 nt, Homo sapiens
agagcaagaugagcaccua

SEQ ID NO: 1495046 - RNA, 19 nt, Homo sapiens
caauaucuuggauguauca

SEQ ID NO: 1495047 - RNA, 19 nt, Homo sapiens
ggugguggccaucacuauu

SEQ ID NO: 1495048 - RNA, 19 nt, Homo sapiens
gcuggugcuugcugugaga

SEQ ID NO: 1495049 - RNA, 19 nt, Homo sapiens
gaaucagcaucuggugcaa

SEQ ID NO: 1495050 - RNA, 19 nt, Homo sapiens
ccuggaggcuggacacaag

SEQ ID NO: 1495051 - RNA, 19 nt, Homo sapiens
gcuaacauuugccuuucag

SEQ ID NO: 1495052 - RNA, 19 nt, Homo sapiens
gagcaagaugagcaccuaa

SEQ ID NO: 1495053 - RNA, 19 nt, Homo sapiens
gcaagaugagcaccuaaac

SEQ ID NO: 1495054 - RNA, 19 nt, Homo sapiens
gagcaucaggucuucaucu

SEQ ID NO: 1495055 - RNA, 19 nt, Homo sapiens
aaucugcucagcuaacauu

SEQ ID NO: 1495056 - RNA, 19 nt, Homo sapiens
ggaaacccgcugccuuugc

SEQ ID NO: 1495057 - RNA, 19 nt, Homo sapiens
aggcugagcgguugaggaa

SEQ ID NO: 1495058 - RNA, 19 nt, Homo sapiens
ugaaggaugcaaauaucga

SEQ ID NO: 1495059 - RNA, 19 nt, Homo sapiens
gggcucugaguguaaacua

SEQ ID NO: 1495060 - RNA, 19 nt, Homo sapiens
ggugggcacuaagcuaugg

SEQ ID NO: 1495061 - RNA, 19 nt, Homo sapiens
ugucauuguuugcccuuuc

SEQ ID NO: 1495062 - RNA, 19 nt, Homo sapiens
gcggaaggaggugucauug

SEQ ID NO: 1495063 - RNA, 19 nt, Homo sapiens
ugacaauaucuuggaugua

SEQ ID NO: 1495064 - RNA, 19 nt, Homo sapiens
guugugaaggaugcaaaua

SEQ ID NO: 1495065 - RNA, 19 nt, Homo sapiens
cggcuucuguuggcuccua

SEQ ID NO: 1495066 - RNA, 19 nt, Homo sapiens
aagaugagcaccuaaacgu

SEQ ID NO: 1495067 - RNA, 19 nt, Homo sapiens
augacaauaucuuggaugu

SEQ ID NO: 1495068 - RNA, 19 nt, Homo sapiens
cugcucagcuaacauuugc

SEQ ID NO: 1495069 - RNA, 19 nt, Homo sapiens
ugucaccacuucccugaac

SEQ ID NO: 1495070 - RNA, 19 nt, Homo sapiens
gugguggccaucacuauuc

SEQ ID NO: 1495071 - RNA, 19 nt, Homo sapiens
gcaguuuguagccugaugu

SEQ ID NO: 1495072 - RNA, 19 nt, Homo sapiens
caauaaagccugcuggaua

SEQ ID NO: 1495073 - RNA, 19 nt, Homo sapiens
gcccaggauuguaauauua

SEQ ID NO: 1495074 - RNA, 19 nt, Homo sapiens
gaaagaggcuguggcagau

SEQ ID NO: 1495075 - RNA, 19 nt, Homo sapiens
uggagaaccugaucuuaaa

SEQ ID NO: 1495076 - RNA, 19 nt, Homo sapiens
ggaguugggcugaggauuu

SEQ ID NO: 1495077 - RNA, 19 nt, Homo sapiens
cauacacagucuucgaaua

SEQ ID NO: 1495078 - RNA, 19 nt, Homo sapiens
gcagauaggaccacguuug

SEQ ID NO: 1495079 - RNA, 19 nt, Homo sapiens
caaagcaaccaucguacua

SEQ ID NO: 1495080 - RNA, 19 nt, Homo sapiens
agaaacugcuggaguauca

SEQ ID NO: 1495081 - RNA, 19 nt, Homo sapiens
gaaauacaggcuugucaau

SEQ ID NO: 1495082 - RNA, 19 nt, Homo sapiens
ggagacggcucagaaacug

SEQ ID NO: 1495083 - RNA, 19 nt, Homo sapiens
aauacaggcuugucaaugu

SEQ ID NO: 1495084 - RNA, 19 nt, Homo sapiens
gcucugaccuauguccaaa

SEQ ID NO: 1495085 - RNA, 19 nt, Homo sapiens
ugaagaggauugcaucaag

SEQ ID NO: 1495086 - RNA, 19 nt, Homo sapiens
aaacaacaauagcaaugug

SEQ ID NO: 1495087 - RNA, 19 nt, Homo sapiens
gaacaucgucagggucauu

SEQ ID NO: 1495088 - RNA, 19 nt, Homo sapiens
caauguggcucugcaaaca

SEQ ID NO: 1495089 - RNA, 19 nt, Homo sapiens
gcauagagacaacgacaau

SEQ ID NO: 1495090 - RNA, 19 nt, Homo sapiens
gugggcaacugcugaaaga

SEQ ID NO: 1495091 - RNA, 19 nt, Homo sapiens
cucagaaacugcuggagua

SEQ ID NO: 1495092 - RNA, 19 nt, Homo sapiens
gaagagaaucgacccucaa

SEQ ID NO: 1495093 - RNA, 19 nt, Homo sapiens
gaaccacaucuucgaguug

SEQ ID NO: 1495094 - RNA, 19 nt, Homo sapiens
ugaccuauguccaaagcaa

SEQ ID NO: 1495095 - RNA, 19 nt, Homo sapiens
gagaaucgacccucaaacu

SEQ ID NO: 1495096 - RNA, 19 nt, Homo sapiens
uuaaagauggguaaacuga

SEQ ID NO: 1495097 - RNA, 19 nt, Homo sapiens
ccgcuaagaugcgcaaaug

SEQ ID NO: 1495098 - RNA, 19 nt, Homo sapiens
aauaaagccugcuggauac

SEQ ID NO: 1495099 - RNA, 19 nt, Homo sapiens
gaguugggcugaggauuuc

SEQ ID NO: 1495100 - RNA, 19 nt, Homo sapiens
gagagugggaucauuaauc

SEQ ID NO: 1495101 - RNA, 19 nt, Homo sapiens
cagcugacuuggagcaguu

SEQ ID NO: 1495102 - RNA, 19 nt, Homo sapiens
gcucauccagcccuucuuu

SEQ ID NO: 1495103 - RNA, 19 nt, Homo sapiens
gcacuugcauagagacaac

SEQ ID NO: 1495104 - RNA, 19 nt, Homo sapiens
cggcacagcuccccuaaaa

SEQ ID NO: 1495105 - RNA, 19 nt, Homo sapiens
guccaaagcaaccaucgua

SEQ ID NO: 1495106 - RNA, 19 nt, Homo sapiens
aaccugaucuuaaaugagu

SEQ ID NO: 1495107 - RNA, 19 nt, Homo sapiens
agaaccugaucuuaaauga

SEQ ID NO: 1495108 - RNA, 19 nt, Homo sapiens
gagaaccugaucuuaaaug

SEQ ID NO: 1495109 - RNA, 19 nt, Homo sapiens
ccugacagccuccucauga

SEQ ID NO: 1495110 - RNA, 19 nt, Homo sapiens
ggaggagaaccacaucuuc

SEQ ID NO: 1495111 - RNA, 19 nt, Homo sapiens
gagagaaacuuggggaaga

SEQ ID NO: 1495112 - RNA, 19 nt, Homo sapiens
cuggagaaccugaucuuaa

SEQ ID NO: 1495113 - RNA, 19 nt, Homo sapiens
gaaaacaacaauagcaaug

SEQ ID NO: 1495114 - RNA, 19 nt, Homo sapiens
caucgagagugggaucauu

SEQ ID NO: 1495115 - RNA, 19 nt, Homo sapiens
ggaccaggacccauacaca

SEQ ID NO: 1495116 - RNA, 19 nt, Homo sapiens
aaacugcuggaguaucaua

SEQ ID NO: 1495117 - RNA, 19 nt, Homo sapiens
aaacuggagagauuuauca

SEQ ID NO: 1495118 - RNA, 19 nt, Homo sapiens
ccaagaaaauccccugaug

SEQ ID NO: 1495119 - RNA, 19 nt, Homo sapiens
aagagcaggucaagcugaa

SEQ ID NO: 1495120 - RNA, 19 nt, Homo sapiens
gaacccaaaggaugcugaa

SEQ ID NO: 1495121 - RNA, 19 nt, Homo sapiens
aagcaaccaucguacuaau

SEQ ID NO: 1495122 - RNA, 19 nt, Homo sapiens
agaaccacaucuucgaguu

SEQ ID NO: 1495123 - RNA, 19 nt, Homo sapiens
gcaaccaucguacuaaugc

SEQ ID NO: 1495124 - RNA, 19 nt, Homo sapiens
cuaccaggcucugaccuau

SEQ ID NO: 1495125 - RNA, 19 nt, Homo sapiens
ggaacucagcugacuugga

SEQ ID NO: 1495126 - RNA, 19 nt, Homo sapiens
caggaacucagcugacuug

SEQ ID NO: 1495127 - RNA, 19 nt, Homo sapiens
auccagcccuucuuugaaa

SEQ ID NO: 1495128 - RNA, 19 nt, Homo sapiens
gggaggagaaccacaucuu

SEQ ID NO: 1495129 - RNA, 19 nt, Homo sapiens
ggagaaccugaucuuaaau

SEQ ID NO: 1495130 - RNA, 19 nt, Homo sapiens
aaagccugcuggauacaga

SEQ ID NO: 1495131 - RNA, 19 nt, Homo sapiens
cccaaaggaugcugaagag

SEQ ID NO: 1495132 - RNA, 19 nt, Homo sapiens
aaagcaaccaucguacuaa

SEQ ID NO: 1495133 - RNA, 19 nt, Homo sapiens
aaccacaucuucgaguuga

SEQ ID NO: 1495134 - RNA, 19 nt, Homo sapiens
ggucggccaucacccucaa

SEQ ID NO: 1495135 - RNA, 19 nt, Homo sapiens
gcacugacagaaccagaag

SEQ ID NO: 1495136 - RNA, 19 nt, Homo sapiens
agaaggcuuuaucugcaaa

SEQ ID NO: 1495137 - RNA, 19 nt, Homo sapiens
ugcccaggauuguaauauu

SEQ ID NO: 1495138 - RNA, 19 nt, Homo sapiens
gcuggagacggcucagaaa

SEQ ID NO: 1495139 - RNA, 19 nt, Homo sapiens
gaaauccagaaccgucuca

SEQ ID NO: 1495140 - RNA, 19 nt, Homo sapiens
gaaccugaucuuaaaugag

SEQ ID NO: 1495141 - RNA, 19 nt, Homo sapiens
ggacccauacacagucuuc

SEQ ID NO: 1495142 - RNA, 19 nt, Homo sapiens
ucauccagcccuucuuuga

SEQ ID NO: 1495143 - RNA, 19 nt, Homo sapiens
aggaacgccuggcugaaga

SEQ ID NO: 1495144 - RNA, 19 nt, Homo sapiens
gcaauguggcucugcaaac

SEQ ID NO: 1495145 - RNA, 19 nt, Homo sapiens
gagcggcugacucugagaa

SEQ ID NO: 1495146 - RNA, 19 nt, Homo sapiens
cauccagcccuucuuugaa

SEQ ID NO: 1495147 - RNA, 19 nt, Homo sapiens
gcggcugacucugagaaga

SEQ ID NO: 1495148 - RNA, 19 nt, Homo sapiens
aagaggcuguggcagauag

SEQ ID NO: 1495149 - RNA, 19 nt, Homo sapiens
agaaauacaggcuugucaa

SEQ ID NO: 1495150 - RNA, 19 nt, Homo sapiens
cagaaauacaggcuuguca

SEQ ID NO: 1495151 - RNA, 19 nt, Homo sapiens
cccucaaacuggagagauu

SEQ ID NO: 1495152 - RNA, 19 nt, Homo sapiens
aagagaaucgacccucaaa

SEQ ID NO: 1495153 - RNA, 19 nt, Homo sapiens
gaaaauggaccuguucuac

SEQ ID NO: 1495154 - RNA, 19 nt, Homo sapiens
cuacauggacgccacuauc

SEQ ID NO: 1495155 - RNA, 19 nt, Homo sapiens
accaggcucugaccuaugu

SEQ ID NO: 1495156 - RNA, 19 nt, Homo sapiens
cagacacgguccugaucga

SEQ ID NO: 1495157 - RNA, 19 nt, Homo sapiens
acacagucuucgaauacau

SEQ ID NO: 1495158 - RNA, 19 nt, Homo sapiens
aagaauugauccagucacu

SEQ ID NO: 1495159 - RNA, 19 nt, Homo sapiens
cugacagccuccucaugaa

SEQ ID NO: 1495160 - RNA, 19 nt, Homo sapiens
aaugugcccaggauuguaa

SEQ ID NO: 1495161 - RNA, 19 nt, Homo sapiens
cggcugacucugagaagaa

SEQ ID NO: 1495162 - RNA, 19 nt, Homo sapiens
caaacuggagagauuuauc

SEQ ID NO: 1495163 - RNA, 19 nt, Homo sapiens
caucaagcagggcuggauu

SEQ ID NO: 1495164 - RNA, 19 nt, Homo sapiens
ccaauaaagccugcuggau

SEQ ID NO: 1495165 - RNA, 19 nt, Homo sapiens
auacacagucuucgaauac

SEQ ID NO: 1495166 - RNA, 19 nt, Homo sapiens
auagagacaacgacaaugu

SEQ ID NO: 1495167 - RNA, 19 nt, Homo sapiens
ugacuuggagcaguuguau

SEQ ID NO: 1495168 - RNA, 19 nt, Homo sapiens
gaaccgccugggcuacaau

SEQ ID NO: 1495169 - RNA, 19 nt, Homo sapiens
gagauggcaguuccugaca

SEQ ID NO: 1495170 - RNA, 19 nt, Homo sapiens
cagauaggaccacguuugg

SEQ ID NO: 1495171 - RNA, 19 nt, Homo sapiens
aaauacaggcuugucaaug

SEQ ID NO: 1495172 - RNA, 19 nt, Homo sapiens
gagaaacacuuuggacaau

SEQ ID NO: 1495173 - RNA, 19 nt, Homo sapiens
caagauggccgaauaggaa

SEQ ID NO: 1495174 - RNA, 19 nt, Homo sapiens
caaguucauucccagauuu

SEQ ID NO: 1495175 - RNA, 19 nt, Homo sapiens
ggacgaagccaaguucauu

SEQ ID NO: 1495176 - RNA, 19 nt, Homo sapiens
guacaucaccaucaucaaa

SEQ ID NO: 1495177 - RNA, 19 nt, Homo sapiens
agauuuggcuacacaauuu

SEQ ID NO: 1495178 - RNA, 19 nt, Homo sapiens
aguaaccucugcagacuua

SEQ ID NO: 1495179 - RNA, 19 nt, Homo sapiens
gcacagcagucugagauca

SEQ ID NO: 1495180 - RNA, 19 nt, Homo sapiens
gaaggcagagaaacacuuu

SEQ ID NO: 1495181 - RNA, 19 nt, Homo sapiens
gaacagcuccggucuacag

SEQ ID NO: 1495182 - RNA, 19 nt, Homo sapiens
ccaaguucauucccagauu

SEQ ID NO: 1495183 - RNA, 19 nt, Homo sapiens
gcagaagacgggugauuuc

SEQ ID NO: 1495184 - RNA, 19 nt, Homo sapiens
gaaacacuuuggacaaucg

SEQ ID NO: 1495185 - RNA, 19 nt, Homo sapiens
gcccaggcuugcuuaggua

SEQ ID NO: 1495186 - RNA, 19 nt, Homo sapiens
ggagggaggagccaagaug

SEQ ID NO: 1495187 - RNA, 19 nt, Homo sapiens
gcagggcacagacaaacaa

SEQ ID NO: 1495188 - RNA, 19 nt, Homo sapiens
ggcaggguauuccaacaga

SEQ ID NO: 1495189 - RNA, 19 nt, Homo sapiens
cagacugccuccucaagug

SEQ ID NO: 1495190 - RNA, 19 nt, Homo sapiens
ucugacagcuuugaagaga

SEQ ID NO: 1495191 - RNA, 19 nt, Homo sapiens
cugaggguccugucuguua

SEQ ID NO: 1495192 - RNA, 19 nt, Homo sapiens
gacgggugauuucugcauu

SEQ ID NO: 1495193 - RNA, 19 nt, Homo sapiens
aaggacaucuacaccgaaa

SEQ ID NO: 1495194 - RNA, 19 nt, Homo sapiens
ggaaggcagagaaacacuu

SEQ ID NO: 1495195 - RNA, 19 nt, Homo sapiens
cagauuuggcuacacaauu

SEQ ID NO: 1495196 - RNA, 19 nt, Homo sapiens
gaaacggcgcaccacaaga

SEQ ID NO: 1495197 - RNA, 19 nt, Homo sapiens
gaagcagggcgaggcauug

SEQ ID NO: 1495198 - RNA, 19 nt, Homo sapiens
ggacgcaccuggaaaaucg

SEQ ID NO: 1495199 - RNA, 19 nt, Homo sapiens
agagaaacacuuuggacaa

SEQ ID NO: 1495200 - RNA, 19 nt, Homo sapiens
aaaggaaggcagagaaaca

SEQ ID NO: 1495201 - RNA, 19 nt, Homo sapiens
gcgcaccacaagacuauau

SEQ ID NO: 1495202 - RNA, 19 nt, Homo sapiens
ggugauuucugcauuucca

SEQ ID NO: 1495203 - RNA, 19 nt, Homo sapiens
caaccagaaaggacaucua

SEQ ID NO: 1495204 - RNA, 19 nt, Homo sapiens
uaaacaaagcagccuggaa

SEQ ID NO: 1495205 - RNA, 19 nt, Homo sapiens
acagcagucugagaucaaa

SEQ ID NO: 1495206 - RNA, 19 nt, Homo sapiens
uuucagaccggcuuaagaa

SEQ ID NO: 1495207 - RNA, 19 nt, Homo sapiens
ggucacucccacccgaaua

SEQ ID NO: 1495208 - RNA, 19 nt, Homo sapiens
ccaagauggccgaauagga

SEQ ID NO: 1495209 - RNA, 19 nt, Homo sapiens
gaaaacccaucuguacauc

SEQ ID NO: 1495210 - RNA, 19 nt, Homo sapiens
aaacuaacaaccagaaagg

SEQ ID NO: 1495211 - RNA, 19 nt, Homo sapiens
uagcacagcagucugagau

SEQ ID NO: 1495212 - RNA, 19 nt, Homo sapiens
cgaagcagggcgaggcauu

SEQ ID NO: 1495213 - RNA, 19 nt, Homo sapiens
guagauaaaaccacaaaga

SEQ ID NO: 1495214 - RNA, 19 nt, Homo sapiens
acaucaccaucaucaaaga

SEQ ID NO: 1495215 - RNA, 19 nt, Homo sapiens
ggaaaacuaacaaccagaa

SEQ ID NO: 1495216 - RNA, 19 nt, Homo sapiens
guaccggguucaucucacu

SEQ ID NO: 1495217 - RNA, 19 nt, Homo sapiens
gaccaaaaguagauaaaac

SEQ ID NO: 1495218 - RNA, 19 nt, Homo sapiens
caucaaagaccaaaaguag

SEQ ID NO: 1495219 - RNA, 19 nt, Homo sapiens
ugaggguccugucuguuag

SEQ ID NO: 1495220 - RNA, 19 nt, Homo sapiens
gaauauugcgcuuuucaga

SEQ ID NO: 1495221 - RNA, 19 nt, Homo sapiens
agaaacacuuuggacaauc

SEQ ID NO: 1495222 - RNA, 19 nt, Homo sapiens
ugacggacgcaccuggaaa

SEQ ID NO: 1495223 - RNA, 19 nt, Homo sapiens
uuucugcauuuccaucuga

SEQ ID NO: 1495224 - RNA, 19 nt, Homo sapiens
cgacgccgaggcaguauuc

SEQ ID NO: 1495225 - RNA, 19 nt, Homo sapiens
aaacccaucuguacaucac

SEQ ID NO: 1495226 - RNA, 19 nt, Homo sapiens
gacgaagccaaguucauuc

SEQ ID NO: 1495227 - RNA, 19 nt, Homo sapiens
cagaccggcuuaagaaacg

SEQ ID NO: 1495228 - RNA, 19 nt, Homo sapiens
acgggugauuucugcauuu

SEQ ID NO: 1495229 - RNA, 19 nt, Homo sapiens
cgcagaagacgggugauuu

SEQ ID NO: 1495230 - RNA, 19 nt, Homo sapiens
cgacagcgaggaggacgaa

SEQ ID NO: 1495231 - RNA, 19 nt, Homo sapiens
gcccgacguucccucaagu

SEQ ID NO: 1495232 - RNA, 19 nt, Homo sapiens
ccagaaaggacaucuacac

SEQ ID NO: 1495233 - RNA, 19 nt, Homo sapiens
gaaggaaaacuaacaacca

SEQ ID NO: 1495234 - RNA, 19 nt, Homo sapiens
aggaacagcuccggucuac

SEQ ID NO: 1495235 - RNA, 19 nt, Homo sapiens
gaaaacuaacaaccagaaa

SEQ ID NO: 1495236 - RNA, 19 nt, Homo sapiens
ucccagauuuggcuacaca

SEQ ID NO: 1495237 - RNA, 19 nt, Homo sapiens
aagaaacggcgcaccacaa

SEQ ID NO: 1495238 - RNA, 19 nt, Homo sapiens
gaggagggaggagccaaga

SEQ ID NO: 1495239 - RNA, 19 nt, Homo sapiens
aaacggcgcaccacaagac

SEQ ID NO: 1495240 - RNA, 19 nt, Homo sapiens
gaguucccuuuccgaguca

SEQ ID NO: 1495241 - RNA, 19 nt, Homo sapiens
ugagguaccggguucaucu

SEQ ID NO: 1495242 - RNA, 19 nt, Homo sapiens
gcaaauagcuuacaaguug

SEQ ID NO: 1495243 - RNA, 19 nt, Homo sapiens
ggaaaucuaucccuacuga

SEQ ID NO: 1495244 - RNA, 19 nt, Homo sapiens
caacuuauguguucuugaa

SEQ ID NO: 1495245 - RNA, 19 nt, Homo sapiens
caucaaagguggacucaaa

SEQ ID NO: 1495246 - RNA, 19 nt, Homo sapiens
ggaaaugcaugcugaaauc

SEQ ID NO: 1495247 - RNA, 19 nt, Homo sapiens
gaaaccaucucaauaucuu

SEQ ID NO: 1495248 - RNA, 19 nt, Homo sapiens
gaauuggcaucuuuguaua

SEQ ID NO: 1495249 - RNA, 19 nt, Homo sapiens
gaacaaacuucagcaggaa

SEQ ID NO: 1495250 - RNA, 19 nt, Homo sapiens
ugaaagacuugcagaugua

SEQ ID NO: 1495251 - RNA, 19 nt, Homo sapiens
gaugaugagugcuuaguga

SEQ ID NO: 1495252 - RNA, 19 nt, Homo sapiens
gaauagaguugcugaaagg

SEQ ID NO: 1495253 - RNA, 19 nt, Homo sapiens
gcagagaauugccgggaaa

SEQ ID NO: 1495254 - RNA, 19 nt, Homo sapiens
caaggcaacuuauguguuc

SEQ ID NO: 1495255 - RNA, 19 nt, Homo sapiens
gcacaagaaguauuucaaa

SEQ ID NO: 1495256 - RNA, 19 nt, Homo sapiens
ggaacaacuacaaagauua

SEQ ID NO: 1495257 - RNA, 19 nt, Homo sapiens
gcaggcauauuacuauuca

SEQ ID NO: 1495258 - RNA, 19 nt, Homo sapiens
agacuacacuucagaauuc

SEQ ID NO: 1495259 - RNA, 19 nt, Homo sapiens
gccauaaaguuccuagaaa

SEQ ID NO: 1495260 - RNA, 19 nt, Homo sapiens
gaacuauguuacaaucaug

SEQ ID NO: 1495261 - RNA, 19 nt, Homo sapiens
gauguugccucaagaacuu

SEQ ID NO: 1495262 - RNA, 19 nt, Homo sapiens
caucuuaccugcccuggaa

SEQ ID NO: 1495263 - RNA, 19 nt, Homo sapiens
ggaauucuucuaugaguuu

SEQ ID NO: 1495264 - RNA, 19 nt, Homo sapiens
gaaggacgcuuuacaaacc

SEQ ID NO: 1495265 - RNA, 19 nt, Homo sapiens
gaacuugaaggauggaauu

SEQ ID NO: 1495266 - RNA, 19 nt, Homo sapiens
gagauuuacuguuggucua

SEQ ID NO: 1495267 - RNA, 19 nt, Homo sapiens
ucugagagauuuacuguug

SEQ ID NO: 1495268 - RNA, 19 nt, Homo sapiens
gcaacugagugaagaggaa

SEQ ID NO: 1495269 - RNA, 19 nt, Homo sapiens
ugaagaggcacaagaagua

SEQ ID NO: 1495270 - RNA, 19 nt, Homo sapiens
gaagaugccuuggaaacca

SEQ ID NO: 1495271 - RNA, 19 nt, Homo sapiens
uaaaggauguugccucaag

SEQ ID NO: 1495272 - RNA, 19 nt, Homo sapiens
caagaagaauggaaacagu

SEQ ID NO: 1495273 - RNA, 19 nt, Homo sapiens
caaccaagguggaucucaa

SEQ ID NO: 1495274 - RNA, 19 nt, Homo sapiens
ugaguucccugcuugguuu

SEQ ID NO: 1495275 - RNA, 19 nt, Homo sapiens
caaauuuacagacgccuua

SEQ ID NO: 1495276 - RNA, 19 nt, Homo sapiens
gaaauugacaaggccauaa

SEQ ID NO: 1495277 - RNA, 19 nt, Homo sapiens
ugcuauagauucaaccuua

SEQ ID NO: 1495278 - RNA, 19 nt, Homo sapiens
gaacaacuacaaagauuac

SEQ ID NO: 1495279 - RNA, 19 nt, Homo sapiens
gaaguaugaccacuaccua

SEQ ID NO: 1495280 - RNA, 19 nt, Homo sapiens
ggaggaauauggcgcucuu

SEQ ID NO: 1495281 - RNA, 19 nt, Homo sapiens
gcuuaaccaucuuagcuuu

SEQ ID NO: 1495282 - RNA, 19 nt, Homo sapiens
gaaagcugcacucacguuu

SEQ ID NO: 1495283 - RNA, 19 nt, Homo sapiens
gaaucuuucucaagucuuc

SEQ ID NO: 1495284 - RNA, 19 nt, Homo sapiens
caaauagcuuacaaguuga

SEQ ID NO: 1495285 - RNA, 19 nt, Homo sapiens
caagguggaucucaagagu

SEQ ID NO: 1495286 - RNA, 19 nt, Homo sapiens
ugugguaacuuuauucaga

SEQ ID NO: 1495287 - RNA, 19 nt, Homo sapiens
gagaaaaccuuccucagau

SEQ ID NO: 1495288 - RNA, 19 nt, Homo sapiens
ugaauuggcaucuuuguau

SEQ ID NO: 1495289 - RNA, 19 nt, Homo sapiens
gagaaugugguaacuuuau

SEQ ID NO: 1495290 - RNA, 19 nt, Homo sapiens
ucucaagucuucuuucuag

SEQ ID NO: 1495291 - RNA, 19 nt, Homo sapiens
gcugaacuauguuacaauc

SEQ ID NO: 1495292 - RNA, 19 nt, Homo sapiens
gcauauuacuauucagauc

SEQ ID NO: 1495293 - RNA, 19 nt, Homo sapiens
caaggaacaacuacaaaga

SEQ ID NO: 1495294 - RNA, 19 nt, Homo sapiens
ugacaaggccauaaaguuc

SEQ ID NO: 1495295 - RNA, 19 nt, Homo sapiens
acacaguuguagaaucuuu

SEQ ID NO: 1495296 - RNA, 19 nt, Homo sapiens
cucaauaucuucucacuca

SEQ ID NO: 1495297 - RNA, 19 nt, Homo sapiens
cagcaggaauucuucuaug

SEQ ID NO: 1495298 - RNA, 19 nt, Homo sapiens
gaaagacuugcagauguaa

SEQ ID NO: 1495299 - RNA, 19 nt, Homo sapiens
gcuauagauucaaccuuau

SEQ ID NO: 1495300 - RNA, 19 nt, Homo sapiens
aggaacaacuacaaagauu

SEQ ID NO: 1495301 - RNA, 19 nt, Homo sapiens
cgaauagaguugcugaaag

SEQ ID NO: 1495302 - RNA, 19 nt, Homo sapiens
uuacagacgccuuagaauu

SEQ ID NO: 1495303 - RNA, 19 nt, Homo sapiens
gaugagugcuuagugaagu

SEQ ID NO: 1495304 - RNA, 19 nt, Homo sapiens
ucagacagguggacagcuu

SEQ ID NO: 1495305 - RNA, 19 nt, Homo sapiens
gcaaggaacaacuacaaag

SEQ ID NO: 1495306 - RNA, 19 nt, Homo sapiens
ggaaauugacaaggccaua

SEQ ID NO: 1495307 - RNA, 19 nt, Homo sapiens
cagcaaggauuaucagacu

SEQ ID NO: 1495308 - RNA, 19 nt, Homo sapiens
ccgagugucuccuacagaa

SEQ ID NO: 1495309 - RNA, 19 nt, Homo sapiens
gaggaucccuggagcaacu

SEQ ID NO: 1495310 - RNA, 19 nt, Homo sapiens
augagaaugugguaacuuu

SEQ ID NO: 1495311 - RNA, 19 nt, Homo sapiens
uuacaucucccuaauacuu

SEQ ID NO: 1495312 - RNA, 19 nt, Homo sapiens
uacagacgccuuagaauug

SEQ ID NO: 1495313 - RNA, 19 nt, Homo sapiens
caagaguggccucgaagaa

SEQ ID NO: 1495314 - RNA, 19 nt, Homo sapiens
ucagauugaucagaacuug

SEQ ID NO: 1495315 - RNA, 19 nt, Homo sapiens
ccauaaaguuccuagaaac

SEQ ID NO: 1495316 - RNA, 19 nt, Homo sapiens
cuugcaagcugaacuaugu

SEQ ID NO: 1495317 - RNA, 19 nt, Homo sapiens
ucacguuugugcaggauga

SEQ ID NO: 1495318 - RNA, 19 nt, Homo sapiens
ggagaaaaccuuccucaga

SEQ ID NO: 1495319 - RNA, 19 nt, Homo sapiens
ggccauaaaguuccuagaa

SEQ ID NO: 1495320 - RNA, 19 nt, Homo sapiens
acaagcagccuucacuuug

SEQ ID NO: 1495321 - RNA, 19 nt, Homo sapiens
gcuguggcauugaacuuau

SEQ ID NO: 1495322 - RNA, 19 nt, Homo sapiens
gcucuucaccucuggagaa

SEQ ID NO: 1495323 - RNA, 19 nt, Homo sapiens
auucagaucugcuuugcaa

SEQ ID NO: 1495324 - RNA, 19 nt, Homo sapiens
uuucgaagaugccuuggaa

SEQ ID NO: 1495325 - RNA, 19 nt, Homo sapiens
agaguggccucgaagaaug

SEQ ID NO: 1495326 - RNA, 19 nt, Homo sapiens
uugaaagacuugcagaugu

SEQ ID NO: 1495327 - RNA, 19 nt, Homo sapiens
gaagaggcacaagaaguau

SEQ ID NO: 1495328 - RNA, 19 nt, Homo sapiens
gcaguggggccuuuaauuu

SEQ ID NO: 1495329 - RNA, 19 nt, Homo sapiens
aaagguggacucaaaauua

SEQ ID NO: 1495330 - RNA, 19 nt, Homo sapiens
ggaaaccaucucaauaucu

SEQ ID NO: 1495331 - RNA, 19 nt, Homo sapiens
gaggaaggcucggcguuac

SEQ ID NO: 1495332 - RNA, 19 nt, Homo sapiens
gcaacaagcagccuucacu

SEQ ID NO: 1495333 - RNA, 19 nt, Homo sapiens
ugucagcaguucaucauca

SEQ ID NO: 1495334 - RNA, 19 nt, Homo sapiens
caggaauucuucuaugagu

SEQ ID NO: 1495335 - RNA, 19 nt, Homo sapiens
aaacugcaaggaacaacua

SEQ ID NO: 1495336 - RNA, 19 nt, Homo sapiens
gaauugccgggaaaucuau

SEQ ID NO: 1495337 - RNA, 19 nt, Homo sapiens
gaaugagaaugugguaacu

SEQ ID NO: 1495338 - RNA, 19 nt, Homo sapiens
auacuuacaucucccuaau

SEQ ID NO: 1495339 - RNA, 19 nt, Homo sapiens
aagcugcacucacguuugu

SEQ ID NO: 1495340 - RNA, 19 nt, Homo sapiens
gggcuaaggagaguaugua

SEQ ID NO: 1495341 - RNA, 19 nt, Homo sapiens
ggcauucuauauuaucuag

SEQ ID NO: 1495342 - RNA, 19 nt, Homo sapiens
gaagaagacugcuuuaguu

SEQ ID NO: 1495343 - RNA, 19 nt, Homo sapiens
ucucagagcuucacaauaa

SEQ ID NO: 1495344 - RNA, 19 nt, Homo sapiens
gcucagauauguuaaguaa

SEQ ID NO: 1495345 - RNA, 19 nt, Homo sapiens
gaagacugcuuuaguuuau

SEQ ID NO: 1495346 - RNA, 19 nt, Homo sapiens
gaagugcucagauauguua

SEQ ID NO: 1495347 - RNA, 19 nt, Homo sapiens
ggagguaccuugacccaaa

SEQ ID NO: 1495348 - RNA, 19 nt, Homo sapiens
gaggaugaaugauggauuu

SEQ ID NO: 1495349 - RNA, 19 nt, Homo sapiens
caacuggccugaagcauug

SEQ ID NO: 1495350 - RNA, 19 nt, Homo sapiens
ggagacaggugaagaugga

SEQ ID NO: 1495351 - RNA, 19 nt, Homo sapiens
ccugagagcucuaaccaaa

SEQ ID NO: 1495352 - RNA, 19 nt, Homo sapiens
ggaagggaguacucagaaa

SEQ ID NO: 1495353 - RNA, 19 nt, Homo sapiens
gagcaagacuccaucucaa

SEQ ID NO: 1495354 - RNA, 19 nt, Homo sapiens
ggccaucaaucaaguguuu

SEQ ID NO: 1495355 - RNA, 19 nt, Homo sapiens
agaagaaggugacauuuca

SEQ ID NO: 1495356 - RNA, 19 nt, Homo sapiens
ggaaaaggcuauauucuuc

SEQ ID NO: 1495357 - RNA, 19 nt, Homo sapiens
cagcaaacguuuccugaga

SEQ ID NO: 1495358 - RNA, 19 nt, Homo sapiens
gaaaccucgucucuacuaa

SEQ ID NO: 1495359 - RNA, 19 nt, Homo sapiens
cacaggaagugcucagaua

SEQ ID NO: 1495360 - RNA, 19 nt, Homo sapiens
ggaacucaguggaauuaug

SEQ ID NO: 1495361 - RNA, 19 nt, Homo sapiens
ggaaaggacagaggacuaa

SEQ ID NO: 1495362 - RNA, 19 nt, Homo sapiens
ccaagacuauguaucgauu

SEQ ID NO: 1495363 - RNA, 19 nt, Homo sapiens
ggugaaaccucgucucuac

SEQ ID NO: 1495364 - RNA, 19 nt, Homo sapiens
ugagagcucuaaccaaaga

SEQ ID NO: 1495365 - RNA, 19 nt, Homo sapiens
guaccugacuccugacuca

SEQ ID NO: 1495366 - RNA, 19 nt, Homo sapiens
aggaauacauggucagaaa

SEQ ID NO: 1495367 - RNA, 19 nt, Homo sapiens
gcagugagccgagauuuca

SEQ ID NO: 1495368 - RNA, 19 nt, Homo sapiens
uagacuggcuggacagauu

SEQ ID NO: 1495369 - RNA, 19 nt, Homo sapiens
gugaaacccuucucuacug

SEQ ID NO: 1495370 - RNA, 19 nt, Homo sapiens
ggaauuaugggccuaagau

SEQ ID NO: 1495371 - RNA, 19 nt, Homo sapiens
aaacagagacacugggaaa

SEQ ID NO: 1495372 - RNA, 19 nt, Homo sapiens
gaacucaguggaauuaugg

SEQ ID NO: 1495373 - RNA, 19 nt, Homo sapiens
ggaucugccucacuggauu

SEQ ID NO: 1495374 - RNA, 19 nt, Homo sapiens
ggacagauucgaagguugu

SEQ ID NO: 1495375 - RNA, 19 nt, Homo sapiens
caaagaaggaauuaaguag

SEQ ID NO: 1495376 - RNA, 19 nt, Homo sapiens
agaagacugcuuuaguuua

SEQ ID NO: 1495377 - RNA, 19 nt, Homo sapiens
ugaaacccuucucuacuga

SEQ ID NO: 1495378 - RNA, 19 nt, Homo sapiens
ccacuuacuuagagacuca

SEQ ID NO: 1495379 - RNA, 19 nt, Homo sapiens
uugauauccuguccacuua

SEQ ID NO: 1495380 - RNA, 19 nt, Homo sapiens
ggaccaagacuauguaucg

SEQ ID NO: 1495381 - RNA, 19 nt, Homo sapiens
gcaagaaggcauccuagag

SEQ ID NO: 1495382 - RNA, 19 nt, Homo sapiens
gaagagugugugaggauga

SEQ ID NO: 1495383 - RNA, 19 nt, Homo sapiens
cuaguuaccuguuagacau

SEQ ID NO: 1495384 - RNA, 19 nt, Homo sapiens
gugcgugccuguagucuca

SEQ ID NO: 1495385 - RNA, 19 nt, Homo sapiens
gcaggagaaucacuugaac

SEQ ID NO: 1495386 - RNA, 19 nt, Homo sapiens
ugucagggaccacauuuaa

SEQ ID NO: 1495387 - RNA, 19 nt, Homo sapiens
ucggugggcuuguggauga

SEQ ID NO: 1495388 - RNA, 19 nt, Homo sapiens
ugaaaccucgucucuacua

SEQ ID NO: 1495389 - RNA, 19 nt, Homo sapiens
ugaggugaguggauuacaa

SEQ ID NO: 1495390 - RNA, 19 nt, Homo sapiens
ucacuggauucacaacaga

SEQ ID NO: 1495391 - RNA, 19 nt, Homo sapiens
gcaaagaagagcaaaagaa

SEQ ID NO: 1495392 - RNA, 19 nt, Homo sapiens
aaacccuucucuacugaaa

SEQ ID NO: 1495393 - RNA, 19 nt, Homo sapiens
gaauuaugggccuaagauu

SEQ ID NO: 1495394 - RNA, 19 nt, Homo sapiens
gaguaugacccacuacaug

SEQ ID NO: 1495395 - RNA, 19 nt, Homo sapiens
gaagggaguacucagaaag

SEQ ID NO: 1495396 - RNA, 19 nt, Homo sapiens
gcuugccaauccaggaaua

SEQ ID NO: 1495397 - RNA, 19 nt, Homo sapiens
caacagacaguccccuuua

SEQ ID NO: 1495398 - RNA, 19 nt, Homo sapiens
caaagaagagcaaaagaaa

SEQ ID NO: 1495399 - RNA, 19 nt, Homo sapiens
gcacauaggcaagugucuu

SEQ ID NO: 1495400 - RNA, 19 nt, Homo sapiens
aaaggaguuucuucaggaa

SEQ ID NO: 1495401 - RNA, 19 nt, Homo sapiens
uauccuguccacuuacuua

SEQ ID NO: 1495402 - RNA, 19 nt, Homo sapiens
gaagaaggugacauuucaa

SEQ ID NO: 1495403 - RNA, 19 nt, Homo sapiens
ggaucagucugguggaaag

SEQ ID NO: 1495404 - RNA, 19 nt, Homo sapiens
gagcuucacaauaauguca

SEQ ID NO: 1495405 - RNA, 19 nt, Homo sapiens
gccguaaugccaacacuuu

SEQ ID NO: 1495406 - RNA, 19 nt, Homo sapiens
cagaagaaggugacauuuc

SEQ ID NO: 1495407 - RNA, 19 nt, Homo sapiens
auucgaagguuguaugguu

SEQ ID NO: 1495408 - RNA, 19 nt, Homo sapiens
gccaaacacucaggaccaa

SEQ ID NO: 1495409 - RNA, 19 nt, Homo sapiens
gauacuggccaucaaucaa

SEQ ID NO: 1495410 - RNA, 19 nt, Homo sapiens
cagagauacuggccaucaa

SEQ ID NO: 1495411 - RNA, 19 nt, Homo sapiens
agaagaagacugcuuuagu

SEQ ID NO: 1495412 - RNA, 19 nt, Homo sapiens
cccacuacaugucaaagaa

SEQ ID NO: 1495413 - RNA, 19 nt, Homo sapiens
aagacuauguaucgauuug

SEQ ID NO: 1495414 - RNA, 19 nt, Homo sapiens
caaacacucaggaccaaga

SEQ ID NO: 1495415 - RNA, 19 nt, Homo sapiens
aagaagacugcuuuaguuu

SEQ ID NO: 1495416 - RNA, 19 nt, Homo sapiens
gcaaaagaaagcaagaaaa

SEQ ID NO: 1495417 - RNA, 19 nt, Homo sapiens
uaacagaagaagacugcuu

SEQ ID NO: 1495418 - RNA, 19 nt, Homo sapiens
gaccaagacuauguaucga

SEQ ID NO: 1495419 - RNA, 19 nt, Homo sapiens
ggaagugcucagauauguu

SEQ ID NO: 1495420 - RNA, 19 nt, Homo sapiens
ugcaugacaucuucucaga

SEQ ID NO: 1495421 - RNA, 19 nt, Homo sapiens
uguaucgauuugaguauga

SEQ ID NO: 1495422 - RNA, 19 nt, Homo sapiens
cacauaggcaagugucuuu

SEQ ID NO: 1495423 - RNA, 19 nt, Homo sapiens
ggcaggagaaucacuugaa

SEQ ID NO: 1495424 - RNA, 19 nt, Homo sapiens
acaacuggccugaagcauu

SEQ ID NO: 1495425 - RNA, 19 nt, Homo sapiens
gauauccuguccacuuacu

SEQ ID NO: 1495426 - RNA, 19 nt, Homo sapiens
aggaagugcucagauaugu

SEQ ID NO: 1495427 - RNA, 19 nt, Homo sapiens
gcaagacuccaucucaaaa

SEQ ID NO: 1495428 - RNA, 19 nt, Homo sapiens
ucggaacucaguggaauua

SEQ ID NO: 1495429 - RNA, 19 nt, Homo sapiens
agacauaacagaagaagac

SEQ ID NO: 1495430 - RNA, 19 nt, Homo sapiens
aagaaggaauuaaguagac

SEQ ID NO: 1495431 - RNA, 19 nt, Homo sapiens
ugacagagcaagacuccau

SEQ ID NO: 1495432 - RNA, 19 nt, Homo sapiens
gcuuccagcuucugcagau

SEQ ID NO: 1495433 - RNA, 19 nt, Homo sapiens
ccuguaaucccagcacuuu

SEQ ID NO: 1495434 - RNA, 19 nt, Homo sapiens
gagguaccuugacccaaag

SEQ ID NO: 1495435 - RNA, 19 nt, Homo sapiens
gaacucgggaggcgaaggu

SEQ ID NO: 1495436 - RNA, 19 nt, Homo sapiens
ccugaagcauugaagaaag

SEQ ID NO: 1495437 - RNA, 19 nt, Homo sapiens
ggccugaagcauugaagaa

SEQ ID NO: 1495438 - RNA, 19 nt, Homo sapiens
acucacaacuggccugaag

SEQ ID NO: 1495439 - RNA, 19 nt, Homo sapiens
cuauguaucgauuugagua

SEQ ID NO: 1495440 - RNA, 19 nt, Homo sapiens
gcgcuuggagguaccuuga

SEQ ID NO: 1495441 - RNA, 19 nt, Homo sapiens
gcauugaagaaaggaguuu

SEQ ID NO: 1495442 - RNA, 19 nt, Homo sapiens
gggcagagcuccagcaaga

SEQ ID NO: 1495443 - RNA, 19 nt, Homo sapiens
gcgaagggccuacucauua

SEQ ID NO: 1495444 - RNA, 19 nt, Homo sapiens
agaaaggacucuacaucaa

SEQ ID NO: 1495445 - RNA, 19 nt, Homo sapiens
gagaaaggacucuacauca

SEQ ID NO: 1495446 - RNA, 19 nt, Homo sapiens
ggacgaggaugcccugaag

SEQ ID NO: 1495447 - RNA, 19 nt, Homo sapiens
gaaguuccaccaagacuga

SEQ ID NO: 1495448 - RNA, 19 nt, Homo sapiens
agacugagaugucggcuau

SEQ ID NO: 1495449 - RNA, 19 nt, Homo sapiens
aagaggaacuccagcaaga

SEQ ID NO: 1495450 - RNA, 19 nt, Homo sapiens
ggagaaaggacucuacauc

SEQ ID NO: 1495451 - RNA, 19 nt, Homo sapiens
ggaccucaccuacuaugaa

SEQ ID NO: 1495452 - RNA, 19 nt, Homo sapiens
gcagagcuccagcgagauu

SEQ ID NO: 1495453 - RNA, 19 nt, Homo sapiens
ggacccagcccaagucuca

SEQ ID NO: 1495454 - RNA, 19 nt, Homo sapiens
ccaggaugcugcuccagaa

SEQ ID NO: 1495455 - RNA, 19 nt, Homo sapiens
ccaccaagacugaggcuuu

SEQ ID NO: 1495456 - RNA, 19 nt, Homo sapiens
gggccagacucuacaacuu

SEQ ID NO: 1495457 - RNA, 19 nt, Homo sapiens
ggcaugagcucaacuucca

SEQ ID NO: 1495458 - RNA, 19 nt, Homo sapiens
gaaggggccucaugacaga

SEQ ID NO: 1495459 - RNA, 19 nt, Homo sapiens
gaacaacagggaggcacua

SEQ ID NO: 1495460 - RNA, 19 nt, Homo sapiens
ccaaagccaugggugauuc

SEQ ID NO: 1495461 - RNA, 19 nt, Homo sapiens
gaaaggacucuacaucaac

SEQ ID NO: 1495462 - RNA, 19 nt, Homo sapiens
ggccagacucuacaacuuu

SEQ ID NO: 1495463 - RNA, 19 nt, Homo sapiens
cagcugaguuuauuauacu

SEQ ID NO: 1495464 - RNA, 19 nt, Homo sapiens
ccacagcugaguuuauuau

SEQ ID NO: 1495465 - RNA, 19 nt, Homo sapiens
ggaugcugcuccagaagau

SEQ ID NO: 1495466 - RNA, 19 nt, Homo sapiens
ucccacagcugaguuuauu

SEQ ID NO: 1495467 - RNA, 19 nt, Homo sapiens
gcaagaccaaggccacuau

SEQ ID NO: 1495468 - RNA, 19 nt, Homo sapiens
cgaagggccuacucauuac

SEQ ID NO: 1495469 - RNA, 19 nt, Homo sapiens
gaccucaccuacuaugaag

SEQ ID NO: 1495470 - RNA, 19 nt, Homo sapiens
aggcggaacuccagcaaga

SEQ ID NO: 1495471 - RNA, 19 nt, Homo sapiens
aggcggaacuccagcaaga

SEQ ID NO: 1495472 - RNA, 19 nt, Homo sapiens
ccgaggcgauugcuucuuc

SEQ ID NO: 1495473 - RNA, 19 nt, Homo sapiens
cuacagggacaaugccuuu

SEQ ID NO: 1495474 - RNA, 19 nt, Homo sapiens
ccaaaggucacaggguuaa

SEQ ID NO: 1495475 - RNA, 19 nt, Homo sapiens
caaggcagaggcccagaaa

SEQ ID NO: 1495476 - RNA, 19 nt, Homo sapiens
gauccugcagcacaucuuu

SEQ ID NO: 1495477 - RNA, 19 nt, Homo sapiens
ggcaagagccagggcauga

SEQ ID NO: 1495478 - RNA, 19 nt, Homo sapiens
caaggccacuauacacaag

SEQ ID NO: 1495479 - RNA, 19 nt, Homo sapiens
caagaccaaggccacuaua

SEQ ID NO: 1495480 - RNA, 19 nt, Homo sapiens
gggacgagcagcaggagaa

SEQ ID NO: 1495481 - RNA, 19 nt, Homo sapiens
ugaaggugcuggacauggu

SEQ ID NO: 1495482 - RNA, 19 nt, Homo sapiens
gccagacucuacaacuuuc

SEQ ID NO: 1495483 - RNA, 19 nt, Homo sapiens
ccacuguccugcuccucaa

SEQ ID NO: 1495484 - RNA, 19 nt, Homo sapiens
gcagugugccuuccuggau

SEQ ID NO: 1495485 - RNA, 19 nt, Homo sapiens
aucaggaccucaccuacua

SEQ ID NO: 1495486 - RNA, 19 nt, Homo sapiens
ggacugcuccgaaguucca

SEQ ID NO: 1495487 - RNA, 19 nt, Homo sapiens
gguggacuucuaugccuua

SEQ ID NO: 1495488 - RNA, 19 nt, Homo sapiens
cagcccaagucucagcaaa

SEQ ID NO: 1495489 - RNA, 19 nt, Homo sapiens
aggaugcccugaagguuga

SEQ ID NO: 1495490 - RNA, 19 nt, Homo sapiens
ucaaagucagggaauacua

SEQ ID NO: 1495491 - RNA, 19 nt, Homo sapiens
uccagacccucccuucuug

SEQ ID NO: 1495492 - RNA, 19 nt, Homo sapiens
gaaaccaugcuuccguuac

SEQ ID NO: 1495493 - RNA, 19 nt, Homo sapiens
gaucaggaccucaccuacu

SEQ ID NO: 1495494 - RNA, 19 nt, Homo sapiens
gcugaugaccaaccucuuc

SEQ ID NO: 1495495 - RNA, 19 nt, Homo sapiens
cccagaaggcccaguacua

SEQ ID NO: 1495496 - RNA, 19 nt, Homo sapiens
caccaagacugaggcuuuc

SEQ ID NO: 1495497 - RNA, 19 nt, Homo sapiens
ccacuauacacaagaggaa

SEQ ID NO: 1495498 - RNA, 19 nt, Homo sapiens
ccaaggccacuauacacaa

SEQ ID NO: 1495499 - RNA, 19 nt, Homo sapiens
caacagggaggcacuaagc

SEQ ID NO: 1495500 - RNA, 19 nt, Homo sapiens
ggacgagcagcaggagaaa

SEQ ID NO: 1495501 - RNA, 19 nt, Homo sapiens
acagcugaguuuauuauac

SEQ ID NO: 1495502 - RNA, 19 nt, Homo sapiens
gcagagccuuagcaagacu

SEQ ID NO: 1495503 - RNA, 19 nt, Homo sapiens
gcuuaaacggcacgaguug

SEQ ID NO: 1495504 - RNA, 19 nt, Homo sapiens
caaagucagggaauacuac

SEQ ID NO: 1495505 - RNA, 19 nt, Homo sapiens
ggagacccagcaagguuga

SEQ ID NO: 1495506 - RNA, 19 nt, Homo sapiens
caccaacgccgaugucuac

SEQ ID NO: 1495507 - RNA, 19 nt, Homo sapiens
gagcccagcaagaccaaga

SEQ ID NO: 1495508 - RNA, 19 nt, Homo sapiens
gcagagcuccagcaagacu

SEQ ID NO: 1495509 - RNA, 19 nt, Homo sapiens
caagguggcgucccugucu

SEQ ID NO: 1495510 - RNA, 19 nt, Homo sapiens
ccaccaacgccgaugucua

SEQ ID NO: 1495511 - RNA, 19 nt, Homo sapiens
uggaugcccugaaugucuu

SEQ ID NO: 1495512 - RNA, 19 nt, Homo sapiens
caaacuggagccucagcaa

SEQ ID NO: 1495513 - RNA, 19 nt, Homo sapiens
ccagaaggcccaguacuac

SEQ ID NO: 1495514 - RNA, 19 nt, Homo sapiens
gcgugcugcugcugaacaa

SEQ ID NO: 1495515 - RNA, 19 nt, Homo sapiens
gcugaccuacaacgacuuu

SEQ ID NO: 1495516 - RNA, 19 nt, Homo sapiens
ggaccacaggcaccucaga

SEQ ID NO: 1495517 - RNA, 19 nt, Homo sapiens
gcgccuugcuguugaaucc

SEQ ID NO: 1495518 - RNA, 19 nt, Homo sapiens
agaaaccaugcuuccguua

SEQ ID NO: 1495519 - RNA, 19 nt, Homo sapiens
cuacuaugaagcugucuga

SEQ ID NO: 1495520 - RNA, 19 nt, Homo sapiens
cuccgaaguuccaccaaga

SEQ ID NO: 1495521 - RNA, 19 nt, Homo sapiens
ggaacuccagcaagaccaa

SEQ ID NO: 1495522 - RNA, 19 nt, Homo sapiens
ggaacuccagcaagaccaa

SEQ ID NO: 1495523 - RNA, 19 nt, Homo sapiens
gaagggccuacucauuaca

SEQ ID NO: 1495524 - RNA, 19 nt, Homo sapiens
gcaauuaaaagucuuagca

SEQ ID NO: 1495525 - RNA, 19 nt, Homo sapiens
gaccaaggccacccaaagc

SEQ ID NO: 1495526 - RNA, 19 nt, Homo sapiens
agaccaaggccacuauaca

SEQ ID NO: 1495527 - RNA, 19 nt, Homo sapiens
ucagagcucauaccuagca

SEQ ID NO: 1495528 - RNA, 19 nt, Homo sapiens
gcaaaacugagguugauca

SEQ ID NO: 1495529 - RNA, 19 nt, Homo sapiens
cagcaaaacugagguugau

SEQ ID NO: 1495530 - RNA, 19 nt, Homo sapiens
cacagcugguggacuucua

SEQ ID NO: 1495531 - RNA, 19 nt, Homo sapiens
gaccaaggccacuauacac

SEQ ID NO: 1495532 - RNA, 19 nt, Homo sapiens
gccgugacauucucugacu

SEQ ID NO: 1495533 - RNA, 19 nt, Homo sapiens
gaaggccaccccugagauu

SEQ ID NO: 1495534 - RNA, 19 nt, Homo sapiens
gccucacgcucaucaccaa

SEQ ID NO: 1495535 - RNA, 19 nt, Homo sapiens
gcaggcagacugggagaca

SEQ ID NO: 1495536 - RNA, 19 nt, Homo sapiens
caaggcaggagcccagcaa

SEQ ID NO: 1495537 - RNA, 19 nt, Homo sapiens
uuaaacggcacgaguugga

SEQ ID NO: 1495538 - RNA, 19 nt, Homo sapiens
ccagccacguguuccaaag

SEQ ID NO: 1495539 - RNA, 19 nt, Homo sapiens
ggcgcaagcaguuccagaa

SEQ ID NO: 1495540 - RNA, 19 nt, Homo sapiens
uggagcgccucaccuuugu

SEQ ID NO: 1495541 - RNA, 19 nt, Homo sapiens
gcaggagaaaggacucuac

SEQ ID NO: 1495542 - RNA, 19 nt, Homo sapiens
auacugagguucaccaaua

SEQ ID NO: 1495543 - RNA, 19 nt, Homo sapiens
ggccacagcugguuucuau

SEQ ID NO: 1495544 - RNA, 19 nt, Homo sapiens
ccacaugccugaguaagaa

SEQ ID NO: 1495545 - RNA, 19 nt, Homo sapiens
gaugagggcuugcuccaau

SEQ ID NO: 1495546 - RNA, 19 nt, Homo sapiens
ggaagcagguagcugaaug

SEQ ID NO: 1495547 - RNA, 19 nt, Homo sapiens
cuagagaagucacuccuuu

SEQ ID NO: 1495548 - RNA, 19 nt, Homo sapiens
gaaggacagucuauucaag

SEQ ID NO: 1495549 - RNA, 19 nt, Homo sapiens
gaauacagaacguguuuga

SEQ ID NO: 1495550 - RNA, 19 nt, Homo sapiens
ggacugccaccuccguuua

SEQ ID NO: 1495551 - RNA, 19 nt, Homo sapiens
ccaaauauccuccaagauc

SEQ ID NO: 1495552 - RNA, 19 nt, Homo sapiens
gaacguguuugaugcaucu

SEQ ID NO: 1495553 - RNA, 19 nt, Homo sapiens
gaacagugaaggagcaaga

SEQ ID NO: 1495554 - RNA, 19 nt, Homo sapiens
agaagucacuccuuuguuc

SEQ ID NO: 1495555 - RNA, 19 nt, Homo sapiens
caaauauccuccaagaucu

SEQ ID NO: 1495556 - RNA, 19 nt, Homo sapiens
gcaccuguccacacuagua

SEQ ID NO: 1495557 - RNA, 19 nt, Homo sapiens
gaucugacagugaauaaga

SEQ ID NO: 1495558 - RNA, 19 nt, Homo sapiens
ucaauugucugaagauucu

SEQ ID NO: 1495559 - RNA, 19 nt, Homo sapiens
ccaauauggugaacucuuc

SEQ ID NO: 1495560 - RNA, 19 nt, Homo sapiens
ggaaugaaagaccaaauca

SEQ ID NO: 1495561 - RNA, 19 nt, Homo sapiens
uacauaugcuuaccacgua

SEQ ID NO: 1495562 - RNA, 19 nt, Homo sapiens
caacgaacccuccagcaau

SEQ ID NO: 1495563 - RNA, 19 nt, Homo sapiens
ccugagaucugacagugaa

SEQ ID NO: 1495564 - RNA, 19 nt, Homo sapiens
ugaaaggccaugauacuga

SEQ ID NO: 1495565 - RNA, 19 nt, Homo sapiens
ccacagcugguuucuauug

SEQ ID NO: 1495566 - RNA, 19 nt, Homo sapiens
gguguggcuucuucucuaa

SEQ ID NO: 1495567 - RNA, 19 nt, Homo sapiens
ggaaggacagucuauucaa

SEQ ID NO: 1495568 - RNA, 19 nt, Homo sapiens
cgacacacauacaaacaca

SEQ ID NO: 1495569 - RNA, 19 nt, Homo sapiens
cagaagaccugggcacauc

SEQ ID NO: 1495570 - RNA, 19 nt, Homo sapiens
gcccacaacaggacgaaua

SEQ ID NO: 1495571 - RNA, 19 nt, Homo sapiens
ccaaugagguaaccagcau

SEQ ID NO: 1495572 - RNA, 19 nt, Homo sapiens
gaagccagaucuccugacu

SEQ ID NO: 1495573 - RNA, 19 nt, Homo sapiens
ugccagaucugccaugaug

SEQ ID NO: 1495574 - RNA, 19 nt, Homo sapiens
aaaggauucuggucaagga

SEQ ID NO: 1495575 - RNA, 19 nt, Homo sapiens
gcaaaggauucuggucaag

SEQ ID NO: 1495576 - RNA, 19 nt, Homo sapiens
gaacaggaagauggugaaa

SEQ ID NO: 1495577 - RNA, 19 nt, Homo sapiens
uccaauggcuguuucuguu

SEQ ID NO: 1495578 - RNA, 19 nt, Homo sapiens
gagaucugacagugaauaa

SEQ ID NO: 1495579 - RNA, 19 nt, Homo sapiens
ggacuggaauacagaacgu

SEQ ID NO: 1495580 - RNA, 19 nt, Homo sapiens
auaccugggugcagaguuu

SEQ ID NO: 1495581 - RNA, 19 nt, Homo sapiens
acaggaagauggugaaagg

SEQ ID NO: 1495582 - RNA, 19 nt, Homo sapiens
cacauucccucccuugguu

SEQ ID NO: 1495583 - RNA, 19 nt, Homo sapiens
gcauugaucccgccuccaa

SEQ ID NO: 1495584 - RNA, 19 nt, Homo sapiens
ucacuccuuuguucaagaa

SEQ ID NO: 1495585 - RNA, 19 nt, Homo sapiens
gaugccagaucugccauga

SEQ ID NO: 1495586 - RNA, 19 nt, Homo sapiens
ccagggccauggaagaguu

SEQ ID NO: 1495587 - RNA, 19 nt, Homo sapiens
gaaagaggaagggcuaagu

SEQ ID NO: 1495588 - RNA, 19 nt, Homo sapiens
ggccugcaauguacauaug

SEQ ID NO: 1495589 - RNA, 19 nt, Homo sapiens
gggaaggacagucuauuca

SEQ ID NO: 1495590 - RNA, 19 nt, Homo sapiens
aaacggaaagcccucauga

SEQ ID NO: 1495591 - RNA, 19 nt, Homo sapiens
ggaaugagacaagaugaca

SEQ ID NO: 1495592 - RNA, 19 nt, Homo sapiens
ucuugcaggugggaaauua

SEQ ID NO: 1495593 - RNA, 19 nt, Homo sapiens
auacagaacguguuugaug

SEQ ID NO: 1495594 - RNA, 19 nt, Homo sapiens
gagaagucacuccuuuguu

SEQ ID NO: 1495595 - RNA, 19 nt, Homo sapiens
gcacaucugggacuggaau

SEQ ID NO: 1495596 - RNA, 19 nt, Homo sapiens
cuccaaauauccuccaaga

SEQ ID NO: 1495597 - RNA, 19 nt, Homo sapiens
gagccagaguaccaggaaa

SEQ ID NO: 1495598 - RNA, 19 nt, Homo sapiens
ccagaucuccugacuccaa

SEQ ID NO: 1495599 - RNA, 19 nt, Homo sapiens
ggccaggcauccauuccaa

SEQ ID NO: 1495600 - RNA, 19 nt, Homo sapiens
acacauacaaacacaaaug

SEQ ID NO: 1495601 - RNA, 19 nt, Homo sapiens
acacacauacaaacacaaa

SEQ ID NO: 1495602 - RNA, 19 nt, Homo sapiens
uuugugagcucauaguuag

SEQ ID NO: 1495603 - RNA, 19 nt, Homo sapiens
gaagucacuccuuuguuca

SEQ ID NO: 1495604 - RNA, 19 nt, Homo sapiens
ggucaccacauaguaauga

SEQ ID NO: 1495605 - RNA, 19 nt, Homo sapiens
ccuccaagaucuagagaag

SEQ ID NO: 1495606 - RNA, 19 nt, Homo sapiens
gaacucuuccggccagcaa

SEQ ID NO: 1495607 - RNA, 19 nt, Homo sapiens
gcugguuucuauugcauca

SEQ ID NO: 1495608 - RNA, 19 nt, Homo sapiens
ggaacaggaagauggugaa

SEQ ID NO: 1495609 - RNA, 19 nt, Homo sapiens
ccaauggcuguuucuguuu

SEQ ID NO: 1495610 - RNA, 19 nt, Homo sapiens
uccaagaucuagagaaguc

SEQ ID NO: 1495611 - RNA, 19 nt, Homo sapiens
acuaguaccucuccaaagg

SEQ ID NO: 1495612 - RNA, 19 nt, Homo sapiens
cagaucuccugacuccaaa

SEQ ID NO: 1495613 - RNA, 19 nt, Homo sapiens
ucacacagcagagucagaa

SEQ ID NO: 1495614 - RNA, 19 nt, Homo sapiens
ccaacgaacccuccagcaa

SEQ ID NO: 1495615 - RNA, 19 nt, Homo sapiens
guuugugagcucauaguua

SEQ ID NO: 1495616 - RNA, 19 nt, Homo sapiens
gaaacgcccacuucuuguc

SEQ ID NO: 1495617 - RNA, 19 nt, Homo sapiens
cauagcaccuguccacacu

SEQ ID NO: 1495618 - RNA, 19 nt, Homo sapiens
cacagcagagucagaagua

SEQ ID NO: 1495619 - RNA, 19 nt, Homo sapiens
gagggaaugagacaagaug

SEQ ID NO: 1495620 - RNA, 19 nt, Homo sapiens
ccuaagcucccacuacaug

SEQ ID NO: 1495621 - RNA, 19 nt, Homo sapiens
gagggagggagaccacauu

SEQ ID NO: 1495622 - RNA, 19 nt, Homo sapiens
ccacucagaggcuccagaa

SEQ ID NO: 1495623 - RNA, 19 nt, Homo sapiens
agagccacaugccugagua

SEQ ID NO: 1495624 - RNA, 19 nt, Homo sapiens
ggugaaaggccaugauacu

SEQ ID NO: 1495625 - RNA, 19 nt, Homo sapiens
ugauagugcugggugaaug

SEQ ID NO: 1495626 - RNA, 19 nt, Homo sapiens
ggucuugggagaauucaau

SEQ ID NO: 1495627 - RNA, 19 nt, Homo sapiens
ggaagaguugguccaggaa

SEQ ID NO: 1495628 - RNA, 19 nt, Homo sapiens
cucagaggcuccagaaaca

SEQ ID NO: 1495629 - RNA, 19 nt, Homo sapiens
caacaggacgaauaaacag

SEQ ID NO: 1495630 - RNA, 19 nt, Homo sapiens
gcccacuucuugucaucuu

SEQ ID NO: 1495631 - RNA, 19 nt, Homo sapiens
cauccagggucccaaccuu

SEQ ID NO: 1495632 - RNA, 19 nt, Homo sapiens
uggaauacagaacguguuu

SEQ ID NO: 1495633 - RNA, 19 nt, Homo sapiens
ccugggaugugccgcauuc

SEQ ID NO: 1495634 - RNA, 19 nt, Homo sapiens
uagcaccuguccacacuag

SEQ ID NO: 1495635 - RNA, 19 nt, Homo sapiens
gcaauguacauaugcuuac

SEQ ID NO: 1495636 - RNA, 19 nt, Homo sapiens
aacgaacccuccagcaaug

SEQ ID NO: 1495637 - RNA, 19 nt, Homo sapiens
cguguuugaugcaucuuug

SEQ ID NO: 1495638 - RNA, 19 nt, Homo sapiens
ccaaacacaggcauugauc

SEQ ID NO: 1495639 - RNA, 19 nt, Homo sapiens
gcaggucuugggagaauuc

SEQ ID NO: 1495640 - RNA, 19 nt, Homo sapiens
ugagaucugacagugaaua

SEQ ID NO: 1495641 - RNA, 19 nt, Homo sapiens
uuugaugcaucuuugaaug

SEQ ID NO: 1495642 - RNA, 19 nt, Homo sapiens
gaaaggaauuuaccucgua

SEQ ID NO: 1495643 - RNA, 19 nt, Homo sapiens
ccacacagauguacgcaua

SEQ ID NO: 1495644 - RNA, 19 nt, Homo sapiens
caaauaaacuuuccugucu

SEQ ID NO: 1495645 - RNA, 19 nt, Homo sapiens
guaaggaguuagcaaauga

SEQ ID NO: 1495646 - RNA, 19 nt, Homo sapiens
gcuguuaacuauucgcuua

SEQ ID NO: 1495647 - RNA, 19 nt, Homo sapiens
guauguauguguuccuuua

SEQ ID NO: 1495648 - RNA, 19 nt, Homo sapiens
gcaggcagcugaacacuuc

SEQ ID NO: 1495649 - RNA, 19 nt, Homo sapiens
uaaacuauguugggaagua

SEQ ID NO: 1495650 - RNA, 19 nt, Homo sapiens
gugaagagaaugagaauuu

SEQ ID NO: 1495651 - RNA, 19 nt, Homo sapiens
ccaaggagguaaaucaguu

SEQ ID NO: 1495652 - RNA, 19 nt, Homo sapiens
ucaguuagguauuauguug

SEQ ID NO: 1495653 - RNA, 19 nt, Homo sapiens
cuacugcucucucuauuug

SEQ ID NO: 1495654 - RNA, 19 nt, Homo sapiens
acuaagaguugauguguuu

SEQ ID NO: 1495655 - RNA, 19 nt, Homo sapiens
gaagaugaccaacagcaaa

SEQ ID NO: 1495656 - RNA, 19 nt, Homo sapiens
uaagauggguggugaagau

SEQ ID NO: 1495657 - RNA, 19 nt, Homo sapiens
ugaacucacuuuccauuga

SEQ ID NO: 1495658 - RNA, 19 nt, Homo sapiens
guaccugucaccauuaaua

SEQ ID NO: 1495659 - RNA, 19 nt, Homo sapiens
gaguucaggcaauaaauua

SEQ ID NO: 1495660 - RNA, 19 nt, Homo sapiens
gaugauaagacucccauuu

SEQ ID NO: 1495661 - RNA, 19 nt, Homo sapiens
ggauauaucuuggcaguac

SEQ ID NO: 1495662 - RNA, 19 nt, Homo sapiens
ggccugcuauugaagcuua

SEQ ID NO: 1495663 - RNA, 19 nt, Homo sapiens
gcucuggccugcuauugaa

SEQ ID NO: 1495664 - RNA, 19 nt, Homo sapiens
cguaaacgaucuuuguuau

SEQ ID NO: 1495665 - RNA, 19 nt, Homo sapiens
ggaaguaaucccagcauug

SEQ ID NO: 1495666 - RNA, 19 nt, Homo sapiens
gaugguacauaguguuguu

SEQ ID NO: 1495667 - RNA, 19 nt, Homo sapiens
gauaagacucccauuuaga

SEQ ID NO: 1495668 - RNA, 19 nt, Homo sapiens
cagcagccauauacuugua

SEQ ID NO: 1495669 - RNA, 19 nt, Homo sapiens
auacaacagugaucugaaa

SEQ ID NO: 1495670 - RNA, 19 nt, Homo sapiens
ccuacuggauuguaaguuu

SEQ ID NO: 1495671 - RNA, 19 nt, Homo sapiens
aaacuuuccugucucuuug

SEQ ID NO: 1495672 - RNA, 19 nt, Homo sapiens
ugauaaagguggcauuaca

SEQ ID NO: 1495673 - RNA, 19 nt, Homo sapiens
ggaguucaggcaauaaauu

SEQ ID NO: 1495674 - RNA, 19 nt, Homo sapiens
ggagguaaaucaguuaggu

SEQ ID NO: 1495675 - RNA, 19 nt, Homo sapiens
agacguggcucaggaaaug

SEQ ID NO: 1495676 - RNA, 19 nt, Homo sapiens
gacaugugcucucuugcuu

SEQ ID NO: 1495677 - RNA, 19 nt, Homo sapiens
ugauaagacucccauuuag

SEQ ID NO: 1495678 - RNA, 19 nt, Homo sapiens
gaacacuucguacaguuug

SEQ ID NO: 1495679 - RNA, 19 nt, Homo sapiens
gauuugaccuaucaguugu

SEQ ID NO: 1495680 - RNA, 19 nt, Homo sapiens
gaaguaaucccagcauugg

SEQ ID NO: 1495681 - RNA, 19 nt, Homo sapiens
gaacucacuuuccauugac

SEQ ID NO: 1495682 - RNA, 19 nt, Homo sapiens
caacuaaaaugcccauaug

SEQ ID NO: 1495683 - RNA, 19 nt, Homo sapiens
uaaacuuuccugucucuuu

SEQ ID NO: 1495684 - RNA, 19 nt, Homo sapiens
caaggagguaaaucaguua

SEQ ID NO: 1495685 - RNA, 19 nt, Homo sapiens
aaacuauguugggaaguaa

SEQ ID NO: 1495686 - RNA, 19 nt, Homo sapiens
gcauauauugucuacugua

SEQ ID NO: 1495687 - RNA, 19 nt, Homo sapiens
uggcauauauugucuacug

SEQ ID NO: 1495688 - RNA, 19 nt, Homo sapiens
gaugaccaacagcaaauaa

SEQ ID NO: 1495689 - RNA, 19 nt, Homo sapiens
ggaugaagcauuuuaguuu

SEQ ID NO: 1495690 - RNA, 19 nt, Homo sapiens
uaaagguggcauuacauuu

SEQ ID NO: 1495691 - RNA, 19 nt, Homo sapiens
ggaaauggccgagaguaag

SEQ ID NO: 1495692 - RNA, 19 nt, Homo sapiens
caacagcaaauaaacuuuc

SEQ ID NO: 1495693 - RNA, 19 nt, Homo sapiens
augauaagacucccauuua

SEQ ID NO: 1495694 - RNA, 19 nt, Homo sapiens
ugccacauauacauacaua

SEQ ID NO: 1495695 - RNA, 19 nt, Homo sapiens
uagugaaucugucagguau

SEQ ID NO: 1495696 - RNA, 19 nt, Homo sapiens
uaguguaccugucaccauu

SEQ ID NO: 1495697 - RNA, 19 nt, Homo sapiens
uaaacgaucuuuguuaucc

SEQ ID NO: 1495698 - RNA, 19 nt, Homo sapiens
uaucauggcaucaucauca

SEQ ID NO: 1495699 - RNA, 19 nt, Homo sapiens
ggagugucauagaaucuca

SEQ ID NO: 1495700 - RNA, 19 nt, Homo sapiens
gaugcuaauuaucucuuug

SEQ ID NO: 1495701 - RNA, 19 nt, Homo sapiens
guaggaacuuauauacagu

SEQ ID NO: 1495702 - RNA, 19 nt, Homo sapiens
uaaagaucaggacagguua

SEQ ID NO: 1495703 - RNA, 19 nt, Homo sapiens
gagguaaaucaguuaggua

SEQ ID NO: 1495704 - RNA, 19 nt, Homo sapiens
uacauaguguuguuugcua

SEQ ID NO: 1495705 - RNA, 19 nt, Homo sapiens
gguguaaggaguuagcaaa

SEQ ID NO: 1495706 - RNA, 19 nt, Homo sapiens
gaucuuuguuauccuuauc

SEQ ID NO: 1495707 - RNA, 19 nt, Homo sapiens
cagcauugguggacacaca

SEQ ID NO: 1495708 - RNA, 19 nt, Homo sapiens
guggugcucuggccugcua

SEQ ID NO: 1495709 - RNA, 19 nt, Homo sapiens
gaaauggccgagaguaagg

SEQ ID NO: 1495710 - RNA, 19 nt, Homo sapiens
uuucauggaugguacauag

SEQ ID NO: 1495711 - RNA, 19 nt, Homo sapiens
gcauugacuguaccaacua

SEQ ID NO: 1495712 - RNA, 19 nt, Homo sapiens
gcauucugccuguuucuga

SEQ ID NO: 1495713 - RNA, 19 nt, Homo sapiens
gcugaacacuucguacagu

SEQ ID NO: 1495714 - RNA, 19 nt, Homo sapiens
auaaagaucaggacagguu

SEQ ID NO: 1495715 - RNA, 19 nt, Homo sapiens
acacagauguacgcauaug

SEQ ID NO: 1495716 - RNA, 19 nt, Homo sapiens
guauuauguugguuugguu

SEQ ID NO: 1495717 - RNA, 19 nt, Homo sapiens
gaacaauagaugauaagac

SEQ ID NO: 1495718 - RNA, 19 nt, Homo sapiens
gguuaugucuguaggaacu

SEQ ID NO: 1495719 - RNA, 19 nt, Homo sapiens
cagguuaugucuguaggaa

SEQ ID NO: 1495720 - RNA, 19 nt, Homo sapiens
aacccaggaugaagcauuu

SEQ ID NO: 1495721 - RNA, 19 nt, Homo sapiens
caacagugaucugaaaaga

SEQ ID NO: 1495722 - RNA, 19 nt, Homo sapiens
gguauuauguugguuuggu

SEQ ID NO: 1495723 - RNA, 19 nt, Homo sapiens
guguaccugucaccauuaa

SEQ ID NO: 1495724 - RNA, 19 nt, Homo sapiens
cauugacuguaccaacuaa

SEQ ID NO: 1495725 - RNA, 19 nt, Homo sapiens
uguaaggaguuagcaaaug

SEQ ID NO: 1495726 - RNA, 19 nt, Homo sapiens
gcuacugcucucucuauuu

SEQ ID NO: 1495727 - RNA, 19 nt, Homo sapiens
gauaaagguggcauuacau

SEQ ID NO: 1495728 - RNA, 19 nt, Homo sapiens
guagcuaucaugcggaaga

SEQ ID NO: 1495729 - RNA, 19 nt, Homo sapiens
uuuagccgcucccuaguga

SEQ ID NO: 1495730 - RNA, 19 nt, Homo sapiens
ugaccuaucaguugucguu

SEQ ID NO: 1495731 - RNA, 19 nt, Homo sapiens
ugucugaggauauaucuug

SEQ ID NO: 1495732 - RNA, 19 nt, Homo sapiens
ggcauugacuguaccaacu

SEQ ID NO: 1495733 - RNA, 19 nt, Homo sapiens
caaccuagccaucacuuuu

SEQ ID NO: 1495734 - RNA, 19 nt, Homo sapiens
gccuguuucugaagcuuaa

SEQ ID NO: 1495735 - RNA, 19 nt, Homo sapiens
gaagccaguagcuaucaug

SEQ ID NO: 1495736 - RNA, 19 nt, Homo sapiens
gagaagccaguagcuauca

SEQ ID NO: 1495737 - RNA, 19 nt, Homo sapiens
gugaaucugucagguaugg

SEQ ID NO: 1495738 - RNA, 19 nt, Homo sapiens
uaagaguugauguguuuga

SEQ ID NO: 1495739 - RNA, 19 nt, Homo sapiens
aauuaucucuuugcaccua

SEQ ID NO: 1495740 - RNA, 19 nt, Homo sapiens
ucuuucagcuccucaguca

SEQ ID NO: 1495741 - RNA, 19 nt, Homo sapiens
ggcauuacauuuugaacaa

SEQ ID NO: 1495742 - RNA, 19 nt, Homo sapiens
gaaagggucuauaccaaug

SEQ ID NO: 1495743 - RNA, 19 nt, Homo sapiens
gcaggugccuagcuucaua

SEQ ID NO: 1495744 - RNA, 19 nt, Homo sapiens
gaccugcacuucagauuaa

SEQ ID NO: 1495745 - RNA, 19 nt, Homo sapiens
gaagugcggucgcuuugaa

SEQ ID NO: 1495746 - RNA, 19 nt, Homo sapiens
gcagacaacugagaauuau

SEQ ID NO: 1495747 - RNA, 19 nt, Homo sapiens
gcgacaagauggaguguuu

SEQ ID NO: 1495748 - RNA, 19 nt, Homo sapiens
gagcagccaucuuucugua

SEQ ID NO: 1495749 - RNA, 19 nt, Homo sapiens
caacagugcaggcccauua

SEQ ID NO: 1495750 - RNA, 19 nt, Homo sapiens
cgacguauaagaaagauua

SEQ ID NO: 1495751 - RNA, 19 nt, Homo sapiens
cuaccaagauuuaugauga

SEQ ID NO: 1495752 - RNA, 19 nt, Homo sapiens
gacaguaaauauccaugua

SEQ ID NO: 1495753 - RNA, 19 nt, Homo sapiens
ccacugaguuucgagauaa

SEQ ID NO: 1495754 - RNA, 19 nt, Homo sapiens
ccacacaccaggacgauua

SEQ ID NO: 1495755 - RNA, 19 nt, Homo sapiens
cagcagagcagccaucuuu

SEQ ID NO: 1495756 - RNA, 19 nt, Homo sapiens
gugaagagaauauggauuu

SEQ ID NO: 1495757 - RNA, 19 nt, Homo sapiens
gaacuacccuuucuaucac

SEQ ID NO: 1495758 - RNA, 19 nt, Homo sapiens
cagaaagggucuauaccaa

SEQ ID NO: 1495759 - RNA, 19 nt, Homo sapiens
gcagccaucuuucuguaga

SEQ ID NO: 1495760 - RNA, 19 nt, Homo sapiens
ggaaaugucccuguggaaa

SEQ ID NO: 1495761 - RNA, 19 nt, Homo sapiens
ggauggaucuucugacaac

SEQ ID NO: 1495762 - RNA, 19 nt, Homo sapiens
ccaaagcucccaucaccua

SEQ ID NO: 1495763 - RNA, 19 nt, Homo sapiens
gugacuaacuacaagauga

SEQ ID NO: 1495764 - RNA, 19 nt, Homo sapiens
ccagagcacuugaauaaaa

SEQ ID NO: 1495765 - RNA, 19 nt, Homo sapiens
cagugaagguccaccagua

SEQ ID NO: 1495766 - RNA, 19 nt, Homo sapiens
uggaggaugugacuaacua

SEQ ID NO: 1495767 - RNA, 19 nt, Homo sapiens
ccacaucucccuaccaaga

SEQ ID NO: 1495768 - RNA, 19 nt, Homo sapiens
cgagauaaguaccaagcuu

SEQ ID NO: 1495769 - RNA, 19 nt, Homo sapiens
cgaccugcacuucagauua

SEQ ID NO: 1495770 - RNA, 19 nt, Homo sapiens
caaaagggccacuuaaauu

SEQ ID NO: 1495771 - RNA, 19 nt, Homo sapiens
ggaaguguuagccugauuu

SEQ ID NO: 1495772 - RNA, 19 nt, Homo sapiens
gugaagaccauaagcugua

SEQ ID NO: 1495773 - RNA, 19 nt, Homo sapiens
uggauuugcucacgacgua

SEQ ID NO: 1495774 - RNA, 19 nt, Homo sapiens
ccgaauauaccgagaacua

SEQ ID NO: 1495775 - RNA, 19 nt, Homo sapiens
ugucuucucuccgaauaua

SEQ ID NO: 1495776 - RNA, 19 nt, Homo sapiens
gaaaugucccuguggaaag

SEQ ID NO: 1495777 - RNA, 19 nt, Homo sapiens
uggaguguuugccuacuua

SEQ ID NO: 1495778 - RNA, 19 nt, Homo sapiens
caucaaaccucgggacagu

SEQ ID NO: 1495779 - RNA, 19 nt, Homo sapiens
caggauggaucuucugaca

SEQ ID NO: 1495780 - RNA, 19 nt, Homo sapiens
ggaugugacuaacuacaag

SEQ ID NO: 1495781 - RNA, 19 nt, Homo sapiens
caugucuucucuccgaaua

SEQ ID NO: 1495782 - RNA, 19 nt, Homo sapiens
uuccagagcacuugaauaa

SEQ ID NO: 1495783 - RNA, 19 nt, Homo sapiens
caacagacgacaggacauu

SEQ ID NO: 1495784 - RNA, 19 nt, Homo sapiens
cagcuuuacucccaaggaa

SEQ ID NO: 1495785 - RNA, 19 nt, Homo sapiens
uaagaagugcggucgcuuu

SEQ ID NO: 1495786 - RNA, 19 nt, Homo sapiens
ugaagaccauaagcuguaa

SEQ ID NO: 1495787 - RNA, 19 nt, Homo sapiens
ucaaaccucgggacaguaa

SEQ ID NO: 1495788 - RNA, 19 nt, Homo sapiens
gcucacgacguauaagaaa

SEQ ID NO: 1495789 - RNA, 19 nt, Homo sapiens
cggcaucacuguccacauc

SEQ ID NO: 1495790 - RNA, 19 nt, Homo sapiens
caccaaggaugacuacaag

SEQ ID NO: 1495791 - RNA, 19 nt, Homo sapiens
gacaugccuuucuguaaca

SEQ ID NO: 1495792 - RNA, 19 nt, Homo sapiens
ccaccaguaugaccaguuc

SEQ ID NO: 1495793 - RNA, 19 nt, Homo sapiens
caaaguggcaccagugaag

SEQ ID NO: 1495794 - RNA, 19 nt, Homo sapiens
gacgacaggacauuucaaa

SEQ ID NO: 1495795 - RNA, 19 nt, Homo sapiens
uaacaccacugaguuucga

SEQ ID NO: 1495796 - RNA, 19 nt, Homo sapiens
gaaagccuuaccacucaaa

SEQ ID NO: 1495797 - RNA, 19 nt, Homo sapiens
ggacaguaaauauccaugu

SEQ ID NO: 1495798 - RNA, 19 nt, Homo sapiens
guccacaucucccuaccaa

SEQ ID NO: 1495799 - RNA, 19 nt, Homo sapiens
gcacuugaauaaaaugaga

SEQ ID NO: 1495800 - RNA, 19 nt, Homo sapiens
gagggaguuggaaguguua

SEQ ID NO: 1495801 - RNA, 19 nt, Homo sapiens
agacaugccuuucuguaac

SEQ ID NO: 1495802 - RNA, 19 nt, Homo sapiens
uugaaagccuuaccacuca

SEQ ID NO: 1495803 - RNA, 19 nt, Homo sapiens
gcaugaagcagagaaguuc

SEQ ID NO: 1495804 - RNA, 19 nt, Homo sapiens
uugaggaaguggaugcuuu

SEQ ID NO: 1495805 - RNA, 19 nt, Homo sapiens
ucagucagguuugauaaca

SEQ ID NO: 1495806 - RNA, 19 nt, Homo sapiens
guguuugccuacuuauaaa

SEQ ID NO: 1495807 - RNA, 19 nt, Homo sapiens
ugaagagaauauggauuug

SEQ ID NO: 1495808 - RNA, 19 nt, Homo sapiens
uggaaggccugacuacauc

SEQ ID NO: 1495809 - RNA, 19 nt, Homo sapiens
gaagacgaagugcaucugu

SEQ ID NO: 1495810 - RNA, 19 nt, Homo sapiens
gauuugcucacgacguaua

SEQ ID NO: 1495811 - RNA, 19 nt, Homo sapiens
agagggaguuggaaguguu

SEQ ID NO: 1495812 - RNA, 19 nt, Homo sapiens
uagacaugccuuucuguaa

SEQ ID NO: 1495813 - RNA, 19 nt, Homo sapiens
gaagcgcuuugugcaugaa

SEQ ID NO: 1495814 - RNA, 19 nt, Homo sapiens
ccaccaaggaugacuacaa

SEQ ID NO: 1495815 - RNA, 19 nt, Homo sapiens
ugccaaagcucuguaacau

SEQ ID NO: 1495816 - RNA, 19 nt, Homo sapiens
acagagaaaccaugucuuc

SEQ ID NO: 1495817 - RNA, 19 nt, Homo sapiens
gaagugcaucugugaacug

SEQ ID NO: 1495818 - RNA, 19 nt, Homo sapiens
gcagagcagccaucuuucu

SEQ ID NO: 1495819 - RNA, 19 nt, Homo sapiens
cggcaucagucagguuuga

SEQ ID NO: 1495820 - RNA, 19 nt, Homo sapiens
ccaggacgauuaccccaua

SEQ ID NO: 1495821 - RNA, 19 nt, Homo sapiens
cugauuauuugccuuggaa

SEQ ID NO: 1495822 - RNA, 19 nt, Homo sapiens
aguguuugccuacuuauaa

SEQ ID NO: 1495823 - RNA, 19 nt, Homo sapiens
agacgaagugcaucuguga

SEQ ID NO: 1495824 - RNA, 19 nt, Homo sapiens
aaacagagaaaccaugucu

SEQ ID NO: 1495825 - RNA, 19 nt, Homo sapiens
gaguguuugccuacuuaua

SEQ ID NO: 1495826 - RNA, 19 nt, Homo sapiens
ucacgacguauaagaaaga

SEQ ID NO: 1495827 - RNA, 19 nt, Homo sapiens
ugaagguccaccaguauga

SEQ ID NO: 1495828 - RNA, 19 nt, Homo sapiens
caggauauacaaaccaguu

SEQ ID NO: 1495829 - RNA, 19 nt, Homo sapiens
cagaccaccuacaccauca

SEQ ID NO: 1495830 - RNA, 19 nt, Homo sapiens
cuagacaugccuuucugua

SEQ ID NO: 1495831 - RNA, 19 nt, Homo sapiens
ccagaaagggucuauacca

SEQ ID NO: 1495832 - RNA, 19 nt, Homo sapiens
agcagacaacugagaauua

SEQ ID NO: 1495833 - RNA, 19 nt, Homo sapiens
ccuccuggcuacaccuuug

SEQ ID NO: 1495834 - RNA, 19 nt, Homo sapiens
gacaggauggaucuucuga

SEQ ID NO: 1495835 - RNA, 19 nt, Homo sapiens
agaagcgcuuugugcauga

SEQ ID NO: 1495836 - RNA, 19 nt, Homo sapiens
ggagaagcgcuuugugcau

SEQ ID NO: 1495837 - RNA, 19 nt, Homo sapiens
uaaaaggccuugugaagac

SEQ ID NO: 1495838 - RNA, 19 nt, Homo sapiens
ugaaacagagaaaccaugu

SEQ ID NO: 1495839 - RNA, 19 nt, Homo sapiens
aaaagggccacuuaaauuu

SEQ ID NO: 1495840 - RNA, 19 nt, Homo sapiens
agucagguuugauaacaga

SEQ ID NO: 1495841 - RNA, 19 nt, Homo sapiens
acuccuaccugcccagaga

SEQ ID NO: 1495842 - RNA, 19 nt, Homo sapiens
gaacagacaucaucuauaa

SEQ ID NO: 1495843 - RNA, 19 nt, Homo sapiens
gaacugcacucuggaauua

SEQ ID NO: 1495844 - RNA, 19 nt, Homo sapiens
gaacugaaguggucucaua

SEQ ID NO: 1495845 - RNA, 19 nt, Homo sapiens
gaaagaagauauugacauc

SEQ ID NO: 1495846 - RNA, 19 nt, Homo sapiens
gagccaaaccucauaauua

SEQ ID NO: 1495847 - RNA, 19 nt, Homo sapiens
gaaguggucucauauugaa

SEQ ID NO: 1495848 - RNA, 19 nt, Homo sapiens
uaaagggacucuuccauuu

SEQ ID NO: 1495849 - RNA, 19 nt, Homo sapiens
gcaaagaaaugauaaugca

SEQ ID NO: 1495850 - RNA, 19 nt, Homo sapiens
gccaaaguauccaucauua

SEQ ID NO: 1495851 - RNA, 19 nt, Homo sapiens
gcaaugggaucgccuggaa

SEQ ID NO: 1495852 - RNA, 19 nt, Homo sapiens
gaacacaguagaccaauug

SEQ ID NO: 1495853 - RNA, 19 nt, Homo sapiens
caaaaggacuuaaacagua

SEQ ID NO: 1495854 - RNA, 19 nt, Homo sapiens
caagggaaauggcaaacaa

SEQ ID NO: 1495855 - RNA, 19 nt, Homo sapiens
caugagaaauuuagccaaa

SEQ ID NO: 1495856 - RNA, 19 nt, Homo sapiens
guauaaaggucaaccaagu

SEQ ID NO: 1495857 - RNA, 19 nt, Homo sapiens
gaccgaauaugaagucugu

SEQ ID NO: 1495858 - RNA, 19 nt, Homo sapiens
aaacccaucuuuggaagua

SEQ ID NO: 1495859 - RNA, 19 nt, Homo sapiens
ggaacagacaucaucuaua

SEQ ID NO: 1495860 - RNA, 19 nt, Homo sapiens
ggaauuaaagggacucuuc

SEQ ID NO: 1495861 - RNA, 19 nt, Homo sapiens
gaacacaacaacaggugaa

SEQ ID NO: 1495862 - RNA, 19 nt, Homo sapiens
ggagaagaaagaagauauu

SEQ ID NO: 1495863 - RNA, 19 nt, Homo sapiens
gggcaaccuuguaacugua

SEQ ID NO: 1495864 - RNA, 19 nt, Homo sapiens
gugauuccaucuaaacuga

SEQ ID NO: 1495865 - RNA, 19 nt, Homo sapiens
caacaacaggugaauuuau

SEQ ID NO: 1495866 - RNA, 19 nt, Homo sapiens
agccaaaccucauaauuau

SEQ ID NO: 1495867 - RNA, 19 nt, Homo sapiens
ggaaagagcuguguuuugg

SEQ ID NO: 1495868 - RNA, 19 nt, Homo sapiens
gaagaaagaagauauugac

SEQ ID NO: 1495869 - RNA, 19 nt, Homo sapiens
guucguccauccucuguuu

SEQ ID NO: 1495870 - RNA, 19 nt, Homo sapiens
caaaguauccaucauuagu

SEQ ID NO: 1495871 - RNA, 19 nt, Homo sapiens
ggaaguaaauucagauacc

SEQ ID NO: 1495872 - RNA, 19 nt, Homo sapiens
cauauugaauggucacaga

SEQ ID NO: 1495873 - RNA, 19 nt, Homo sapiens
caggugaauuuauccauga

SEQ ID NO: 1495874 - RNA, 19 nt, Homo sapiens
cauccucuguuuauagaaa

SEQ ID NO: 1495875 - RNA, 19 nt, Homo sapiens
cacaacaacaggugaauuu

SEQ ID NO: 1495876 - RNA, 19 nt, Homo sapiens
caucauaaacccaucuuug

SEQ ID NO: 1495877 - RNA, 19 nt, Homo sapiens
gagaagaaagaagauauug

SEQ ID NO: 1495878 - RNA, 19 nt, Homo sapiens
ggacauuggugggagaaag

SEQ ID NO: 1495879 - RNA, 19 nt, Homo sapiens
ccuugaaacuggaggauga

SEQ ID NO: 1495880 - RNA, 19 nt, Homo sapiens
gauuccaucuaaacugauu

SEQ ID NO: 1495881 - RNA, 19 nt, Homo sapiens
gaauaugaagucugugaga

SEQ ID NO: 1495882 - RNA, 19 nt, Homo sapiens
gaucgguggugaaccuguu

SEQ ID NO: 1495883 - RNA, 19 nt, Homo sapiens
gcagaaaggcaccuggaau

SEQ ID NO: 1495884 - RNA, 19 nt, Homo sapiens
cugaaguggucucauauug

SEQ ID NO: 1495885 - RNA, 19 nt, Homo sapiens
gugaauuuauccaugagaa

SEQ ID NO: 1495886 - RNA, 19 nt, Homo sapiens
caaaacagcuccucguauc

SEQ ID NO: 1495887 - RNA, 19 nt, Homo sapiens
ggagagccaaaccucauaa

SEQ ID NO: 1495888 - RNA, 19 nt, Homo sapiens
cagauaccguggaauuuca

SEQ ID NO: 1495889 - RNA, 19 nt, Homo sapiens
guaucacacucuugcauuc

SEQ ID NO: 1495890 - RNA, 19 nt, Homo sapiens
ggaaauggcaaacaaaaga

SEQ ID NO: 1495891 - RNA, 19 nt, Homo sapiens
cauaaacccaucuuuggaa

SEQ ID NO: 1495892 - RNA, 19 nt, Homo sapiens
gaaugcggcugcccaagcu

SEQ ID NO: 1495893 - RNA, 19 nt, Homo sapiens
cagaaaggcaccuggaaug

SEQ ID NO: 1495894 - RNA, 19 nt, Homo sapiens
gggagaagaaagaagauau

SEQ ID NO: 1495895 - RNA, 19 nt, Homo sapiens
ugaaguggucucauauuga

SEQ ID NO: 1495896 - RNA, 19 nt, Homo sapiens
uuaaagggacucuuccauu

SEQ ID NO: 1495897 - RNA, 19 nt, Homo sapiens
ggccaaaguauccaucauu

SEQ ID NO: 1495898 - RNA, 19 nt, Homo sapiens
gaugaguccuuggcaguca

SEQ ID NO: 1495899 - RNA, 19 nt, Homo sapiens
uaugaagucugugagaaug

SEQ ID NO: 1495900 - RNA, 19 nt, Homo sapiens
ugaacacaguagaccaauu

SEQ ID NO: 1495901 - RNA, 19 nt, Homo sapiens
gaacucggccacuccucaa

SEQ ID NO: 1495902 - RNA, 19 nt, Homo sapiens
aacaacaggugaauuuauc

SEQ ID NO: 1495903 - RNA, 19 nt, Homo sapiens
gaagcuguaucagugcaau

SEQ ID NO: 1495904 - RNA, 19 nt, Homo sapiens
gugagaauguggguuuguu

SEQ ID NO: 1495905 - RNA, 19 nt, Homo sapiens
aauaugaagucugugagaa

SEQ ID NO: 1495906 - RNA, 19 nt, Homo sapiens
aaauucagauaccguggaa

SEQ ID NO: 1495907 - RNA, 19 nt, Homo sapiens
ccuguugccuucaccaaug

SEQ ID NO: 1495908 - RNA, 19 nt, Homo sapiens
ucaagcagauaagguggaa

SEQ ID NO: 1495909 - RNA, 19 nt, Homo sapiens
gaaauggaacagacaucau

SEQ ID NO: 1495910 - RNA, 19 nt, Homo sapiens
ccaagugucagcugcaguu

SEQ ID NO: 1495911 - RNA, 19 nt, Homo sapiens
gcacugggagaagaaagaa

SEQ ID NO: 1495912 - RNA, 19 nt, Homo sapiens
aagaagauauugacaucgu

SEQ ID NO: 1495913 - RNA, 19 nt, Homo sapiens
ggacaucuggagaacacaa

SEQ ID NO: 1495914 - RNA, 19 nt, Homo sapiens
ggaccaguugcccucauuu

SEQ ID NO: 1495915 - RNA, 19 nt, Homo sapiens
caaaaggaaggccaaagua

SEQ ID NO: 1495916 - RNA, 19 nt, Homo sapiens
uuguugcccuuggaaauua

SEQ ID NO: 1495917 - RNA, 19 nt, Homo sapiens
gcaaccuuguaacuguauu

SEQ ID NO: 1495918 - RNA, 19 nt, Homo sapiens
ucacagaccgaauaugaag

SEQ ID NO: 1495919 - RNA, 19 nt, Homo sapiens
ugacaucgugaacacagua

SEQ ID NO: 1495920 - RNA, 19 nt, Homo sapiens
acaacaacaggugaauuua

SEQ ID NO: 1495921 - RNA, 19 nt, Homo sapiens
aauuauguguguuccagaa

SEQ ID NO: 1495922 - RNA, 19 nt, Homo sapiens
caguugcccucauuuccaa

SEQ ID NO: 1495923 - RNA, 19 nt, Homo sapiens
ggaauccacaacugacuca

SEQ ID NO: 1495924 - RNA, 19 nt, Homo sapiens
auaaugcacugggagaaga

SEQ ID NO: 1495925 - RNA, 19 nt, Homo sapiens
aggcuacugucacaucuug

SEQ ID NO: 1495926 - RNA, 19 nt, Homo sapiens
aaaggaaggccaaaguauc

SEQ ID NO: 1495927 - RNA, 19 nt, Homo sapiens
cguccauccucuguuuaua

SEQ ID NO: 1495928 - RNA, 19 nt, Homo sapiens
ugggcaaccuuguaacugu

SEQ ID NO: 1495929 - RNA, 19 nt, Homo sapiens
aaguauccaucauuaguca

SEQ ID NO: 1495930 - RNA, 19 nt, Homo sapiens
ugaagucugugagaaugug

SEQ ID NO: 1495931 - RNA, 19 nt, Homo sapiens
ucagauaccguggaauuuc

SEQ ID NO: 1495932 - RNA, 19 nt, Homo sapiens
ucauaaacccaucuuugga

SEQ ID NO: 1495933 - RNA, 19 nt, Homo sapiens
ucacuucccgcguguugaa

SEQ ID NO: 1495934 - RNA, 19 nt, Homo sapiens
acugcacucuggaauuaaa

SEQ ID NO: 1495935 - RNA, 19 nt, Homo sapiens
caaucaaaguggcagaacu

SEQ ID NO: 1495936 - RNA, 19 nt, Homo sapiens
caccgugauuccaucuaaa

SEQ ID NO: 1495937 - RNA, 19 nt, Homo sapiens
gcauccagaagcuguauca

SEQ ID NO: 1495938 - RNA, 19 nt, Homo sapiens
ugaagaaggcauccagaag

SEQ ID NO: 1495939 - RNA, 19 nt, Homo sapiens
ccacaacugacucacacuu

SEQ ID NO: 1495940 - RNA, 19 nt, Homo sapiens
ccgaauaugaagucuguga

SEQ ID NO: 1495941 - RNA, 19 nt, Homo sapiens
aaauauaacagacccuaca

SEQ ID NO: 1495942 - RNA, 19 nt, Homo sapiens
gaagaaagccuugugauua

SEQ ID NO: 1495943 - RNA, 19 nt, Homo sapiens
guacagaacuucagacauu

SEQ ID NO: 1495944 - RNA, 19 nt, Homo sapiens
ccucagauguugaaauuua

SEQ ID NO: 1495945 - RNA, 19 nt, Homo sapiens
uaaaugagccgucaaguuu

SEQ ID NO: 1495946 - RNA, 19 nt, Homo sapiens
uuacagagaugcuuuauug

SEQ ID NO: 1495947 - RNA, 19 nt, Homo sapiens
gaaagugcuucaauuagaa

SEQ ID NO: 1495948 - RNA, 19 nt, Homo sapiens
guaaguacaucacaguaaa

SEQ ID NO: 1495949 - RNA, 19 nt, Homo sapiens
gaaacaagcaggacuaaau

SEQ ID NO: 1495950 - RNA, 19 nt, Homo sapiens
cgaaagugcuucaauuaga

SEQ ID NO: 1495951 - RNA, 19 nt, Homo sapiens
gaaaacaccuaccaacuuu

SEQ ID NO: 1495952 - RNA, 19 nt, Homo sapiens
uggaacaucugaauacaua

SEQ ID NO: 1495953 - RNA, 19 nt, Homo sapiens
aagaaagccuugugauuaa

SEQ ID NO: 1495954 - RNA, 19 nt, Homo sapiens
ucgaaucccuucauguuua

SEQ ID NO: 1495955 - RNA, 19 nt, Homo sapiens
gaaagaaguuuuacagaga

SEQ ID NO: 1495956 - RNA, 19 nt, Homo sapiens
gcuaaugaauacuacauga

SEQ ID NO: 1495957 - RNA, 19 nt, Homo sapiens
cuacgaaagugcuucaauu

SEQ ID NO: 1495958 - RNA, 19 nt, Homo sapiens
caagagaaacuagaagaua

SEQ ID NO: 1495959 - RNA, 19 nt, Homo sapiens
uagaggaggucaguuuaua

SEQ ID NO: 1495960 - RNA, 19 nt, Homo sapiens
gaugaaaguuaccauguag

SEQ ID NO: 1495961 - RNA, 19 nt, Homo sapiens
gaugaaguuugacuagcua

SEQ ID NO: 1495962 - RNA, 19 nt, Homo sapiens
ucagugaauucauuacgua

SEQ ID NO: 1495963 - RNA, 19 nt, Homo sapiens
ugacccagauuaauuguga

SEQ ID NO: 1495964 - RNA, 19 nt, Homo sapiens
gccacuaacuccucuauuc

SEQ ID NO: 1495965 - RNA, 19 nt, Homo sapiens
uaccucagauguugaaauu

SEQ ID NO: 1495966 - RNA, 19 nt, Homo sapiens
gaaauaucaugcaauagac

SEQ ID NO: 1495967 - RNA, 19 nt, Homo sapiens
agaaucagcuaaugaauac

SEQ ID NO: 1495968 - RNA, 19 nt, Homo sapiens
aaauucagcuccacagaga

SEQ ID NO: 1495969 - RNA, 19 nt, Homo sapiens
ccacauggacuacaaugaa

SEQ ID NO: 1495970 - RNA, 19 nt, Homo sapiens
cuucagacauuuccauuau

SEQ ID NO: 1495971 - RNA, 19 nt, Homo sapiens
caguaaaccaggagaguua

SEQ ID NO: 1495972 - RNA, 19 nt, Homo sapiens
gaauguuucucucuucaag

SEQ ID NO: 1495973 - RNA, 19 nt, Homo sapiens
ccagaaccaagauuuauuu

SEQ ID NO: 1495974 - RNA, 19 nt, Homo sapiens
gcagagugguggaaacaag

SEQ ID NO: 1495975 - RNA, 19 nt, Homo sapiens
gcaauuagaaagauguaga

SEQ ID NO: 1495976 - RNA, 19 nt, Homo sapiens
gagaaugugguuagaaaga

SEQ ID NO: 1495977 - RNA, 19 nt, Homo sapiens
gaauggugacccagauuaa

SEQ ID NO: 1495978 - RNA, 19 nt, Homo sapiens
uaacaagcauggaauugag

SEQ ID NO: 1495979 - RNA, 19 nt, Homo sapiens
aaaccagaaccaagauuua

SEQ ID NO: 1495980 - RNA, 19 nt, Homo sapiens
agaugaaaguuaccaugua

SEQ ID NO: 1495981 - RNA, 19 nt, Homo sapiens
gaacuuuugucaagagaaa

SEQ ID NO: 1495982 - RNA, 19 nt, Homo sapiens
cagagaugcuuuauugcuu

SEQ ID NO: 1495983 - RNA, 19 nt, Homo sapiens
ugccagaauuuaugacuuu

SEQ ID NO: 1495984 - RNA, 19 nt, Homo sapiens
gaaauuuacacugcuuuga

SEQ ID NO: 1495985 - RNA, 19 nt, Homo sapiens
guucuagcauuccauauag

SEQ ID NO: 1495986 - RNA, 19 nt, Homo sapiens
uacgaaagugcuucaauua

SEQ ID NO: 1495987 - RNA, 19 nt, Homo sapiens
ugaagaaucagcuaaugaa

SEQ ID NO: 1495988 - RNA, 19 nt, Homo sapiens
gaagauauguuuucagcau

SEQ ID NO: 1495989 - RNA, 19 nt, Homo sapiens
caagaauggugacccagau

SEQ ID NO: 1495990 - RNA, 19 nt, Homo sapiens
caagaaacuuuggaagcuu

SEQ ID NO: 1495991 - RNA, 19 nt, Homo sapiens
aauccagacucccaaauug

SEQ ID NO: 1495992 - RNA, 19 nt, Homo sapiens
gguucuagcauuccauaua

SEQ ID NO: 1495993 - RNA, 19 nt, Homo sapiens
gcuuacugcugaagaauca

SEQ ID NO: 1495994 - RNA, 19 nt, Homo sapiens
cauuaucuccgguuuguaa

SEQ ID NO: 1495995 - RNA, 19 nt, Homo sapiens
aagaaacuuuggaagcuuu

SEQ ID NO: 1495996 - RNA, 19 nt, Homo sapiens
agucucagcuguuucaguu

SEQ ID NO: 1495997 - RNA, 19 nt, Homo sapiens
gugcuucaauuagaaugua

SEQ ID NO: 1495998 - RNA, 19 nt, Homo sapiens
caagcaggacuaaaucuga

SEQ ID NO: 1495999 - RNA, 19 nt, Homo sapiens
gaaugugguuagaaagaag

SEQ ID NO: 1496000 - RNA, 19 nt, Homo sapiens
gggaauguuucucucuuca

SEQ ID NO: 1496001 - RNA, 19 nt, Homo sapiens
uuaaauugcuagcaguuuc

SEQ ID NO: 1496002 - RNA, 19 nt, Homo sapiens
ggacuaaaucugaaaauga

SEQ ID NO: 1496003 - RNA, 19 nt, Homo sapiens
agaagaaagccuugugauu

SEQ ID NO: 1496004 - RNA, 19 nt, Homo sapiens
cacagccaauauucaguua

SEQ ID NO: 1496005 - RNA, 19 nt, Homo sapiens
aaggacagaucuucacaga

SEQ ID NO: 1496006 - RNA, 19 nt, Homo sapiens
cagaauuuaugacuuugga

SEQ ID NO: 1496007 - RNA, 19 nt, Homo sapiens
gaagaaucagcuaaugaau

SEQ ID NO: 1496008 - RNA, 19 nt, Homo sapiens
cgaaucccuucauguuuau

SEQ ID NO: 1496009 - RNA, 19 nt, Homo sapiens
ccagaagagugcaguaaac

SEQ ID NO: 1496010 - RNA, 19 nt, Homo sapiens
uaacaugccaacauucuuc

SEQ ID NO: 1496011 - RNA, 19 nt, Homo sapiens
cagccaauauucaguuaca

SEQ ID NO: 1496012 - RNA, 19 nt, Homo sapiens
ucagacauuuccauuaucu

SEQ ID NO: 1496013 - RNA, 19 nt, Homo sapiens
gaaccagaagagugcagua

SEQ ID NO: 1496014 - RNA, 19 nt, Homo sapiens
aagagaaacuagaagauac

SEQ ID NO: 1496015 - RNA, 19 nt, Homo sapiens
ucaagaaacuuuggaagcu

SEQ ID NO: 1496016 - RNA, 19 nt, Homo sapiens
ccugucaguuguuuagaaa

SEQ ID NO: 1496017 - RNA, 19 nt, Homo sapiens
gcaguuuccguucacauug

SEQ ID NO: 1496018 - RNA, 19 nt, Homo sapiens
gauucuggauuuccucuag

SEQ ID NO: 1496019 - RNA, 19 nt, Homo sapiens
aagcaggacuaaaucugaa

SEQ ID NO: 1496020 - RNA, 19 nt, Homo sapiens
gaagcccuuugaacccauu

SEQ ID NO: 1496021 - RNA, 19 nt, Homo sapiens
agaaugugguuagaaagaa

SEQ ID NO: 1496022 - RNA, 19 nt, Homo sapiens
caacuuugccuacucucuu

SEQ ID NO: 1496023 - RNA, 19 nt, Homo sapiens
gaaguuguuccaaguucaa

SEQ ID NO: 1496024 - RNA, 19 nt, Homo sapiens
agaauggugacccagauua

SEQ ID NO: 1496025 - RNA, 19 nt, Homo sapiens
gcaguaaaccaggagaguu

SEQ ID NO: 1496026 - RNA, 19 nt, Homo sapiens
augagaaugugguuagaaa

SEQ ID NO: 1496027 - RNA, 19 nt, Homo sapiens
gaacuucagacauuuccau

SEQ ID NO: 1496028 - RNA, 19 nt, Homo sapiens
aaacccagugccagaaaua

SEQ ID NO: 1496029 - RNA, 19 nt, Homo sapiens
gauuuccucuagguaauug

SEQ ID NO: 1496030 - RNA, 19 nt, Homo sapiens
ggaaacaagcaggacuaaa

SEQ ID NO: 1496031 - RNA, 19 nt, Homo sapiens
ccacagccaauauucaguu

SEQ ID NO: 1496032 - RNA, 19 nt, Homo sapiens
ccacagagauuuugaccau

SEQ ID NO: 1496033 - RNA, 19 nt, Homo sapiens
uuaaaugagccgucaaguu

SEQ ID NO: 1496034 - RNA, 19 nt, Homo sapiens
gaaagccuugugauuaauc

SEQ ID NO: 1496035 - RNA, 19 nt, Homo sapiens
gauguggcaauuagaaaga

SEQ ID NO: 1496036 - RNA, 19 nt, Homo sapiens
uacagaacuucagacauuu

SEQ ID NO: 1496037 - RNA, 19 nt, Homo sapiens
gacagauaccucagucuug

SEQ ID NO: 1496038 - RNA, 19 nt, Homo sapiens
gaggaggucaguuuauaca

SEQ ID NO: 1496039 - RNA, 19 nt, Homo sapiens
gaugcuuuauugcuucgaa

SEQ ID NO: 1496040 - RNA, 19 nt, Homo sapiens
guagaggaggucaguuuau

SEQ ID NO: 1496041 - RNA, 19 nt, Homo sapiens
aaacaagcaggacuaaauc

SEQ ID NO: 1496042 - RNA, 19 nt, Homo sapiens
ccaaagaaguuccaacaaa

SEQ ID NO: 1496043 - RNA, 19 nt, Homo sapiens
gcagcaauuugucuaauaa

SEQ ID NO: 1496044 - RNA, 19 nt, Homo sapiens
gauguggccuucuucauuu

SEQ ID NO: 1496045 - RNA, 19 nt, Homo sapiens
caaggaggguuaauaaaga

SEQ ID NO: 1496046 - RNA, 19 nt, Homo sapiens
ucacacagguuccaagaaa

SEQ ID NO: 1496047 - RNA, 19 nt, Homo sapiens
aaagggaaguuguuuguuu

SEQ ID NO: 1496048 - RNA, 19 nt, Homo sapiens
ccagacagcuucuauuuua

SEQ ID NO: 1496049 - RNA, 19 nt, Homo sapiens
gcauagaccaacagauuua

SEQ ID NO: 1496050 - RNA, 19 nt, Homo sapiens
gagaugaccuggagaacug

SEQ ID NO: 1496051 - RNA, 19 nt, Homo sapiens
gaagagagaccuuagaaag

SEQ ID NO: 1496052 - RNA, 19 nt, Homo sapiens
gcugggccauuacuaaaua

SEQ ID NO: 1496053 - RNA, 19 nt, Homo sapiens
ucucuaagcugggccauua

SEQ ID NO: 1496054 - RNA, 19 nt, Homo sapiens
uaaaucagcccuccaugua

SEQ ID NO: 1496055 - RNA, 19 nt, Homo sapiens
gcaacuggcugugacauug

SEQ ID NO: 1496056 - RNA, 19 nt, Homo sapiens
caaauuggcuaccagacuu

SEQ ID NO: 1496057 - RNA, 19 nt, Homo sapiens
cauuguggcuuaacacuuu

SEQ ID NO: 1496058 - RNA, 19 nt, Homo sapiens
gaaaauaacucccaaaagc

SEQ ID NO: 1496059 - RNA, 19 nt, Homo sapiens
acaaguaccuggaagaguu

SEQ ID NO: 1496060 - RNA, 19 nt, Homo sapiens
caacacaacaugcugauga

SEQ ID NO: 1496061 - RNA, 19 nt, Homo sapiens
guucaagggucaacuguau

SEQ ID NO: 1496062 - RNA, 19 nt, Homo sapiens
caucugccaucuacccuua

SEQ ID NO: 1496063 - RNA, 19 nt, Homo sapiens
gcuaugcucuguccuacaa

SEQ ID NO: 1496064 - RNA, 19 nt, Homo sapiens
ucacauccaucauaagguu

SEQ ID NO: 1496065 - RNA, 19 nt, Homo sapiens
ccacuuaccugagacauuc

SEQ ID NO: 1496066 - RNA, 19 nt, Homo sapiens
gaccaaaccagcauccaua

SEQ ID NO: 1496067 - RNA, 19 nt, Homo sapiens
caaaccagaugccuucuuc

SEQ ID NO: 1496068 - RNA, 19 nt, Homo sapiens
gcugaaaucacuaaugaaa

SEQ ID NO: 1496069 - RNA, 19 nt, Homo sapiens
gaacccacguaugugauaa

SEQ ID NO: 1496070 - RNA, 19 nt, Homo sapiens
acaacaugcugaugaaauu

SEQ ID NO: 1496071 - RNA, 19 nt, Homo sapiens
gagguggccuuaaagaugu

SEQ ID NO: 1496072 - RNA, 19 nt, Homo sapiens
caugacacauucuuacuga

SEQ ID NO: 1496073 - RNA, 19 nt, Homo sapiens
aaagagugccuuccacaua

SEQ ID NO: 1496074 - RNA, 19 nt, Homo sapiens
caaagaaguuccaacaaaa

SEQ ID NO: 1496075 - RNA, 19 nt, Homo sapiens
uggcagaguugaauaguug

SEQ ID NO: 1496076 - RNA, 19 nt, Homo sapiens
gaaauacucguuugcaaag

SEQ ID NO: 1496077 - RNA, 19 nt, Homo sapiens
uaagcucggugacauuuga

SEQ ID NO: 1496078 - RNA, 19 nt, Homo sapiens
cuacagaacccacguaugu

SEQ ID NO: 1496079 - RNA, 19 nt, Homo sapiens
guagaaauaaccauccuuu

SEQ ID NO: 1496080 - RNA, 19 nt, Homo sapiens
gagcagcaccuuuggcauu

SEQ ID NO: 1496081 - RNA, 19 nt, Homo sapiens
gagaagagagugcugaugu

SEQ ID NO: 1496082 - RNA, 19 nt, Homo sapiens
ccugagacauucugauuug

SEQ ID NO: 1496083 - RNA, 19 nt, Homo sapiens
ggaaauuuaucccucuagu

SEQ ID NO: 1496084 - RNA, 19 nt, Homo sapiens
agaagagagugcugaugua

SEQ ID NO: 1496085 - RNA, 19 nt, Homo sapiens
uuucugaccuggauuuaaa

SEQ ID NO: 1496086 - RNA, 19 nt, Homo sapiens
caaaaggaaucucauguug

SEQ ID NO: 1496087 - RNA, 19 nt, Homo sapiens
uaaauaccauagccauguu

SEQ ID NO: 1496088 - RNA, 19 nt, Homo sapiens
gaggguuaauaaagaauga

SEQ ID NO: 1496089 - RNA, 19 nt, Homo sapiens
caacagugaugugguguca

SEQ ID NO: 1496090 - RNA, 19 nt, Homo sapiens
gaugaacgcuaugcucugu

SEQ ID NO: 1496091 - RNA, 19 nt, Homo sapiens
gaugaccuguguaaagaug

SEQ ID NO: 1496092 - RNA, 19 nt, Homo sapiens
ggaagagagaccuuagaaa

SEQ ID NO: 1496093 - RNA, 19 nt, Homo sapiens
uugcugaaaucacuaauga

SEQ ID NO: 1496094 - RNA, 19 nt, Homo sapiens
gcauaugcccuuucuguuc

SEQ ID NO: 1496095 - RNA, 19 nt, Homo sapiens
ccaaagcugcugagggaua

SEQ ID NO: 1496096 - RNA, 19 nt, Homo sapiens
agaauuagauggcaguaca

SEQ ID NO: 1496097 - RNA, 19 nt, Homo sapiens
accagcagcucaucugaua

SEQ ID NO: 1496098 - RNA, 19 nt, Homo sapiens
ucuaauaagugaugagauc

SEQ ID NO: 1496099 - RNA, 19 nt, Homo sapiens
uaacuggcacugugguaua

SEQ ID NO: 1496100 - RNA, 19 nt, Homo sapiens
uagaucagcaccuggaaua

SEQ ID NO: 1496101 - RNA, 19 nt, Homo sapiens
gcaguucaaacccauauug

SEQ ID NO: 1496102 - RNA, 19 nt, Homo sapiens
gaacgccugaguauacaaa

SEQ ID NO: 1496103 - RNA, 19 nt, Homo sapiens
gggaagagagaccuuagaa

SEQ ID NO: 1496104 - RNA, 19 nt, Homo sapiens
gcacugugguauauuaaaa

SEQ ID NO: 1496105 - RNA, 19 nt, Homo sapiens
ggagguauuuaacugaaag

SEQ ID NO: 1496106 - RNA, 19 nt, Homo sapiens
gaaaggaauaucugcuuca

SEQ ID NO: 1496107 - RNA, 19 nt, Homo sapiens
ccagaacgccugaguauac

SEQ ID NO: 1496108 - RNA, 19 nt, Homo sapiens
gagaaagcauggcaagacu

SEQ ID NO: 1496109 - RNA, 19 nt, Homo sapiens
uauaaacucugcucuacuc

SEQ ID NO: 1496110 - RNA, 19 nt, Homo sapiens
agaauugcguguuggugua

SEQ ID NO: 1496111 - RNA, 19 nt, Homo sapiens
gcaauuugucuaauaagug

SEQ ID NO: 1496112 - RNA, 19 nt, Homo sapiens
gcucagugcucuggaguuc

SEQ ID NO: 1496113 - RNA, 19 nt, Homo sapiens
caugaucuauggcagaguu

SEQ ID NO: 1496114 - RNA, 19 nt, Homo sapiens
gaauaucugcuucacuguu

SEQ ID NO: 1496115 - RNA, 19 nt, Homo sapiens
gaggaugggccagugcuua

SEQ ID NO: 1496116 - RNA, 19 nt, Homo sapiens
ucaguuacuucccuagcua

SEQ ID NO: 1496117 - RNA, 19 nt, Homo sapiens
caaaggaggagcucacugu

SEQ ID NO: 1496118 - RNA, 19 nt, Homo sapiens
gacaguugguggaagcaaa

SEQ ID NO: 1496119 - RNA, 19 nt, Homo sapiens
caccagacagcuucuauuu

SEQ ID NO: 1496120 - RNA, 19 nt, Homo sapiens
cauauaagcucggugacau

SEQ ID NO: 1496121 - RNA, 19 nt, Homo sapiens
gcagagguggccuuaaaga

SEQ ID NO: 1496122 - RNA, 19 nt, Homo sapiens
guucaaacccauauuguuc

SEQ ID NO: 1496123 - RNA, 19 nt, Homo sapiens
gaaaauaggugagcugcau

SEQ ID NO: 1496124 - RNA, 19 nt, Homo sapiens
uggcaagacugcagaaaca

SEQ ID NO: 1496125 - RNA, 19 nt, Homo sapiens
gcaaaucaagaacaaagug

SEQ ID NO: 1496126 - RNA, 19 nt, Homo sapiens
ucgaauugcugcagaagga

SEQ ID NO: 1496127 - RNA, 19 nt, Homo sapiens
ccaaggaggguuaauaaag

SEQ ID NO: 1496128 - RNA, 19 nt, Homo sapiens
gggcuuaccuccugcuuuu

SEQ ID NO: 1496129 - RNA, 19 nt, Homo sapiens
auacuauccuucuugauug

SEQ ID NO: 1496130 - RNA, 19 nt, Homo sapiens
ucaggcaaaucaagaacaa

SEQ ID NO: 1496131 - RNA, 19 nt, Homo sapiens
gcaccucacaggcaagauu

SEQ ID NO: 1496132 - RNA, 19 nt, Homo sapiens
cugcuuggcucccugauau

SEQ ID NO: 1496133 - RNA, 19 nt, Homo sapiens
aaaggaaucucauguugac

SEQ ID NO: 1496134 - RNA, 19 nt, Homo sapiens
gguaaugaaagguugguuu

SEQ ID NO: 1496135 - RNA, 19 nt, Homo sapiens
uaagguuggcauucaauaa

SEQ ID NO: 1496136 - RNA, 19 nt, Homo sapiens
uaagcugggccauuacuaa

SEQ ID NO: 1496137 - RNA, 19 nt, Homo sapiens
gaccuuguccuuuaucaug

SEQ ID NO: 1496138 - RNA, 19 nt, Homo sapiens
gcacuuacucucugagcuu

SEQ ID NO: 1496139 - RNA, 19 nt, Homo sapiens
gcagggaagagagaccuua

SEQ ID NO: 1496140 - RNA, 19 nt, Homo sapiens
gagacauucugauuuggau

SEQ ID NO: 1496141 - RNA, 19 nt, Homo sapiens
cagcagcagucuuaaagca

SEQ ID NO: 1496142 - RNA, 19 nt, Homo sapiens
acaaagaccuugcugauaa

SEQ ID NO: 1496143 - RNA, 19 nt, Homo sapiens
caacagcuguggcuuaaau

SEQ ID NO: 1496144 - RNA, 19 nt, Homo sapiens
gcagacaaauagaagauau

SEQ ID NO: 1496145 - RNA, 19 nt, Homo sapiens
caaagaccuugcugauaaa

SEQ ID NO: 1496146 - RNA, 19 nt, Homo sapiens
caagccauccuucaacuua

SEQ ID NO: 1496147 - RNA, 19 nt, Homo sapiens
gcagaggaauccacaaugg

SEQ ID NO: 1496148 - RNA, 19 nt, Homo sapiens
ggaaagaaaggaaggcauu

SEQ ID NO: 1496149 - RNA, 19 nt, Homo sapiens
gauugacucucucuuguau

SEQ ID NO: 1496150 - RNA, 19 nt, Homo sapiens
gcuuaaaucugaguccuuu

SEQ ID NO: 1496151 - RNA, 19 nt, Homo sapiens
cuacugggcugcauucuca

SEQ ID NO: 1496152 - RNA, 19 nt, Homo sapiens
uagaaucucugacuacuag

SEQ ID NO: 1496153 - RNA, 19 nt, Homo sapiens
uauagggacuuugcacaua

SEQ ID NO: 1496154 - RNA, 19 nt, Homo sapiens
uaaugaagcuaaccagcaa

SEQ ID NO: 1496155 - RNA, 19 nt, Homo sapiens
aaacucgucuccuaaugaa

SEQ ID NO: 1496156 - RNA, 19 nt, Homo sapiens
ugaaacccguccuaauuga

SEQ ID NO: 1496157 - RNA, 19 nt, Homo sapiens
ccacaaacucgucuccuaa

SEQ ID NO: 1496158 - RNA, 19 nt, Homo sapiens
gauccuguaucgaguuaga

SEQ ID NO: 1496159 - RNA, 19 nt, Homo sapiens
ugagaagccugagaaguga

SEQ ID NO: 1496160 - RNA, 19 nt, Homo sapiens
uaaaacagguugcaguaaa

SEQ ID NO: 1496161 - RNA, 19 nt, Homo sapiens
caaacucgucuccuaauga

SEQ ID NO: 1496162 - RNA, 19 nt, Homo sapiens
gaaaagagcaucccgaaca

SEQ ID NO: 1496163 - RNA, 19 nt, Homo sapiens
gauaggaggucggcacaag

SEQ ID NO: 1496164 - RNA, 19 nt, Homo sapiens
cagauugacucucucuugu

SEQ ID NO: 1496165 - RNA, 19 nt, Homo sapiens
uaaaccagauugacucucu

SEQ ID NO: 1496166 - RNA, 19 nt, Homo sapiens
uaauauggcuaagguggaa

SEQ ID NO: 1496167 - RNA, 19 nt, Homo sapiens
gaucaggccaaccuuagaa

SEQ ID NO: 1496168 - RNA, 19 nt, Homo sapiens
ucaauaaacuugcuuucac

SEQ ID NO: 1496169 - RNA, 19 nt, Homo sapiens
ucagcgccaugacaguuua

SEQ ID NO: 1496170 - RNA, 19 nt, Homo sapiens
aaagaaagaggcauuaaag

SEQ ID NO: 1496171 - RNA, 19 nt, Homo sapiens
ggugaaugccugcagauga

SEQ ID NO: 1496172 - RNA, 19 nt, Homo sapiens
gugaaacccguccuaauug

SEQ ID NO: 1496173 - RNA, 19 nt, Homo sapiens
ccucugcacugccuaugaa

SEQ ID NO: 1496174 - RNA, 19 nt, Homo sapiens
gaagauccuguaucgaguu

SEQ ID NO: 1496175 - RNA, 19 nt, Homo sapiens
caauaaacuugcuuucacu

SEQ ID NO: 1496176 - RNA, 19 nt, Homo sapiens
uaagucacaggaugagaua

SEQ ID NO: 1496177 - RNA, 19 nt, Homo sapiens
gcagugaaacccguccuaa

SEQ ID NO: 1496178 - RNA, 19 nt, Homo sapiens
gcacugccuaugaauuuga

SEQ ID NO: 1496179 - RNA, 19 nt, Homo sapiens
guaucgaguuagagaaaug

SEQ ID NO: 1496180 - RNA, 19 nt, Homo sapiens
ucacaaagaccuugcugau

SEQ ID NO: 1496181 - RNA, 19 nt, Homo sapiens
aagauccuguaucgaguua

SEQ ID NO: 1496182 - RNA, 19 nt, Homo sapiens
cacaaagaccuugcugaua

SEQ ID NO: 1496183 - RNA, 19 nt, Homo sapiens
agugaaacccguccuaauu

SEQ ID NO: 1496184 - RNA, 19 nt, Homo sapiens
uagcaacgucuggaaguua

SEQ ID NO: 1496185 - RNA, 19 nt, Homo sapiens
ccaugacaguuuacagaug

SEQ ID NO: 1496186 - RNA, 19 nt, Homo sapiens
ccagauugacucucucuug

SEQ ID NO: 1496187 - RNA, 19 nt, Homo sapiens
gugaaugccugcagaugag

SEQ ID NO: 1496188 - RNA, 19 nt, Homo sapiens
gaaagaaaggaaggcauuc

SEQ ID NO: 1496189 - RNA, 19 nt, Homo sapiens
ugaugaagauccuguaucg

SEQ ID NO: 1496190 - RNA, 19 nt, Homo sapiens
ccaagauggugacgagagu

SEQ ID NO: 1496191 - RNA, 19 nt, Homo sapiens
cccacaaacucgucuccua

SEQ ID NO: 1496192 - RNA, 19 nt, Homo sapiens
uuagagaaauggaagaaac

SEQ ID NO: 1496193 - RNA, 19 nt, Homo sapiens
gggcuccucugccuaugga

SEQ ID NO: 1496194 - RNA, 19 nt, Homo sapiens
gauaaaacagguugcagua

SEQ ID NO: 1496195 - RNA, 19 nt, Homo sapiens
agaaagaggcauuaaagca

SEQ ID NO: 1496196 - RNA, 19 nt, Homo sapiens
uuaugcagcugaguugaaa

SEQ ID NO: 1496197 - RNA, 19 nt, Homo sapiens
acaaacucgucuccuaaug

SEQ ID NO: 1496198 - RNA, 19 nt, Homo sapiens
guuuacagaugccauagca

SEQ ID NO: 1496199 - RNA, 19 nt, Homo sapiens
agccauccuucaacuuaua

SEQ ID NO: 1496200 - RNA, 19 nt, Homo sapiens
cugcacugccuaugaauuu

SEQ ID NO: 1496201 - RNA, 19 nt, Homo sapiens
gaagugaucaggccaaccu

SEQ ID NO: 1496202 - RNA, 19 nt, Homo sapiens
uuaccuguacggucuauaa

SEQ ID NO: 1496203 - RNA, 19 nt, Homo sapiens
ugucagagguguuuaaacc

SEQ ID NO: 1496204 - RNA, 19 nt, Homo sapiens
cugagaagccugagaagug

SEQ ID NO: 1496205 - RNA, 19 nt, Homo sapiens
ugaggauguugggagaaua

SEQ ID NO: 1496206 - RNA, 19 nt, Homo sapiens
ggcuugacuugcagugaaa

SEQ ID NO: 1496207 - RNA, 19 nt, Homo sapiens
caagauacagaucacaaag

SEQ ID NO: 1496208 - RNA, 19 nt, Homo sapiens
caacuuauagggacuuugc

SEQ ID NO: 1496209 - RNA, 19 nt, Homo sapiens
ggccucagcaccaugacua

SEQ ID NO: 1496210 - RNA, 19 nt, Homo sapiens
ggacacagcagaggaaucc

SEQ ID NO: 1496211 - RNA, 19 nt, Homo sapiens
gaaacccguccuaauugau

SEQ ID NO: 1496212 - RNA, 19 nt, Homo sapiens
agauacagaucacaaagac

SEQ ID NO: 1496213 - RNA, 19 nt, Homo sapiens
cagcagaggaauccacaau

SEQ ID NO: 1496214 - RNA, 19 nt, Homo sapiens
uggcuaagguggaaguucu

SEQ ID NO: 1496215 - RNA, 19 nt, Homo sapiens
aaucugaguccuuuggaaa

SEQ ID NO: 1496216 - RNA, 19 nt, Homo sapiens
cguccuaauugaugaagau

SEQ ID NO: 1496217 - RNA, 19 nt, Homo sapiens
aggcuugacuugcagugaa

SEQ ID NO: 1496218 - RNA, 19 nt, Homo sapiens
acaagauacagaucacaaa

SEQ ID NO: 1496219 - RNA, 19 nt, Homo sapiens
uugacucucucuuguauag

SEQ ID NO: 1496220 - RNA, 19 nt, Homo sapiens
acuagaggcuugacuugca

SEQ ID NO: 1496221 - RNA, 19 nt, Homo sapiens
aaaucugaguccuuuggaa

SEQ ID NO: 1496222 - RNA, 19 nt, Homo sapiens
uaaaggggaggcaugaaua

SEQ ID NO: 1496223 - RNA, 19 nt, Homo sapiens
ccuguacggucuauaaagg

SEQ ID NO: 1496224 - RNA, 19 nt, Homo sapiens
gaacaguggagaggaagag

SEQ ID NO: 1496225 - RNA, 19 nt, Homo sapiens
cggaagcccuagagcaucu

SEQ ID NO: 1496226 - RNA, 19 nt, Homo sapiens
uuucuaauauggcuaaggu

SEQ ID NO: 1496227 - RNA, 19 nt, Homo sapiens
caucagcgccaugacaguu

SEQ ID NO: 1496228 - RNA, 19 nt, Homo sapiens
aaaaugaggcugagaccua

SEQ ID NO: 1496229 - RNA, 19 nt, Homo sapiens
gcccagaaaggaacagugu

SEQ ID NO: 1496230 - RNA, 19 nt, Homo sapiens
gaggauguugggagaauag

SEQ ID NO: 1496231 - RNA, 19 nt, Homo sapiens
agcuguggcuuaaaucuga

SEQ ID NO: 1496232 - RNA, 19 nt, Homo sapiens
ccucugagaagccugagaa

SEQ ID NO: 1496233 - RNA, 19 nt, Homo sapiens
ggaggucggcacaagauac

SEQ ID NO: 1496234 - RNA, 19 nt, Homo sapiens
aaacccguccuaauugaug

SEQ ID NO: 1496235 - RNA, 19 nt, Homo sapiens
cuacuagaggcuugacuug

SEQ ID NO: 1496236 - RNA, 19 nt, Homo sapiens
cacaagauacagaucacaa

SEQ ID NO: 1496237 - RNA, 19 nt, Homo sapiens
caggagauuaggcauucua

SEQ ID NO: 1496238 - RNA, 19 nt, Homo sapiens
auagggacuuugcacauag

SEQ ID NO: 1496239 - RNA, 19 nt, Homo sapiens
gaguggccauucuuuuauu

SEQ ID NO: 1496240 - RNA, 19 nt, Homo sapiens
ggucggcacaagauacaga

SEQ ID NO: 1496241 - RNA, 19 nt, Homo sapiens
aagccauccuucaacuuau

SEQ ID NO: 1496242 - RNA, 19 nt, Homo sapiens
gaacugaauucaacuacuu

SEQ ID NO: 1496243 - RNA, 19 nt, Homo sapiens
ggaauauaguggcagguua

SEQ ID NO: 1496244 - RNA, 19 nt, Homo sapiens
gcugucagauggagaaaua

SEQ ID NO: 1496245 - RNA, 19 nt, Homo sapiens
gcucaggguuuaaguauug

SEQ ID NO: 1496246 - RNA, 19 nt, Homo sapiens
gcagagcgaugccaacguu

SEQ ID NO: 1496247 - RNA, 19 nt, Homo sapiens
gauaguccuuugcuucuuu

SEQ ID NO: 1496248 - RNA, 19 nt, Homo sapiens
uagguucacuuccauauuu

SEQ ID NO: 1496249 - RNA, 19 nt, Homo sapiens
gcaauuaugauauguguga

SEQ ID NO: 1496250 - RNA, 19 nt, Homo sapiens
gcagugugcuggcgaguga

SEQ ID NO: 1496251 - RNA, 19 nt, Homo sapiens
gaacauaccaagaacugaa

SEQ ID NO: 1496252 - RNA, 19 nt, Homo sapiens
ugacuuggauucucucauu

SEQ ID NO: 1496253 - RNA, 19 nt, Homo sapiens
agauguggguguauauuua

SEQ ID NO: 1496254 - RNA, 19 nt, Homo sapiens
gaagguccaugugguuauu

SEQ ID NO: 1496255 - RNA, 19 nt, Homo sapiens
guaccacccuguauuguuc

SEQ ID NO: 1496256 - RNA, 19 nt, Homo sapiens
guucagugcucaggguuua

SEQ ID NO: 1496257 - RNA, 19 nt, Homo sapiens
cuucacauaugcuuacuuu

SEQ ID NO: 1496258 - RNA, 19 nt, Homo sapiens
uaaacugaaucgaagcaaa

SEQ ID NO: 1496259 - RNA, 19 nt, Homo sapiens
cacauaugcuuacuuucua

SEQ ID NO: 1496260 - RNA, 19 nt, Homo sapiens
cugagcaacuggaauguaa

SEQ ID NO: 1496261 - RNA, 19 nt, Homo sapiens
gagaagguccaugugguua

SEQ ID NO: 1496262 - RNA, 19 nt, Homo sapiens
gaauauaguggcagguuau

SEQ ID NO: 1496263 - RNA, 19 nt, Homo sapiens
gagaggacaucaucaacgu

SEQ ID NO: 1496264 - RNA, 19 nt, Homo sapiens
ggaugaccauggaaucaga

SEQ ID NO: 1496265 - RNA, 19 nt, Homo sapiens
gcuaaauauuuccgaauca

SEQ ID NO: 1496266 - RNA, 19 nt, Homo sapiens
aaaccuggauucucaagau

SEQ ID NO: 1496267 - RNA, 19 nt, Homo sapiens
gcaacgcgccaaaucuaaa

SEQ ID NO: 1496268 - RNA, 19 nt, Homo sapiens
ucaaguggaugaccaugga

SEQ ID NO: 1496269 - RNA, 19 nt, Homo sapiens
gcaguugucaaagucauua

SEQ ID NO: 1496270 - RNA, 19 nt, Homo sapiens
guccuuugcuucuuuguga

SEQ ID NO: 1496271 - RNA, 19 nt, Homo sapiens
gaaauaaaaguggccauua

SEQ ID NO: 1496272 - RNA, 19 nt, Homo sapiens
caagagaggacaucaucaa

SEQ ID NO: 1496273 - RNA, 19 nt, Homo sapiens
aaacaaacacucagaugug

SEQ ID NO: 1496274 - RNA, 19 nt, Homo sapiens
ugccaaaccuggauucuca

SEQ ID NO: 1496275 - RNA, 19 nt, Homo sapiens
cgccaaaucuaaacugaau

SEQ ID NO: 1496276 - RNA, 19 nt, Homo sapiens
ccucuucucucgugcuaaa

SEQ ID NO: 1496277 - RNA, 19 nt, Homo sapiens
gccacgacauggaagaauu

SEQ ID NO: 1496278 - RNA, 19 nt, Homo sapiens
ggagaagguccaugugguu

SEQ ID NO: 1496279 - RNA, 19 nt, Homo sapiens
ugauaugugugauuagguu

SEQ ID NO: 1496280 - RNA, 19 nt, Homo sapiens
gauguggguguauauuuaa

SEQ ID NO: 1496281 - RNA, 19 nt, Homo sapiens
agaaucagcaguugucaaa

SEQ ID NO: 1496282 - RNA, 19 nt, Homo sapiens
gcaaacgcuuggagaaggu

SEQ ID NO: 1496283 - RNA, 19 nt, Homo sapiens
cagacaauguugaaagauc

SEQ ID NO: 1496284 - RNA, 19 nt, Homo sapiens
caagaacugaauucaacua

SEQ ID NO: 1496285 - RNA, 19 nt, Homo sapiens
gugcugaacauaccaagaa

SEQ ID NO: 1496286 - RNA, 19 nt, Homo sapiens
cagagaagcaggaggaaau

SEQ ID NO: 1496287 - RNA, 19 nt, Homo sapiens
ucacauaugcuuacuuucu

SEQ ID NO: 1496288 - RNA, 19 nt, Homo sapiens
aaucagcaguugucaaagu

SEQ ID NO: 1496289 - RNA, 19 nt, Homo sapiens
gacuuggauucucucauuu

SEQ ID NO: 1496290 - RNA, 19 nt, Homo sapiens
uaaaucgugugacuuggau

SEQ ID NO: 1496291 - RNA, 19 nt, Homo sapiens
acucagauguggguguaua

SEQ ID NO: 1496292 - RNA, 19 nt, Homo sapiens
uauaguggcagguuauuau

SEQ ID NO: 1496293 - RNA, 19 nt, Homo sapiens
ccacgacauggaagaauuu

SEQ ID NO: 1496294 - RNA, 19 nt, Homo sapiens
gagacgagguuuauuuuag

SEQ ID NO: 1496295 - RNA, 19 nt, Homo sapiens
cagauguggguguauauuu

SEQ ID NO: 1496296 - RNA, 19 nt, Homo sapiens
cauuugacuuggaauauag

SEQ ID NO: 1496297 - RNA, 19 nt, Homo sapiens
uaaccugcaucagcuaaau

SEQ ID NO: 1496298 - RNA, 19 nt, Homo sapiens
ugauacauuugacuuggaa

SEQ ID NO: 1496299 - RNA, 19 nt, Homo sapiens
guaagggugggaaugcuuu

SEQ ID NO: 1496300 - RNA, 19 nt, Homo sapiens
gcuggcgagugaagacaaa

SEQ ID NO: 1496301 - RNA, 19 nt, Homo sapiens
ugaagggaaguuaucgaua

SEQ ID NO: 1496302 - RNA, 19 nt, Homo sapiens
aguggcagguuauuauuug

SEQ ID NO: 1496303 - RNA, 19 nt, Homo sapiens
gaagcaggaggaaauucuu

SEQ ID NO: 1496304 - RNA, 19 nt, Homo sapiens
ucauuucuaccuucacaua

SEQ ID NO: 1496305 - RNA, 19 nt, Homo sapiens
uggauucucucauuucuac

SEQ ID NO: 1496306 - RNA, 19 nt, Homo sapiens
cauauuccgggaugaaauu

SEQ ID NO: 1496307 - RNA, 19 nt, Homo sapiens
agacaauguugaaagaucu

SEQ ID NO: 1496308 - RNA, 19 nt, Homo sapiens
gcuucuuugugauacauuu

SEQ ID NO: 1496309 - RNA, 19 nt, Homo sapiens
ggagcugucagauggagaa

SEQ ID NO: 1496310 - RNA, 19 nt, Homo sapiens
cuaaaggagcugucagaug

SEQ ID NO: 1496311 - RNA, 19 nt, Homo sapiens
gccuaaaucgugugacuug

SEQ ID NO: 1496312 - RNA, 19 nt, Homo sapiens
acacuaugcuaagucaaug

SEQ ID NO: 1496313 - RNA, 19 nt, Homo sapiens
gugauacauuugacuugga

SEQ ID NO: 1496314 - RNA, 19 nt, Homo sapiens
gcaacuggaauguaacucu

SEQ ID NO: 1496315 - RNA, 19 nt, Homo sapiens
ggaugaaauuaaccugcau

SEQ ID NO: 1496316 - RNA, 19 nt, Homo sapiens
gagcuaaauauuuccgaau

SEQ ID NO: 1496317 - RNA, 19 nt, Homo sapiens
accaagaacugaauucaac

SEQ ID NO: 1496318 - RNA, 19 nt, Homo sapiens
caccagggguucuguguuu

SEQ ID NO: 1496319 - RNA, 19 nt, Homo sapiens
ccuggauucucaagaugaa

SEQ ID NO: 1496320 - RNA, 19 nt, Homo sapiens
ccacauauuccgggaugaa

SEQ ID NO: 1496321 - RNA, 19 nt, Homo sapiens
gggccuaaaucgugugacu

SEQ ID NO: 1496322 - RNA, 19 nt, Homo sapiens
gauuagguucacuuccaua

SEQ ID NO: 1496323 - RNA, 19 nt, Homo sapiens
ggugaaaacacuaugcuaa

SEQ ID NO: 1496324 - RNA, 19 nt, Homo sapiens
gugcucaggguuuaaguau

SEQ ID NO: 1496325 - RNA, 19 nt, Homo sapiens
gaccauggaaucagagaag

SEQ ID NO: 1496326 - RNA, 19 nt, Homo sapiens
uaaaugaugaagggaaguu

SEQ ID NO: 1496327 - RNA, 19 nt, Homo sapiens
gagugaagacaaaacuuua

SEQ ID NO: 1496328 - RNA, 19 nt, Homo sapiens
ucccacaauugcagucuga

SEQ ID NO: 1496329 - RNA, 19 nt, Homo sapiens
uuuccuaacuugccuccaa

SEQ ID NO: 1496330 - RNA, 19 nt, Homo sapiens
uaugauaugugugauuagg

SEQ ID NO: 1496331 - RNA, 19 nt, Homo sapiens
ugucagauggagaaauaaa

SEQ ID NO: 1496332 - RNA, 19 nt, Homo sapiens
cgaguacccggguuccaaa

SEQ ID NO: 1496333 - RNA, 19 nt, Homo sapiens
ucaccgagacgagguuuau

SEQ ID NO: 1496334 - RNA, 19 nt, Homo sapiens
cacccuguauuguucauag

SEQ ID NO: 1496335 - RNA, 19 nt, Homo sapiens
gguguauauuuaaccuguu

SEQ ID NO: 1496336 - RNA, 19 nt, Homo sapiens
ggaauguaacucucuccau

SEQ ID NO: 1496337 - RNA, 19 nt, Homo sapiens
aaauaaaaguggccauuag

SEQ ID NO: 1496338 - RNA, 19 nt, Homo sapiens
ucucauuucuaccuucaca

SEQ ID NO: 1496339 - RNA, 19 nt, Homo sapiens
ggauaaguccaugauaguc

SEQ ID NO: 1496340 - RNA, 19 nt, Homo sapiens
gacaauguugaaagaucua

SEQ ID NO: 1496341 - RNA, 19 nt, Homo sapiens
gguuauuauuugggugaaa

SEQ ID NO: 1496342 - RNA, 19 nt, Homo sapiens
gaacauacuugucucagaa

SEQ ID NO: 1496343 - RNA, 19 nt, Homo sapiens
caacaccucccgacuauua

SEQ ID NO: 1496344 - RNA, 19 nt, Homo sapiens
gagaaaacauggcaauuua

SEQ ID NO: 1496345 - RNA, 19 nt, Homo sapiens
caaagucggauauaaagua

SEQ ID NO: 1496346 - RNA, 19 nt, Homo sapiens
caaggaauaugaacaagau

SEQ ID NO: 1496347 - RNA, 19 nt, Homo sapiens
gagaagacauagacgguau

SEQ ID NO: 1496348 - RNA, 19 nt, Homo sapiens
uaaacgagguucugucuuc

SEQ ID NO: 1496349 - RNA, 19 nt, Homo sapiens
gaagguggccugcauggaa

SEQ ID NO: 1496350 - RNA, 19 nt, Homo sapiens
caacauaaucagccacaua

SEQ ID NO: 1496351 - RNA, 19 nt, Homo sapiens
ggaaguagacaaaccuaaa

SEQ ID NO: 1496352 - RNA, 19 nt, Homo sapiens
caagaugccugcuggugaa

SEQ ID NO: 1496353 - RNA, 19 nt, Homo sapiens
gaagacauagacgguauua

SEQ ID NO: 1496354 - RNA, 19 nt, Homo sapiens
agacaaaccuaaauaugug

SEQ ID NO: 1496355 - RNA, 19 nt, Homo sapiens
uaagagagcucgaaaacaa

SEQ ID NO: 1496356 - RNA, 19 nt, Homo sapiens
ugacaaagucggauauaaa

SEQ ID NO: 1496357 - RNA, 19 nt, Homo sapiens
caagugaauuugcuucuca

SEQ ID NO: 1496358 - RNA, 19 nt, Homo sapiens
gccaacaccucccgacuau

SEQ ID NO: 1496359 - RNA, 19 nt, Homo sapiens
gaauuugcuucucaccauu

SEQ ID NO: 1496360 - RNA, 19 nt, Homo sapiens
cugaagaccugaugggaaa

SEQ ID NO: 1496361 - RNA, 19 nt, Homo sapiens
gaugauaacaguauuugga

SEQ ID NO: 1496362 - RNA, 19 nt, Homo sapiens
cauggucgaucacaucauu

SEQ ID NO: 1496363 - RNA, 19 nt, Homo sapiens
acaaacagaugcaauggau

SEQ ID NO: 1496364 - RNA, 19 nt, Homo sapiens
gaaguagacaaaccuaaau

SEQ ID NO: 1496365 - RNA, 19 nt, Homo sapiens
aaacugaaaucucugacau

SEQ ID NO: 1496366 - RNA, 19 nt, Homo sapiens
cuaaauaugugucugaacu

SEQ ID NO: 1496367 - RNA, 19 nt, Homo sapiens
ccagaacuaucucuaaguc

SEQ ID NO: 1496368 - RNA, 19 nt, Homo sapiens
ccucuggugugguaaauug

SEQ ID NO: 1496369 - RNA, 19 nt, Homo sapiens
guucagcagugcaagagaa

SEQ ID NO: 1496370 - RNA, 19 nt, Homo sapiens
ggugaccucugacgauuuc

SEQ ID NO: 1496371 - RNA, 19 nt, Homo sapiens
ugggaaaccguuaguauuu

SEQ ID NO: 1496372 - RNA, 19 nt, Homo sapiens
caagacagggaccaucuaa

SEQ ID NO: 1496373 - RNA, 19 nt, Homo sapiens
cuuacaggcucauaucaaa

SEQ ID NO: 1496374 - RNA, 19 nt, Homo sapiens
acaaagaagggaaguacua

SEQ ID NO: 1496375 - RNA, 19 nt, Homo sapiens
guagacaaaccuaaauaug

SEQ ID NO: 1496376 - RNA, 19 nt, Homo sapiens
cuaucacugugcuaauuua

SEQ ID NO: 1496377 - RNA, 19 nt, Homo sapiens
uaugaauucuccuccacua

SEQ ID NO: 1496378 - RNA, 19 nt, Homo sapiens
gaccuacgauccaucaucu

SEQ ID NO: 1496379 - RNA, 19 nt, Homo sapiens
gaacuccaaggaauaugaa

SEQ ID NO: 1496380 - RNA, 19 nt, Homo sapiens
gguaauccaucugcaagug

SEQ ID NO: 1496381 - RNA, 19 nt, Homo sapiens
uaaaaucuaugggcgaaua

SEQ ID NO: 1496382 - RNA, 19 nt, Homo sapiens
agacauagacgguauuaag

SEQ ID NO: 1496383 - RNA, 19 nt, Homo sapiens
cagaugcaauggaucauag

SEQ ID NO: 1496384 - RNA, 19 nt, Homo sapiens
ugaauuugcuucucaccau

SEQ ID NO: 1496385 - RNA, 19 nt, Homo sapiens
gagguucugucuucaugug

SEQ ID NO: 1496386 - RNA, 19 nt, Homo sapiens
caaguucuauacuguacug

SEQ ID NO: 1496387 - RNA, 19 nt, Homo sapiens
ugucugaacuccaaggaau

SEQ ID NO: 1496388 - RNA, 19 nt, Homo sapiens
cauagaagguggccugcau

SEQ ID NO: 1496389 - RNA, 19 nt, Homo sapiens
aaacagaugcaauggauca

SEQ ID NO: 1496390 - RNA, 19 nt, Homo sapiens
gccacaaacugaaaucucu

SEQ ID NO: 1496391 - RNA, 19 nt, Homo sapiens
gacaaagucggauauaaag

SEQ ID NO: 1496392 - RNA, 19 nt, Homo sapiens
ccaauucauuucugugaca

SEQ ID NO: 1496393 - RNA, 19 nt, Homo sapiens
cgacuauuauccugagugu

SEQ ID NO: 1496394 - RNA, 19 nt, Homo sapiens
gcaagacagggaccaucua

SEQ ID NO: 1496395 - RNA, 19 nt, Homo sapiens
uagacgguauuaaggauga

SEQ ID NO: 1496396 - RNA, 19 nt, Homo sapiens
uacaagagcaacauaauca

SEQ ID NO: 1496397 - RNA, 19 nt, Homo sapiens
gaccaucuaagcuauauuc

SEQ ID NO: 1496398 - RNA, 19 nt, Homo sapiens
aaaguucguccucauauug

SEQ ID NO: 1496399 - RNA, 19 nt, Homo sapiens
gguucugucuucaugugua

SEQ ID NO: 1496400 - RNA, 19 nt, Homo sapiens
ugugguaaauugaccuaaa

SEQ ID NO: 1496401 - RNA, 19 nt, Homo sapiens
cauggcaauuuaacaguug

SEQ ID NO: 1496402 - RNA, 19 nt, Homo sapiens
gggaccaucuaagcuauau

SEQ ID NO: 1496403 - RNA, 19 nt, Homo sapiens
gaauugaggcgcauaaacg

SEQ ID NO: 1496404 - RNA, 19 nt, Homo sapiens
gcuaucacugugcuaauuu

SEQ ID NO: 1496405 - RNA, 19 nt, Homo sapiens
cauagacgguauuaaggau

SEQ ID NO: 1496406 - RNA, 19 nt, Homo sapiens
uaauccaucugcaagugaa

SEQ ID NO: 1496407 - RNA, 19 nt, Homo sapiens
uaaaccaucaaaugccaua

SEQ ID NO: 1496408 - RNA, 19 nt, Homo sapiens
ucacaccagagaagacaua

SEQ ID NO: 1496409 - RNA, 19 nt, Homo sapiens
caucauaggugaaaaggau

SEQ ID NO: 1496410 - RNA, 19 nt, Homo sapiens
aacauaaucagccacauaa

SEQ ID NO: 1496411 - RNA, 19 nt, Homo sapiens
aaggaugauuuaccaauuc

SEQ ID NO: 1496412 - RNA, 19 nt, Homo sapiens
agaacauacuugucucaga

SEQ ID NO: 1496413 - RNA, 19 nt, Homo sapiens
gcaauuuaacaguugauca

SEQ ID NO: 1496414 - RNA, 19 nt, Homo sapiens
gugggaaaccguuaguauu

SEQ ID NO: 1496415 - RNA, 19 nt, Homo sapiens
uaacaaagaagggaaguac

SEQ ID NO: 1496416 - RNA, 19 nt, Homo sapiens
gaugccugcuggugaacaa

SEQ ID NO: 1496417 - RNA, 19 nt, Homo sapiens
gugguaaauugaccuaaag

SEQ ID NO: 1496418 - RNA, 19 nt, Homo sapiens
aaacgacugucaccuuguc

SEQ ID NO: 1496419 - RNA, 19 nt, Homo sapiens
ucucaccauuauaaccuua

SEQ ID NO: 1496420 - RNA, 19 nt, Homo sapiens
caucauauuauaccucaga

SEQ ID NO: 1496421 - RNA, 19 nt, Homo sapiens
agucggauauaaaguaugu

SEQ ID NO: 1496422 - RNA, 19 nt, Homo sapiens
ccaaggaauaugaacaaga

SEQ ID NO: 1496423 - RNA, 19 nt, Homo sapiens
caucaccaguaaaccauca

SEQ ID NO: 1496424 - RNA, 19 nt, Homo sapiens
gcuacaagagcaacauaau

SEQ ID NO: 1496425 - RNA, 19 nt, Homo sapiens
ugcaacauaugcuacaaga

SEQ ID NO: 1496426 - RNA, 19 nt, Homo sapiens
gggaaaccguuaguauuuu

SEQ ID NO: 1496427 - RNA, 19 nt, Homo sapiens
uaccgucugugcaacauau

SEQ ID NO: 1496428 - RNA, 19 nt, Homo sapiens
cagggaccaucuaagcuau

SEQ ID NO: 1496429 - RNA, 19 nt, Homo sapiens
aagguggccugcauggaaa

SEQ ID NO: 1496430 - RNA, 19 nt, Homo sapiens
acauggcaauuuaacaguu

SEQ ID NO: 1496431 - RNA, 19 nt, Homo sapiens
gauaaacaucauaggugaa

SEQ ID NO: 1496432 - RNA, 19 nt, Homo sapiens
gagaauugaggcgcauaaa

SEQ ID NO: 1496433 - RNA, 19 nt, Homo sapiens
uauacuguacuguggauaa

SEQ ID NO: 1496434 - RNA, 19 nt, Homo sapiens
gaaacgacugucaccuugu

SEQ ID NO: 1496435 - RNA, 19 nt, Homo sapiens
guaauccaucugcaaguga

SEQ ID NO: 1496436 - RNA, 19 nt, Homo sapiens
gaauucuccuccacuacgu

SEQ ID NO: 1496437 - RNA, 19 nt, Homo sapiens
acuccuaacucgguucgua

SEQ ID NO: 1496438 - RNA, 19 nt, Homo sapiens
ccaguaaaccaucaaaugc

SEQ ID NO: 1496439 - RNA, 19 nt, Homo sapiens
aaacauggcaauuuaacag

SEQ ID NO: 1496440 - RNA, 19 nt, Homo sapiens
cuucauguguaguauuguu

SEQ ID NO: 1496441 - RNA, 19 nt, Homo sapiens
gucuucauguguaguauug

SEQ ID NO: 1496442 - RNA, 19 nt, Homo sapiens
gaaauacgguuuacauauc

SEQ ID NO: 1496443 - RNA, 19 nt, Homo sapiens
ggaagaagacagacacuuu

SEQ ID NO: 1496444 - RNA, 19 nt, Homo sapiens
ggaguagacuguacagaga

SEQ ID NO: 1496445 - RNA, 19 nt, Homo sapiens
gagcacagcagcccaaauu

SEQ ID NO: 1496446 - RNA, 19 nt, Homo sapiens
gaagaaauacgguuuacau

SEQ ID NO: 1496447 - RNA, 19 nt, Homo sapiens
caaauuugcuuguaauguc

SEQ ID NO: 1496448 - RNA, 19 nt, Homo sapiens
ccaaagagguucccaagac

SEQ ID NO: 1496449 - RNA, 19 nt, Homo sapiens
gcacagcagcccaaauuug

SEQ ID NO: 1496450 - RNA, 19 nt, Homo sapiens
guauugaccucuggaagaa

SEQ ID NO: 1496451 - RNA, 19 nt, Homo sapiens
gaagaagacagacacuuuc

SEQ ID NO: 1496452 - RNA, 19 nt, Homo sapiens
caaagagguucccaagaca

SEQ ID NO: 1496453 - RNA, 19 nt, Homo sapiens
ggguggaacuggauucuuc

SEQ ID NO: 1496454 - RNA, 19 nt, Homo sapiens
acacuggucuggugaagau

SEQ ID NO: 1496455 - RNA, 19 nt, Homo sapiens
ggacuggaguagacuguac

SEQ ID NO: 1496456 - RNA, 19 nt, Homo sapiens
gcccaaauuugcuuguaau

SEQ ID NO: 1496457 - RNA, 19 nt, Homo sapiens
caacaaccacccaucaaca

SEQ ID NO: 1496458 - RNA, 19 nt, Homo sapiens
acaaaaggcucucccuaaa

SEQ ID NO: 1496459 - RNA, 19 nt, Homo sapiens
ggaauggagugggccaaca

SEQ ID NO: 1496460 - RNA, 19 nt, Homo sapiens
aaagggacccgucaaggaa

SEQ ID NO: 1496461 - RNA, 19 nt, Homo sapiens
gugaagauguccaggaaac

SEQ ID NO: 1496462 - RNA, 19 nt, Homo sapiens
ccaacaggguguagaguac

SEQ ID NO: 1496463 - RNA, 19 nt, Homo sapiens
ccagauaaauagccaacag

SEQ ID NO: 1496464 - RNA, 19 nt, Homo sapiens
gccaacaggguguagagua

SEQ ID NO: 1496465 - RNA, 19 nt, Homo sapiens
ccauggugauagaaauaaa

SEQ ID NO: 1496466 - RNA, 19 nt, Homo sapiens
aaccuuugguccuaaauga

SEQ ID NO: 1496467 - RNA, 19 nt, Homo sapiens
caucaacaccaaagagguu

SEQ ID NO: 1496468 - RNA, 19 nt, Homo sapiens
cagcccaaauuugcuugua

SEQ ID NO: 1496469 - RNA, 19 nt, Homo sapiens
ugaaaagucuccagaaguc

SEQ ID NO: 1496470 - RNA, 19 nt, Homo sapiens
guauauauguaggguugau

SEQ ID NO: 1496471 - RNA, 19 nt, Homo sapiens
uggugaagauguccaggaa

SEQ ID NO: 1496472 - RNA, 19 nt, Homo sapiens
gaagauguccaggaaacca

SEQ ID NO: 1496473 - RNA, 19 nt, Homo sapiens
aaaaggcucucccuaaaag

SEQ ID NO: 1496474 - RNA, 19 nt, Homo sapiens
ccaaauuugcuuguaaugu

SEQ ID NO: 1496475 - RNA, 19 nt, Homo sapiens
cguauugaccucuggaaga

SEQ ID NO: 1496476 - RNA, 19 nt, Homo sapiens
guuuacauaucuuccaagu

SEQ ID NO: 1496477 - RNA, 19 nt, Homo sapiens
caaaaggcucucccuaaaa

SEQ ID NO: 1496478 - RNA, 19 nt, Homo sapiens
gagcuacacuuggcaaacc

SEQ ID NO: 1496479 - RNA, 19 nt, Homo sapiens
gagcucccacgaucguauu

SEQ ID NO: 1496480 - RNA, 19 nt, Homo sapiens
ggagcucccacgaucguau

SEQ ID NO: 1496481 - RNA, 19 nt, Homo sapiens
cagguggacuggaguagac

SEQ ID NO: 1496482 - RNA, 19 nt, Homo sapiens
agcccaaauuugcuuguaa

SEQ ID NO: 1496483 - RNA, 19 nt, Homo sapiens
aaagucuccagaagucuaa

SEQ ID NO: 1496484 - RNA, 19 nt, Homo sapiens
gcaaggccagagacuucaa

SEQ ID NO: 1496485 - RNA, 19 nt, Homo sapiens
ccuuugguccuaaaugauu

SEQ ID NO: 1496486 - RNA, 19 nt, Homo sapiens
ggguguagaguacguuuua

SEQ ID NO: 1496487 - RNA, 19 nt, Homo sapiens
ccagccagagcuacacuug

SEQ ID NO: 1496488 - RNA, 19 nt, Homo sapiens
aaagagguucccaagacaa

SEQ ID NO: 1496489 - RNA, 19 nt, Homo sapiens
cgguuuacauaucuuccaa

SEQ ID NO: 1496490 - RNA, 19 nt, Homo sapiens
ggaguagacuguacagaga

SEQ ID NO: 1496491 - RNA, 19 nt, Homo sapiens
gagcacagcagcccaaauu

SEQ ID NO: 1496492 - RNA, 19 nt, Homo sapiens
caaauuugcuuguaauguc

SEQ ID NO: 1496493 - RNA, 19 nt, Homo sapiens
ccaaagagguucccaagac

SEQ ID NO: 1496494 - RNA, 19 nt, Homo sapiens
gcacagcagcccaaauuug

SEQ ID NO: 1496495 - RNA, 19 nt, Homo sapiens
caaagagguucccaagaca

SEQ ID NO: 1496496 - RNA, 19 nt, Homo sapiens
ggagguggaggguugauuu

SEQ ID NO: 1496497 - RNA, 19 nt, Homo sapiens
ggguggaacuggauucuuc

SEQ ID NO: 1496498 - RNA, 19 nt, Homo sapiens
acacuggucuggugaagau

SEQ ID NO: 1496499 - RNA, 19 nt, Homo sapiens
ggacuggaguagacuguac

SEQ ID NO: 1496500 - RNA, 19 nt, Homo sapiens
gcccaaauuugcuuguaau

SEQ ID NO: 1496501 - RNA, 19 nt, Homo sapiens
caacaaccacccaucaaca

SEQ ID NO: 1496502 - RNA, 19 nt, Homo sapiens
acaaaaggcucucccuaaa

SEQ ID NO: 1496503 - RNA, 19 nt, Homo sapiens
ggaauggagugggccaaca

SEQ ID NO: 1496504 - RNA, 19 nt, Homo sapiens
aaagggacccgucaaggaa

SEQ ID NO: 1496505 - RNA, 19 nt, Homo sapiens
gugaagauguccaggaaac

SEQ ID NO: 1496506 - RNA, 19 nt, Homo sapiens
ccaacaggguguagaguac

SEQ ID NO: 1496507 - RNA, 19 nt, Homo sapiens
ccagauaaauagccaacag

SEQ ID NO: 1496508 - RNA, 19 nt, Homo sapiens
gccaacaggguguagagua

SEQ ID NO: 1496509 - RNA, 19 nt, Homo sapiens
ccauggugauagaaauaaa

SEQ ID NO: 1496510 - RNA, 19 nt, Homo sapiens
caucaacaccaaagagguu

SEQ ID NO: 1496511 - RNA, 19 nt, Homo sapiens
cagcccaaauuugcuugua

SEQ ID NO: 1496512 - RNA, 19 nt, Homo sapiens
ugaaaagucuccagaaguc

SEQ ID NO: 1496513 - RNA, 19 nt, Homo sapiens
uggugaagauguccaggaa

SEQ ID NO: 1496514 - RNA, 19 nt, Homo sapiens
gaagauguccaggaaacca

SEQ ID NO: 1496515 - RNA, 19 nt, Homo sapiens
aaaaggcucucccuaaaag

SEQ ID NO: 1496516 - RNA, 19 nt, Homo sapiens
ccaaauuugcuuguaaugu

SEQ ID NO: 1496517 - RNA, 19 nt, Homo sapiens
caaaaggcucucccuaaaa

SEQ ID NO: 1496518 - RNA, 19 nt, Homo sapiens
gagguggaggguugauuug

SEQ ID NO: 1496519 - RNA, 19 nt, Homo sapiens
agcccaaauuugcuuguaa

SEQ ID NO: 1496520 - RNA, 19 nt, Homo sapiens
cagguggacuggaguagac

SEQ ID NO: 1496521 - RNA, 19 nt, Homo sapiens
aaagucuccagaagucuaa

SEQ ID NO: 1496522 - RNA, 19 nt, Homo sapiens
gcaaggccagagacuucaa

SEQ ID NO: 1496523 - RNA, 19 nt, Homo sapiens
ggguguagaguacguuuua

SEQ ID NO: 1496524 - RNA, 19 nt, Homo sapiens
aaagagguucccaagacaa

SEQ ID NO: 1496525 - RNA, 19 nt, Homo sapiens
gaggaagucugaaauguua

SEQ ID NO: 1496526 - RNA, 19 nt, Homo sapiens
guaaugagcugcaagaucu

SEQ ID NO: 1496527 - RNA, 19 nt, Homo sapiens
gcaagagaccaaagcauua

SEQ ID NO: 1496528 - RNA, 19 nt, Homo sapiens
gcuacuaccuguccuacua

SEQ ID NO: 1496529 - RNA, 19 nt, Homo sapiens
acuuagagcuggcaacuua

SEQ ID NO: 1496530 - RNA, 19 nt, Homo sapiens
ggacauauccugcccaaca

SEQ ID NO: 1496531 - RNA, 19 nt, Homo sapiens
cuaaacagaugaugcaaau

SEQ ID NO: 1496532 - RNA, 19 nt, Homo sapiens
gaaggaagcgaaagaggaa

SEQ ID NO: 1496533 - RNA, 19 nt, Homo sapiens
ccacgagcuucaaauguuu

SEQ ID NO: 1496534 - RNA, 19 nt, Homo sapiens
gccaaucucuggaagaaga

SEQ ID NO: 1496535 - RNA, 19 nt, Homo sapiens
gaaagaggaagucugaaau

SEQ ID NO: 1496536 - RNA, 19 nt, Homo sapiens
gaucagccuuauccuggua

SEQ ID NO: 1496537 - RNA, 19 nt, Homo sapiens
ugguaugucugcccauuua

SEQ ID NO: 1496538 - RNA, 19 nt, Homo sapiens
ccaacaacuugcaaucuga

SEQ ID NO: 1496539 - RNA, 19 nt, Homo sapiens
cgaaagaggaagucugaaa

SEQ ID NO: 1496540 - RNA, 19 nt, Homo sapiens
caaagaaggaagcgaaaga

SEQ ID NO: 1496541 - RNA, 19 nt, Homo sapiens
uggaagcuuugcugaauuu

SEQ ID NO: 1496542 - RNA, 19 nt, Homo sapiens
caagacaacagaaaccauu

SEQ ID NO: 1496543 - RNA, 19 nt, Homo sapiens
aaacagaugaugcaaaugu

SEQ ID NO: 1496544 - RNA, 19 nt, Homo sapiens
uggcaaagccuuguaauga

SEQ ID NO: 1496545 - RNA, 19 nt, Homo sapiens
ggaacauggugacgaguag

SEQ ID NO: 1496546 - RNA, 19 nt, Homo sapiens
caaaccucauggagcauuu

SEQ ID NO: 1496547 - RNA, 19 nt, Homo sapiens
ggaccacgagcuucaaaug

SEQ ID NO: 1496548 - RNA, 19 nt, Homo sapiens
gaagaagauuccgcauugg

SEQ ID NO: 1496549 - RNA, 19 nt, Homo sapiens
ggcaaagccuuguaaugag

SEQ ID NO: 1496550 - RNA, 19 nt, Homo sapiens
uuagugagagugaauguuu

SEQ ID NO: 1496551 - RNA, 19 nt, Homo sapiens
gagaugugccuaaacagau

SEQ ID NO: 1496552 - RNA, 19 nt, Homo sapiens
caagagaccaaagcauuau

SEQ ID NO: 1496553 - RNA, 19 nt, Homo sapiens
gcuccggguccucauauuu

SEQ ID NO: 1496554 - RNA, 19 nt, Homo sapiens
ccauuuggauccugcuguu

SEQ ID NO: 1496555 - RNA, 19 nt, Homo sapiens
gcguguggcucacuuagag

SEQ ID NO: 1496556 - RNA, 19 nt, Homo sapiens
gcaaaccucauggagcauu

SEQ ID NO: 1496557 - RNA, 19 nt, Homo sapiens
aagaggaagucugaaaugu

SEQ ID NO: 1496558 - RNA, 19 nt, Homo sapiens
uggcgggaaucucuaaaga

SEQ ID NO: 1496559 - RNA, 19 nt, Homo sapiens
caagaggacgugaggaaca

SEQ ID NO: 1496560 - RNA, 19 nt, Homo sapiens
uguaacggguuugaagaaa

SEQ ID NO: 1496561 - RNA, 19 nt, Homo sapiens
accacgagcuucaaauguu

SEQ ID NO: 1496562 - RNA, 19 nt, Homo sapiens
aaagaggaagucugaaaug

SEQ ID NO: 1496563 - RNA, 19 nt, Homo sapiens
gaucuuagugagagugaau

SEQ ID NO: 1496564 - RNA, 19 nt, Homo sapiens
ggauggcgggaaucucuaa

SEQ ID NO: 1496565 - RNA, 19 nt, Homo sapiens
uggccaaucucuggaagaa

SEQ ID NO: 1496566 - RNA, 19 nt, Homo sapiens
guaugucugcccauuuauu

SEQ ID NO: 1496567 - RNA, 19 nt, Homo sapiens
agagaccaaagcauuauuu

SEQ ID NO: 1496568 - RNA, 19 nt, Homo sapiens
gaccacgagcuucaaaugu

SEQ ID NO: 1496569 - RNA, 19 nt, Homo sapiens
gcaagaucuuagugagagu

SEQ ID NO: 1496570 - RNA, 19 nt, Homo sapiens
ggagcauuuuggaaaguua

SEQ ID NO: 1496571 - RNA, 19 nt, Homo sapiens
uaaagaugcgggucagcaa

SEQ ID NO: 1496572 - RNA, 19 nt, Homo sapiens
ggugacgaguagcaagaga

SEQ ID NO: 1496573 - RNA, 19 nt, Homo sapiens
agaggaagucugaaauguu

SEQ ID NO: 1496574 - RNA, 19 nt, Homo sapiens
acagaguuguaacggguuu

SEQ ID NO: 1496575 - RNA, 19 nt, Homo sapiens
ggaggaauaggagaaguca

SEQ ID NO: 1496576 - RNA, 19 nt, Homo sapiens
ggaagucugaaauguuaca

SEQ ID NO: 1496577 - RNA, 19 nt, Homo sapiens
ggccgaugauuuacaaagg

SEQ ID NO: 1496578 - RNA, 19 nt, Homo sapiens
gacauauccugcccaacag

SEQ ID NO: 1496579 - RNA, 19 nt, Homo sapiens
gcuugcaaauggacauauc

SEQ ID NO: 1496580 - RNA, 19 nt, Homo sapiens
uaugucugcccauuuauug

SEQ ID NO: 1496581 - RNA, 19 nt, Homo sapiens
acagaugaugcaaauguuu

SEQ ID NO: 1496582 - RNA, 19 nt, Homo sapiens
agaugugccuaaacagaug

SEQ ID NO: 1496583 - RNA, 19 nt, Homo sapiens
uccaacaacuugcaaucug

SEQ ID NO: 1496584 - RNA, 19 nt, Homo sapiens
ugaagaaacaaagaaggaa

SEQ ID NO: 1496585 - RNA, 19 nt, Homo sapiens
agagaugugccuaaacaga

SEQ ID NO: 1496586 - RNA, 19 nt, Homo sapiens
gugaauguuugagacacaa

SEQ ID NO: 1496587 - RNA, 19 nt, Homo sapiens
uagugagagugaauguuug

SEQ ID NO: 1496588 - RNA, 19 nt, Homo sapiens
agcaagagaccaaagcauu

SEQ ID NO: 1496589 - RNA, 19 nt, Homo sapiens
aaagaugcgggucagcaaa

SEQ ID NO: 1496590 - RNA, 19 nt, Homo sapiens
acaaaggcaggacaacaga

SEQ ID NO: 1496591 - RNA, 19 nt, Homo sapiens
ccuaaacagaugaugcaaa

SEQ ID NO: 1496592 - RNA, 19 nt, Homo sapiens
ugagagugaauguuugaga

SEQ ID NO: 1496593 - RNA, 19 nt, Homo sapiens
gggaaaaucagguggcaaa

SEQ ID NO: 1496594 - RNA, 19 nt, Homo sapiens
ccggagccaugucuucaca

SEQ ID NO: 1496595 - RNA, 19 nt, Homo sapiens
gagcugcaagaucuuagug

SEQ ID NO: 1496596 - RNA, 19 nt, Homo sapiens
auuggaagcuuugcugaau

SEQ ID NO: 1496597 - RNA, 19 nt, Homo sapiens
gagcuggcaacuuaugagu

SEQ ID NO: 1496598 - RNA, 19 nt, Homo sapiens
ccugguaugucugcccauu

SEQ ID NO: 1496599 - RNA, 19 nt, Homo sapiens
uuggaagcuuugcugaauu

SEQ ID NO: 1496600 - RNA, 19 nt, Homo sapiens
guuguaacggguuugaaga

SEQ ID NO: 1496601 - RNA, 19 nt, Homo sapiens
guggcaaagccuuguaaug

SEQ ID NO: 1496602 - RNA, 19 nt, Homo sapiens
caggauggcgggaaucucu

SEQ ID NO: 1496603 - RNA, 19 nt, Homo sapiens
gcucaugcucuccauuugg

SEQ ID NO: 1496604 - RNA, 19 nt, Homo sapiens
aaugagcugcaagaucuua

SEQ ID NO: 1496605 - RNA, 19 nt, Homo sapiens
aagaagauuccgcauugga

SEQ ID NO: 1496606 - RNA, 19 nt, Homo sapiens
guaaagagcugguggauau

SEQ ID NO: 1496607 - RNA, 19 nt, Homo sapiens
gaaggaaccugugaaauuu

SEQ ID NO: 1496608 - RNA, 19 nt, Homo sapiens
gaagggagcuggugccauu

SEQ ID NO: 1496609 - RNA, 19 nt, Homo sapiens
ggaaggaaccugugaaauu

SEQ ID NO: 1496610 - RNA, 19 nt, Homo sapiens
gaagaaagccugcguaaag

SEQ ID NO: 1496611 - RNA, 19 nt, Homo sapiens
ggaccaagaucucauuaug

SEQ ID NO: 1496612 - RNA, 19 nt, Homo sapiens
ccgagcagcuuuagucuua

SEQ ID NO: 1496613 - RNA, 19 nt, Homo sapiens
agagaaaggugaaauguau

SEQ ID NO: 1496614 - RNA, 19 nt, Homo sapiens
gaucaaacaacccauauga

SEQ ID NO: 1496615 - RNA, 19 nt, Homo sapiens
gagggaggcucaugcugua

SEQ ID NO: 1496616 - RNA, 19 nt, Homo sapiens
caaacaacccauaugauuu

SEQ ID NO: 1496617 - RNA, 19 nt, Homo sapiens
gcgcuaggcuuucucauag

SEQ ID NO: 1496618 - RNA, 19 nt, Homo sapiens
gaagaaaagcucagauaua

SEQ ID NO: 1496619 - RNA, 19 nt, Homo sapiens
gaaguacucuuuucaguug

SEQ ID NO: 1496620 - RNA, 19 nt, Homo sapiens
gggaauuuauugacucauu

SEQ ID NO: 1496621 - RNA, 19 nt, Homo sapiens
ucaaacaacccauaugauu

SEQ ID NO: 1496622 - RNA, 19 nt, Homo sapiens
ggugugggcucugauauug

SEQ ID NO: 1496623 - RNA, 19 nt, Homo sapiens
ggugaaauguauagauguu

SEQ ID NO: 1496624 - RNA, 19 nt, Homo sapiens
ggugguguuucuauuaauu

SEQ ID NO: 1496625 - RNA, 19 nt, Homo sapiens
gcaaugaugucagcaaagg

SEQ ID NO: 1496626 - RNA, 19 nt, Homo sapiens
gcgauggcaccuucauuua

SEQ ID NO: 1496627 - RNA, 19 nt, Homo sapiens
gguuguggcuggacccuuu

SEQ ID NO: 1496628 - RNA, 19 nt, Homo sapiens
agacacaaagguacauuua

SEQ ID NO: 1496629 - RNA, 19 nt, Homo sapiens
cagagaagcaggaagauga

SEQ ID NO: 1496630 - RNA, 19 nt, Homo sapiens
uaacacggcccuucaacuu

SEQ ID NO: 1496631 - RNA, 19 nt, Homo sapiens
gaaccgucgugaugccauu

SEQ ID NO: 1496632 - RNA, 19 nt, Homo sapiens
guggugguguuucuauuaa

SEQ ID NO: 1496633 - RNA, 19 nt, Homo sapiens
guaaauggauaagugcaau

SEQ ID NO: 1496634 - RNA, 19 nt, Homo sapiens
acacggcccuucaacuuug

SEQ ID NO: 1496635 - RNA, 19 nt, Homo sapiens
gaugguguguucuuauauc

SEQ ID NO: 1496636 - RNA, 19 nt, Homo sapiens
acacuggacuuguaaacga

SEQ ID NO: 1496637 - RNA, 19 nt, Homo sapiens
ccucuuugcuuaguacuuu

SEQ ID NO: 1496638 - RNA, 19 nt, Homo sapiens
uagauguuguucaggcuua

SEQ ID NO: 1496639 - RNA, 19 nt, Homo sapiens
gagaaaggugaaauguaua

SEQ ID NO: 1496640 - RNA, 19 nt, Homo sapiens
ucgaaugccugcuuucuuc

SEQ ID NO: 1496641 - RNA, 19 nt, Homo sapiens
uaggacauguaaauggaua

SEQ ID NO: 1496642 - RNA, 19 nt, Homo sapiens
gcuggacccuuuaaugauc

SEQ ID NO: 1496643 - RNA, 19 nt, Homo sapiens
ucaaggacgugaacccaau

SEQ ID NO: 1496644 - RNA, 19 nt, Homo sapiens
aagaaagccugcguaaaga

SEQ ID NO: 1496645 - RNA, 19 nt, Homo sapiens
ggaagaaagccugcguaaa

SEQ ID NO: 1496646 - RNA, 19 nt, Homo sapiens
ccauuggacuggcuuuguu

SEQ ID NO: 1496647 - RNA, 19 nt, Homo sapiens
gagccucaguucaacaugu

SEQ ID NO: 1496648 - RNA, 19 nt, Homo sapiens
cuucauaagucccucuuug

SEQ ID NO: 1496649 - RNA, 19 nt, Homo sapiens
gaaccauugcuucugcuuu

SEQ ID NO: 1496650 - RNA, 19 nt, Homo sapiens
ggauaagugcaauaaaguu

SEQ ID NO: 1496651 - RNA, 19 nt, Homo sapiens
gccggugacugaaccauug

SEQ ID NO: 1496652 - RNA, 19 nt, Homo sapiens
gacacaaagguacauuuaa

SEQ ID NO: 1496653 - RNA, 19 nt, Homo sapiens
gcccaggaguuguuucugu

SEQ ID NO: 1496654 - RNA, 19 nt, Homo sapiens
cagagaaaggugaaaugua

SEQ ID NO: 1496655 - RNA, 19 nt, Homo sapiens
acauguaaauggauaagug

SEQ ID NO: 1496656 - RNA, 19 nt, Homo sapiens
ugaugaugguguguucuua

SEQ ID NO: 1496657 - RNA, 19 nt, Homo sapiens
guagugaguuguguaugug

SEQ ID NO: 1496658 - RNA, 19 nt, Homo sapiens
gacgugaacccaaugauca

SEQ ID NO: 1496659 - RNA, 19 nt, Homo sapiens
aaggugaaauguauagaug

SEQ ID NO: 1496660 - RNA, 19 nt, Homo sapiens
agaaacaacuggggaauuu

SEQ ID NO: 1496661 - RNA, 19 nt, Homo sapiens
cagcagacaagcagagaaa

SEQ ID NO: 1496662 - RNA, 19 nt, Homo sapiens
caacccauaugauuuacag

SEQ ID NO: 1496663 - RNA, 19 nt, Homo sapiens
cuacaaggaaugcccaauu

SEQ ID NO: 1496664 - RNA, 19 nt, Homo sapiens
gcauucaguuguuccucuu

SEQ ID NO: 1496665 - RNA, 19 nt, Homo sapiens
gcccuggguuugccuguga

SEQ ID NO: 1496666 - RNA, 19 nt, Homo sapiens
ucagauauagcaaugagaa

SEQ ID NO: 1496667 - RNA, 19 nt, Homo sapiens
ugugggaguugaucaaaug

SEQ ID NO: 1496668 - RNA, 19 nt, Homo sapiens
aaacaugucaguccucugu

SEQ ID NO: 1496669 - RNA, 19 nt, Homo sapiens
ugauauuggugguagcauu

SEQ ID NO: 1496670 - RNA, 19 nt, Homo sapiens
gaugaagccacccuggaaa

SEQ ID NO: 1496671 - RNA, 19 nt, Homo sapiens
ggacgugaacccaaugauc

SEQ ID NO: 1496672 - RNA, 19 nt, Homo sapiens
uaacuguuggucuuacuaa

SEQ ID NO: 1496673 - RNA, 19 nt, Homo sapiens
gggacugaaugccaaagga

SEQ ID NO: 1496674 - RNA, 19 nt, Homo sapiens
guucuuauaucccucacau

SEQ ID NO: 1496675 - RNA, 19 nt, Homo sapiens
ccugugaaauuuguagauu

SEQ ID NO: 1496676 - RNA, 19 nt, Homo sapiens
gcagacaagcagagaaaca

SEQ ID NO: 1496677 - RNA, 19 nt, Homo sapiens
ucgcaaugaugucagcaaa

SEQ ID NO: 1496678 - RNA, 19 nt, Homo sapiens
gguuaaaacuagacacaaa

SEQ ID NO: 1496679 - RNA, 19 nt, Homo sapiens
gguccuaugugccgcuaug

SEQ ID NO: 1496680 - RNA, 19 nt, Homo sapiens
uguagugaguuguguaugu

SEQ ID NO: 1496681 - RNA, 19 nt, Homo sapiens
gcuuauaucaacagaauca

SEQ ID NO: 1496682 - RNA, 19 nt, Homo sapiens
aggcuuauaucaacagaau

SEQ ID NO: 1496683 - RNA, 19 nt, Homo sapiens
ggcgcuaggcuuucucaua

SEQ ID NO: 1496684 - RNA, 19 nt, Homo sapiens
augaugguguguucuuaua

SEQ ID NO: 1496685 - RNA, 19 nt, Homo sapiens
aagaaaagcucagauauag

SEQ ID NO: 1496686 - RNA, 19 nt, Homo sapiens
gcaaugagaaauaccaaaa

SEQ ID NO: 1496687 - RNA, 19 nt, Homo sapiens
aagcucagauauagcaaug

SEQ ID NO: 1496688 - RNA, 19 nt, Homo sapiens
gaaaagcucagauauagca

SEQ ID NO: 1496689 - RNA, 19 nt, Homo sapiens
ccuugaaacuauucuagga

SEQ ID NO: 1496690 - RNA, 19 nt, Homo sapiens
caauucuucuggacucaug

SEQ ID NO: 1496691 - RNA, 19 nt, Homo sapiens
ggucuguccaggaaaguuu

SEQ ID NO: 1496692 - RNA, 19 nt, Homo sapiens
uggcuggacccuuuaauga

SEQ ID NO: 1496693 - RNA, 19 nt, Homo sapiens
gauauuggugguagcauuc

SEQ ID NO: 1496694 - RNA, 19 nt, Homo sapiens
gcuucuugcuuuuauguua

SEQ ID NO: 1496695 - RNA, 19 nt, Homo sapiens
gaugaugguguguucuuau

SEQ ID NO: 1496696 - RNA, 19 nt, Homo sapiens
aagcugauccgacagagaa

SEQ ID NO: 1496697 - RNA, 19 nt, Homo sapiens
guuaauguguguguguguu

SEQ ID NO: 1496698 - RNA, 19 nt, Homo sapiens
aaccauugcuucugcuuuc

SEQ ID NO: 1496699 - RNA, 19 nt, Homo sapiens
caacauguuaaacugaaga

SEQ ID NO: 1496700 - RNA, 19 nt, Homo sapiens
ucuaggagccucaguucaa

SEQ ID NO: 1496701 - RNA, 19 nt, Homo sapiens
gcagagaagcaggaagaug

SEQ ID NO: 1496702 - RNA, 19 nt, Homo sapiens
gccugggucugucagugua

SEQ ID NO: 1496703 - RNA, 19 nt, Homo sapiens
gaaccugugaaauuuguag

SEQ ID NO: 1496704 - RNA, 19 nt, Homo sapiens
ggaggcucaugcuguagau

SEQ ID NO: 1496705 - RNA, 19 nt, Homo sapiens
ggaaaauuaggacauguaa

SEQ ID NO: 1496706 - RNA, 19 nt, Homo sapiens
cagcagagcuccuuaaaua

SEQ ID NO: 1496707 - RNA, 19 nt, Homo sapiens
guaauaaacucuucacauc

SEQ ID NO: 1496708 - RNA, 19 nt, Homo sapiens
gaucuccucuuguaauaaa

SEQ ID NO: 1496709 - RNA, 19 nt, Homo sapiens
cgagagaccuuuccuuugu

SEQ ID NO: 1496710 - RNA, 19 nt, Homo sapiens
ggugaacucuggaaucuug

SEQ ID NO: 1496711 - RNA, 19 nt, Homo sapiens
gcaccucccugcuaauaau

SEQ ID NO: 1496712 - RNA, 19 nt, Homo sapiens
gcagagcuccuuaaauaug

SEQ ID NO: 1496713 - RNA, 19 nt, Homo sapiens
ucuggaaucuugacuauug

SEQ ID NO: 1496714 - RNA, 19 nt, Homo sapiens
gauagugucucucuucucu

SEQ ID NO: 1496715 - RNA, 19 nt, Homo sapiens
gggcaaaccuucgccaaga

SEQ ID NO: 1496716 - RNA, 19 nt, Homo sapiens
agaaacaccugcaggaugu

SEQ ID NO: 1496717 - RNA, 19 nt, Homo sapiens
ugggaucucuggacucuuu

SEQ ID NO: 1496718 - RNA, 19 nt, Homo sapiens
ccgaucuccucuuguaaua

SEQ ID NO: 1496719 - RNA, 19 nt, Homo sapiens
ugaagacgcacaugguuaa

SEQ ID NO: 1496720 - RNA, 19 nt, Homo sapiens
ggaccuucaccaccucuua

SEQ ID NO: 1496721 - RNA, 19 nt, Homo sapiens
ccaagaagcaccagcugaa

SEQ ID NO: 1496722 - RNA, 19 nt, Homo sapiens
ggaaggcugugggaaaucu

SEQ ID NO: 1496723 - RNA, 19 nt, Homo sapiens
caagaagacauuuaucaca

SEQ ID NO: 1496724 - RNA, 19 nt, Homo sapiens
cagcgacccuccucaaagu

SEQ ID NO: 1496725 - RNA, 19 nt, Homo sapiens
ggcgagagaccuuuccuuu

SEQ ID NO: 1496726 - RNA, 19 nt, Homo sapiens
gggcaccucccugcuaaua

SEQ ID NO: 1496727 - RNA, 19 nt, Homo sapiens
ggcaaaccuucgccaagaa

SEQ ID NO: 1496728 - RNA, 19 nt, Homo sapiens
gaccugcuguugcgcuuug

SEQ ID NO: 1496729 - RNA, 19 nt, Homo sapiens
gagagaccuuuccuuugug

SEQ ID NO: 1496730 - RNA, 19 nt, Homo sapiens
aaacagugucucagaacua

SEQ ID NO: 1496731 - RNA, 19 nt, Homo sapiens
gacagaaugaucucaguga

SEQ ID NO: 1496732 - RNA, 19 nt, Homo sapiens
gccagaggcccuucaaaug

SEQ ID NO: 1496733 - RNA, 19 nt, Homo sapiens
uagugucucucuucucuga

SEQ ID NO: 1496734 - RNA, 19 nt, Homo sapiens
gcacagucacuauccacaa

SEQ ID NO: 1496735 - RNA, 19 nt, Homo sapiens
gcgagagaccuuuccuuug

SEQ ID NO: 1496736 - RNA, 19 nt, Homo sapiens
guggaaggcugugggaaau

SEQ ID NO: 1496737 - RNA, 19 nt, Homo sapiens
aauaaacucuucacaucca

SEQ ID NO: 1496738 - RNA, 19 nt, Homo sapiens
ugcccgaucuccucuugua

SEQ ID NO: 1496739 - RNA, 19 nt, Homo sapiens
cuauugauguggcuucugu

SEQ ID NO: 1496740 - RNA, 19 nt, Homo sapiens
ggacacagcauuggugaac

SEQ ID NO: 1496741 - RNA, 19 nt, Homo sapiens
aaucuugacuauugaugug

SEQ ID NO: 1496742 - RNA, 19 nt, Homo sapiens
ggugggccaggaucucuua

SEQ ID NO: 1496743 - RNA, 19 nt, Homo sapiens
gcaagaagacauuuaucac

SEQ ID NO: 1496744 - RNA, 19 nt, Homo sapiens
cagagcuccuuaaauaugg

SEQ ID NO: 1496745 - RNA, 19 nt, Homo sapiens
gaaucuugacuauugaugu

SEQ ID NO: 1496746 - RNA, 19 nt, Homo sapiens
acacccagcagugaacuua

SEQ ID NO: 1496747 - RNA, 19 nt, Homo sapiens
gaagacgcacaugguuaaa

SEQ ID NO: 1496748 - RNA, 19 nt, Homo sapiens
ugcaggauguggacacuug

SEQ ID NO: 1496749 - RNA, 19 nt, Homo sapiens
cuacauucacuccaagaaa

SEQ ID NO: 1496750 - RNA, 19 nt, Homo sapiens
agagaccuuuccuuuguga

SEQ ID NO: 1496751 - RNA, 19 nt, Homo sapiens
ugaaaacagugucucagaa

SEQ ID NO: 1496752 - RNA, 19 nt, Homo sapiens
gcuuugacacccagcagua

SEQ ID NO: 1496753 - RNA, 19 nt, Homo sapiens
acucuggaaucuugacuau

SEQ ID NO: 1496754 - RNA, 19 nt, Homo sapiens
ggauguggacacuuggaaa

SEQ ID NO: 1496755 - RNA, 19 nt, Homo sapiens
gcugcaagaagacauuuau

SEQ ID NO: 1496756 - RNA, 19 nt, Homo sapiens
acacccagcaguaagcuaa

SEQ ID NO: 1496757 - RNA, 19 nt, Homo sapiens
agaagacauuuaucacagu

SEQ ID NO: 1496758 - RNA, 19 nt, Homo sapiens
caguacuucugcugcauug

SEQ ID NO: 1496759 - RNA, 19 nt, Homo sapiens
ccagaggcccuucaaaugc

SEQ ID NO: 1496760 - RNA, 19 nt, Homo sapiens
gaccuuuccuuugugacuu

SEQ ID NO: 1496761 - RNA, 19 nt, Homo sapiens
caagaaacaccugcaggau

SEQ ID NO: 1496762 - RNA, 19 nt, Homo sapiens
ggcuguggcuggaacuuca

SEQ ID NO: 1496763 - RNA, 19 nt, Homo sapiens
ucgagcacccuuugugaaa

SEQ ID NO: 1496764 - RNA, 19 nt, Homo sapiens
gcguggugcuguacuugug

SEQ ID NO: 1496765 - RNA, 19 nt, Homo sapiens
cagaaugaucucagugaug

SEQ ID NO: 1496766 - RNA, 19 nt, Homo sapiens
acagaaugaucucagugau

SEQ ID NO: 1496767 - RNA, 19 nt, Homo sapiens
uacauucacuccaagaaac

SEQ ID NO: 1496768 - RNA, 19 nt, Homo sapiens
guucaugugcccuguggaa

SEQ ID NO: 1496769 - RNA, 19 nt, Homo sapiens
gacgaugaccggagguuca

SEQ ID NO: 1496770 - RNA, 19 nt, Homo sapiens
aaauucaccugcggaguca

SEQ ID NO: 1496771 - RNA, 19 nt, Homo sapiens
acacagcauuggugaacuc

SEQ ID NO: 1496772 - RNA, 19 nt, Homo sapiens
cuggauaccucucucuuuu

SEQ ID NO: 1496773 - RNA, 19 nt, Homo sapiens
ggaaucuugacuauugaug

SEQ ID NO: 1496774 - RNA, 19 nt, Homo sapiens
gggccaggaucucuuagcu

SEQ ID NO: 1496775 - RNA, 19 nt, Homo sapiens
gugucucucuucucugaug

SEQ ID NO: 1496776 - RNA, 19 nt, Homo sapiens
gccaugagcaggagaacuc

SEQ ID NO: 1496777 - RNA, 19 nt, Homo sapiens
ugcaagaagacauuuauca

SEQ ID NO: 1496778 - RNA, 19 nt, Homo sapiens
gcuaacaguggacacagau

SEQ ID NO: 1496779 - RNA, 19 nt, Homo sapiens
augaagacgcacaugguua

SEQ ID NO: 1496780 - RNA, 19 nt, Homo sapiens
cauccaagcacagcaugaa

SEQ ID NO: 1496781 - RNA, 19 nt, Homo sapiens
guugcccgaucuccucuug

SEQ ID NO: 1496782 - RNA, 19 nt, Homo sapiens
ccucaaggcgcacaugaag

SEQ ID NO: 1496783 - RNA, 19 nt, Homo sapiens
caaugcagcaggaaaccau

SEQ ID NO: 1496784 - RNA, 19 nt, Homo sapiens
ccagcgacccuccucaaag

SEQ ID NO: 1496785 - RNA, 19 nt, Homo sapiens
gacaguacuucugcugcau

SEQ ID NO: 1496786 - RNA, 19 nt, Homo sapiens
ccagccagagacagaauga

SEQ ID NO: 1496787 - RNA, 19 nt, Homo sapiens
ucagcuagaagcagcaaau

SEQ ID NO: 1496788 - RNA, 19 nt, Homo sapiens
uguggaaggcugugggaaa

SEQ ID NO: 1496789 - RNA, 19 nt, Homo sapiens
cacagucacuauccacaac

SEQ ID NO: 1496790 - RNA, 19 nt, Homo sapiens
ggacucuuuggccaugaaa

SEQ ID NO: 1496791 - RNA, 19 nt, Homo sapiens
ggcaccucccugcuaauaa

SEQ ID NO: 1496792 - RNA, 19 nt, Homo sapiens
cagcuagaagcagcaaauu

SEQ ID NO: 1496793 - RNA, 19 nt, Homo sapiens
ccgaggaccgaucaaccua

SEQ ID NO: 1496794 - RNA, 19 nt, Homo sapiens
gagcaauaguugagacuua

SEQ ID NO: 1496795 - RNA, 19 nt, Homo sapiens
gcagugauguugccuauau

SEQ ID NO: 1496796 - RNA, 19 nt, Homo sapiens
aaacuaagcugcagugaug

SEQ ID NO: 1496797 - RNA, 19 nt, Homo sapiens
ggaagaacuuaacuuacua

SEQ ID NO: 1496798 - RNA, 19 nt, Homo sapiens
gauaguuugugguccauua

SEQ ID NO: 1496799 - RNA, 19 nt, Homo sapiens
guacauaguucuuacauac

SEQ ID NO: 1496800 - RNA, 19 nt, Homo sapiens
ggagaguucugcauguuga

SEQ ID NO: 1496801 - RNA, 19 nt, Homo sapiens
gaacuaguuucugagauug

SEQ ID NO: 1496802 - RNA, 19 nt, Homo sapiens
ccacauugaugauaauuuc

SEQ ID NO: 1496803 - RNA, 19 nt, Homo sapiens
acaguaggaucacauuaua

SEQ ID NO: 1496804 - RNA, 19 nt, Homo sapiens
cacaacaucuggccuauau

SEQ ID NO: 1496805 - RNA, 19 nt, Homo sapiens
gaaagaaccaaggaguaua

SEQ ID NO: 1496806 - RNA, 19 nt, Homo sapiens
ggaaagaaccaaggaguau

SEQ ID NO: 1496807 - RNA, 19 nt, Homo sapiens
gaagcaauaccuaauccua

SEQ ID NO: 1496808 - RNA, 19 nt, Homo sapiens
caacaucuggccuauauug

SEQ ID NO: 1496809 - RNA, 19 nt, Homo sapiens
cauaugcacucaaugucua

SEQ ID NO: 1496810 - RNA, 19 nt, Homo sapiens
gcagcugcauguucaagaa

SEQ ID NO: 1496811 - RNA, 19 nt, Homo sapiens
caggguaggccuagaauaa

SEQ ID NO: 1496812 - RNA, 19 nt, Homo sapiens
gcagccaccuauauguaaa

SEQ ID NO: 1496813 - RNA, 19 nt, Homo sapiens
ggacaguaggaucacauua

SEQ ID NO: 1496814 - RNA, 19 nt, Homo sapiens
cugauggucuacuuuauuu

SEQ ID NO: 1496815 - RNA, 19 nt, Homo sapiens
gcucugauggucuacuuua

SEQ ID NO: 1496816 - RNA, 19 nt, Homo sapiens
gccaagcucugauggucua

SEQ ID NO: 1496817 - RNA, 19 nt, Homo sapiens
cuacauaggcagcaaacua

SEQ ID NO: 1496818 - RNA, 19 nt, Homo sapiens
ucagagauguucuuaaagg

SEQ ID NO: 1496819 - RNA, 19 nt, Homo sapiens
gaaaauggaguaacaaguu

SEQ ID NO: 1496820 - RNA, 19 nt, Homo sapiens
auaguuaccuggauuguca

SEQ ID NO: 1496821 - RNA, 19 nt, Homo sapiens
gacaguaggaucacauuau

SEQ ID NO: 1496822 - RNA, 19 nt, Homo sapiens
gcaauaguugagacuuaua

SEQ ID NO: 1496823 - RNA, 19 nt, Homo sapiens
gauggucuacuuuauuuga

SEQ ID NO: 1496824 - RNA, 19 nt, Homo sapiens
uggaagaacuuaacuuacu

SEQ ID NO: 1496825 - RNA, 19 nt, Homo sapiens
cuaaaguccuaaagaguuc

SEQ ID NO: 1496826 - RNA, 19 nt, Homo sapiens
gcucuugccucaccuuucu

SEQ ID NO: 1496827 - RNA, 19 nt, Homo sapiens
gcuuaucgccauuugagua

SEQ ID NO: 1496828 - RNA, 19 nt, Homo sapiens
cuugguagccuuugucuaa

SEQ ID NO: 1496829 - RNA, 19 nt, Homo sapiens
uucccuaucucccauauuu

SEQ ID NO: 1496830 - RNA, 19 nt, Homo sapiens
ggaguaacaaguucccuau

SEQ ID NO: 1496831 - RNA, 19 nt, Homo sapiens
ccuuaagcuugaaaucaua

SEQ ID NO: 1496832 - RNA, 19 nt, Homo sapiens
gggcauaugcacucaaugu

SEQ ID NO: 1496833 - RNA, 19 nt, Homo sapiens
acacaaaucagggacagua

SEQ ID NO: 1496834 - RNA, 19 nt, Homo sapiens
cuaauccuauguugcuauu

SEQ ID NO: 1496835 - RNA, 19 nt, Homo sapiens
gagaagcaauaccuaaucc

SEQ ID NO: 1496836 - RNA, 19 nt, Homo sapiens
ggccuagaauaaccacaaa

SEQ ID NO: 1496837 - RNA, 19 nt, Homo sapiens
gugauguugccuauauuua

SEQ ID NO: 1496838 - RNA, 19 nt, Homo sapiens
guaacaaguucccuaucuc

SEQ ID NO: 1496839 - RNA, 19 nt, Homo sapiens
ccauuuaguuuagugauca

SEQ ID NO: 1496840 - RNA, 19 nt, Homo sapiens
guuacggucuuagaguuaa

SEQ ID NO: 1496841 - RNA, 19 nt, Homo sapiens
ucaaauggccaagcucuga

SEQ ID NO: 1496842 - RNA, 19 nt, Homo sapiens
ucuacccacugcagauaua

SEQ ID NO: 1496843 - RNA, 19 nt, Homo sapiens
cagagauguucuuaaagga

SEQ ID NO: 1496844 - RNA, 19 nt, Homo sapiens
uacauaggcagcaaacuaa

SEQ ID NO: 1496845 - RNA, 19 nt, Homo sapiens
gaagcuacauaggcagcaa

SEQ ID NO: 1496846 - RNA, 19 nt, Homo sapiens
ucuaaaguccuaaagaguu

SEQ ID NO: 1496847 - RNA, 19 nt, Homo sapiens
gagauugucagcccuuugu

SEQ ID NO: 1496848 - RNA, 19 nt, Homo sapiens
caucagaaucucucuuuca

SEQ ID NO: 1496849 - RNA, 19 nt, Homo sapiens
uacccuguuucauccauua

SEQ ID NO: 1496850 - RNA, 19 nt, Homo sapiens
caauggaggagauaguuug

SEQ ID NO: 1496851 - RNA, 19 nt, Homo sapiens
ugucauagggauucgauuu

SEQ ID NO: 1496852 - RNA, 19 nt, Homo sapiens
ugucagcccuuugucuaaa

SEQ ID NO: 1496853 - RNA, 19 nt, Homo sapiens
gcaucagaaucucucuuuc

SEQ ID NO: 1496854 - RNA, 19 nt, Homo sapiens
uauaaaagguuccaguaga

SEQ ID NO: 1496855 - RNA, 19 nt, Homo sapiens
ucaccagguuucagagaug

SEQ ID NO: 1496856 - RNA, 19 nt, Homo sapiens
aauccuauguugcuauugu

SEQ ID NO: 1496857 - RNA, 19 nt, Homo sapiens
agaaguggccggagaguuc

SEQ ID NO: 1496858 - RNA, 19 nt, Homo sapiens
aggaucacauuauaaccua

SEQ ID NO: 1496859 - RNA, 19 nt, Homo sapiens
gaagaacuuaacuuacuag

SEQ ID NO: 1496860 - RNA, 19 nt, Homo sapiens
caucuggccuauauugucu

SEQ ID NO: 1496861 - RNA, 19 nt, Homo sapiens
agugguuggugauucuuua

SEQ ID NO: 1496862 - RNA, 19 nt, Homo sapiens
ugucuaaaguccuaaagag

SEQ ID NO: 1496863 - RNA, 19 nt, Homo sapiens
uaugagaagcaauaccuaa

SEQ ID NO: 1496864 - RNA, 19 nt, Homo sapiens
caaaucagggacaguagga

SEQ ID NO: 1496865 - RNA, 19 nt, Homo sapiens
ccauuauuguacccuguuu

SEQ ID NO: 1496866 - RNA, 19 nt, Homo sapiens
ccaccuauauguaaaacaa

SEQ ID NO: 1496867 - RNA, 19 nt, Homo sapiens
cgauugagucugaauacaa

SEQ ID NO: 1496868 - RNA, 19 nt, Homo sapiens
gcugagguuugccugaauc

SEQ ID NO: 1496869 - RNA, 19 nt, Homo sapiens
uaguuaugcaugcuucuua

SEQ ID NO: 1496870 - RNA, 19 nt, Homo sapiens
guaaaacaauggaggagau

SEQ ID NO: 1496871 - RNA, 19 nt, Homo sapiens
uggaaagaaccaaggagua

SEQ ID NO: 1496872 - RNA, 19 nt, Homo sapiens
caugggaaauggaaagaac

SEQ ID NO: 1496873 - RNA, 19 nt, Homo sapiens
gaugcugauugcugagguu

SEQ ID NO: 1496874 - RNA, 19 nt, Homo sapiens
aguaacaaguucccuaucu

SEQ ID NO: 1496875 - RNA, 19 nt, Homo sapiens
gcaauaccuaauccuaugu

SEQ ID NO: 1496876 - RNA, 19 nt, Homo sapiens
agcaauaccuaauccuaug

SEQ ID NO: 1496877 - RNA, 19 nt, Homo sapiens
uuagugaucaguaugagaa

SEQ ID NO: 1496878 - RNA, 19 nt, Homo sapiens
gcauaugcacucaaugucu

SEQ ID NO: 1496879 - RNA, 19 nt, Homo sapiens
cauuauaaccuacuuuguc

SEQ ID NO: 1496880 - RNA, 19 nt, Homo sapiens
uggccuauauugucuguca

SEQ ID NO: 1496881 - RNA, 19 nt, Homo sapiens
ugccauaguuaccuggauu

SEQ ID NO: 1496882 - RNA, 19 nt, Homo sapiens
guacuguuacggucuuaga

SEQ ID NO: 1496883 - RNA, 19 nt, Homo sapiens
gcacucaaugucuaauaca

SEQ ID NO: 1496884 - RNA, 19 nt, Homo sapiens
aaagaaccaaggaguauag

SEQ ID NO: 1496885 - RNA, 19 nt, Homo sapiens
guucuuacauacuucaacu

SEQ ID NO: 1496886 - RNA, 19 nt, Homo sapiens
caaacuaagcugcagugau

SEQ ID NO: 1496887 - RNA, 19 nt, Homo sapiens
uaaauagugguuggugauu

SEQ ID NO: 1496888 - RNA, 19 nt, Homo sapiens
guacccuguuucauccauu

SEQ ID NO: 1496889 - RNA, 19 nt, Homo sapiens
uuacugcagccaccuauau

SEQ ID NO: 1496890 - RNA, 19 nt, Homo sapiens
gugauucuuuacaguagga

SEQ ID NO: 1496891 - RNA, 19 nt, Homo sapiens
aaauagugguuggugauuc

SEQ ID NO: 1496892 - RNA, 19 nt, Homo sapiens
ccggagaguucugcauguu

SEQ ID NO: 1496893 - RNA, 19 nt, Homo sapiens
cugcagugauguugccuau

SEQ ID NO: 1496894 - RNA, 19 nt, Homo sapiens
gaagaaagcuaugagaaua

SEQ ID NO: 1496895 - RNA, 19 nt, Homo sapiens
gcacagaagucaagaauug

SEQ ID NO: 1496896 - RNA, 19 nt, Homo sapiens
gaaauuggcaucuguauaa

SEQ ID NO: 1496897 - RNA, 19 nt, Homo sapiens
ggaaauaacuaacuugcuu

SEQ ID NO: 1496898 - RNA, 19 nt, Homo sapiens
ggaauaagcauguguauau

SEQ ID NO: 1496899 - RNA, 19 nt, Homo sapiens
ccaaaucucuccuugaauu

SEQ ID NO: 1496900 - RNA, 19 nt, Homo sapiens
ucaaugcacuucaucuuua

SEQ ID NO: 1496901 - RNA, 19 nt, Homo sapiens
uuacauaacugcaguauca

SEQ ID NO: 1496902 - RNA, 19 nt, Homo sapiens
guagagaugugccauaguu

SEQ ID NO: 1496903 - RNA, 19 nt, Homo sapiens
uaagaucccuugugcuauu

SEQ ID NO: 1496904 - RNA, 19 nt, Homo sapiens
gaacuaaugcacaggguaa

SEQ ID NO: 1496905 - RNA, 19 nt, Homo sapiens
cgacugcccuauuggauuu

SEQ ID NO: 1496906 - RNA, 19 nt, Homo sapiens
ggaacuagggucagaauga

SEQ ID NO: 1496907 - RNA, 19 nt, Homo sapiens
cauccaaacuguuguguau

SEQ ID NO: 1496908 - RNA, 19 nt, Homo sapiens
gaacuagggucagaaugau

SEQ ID NO: 1496909 - RNA, 19 nt, Homo sapiens
gcaugagaaugaacuaaug

SEQ ID NO: 1496910 - RNA, 19 nt, Homo sapiens
uauaacagauccaaugguu

SEQ ID NO: 1496911 - RNA, 19 nt, Homo sapiens
ggaagggacuugcuuuguc

SEQ ID NO: 1496912 - RNA, 19 nt, Homo sapiens
gggaaccucugccuagauu

SEQ ID NO: 1496913 - RNA, 19 nt, Homo sapiens
ggaagggcaugauuguguu

SEQ ID NO: 1496914 - RNA, 19 nt, Homo sapiens
ggacuugcaugggccuaua

SEQ ID NO: 1496915 - RNA, 19 nt, Homo sapiens
ggacuugcuuugucucaga

SEQ ID NO: 1496916 - RNA, 19 nt, Homo sapiens
gacuuggacuucuggguua

SEQ ID NO: 1496917 - RNA, 19 nt, Homo sapiens
gcaaguaaacaagccaaua

SEQ ID NO: 1496918 - RNA, 19 nt, Homo sapiens
gguaucaacuuacauaacu

SEQ ID NO: 1496919 - RNA, 19 nt, Homo sapiens
gaagggacuugcuuugucu

SEQ ID NO: 1496920 - RNA, 19 nt, Homo sapiens
caacuucucccauuuggaa

SEQ ID NO: 1496921 - RNA, 19 nt, Homo sapiens
gagaugugccauaguuuaa

SEQ ID NO: 1496922 - RNA, 19 nt, Homo sapiens
gcacaauucccuugagaug

SEQ ID NO: 1496923 - RNA, 19 nt, Homo sapiens
aaucuguucuucauccuua

SEQ ID NO: 1496924 - RNA, 19 nt, Homo sapiens
gauaugacucuucccuaua

SEQ ID NO: 1496925 - RNA, 19 nt, Homo sapiens
agaaugaugugguuugguu

SEQ ID NO: 1496926 - RNA, 19 nt, Homo sapiens
caaugcacuucaucuuuaa

SEQ ID NO: 1496927 - RNA, 19 nt, Homo sapiens
cuacaaugaucaagauaug

SEQ ID NO: 1496928 - RNA, 19 nt, Homo sapiens
ccacuacaaugaucaagau

SEQ ID NO: 1496929 - RNA, 19 nt, Homo sapiens
aaaggaagaugcaaagagu

SEQ ID NO: 1496930 - RNA, 19 nt, Homo sapiens
gccaauauuucaacuguuc

SEQ ID NO: 1496931 - RNA, 19 nt, Homo sapiens
gaagugcuauaugcccuuu

SEQ ID NO: 1496932 - RNA, 19 nt, Homo sapiens
guaaacaagccaauauuuc

SEQ ID NO: 1496933 - RNA, 19 nt, Homo sapiens
caaguaaacaagccaauau

SEQ ID NO: 1496934 - RNA, 19 nt, Homo sapiens
acacuaaucuguucuucau

SEQ ID NO: 1496935 - RNA, 19 nt, Homo sapiens
ccuguuagguauaucaauu

SEQ ID NO: 1496936 - RNA, 19 nt, Homo sapiens
guaggucuaugcaauuuua

SEQ ID NO: 1496937 - RNA, 19 nt, Homo sapiens
acucagacuucucuaguuu

SEQ ID NO: 1496938 - RNA, 19 nt, Homo sapiens
uauggaagcaugagaauga

SEQ ID NO: 1496939 - RNA, 19 nt, Homo sapiens
uaccacauguguauauuug

SEQ ID NO: 1496940 - RNA, 19 nt, Homo sapiens
gaauauuccuaucacuaca

SEQ ID NO: 1496941 - RNA, 19 nt, Homo sapiens
gcuauaugcccuuuaucua

SEQ ID NO: 1496942 - RNA, 19 nt, Homo sapiens
gaagaugcaaagaguauag

SEQ ID NO: 1496943 - RNA, 19 nt, Homo sapiens
agucuuggguauuucuuua

SEQ ID NO: 1496944 - RNA, 19 nt, Homo sapiens
ugagaugcauccaaacugu

SEQ ID NO: 1496945 - RNA, 19 nt, Homo sapiens
ugugagacauggagccuaa

SEQ ID NO: 1496946 - RNA, 19 nt, Homo sapiens
gaaccucugccuagauuuc

SEQ ID NO: 1496947 - RNA, 19 nt, Homo sapiens
gagcacagaagucaagaau

SEQ ID NO: 1496948 - RNA, 19 nt, Homo sapiens
gguaaccacuacaaugauc

SEQ ID NO: 1496949 - RNA, 19 nt, Homo sapiens
caagaaauuggcaucugua

SEQ ID NO: 1496950 - RNA, 19 nt, Homo sapiens
acaaaugcgugcaccaugu

SEQ ID NO: 1496951 - RNA, 19 nt, Homo sapiens
agagaugugccauaguuua

SEQ ID NO: 1496952 - RNA, 19 nt, Homo sapiens
uccaaacuguuguguauau

SEQ ID NO: 1496953 - RNA, 19 nt, Homo sapiens
caaaugcgugcaccaugua

SEQ ID NO: 1496954 - RNA, 19 nt, Homo sapiens
agauaugacucuucccuau

SEQ ID NO: 1496955 - RNA, 19 nt, Homo sapiens
caacuguucccauugcauu

SEQ ID NO: 1496956 - RNA, 19 nt, Homo sapiens
acccaaaucucuccuugaa

SEQ ID NO: 1496957 - RNA, 19 nt, Homo sapiens
cagcacaauucccuugaga

SEQ ID NO: 1496958 - RNA, 19 nt, Homo sapiens
acacauagagauuggcuuu

SEQ ID NO: 1496959 - RNA, 19 nt, Homo sapiens
ucauguguauugacaaaug

SEQ ID NO: 1496960 - RNA, 19 nt, Homo sapiens
ggacuucuggguuaauguu

SEQ ID NO: 1496961 - RNA, 19 nt, Homo sapiens
ugaagaaagcuaugagaau

SEQ ID NO: 1496962 - RNA, 19 nt, Homo sapiens
ccuauaccuuaucuucaua

SEQ ID NO: 1496963 - RNA, 19 nt, Homo sapiens
ucuuucaguuucccaaaua

SEQ ID NO: 1496964 - RNA, 19 nt, Homo sapiens
gggaggaacuagggucaga

SEQ ID NO: 1496965 - RNA, 19 nt, Homo sapiens
uuuaacgacugcccuauug

SEQ ID NO: 1496966 - RNA, 19 nt, Homo sapiens
gaaugucucuagggcaugu

SEQ ID NO: 1496967 - RNA, 19 nt, Homo sapiens
cuugugcuauuccuuuaua

SEQ ID NO: 1496968 - RNA, 19 nt, Homo sapiens
guguaggucuaugcaauuu

SEQ ID NO: 1496969 - RNA, 19 nt, Homo sapiens
caaagaguauagggaagug

SEQ ID NO: 1496970 - RNA, 19 nt, Homo sapiens
ggaagaugcaaagaguaua

SEQ ID NO: 1496971 - RNA, 19 nt, Homo sapiens
acaauucccuugagaugca

SEQ ID NO: 1496972 - RNA, 19 nt, Homo sapiens
acuaagaucccuugugcua

SEQ ID NO: 1496973 - RNA, 19 nt, Homo sapiens
uauaugcccuuuaucuagu

SEQ ID NO: 1496974 - RNA, 19 nt, Homo sapiens
uaacagauccaaugguuuu

SEQ ID NO: 1496975 - RNA, 19 nt, Homo sapiens
cagaugagacuuuggacuu

SEQ ID NO: 1496976 - RNA, 19 nt, Homo sapiens
caggaaguagaguuuaaua

SEQ ID NO: 1496977 - RNA, 19 nt, Homo sapiens
uauuucaacuguucccauu

SEQ ID NO: 1496978 - RNA, 19 nt, Homo sapiens
aaucucuccuugaauugua

SEQ ID NO: 1496979 - RNA, 19 nt, Homo sapiens
gaagggcaugauuguguuu

SEQ ID NO: 1496980 - RNA, 19 nt, Homo sapiens
cagaggauguauggaaaug

SEQ ID NO: 1496981 - RNA, 19 nt, Homo sapiens
uguguaguauuccauggua

SEQ ID NO: 1496982 - RNA, 19 nt, Homo sapiens
ucagacuucucuaguuuua

SEQ ID NO: 1496983 - RNA, 19 nt, Homo sapiens
gcaaagaguauagggaagu

SEQ ID NO: 1496984 - RNA, 19 nt, Homo sapiens
gcucuuugcagccuugaaa

SEQ ID NO: 1496985 - RNA, 19 nt, Homo sapiens
ucaugcauaucaggaagua

SEQ ID NO: 1496986 - RNA, 19 nt, Homo sapiens
gagccuaaggagaucauuu

SEQ ID NO: 1496987 - RNA, 19 nt, Homo sapiens
gcuaaaaggggccaacaua

SEQ ID NO: 1496988 - RNA, 19 nt, Homo sapiens
acugcagccucucccauua

SEQ ID NO: 1496989 - RNA, 19 nt, Homo sapiens
caaaggaagaugcaaagag

SEQ ID NO: 1496990 - RNA, 19 nt, Homo sapiens
aagccaauauuucaacugu

SEQ ID NO: 1496991 - RNA, 19 nt, Homo sapiens
agacaucaaugcacuucau

SEQ ID NO: 1496992 - RNA, 19 nt, Homo sapiens
acauacagcucaggccauu

SEQ ID NO: 1496993 - RNA, 19 nt, Homo sapiens
uguauaauccacagacauu

SEQ ID NO: 1496994 - RNA, 19 nt, Homo sapiens
cagaacaggucaagguuua

SEQ ID NO: 1496995 - RNA, 19 nt, Homo sapiens
caauagagccugugucuuu

SEQ ID NO: 1496996 - RNA, 19 nt, Homo sapiens
gcaagacccuacaugguuu

SEQ ID NO: 1496997 - RNA, 19 nt, Homo sapiens
aaacagaaaucacgucaug

SEQ ID NO: 1496998 - RNA, 19 nt, Homo sapiens
gaagcucaaucucagguaa

SEQ ID NO: 1496999 - RNA, 19 nt, Homo sapiens
guaacaugcuagaucauuu

SEQ ID NO: 1497000 - RNA, 19 nt, Homo sapiens
gaaaucacgucaugucucu

SEQ ID NO: 1497001 - RNA, 19 nt, Homo sapiens
uuucaucccucguuucuua

SEQ ID NO: 1497002 - RNA, 19 nt, Homo sapiens
gcccuuccaucuuuaauuu

SEQ ID NO: 1497003 - RNA, 19 nt, Homo sapiens
guacuucccuugugucugu

SEQ ID NO: 1497004 - RNA, 19 nt, Homo sapiens
gcuaacagcugugggaaga

SEQ ID NO: 1497005 - RNA, 19 nt, Homo sapiens
cuacagcaaucaucaguug

SEQ ID NO: 1497006 - RNA, 19 nt, Homo sapiens
ucaaagcaauuuccaguca

SEQ ID NO: 1497007 - RNA, 19 nt, Homo sapiens
uaacagcugugggaagaaa

SEQ ID NO: 1497008 - RNA, 19 nt, Homo sapiens
gaacauccuuacacaagag

SEQ ID NO: 1497009 - RNA, 19 nt, Homo sapiens
ccaggaaggcaguaaauuu

SEQ ID NO: 1497010 - RNA, 19 nt, Homo sapiens
caaugucuaccuuaucuua

SEQ ID NO: 1497011 - RNA, 19 nt, Homo sapiens
gcaauuuccagucaaacua

SEQ ID NO: 1497012 - RNA, 19 nt, Homo sapiens
ggguugagauaaugauauu

SEQ ID NO: 1497013 - RNA, 19 nt, Homo sapiens
gcaaucaucaguuguaaca

SEQ ID NO: 1497014 - RNA, 19 nt, Homo sapiens
cuaauucucugauuucauc

SEQ ID NO: 1497015 - RNA, 19 nt, Homo sapiens
cccaagcccuuccaucuuu

SEQ ID NO: 1497016 - RNA, 19 nt, Homo sapiens
gaagguguccuaacauaca

SEQ ID NO: 1497017 - RNA, 19 nt, Homo sapiens
ccuaagaccuuuaucacau

SEQ ID NO: 1497018 - RNA, 19 nt, Homo sapiens
uguaaucucuuccuugguu

SEQ ID NO: 1497019 - RNA, 19 nt, Homo sapiens
ccaagcccuuccaucuuua

SEQ ID NO: 1497020 - RNA, 19 nt, Homo sapiens
gagggaagcuuuucuuaau

SEQ ID NO: 1497021 - RNA, 19 nt, Homo sapiens
gaaguccguauaucuauga

SEQ ID NO: 1497022 - RNA, 19 nt, Homo sapiens
ucuguacccuuuccaaauu

SEQ ID NO: 1497023 - RNA, 19 nt, Homo sapiens
guaccuuguucucagcaua

SEQ ID NO: 1497024 - RNA, 19 nt, Homo sapiens
cuaagaccuuuaucacauu

SEQ ID NO: 1497025 - RNA, 19 nt, Homo sapiens
gccaauguuuguuaaugaa

SEQ ID NO: 1497026 - RNA, 19 nt, Homo sapiens
uugaagguguccuaacaua

SEQ ID NO: 1497027 - RNA, 19 nt, Homo sapiens
cccuaacucugcucuauuu

SEQ ID NO: 1497028 - RNA, 19 nt, Homo sapiens
gugcaccuauuuccuaaga

SEQ ID NO: 1497029 - RNA, 19 nt, Homo sapiens
aaagcaauuuccagucaaa

SEQ ID NO: 1497030 - RNA, 19 nt, Homo sapiens
aaucaucaguuguaacaug

SEQ ID NO: 1497031 - RNA, 19 nt, Homo sapiens
ucacaaacacgaggcauuu

SEQ ID NO: 1497032 - RNA, 19 nt, Homo sapiens
cgucaugucucugcucaaa

SEQ ID NO: 1497033 - RNA, 19 nt, Homo sapiens
guuguaacaugcuagauca

SEQ ID NO: 1497034 - RNA, 19 nt, Homo sapiens
caaagcaauuuccagucaa

SEQ ID NO: 1497035 - RNA, 19 nt, Homo sapiens
ccguauaucuaugauguaa

SEQ ID NO: 1497036 - RNA, 19 nt, Homo sapiens
cagcaaucaucaguuguaa

SEQ ID NO: 1497037 - RNA, 19 nt, Homo sapiens
caguguacauaucccauuu

SEQ ID NO: 1497038 - RNA, 19 nt, Homo sapiens
guuaaacuucugugaguaa

SEQ ID NO: 1497039 - RNA, 19 nt, Homo sapiens
guccguauaucuaugaugu

SEQ ID NO: 1497040 - RNA, 19 nt, Homo sapiens
caauuggguugagauaaug

SEQ ID NO: 1497041 - RNA, 19 nt, Homo sapiens
gaaaggucauaaagcuucu

SEQ ID NO: 1497042 - RNA, 19 nt, Homo sapiens
aaacuucugugaguaaaca

SEQ ID NO: 1497043 - RNA, 19 nt, Homo sapiens
uaacucugcucuauuuggu

SEQ ID NO: 1497044 - RNA, 19 nt, Homo sapiens
agaaacaagugcaggaaag

SEQ ID NO: 1497045 - RNA, 19 nt, Homo sapiens
gggcagacauaauauucuc

SEQ ID NO: 1497046 - RNA, 19 nt, Homo sapiens
ccuagaacauccuuacaca

SEQ ID NO: 1497047 - RNA, 19 nt, Homo sapiens
ugacagaccuugggaagcu

SEQ ID NO: 1497048 - RNA, 19 nt, Homo sapiens
ugaggcacguccaguguug

SEQ ID NO: 1497049 - RNA, 19 nt, Homo sapiens
caucaguuguaacaugcua

SEQ ID NO: 1497050 - RNA, 19 nt, Homo sapiens
guaaucucuuccuugguuu

SEQ ID NO: 1497051 - RNA, 19 nt, Homo sapiens
uuacggcacuucauuaaaa

SEQ ID NO: 1497052 - RNA, 19 nt, Homo sapiens
guuaaugaaguccguauau

SEQ ID NO: 1497053 - RNA, 19 nt, Homo sapiens
gggaagcuuuucuuaauug

SEQ ID NO: 1497054 - RNA, 19 nt, Homo sapiens
ggaaauuguacagcauaaa

SEQ ID NO: 1497055 - RNA, 19 nt, Homo sapiens
uccuagauguguucaauug

SEQ ID NO: 1497056 - RNA, 19 nt, Homo sapiens
uagccaauguuuguuaaug

SEQ ID NO: 1497057 - RNA, 19 nt, Homo sapiens
auagccagcucuccugauu

SEQ ID NO: 1497058 - RNA, 19 nt, Homo sapiens
ccugaccacuguauuuaau

SEQ ID NO: 1497059 - RNA, 19 nt, Homo sapiens
gcagaaacaagugcaggaa

SEQ ID NO: 1497060 - RNA, 19 nt, Homo sapiens
cccaaucucuuguaaaggu

SEQ ID NO: 1497061 - RNA, 19 nt, Homo sapiens
cauacuugauuguuagugu

SEQ ID NO: 1497062 - RNA, 19 nt, Homo sapiens
acucugcucuauuugguuu

SEQ ID NO: 1497063 - RNA, 19 nt, Homo sapiens
agaacauccuuacacaaga

SEQ ID NO: 1497064 - RNA, 19 nt, Homo sapiens
ugaaguccguauaucuaug

SEQ ID NO: 1497065 - RNA, 19 nt, Homo sapiens
ucacugauauaucccaaac

SEQ ID NO: 1497066 - RNA, 19 nt, Homo sapiens
ugucuaccuuaucuuagua

SEQ ID NO: 1497067 - RNA, 19 nt, Homo sapiens
uaagaccuuuaucacauuc

SEQ ID NO: 1497068 - RNA, 19 nt, Homo sapiens
caggaaauuguacagcaua

SEQ ID NO: 1497069 - RNA, 19 nt, Homo sapiens
aaugaaguccguauaucua

SEQ ID NO: 1497070 - RNA, 19 nt, Homo sapiens
ggagguugagggaagcuuu

SEQ ID NO: 1497071 - RNA, 19 nt, Homo sapiens
uuaauacuguaccuuguuc

SEQ ID NO: 1497072 - RNA, 19 nt, Homo sapiens
gaaacaagugcaggaaagu

SEQ ID NO: 1497073 - RNA, 19 nt, Homo sapiens
gcuauacccaggugcugua

SEQ ID NO: 1497074 - RNA, 19 nt, Homo sapiens
ccaggaaauuguacagcau

SEQ ID NO: 1497075 - RNA, 19 nt, Homo sapiens
uuaaugaaguccguauauc

SEQ ID NO: 1497076 - RNA, 19 nt, Homo sapiens
uagaacauccuuacacaag

SEQ ID NO: 1497077 - RNA, 19 nt, Homo sapiens
ccaggcacauuggcuguug

SEQ ID NO: 1497078 - RNA, 19 nt, Homo sapiens
uguuggaccucacagcaaa

SEQ ID NO: 1497079 - RNA, 19 nt, Homo sapiens
aggaaauuguacagcauaa

SEQ ID NO: 1497080 - RNA, 19 nt, Homo sapiens
agccaauguuuguuaauga

SEQ ID NO: 1497081 - RNA, 19 nt, Homo sapiens
acagcaaucaucaguugua

SEQ ID NO: 1497082 - RNA, 19 nt, Homo sapiens
ucuuugcacuugugucuug

SEQ ID NO: 1497083 - RNA, 19 nt, Homo sapiens
gagccucugcuucagugua

SEQ ID NO: 1497084 - RNA, 19 nt, Homo sapiens
aauccuagauguguucaau

SEQ ID NO: 1497085 - RNA, 19 nt, Homo sapiens
uaaugaaguccguauaucu

SEQ ID NO: 1497086 - RNA, 19 nt, Homo sapiens
cuucugagcuaccuuuaac

SEQ ID NO: 1497087 - RNA, 19 nt, Homo sapiens
ggaagcucaaucucaggua

SEQ ID NO: 1497088 - RNA, 19 nt, Homo sapiens
ucagaacaggucaagguuu

SEQ ID NO: 1497089 - RNA, 19 nt, Homo sapiens
guacauaucccauuuucau

SEQ ID NO: 1497090 - RNA, 19 nt, Homo sapiens
gguagugcagcucaucuga

SEQ ID NO: 1497091 - RNA, 19 nt, Homo sapiens
ugcaagacccuacaugguu

SEQ ID NO: 1497092 - RNA, 19 nt, Homo sapiens
cagaaacaagugcaggaaa

SEQ ID NO: 1497093 - RNA, 19 nt, Homo sapiens
ccaaucucuuguaaagguu

SEQ ID NO: 1497094 - RNA, 19 nt, Homo sapiens
gaacaaacaccucuucuua

SEQ ID NO: 1497095 - RNA, 19 nt, Homo sapiens
gaacugauccuuucaagua

SEQ ID NO: 1497096 - RNA, 19 nt, Homo sapiens
gauaauggcugcagaaaug

SEQ ID NO: 1497097 - RNA, 19 nt, Homo sapiens
caaagaagguaacaaauug

SEQ ID NO: 1497098 - RNA, 19 nt, Homo sapiens
ccaauugacuuacuugaua

SEQ ID NO: 1497099 - RNA, 19 nt, Homo sapiens
gcagugagcuuguugaagu

SEQ ID NO: 1497100 - RNA, 19 nt, Homo sapiens
gaagauauaugucuacaac

SEQ ID NO: 1497101 - RNA, 19 nt, Homo sapiens
caaacacucuuacguuaaa

SEQ ID NO: 1497102 - RNA, 19 nt, Homo sapiens
ggugucagcucuccguuua

SEQ ID NO: 1497103 - RNA, 19 nt, Homo sapiens
gaaacaaagugauggaaca

SEQ ID NO: 1497104 - RNA, 19 nt, Homo sapiens
acaaacaccucuucuuaaa

SEQ ID NO: 1497105 - RNA, 19 nt, Homo sapiens
gaagaacuguacuuuggaa

SEQ ID NO: 1497106 - RNA, 19 nt, Homo sapiens
gaaagaaguucccagaaac

SEQ ID NO: 1497107 - RNA, 19 nt, Homo sapiens
gcaaugacaugaguuuguu

SEQ ID NO: 1497108 - RNA, 19 nt, Homo sapiens
gcauauccauuguguaaau

SEQ ID NO: 1497109 - RNA, 19 nt, Homo sapiens
gauaugccuugguuaauga

SEQ ID NO: 1497110 - RNA, 19 nt, Homo sapiens
ucaaugaccuuaaugaauc

SEQ ID NO: 1497111 - RNA, 19 nt, Homo sapiens
aagaaaugcuggagaaauu

SEQ ID NO: 1497112 - RNA, 19 nt, Homo sapiens
gagaaucacgcccagaaua

SEQ ID NO: 1497113 - RNA, 19 nt, Homo sapiens
cagaagaacuguacuuugg

SEQ ID NO: 1497114 - RNA, 19 nt, Homo sapiens
agacaaugcuuucaauaug

SEQ ID NO: 1497115 - RNA, 19 nt, Homo sapiens
cacuauagcuggacacuga

SEQ ID NO: 1497116 - RNA, 19 nt, Homo sapiens
gucagaaacuggaauaaau

SEQ ID NO: 1497117 - RNA, 19 nt, Homo sapiens
ugacaaagaagguaacaaa

SEQ ID NO: 1497118 - RNA, 19 nt, Homo sapiens
cauagaaagugauggcaaa

SEQ ID NO: 1497119 - RNA, 19 nt, Homo sapiens
gacaaugcuuucaauaugu

SEQ ID NO: 1497120 - RNA, 19 nt, Homo sapiens
gcauugacauggacuuugu

SEQ ID NO: 1497121 - RNA, 19 nt, Homo sapiens
gcacaggcccagcagaauu

SEQ ID NO: 1497122 - RNA, 19 nt, Homo sapiens
agaaagugauggcaaagaa

SEQ ID NO: 1497123 - RNA, 19 nt, Homo sapiens
aagccaagcucaucucuga

SEQ ID NO: 1497124 - RNA, 19 nt, Homo sapiens
guaaaggcauauccauugu

SEQ ID NO: 1497125 - RNA, 19 nt, Homo sapiens
auaaagaaaugcuggagaa

SEQ ID NO: 1497126 - RNA, 19 nt, Homo sapiens
gaagaaaaccuuaauagug

SEQ ID NO: 1497127 - RNA, 19 nt, Homo sapiens
uaaauagcauugacaugga

SEQ ID NO: 1497128 - RNA, 19 nt, Homo sapiens
aaaagaagcucauagcauu

SEQ ID NO: 1497129 - RNA, 19 nt, Homo sapiens
aaagauacaccuugcagua

SEQ ID NO: 1497130 - RNA, 19 nt, Homo sapiens
ucaccucuuucuucuauuu

SEQ ID NO: 1497131 - RNA, 19 nt, Homo sapiens
accaaacacucuuacguua

SEQ ID NO: 1497132 - RNA, 19 nt, Homo sapiens
aagaagacauagaaaguga

SEQ ID NO: 1497133 - RNA, 19 nt, Homo sapiens
guauagcuauccaccacua

SEQ ID NO: 1497134 - RNA, 19 nt, Homo sapiens
ggaucagggugaaguauca

SEQ ID NO: 1497135 - RNA, 19 nt, Homo sapiens
cugaguaugugacagauaa

SEQ ID NO: 1497136 - RNA, 19 nt, Homo sapiens
ccaaaccaccuuaaccuuu

SEQ ID NO: 1497137 - RNA, 19 nt, Homo sapiens
gcaauaggaagcuugaaga

SEQ ID NO: 1497138 - RNA, 19 nt, Homo sapiens
gaaagugauggcaaagaaa

SEQ ID NO: 1497139 - RNA, 19 nt, Homo sapiens
ucaacugcuuuaagguuua

SEQ ID NO: 1497140 - RNA, 19 nt, Homo sapiens
gaaaugcuggagaaauuga

SEQ ID NO: 1497141 - RNA, 19 nt, Homo sapiens
gcagaagaacuguacuuug

SEQ ID NO: 1497142 - RNA, 19 nt, Homo sapiens
gagaacaacagcuccagaa

SEQ ID NO: 1497143 - RNA, 19 nt, Homo sapiens
aagaaaccauugaguguau

SEQ ID NO: 1497144 - RNA, 19 nt, Homo sapiens
caagaaaccauugagugua

SEQ ID NO: 1497145 - RNA, 19 nt, Homo sapiens
gaaaggcuacaacaagaug

SEQ ID NO: 1497146 - RNA, 19 nt, Homo sapiens
uaacagaccuaaaacucua

SEQ ID NO: 1497147 - RNA, 19 nt, Homo sapiens
gauggaacauagguuaaga

SEQ ID NO: 1497148 - RNA, 19 nt, Homo sapiens
gaauaaagccaagcucauc

SEQ ID NO: 1497149 - RNA, 19 nt, Homo sapiens
ccaggacuaugucagugua

SEQ ID NO: 1497150 - RNA, 19 nt, Homo sapiens
gagaauuccucccagugau

SEQ ID NO: 1497151 - RNA, 19 nt, Homo sapiens
guucgaagcugaguaugug

SEQ ID NO: 1497152 - RNA, 19 nt, Homo sapiens
acaaagugauggaacauag

SEQ ID NO: 1497153 - RNA, 19 nt, Homo sapiens
gaaaccauugaguguauuu

SEQ ID NO: 1497154 - RNA, 19 nt, Homo sapiens
gaaacuggaauaaauagca

SEQ ID NO: 1497155 - RNA, 19 nt, Homo sapiens
ucacauguacaucuacuuu

SEQ ID NO: 1497156 - RNA, 19 nt, Homo sapiens
acaaugcucuugcuugcuu

SEQ ID NO: 1497157 - RNA, 19 nt, Homo sapiens
caaagaaacauuggaaaca

SEQ ID NO: 1497158 - RNA, 19 nt, Homo sapiens
acuaguagaugaugacuuc

SEQ ID NO: 1497159 - RNA, 19 nt, Homo sapiens
gaaugcugcuuucaaaauu

SEQ ID NO: 1497160 - RNA, 19 nt, Homo sapiens
aaauuggccuaggaaauaa

SEQ ID NO: 1497161 - RNA, 19 nt, Homo sapiens
ugucaccucuuucuucuau

SEQ ID NO: 1497162 - RNA, 19 nt, Homo sapiens
acaacucagucguuuacua

SEQ ID NO: 1497163 - RNA, 19 nt, Homo sapiens
ccaaacacucuuacguuaa

SEQ ID NO: 1497164 - RNA, 19 nt, Homo sapiens
gcaaagaaacauuggaaac

SEQ ID NO: 1497165 - RNA, 19 nt, Homo sapiens
guaaagaagacauagaaag

SEQ ID NO: 1497166 - RNA, 19 nt, Homo sapiens
guuaaugaaugcugcuuuc

SEQ ID NO: 1497167 - RNA, 19 nt, Homo sapiens
auaaaggccugacccucua

SEQ ID NO: 1497168 - RNA, 19 nt, Homo sapiens
gaacaacagcuccagaaaa

SEQ ID NO: 1497169 - RNA, 19 nt, Homo sapiens
gaagacauagaaagugaug

SEQ ID NO: 1497170 - RNA, 19 nt, Homo sapiens
ugauaugccuugguuaaug

SEQ ID NO: 1497171 - RNA, 19 nt, Homo sapiens
gaaaaugggaaaccuguaa

SEQ ID NO: 1497172 - RNA, 19 nt, Homo sapiens
ccagaugguuauuggaaau

SEQ ID NO: 1497173 - RNA, 19 nt, Homo sapiens
uaagaugccauacuguuga

SEQ ID NO: 1497174 - RNA, 19 nt, Homo sapiens
gaaguucccagaaacaaag

SEQ ID NO: 1497175 - RNA, 19 nt, Homo sapiens
gaaucacgcccagaauaaa

SEQ ID NO: 1497176 - RNA, 19 nt, Homo sapiens
agaaucacgcccagaauaa

SEQ ID NO: 1497177 - RNA, 19 nt, Homo sapiens
gauauaacaguuccuucaa

SEQ ID NO: 1497178 - RNA, 19 nt, Homo sapiens
ggagacauaauauuguaga

SEQ ID NO: 1497179 - RNA, 19 nt, Homo sapiens
gcucuccguuuaaagaaug

SEQ ID NO: 1497180 - RNA, 19 nt, Homo sapiens
gaauuuauguaaccaugac

SEQ ID NO: 1497181 - RNA, 19 nt, Homo sapiens
aaaggcauauccauugugu

SEQ ID NO: 1497182 - RNA, 19 nt, Homo sapiens
gcaguaaaccaaacacucu

SEQ ID NO: 1497183 - RNA, 19 nt, Homo sapiens
uaaauaugaugcacgugau

SEQ ID NO: 1497184 - RNA, 19 nt, Homo sapiens
cacaggcccagcagaauua

SEQ ID NO: 1497185 - RNA, 19 nt, Homo sapiens
ccaagaccguuuucugaua

SEQ ID NO: 1497186 - RNA, 19 nt, Homo sapiens
ggguggaacugauccuuuc

SEQ ID NO: 1497187 - RNA, 19 nt, Homo sapiens
ugacuuacuugauauucug

SEQ ID NO: 1497188 - RNA, 19 nt, Homo sapiens
ugucagcucuccguuuaaa

SEQ ID NO: 1497189 - RNA, 19 nt, Homo sapiens
aggcauauccauuguguaa

SEQ ID NO: 1497190 - RNA, 19 nt, Homo sapiens
caacucagucguuuacuag

SEQ ID NO: 1497191 - RNA, 19 nt, Homo sapiens
gaaagcaguaaaccaaaca

SEQ ID NO: 1497192 - RNA, 19 nt, Homo sapiens
uugaaaggcuacaacaaga

SEQ ID NO: 1497193 - RNA, 19 nt, Homo sapiens
cacugaagaugcucgauga

SEQ ID NO: 1497194 - RNA, 19 nt, Homo sapiens
ggacauauaguuccaagua

SEQ ID NO: 1497195 - RNA, 19 nt, Homo sapiens
aaacuucucuggcauuuaa

SEQ ID NO: 1497196 - RNA, 19 nt, Homo sapiens
ggagagaguugaagguaaa

SEQ ID NO: 1497197 - RNA, 19 nt, Homo sapiens
ggaagaggaugcacuacuu

SEQ ID NO: 1497198 - RNA, 19 nt, Homo sapiens
guaaagaucugaagguaag

SEQ ID NO: 1497199 - RNA, 19 nt, Homo sapiens
cugcugagcucaaagauuu

SEQ ID NO: 1497200 - RNA, 19 nt, Homo sapiens
cagcugauauuauggauga

SEQ ID NO: 1497201 - RNA, 19 nt, Homo sapiens
ccagagagcucaguuggaa

SEQ ID NO: 1497202 - RNA, 19 nt, Homo sapiens
cacaagacauuuggcauua

SEQ ID NO: 1497203 - RNA, 19 nt, Homo sapiens
caaaacagcuaguuaggua

SEQ ID NO: 1497204 - RNA, 19 nt, Homo sapiens
gaacugcgaggacucaauu

SEQ ID NO: 1497205 - RNA, 19 nt, Homo sapiens
uaacugggauguccucuuc

SEQ ID NO: 1497206 - RNA, 19 nt, Homo sapiens
cagaugggauugcaugauu

SEQ ID NO: 1497207 - RNA, 19 nt, Homo sapiens
ccaaauggccucucccaaa

SEQ ID NO: 1497208 - RNA, 19 nt, Homo sapiens
ugaagacuguauuguauug

SEQ ID NO: 1497209 - RNA, 19 nt, Homo sapiens
ucaaguguaggucuaauua

SEQ ID NO: 1497210 - RNA, 19 nt, Homo sapiens
caaauguucuuaacuaucg

SEQ ID NO: 1497211 - RNA, 19 nt, Homo sapiens
gaugagaauuccaaacaca

SEQ ID NO: 1497212 - RNA, 19 nt, Homo sapiens
uaacuuggccuugguguuu

SEQ ID NO: 1497213 - RNA, 19 nt, Homo sapiens
uuucugggauccaaaguua

SEQ ID NO: 1497214 - RNA, 19 nt, Homo sapiens
gaggcaugcuagaacguua

SEQ ID NO: 1497215 - RNA, 19 nt, Homo sapiens
gaagaggaugcacuacuuu

SEQ ID NO: 1497216 - RNA, 19 nt, Homo sapiens
gauccagagugcacgcaua

SEQ ID NO: 1497217 - RNA, 19 nt, Homo sapiens
ugcauaugauccagaauua

SEQ ID NO: 1497218 - RNA, 19 nt, Homo sapiens
caagagagaguccaggaaa

SEQ ID NO: 1497219 - RNA, 19 nt, Homo sapiens
ucagcuacuucuuuccuua

SEQ ID NO: 1497220 - RNA, 19 nt, Homo sapiens
cuaguuagguaaggacaua

SEQ ID NO: 1497221 - RNA, 19 nt, Homo sapiens
ccaaaauucuguacaguuu

SEQ ID NO: 1497222 - RNA, 19 nt, Homo sapiens
aagcaagccuucugaugaa

SEQ ID NO: 1497223 - RNA, 19 nt, Homo sapiens
aaagcaagccuucugauga

SEQ ID NO: 1497224 - RNA, 19 nt, Homo sapiens
aaacaaagcuggggauuga

SEQ ID NO: 1497225 - RNA, 19 nt, Homo sapiens
gacaugcucugguaacaca

SEQ ID NO: 1497226 - RNA, 19 nt, Homo sapiens
gauccaaaguuagaggaaa

SEQ ID NO: 1497227 - RNA, 19 nt, Homo sapiens
gcacugcccguucccauga

SEQ ID NO: 1497228 - RNA, 19 nt, Homo sapiens
caacugcuaagguccauaa

SEQ ID NO: 1497229 - RNA, 19 nt, Homo sapiens
cagggaaccucacaaaucu

SEQ ID NO: 1497230 - RNA, 19 nt, Homo sapiens
ucagcuccgugaagaauuu

SEQ ID NO: 1497231 - RNA, 19 nt, Homo sapiens
caaauggccucucccaaaa

SEQ ID NO: 1497232 - RNA, 19 nt, Homo sapiens
uguauuguauugagggaua

SEQ ID NO: 1497233 - RNA, 19 nt, Homo sapiens
cagcaacuccaccaccuua

SEQ ID NO: 1497234 - RNA, 19 nt, Homo sapiens
ggagcaagaccgcccauug

SEQ ID NO: 1497235 - RNA, 19 nt, Homo sapiens
aaacaucuguauugugaca

SEQ ID NO: 1497236 - RNA, 19 nt, Homo sapiens
ccaaguagguaaagucacu

SEQ ID NO: 1497237 - RNA, 19 nt, Homo sapiens
gauggaagaggaugcacua

SEQ ID NO: 1497238 - RNA, 19 nt, Homo sapiens
uggaagagguccuggugaa

SEQ ID NO: 1497239 - RNA, 19 nt, Homo sapiens
ugaagaauuugaucaaggu

SEQ ID NO: 1497240 - RNA, 19 nt, Homo sapiens
acugacagcugacaaacaa

SEQ ID NO: 1497241 - RNA, 19 nt, Homo sapiens
gaucugaagguaagaagga

SEQ ID NO: 1497242 - RNA, 19 nt, Homo sapiens
guucuuaacuaucgucucu

SEQ ID NO: 1497243 - RNA, 19 nt, Homo sapiens
gaucugcuuuaaagacaau

SEQ ID NO: 1497244 - RNA, 19 nt, Homo sapiens
gguaaagaucugaagguaa

SEQ ID NO: 1497245 - RNA, 19 nt, Homo sapiens
cgcaggaacuugaggaaga

SEQ ID NO: 1497246 - RNA, 19 nt, Homo sapiens
ucucuggcauuuaaucauu

SEQ ID NO: 1497247 - RNA, 19 nt, Homo sapiens
guaggucuaauuaguguuu

SEQ ID NO: 1497248 - RNA, 19 nt, Homo sapiens
caauuaaugcgaaaucaug

SEQ ID NO: 1497249 - RNA, 19 nt, Homo sapiens
ccagggaaccucacaaauc

SEQ ID NO: 1497250 - RNA, 19 nt, Homo sapiens
gcaggaacuugaggaagau

SEQ ID NO: 1497251 - RNA, 19 nt, Homo sapiens
aaaggaaaguuuggcaaga

SEQ ID NO: 1497252 - RNA, 19 nt, Homo sapiens
gaggcuugcugccaauuca

SEQ ID NO: 1497253 - RNA, 19 nt, Homo sapiens
guauugagggauagaaauu

SEQ ID NO: 1497254 - RNA, 19 nt, Homo sapiens
uuaacuaucgucucuguaa

SEQ ID NO: 1497255 - RNA, 19 nt, Homo sapiens
caaauuauucagaccaaug

SEQ ID NO: 1497256 - RNA, 19 nt, Homo sapiens
gacagcugacaaacaauua

SEQ ID NO: 1497257 - RNA, 19 nt, Homo sapiens
caaagcaagccuucugaug

SEQ ID NO: 1497258 - RNA, 19 nt, Homo sapiens
guaaggacauauaguucca

SEQ ID NO: 1497259 - RNA, 19 nt, Homo sapiens
cagggaaaccucaagugua

SEQ ID NO: 1497260 - RNA, 19 nt, Homo sapiens
gaaaguuuggcaagagaga

SEQ ID NO: 1497261 - RNA, 19 nt, Homo sapiens
ccaauuggccaacgacuuc

SEQ ID NO: 1497262 - RNA, 19 nt, Homo sapiens
caacugcugagcucaaaga

SEQ ID NO: 1497263 - RNA, 19 nt, Homo sapiens
uaacuaucgucucuguaau

SEQ ID NO: 1497264 - RNA, 19 nt, Homo sapiens
agggaaaccucaaguguag

SEQ ID NO: 1497265 - RNA, 19 nt, Homo sapiens
ucugcagacuuuccuuuaa

SEQ ID NO: 1497266 - RNA, 19 nt, Homo sapiens
uggcauugauggacaguug

SEQ ID NO: 1497267 - RNA, 19 nt, Homo sapiens
gcugaaggcccugcauaaa

SEQ ID NO: 1497268 - RNA, 19 nt, Homo sapiens
gacauauaguuccaaguag

SEQ ID NO: 1497269 - RNA, 19 nt, Homo sapiens
gccuggaucugcuuuaaag

SEQ ID NO: 1497270 - RNA, 19 nt, Homo sapiens
ggucucuucugcugguaaa

SEQ ID NO: 1497271 - RNA, 19 nt, Homo sapiens
cuacuucuuuccuuagaug

SEQ ID NO: 1497272 - RNA, 19 nt, Homo sapiens
ugugggacaugcucuggua

SEQ ID NO: 1497273 - RNA, 19 nt, Homo sapiens
ugacagcugacaaacaauu

SEQ ID NO: 1497274 - RNA, 19 nt, Homo sapiens
gggaaccucacaaaucuug

SEQ ID NO: 1497275 - RNA, 19 nt, Homo sapiens
gcaagagagaguccaggaa

SEQ ID NO: 1497276 - RNA, 19 nt, Homo sapiens
aaagacaauugguguuuac

SEQ ID NO: 1497277 - RNA, 19 nt, Homo sapiens
cagccacgaugcagguuga

SEQ ID NO: 1497278 - RNA, 19 nt, Homo sapiens
gcagacuuuccuuuaauug

SEQ ID NO: 1497279 - RNA, 19 nt, Homo sapiens
cuaccuugccuuucucuuu

SEQ ID NO: 1497280 - RNA, 19 nt, Homo sapiens
ggugcuaccuugccuuucu

SEQ ID NO: 1497281 - RNA, 19 nt, Homo sapiens
acacaagacauuuggcauu

SEQ ID NO: 1497282 - RNA, 19 nt, Homo sapiens
gaaggaguuccaccugaug

SEQ ID NO: 1497283 - RNA, 19 nt, Homo sapiens
cagaauuacagcugauauu

SEQ ID NO: 1497284 - RNA, 19 nt, Homo sapiens
gguugcauaugauccagaa

SEQ ID NO: 1497285 - RNA, 19 nt, Homo sapiens
ccagcuguaucacacaaga

SEQ ID NO: 1497286 - RNA, 19 nt, Homo sapiens
ugaucaaggucuggaugua

SEQ ID NO: 1497287 - RNA, 19 nt, Homo sapiens
cauaugauccagaauuaca

SEQ ID NO: 1497288 - RNA, 19 nt, Homo sapiens
gguaaaagcagagauguuu

SEQ ID NO: 1497289 - RNA, 19 nt, Homo sapiens
gcuaagcgcguguggaagu

SEQ ID NO: 1497290 - RNA, 19 nt, Homo sapiens
acaaucagaaugugcauga

SEQ ID NO: 1497291 - RNA, 19 nt, Homo sapiens
uagguaaggacauauaguu

SEQ ID NO: 1497292 - RNA, 19 nt, Homo sapiens
cugcagacuuuccuuuaau

SEQ ID NO: 1497293 - RNA, 19 nt, Homo sapiens
agguaaagaucugaaggua

SEQ ID NO: 1497294 - RNA, 19 nt, Homo sapiens
ggaaugcccuuugcucuuu

SEQ ID NO: 1497295 - RNA, 19 nt, Homo sapiens
gaccaugucuuaucuacuu

SEQ ID NO: 1497296 - RNA, 19 nt, Homo sapiens
gggcaaggaccaugucuua

SEQ ID NO: 1497297 - RNA, 19 nt, Homo sapiens
gaugagaauuauacaggua

SEQ ID NO: 1497298 - RNA, 19 nt, Homo sapiens
gguuggugcugaaauguua

SEQ ID NO: 1497299 - RNA, 19 nt, Homo sapiens
gggcgugaauuuagucuuu

SEQ ID NO: 1497300 - RNA, 19 nt, Homo sapiens
gaacgggcgugaauuuagu

SEQ ID NO: 1497301 - RNA, 19 nt, Homo sapiens
gcauuguucuugauuaguu

SEQ ID NO: 1497302 - RNA, 19 nt, Homo sapiens
ggacaggauuuaauucgau

SEQ ID NO: 1497303 - RNA, 19 nt, Homo sapiens
ccaagaaaguccaggaguu

SEQ ID NO: 1497304 - RNA, 19 nt, Homo sapiens
caagaacgggcgugaauuu

SEQ ID NO: 1497305 - RNA, 19 nt, Homo sapiens
guuaugcgcuugagaaauc

SEQ ID NO: 1497306 - RNA, 19 nt, Homo sapiens
guagcauuguucuugauua

SEQ ID NO: 1497307 - RNA, 19 nt, Homo sapiens
ggauuuaauucgaugguau

SEQ ID NO: 1497308 - RNA, 19 nt, Homo sapiens
gagcaguucuugagguuca

SEQ ID NO: 1497309 - RNA, 19 nt, Homo sapiens
caagaaaguccaggaguuu

SEQ ID NO: 1497310 - RNA, 19 nt, Homo sapiens
gcaaggaccaugucuuauc

SEQ ID NO: 1497311 - RNA, 19 nt, Homo sapiens
ccauugcucuugccagauu

SEQ ID NO: 1497312 - RNA, 19 nt, Homo sapiens
guagcuaauugugaaagua

SEQ ID NO: 1497313 - RNA, 19 nt, Homo sapiens
caaccucccugacuuccuu

SEQ ID NO: 1497314 - RNA, 19 nt, Homo sapiens
ggagguccacuuauccaua

SEQ ID NO: 1497315 - RNA, 19 nt, Homo sapiens
ccagccaggugcaguauga

SEQ ID NO: 1497316 - RNA, 19 nt, Homo sapiens
caucgaggcuagaagaaau

SEQ ID NO: 1497317 - RNA, 19 nt, Homo sapiens
caaggaccaugucuuaucu

SEQ ID NO: 1497318 - RNA, 19 nt, Homo sapiens
agaagucacagcaggauua

SEQ ID NO: 1497319 - RNA, 19 nt, Homo sapiens
guacacacacaaacacaaa

SEQ ID NO: 1497320 - RNA, 19 nt, Homo sapiens
ccaagguugaugagaauua

SEQ ID NO: 1497321 - RNA, 19 nt, Homo sapiens
ggaagaggcagaucgaaca

SEQ ID NO: 1497322 - RNA, 19 nt, Homo sapiens
gcaaggaggcagcuuaugg

SEQ ID NO: 1497323 - RNA, 19 nt, Homo sapiens
gagguccacuuauccauag

SEQ ID NO: 1497324 - RNA, 19 nt, Homo sapiens
guacaucccugccauugcu

SEQ ID NO: 1497325 - RNA, 19 nt, Homo sapiens
caagguugaugagaauuau

SEQ ID NO: 1497326 - RNA, 19 nt, Homo sapiens
caaccuaucuuaguuacag

SEQ ID NO: 1497327 - RNA, 19 nt, Homo sapiens
gggcuuccaaccuaucuua

SEQ ID NO: 1497328 - RNA, 19 nt, Homo sapiens
cacgucagcuggccaagaa

SEQ ID NO: 1497329 - RNA, 19 nt, Homo sapiens
gaaggaagaggcagaucga

SEQ ID NO: 1497330 - RNA, 19 nt, Homo sapiens
caaaaccgauucuucaaug

SEQ ID NO: 1497331 - RNA, 19 nt, Homo sapiens
gcuagaagaaaucgagaaa

SEQ ID NO: 1497332 - RNA, 19 nt, Homo sapiens
ggaggcaucuuuuaguuau

SEQ ID NO: 1497333 - RNA, 19 nt, Homo sapiens
cagagcaguucuugagguu

SEQ ID NO: 1497334 - RNA, 19 nt, Homo sapiens
aagccaagguugaugagaa

SEQ ID NO: 1497335 - RNA, 19 nt, Homo sapiens
ggugcaguaugauguggua

SEQ ID NO: 1497336 - RNA, 19 nt, Homo sapiens
gcugaaauguuagguugug

SEQ ID NO: 1497337 - RNA, 19 nt, Homo sapiens
gggauuccuuacugagaaa

SEQ ID NO: 1497338 - RNA, 19 nt, Homo sapiens
caguguggcuggagcagaa

SEQ ID NO: 1497339 - RNA, 19 nt, Homo sapiens
gucaacagauaccaaggaa

SEQ ID NO: 1497340 - RNA, 19 nt, Homo sapiens
agaagcagcagcucaagaa

SEQ ID NO: 1497341 - RNA, 19 nt, Homo sapiens
gcccuuagacugagauuca

SEQ ID NO: 1497342 - RNA, 19 nt, Homo sapiens
gaauggagcaagccaguac

SEQ ID NO: 1497343 - RNA, 19 nt, Homo sapiens
acacaaaacuugcugaaca

SEQ ID NO: 1497344 - RNA, 19 nt, Homo sapiens
uuucaaggaucaccucuuc

SEQ ID NO: 1497345 - RNA, 19 nt, Homo sapiens
uagcauuguucuugauuag

SEQ ID NO: 1497346 - RNA, 19 nt, Homo sapiens
cagccagccugcaguacuu

SEQ ID NO: 1497347 - RNA, 19 nt, Homo sapiens
cuuccaaccuaucuuaguu

SEQ ID NO: 1497348 - RNA, 19 nt, Homo sapiens
gcaugcagagccaaccuaa

SEQ ID NO: 1497349 - RNA, 19 nt, Homo sapiens
gaacaaauggcuggaugag

SEQ ID NO: 1497350 - RNA, 19 nt, Homo sapiens
gucaguaccuuugcucaug

SEQ ID NO: 1497351 - RNA, 19 nt, Homo sapiens
gcaagaggaagaguucaga

SEQ ID NO: 1497352 - RNA, 19 nt, Homo sapiens
gcaguaugaugugguaguc

SEQ ID NO: 1497353 - RNA, 19 nt, Homo sapiens
cagauuguggucuauguuu

SEQ ID NO: 1497354 - RNA, 19 nt, Homo sapiens
ccacauccuucucuuccau

SEQ ID NO: 1497355 - RNA, 19 nt, Homo sapiens
gugcuucaguuucuucauc

SEQ ID NO: 1497356 - RNA, 19 nt, Homo sapiens
cgggauuccuuacugagaa

SEQ ID NO: 1497357 - RNA, 19 nt, Homo sapiens
guaccagccaggugcagua

SEQ ID NO: 1497358 - RNA, 19 nt, Homo sapiens
gauuguggucuauguuuga

SEQ ID NO: 1497359 - RNA, 19 nt, Homo sapiens
ccuaagagcuucaaaaucg

SEQ ID NO: 1497360 - RNA, 19 nt, Homo sapiens
ugacaggucuuaggaacag

SEQ ID NO: 1497361 - RNA, 19 nt, Homo sapiens
ccauaggguuggugcugaa

SEQ ID NO: 1497362 - RNA, 19 nt, Homo sapiens
ggaauggagcaagccagua

SEQ ID NO: 1497363 - RNA, 19 nt, Homo sapiens
caaauggcuggaugaguga

SEQ ID NO: 1497364 - RNA, 19 nt, Homo sapiens
aaccaucucuuucaugucu

SEQ ID NO: 1497365 - RNA, 19 nt, Homo sapiens
aaacauucguacacacaca

SEQ ID NO: 1497366 - RNA, 19 nt, Homo sapiens
cuucacaucaacccuguua

SEQ ID NO: 1497367 - RNA, 19 nt, Homo sapiens
ggagucagagcaguucuug

SEQ ID NO: 1497368 - RNA, 19 nt, Homo sapiens
gaagucacagcaggauuau

SEQ ID NO: 1497369 - RNA, 19 nt, Homo sapiens
aaaacuugcugaacaaaug

SEQ ID NO: 1497370 - RNA, 19 nt, Homo sapiens
ucucugaggacaggauuua

SEQ ID NO: 1497371 - RNA, 19 nt, Homo sapiens
gccagauuguggucuaugu

SEQ ID NO: 1497372 - RNA, 19 nt, Homo sapiens
uuaauacccuguguacauc

SEQ ID NO: 1497373 - RNA, 19 nt, Homo sapiens
acauccuucucuuccauua

SEQ ID NO: 1497374 - RNA, 19 nt, Homo sapiens
uaggguuggugcugaaaug

SEQ ID NO: 1497375 - RNA, 19 nt, Homo sapiens
cacauggcccuuagacuga

SEQ ID NO: 1497376 - RNA, 19 nt, Homo sapiens
gaacagcaaggagcucagu

SEQ ID NO: 1497377 - RNA, 19 nt, Homo sapiens
gaccacuuauuguaguugu

SEQ ID NO: 1497378 - RNA, 19 nt, Homo sapiens
aagaacgggcgugaauuua

SEQ ID NO: 1497379 - RNA, 19 nt, Homo sapiens
cuuaauacccuguguacau

SEQ ID NO: 1497380 - RNA, 19 nt, Homo sapiens
ucacaucaacccuguuaca

SEQ ID NO: 1497381 - RNA, 19 nt, Homo sapiens
ggacacacggcugagaaug

SEQ ID NO: 1497382 - RNA, 19 nt, Homo sapiens
caagaggaagaguucagaa

SEQ ID NO: 1497383 - RNA, 19 nt, Homo sapiens
gcacuguucacccuucaca

SEQ ID NO: 1497384 - RNA, 19 nt, Homo sapiens
cgacaaaaccgauucuuca

SEQ ID NO: 1497385 - RNA, 19 nt, Homo sapiens
augcagagccaaccuaaga

SEQ ID NO: 1497386 - RNA, 19 nt, Homo sapiens
aguuguagcuaauugugaa

SEQ ID NO: 1497387 - RNA, 19 nt, Homo sapiens
gcaacagcaagccaagguu

SEQ ID NO: 1497388 - RNA, 19 nt, Homo sapiens
auaucugucuucucccuaa

SEQ ID NO: 1497389 - RNA, 19 nt, Homo sapiens
ccacuuacuagcugguuug

SEQ ID NO: 1497390 - RNA, 19 nt, Homo sapiens
gccacuuacuagcugguuu

SEQ ID NO: 1497391 - RNA, 19 nt, Homo sapiens
ggcaacagcaggagcaaca

SEQ ID NO: 1497392 - RNA, 19 nt, Homo sapiens
acacacggcugagaaugca

SEQ ID NO: 1497393 - RNA, 19 nt, Homo sapiens
ucgggaagcagcagaaaga

SEQ ID NO: 1497394 - RNA, 19 nt, Homo sapiens
gcacgaaguucacgcuguu

SEQ ID NO: 1497395 - RNA, 19 nt, Homo sapiens
gaagggaacuugccgaaaa

SEQ ID NO: 1497396 - RNA, 19 nt, Homo sapiens
ggguuugguuuaagaauaa

SEQ ID NO: 1497397 - RNA, 19 nt, Homo sapiens
gaagacaaagugcggguuu

SEQ ID NO: 1497398 - RNA, 19 nt, Homo sapiens
aaacuuaggugugacugaa

SEQ ID NO: 1497399 - RNA, 19 nt, Homo sapiens
uggaggagcuggaaagugu

SEQ ID NO: 1497400 - RNA, 19 nt, Homo sapiens
aauuaaugcucgccaauga

SEQ ID NO: 1497401 - RNA, 19 nt, Homo sapiens
cggguuugguuuaagaaua

SEQ ID NO: 1497402 - RNA, 19 nt, Homo sapiens
ggaacuugccgaaaacuua

SEQ ID NO: 1497403 - RNA, 19 nt, Homo sapiens
aaagugcggguuugguuua

SEQ ID NO: 1497404 - RNA, 19 nt, Homo sapiens
ccucugcacuuauguuauc

SEQ ID NO: 1497405 - RNA, 19 nt, Homo sapiens
uaucuccucugcacuuaug

SEQ ID NO: 1497406 - RNA, 19 nt, Homo sapiens
gaauuaaugcucgccaaug

SEQ ID NO: 1497407 - RNA, 19 nt, Homo sapiens
cgacaucagagagaauuaa

SEQ ID NO: 1497408 - RNA, 19 nt, Homo sapiens
gugcggguuugguuuaaga

SEQ ID NO: 1497409 - RNA, 19 nt, Homo sapiens
gaacaugcagccacgaacu

SEQ ID NO: 1497410 - RNA, 19 nt, Homo sapiens
gagaacaugcagccacgaa

SEQ ID NO: 1497411 - RNA, 19 nt, Homo sapiens
cuccaggccucauggguaa

SEQ ID NO: 1497412 - RNA, 19 nt, Homo sapiens
gaggagcuggaaaguguuu

SEQ ID NO: 1497413 - RNA, 19 nt, Homo sapiens
gcccuagaaugccauccuu

SEQ ID NO: 1497414 - RNA, 19 nt, Homo sapiens
caucagagagaauuaaugc

SEQ ID NO: 1497415 - RNA, 19 nt, Homo sapiens
ucuacugccugaguguaua

SEQ ID NO: 1497416 - RNA, 19 nt, Homo sapiens
cuuaucuccucugcacuua

SEQ ID NO: 1497417 - RNA, 19 nt, Homo sapiens
aggugugacugaagacaaa

SEQ ID NO: 1497418 - RNA, 19 nt, Homo sapiens
gccgaaaacuuagguguga

SEQ ID NO: 1497419 - RNA, 19 nt, Homo sapiens
gacaucagagagaauuaau

SEQ ID NO: 1497420 - RNA, 19 nt, Homo sapiens
gcgacaucagagagaauua

SEQ ID NO: 1497421 - RNA, 19 nt, Homo sapiens
ccaggccucauggguaaua

SEQ ID NO: 1497422 - RNA, 19 nt, Homo sapiens
gcucgccaaugaacuacgu

SEQ ID NO: 1497423 - RNA, 19 nt, Homo sapiens
guaggcgacaucagagaga

SEQ ID NO: 1497424 - RNA, 19 nt, Homo sapiens
gcagguggaggagcuggaa

SEQ ID NO: 1497425 - RNA, 19 nt, Homo sapiens
gaauaaaagggccagaugu

SEQ ID NO: 1497426 - RNA, 19 nt, Homo sapiens
gcagacgccacggaguuug

SEQ ID NO: 1497427 - RNA, 19 nt, Homo sapiens
gcacccagcuugaacaauu

SEQ ID NO: 1497428 - RNA, 19 nt, Homo sapiens
gaaccaauguuuacaagga

SEQ ID NO: 1497429 - RNA, 19 nt, Homo sapiens
ggacagagccaaaccauau

SEQ ID NO: 1497430 - RNA, 19 nt, Homo sapiens
gaaacagacuccagugaug

SEQ ID NO: 1497431 - RNA, 19 nt, Homo sapiens
ggucaaauguguauaaaca

SEQ ID NO: 1497432 - RNA, 19 nt, Homo sapiens
gaagauuccuuuagacuac

SEQ ID NO: 1497433 - RNA, 19 nt, Homo sapiens
aaaugaggcuuccuuguaa

SEQ ID NO: 1497434 - RNA, 19 nt, Homo sapiens
gaaaagagguauugauuca

SEQ ID NO: 1497435 - RNA, 19 nt, Homo sapiens
ggaagcaccagacacuuua

SEQ ID NO: 1497436 - RNA, 19 nt, Homo sapiens
ucuaagcucuucagcauaa

SEQ ID NO: 1497437 - RNA, 19 nt, Homo sapiens
gcaauauacuagauagaug

SEQ ID NO: 1497438 - RNA, 19 nt, Homo sapiens
gagcaaagacagcuaagaa

SEQ ID NO: 1497439 - RNA, 19 nt, Homo sapiens
gaugggcccugucuugaaa

SEQ ID NO: 1497440 - RNA, 19 nt, Homo sapiens
cugcauauguccacuuaua

SEQ ID NO: 1497441 - RNA, 19 nt, Homo sapiens
gaagacagcauaaagaaag

SEQ ID NO: 1497442 - RNA, 19 nt, Homo sapiens
ccagacacuuuacagauaa

SEQ ID NO: 1497443 - RNA, 19 nt, Homo sapiens
gaaccaggguccuuucaag

SEQ ID NO: 1497444 - RNA, 19 nt, Homo sapiens
gauaaccaguucucaugaa

SEQ ID NO: 1497445 - RNA, 19 nt, Homo sapiens
gaacuuugggccagaauga

SEQ ID NO: 1497446 - RNA, 19 nt, Homo sapiens
caagaaaggaagaaagaaa

SEQ ID NO: 1497447 - RNA, 19 nt, Homo sapiens
gggaauguguugcaguuug

SEQ ID NO: 1497448 - RNA, 19 nt, Homo sapiens
ccagguauagugucauuua

SEQ ID NO: 1497449 - RNA, 19 nt, Homo sapiens
gguuagagcugcauauguc

SEQ ID NO: 1497450 - RNA, 19 nt, Homo sapiens
ggagaugggcccugucuug

SEQ ID NO: 1497451 - RNA, 19 nt, Homo sapiens
aaacccauccauccaauua

SEQ ID NO: 1497452 - RNA, 19 nt, Homo sapiens
ggaaacccauccauccaau

SEQ ID NO: 1497453 - RNA, 19 nt, Homo sapiens
ggaggccucaggaaauuua

SEQ ID NO: 1497454 - RNA, 19 nt, Homo sapiens
ggaauguguugcaguuugu

SEQ ID NO: 1497455 - RNA, 19 nt, Homo sapiens
gcaaccaaaugcagaucaa

SEQ ID NO: 1497456 - RNA, 19 nt, Homo sapiens
caaaacagauauacaguug

SEQ ID NO: 1497457 - RNA, 19 nt, Homo sapiens
gugaacagaauuugcaaua

SEQ ID NO: 1497458 - RNA, 19 nt, Homo sapiens
ggaagacagcauaaagaaa

SEQ ID NO: 1497459 - RNA, 19 nt, Homo sapiens
caacguacucgcaauaguu

SEQ ID NO: 1497460 - RNA, 19 nt, Homo sapiens
gaggaagacagcauaaaga

SEQ ID NO: 1497461 - RNA, 19 nt, Homo sapiens
caugaaaacucacucagua

SEQ ID NO: 1497462 - RNA, 19 nt, Homo sapiens
gaaaccaaucccagguaua

SEQ ID NO: 1497463 - RNA, 19 nt, Homo sapiens
gggaagcaccagacacuuu

SEQ ID NO: 1497464 - RNA, 19 nt, Homo sapiens
gcaauaguucccaugguuu

SEQ ID NO: 1497465 - RNA, 19 nt, Homo sapiens
gaagauagcgacagugacu

SEQ ID NO: 1497466 - RNA, 19 nt, Homo sapiens
gaaguauucugaagauagc

SEQ ID NO: 1497467 - RNA, 19 nt, Homo sapiens
ccucuuguguuucauuuga

SEQ ID NO: 1497468 - RNA, 19 nt, Homo sapiens
gcaaggcacaucugacaug

SEQ ID NO: 1497469 - RNA, 19 nt, Homo sapiens
aaaugcagauggccagauu

SEQ ID NO: 1497470 - RNA, 19 nt, Homo sapiens
gaccaucacuuucgcuucu

SEQ ID NO: 1497471 - RNA, 19 nt, Homo sapiens
ggaggauagugaacagaau

SEQ ID NO: 1497472 - RNA, 19 nt, Homo sapiens
cacccagcuugaacaauua

SEQ ID NO: 1497473 - RNA, 19 nt, Homo sapiens
gcugccaccuucccauaaa

SEQ ID NO: 1497474 - RNA, 19 nt, Homo sapiens
aaagaaagccaaggucuga

SEQ ID NO: 1497475 - RNA, 19 nt, Homo sapiens
accagacacuuuacagaua

SEQ ID NO: 1497476 - RNA, 19 nt, Homo sapiens
ggaagcaaggcacaucuga

SEQ ID NO: 1497477 - RNA, 19 nt, Homo sapiens
caagugaaagguccaagaa

SEQ ID NO: 1497478 - RNA, 19 nt, Homo sapiens
gugaauccguggcagagaa

SEQ ID NO: 1497479 - RNA, 19 nt, Homo sapiens
ugucuaagcucuucagcau

SEQ ID NO: 1497480 - RNA, 19 nt, Homo sapiens
cauaaagacauacuugaga

SEQ ID NO: 1497481 - RNA, 19 nt, Homo sapiens
ugaaaccaaucccagguau

SEQ ID NO: 1497482 - RNA, 19 nt, Homo sapiens
cgcaauaguucccaugguu

SEQ ID NO: 1497483 - RNA, 19 nt, Homo sapiens
gaggauagugaacagaauu

SEQ ID NO: 1497484 - RNA, 19 nt, Homo sapiens
gagcaaaggcaacggauac

SEQ ID NO: 1497485 - RNA, 19 nt, Homo sapiens
caggaaauuuacaaucaug

SEQ ID NO: 1497486 - RNA, 19 nt, Homo sapiens
uacaaggaauucacaacuu

SEQ ID NO: 1497487 - RNA, 19 nt, Homo sapiens
gcaccagacacuuuacaga

SEQ ID NO: 1497488 - RNA, 19 nt, Homo sapiens
gcaaagacagcuaagaaaa

SEQ ID NO: 1497489 - RNA, 19 nt, Homo sapiens
gggaaccaauguuuacaag

SEQ ID NO: 1497490 - RNA, 19 nt, Homo sapiens
aaacagauauacaguugac

SEQ ID NO: 1497491 - RNA, 19 nt, Homo sapiens
ccuauguccuccacagaaa

SEQ ID NO: 1497492 - RNA, 19 nt, Homo sapiens
ggagcaaaggcaacggaua

SEQ ID NO: 1497493 - RNA, 19 nt, Homo sapiens
aacaauaacuccucaacuc

SEQ ID NO: 1497494 - RNA, 19 nt, Homo sapiens
gggauuauaauacaagaug

SEQ ID NO: 1497495 - RNA, 19 nt, Homo sapiens
gugggaauguguugcaguu

SEQ ID NO: 1497496 - RNA, 19 nt, Homo sapiens
gaaaacacaagaaguauuc

SEQ ID NO: 1497497 - RNA, 19 nt, Homo sapiens
gaaagguccaagaaaggaa

SEQ ID NO: 1497498 - RNA, 19 nt, Homo sapiens
uuucacaccugcaaccaaa

SEQ ID NO: 1497499 - RNA, 19 nt, Homo sapiens
gagaugggcccugucuuga

SEQ ID NO: 1497500 - RNA, 19 nt, Homo sapiens
cagaaagggaggauaguga

SEQ ID NO: 1497501 - RNA, 19 nt, Homo sapiens
agggagaacugccucauuc

SEQ ID NO: 1497502 - RNA, 19 nt, Homo sapiens
ggagguugaaugagacaaa

SEQ ID NO: 1497503 - RNA, 19 nt, Homo sapiens
cagauaaccaguucucaug

SEQ ID NO: 1497504 - RNA, 19 nt, Homo sapiens
gaaaaggucaaauguguau

SEQ ID NO: 1497505 - RNA, 19 nt, Homo sapiens
acuacaggguugugucuaa

SEQ ID NO: 1497506 - RNA, 19 nt, Homo sapiens
ccacagaaagggaggauag

SEQ ID NO: 1497507 - RNA, 19 nt, Homo sapiens
gccuagcaguuucacauga

SEQ ID NO: 1497508 - RNA, 19 nt, Homo sapiens
cucaggaaauuuacaauca

SEQ ID NO: 1497509 - RNA, 19 nt, Homo sapiens
gaaacccauccauccaauu

SEQ ID NO: 1497510 - RNA, 19 nt, Homo sapiens
ugacucugauucugaaaca

SEQ ID NO: 1497511 - RNA, 19 nt, Homo sapiens
cacacaccauaaagacaua

SEQ ID NO: 1497512 - RNA, 19 nt, Homo sapiens
gcuugaguaugcauggauu

SEQ ID NO: 1497513 - RNA, 19 nt, Homo sapiens
gauagguaaggccaacuuu

SEQ ID NO: 1497514 - RNA, 19 nt, Homo sapiens
ccucaacucucaucacacu

SEQ ID NO: 1497515 - RNA, 19 nt, Homo sapiens
auaaccaguucucaugaaa

SEQ ID NO: 1497516 - RNA, 19 nt, Homo sapiens
caugggagcagaagagaga

SEQ ID NO: 1497517 - RNA, 19 nt, Homo sapiens
aaacagacuccagugauga

SEQ ID NO: 1497518 - RNA, 19 nt, Homo sapiens
aaaaugaggcuuccuugua

SEQ ID NO: 1497519 - RNA, 19 nt, Homo sapiens
gaggaaugucagcucauaa

SEQ ID NO: 1497520 - RNA, 19 nt, Homo sapiens
gggaggauagugaacagaa

SEQ ID NO: 1497521 - RNA, 19 nt, Homo sapiens
ugggaggccucaggaaauu

SEQ ID NO: 1497522 - RNA, 19 nt, Homo sapiens
cagguauagugucauuuau

SEQ ID NO: 1497523 - RNA, 19 nt, Homo sapiens
agugaaagguccaagaaag

SEQ ID NO: 1497524 - RNA, 19 nt, Homo sapiens
gaggaacuuugggccagaa

SEQ ID NO: 1497525 - RNA, 19 nt, Homo sapiens
ucuagcagcacuaaacaaa

SEQ ID NO: 1497526 - RNA, 19 nt, Homo sapiens
gagccaaaccauaucagau

SEQ ID NO: 1497527 - RNA, 19 nt, Homo sapiens
guagugagcuuucuaagua

SEQ ID NO: 1497528 - RNA, 19 nt, Homo sapiens
uaacauagcucucacauuc

SEQ ID NO: 1497529 - RNA, 19 nt, Homo sapiens
gaucauuacugaagauuug

SEQ ID NO: 1497530 - RNA, 19 nt, Homo sapiens
gcaaagaugcuguaaagaa

SEQ ID NO: 1497531 - RNA, 19 nt, Homo sapiens
aaucuuaacuccacaguaa

SEQ ID NO: 1497532 - RNA, 19 nt, Homo sapiens
ugaguaacuugcagauuua

SEQ ID NO: 1497533 - RNA, 19 nt, Homo sapiens
uaacaccagucccgguuua

SEQ ID NO: 1497534 - RNA, 19 nt, Homo sapiens
gaagaaguuugagaagaaa

SEQ ID NO: 1497535 - RNA, 19 nt, Homo sapiens
gagagagcauugagacuga

SEQ ID NO: 1497536 - RNA, 19 nt, Homo sapiens
agaagaaguuugagaagaa

SEQ ID NO: 1497537 - RNA, 19 nt, Homo sapiens
aaggauaccuggauuuauu

SEQ ID NO: 1497538 - RNA, 19 nt, Homo sapiens
ucacauucauggcuguuua

SEQ ID NO: 1497539 - RNA, 19 nt, Homo sapiens
caaagaugcuguaaagaag

SEQ ID NO: 1497540 - RNA, 19 nt, Homo sapiens
ggaagaucauuacugaaga

SEQ ID NO: 1497541 - RNA, 19 nt, Homo sapiens
guaugaagacgcuuugaua

SEQ ID NO: 1497542 - RNA, 19 nt, Homo sapiens
gaagaucauuacugaagau

SEQ ID NO: 1497543 - RNA, 19 nt, Homo sapiens
gaagucgggucuccugaug

SEQ ID NO: 1497544 - RNA, 19 nt, Homo sapiens
ccuguuaagugaagguuua

SEQ ID NO: 1497545 - RNA, 19 nt, Homo sapiens
gaagacgcuuugauagaug

SEQ ID NO: 1497546 - RNA, 19 nt, Homo sapiens
caagauaaguacgugguuu

SEQ ID NO: 1497547 - RNA, 19 nt, Homo sapiens
gaagauuuggugcaagaua

SEQ ID NO: 1497548 - RNA, 19 nt, Homo sapiens
caacagaaccucccaacau

SEQ ID NO: 1497549 - RNA, 19 nt, Homo sapiens
agaacuagauaacauggua

SEQ ID NO: 1497550 - RNA, 19 nt, Homo sapiens
gaagaugaggaaaguguaa

SEQ ID NO: 1497551 - RNA, 19 nt, Homo sapiens
gagaagaaagaguccauuu

SEQ ID NO: 1497552 - RNA, 19 nt, Homo sapiens
gauccugcauucaaucuau

SEQ ID NO: 1497553 - RNA, 19 nt, Homo sapiens
uagauaacaugguaacaga

SEQ ID NO: 1497554 - RNA, 19 nt, Homo sapiens
ggagggaacaagauaugua

SEQ ID NO: 1497555 - RNA, 19 nt, Homo sapiens
ucacagaaagccaucauuu

SEQ ID NO: 1497556 - RNA, 19 nt, Homo sapiens
augaguaacuugcagauuu

SEQ ID NO: 1497557 - RNA, 19 nt, Homo sapiens
gaagagaguagugagcuuu

SEQ ID NO: 1497558 - RNA, 19 nt, Homo sapiens
ugaagacgcuuugauagau

SEQ ID NO: 1497559 - RNA, 19 nt, Homo sapiens
cagaagaaguuugagaaga

SEQ ID NO: 1497560 - RNA, 19 nt, Homo sapiens
gcaguuguuucauauucaa

SEQ ID NO: 1497561 - RNA, 19 nt, Homo sapiens
gguaacagagaauugauuu

SEQ ID NO: 1497562 - RNA, 19 nt, Homo sapiens
cuacagauccucccauuuc

SEQ ID NO: 1497563 - RNA, 19 nt, Homo sapiens
gcugaaaccaccaagauga

SEQ ID NO: 1497564 - RNA, 19 nt, Homo sapiens
aagauuuggugcaagauaa

SEQ ID NO: 1497565 - RNA, 19 nt, Homo sapiens
aacagaaccucccaacauu

SEQ ID NO: 1497566 - RNA, 19 nt, Homo sapiens
gaagaaagaguccauuuug

SEQ ID NO: 1497567 - RNA, 19 nt, Homo sapiens
ggaaggaggcgucccagau

SEQ ID NO: 1497568 - RNA, 19 nt, Homo sapiens
gaucuucucagcugucuug

SEQ ID NO: 1497569 - RNA, 19 nt, Homo sapiens
gcgcuugucugggugauug

SEQ ID NO: 1497570 - RNA, 19 nt, Homo sapiens
cugaugcaguuguuucaua

SEQ ID NO: 1497571 - RNA, 19 nt, Homo sapiens
ugucguaggucuucugaug

SEQ ID NO: 1497572 - RNA, 19 nt, Homo sapiens
aauaaaggauaccuggauu

SEQ ID NO: 1497573 - RNA, 19 nt, Homo sapiens
gauaacaugguaacagaga

SEQ ID NO: 1497574 - RNA, 19 nt, Homo sapiens
gaacuagauaacaugguaa

SEQ ID NO: 1497575 - RNA, 19 nt, Homo sapiens
ggaauucugaguggugaua

SEQ ID NO: 1497576 - RNA, 19 nt, Homo sapiens
ccucagauccucaacagaa

SEQ ID NO: 1497577 - RNA, 19 nt, Homo sapiens
gaaggaggcgucccagauc

SEQ ID NO: 1497578 - RNA, 19 nt, Homo sapiens
gaugggauccugcauucaa

SEQ ID NO: 1497579 - RNA, 19 nt, Homo sapiens
ggcguugaauugaaagaaa

SEQ ID NO: 1497580 - RNA, 19 nt, Homo sapiens
guaagcgccucacagaaag

SEQ ID NO: 1497581 - RNA, 19 nt, Homo sapiens
ccacgagccuaugcugaaa

SEQ ID NO: 1497582 - RNA, 19 nt, Homo sapiens
uguaagcgccucacagaaa

SEQ ID NO: 1497583 - RNA, 19 nt, Homo sapiens
ggauaccuggauuuauuua

SEQ ID NO: 1497584 - RNA, 19 nt, Homo sapiens
uaaguagugcaguauagua

SEQ ID NO: 1497585 - RNA, 19 nt, Homo sapiens
aggcagggcuggcacuauu

SEQ ID NO: 1497586 - RNA, 19 nt, Homo sapiens
cauugagacugagagcuua

SEQ ID NO: 1497587 - RNA, 19 nt, Homo sapiens
gcauugagacugagagcuu

SEQ ID NO: 1497588 - RNA, 19 nt, Homo sapiens
gagggaacaagauauguau

SEQ ID NO: 1497589 - RNA, 19 nt, Homo sapiens
ccaagcacuucccaugaug

SEQ ID NO: 1497590 - RNA, 19 nt, Homo sapiens
agggaggucugaaguagaa

SEQ ID NO: 1497591 - RNA, 19 nt, Homo sapiens
caacggccaagaugagaaa

SEQ ID NO: 1497592 - RNA, 19 nt, Homo sapiens
caacggccaagaugagaaa

SEQ ID NO: 1497593 - RNA, 19 nt, Homo sapiens
ugaugcaguuguuucauau

SEQ ID NO: 1497594 - RNA, 19 nt, Homo sapiens
caaagucauacaacacauu

SEQ ID NO: 1497595 - RNA, 19 nt, Homo sapiens
guaacuugcagauuuaugu

SEQ ID NO: 1497596 - RNA, 19 nt, Homo sapiens
auaaugcgcugccgaaguc

SEQ ID NO: 1497597 - RNA, 19 nt, Homo sapiens
cagaaccucccaacauuug

SEQ ID NO: 1497598 - RNA, 19 nt, Homo sapiens
cgcaauuccugcagaagaa

SEQ ID NO: 1497599 - RNA, 19 nt, Homo sapiens
cauuguuccuguuaaguga

SEQ ID NO: 1497600 - RNA, 19 nt, Homo sapiens
gauccuccaugcuaugagu

SEQ ID NO: 1497601 - RNA, 19 nt, Homo sapiens
acagugauccuccaugcua

SEQ ID NO: 1497602 - RNA, 19 nt, Homo sapiens
aagauaaguacgugguuua

SEQ ID NO: 1497603 - RNA, 19 nt, Homo sapiens
gaugcucggaagaucauua

SEQ ID NO: 1497604 - RNA, 19 nt, Homo sapiens
gcguugaauugaaagaaau

SEQ ID NO: 1497605 - RNA, 19 nt, Homo sapiens
cagacaugcugaagugugu

SEQ ID NO: 1497606 - RNA, 19 nt, Homo sapiens
gagaguagugagcuuucua

SEQ ID NO: 1497607 - RNA, 19 nt, Homo sapiens
cugaagauuuggugcaaga

SEQ ID NO: 1497608 - RNA, 19 nt, Homo sapiens
gcaacugugccacugaaga

SEQ ID NO: 1497609 - RNA, 19 nt, Homo sapiens
aggcagacaugcugaagug

SEQ ID NO: 1497610 - RNA, 19 nt, Homo sapiens
cucggaagaucauuacuga

SEQ ID NO: 1497611 - RNA, 19 nt, Homo sapiens
gcgcaauuccugcagaaga

SEQ ID NO: 1497612 - RNA, 19 nt, Homo sapiens
aagaugcuguaaagaagaa

SEQ ID NO: 1497613 - RNA, 19 nt, Homo sapiens
acccacaucuguaugaaga

SEQ ID NO: 1497614 - RNA, 19 nt, Homo sapiens
ugaugucgcuccugguugu

SEQ ID NO: 1497615 - RNA, 19 nt, Homo sapiens
gaaucuuaacuccacagua

SEQ ID NO: 1497616 - RNA, 19 nt, Homo sapiens
gaggucugaaguagaauuu

SEQ ID NO: 1497617 - RNA, 19 nt, Homo sapiens
gauaaugcgcugccgaagu

SEQ ID NO: 1497618 - RNA, 19 nt, Homo sapiens
gcagaagaaguuugagaag

SEQ ID NO: 1497619 - RNA, 19 nt, Homo sapiens
ucuaaguagugcaguauag

SEQ ID NO: 1497620 - RNA, 19 nt, Homo sapiens
cuagggaggucugaaguag

SEQ ID NO: 1497621 - RNA, 19 nt, Homo sapiens
gggugaagaugaggaaagu

SEQ ID NO: 1497622 - RNA, 19 nt, Homo sapiens
auucuugguuugccuaauu

SEQ ID NO: 1497623 - RNA, 19 nt, Homo sapiens
guagugcaguauaguagag

SEQ ID NO: 1497624 - RNA, 19 nt, Homo sapiens
gauagaugagguagagaga

SEQ ID NO: 1497625 - RNA, 19 nt, Homo sapiens
gcaagauaaguacgugguu

SEQ ID NO: 1497626 - RNA, 19 nt, Homo sapiens
aagaggaggucugggaguu

SEQ ID NO: 1497627 - RNA, 19 nt, Homo sapiens
ggaagagucugaaccauua

SEQ ID NO: 1497628 - RNA, 19 nt, Homo sapiens
gaaaggauaacuuguguuu

SEQ ID NO: 1497629 - RNA, 19 nt, Homo sapiens
gcagaaaccugguagcaau

SEQ ID NO: 1497630 - RNA, 19 nt, Homo sapiens
ccaauuggauucucagauu

SEQ ID NO: 1497631 - RNA, 19 nt, Homo sapiens
aagaagcucucuagacaua

SEQ ID NO: 1497632 - RNA, 19 nt, Homo sapiens
gcugaagucuccuggcaua

SEQ ID NO: 1497633 - RNA, 19 nt, Homo sapiens
cuaagaagcucucuagaca

SEQ ID NO: 1497634 - RNA, 19 nt, Homo sapiens
agaagaaacugaaacguau

SEQ ID NO: 1497635 - RNA, 19 nt, Homo sapiens
ugauguagcuggcguuuau

SEQ ID NO: 1497636 - RNA, 19 nt, Homo sapiens
gaagucuccuggcauaugu

SEQ ID NO: 1497637 - RNA, 19 nt, Homo sapiens
ugagauagcaugucaguug

SEQ ID NO: 1497638 - RNA, 19 nt, Homo sapiens
gaccuagaaugcagagaaa

SEQ ID NO: 1497639 - RNA, 19 nt, Homo sapiens
gugaauagugccacaauaa

SEQ ID NO: 1497640 - RNA, 19 nt, Homo sapiens
ggacuaagaagcucucuag

SEQ ID NO: 1497641 - RNA, 19 nt, Homo sapiens
uggaaacaaugaccgauaa

SEQ ID NO: 1497642 - RNA, 19 nt, Homo sapiens
uuucauggcugcauaguau

SEQ ID NO: 1497643 - RNA, 19 nt, Homo sapiens
gaagcucucuagacauauc

SEQ ID NO: 1497644 - RNA, 19 nt, Homo sapiens
ugaaacguaugauuugaga

SEQ ID NO: 1497645 - RNA, 19 nt, Homo sapiens
gaaacugaaacguaugauu

SEQ ID NO: 1497646 - RNA, 19 nt, Homo sapiens
gcaggagacagccuuauug

SEQ ID NO: 1497647 - RNA, 19 nt, Homo sapiens
cagagaagguggcuguaga

SEQ ID NO: 1497648 - RNA, 19 nt, Homo sapiens
uagcuggcguuuauaacua

SEQ ID NO: 1497649 - RNA, 19 nt, Homo sapiens
caaggaagcagcaagaugu

SEQ ID NO: 1497650 - RNA, 19 nt, Homo sapiens
gaagguggcuguagauccu

SEQ ID NO: 1497651 - RNA, 19 nt, Homo sapiens
gaaugaugguuuccagcuu

SEQ ID NO: 1497652 - RNA, 19 nt, Homo sapiens
guguauaugugccacguuu

SEQ ID NO: 1497653 - RNA, 19 nt, Homo sapiens
aagaagaaacugaaacgua

SEQ ID NO: 1497654 - RNA, 19 nt, Homo sapiens
cagcaaagauaggaugaug

SEQ ID NO: 1497655 - RNA, 19 nt, Homo sapiens
uaucauuguuggacauuug

SEQ ID NO: 1497656 - RNA, 19 nt, Homo sapiens
gauaguuugcugagaauga

SEQ ID NO: 1497657 - RNA, 19 nt, Homo sapiens
aaacacaggaggacuaaga

SEQ ID NO: 1497658 - RNA, 19 nt, Homo sapiens
gaagcagcaagauguauga

SEQ ID NO: 1497659 - RNA, 19 nt, Homo sapiens
gcaaagauaggaugaugca

SEQ ID NO: 1497660 - RNA, 19 nt, Homo sapiens
cccauuagguaaauacuau

SEQ ID NO: 1497661 - RNA, 19 nt, Homo sapiens
gaucggugcuucuggaaac

SEQ ID NO: 1497662 - RNA, 19 nt, Homo sapiens
aagauaggaugaugcagaa

SEQ ID NO: 1497663 - RNA, 19 nt, Homo sapiens
gcccugagauagcauguca

SEQ ID NO: 1497664 - RNA, 19 nt, Homo sapiens
caccugugcugguagauau

SEQ ID NO: 1497665 - RNA, 19 nt, Homo sapiens
gacgagacuuuguuaagca

SEQ ID NO: 1497666 - RNA, 19 nt, Homo sapiens
ggaagcagcaagauguaug

SEQ ID NO: 1497667 - RNA, 19 nt, Homo sapiens
guaaauuagugaaggaacu

SEQ ID NO: 1497668 - RNA, 19 nt, Homo sapiens
ugaauagugccacaauaaa

SEQ ID NO: 1497669 - RNA, 19 nt, Homo sapiens
gcugguagauauuauuaac

SEQ ID NO: 1497670 - RNA, 19 nt, Homo sapiens
uggcauauguuaccgaauc

SEQ ID NO: 1497671 - RNA, 19 nt, Homo sapiens
ggaaacaaugaccgauaaa

SEQ ID NO: 1497672 - RNA, 19 nt, Homo sapiens
uuaauccagucuaucauug

SEQ ID NO: 1497673 - RNA, 19 nt, Homo sapiens
guucaguucccaccuauga

SEQ ID NO: 1497674 - RNA, 19 nt, Homo sapiens
gugcugguagauauuauua

SEQ ID NO: 1497675 - RNA, 19 nt, Homo sapiens
gaauagugccacaauaaac

SEQ ID NO: 1497676 - RNA, 19 nt, Homo sapiens
ccaagucuuugcuauugug

SEQ ID NO: 1497677 - RNA, 19 nt, Homo sapiens
aguauuccaugguguauau

SEQ ID NO: 1497678 - RNA, 19 nt, Homo sapiens
gcgauaguuugcugagaau

SEQ ID NO: 1497679 - RNA, 19 nt, Homo sapiens
gacaguccuucguaucaga

SEQ ID NO: 1497680 - RNA, 19 nt, Homo sapiens
gagacgagacuuuguuaag

SEQ ID NO: 1497681 - RNA, 19 nt, Homo sapiens
uccagaggcuaagaaauuu

SEQ ID NO: 1497682 - RNA, 19 nt, Homo sapiens
cgaaucaacuggccuucca

SEQ ID NO: 1497683 - RNA, 19 nt, Homo sapiens
acuugucccuggaggauua

SEQ ID NO: 1497684 - RNA, 19 nt, Homo sapiens
gaagaaacugaaacguaug

SEQ ID NO: 1497685 - RNA, 19 nt, Homo sapiens
cuagacauaucacacauac

SEQ ID NO: 1497686 - RNA, 19 nt, Homo sapiens
guccauguguucucauugu

SEQ ID NO: 1497687 - RNA, 19 nt, Homo sapiens
aaggauaacuuguguuuug

SEQ ID NO: 1497688 - RNA, 19 nt, Homo sapiens
gacaggacaugcuauucca

SEQ ID NO: 1497689 - RNA, 19 nt, Homo sapiens
cauaguauuccauggugua

SEQ ID NO: 1497690 - RNA, 19 nt, Homo sapiens
gagucugaaccauuagaua

SEQ ID NO: 1497691 - RNA, 19 nt, Homo sapiens
cggaagagucugaaccauu

SEQ ID NO: 1497692 - RNA, 19 nt, Homo sapiens
ggagcaggagacagccuua

SEQ ID NO: 1497693 - RNA, 19 nt, Homo sapiens
agacauaucacacauacuc

SEQ ID NO: 1497694 - RNA, 19 nt, Homo sapiens
uuccagaggcuaagaaauu

SEQ ID NO: 1497695 - RNA, 19 nt, Homo sapiens
ggcagaggauggcccuguu

SEQ ID NO: 1497696 - RNA, 19 nt, Homo sapiens
caucaaggaagcagcaaga

SEQ ID NO: 1497697 - RNA, 19 nt, Homo sapiens
ucacugguuucagcaaaga

SEQ ID NO: 1497698 - RNA, 19 nt, Homo sapiens
ugcgauaguuugcugagaa

SEQ ID NO: 1497699 - RNA, 19 nt, Homo sapiens
cauguguucucauuguuca

SEQ ID NO: 1497700 - RNA, 19 nt, Homo sapiens
gcaggauauugcugaaguc

SEQ ID NO: 1497701 - RNA, 19 nt, Homo sapiens
caaaagccaacaagaaauu

SEQ ID NO: 1497702 - RNA, 19 nt, Homo sapiens
uuccaagucuuugcuauug

SEQ ID NO: 1497703 - RNA, 19 nt, Homo sapiens
gcaggaugacucaaaccuu

SEQ ID NO: 1497704 - RNA, 19 nt, Homo sapiens
ugaccuagaaugcagagaa

SEQ ID NO: 1497705 - RNA, 19 nt, Homo sapiens
ggagaugaccuagaaugca

SEQ ID NO: 1497706 - RNA, 19 nt, Homo sapiens
uugaugacuucacugguuu

SEQ ID NO: 1497707 - RNA, 19 nt, Homo sapiens
ccacccagccaauuggauu

SEQ ID NO: 1497708 - RNA, 19 nt, Homo sapiens
cuacaaaggacaugaacuc

SEQ ID NO: 1497709 - RNA, 19 nt, Homo sapiens
uugaaaggauaacuugugu

SEQ ID NO: 1497710 - RNA, 19 nt, Homo sapiens
gcagaggauggcccuguug

SEQ ID NO: 1497711 - RNA, 19 nt, Homo sapiens
ucagauugaugacuucacu

SEQ ID NO: 1497712 - RNA, 19 nt, Homo sapiens
aauccagucuaucauuguu

SEQ ID NO: 1497713 - RNA, 19 nt, Homo sapiens
ggaaacguuaccagcaguu

SEQ ID NO: 1497714 - RNA, 19 nt, Homo sapiens
ucauccaugucccuacaaa

SEQ ID NO: 1497715 - RNA, 19 nt, Homo sapiens
cagcagcucacacugaugu

SEQ ID NO: 1497716 - RNA, 19 nt, Homo sapiens
gaaaccugguagcaaugca

SEQ ID NO: 1497717 - RNA, 19 nt, Homo sapiens
ggcuguagauccugaaacu

SEQ ID NO: 1497718 - RNA, 19 nt, Homo sapiens
auugaugacuucacugguu

SEQ ID NO: 1497719 - RNA, 19 nt, Homo sapiens
ucaaggaagcagcaagaug

SEQ ID NO: 1497720 - RNA, 19 nt, Homo sapiens
gcucugccauguccaaagc

SEQ ID NO: 1497721 - RNA, 19 nt, Homo sapiens
gugacaguccuucguauca

SEQ ID NO: 1497722 - RNA, 19 nt, Homo sapiens
agucugaaccauuagauau

SEQ ID NO: 1497723 - RNA, 19 nt, Homo sapiens
gaaacaaugaccgauaaaa

SEQ ID NO: 1497724 - RNA, 19 nt, Homo sapiens
ggcauauguuaccgaauca

SEQ ID NO: 1497725 - RNA, 19 nt, Homo sapiens
gaaggagugcaaggaccua

SEQ ID NO: 1497726 - RNA, 19 nt, Homo sapiens
gauaggaugaugcagaaac

SEQ ID NO: 1497727 - RNA, 19 nt, Homo sapiens
ucaaauacuugcuguguaa

SEQ ID NO: 1497728 - RNA, 19 nt, Homo sapiens
caugaaagccuaaauguaa

SEQ ID NO: 1497729 - RNA, 19 nt, Homo sapiens
caaccaagauuauccagaa

SEQ ID NO: 1497730 - RNA, 19 nt, Homo sapiens
ggaaaucauuguaaucuuc

SEQ ID NO: 1497731 - RNA, 19 nt, Homo sapiens
ggacacuccuucccuauga

SEQ ID NO: 1497732 - RNA, 19 nt, Homo sapiens
gaagaaaccugggaagaca

SEQ ID NO: 1497733 - RNA, 19 nt, Homo sapiens
ggaauuugguagcaguuaa

SEQ ID NO: 1497734 - RNA, 19 nt, Homo sapiens
guaaauguuucuggacuuu

SEQ ID NO: 1497735 - RNA, 19 nt, Homo sapiens
caacgaggaugacaaccaa

SEQ ID NO: 1497736 - RNA, 19 nt, Homo sapiens
gcagaugcuuguugauaug

SEQ ID NO: 1497737 - RNA, 19 nt, Homo sapiens
ucacaaauguuccugaaag

SEQ ID NO: 1497738 - RNA, 19 nt, Homo sapiens
ucauucaucuuaucaggua

SEQ ID NO: 1497739 - RNA, 19 nt, Homo sapiens
caccacagcuacucaagaa

SEQ ID NO: 1497740 - RNA, 19 nt, Homo sapiens
gcaguuaauucaagccaau

SEQ ID NO: 1497741 - RNA, 19 nt, Homo sapiens
ccuaugaggucuaugaaug

SEQ ID NO: 1497742 - RNA, 19 nt, Homo sapiens
ccaugaggcuuacagaguu

SEQ ID NO: 1497743 - RNA, 19 nt, Homo sapiens
ggaagucuaucuuuacacu

SEQ ID NO: 1497744 - RNA, 19 nt, Homo sapiens
cagcagguguuuggagaua

SEQ ID NO: 1497745 - RNA, 19 nt, Homo sapiens
ucacauauauagggccuuu

SEQ ID NO: 1497746 - RNA, 19 nt, Homo sapiens
gaaggcucaucaucucuug

SEQ ID NO: 1497747 - RNA, 19 nt, Homo sapiens
ucaagaagaucaaauucag

SEQ ID NO: 1497748 - RNA, 19 nt, Homo sapiens
ggaauuugaacaacaaugu

SEQ ID NO: 1497749 - RNA, 19 nt, Homo sapiens
gugcauuugugaacacgua

SEQ ID NO: 1497750 - RNA, 19 nt, Homo sapiens
ccagaaggcucaucaucuc

SEQ ID NO: 1497751 - RNA, 19 nt, Homo sapiens
gaaguggagcuguacgauu

SEQ ID NO: 1497752 - RNA, 19 nt, Homo sapiens
caaaauaagucaccguguu

SEQ ID NO: 1497753 - RNA, 19 nt, Homo sapiens
cuucagcuauuucaucaaa

SEQ ID NO: 1497754 - RNA, 19 nt, Homo sapiens
cgacagucuucagcuauuu

SEQ ID NO: 1497755 - RNA, 19 nt, Homo sapiens
gaucaaauucaggacauaa

SEQ ID NO: 1497756 - RNA, 19 nt, Homo sapiens
aaucaucgcuauaucaagu

SEQ ID NO: 1497757 - RNA, 19 nt, Homo sapiens
cuacuaugccuacgucuuu

SEQ ID NO: 1497758 - RNA, 19 nt, Homo sapiens
cuacgacagucuucagcua

SEQ ID NO: 1497759 - RNA, 19 nt, Homo sapiens
gggaagacaacgaggauga

SEQ ID NO: 1497760 - RNA, 19 nt, Homo sapiens
caucacugcccuuggguua

SEQ ID NO: 1497761 - RNA, 19 nt, Homo sapiens
cugaagccuuuguuuaauu

SEQ ID NO: 1497762 - RNA, 19 nt, Homo sapiens
gacaaggagcgcuaugaaa

SEQ ID NO: 1497763 - RNA, 19 nt, Homo sapiens
uacuggaagucuaucuuua

SEQ ID NO: 1497764 - RNA, 19 nt, Homo sapiens
ccacagcuacucaagaaga

SEQ ID NO: 1497765 - RNA, 19 nt, Homo sapiens
gugaacacguacagcauau

SEQ ID NO: 1497766 - RNA, 19 nt, Homo sapiens
auucuuagcuuacucuguu

SEQ ID NO: 1497767 - RNA, 19 nt, Homo sapiens
gaacacguacagcauaucu

SEQ ID NO: 1497768 - RNA, 19 nt, Homo sapiens
ccaugaaagccuaaaugua

SEQ ID NO: 1497769 - RNA, 19 nt, Homo sapiens
aaguggagcuguacgauuc

SEQ ID NO: 1497770 - RNA, 19 nt, Homo sapiens
gaauauccagcagguguuu

SEQ ID NO: 1497771 - RNA, 19 nt, Homo sapiens
gaggaugacaaccaagauu

SEQ ID NO: 1497772 - RNA, 19 nt, Homo sapiens
gcagguguuuggagauaag

SEQ ID NO: 1497773 - RNA, 19 nt, Homo sapiens
ggaugacaaccaagauuau

SEQ ID NO: 1497774 - RNA, 19 nt, Homo sapiens
ccugaaagcaccacagcua

SEQ ID NO: 1497775 - RNA, 19 nt, Homo sapiens
acucuaccaugccaucuuu

SEQ ID NO: 1497776 - RNA, 19 nt, Homo sapiens
ucacugcccuuggguuaau

SEQ ID NO: 1497777 - RNA, 19 nt, Homo sapiens
gcaccacagcuacucaaga

SEQ ID NO: 1497778 - RNA, 19 nt, Homo sapiens
gaacaacaauguaaaaccu

SEQ ID NO: 1497779 - RNA, 19 nt, Homo sapiens
guacagcauaucuauacaa

SEQ ID NO: 1497780 - RNA, 19 nt, Homo sapiens
ugaagggaaucaaacuaca

SEQ ID NO: 1497781 - RNA, 19 nt, Homo sapiens
agaguucaauguuggaaau

SEQ ID NO: 1497782 - RNA, 19 nt, Homo sapiens
ugucacaaauguuccugaa

SEQ ID NO: 1497783 - RNA, 19 nt, Homo sapiens
aaauucugcuauaguguga

SEQ ID NO: 1497784 - RNA, 19 nt, Homo sapiens
gaagggaaucaaacuacau

SEQ ID NO: 1497785 - RNA, 19 nt, Homo sapiens
agacaggacucaccaucuc

SEQ ID NO: 1497786 - RNA, 19 nt, Homo sapiens
cauagcaguuuucacauuu

SEQ ID NO: 1497787 - RNA, 19 nt, Homo sapiens
aaacggaaacauagcaguu

SEQ ID NO: 1497788 - RNA, 19 nt, Homo sapiens
caacuacaaauucuuccuu

SEQ ID NO: 1497789 - RNA, 19 nt, Homo sapiens
ggaccuacuggaagucuau

SEQ ID NO: 1497790 - RNA, 19 nt, Homo sapiens
aaccugaagccuuuguuua

SEQ ID NO: 1497791 - RNA, 19 nt, Homo sapiens
gaauuugguagcaguuaau

SEQ ID NO: 1497792 - RNA, 19 nt, Homo sapiens
guuucuggacuuuauguua

SEQ ID NO: 1497793 - RNA, 19 nt, Homo sapiens
ucaccguguuggauugaaa

SEQ ID NO: 1497794 - RNA, 19 nt, Homo sapiens
aggaugacaaccaagauua

SEQ ID NO: 1497795 - RNA, 19 nt, Homo sapiens
cuacaaauucuuccuucaa

SEQ ID NO: 1497796 - RNA, 19 nt, Homo sapiens
cuacuggaagucuaucuuu

SEQ ID NO: 1497797 - RNA, 19 nt, Homo sapiens
ccuguucugucacaaaugu

SEQ ID NO: 1497798 - RNA, 19 nt, Homo sapiens
gacuuugaaucaucgcuau

SEQ ID NO: 1497799 - RNA, 19 nt, Homo sapiens
ccugaagccuuuguuuaau

SEQ ID NO: 1497800 - RNA, 19 nt, Homo sapiens
uaagucaccguguuggauu

SEQ ID NO: 1497801 - RNA, 19 nt, Homo sapiens
gaaacaaaaccaccuuaga

SEQ ID NO: 1497802 - RNA, 19 nt, Homo sapiens
uguaaaaccuguucuguca

SEQ ID NO: 1497803 - RNA, 19 nt, Homo sapiens
ugaaucaucgcuauaucaa

SEQ ID NO: 1497804 - RNA, 19 nt, Homo sapiens
acacguacagcauaucuau

SEQ ID NO: 1497805 - RNA, 19 nt, Homo sapiens
cguguuggauugaaagcuu

SEQ ID NO: 1497806 - RNA, 19 nt, Homo sapiens
agaacccacugcuagcaaa

SEQ ID NO: 1497807 - RNA, 19 nt, Homo sapiens
caucaaauacuugcugugu

SEQ ID NO: 1497808 - RNA, 19 nt, Homo sapiens
guucaaccuuggcuucauc

SEQ ID NO: 1497809 - RNA, 19 nt, Homo sapiens
gcuaccgguuuacacaaga

SEQ ID NO: 1497810 - RNA, 19 nt, Homo sapiens
ugccagugcucguuauugu

SEQ ID NO: 1497811 - RNA, 19 nt, Homo sapiens
agacaaggagcgcuaugaa

SEQ ID NO: 1497812 - RNA, 19 nt, Homo sapiens
uugggagggugaaucagua

SEQ ID NO: 1497813 - RNA, 19 nt, Homo sapiens
aauacuugcuguguaaaug

SEQ ID NO: 1497814 - RNA, 19 nt, Homo sapiens
gaaagcaccacagcuacuc

SEQ ID NO: 1497815 - RNA, 19 nt, Homo sapiens
gaagacaacgaggaugaca

SEQ ID NO: 1497816 - RNA, 19 nt, Homo sapiens
gagcuguacgauucuguga

SEQ ID NO: 1497817 - RNA, 19 nt, Homo sapiens
cuuacagaguucaauguug

SEQ ID NO: 1497818 - RNA, 19 nt, Homo sapiens
gcuuacagaguucaauguu

SEQ ID NO: 1497819 - RNA, 19 nt, Homo sapiens
gcuagcaaaugaagaaacc

SEQ ID NO: 1497820 - RNA, 19 nt, Homo sapiens
acaaaauucugcuauagug

SEQ ID NO: 1497821 - RNA, 19 nt, Homo sapiens
ugugaacacguacagcaua

SEQ ID NO: 1497822 - RNA, 19 nt, Homo sapiens
uguaaauguuucuggacuu

SEQ ID NO: 1497823 - RNA, 19 nt, Homo sapiens
gaauuccaucaaauacuug

SEQ ID NO: 1497824 - RNA, 19 nt, Homo sapiens
guucaauguuggaaaucau

SEQ ID NO: 1497825 - RNA, 19 nt, Homo sapiens
gaacccacugcuagcaaau

SEQ ID NO: 1497826 - RNA, 19 nt, Homo sapiens
gucuucagcuauuucauca

SEQ ID NO: 1497827 - RNA, 19 nt, Homo sapiens
ucacuaggcuccagaaaua

SEQ ID NO: 1497828 - RNA, 19 nt, Homo sapiens
ucagauggcuuuauucaua

SEQ ID NO: 1497829 - RNA, 19 nt, Homo sapiens
gcauauaccucuguaagua

SEQ ID NO: 1497830 - RNA, 19 nt, Homo sapiens
agaaauggauccacaguua

SEQ ID NO: 1497831 - RNA, 19 nt, Homo sapiens
gaagagagaagacaaugua

SEQ ID NO: 1497832 - RNA, 19 nt, Homo sapiens
caggagggcuggaauauaa

SEQ ID NO: 1497833 - RNA, 19 nt, Homo sapiens
aagcagagauuaagacuaa

SEQ ID NO: 1497834 - RNA, 19 nt, Homo sapiens
gagagaagacaauguauuu

SEQ ID NO: 1497835 - RNA, 19 nt, Homo sapiens
gauuugaacucuucgaauu

SEQ ID NO: 1497836 - RNA, 19 nt, Homo sapiens
ucaaggaggucuucccaua

SEQ ID NO: 1497837 - RNA, 19 nt, Homo sapiens
ggagaaaucugaggaguag

SEQ ID NO: 1497838 - RNA, 19 nt, Homo sapiens
ggagaugaaucaccugcua

SEQ ID NO: 1497839 - RNA, 19 nt, Homo sapiens
caaacacugugaugaaauu

SEQ ID NO: 1497840 - RNA, 19 nt, Homo sapiens
gaacacuggucaugacaga

SEQ ID NO: 1497841 - RNA, 19 nt, Homo sapiens
gaacugccucggaucauua

SEQ ID NO: 1497842 - RNA, 19 nt, Homo sapiens
uaagaucacuggaagcaaa

SEQ ID NO: 1497843 - RNA, 19 nt, Homo sapiens
gaucaaagacucagagaga

SEQ ID NO: 1497844 - RNA, 19 nt, Homo sapiens
gagaauacaccaacaaaga

SEQ ID NO: 1497845 - RNA, 19 nt, Homo sapiens
ccaagagcauucccuagua

SEQ ID NO: 1497846 - RNA, 19 nt, Homo sapiens
ggagguugguuguuauaaa

SEQ ID NO: 1497847 - RNA, 19 nt, Homo sapiens
caagagcauucccuaguaa

SEQ ID NO: 1497848 - RNA, 19 nt, Homo sapiens
gugaggagguugguuguua

SEQ ID NO: 1497849 - RNA, 19 nt, Homo sapiens
gguagaagguggagaaauc

SEQ ID NO: 1497850 - RNA, 19 nt, Homo sapiens
cagaaugccuuaaucauca

SEQ ID NO: 1497851 - RNA, 19 nt, Homo sapiens
gcacacuucugagaucuuu

SEQ ID NO: 1497852 - RNA, 19 nt, Homo sapiens
gagaaaguguauaugcaaa

SEQ ID NO: 1497853 - RNA, 19 nt, Homo sapiens
gaccaaagcugaaacucau

SEQ ID NO: 1497854 - RNA, 19 nt, Homo sapiens
gaaagagaauacaccaaca

SEQ ID NO: 1497855 - RNA, 19 nt, Homo sapiens
gauuacagguugcuaugaa

SEQ ID NO: 1497856 - RNA, 19 nt, Homo sapiens
gaacuucccagcccucaaa

SEQ ID NO: 1497857 - RNA, 19 nt, Homo sapiens
cauagaagauggcgggaaa

SEQ ID NO: 1497858 - RNA, 19 nt, Homo sapiens
agacagagauuaacagagu

SEQ ID NO: 1497859 - RNA, 19 nt, Homo sapiens
guaaguauggcaucaaauu

SEQ ID NO: 1497860 - RNA, 19 nt, Homo sapiens
gaguaaguauggcaucaaa

SEQ ID NO: 1497861 - RNA, 19 nt, Homo sapiens
gaaauggauccacaguuaa

SEQ ID NO: 1497862 - RNA, 19 nt, Homo sapiens
gcaaagcacacuucugaga

SEQ ID NO: 1497863 - RNA, 19 nt, Homo sapiens
ggaaagcggagcaguaguu

SEQ ID NO: 1497864 - RNA, 19 nt, Homo sapiens
ggaaagaggaggagaucaa

SEQ ID NO: 1497865 - RNA, 19 nt, Homo sapiens
cugcaucccuucaagauuu

SEQ ID NO: 1497866 - RNA, 19 nt, Homo sapiens
gguagcagaggaauuguua

SEQ ID NO: 1497867 - RNA, 19 nt, Homo sapiens
gagaagaugaugagccuuu

SEQ ID NO: 1497868 - RNA, 19 nt, Homo sapiens
caaagaguuucgggacaua

SEQ ID NO: 1497869 - RNA, 19 nt, Homo sapiens
ggaagagacuguguugauc

SEQ ID NO: 1497870 - RNA, 19 nt, Homo sapiens
ggaacugccucggaucauu

SEQ ID NO: 1497871 - RNA, 19 nt, Homo sapiens
uagauaggccucuggaaua

SEQ ID NO: 1497872 - RNA, 19 nt, Homo sapiens
gaccaaggaacucauuuaa

SEQ ID NO: 1497873 - RNA, 19 nt, Homo sapiens
uaucagaccuuugagaaau

SEQ ID NO: 1497874 - RNA, 19 nt, Homo sapiens
guagggcuguuuaccauug

SEQ ID NO: 1497875 - RNA, 19 nt, Homo sapiens
ugaggacucuugccagaaa

SEQ ID NO: 1497876 - RNA, 19 nt, Homo sapiens
gaauaugggagaauuaauc

SEQ ID NO: 1497877 - RNA, 19 nt, Homo sapiens
cgaguuaugugccaugguu

SEQ ID NO: 1497878 - RNA, 19 nt, Homo sapiens
gcauuugugucaugaggaa

SEQ ID NO: 1497879 - RNA, 19 nt, Homo sapiens
gugcuuauguacuaugauu

SEQ ID NO: 1497880 - RNA, 19 nt, Homo sapiens
ggugguagguggaguagau

SEQ ID NO: 1497881 - RNA, 19 nt, Homo sapiens
gaccaaggccacugcuaua

SEQ ID NO: 1497882 - RNA, 19 nt, Homo sapiens
uagcaucgauauuauggaa

SEQ ID NO: 1497883 - RNA, 19 nt, Homo sapiens
gaucaggagggcuggaaua

SEQ ID NO: 1497884 - RNA, 19 nt, Homo sapiens
ugaaagcuauguuugaaag

SEQ ID NO: 1497885 - RNA, 19 nt, Homo sapiens
gagguugguuguuauaaag

SEQ ID NO: 1497886 - RNA, 19 nt, Homo sapiens
uugaagugcuuauguacua

SEQ ID NO: 1497887 - RNA, 19 nt, Homo sapiens
uaaucuagcuggugaugug

SEQ ID NO: 1497888 - RNA, 19 nt, Homo sapiens
cuacccagcugucaaugaa

SEQ ID NO: 1497889 - RNA, 19 nt, Homo sapiens
ugacacagaccaaggcuaa

SEQ ID NO: 1497890 - RNA, 19 nt, Homo sapiens
ggaaguggccaugaaagaa

SEQ ID NO: 1497891 - RNA, 19 nt, Homo sapiens
ggaagagcccagaguguga

SEQ ID NO: 1497892 - RNA, 19 nt, Homo sapiens
acacacauuuaccuucuuu

SEQ ID NO: 1497893 - RNA, 19 nt, Homo sapiens
gcuggaauauaaacuugaa

SEQ ID NO: 1497894 - RNA, 19 nt, Homo sapiens
ccaucuugcuucaauauau

SEQ ID NO: 1497895 - RNA, 19 nt, Homo sapiens
guccuacuccucccuauua

SEQ ID NO: 1497896 - RNA, 19 nt, Homo sapiens
agacuggaauuguggauga

SEQ ID NO: 1497897 - RNA, 19 nt, Homo sapiens
gaagaagagagaagacaau

SEQ ID NO: 1497898 - RNA, 19 nt, Homo sapiens
acuaacauaucuuccagua

SEQ ID NO: 1497899 - RNA, 19 nt, Homo sapiens
gggcuggaauauaaacuug

SEQ ID NO: 1497900 - RNA, 19 nt, Homo sapiens
uaagguagcagaggaauug

SEQ ID NO: 1497901 - RNA, 19 nt, Homo sapiens
agauaggccucuggaauaa

SEQ ID NO: 1497902 - RNA, 19 nt, Homo sapiens
gaaagcaaacacugugaug

SEQ ID NO: 1497903 - RNA, 19 nt, Homo sapiens
gaaaggaaggagaggagaa

SEQ ID NO: 1497904 - RNA, 19 nt, Homo sapiens
ggacuuccagaaugccuua

SEQ ID NO: 1497905 - RNA, 19 nt, Homo sapiens
uccaguagcuuccugagaa

SEQ ID NO: 1497906 - RNA, 19 nt, Homo sapiens
ggacuggauuaguuacugu

SEQ ID NO: 1497907 - RNA, 19 nt, Homo sapiens
agucuucuaugccgaguua

SEQ ID NO: 1497908 - RNA, 19 nt, Homo sapiens
gcagaggaauuguuaaaau

SEQ ID NO: 1497909 - RNA, 19 nt, Homo sapiens
ggagaaaacugcacuggau

SEQ ID NO: 1497910 - RNA, 19 nt, Homo sapiens
ccagggaaguggccaugaa

SEQ ID NO: 1497911 - RNA, 19 nt, Homo sapiens
gggcagagccagagacuca

SEQ ID NO: 1497912 - RNA, 19 nt, Homo sapiens
cgagugcgcucuaccauac

SEQ ID NO: 1497913 - RNA, 19 nt, Homo sapiens
ucaugggacuggauuaguu

SEQ ID NO: 1497914 - RNA, 19 nt, Homo sapiens
ccacugggccuauaacuag

SEQ ID NO: 1497915 - RNA, 19 nt, Homo sapiens
gaaugggacucugacacuu

SEQ ID NO: 1497916 - RNA, 19 nt, Homo sapiens
gaaacuggagcaagaagug

SEQ ID NO: 1497917 - RNA, 19 nt, Homo sapiens
ggaagaagagagaagacaa

SEQ ID NO: 1497918 - RNA, 19 nt, Homo sapiens
gaugagccuuuauaagaca

SEQ ID NO: 1497919 - RNA, 19 nt, Homo sapiens
agagagacauaaaggagaa

SEQ ID NO: 1497920 - RNA, 19 nt, Homo sapiens
gguaaaaggggacacauua

SEQ ID NO: 1497921 - RNA, 19 nt, Homo sapiens
uaacuggguuggcauacug

SEQ ID NO: 1497922 - RNA, 19 nt, Homo sapiens
guagauaggccucuggaau

SEQ ID NO: 1497923 - RNA, 19 nt, Homo sapiens
gcaaugacccagaccaaag

SEQ ID NO: 1497924 - RNA, 19 nt, Homo sapiens
gcaccugcuacuacauuua

SEQ ID NO: 1497925 - RNA, 19 nt, Homo sapiens
gacaauguauuucuucacu

SEQ ID NO: 1497926 - RNA, 19 nt, Homo sapiens
ugaccaaggaacucauuua

SEQ ID NO: 1497927 - RNA, 19 nt, Homo sapiens
ggagaaacuucaagagaua

SEQ ID NO: 1497928 - RNA, 19 nt, Homo sapiens
gaaauggccuuacagaaga

SEQ ID NO: 1497929 - RNA, 19 nt, Homo sapiens
ucacagagguaauuaaaug

SEQ ID NO: 1497930 - RNA, 19 nt, Homo sapiens
caacagaaauggagaugug

SEQ ID NO: 1497931 - RNA, 19 nt, Homo sapiens
gaaaugcaguuacuaaagg

SEQ ID NO: 1497932 - RNA, 19 nt, Homo sapiens
ccaagucaaugaaauagaa

SEQ ID NO: 1497933 - RNA, 19 nt, Homo sapiens
gcaguauacuccagaauag

SEQ ID NO: 1497934 - RNA, 19 nt, Homo sapiens
gaaagucacagagguaauu

SEQ ID NO: 1497935 - RNA, 19 nt, Homo sapiens
cuacguggcuucgagauuu

SEQ ID NO: 1497936 - RNA, 19 nt, Homo sapiens
ggugugcgcugaauggaaa

SEQ ID NO: 1497937 - RNA, 19 nt, Homo sapiens
gagccaagucaaugaaaua

SEQ ID NO: 1497938 - RNA, 19 nt, Homo sapiens
caaugaggaucuuagaaau

SEQ ID NO: 1497939 - RNA, 19 nt, Homo sapiens
ggacuuuccucuaacucuu

SEQ ID NO: 1497940 - RNA, 19 nt, Homo sapiens
ugacugggcuguucacauc

SEQ ID NO: 1497941 - RNA, 19 nt, Homo sapiens
gaaaccccaucucuacuua

SEQ ID NO: 1497942 - RNA, 19 nt, Homo sapiens
gcucucaaaucgacuggaa

SEQ ID NO: 1497943 - RNA, 19 nt, Homo sapiens
aaugugaaaugggaacuua

SEQ ID NO: 1497944 - RNA, 19 nt, Homo sapiens
ggcaguauacuccagaaua

SEQ ID NO: 1497945 - RNA, 19 nt, Homo sapiens
ugaggaaugugaugcaguu

SEQ ID NO: 1497946 - RNA, 19 nt, Homo sapiens
gagaaacaaugaggaucuu

SEQ ID NO: 1497947 - RNA, 19 nt, Homo sapiens
cugaagagcucucaaaucg

SEQ ID NO: 1497948 - RNA, 19 nt, Homo sapiens
acaaggaccugaggaaugu

SEQ ID NO: 1497949 - RNA, 19 nt, Homo sapiens
aaucaggcauguucuguga

SEQ ID NO: 1497950 - RNA, 19 nt, Homo sapiens
gaucuuagaaauggccuua

SEQ ID NO: 1497951 - RNA, 19 nt, Homo sapiens
ucaagaacaucccagagau

SEQ ID NO: 1497952 - RNA, 19 nt, Homo sapiens
ucaggcauguucugugaaa

SEQ ID NO: 1497953 - RNA, 19 nt, Homo sapiens
caagagguguugccugaag

SEQ ID NO: 1497954 - RNA, 19 nt, Homo sapiens
acaaugaggaucuuagaaa

SEQ ID NO: 1497955 - RNA, 19 nt, Homo sapiens
gauauaucuucaagcagaa

SEQ ID NO: 1497956 - RNA, 19 nt, Homo sapiens
gaacaucccagagauugug

SEQ ID NO: 1497957 - RNA, 19 nt, Homo sapiens
aaagaaagucacagaggua

SEQ ID NO: 1497958 - RNA, 19 nt, Homo sapiens
cagaagauaugcagaagcu

SEQ ID NO: 1497959 - RNA, 19 nt, Homo sapiens
uaaaggagaaacuucaaga

SEQ ID NO: 1497960 - RNA, 19 nt, Homo sapiens
gaaacaaugaggaucuuag

SEQ ID NO: 1497961 - RNA, 19 nt, Homo sapiens
cagagauuguggcaguaua

SEQ ID NO: 1497962 - RNA, 19 nt, Homo sapiens
caaacaaggaccugaggaa

SEQ ID NO: 1497963 - RNA, 19 nt, Homo sapiens
agaaauggccuuacagaag

SEQ ID NO: 1497964 - RNA, 19 nt, Homo sapiens
uggaaguggugaaggaauu

SEQ ID NO: 1497965 - RNA, 19 nt, Homo sapiens
caagaacaucccagagauu

SEQ ID NO: 1497966 - RNA, 19 nt, Homo sapiens
gaaauagaaaugcaguuac

SEQ ID NO: 1497967 - RNA, 19 nt, Homo sapiens
ggaaguggugaaggaauuu

SEQ ID NO: 1497968 - RNA, 19 nt, Homo sapiens
aggagaaacuucaagagau

SEQ ID NO: 1497969 - RNA, 19 nt, Homo sapiens
ggaacuuaccugagugaga

SEQ ID NO: 1497970 - RNA, 19 nt, Homo sapiens
gagaugggugugaauguga

SEQ ID NO: 1497971 - RNA, 19 nt, Homo sapiens
gcgaucacuucgugguuga

SEQ ID NO: 1497972 - RNA, 19 nt, Homo sapiens
ggaaugugaugcaguugcu

SEQ ID NO: 1497973 - RNA, 19 nt, Homo sapiens
gacuggaaguggugaagga

SEQ ID NO: 1497974 - RNA, 19 nt, Homo sapiens
cgagaugggugugaaugug

SEQ ID NO: 1497975 - RNA, 19 nt, Homo sapiens
cgaggaagaucagcgagau

SEQ ID NO: 1497976 - RNA, 19 nt, Homo sapiens
ccagaguauuguacccaaa

SEQ ID NO: 1497977 - RNA, 19 nt, Homo sapiens
caucaugucaacagaaaug

SEQ ID NO: 1497978 - RNA, 19 nt, Homo sapiens
aaugggaacuuaccugagu

SEQ ID NO: 1497979 - RNA, 19 nt, Homo sapiens
uuacagaagauaugcagaa

SEQ ID NO: 1497980 - RNA, 19 nt, Homo sapiens
aaacaaugaggaucuuaga

SEQ ID NO: 1497981 - RNA, 19 nt, Homo sapiens
ggugaaggaauuucugaga

SEQ ID NO: 1497982 - RNA, 19 nt, Homo sapiens
uaaaugucguaaugagauc

SEQ ID NO: 1497983 - RNA, 19 nt, Homo sapiens
cgugguugaucgaaagaaa

SEQ ID NO: 1497984 - RNA, 19 nt, Homo sapiens
gagguaauuaaaugucgua

SEQ ID NO: 1497985 - RNA, 19 nt, Homo sapiens
caacugcgccgaguacaag

SEQ ID NO: 1497986 - RNA, 19 nt, Homo sapiens
cuaacucuuuggaacuauu

SEQ ID NO: 1497987 - RNA, 19 nt, Homo sapiens
gagagccaagucaaugaaa

SEQ ID NO: 1497988 - RNA, 19 nt, Homo sapiens
aaaugcaguuacuaaagga

SEQ ID NO: 1497989 - RNA, 19 nt, Homo sapiens
uagaaauggccuuacagaa

SEQ ID NO: 1497990 - RNA, 19 nt, Homo sapiens
caacuccugcgaucacuuc

SEQ ID NO: 1497991 - RNA, 19 nt, Homo sapiens
aaggagaaacuucaagaga

SEQ ID NO: 1497992 - RNA, 19 nt, Homo sapiens
aaagucacagagguaauua

SEQ ID NO: 1497993 - RNA, 19 nt, Homo sapiens
aaagggagauuuugagaca

SEQ ID NO: 1497994 - RNA, 19 nt, Homo sapiens
gcgaggugcucuccuucca

SEQ ID NO: 1497995 - RNA, 19 nt, Homo sapiens
agucacagagguaauuaaa

SEQ ID NO: 1497996 - RNA, 19 nt, Homo sapiens
ugaugcaguugcucuuuua

SEQ ID NO: 1497997 - RNA, 19 nt, Homo sapiens
cagccucugucuacaucaa

SEQ ID NO: 1497998 - RNA, 19 nt, Homo sapiens
gagaaacuucaagagauau

SEQ ID NO: 1497999 - RNA, 19 nt, Homo sapiens
agaaaugcaguuacuaaag

SEQ ID NO: 1498000 - RNA, 19 nt, Homo sapiens
gugagagccaagucaauga

SEQ ID NO: 1498001 - RNA, 19 nt, Homo sapiens
aagaacaucccagagauug

SEQ ID NO: 1498002 - RNA, 19 nt, Homo sapiens
ugauggcucacaccuguaa

SEQ ID NO: 1498003 - RNA, 19 nt, Homo sapiens
uuagaaauggccuuacaga

SEQ ID NO: 1498004 - RNA, 19 nt, Homo sapiens
ucuuagaaauggccuuaca

SEQ ID NO: 1498005 - RNA, 19 nt, Homo sapiens
aaacaaggaccugaggaau

SEQ ID NO: 1498006 - RNA, 19 nt, Homo sapiens
aaaguuaccagaguauugu

SEQ ID NO: 1498007 - RNA, 19 nt, Homo sapiens
aaaacuggauucacaggaa

SEQ ID NO: 1498008 - RNA, 19 nt, Homo sapiens
agagccaagucaaugaaau

SEQ ID NO: 1498009 - RNA, 19 nt, Homo sapiens
ucagcgagaugggugugaa

SEQ ID NO: 1498010 - RNA, 19 nt, Homo sapiens
guacaagaacugggugaag

SEQ ID NO: 1498011 - RNA, 19 nt, Homo sapiens
ugagaaacaaugaggaucu

SEQ ID NO: 1498012 - RNA, 19 nt, Homo sapiens
gcaguuacuaaaggagaaa

SEQ ID NO: 1498013 - RNA, 19 nt, Homo sapiens
gggguuguauaaucuauug

SEQ ID NO: 1498014 - RNA, 19 nt, Homo sapiens
gacuuuccucuaacucuuu

SEQ ID NO: 1498015 - RNA, 19 nt, Homo sapiens
ggacuagcagacaaacaag

SEQ ID NO: 1498016 - RNA, 19 nt, Homo sapiens
augaggaucuuagaaaugg

SEQ ID NO: 1498017 - RNA, 19 nt, Homo sapiens
agaaacaaugaggaucuua

SEQ ID NO: 1498018 - RNA, 19 nt, Homo sapiens
ugagagccaagucaaugaa

SEQ ID NO: 1498019 - RNA, 19 nt, Homo sapiens
gaaugugaaaugggaacuu

SEQ ID NO: 1498020 - RNA, 19 nt, Homo sapiens
aagaaagucacagagguaa

SEQ ID NO: 1498021 - RNA, 19 nt, Homo sapiens
gaaccugggagacaaacac

SEQ ID NO: 1498022 - RNA, 19 nt, Homo sapiens
ucaagcagaagaacaagag

SEQ ID NO: 1498023 - RNA, 19 nt, Homo sapiens
gcgagaugggugugaaugu

SEQ ID NO: 1498024 - RNA, 19 nt, Homo sapiens
aguauacuccagaauagaa

SEQ ID NO: 1498025 - RNA, 19 nt, Homo sapiens
aacaaggaccugaggaaug

SEQ ID NO: 1498026 - RNA, 19 nt, Homo sapiens
aagagguguugccugaaga

SEQ ID NO: 1498027 - RNA, 19 nt, Homo sapiens
gaacuuugauccauaauga

SEQ ID NO: 1498028 - RNA, 19 nt, Homo sapiens
gaaaggcacugauguguau

SEQ ID NO: 1498029 - RNA, 19 nt, Homo sapiens
gcagugauaugacagauuu

SEQ ID NO: 1498030 - RNA, 19 nt, Homo sapiens
ugacagauuugaucagaaa

SEQ ID NO: 1498031 - RNA, 19 nt, Homo sapiens
cagagaaacugcacaugaa

SEQ ID NO: 1498032 - RNA, 19 nt, Homo sapiens
ugacauggcucaggagaaa

SEQ ID NO: 1498033 - RNA, 19 nt, Homo sapiens
ggaagagacugcagguugu

SEQ ID NO: 1498034 - RNA, 19 nt, Homo sapiens
cagagaacuuugauccaua

SEQ ID NO: 1498035 - RNA, 19 nt, Homo sapiens
gcagagaacuuugauccau

SEQ ID NO: 1498036 - RNA, 19 nt, Homo sapiens
aaauggagcuggaccuuga

SEQ ID NO: 1498037 - RNA, 19 nt, Homo sapiens
gaugaucucucacccaagu

SEQ ID NO: 1498038 - RNA, 19 nt, Homo sapiens
ugacaagccggagaaauua

SEQ ID NO: 1498039 - RNA, 19 nt, Homo sapiens
gaagaaggccuggauaugg

SEQ ID NO: 1498040 - RNA, 19 nt, Homo sapiens
aaagauagcagcaugaguu

SEQ ID NO: 1498041 - RNA, 19 nt, Homo sapiens
gacugcagguuguagauuu

SEQ ID NO: 1498042 - RNA, 19 nt, Homo sapiens
agagaacuuugauccauaa

SEQ ID NO: 1498043 - RNA, 19 nt, Homo sapiens
uuacagauuucacacauuc

SEQ ID NO: 1498044 - RNA, 19 nt, Homo sapiens
ccaaggcacuaccaauaug

SEQ ID NO: 1498045 - RNA, 19 nt, Homo sapiens
ccaguagcaugcuccaauu

SEQ ID NO: 1498046 - RNA, 19 nt, Homo sapiens
gcaaacggcaaugcagaua

SEQ ID NO: 1498047 - RNA, 19 nt, Homo sapiens
gaacagagaaacugcacau

SEQ ID NO: 1498048 - RNA, 19 nt, Homo sapiens
gaggaauaguacaacaauu

SEQ ID NO: 1498049 - RNA, 19 nt, Homo sapiens
ugauguguauugccuuuaa

SEQ ID NO: 1498050 - RNA, 19 nt, Homo sapiens
ggaagaaggccuggauaug

SEQ ID NO: 1498051 - RNA, 19 nt, Homo sapiens
uaacugcuguuuccuacau

SEQ ID NO: 1498052 - RNA, 19 nt, Homo sapiens
cuacauaguuucaaaucuc

SEQ ID NO: 1498053 - RNA, 19 nt, Homo sapiens
ugacuucacuccaguuucu

SEQ ID NO: 1498054 - RNA, 19 nt, Homo sapiens
gaagagacugcagguugua

SEQ ID NO: 1498055 - RNA, 19 nt, Homo sapiens
uaagagaauugacuucacu

SEQ ID NO: 1498056 - RNA, 19 nt, Homo sapiens
ggaggaauaguacaacaau

SEQ ID NO: 1498057 - RNA, 19 nt, Homo sapiens
ccagaccaccuccuucuuu

SEQ ID NO: 1498058 - RNA, 19 nt, Homo sapiens
guccucagccggaaagaua

SEQ ID NO: 1498059 - RNA, 19 nt, Homo sapiens
ccucagacccgcuggcuaa

SEQ ID NO: 1498060 - RNA, 19 nt, Homo sapiens
gcucuucguucaucuugau

SEQ ID NO: 1498061 - RNA, 19 nt, Homo sapiens
acagagaaacugcacauga

SEQ ID NO: 1498062 - RNA, 19 nt, Homo sapiens
uaugacagauuugaucaga

SEQ ID NO: 1498063 - RNA, 19 nt, Homo sapiens
gcaucucucuucuccaaag

SEQ ID NO: 1498064 - RNA, 19 nt, Homo sapiens
uggcaucucucuucuccaa

SEQ ID NO: 1498065 - RNA, 19 nt, Homo sapiens
uaagaaaggcacugaugug

SEQ ID NO: 1498066 - RNA, 19 nt, Homo sapiens
gaacgcagagaacuuugau

SEQ ID NO: 1498067 - RNA, 19 nt, Homo sapiens
gcgcaacugucugaucuca

SEQ ID NO: 1498068 - RNA, 19 nt, Homo sapiens
aaacggcaaugcagauaag

SEQ ID NO: 1498069 - RNA, 19 nt, Homo sapiens
caaacggcaaugcagauaa

SEQ ID NO: 1498070 - RNA, 19 nt, Homo sapiens
cauccucccuuccucauca

SEQ ID NO: 1498071 - RNA, 19 nt, Homo sapiens
gauaugacagauuugauca

SEQ ID NO: 1498072 - RNA, 19 nt, Homo sapiens
gcaguggcuuauccucaga

SEQ ID NO: 1498073 - RNA, 19 nt, Homo sapiens
caguucauguucagauauu

SEQ ID NO: 1498074 - RNA, 19 nt, Homo sapiens
gacuuaaccauuucugauu

SEQ ID NO: 1498075 - RNA, 19 nt, Homo sapiens
gcacuaccaauauguuauc

SEQ ID NO: 1498076 - RNA, 19 nt, Homo sapiens
gaacucggaggaauaguac

SEQ ID NO: 1498077 - RNA, 19 nt, Homo sapiens
ggaacgcagagaacuuuga

SEQ ID NO: 1498078 - RNA, 19 nt, Homo sapiens
gaucucaguucauguucag

SEQ ID NO: 1498079 - RNA, 19 nt, Homo sapiens
gaagucagaguccagucaa

SEQ ID NO: 1498080 - RNA, 19 nt, Homo sapiens
agaaaggcacugaugugua

SEQ ID NO: 1498081 - RNA, 19 nt, Homo sapiens
aaggugaaauggagacaga

SEQ ID NO: 1498082 - RNA, 19 nt, Homo sapiens
ccaagacgauuuucaagga

SEQ ID NO: 1498083 - RNA, 19 nt, Homo sapiens
cuucuuuccuucauccuuu

SEQ ID NO: 1498084 - RNA, 19 nt, Homo sapiens
cuugauggaugaucucuca

SEQ ID NO: 1498085 - RNA, 19 nt, Homo sapiens
caaccuuacacacuuagaa

SEQ ID NO: 1498086 - RNA, 19 nt, Homo sapiens
cagaccaccuccuucuuuc

SEQ ID NO: 1498087 - RNA, 19 nt, Homo sapiens
gauguguauugccuuuaau

SEQ ID NO: 1498088 - RNA, 19 nt, Homo sapiens
ggugaaauggagacagaaa

SEQ ID NO: 1498089 - RNA, 19 nt, Homo sapiens
acaagccggagaaauuaua

SEQ ID NO: 1498090 - RNA, 19 nt, Homo sapiens
uugacaagccggagaaauu

SEQ ID NO: 1498091 - RNA, 19 nt, Homo sapiens
gcaaugcagauaagccaau

SEQ ID NO: 1498092 - RNA, 19 nt, Homo sapiens
gauauggugaacagagaaa

SEQ ID NO: 1498093 - RNA, 19 nt, Homo sapiens
ccgcagcagugauaugaca

SEQ ID NO: 1498094 - RNA, 19 nt, Homo sapiens
guagcaugcuccaauucau

SEQ ID NO: 1498095 - RNA, 19 nt, Homo sapiens
ccucugcccuccucuuauc

SEQ ID NO: 1498096 - RNA, 19 nt, Homo sapiens
caugaaagggaaaugcaaa

SEQ ID NO: 1498097 - RNA, 19 nt, Homo sapiens
aagaaggccuggauauggu

SEQ ID NO: 1498098 - RNA, 19 nt, Homo sapiens
agaacucggaggaauagua

SEQ ID NO: 1498099 - RNA, 19 nt, Homo sapiens
cagcagcgcuccccuaauc

SEQ ID NO: 1498100 - RNA, 19 nt, Homo sapiens
ugacuuaaccauuucugau

SEQ ID NO: 1498101 - RNA, 19 nt, Homo sapiens
gaaauggagacagaaaguc

SEQ ID NO: 1498102 - RNA, 19 nt, Homo sapiens
gagaaacugcacaugaaag

SEQ ID NO: 1498103 - RNA, 19 nt, Homo sapiens
gagccugacacaucuuaug

SEQ ID NO: 1498104 - RNA, 19 nt, Homo sapiens
ucacacauucugaugcuau

SEQ ID NO: 1498105 - RNA, 19 nt, Homo sapiens
uggauauggugaacagaga

SEQ ID NO: 1498106 - RNA, 19 nt, Homo sapiens
gggaguccauagcuaagca

SEQ ID NO: 1498107 - RNA, 19 nt, Homo sapiens
ggaaagauagcagcaugag

SEQ ID NO: 1498108 - RNA, 19 nt, Homo sapiens
cauuucugauucaacguuu

SEQ ID NO: 1498109 - RNA, 19 nt, Homo sapiens
gaaagauagcagcaugagu

SEQ ID NO: 1498110 - RNA, 19 nt, Homo sapiens
ccgcgcaacugucugaucu

SEQ ID NO: 1498111 - RNA, 19 nt, Homo sapiens
ugaaauggagacagaaagu

SEQ ID NO: 1498112 - RNA, 19 nt, Homo sapiens
ccagucaagugcauuagac

SEQ ID NO: 1498113 - RNA, 19 nt, Homo sapiens
gagccugagugacagugau

SEQ ID NO: 1498114 - RNA, 19 nt, Homo sapiens
guccucuguugacuacaua

SEQ ID NO: 1498115 - RNA, 19 nt, Homo sapiens
cacacauucugaugcuauu

SEQ ID NO: 1498116 - RNA, 19 nt, Homo sapiens
uuccaaggcacuaccaaua

SEQ ID NO: 1498117 - RNA, 19 nt, Homo sapiens
agagaaacugcacaugaaa

SEQ ID NO: 1498118 - RNA, 19 nt, Homo sapiens
uuuccaaccuuacacacuu

SEQ ID NO: 1498119 - RNA, 19 nt, Homo sapiens
cuuagaacucggaggaaua

SEQ ID NO: 1498120 - RNA, 19 nt, Homo sapiens
uuccaaccuuacacacuua

SEQ ID NO: 1498121 - RNA, 19 nt, Homo sapiens
acugauguguauugccuuu

SEQ ID NO: 1498122 - RNA, 19 nt, Homo sapiens
cucaguucauguucagaua

SEQ ID NO: 1498123 - RNA, 19 nt, Homo sapiens
aaauggagacagaaaguca

SEQ ID NO: 1498124 - RNA, 19 nt, Homo sapiens
ggauauggugaacagagaa

SEQ ID NO: 1498125 - RNA, 19 nt, Homo sapiens
cagacccgcuggcuaaagg

SEQ ID NO: 1498126 - RNA, 19 nt, Homo sapiens
gacaagccggagaaauuau

SEQ ID NO: 1498127 - RNA, 19 nt, Homo sapiens
gaagaaggcuugaaacuga

SEQ ID NO: 1498128 - RNA, 19 nt, Homo sapiens
gcugacauguuaagaauua

SEQ ID NO: 1498129 - RNA, 19 nt, Homo sapiens
gaacuugcguguauaauuc

SEQ ID NO: 1498130 - RNA, 19 nt, Homo sapiens
ggaagaagccauggauuua

SEQ ID NO: 1498131 - RNA, 19 nt, Homo sapiens
ggaaagccuugagaacuua

SEQ ID NO: 1498132 - RNA, 19 nt, Homo sapiens
gacaauggcuuacagaaau

SEQ ID NO: 1498133 - RNA, 19 nt, Homo sapiens
guugcaagcugacauguua

SEQ ID NO: 1498134 - RNA, 19 nt, Homo sapiens
gagaaacaaugucugaaug

SEQ ID NO: 1498135 - RNA, 19 nt, Homo sapiens
gaaaucauccucucuaaag

SEQ ID NO: 1498136 - RNA, 19 nt, Homo sapiens
ugagagagauggagaagga

SEQ ID NO: 1498137 - RNA, 19 nt, Homo sapiens
gaagauacaagcguaaauu

SEQ ID NO: 1498138 - RNA, 19 nt, Homo sapiens
gaagaagccauggauuuaa

SEQ ID NO: 1498139 - RNA, 19 nt, Homo sapiens
gaaacaaugucugaaugga

SEQ ID NO: 1498140 - RNA, 19 nt, Homo sapiens
ggacaaacagaacaacauu

SEQ ID NO: 1498141 - RNA, 19 nt, Homo sapiens
ucaagucgcugccgaguuc

SEQ ID NO: 1498142 - RNA, 19 nt, Homo sapiens
cagaaaucauccucucuaa

SEQ ID NO: 1498143 - RNA, 19 nt, Homo sapiens
ggacauggcacaggagaaa

SEQ ID NO: 1498144 - RNA, 19 nt, Homo sapiens
guagacaaacuuucaacua

SEQ ID NO: 1498145 - RNA, 19 nt, Homo sapiens
ccaguuacauuauagacuu

SEQ ID NO: 1498146 - RNA, 19 nt, Homo sapiens
guucucauuuguucuagua

SEQ ID NO: 1498147 - RNA, 19 nt, Homo sapiens
caaagugagauacagauaa

SEQ ID NO: 1498148 - RNA, 19 nt, Homo sapiens
aauggaagcuacaaaguga

SEQ ID NO: 1498149 - RNA, 19 nt, Homo sapiens
ggacccaacugauugucaa

SEQ ID NO: 1498150 - RNA, 19 nt, Homo sapiens
gaacaacauuuaggaaucg

SEQ ID NO: 1498151 - RNA, 19 nt, Homo sapiens
ucucuaaagugcauugauu

SEQ ID NO: 1498152 - RNA, 19 nt, Homo sapiens
gcuugaaacugaaugacaa

SEQ ID NO: 1498153 - RNA, 19 nt, Homo sapiens
gaagcuacaaagugagaua

SEQ ID NO: 1498154 - RNA, 19 nt, Homo sapiens
cggaaagccuugagaacuu

SEQ ID NO: 1498155 - RNA, 19 nt, Homo sapiens
gaauggaagcuacaaagug

SEQ ID NO: 1498156 - RNA, 19 nt, Homo sapiens
gaaccauguugaagauaca

SEQ ID NO: 1498157 - RNA, 19 nt, Homo sapiens
uacaucaccugcccacuaa

SEQ ID NO: 1498158 - RNA, 19 nt, Homo sapiens
gauacugguucucauuugu

SEQ ID NO: 1498159 - RNA, 19 nt, Homo sapiens
gaagccauggauuuaauaa

SEQ ID NO: 1498160 - RNA, 19 nt, Homo sapiens
caaaucagaaccauguuga

SEQ ID NO: 1498161 - RNA, 19 nt, Homo sapiens
ucagaaccauguugaagau

SEQ ID NO: 1498162 - RNA, 19 nt, Homo sapiens
ggaaaggcuuaccaugagu

SEQ ID NO: 1498163 - RNA, 19 nt, Homo sapiens
ggaagaaggcuugaaacug

SEQ ID NO: 1498164 - RNA, 19 nt, Homo sapiens
aaagugagauacagauaag

SEQ ID NO: 1498165 - RNA, 19 nt, Homo sapiens
ggagaaacacacacaucaa

SEQ ID NO: 1498166 - RNA, 19 nt, Homo sapiens
ugacaauggcuuacagaaa

SEQ ID NO: 1498167 - RNA, 19 nt, Homo sapiens
aagcugacauguuaagaau

SEQ ID NO: 1498168 - RNA, 19 nt, Homo sapiens
gaaacacacacaucaagca

SEQ ID NO: 1498169 - RNA, 19 nt, Homo sapiens
gaaugacaauggcuuacag

SEQ ID NO: 1498170 - RNA, 19 nt, Homo sapiens
gaaucgacgcucucuguug

SEQ ID NO: 1498171 - RNA, 19 nt, Homo sapiens
cggaaaggcuuaccaugag

SEQ ID NO: 1498172 - RNA, 19 nt, Homo sapiens
gagaaacacacacaucaag

SEQ ID NO: 1498173 - RNA, 19 nt, Homo sapiens
gguaauucgucagcugaaa

SEQ ID NO: 1498174 - RNA, 19 nt, Homo sapiens
gaaaggcuuaccaugaguu

SEQ ID NO: 1498175 - RNA, 19 nt, Homo sapiens
aagaagccauggauuuaau

SEQ ID NO: 1498176 - RNA, 19 nt, Homo sapiens
agaacaacauuuaggaauc

SEQ ID NO: 1498177 - RNA, 19 nt, Homo sapiens
ucacccaucccaagacuuu

SEQ ID NO: 1498178 - RNA, 19 nt, Homo sapiens
agaauuaggacaaacagaa

SEQ ID NO: 1498179 - RNA, 19 nt, Homo sapiens
gcugaaaucggcacuguca

SEQ ID NO: 1498180 - RNA, 19 nt, Homo sapiens
ugucaaaggcggcagauug

SEQ ID NO: 1498181 - RNA, 19 nt, Homo sapiens
aaucgacgcucucuguugu

SEQ ID NO: 1498182 - RNA, 19 nt, Homo sapiens
gacaaacagaacaacauuu

SEQ ID NO: 1498183 - RNA, 19 nt, Homo sapiens
ccggaaaggcuuaccauga

SEQ ID NO: 1498184 - RNA, 19 nt, Homo sapiens
guaaauuguuaggcugcua

SEQ ID NO: 1498185 - RNA, 19 nt, Homo sapiens
caagucagagcaaugagaa

SEQ ID NO: 1498186 - RNA, 19 nt, Homo sapiens
caagcugacauguuaagaa

SEQ ID NO: 1498187 - RNA, 19 nt, Homo sapiens
uuacaucaccugcccacua

SEQ ID NO: 1498188 - RNA, 19 nt, Homo sapiens
gaaaucggcacugucacaa

SEQ ID NO: 1498189 - RNA, 19 nt, Homo sapiens
aggaagaagccauggauuu

SEQ ID NO: 1498190 - RNA, 19 nt, Homo sapiens
uuucuccucucuucucuuu

SEQ ID NO: 1498191 - RNA, 19 nt, Homo sapiens
uaacuccaguauccucaau

SEQ ID NO: 1498192 - RNA, 19 nt, Homo sapiens
ugauuuaacuccaguaucc

SEQ ID NO: 1498193 - RNA, 19 nt, Homo sapiens
acagaaaucauccucucua

SEQ ID NO: 1498194 - RNA, 19 nt, Homo sapiens
caaaggcggcagauuguag

SEQ ID NO: 1498195 - RNA, 19 nt, Homo sapiens
ugauacugguucucauuug

SEQ ID NO: 1498196 - RNA, 19 nt, Homo sapiens
aaugcuggaucuucuggua

SEQ ID NO: 1498197 - RNA, 19 nt, Homo sapiens
aaacaaugucugaauggaa

SEQ ID NO: 1498198 - RNA, 19 nt, Homo sapiens
ucaauggacuugguuuuaa

SEQ ID NO: 1498199 - RNA, 19 nt, Homo sapiens
acacacacaucaagcaaac

SEQ ID NO: 1498200 - RNA, 19 nt, Homo sapiens
gauggaaacgacagcaaug

SEQ ID NO: 1498201 - RNA, 19 nt, Homo sapiens
acaaagugagauacagaua

SEQ ID NO: 1498202 - RNA, 19 nt, Homo sapiens
cuaacuuuguguucacuga

SEQ ID NO: 1498203 - RNA, 19 nt, Homo sapiens
agaaaaugcuguaccuuga

SEQ ID NO: 1498204 - RNA, 19 nt, Homo sapiens
ccaaaucagaaccauguug

SEQ ID NO: 1498205 - RNA, 19 nt, Homo sapiens
gcaaaccaagucagagcaa

SEQ ID NO: 1498206 - RNA, 19 nt, Homo sapiens
cagcugaaaucggcacugu

SEQ ID NO: 1498207 - RNA, 19 nt, Homo sapiens
ccuccucccuuucaugguu

SEQ ID NO: 1498208 - RNA, 19 nt, Homo sapiens
guugccaccuccucccuuu

SEQ ID NO: 1498209 - RNA, 19 nt, Homo sapiens
cagaacaacauuuaggaau

SEQ ID NO: 1498210 - RNA, 19 nt, Homo sapiens
cccuuugccucucuccuua

SEQ ID NO: 1498211 - RNA, 19 nt, Homo sapiens
agaacuugcguguauaauu

SEQ ID NO: 1498212 - RNA, 19 nt, Homo sapiens
ggaaucgacgcucucuguu

SEQ ID NO: 1498213 - RNA, 19 nt, Homo sapiens
ucaagcaaaccaagucaga

SEQ ID NO: 1498214 - RNA, 19 nt, Homo sapiens
aaacagaacaacauuuagg

SEQ ID NO: 1498215 - RNA, 19 nt, Homo sapiens
acagaacuugcguguauaa

SEQ ID NO: 1498216 - RNA, 19 nt, Homo sapiens
caaaccaagucagagcaau

SEQ ID NO: 1498217 - RNA, 19 nt, Homo sapiens
ggcggugacagauuaaauu

SEQ ID NO: 1498218 - RNA, 19 nt, Homo sapiens
guaauucgucagcugaaau

SEQ ID NO: 1498219 - RNA, 19 nt, Homo sapiens
cuacaaagugagauacaga

SEQ ID NO: 1498220 - RNA, 19 nt, Homo sapiens
guguauaauucuuguguac

SEQ ID NO: 1498221 - RNA, 19 nt, Homo sapiens
gggaucuucucaucguuag

SEQ ID NO: 1498222 - RNA, 19 nt, Homo sapiens
uauccucaauggcuucuuc

SEQ ID NO: 1498223 - RNA, 19 nt, Homo sapiens
agaaaucauccucucuaaa

SEQ ID NO: 1498224 - RNA, 19 nt, Homo sapiens
aagaaggcuugaaacugaa

SEQ ID NO: 1498225 - RNA, 19 nt, Homo sapiens
cagauuaaauuccccaguu

SEQ ID NO: 1498226 - RNA, 19 nt, Homo sapiens
auucuuguguacauccuua

SEQ ID NO: 1498227 - RNA, 19 nt, Homo sapiens
guagauauauugccgcaua

SEQ ID NO: 1498228 - RNA, 19 nt, Homo sapiens
caacaacacuccaccaugu

SEQ ID NO: 1498229 - RNA, 19 nt, Homo sapiens
gaaggacgcuuggguaaug

SEQ ID NO: 1498230 - RNA, 19 nt, Homo sapiens
gcaaacaucuaugcaaaug

SEQ ID NO: 1498231 - RNA, 19 nt, Homo sapiens
gaguccaucucaauaaaua

SEQ ID NO: 1498232 - RNA, 19 nt, Homo sapiens
cugcagaacucauuuauau

SEQ ID NO: 1498233 - RNA, 19 nt, Homo sapiens
gcaagaguccaucucaaua

SEQ ID NO: 1498234 - RNA, 19 nt, Homo sapiens
gcagaacucauuuauauuc

SEQ ID NO: 1498235 - RNA, 19 nt, Homo sapiens
ccagauguguaauuaauug

SEQ ID NO: 1498236 - RNA, 19 nt, Homo sapiens
gaaacccugucucuccuaa

SEQ ID NO: 1498237 - RNA, 19 nt, Homo sapiens
augcauagcuacaugguua

SEQ ID NO: 1498238 - RNA, 19 nt, Homo sapiens
acagagaguuuguacauug

SEQ ID NO: 1498239 - RNA, 19 nt, Homo sapiens
guaauaacguuggauugaa

SEQ ID NO: 1498240 - RNA, 19 nt, Homo sapiens
caagaguccaucucaauaa

SEQ ID NO: 1498241 - RNA, 19 nt, Homo sapiens
ucucagcacuucaggagua

SEQ ID NO: 1498242 - RNA, 19 nt, Homo sapiens
uaagaaugcugccaaacau

SEQ ID NO: 1498243 - RNA, 19 nt, Homo sapiens
gaacuuuaacuucugcaaa

SEQ ID NO: 1498244 - RNA, 19 nt, Homo sapiens
ggaaaacaaugaaaagaug

SEQ ID NO: 1498245 - RNA, 19 nt, Homo sapiens
ccaccuauguuaugcaugu

SEQ ID NO: 1498246 - RNA, 19 nt, Homo sapiens
uaagaugcauagcuacaug

SEQ ID NO: 1498247 - RNA, 19 nt, Homo sapiens
gauaagacacugaaaauga

SEQ ID NO: 1498248 - RNA, 19 nt, Homo sapiens
guauauaugugugcaaaca

SEQ ID NO: 1498249 - RNA, 19 nt, Homo sapiens
uccagaggcuuugcauuua

SEQ ID NO: 1498250 - RNA, 19 nt, Homo sapiens
cagcaaauccagaggcuuu

SEQ ID NO: 1498251 - RNA, 19 nt, Homo sapiens
aaccacugcuucacauaua

SEQ ID NO: 1498252 - RNA, 19 nt, Homo sapiens
gaagauaucgaaauuucuc

SEQ ID NO: 1498253 - RNA, 19 nt, Homo sapiens
gagccgagaucaggccauu

SEQ ID NO: 1498254 - RNA, 19 nt, Homo sapiens
aagaguccaucucaauaaa

SEQ ID NO: 1498255 - RNA, 19 nt, Homo sapiens
acucaguacuuaagauuga

SEQ ID NO: 1498256 - RNA, 19 nt, Homo sapiens
gcccagaacuucauaucag

SEQ ID NO: 1498257 - RNA, 19 nt, Homo sapiens
gcuuugcauuuacuacuuu

SEQ ID NO: 1498258 - RNA, 19 nt, Homo sapiens
cggagcagguggaccauga

SEQ ID NO: 1498259 - RNA, 19 nt, Homo sapiens
ggccugccauaaagcauuu

SEQ ID NO: 1498260 - RNA, 19 nt, Homo sapiens
gccaauugcugcuacucaa

SEQ ID NO: 1498261 - RNA, 19 nt, Homo sapiens
gaacaagccaagaaaccau

SEQ ID NO: 1498262 - RNA, 19 nt, Homo sapiens
ucgguuaacuuguauuauc

SEQ ID NO: 1498263 - RNA, 19 nt, Homo sapiens
gggcaagaguccaucucaa

SEQ ID NO: 1498264 - RNA, 19 nt, Homo sapiens
guaacucaguacuuaagau

SEQ ID NO: 1498265 - RNA, 19 nt, Homo sapiens
gcaccuguaaucccaacua

SEQ ID NO: 1498266 - RNA, 19 nt, Homo sapiens
acucaugccugacaucuca

SEQ ID NO: 1498267 - RNA, 19 nt, Homo sapiens
ucuaaguacuaaaggugua

SEQ ID NO: 1498268 - RNA, 19 nt, Homo sapiens
ccaccagcuuccucaagaa

SEQ ID NO: 1498269 - RNA, 19 nt, Homo sapiens
gaugggcuggguuuaguaa

SEQ ID NO: 1498270 - RNA, 19 nt, Homo sapiens
uuuguuugcuggaggauaa

SEQ ID NO: 1498271 - RNA, 19 nt, Homo sapiens
ccauaggacugaaagaaaa

SEQ ID NO: 1498272 - RNA, 19 nt, Homo sapiens
ggaaguaguggaggaacaa

SEQ ID NO: 1498273 - RNA, 19 nt, Homo sapiens
gaacacugcagaugcuaag

SEQ ID NO: 1498274 - RNA, 19 nt, Homo sapiens
uaaagcaguauuugcgaaa

SEQ ID NO: 1498275 - RNA, 19 nt, Homo sapiens
ggcaagaguccaucucaau

SEQ ID NO: 1498276 - RNA, 19 nt, Homo sapiens
caucuaugcaaauguauug

SEQ ID NO: 1498277 - RNA, 19 nt, Homo sapiens
uaaaggaucgaaccagcaa

SEQ ID NO: 1498278 - RNA, 19 nt, Homo sapiens
cauaagggaauuguaagaa

SEQ ID NO: 1498279 - RNA, 19 nt, Homo sapiens
aguggaaauugcaguguuu

SEQ ID NO: 1498280 - RNA, 19 nt, Homo sapiens
uggcaucccucacaugaag

SEQ ID NO: 1498281 - RNA, 19 nt, Homo sapiens
cuaagaaugcugccaaaca

SEQ ID NO: 1498282 - RNA, 19 nt, Homo sapiens
ccagaggcuuugcauuuac

SEQ ID NO: 1498283 - RNA, 19 nt, Homo sapiens
uguguauucuaaccuguaa

SEQ ID NO: 1498284 - RNA, 19 nt, Homo sapiens
gaaguggaagcugcaguga

SEQ ID NO: 1498285 - RNA, 19 nt, Homo sapiens
uguaauaacguuggauuga

SEQ ID NO: 1498286 - RNA, 19 nt, Homo sapiens
ggacgcuuggguaauguuu

SEQ ID NO: 1498287 - RNA, 19 nt, Homo sapiens
caccaugucugagaaugug

SEQ ID NO: 1498288 - RNA, 19 nt, Homo sapiens
ugagaacacugcagaugcu

SEQ ID NO: 1498289 - RNA, 19 nt, Homo sapiens
uagcauaguguaaucugaa

SEQ ID NO: 1498290 - RNA, 19 nt, Homo sapiens
uuucauugguggccuaaau

SEQ ID NO: 1498291 - RNA, 19 nt, Homo sapiens
agaaugcugccaaacauau

SEQ ID NO: 1498292 - RNA, 19 nt, Homo sapiens
guauguaucuuuguuugcu

SEQ ID NO: 1498293 - RNA, 19 nt, Homo sapiens
gaucgaaccagcaaaucca

SEQ ID NO: 1498294 - RNA, 19 nt, Homo sapiens
gaaugcugccaaacauaug

SEQ ID NO: 1498295 - RNA, 19 nt, Homo sapiens
ugucugagaauguguguau

SEQ ID NO: 1498296 - RNA, 19 nt, Homo sapiens
ggaugggcuggguuuagua

SEQ ID NO: 1498297 - RNA, 19 nt, Homo sapiens
aaaccacugcuucacauau

SEQ ID NO: 1498298 - RNA, 19 nt, Homo sapiens
accuaucgguuaacuugua

SEQ ID NO: 1498299 - RNA, 19 nt, Homo sapiens
cagagaguuuguacauugg

SEQ ID NO: 1498300 - RNA, 19 nt, Homo sapiens
gaaccauaggacugaaaga

SEQ ID NO: 1498301 - RNA, 19 nt, Homo sapiens
ggcuuugcauuuacuacuu

SEQ ID NO: 1498302 - RNA, 19 nt, Homo sapiens
gcauagcuacaugguuauu

SEQ ID NO: 1498303 - RNA, 19 nt, Homo sapiens
auaccuaucgguuaacuug

SEQ ID NO: 1498304 - RNA, 19 nt, Homo sapiens
ggucccauaucagaaguuc

SEQ ID NO: 1498305 - RNA, 19 nt, Homo sapiens
uuccgaagccgguuacgua

SEQ ID NO: 1498306 - RNA, 19 nt, Homo sapiens
caggcucuuuguccuacua

SEQ ID NO: 1498307 - RNA, 19 nt, Homo sapiens
gcgaaccucaggcucuuug

SEQ ID NO: 1498308 - RNA, 19 nt, Homo sapiens
ugcaguguuugcuccauuu

SEQ ID NO: 1498309 - RNA, 19 nt, Homo sapiens
auccagaggcuuugcauuu

SEQ ID NO: 1498310 - RNA, 19 nt, Homo sapiens
aagaaugcugccaaacaua

SEQ ID NO: 1498311 - RNA, 19 nt, Homo sapiens
ccuaucgguuaacuuguau

SEQ ID NO: 1498312 - RNA, 19 nt, Homo sapiens
ggaaaagcaauaaaaguag

SEQ ID NO: 1498313 - RNA, 19 nt, Homo sapiens
ggauggaaaagcaauaaaa

SEQ ID NO: 1498314 - RNA, 19 nt, Homo sapiens
ucauaagggaauuguaaga

SEQ ID NO: 1498315 - RNA, 19 nt, Homo sapiens
ccuauguuaugcauguaga

SEQ ID NO: 1498316 - RNA, 19 nt, Homo sapiens
cacugcagaugcuaagaau

SEQ ID NO: 1498317 - RNA, 19 nt, Homo sapiens
uaaccuguaacaccaccua

SEQ ID NO: 1498318 - RNA, 19 nt, Homo sapiens
gaggauaagacacugaaaa

SEQ ID NO: 1498319 - RNA, 19 nt, Homo sapiens
ugucugagaucugcaagag

SEQ ID NO: 1498320 - RNA, 19 nt, Homo sapiens
acacugcagaugcuaagaa

SEQ ID NO: 1498321 - RNA, 19 nt, Homo sapiens
uuagcauaguguaaucuga

SEQ ID NO: 1498322 - RNA, 19 nt, Homo sapiens
uggcaagcauuucauuggu

SEQ ID NO: 1498323 - RNA, 19 nt, Homo sapiens
gaaccucaggcucuuuguc

SEQ ID NO: 1498324 - RNA, 19 nt, Homo sapiens
ccuguaacaccaccuaugu

SEQ ID NO: 1498325 - RNA, 19 nt, Homo sapiens
gcgcagcacaaugguagaa

SEQ ID NO: 1498326 - RNA, 19 nt, Homo sapiens
aagcaguauuugcgaaaca

SEQ ID NO: 1498327 - RNA, 19 nt, Homo sapiens
gauagaaguuugucaggua

SEQ ID NO: 1498328 - RNA, 19 nt, Homo sapiens
agagucagcugaacuauuu

SEQ ID NO: 1498329 - RNA, 19 nt, Homo sapiens
gaagaggcauugcucaaga

SEQ ID NO: 1498330 - RNA, 19 nt, Homo sapiens
gaagaauucucaucauagu

SEQ ID NO: 1498331 - RNA, 19 nt, Homo sapiens
gagaagcugucccaaguga

SEQ ID NO: 1498332 - RNA, 19 nt, Homo sapiens
gaugaugacuggaggcaaa

SEQ ID NO: 1498333 - RNA, 19 nt, Homo sapiens
caacuucuacucuuuguuu

SEQ ID NO: 1498334 - RNA, 19 nt, Homo sapiens
gaacagugcguacuucuca

SEQ ID NO: 1498335 - RNA, 19 nt, Homo sapiens
gcaggagaccucagaauug

SEQ ID NO: 1498336 - RNA, 19 nt, Homo sapiens
ccaugacccuucuguguuu

SEQ ID NO: 1498337 - RNA, 19 nt, Homo sapiens
gcagcacagucaaugguaa

SEQ ID NO: 1498338 - RNA, 19 nt, Homo sapiens
caagcucccuccacaagaa

SEQ ID NO: 1498339 - RNA, 19 nt, Homo sapiens
ccuauuaccugacccuuug

SEQ ID NO: 1498340 - RNA, 19 nt, Homo sapiens
guacagguuucaaggauag

SEQ ID NO: 1498341 - RNA, 19 nt, Homo sapiens
augcggagcugccaacaua

SEQ ID NO: 1498342 - RNA, 19 nt, Homo sapiens
aaagaugaauccaugguau

SEQ ID NO: 1498343 - RNA, 19 nt, Homo sapiens
gaaauuccaacuuccauuc

SEQ ID NO: 1498344 - RNA, 19 nt, Homo sapiens
gaggucagcuuggaauuca

SEQ ID NO: 1498345 - RNA, 19 nt, Homo sapiens
ggagugaucuuuuccauuc

SEQ ID NO: 1498346 - RNA, 19 nt, Homo sapiens
caaacaggcucugcagaug

SEQ ID NO: 1498347 - RNA, 19 nt, Homo sapiens
gcaccuaggccaggaauga

SEQ ID NO: 1498348 - RNA, 19 nt, Homo sapiens
gcagugaggagaccuauag

SEQ ID NO: 1498349 - RNA, 19 nt, Homo sapiens
gggaccagauuccugacua

SEQ ID NO: 1498350 - RNA, 19 nt, Homo sapiens
caaggaguguccagcaguu

SEQ ID NO: 1498351 - RNA, 19 nt, Homo sapiens
caagcuggcuguucuggau

SEQ ID NO: 1498352 - RNA, 19 nt, Homo sapiens
ggacuuccuugccuuugga

SEQ ID NO: 1498353 - RNA, 19 nt, Homo sapiens
aagagaagcugucccaagu

SEQ ID NO: 1498354 - RNA, 19 nt, Homo sapiens
gcucagucgucaauguaaa

SEQ ID NO: 1498355 - RNA, 19 nt, Homo sapiens
gagcuacaccuuucuuugu

SEQ ID NO: 1498356 - RNA, 19 nt, Homo sapiens
agagagaaaucacauccuu

SEQ ID NO: 1498357 - RNA, 19 nt, Homo sapiens
uaaccuauccagagagaaa

SEQ ID NO: 1498358 - RNA, 19 nt, Homo sapiens
gggcagcaguacugacuug

SEQ ID NO: 1498359 - RNA, 19 nt, Homo sapiens
ggaauagccaccucugaga

SEQ ID NO: 1498360 - RNA, 19 nt, Homo sapiens
gaauucagauccuguucca

SEQ ID NO: 1498361 - RNA, 19 nt, Homo sapiens
gaagcugucccaagugaga

SEQ ID NO: 1498362 - RNA, 19 nt, Homo sapiens
gaaggacuuugaacuacca

SEQ ID NO: 1498363 - RNA, 19 nt, Homo sapiens
gaauuggagucucuguauc

SEQ ID NO: 1498364 - RNA, 19 nt, Homo sapiens
ccagacauauaccaagaga

SEQ ID NO: 1498365 - RNA, 19 nt, Homo sapiens
aacauaacauucacccuuu

SEQ ID NO: 1498366 - RNA, 19 nt, Homo sapiens
caggaaggacuuugaacua

SEQ ID NO: 1498367 - RNA, 19 nt, Homo sapiens
gccuguugcuucuucauuu

SEQ ID NO: 1498368 - RNA, 19 nt, Homo sapiens
cauaaugccuguugcuucu

SEQ ID NO: 1498369 - RNA, 19 nt, Homo sapiens
cuacuauacucccaacuuc

SEQ ID NO: 1498370 - RNA, 19 nt, Homo sapiens
ggagagggguuucuguuug

SEQ ID NO: 1498371 - RNA, 19 nt, Homo sapiens
cauccucuguucccuacua

SEQ ID NO: 1498372 - RNA, 19 nt, Homo sapiens
uaaagaugaauccauggua

SEQ ID NO: 1498373 - RNA, 19 nt, Homo sapiens
gcaggagaauugcuugaac

SEQ ID NO: 1498374 - RNA, 19 nt, Homo sapiens
gagaccaaccagcauauug

SEQ ID NO: 1498375 - RNA, 19 nt, Homo sapiens
gagagaaaucacauccuuu

SEQ ID NO: 1498376 - RNA, 19 nt, Homo sapiens
gcuguaguccuucaaauuc

SEQ ID NO: 1498377 - RNA, 19 nt, Homo sapiens
gauacuagccauuccuuag

SEQ ID NO: 1498378 - RNA, 19 nt, Homo sapiens
gaagaguccacugaacauu

SEQ ID NO: 1498379 - RNA, 19 nt, Homo sapiens
gcagaaaacuaaccaaugc

SEQ ID NO: 1498380 - RNA, 19 nt, Homo sapiens
ggagcuacaccuuucuuug

SEQ ID NO: 1498381 - RNA, 19 nt, Homo sapiens
cugcaucacugccaugguu

SEQ ID NO: 1498382 - RNA, 19 nt, Homo sapiens
ucagagaccaaccagcaua

SEQ ID NO: 1498383 - RNA, 19 nt, Homo sapiens
gugcguacuucucaggauu

SEQ ID NO: 1498384 - RNA, 19 nt, Homo sapiens
gugcuucacuguccugauc

SEQ ID NO: 1498385 - RNA, 19 nt, Homo sapiens
gagcugccaacauaacauu

SEQ ID NO: 1498386 - RNA, 19 nt, Homo sapiens
agaugaauccaugguauua

SEQ ID NO: 1498387 - RNA, 19 nt, Homo sapiens
uaucugagccacuuuaaag

SEQ ID NO: 1498388 - RNA, 19 nt, Homo sapiens
ggaagaguccacugaacau

SEQ ID NO: 1498389 - RNA, 19 nt, Homo sapiens
agaauucucaucauaguug

SEQ ID NO: 1498390 - RNA, 19 nt, Homo sapiens
ggauacuagccauuccuua

SEQ ID NO: 1498391 - RNA, 19 nt, Homo sapiens
gcaauccucaacuaaccua

SEQ ID NO: 1498392 - RNA, 19 nt, Homo sapiens
ccaaacaggcucugcagau

SEQ ID NO: 1498393 - RNA, 19 nt, Homo sapiens
gggaagaguccacugaaca

SEQ ID NO: 1498394 - RNA, 19 nt, Homo sapiens
caggagaccucagaauugg

SEQ ID NO: 1498395 - RNA, 19 nt, Homo sapiens
gaaaucacauccuuuugca

SEQ ID NO: 1498396 - RNA, 19 nt, Homo sapiens
gaucugggcagcaguacug

SEQ ID NO: 1498397 - RNA, 19 nt, Homo sapiens
auucuucucuugccuuaaa

SEQ ID NO: 1498398 - RNA, 19 nt, Homo sapiens
ccacugaacauucuucucu

SEQ ID NO: 1498399 - RNA, 19 nt, Homo sapiens
aaagaaggauccugcuaac

SEQ ID NO: 1498400 - RNA, 19 nt, Homo sapiens
gcacucccgcuuggcaaua

SEQ ID NO: 1498401 - RNA, 19 nt, Homo sapiens
ggaccagauuccugacuac

SEQ ID NO: 1498402 - RNA, 19 nt, Homo sapiens
guacuucucaggauucauc

SEQ ID NO: 1498403 - RNA, 19 nt, Homo sapiens
ccagaacagugcguacuuc

SEQ ID NO: 1498404 - RNA, 19 nt, Homo sapiens
gauccuggucucucaaaga

SEQ ID NO: 1498405 - RNA, 19 nt, Homo sapiens
agccuucuguccucaauaa

SEQ ID NO: 1498406 - RNA, 19 nt, Homo sapiens
ggagucaggcacacuaaca

SEQ ID NO: 1498407 - RNA, 19 nt, Homo sapiens
caagaaggaagaggcauug

SEQ ID NO: 1498408 - RNA, 19 nt, Homo sapiens
gagccacuuuaaagaugaa

SEQ ID NO: 1498409 - RNA, 19 nt, Homo sapiens
gaauugguggguucuccua

SEQ ID NO: 1498410 - RNA, 19 nt, Homo sapiens
aaccuacacugccacacua

SEQ ID NO: 1498411 - RNA, 19 nt, Homo sapiens
uguguaaccuauccagaga

SEQ ID NO: 1498412 - RNA, 19 nt, Homo sapiens
agacauauaccaagagaag

SEQ ID NO: 1498413 - RNA, 19 nt, Homo sapiens
acauucuucucuugccuua

SEQ ID NO: 1498414 - RNA, 19 nt, Homo sapiens
gauggagucaggcacacua

SEQ ID NO: 1498415 - RNA, 19 nt, Homo sapiens
gaaaagaaggauccugcua

SEQ ID NO: 1498416 - RNA, 19 nt, Homo sapiens
ugagccacuuuaaagauga

SEQ ID NO: 1498417 - RNA, 19 nt, Homo sapiens
gcaagcucccuccacaaga

SEQ ID NO: 1498418 - RNA, 19 nt, Homo sapiens
ggaagaggcauugcucaag

SEQ ID NO: 1498419 - RNA, 19 nt, Homo sapiens
ccauacguguguaaccuau

SEQ ID NO: 1498420 - RNA, 19 nt, Homo sapiens
acucugggcugccuaaugg

SEQ ID NO: 1498421 - RNA, 19 nt, Homo sapiens
ucagguagucuaaggaaga

SEQ ID NO: 1498422 - RNA, 19 nt, Homo sapiens
uuucaaggauagaaguuug

SEQ ID NO: 1498423 - RNA, 19 nt, Homo sapiens
ugaggaagccuuuggaaac

SEQ ID NO: 1498424 - RNA, 19 nt, Homo sapiens
ccucagaauuggagucucu

SEQ ID NO: 1498425 - RNA, 19 nt, Homo sapiens
guucugugauucucagcuu

SEQ ID NO: 1498426 - RNA, 19 nt, Homo sapiens
cagguagucuaaggaagaa

SEQ ID NO: 1498427 - RNA, 19 nt, Homo sapiens
ggucguggcuugagaaauu

SEQ ID NO: 1498428 - RNA, 19 nt, Homo sapiens
uauuuggacuggacaauua

SEQ ID NO: 1498429 - RNA, 19 nt, Homo sapiens
gagaagggccugaccuaaa

SEQ ID NO: 1498430 - RNA, 19 nt, Homo sapiens
ggacaagucucuggagcuu

SEQ ID NO: 1498431 - RNA, 19 nt, Homo sapiens
caauaaacaaggugcaaua

SEQ ID NO: 1498432 - RNA, 19 nt, Homo sapiens
cgaaugagaucaaaaguug

SEQ ID NO: 1498433 - RNA, 19 nt, Homo sapiens
gcaggacucuucgaggaaa

SEQ ID NO: 1498434 - RNA, 19 nt, Homo sapiens
cuacaggagucaauaaaca

SEQ ID NO: 1498435 - RNA, 19 nt, Homo sapiens
ggcgagaaauuguccuauu

SEQ ID NO: 1498436 - RNA, 19 nt, Homo sapiens
gcacauguuaucuaucuau

SEQ ID NO: 1498437 - RNA, 19 nt, Homo sapiens
cagcacauguuaucuaucu

SEQ ID NO: 1498438 - RNA, 19 nt, Homo sapiens
ggaagacgagggcgagaaa

SEQ ID NO: 1498439 - RNA, 19 nt, Homo sapiens
gaacgugagcaaccuagga

SEQ ID NO: 1498440 - RNA, 19 nt, Homo sapiens
agaagggccugaccuaaag

SEQ ID NO: 1498441 - RNA, 19 nt, Homo sapiens
gcagcgagcccaaggaaca

SEQ ID NO: 1498442 - RNA, 19 nt, Homo sapiens
ggacuuggagcaccacuuc

SEQ ID NO: 1498443 - RNA, 19 nt, Homo sapiens
guccagaucuccggauugu

SEQ ID NO: 1498444 - RNA, 19 nt, Homo sapiens
ggccaauggaggcgauuua

SEQ ID NO: 1498445 - RNA, 19 nt, Homo sapiens
acaauuaaguggcccugau

SEQ ID NO: 1498446 - RNA, 19 nt, Homo sapiens
uaaguggcccugaugaugu

SEQ ID NO: 1498447 - RNA, 19 nt, Homo sapiens
cagaaucgcagguacaagu

SEQ ID NO: 1498448 - RNA, 19 nt, Homo sapiens
gggaggaggacgaggaaga

SEQ ID NO: 1498449 - RNA, 19 nt, Homo sapiens
cgagaagggccugaccuaa

SEQ ID NO: 1498450 - RNA, 19 nt, Homo sapiens
acacuacaggagucaauaa

SEQ ID NO: 1498451 - RNA, 19 nt, Homo sapiens
guauucagcacauguuauc

SEQ ID NO: 1498452 - RNA, 19 nt, Homo sapiens
gcacagucgauuucguuuc

SEQ ID NO: 1498453 - RNA, 19 nt, Homo sapiens
uagcacagucgauuucguu

SEQ ID NO: 1498454 - RNA, 19 nt, Homo sapiens
cacauccacucaggugaaa

SEQ ID NO: 1498455 - RNA, 19 nt, Homo sapiens
ccaauggaggcgauuuaga

SEQ ID NO: 1498456 - RNA, 19 nt, Homo sapiens
caauuaaguggcccugaug

SEQ ID NO: 1498457 - RNA, 19 nt, Homo sapiens
gguguuaccggguuuccuu

SEQ ID NO: 1498458 - RNA, 19 nt, Homo sapiens
caauggaggcgauuuagac

SEQ ID NO: 1498459 - RNA, 19 nt, Homo sapiens
gaaaaccagccgaaugaga

SEQ ID NO: 1498460 - RNA, 19 nt, Homo sapiens
agacgagggcgagaaauug

SEQ ID NO: 1498461 - RNA, 19 nt, Homo sapiens
ccauagcacagucgauuuc

SEQ ID NO: 1498462 - RNA, 19 nt, Homo sapiens
gcacuugcaggcggacuug

SEQ ID NO: 1498463 - RNA, 19 nt, Homo sapiens
gccauagcacagucgauuu

SEQ ID NO: 1498464 - RNA, 19 nt, Homo sapiens
gacgagggcgagaaauugu

SEQ ID NO: 1498465 - RNA, 19 nt, Homo sapiens
aagacgagggcgagaaauu

SEQ ID NO: 1498466 - RNA, 19 nt, Homo sapiens
cacagucgauuucguuucg

SEQ ID NO: 1498467 - RNA, 19 nt, Homo sapiens
gugagggaccggagccaaa

SEQ ID NO: 1498468 - RNA, 19 nt, Homo sapiens
aaguggcccugaugauguu

SEQ ID NO: 1498469 - RNA, 19 nt, Homo sapiens
uuaaguggcccugaugaug

SEQ ID NO: 1498470 - RNA, 19 nt, Homo sapiens
ggucagguccccucguuaa

SEQ ID NO: 1498471 - RNA, 19 nt, Homo sapiens
agagacagcggcaggacaa

SEQ ID NO: 1498472 - RNA, 19 nt, Homo sapiens
gugcagcgagcccaaggaa

SEQ ID NO: 1498473 - RNA, 19 nt, Homo sapiens
ccggguuuccuuucuguuu

SEQ ID NO: 1498474 - RNA, 19 nt, Homo sapiens
uucagcacauguuaucuau

SEQ ID NO: 1498475 - RNA, 19 nt, Homo sapiens
cggguuuccuuucuguuuc

SEQ ID NO: 1498476 - RNA, 19 nt, Homo sapiens
ccagccgaaugagaucaaa

SEQ ID NO: 1498477 - RNA, 19 nt, Homo sapiens
cgccauagcacagucgauu

SEQ ID NO: 1498478 - RNA, 19 nt, Homo sapiens
ucgagaagggccugaccua

SEQ ID NO: 1498479 - RNA, 19 nt, Homo sapiens
ccacucaggugaaaaucug

SEQ ID NO: 1498480 - RNA, 19 nt, Homo sapiens
gaagacgagggcgagaaau

SEQ ID NO: 1498481 - RNA, 19 nt, Homo sapiens
gaggaaaaccagccgaaug

SEQ ID NO: 1498482 - RNA, 19 nt, Homo sapiens
gaggagagcucauuguuug

SEQ ID NO: 1498483 - RNA, 19 nt, Homo sapiens
uagaauaggugccugcuua

SEQ ID NO: 1498484 - RNA, 19 nt, Homo sapiens
aagaauagcuagucuguuu

SEQ ID NO: 1498485 - RNA, 19 nt, Homo sapiens
guaccaaaguuccaaauga

SEQ ID NO: 1498486 - RNA, 19 nt, Homo sapiens
caaaugaauuggccuuauu

SEQ ID NO: 1498487 - RNA, 19 nt, Homo sapiens
gaaguugaagcuuagaaua

SEQ ID NO: 1498488 - RNA, 19 nt, Homo sapiens
gacaauggauguggucuuu

SEQ ID NO: 1498489 - RNA, 19 nt, Homo sapiens
ucagugggcucuuuauuug

SEQ ID NO: 1498490 - RNA, 19 nt, Homo sapiens
auagauaccuccauuauuc

SEQ ID NO: 1498491 - RNA, 19 nt, Homo sapiens
ccaugaugcuuauauacua

SEQ ID NO: 1498492 - RNA, 19 nt, Homo sapiens
uguuaucccuugcuuaaua

SEQ ID NO: 1498493 - RNA, 19 nt, Homo sapiens
caaaagcacuucaaauaga

SEQ ID NO: 1498494 - RNA, 19 nt, Homo sapiens
ggacaggcuauuucucaua

SEQ ID NO: 1498495 - RNA, 19 nt, Homo sapiens
caucauccucucuguauua

SEQ ID NO: 1498496 - RNA, 19 nt, Homo sapiens
gaaaaucuguggacuacuu

SEQ ID NO: 1498497 - RNA, 19 nt, Homo sapiens
ccuaauagauaccuccauu

SEQ ID NO: 1498498 - RNA, 19 nt, Homo sapiens
ucauugggcucuuugguuu

SEQ ID NO: 1498499 - RNA, 19 nt, Homo sapiens
caucauugcugaaauacau

SEQ ID NO: 1498500 - RNA, 19 nt, Homo sapiens
gacaggcuauuucucauau

SEQ ID NO: 1498501 - RNA, 19 nt, Homo sapiens
aggaugaaguugaagcuua

SEQ ID NO: 1498502 - RNA, 19 nt, Homo sapiens
gagaguggagucugccuua

SEQ ID NO: 1498503 - RNA, 19 nt, Homo sapiens
cagcuagcauacuauaauu

SEQ ID NO: 1498504 - RNA, 19 nt, Homo sapiens
gcacacaucuggaaaaucu

SEQ ID NO: 1498505 - RNA, 19 nt, Homo sapiens
gcagcuagcauacuauaau

SEQ ID NO: 1498506 - RNA, 19 nt, Homo sapiens
ggaugaaguugaagcuuag

SEQ ID NO: 1498507 - RNA, 19 nt, Homo sapiens
cuacuaccaugaucuuuau

SEQ ID NO: 1498508 - RNA, 19 nt, Homo sapiens
gcuagucuguuugguguaa

SEQ ID NO: 1498509 - RNA, 19 nt, Homo sapiens
uaccaaaguuccaaaugaa

SEQ ID NO: 1498510 - RNA, 19 nt, Homo sapiens
ggacuuggcuuguuuuaca

SEQ ID NO: 1498511 - RNA, 19 nt, Homo sapiens
ggauaugucucaaggaaaa

SEQ ID NO: 1498512 - RNA, 19 nt, Homo sapiens
guacuuggccucguugaaa

SEQ ID NO: 1498513 - RNA, 19 nt, Homo sapiens
uagaagacuuuggaguaua

SEQ ID NO: 1498514 - RNA, 19 nt, Homo sapiens
aauagaagacuuuggagua

SEQ ID NO: 1498515 - RNA, 19 nt, Homo sapiens
ucagaucucuaaaucacaa

SEQ ID NO: 1498516 - RNA, 19 nt, Homo sapiens
ggucuuugcuuuuaucuuu

SEQ ID NO: 1498517 - RNA, 19 nt, Homo sapiens
gcaagacguccaugcugua

SEQ ID NO: 1498518 - RNA, 19 nt, Homo sapiens
agaagacuuuggaguauau

SEQ ID NO: 1498519 - RNA, 19 nt, Homo sapiens
gagaggagagcucauuguu

SEQ ID NO: 1498520 - RNA, 19 nt, Homo sapiens
uaaauugccuaaaguacca

SEQ ID NO: 1498521 - RNA, 19 nt, Homo sapiens
ugaaauagaagacuuugga

SEQ ID NO: 1498522 - RNA, 19 nt, Homo sapiens
ggacuacuuucugagcauu

SEQ ID NO: 1498523 - RNA, 19 nt, Homo sapiens
ccacaguuaucacguuuag

SEQ ID NO: 1498524 - RNA, 19 nt, Homo sapiens
cauaugauucacccuaaua

SEQ ID NO: 1498525 - RNA, 19 nt, Homo sapiens
auagugugaugccaaauaa

SEQ ID NO: 1498526 - RNA, 19 nt, Homo sapiens
caaauuuggcuaguaguuu

SEQ ID NO: 1498527 - RNA, 19 nt, Homo sapiens
aauuggaagugccguauuu

SEQ ID NO: 1498528 - RNA, 19 nt, Homo sapiens
ugauucacccuaauagaua

SEQ ID NO: 1498529 - RNA, 19 nt, Homo sapiens
caaguacaccaucaccuaa

SEQ ID NO: 1498530 - RNA, 19 nt, Homo sapiens
gauguggucuuugcuuuua

SEQ ID NO: 1498531 - RNA, 19 nt, Homo sapiens
gagcauuugguauuaugua

SEQ ID NO: 1498532 - RNA, 19 nt, Homo sapiens
guuguuaucccuugcuuaa

SEQ ID NO: 1498533 - RNA, 19 nt, Homo sapiens
cuaauucacauacagcaua

SEQ ID NO: 1498534 - RNA, 19 nt, Homo sapiens
cacaaaagcacuucaaaua

SEQ ID NO: 1498535 - RNA, 19 nt, Homo sapiens
guuuagcaguccaguguuu

SEQ ID NO: 1498536 - RNA, 19 nt, Homo sapiens
uuucauaguuuccugcauu

SEQ ID NO: 1498537 - RNA, 19 nt, Homo sapiens
ucaaguacaccaucaccua

SEQ ID NO: 1498538 - RNA, 19 nt, Homo sapiens
guaaaugguaccaaaguuc

SEQ ID NO: 1498539 - RNA, 19 nt, Homo sapiens
gcaauaaugaagacaaugg

SEQ ID NO: 1498540 - RNA, 19 nt, Homo sapiens
guguuuacguccauauuug

SEQ ID NO: 1498541 - RNA, 19 nt, Homo sapiens
uuaggaggaugaaguugaa

SEQ ID NO: 1498542 - RNA, 19 nt, Homo sapiens
cguaaaugguaccaaaguu

SEQ ID NO: 1498543 - RNA, 19 nt, Homo sapiens
guaguagccaguaauguug

SEQ ID NO: 1498544 - RNA, 19 nt, Homo sapiens
cucaggaucuuauuagguu

SEQ ID NO: 1498545 - RNA, 19 nt, Homo sapiens
gaauuggccuuauuuucaa

SEQ ID NO: 1498546 - RNA, 19 nt, Homo sapiens
gcaaccuuauucuauuuag

SEQ ID NO: 1498547 - RNA, 19 nt, Homo sapiens
ccgccaugaugcuuauaua

SEQ ID NO: 1498548 - RNA, 19 nt, Homo sapiens
uauagugugaugccaaaua

SEQ ID NO: 1498549 - RNA, 19 nt, Homo sapiens
ggagagcucauuguuugaa

SEQ ID NO: 1498550 - RNA, 19 nt, Homo sapiens
cauguuugauugacuuuca

SEQ ID NO: 1498551 - RNA, 19 nt, Homo sapiens
acaaaugaauuggccuuau

SEQ ID NO: 1498552 - RNA, 19 nt, Homo sapiens
cguccaugcuguagagauu

SEQ ID NO: 1498553 - RNA, 19 nt, Homo sapiens
cauauucauugggcucuuu

SEQ ID NO: 1498554 - RNA, 19 nt, Homo sapiens
auagaagacuuuggaguau

SEQ ID NO: 1498555 - RNA, 19 nt, Homo sapiens
cguaguagccaguaauguu

SEQ ID NO: 1498556 - RNA, 19 nt, Homo sapiens
caggcuauuucucauauuc

SEQ ID NO: 1498557 - RNA, 19 nt, Homo sapiens
guuaucccuugcuuaauau

SEQ ID NO: 1498558 - RNA, 19 nt, Homo sapiens
guugaaccauauguaauug

SEQ ID NO: 1498559 - RNA, 19 nt, Homo sapiens
ucuacuaccaugaucuuua

SEQ ID NO: 1498560 - RNA, 19 nt, Homo sapiens
guaaagacuugugaaucca

SEQ ID NO: 1498561 - RNA, 19 nt, Homo sapiens
cauauguaauugccaagau

SEQ ID NO: 1498562 - RNA, 19 nt, Homo sapiens
caauggauguggucuuugc

SEQ ID NO: 1498563 - RNA, 19 nt, Homo sapiens
gcagggccaguagcaauaa

SEQ ID NO: 1498564 - RNA, 19 nt, Homo sapiens
gggaacauucgcagcaauu

SEQ ID NO: 1498565 - RNA, 19 nt, Homo sapiens
gagcucauuguuugaagaa

SEQ ID NO: 1498566 - RNA, 19 nt, Homo sapiens
uggauguggucuuugcuuu

SEQ ID NO: 1498567 - RNA, 19 nt, Homo sapiens
gauggaagaaagcuauuca

SEQ ID NO: 1498568 - RNA, 19 nt, Homo sapiens
auacuaugcuuaccagaca

SEQ ID NO: 1498569 - RNA, 19 nt, Homo sapiens
uguaaagacuugugaaucc

SEQ ID NO: 1498570 - RNA, 19 nt, Homo sapiens
gacuuuggaguauauguuu

SEQ ID NO: 1498571 - RNA, 19 nt, Homo sapiens
gagauuagugcguuucgau

SEQ ID NO: 1498572 - RNA, 19 nt, Homo sapiens
uuggauaugucucaaggaa

SEQ ID NO: 1498573 - RNA, 19 nt, Homo sapiens
gauugacuuucauaguuuc

SEQ ID NO: 1498574 - RNA, 19 nt, Homo sapiens
gacucuaguuauccuaaga

SEQ ID NO: 1498575 - RNA, 19 nt, Homo sapiens
gaacauucgcagcaauugg

SEQ ID NO: 1498576 - RNA, 19 nt, Homo sapiens
aaacuaugccuuccagaca

SEQ ID NO: 1498577 - RNA, 19 nt, Homo sapiens
gcucauuguuugaagaaaa

SEQ ID NO: 1498578 - RNA, 19 nt, Homo sapiens
gaauagcuagucuguuugg

SEQ ID NO: 1498579 - RNA, 19 nt, Homo sapiens
ggagcggccauucguaaau

SEQ ID NO: 1498580 - RNA, 19 nt, Homo sapiens
uaaugaagacaauggaugu

SEQ ID NO: 1498581 - RNA, 19 nt, Homo sapiens
ucuguggacuacuuucuga

SEQ ID NO: 1498582 - RNA, 19 nt, Homo sapiens
gaagugagcugcagucucu

SEQ ID NO: 1498583 - RNA, 19 nt, Homo sapiens
gugcagauguugcucaaua

SEQ ID NO: 1498584 - RNA, 19 nt, Homo sapiens
aaaggaaguuucuggaaua

SEQ ID NO: 1498585 - RNA, 19 nt, Homo sapiens
aaagagaacucaccugugu

SEQ ID NO: 1498586 - RNA, 19 nt, Homo sapiens
gaaacuggaucuccugaag

SEQ ID NO: 1498587 - RNA, 19 nt, Homo sapiens
ggaaugcaguuguccugaa

SEQ ID NO: 1498588 - RNA, 19 nt, Homo sapiens
gcaguacccuguauuaggu

SEQ ID NO: 1498589 - RNA, 19 nt, Homo sapiens
gaagugagcgaggcuguaa

SEQ ID NO: 1498590 - RNA, 19 nt, Homo sapiens
aaacggcgcugaggacuga

SEQ ID NO: 1498591 - RNA, 19 nt, Homo sapiens
ugagagugaucuucaaguu

SEQ ID NO: 1498592 - RNA, 19 nt, Homo sapiens
ggaaguuucuggaauacca

SEQ ID NO: 1498593 - RNA, 19 nt, Homo sapiens
gcaccaagcgauccacauu

SEQ ID NO: 1498594 - RNA, 19 nt, Homo sapiens
ggaucaggauggcuacuug

SEQ ID NO: 1498595 - RNA, 19 nt, Homo sapiens
guuggcagcuggacaguug

SEQ ID NO: 1498596 - RNA, 19 nt, Homo sapiens
caggugcuguaacaaauaa

SEQ ID NO: 1498597 - RNA, 19 nt, Homo sapiens
gaggaagucaggaaacaaa

SEQ ID NO: 1498598 - RNA, 19 nt, Homo sapiens
agagugaucuucaaguuca

SEQ ID NO: 1498599 - RNA, 19 nt, Homo sapiens
ucacuuacccucagcuuga

SEQ ID NO: 1498600 - RNA, 19 nt, Homo sapiens
acaaauaaaucccauaucc

SEQ ID NO: 1498601 - RNA, 19 nt, Homo sapiens
gaaugcaguuguccugaag

SEQ ID NO: 1498602 - RNA, 19 nt, Homo sapiens
gcugaggacugacgaugug

SEQ ID NO: 1498603 - RNA, 19 nt, Homo sapiens
ccacaaagccagugacucu

SEQ ID NO: 1498604 - RNA, 19 nt, Homo sapiens
gggacaugcuggaaaggaa

SEQ ID NO: 1498605 - RNA, 19 nt, Homo sapiens
gcucaggcauuuguauuca

SEQ ID NO: 1498606 - RNA, 19 nt, Homo sapiens
gaagcaagccaagaucaug

SEQ ID NO: 1498607 - RNA, 19 nt, Homo sapiens
agauguugcucaauauuug

SEQ ID NO: 1498608 - RNA, 19 nt, Homo sapiens
caaguccuccuuugagauu

SEQ ID NO: 1498609 - RNA, 19 nt, Homo sapiens
uccaaaggcuggcugaaga

SEQ ID NO: 1498610 - RNA, 19 nt, Homo sapiens
cacauuugcucaggcauuu

SEQ ID NO: 1498611 - RNA, 19 nt, Homo sapiens
gauuucaaguccuccuuug

SEQ ID NO: 1498612 - RNA, 19 nt, Homo sapiens
aagccaagaucaugaggaa

SEQ ID NO: 1498613 - RNA, 19 nt, Homo sapiens
cuacgugccucaugagauc

SEQ ID NO: 1498614 - RNA, 19 nt, Homo sapiens
gcuucaaguuccaucauga

SEQ ID NO: 1498615 - RNA, 19 nt, Homo sapiens
gcccagaaccucagcauca

SEQ ID NO: 1498616 - RNA, 19 nt, Homo sapiens
gcagauguugcucaauauu

SEQ ID NO: 1498617 - RNA, 19 nt, Homo sapiens
gaagucaggaaacaaagug

SEQ ID NO: 1498618 - RNA, 19 nt, Homo sapiens
gccuuuaccucuucuuugu

SEQ ID NO: 1498619 - RNA, 19 nt, Homo sapiens
uacagcaucugaucaagga

SEQ ID NO: 1498620 - RNA, 19 nt, Homo sapiens
aaucccauauccucaguaa

SEQ ID NO: 1498621 - RNA, 19 nt, Homo sapiens
cgaaagguacagcaucuga

SEQ ID NO: 1498622 - RNA, 19 nt, Homo sapiens
cagauguugcucaauauuu

SEQ ID NO: 1498623 - RNA, 19 nt, Homo sapiens
gcccaugccuucugauguc

SEQ ID NO: 1498624 - RNA, 19 nt, Homo sapiens
ggaggcagaagaucuuuca

SEQ ID NO: 1498625 - RNA, 19 nt, Homo sapiens
agaagagccuguugagucu

SEQ ID NO: 1498626 - RNA, 19 nt, Homo sapiens
cagcccaucucgcaguuug

SEQ ID NO: 1498627 - RNA, 19 nt, Homo sapiens
ggaaugcucgaaacuucuu

SEQ ID NO: 1498628 - RNA, 19 nt, Homo sapiens
gggcaggguugcugagucu

SEQ ID NO: 1498629 - RNA, 19 nt, Homo sapiens
gucaggugcuguaacaaau

SEQ ID NO: 1498630 - RNA, 19 nt, Homo sapiens
ucaagaucuuccuggauga

SEQ ID NO: 1498631 - RNA, 19 nt, Homo sapiens
ucaggcauuuguauucaug

SEQ ID NO: 1498632 - RNA, 19 nt, Homo sapiens
accaagcgauccacauuug

SEQ ID NO: 1498633 - RNA, 19 nt, Homo sapiens
ccacagcucucugggacau

SEQ ID NO: 1498634 - RNA, 19 nt, Homo sapiens
gcuauccucugcugcucaa

SEQ ID NO: 1498635 - RNA, 19 nt, Homo sapiens
cucaugagauccugcgaaa

SEQ ID NO: 1498636 - RNA, 19 nt, Homo sapiens
caaaggcugaagacagaaa

SEQ ID NO: 1498637 - RNA, 19 nt, Homo sapiens
ggugaggaaugcaguuguc

SEQ ID NO: 1498638 - RNA, 19 nt, Homo sapiens
gaaaggcucggugaggaau

SEQ ID NO: 1498639 - RNA, 19 nt, Homo sapiens
gcugaggauuguagucaca

SEQ ID NO: 1498640 - RNA, 19 nt, Homo sapiens
gaaagguacagcaucugau

SEQ ID NO: 1498641 - RNA, 19 nt, Homo sapiens
gagcugaagguguuugaca

SEQ ID NO: 1498642 - RNA, 19 nt, Homo sapiens
gagagugaucuucaaguuc

SEQ ID NO: 1498643 - RNA, 19 nt, Homo sapiens
caugagauccugcgaaagg

SEQ ID NO: 1498644 - RNA, 19 nt, Homo sapiens
cuggaaugcucgaaacuuc

SEQ ID NO: 1498645 - RNA, 19 nt, Homo sapiens
ucaggugcuguaacaaaua

SEQ ID NO: 1498646 - RNA, 19 nt, Homo sapiens
cgucaggugcuguaacaaa

SEQ ID NO: 1498647 - RNA, 19 nt, Homo sapiens
gccaagaucaugaggaagu

SEQ ID NO: 1498648 - RNA, 19 nt, Homo sapiens
ggaagcaagccaagaucau

SEQ ID NO: 1498649 - RNA, 19 nt, Homo sapiens
uaaaucccauauccucagu

SEQ ID NO: 1498650 - RNA, 19 nt, Homo sapiens
ccacauuugcucaggcauu

SEQ ID NO: 1498651 - RNA, 19 nt, Homo sapiens
ggaagucaggaaacaaagu

SEQ ID NO: 1498652 - RNA, 19 nt, Homo sapiens
ugaagacccagguuccaaa

SEQ ID NO: 1498653 - RNA, 19 nt, Homo sapiens
gcauggugcccuucaucaa

SEQ ID NO: 1498654 - RNA, 19 nt, Homo sapiens
gggugacuguuaagaaucu

SEQ ID NO: 1498655 - RNA, 19 nt, Homo sapiens
caucuggggugacuguuaa

SEQ ID NO: 1498656 - RNA, 19 nt, Homo sapiens
gaucuugggauucgugaag

SEQ ID NO: 1498657 - RNA, 19 nt, Homo sapiens
gaggaguacaugagcauca

SEQ ID NO: 1498658 - RNA, 19 nt, Homo sapiens
uagaggcccugguguucga

SEQ ID NO: 1498659 - RNA, 19 nt, Homo sapiens
aggcauuuguauucaugua

SEQ ID NO: 1498660 - RNA, 19 nt, Homo sapiens
uaccagcaguugacucaca

SEQ ID NO: 1498661 - RNA, 19 nt, Homo sapiens
caccaagcgauccacauuu

SEQ ID NO: 1498662 - RNA, 19 nt, Homo sapiens
uaagccugaucuugggauu

SEQ ID NO: 1498663 - RNA, 19 nt, Homo sapiens
gcugaagacagaaaugaag

SEQ ID NO: 1498664 - RNA, 19 nt, Homo sapiens
uacagugccuuuaccucuu

SEQ ID NO: 1498665 - RNA, 19 nt, Homo sapiens
ccauugagcgucagaagag

SEQ ID NO: 1498666 - RNA, 19 nt, Homo sapiens
gcccaucucgcaguuugua

SEQ ID NO: 1498667 - RNA, 19 nt, Homo sapiens
gcauggaggcagaagaucu

SEQ ID NO: 1498668 - RNA, 19 nt, Homo sapiens
aggcagaagaucuuucaaa

SEQ ID NO: 1498669 - RNA, 19 nt, Homo sapiens
cuaaaggccugggaacacu

SEQ ID NO: 1498670 - RNA, 19 nt, Homo sapiens
ugaaaggcucggugaggaa

SEQ ID NO: 1498671 - RNA, 19 nt, Homo sapiens
uguagucacacuucugaaa

SEQ ID NO: 1498672 - RNA, 19 nt, Homo sapiens
ccucuucaccgacaucuuc

SEQ ID NO: 1498673 - RNA, 19 nt, Homo sapiens
ggcauuuguauucauguaa

SEQ ID NO: 1498674 - RNA, 19 nt, Homo sapiens
cgucagaagagccuguuga

SEQ ID NO: 1498675 - RNA, 19 nt, Homo sapiens
guagucacacuucugaaag

SEQ ID NO: 1498676 - RNA, 19 nt, Homo sapiens
uguuugacagcaucacuua

SEQ ID NO: 1498677 - RNA, 19 nt, Homo sapiens
acagugccuuuaccucuuc

SEQ ID NO: 1498678 - RNA, 19 nt, Homo sapiens
ggcaguacccuguauuagg

SEQ ID NO: 1498679 - RNA, 19 nt, Homo sapiens
caucaacgccgaggaguac

SEQ ID NO: 1498680 - RNA, 19 nt, Homo sapiens
ggauuguagucacacuucu

SEQ ID NO: 1498681 - RNA, 19 nt, Homo sapiens
aagcaagccaagaucauga

SEQ ID NO: 1498682 - RNA, 19 nt, Homo sapiens
gaacugugcugaugugaaa

SEQ ID NO: 1498683 - RNA, 19 nt, Homo sapiens
uaacgaaacuuguagaaug

SEQ ID NO: 1498684 - RNA, 19 nt, Homo sapiens
ugaaauaguugcugugaaa

SEQ ID NO: 1498685 - RNA, 19 nt, Homo sapiens
gaaaugaugcagucaauga

SEQ ID NO: 1498686 - RNA, 19 nt, Homo sapiens
ggaaaggguaguuuaauuu

SEQ ID NO: 1498687 - RNA, 19 nt, Homo sapiens
uggaaagagugaugaauua

SEQ ID NO: 1498688 - RNA, 19 nt, Homo sapiens
gaaaggaaacugcaucaga

SEQ ID NO: 1498689 - RNA, 19 nt, Homo sapiens
aaaggaaacugcaucagaa

SEQ ID NO: 1498690 - RNA, 19 nt, Homo sapiens
gggaacagcuucaggauac

SEQ ID NO: 1498691 - RNA, 19 nt, Homo sapiens
gauagaaauuguucagugu

SEQ ID NO: 1498692 - RNA, 19 nt, Homo sapiens
gagaaaugaugcagucaau

SEQ ID NO: 1498693 - RNA, 19 nt, Homo sapiens
ucagaaacaugaacagaga

SEQ ID NO: 1498694 - RNA, 19 nt, Homo sapiens
gaagaccuuuagaaguuaa

SEQ ID NO: 1498695 - RNA, 19 nt, Homo sapiens
gcaaugaagaccuuuagaa

SEQ ID NO: 1498696 - RNA, 19 nt, Homo sapiens
gaaaagugcuccagaggaa

SEQ ID NO: 1498697 - RNA, 19 nt, Homo sapiens
gaagaggauugcaaacaca

SEQ ID NO: 1498698 - RNA, 19 nt, Homo sapiens
guuaaugguucuucuguga

SEQ ID NO: 1498699 - RNA, 19 nt, Homo sapiens
cuaaagaacugugcugaug

SEQ ID NO: 1498700 - RNA, 19 nt, Homo sapiens
gaacagagaaagauugucu

SEQ ID NO: 1498701 - RNA, 19 nt, Homo sapiens
ggaggaaaggguaguuuaa

SEQ ID NO: 1498702 - RNA, 19 nt, Homo sapiens
gccaugaccugugcaauga

SEQ ID NO: 1498703 - RNA, 19 nt, Homo sapiens
ggcauuaucuggaucacuu

SEQ ID NO: 1498704 - RNA, 19 nt, Homo sapiens
aaagaaagcacauaacugu

SEQ ID NO: 1498705 - RNA, 19 nt, Homo sapiens
ugaagaccuuuagaaguua

SEQ ID NO: 1498706 - RNA, 19 nt, Homo sapiens
ggagaagucuaugggauuc

SEQ ID NO: 1498707 - RNA, 19 nt, Homo sapiens
augaagaccuuuagaaguu

SEQ ID NO: 1498708 - RNA, 19 nt, Homo sapiens
agaggaagcugagaaaugu

SEQ ID NO: 1498709 - RNA, 19 nt, Homo sapiens
ccacuugugugaagagaug

SEQ ID NO: 1498710 - RNA, 19 nt, Homo sapiens
uaagguggagugucuauuu

SEQ ID NO: 1498711 - RNA, 19 nt, Homo sapiens
aggaaaggguaguuuaauu

SEQ ID NO: 1498712 - RNA, 19 nt, Homo sapiens
gaagauugggacauagaaa

SEQ ID NO: 1498713 - RNA, 19 nt, Homo sapiens
gcacagcaacaacagaaga

SEQ ID NO: 1498714 - RNA, 19 nt, Homo sapiens
cuaugggauucuagaaaua

SEQ ID NO: 1498715 - RNA, 19 nt, Homo sapiens
gaaacugcaucagaaacau

SEQ ID NO: 1498716 - RNA, 19 nt, Homo sapiens
ggaaacugcaucagaaaca

SEQ ID NO: 1498717 - RNA, 19 nt, Homo sapiens
aggagaagauugggacaua

SEQ ID NO: 1498718 - RNA, 19 nt, Homo sapiens
ggaaagagugaugaauuau

SEQ ID NO: 1498719 - RNA, 19 nt, Homo sapiens
gaaugaagccuggaaagag

SEQ ID NO: 1498720 - RNA, 19 nt, Homo sapiens
gaaauuguucaguguagga

SEQ ID NO: 1498721 - RNA, 19 nt, Homo sapiens
aacgaaacuuguagaauga

SEQ ID NO: 1498722 - RNA, 19 nt, Homo sapiens
ggcauaagguggagugucu

SEQ ID NO: 1498723 - RNA, 19 nt, Homo sapiens
aaagaacugugcugaugug

SEQ ID NO: 1498724 - RNA, 19 nt, Homo sapiens
ucuagaaucagaucuguuu

SEQ ID NO: 1498725 - RNA, 19 nt, Homo sapiens
aaacaugaacagagaaaga

SEQ ID NO: 1498726 - RNA, 19 nt, Homo sapiens
gagaagauugggacauaga

SEQ ID NO: 1498727 - RNA, 19 nt, Homo sapiens
gguaaucccugguuaaccu

SEQ ID NO: 1498728 - RNA, 19 nt, Homo sapiens
ggagaagauugggacauag

SEQ ID NO: 1498729 - RNA, 19 nt, Homo sapiens
gaugguaaucccugguuaa

SEQ ID NO: 1498730 - RNA, 19 nt, Homo sapiens
gugaagagaugccccauga

SEQ ID NO: 1498731 - RNA, 19 nt, Homo sapiens
aagauugucugccuucuag

SEQ ID NO: 1498732 - RNA, 19 nt, Homo sapiens
ggaguuuguucaugaaugc

SEQ ID NO: 1498733 - RNA, 19 nt, Homo sapiens
caaagaaagcacauaacug

SEQ ID NO: 1498734 - RNA, 19 nt, Homo sapiens
gcauagaggaagcugagaa

SEQ ID NO: 1498735 - RNA, 19 nt, Homo sapiens
aaggagacaucaaccucua

SEQ ID NO: 1498736 - RNA, 19 nt, Homo sapiens
ggacauagaaaggaaacug

SEQ ID NO: 1498737 - RNA, 19 nt, Homo sapiens
caaugaagaccuuuagaag

SEQ ID NO: 1498738 - RNA, 19 nt, Homo sapiens
agaggaauaugcacagcaa

SEQ ID NO: 1498739 - RNA, 19 nt, Homo sapiens
ggaucacuuucaaugagaa

SEQ ID NO: 1498740 - RNA, 19 nt, Homo sapiens
agaagaggccugcaugguu

SEQ ID NO: 1498741 - RNA, 19 nt, Homo sapiens
uagaaauuguucaguguag

SEQ ID NO: 1498742 - RNA, 19 nt, Homo sapiens
ccaaagaaagcacauaacu

SEQ ID NO: 1498743 - RNA, 19 nt, Homo sapiens
gaggaaaggguaguuuaau

SEQ ID NO: 1498744 - RNA, 19 nt, Homo sapiens
ggaauaugcacagcaacaa

SEQ ID NO: 1498745 - RNA, 19 nt, Homo sapiens
uagaggaagcugagaaaug

SEQ ID NO: 1498746 - RNA, 19 nt, Homo sapiens
gaacaagaucaauauaucc

SEQ ID NO: 1498747 - RNA, 19 nt, Homo sapiens
gaggcugauuucuaacgaa

SEQ ID NO: 1498748 - RNA, 19 nt, Homo sapiens
ggagacaucaaccucuaga

SEQ ID NO: 1498749 - RNA, 19 nt, Homo sapiens
gagagaaagaacaagauca

SEQ ID NO: 1498750 - RNA, 19 nt, Homo sapiens
aaugaagccuggaaagagu

SEQ ID NO: 1498751 - RNA, 19 nt, Homo sapiens
ggucugaggaagccauuug

SEQ ID NO: 1498752 - RNA, 19 nt, Homo sapiens
cauagaggaagcugagaaa

SEQ ID NO: 1498753 - RNA, 19 nt, Homo sapiens
gaacagcuucaggauacuu

SEQ ID NO: 1498754 - RNA, 19 nt, Homo sapiens
cagcuucccugccaaacuc

SEQ ID NO: 1498755 - RNA, 19 nt, Homo sapiens
gaaagauugucugccuucu

SEQ ID NO: 1498756 - RNA, 19 nt, Homo sapiens
ucuuggaguuuguucauga

SEQ ID NO: 1498757 - RNA, 19 nt, Homo sapiens
uucaugggcugccuaaaga

SEQ ID NO: 1498758 - RNA, 19 nt, Homo sapiens
uauagccaguucauucaga

SEQ ID NO: 1498759 - RNA, 19 nt, Homo sapiens
agagaaagaacaagaucaa

SEQ ID NO: 1498760 - RNA, 19 nt, Homo sapiens
acacacacacuacagaaga

SEQ ID NO: 1498761 - RNA, 19 nt, Homo sapiens
ugcagucaaugaaauaguu

SEQ ID NO: 1498762 - RNA, 19 nt, Homo sapiens
guucuucugugacuccaau

SEQ ID NO: 1498763 - RNA, 19 nt, Homo sapiens
gauugucugccuucuagaa

SEQ ID NO: 1498764 - RNA, 19 nt, Homo sapiens
aagguggagugucuauuug

SEQ ID NO: 1498765 - RNA, 19 nt, Homo sapiens
uaaagaacugugcugaugu

SEQ ID NO: 1498766 - RNA, 19 nt, Homo sapiens
ugaugcagucaaugaaaua

SEQ ID NO: 1498767 - RNA, 19 nt, Homo sapiens
caacagaagaggccugcau

SEQ ID NO: 1498768 - RNA, 19 nt, Homo sapiens
guagaaugaagccuggaaa

SEQ ID NO: 1498769 - RNA, 19 nt, Homo sapiens
cuucuuaucccacuccaaa

SEQ ID NO: 1498770 - RNA, 19 nt, Homo sapiens
auccugcucugcugcuuua

SEQ ID NO: 1498771 - RNA, 19 nt, Homo sapiens
gaggaagccauuugagucu

SEQ ID NO: 1498772 - RNA, 19 nt, Homo sapiens
cagaagaggauugcaaaca

SEQ ID NO: 1498773 - RNA, 19 nt, Homo sapiens
cuacagaagaggauugcaa

SEQ ID NO: 1498774 - RNA, 19 nt, Homo sapiens
cucagccucuucacaauga

SEQ ID NO: 1498775 - RNA, 19 nt, Homo sapiens
cuggaaagagugaugaauu

SEQ ID NO: 1498776 - RNA, 19 nt, Homo sapiens
caugaacagagaaagauug

SEQ ID NO: 1498777 - RNA, 19 nt, Homo sapiens
gagaaagaacaagaucaau

SEQ ID NO: 1498778 - RNA, 19 nt, Homo sapiens
agaagaggauugcaaacac

SEQ ID NO: 1498779 - RNA, 19 nt, Homo sapiens
agaaugaagccuggaaaga

SEQ ID NO: 1498780 - RNA, 19 nt, Homo sapiens
ggaugugccaccuccaguu

SEQ ID NO: 1498781 - RNA, 19 nt, Homo sapiens
gcagucaaugaaauaguug

SEQ ID NO: 1498782 - RNA, 19 nt, Homo sapiens
gugcugaacuggacaaaua

SEQ ID NO: 1498783 - RNA, 19 nt, Homo sapiens
gaaagaggaaucagaauuu

SEQ ID NO: 1498784 - RNA, 19 nt, Homo sapiens
gaacuuugaugaguacauu

SEQ ID NO: 1498785 - RNA, 19 nt, Homo sapiens
uaacagcccuagaaauuau

SEQ ID NO: 1498786 - RNA, 19 nt, Homo sapiens
gcuaacagcccuagaaauu

SEQ ID NO: 1498787 - RNA, 19 nt, Homo sapiens
gaagaucucugugcuaaca

SEQ ID NO: 1498788 - RNA, 19 nt, Homo sapiens
cagauuagguggaguuaaa

SEQ ID NO: 1498789 - RNA, 19 nt, Homo sapiens
ggaaggaaauugcuacaag

SEQ ID NO: 1498790 - RNA, 19 nt, Homo sapiens
ggaaagaggaaucagaauu

SEQ ID NO: 1498791 - RNA, 19 nt, Homo sapiens
gaagagaaggcaagauuug

SEQ ID NO: 1498792 - RNA, 19 nt, Homo sapiens
ucacagaccuauugaagau

SEQ ID NO: 1498793 - RNA, 19 nt, Homo sapiens
ggacaaauacacugaacuu

SEQ ID NO: 1498794 - RNA, 19 nt, Homo sapiens
gcaaagcauacaucucaua

SEQ ID NO: 1498795 - RNA, 19 nt, Homo sapiens
gaauaccagaugauacuua

SEQ ID NO: 1498796 - RNA, 19 nt, Homo sapiens
gaggagacauaucaaagau

SEQ ID NO: 1498797 - RNA, 19 nt, Homo sapiens
ucaugaaacucuaggacua

SEQ ID NO: 1498798 - RNA, 19 nt, Homo sapiens
caggaagucuggaggcuaa

SEQ ID NO: 1498799 - RNA, 19 nt, Homo sapiens
gccaguuucugauacauuu

SEQ ID NO: 1498800 - RNA, 19 nt, Homo sapiens
cagaugauacuuacuauga

SEQ ID NO: 1498801 - RNA, 19 nt, Homo sapiens
caaauguacuacucaggaa

SEQ ID NO: 1498802 - RNA, 19 nt, Homo sapiens
cauaguggcugguaucauc

SEQ ID NO: 1498803 - RNA, 19 nt, Homo sapiens
caaagcauacaucucauaa

SEQ ID NO: 1498804 - RNA, 19 nt, Homo sapiens
cagcaaagcauacaucuca

SEQ ID NO: 1498805 - RNA, 19 nt, Homo sapiens
ggaggagacauaucaaaga

SEQ ID NO: 1498806 - RNA, 19 nt, Homo sapiens
ucaaaggauucagguuuaa

SEQ ID NO: 1498807 - RNA, 19 nt, Homo sapiens
gauuagagcuuuugaagau

SEQ ID NO: 1498808 - RNA, 19 nt, Homo sapiens
cacgucagauagugaaaua

SEQ ID NO: 1498809 - RNA, 19 nt, Homo sapiens
gaaacucuaggacuaauuc

SEQ ID NO: 1498810 - RNA, 19 nt, Homo sapiens
cgucagauagugaaauaua

SEQ ID NO: 1498811 - RNA, 19 nt, Homo sapiens
uucaaaggauucagguuua

SEQ ID NO: 1498812 - RNA, 19 nt, Homo sapiens
gauagauucugugauggaa

SEQ ID NO: 1498813 - RNA, 19 nt, Homo sapiens
gaauuuacaaagcaggaua

SEQ ID NO: 1498814 - RNA, 19 nt, Homo sapiens
ggaaucagaauuuacaaag

SEQ ID NO: 1498815 - RNA, 19 nt, Homo sapiens
uaacgccugauucuacuua

SEQ ID NO: 1498816 - RNA, 19 nt, Homo sapiens
caacacaucaugaaacucu

SEQ ID NO: 1498817 - RNA, 19 nt, Homo sapiens
cuaacagcccuagaaauua

SEQ ID NO: 1498818 - RNA, 19 nt, Homo sapiens
uugaagaucucugugcuaa

SEQ ID NO: 1498819 - RNA, 19 nt, Homo sapiens
gaaccaaauguaacuagau

SEQ ID NO: 1498820 - RNA, 19 nt, Homo sapiens
caaaugggaauaccagaug

SEQ ID NO: 1498821 - RNA, 19 nt, Homo sapiens
ggaugaggcaaauguacua

SEQ ID NO: 1498822 - RNA, 19 nt, Homo sapiens
cagcagcgauuggaauuuc

SEQ ID NO: 1498823 - RNA, 19 nt, Homo sapiens
gaaccacgucagauaguga

SEQ ID NO: 1498824 - RNA, 19 nt, Homo sapiens
ucaaaugccuuggaaagag

SEQ ID NO: 1498825 - RNA, 19 nt, Homo sapiens
acacugaacuuugaugagu

SEQ ID NO: 1498826 - RNA, 19 nt, Homo sapiens
gaggcuaagucaacacauc

SEQ ID NO: 1498827 - RNA, 19 nt, Homo sapiens
caugugcgauucagauuag

SEQ ID NO: 1498828 - RNA, 19 nt, Homo sapiens
ggagaaccacgucagauag

SEQ ID NO: 1498829 - RNA, 19 nt, Homo sapiens
gauuaacgccugauucuac

SEQ ID NO: 1498830 - RNA, 19 nt, Homo sapiens
gagaaggcaagauuuggaa

SEQ ID NO: 1498831 - RNA, 19 nt, Homo sapiens
caaagaggcagagcuucua

SEQ ID NO: 1498832 - RNA, 19 nt, Homo sapiens
gugaauuccauuucucuaa

SEQ ID NO: 1498833 - RNA, 19 nt, Homo sapiens
uggcugguaucaucguaua

SEQ ID NO: 1498834 - RNA, 19 nt, Homo sapiens
gcaaaugggaauaccagau

SEQ ID NO: 1498835 - RNA, 19 nt, Homo sapiens
gaaucagaauuuacaaagc

SEQ ID NO: 1498836 - RNA, 19 nt, Homo sapiens
cggcuaacuucaaaggauu

SEQ ID NO: 1498837 - RNA, 19 nt, Homo sapiens
ggggauagauucugugaug

SEQ ID NO: 1498838 - RNA, 19 nt, Homo sapiens
cgcuauauuucaacacuuu

SEQ ID NO: 1498839 - RNA, 19 nt, Homo sapiens
uaagucaacacaucaugaa

SEQ ID NO: 1498840 - RNA, 19 nt, Homo sapiens
ugaagagaaggcaagauuu

SEQ ID NO: 1498841 - RNA, 19 nt, Homo sapiens
aaacuuccagcaaagcaua

SEQ ID NO: 1498842 - RNA, 19 nt, Homo sapiens
ggauagauucugugaugga

SEQ ID NO: 1498843 - RNA, 19 nt, Homo sapiens
ggacuaauucacacugcaa

SEQ ID NO: 1498844 - RNA, 19 nt, Homo sapiens
gaauuccauuucucuaaac

SEQ ID NO: 1498845 - RNA, 19 nt, Homo sapiens
ggaggccaguuucugauac

SEQ ID NO: 1498846 - RNA, 19 nt, Homo sapiens
cuucaaaggauucagguuu

SEQ ID NO: 1498847 - RNA, 19 nt, Homo sapiens
uaccagaugauacuuacua

SEQ ID NO: 1498848 - RNA, 19 nt, Homo sapiens
gacaaauacacugaacuuu

SEQ ID NO: 1498849 - RNA, 19 nt, Homo sapiens
ggaaugggaaguggaugaa

SEQ ID NO: 1498850 - RNA, 19 nt, Homo sapiens
cagcaggccuggaaaaguu

SEQ ID NO: 1498851 - RNA, 19 nt, Homo sapiens
gcaacaaaggggcugauua

SEQ ID NO: 1498852 - RNA, 19 nt, Homo sapiens
gcuaucuacugaugguaug

SEQ ID NO: 1498853 - RNA, 19 nt, Homo sapiens
gaucauaguggcugguauc

SEQ ID NO: 1498854 - RNA, 19 nt, Homo sapiens
gggaauaccagaugauacu

SEQ ID NO: 1498855 - RNA, 19 nt, Homo sapiens
aaaugggaauaccagauga

SEQ ID NO: 1498856 - RNA, 19 nt, Homo sapiens
agaaccaaauguaacuaga

SEQ ID NO: 1498857 - RNA, 19 nt, Homo sapiens
caagcaacucuucggcuaa

SEQ ID NO: 1498858 - RNA, 19 nt, Homo sapiens
cacugaacuuugaugagua

SEQ ID NO: 1498859 - RNA, 19 nt, Homo sapiens
uaauucacacugcaacaaa

SEQ ID NO: 1498860 - RNA, 19 nt, Homo sapiens
guuaaauuuccaccugaua

SEQ ID NO: 1498861 - RNA, 19 nt, Homo sapiens
caaggagaaccacgucaga

SEQ ID NO: 1498862 - RNA, 19 nt, Homo sapiens
ggcaagauuuggaaaagaa

SEQ ID NO: 1498863 - RNA, 19 nt, Homo sapiens
cugaagagaaggcaagauu

SEQ ID NO: 1498864 - RNA, 19 nt, Homo sapiens
ccauuucucuaaacugaag

SEQ ID NO: 1498865 - RNA, 19 nt, Homo sapiens
aggagaaccacgucagaua

SEQ ID NO: 1498866 - RNA, 19 nt, Homo sapiens
gauuagguggaguuaaauu

SEQ ID NO: 1498867 - RNA, 19 nt, Homo sapiens
uggaugaagugcugaacug

SEQ ID NO: 1498868 - RNA, 19 nt, Homo sapiens
caugaaacucuaggacuaa

SEQ ID NO: 1498869 - RNA, 19 nt, Homo sapiens
uuccauuucucuaaacuga

SEQ ID NO: 1498870 - RNA, 19 nt, Homo sapiens
gaggccaguuucugauaca

SEQ ID NO: 1498871 - RNA, 19 nt, Homo sapiens
ugauucuacuuauggacua

SEQ ID NO: 1498872 - RNA, 19 nt, Homo sapiens
gucaacacaucaugaaacu

SEQ ID NO: 1498873 - RNA, 19 nt, Homo sapiens
uagaguggaugaggcaaau

SEQ ID NO: 1498874 - RNA, 19 nt, Homo sapiens
guauggugguggaagacaa

SEQ ID NO: 1498875 - RNA, 19 nt, Homo sapiens
ucaugugcgauucagauua

SEQ ID NO: 1498876 - RNA, 19 nt, Homo sapiens
gagaaccacgucagauagu

SEQ ID NO: 1498877 - RNA, 19 nt, Homo sapiens
gcaacucuucggcuaacuu

SEQ ID NO: 1498878 - RNA, 19 nt, Homo sapiens
ccaaagaggcagagcuucu

SEQ ID NO: 1498879 - RNA, 19 nt, Homo sapiens
aaagugaauuccauuucuc

SEQ ID NO: 1498880 - RNA, 19 nt, Homo sapiens
gugcuaacagcccuagaaa

SEQ ID NO: 1498881 - RNA, 19 nt, Homo sapiens
caagaaccaaauguaacua

SEQ ID NO: 1498882 - RNA, 19 nt, Homo sapiens
cgaaauguauccaucuuua

SEQ ID NO: 1498883 - RNA, 19 nt, Homo sapiens
guggauaucuuaacuuaug

SEQ ID NO: 1498884 - RNA, 19 nt, Homo sapiens
caguggauaucuuaacuua

SEQ ID NO: 1498885 - RNA, 19 nt, Homo sapiens
gagaaacacgccuugauuu

SEQ ID NO: 1498886 - RNA, 19 nt, Homo sapiens
ggagaaacacgccuugauu

SEQ ID NO: 1498887 - RNA, 19 nt, Homo sapiens
aauaagaucuccauuguag

SEQ ID NO: 1498888 - RNA, 19 nt, Homo sapiens
gcuaucagcaucuuauuaa

SEQ ID NO: 1498889 - RNA, 19 nt, Homo sapiens
gcaaacugcuuauuguuac

SEQ ID NO: 1498890 - RNA, 19 nt, Homo sapiens
uaacuuauguagccuggaa

SEQ ID NO: 1498891 - RNA, 19 nt, Homo sapiens
gacaauggaucuucaacau

SEQ ID NO: 1498892 - RNA, 19 nt, Homo sapiens
ccagauauaggaacugaua

SEQ ID NO: 1498893 - RNA, 19 nt, Homo sapiens
agaaacacgccuugauuua

SEQ ID NO: 1498894 - RNA, 19 nt, Homo sapiens
uauaggaacugauaaggau

SEQ ID NO: 1498895 - RNA, 19 nt, Homo sapiens
caacauggcagcccuuuua

SEQ ID NO: 1498896 - RNA, 19 nt, Homo sapiens
gugaugaacuuguccuugu

SEQ ID NO: 1498897 - RNA, 19 nt, Homo sapiens
aaacacgccuugauuuagu

SEQ ID NO: 1498898 - RNA, 19 nt, Homo sapiens
gaaacacgccuugauuuag

SEQ ID NO: 1498899 - RNA, 19 nt, Homo sapiens
ggauguugaugaaggcaaa

SEQ ID NO: 1498900 - RNA, 19 nt, Homo sapiens
gaacccagauauaggaacu

SEQ ID NO: 1498901 - RNA, 19 nt, Homo sapiens
caaauauugucuccagcaa

SEQ ID NO: 1498902 - RNA, 19 nt, Homo sapiens
ggcauuagccuaucuguag

SEQ ID NO: 1498903 - RNA, 19 nt, Homo sapiens
gcuaugagauggucaaaau

SEQ ID NO: 1498904 - RNA, 19 nt, Homo sapiens
uggcaacuaucaagaguga

SEQ ID NO: 1498905 - RNA, 19 nt, Homo sapiens
gauggcaacuaucaagagu

SEQ ID NO: 1498906 - RNA, 19 nt, Homo sapiens
gagcauggcgacucaagug

SEQ ID NO: 1498907 - RNA, 19 nt, Homo sapiens
uauguagccuggaaguuga

SEQ ID NO: 1498908 - RNA, 19 nt, Homo sapiens
uaagaucuccauuguagga

SEQ ID NO: 1498909 - RNA, 19 nt, Homo sapiens
uuaagaauuucgcggaaga

SEQ ID NO: 1498910 - RNA, 19 nt, Homo sapiens
caucacaccugccaagcau

SEQ ID NO: 1498911 - RNA, 19 nt, Homo sapiens
caucacaccugccaagcau

SEQ ID NO: 1498912 - RNA, 19 nt, Homo sapiens
caucacaccugccaagcau

SEQ ID NO: 1498913 - RNA, 19 nt, Homo sapiens
gaugagcuuuaacgccauu

SEQ ID NO: 1498914 - RNA, 19 nt, Homo sapiens
ggaguggugugaacauugc

SEQ ID NO: 1498915 - RNA, 19 nt, Homo sapiens
ugcaaacugcuuauuguua

SEQ ID NO: 1498916 - RNA, 19 nt, Homo sapiens
gaagaggaggccauucauc

SEQ ID NO: 1498917 - RNA, 19 nt, Homo sapiens
gcaaacuccaaucuaguga

SEQ ID NO: 1498918 - RNA, 19 nt, Homo sapiens
gcgaaauguauccaucuuu

SEQ ID NO: 1498919 - RNA, 19 nt, Homo sapiens
gugccucgaugagcuuuaa

SEQ ID NO: 1498920 - RNA, 19 nt, Homo sapiens
aauauugucuccagcaaag

SEQ ID NO: 1498921 - RNA, 19 nt, Homo sapiens
ggaggccauucaucacaau

SEQ ID NO: 1498922 - RNA, 19 nt, Homo sapiens
gccuaucuguagcugauuu

SEQ ID NO: 1498923 - RNA, 19 nt, Homo sapiens
caagauggcaacuaucaag

SEQ ID NO: 1498924 - RNA, 19 nt, Homo sapiens
uuuccaagauggcaacuau

SEQ ID NO: 1498925 - RNA, 19 nt, Homo sapiens
uuccgaauauuacccagua

SEQ ID NO: 1498926 - RNA, 19 nt, Homo sapiens
gugagacaauggaucuuca

SEQ ID NO: 1498927 - RNA, 19 nt, Homo sapiens
uagccuaucuguagcugau

SEQ ID NO: 1498928 - RNA, 19 nt, Homo sapiens
ugaaagguuauacuucuug

SEQ ID NO: 1498929 - RNA, 19 nt, Homo sapiens
cauggcgacucaaguguuc

SEQ ID NO: 1498930 - RNA, 19 nt, Homo sapiens
gggcauuagccuaucugua

SEQ ID NO: 1498931 - RNA, 19 nt, Homo sapiens
ccucacaccugccaagcau

SEQ ID NO: 1498932 - RNA, 19 nt, Homo sapiens
gcauggcgacucaaguguu

SEQ ID NO: 1498933 - RNA, 19 nt, Homo sapiens
gaggaggccauucaucaca

SEQ ID NO: 1498934 - RNA, 19 nt, Homo sapiens
ccuuguggauguugaugaa

SEQ ID NO: 1498935 - RNA, 19 nt, Homo sapiens
aagaggaggccauucauca

SEQ ID NO: 1498936 - RNA, 19 nt, Homo sapiens
ggaagaggaggccauucau

SEQ ID NO: 1498937 - RNA, 19 nt, Homo sapiens
guggaguggugugaacauu

SEQ ID NO: 1498938 - RNA, 19 nt, Homo sapiens
gaauauuacccaguacagu

SEQ ID NO: 1498939 - RNA, 19 nt, Homo sapiens
ggccauucaucacaauaag

SEQ ID NO: 1498940 - RNA, 19 nt, Homo sapiens
aaucuggacucugcucguu

SEQ ID NO: 1498941 - RNA, 19 nt, Homo sapiens
acugcaaacugcuuauugu

SEQ ID NO: 1498942 - RNA, 19 nt, Homo sapiens
uggcagcccuuuuaugaaa

SEQ ID NO: 1498943 - RNA, 19 nt, Homo sapiens
gcaacuaucaagagugaac

SEQ ID NO: 1498944 - RNA, 19 nt, Homo sapiens
ggcaaaggcuuggcaucca

SEQ ID NO: 1498945 - RNA, 19 nt, Homo sapiens
uauuggaagugguuguaau

SEQ ID NO: 1498946 - RNA, 19 nt, Homo sapiens
uaaaagguuugagugauga

SEQ ID NO: 1498947 - RNA, 19 nt, Homo sapiens
cggaagaggaggccauuca

SEQ ID NO: 1498948 - RNA, 19 nt, Homo sapiens
acugcaaacuccaaucuag

SEQ ID NO: 1498949 - RNA, 19 nt, Homo sapiens
ugaugaacuuguccuugug

SEQ ID NO: 1498950 - RNA, 19 nt, Homo sapiens
ggcuuggcauccacucuga

SEQ ID NO: 1498951 - RNA, 19 nt, Homo sapiens
uuauguagccuggaaguug

SEQ ID NO: 1498952 - RNA, 19 nt, Homo sapiens
ccuggaaguugaguggauu

SEQ ID NO: 1498953 - RNA, 19 nt, Homo sapiens
guugaugaaggcaaacuga

SEQ ID NO: 1498954 - RNA, 19 nt, Homo sapiens
gaucuccauuguaggaacu

SEQ ID NO: 1498955 - RNA, 19 nt, Homo sapiens
ccauucaucacaauaagau

SEQ ID NO: 1498956 - RNA, 19 nt, Homo sapiens
uggaagugguuguaaucug

SEQ ID NO: 1498957 - RNA, 19 nt, Homo sapiens
guuauuggaagugguugua

SEQ ID NO: 1498958 - RNA, 19 nt, Homo sapiens
gaaaaugccaaauauuguc

SEQ ID NO: 1498959 - RNA, 19 nt, Homo sapiens
uuaaaagguuugagugaug

SEQ ID NO: 1498960 - RNA, 19 nt, Homo sapiens
gaggccauucaucacaaua

SEQ ID NO: 1498961 - RNA, 19 nt, Homo sapiens
ucacaccugccaagcauca

SEQ ID NO: 1498962 - RNA, 19 nt, Homo sapiens
gauauaggaacugauaagg

SEQ ID NO: 1498963 - RNA, 19 nt, Homo sapiens
uggagagcauggcgacuca

SEQ ID NO: 1498964 - RNA, 19 nt, Homo sapiens
gcugauccuuggagagcau

SEQ ID NO: 1498965 - RNA, 19 nt, Homo sapiens
ucacaccugccaagcauca

SEQ ID NO: 1498966 - RNA, 19 nt, Homo sapiens
caaacugcuuauuguuacu

SEQ ID NO: 1498967 - RNA, 19 nt, Homo sapiens
ucacaccugccaagcauca

SEQ ID NO: 1498968 - RNA, 19 nt, Homo sapiens
ccucacugcaaacugcuua

SEQ ID NO: 1498969 - RNA, 19 nt, Homo sapiens
ucacaccugccaagcauca

SEQ ID NO: 1498970 - RNA, 19 nt, Homo sapiens
gguguggcuugugcuauca

SEQ ID NO: 1498971 - RNA, 19 nt, Homo sapiens
cauggcagcccuuuuauga

SEQ ID NO: 1498972 - RNA, 19 nt, Homo sapiens
gccuggaaguugaguggau

SEQ ID NO: 1498973 - RNA, 19 nt, Homo sapiens
ccuccauucucuuucuuca

SEQ ID NO: 1498974 - RNA, 19 nt, Homo sapiens
uucuucaccucuugaguuu

SEQ ID NO: 1498975 - RNA, 19 nt, Homo sapiens
gcaucacaccugccaagca

SEQ ID NO: 1498976 - RNA, 19 nt, Homo sapiens
gcaucacaccugccaagca

SEQ ID NO: 1498977 - RNA, 19 nt, Homo sapiens
acaauggaucuucaacaug

SEQ ID NO: 1498978 - RNA, 19 nt, Homo sapiens
ggugagacaauggaucuuc

SEQ ID NO: 1498979 - RNA, 19 nt, Homo sapiens
gaagggugagacaauggau

SEQ ID NO: 1498980 - RNA, 19 nt, Homo sapiens
gcaucacaccugccaagca

SEQ ID NO: 1498981 - RNA, 19 nt, Homo sapiens
gauccugagcagugggaaa

SEQ ID NO: 1498982 - RNA, 19 nt, Homo sapiens
ggacaaacccaccagauuc

SEQ ID NO: 1498983 - RNA, 19 nt, Homo sapiens
guacuggucucuaauaaac

SEQ ID NO: 1498984 - RNA, 19 nt, Homo sapiens
gagcagagagagccuauga

SEQ ID NO: 1498985 - RNA, 19 nt, Homo sapiens
ccucagaguucgacaguga

SEQ ID NO: 1498986 - RNA, 19 nt, Homo sapiens
cacagaagccucucacuaa

SEQ ID NO: 1498987 - RNA, 19 nt, Homo sapiens
acagaagccucucacuaaa

SEQ ID NO: 1498988 - RNA, 19 nt, Homo sapiens
ccacagaagccucucacua

SEQ ID NO: 1498989 - RNA, 19 nt, Homo sapiens
agaagccucucacuaaaga

SEQ ID NO: 1498990 - RNA, 19 nt, Homo sapiens
ggguacuggucucuaauaa

SEQ ID NO: 1498991 - RNA, 19 nt, Homo sapiens
ggacccucaucaaggauaa

SEQ ID NO: 1498992 - RNA, 19 nt, Homo sapiens
caacugaagcugcugaugu

SEQ ID NO: 1498993 - RNA, 19 nt, Homo sapiens
uaccaggucuucucuuguu

SEQ ID NO: 1498994 - RNA, 19 nt, Homo sapiens
gcagagagagccuaugaag

SEQ ID NO: 1498995 - RNA, 19 nt, Homo sapiens
gagagagccuaugaagaga

SEQ ID NO: 1498996 - RNA, 19 nt, Homo sapiens
cgacugaagcugaagcaaa

SEQ ID NO: 1498997 - RNA, 19 nt, Homo sapiens
ugcaagauccgccuacaua

SEQ ID NO: 1498998 - RNA, 19 nt, Homo sapiens
cagcaucuaugucaucuac

SEQ ID NO: 1498999 - RNA, 19 nt, Homo sapiens
gcaagauccgccuacauau

SEQ ID NO: 1499000 - RNA, 19 nt, Homo sapiens
ccaaauggccgagcagaga

SEQ ID NO: 1499001 - RNA, 19 nt, Homo sapiens
caagauccgccuacauaug

SEQ ID NO: 1499002 - RNA, 19 nt, Homo sapiens
agagagagccuaugaagag

SEQ ID NO: 1499003 - RNA, 19 nt, Homo sapiens
gacugaagcugaagcaaaa

SEQ ID NO: 1499004 - RNA, 19 nt, Homo sapiens
cgggaauacucaccaaaug

SEQ ID NO: 1499005 - RNA, 19 nt, Homo sapiens
ccacugcacucgggaauac

SEQ ID NO: 1499006 - RNA, 19 nt, Homo sapiens
ggaagggccagaggacaaa

SEQ ID NO: 1499007 - RNA, 19 nt, Homo sapiens
gcaucuaugucaucuacca

SEQ ID NO: 1499008 - RNA, 19 nt, Homo sapiens
ugaagagacgcgaauguug

SEQ ID NO: 1499009 - RNA, 19 nt, Homo sapiens
gcccaaugcaguagcagua

SEQ ID NO: 1499010 - RNA, 19 nt, Homo sapiens
ggucaucgaggagcacuuu

SEQ ID NO: 1499011 - RNA, 19 nt, Homo sapiens
ccaccagauucuccuacaa

SEQ ID NO: 1499012 - RNA, 19 nt, Homo sapiens
ucuaccaggucuucucuug

SEQ ID NO: 1499013 - RNA, 19 nt, Homo sapiens
gguacuggucucuaauaaa

SEQ ID NO: 1499014 - RNA, 19 nt, Homo sapiens
ccuggacccucaucaagga

SEQ ID NO: 1499015 - RNA, 19 nt, Homo sapiens
caucaaggauaaggucauc

SEQ ID NO: 1499016 - RNA, 19 nt, Homo sapiens
agcaguaccuuuccuguca

SEQ ID NO: 1499017 - RNA, 19 nt, Homo sapiens
gcacccacagcaucuaugu

SEQ ID NO: 1499018 - RNA, 19 nt, Homo sapiens
gacacuggaugaagcugau

SEQ ID NO: 1499019 - RNA, 19 nt, Homo sapiens
ugggugaccugcgcaagaa

SEQ ID NO: 1499020 - RNA, 19 nt, Homo sapiens
gaagcacccacagcaucua

SEQ ID NO: 1499021 - RNA, 19 nt, Homo sapiens
gggaauacucaccaaaugg

SEQ ID NO: 1499022 - RNA, 19 nt, Homo sapiens
guaccuuuccugucagaug

SEQ ID NO: 1499023 - RNA, 19 nt, Homo sapiens
gacaaacccaccagauucu

SEQ ID NO: 1499024 - RNA, 19 nt, Homo sapiens
gaggacaaacccaccagau

SEQ ID NO: 1499025 - RNA, 19 nt, Homo sapiens
caucugcugauacaacuga

SEQ ID NO: 1499026 - RNA, 19 nt, Homo sapiens
ccacagcaucuaugucauc

SEQ ID NO: 1499027 - RNA, 19 nt, Homo sapiens
gauggacagcccugcaaga

SEQ ID NO: 1499028 - RNA, 19 nt, Homo sapiens
cccagauacugucagagaa

SEQ ID NO: 1499029 - RNA, 19 nt, Homo sapiens
aacugaagcugcugaugug

SEQ ID NO: 1499030 - RNA, 19 nt, Homo sapiens
ccggcuacuucggucauua

SEQ ID NO: 1499031 - RNA, 19 nt, Homo sapiens
cagagagagccuaugaaga

SEQ ID NO: 1499032 - RNA, 19 nt, Homo sapiens
ccuacugggugugcuggua

SEQ ID NO: 1499033 - RNA, 19 nt, Homo sapiens
gacccaaccucagcaucau

SEQ ID NO: 1499034 - RNA, 19 nt, Homo sapiens
cagggucuauccucagagu

SEQ ID NO: 1499035 - RNA, 19 nt, Homo sapiens
gggucuauccucagaguuc

SEQ ID NO: 1499036 - RNA, 19 nt, Homo sapiens
aggacaaacccaccagauu

SEQ ID NO: 1499037 - RNA, 19 nt, Homo sapiens
cuacugggugugcugguaa

SEQ ID NO: 1499038 - RNA, 19 nt, Homo sapiens
ccaccuggacccucaucaa

SEQ ID NO: 1499039 - RNA, 19 nt, Homo sapiens
cagaagccucucacuaaag

SEQ ID NO: 1499040 - RNA, 19 nt, Homo sapiens
cuucggucauuaccuguug

SEQ ID NO: 1499041 - RNA, 19 nt, Homo sapiens
ucaaggauaaggucaucga

SEQ ID NO: 1499042 - RNA, 19 nt, Homo sapiens
agacccaaccucagcauca

SEQ ID NO: 1499043 - RNA, 19 nt, Homo sapiens
aagauccgccuacauaugg

SEQ ID NO: 1499044 - RNA, 19 nt, Homo sapiens
agugacgacugaagcugaa

SEQ ID NO: 1499045 - RNA, 19 nt, Homo sapiens
ugcagggucuauccucaga

SEQ ID NO: 1499046 - RNA, 19 nt, Homo sapiens
cgaagcacccacagcaucu

SEQ ID NO: 1499047 - RNA, 19 nt, Homo sapiens
ggaagaagcucgucucaua

SEQ ID NO: 1499048 - RNA, 19 nt, Homo sapiens
gcaauagaguguagcauua

SEQ ID NO: 1499049 - RNA, 19 nt, Homo sapiens
cagaagcacuacauuauua

SEQ ID NO: 1499050 - RNA, 19 nt, Homo sapiens
gacaagagcugguguuaga

SEQ ID NO: 1499051 - RNA, 19 nt, Homo sapiens
caauuaggguuaaguguua

SEQ ID NO: 1499052 - RNA, 19 nt, Homo sapiens
ccacagagcuuguacaaca

SEQ ID NO: 1499053 - RNA, 19 nt, Homo sapiens
uaggaaagcuguaucauga

SEQ ID NO: 1499054 - RNA, 19 nt, Homo sapiens
gaaauguucugaagaguca

SEQ ID NO: 1499055 - RNA, 19 nt, Homo sapiens
gcacagaguuugauguugu

SEQ ID NO: 1499056 - RNA, 19 nt, Homo sapiens
ggacauagcugccuuucag

SEQ ID NO: 1499057 - RNA, 19 nt, Homo sapiens
aaacaaggcuuaaagacuu

SEQ ID NO: 1499058 - RNA, 19 nt, Homo sapiens
gaaagcgccuauagaaaug

SEQ ID NO: 1499059 - RNA, 19 nt, Homo sapiens
ggagaaaccuacacacugu

SEQ ID NO: 1499060 - RNA, 19 nt, Homo sapiens
ggaaaugcuuuauagauca

SEQ ID NO: 1499061 - RNA, 19 nt, Homo sapiens
gagcgaguauuauauauuc

SEQ ID NO: 1499062 - RNA, 19 nt, Homo sapiens
gaacccagcuuccuucuac

SEQ ID NO: 1499063 - RNA, 19 nt, Homo sapiens
gcacacaagagcucuguua

SEQ ID NO: 1499064 - RNA, 19 nt, Homo sapiens
gcagagcgaguauuauaua

SEQ ID NO: 1499065 - RNA, 19 nt, Homo sapiens
gaauacagugggauaaaua

SEQ ID NO: 1499066 - RNA, 19 nt, Homo sapiens
gcacagcuguuaacaccaa

SEQ ID NO: 1499067 - RNA, 19 nt, Homo sapiens
ggagaggagucguggauug

SEQ ID NO: 1499068 - RNA, 19 nt, Homo sapiens
ggaaggcgguggagagaug

SEQ ID NO: 1499069 - RNA, 19 nt, Homo sapiens
gcugauaaauguucaagga

SEQ ID NO: 1499070 - RNA, 19 nt, Homo sapiens
ggguagguaucgaauguua

SEQ ID NO: 1499071 - RNA, 19 nt, Homo sapiens
gauauuaccuaccauuuac

SEQ ID NO: 1499072 - RNA, 19 nt, Homo sapiens
gucagaggcuucauucuuu

SEQ ID NO: 1499073 - RNA, 19 nt, Homo sapiens
caacaaacccguggucaaa

SEQ ID NO: 1499074 - RNA, 19 nt, Homo sapiens
guuaaucacuuucuaaugg

SEQ ID NO: 1499075 - RNA, 19 nt, Homo sapiens
gagaguagagcuaaccaua

SEQ ID NO: 1499076 - RNA, 19 nt, Homo sapiens
uggcugacaugcuuuauaa

SEQ ID NO: 1499077 - RNA, 19 nt, Homo sapiens
guucggagaucccagauga

SEQ ID NO: 1499078 - RNA, 19 nt, Homo sapiens
gaaacuguuacaugcauua

SEQ ID NO: 1499079 - RNA, 19 nt, Homo sapiens
cgacggacauucuuaaagu

SEQ ID NO: 1499080 - RNA, 19 nt, Homo sapiens
aaacaaaccaccaagcuuu

SEQ ID NO: 1499081 - RNA, 19 nt, Homo sapiens
aggaagaacuugucgcuuu

SEQ ID NO: 1499082 - RNA, 19 nt, Homo sapiens
ggagauugaugcuucuguu

SEQ ID NO: 1499083 - RNA, 19 nt, Homo sapiens
gcagaagcacuacauuauu

SEQ ID NO: 1499084 - RNA, 19 nt, Homo sapiens
gcugaaagcgccuauagaa

SEQ ID NO: 1499085 - RNA, 19 nt, Homo sapiens
aaacagauauuaccuacca

SEQ ID NO: 1499086 - RNA, 19 nt, Homo sapiens
gaaaguaguguuccuaugg

SEQ ID NO: 1499087 - RNA, 19 nt, Homo sapiens
uggagaaugugcaagcuua

SEQ ID NO: 1499088 - RNA, 19 nt, Homo sapiens
gaaagcccuucuguaauau

SEQ ID NO: 1499089 - RNA, 19 nt, Homo sapiens
ugaagcagcugagaaguau

SEQ ID NO: 1499090 - RNA, 19 nt, Homo sapiens
caaaggaaacuguuacaug

SEQ ID NO: 1499091 - RNA, 19 nt, Homo sapiens
caugaugggugaagcauau

SEQ ID NO: 1499092 - RNA, 19 nt, Homo sapiens
caaggaagcaauucagaaa

SEQ ID NO: 1499093 - RNA, 19 nt, Homo sapiens
gaacagcagguuugcagaa

SEQ ID NO: 1499094 - RNA, 19 nt, Homo sapiens
gagagaugauugcagaguu

SEQ ID NO: 1499095 - RNA, 19 nt, Homo sapiens
ccaguagaauucauuguau

SEQ ID NO: 1499096 - RNA, 19 nt, Homo sapiens
uaacaggucguaagaguga

SEQ ID NO: 1499097 - RNA, 19 nt, Homo sapiens
ugaaagcgccuauagaaau

SEQ ID NO: 1499098 - RNA, 19 nt, Homo sapiens
gcuaccaucuugucaaugu

SEQ ID NO: 1499099 - RNA, 19 nt, Homo sapiens
gagcuaccaucuugucaau

SEQ ID NO: 1499100 - RNA, 19 nt, Homo sapiens
guaacuacuucaaugauca

SEQ ID NO: 1499101 - RNA, 19 nt, Homo sapiens
ucucagauguugcugguuu

SEQ ID NO: 1499102 - RNA, 19 nt, Homo sapiens
gcagagcauugguauaugg

SEQ ID NO: 1499103 - RNA, 19 nt, Homo sapiens
ggguugaaguguauuauuc

SEQ ID NO: 1499104 - RNA, 19 nt, Homo sapiens
gcauuaagccaguucuuug

SEQ ID NO: 1499105 - RNA, 19 nt, Homo sapiens
gcauuagccugcauguuuc

SEQ ID NO: 1499106 - RNA, 19 nt, Homo sapiens
cuaauuauccggcugcuuu

SEQ ID NO: 1499107 - RNA, 19 nt, Homo sapiens
cagcugagaaguauuauga

SEQ ID NO: 1499108 - RNA, 19 nt, Homo sapiens
gaggaaaugcuuuauagau

SEQ ID NO: 1499109 - RNA, 19 nt, Homo sapiens
gaaacaaaccaccaagcuu

SEQ ID NO: 1499110 - RNA, 19 nt, Homo sapiens
ggguaaauguagugagaaa

SEQ ID NO: 1499111 - RNA, 19 nt, Homo sapiens
acagugggauaaauaauug

SEQ ID NO: 1499112 - RNA, 19 nt, Homo sapiens
gcugcugucuucccuguuu

SEQ ID NO: 1499113 - RNA, 19 nt, Homo sapiens
gaggaagcccuuaguguau

SEQ ID NO: 1499114 - RNA, 19 nt, Homo sapiens
ugaggaagcccuuagugua

SEQ ID NO: 1499115 - RNA, 19 nt, Homo sapiens
ggcggaagguggagauuga

SEQ ID NO: 1499116 - RNA, 19 nt, Homo sapiens
gcugacaugcuuuauaauu

SEQ ID NO: 1499117 - RNA, 19 nt, Homo sapiens
uaacaaauggcaagcagaa

SEQ ID NO: 1499118 - RNA, 19 nt, Homo sapiens
ggacauucuuaaaguguuc

SEQ ID NO: 1499119 - RNA, 19 nt, Homo sapiens
gaagucagaguguccauuc

SEQ ID NO: 1499120 - RNA, 19 nt, Homo sapiens
ggaaacuguuacaugcauu

SEQ ID NO: 1499121 - RNA, 19 nt, Homo sapiens
ccaagaaccucuggcuguu

SEQ ID NO: 1499122 - RNA, 19 nt, Homo sapiens
gauggauacuggacauuca

SEQ ID NO: 1499123 - RNA, 19 nt, Homo sapiens
aauaguggguugaagugua

SEQ ID NO: 1499124 - RNA, 19 nt, Homo sapiens
ggaaaggguagguaucgaa

SEQ ID NO: 1499125 - RNA, 19 nt, Homo sapiens
gcugagaaguauuaugauc

SEQ ID NO: 1499126 - RNA, 19 nt, Homo sapiens
gaacuagacagcacagagu

SEQ ID NO: 1499127 - RNA, 19 nt, Homo sapiens
gagcauugguauauggaau

SEQ ID NO: 1499128 - RNA, 19 nt, Homo sapiens
gcagggacacuaugaggaa

SEQ ID NO: 1499129 - RNA, 19 nt, Homo sapiens
caaaagcgguuccucaaga

SEQ ID NO: 1499130 - RNA, 19 nt, Homo sapiens
gcggauuucugcuaugaug

SEQ ID NO: 1499131 - RNA, 19 nt, Homo sapiens
gcccuucuguaauauauau

SEQ ID NO: 1499132 - RNA, 19 nt, Homo sapiens
caacagguuauuagacaaa

SEQ ID NO: 1499133 - RNA, 19 nt, Homo sapiens
uaccagaacucagagacua

SEQ ID NO: 1499134 - RNA, 19 nt, Homo sapiens
ggaagaacuugucgcuuuu

SEQ ID NO: 1499135 - RNA, 19 nt, Homo sapiens
gaucagccucuccauuaaa

SEQ ID NO: 1499136 - RNA, 19 nt, Homo sapiens
gaugacagccgugcuauca

SEQ ID NO: 1499137 - RNA, 19 nt, Homo sapiens
ggcaaacaauuaggguuaa

SEQ ID NO: 1499138 - RNA, 19 nt, Homo sapiens
agaaugaggaaaugcuuua

SEQ ID NO: 1499139 - RNA, 19 nt, Homo sapiens
ucacuggucucuucacaag

SEQ ID NO: 1499140 - RNA, 19 nt, Homo sapiens
gccgugcuaucaagacuaa

SEQ ID NO: 1499141 - RNA, 19 nt, Homo sapiens
gcaaugcugauaaauguuc

SEQ ID NO: 1499142 - RNA, 19 nt, Homo sapiens
gagcuaaccauacuucaca

SEQ ID NO: 1499143 - RNA, 19 nt, Homo sapiens
aagcagcugagaaguauua

SEQ ID NO: 1499144 - RNA, 19 nt, Homo sapiens
gcaagcagaaugcaaaugg

SEQ ID NO: 1499145 - RNA, 19 nt, Homo sapiens
ugaucagccucuccauuaa

SEQ ID NO: 1499146 - RNA, 19 nt, Homo sapiens
acagccugcuuaucaauuu

SEQ ID NO: 1499147 - RNA, 19 nt, Homo sapiens
gaagagcuccagagaaaua

SEQ ID NO: 1499148 - RNA, 19 nt, Homo sapiens
gugaagagcuccagagaaa

SEQ ID NO: 1499149 - RNA, 19 nt, Homo sapiens
ggacagcuguuauuuccua

SEQ ID NO: 1499150 - RNA, 19 nt, Homo sapiens
gggauuaucuccugaagaa

SEQ ID NO: 1499151 - RNA, 19 nt, Homo sapiens
caaauuaugucgugagcua

SEQ ID NO: 1499152 - RNA, 19 nt, Homo sapiens
ggagauggauuuggcauaa

SEQ ID NO: 1499153 - RNA, 19 nt, Homo sapiens
gagaauagacugugaaugu

SEQ ID NO: 1499154 - RNA, 19 nt, Homo sapiens
gaauagacugugaauguua

SEQ ID NO: 1499155 - RNA, 19 nt, Homo sapiens
gcaccugacuuaaauaaca

SEQ ID NO: 1499156 - RNA, 19 nt, Homo sapiens
gaacaagagcacaaaugua

SEQ ID NO: 1499157 - RNA, 19 nt, Homo sapiens
guagcaagcuucagagaga

SEQ ID NO: 1499158 - RNA, 19 nt, Homo sapiens
aacaauagccaccaaauua

SEQ ID NO: 1499159 - RNA, 19 nt, Homo sapiens
aaacgcaccugacuuaaau

SEQ ID NO: 1499160 - RNA, 19 nt, Homo sapiens
gaaacgcaccugacuuaaa

SEQ ID NO: 1499161 - RNA, 19 nt, Homo sapiens
ucacugcacuuauaaacaa

SEQ ID NO: 1499162 - RNA, 19 nt, Homo sapiens
gagaguggauaauauaauc

SEQ ID NO: 1499163 - RNA, 19 nt, Homo sapiens
aaacauggcaggagaguaa

SEQ ID NO: 1499164 - RNA, 19 nt, Homo sapiens
gaggaaguccauucagaua

SEQ ID NO: 1499165 - RNA, 19 nt, Homo sapiens
aagaaacgcaccugacuua

SEQ ID NO: 1499166 - RNA, 19 nt, Homo sapiens
guaugagaguggauaauau

SEQ ID NO: 1499167 - RNA, 19 nt, Homo sapiens
gguaugagaguggauaaua

SEQ ID NO: 1499168 - RNA, 19 nt, Homo sapiens
gcuguuauuuccuaaguga

SEQ ID NO: 1499169 - RNA, 19 nt, Homo sapiens
caacugaugaguaacauga

SEQ ID NO: 1499170 - RNA, 19 nt, Homo sapiens
ggacaugcauuuauuaccu

SEQ ID NO: 1499171 - RNA, 19 nt, Homo sapiens
gaauggauauggacaugca

SEQ ID NO: 1499172 - RNA, 19 nt, Homo sapiens
gcaaagaacaagagcacaa

SEQ ID NO: 1499173 - RNA, 19 nt, Homo sapiens
ccagagagguauaaugaag

SEQ ID NO: 1499174 - RNA, 19 nt, Homo sapiens
guucuaggcuauagguaaa

SEQ ID NO: 1499175 - RNA, 19 nt, Homo sapiens
cagcuugguucuacauauu

SEQ ID NO: 1499176 - RNA, 19 nt, Homo sapiens
ggauauggacaugcauuua

SEQ ID NO: 1499177 - RNA, 19 nt, Homo sapiens
gcagcuugguucuacauau

SEQ ID NO: 1499178 - RNA, 19 nt, Homo sapiens
caaagaaugauaugugaga

SEQ ID NO: 1499179 - RNA, 19 nt, Homo sapiens
gaguagaucauaugacuau

SEQ ID NO: 1499180 - RNA, 19 nt, Homo sapiens
aacaagagcacaaauguaa

SEQ ID NO: 1499181 - RNA, 19 nt, Homo sapiens
gauauggacaugcauuuau

SEQ ID NO: 1499182 - RNA, 19 nt, Homo sapiens
gcaugaggcaucaaucaaa

SEQ ID NO: 1499183 - RNA, 19 nt, Homo sapiens
ccagcagccuuguuucuga

SEQ ID NO: 1499184 - RNA, 19 nt, Homo sapiens
ccaccacacugcaaacaau

SEQ ID NO: 1499185 - RNA, 19 nt, Homo sapiens
augaauaucuccaacaaga

SEQ ID NO: 1499186 - RNA, 19 nt, Homo sapiens
cagaguagaucauaugacu

SEQ ID NO: 1499187 - RNA, 19 nt, Homo sapiens
caaaggacuuauagccaau

SEQ ID NO: 1499188 - RNA, 19 nt, Homo sapiens
ggaagaggaaguccauuca

SEQ ID NO: 1499189 - RNA, 19 nt, Homo sapiens
gauuaucuccugaagaaga

SEQ ID NO: 1499190 - RNA, 19 nt, Homo sapiens
ggacuuauagccaauugau

SEQ ID NO: 1499191 - RNA, 19 nt, Homo sapiens
agaaugauaugugagaaga

SEQ ID NO: 1499192 - RNA, 19 nt, Homo sapiens
aaacaauagccaccaaauu

SEQ ID NO: 1499193 - RNA, 19 nt, Homo sapiens
ccagcucccucucauguau

SEQ ID NO: 1499194 - RNA, 19 nt, Homo sapiens
gaucuucaauuccagaacu

SEQ ID NO: 1499195 - RNA, 19 nt, Homo sapiens
agaauagacugugaauguu

SEQ ID NO: 1499196 - RNA, 19 nt, Homo sapiens
caugaggcaucaaucaaau

SEQ ID NO: 1499197 - RNA, 19 nt, Homo sapiens
gagcuccagagaaauauuu

SEQ ID NO: 1499198 - RNA, 19 nt, Homo sapiens
aagaggaaguccauucaga

SEQ ID NO: 1499199 - RNA, 19 nt, Homo sapiens
cagagagaauagacuguga

SEQ ID NO: 1499200 - RNA, 19 nt, Homo sapiens
gccagccuguugaagauaa

SEQ ID NO: 1499201 - RNA, 19 nt, Homo sapiens
gcaaacaauagccaccaaa

SEQ ID NO: 1499202 - RNA, 19 nt, Homo sapiens
cugaaggccuuaugaguca

SEQ ID NO: 1499203 - RNA, 19 nt, Homo sapiens
guagaucauaugacuauug

SEQ ID NO: 1499204 - RNA, 19 nt, Homo sapiens
caaagaacaagagcacaaa

SEQ ID NO: 1499205 - RNA, 19 nt, Homo sapiens
cauguaacuuugaagauag

SEQ ID NO: 1499206 - RNA, 19 nt, Homo sapiens
ccugaacccuggaggaaga

SEQ ID NO: 1499207 - RNA, 19 nt, Homo sapiens
gagguauaaugaagcaugu

SEQ ID NO: 1499208 - RNA, 19 nt, Homo sapiens
ggcauaaggacagcuguua

SEQ ID NO: 1499209 - RNA, 19 nt, Homo sapiens
uuaugcagaucuucaauuc

SEQ ID NO: 1499210 - RNA, 19 nt, Homo sapiens
acaugaauaucuccaacaa

SEQ ID NO: 1499211 - RNA, 19 nt, Homo sapiens
gcuuaagcuuccguuuaua

SEQ ID NO: 1499212 - RNA, 19 nt, Homo sapiens
ggccugugcugcucagaau

SEQ ID NO: 1499213 - RNA, 19 nt, Homo sapiens
ccuaagugaugauguccaa

SEQ ID NO: 1499214 - RNA, 19 nt, Homo sapiens
caauagccaccaaauuaug

SEQ ID NO: 1499215 - RNA, 19 nt, Homo sapiens
uuccagaacuccagugaga

SEQ ID NO: 1499216 - RNA, 19 nt, Homo sapiens
caucucggguccauccuau

SEQ ID NO: 1499217 - RNA, 19 nt, Homo sapiens
gugagaagauggccaaucc

SEQ ID NO: 1499218 - RNA, 19 nt, Homo sapiens
caaacaauagccaccaaau

SEQ ID NO: 1499219 - RNA, 19 nt, Homo sapiens
ugaguaacaugaauaucuc

SEQ ID NO: 1499220 - RNA, 19 nt, Homo sapiens
ugccagagagguauaauga

SEQ ID NO: 1499221 - RNA, 19 nt, Homo sapiens
gcaagcuucagagagaaua

SEQ ID NO: 1499222 - RNA, 19 nt, Homo sapiens
ccagguagcaagcuucaga

SEQ ID NO: 1499223 - RNA, 19 nt, Homo sapiens
cugaagaccugggauuuua

SEQ ID NO: 1499224 - RNA, 19 nt, Homo sapiens
aucaaugucugaagaaguu

SEQ ID NO: 1499225 - RNA, 19 nt, Homo sapiens
aaugauaugugagaagaug

SEQ ID NO: 1499226 - RNA, 19 nt, Homo sapiens
auucagcucuguuaacuca

SEQ ID NO: 1499227 - RNA, 19 nt, Homo sapiens
ucuguuaacucacucaucu

SEQ ID NO: 1499228 - RNA, 19 nt, Homo sapiens
uagaucauaugacuauugg

SEQ ID NO: 1499229 - RNA, 19 nt, Homo sapiens
cucuacaacugaugaguaa

SEQ ID NO: 1499230 - RNA, 19 nt, Homo sapiens
gauugguacaguagguuua

SEQ ID NO: 1499231 - RNA, 19 nt, Homo sapiens
acaauagccaccaaauuau

SEQ ID NO: 1499232 - RNA, 19 nt, Homo sapiens
gagagaauagacugugaau

SEQ ID NO: 1499233 - RNA, 19 nt, Homo sapiens
gguucuaggcuauagguaa

SEQ ID NO: 1499234 - RNA, 19 nt, Homo sapiens
cugccuggguuauaagaaa

SEQ ID NO: 1499235 - RNA, 19 nt, Homo sapiens
cagcuguuauuuccuaagu

SEQ ID NO: 1499236 - RNA, 19 nt, Homo sapiens
cuuaagcuuccguuuauaa

SEQ ID NO: 1499237 - RNA, 19 nt, Homo sapiens
ggaggaagaggaaguccau

SEQ ID NO: 1499238 - RNA, 19 nt, Homo sapiens
ccagaacuccagugagaug

SEQ ID NO: 1499239 - RNA, 19 nt, Homo sapiens
cagaaugccagccuguuga

SEQ ID NO: 1499240 - RNA, 19 nt, Homo sapiens
uaaggacagcuguuauuuc

SEQ ID NO: 1499241 - RNA, 19 nt, Homo sapiens
ggccagguaagaauggaua

SEQ ID NO: 1499242 - RNA, 19 nt, Homo sapiens
gaaggccuuaugagucaaa

SEQ ID NO: 1499243 - RNA, 19 nt, Homo sapiens
uaagaaacgcaccugacuu

SEQ ID NO: 1499244 - RNA, 19 nt, Homo sapiens
guuauuuccuaagugauga

SEQ ID NO: 1499245 - RNA, 19 nt, Homo sapiens
agaacaagagcacaaaugu

SEQ ID NO: 1499246 - RNA, 19 nt, Homo sapiens
gaccugggauuuuaucaug

SEQ ID NO: 1499247 - RNA, 19 nt, Homo sapiens
gaacucgcguuuccacuuc

SEQ ID NO: 1499248 - RNA, 19 nt, Homo sapiens
uaaaucauguccugccaaa

SEQ ID NO: 1499249 - RNA, 19 nt, Homo sapiens
caaaaugacugugccauaa

SEQ ID NO: 1499250 - RNA, 19 nt, Homo sapiens
ugcaauggcuggagaugua

SEQ ID NO: 1499251 - RNA, 19 nt, Homo sapiens
ggacaucauuuguggucuu

SEQ ID NO: 1499252 - RNA, 19 nt, Homo sapiens
ucugcuaccuugauuagua

SEQ ID NO: 1499253 - RNA, 19 nt, Homo sapiens
agucuacgcugacaucaaa

SEQ ID NO: 1499254 - RNA, 19 nt, Homo sapiens
uaguaagacugaacacauu

SEQ ID NO: 1499255 - RNA, 19 nt, Homo sapiens
gaaggaaauuugccaucuc

SEQ ID NO: 1499256 - RNA, 19 nt, Homo sapiens
ggaaggugcauaagggaaa

SEQ ID NO: 1499257 - RNA, 19 nt, Homo sapiens
uuacugcuauggugagauu

SEQ ID NO: 1499258 - RNA, 19 nt, Homo sapiens
ggaaauuugccaucucaau

SEQ ID NO: 1499259 - RNA, 19 nt, Homo sapiens
ggugagauuuaacauuuag

SEQ ID NO: 1499260 - RNA, 19 nt, Homo sapiens
agacugaacacauugguuu

SEQ ID NO: 1499261 - RNA, 19 nt, Homo sapiens
gggaaaauguuacuggauu

SEQ ID NO: 1499262 - RNA, 19 nt, Homo sapiens
agagaucuguuucuuucaa

SEQ ID NO: 1499263 - RNA, 19 nt, Homo sapiens
aaucauguccugccaaaga

SEQ ID NO: 1499264 - RNA, 19 nt, Homo sapiens
cauggugauucaagacauu

SEQ ID NO: 1499265 - RNA, 19 nt, Homo sapiens
aguaauuucuuccauguca

SEQ ID NO: 1499266 - RNA, 19 nt, Homo sapiens
ggaaaauguuacuggauug

SEQ ID NO: 1499267 - RNA, 19 nt, Homo sapiens
gggagcagaaggaaauuug

SEQ ID NO: 1499268 - RNA, 19 nt, Homo sapiens
aaggaaauuugccaucuca

SEQ ID NO: 1499269 - RNA, 19 nt, Homo sapiens
cugcuaccuugauuaguaa

SEQ ID NO: 1499270 - RNA, 19 nt, Homo sapiens
ggaacaaaagucaaaauga

SEQ ID NO: 1499271 - RNA, 19 nt, Homo sapiens
auucauaucucauggugau

SEQ ID NO: 1499272 - RNA, 19 nt, Homo sapiens
ugccaucucaauuuacuua

SEQ ID NO: 1499273 - RNA, 19 nt, Homo sapiens
uucaagacauuacugcuau

SEQ ID NO: 1499274 - RNA, 19 nt, Homo sapiens
aaauaugauugucccuuca

SEQ ID NO: 1499275 - RNA, 19 nt, Homo sapiens
agaaggaaauuugccaucu

SEQ ID NO: 1499276 - RNA, 19 nt, Homo sapiens
acacauugguuuugucauu

SEQ ID NO: 1499277 - RNA, 19 nt, Homo sapiens
gacaucauuuguggucuuc

SEQ ID NO: 1499278 - RNA, 19 nt, Homo sapiens
ugacugugccauaaacaau

SEQ ID NO: 1499279 - RNA, 19 nt, Homo sapiens
gcuauggugagauuuaaca

SEQ ID NO: 1499280 - RNA, 19 nt, Homo sapiens
cugcuauggugagauuuaa

SEQ ID NO: 1499281 - RNA, 19 nt, Homo sapiens
ucaagacauuacugcuaug

SEQ ID NO: 1499282 - RNA, 19 nt, Homo sapiens
gaucuguuucuuucaacuu

SEQ ID NO: 1499283 - RNA, 19 nt, Homo sapiens
uuucuuccaugucauacaa

SEQ ID NO: 1499284 - RNA, 19 nt, Homo sapiens
ccaucucaauuuacuuauc

SEQ ID NO: 1499285 - RNA, 19 nt, Homo sapiens
cauaucucauggugauuca

SEQ ID NO: 1499286 - RNA, 19 nt, Homo sapiens
gacugugccauaaacaauu

SEQ ID NO: 1499287 - RNA, 19 nt, Homo sapiens
aaaugacugugccauaaac

SEQ ID NO: 1499288 - RNA, 19 nt, Homo sapiens
ggauugcugaaacuaagaa

SEQ ID NO: 1499289 - RNA, 19 nt, Homo sapiens
uuucuacuguccauaaauc

SEQ ID NO: 1499290 - RNA, 19 nt, Homo sapiens
gagaucuguuucuuucaac

SEQ ID NO: 1499291 - RNA, 19 nt, Homo sapiens
agaaaucugcuaccuugau

SEQ ID NO: 1499292 - RNA, 19 nt, Homo sapiens
gccauaaacaauucauauc

SEQ ID NO: 1499293 - RNA, 19 nt, Homo sapiens
guuacuggauugcugaaac

SEQ ID NO: 1499294 - RNA, 19 nt, Homo sapiens
gaaggugcauaagggaaaa

SEQ ID NO: 1499295 - RNA, 19 nt, Homo sapiens
gaacacauugguuuuguca

SEQ ID NO: 1499296 - RNA, 19 nt, Homo sapiens
gagaaaucugcuaccuuga

SEQ ID NO: 1499297 - RNA, 19 nt, Homo sapiens
uacaaguauucgagaaauc

SEQ ID NO: 1499298 - RNA, 19 nt, Homo sapiens
guaauuucuuccaugucau

SEQ ID NO: 1499299 - RNA, 19 nt, Homo sapiens
caucauuuguggucuucuc

SEQ ID NO: 1499300 - RNA, 19 nt, Homo sapiens
gguuaguaauuucuuccau

SEQ ID NO: 1499301 - RNA, 19 nt, Homo sapiens
uuaguaagacugaacacau

SEQ ID NO: 1499302 - RNA, 19 nt, Homo sapiens
ucaaaaugacugugccaua

SEQ ID NO: 1499303 - RNA, 19 nt, Homo sapiens
uuacuggauugcugaaacu

SEQ ID NO: 1499304 - RNA, 19 nt, Homo sapiens
cuacuguccauaaaucaug

SEQ ID NO: 1499305 - RNA, 19 nt, Homo sapiens
cuggauugcugaaacuaag

SEQ ID NO: 1499306 - RNA, 19 nt, Homo sapiens
aagacuggaaggugcauaa

SEQ ID NO: 1499307 - RNA, 19 nt, Homo sapiens
cguuagaacucgcguuucc

SEQ ID NO: 1499308 - RNA, 19 nt, Homo sapiens
ucagugggacaucauuugu

SEQ ID NO: 1499309 - RNA, 19 nt, Homo sapiens
ggagagagaggaaauguuu

SEQ ID NO: 1499310 - RNA, 19 nt, Homo sapiens
caauaaaggagauguguua

SEQ ID NO: 1499311 - RNA, 19 nt, Homo sapiens
ccacagaacuuuccuaacu

SEQ ID NO: 1499312 - RNA, 19 nt, Homo sapiens
gaagaagccucauuuuaaa

SEQ ID NO: 1499313 - RNA, 19 nt, Homo sapiens
ggaggugacuguuauguuc

SEQ ID NO: 1499314 - RNA, 19 nt, Homo sapiens
gaaagaaauucaggaagga

SEQ ID NO: 1499315 - RNA, 19 nt, Homo sapiens
ggaaguagaugaacaaaau

SEQ ID NO: 1499316 - RNA, 19 nt, Homo sapiens
gauccacuuugcagauuua

SEQ ID NO: 1499317 - RNA, 19 nt, Homo sapiens
ggaaguacauugugcucuu

SEQ ID NO: 1499318 - RNA, 19 nt, Homo sapiens
acaauaaaguccaugcuaa

SEQ ID NO: 1499319 - RNA, 19 nt, Homo sapiens
cagcaaaccucgaaauauc

SEQ ID NO: 1499320 - RNA, 19 nt, Homo sapiens
gagaggaaauguuuagauc

SEQ ID NO: 1499321 - RNA, 19 nt, Homo sapiens
gaagaaaugggagcaagua

SEQ ID NO: 1499322 - RNA, 19 nt, Homo sapiens
ccaaagcauucccuaacua

SEQ ID NO: 1499323 - RNA, 19 nt, Homo sapiens
gaaguacauugugcucuuu

SEQ ID NO: 1499324 - RNA, 19 nt, Homo sapiens
gaaagaaaucaccauauca

SEQ ID NO: 1499325 - RNA, 19 nt, Homo sapiens
ggagauagucuuacaguuc

SEQ ID NO: 1499326 - RNA, 19 nt, Homo sapiens
gaaaggcaaggugaaauaa

SEQ ID NO: 1499327 - RNA, 19 nt, Homo sapiens
cgacaaaacuuagccaaua

SEQ ID NO: 1499328 - RNA, 19 nt, Homo sapiens
agacugacauugcugcuuu

SEQ ID NO: 1499329 - RNA, 19 nt, Homo sapiens
agaaagaaaucaccauauc

SEQ ID NO: 1499330 - RNA, 19 nt, Homo sapiens
ggaagaagaggaaguagau

SEQ ID NO: 1499331 - RNA, 19 nt, Homo sapiens
gugcauuacuccaaacauu

SEQ ID NO: 1499332 - RNA, 19 nt, Homo sapiens
caaccucaguccagacaaa

SEQ ID NO: 1499333 - RNA, 19 nt, Homo sapiens
gagaauaucaguaugaagu

SEQ ID NO: 1499334 - RNA, 19 nt, Homo sapiens
cagcaaaacugcagcauuu

SEQ ID NO: 1499335 - RNA, 19 nt, Homo sapiens
gcaaccacuuucagcguuu

SEQ ID NO: 1499336 - RNA, 19 nt, Homo sapiens
acgcauggguccuacaaua

SEQ ID NO: 1499337 - RNA, 19 nt, Homo sapiens
ugaaaggcaaggugaaaua

SEQ ID NO: 1499338 - RNA, 19 nt, Homo sapiens
ccacagagggucauauuuc

SEQ ID NO: 1499339 - RNA, 19 nt, Homo sapiens
gaggaaauguuuagaucca

SEQ ID NO: 1499340 - RNA, 19 nt, Homo sapiens
gcauggguccuacaauaaa

SEQ ID NO: 1499341 - RNA, 19 nt, Homo sapiens
gaaaugggagcaaguaaac

SEQ ID NO: 1499342 - RNA, 19 nt, Homo sapiens
gagaaugcauccuauaucc

SEQ ID NO: 1499343 - RNA, 19 nt, Homo sapiens
gagaaagaaaucaccauau

SEQ ID NO: 1499344 - RNA, 19 nt, Homo sapiens
caauaucacacuacagaaa

SEQ ID NO: 1499345 - RNA, 19 nt, Homo sapiens
ugaagaagccucauuuuaa

SEQ ID NO: 1499346 - RNA, 19 nt, Homo sapiens
gaaacucagccucuugguu

SEQ ID NO: 1499347 - RNA, 19 nt, Homo sapiens
cagcguuucugcaaagcua

SEQ ID NO: 1499348 - RNA, 19 nt, Homo sapiens
agaaggagauagucuuaca

SEQ ID NO: 1499349 - RNA, 19 nt, Homo sapiens
aagugaagcuuuaacugaa

SEQ ID NO: 1499350 - RNA, 19 nt, Homo sapiens
caugacaccuacagcagaa

SEQ ID NO: 1499351 - RNA, 19 nt, Homo sapiens
ggacaaagaccccugaaga

SEQ ID NO: 1499352 - RNA, 19 nt, Homo sapiens
gagagagaggaaauguuua

SEQ ID NO: 1499353 - RNA, 19 nt, Homo sapiens
ggagaaugcauccuauauc

SEQ ID NO: 1499354 - RNA, 19 nt, Homo sapiens
uggaggaggugacuguuau

SEQ ID NO: 1499355 - RNA, 19 nt, Homo sapiens
cauccaccauccuuuaguu

SEQ ID NO: 1499356 - RNA, 19 nt, Homo sapiens
accaacagcugccagugua

SEQ ID NO: 1499357 - RNA, 19 nt, Homo sapiens
acucaaguacuccauguua

SEQ ID NO: 1499358 - RNA, 19 nt, Homo sapiens
caaauauacgucaacauca

SEQ ID NO: 1499359 - RNA, 19 nt, Homo sapiens
acaaauauacgucaacauc

SEQ ID NO: 1499360 - RNA, 19 nt, Homo sapiens
agagaaagaaaucaccaua

SEQ ID NO: 1499361 - RNA, 19 nt, Homo sapiens
gaaaccaaagacugacauu

SEQ ID NO: 1499362 - RNA, 19 nt, Homo sapiens
ccaccauccuuuaguuuua

SEQ ID NO: 1499363 - RNA, 19 nt, Homo sapiens
ggauagccaaagaugauaa

SEQ ID NO: 1499364 - RNA, 19 nt, Homo sapiens
gaguuugugugcuuacuag

SEQ ID NO: 1499365 - RNA, 19 nt, Homo sapiens
gcaauaaaggagauguguu

SEQ ID NO: 1499366 - RNA, 19 nt, Homo sapiens
cacagcaaaccucgaaaua

SEQ ID NO: 1499367 - RNA, 19 nt, Homo sapiens
gcaaaccucgaaauaucaa

SEQ ID NO: 1499368 - RNA, 19 nt, Homo sapiens
cauguuauguaguggauag

SEQ ID NO: 1499369 - RNA, 19 nt, Homo sapiens
gagaugcugucaggacugu

SEQ ID NO: 1499370 - RNA, 19 nt, Homo sapiens
cauccuauauccacguuca

SEQ ID NO: 1499371 - RNA, 19 nt, Homo sapiens
ugacauugcugcuuuugaa

SEQ ID NO: 1499372 - RNA, 19 nt, Homo sapiens
uguaguggauagccaaaga

SEQ ID NO: 1499373 - RNA, 19 nt, Homo sapiens
gugaagaagccucauuuua

SEQ ID NO: 1499374 - RNA, 19 nt, Homo sapiens
aaagagcaauaaaggagau

SEQ ID NO: 1499375 - RNA, 19 nt, Homo sapiens
aaagaccccugaagaaauu

SEQ ID NO: 1499376 - RNA, 19 nt, Homo sapiens
gaucagcuguaucuuuuau

SEQ ID NO: 1499377 - RNA, 19 nt, Homo sapiens
aaaauaagaugcaggaagu

SEQ ID NO: 1499378 - RNA, 19 nt, Homo sapiens
ccagacaaauauacgucaa

SEQ ID NO: 1499379 - RNA, 19 nt, Homo sapiens
cagagggucauauuucuug

SEQ ID NO: 1499380 - RNA, 19 nt, Homo sapiens
ucauacuccuccagauauu

SEQ ID NO: 1499381 - RNA, 19 nt, Homo sapiens
caacagcugccaguguauu

SEQ ID NO: 1499382 - RNA, 19 nt, Homo sapiens
gauagccaaagaugauaaa

SEQ ID NO: 1499383 - RNA, 19 nt, Homo sapiens
agaaaugggagcaaguaaa

SEQ ID NO: 1499384 - RNA, 19 nt, Homo sapiens
agacaaauauacgucaaca

SEQ ID NO: 1499385 - RNA, 19 nt, Homo sapiens
ucaggacugucgcguugaa

SEQ ID NO: 1499386 - RNA, 19 nt, Homo sapiens
gaaccacagaacuuuccua

SEQ ID NO: 1499387 - RNA, 19 nt, Homo sapiens
gugaagcuuuaacugaaga

SEQ ID NO: 1499388 - RNA, 19 nt, Homo sapiens
uagauccacuuugcagauu

SEQ ID NO: 1499389 - RNA, 19 nt, Homo sapiens
gacaaaacuuagccaauau

SEQ ID NO: 1499390 - RNA, 19 nt, Homo sapiens
ugaggaagaagaggaagua

SEQ ID NO: 1499391 - RNA, 19 nt, Homo sapiens
uuauguaggucuggaauuc

SEQ ID NO: 1499392 - RNA, 19 nt, Homo sapiens
gcggagaaugcauccuaua

SEQ ID NO: 1499393 - RNA, 19 nt, Homo sapiens
uggagucgaugaaagugaa

SEQ ID NO: 1499394 - RNA, 19 nt, Homo sapiens
gcaauaucacacuacagaa

SEQ ID NO: 1499395 - RNA, 19 nt, Homo sapiens
ucaaguacuccauguuaug

SEQ ID NO: 1499396 - RNA, 19 nt, Homo sapiens
aagaagaggaaguagauga

SEQ ID NO: 1499397 - RNA, 19 nt, Homo sapiens
ccaccaaguagcaauauca

SEQ ID NO: 1499398 - RNA, 19 nt, Homo sapiens
cucgaaauaucaauggauu

SEQ ID NO: 1499399 - RNA, 19 nt, Homo sapiens
guggauagccaaagaugau

SEQ ID NO: 1499400 - RNA, 19 nt, Homo sapiens
cagugaagaagccucauuu

SEQ ID NO: 1499401 - RNA, 19 nt, Homo sapiens
cacagagggucauauuucu

SEQ ID NO: 1499402 - RNA, 19 nt, Homo sapiens
ucuaguuuauggacaaaga

SEQ ID NO: 1499403 - RNA, 19 nt, Homo sapiens
gcuucuaguuuauggacaa

SEQ ID NO: 1499404 - RNA, 19 nt, Homo sapiens
gugugaagaucagcuguau

SEQ ID NO: 1499405 - RNA, 19 nt, Homo sapiens
ccagagccaagaagaaaug

SEQ ID NO: 1499406 - RNA, 19 nt, Homo sapiens
agcuuuaacugaagagaaa

SEQ ID NO: 1499407 - RNA, 19 nt, Homo sapiens
gagucaagaaccucugaaa

SEQ ID NO: 1499408 - RNA, 19 nt, Homo sapiens
acagaaagaaauucaggaa

SEQ ID NO: 1499409 - RNA, 19 nt, Homo sapiens
gcagucaacucaaccuuua

SEQ ID NO: 1499410 - RNA, 19 nt, Homo sapiens
ugaaauagcugaagugaau

SEQ ID NO: 1499411 - RNA, 19 nt, Homo sapiens
gaagguaguuggauuaaca

SEQ ID NO: 1499412 - RNA, 19 nt, Homo sapiens
ugaagaaguuggccaauuu

SEQ ID NO: 1499413 - RNA, 19 nt, Homo sapiens
caacucaaccuuuaaagua

SEQ ID NO: 1499414 - RNA, 19 nt, Homo sapiens
guaguuggauuaacagaaa

SEQ ID NO: 1499415 - RNA, 19 nt, Homo sapiens
gcagaugguuaguauuauu

SEQ ID NO: 1499416 - RNA, 19 nt, Homo sapiens
gcaauaagcagucaacuca

SEQ ID NO: 1499417 - RNA, 19 nt, Homo sapiens
aaaccuagcugaugcuuga

SEQ ID NO: 1499418 - RNA, 19 nt, Homo sapiens
gaagacaucacauuucuau

SEQ ID NO: 1499419 - RNA, 19 nt, Homo sapiens
gcaggcaaauuccacagua

SEQ ID NO: 1499420 - RNA, 19 nt, Homo sapiens
gaagacaucugagucacaa

SEQ ID NO: 1499421 - RNA, 19 nt, Homo sapiens
gaagaaacaggaugaauca

SEQ ID NO: 1499422 - RNA, 19 nt, Homo sapiens
guacagaacucacaaaaga

SEQ ID NO: 1499423 - RNA, 19 nt, Homo sapiens
gaaggaacaagacaaguuu

SEQ ID NO: 1499424 - RNA, 19 nt, Homo sapiens
gaagaaguuggccaauuua

SEQ ID NO: 1499425 - RNA, 19 nt, Homo sapiens
agacaaacuuggaguauau

SEQ ID NO: 1499426 - RNA, 19 nt, Homo sapiens
ggagaagauuauuuccuuu

SEQ ID NO: 1499427 - RNA, 19 nt, Homo sapiens
gagcaaguccugauuguau

SEQ ID NO: 1499428 - RNA, 19 nt, Homo sapiens
guacuaguuugguaaagaa

SEQ ID NO: 1499429 - RNA, 19 nt, Homo sapiens
guacuuacauauccucaug

SEQ ID NO: 1499430 - RNA, 19 nt, Homo sapiens
gaugaaaucacaaguccua

SEQ ID NO: 1499431 - RNA, 19 nt, Homo sapiens
caagacaaguuuagagcaa

SEQ ID NO: 1499432 - RNA, 19 nt, Homo sapiens
ucuuggagauguugaaaua

SEQ ID NO: 1499433 - RNA, 19 nt, Homo sapiens
aagcagaugguuaguauua

SEQ ID NO: 1499434 - RNA, 19 nt, Homo sapiens
ggaaggaacaagacaaguu

SEQ ID NO: 1499435 - RNA, 19 nt, Homo sapiens
gaucaggauuggcuauguu

SEQ ID NO: 1499436 - RNA, 19 nt, Homo sapiens
guaacuauaucaacaacug

SEQ ID NO: 1499437 - RNA, 19 nt, Homo sapiens
acaagcagaugguuaguau

SEQ ID NO: 1499438 - RNA, 19 nt, Homo sapiens
gaaugccucuugguuacua

SEQ ID NO: 1499439 - RNA, 19 nt, Homo sapiens
caauugacuucuaaagcua

SEQ ID NO: 1499440 - RNA, 19 nt, Homo sapiens
gaagagcacgugcaauugu

SEQ ID NO: 1499441 - RNA, 19 nt, Homo sapiens
gacaucacauuucuauaug

SEQ ID NO: 1499442 - RNA, 19 nt, Homo sapiens
gaucauauucuccagcaaa

SEQ ID NO: 1499443 - RNA, 19 nt, Homo sapiens
uuacauauccucaugagaa

SEQ ID NO: 1499444 - RNA, 19 nt, Homo sapiens
gaaaucccaccaaccguuu

SEQ ID NO: 1499445 - RNA, 19 nt, Homo sapiens
acaaagaaauggcaauugg

SEQ ID NO: 1499446 - RNA, 19 nt, Homo sapiens
gaacaagacaaguuuagag

SEQ ID NO: 1499447 - RNA, 19 nt, Homo sapiens
caaauuaucagguggaaca

SEQ ID NO: 1499448 - RNA, 19 nt, Homo sapiens
gcaauuggagaucauauuc

SEQ ID NO: 1499449 - RNA, 19 nt, Homo sapiens
gaagacaaacuuggaguau

SEQ ID NO: 1499450 - RNA, 19 nt, Homo sapiens
gcaucaaccuccaucagau

SEQ ID NO: 1499451 - RNA, 19 nt, Homo sapiens
caggaugaaucacccauga

SEQ ID NO: 1499452 - RNA, 19 nt, Homo sapiens
aagaagagcacgugcaauu

SEQ ID NO: 1499453 - RNA, 19 nt, Homo sapiens
gaaaacaagcagaugguua

SEQ ID NO: 1499454 - RNA, 19 nt, Homo sapiens
cagcuacaauaacuaaaga

SEQ ID NO: 1499455 - RNA, 19 nt, Homo sapiens
gcaucuacagcuacaauaa

SEQ ID NO: 1499456 - RNA, 19 nt, Homo sapiens
aguaguaucuccaacauuc

SEQ ID NO: 1499457 - RNA, 19 nt, Homo sapiens
uggagaagauuauuuccuu

SEQ ID NO: 1499458 - RNA, 19 nt, Homo sapiens
gguacuaguuugguaaaga

SEQ ID NO: 1499459 - RNA, 19 nt, Homo sapiens
gcaaguccugauuguauaa

SEQ ID NO: 1499460 - RNA, 19 nt, Homo sapiens
gagcacgugcaauuguuua

SEQ ID NO: 1499461 - RNA, 19 nt, Homo sapiens
guauaacaauccugugcaa

SEQ ID NO: 1499462 - RNA, 19 nt, Homo sapiens
aagcucaaguucuucuuaa

SEQ ID NO: 1499463 - RNA, 19 nt, Homo sapiens
caagcucaaguucuucuua

SEQ ID NO: 1499464 - RNA, 19 nt, Homo sapiens
aaaauuagaugcugacguu

SEQ ID NO: 1499465 - RNA, 19 nt, Homo sapiens
caauuuaccuccaguucuc

SEQ ID NO: 1499466 - RNA, 19 nt, Homo sapiens
ggauggagaagauuauuuc

SEQ ID NO: 1499467 - RNA, 19 nt, Homo sapiens
guggaaugccucuugguua

SEQ ID NO: 1499468 - RNA, 19 nt, Homo sapiens
aagacaaacuuggaguaua

SEQ ID NO: 1499469 - RNA, 19 nt, Homo sapiens
caucacauuucuauaugga

SEQ ID NO: 1499470 - RNA, 19 nt, Homo sapiens
gaucaaccuaagaaagaua

SEQ ID NO: 1499471 - RNA, 19 nt, Homo sapiens
gucaagccauugcguggua

SEQ ID NO: 1499472 - RNA, 19 nt, Homo sapiens
gugcaauuguuuaaccauu

SEQ ID NO: 1499473 - RNA, 19 nt, Homo sapiens
gcuauuugccuuagauuuc

SEQ ID NO: 1499474 - RNA, 19 nt, Homo sapiens
cuacagcuacaauaacuaa

SEQ ID NO: 1499475 - RNA, 19 nt, Homo sapiens
ccauugucaucuucaaauu

SEQ ID NO: 1499476 - RNA, 19 nt, Homo sapiens
gcuugaagguaguuggauu

SEQ ID NO: 1499477 - RNA, 19 nt, Homo sapiens
augcugacguugaauuuaa

SEQ ID NO: 1499478 - RNA, 19 nt, Homo sapiens
caggcaaauuccacaguaa

SEQ ID NO: 1499479 - RNA, 19 nt, Homo sapiens
gcuggaggcagauuggaua

SEQ ID NO: 1499480 - RNA, 19 nt, Homo sapiens
uuacagcacacucaaacua

SEQ ID NO: 1499481 - RNA, 19 nt, Homo sapiens
cgaagaaacaggaugaauc

SEQ ID NO: 1499482 - RNA, 19 nt, Homo sapiens
gagaagauuauuuccuuuc

SEQ ID NO: 1499483 - RNA, 19 nt, Homo sapiens
acaauugacuucuaaagcu

SEQ ID NO: 1499484 - RNA, 19 nt, Homo sapiens
cauccuuacuguccucuga

SEQ ID NO: 1499485 - RNA, 19 nt, Homo sapiens
ggaacaagacaaguuuaga

SEQ ID NO: 1499486 - RNA, 19 nt, Homo sapiens
gacguugaauuuaacagau

SEQ ID NO: 1499487 - RNA, 19 nt, Homo sapiens
gaugcugacguugaauuua

SEQ ID NO: 1499488 - RNA, 19 nt, Homo sapiens
uagcugaagugaaugucaa

SEQ ID NO: 1499489 - RNA, 19 nt, Homo sapiens
gaaacuuacagcacacuca

SEQ ID NO: 1499490 - RNA, 19 nt, Homo sapiens
aucaacaacuggacaauug

SEQ ID NO: 1499491 - RNA, 19 nt, Homo sapiens
aagaucaaccuaagaaaga

SEQ ID NO: 1499492 - RNA, 19 nt, Homo sapiens
caagaucaaccuaagaaag

SEQ ID NO: 1499493 - RNA, 19 nt, Homo sapiens
ggacaauugacuucuaaag

SEQ ID NO: 1499494 - RNA, 19 nt, Homo sapiens
ggaguauauucuuuaguac

SEQ ID NO: 1499495 - RNA, 19 nt, Homo sapiens
uuguauugcuguagaauug

SEQ ID NO: 1499496 - RNA, 19 nt, Homo sapiens
caaccucccugcuauucca

SEQ ID NO: 1499497 - RNA, 19 nt, Homo sapiens
uaacucuucccuugacaaa

SEQ ID NO: 1499498 - RNA, 19 nt, Homo sapiens
gggauggagaagauuauuu

SEQ ID NO: 1499499 - RNA, 19 nt, Homo sapiens
caacuggacaauugacuuc

SEQ ID NO: 1499500 - RNA, 19 nt, Homo sapiens
gaaaucacaaguccuacca

SEQ ID NO: 1499501 - RNA, 19 nt, Homo sapiens
aaagaagacaucugaguca

SEQ ID NO: 1499502 - RNA, 19 nt, Homo sapiens
ugacaaagaaauggcaauu

SEQ ID NO: 1499503 - RNA, 19 nt, Homo sapiens
gaaguuggccaauuuaccu

SEQ ID NO: 1499504 - RNA, 19 nt, Homo sapiens
ccucagauuaguagaguaa

SEQ ID NO: 1499505 - RNA, 19 nt, Homo sapiens
cauauccucaugagaauug

SEQ ID NO: 1499506 - RNA, 19 nt, Homo sapiens
ggaggcagauuggauagac

SEQ ID NO: 1499507 - RNA, 19 nt, Homo sapiens
agcaaguccugauuguaua

SEQ ID NO: 1499508 - RNA, 19 nt, Homo sapiens
uagagcaaguccugauugu

SEQ ID NO: 1499509 - RNA, 19 nt, Homo sapiens
ggcaaugucuguacuaaua

SEQ ID NO: 1499510 - RNA, 19 nt, Homo sapiens
gaagggcaaugaaaccaua

SEQ ID NO: 1499511 - RNA, 19 nt, Homo sapiens
ggacacaaacggacaauaa

SEQ ID NO: 1499512 - RNA, 19 nt, Homo sapiens
cgauacaacuccuaugaua

SEQ ID NO: 1499513 - RNA, 19 nt, Homo sapiens
ugaaagacuuggucaauga

SEQ ID NO: 1499514 - RNA, 19 nt, Homo sapiens
ugaguugccugaagaauuu

SEQ ID NO: 1499515 - RNA, 19 nt, Homo sapiens
ccagcaaacugaagaauau

SEQ ID NO: 1499516 - RNA, 19 nt, Homo sapiens
ggaggucacugaaauuuua

SEQ ID NO: 1499517 - RNA, 19 nt, Homo sapiens
gcaaauccuucucuacuca

SEQ ID NO: 1499518 - RNA, 19 nt, Homo sapiens
gaacagaugcagaacuuug

SEQ ID NO: 1499519 - RNA, 19 nt, Homo sapiens
gcacaacgcugagcauuac

SEQ ID NO: 1499520 - RNA, 19 nt, Homo sapiens
caaauaaaccagcucauug

SEQ ID NO: 1499521 - RNA, 19 nt, Homo sapiens
gggaacagaugcagaacuu

SEQ ID NO: 1499522 - RNA, 19 nt, Homo sapiens
gcaaauaaaccagcucauu

SEQ ID NO: 1499523 - RNA, 19 nt, Homo sapiens
gaaggcaucaccacacuuu

SEQ ID NO: 1499524 - RNA, 19 nt, Homo sapiens
ccaaaguucucgcccacua

SEQ ID NO: 1499525 - RNA, 19 nt, Homo sapiens
ggagauacaacuucccuuu

SEQ ID NO: 1499526 - RNA, 19 nt, Homo sapiens
ccacuauccucagaauaua

SEQ ID NO: 1499527 - RNA, 19 nt, Homo sapiens
gagaguaccagcaaacuga

SEQ ID NO: 1499528 - RNA, 19 nt, Homo sapiens
ucaagaggcuaauuugugu

SEQ ID NO: 1499529 - RNA, 19 nt, Homo sapiens
gcagagacacccuguaugu

SEQ ID NO: 1499530 - RNA, 19 nt, Homo sapiens
gcagacacuuuaccagaug

SEQ ID NO: 1499531 - RNA, 19 nt, Homo sapiens
ccagggaggucacugaaau

SEQ ID NO: 1499532 - RNA, 19 nt, Homo sapiens
acacagauguuugcagauu

SEQ ID NO: 1499533 - RNA, 19 nt, Homo sapiens
gaaauuccuuauccagcuu

SEQ ID NO: 1499534 - RNA, 19 nt, Homo sapiens
aagcaaaucugcacagcaa

SEQ ID NO: 1499535 - RNA, 19 nt, Homo sapiens
cauuugagcuccugggauu

SEQ ID NO: 1499536 - RNA, 19 nt, Homo sapiens
gcacagcaaugcagacacu

SEQ ID NO: 1499537 - RNA, 19 nt, Homo sapiens
ugaagaauuuccacaguuc

SEQ ID NO: 1499538 - RNA, 19 nt, Homo sapiens
gcaagaaauuccuuaucca

SEQ ID NO: 1499539 - RNA, 19 nt, Homo sapiens
uuacgaagcauuugucauu

SEQ ID NO: 1499540 - RNA, 19 nt, Homo sapiens
ccaccacccuugccacuug

SEQ ID NO: 1499541 - RNA, 19 nt, Homo sapiens
gagacacccuguauguuuc

SEQ ID NO: 1499542 - RNA, 19 nt, Homo sapiens
uaaaccagcucauugaacu

SEQ ID NO: 1499543 - RNA, 19 nt, Homo sapiens
cacagauguuugcagauua

SEQ ID NO: 1499544 - RNA, 19 nt, Homo sapiens
ggacuaccagcucaaugua

SEQ ID NO: 1499545 - RNA, 19 nt, Homo sapiens
cugcuucucugcuacauuu

SEQ ID NO: 1499546 - RNA, 19 nt, Homo sapiens
cagcaaugcagacacuuua

SEQ ID NO: 1499547 - RNA, 19 nt, Homo sapiens
gaacggcaaugucuguacu

SEQ ID NO: 1499548 - RNA, 19 nt, Homo sapiens
gaucacaccguuaccauuc

SEQ ID NO: 1499549 - RNA, 19 nt, Homo sapiens
gcaaugucuguacuaauaa

SEQ ID NO: 1499550 - RNA, 19 nt, Homo sapiens
ugaaagcuauauccacaau

SEQ ID NO: 1499551 - RNA, 19 nt, Homo sapiens
agagacacccuguauguuu

SEQ ID NO: 1499552 - RNA, 19 nt, Homo sapiens
aaauaaaccagcucauuga

SEQ ID NO: 1499553 - RNA, 19 nt, Homo sapiens
guguuuaccuguguucuuu

SEQ ID NO: 1499554 - RNA, 19 nt, Homo sapiens
gcaaaucugcacagcaaug

SEQ ID NO: 1499555 - RNA, 19 nt, Homo sapiens
ugaugggccuucagucaaa

SEQ ID NO: 1499556 - RNA, 19 nt, Homo sapiens
uccgagaggucuuugcuaa

SEQ ID NO: 1499557 - RNA, 19 nt, Homo sapiens
caucagcauguaugaguua

SEQ ID NO: 1499558 - RNA, 19 nt, Homo sapiens
ugagguucuuguucaauuu

SEQ ID NO: 1499559 - RNA, 19 nt, Homo sapiens
gacacaaacggacaauaaa

SEQ ID NO: 1499560 - RNA, 19 nt, Homo sapiens
gcagugagaguaccagcaa

SEQ ID NO: 1499561 - RNA, 19 nt, Homo sapiens
gaaagcuauauccacaaua

SEQ ID NO: 1499562 - RNA, 19 nt, Homo sapiens
gcuuacccauauauuauug

SEQ ID NO: 1499563 - RNA, 19 nt, Homo sapiens
gguuauuaguggcuuuauu

SEQ ID NO: 1499564 - RNA, 19 nt, Homo sapiens
ucucugagguucuuguuca

SEQ ID NO: 1499565 - RNA, 19 nt, Homo sapiens
gauacaacuccuaugauau

SEQ ID NO: 1499566 - RNA, 19 nt, Homo sapiens
gaauaugguucugaaagac

SEQ ID NO: 1499567 - RNA, 19 nt, Homo sapiens
aagaugcggugaacauguu

SEQ ID NO: 1499568 - RNA, 19 nt, Homo sapiens
gaaccauaguuuuccuuuu

SEQ ID NO: 1499569 - RNA, 19 nt, Homo sapiens
cugaagaauuuccacaguu

SEQ ID NO: 1499570 - RNA, 19 nt, Homo sapiens
gaacauucaaauccaaagu

SEQ ID NO: 1499571 - RNA, 19 nt, Homo sapiens
ccaguuucacucauuuaua

SEQ ID NO: 1499572 - RNA, 19 nt, Homo sapiens
aacuagaacuuccucaaga

SEQ ID NO: 1499573 - RNA, 19 nt, Homo sapiens
ccuaugauauuagcagaga

SEQ ID NO: 1499574 - RNA, 19 nt, Homo sapiens
gauguuugcagauuacgaa

SEQ ID NO: 1499575 - RNA, 19 nt, Homo sapiens
gaaaagaacauucaaaucc

SEQ ID NO: 1499576 - RNA, 19 nt, Homo sapiens
gcuccugucccuuaucuga

SEQ ID NO: 1499577 - RNA, 19 nt, Homo sapiens
uagcagagacacccuguau

SEQ ID NO: 1499578 - RNA, 19 nt, Homo sapiens
cugagguucuuguucaauu

SEQ ID NO: 1499579 - RNA, 19 nt, Homo sapiens
ccaagaacucucugagguu

SEQ ID NO: 1499580 - RNA, 19 nt, Homo sapiens
cacaaacggacaauaaaga

SEQ ID NO: 1499581 - RNA, 19 nt, Homo sapiens
caacuucccuuuugaaacu

SEQ ID NO: 1499582 - RNA, 19 nt, Homo sapiens
gaugaaggagauacaacuu

SEQ ID NO: 1499583 - RNA, 19 nt, Homo sapiens
uuauugaguugccugaaga

SEQ ID NO: 1499584 - RNA, 19 nt, Homo sapiens
gagcauuacagcagugugu

SEQ ID NO: 1499585 - RNA, 19 nt, Homo sapiens
gggacuaccagcucaaugu

SEQ ID NO: 1499586 - RNA, 19 nt, Homo sapiens
cagcauguaugaguuacug

SEQ ID NO: 1499587 - RNA, 19 nt, Homo sapiens
caacuccuaugauauuagc

SEQ ID NO: 1499588 - RNA, 19 nt, Homo sapiens
gcauguaugaguuacugaa

SEQ ID NO: 1499589 - RNA, 19 nt, Homo sapiens
cugaaagacuuggucaaug

SEQ ID NO: 1499590 - RNA, 19 nt, Homo sapiens
ggacauugacaaccauuuu

SEQ ID NO: 1499591 - RNA, 19 nt, Homo sapiens
acaaggcuguuaccucaca

SEQ ID NO: 1499592 - RNA, 19 nt, Homo sapiens
gauacaacuucccuuuuga

SEQ ID NO: 1499593 - RNA, 19 nt, Homo sapiens
aggcagaacuaagggacua

SEQ ID NO: 1499594 - RNA, 19 nt, Homo sapiens
uuacugaagggcaaugaaa

SEQ ID NO: 1499595 - RNA, 19 nt, Homo sapiens
guacuaauaacaucagcau

SEQ ID NO: 1499596 - RNA, 19 nt, Homo sapiens
caagaugcggugaacaugu

SEQ ID NO: 1499597 - RNA, 19 nt, Homo sapiens
uaaacuagaacuuccucaa

SEQ ID NO: 1499598 - RNA, 19 nt, Homo sapiens
acauucaaauccaaaguuc

SEQ ID NO: 1499599 - RNA, 19 nt, Homo sapiens
cuacauugcagugagagua

SEQ ID NO: 1499600 - RNA, 19 nt, Homo sapiens
gagggcagccuacauugca

SEQ ID NO: 1499601 - RNA, 19 nt, Homo sapiens
ccugaugacuguggcagaa

SEQ ID NO: 1499602 - RNA, 19 nt, Homo sapiens
agacaaggauuuaaaacug

SEQ ID NO: 1499603 - RNA, 19 nt, Homo sapiens
cccacuauccucagaauau

SEQ ID NO: 1499604 - RNA, 19 nt, Homo sapiens
ucaauggcaacauguuuau

SEQ ID NO: 1499605 - RNA, 19 nt, Homo sapiens
cagaaggcaucaccacacu

SEQ ID NO: 1499606 - RNA, 19 nt, Homo sapiens
ugaagaggcagaacuaagg

SEQ ID NO: 1499607 - RNA, 19 nt, Homo sapiens
aaagaacggcaaugucugu

SEQ ID NO: 1499608 - RNA, 19 nt, Homo sapiens
ccugaagaauuuccacagu

SEQ ID NO: 1499609 - RNA, 19 nt, Homo sapiens
gcucaugccuuauuuggua

SEQ ID NO: 1499610 - RNA, 19 nt, Homo sapiens
gaacaguccucuucauugu

SEQ ID NO: 1499611 - RNA, 19 nt, Homo sapiens
gaauugaacucagaucaga

SEQ ID NO: 1499612 - RNA, 19 nt, Homo sapiens
gcacucagcguauuuggua

SEQ ID NO: 1499613 - RNA, 19 nt, Homo sapiens
gaacugauaauccugcuuu

SEQ ID NO: 1499614 - RNA, 19 nt, Homo sapiens
gaagaugguggaacugaua

SEQ ID NO: 1499615 - RNA, 19 nt, Homo sapiens
aaucaaaccuuacuucaga

SEQ ID NO: 1499616 - RNA, 19 nt, Homo sapiens
ggagggaccuucacaugga

SEQ ID NO: 1499617 - RNA, 19 nt, Homo sapiens
cagaccagcucaugccuua

SEQ ID NO: 1499618 - RNA, 19 nt, Homo sapiens
gcagagauauauuucuugu

SEQ ID NO: 1499619 - RNA, 19 nt, Homo sapiens
ggacuaucuucauuuacua

SEQ ID NO: 1499620 - RNA, 19 nt, Homo sapiens
ucaaauauauccuccacuu

SEQ ID NO: 1499621 - RNA, 19 nt, Homo sapiens
ucaaaggacuccacugaug

SEQ ID NO: 1499622 - RNA, 19 nt, Homo sapiens
ggaauuggagcucaaauau

SEQ ID NO: 1499623 - RNA, 19 nt, Homo sapiens
gaauuggagcucaaauaua

SEQ ID NO: 1499624 - RNA, 19 nt, Homo sapiens
acaguguccuccaguauua

SEQ ID NO: 1499625 - RNA, 19 nt, Homo sapiens
cuacauagaugcugaaagg

SEQ ID NO: 1499626 - RNA, 19 nt, Homo sapiens
caaugggacucguuuguga

SEQ ID NO: 1499627 - RNA, 19 nt, Homo sapiens
ggauaacugguauucuuua

SEQ ID NO: 1499628 - RNA, 19 nt, Homo sapiens
gugcagagauauauuucuu

SEQ ID NO: 1499629 - RNA, 19 nt, Homo sapiens
gguggaagauuaaauuucu

SEQ ID NO: 1499630 - RNA, 19 nt, Homo sapiens
gguggaaucagcacuauuu

SEQ ID NO: 1499631 - RNA, 19 nt, Homo sapiens
ggaacaguccucuucauug

SEQ ID NO: 1499632 - RNA, 19 nt, Homo sapiens
ccagauauauacuaaccaa

SEQ ID NO: 1499633 - RNA, 19 nt, Homo sapiens
ucagaucgcucucagaaag

SEQ ID NO: 1499634 - RNA, 19 nt, Homo sapiens
gcuaauacacgcauaugaa

SEQ ID NO: 1499635 - RNA, 19 nt, Homo sapiens
gaaugagugugguguaugg

SEQ ID NO: 1499636 - RNA, 19 nt, Homo sapiens
uguggaagaucuaaucaaa

SEQ ID NO: 1499637 - RNA, 19 nt, Homo sapiens
cgaugaagcuauaauugug

SEQ ID NO: 1499638 - RNA, 19 nt, Homo sapiens
gggauaagguuuuguuaaa

SEQ ID NO: 1499639 - RNA, 19 nt, Homo sapiens
agacacaccuucuggacaa

SEQ ID NO: 1499640 - RNA, 19 nt, Homo sapiens
ucuggacuaucuucauuua

SEQ ID NO: 1499641 - RNA, 19 nt, Homo sapiens
gaacuuagaccccagauau

SEQ ID NO: 1499642 - RNA, 19 nt, Homo sapiens
gcaagauuauccaggacuu

SEQ ID NO: 1499643 - RNA, 19 nt, Homo sapiens
gaugguggaagauuaaauu

SEQ ID NO: 1499644 - RNA, 19 nt, Homo sapiens
ggaaucagcacuauuuuaa

SEQ ID NO: 1499645 - RNA, 19 nt, Homo sapiens
gaucaugguggcuggauuu

SEQ ID NO: 1499646 - RNA, 19 nt, Homo sapiens
gagagaacauugccauugc

SEQ ID NO: 1499647 - RNA, 19 nt, Homo sapiens
cuaugaugguggaagauua

SEQ ID NO: 1499648 - RNA, 19 nt, Homo sapiens
uaucauaucuguacuucag

SEQ ID NO: 1499649 - RNA, 19 nt, Homo sapiens
gcaccuacaaugagacaaa

SEQ ID NO: 1499650 - RNA, 19 nt, Homo sapiens
gaagaucuaaucaaaccuu

SEQ ID NO: 1499651 - RNA, 19 nt, Homo sapiens
cuacgaguauuuagaacuu

SEQ ID NO: 1499652 - RNA, 19 nt, Homo sapiens
uugugaagcugcucugaua

SEQ ID NO: 1499653 - RNA, 19 nt, Homo sapiens
caaauguguucgucucugu

SEQ ID NO: 1499654 - RNA, 19 nt, Homo sapiens
ggaagaugguggaacugau

SEQ ID NO: 1499655 - RNA, 19 nt, Homo sapiens
gaagaaaacagaacuuaga

SEQ ID NO: 1499656 - RNA, 19 nt, Homo sapiens
caacucaauuggagcacuu

SEQ ID NO: 1499657 - RNA, 19 nt, Homo sapiens
cagcguauuugguaugguu

SEQ ID NO: 1499658 - RNA, 19 nt, Homo sapiens
uggacauucugcaagauua

SEQ ID NO: 1499659 - RNA, 19 nt, Homo sapiens
guucaaaggacuccacuga

SEQ ID NO: 1499660 - RNA, 19 nt, Homo sapiens
aaucccaggugcagagaua

SEQ ID NO: 1499661 - RNA, 19 nt, Homo sapiens
caucuacggugucaaccaa

SEQ ID NO: 1499662 - RNA, 19 nt, Homo sapiens
guaacagcaccuacaauga

SEQ ID NO: 1499663 - RNA, 19 nt, Homo sapiens
gcacaguguccuccaguau

SEQ ID NO: 1499664 - RNA, 19 nt, Homo sapiens
cacaccuucuggacaauua

SEQ ID NO: 1499665 - RNA, 19 nt, Homo sapiens
aaaggucucugucuuggau

SEQ ID NO: 1499666 - RNA, 19 nt, Homo sapiens
gaccagcucaugccuuauu

SEQ ID NO: 1499667 - RNA, 19 nt, Homo sapiens
ugaagcugcucugauacua

SEQ ID NO: 1499668 - RNA, 19 nt, Homo sapiens
ccagguaccaugacuguga

SEQ ID NO: 1499669 - RNA, 19 nt, Homo sapiens
gcaccuacgaguauuuaga

SEQ ID NO: 1499670 - RNA, 19 nt, Homo sapiens
gauuacaaccacagaaaug

SEQ ID NO: 1499671 - RNA, 19 nt, Homo sapiens
ggauuugccauuucucuau

SEQ ID NO: 1499672 - RNA, 19 nt, Homo sapiens
ggggauacuugucaguuua

SEQ ID NO: 1499673 - RNA, 19 nt, Homo sapiens
uaacagcaccuacaaugag

SEQ ID NO: 1499674 - RNA, 19 nt, Homo sapiens
acaauucuguauacuggaa

SEQ ID NO: 1499675 - RNA, 19 nt, Homo sapiens
gauuugccauuucucuaug

SEQ ID NO: 1499676 - RNA, 19 nt, Homo sapiens
gaugaagcuauaauuguga

SEQ ID NO: 1499677 - RNA, 19 nt, Homo sapiens
aagcugcucugauacuaga

SEQ ID NO: 1499678 - RNA, 19 nt, Homo sapiens
ucaauuggagcacuuguug

SEQ ID NO: 1499679 - RNA, 19 nt, Homo sapiens
gcgcuggcgucacuuaugg

SEQ ID NO: 1499680 - RNA, 19 nt, Homo sapiens
ggagcccuguguauuggaa

SEQ ID NO: 1499681 - RNA, 19 nt, Homo sapiens
caagguggaaucagcacua

SEQ ID NO: 1499682 - RNA, 19 nt, Homo sapiens
cacacuggguggucuuaaa

SEQ ID NO: 1499683 - RNA, 19 nt, Homo sapiens
ccucaccgcuagcuucaug

SEQ ID NO: 1499684 - RNA, 19 nt, Homo sapiens
ccucacaugcucaguguuu

SEQ ID NO: 1499685 - RNA, 19 nt, Homo sapiens
caugguggcuggauuugca

SEQ ID NO: 1499686 - RNA, 19 nt, Homo sapiens
ggacauucugcaagauuau

SEQ ID NO: 1499687 - RNA, 19 nt, Homo sapiens
acaguccucuucauuguuc

SEQ ID NO: 1499688 - RNA, 19 nt, Homo sapiens
ccuacaaugagacaaauuu

SEQ ID NO: 1499689 - RNA, 19 nt, Homo sapiens
ugagagaacauugccauug

SEQ ID NO: 1499690 - RNA, 19 nt, Homo sapiens
uuaugggccuguucgcuuu

SEQ ID NO: 1499691 - RNA, 19 nt, Homo sapiens
guauggagcccuguguauu

SEQ ID NO: 1499692 - RNA, 19 nt, Homo sapiens
caaacaauucuguauacug

SEQ ID NO: 1499693 - RNA, 19 nt, Homo sapiens
gcaaugggacucguuugug

SEQ ID NO: 1499694 - RNA, 19 nt, Homo sapiens
uggaauuggagcucaaaua

SEQ ID NO: 1499695 - RNA, 19 nt, Homo sapiens
cagcaccuacgaguauuua

SEQ ID NO: 1499696 - RNA, 19 nt, Homo sapiens
gcaaaacugucucucuaca

SEQ ID NO: 1499697 - RNA, 19 nt, Homo sapiens
ggaucaugguggcuggauu

SEQ ID NO: 1499698 - RNA, 19 nt, Homo sapiens
acauugaauugaacucaga

SEQ ID NO: 1499699 - RNA, 19 nt, Homo sapiens
auggauaacugguauucuu

SEQ ID NO: 1499700 - RNA, 19 nt, Homo sapiens
uauggagcccuguguauug

SEQ ID NO: 1499701 - RNA, 19 nt, Homo sapiens
ucacauggaccagcaucua

SEQ ID NO: 1499702 - RNA, 19 nt, Homo sapiens
cagggcagcgggucgauuu

SEQ ID NO: 1499703 - RNA, 19 nt, Homo sapiens
caggugcagagauauauuu

SEQ ID NO: 1499704 - RNA, 19 nt, Homo sapiens
caaccacauugaauugaac

SEQ ID NO: 1499705 - RNA, 19 nt, Homo sapiens
uaugaugguggaagauuaa

SEQ ID NO: 1499706 - RNA, 19 nt, Homo sapiens
ugacauuucccucucuuuc

SEQ ID NO: 1499707 - RNA, 19 nt, Homo sapiens
gaucagguuuucuuugugu

SEQ ID NO: 1499708 - RNA, 19 nt, Homo sapiens
ggaacuuugguaacauuau

SEQ ID NO: 1499709 - RNA, 19 nt, Homo sapiens
caaaguaguugaaguauug

SEQ ID NO: 1499710 - RNA, 19 nt, Homo sapiens
gagaaacgauuguuagaaa

SEQ ID NO: 1499711 - RNA, 19 nt, Homo sapiens
caacaugccugauuauaug

SEQ ID NO: 1499712 - RNA, 19 nt, Homo sapiens
gaagagauccaauauuuga

SEQ ID NO: 1499713 - RNA, 19 nt, Homo sapiens
ggacggagucucuauuuaa

SEQ ID NO: 1499714 - RNA, 19 nt, Homo sapiens
gggagacacuuuaccagua

SEQ ID NO: 1499715 - RNA, 19 nt, Homo sapiens
guaagggccuccucaagaa

SEQ ID NO: 1499716 - RNA, 19 nt, Homo sapiens
guaacaggcauuucauuua

SEQ ID NO: 1499717 - RNA, 19 nt, Homo sapiens
guacaagucuaacacaaau

SEQ ID NO: 1499718 - RNA, 19 nt, Homo sapiens
ggcaacagauggacucuuu

SEQ ID NO: 1499719 - RNA, 19 nt, Homo sapiens
gagaaccacuacuaucauu

SEQ ID NO: 1499720 - RNA, 19 nt, Homo sapiens
cagaugagcagcagcauua

SEQ ID NO: 1499721 - RNA, 19 nt, Homo sapiens
uaacauugguguauagaug

SEQ ID NO: 1499722 - RNA, 19 nt, Homo sapiens
gauacugacucccugguuu

SEQ ID NO: 1499723 - RNA, 19 nt, Homo sapiens
ccucaaagccuagaaauuu

SEQ ID NO: 1499724 - RNA, 19 nt, Homo sapiens
ggagacacuuuaccaguau

SEQ ID NO: 1499725 - RNA, 19 nt, Homo sapiens
ggagaaaucaucaugcuau

SEQ ID NO: 1499726 - RNA, 19 nt, Homo sapiens
gaaggacgguucguaccua

SEQ ID NO: 1499727 - RNA, 19 nt, Homo sapiens
caaguugacugcuguaaag

SEQ ID NO: 1499728 - RNA, 19 nt, Homo sapiens
ccacuacuaucauucacua

SEQ ID NO: 1499729 - RNA, 19 nt, Homo sapiens
ugacugcuguaaagauaua

SEQ ID NO: 1499730 - RNA, 19 nt, Homo sapiens
gaugauugguguggcuuua

SEQ ID NO: 1499731 - RNA, 19 nt, Homo sapiens
ggaauuggcuuuggaucug

SEQ ID NO: 1499732 - RNA, 19 nt, Homo sapiens
guugacugcuguaaagaua

SEQ ID NO: 1499733 - RNA, 19 nt, Homo sapiens
gggcaagaauugaguuuca

SEQ ID NO: 1499734 - RNA, 19 nt, Homo sapiens
gagaaucuacuugagaaua

SEQ ID NO: 1499735 - RNA, 19 nt, Homo sapiens
gagugcugcuuaacaagua

SEQ ID NO: 1499736 - RNA, 19 nt, Homo sapiens
guaagccguucaguaauuu

SEQ ID NO: 1499737 - RNA, 19 nt, Homo sapiens
ggaaauaauacucaagguu

SEQ ID NO: 1499738 - RNA, 19 nt, Homo sapiens
gcucuggguuauacaguuu

SEQ ID NO: 1499739 - RNA, 19 nt, Homo sapiens
caauuaaaccugaugagaa

SEQ ID NO: 1499740 - RNA, 19 nt, Homo sapiens
gugaugaucugacauuuac

SEQ ID NO: 1499741 - RNA, 19 nt, Homo sapiens
cucaaagccuagaaauuua

SEQ ID NO: 1499742 - RNA, 19 nt, Homo sapiens
caacuuauuuacucagcuu

SEQ ID NO: 1499743 - RNA, 19 nt, Homo sapiens
uguaagccguucaguaauu

SEQ ID NO: 1499744 - RNA, 19 nt, Homo sapiens
ggacgguucguaccuagua

SEQ ID NO: 1499745 - RNA, 19 nt, Homo sapiens
gagaaaucaucaugcuaug

SEQ ID NO: 1499746 - RNA, 19 nt, Homo sapiens
uaacuacccuaacuugaca

SEQ ID NO: 1499747 - RNA, 19 nt, Homo sapiens
gcauucaguuuucacauua

SEQ ID NO: 1499748 - RNA, 19 nt, Homo sapiens
guugagaucuuuguugaga

SEQ ID NO: 1499749 - RNA, 19 nt, Homo sapiens
gcaauuaaaccugaugaga

SEQ ID NO: 1499750 - RNA, 19 nt, Homo sapiens
aaacauugcucuggguuau

SEQ ID NO: 1499751 - RNA, 19 nt, Homo sapiens
cuaaagggaugguacaagu

SEQ ID NO: 1499752 - RNA, 19 nt, Homo sapiens
caacagauggacucuuuga

SEQ ID NO: 1499753 - RNA, 19 nt, Homo sapiens
cagcaaaccugggcgauuc

SEQ ID NO: 1499754 - RNA, 19 nt, Homo sapiens
cuaguugucugauagaaug

SEQ ID NO: 1499755 - RNA, 19 nt, Homo sapiens
gaaccacuacuaucauuca

SEQ ID NO: 1499756 - RNA, 19 nt, Homo sapiens
cagauggacucuuugacaa

SEQ ID NO: 1499757 - RNA, 19 nt, Homo sapiens
gagagacuauggaguugau

SEQ ID NO: 1499758 - RNA, 19 nt, Homo sapiens
gagacucguugagaucuuu

SEQ ID NO: 1499759 - RNA, 19 nt, Homo sapiens
ugaaauuccuccuaguugu

SEQ ID NO: 1499760 - RNA, 19 nt, Homo sapiens
gguguggcuuuaugucuuu

SEQ ID NO: 1499761 - RNA, 19 nt, Homo sapiens
agaaauugacgauguguuu

SEQ ID NO: 1499762 - RNA, 19 nt, Homo sapiens
gagauccaauauuugaaga

SEQ ID NO: 1499763 - RNA, 19 nt, Homo sapiens
gaugagaaucuacuugaga

SEQ ID NO: 1499764 - RNA, 19 nt, Homo sapiens
cagguaacauugguguaua

SEQ ID NO: 1499765 - RNA, 19 nt, Homo sapiens
ccacaggcauagucuuugu

SEQ ID NO: 1499766 - RNA, 19 nt, Homo sapiens
uugacaacaugccugauua

SEQ ID NO: 1499767 - RNA, 19 nt, Homo sapiens
ggucagaggcuguguugga

SEQ ID NO: 1499768 - RNA, 19 nt, Homo sapiens
ggcaggaccacauuucuuu

SEQ ID NO: 1499769 - RNA, 19 nt, Homo sapiens
ggugucaaguccugccuuu

SEQ ID NO: 1499770 - RNA, 19 nt, Homo sapiens
cagacuagcugagguguca

SEQ ID NO: 1499771 - RNA, 19 nt, Homo sapiens
gacaucaccguccuucuuu

SEQ ID NO: 1499772 - RNA, 19 nt, Homo sapiens
ccuaugacccaaauuauau

SEQ ID NO: 1499773 - RNA, 19 nt, Homo sapiens
gacaacaugccugauuaua

SEQ ID NO: 1499774 - RNA, 19 nt, Homo sapiens
guauguagccuuaugaucu

SEQ ID NO: 1499775 - RNA, 19 nt, Homo sapiens
ugcagucucuguguauuua

SEQ ID NO: 1499776 - RNA, 19 nt, Homo sapiens
uggacggagucucuauuua

SEQ ID NO: 1499777 - RNA, 19 nt, Homo sapiens
ggcauaauguuagauaauc

SEQ ID NO: 1499778 - RNA, 19 nt, Homo sapiens
agacagcuguaacuuugaa

SEQ ID NO: 1499779 - RNA, 19 nt, Homo sapiens
guaggaggcuggagagacu

SEQ ID NO: 1499780 - RNA, 19 nt, Homo sapiens
guaaugauacaucuacuag

SEQ ID NO: 1499781 - RNA, 19 nt, Homo sapiens
gguacaagucuaacacaaa

SEQ ID NO: 1499782 - RNA, 19 nt, Homo sapiens
caccguccuucuuucaaua

SEQ ID NO: 1499783 - RNA, 19 nt, Homo sapiens
gccuaugacccaaauuaua

SEQ ID NO: 1499784 - RNA, 19 nt, Homo sapiens
aagcuuccauggguuguua

SEQ ID NO: 1499785 - RNA, 19 nt, Homo sapiens
uauuaggacugacaacuuc

SEQ ID NO: 1499786 - RNA, 19 nt, Homo sapiens
gacggagucucuauuuaag

SEQ ID NO: 1499787 - RNA, 19 nt, Homo sapiens
ccuauagauuagugacaua

SEQ ID NO: 1499788 - RNA, 19 nt, Homo sapiens
gaaauugacgauguguuug

SEQ ID NO: 1499789 - RNA, 19 nt, Homo sapiens
ucugcaagcugaaacuuau

SEQ ID NO: 1499790 - RNA, 19 nt, Homo sapiens
gaguaauguugguaaagug

SEQ ID NO: 1499791 - RNA, 19 nt, Homo sapiens
gauggacucuuugacaaca

SEQ ID NO: 1499792 - RNA, 19 nt, Homo sapiens
guuuacaguuuccaaauag

SEQ ID NO: 1499793 - RNA, 19 nt, Homo sapiens
gcugaaauuccuccuaguu

SEQ ID NO: 1499794 - RNA, 19 nt, Homo sapiens
cggagucucuauuuaagga

SEQ ID NO: 1499795 - RNA, 19 nt, Homo sapiens
uuuguaagccguucaguaa

SEQ ID NO: 1499796 - RNA, 19 nt, Homo sapiens
cagcuguaacuuugaauuu

SEQ ID NO: 1499797 - RNA, 19 nt, Homo sapiens
uuacugugcuguaccacuu

SEQ ID NO: 1499798 - RNA, 19 nt, Homo sapiens
guuagaaauugacgaugug

SEQ ID NO: 1499799 - RNA, 19 nt, Homo sapiens
cguaagggccuccucaaga

SEQ ID NO: 1499800 - RNA, 19 nt, Homo sapiens
gguugcagaugguguagga

SEQ ID NO: 1499801 - RNA, 19 nt, Homo sapiens
gaugaucugacauuuacaa

SEQ ID NO: 1499802 - RNA, 19 nt, Homo sapiens
ugaguaauguugguaaagu

SEQ ID NO: 1499803 - RNA, 19 nt, Homo sapiens
cuagauuggugguguuuua

SEQ ID NO: 1499804 - RNA, 19 nt, Homo sapiens
uguaacaggcauuucauuu

SEQ ID NO: 1499805 - RNA, 19 nt, Homo sapiens
cugacucccugguuuauug

SEQ ID NO: 1499806 - RNA, 19 nt, Homo sapiens
uauagagcaugcaccaaau

SEQ ID NO: 1499807 - RNA, 19 nt, Homo sapiens
cuauagagcaugcaccaaa

SEQ ID NO: 1499808 - RNA, 19 nt, Homo sapiens
ucaauucucagggacuuua

SEQ ID NO: 1499809 - RNA, 19 nt, Homo sapiens
caacauaaccgaaagaaua

SEQ ID NO: 1499810 - RNA, 19 nt, Homo sapiens
ugagacagcuggaggauaa

SEQ ID NO: 1499811 - RNA, 19 nt, Homo sapiens
caaagaagcaugucaagaa

SEQ ID NO: 1499812 - RNA, 19 nt, Homo sapiens
gagaaacuguucaagaaga

SEQ ID NO: 1499813 - RNA, 19 nt, Homo sapiens
ucaagaagauaaacuguga

SEQ ID NO: 1499814 - RNA, 19 nt, Homo sapiens
uaaaccagcucauugaaga

SEQ ID NO: 1499815 - RNA, 19 nt, Homo sapiens
ucacggagcucaacaacga

SEQ ID NO: 1499816 - RNA, 19 nt, Homo sapiens
ccaaggaggagaagaauuu

SEQ ID NO: 1499817 - RNA, 19 nt, Homo sapiens
gaaggagauugaagaccua

SEQ ID NO: 1499818 - RNA, 19 nt, Homo sapiens
gaaggcugcuuaugacaau

SEQ ID NO: 1499819 - RNA, 19 nt, Homo sapiens
acaagaugcugaccacuaa

SEQ ID NO: 1499820 - RNA, 19 nt, Homo sapiens
ggaagaaaguaaccaugug

SEQ ID NO: 1499821 - RNA, 19 nt, Homo sapiens
gaagaaaguaaccauguga

SEQ ID NO: 1499822 - RNA, 19 nt, Homo sapiens
uggagaaacuguucaagaa

SEQ ID NO: 1499823 - RNA, 19 nt, Homo sapiens
ggagacagccugccugaga

SEQ ID NO: 1499824 - RNA, 19 nt, Homo sapiens
gaacuuggccauugagcaa

SEQ ID NO: 1499825 - RNA, 19 nt, Homo sapiens
caaccacucuguccugaga

SEQ ID NO: 1499826 - RNA, 19 nt, Homo sapiens
gauugaagaccuacgauuu

SEQ ID NO: 1499827 - RNA, 19 nt, Homo sapiens
aaacuaaggaggacuauga

SEQ ID NO: 1499828 - RNA, 19 nt, Homo sapiens
ucaagacccugaagacaga

SEQ ID NO: 1499829 - RNA, 19 nt, Homo sapiens
gcagagagacagagagaga

SEQ ID NO: 1499830 - RNA, 19 nt, Homo sapiens
gaagaacucaguggagaaa

SEQ ID NO: 1499831 - RNA, 19 nt, Homo sapiens
ggaggaggcagauauguau

SEQ ID NO: 1499832 - RNA, 19 nt, Homo sapiens
ugaaugaucgcaaugaauu

SEQ ID NO: 1499833 - RNA, 19 nt, Homo sapiens
ugaaagaccgccagaagaa

SEQ ID NO: 1499834 - RNA, 19 nt, Homo sapiens
ucucgucacuguucacuuu

SEQ ID NO: 1499835 - RNA, 19 nt, Homo sapiens
gagacagccugccugagaa

SEQ ID NO: 1499836 - RNA, 19 nt, Homo sapiens
gaggauaaacugaggaaga

SEQ ID NO: 1499837 - RNA, 19 nt, Homo sapiens
agaagcaugucaagaagaa

SEQ ID NO: 1499838 - RNA, 19 nt, Homo sapiens
gcagaaacagauucacauu

SEQ ID NO: 1499839 - RNA, 19 nt, Homo sapiens
gaaccuaaaccagcucauu

SEQ ID NO: 1499840 - RNA, 19 nt, Homo sapiens
gauuugagaaggcugcuua

SEQ ID NO: 1499841 - RNA, 19 nt, Homo sapiens
ccaacgaccugcugcuguu

SEQ ID NO: 1499842 - RNA, 19 nt, Homo sapiens
gaagaccuacgauuugaga

SEQ ID NO: 1499843 - RNA, 19 nt, Homo sapiens
gacaagaugcugaccacua

SEQ ID NO: 1499844 - RNA, 19 nt, Homo sapiens
gagaucacccuacuguuga

SEQ ID NO: 1499845 - RNA, 19 nt, Homo sapiens
caagaugucuguguugaag

SEQ ID NO: 1499846 - RNA, 19 nt, Homo sapiens
gaccuuggaucuauugaag

SEQ ID NO: 1499847 - RNA, 19 nt, Homo sapiens
gcugaaugaucgcaaugaa

SEQ ID NO: 1499848 - RNA, 19 nt, Homo sapiens
uggcugaacuggaugagaa

SEQ ID NO: 1499849 - RNA, 19 nt, Homo sapiens
ggaggacuaugaggcauug

SEQ ID NO: 1499850 - RNA, 19 nt, Homo sapiens
ccaagauccuggugcaguu

SEQ ID NO: 1499851 - RNA, 19 nt, Homo sapiens
gcuguuggcugaacuggau

SEQ ID NO: 1499852 - RNA, 19 nt, Homo sapiens
gaugagaucacccuacugu

SEQ ID NO: 1499853 - RNA, 19 nt, Homo sapiens
gcaaagaagcaugucaaga

SEQ ID NO: 1499854 - RNA, 19 nt, Homo sapiens
gaaggacaccucucaguac

SEQ ID NO: 1499855 - RNA, 19 nt, Homo sapiens
ggacuaugaggcauugauu

SEQ ID NO: 1499856 - RNA, 19 nt, Homo sapiens
ucaggaagaugguggaaag

SEQ ID NO: 1499857 - RNA, 19 nt, Homo sapiens
gcaaagugcgguuccuuca

SEQ ID NO: 1499858 - RNA, 19 nt, Homo sapiens
gggccaccuuugcaacaua

SEQ ID NO: 1499859 - RNA, 19 nt, Homo sapiens
cagguuggaugauguggaa

SEQ ID NO: 1499860 - RNA, 19 nt, Homo sapiens
cagaaacagauucacauuu

SEQ ID NO: 1499861 - RNA, 19 nt, Homo sapiens
ugagaucacccuacuguug

SEQ ID NO: 1499862 - RNA, 19 nt, Homo sapiens
acaucaaccuuccgcagua

SEQ ID NO: 1499863 - RNA, 19 nt, Homo sapiens
gaaauugucccacgaugac

SEQ ID NO: 1499864 - RNA, 19 nt, Homo sapiens
aaagaagcaugucaagaag

SEQ ID NO: 1499865 - RNA, 19 nt, Homo sapiens
ggccaccuuugcaacauaa

SEQ ID NO: 1499866 - RNA, 19 nt, Homo sapiens
gcagcugguucucgacaau

SEQ ID NO: 1499867 - RNA, 19 nt, Homo sapiens
caagaggacccaacgaauc

SEQ ID NO: 1499868 - RNA, 19 nt, Homo sapiens
ggacaccucucaguacaac

SEQ ID NO: 1499869 - RNA, 19 nt, Homo sapiens
ccaugaacuuggccauuga

SEQ ID NO: 1499870 - RNA, 19 nt, Homo sapiens
ugaacuggaugagaagauu

SEQ ID NO: 1499871 - RNA, 19 nt, Homo sapiens
ggagugagaagaacuacau

SEQ ID NO: 1499872 - RNA, 19 nt, Homo sapiens
aggaagcucucaaggcaaa

SEQ ID NO: 1499873 - RNA, 19 nt, Homo sapiens
agaaggacaccucucagua

SEQ ID NO: 1499874 - RNA, 19 nt, Homo sapiens
ugagaaggcugcuuaugac

SEQ ID NO: 1499875 - RNA, 19 nt, Homo sapiens
guuugaaucucgucacugu

SEQ ID NO: 1499876 - RNA, 19 nt, Homo sapiens
gaaacagauucacauuuug

SEQ ID NO: 1499877 - RNA, 19 nt, Homo sapiens
ccuuggaucuauugaagaa

SEQ ID NO: 1499878 - RNA, 19 nt, Homo sapiens
ccacggaggaggcagauau

SEQ ID NO: 1499879 - RNA, 19 nt, Homo sapiens
gaaacugcagaaacagauu

SEQ ID NO: 1499880 - RNA, 19 nt, Homo sapiens
gacuaugaggcauugauua

SEQ ID NO: 1499881 - RNA, 19 nt, Homo sapiens
gaaaccagcagaagauugc

SEQ ID NO: 1499882 - RNA, 19 nt, Homo sapiens
ugaaggagaaucggaguaa

SEQ ID NO: 1499883 - RNA, 19 nt, Homo sapiens
gaaacuguucaagaagaua

SEQ ID NO: 1499884 - RNA, 19 nt, Homo sapiens
gcaaucuucucaggccuau

SEQ ID NO: 1499885 - RNA, 19 nt, Homo sapiens
agacagagcaggaugagau

SEQ ID NO: 1499886 - RNA, 19 nt, Homo sapiens
uaaggcagcaguucaggaa

SEQ ID NO: 1499887 - RNA, 19 nt, Homo sapiens
aaagugcgguuccuucaag

SEQ ID NO: 1499888 - RNA, 19 nt, Homo sapiens
ggaaacugcagaaacagau

SEQ ID NO: 1499889 - RNA, 19 nt, Homo sapiens
acauggagaugaugcacaa

SEQ ID NO: 1499890 - RNA, 19 nt, Homo sapiens
gcugagagugggaaccuaa

SEQ ID NO: 1499891 - RNA, 19 nt, Homo sapiens
gaaggagaaucggaguaag

SEQ ID NO: 1499892 - RNA, 19 nt, Homo sapiens
gaagaaaaccaugaacuug

SEQ ID NO: 1499893 - RNA, 19 nt, Homo sapiens
gaagauugcgagucaguac

SEQ ID NO: 1499894 - RNA, 19 nt, Homo sapiens
cugagaagguggaugacuu

SEQ ID NO: 1499895 - RNA, 19 nt, Homo sapiens
ugaagaagaacaggagaaa

SEQ ID NO: 1499896 - RNA, 19 nt, Homo sapiens
caagcugaaugaucgcaau

SEQ ID NO: 1499897 - RNA, 19 nt, Homo sapiens
gaucaagacccugaagaca

SEQ ID NO: 1499898 - RNA, 19 nt, Homo sapiens
cgacaauuauauccugaag

SEQ ID NO: 1499899 - RNA, 19 nt, Homo sapiens
ccagaacccaucaaaguca

SEQ ID NO: 1499900 - RNA, 19 nt, Homo sapiens
caagauccuggugcaguua

SEQ ID NO: 1499901 - RNA, 19 nt, Homo sapiens
ggagaaacuguucaagaag

SEQ ID NO: 1499902 - RNA, 19 nt, Homo sapiens
caacaacgacauggagaug

SEQ ID NO: 1499903 - RNA, 19 nt, Homo sapiens
uugaagaccuacgauuuga

SEQ ID NO: 1499904 - RNA, 19 nt, Homo sapiens
agaugucuguguugaagaa

SEQ ID NO: 1499905 - RNA, 19 nt, Homo sapiens
gcgacagguuggaugaugu

SEQ ID NO: 1499906 - RNA, 19 nt, Homo sapiens
guggagaaacuguucaaga

SEQ ID NO: 1499907 - RNA, 19 nt, Homo sapiens
ggacgagaucauccucuug

SEQ ID NO: 1499908 - RNA, 19 nt, Homo sapiens
uugagaaggcugcuuauga

SEQ ID NO: 1499909 - RNA, 19 nt, Homo sapiens
gaaaggagauggaggauug

SEQ ID NO: 1499910 - RNA, 19 nt, Homo sapiens
ggaaaugccuuugguguaa

SEQ ID NO: 1499911 - RNA, 19 nt, Homo sapiens
ggaagaagaugcuguggaa

SEQ ID NO: 1499912 - RNA, 19 nt, Homo sapiens
ggaaggacauuauagaaga

SEQ ID NO: 1499913 - RNA, 19 nt, Homo sapiens
ugaaggcgcuguauaauga

SEQ ID NO: 1499914 - RNA, 19 nt, Homo sapiens
gaucaucacuccauucaga

SEQ ID NO: 1499915 - RNA, 19 nt, Homo sapiens
ggacagcuauugaagcaaa

SEQ ID NO: 1499916 - RNA, 19 nt, Homo sapiens
agaagcaucugaagaauuu

SEQ ID NO: 1499917 - RNA, 19 nt, Homo sapiens
gcagugagagcaacaaaua

SEQ ID NO: 1499918 - RNA, 19 nt, Homo sapiens
ggaguucgauuaucaacaa

SEQ ID NO: 1499919 - RNA, 19 nt, Homo sapiens
gaaauagccaucaauguga

SEQ ID NO: 1499920 - RNA, 19 nt, Homo sapiens
gaacucaaauugccaccaa

SEQ ID NO: 1499921 - RNA, 19 nt, Homo sapiens
caacagaagcaccguauuu

SEQ ID NO: 1499922 - RNA, 19 nt, Homo sapiens
guagauggauauucagaaa

SEQ ID NO: 1499923 - RNA, 19 nt, Homo sapiens
ggaggaagcuaaagaugau

SEQ ID NO: 1499924 - RNA, 19 nt, Homo sapiens
gaagugugauucugguaaa

SEQ ID NO: 1499925 - RNA, 19 nt, Homo sapiens
ggaguauaaugacauauga

SEQ ID NO: 1499926 - RNA, 19 nt, Homo sapiens
cagaggagcucauuacuag

SEQ ID NO: 1499927 - RNA, 19 nt, Homo sapiens
gaacuaaagaggaugauau

SEQ ID NO: 1499928 - RNA, 19 nt, Homo sapiens
uuacagagaucguacaaga

SEQ ID NO: 1499929 - RNA, 19 nt, Homo sapiens
gaauagugccaaaguuuaa

SEQ ID NO: 1499930 - RNA, 19 nt, Homo sapiens
guacauccaucacgccauu

SEQ ID NO: 1499931 - RNA, 19 nt, Homo sapiens
agaauaaucugcccagguu

SEQ ID NO: 1499932 - RNA, 19 nt, Homo sapiens
gcucagguguuugauuuaa

SEQ ID NO: 1499933 - RNA, 19 nt, Homo sapiens
gcaaaccaguucuuuccaa

SEQ ID NO: 1499934 - RNA, 19 nt, Homo sapiens
gaacaauuacuuugggauu

SEQ ID NO: 1499935 - RNA, 19 nt, Homo sapiens
agucggagguguaaucaua

SEQ ID NO: 1499936 - RNA, 19 nt, Homo sapiens
gcacuaaacagcaccgauu

SEQ ID NO: 1499937 - RNA, 19 nt, Homo sapiens
gagcaacaaauaacuguaa

SEQ ID NO: 1499938 - RNA, 19 nt, Homo sapiens
gagauuccuuggcuuuauu

SEQ ID NO: 1499939 - RNA, 19 nt, Homo sapiens
gcgaguauccaaugccuua

SEQ ID NO: 1499940 - RNA, 19 nt, Homo sapiens
gaaguugaccucucagaug

SEQ ID NO: 1499941 - RNA, 19 nt, Homo sapiens
ggaccaagaccaguauuaa

SEQ ID NO: 1499942 - RNA, 19 nt, Homo sapiens
gcagaggagcucauuacua

SEQ ID NO: 1499943 - RNA, 19 nt, Homo sapiens
uggcaaacauugauccuuu

SEQ ID NO: 1499944 - RNA, 19 nt, Homo sapiens
gaagagcgaguauccaaug

SEQ ID NO: 1499945 - RNA, 19 nt, Homo sapiens
gcaccucggucuccagaug

SEQ ID NO: 1499946 - RNA, 19 nt, Homo sapiens
uaaagaugauggugccaaa

SEQ ID NO: 1499947 - RNA, 19 nt, Homo sapiens
caaaccaguucuuuccaaa

SEQ ID NO: 1499948 - RNA, 19 nt, Homo sapiens
cgaauagugccaaaguuua

SEQ ID NO: 1499949 - RNA, 19 nt, Homo sapiens
caagagacacugccacuga

SEQ ID NO: 1499950 - RNA, 19 nt, Homo sapiens
cagaagaggugucgcagau

SEQ ID NO: 1499951 - RNA, 19 nt, Homo sapiens
ccuggaaguuguagcaaua

SEQ ID NO: 1499952 - RNA, 19 nt, Homo sapiens
gcugggaguucgauuauca

SEQ ID NO: 1499953 - RNA, 19 nt, Homo sapiens
gggcaaauaguuuaaagaa

SEQ ID NO: 1499954 - RNA, 19 nt, Homo sapiens
ggaacgagccaguaccaaa

SEQ ID NO: 1499955 - RNA, 19 nt, Homo sapiens
caacuugaauaaacagugu

SEQ ID NO: 1499956 - RNA, 19 nt, Homo sapiens
cggcucagguguuugauuu

SEQ ID NO: 1499957 - RNA, 19 nt, Homo sapiens
gaaguuguagcaauauuug

SEQ ID NO: 1499958 - RNA, 19 nt, Homo sapiens
ggaaguuguagcaauauuu

SEQ ID NO: 1499959 - RNA, 19 nt, Homo sapiens
gaaaagacguaugacaaaa

SEQ ID NO: 1499960 - RNA, 19 nt, Homo sapiens
uaucauaccuccaauugca

SEQ ID NO: 1499961 - RNA, 19 nt, Homo sapiens
gguggaguauaaugacaua

SEQ ID NO: 1499962 - RNA, 19 nt, Homo sapiens
ugaaauagccaucaaugug

SEQ ID NO: 1499963 - RNA, 19 nt, Homo sapiens
ucauuaaacugcagcauca

SEQ ID NO: 1499964 - RNA, 19 nt, Homo sapiens
gaaggacauuauagaagau

SEQ ID NO: 1499965 - RNA, 19 nt, Homo sapiens
gcacagaaacagaugaauc

SEQ ID NO: 1499966 - RNA, 19 nt, Homo sapiens
caguaaauguucaguccua

SEQ ID NO: 1499967 - RNA, 19 nt, Homo sapiens
cauccaauauguccacuug

SEQ ID NO: 1499968 - RNA, 19 nt, Homo sapiens
ggacuacccuggccuccau

SEQ ID NO: 1499969 - RNA, 19 nt, Homo sapiens
caaaagaugugcagugaga

SEQ ID NO: 1499970 - RNA, 19 nt, Homo sapiens
gggcagauccggaccaaga

SEQ ID NO: 1499971 - RNA, 19 nt, Homo sapiens
ggagguggaauuacagaaa

SEQ ID NO: 1499972 - RNA, 19 nt, Homo sapiens
gacaagauccuggaaguug

SEQ ID NO: 1499973 - RNA, 19 nt, Homo sapiens
aaacugauccgcaaagugu

SEQ ID NO: 1499974 - RNA, 19 nt, Homo sapiens
aacaacagcuucacgauca

SEQ ID NO: 1499975 - RNA, 19 nt, Homo sapiens
gaccaagaccaguauuaaa

SEQ ID NO: 1499976 - RNA, 19 nt, Homo sapiens
guaaucauauuggugcuau

SEQ ID NO: 1499977 - RNA, 19 nt, Homo sapiens
ccacugaaauagccaucaa

SEQ ID NO: 1499978 - RNA, 19 nt, Homo sapiens
gaucguacaagaauuuaga

SEQ ID NO: 1499979 - RNA, 19 nt, Homo sapiens
gaacaugcaguggucauau

SEQ ID NO: 1499980 - RNA, 19 nt, Homo sapiens
uuggacagguggaguauaa

SEQ ID NO: 1499981 - RNA, 19 nt, Homo sapiens
gguacacacugccugcaaa

SEQ ID NO: 1499982 - RNA, 19 nt, Homo sapiens
ggaauuaaagagcuuggaa

SEQ ID NO: 1499983 - RNA, 19 nt, Homo sapiens
ugaaacagaaucuuugcua

SEQ ID NO: 1499984 - RNA, 19 nt, Homo sapiens
ggagaggauucgucugaca

SEQ ID NO: 1499985 - RNA, 19 nt, Homo sapiens
ggaaguguagguuggguuu

SEQ ID NO: 1499986 - RNA, 19 nt, Homo sapiens
ccucucagaugcuagugua

SEQ ID NO: 1499987 - RNA, 19 nt, Homo sapiens
gccaaagaaucaauaacug

SEQ ID NO: 1499988 - RNA, 19 nt, Homo sapiens
gacgcuaugugaaacugua

SEQ ID NO: 1499989 - RNA, 19 nt, Homo sapiens
cucaaagucucugauauuu

SEQ ID NO: 1499990 - RNA, 19 nt, Homo sapiens
gaacuggcccaugcuguga

SEQ ID NO: 1499991 - RNA, 19 nt, Homo sapiens
aagauaagcagaaguguga

SEQ ID NO: 1499992 - RNA, 19 nt, Homo sapiens
gaagcaaaccaguucuuuc

SEQ ID NO: 1499993 - RNA, 19 nt, Homo sapiens
ccagaaagccgucaaacca

SEQ ID NO: 1499994 - RNA, 19 nt, Homo sapiens
gaagagucccugggugaaa

SEQ ID NO: 1499995 - RNA, 19 nt, Homo sapiens
gccaagacgcuaugugaaa

SEQ ID NO: 1499996 - RNA, 19 nt, Homo sapiens
gacaauuuccggauucuug

SEQ ID NO: 1499997 - RNA, 19 nt, Homo sapiens
gaugguuucuguagagcaa

SEQ ID NO: 1499998 - RNA, 19 nt, Homo sapiens
ggagcucauuacuaggaua

SEQ ID NO: 1499999 - RNA, 19 nt, Homo sapiens
gacaaaaccuuggaaaaug

SEQ ID NO: 1500000 - RNA, 19 nt, Homo sapiens
ggacagguggaguauaaug

SEQ ID NO: 1500001 - RNA, 19 nt, Homo sapiens
ucagaaguuugacaauuuc

SEQ ID NO: 1500002 - RNA, 19 nt, Homo sapiens
gauuaugacagcacagaaa

SEQ ID NO: 1500003 - RNA, 19 nt, Homo sapiens
ucagguguuugauuuaaug

SEQ ID NO: 1500004 - RNA, 19 nt, Homo sapiens
gcaccgauuccgaugguuu

SEQ ID NO: 1500005 - RNA, 19 nt, Homo sapiens
uacagaaacugacagagau

SEQ ID NO: 1500006 - RNA, 19 nt, Homo sapiens
agacacugccacugaaaua

SEQ ID NO: 1500007 - RNA, 19 nt, Homo sapiens
gcaugcaaauggcaguuuc

SEQ ID NO: 1500008 - RNA, 19 nt, Homo sapiens
gaugugguauggaguccuu

SEQ ID NO: 1500009 - RNA, 19 nt, Homo sapiens
ggaagacauuacaaacuua

SEQ ID NO: 1500010 - RNA, 19 nt, Homo sapiens
ggacauaaucucauucuuu

SEQ ID NO: 1500011 - RNA, 19 nt, Homo sapiens
uaaagaaggugaauuccaa

SEQ ID NO: 1500012 - RNA, 19 nt, Homo sapiens
gaaguuguuuaucagcuua

SEQ ID NO: 1500013 - RNA, 19 nt, Homo sapiens
caaaggacauaaucucauu

SEQ ID NO: 1500014 - RNA, 19 nt, Homo sapiens
gugagaacauccaguauuu

SEQ ID NO: 1500015 - RNA, 19 nt, Homo sapiens
ucaacaagauucugccaua

SEQ ID NO: 1500016 - RNA, 19 nt, Homo sapiens
gaaguaaucccuaguguca

SEQ ID NO: 1500017 - RNA, 19 nt, Homo sapiens
guugguaggcuauuuauua

SEQ ID NO: 1500018 - RNA, 19 nt, Homo sapiens
caccaacaguguauaauaa

SEQ ID NO: 1500019 - RNA, 19 nt, Homo sapiens
gaaagaagaacuuaugcaa

SEQ ID NO: 1500020 - RNA, 19 nt, Homo sapiens
gcuagcaguuuaucuguuu

SEQ ID NO: 1500021 - RNA, 19 nt, Homo sapiens
aagaagaacuuaugcaaga

SEQ ID NO: 1500022 - RNA, 19 nt, Homo sapiens
ggugauauccuccucauuu

SEQ ID NO: 1500023 - RNA, 19 nt, Homo sapiens
gcuaggacuucgaauacua

SEQ ID NO: 1500024 - RNA, 19 nt, Homo sapiens
gagaauaccaaacuucauu

SEQ ID NO: 1500025 - RNA, 19 nt, Homo sapiens
gaacauccaguauuugguu

SEQ ID NO: 1500026 - RNA, 19 nt, Homo sapiens
gaucuucucuauucugugu

SEQ ID NO: 1500027 - RNA, 19 nt, Homo sapiens
cacaaugguugaacuaauu

SEQ ID NO: 1500028 - RNA, 19 nt, Homo sapiens
cagcgguacugguguauaa

SEQ ID NO: 1500029 - RNA, 19 nt, Homo sapiens
ccuggaaacucaaaucaaa

SEQ ID NO: 1500030 - RNA, 19 nt, Homo sapiens
ggccaggacuguuggguuu

SEQ ID NO: 1500031 - RNA, 19 nt, Homo sapiens
ucauuuagcucccacuuau

SEQ ID NO: 1500032 - RNA, 19 nt, Homo sapiens
uaacacaaguacaggaaga

SEQ ID NO: 1500033 - RNA, 19 nt, Homo sapiens
ucauagauggcucuuauua

SEQ ID NO: 1500034 - RNA, 19 nt, Homo sapiens
gcauuuagguugauuccau

SEQ ID NO: 1500035 - RNA, 19 nt, Homo sapiens
caacaacaaucacaagcau

SEQ ID NO: 1500036 - RNA, 19 nt, Homo sapiens
aaacuugcaucccagauau

SEQ ID NO: 1500037 - RNA, 19 nt, Homo sapiens
ugucauagauggcucuuau

SEQ ID NO: 1500038 - RNA, 19 nt, Homo sapiens
cauaguauuucauggugua

SEQ ID NO: 1500039 - RNA, 19 nt, Homo sapiens
auaccaaacuucauuguga

SEQ ID NO: 1500040 - RNA, 19 nt, Homo sapiens
gguaccagcucuucuuugu

SEQ ID NO: 1500041 - RNA, 19 nt, Homo sapiens
guaugugucuuuaugauag

SEQ ID NO: 1500042 - RNA, 19 nt, Homo sapiens
ccaagacacaaguucauua

SEQ ID NO: 1500043 - RNA, 19 nt, Homo sapiens
ccaccaacaguguauaaua

SEQ ID NO: 1500044 - RNA, 19 nt, Homo sapiens
uaaagaagauaaccaagac

SEQ ID NO: 1500045 - RNA, 19 nt, Homo sapiens
caauauagucagaccauuu

SEQ ID NO: 1500046 - RNA, 19 nt, Homo sapiens
uaccagcucuucuuuguau

SEQ ID NO: 1500047 - RNA, 19 nt, Homo sapiens
caucaaaucuauacauugc

SEQ ID NO: 1500048 - RNA, 19 nt, Homo sapiens
uaagugagaacauccagua

SEQ ID NO: 1500049 - RNA, 19 nt, Homo sapiens
gaagauaaccaagacacaa

SEQ ID NO: 1500050 - RNA, 19 nt, Homo sapiens
guacugguguauaauagga

SEQ ID NO: 1500051 - RNA, 19 nt, Homo sapiens
gcuucuggauucaauuuaa

SEQ ID NO: 1500052 - RNA, 19 nt, Homo sapiens
gauguuggcuguggguuug

SEQ ID NO: 1500053 - RNA, 19 nt, Homo sapiens
ccacaaugguugaacuaau

SEQ ID NO: 1500054 - RNA, 19 nt, Homo sapiens
gaguaaagaagguaaauca

SEQ ID NO: 1500055 - RNA, 19 nt, Homo sapiens
gaguaaccuucuucucaaa

SEQ ID NO: 1500056 - RNA, 19 nt, Homo sapiens
gcuccuagauucacugauc

SEQ ID NO: 1500057 - RNA, 19 nt, Homo sapiens
gcugugaacccaucuggua

SEQ ID NO: 1500058 - RNA, 19 nt, Homo sapiens
guaugcagguuuguuauau

SEQ ID NO: 1500059 - RNA, 19 nt, Homo sapiens
gaaccgaauaacacaagua

SEQ ID NO: 1500060 - RNA, 19 nt, Homo sapiens
uagucuagcuagcaguuua

SEQ ID NO: 1500061 - RNA, 19 nt, Homo sapiens
caaacuugcaucccagaua

SEQ ID NO: 1500062 - RNA, 19 nt, Homo sapiens
uaaauuguaucgacagucu

SEQ ID NO: 1500063 - RNA, 19 nt, Homo sapiens
gaaaggaagagucaaggau

SEQ ID NO: 1500064 - RNA, 19 nt, Homo sapiens
ugacugaacuccaugaaaa

SEQ ID NO: 1500065 - RNA, 19 nt, Homo sapiens
guguaugucuccaggaauu

SEQ ID NO: 1500066 - RNA, 19 nt, Homo sapiens
gguaggcuauuuauuacug

SEQ ID NO: 1500067 - RNA, 19 nt, Homo sapiens
gauauugaccugaaguuuc

SEQ ID NO: 1500068 - RNA, 19 nt, Homo sapiens
ugagauaauucauguugug

SEQ ID NO: 1500069 - RNA, 19 nt, Homo sapiens
gaacuuaugcaagaucuuc

SEQ ID NO: 1500070 - RNA, 19 nt, Homo sapiens
ccaagaagauuuugaggaa

SEQ ID NO: 1500071 - RNA, 19 nt, Homo sapiens
gugauagccuggaaacuca

SEQ ID NO: 1500072 - RNA, 19 nt, Homo sapiens
aaggaagagucaaggauuu

SEQ ID NO: 1500073 - RNA, 19 nt, Homo sapiens
ccucauuucugauuagguu

SEQ ID NO: 1500074 - RNA, 19 nt, Homo sapiens
aggaagacauuacaaacuu

SEQ ID NO: 1500075 - RNA, 19 nt, Homo sapiens
aaacagcccaagaagauuu

SEQ ID NO: 1500076 - RNA, 19 nt, Homo sapiens
agaaacagcccaagaagau

SEQ ID NO: 1500077 - RNA, 19 nt, Homo sapiens
cugaaacucuaaucucauu

SEQ ID NO: 1500078 - RNA, 19 nt, Homo sapiens
ggaaguagagagcaaaugg

SEQ ID NO: 1500079 - RNA, 19 nt, Homo sapiens
uucauuagcugaugcugua

SEQ ID NO: 1500080 - RNA, 19 nt, Homo sapiens
cugguuggcuguguucuua

SEQ ID NO: 1500081 - RNA, 19 nt, Homo sapiens
cauagaaacagcccaagaa

SEQ ID NO: 1500082 - RNA, 19 nt, Homo sapiens
caacaagauucugccauag

SEQ ID NO: 1500083 - RNA, 19 nt, Homo sapiens
guucagagauucgauuucu

SEQ ID NO: 1500084 - RNA, 19 nt, Homo sapiens
uugcauauguugaaccaaa

SEQ ID NO: 1500085 - RNA, 19 nt, Homo sapiens
gauuuaugaugcugaacuu

SEQ ID NO: 1500086 - RNA, 19 nt, Homo sapiens
ucaaauccuuacauucaga

SEQ ID NO: 1500087 - RNA, 19 nt, Homo sapiens
aggaauagcaucaaaucua

SEQ ID NO: 1500088 - RNA, 19 nt, Homo sapiens
gagauuacagacacagaaa

SEQ ID NO: 1500089 - RNA, 19 nt, Homo sapiens
gcagguuuguuauauaggu

SEQ ID NO: 1500090 - RNA, 19 nt, Homo sapiens
uagagaaaguugcaaagca

SEQ ID NO: 1500091 - RNA, 19 nt, Homo sapiens
ugccuggacuacagcauua

SEQ ID NO: 1500092 - RNA, 19 nt, Homo sapiens
gaagcugaaggaccaauau

SEQ ID NO: 1500093 - RNA, 19 nt, Homo sapiens
guauguuccuucaguacuu

SEQ ID NO: 1500094 - RNA, 19 nt, Homo sapiens
uccauaaguucucaucauu

SEQ ID NO: 1500095 - RNA, 19 nt, Homo sapiens
gaaacagcccaagaagauu

SEQ ID NO: 1500096 - RNA, 19 nt, Homo sapiens
gcuguggguuugucauaga

SEQ ID NO: 1500097 - RNA, 19 nt, Homo sapiens
ggauuugacucaguuugau

SEQ ID NO: 1500098 - RNA, 19 nt, Homo sapiens
gaaugggauuugacucagu

SEQ ID NO: 1500099 - RNA, 19 nt, Homo sapiens
caccacacccagcuaauuu

SEQ ID NO: 1500100 - RNA, 19 nt, Homo sapiens
cuaaagaagauaaccaaga

SEQ ID NO: 1500101 - RNA, 19 nt, Homo sapiens
ccaggaauuuauccauuuc

SEQ ID NO: 1500102 - RNA, 19 nt, Homo sapiens
uccaggaauuuauccauuu

SEQ ID NO: 1500103 - RNA, 19 nt, Homo sapiens
uuaugucucuuucggguuu

SEQ ID NO: 1500104 - RNA, 19 nt, Homo sapiens
ggauauugaccugaaguuu

SEQ ID NO: 1500105 - RNA, 19 nt, Homo sapiens
ucagguauguuccuucagu

SEQ ID NO: 1500106 - RNA, 19 nt, Homo sapiens
uugcugaaguuguuuauca

SEQ ID NO: 1500107 - RNA, 19 nt, Homo sapiens
caguuugauugguguuaua

SEQ ID NO: 1500108 - RNA, 19 nt, Homo sapiens
gcgguacugguguauaaua

SEQ ID NO: 1500109 - RNA, 19 nt, Homo sapiens
acaagaagcuuccaaauaa

SEQ ID NO: 1500110 - RNA, 19 nt, Homo sapiens
uaacauaggccucauauuu

SEQ ID NO: 1500111 - RNA, 19 nt, Homo sapiens
gaucuuagcuggacgagaa

SEQ ID NO: 1500112 - RNA, 19 nt, Homo sapiens
gagaagagaucgcccauag

SEQ ID NO: 1500113 - RNA, 19 nt, Homo sapiens
gaagcaagauaaagagaau

SEQ ID NO: 1500114 - RNA, 19 nt, Homo sapiens
caaagaaggcauagaauau

SEQ ID NO: 1500115 - RNA, 19 nt, Homo sapiens
gaagagcauuggcaggaaa

SEQ ID NO: 1500116 - RNA, 19 nt, Homo sapiens
ggaguugucuauuacagaa

SEQ ID NO: 1500117 - RNA, 19 nt, Homo sapiens
caagaagcuuccaaauaaa

SEQ ID NO: 1500118 - RNA, 19 nt, Homo sapiens
aaacaaagaaggcauagaa

SEQ ID NO: 1500119 - RNA, 19 nt, Homo sapiens
guaugaacgugcuguugua

SEQ ID NO: 1500120 - RNA, 19 nt, Homo sapiens
cacaagaagcuuccaaaua

SEQ ID NO: 1500121 - RNA, 19 nt, Homo sapiens
gcauagauguguuugucaa

SEQ ID NO: 1500122 - RNA, 19 nt, Homo sapiens
gagaaugcuuggaaagguu

SEQ ID NO: 1500123 - RNA, 19 nt, Homo sapiens
gaagagaucgcccauagca

SEQ ID NO: 1500124 - RNA, 19 nt, Homo sapiens
gaauguuugugaacucuau

SEQ ID NO: 1500125 - RNA, 19 nt, Homo sapiens
agaaaugaaugcuuccaaa

SEQ ID NO: 1500126 - RNA, 19 nt, Homo sapiens
caacauuccuccacaagag

SEQ ID NO: 1500127 - RNA, 19 nt, Homo sapiens
gcuugaagaucauuaagga

SEQ ID NO: 1500128 - RNA, 19 nt, Homo sapiens
acaaagaaggcauagaaua

SEQ ID NO: 1500129 - RNA, 19 nt, Homo sapiens
ggccagcuccugucaauuu

SEQ ID NO: 1500130 - RNA, 19 nt, Homo sapiens
gaaaugaaugcuuccaaau

SEQ ID NO: 1500131 - RNA, 19 nt, Homo sapiens
gaagaucauuaaggaguau

SEQ ID NO: 1500132 - RNA, 19 nt, Homo sapiens
ugaagaucauuaaggagua

SEQ ID NO: 1500133 - RNA, 19 nt, Homo sapiens
aacauaggccucauauuua

SEQ ID NO: 1500134 - RNA, 19 nt, Homo sapiens
ggaacuuucugguaguaug

SEQ ID NO: 1500135 - RNA, 19 nt, Homo sapiens
gaguggaaaucaaagaugu

SEQ ID NO: 1500136 - RNA, 19 nt, Homo sapiens
ugaacgugcuguuguauuc

SEQ ID NO: 1500137 - RNA, 19 nt, Homo sapiens
ggagaaugcuuggaaaggu

SEQ ID NO: 1500138 - RNA, 19 nt, Homo sapiens
gccagcuccugucaauuua

SEQ ID NO: 1500139 - RNA, 19 nt, Homo sapiens
ggaagagcauuggcaggaa

SEQ ID NO: 1500140 - RNA, 19 nt, Homo sapiens
ggagaagccaguaguuaga

SEQ ID NO: 1500141 - RNA, 19 nt, Homo sapiens
caaauaaccuguucaaaac

SEQ ID NO: 1500142 - RNA, 19 nt, Homo sapiens
gguggucuccgacuuuaua

SEQ ID NO: 1500143 - RNA, 19 nt, Homo sapiens
gaagaauucuacgauugug

SEQ ID NO: 1500144 - RNA, 19 nt, Homo sapiens
gaccuugucccagaucuua

SEQ ID NO: 1500145 - RNA, 19 nt, Homo sapiens
ccaaauaaccuguucaaaa

SEQ ID NO: 1500146 - RNA, 19 nt, Homo sapiens
ggccucauauuuacacuau

SEQ ID NO: 1500147 - RNA, 19 nt, Homo sapiens
gaaaucauugggugacuau

SEQ ID NO: 1500148 - RNA, 19 nt, Homo sapiens
aaugagaccuguauauuac

SEQ ID NO: 1500149 - RNA, 19 nt, Homo sapiens
cgaaguuguuauuugcuaa

SEQ ID NO: 1500150 - RNA, 19 nt, Homo sapiens
gaacuuucugguaguauga

SEQ ID NO: 1500151 - RNA, 19 nt, Homo sapiens
ggaccauaaucaacuuugu

SEQ ID NO: 1500152 - RNA, 19 nt, Homo sapiens
gaccauaaucaacuuugua

SEQ ID NO: 1500153 - RNA, 19 nt, Homo sapiens
aacaguaacuccauagaug

SEQ ID NO: 1500154 - RNA, 19 nt, Homo sapiens
gacuaugacuaauguuuca

SEQ ID NO: 1500155 - RNA, 19 nt, Homo sapiens
gguagucagcuauugcaua

SEQ ID NO: 1500156 - RNA, 19 nt, Homo sapiens
gcuaugauaaccacaagaa

SEQ ID NO: 1500157 - RNA, 19 nt, Homo sapiens
guugaccuccgaacaguua

SEQ ID NO: 1500158 - RNA, 19 nt, Homo sapiens
cagcuccugucaauuuauu

SEQ ID NO: 1500159 - RNA, 19 nt, Homo sapiens
ugccuguucuucacacuua

SEQ ID NO: 1500160 - RNA, 19 nt, Homo sapiens
gcaggaacuuucugguagu

SEQ ID NO: 1500161 - RNA, 19 nt, Homo sapiens
aaaccacucugagaaaugu

SEQ ID NO: 1500162 - RNA, 19 nt, Homo sapiens
ccacaaugcugaaaacaga

SEQ ID NO: 1500163 - RNA, 19 nt, Homo sapiens
ucaaaccacucugagaaau

SEQ ID NO: 1500164 - RNA, 19 nt, Homo sapiens
ucagguagauggaguuguc

SEQ ID NO: 1500165 - RNA, 19 nt, Homo sapiens
uacacuauauguucgcuuu

SEQ ID NO: 1500166 - RNA, 19 nt, Homo sapiens
gugguggucuccgacuuua

SEQ ID NO: 1500167 - RNA, 19 nt, Homo sapiens
ucuagaggcuauacagaga

SEQ ID NO: 1500168 - RNA, 19 nt, Homo sapiens
ccgaaguuguuauuugcua

SEQ ID NO: 1500169 - RNA, 19 nt, Homo sapiens
caccugagaagcaagauaa

SEQ ID NO: 1500170 - RNA, 19 nt, Homo sapiens
ccauauggaugugcuugaa

SEQ ID NO: 1500171 - RNA, 19 nt, Homo sapiens
uaaacggcuugguguaugu

SEQ ID NO: 1500172 - RNA, 19 nt, Homo sapiens
caauaaacggcuuggugua

SEQ ID NO: 1500173 - RNA, 19 nt, Homo sapiens
aaagcacuccagauaauuu

SEQ ID NO: 1500174 - RNA, 19 nt, Homo sapiens
caggaacuuucugguagua

SEQ ID NO: 1500175 - RNA, 19 nt, Homo sapiens
gcccauagcauccagacuu

SEQ ID NO: 1500176 - RNA, 19 nt, Homo sapiens
gaaagguugcauugguuga

SEQ ID NO: 1500177 - RNA, 19 nt, Homo sapiens
uggaaagguugcauugguu

SEQ ID NO: 1500178 - RNA, 19 nt, Homo sapiens
uccaaugguugcaaucaaa

SEQ ID NO: 1500179 - RNA, 19 nt, Homo sapiens
uagcaggaacuuucuggua

SEQ ID NO: 1500180 - RNA, 19 nt, Homo sapiens
agaguggugucuauuccua

SEQ ID NO: 1500181 - RNA, 19 nt, Homo sapiens
gaaggagaaaugaaugcuu

SEQ ID NO: 1500182 - RNA, 19 nt, Homo sapiens
cauccagacuuuacuugau

SEQ ID NO: 1500183 - RNA, 19 nt, Homo sapiens
ucucagcaguggcuaaugu

SEQ ID NO: 1500184 - RNA, 19 nt, Homo sapiens
gcaacauuccuccacaaga

SEQ ID NO: 1500185 - RNA, 19 nt, Homo sapiens
acaguuacuugcaacauuc

SEQ ID NO: 1500186 - RNA, 19 nt, Homo sapiens
cagguaaucgagaauguuu

SEQ ID NO: 1500187 - RNA, 19 nt, Homo sapiens
gggugacuaugacuaaugu

SEQ ID NO: 1500188 - RNA, 19 nt, Homo sapiens
cccauagcauccagacuuu

SEQ ID NO: 1500189 - RNA, 19 nt, Homo sapiens
uggcuaaugucaacgaugu

SEQ ID NO: 1500190 - RNA, 19 nt, Homo sapiens
uggaugugcuugaagauca

SEQ ID NO: 1500191 - RNA, 19 nt, Homo sapiens
gagaauguuugugaacucu

SEQ ID NO: 1500192 - RNA, 19 nt, Homo sapiens
ggaaaaggcacaugaaagu

SEQ ID NO: 1500193 - RNA, 19 nt, Homo sapiens
gguaguaugagaagaaauc

SEQ ID NO: 1500194 - RNA, 19 nt, Homo sapiens
gagacuccguaacuacuca

SEQ ID NO: 1500195 - RNA, 19 nt, Homo sapiens
gaacaaaagaaguauggaa

SEQ ID NO: 1500196 - RNA, 19 nt, Homo sapiens
gagaagcaagauaaagaga

SEQ ID NO: 1500197 - RNA, 19 nt, Homo sapiens
acauaggccucauauuuac

SEQ ID NO: 1500198 - RNA, 19 nt, Homo sapiens
uaacaguaacuccauagau

SEQ ID NO: 1500199 - RNA, 19 nt, Homo sapiens
cuccguaacuacucaggua

SEQ ID NO: 1500200 - RNA, 19 nt, Homo sapiens
ccaccuuccagcaccauua

SEQ ID NO: 1500201 - RNA, 19 nt, Homo sapiens
aaacugcgaugagcucaca

SEQ ID NO: 1500202 - RNA, 19 nt, Homo sapiens
ugcuaaaucuccaaugguu

SEQ ID NO: 1500203 - RNA, 19 nt, Homo sapiens
gcuuuauaauuccgaaguu

SEQ ID NO: 1500204 - RNA, 19 nt, Homo sapiens
agaaaucauugggugacua

SEQ ID NO: 1500205 - RNA, 19 nt, Homo sapiens
gaaacggugagaauuccaa

SEQ ID NO: 1500206 - RNA, 19 nt, Homo sapiens
gagaagccaguaguuagaa

SEQ ID NO: 1500207 - RNA, 19 nt, Homo sapiens
gagaaaugaaugcuuccaa

SEQ ID NO: 1500208 - RNA, 19 nt, Homo sapiens
uaaucgagaauguuuguga

SEQ ID NO: 1500209 - RNA, 19 nt, Homo sapiens
ccaaggagaugaaggauaa

SEQ ID NO: 1500210 - RNA, 19 nt, Homo sapiens
gauaagaccucugaagaaa

SEQ ID NO: 1500211 - RNA, 19 nt, Homo sapiens
ggaggaagcucaaacugaa

SEQ ID NO: 1500212 - RNA, 19 nt, Homo sapiens
gaaauaaagccuaugacua

SEQ ID NO: 1500213 - RNA, 19 nt, Homo sapiens
ucaagucucucaggaauua

SEQ ID NO: 1500214 - RNA, 19 nt, Homo sapiens
cagcauagauuucccagaa

SEQ ID NO: 1500215 - RNA, 19 nt, Homo sapiens
cagaagaggugaauccauu

SEQ ID NO: 1500216 - RNA, 19 nt, Homo sapiens
gcauagauuucccagaauu

SEQ ID NO: 1500217 - RNA, 19 nt, Homo sapiens
gaacaugagccugaaagua

SEQ ID NO: 1500218 - RNA, 19 nt, Homo sapiens
gaacugacuucuccaccuu

SEQ ID NO: 1500219 - RNA, 19 nt, Homo sapiens
gaaugaaugugaggaaaga

SEQ ID NO: 1500220 - RNA, 19 nt, Homo sapiens
gaagaggugaauccauuua

SEQ ID NO: 1500221 - RNA, 19 nt, Homo sapiens
auaaacaccugcuaaagaa

SEQ ID NO: 1500222 - RNA, 19 nt, Homo sapiens
cgagagaucuucaaaauau

SEQ ID NO: 1500223 - RNA, 19 nt, Homo sapiens
gcagaaauaaagccuauga

SEQ ID NO: 1500224 - RNA, 19 nt, Homo sapiens
ggauaagaccucugaagaa

SEQ ID NO: 1500225 - RNA, 19 nt, Homo sapiens
ucacagaagucauagaagu

SEQ ID NO: 1500226 - RNA, 19 nt, Homo sapiens
gcucugauauuacaaacug

SEQ ID NO: 1500227 - RNA, 19 nt, Homo sapiens
uaaagccuaugacuaauca

SEQ ID NO: 1500228 - RNA, 19 nt, Homo sapiens
ucacagaucuuccagaaaa

SEQ ID NO: 1500229 - RNA, 19 nt, Homo sapiens
cauaaacaccugcuaaaga

SEQ ID NO: 1500230 - RNA, 19 nt, Homo sapiens
agacagcucugauauuaca

SEQ ID NO: 1500231 - RNA, 19 nt, Homo sapiens
ggaaagacaaucagugcaa

SEQ ID NO: 1500232 - RNA, 19 nt, Homo sapiens
cauaucaaaucuccuucua

SEQ ID NO: 1500233 - RNA, 19 nt, Homo sapiens
gaauccauuuaccuucaua

SEQ ID NO: 1500234 - RNA, 19 nt, Homo sapiens
gaacugaaucaaacacuuc

SEQ ID NO: 1500235 - RNA, 19 nt, Homo sapiens
caagcgcaaugaagaagaa

SEQ ID NO: 1500236 - RNA, 19 nt, Homo sapiens
aaacacagcucagggaaag

SEQ ID NO: 1500237 - RNA, 19 nt, Homo sapiens
aacaugagccugaaaguaa

SEQ ID NO: 1500238 - RNA, 19 nt, Homo sapiens
gucaccaucucaaacauaa

SEQ ID NO: 1500239 - RNA, 19 nt, Homo sapiens
aagaaaagaugccugauuu

SEQ ID NO: 1500240 - RNA, 19 nt, Homo sapiens
ugucacagaucuuccagaa

SEQ ID NO: 1500241 - RNA, 19 nt, Homo sapiens
gggaaugaaugugaggaaa

SEQ ID NO: 1500242 - RNA, 19 nt, Homo sapiens
gaagaauccaggagcuuga

SEQ ID NO: 1500243 - RNA, 19 nt, Homo sapiens
gaaucaaacacuucaguuc

SEQ ID NO: 1500244 - RNA, 19 nt, Homo sapiens
gacauaaacaccugcuaaa

SEQ ID NO: 1500245 - RNA, 19 nt, Homo sapiens
uguaagaauugucacagaa

SEQ ID NO: 1500246 - RNA, 19 nt, Homo sapiens
ucacagacaucaccgacau

SEQ ID NO: 1500247 - RNA, 19 nt, Homo sapiens
gaaagaauccucaaaacau

SEQ ID NO: 1500248 - RNA, 19 nt, Homo sapiens
gcccucaucucccucuuga

SEQ ID NO: 1500249 - RNA, 19 nt, Homo sapiens
guagaaagugaggcaaaua

SEQ ID NO: 1500250 - RNA, 19 nt, Homo sapiens
ggucccggauguaagaauu

SEQ ID NO: 1500251 - RNA, 19 nt, Homo sapiens
ucucaggaauuacgaauag

SEQ ID NO: 1500252 - RNA, 19 nt, Homo sapiens
agacaaaguugauggaaaa

SEQ ID NO: 1500253 - RNA, 19 nt, Homo sapiens
gaaagugaggcaaauacau

SEQ ID NO: 1500254 - RNA, 19 nt, Homo sapiens
gaauagcacagacaucaca

SEQ ID NO: 1500255 - RNA, 19 nt, Homo sapiens
uguaucuccucccauguua

SEQ ID NO: 1500256 - RNA, 19 nt, Homo sapiens
agacauaaacaccugcuaa

SEQ ID NO: 1500257 - RNA, 19 nt, Homo sapiens
guaagagugaguugaaaga

SEQ ID NO: 1500258 - RNA, 19 nt, Homo sapiens
ucugaagccuggguguuua

SEQ ID NO: 1500259 - RNA, 19 nt, Homo sapiens
caggagaaagccaaaguuu

SEQ ID NO: 1500260 - RNA, 19 nt, Homo sapiens
agagugaguugaaagaauc

SEQ ID NO: 1500261 - RNA, 19 nt, Homo sapiens
aaaguaagagugaguugaa

SEQ ID NO: 1500262 - RNA, 19 nt, Homo sapiens
uaagaauugucacagaagu

SEQ ID NO: 1500263 - RNA, 19 nt, Homo sapiens
aagacaaaguugauggaaa

SEQ ID NO: 1500264 - RNA, 19 nt, Homo sapiens
cuaauuuccucaaacuugu

SEQ ID NO: 1500265 - RNA, 19 nt, Homo sapiens
gaagaaaagaugccugauu

SEQ ID NO: 1500266 - RNA, 19 nt, Homo sapiens
uggcagaaauaaagccuau

SEQ ID NO: 1500267 - RNA, 19 nt, Homo sapiens
guuaguugccugcugagua

SEQ ID NO: 1500268 - RNA, 19 nt, Homo sapiens
ugaaggauaagaccucuga

SEQ ID NO: 1500269 - RNA, 19 nt, Homo sapiens
guggaaacgugcuauuugg

SEQ ID NO: 1500270 - RNA, 19 nt, Homo sapiens
gaguggaaacgugcuauuu

SEQ ID NO: 1500271 - RNA, 19 nt, Homo sapiens
ccagaggucccggauguaa

SEQ ID NO: 1500272 - RNA, 19 nt, Homo sapiens
ccauggaugugacggaugu

SEQ ID NO: 1500273 - RNA, 19 nt, Homo sapiens
gccaaaguuuccaaagugu

SEQ ID NO: 1500274 - RNA, 19 nt, Homo sapiens
acaugagccugaaaguaaa

SEQ ID NO: 1500275 - RNA, 19 nt, Homo sapiens
ccaugaggaucaauaagca

SEQ ID NO: 1500276 - RNA, 19 nt, Homo sapiens
gcaagacuaccaugaggau

SEQ ID NO: 1500277 - RNA, 19 nt, Homo sapiens
gaagaacaccagcaagacu

SEQ ID NO: 1500278 - RNA, 19 nt, Homo sapiens
uccaggagcuugagaacug

SEQ ID NO: 1500279 - RNA, 19 nt, Homo sapiens
gaaaguaaagcuggugagu

SEQ ID NO: 1500280 - RNA, 19 nt, Homo sapiens
ucucaaggcugaagaaucc

SEQ ID NO: 1500281 - RNA, 19 nt, Homo sapiens
gagucacagugguguuuga

SEQ ID NO: 1500282 - RNA, 19 nt, Homo sapiens
ucagggacagcauagauuu

SEQ ID NO: 1500283 - RNA, 19 nt, Homo sapiens
ucaucucccucuugaauca

SEQ ID NO: 1500284 - RNA, 19 nt, Homo sapiens
ucaguucucuccccucaua

SEQ ID NO: 1500285 - RNA, 19 nt, Homo sapiens
gaggaucaauaagcaagau

SEQ ID NO: 1500286 - RNA, 19 nt, Homo sapiens
ggaaugaaugugaggaaag

SEQ ID NO: 1500287 - RNA, 19 nt, Homo sapiens
uuaguugccugcugaguag

SEQ ID NO: 1500288 - RNA, 19 nt, Homo sapiens
aagagugaguugaaagaau

SEQ ID NO: 1500289 - RNA, 19 nt, Homo sapiens
ccuggguguuuacaagaua

SEQ ID NO: 1500290 - RNA, 19 nt, Homo sapiens
ugucggagguuucaagucu

SEQ ID NO: 1500291 - RNA, 19 nt, Homo sapiens
cauauaaacaggacaccuu

SEQ ID NO: 1500292 - RNA, 19 nt, Homo sapiens
uggucgagccuacuacuua

SEQ ID NO: 1500293 - RNA, 19 nt, Homo sapiens
aagaagaacaccagcaaga

SEQ ID NO: 1500294 - RNA, 19 nt, Homo sapiens
gcucagggaaagacaauca

SEQ ID NO: 1500295 - RNA, 19 nt, Homo sapiens
ucacagugguguuugaaaa

SEQ ID NO: 1500296 - RNA, 19 nt, Homo sapiens
ugaagaagaacaccagcaa

SEQ ID NO: 1500297 - RNA, 19 nt, Homo sapiens
cuacguggcagaaauaaag

SEQ ID NO: 1500298 - RNA, 19 nt, Homo sapiens
caaacacagcucagggaaa

SEQ ID NO: 1500299 - RNA, 19 nt, Homo sapiens
ucccagaggucccggaugu

SEQ ID NO: 1500300 - RNA, 19 nt, Homo sapiens
agccaaaguuuccaaagug

SEQ ID NO: 1500301 - RNA, 19 nt, Homo sapiens
ucuaauuuccucaaacuug

SEQ ID NO: 1500302 - RNA, 19 nt, Homo sapiens
agaacugaaucaaacacuu

SEQ ID NO: 1500303 - RNA, 19 nt, Homo sapiens
caaacauaacacugacuuu

SEQ ID NO: 1500304 - RNA, 19 nt, Homo sapiens
aaacaugucaccaucucaa

SEQ ID NO: 1500305 - RNA, 19 nt, Homo sapiens
aaacaccugcuaaagaaau

SEQ ID NO: 1500306 - RNA, 19 nt, Homo sapiens
agacaucaccgacaucaca

SEQ ID NO: 1500307 - RNA, 19 nt, Homo sapiens
gaauuacgaauagcacaga

SEQ ID NO: 1500308 - RNA, 19 nt, Homo sapiens
uuucaagucucucaggaau

SEQ ID NO: 1500309 - RNA, 19 nt, Homo sapiens
gaagaaagaccuccugauu

SEQ ID NO: 1500310 - RNA, 19 nt, Homo sapiens
acagagaccugcugcauaa

SEQ ID NO: 1500311 - RNA, 19 nt, Homo sapiens
ugaaagagcugcugacgau

SEQ ID NO: 1500312 - RNA, 19 nt, Homo sapiens
ggaaagcucccgccugaaa

SEQ ID NO: 1500313 - RNA, 19 nt, Homo sapiens
gcacacaggugacuuucuc

SEQ ID NO: 1500314 - RNA, 19 nt, Homo sapiens
gaagggagccaugaagauu

SEQ ID NO: 1500315 - RNA, 19 nt, Homo sapiens
agaaagaccuccugauugg

SEQ ID NO: 1500316 - RNA, 19 nt, Homo sapiens
cggaugagcuggaagaucu

SEQ ID NO: 1500317 - RNA, 19 nt, Homo sapiens
gacagagaccugcugcaua

SEQ ID NO: 1500318 - RNA, 19 nt, Homo sapiens
ccaacaacaucccaaaguc

SEQ ID NO: 1500319 - RNA, 19 nt, Homo sapiens
ugacgaugcugcagcugaa

SEQ ID NO: 1500320 - RNA, 19 nt, Homo sapiens
gaagaagggagccaugaag

SEQ ID NO: 1500321 - RNA, 19 nt, Homo sapiens
caacaacaucccaaaguca

SEQ ID NO: 1500322 - RNA, 19 nt, Homo sapiens
ccauaucagugcuguguca

SEQ ID NO: 1500323 - RNA, 19 nt, Homo sapiens
acuccaagcugguuagaau

SEQ ID NO: 1500324 - RNA, 19 nt, Homo sapiens
gaucgaggcagcccugaug

SEQ ID NO: 1500325 - RNA, 19 nt, Homo sapiens
caggagcacugcaccuuca

SEQ ID NO: 1500326 - RNA, 19 nt, Homo sapiens
aagaaagaccuccugauug

SEQ ID NO: 1500327 - RNA, 19 nt, Homo sapiens
gaaggucagcaucucuuug

SEQ ID NO: 1500328 - RNA, 19 nt, Homo sapiens
ggacagagaccugcugcau

SEQ ID NO: 1500329 - RNA, 19 nt, Homo sapiens
ucgcuaccauccaggagua

SEQ ID NO: 1500330 - RNA, 19 nt, Homo sapiens
uggcagaauucccggagaa

SEQ ID NO: 1500331 - RNA, 19 nt, Homo sapiens
ugucagcguucccagaaga

SEQ ID NO: 1500332 - RNA, 19 nt, Homo sapiens
gcugcacccuggccaacaa

SEQ ID NO: 1500333 - RNA, 19 nt, Homo sapiens
cccaagaggccgaguuuga

SEQ ID NO: 1500334 - RNA, 19 nt, Homo sapiens
caagaggccgaguuugaga

SEQ ID NO: 1500335 - RNA, 19 nt, Homo sapiens
gucaggauuucucaucaau

SEQ ID NO: 1500336 - RNA, 19 nt, Homo sapiens
ccuugaggcugcuggaaga

SEQ ID NO: 1500337 - RNA, 19 nt, Homo sapiens
cccagaagacacuuacuuu

SEQ ID NO: 1500338 - RNA, 19 nt, Homo sapiens
gaaagcucccgccugaaag

SEQ ID NO: 1500339 - RNA, 19 nt, Homo sapiens
caagcugguuagaaucauc

SEQ ID NO: 1500340 - RNA, 19 nt, Homo sapiens
cagaauucccggagaagga

SEQ ID NO: 1500341 - RNA, 19 nt, Homo sapiens
ccuccugauuggcaucuuu

SEQ ID NO: 1500342 - RNA, 19 nt, Homo sapiens
gaccucggaugagcuggaa

SEQ ID NO: 1500343 - RNA, 19 nt, Homo sapiens
gaggcagcccugauggaaa

SEQ ID NO: 1500344 - RNA, 19 nt, Homo sapiens
ugcugcagcugaagaaaga

SEQ ID NO: 1500345 - RNA, 19 nt, Homo sapiens
cuacaugugacuagggaaa

SEQ ID NO: 1500346 - RNA, 19 nt, Homo sapiens
gggaugcucgccagggaaa

SEQ ID NO: 1500347 - RNA, 19 nt, Homo sapiens
gaaaacuccaagcugguua

SEQ ID NO: 1500348 - RNA, 19 nt, Homo sapiens
aggcccagcucucaagguu

SEQ ID NO: 1500349 - RNA, 19 nt, Homo sapiens
gagaccugcugcauaacag

SEQ ID NO: 1500350 - RNA, 19 nt, Homo sapiens
uguagccacucucugauag

SEQ ID NO: 1500351 - RNA, 19 nt, Homo sapiens
aggcagcccugauggaaag

SEQ ID NO: 1500352 - RNA, 19 nt, Homo sapiens
uggaagaucugcgcuacca

SEQ ID NO: 1500353 - RNA, 19 nt, Homo sapiens
auacaguguugucuuaguc

SEQ ID NO: 1500354 - RNA, 19 nt, Homo sapiens
uauacaguguugucuuagu

SEQ ID NO: 1500355 - RNA, 19 nt, Homo sapiens
aaggucagcaucucuuuga

SEQ ID NO: 1500356 - RNA, 19 nt, Homo sapiens
ccaaagucaggauuucuca

SEQ ID NO: 1500357 - RNA, 19 nt, Homo sapiens
cgaggcagcccugauggaa

SEQ ID NO: 1500358 - RNA, 19 nt, Homo sapiens
gcuggcuggugauggagaa

SEQ ID NO: 1500359 - RNA, 19 nt, Homo sapiens
acaguguugucuuagucua

SEQ ID NO: 1500360 - RNA, 19 nt, Homo sapiens
guacaaguccaagcugaag

SEQ ID NO: 1500361 - RNA, 19 nt, Homo sapiens
ugaggcugcuggaagaaag

SEQ ID NO: 1500362 - RNA, 19 nt, Homo sapiens
gcacagauggaggcugcaa

SEQ ID NO: 1500363 - RNA, 19 nt, Homo sapiens
agaagaagggagccaugaa

SEQ ID NO: 1500364 - RNA, 19 nt, Homo sapiens
cgucgacgcgcaaaucuuc

SEQ ID NO: 1500365 - RNA, 19 nt, Homo sapiens
ucaccaacaacaucccaaa

SEQ ID NO: 1500366 - RNA, 19 nt, Homo sapiens
agaggcugguggcagaauu

SEQ ID NO: 1500367 - RNA, 19 nt, Homo sapiens
aaacaggcccagcucucaa

SEQ ID NO: 1500368 - RNA, 19 nt, Homo sapiens
accaguggaugcuguacaa

SEQ ID NO: 1500369 - RNA, 19 nt, Homo sapiens
agggagccaugaagauuuc

SEQ ID NO: 1500370 - RNA, 19 nt, Homo sapiens
aagggagccaugaagauuu

SEQ ID NO: 1500371 - RNA, 19 nt, Homo sapiens
aagaagggagccaugaaga

SEQ ID NO: 1500372 - RNA, 19 nt, Homo sapiens
gagcugcauccauaucagu

SEQ ID NO: 1500373 - RNA, 19 nt, Homo sapiens
ggccaccugcugacacaaa

SEQ ID NO: 1500374 - RNA, 19 nt, Homo sapiens
cagaaggucagcaucucuu

SEQ ID NO: 1500375 - RNA, 19 nt, Homo sapiens
agucaggauuucucaucaa

SEQ ID NO: 1500376 - RNA, 19 nt, Homo sapiens
aaagucaggauuucucauc

SEQ ID NO: 1500377 - RNA, 19 nt, Homo sapiens
aguguugucuuagucuauu

SEQ ID NO: 1500378 - RNA, 19 nt, Homo sapiens
gcacccuggccaacaacuu

SEQ ID NO: 1500379 - RNA, 19 nt, Homo sapiens
ugccuucccuucacaccuu

SEQ ID NO: 1500380 - RNA, 19 nt, Homo sapiens
gcagaggauggaaguggau

SEQ ID NO: 1500381 - RNA, 19 nt, Homo sapiens
guguugucuuagucuauuu

SEQ ID NO: 1500382 - RNA, 19 nt, Homo sapiens
aaagcucccgccugaaaga

SEQ ID NO: 1500383 - RNA, 19 nt, Homo sapiens
ccagaagacacuuacuuuu

SEQ ID NO: 1500384 - RNA, 19 nt, Homo sapiens
cagagcugcauccauauca

SEQ ID NO: 1500385 - RNA, 19 nt, Homo sapiens
gccagaaggucagcaucuc

SEQ ID NO: 1500386 - RNA, 19 nt, Homo sapiens
gucccaagaggccgaguuu

SEQ ID NO: 1500387 - RNA, 19 nt, Homo sapiens
agaaggucagcaucucuuu

SEQ ID NO: 1500388 - RNA, 19 nt, Homo sapiens
agaagggagccaugaagau

SEQ ID NO: 1500389 - RNA, 19 nt, Homo sapiens
ccaagaggccgaguuugag

SEQ ID NO: 1500390 - RNA, 19 nt, Homo sapiens
gaacaugccucaccuuuaa

SEQ ID NO: 1500391 - RNA, 19 nt, Homo sapiens
gauggauucucuugacuua

SEQ ID NO: 1500392 - RNA, 19 nt, Homo sapiens
gcgagagccucaccaagaa

SEQ ID NO: 1500393 - RNA, 19 nt, Homo sapiens
gcagaugccacgcuacuaa

SEQ ID NO: 1500394 - RNA, 19 nt, Homo sapiens
gaagugcuguuccugagau

SEQ ID NO: 1500395 - RNA, 19 nt, Homo sapiens
acacggaccuggacacaga

SEQ ID NO: 1500396 - RNA, 19 nt, Homo sapiens
gaagucagagaaacuguug

SEQ ID NO: 1500397 - RNA, 19 nt, Homo sapiens
caccucaucuguaaagaga

SEQ ID NO: 1500398 - RNA, 19 nt, Homo sapiens
guaaagagauucuaaaagc

SEQ ID NO: 1500399 - RNA, 19 nt, Homo sapiens
ccacggcacuuccccuuua

SEQ ID NO: 1500400 - RNA, 19 nt, Homo sapiens
ugaacaugccucaccuuua

SEQ ID NO: 1500401 - RNA, 19 nt, Homo sapiens
gaacccagaggauaccuau

SEQ ID NO: 1500402 - RNA, 19 nt, Homo sapiens
gggagacagugcucacgaa

SEQ ID NO: 1500403 - RNA, 19 nt, Homo sapiens
ccaagaaagccaagagguu

SEQ ID NO: 1500404 - RNA, 19 nt, Homo sapiens
ggcccaggcuguagaugaa

SEQ ID NO: 1500405 - RNA, 19 nt, Homo sapiens
gagaaacuguuggcagagu

SEQ ID NO: 1500406 - RNA, 19 nt, Homo sapiens
gaguuugccuccuuuguac

SEQ ID NO: 1500407 - RNA, 19 nt, Homo sapiens
gcaucaugguggauaagga

SEQ ID NO: 1500408 - RNA, 19 nt, Homo sapiens
gguggaggccgucuaggaa

SEQ ID NO: 1500409 - RNA, 19 nt, Homo sapiens
caccacgaccuacccguua

SEQ ID NO: 1500410 - RNA, 19 nt, Homo sapiens
cuaaagaagucagagaaac

SEQ ID NO: 1500411 - RNA, 19 nt, Homo sapiens
ggaccuggacacagacaug

SEQ ID NO: 1500412 - RNA, 19 nt, Homo sapiens
gaaaagugcuucguagacu

SEQ ID NO: 1500413 - RNA, 19 nt, Homo sapiens
gacgcaucaugguggauaa

SEQ ID NO: 1500414 - RNA, 19 nt, Homo sapiens
uaaagaagucagagaaacu

SEQ ID NO: 1500415 - RNA, 19 nt, Homo sapiens
gcgcaacgccaaguucuuc

SEQ ID NO: 1500416 - RNA, 19 nt, Homo sapiens
gggcccaggcuguagauga

SEQ ID NO: 1500417 - RNA, 19 nt, Homo sapiens
cgcgagagccucaccaaga

SEQ ID NO: 1500418 - RNA, 19 nt, Homo sapiens
cgggaccacugccuucaga

SEQ ID NO: 1500419 - RNA, 19 nt, Homo sapiens
ccggagaacccagaggaua

SEQ ID NO: 1500420 - RNA, 19 nt, Homo sapiens
gaugccacgcuacuaaaga

SEQ ID NO: 1500421 - RNA, 19 nt, Homo sapiens
uguguccacuuugccuuua

SEQ ID NO: 1500422 - RNA, 19 nt, Homo sapiens
ucuagucguuuaugacauc

SEQ ID NO: 1500423 - RNA, 19 nt, Homo sapiens
ggacauggacacagaaacc

SEQ ID NO: 1500424 - RNA, 19 nt, Homo sapiens
acccagaggauaccuauga

SEQ ID NO: 1500425 - RNA, 19 nt, Homo sapiens
ccacgcuacuaaagaaguc

SEQ ID NO: 1500426 - RNA, 19 nt, Homo sapiens
gcacacggaccuggacaca

SEQ ID NO: 1500427 - RNA, 19 nt, Homo sapiens
uaaagguaaagacacgaaa

SEQ ID NO: 1500428 - RNA, 19 nt, Homo sapiens
cagaugccacgcuacuaaa

SEQ ID NO: 1500429 - RNA, 19 nt, Homo sapiens
uuggccaccucaucuguaa

SEQ ID NO: 1500430 - RNA, 19 nt, Homo sapiens
acacgcacacgcacacuga

SEQ ID NO: 1500431 - RNA, 19 nt, Homo sapiens
gcaacgccaaguucuucaa

SEQ ID NO: 1500432 - RNA, 19 nt, Homo sapiens
caucuucaaggucaugcua

SEQ ID NO: 1500433 - RNA, 19 nt, Homo sapiens
cgcguucucuggagcuuug

SEQ ID NO: 1500434 - RNA, 19 nt, Homo sapiens
gggccacccuuucccuuuu

SEQ ID NO: 1500435 - RNA, 19 nt, Homo sapiens
augccacgcuacuaaagaa

SEQ ID NO: 1500436 - RNA, 19 nt, Homo sapiens
ggauaaggaggaagugacu

SEQ ID NO: 1500437 - RNA, 19 nt, Homo sapiens
caugguggauaaggaggaa

SEQ ID NO: 1500438 - RNA, 19 nt, Homo sapiens
cuacuaaagaagucagaga

SEQ ID NO: 1500439 - RNA, 19 nt, Homo sapiens
cggcauguguccacuuugc

SEQ ID NO: 1500440 - RNA, 19 nt, Homo sapiens
ugcggcauguguccacuuu

SEQ ID NO: 1500441 - RNA, 19 nt, Homo sapiens
gcgcuuggccaccucaucu

SEQ ID NO: 1500442 - RNA, 19 nt, Homo sapiens
agacgcaucaugguggaua

SEQ ID NO: 1500443 - RNA, 19 nt, Homo sapiens
cgagagccucaccaagaaa

SEQ ID NO: 1500444 - RNA, 19 nt, Homo sapiens
acuaaagaagucagagaaa

SEQ ID NO: 1500445 - RNA, 19 nt, Homo sapiens
agacgaagaggcaguaugc

SEQ ID NO: 1500446 - RNA, 19 nt, Homo sapiens
uauccucguuggaaacaag

SEQ ID NO: 1500447 - RNA, 19 nt, Homo sapiens
guguccacuuugccuuuaa

SEQ ID NO: 1500448 - RNA, 19 nt, Homo sapiens
agagagucuuaaagguaaa

SEQ ID NO: 1500449 - RNA, 19 nt, Homo sapiens
cgaggacgcagaccugaag

SEQ ID NO: 1500450 - RNA, 19 nt, Homo sapiens
guggaggccgucuaggaaa

SEQ ID NO: 1500451 - RNA, 19 nt, Homo sapiens
gagagccucaccaagaaag

SEQ ID NO: 1500452 - RNA, 19 nt, Homo sapiens
ggcuguagaugaacuugac

SEQ ID NO: 1500453 - RNA, 19 nt, Homo sapiens
ccguuauccucguuggaaa

SEQ ID NO: 1500454 - RNA, 19 nt, Homo sapiens
ccagaggauaccuaugaga

SEQ ID NO: 1500455 - RNA, 19 nt, Homo sapiens
uacuaaagaagucagagaa

SEQ ID NO: 1500456 - RNA, 19 nt, Homo sapiens
gaugaggucuucuccauuu

SEQ ID NO: 1500457 - RNA, 19 nt, Homo sapiens
caacauuucuucuuccuuu

SEQ ID NO: 1500458 - RNA, 19 nt, Homo sapiens
ggagagaaaucuuaaguca

SEQ ID NO: 1500459 - RNA, 19 nt, Homo sapiens
gggaauaccuggaacaaga

SEQ ID NO: 1500460 - RNA, 19 nt, Homo sapiens
gaacugaacgggcuggaua

SEQ ID NO: 1500461 - RNA, 19 nt, Homo sapiens
gaacagcaaggucgaagua

SEQ ID NO: 1500462 - RNA, 19 nt, Homo sapiens
caagaaagcagcccuggua

SEQ ID NO: 1500463 - RNA, 19 nt, Homo sapiens
uaaauuugcugugguguuu

SEQ ID NO: 1500464 - RNA, 19 nt, Homo sapiens
gcaccacccuacagcauuu

SEQ ID NO: 1500465 - RNA, 19 nt, Homo sapiens
cugcagaccuuucggguua

SEQ ID NO: 1500466 - RNA, 19 nt, Homo sapiens
gcaaauggccuuucugagu

SEQ ID NO: 1500467 - RNA, 19 nt, Homo sapiens
ugaauaaagugcaaacaga

SEQ ID NO: 1500468 - RNA, 19 nt, Homo sapiens
ggacagauccagggcguua

SEQ ID NO: 1500469 - RNA, 19 nt, Homo sapiens
ggccugagaucuucacuga

SEQ ID NO: 1500470 - RNA, 19 nt, Homo sapiens
gcagagagggcacuacaaa

SEQ ID NO: 1500471 - RNA, 19 nt, Homo sapiens
gcagggaacuaguguuaca

SEQ ID NO: 1500472 - RNA, 19 nt, Homo sapiens
caaugacacuugcuuccua

SEQ ID NO: 1500473 - RNA, 19 nt, Homo sapiens
gcaggccaaugcaggauaa

SEQ ID NO: 1500474 - RNA, 19 nt, Homo sapiens
ccaaugacaccauguauga

SEQ ID NO: 1500475 - RNA, 19 nt, Homo sapiens
ggacuucguucaucugaca

SEQ ID NO: 1500476 - RNA, 19 nt, Homo sapiens
gcauuguggucuccaguuu

SEQ ID NO: 1500477 - RNA, 19 nt, Homo sapiens
gcagaucaacuccauggua

SEQ ID NO: 1500478 - RNA, 19 nt, Homo sapiens
gaaugaggccugaacagaa

SEQ ID NO: 1500479 - RNA, 19 nt, Homo sapiens
ccaguuuccugaugaguuu

SEQ ID NO: 1500480 - RNA, 19 nt, Homo sapiens
gaauaaagugcaaacagaa

SEQ ID NO: 1500481 - RNA, 19 nt, Homo sapiens
gaaccagaauggacaacug

SEQ ID NO: 1500482 - RNA, 19 nt, Homo sapiens
cagaagugcauccugauua

SEQ ID NO: 1500483 - RNA, 19 nt, Homo sapiens
gagcugggauggcugcuau

SEQ ID NO: 1500484 - RNA, 19 nt, Homo sapiens
gaaggaggcucuggcaaag

SEQ ID NO: 1500485 - RNA, 19 nt, Homo sapiens
gaaaggagagcccagaaca

SEQ ID NO: 1500486 - RNA, 19 nt, Homo sapiens
gagcaaauggccuuucuga

SEQ ID NO: 1500487 - RNA, 19 nt, Homo sapiens
gcucacgguucuuuacauu

SEQ ID NO: 1500488 - RNA, 19 nt, Homo sapiens
ggacuuaccgauccaguug

SEQ ID NO: 1500489 - RNA, 19 nt, Homo sapiens
cagaaccugugccaaauug

SEQ ID NO: 1500490 - RNA, 19 nt, Homo sapiens
caaguacccaccaaccuua

SEQ ID NO: 1500491 - RNA, 19 nt, Homo sapiens
ugacagcgcuggguuauac

SEQ ID NO: 1500492 - RNA, 19 nt, Homo sapiens
gggaagugcuggagaccuu

SEQ ID NO: 1500493 - RNA, 19 nt, Homo sapiens
gcucagcccucaccagauc

SEQ ID NO: 1500494 - RNA, 19 nt, Homo sapiens
ccagacagcugugugguau

SEQ ID NO: 1500495 - RNA, 19 nt, Homo sapiens
ggacagacuauccaaugaa

SEQ ID NO: 1500496 - RNA, 19 nt, Homo sapiens
ggaaugaggccugaacaga

SEQ ID NO: 1500497 - RNA, 19 nt, Homo sapiens
gaacucaccuccgguacca

SEQ ID NO: 1500498 - RNA, 19 nt, Homo sapiens
cagaggagcuccagcacau

SEQ ID NO: 1500499 - RNA, 19 nt, Homo sapiens
caacccagauugcagagau

SEQ ID NO: 1500500 - RNA, 19 nt, Homo sapiens
gagagacauuugccacaga

SEQ ID NO: 1500501 - RNA, 19 nt, Homo sapiens
gacagacuauccaaugaau

SEQ ID NO: 1500502 - RNA, 19 nt, Homo sapiens
gcaaguacccaccaaccuu

SEQ ID NO: 1500503 - RNA, 19 nt, Homo sapiens
cauuaaagcugcuacaacu

SEQ ID NO: 1500504 - RNA, 19 nt, Homo sapiens
gcaguaaccucuccuuuuc

SEQ ID NO: 1500505 - RNA, 19 nt, Homo sapiens
caacuucuccauccacuug

SEQ ID NO: 1500506 - RNA, 19 nt, Homo sapiens
ccacucagcuccgcauugu

SEQ ID NO: 1500507 - RNA, 19 nt, Homo sapiens
gccaaauugugcagaugua

SEQ ID NO: 1500508 - RNA, 19 nt, Homo sapiens
gaaagcagcccugguagca

SEQ ID NO: 1500509 - RNA, 19 nt, Homo sapiens
gauuacagcccaggaauga

SEQ ID NO: 1500510 - RNA, 19 nt, Homo sapiens
ccucccagcucuucauuga

SEQ ID NO: 1500511 - RNA, 19 nt, Homo sapiens
agaagugcauccugauuau

SEQ ID NO: 1500512 - RNA, 19 nt, Homo sapiens
gcuaugagccugucucuac

SEQ ID NO: 1500513 - RNA, 19 nt, Homo sapiens
ugucaucccuccuccuaaa

SEQ ID NO: 1500514 - RNA, 19 nt, Homo sapiens
cuuaauaggucuaggagau

SEQ ID NO: 1500515 - RNA, 19 nt, Homo sapiens
gcaagcuacuccuggacuu

SEQ ID NO: 1500516 - RNA, 19 nt, Homo sapiens
ugaacgggcuggauagcaa

SEQ ID NO: 1500517 - RNA, 19 nt, Homo sapiens
agauggagcucucagacuu

SEQ ID NO: 1500518 - RNA, 19 nt, Homo sapiens
gaccuuaggcccuuugguu

SEQ ID NO: 1500519 - RNA, 19 nt, Homo sapiens
caucccuccuccuaaauuu

SEQ ID NO: 1500520 - RNA, 19 nt, Homo sapiens
gcagcuugguaggcucuua

SEQ ID NO: 1500521 - RNA, 19 nt, Homo sapiens
ggacugccugacauuauuu

SEQ ID NO: 1500522 - RNA, 19 nt, Homo sapiens
gagccaggaugaaguagag

SEQ ID NO: 1500523 - RNA, 19 nt, Homo sapiens
ggaggcauguccugugagu

SEQ ID NO: 1500524 - RNA, 19 nt, Homo sapiens
ugucaccacucaucccuuu

SEQ ID NO: 1500525 - RNA, 19 nt, Homo sapiens
cuacagcauuuccaacuuc

SEQ ID NO: 1500526 - RNA, 19 nt, Homo sapiens
cagaagcugaugaggaaua

SEQ ID NO: 1500527 - RNA, 19 nt, Homo sapiens
ucuaggagaucgggaacua

SEQ ID NO: 1500528 - RNA, 19 nt, Homo sapiens
ccacacgccuacacuaucu

SEQ ID NO: 1500529 - RNA, 19 nt, Homo sapiens
ucuaucagcugcccacuag

SEQ ID NO: 1500530 - RNA, 19 nt, Homo sapiens
gagcugcuggccugcuuua

SEQ ID NO: 1500531 - RNA, 19 nt, Homo sapiens
ccagacaacugcuccuucu

SEQ ID NO: 1500532 - RNA, 19 nt, Homo sapiens
gcagaccuuucggguuaaa

SEQ ID NO: 1500533 - RNA, 19 nt, Homo sapiens
gagcagcgacgagcaguug

SEQ ID NO: 1500534 - RNA, 19 nt, Homo sapiens
gaaccugugccaaauugug

SEQ ID NO: 1500535 - RNA, 19 nt, Homo sapiens
acagagagcacacgacaga

SEQ ID NO: 1500536 - RNA, 19 nt, Homo sapiens
aaggacggguggcauauga

SEQ ID NO: 1500537 - RNA, 19 nt, Homo sapiens
cagaaggacggguggcaua

SEQ ID NO: 1500538 - RNA, 19 nt, Homo sapiens
gcucugcggcuccaugauu

SEQ ID NO: 1500539 - RNA, 19 nt, Homo sapiens
ggagagcccagaacagcaa

SEQ ID NO: 1500540 - RNA, 19 nt, Homo sapiens
ccagugcucugaggaacaa

SEQ ID NO: 1500541 - RNA, 19 nt, Homo sapiens
gaggacugccugacauuau

SEQ ID NO: 1500542 - RNA, 19 nt, Homo sapiens
ggagucuguucuugggaaa

SEQ ID NO: 1500543 - RNA, 19 nt, Homo sapiens
uuacuccucuugccauuuc

SEQ ID NO: 1500544 - RNA, 19 nt, Homo sapiens
gcaagcuggacgccuagua

SEQ ID NO: 1500545 - RNA, 19 nt, Homo sapiens
caugguagacuuccuugaa

SEQ ID NO: 1500546 - RNA, 19 nt, Homo sapiens
ccacacaggugagaauaac

SEQ ID NO: 1500547 - RNA, 19 nt, Homo sapiens
agaaggaggcucuggcaaa

SEQ ID NO: 1500548 - RNA, 19 nt, Homo sapiens
gccagagccugauaccaau

SEQ ID NO: 1500549 - RNA, 19 nt, Homo sapiens
gaagugcauccugauuauu

SEQ ID NO: 1500550 - RNA, 19 nt, Homo sapiens
gcacaguuucucuggaaga

SEQ ID NO: 1500551 - RNA, 19 nt, Homo sapiens
cugcagggaacuaguguua

SEQ ID NO: 1500552 - RNA, 19 nt, Homo sapiens
uggaugcgaucugcaguaa

SEQ ID NO: 1500553 - RNA, 19 nt, Homo sapiens
uucaacagcugcucuuaug

SEQ ID NO: 1500554 - RNA, 19 nt, Homo sapiens
gcaggagacccaggacuug

SEQ ID NO: 1500555 - RNA, 19 nt, Homo sapiens
gcagaguggucggcaugug

SEQ ID NO: 1500556 - RNA, 19 nt, Homo sapiens
caaagaagcucaauugaua

SEQ ID NO: 1500557 - RNA, 19 nt, Homo sapiens
gaagauggcuauauucauu

SEQ ID NO: 1500558 - RNA, 19 nt, Homo sapiens
aaacagcucuggagaauaa

SEQ ID NO: 1500559 - RNA, 19 nt, Homo sapiens
gcacccaugugauuagaua

SEQ ID NO: 1500560 - RNA, 19 nt, Homo sapiens
caugugaacugcuggaaua

SEQ ID NO: 1500561 - RNA, 19 nt, Homo sapiens
gcaaacaugucccauuuua

SEQ ID NO: 1500562 - RNA, 19 nt, Homo sapiens
uaaaucagaucccaaauag

SEQ ID NO: 1500563 - RNA, 19 nt, Homo sapiens
gaugaggucucccauguga

SEQ ID NO: 1500564 - RNA, 19 nt, Homo sapiens
gaaagacgaauuagaggua

SEQ ID NO: 1500565 - RNA, 19 nt, Homo sapiens
cugaagagcucaugaaaga

SEQ ID NO: 1500566 - RNA, 19 nt, Homo sapiens
gaacucagcuuccucuacu

SEQ ID NO: 1500567 - RNA, 19 nt, Homo sapiens
gaccugagccuguguauga

SEQ ID NO: 1500568 - RNA, 19 nt, Homo sapiens
gaugaaauaccgccacaua

SEQ ID NO: 1500569 - RNA, 19 nt, Homo sapiens
ggucaugccucaagcuauu

SEQ ID NO: 1500570 - RNA, 19 nt, Homo sapiens
gcaauccgcuucuuaaggu

SEQ ID NO: 1500571 - RNA, 19 nt, Homo sapiens
gaaauaccgccacauagaa

SEQ ID NO: 1500572 - RNA, 19 nt, Homo sapiens
guccuuugcugaugaaaua

SEQ ID NO: 1500573 - RNA, 19 nt, Homo sapiens
aaucagaucccaaauagua

SEQ ID NO: 1500574 - RNA, 19 nt, Homo sapiens
acacauaccuggauucaca

SEQ ID NO: 1500575 - RNA, 19 nt, Homo sapiens
caagaggacuuugguucua

SEQ ID NO: 1500576 - RNA, 19 nt, Homo sapiens
ggccuuaccuuggaauuaa

SEQ ID NO: 1500577 - RNA, 19 nt, Homo sapiens
gaaaggaggcugagguugu

SEQ ID NO: 1500578 - RNA, 19 nt, Homo sapiens
gagauucccuagggcuuua

SEQ ID NO: 1500579 - RNA, 19 nt, Homo sapiens
gcaaagaagcucaauugau

SEQ ID NO: 1500580 - RNA, 19 nt, Homo sapiens
gugaacugcuggaauauga

SEQ ID NO: 1500581 - RNA, 19 nt, Homo sapiens
uuagauaguuccugacaaa

SEQ ID NO: 1500582 - RNA, 19 nt, Homo sapiens
ccugaucaguaaccuauua

SEQ ID NO: 1500583 - RNA, 19 nt, Homo sapiens
gguguaaccucccugcaaa

SEQ ID NO: 1500584 - RNA, 19 nt, Homo sapiens
gaagcucaauugauagugu

SEQ ID NO: 1500585 - RNA, 19 nt, Homo sapiens
caggugggcuuaucuaaau

SEQ ID NO: 1500586 - RNA, 19 nt, Homo sapiens
gauaguuccugacaaaaua

SEQ ID NO: 1500587 - RNA, 19 nt, Homo sapiens
cugcaaacaugucccauuu

SEQ ID NO: 1500588 - RNA, 19 nt, Homo sapiens
cuuugaaacuggcacauua

SEQ ID NO: 1500589 - RNA, 19 nt, Homo sapiens
aaaggaggcugagguugua

SEQ ID NO: 1500590 - RNA, 19 nt, Homo sapiens
cagaugaggucucccaugu

SEQ ID NO: 1500591 - RNA, 19 nt, Homo sapiens
uuaaggugcuuucgagauu

SEQ ID NO: 1500592 - RNA, 19 nt, Homo sapiens
uaaccucccugcaaacaug

SEQ ID NO: 1500593 - RNA, 19 nt, Homo sapiens
cuaaaucagaucccaaaua

SEQ ID NO: 1500594 - RNA, 19 nt, Homo sapiens
ggucuuggcuccaggaagu

SEQ ID NO: 1500595 - RNA, 19 nt, Homo sapiens
uaaggugcuuucgagauua

SEQ ID NO: 1500596 - RNA, 19 nt, Homo sapiens
gguuguagcucacacauac

SEQ ID NO: 1500597 - RNA, 19 nt, Homo sapiens
ccacauagaacuucaaugg

SEQ ID NO: 1500598 - RNA, 19 nt, Homo sapiens
ggucaaguccuuagauaug

SEQ ID NO: 1500599 - RNA, 19 nt, Homo sapiens
ugaaauaccgccacauaga

SEQ ID NO: 1500600 - RNA, 19 nt, Homo sapiens
gaaguguaccuaacagaug

SEQ ID NO: 1500601 - RNA, 19 nt, Homo sapiens
gcaggugggcuuaucuaaa

SEQ ID NO: 1500602 - RNA, 19 nt, Homo sapiens
acagagaaguagaagacua

SEQ ID NO: 1500603 - RNA, 19 nt, Homo sapiens
ggacugaagagcucaugaa

SEQ ID NO: 1500604 - RNA, 19 nt, Homo sapiens
ucagcuuccucuacuuaua

SEQ ID NO: 1500605 - RNA, 19 nt, Homo sapiens
gaaucucuaccuugucuuu

SEQ ID NO: 1500606 - RNA, 19 nt, Homo sapiens
uaaagcuguuggaccuaua

SEQ ID NO: 1500607 - RNA, 19 nt, Homo sapiens
cuacaaggacagugcguua

SEQ ID NO: 1500608 - RNA, 19 nt, Homo sapiens
gcucacacauaccuggauu

SEQ ID NO: 1500609 - RNA, 19 nt, Homo sapiens
aagcaaagaagcucaauug

SEQ ID NO: 1500610 - RNA, 19 nt, Homo sapiens
ggaagcagagcucaaagga

SEQ ID NO: 1500611 - RNA, 19 nt, Homo sapiens
aaacauuuccaccuuugua

SEQ ID NO: 1500612 - RNA, 19 nt, Homo sapiens
ggccaugaauauaagcaaa

SEQ ID NO: 1500613 - RNA, 19 nt, Homo sapiens
cagagaaguagaagacuaa

SEQ ID NO: 1500614 - RNA, 19 nt, Homo sapiens
cagaaucucuaccuugucu

SEQ ID NO: 1500615 - RNA, 19 nt, Homo sapiens
uuaaacauuuccaccuuug

SEQ ID NO: 1500616 - RNA, 19 nt, Homo sapiens
guguaugacuccagaugaa

SEQ ID NO: 1500617 - RNA, 19 nt, Homo sapiens
gaagagcucaugaaagacu

SEQ ID NO: 1500618 - RNA, 19 nt, Homo sapiens
caguuucccucuugaaugu

SEQ ID NO: 1500619 - RNA, 19 nt, Homo sapiens
ggaaguguaccuaacagau

SEQ ID NO: 1500620 - RNA, 19 nt, Homo sapiens
gcuguggccuuaccuugga

SEQ ID NO: 1500621 - RNA, 19 nt, Homo sapiens
uaccacaguuucccucuug

SEQ ID NO: 1500622 - RNA, 19 nt, Homo sapiens
ccaauuggcagaaacacuu

SEQ ID NO: 1500623 - RNA, 19 nt, Homo sapiens
gcuguuggaccuauacuga

SEQ ID NO: 1500624 - RNA, 19 nt, Homo sapiens
cucaucaaauguagcuuua

SEQ ID NO: 1500625 - RNA, 19 nt, Homo sapiens
ucauuacggugacaaagug

SEQ ID NO: 1500626 - RNA, 19 nt, Homo sapiens
uaacugaagauggcuauau

SEQ ID NO: 1500627 - RNA, 19 nt, Homo sapiens
ucucugggcacuauauuaa

SEQ ID NO: 1500628 - RNA, 19 nt, Homo sapiens
ccaaggaaccacuggaugu

SEQ ID NO: 1500629 - RNA, 19 nt, Homo sapiens
caaggacagugcguuacuu

SEQ ID NO: 1500630 - RNA, 19 nt, Homo sapiens
cagcucuggagaauaauua

SEQ ID NO: 1500631 - RNA, 19 nt, Homo sapiens
cacaacugauucucucuug

SEQ ID NO: 1500632 - RNA, 19 nt, Homo sapiens
ugagaccgaugcaacuuuc

SEQ ID NO: 1500633 - RNA, 19 nt, Homo sapiens
guagaagacuaaaacagaa

SEQ ID NO: 1500634 - RNA, 19 nt, Homo sapiens
aagaggacuuugguucuaa

SEQ ID NO: 1500635 - RNA, 19 nt, Homo sapiens
gaauauaagcaaagaagcu

SEQ ID NO: 1500636 - RNA, 19 nt, Homo sapiens
ccaugaauauaagcaaaga

SEQ ID NO: 1500637 - RNA, 19 nt, Homo sapiens
ccaccggcaucuuuucuua

SEQ ID NO: 1500638 - RNA, 19 nt, Homo sapiens
gaagaauuccugccagacu

SEQ ID NO: 1500639 - RNA, 19 nt, Homo sapiens
aaguguaccuaacagauga

SEQ ID NO: 1500640 - RNA, 19 nt, Homo sapiens
caggaggauuugacaacaa

SEQ ID NO: 1500641 - RNA, 19 nt, Homo sapiens
cuagcaauccgcuucuuaa

SEQ ID NO: 1500642 - RNA, 19 nt, Homo sapiens
gagcgcaggugggcuuauc

SEQ ID NO: 1500643 - RNA, 19 nt, Homo sapiens
gcagcccaccggcaucuuu

SEQ ID NO: 1500644 - RNA, 19 nt, Homo sapiens
cuggucaaguccuuagaua

SEQ ID NO: 1500645 - RNA, 19 nt, Homo sapiens
aaagaugacagccauggaa

SEQ ID NO: 1500646 - RNA, 19 nt, Homo sapiens
aaauguccuuugcugauga

SEQ ID NO: 1500647 - RNA, 19 nt, Homo sapiens
caaucacugucacacaaau

SEQ ID NO: 1500648 - RNA, 19 nt, Homo sapiens
aacugaagauggcuauauu

SEQ ID NO: 1500649 - RNA, 19 nt, Homo sapiens
gcaacuuuccguaacugaa

SEQ ID NO: 1500650 - RNA, 19 nt, Homo sapiens
ugaaagugacaaacaauag

SEQ ID NO: 1500651 - RNA, 19 nt, Homo sapiens
gggacucucugggcacuau

SEQ ID NO: 1500652 - RNA, 19 nt, Homo sapiens
auaccuggauucacauaga

SEQ ID NO: 1500653 - RNA, 19 nt, Homo sapiens
gggaaacuucucauacaga

SEQ ID NO: 1500654 - RNA, 19 nt, Homo sapiens
aagcucaauugauagugua

SEQ ID NO: 1500655 - RNA, 19 nt, Homo sapiens
cuccugaaaucgucuaaga

SEQ ID NO: 1500656 - RNA, 19 nt, Homo sapiens
aaacaguccucuggaauaa

SEQ ID NO: 1500657 - RNA, 19 nt, Homo sapiens
cagcagggcuuccaugaga

SEQ ID NO: 1500658 - RNA, 19 nt, Homo sapiens
ucacagagacucgcaauaa

SEQ ID NO: 1500659 - RNA, 19 nt, Homo sapiens
ccaaauguaugagaagauu

SEQ ID NO: 1500660 - RNA, 19 nt, Homo sapiens
uaaacaguccucuggaaua

SEQ ID NO: 1500661 - RNA, 19 nt, Homo sapiens
ccucagacauuaaaggauu

SEQ ID NO: 1500662 - RNA, 19 nt, Homo sapiens
cacgagaccuucuggcuuu

SEQ ID NO: 1500663 - RNA, 19 nt, Homo sapiens
ggacugaagccuggaaauu

SEQ ID NO: 1500664 - RNA, 19 nt, Homo sapiens
ggagugagggaguagauaa

SEQ ID NO: 1500665 - RNA, 19 nt, Homo sapiens
gcaacacgcaggcagagua

SEQ ID NO: 1500666 - RNA, 19 nt, Homo sapiens
uaacauugcacgugacauu

SEQ ID NO: 1500667 - RNA, 19 nt, Homo sapiens
gaagaacuacaaggccuua

SEQ ID NO: 1500668 - RNA, 19 nt, Homo sapiens
caccggaacuucacagaga

SEQ ID NO: 1500669 - RNA, 19 nt, Homo sapiens
uauaaacaguccucuggaa

SEQ ID NO: 1500670 - RNA, 19 nt, Homo sapiens
ucacgggacuucauuugug

SEQ ID NO: 1500671 - RNA, 19 nt, Homo sapiens
agaagaggcuagagaagau

SEQ ID NO: 1500672 - RNA, 19 nt, Homo sapiens
uacaaggccuuaugccaaa

SEQ ID NO: 1500673 - RNA, 19 nt, Homo sapiens
gcaacguccucaucgacaa

SEQ ID NO: 1500674 - RNA, 19 nt, Homo sapiens
ugggacagcuucuuugaug

SEQ ID NO: 1500675 - RNA, 19 nt, Homo sapiens
agaucuugcuccugaguua

SEQ ID NO: 1500676 - RNA, 19 nt, Homo sapiens
ggacuucauuuguguuaac

SEQ ID NO: 1500677 - RNA, 19 nt, Homo sapiens
cgaaaaggauuaagcauca

SEQ ID NO: 1500678 - RNA, 19 nt, Homo sapiens
caaaucacgggacuucauu

SEQ ID NO: 1500679 - RNA, 19 nt, Homo sapiens
augcugagcucauccagaa

SEQ ID NO: 1500680 - RNA, 19 nt, Homo sapiens
gcaugaggaggaagaacua

SEQ ID NO: 1500681 - RNA, 19 nt, Homo sapiens
gggaagcccugcaggaacu

SEQ ID NO: 1500682 - RNA, 19 nt, Homo sapiens
gaaugggacagcuucuuug

SEQ ID NO: 1500683 - RNA, 19 nt, Homo sapiens
gacauuaaaggauuucuuc

SEQ ID NO: 1500684 - RNA, 19 nt, Homo sapiens
gacaagaagaggcuagaga

SEQ ID NO: 1500685 - RNA, 19 nt, Homo sapiens
gaacuacaaggccuuaugc

SEQ ID NO: 1500686 - RNA, 19 nt, Homo sapiens
gggacagcuucuuugauga

SEQ ID NO: 1500687 - RNA, 19 nt, Homo sapiens
ccaagaaccuagacaugcu

SEQ ID NO: 1500688 - RNA, 19 nt, Homo sapiens
ucaaguccuucgaugaugu

SEQ ID NO: 1500689 - RNA, 19 nt, Homo sapiens
ggccuuaugccaaauguau

SEQ ID NO: 1500690 - RNA, 19 nt, Homo sapiens
acaagaagaggcuagagaa

SEQ ID NO: 1500691 - RNA, 19 nt, Homo sapiens
gggcuuccaugagaugaug

SEQ ID NO: 1500692 - RNA, 19 nt, Homo sapiens
gacugaagccuggaaauuc

SEQ ID NO: 1500693 - RNA, 19 nt, Homo sapiens
gaaaaccacccauugacaa

SEQ ID NO: 1500694 - RNA, 19 nt, Homo sapiens
gcacgugacauucagaaaa

SEQ ID NO: 1500695 - RNA, 19 nt, Homo sapiens
ggacagcuucuuugaugag

SEQ ID NO: 1500696 - RNA, 19 nt, Homo sapiens
gaagagaaaaccacccauu

SEQ ID NO: 1500697 - RNA, 19 nt, Homo sapiens
gagugagggaguagauaaa

SEQ ID NO: 1500698 - RNA, 19 nt, Homo sapiens
gaagaucuugcuccugagu

SEQ ID NO: 1500699 - RNA, 19 nt, Homo sapiens
cagcugcaauauaaacagu

SEQ ID NO: 1500700 - RNA, 19 nt, Homo sapiens
ccaagugaguucugaucag

SEQ ID NO: 1500701 - RNA, 19 nt, Homo sapiens
aagaagaggcuagagaaga

SEQ ID NO: 1500702 - RNA, 19 nt, Homo sapiens
uaugccaaauguaugagaa

SEQ ID NO: 1500703 - RNA, 19 nt, Homo sapiens
gggacuucauuuguguuaa

SEQ ID NO: 1500704 - RNA, 19 nt, Homo sapiens
ccaaaucacgggacuucau

SEQ ID NO: 1500705 - RNA, 19 nt, Homo sapiens
cagcuucuuugaugagagu

SEQ ID NO: 1500706 - RNA, 19 nt, Homo sapiens
gacagcuucuuugaugaga

SEQ ID NO: 1500707 - RNA, 19 nt, Homo sapiens
ggccaagaaccuagacaug

SEQ ID NO: 1500708 - RNA, 19 nt, Homo sapiens
gcagggcuuccaugagaug

SEQ ID NO: 1500709 - RNA, 19 nt, Homo sapiens
cacagagacucgcaauaac

SEQ ID NO: 1500710 - RNA, 19 nt, Homo sapiens
aaacagcugcaauauaaac

SEQ ID NO: 1500711 - RNA, 19 nt, Homo sapiens
caacaaccucaucgaccuu

SEQ ID NO: 1500712 - RNA, 19 nt, Homo sapiens
caagaagaggcuagagaag

SEQ ID NO: 1500713 - RNA, 19 nt, Homo sapiens
guguuaacauccuggaaag

SEQ ID NO: 1500714 - RNA, 19 nt, Homo sapiens
gauaaaacagcugcaauau

SEQ ID NO: 1500715 - RNA, 19 nt, Homo sapiens
acagucagccuccuucauc

SEQ ID NO: 1500716 - RNA, 19 nt, Homo sapiens
acagagacucgcaauaaca

SEQ ID NO: 1500717 - RNA, 19 nt, Homo sapiens
cgggacuucauuuguguua

SEQ ID NO: 1500718 - RNA, 19 nt, Homo sapiens
cacgggacuucauuugugu

SEQ ID NO: 1500719 - RNA, 19 nt, Homo sapiens
acaguccucuggaauaaaa

SEQ ID NO: 1500720 - RNA, 19 nt, Homo sapiens
ugaggaggaagaacuacaa

SEQ ID NO: 1500721 - RNA, 19 nt, Homo sapiens
cuucauuuguguuaacauc

SEQ ID NO: 1500722 - RNA, 19 nt, Homo sapiens
ggccaaaucacgggacuuc

SEQ ID NO: 1500723 - RNA, 19 nt, Homo sapiens
cgaccuugaugcugaugag

SEQ ID NO: 1500724 - RNA, 19 nt, Homo sapiens
gcugugucaucaacauugg

SEQ ID NO: 1500725 - RNA, 19 nt, Homo sapiens
uguguuaacauccuggaaa

SEQ ID NO: 1500726 - RNA, 19 nt, Homo sapiens
agauaaaacagcugcaaua

SEQ ID NO: 1500727 - RNA, 19 nt, Homo sapiens
gguuuaugcugagcucauc

SEQ ID NO: 1500728 - RNA, 19 nt, Homo sapiens
cagagacucgcaauaacau

SEQ ID NO: 1500729 - RNA, 19 nt, Homo sapiens
ugccaaauguaugagaaga

SEQ ID NO: 1500730 - RNA, 19 nt, Homo sapiens
gaagaggcuagagaagauc

SEQ ID NO: 1500731 - RNA, 19 nt, Homo sapiens
aaucacgggacuucauuug

SEQ ID NO: 1500732 - RNA, 19 nt, Homo sapiens
ccuuaugccaaauguauga

SEQ ID NO: 1500733 - RNA, 19 nt, Homo sapiens
gacagcaugaggaggaaga

SEQ ID NO: 1500734 - RNA, 19 nt, Homo sapiens
cucagacauuaaaggauuu

SEQ ID NO: 1500735 - RNA, 19 nt, Homo sapiens
cagaaaaucuaugacaaag

SEQ ID NO: 1500736 - RNA, 19 nt, Homo sapiens
gaagagcaaugaauacuga

SEQ ID NO: 1500737 - RNA, 19 nt, Homo sapiens
ccaggacacuuacugauua

SEQ ID NO: 1500738 - RNA, 19 nt, Homo sapiens
gaauuaagcuugcccuugu

SEQ ID NO: 1500739 - RNA, 19 nt, Homo sapiens
gcacgaagagcaaugaaua

SEQ ID NO: 1500740 - RNA, 19 nt, Homo sapiens
gagaugaugcaaagaauua

SEQ ID NO: 1500741 - RNA, 19 nt, Homo sapiens
ggaggcaucuuuguacaua

SEQ ID NO: 1500742 - RNA, 19 nt, Homo sapiens
gaaagaaaaugaacggaua

SEQ ID NO: 1500743 - RNA, 19 nt, Homo sapiens
uagaaggccuacaggauua

SEQ ID NO: 1500744 - RNA, 19 nt, Homo sapiens
cagaaugguugaaggauaa

SEQ ID NO: 1500745 - RNA, 19 nt, Homo sapiens
ugacauagcugaacuuugc

SEQ ID NO: 1500746 - RNA, 19 nt, Homo sapiens
cuagaaaucuugcuccaaa

SEQ ID NO: 1500747 - RNA, 19 nt, Homo sapiens
caacuagaauuguauguag

SEQ ID NO: 1500748 - RNA, 19 nt, Homo sapiens
gaugaagauugaagaagaa

SEQ ID NO: 1500749 - RNA, 19 nt, Homo sapiens
ggucaacuuuccuccauuu

SEQ ID NO: 1500750 - RNA, 19 nt, Homo sapiens
cuaaggcacuggaauuauu

SEQ ID NO: 1500751 - RNA, 19 nt, Homo sapiens
ccagaaugguugaaggaua

SEQ ID NO: 1500752 - RNA, 19 nt, Homo sapiens
ugacuugaaucauuucuga

SEQ ID NO: 1500753 - RNA, 19 nt, Homo sapiens
acaaagagaugaugcaaag

SEQ ID NO: 1500754 - RNA, 19 nt, Homo sapiens
aagcaaagauugggaauga

SEQ ID NO: 1500755 - RNA, 19 nt, Homo sapiens
uagcugaacuuugcgauuu

SEQ ID NO: 1500756 - RNA, 19 nt, Homo sapiens
ucagagagaagagaaauua

SEQ ID NO: 1500757 - RNA, 19 nt, Homo sapiens
ggauaaaggaaacaaauug

SEQ ID NO: 1500758 - RNA, 19 nt, Homo sapiens
acacaaggcuauugaagau

SEQ ID NO: 1500759 - RNA, 19 nt, Homo sapiens
gaaauuuggcaucuagaaa

SEQ ID NO: 1500760 - RNA, 19 nt, Homo sapiens
caacagcucuucgugaauc

SEQ ID NO: 1500761 - RNA, 19 nt, Homo sapiens
ggaaugccucuucagguua

SEQ ID NO: 1500762 - RNA, 19 nt, Homo sapiens
ugaugaagauugaagaaga

SEQ ID NO: 1500763 - RNA, 19 nt, Homo sapiens
ggacacuuacugauuaauu

SEQ ID NO: 1500764 - RNA, 19 nt, Homo sapiens
gcacauguacgacguggaa

SEQ ID NO: 1500765 - RNA, 19 nt, Homo sapiens
gagaagagaaauuauguca

SEQ ID NO: 1500766 - RNA, 19 nt, Homo sapiens
gaugagagcagcaaagcaa

SEQ ID NO: 1500767 - RNA, 19 nt, Homo sapiens
agacaaugcuaaugcaaga

SEQ ID NO: 1500768 - RNA, 19 nt, Homo sapiens
ugacggguguugacaaaga

SEQ ID NO: 1500769 - RNA, 19 nt, Homo sapiens
gagagaagagaaauuaugu

SEQ ID NO: 1500770 - RNA, 19 nt, Homo sapiens
aagcggcacuuaagauuga

SEQ ID NO: 1500771 - RNA, 19 nt, Homo sapiens
cggaaugccucuucagguu

SEQ ID NO: 1500772 - RNA, 19 nt, Homo sapiens
uggcagcuaucaaugcaua

SEQ ID NO: 1500773 - RNA, 19 nt, Homo sapiens
cagcaaagcgggaagauca

SEQ ID NO: 1500774 - RNA, 19 nt, Homo sapiens
uaagaugccacuauuguau

SEQ ID NO: 1500775 - RNA, 19 nt, Homo sapiens
gaaugccucuucagguuag

SEQ ID NO: 1500776 - RNA, 19 nt, Homo sapiens
caaccaagcaggcgcaaga

SEQ ID NO: 1500777 - RNA, 19 nt, Homo sapiens
ucgcucagaucguaaggua

SEQ ID NO: 1500778 - RNA, 19 nt, Homo sapiens
gaaguuaaaggaagacagu

SEQ ID NO: 1500779 - RNA, 19 nt, Homo sapiens
gguaugggucuacuucuuu

SEQ ID NO: 1500780 - RNA, 19 nt, Homo sapiens
gagcagcaaagcaaagauu

SEQ ID NO: 1500781 - RNA, 19 nt, Homo sapiens
gaagcggcacuuaagauug

SEQ ID NO: 1500782 - RNA, 19 nt, Homo sapiens
acaaggcuauugaagauuc

SEQ ID NO: 1500783 - RNA, 19 nt, Homo sapiens
gcugaacuuugcgauuuaa

SEQ ID NO: 1500784 - RNA, 19 nt, Homo sapiens
gcaaauuaaagaaggaaga

SEQ ID NO: 1500785 - RNA, 19 nt, Homo sapiens
aaagagaugaugcaaagaa

SEQ ID NO: 1500786 - RNA, 19 nt, Homo sapiens
gcaaagauugggaaugaca

SEQ ID NO: 1500787 - RNA, 19 nt, Homo sapiens
auaguuaccaggacacuua

SEQ ID NO: 1500788 - RNA, 19 nt, Homo sapiens
gaaggauaaaggaaacaaa

SEQ ID NO: 1500789 - RNA, 19 nt, Homo sapiens
gaggaggaguggcuacaca

SEQ ID NO: 1500790 - RNA, 19 nt, Homo sapiens
cccaacagcucuucgugaa

SEQ ID NO: 1500791 - RNA, 19 nt, Homo sapiens
caggacacuuacugauuaa

SEQ ID NO: 1500792 - RNA, 19 nt, Homo sapiens
guaugggucuacuucuuug

SEQ ID NO: 1500793 - RNA, 19 nt, Homo sapiens
gaagggcuggcgcauggua

SEQ ID NO: 1500794 - RNA, 19 nt, Homo sapiens
acaaauugaugcugagaag

SEQ ID NO: 1500795 - RNA, 19 nt, Homo sapiens
agaugccacuauuguauuu

SEQ ID NO: 1500796 - RNA, 19 nt, Homo sapiens
gcagcuaucaaugcauaua

SEQ ID NO: 1500797 - RNA, 19 nt, Homo sapiens
gaagauugaagaagaagag

SEQ ID NO: 1500798 - RNA, 19 nt, Homo sapiens
gcaaagcgggaagaucaaa

SEQ ID NO: 1500799 - RNA, 19 nt, Homo sapiens
ggguaugggucuacuucuu

SEQ ID NO: 1500800 - RNA, 19 nt, Homo sapiens
ucugucaacuagaauugua

SEQ ID NO: 1500801 - RNA, 19 nt, Homo sapiens
aacauucgcucagaucgua

SEQ ID NO: 1500802 - RNA, 19 nt, Homo sapiens
gaaaaugaacggauaaaag

SEQ ID NO: 1500803 - RNA, 19 nt, Homo sapiens
gggagaaauucagaaaaua

SEQ ID NO: 1500804 - RNA, 19 nt, Homo sapiens
uuauugaugccaccuguua

SEQ ID NO: 1500805 - RNA, 19 nt, Homo sapiens
ugaagcggcacuuaagauu

SEQ ID NO: 1500806 - RNA, 19 nt, Homo sapiens
ggaggaguggcuacacaaa

SEQ ID NO: 1500807 - RNA, 19 nt, Homo sapiens
aaagggagaaauucagaaa

SEQ ID NO: 1500808 - RNA, 19 nt, Homo sapiens
agcaaugaauacugacaua

SEQ ID NO: 1500809 - RNA, 19 nt, Homo sapiens
guuaaaggaagacaguauu

SEQ ID NO: 1500810 - RNA, 19 nt, Homo sapiens
uuacugagaaguuaaagga

SEQ ID NO: 1500811 - RNA, 19 nt, Homo sapiens
gaaaagcugaggagcaaaa

SEQ ID NO: 1500812 - RNA, 19 nt, Homo sapiens
aaaagaagcuacagaagca

SEQ ID NO: 1500813 - RNA, 19 nt, Homo sapiens
aggcaucuuuguacauauu

SEQ ID NO: 1500814 - RNA, 19 nt, Homo sapiens
aaucacaaguagcagaaga

SEQ ID NO: 1500815 - RNA, 19 nt, Homo sapiens
cagcuucccuagcaaccaa

SEQ ID NO: 1500816 - RNA, 19 nt, Homo sapiens
gauaaaagccacuaaagca

SEQ ID NO: 1500817 - RNA, 19 nt, Homo sapiens
gacaaagagaugaugcaaa

SEQ ID NO: 1500818 - RNA, 19 nt, Homo sapiens
ugggagacccuuucuguga

SEQ ID NO: 1500819 - RNA, 19 nt, Homo sapiens
guacuuuaguucuguugag

SEQ ID NO: 1500820 - RNA, 19 nt, Homo sapiens
gauuaugaagcggcacuua

SEQ ID NO: 1500821 - RNA, 19 nt, Homo sapiens
gagucuuacuagaaauuug

SEQ ID NO: 1500822 - RNA, 19 nt, Homo sapiens
ugugacggguguugacaaa

SEQ ID NO: 1500823 - RNA, 19 nt, Homo sapiens
ggaagccuggaaagaauau

SEQ ID NO: 1500824 - RNA, 19 nt, Homo sapiens
gagagcagcaaagcaaaga

SEQ ID NO: 1500825 - RNA, 19 nt, Homo sapiens
cuguuugacuugaaucauu

SEQ ID NO: 1500826 - RNA, 19 nt, Homo sapiens
cagcuaucaaugcauauaa

SEQ ID NO: 1500827 - RNA, 19 nt, Homo sapiens
aagagaugaugcaaagaau

SEQ ID NO: 1500828 - RNA, 19 nt, Homo sapiens
ucaaggaacagaacuaaaa

SEQ ID NO: 1500829 - RNA, 19 nt, Homo sapiens
cugagaaguuaaaggaaga

SEQ ID NO: 1500830 - RNA, 19 nt, Homo sapiens
cuggaaagaauaucaaaga

SEQ ID NO: 1500831 - RNA, 19 nt, Homo sapiens
caacuggaggcaucuuugu

SEQ ID NO: 1500832 - RNA, 19 nt, Homo sapiens
caagaaugaaggcacaugu

SEQ ID NO: 1500833 - RNA, 19 nt, Homo sapiens
gguugaaggauaaaggaaa

SEQ ID NO: 1500834 - RNA, 19 nt, Homo sapiens
gcaaugaauacugacauag

SEQ ID NO: 1500835 - RNA, 19 nt, Homo sapiens
aggaguggcuacacaaaca

SEQ ID NO: 1500836 - RNA, 19 nt, Homo sapiens
ggaaagacgacaacgauaa

SEQ ID NO: 1500837 - RNA, 19 nt, Homo sapiens
gggcagcacuucuacauga

SEQ ID NO: 1500838 - RNA, 19 nt, Homo sapiens
gcagauggaugguuucuag

SEQ ID NO: 1500839 - RNA, 19 nt, Homo sapiens
ggaaagcucucuauaccau

SEQ ID NO: 1500840 - RNA, 19 nt, Homo sapiens
gaacagagagaccagcaaa

SEQ ID NO: 1500841 - RNA, 19 nt, Homo sapiens
ggucaaacguuccuaaugg

SEQ ID NO: 1500842 - RNA, 19 nt, Homo sapiens
uguccuagcccauauauua

SEQ ID NO: 1500843 - RNA, 19 nt, Homo sapiens
ggacgacauugcccaagaa

SEQ ID NO: 1500844 - RNA, 19 nt, Homo sapiens
gcucaggucucugcaugua

SEQ ID NO: 1500845 - RNA, 19 nt, Homo sapiens
gcaagacgcugggcaucaa

SEQ ID NO: 1500846 - RNA, 19 nt, Homo sapiens
gcacacacuucagcaagaa

SEQ ID NO: 1500847 - RNA, 19 nt, Homo sapiens
caacaaugguggcuuugga

SEQ ID NO: 1500848 - RNA, 19 nt, Homo sapiens
gcaauucuaacagcaauaa

SEQ ID NO: 1500849 - RNA, 19 nt, Homo sapiens
cagauacaauguuaagaga

SEQ ID NO: 1500850 - RNA, 19 nt, Homo sapiens
gauccuaugacucuugaua

SEQ ID NO: 1500851 - RNA, 19 nt, Homo sapiens
ccacgcagcuggugcucaa

SEQ ID NO: 1500852 - RNA, 19 nt, Homo sapiens
ggaucuaccugcccuugga

SEQ ID NO: 1500853 - RNA, 19 nt, Homo sapiens
uguggcagauacaauguua

SEQ ID NO: 1500854 - RNA, 19 nt, Homo sapiens
gcaaggacaaggagaagga

SEQ ID NO: 1500855 - RNA, 19 nt, Homo sapiens
gauacaauguuaagagacu

SEQ ID NO: 1500856 - RNA, 19 nt, Homo sapiens
cagccaaucugccacaugu

SEQ ID NO: 1500857 - RNA, 19 nt, Homo sapiens
ccacguacccgcagcagaa

SEQ ID NO: 1500858 - RNA, 19 nt, Homo sapiens
gauggaugguuucuagugu

SEQ ID NO: 1500859 - RNA, 19 nt, Homo sapiens
guucuaccuucgaggauuu

SEQ ID NO: 1500860 - RNA, 19 nt, Homo sapiens
ccauuuccaucacguggua

SEQ ID NO: 1500861 - RNA, 19 nt, Homo sapiens
gcagauacaauguuaagag

SEQ ID NO: 1500862 - RNA, 19 nt, Homo sapiens
cagcagacgcagcagaaua

SEQ ID NO: 1500863 - RNA, 19 nt, Homo sapiens
ggaaguacagcacggaugu

SEQ ID NO: 1500864 - RNA, 19 nt, Homo sapiens
gaaggcccaucguuguugu

SEQ ID NO: 1500865 - RNA, 19 nt, Homo sapiens
uaagaaggcccaucguugu

SEQ ID NO: 1500866 - RNA, 19 nt, Homo sapiens
aaagcucucuauaccauga

SEQ ID NO: 1500867 - RNA, 19 nt, Homo sapiens
gggaaagacgacaacgaua

SEQ ID NO: 1500868 - RNA, 19 nt, Homo sapiens
ugccacauguguucaauga

SEQ ID NO: 1500869 - RNA, 19 nt, Homo sapiens
gcaagaacggcaaggacaa

SEQ ID NO: 1500870 - RNA, 19 nt, Homo sapiens
gaaagacgacaacgauaac

SEQ ID NO: 1500871 - RNA, 19 nt, Homo sapiens
gcagaggcaggacgacauu

SEQ ID NO: 1500872 - RNA, 19 nt, Homo sapiens
gaggauuucuuuuccauug

SEQ ID NO: 1500873 - RNA, 19 nt, Homo sapiens
gcaaggagaaggacaagac

SEQ ID NO: 1500874 - RNA, 19 nt, Homo sapiens
ggucccacguggcaaguga

SEQ ID NO: 1500875 - RNA, 19 nt, Homo sapiens
gcacgucgccgucggaaaa

SEQ ID NO: 1500876 - RNA, 19 nt, Homo sapiens
aggcaacaaugguggcuuu

SEQ ID NO: 1500877 - RNA, 19 nt, Homo sapiens
guacagcacggaugugaag

SEQ ID NO: 1500878 - RNA, 19 nt, Homo sapiens
cagcaauucuaacagcaau

SEQ ID NO: 1500879 - RNA, 19 nt, Homo sapiens
gauucggugugcagcaauu

SEQ ID NO: 1500880 - RNA, 19 nt, Homo sapiens
gcugcugccucugcacuuu

SEQ ID NO: 1500881 - RNA, 19 nt, Homo sapiens
ccauuucucugcccuugug

SEQ ID NO: 1500882 - RNA, 19 nt, Homo sapiens
gaccugguguuacggaaag

SEQ ID NO: 1500883 - RNA, 19 nt, Homo sapiens
cuaugacucuugauaugga

SEQ ID NO: 1500884 - RNA, 19 nt, Homo sapiens
gaugguuucuagugugcuu

SEQ ID NO: 1500885 - RNA, 19 nt, Homo sapiens
agagagaccagcaaagaga

SEQ ID NO: 1500886 - RNA, 19 nt, Homo sapiens
ccuaugaucaagcccauuu

SEQ ID NO: 1500887 - RNA, 19 nt, Homo sapiens
uuacggaaagcucucuaua

SEQ ID NO: 1500888 - RNA, 19 nt, Homo sapiens
cgaccgggaccugguguua

SEQ ID NO: 1500889 - RNA, 19 nt, Homo sapiens
gcgauucggugugcagcaa

SEQ ID NO: 1500890 - RNA, 19 nt, Homo sapiens
acagagagaccagcaaaga

SEQ ID NO: 1500891 - RNA, 19 nt, Homo sapiens
agacgcagcagaauaagga

SEQ ID NO: 1500892 - RNA, 19 nt, Homo sapiens
gagagaccagcaaagagaa

SEQ ID NO: 1500893 - RNA, 19 nt, Homo sapiens
ucaggucucugcauguagu

SEQ ID NO: 1500894 - RNA, 19 nt, Homo sapiens
gcacuucuacaugauccua

SEQ ID NO: 1500895 - RNA, 19 nt, Homo sapiens
cugggcagcuucagcaaga

SEQ ID NO: 1500896 - RNA, 19 nt, Homo sapiens
agaagcagcgcaaggagaa

SEQ ID NO: 1500897 - RNA, 19 nt, Homo sapiens
aagccaagcugaaccuucu

SEQ ID NO: 1500898 - RNA, 19 nt, Homo sapiens
ugccagaccugagcgugua

SEQ ID NO: 1500899 - RNA, 19 nt, Homo sapiens
ccaccucggcugaguguug

SEQ ID NO: 1500900 - RNA, 19 nt, Homo sapiens
uaaaaugcccuuucucuuc

SEQ ID NO: 1500901 - RNA, 19 nt, Homo sapiens
guccuagcccauauauuaa

SEQ ID NO: 1500902 - RNA, 19 nt, Homo sapiens
acgagagccuggaagaguu

SEQ ID NO: 1500903 - RNA, 19 nt, Homo sapiens
gaugggaacugccuuuuac

SEQ ID NO: 1500904 - RNA, 19 nt, Homo sapiens
gguucuaccuucgaggauu

SEQ ID NO: 1500905 - RNA, 19 nt, Homo sapiens
gcagcaauucuaacagcaa

SEQ ID NO: 1500906 - RNA, 19 nt, Homo sapiens
ugaaccuucugcacagcua

SEQ ID NO: 1500907 - RNA, 19 nt, Homo sapiens
ggaccugguguuacggaaa

SEQ ID NO: 1500908 - RNA, 19 nt, Homo sapiens
ucagugccguguacguguu

SEQ ID NO: 1500909 - RNA, 19 nt, Homo sapiens
ccacugcucgccucugguu

SEQ ID NO: 1500910 - RNA, 19 nt, Homo sapiens
ccuagcccauauauuaaga

SEQ ID NO: 1500911 - RNA, 19 nt, Homo sapiens
gaucgagcaggcaacaaug

SEQ ID NO: 1500912 - RNA, 19 nt, Homo sapiens
uaccuucgaggauuucuuu

SEQ ID NO: 1500913 - RNA, 19 nt, Homo sapiens
ggagaugaucggcuacuac

SEQ ID NO: 1500914 - RNA, 19 nt, Homo sapiens
gcgaggauuucaggagcuu

SEQ ID NO: 1500915 - RNA, 19 nt, Homo sapiens
aaucuacacauuccaguug

SEQ ID NO: 1500916 - RNA, 19 nt, Homo sapiens
gcguguacagcgaggauuu

SEQ ID NO: 1500917 - RNA, 19 nt, Homo sapiens
gggcaucaagcugaagaaa

SEQ ID NO: 1500918 - RNA, 19 nt, Homo sapiens
uuucuagugugcuuccaaa

SEQ ID NO: 1500919 - RNA, 19 nt, Homo sapiens
cgcacacacuucagcaaga

SEQ ID NO: 1500920 - RNA, 19 nt, Homo sapiens
agcagacgcagcagaauaa

SEQ ID NO: 1500921 - RNA, 19 nt, Homo sapiens
ggaugggaacugccuuuua

SEQ ID NO: 1500922 - RNA, 19 nt, Homo sapiens
caagugaaugcaacaacga

SEQ ID NO: 1500923 - RNA, 19 nt, Homo sapiens
uccuaugacucuugauaug

SEQ ID NO: 1500924 - RNA, 19 nt, Homo sapiens
gucaaacguuccuaauggu

SEQ ID NO: 1500925 - RNA, 19 nt, Homo sapiens
acaaggagaaggagaagca

SEQ ID NO: 1500926 - RNA, 19 nt, Homo sapiens
gccaaucugccacaugugu

SEQ ID NO: 1500927 - RNA, 19 nt, Homo sapiens
uacaugauccuaugacucu

SEQ ID NO: 1500928 - RNA, 19 nt, Homo sapiens
ugacggauucugagcacaa

SEQ ID NO: 1500929 - RNA, 19 nt, Homo sapiens
ggcagcagacgcagcagaa

SEQ ID NO: 1500930 - RNA, 19 nt, Homo sapiens
ggacaaggagaaggagaag

SEQ ID NO: 1500931 - RNA, 19 nt, Homo sapiens
ggaacagagagaccagcaa

SEQ ID NO: 1500932 - RNA, 19 nt, Homo sapiens
gaggauuucaggagcuuca

SEQ ID NO: 1500933 - RNA, 19 nt, Homo sapiens
ggcagcacuucuacaugau

SEQ ID NO: 1500934 - RNA, 19 nt, Homo sapiens
ggagcgcaaguucaucuuc

SEQ ID NO: 1500935 - RNA, 19 nt, Homo sapiens
ugaucaagcccauuucucu

SEQ ID NO: 1500936 - RNA, 19 nt, Homo sapiens
gaagucaaauugucuguuu

SEQ ID NO: 1500937 - RNA, 19 nt, Homo sapiens
ggaauuagcuaacuuggau

SEQ ID NO: 1500938 - RNA, 19 nt, Homo sapiens
ccucagugcuuauuauuua

SEQ ID NO: 1500939 - RNA, 19 nt, Homo sapiens
caaagacucugugguauuu

SEQ ID NO: 1500940 - RNA, 19 nt, Homo sapiens
ggaaagagaugaugcugau

SEQ ID NO: 1500941 - RNA, 19 nt, Homo sapiens
gcacagauguaauugucua

SEQ ID NO: 1500942 - RNA, 19 nt, Homo sapiens
uauaagaccuucucccuuu

SEQ ID NO: 1500943 - RNA, 19 nt, Homo sapiens
gcagaugacuuacaagcaa

SEQ ID NO: 1500944 - RNA, 19 nt, Homo sapiens
uaaggucacuccaacauuu

SEQ ID NO: 1500945 - RNA, 19 nt, Homo sapiens
ggaaaugaacuguguauau

SEQ ID NO: 1500946 - RNA, 19 nt, Homo sapiens
gaagagcuauagaggauau

SEQ ID NO: 1500947 - RNA, 19 nt, Homo sapiens
caaagucccucaucaggaa

SEQ ID NO: 1500948 - RNA, 19 nt, Homo sapiens
gcagaaaguuugacuggau

SEQ ID NO: 1500949 - RNA, 19 nt, Homo sapiens
gaugggaacguaacacuua

SEQ ID NO: 1500950 - RNA, 19 nt, Homo sapiens
acauaaagcugcuggauga

SEQ ID NO: 1500951 - RNA, 19 nt, Homo sapiens
gaauggcugugcugacuuu

SEQ ID NO: 1500952 - RNA, 19 nt, Homo sapiens
ccacuuugcugcuaagauu

SEQ ID NO: 1500953 - RNA, 19 nt, Homo sapiens
gagagcauguuguaucauu

SEQ ID NO: 1500954 - RNA, 19 nt, Homo sapiens
caggaaagguuuaaucaug

SEQ ID NO: 1500955 - RNA, 19 nt, Homo sapiens
ggaaagguuuaaucaugaa

SEQ ID NO: 1500956 - RNA, 19 nt, Homo sapiens
uaaguuaaguucacccaaa

SEQ ID NO: 1500957 - RNA, 19 nt, Homo sapiens
agaauaaacccucgagaua

SEQ ID NO: 1500958 - RNA, 19 nt, Homo sapiens
ggaugagauugucagaaua

SEQ ID NO: 1500959 - RNA, 19 nt, Homo sapiens
gggauaaaguugagaagug

SEQ ID NO: 1500960 - RNA, 19 nt, Homo sapiens
uauggaaucuugccuggua

SEQ ID NO: 1500961 - RNA, 19 nt, Homo sapiens
gaauaaacccucgagauau

SEQ ID NO: 1500962 - RNA, 19 nt, Homo sapiens
gcaaauauccaaggaaugu

SEQ ID NO: 1500963 - RNA, 19 nt, Homo sapiens
gcuaaacuaucccaggaaa

SEQ ID NO: 1500964 - RNA, 19 nt, Homo sapiens
gacgcagccuuccucauua

SEQ ID NO: 1500965 - RNA, 19 nt, Homo sapiens
gaugagauugucagaauaa

SEQ ID NO: 1500966 - RNA, 19 nt, Homo sapiens
aaucagacaugucagcuuu

SEQ ID NO: 1500967 - RNA, 19 nt, Homo sapiens
cagcgucacugucuucaaa

SEQ ID NO: 1500968 - RNA, 19 nt, Homo sapiens
guuaagcacuaaucaguau

SEQ ID NO: 1500969 - RNA, 19 nt, Homo sapiens
gaagaggguauuucuaguu

SEQ ID NO: 1500970 - RNA, 19 nt, Homo sapiens
cuacagacauccugacaug

SEQ ID NO: 1500971 - RNA, 19 nt, Homo sapiens
cagaaaguuugacuggaua

SEQ ID NO: 1500972 - RNA, 19 nt, Homo sapiens
gaaaugguccagugccaaa

SEQ ID NO: 1500973 - RNA, 19 nt, Homo sapiens
caugucagcuuucaagaug

SEQ ID NO: 1500974 - RNA, 19 nt, Homo sapiens
ggauaaaguugagaagugu

SEQ ID NO: 1500975 - RNA, 19 nt, Homo sapiens
gcauauaucaaguuaguug

SEQ ID NO: 1500976 - RNA, 19 nt, Homo sapiens
ucagcuguguuacuaauuu

SEQ ID NO: 1500977 - RNA, 19 nt, Homo sapiens
aaguuugacuggauaguua

SEQ ID NO: 1500978 - RNA, 19 nt, Homo sapiens
gcagagagcauguuguauc

SEQ ID NO: 1500979 - RNA, 19 nt, Homo sapiens
ggucuuacguuucaaaguc

SEQ ID NO: 1500980 - RNA, 19 nt, Homo sapiens
gguuagcccugguagcuuu

SEQ ID NO: 1500981 - RNA, 19 nt, Homo sapiens
gaggauauuucucaaggau

SEQ ID NO: 1500982 - RNA, 19 nt, Homo sapiens
uaaagcugcuggaugaaau

SEQ ID NO: 1500983 - RNA, 19 nt, Homo sapiens
gaggguauuucuaguuuua

SEQ ID NO: 1500984 - RNA, 19 nt, Homo sapiens
ucacguaucauucugcuaa

SEQ ID NO: 1500985 - RNA, 19 nt, Homo sapiens
guaauugucuaauguucug

SEQ ID NO: 1500986 - RNA, 19 nt, Homo sapiens
aaucuugccugguaucauu

SEQ ID NO: 1500987 - RNA, 19 nt, Homo sapiens
ccgaagagcuauagaggau

SEQ ID NO: 1500988 - RNA, 19 nt, Homo sapiens
aaaguuuggucuuacguuu

SEQ ID NO: 1500989 - RNA, 19 nt, Homo sapiens
auaacuugcuggcuauaua

SEQ ID NO: 1500990 - RNA, 19 nt, Homo sapiens
aagaggguauuucuaguuu

SEQ ID NO: 1500991 - RNA, 19 nt, Homo sapiens
ggaggaagcagaacucauc

SEQ ID NO: 1500992 - RNA, 19 nt, Homo sapiens
cagagagcauguuguauca

SEQ ID NO: 1500993 - RNA, 19 nt, Homo sapiens
caaaauaguuggguaaaug

SEQ ID NO: 1500994 - RNA, 19 nt, Homo sapiens
gagaauggcugugcugacu

SEQ ID NO: 1500995 - RNA, 19 nt, Homo sapiens
ggaaaaugcuguggaaaug

SEQ ID NO: 1500996 - RNA, 19 nt, Homo sapiens
gaucaaacugaacaaugua

SEQ ID NO: 1500997 - RNA, 19 nt, Homo sapiens
guugagaucuucacguauc

SEQ ID NO: 1500998 - RNA, 19 nt, Homo sapiens
caagugcaacuaaaucauu

SEQ ID NO: 1500999 - RNA, 19 nt, Homo sapiens
gugcagagagcauguugua

SEQ ID NO: 1501000 - RNA, 19 nt, Homo sapiens
gcagagcauuauauuacug

SEQ ID NO: 1501001 - RNA, 19 nt, Homo sapiens
ccaugcgaaugauuugaua

SEQ ID NO: 1501002 - RNA, 19 nt, Homo sapiens
aguuaacacuugggaauua

SEQ ID NO: 1501003 - RNA, 19 nt, Homo sapiens
agaagagucuacaugcaaa

SEQ ID NO: 1501004 - RNA, 19 nt, Homo sapiens
ccuuauagaagcucaaaua

SEQ ID NO: 1501005 - RNA, 19 nt, Homo sapiens
uuuaauggcuugaaguuuc

SEQ ID NO: 1501006 - RNA, 19 nt, Homo sapiens
aggaaagguuuaaucauga

SEQ ID NO: 1501007 - RNA, 19 nt, Homo sapiens
aauaaacccucgagauauc

SEQ ID NO: 1501008 - RNA, 19 nt, Homo sapiens
agacaguuguuaccaguga

SEQ ID NO: 1501009 - RNA, 19 nt, Homo sapiens
ccaguucucuagugaagga

SEQ ID NO: 1501010 - RNA, 19 nt, Homo sapiens
ggaggaacaaauuuaauca

SEQ ID NO: 1501011 - RNA, 19 nt, Homo sapiens
gcuuaauccucagugcuua

SEQ ID NO: 1501012 - RNA, 19 nt, Homo sapiens
uguaaaagcuucauguuga

SEQ ID NO: 1501013 - RNA, 19 nt, Homo sapiens
cagauguaauugucuaaug

SEQ ID NO: 1501014 - RNA, 19 nt, Homo sapiens
ugaaaucaaucagacaugu

SEQ ID NO: 1501015 - RNA, 19 nt, Homo sapiens
cggcaaauauccaaggaau

SEQ ID NO: 1501016 - RNA, 19 nt, Homo sapiens
ccagugagccuuauagaag

SEQ ID NO: 1501017 - RNA, 19 nt, Homo sapiens
agaucaaacugaacaaugu

SEQ ID NO: 1501018 - RNA, 19 nt, Homo sapiens
gggaacguaacacuuauuu

SEQ ID NO: 1501019 - RNA, 19 nt, Homo sapiens
ccaaagacucugugguauu

SEQ ID NO: 1501020 - RNA, 19 nt, Homo sapiens
gacccgagaugacucaagu

SEQ ID NO: 1501021 - RNA, 19 nt, Homo sapiens
uagaguauuugcagaagga

SEQ ID NO: 1501022 - RNA, 19 nt, Homo sapiens
agacgcagccuuccucauu

SEQ ID NO: 1501023 - RNA, 19 nt, Homo sapiens
caacauuucaccacuggaa

SEQ ID NO: 1501024 - RNA, 19 nt, Homo sapiens
aggaugagauugucagaau

SEQ ID NO: 1501025 - RNA, 19 nt, Homo sapiens
cgacuucugacaacgauaa

SEQ ID NO: 1501026 - RNA, 19 nt, Homo sapiens
guucagcuguguuacuaau

SEQ ID NO: 1501027 - RNA, 19 nt, Homo sapiens
gagacugaguaaacaaaca

SEQ ID NO: 1501028 - RNA, 19 nt, Homo sapiens
aagacucugugguauuuaa

SEQ ID NO: 1501029 - RNA, 19 nt, Homo sapiens
gggaugagacuaaguuaag

SEQ ID NO: 1501030 - RNA, 19 nt, Homo sapiens
uuacaaggcagaaaguuug

SEQ ID NO: 1501031 - RNA, 19 nt, Homo sapiens
gaauuuauuaggacacgaa

SEQ ID NO: 1501032 - RNA, 19 nt, Homo sapiens
aagccaagccaaucagaua

SEQ ID NO: 1501033 - RNA, 19 nt, Homo sapiens
cagaugacuuacaagcaaa

SEQ ID NO: 1501034 - RNA, 19 nt, Homo sapiens
aacacuaucugucuguaaa

SEQ ID NO: 1501035 - RNA, 19 nt, Homo sapiens
cgucauuuauguaucauuc

SEQ ID NO: 1501036 - RNA, 19 nt, Homo sapiens
cuacauagaucaugacauc

SEQ ID NO: 1501037 - RNA, 19 nt, Homo sapiens
gcacacagaagacauuaga

SEQ ID NO: 1501038 - RNA, 19 nt, Homo sapiens
ugaccaagauuucuaguag

SEQ ID NO: 1501039 - RNA, 19 nt, Homo sapiens
caggagcucuguguacuuu

SEQ ID NO: 1501040 - RNA, 19 nt, Homo sapiens
gcaauuugaccaagauuuc

SEQ ID NO: 1501041 - RNA, 19 nt, Homo sapiens
acagaagacauuagagaua

SEQ ID NO: 1501042 - RNA, 19 nt, Homo sapiens
gaccugagccauccaucua

SEQ ID NO: 1501043 - RNA, 19 nt, Homo sapiens
cagaagacauuagagauac

SEQ ID NO: 1501044 - RNA, 19 nt, Homo sapiens
caucgacauucgugacuga

SEQ ID NO: 1501045 - RNA, 19 nt, Homo sapiens
gccgguaccugcugagugu

SEQ ID NO: 1501046 - RNA, 19 nt, Homo sapiens
gcaggucacugugcacaag

SEQ ID NO: 1501047 - RNA, 19 nt, Homo sapiens
caucauggccaagaucaaa

SEQ ID NO: 1501048 - RNA, 19 nt, Homo sapiens
ggaccaggagcucugugua

SEQ ID NO: 1501049 - RNA, 19 nt, Homo sapiens
cuggagaacugucuuccuu

SEQ ID NO: 1501050 - RNA, 19 nt, Homo sapiens
acacagaagacauuagaga

SEQ ID NO: 1501051 - RNA, 19 nt, Homo sapiens
guucaaggcaccagcuuau

SEQ ID NO: 1501052 - RNA, 19 nt, Homo sapiens
gcucugccgugacgucauc

SEQ ID NO: 1501053 - RNA, 19 nt, Homo sapiens
gcccuggaccuaccacgua

SEQ ID NO: 1501054 - RNA, 19 nt, Homo sapiens
guacuacuuugagaagauc

SEQ ID NO: 1501055 - RNA, 19 nt, Homo sapiens
gcagaccccugucaucaug

SEQ ID NO: 1501056 - RNA, 19 nt, Homo sapiens
ugagcaauuugaccaagau

SEQ ID NO: 1501057 - RNA, 19 nt, Homo sapiens
cagcuuauacccugcauag

SEQ ID NO: 1501058 - RNA, 19 nt, Homo sapiens
ggagcucuguguacuuugc

SEQ ID NO: 1501059 - RNA, 19 nt, Homo sapiens
gcacgggcuacauagauca

SEQ ID NO: 1501060 - RNA, 19 nt, Homo sapiens
cagaaccgcagcccuacuu

SEQ ID NO: 1501061 - RNA, 19 nt, Homo sapiens
cgggcuacauagaucauga

SEQ ID NO: 1501062 - RNA, 19 nt, Homo sapiens
gaaccgcagcccuacuuac

SEQ ID NO: 1501063 - RNA, 19 nt, Homo sapiens
agccauccaucuaucagaa

SEQ ID NO: 1501064 - RNA, 19 nt, Homo sapiens
acagagugauggaccucaa

SEQ ID NO: 1501065 - RNA, 19 nt, Homo sapiens
ucaaggcaccagcuuauac

SEQ ID NO: 1501066 - RNA, 19 nt, Homo sapiens
gaagacauuagagauacau

SEQ ID NO: 1501067 - RNA, 19 nt, Homo sapiens
auaacucgguuuggaaugu

SEQ ID NO: 1501068 - RNA, 19 nt, Homo sapiens
gagauacauuuucaugcaa

SEQ ID NO: 1501069 - RNA, 19 nt, Homo sapiens
agaagacauuagagauaca

SEQ ID NO: 1501070 - RNA, 19 nt, Homo sapiens
aaauaacucgguuuggaau

SEQ ID NO: 1501071 - RNA, 19 nt, Homo sapiens
gaccaggagcucuguguac

SEQ ID NO: 1501072 - RNA, 19 nt, Homo sapiens
gagcaauuugaccaagauu

SEQ ID NO: 1501073 - RNA, 19 nt, Homo sapiens
gagccauccaucuaucaga

SEQ ID NO: 1501074 - RNA, 19 nt, Homo sapiens
caaggcaggaggucaagca

SEQ ID NO: 1501075 - RNA, 19 nt, Homo sapiens
cacagaagacauuagagau

SEQ ID NO: 1501076 - RNA, 19 nt, Homo sapiens
accaagauuucuaguagca

SEQ ID NO: 1501077 - RNA, 19 nt, Homo sapiens
ccacuggucaucgacauuc

SEQ ID NO: 1501078 - RNA, 19 nt, Homo sapiens
uaacucgguuuggaauguc

SEQ ID NO: 1501079 - RNA, 19 nt, Homo sapiens
ccugagccauccaucuauc

SEQ ID NO: 1501080 - RNA, 19 nt, Homo sapiens
ggaaagagcucuacaucaa

SEQ ID NO: 1501081 - RNA, 19 nt, Homo sapiens
ggaaauagaugauucugau

SEQ ID NO: 1501082 - RNA, 19 nt, Homo sapiens
gcaaggaggugacaauguu

SEQ ID NO: 1501083 - RNA, 19 nt, Homo sapiens
gaaaacagauuccaaauga

SEQ ID NO: 1501084 - RNA, 19 nt, Homo sapiens
ggaaagacacugacaauga

SEQ ID NO: 1501085 - RNA, 19 nt, Homo sapiens
cgaaauaucucgcuucugu

SEQ ID NO: 1501086 - RNA, 19 nt, Homo sapiens
ggacucggcugaucaaaug

SEQ ID NO: 1501087 - RNA, 19 nt, Homo sapiens
gcaagaagauccggaaaga

SEQ ID NO: 1501088 - RNA, 19 nt, Homo sapiens
ggaaagaaacgcgcuauuu

SEQ ID NO: 1501089 - RNA, 19 nt, Homo sapiens
gaagcuauauguacuuugu

SEQ ID NO: 1501090 - RNA, 19 nt, Homo sapiens
gcugaaaugucaaauccua

SEQ ID NO: 1501091 - RNA, 19 nt, Homo sapiens
gacacaagguuugguauaa

SEQ ID NO: 1501092 - RNA, 19 nt, Homo sapiens
uaauauaucucccaugcuu

SEQ ID NO: 1501093 - RNA, 19 nt, Homo sapiens
gauuuggucugaagcuaua

SEQ ID NO: 1501094 - RNA, 19 nt, Homo sapiens
gaaagacacugacaaugac

SEQ ID NO: 1501095 - RNA, 19 nt, Homo sapiens
gcaugguucugguauauug

SEQ ID NO: 1501096 - RNA, 19 nt, Homo sapiens
gaaaucaucacgcauuguu

SEQ ID NO: 1501097 - RNA, 19 nt, Homo sapiens
gaaagucagucugguuaug

SEQ ID NO: 1501098 - RNA, 19 nt, Homo sapiens
gcgaauggauaaauggaaa

SEQ ID NO: 1501099 - RNA, 19 nt, Homo sapiens
guagugggauuuccaucua

SEQ ID NO: 1501100 - RNA, 19 nt, Homo sapiens
guucuuuacugaggaauua

SEQ ID NO: 1501101 - RNA, 19 nt, Homo sapiens
gaacuuauggcacugaaau

SEQ ID NO: 1501102 - RNA, 19 nt, Homo sapiens
ggacgacuguagccagauu

SEQ ID NO: 1501103 - RNA, 19 nt, Homo sapiens
ggagaaacaccauccagaa

SEQ ID NO: 1501104 - RNA, 19 nt, Homo sapiens
gaaagucaaguguguguug

SEQ ID NO: 1501105 - RNA, 19 nt, Homo sapiens
caaccuuacucccaaaguu

SEQ ID NO: 1501106 - RNA, 19 nt, Homo sapiens
gaaagaaacgcgcuauuuu

SEQ ID NO: 1501107 - RNA, 19 nt, Homo sapiens
uuacagugcugaacuccua

SEQ ID NO: 1501108 - RNA, 19 nt, Homo sapiens
gaucaaaugcuuacuucuu

SEQ ID NO: 1501109 - RNA, 19 nt, Homo sapiens
gaugaaaggcuucuucugu

SEQ ID NO: 1501110 - RNA, 19 nt, Homo sapiens
cgacaaggauggcaagaag

SEQ ID NO: 1501111 - RNA, 19 nt, Homo sapiens
acagaaacauugcaguuga

SEQ ID NO: 1501112 - RNA, 19 nt, Homo sapiens
ugauaucacugacccauug

SEQ ID NO: 1501113 - RNA, 19 nt, Homo sapiens
ggcaugaauuugaaagauu

SEQ ID NO: 1501114 - RNA, 19 nt, Homo sapiens
gauaagaucaggccucugu

SEQ ID NO: 1501115 - RNA, 19 nt, Homo sapiens
gaaacaccauccagaagag

SEQ ID NO: 1501116 - RNA, 19 nt, Homo sapiens
aaauaucucgcuucuguua

SEQ ID NO: 1501117 - RNA, 19 nt, Homo sapiens
gaugagccauauaaacuuc

SEQ ID NO: 1501118 - RNA, 19 nt, Homo sapiens
aagaagauccggaaagaaa

SEQ ID NO: 1501119 - RNA, 19 nt, Homo sapiens
agacuggcauugauugaaa

SEQ ID NO: 1501120 - RNA, 19 nt, Homo sapiens
ccaaggguauugugucuuc

SEQ ID NO: 1501121 - RNA, 19 nt, Homo sapiens
caaaggcccagauuucauu

SEQ ID NO: 1501122 - RNA, 19 nt, Homo sapiens
gugaaagucagucugguua

SEQ ID NO: 1501123 - RNA, 19 nt, Homo sapiens
gaagaucaaaccuguguuc

SEQ ID NO: 1501124 - RNA, 19 nt, Homo sapiens
ucagggcgcuccaugaaau

SEQ ID NO: 1501125 - RNA, 19 nt, Homo sapiens
caaaagacaucauucuguu

SEQ ID NO: 1501126 - RNA, 19 nt, Homo sapiens
guucugguauauugacuuu

SEQ ID NO: 1501127 - RNA, 19 nt, Homo sapiens
cauuagcuaugaagcagua

SEQ ID NO: 1501128 - RNA, 19 nt, Homo sapiens
caagacguaugagaugaaa

SEQ ID NO: 1501129 - RNA, 19 nt, Homo sapiens
guucuuaccuuggucaaug

SEQ ID NO: 1501130 - RNA, 19 nt, Homo sapiens
aaccugagcuggagauguu

SEQ ID NO: 1501131 - RNA, 19 nt, Homo sapiens
ucaggccucugucccauuu

SEQ ID NO: 1501132 - RNA, 19 nt, Homo sapiens
gagacuggcuucgggagaa

SEQ ID NO: 1501133 - RNA, 19 nt, Homo sapiens
guuccgugcuuugaaauuu

SEQ ID NO: 1501134 - RNA, 19 nt, Homo sapiens
cgaguacgauuuggucuga

SEQ ID NO: 1501135 - RNA, 19 nt, Homo sapiens
aauuaugacuggugaaaga

SEQ ID NO: 1501136 - RNA, 19 nt, Homo sapiens
gagcacacgaugagccaua

SEQ ID NO: 1501137 - RNA, 19 nt, Homo sapiens
gauuccaaaugaucugaaa

SEQ ID NO: 1501138 - RNA, 19 nt, Homo sapiens
uauugugucuuccucgaua

SEQ ID NO: 1501139 - RNA, 19 nt, Homo sapiens
aaacagaaacauugcaguu

SEQ ID NO: 1501140 - RNA, 19 nt, Homo sapiens
cacaagguuugguauaaga

SEQ ID NO: 1501141 - RNA, 19 nt, Homo sapiens
aaacauugcaguugaugaa

SEQ ID NO: 1501142 - RNA, 19 nt, Homo sapiens
uauaucugcuggucaauca

SEQ ID NO: 1501143 - RNA, 19 nt, Homo sapiens
uaugacuggugaaagauuu

SEQ ID NO: 1501144 - RNA, 19 nt, Homo sapiens
caaauuaugacuggugaaa

SEQ ID NO: 1501145 - RNA, 19 nt, Homo sapiens
aaagagcucuacaucaagu

SEQ ID NO: 1501146 - RNA, 19 nt, Homo sapiens
ccuuaucucaggcaaauua

SEQ ID NO: 1501147 - RNA, 19 nt, Homo sapiens
caccaucuucuacacauua

SEQ ID NO: 1501148 - RNA, 19 nt, Homo sapiens
gaaggggacugcccaugaa

SEQ ID NO: 1501149 - RNA, 19 nt, Homo sapiens
gcaagguauugugcagaaa

SEQ ID NO: 1501150 - RNA, 19 nt, Homo sapiens
ggauuacagugccaaccuu

SEQ ID NO: 1501151 - RNA, 19 nt, Homo sapiens
ggacugcccaugaagugaa

SEQ ID NO: 1501152 - RNA, 19 nt, Homo sapiens
guguucgacuuucuuguaa

SEQ ID NO: 1501153 - RNA, 19 nt, Homo sapiens
gcuaugauuccacgucaaa

SEQ ID NO: 1501154 - RNA, 19 nt, Homo sapiens
gaaaugucaaauccuagaa

SEQ ID NO: 1501155 - RNA, 19 nt, Homo sapiens
gauuacagugccaaccuua

SEQ ID NO: 1501156 - RNA, 19 nt, Homo sapiens
guuguuccgugcuuugaaa

SEQ ID NO: 1501157 - RNA, 19 nt, Homo sapiens
gaugaugucacaccucuuc

SEQ ID NO: 1501158 - RNA, 19 nt, Homo sapiens
gcaguggacucggcugauc

SEQ ID NO: 1501159 - RNA, 19 nt, Homo sapiens
guucgacuuucuuguaaau

SEQ ID NO: 1501160 - RNA, 19 nt, Homo sapiens
uaauguuacugcaagguau

SEQ ID NO: 1501161 - RNA, 19 nt, Homo sapiens
gaaagagcucuacaucaag

SEQ ID NO: 1501162 - RNA, 19 nt, Homo sapiens
cacgugucauuguggauua

SEQ ID NO: 1501163 - RNA, 19 nt, Homo sapiens
aaacagauuccaaaugauc

SEQ ID NO: 1501164 - RNA, 19 nt, Homo sapiens
ggacagcucguuugaacag

SEQ ID NO: 1501165 - RNA, 19 nt, Homo sapiens
ggccuggcaugaauuugaa

SEQ ID NO: 1501166 - RNA, 19 nt, Homo sapiens
ucaaaccuguguucgacuu

SEQ ID NO: 1501167 - RNA, 19 nt, Homo sapiens
gaaacauugcaguugauga

SEQ ID NO: 1501168 - RNA, 19 nt, Homo sapiens
guauauacuccaaacagaa

SEQ ID NO: 1501169 - RNA, 19 nt, Homo sapiens
uaucucaggcaaauuauga

SEQ ID NO: 1501170 - RNA, 19 nt, Homo sapiens
caccuuaucucaggcaaau

SEQ ID NO: 1501171 - RNA, 19 nt, Homo sapiens
gauguuccgcuuuguguug

SEQ ID NO: 1501172 - RNA, 19 nt, Homo sapiens
uggcauugauugaaagaau

SEQ ID NO: 1501173 - RNA, 19 nt, Homo sapiens
gauuauaacgagaauaugg

SEQ ID NO: 1501174 - RNA, 19 nt, Homo sapiens
gagaaacaccauccagaag

SEQ ID NO: 1501175 - RNA, 19 nt, Homo sapiens
cagauuucauugcagaaga

SEQ ID NO: 1501176 - RNA, 19 nt, Homo sapiens
agacacaagguuugguaua

SEQ ID NO: 1501177 - RNA, 19 nt, Homo sapiens
aaagacacaagguuuggua

SEQ ID NO: 1501178 - RNA, 19 nt, Homo sapiens
agcaguaccucccgacaaa

SEQ ID NO: 1501179 - RNA, 19 nt, Homo sapiens
cagaaacauugcaguugau

SEQ ID NO: 1501180 - RNA, 19 nt, Homo sapiens
gaagaucgauuccuggaua

SEQ ID NO: 1501181 - RNA, 19 nt, Homo sapiens
ggagaaagcugcaagagaa

SEQ ID NO: 1501182 - RNA, 19 nt, Homo sapiens
gagaauaacucagaaagaa

SEQ ID NO: 1501183 - RNA, 19 nt, Homo sapiens
gcagauggcuuauuuccuu

SEQ ID NO: 1501184 - RNA, 19 nt, Homo sapiens
gcacugagccuacauguau

SEQ ID NO: 1501185 - RNA, 19 nt, Homo sapiens
gaaagucaaaggcuucuua

SEQ ID NO: 1501186 - RNA, 19 nt, Homo sapiens
gaaguuuggugcugcgaua

SEQ ID NO: 1501187 - RNA, 19 nt, Homo sapiens
gcaaaagcaucuucuguua

SEQ ID NO: 1501188 - RNA, 19 nt, Homo sapiens
ccugauaacuuuaccagua

SEQ ID NO: 1501189 - RNA, 19 nt, Homo sapiens
gcaggagaguuuaaucaaa

SEQ ID NO: 1501190 - RNA, 19 nt, Homo sapiens
ggacagugcuacagccaaa

SEQ ID NO: 1501191 - RNA, 19 nt, Homo sapiens
gaaggcagcuuguauugag

SEQ ID NO: 1501192 - RNA, 19 nt, Homo sapiens
caggaagacuccaucauuu

SEQ ID NO: 1501193 - RNA, 19 nt, Homo sapiens
caaacugcaucacuacuuu

SEQ ID NO: 1501194 - RNA, 19 nt, Homo sapiens
uagaugagaugaugucuga

SEQ ID NO: 1501195 - RNA, 19 nt, Homo sapiens
gagcagggcuacaccauag

SEQ ID NO: 1501196 - RNA, 19 nt, Homo sapiens
cuaaauaucucuccuuucu

SEQ ID NO: 1501197 - RNA, 19 nt, Homo sapiens
ggaugugaauuuacugaaa

SEQ ID NO: 1501198 - RNA, 19 nt, Homo sapiens
gagaugaugucugaccuaa

SEQ ID NO: 1501199 - RNA, 19 nt, Homo sapiens
ggaaacggguggcuaucuu

SEQ ID NO: 1501200 - RNA, 19 nt, Homo sapiens
gaugggcaguuuguucuua

SEQ ID NO: 1501201 - RNA, 19 nt, Homo sapiens
caaagaaauuagugacaga

SEQ ID NO: 1501202 - RNA, 19 nt, Homo sapiens
ggaagcuaccuaccuguua

SEQ ID NO: 1501203 - RNA, 19 nt, Homo sapiens
ugaccagagugcauuauuu

SEQ ID NO: 1501204 - RNA, 19 nt, Homo sapiens
gaaagaggagaaagucaaa

SEQ ID NO: 1501205 - RNA, 19 nt, Homo sapiens
caucagggcuuuccacagu

SEQ ID NO: 1501206 - RNA, 19 nt, Homo sapiens
agucaaaggcuucuuauuu

SEQ ID NO: 1501207 - RNA, 19 nt, Homo sapiens
gaagagaccugguaaaacu

SEQ ID NO: 1501208 - RNA, 19 nt, Homo sapiens
ggagaaugagaaugaauaa

SEQ ID NO: 1501209 - RNA, 19 nt, Homo sapiens
ccagguuucucauguugua

SEQ ID NO: 1501210 - RNA, 19 nt, Homo sapiens
ggaaagaggagaaagucaa

SEQ ID NO: 1501211 - RNA, 19 nt, Homo sapiens
cuaccucucugcugaauga

SEQ ID NO: 1501212 - RNA, 19 nt, Homo sapiens
acagugaauuccuagcuua

SEQ ID NO: 1501213 - RNA, 19 nt, Homo sapiens
gaaaguugaagaccuaaau

SEQ ID NO: 1501214 - RNA, 19 nt, Homo sapiens
ccacuuggcugaaauuagg

SEQ ID NO: 1501215 - RNA, 19 nt, Homo sapiens
gaaaggaaggcagcuugua

SEQ ID NO: 1501216 - RNA, 19 nt, Homo sapiens
aaauaucucuccuuucuag

SEQ ID NO: 1501217 - RNA, 19 nt, Homo sapiens
aaucaaacaccuucaagua

SEQ ID NO: 1501218 - RNA, 19 nt, Homo sapiens
cagcuuguauugagccuuu

SEQ ID NO: 1501219 - RNA, 19 nt, Homo sapiens
caauggacuucagaugaua

SEQ ID NO: 1501220 - RNA, 19 nt, Homo sapiens
gcagaaggagcgaauguau

SEQ ID NO: 1501221 - RNA, 19 nt, Homo sapiens
ugaaugaccucaaguacag

SEQ ID NO: 1501222 - RNA, 19 nt, Homo sapiens
aaugaaaguugaagaccua

SEQ ID NO: 1501223 - RNA, 19 nt, Homo sapiens
gaagcuaccuaccuguuac

SEQ ID NO: 1501224 - RNA, 19 nt, Homo sapiens
ggaaaacaaggaagauuua

SEQ ID NO: 1501225 - RNA, 19 nt, Homo sapiens
ggagacagaacaguuauug

SEQ ID NO: 1501226 - RNA, 19 nt, Homo sapiens
gaccagagaauaacucaga

SEQ ID NO: 1501227 - RNA, 19 nt, Homo sapiens
ucagaggaccagagaauaa

SEQ ID NO: 1501228 - RNA, 19 nt, Homo sapiens
gaaagcugcaagagaauau

SEQ ID NO: 1501229 - RNA, 19 nt, Homo sapiens
cgagacuucuuccuucauu

SEQ ID NO: 1501230 - RNA, 19 nt, Homo sapiens
gaauaacucagaaagaaca

SEQ ID NO: 1501231 - RNA, 19 nt, Homo sapiens
gaugugaauuuacugaaag

SEQ ID NO: 1501232 - RNA, 19 nt, Homo sapiens
uagcagauguacuucaguu

SEQ ID NO: 1501233 - RNA, 19 nt, Homo sapiens
gaaccuggauggagaaaau

SEQ ID NO: 1501234 - RNA, 19 nt, Homo sapiens
uagauaaagcuccaaguuu

SEQ ID NO: 1501235 - RNA, 19 nt, Homo sapiens
aaaggcuucuuauuuggua

SEQ ID NO: 1501236 - RNA, 19 nt, Homo sapiens
caggcaaguuuaucuuuga

SEQ ID NO: 1501237 - RNA, 19 nt, Homo sapiens
gcuuggcacuccuagauga

SEQ ID NO: 1501238 - RNA, 19 nt, Homo sapiens
gucguuggcuuucugauug

SEQ ID NO: 1501239 - RNA, 19 nt, Homo sapiens
gaagcagaauguccugagu

SEQ ID NO: 1501240 - RNA, 19 nt, Homo sapiens
ggaguguagugguguaauc

SEQ ID NO: 1501241 - RNA, 19 nt, Homo sapiens
ucaggaagacuccaucauu

SEQ ID NO: 1501242 - RNA, 19 nt, Homo sapiens
gaaauuagugacagagaca

SEQ ID NO: 1501243 - RNA, 19 nt, Homo sapiens
ugaagguuauccaugauug

SEQ ID NO: 1501244 - RNA, 19 nt, Homo sapiens
cauacacagucauuaauca

SEQ ID NO: 1501245 - RNA, 19 nt, Homo sapiens
ccaaagugcugggauuaca

SEQ ID NO: 1501246 - RNA, 19 nt, Homo sapiens
auugguaccugauaacuuu

SEQ ID NO: 1501247 - RNA, 19 nt, Homo sapiens
cuacaaauccucaacaucu

SEQ ID NO: 1501248 - RNA, 19 nt, Homo sapiens
gauacuagaagacaagaga

SEQ ID NO: 1501249 - RNA, 19 nt, Homo sapiens
acaauggacuucagaugau

SEQ ID NO: 1501250 - RNA, 19 nt, Homo sapiens
guacagcccaucagaggaa

SEQ ID NO: 1501251 - RNA, 19 nt, Homo sapiens
ggagcagggcuacaccaua

SEQ ID NO: 1501252 - RNA, 19 nt, Homo sapiens
uacaaauccucaacaucua

SEQ ID NO: 1501253 - RNA, 19 nt, Homo sapiens
agauaaagcuccaaguuuu

SEQ ID NO: 1501254 - RNA, 19 nt, Homo sapiens
cagaggaacugcuucaacu

SEQ ID NO: 1501255 - RNA, 19 nt, Homo sapiens
cgaguuuacuuauuugaca

SEQ ID NO: 1501256 - RNA, 19 nt, Homo sapiens
uugccgaguuuacuuauuu

SEQ ID NO: 1501257 - RNA, 19 nt, Homo sapiens
ggccacaaauugccgaguu

SEQ ID NO: 1501258 - RNA, 19 nt, Homo sapiens
gugaauuccuagcuuaugu

SEQ ID NO: 1501259 - RNA, 19 nt, Homo sapiens
uaauuuggguuuagaggau

SEQ ID NO: 1501260 - RNA, 19 nt, Homo sapiens
cugauuaugucacugugua

SEQ ID NO: 1501261 - RNA, 19 nt, Homo sapiens
ucaggcaaguuuaucuuug

SEQ ID NO: 1501262 - RNA, 19 nt, Homo sapiens
acacacagguagcagaugu

SEQ ID NO: 1501263 - RNA, 19 nt, Homo sapiens
gacagugaauuccuagcuu

SEQ ID NO: 1501264 - RNA, 19 nt, Homo sapiens
gccacaaauugccgaguuu

SEQ ID NO: 1501265 - RNA, 19 nt, Homo sapiens
ggaguuaguauacuuucuu

SEQ ID NO: 1501266 - RNA, 19 nt, Homo sapiens
gcccagguuucucauguug

SEQ ID NO: 1501267 - RNA, 19 nt, Homo sapiens
gaugaugucugaccuaacc

SEQ ID NO: 1501268 - RNA, 19 nt, Homo sapiens
cuagaagacaagagaauuu

SEQ ID NO: 1501269 - RNA, 19 nt, Homo sapiens
guugaagaccuaaauguau

SEQ ID NO: 1501270 - RNA, 19 nt, Homo sapiens
ggaaggcagcuuguauuga

SEQ ID NO: 1501271 - RNA, 19 nt, Homo sapiens
gaaaccagagugucuccaa

SEQ ID NO: 1501272 - RNA, 19 nt, Homo sapiens
agaggagacagaacaguua

SEQ ID NO: 1501273 - RNA, 19 nt, Homo sapiens
cuagugaggauuccaguaa

SEQ ID NO: 1501274 - RNA, 19 nt, Homo sapiens
gagaauauagggugaaugc

SEQ ID NO: 1501275 - RNA, 19 nt, Homo sapiens
ucaaguagccccuaaauau

SEQ ID NO: 1501276 - RNA, 19 nt, Homo sapiens
cuuccaaacugcaucacua

SEQ ID NO: 1501277 - RNA, 19 nt, Homo sapiens
cacaauggacuucagauga

SEQ ID NO: 1501278 - RNA, 19 nt, Homo sapiens
auugaaugcuugcaaauug

SEQ ID NO: 1501279 - RNA, 19 nt, Homo sapiens
ucaggaaaauccagaagua

SEQ ID NO: 1501280 - RNA, 19 nt, Homo sapiens
uaagagagaugguuuaguu

SEQ ID NO: 1501281 - RNA, 19 nt, Homo sapiens
gaauaaagcugugggaaga

SEQ ID NO: 1501282 - RNA, 19 nt, Homo sapiens
gaagcaaggucuagaaaug

SEQ ID NO: 1501283 - RNA, 19 nt, Homo sapiens
ggaaggauuucaauggaua

SEQ ID NO: 1501284 - RNA, 19 nt, Homo sapiens
uaaagugucuucuggauga

SEQ ID NO: 1501285 - RNA, 19 nt, Homo sapiens
gaaaugaauugucucaaca

SEQ ID NO: 1501286 - RNA, 19 nt, Homo sapiens
gaaaguugguaaugaaguu

SEQ ID NO: 1501287 - RNA, 19 nt, Homo sapiens
gaucaaaucaggaaagaaa

SEQ ID NO: 1501288 - RNA, 19 nt, Homo sapiens
ucaaaucccuccagaagaa

SEQ ID NO: 1501289 - RNA, 19 nt, Homo sapiens
gguagaagaugcagauaug

SEQ ID NO: 1501290 - RNA, 19 nt, Homo sapiens
caggaaagcugcucugaga

SEQ ID NO: 1501291 - RNA, 19 nt, Homo sapiens
cagaagcucuugucacuga

SEQ ID NO: 1501292 - RNA, 19 nt, Homo sapiens
gagaacagaagaacuagua

SEQ ID NO: 1501293 - RNA, 19 nt, Homo sapiens
gguacaaccugccauaaga

SEQ ID NO: 1501294 - RNA, 19 nt, Homo sapiens
gaagaacuaguaaugauga

SEQ ID NO: 1501295 - RNA, 19 nt, Homo sapiens
cagagacuauucuuuauug

SEQ ID NO: 1501296 - RNA, 19 nt, Homo sapiens
ucagaaaguugguaaugaa

SEQ ID NO: 1501297 - RNA, 19 nt, Homo sapiens
ccaaggacguuauuauuag

SEQ ID NO: 1501298 - RNA, 19 nt, Homo sapiens
caucaucucuaaauugcua

SEQ ID NO: 1501299 - RNA, 19 nt, Homo sapiens
gccauaagaugaaaugaau

SEQ ID NO: 1501300 - RNA, 19 nt, Homo sapiens
ggaaagcugcucugagaaa

SEQ ID NO: 1501301 - RNA, 19 nt, Homo sapiens
aaaccuagauggaauuuca

SEQ ID NO: 1501302 - RNA, 19 nt, Homo sapiens
guaaagaacccuaaucaag

SEQ ID NO: 1501303 - RNA, 19 nt, Homo sapiens
cagauaugcuugagaguga

SEQ ID NO: 1501304 - RNA, 19 nt, Homo sapiens
ggacuuggaugagaaagau

SEQ ID NO: 1501305 - RNA, 19 nt, Homo sapiens
ccacuugucucaugucugu

SEQ ID NO: 1501306 - RNA, 19 nt, Homo sapiens
gacuaaagaugcagcagaa

SEQ ID NO: 1501307 - RNA, 19 nt, Homo sapiens
gauaaucucugaguguuca

SEQ ID NO: 1501308 - RNA, 19 nt, Homo sapiens
gaagagggaucagaugaag

SEQ ID NO: 1501309 - RNA, 19 nt, Homo sapiens
gaugacacguuucuuaagu

SEQ ID NO: 1501310 - RNA, 19 nt, Homo sapiens
ggugaugacacguuucuua

SEQ ID NO: 1501311 - RNA, 19 nt, Homo sapiens
cagaugaacccaaauuaaa

SEQ ID NO: 1501312 - RNA, 19 nt, Homo sapiens
cagaagaacuaguaaugau

SEQ ID NO: 1501313 - RNA, 19 nt, Homo sapiens
cagaugagcaggagacuaa

SEQ ID NO: 1501314 - RNA, 19 nt, Homo sapiens
ccagguccaucaucucuaa

SEQ ID NO: 1501315 - RNA, 19 nt, Homo sapiens
gcagaagaauguaaagaac

SEQ ID NO: 1501316 - RNA, 19 nt, Homo sapiens
gagcaacgcgaucugcaua

SEQ ID NO: 1501317 - RNA, 19 nt, Homo sapiens
aaagaacccuaaucaagga

SEQ ID NO: 1501318 - RNA, 19 nt, Homo sapiens
ggaagacauugaggacgua

SEQ ID NO: 1501319 - RNA, 19 nt, Homo sapiens
guaaacacaaccaggauuu

SEQ ID NO: 1501320 - RNA, 19 nt, Homo sapiens
gcagagacuauucuuuauu

SEQ ID NO: 1501321 - RNA, 19 nt, Homo sapiens
cugcagagacuauucuuua

SEQ ID NO: 1501322 - RNA, 19 nt, Homo sapiens
gagaaaagauacuuaggaa

SEQ ID NO: 1501323 - RNA, 19 nt, Homo sapiens
ugcagaaacucaauaaaga

SEQ ID NO: 1501324 - RNA, 19 nt, Homo sapiens
cuggaugaaugcauacuua

SEQ ID NO: 1501325 - RNA, 19 nt, Homo sapiens
gaacagaagaacuaguaau

SEQ ID NO: 1501326 - RNA, 19 nt, Homo sapiens
gaugauccacuguauggua

SEQ ID NO: 1501327 - RNA, 19 nt, Homo sapiens
caucacgucucucugaaga

SEQ ID NO: 1501328 - RNA, 19 nt, Homo sapiens
gagagaugguuuaguuaca

SEQ ID NO: 1501329 - RNA, 19 nt, Homo sapiens
agaagagccuuuacuaucu

SEQ ID NO: 1501330 - RNA, 19 nt, Homo sapiens
ucuaaaggcuacuaucuca

SEQ ID NO: 1501331 - RNA, 19 nt, Homo sapiens
ugagagagauugaugaaaa

SEQ ID NO: 1501332 - RNA, 19 nt, Homo sapiens
ugaaggacuuggaugagaa

SEQ ID NO: 1501333 - RNA, 19 nt, Homo sapiens
uaagagaaacauugaguug

SEQ ID NO: 1501334 - RNA, 19 nt, Homo sapiens
ggucuagaaaugagaauaa

SEQ ID NO: 1501335 - RNA, 19 nt, Homo sapiens
gaaguccaguuuauuucug

SEQ ID NO: 1501336 - RNA, 19 nt, Homo sapiens
ccacaucacgucucucuga

SEQ ID NO: 1501337 - RNA, 19 nt, Homo sapiens
ugacugcuguuucugaaga

SEQ ID NO: 1501338 - RNA, 19 nt, Homo sapiens
ugaguuggcauuagaauug

SEQ ID NO: 1501339 - RNA, 19 nt, Homo sapiens
uccaaggacguuauuauua

SEQ ID NO: 1501340 - RNA, 19 nt, Homo sapiens
ucagaugaacccaaauuaa

SEQ ID NO: 1501341 - RNA, 19 nt, Homo sapiens
acagagaacagaagaacua

SEQ ID NO: 1501342 - RNA, 19 nt, Homo sapiens
gcaacgcgaucugcauaau

SEQ ID NO: 1501343 - RNA, 19 nt, Homo sapiens
caacuugaacucugguaaa

SEQ ID NO: 1501344 - RNA, 19 nt, Homo sapiens
gcuauugugcugccuuuaa

SEQ ID NO: 1501345 - RNA, 19 nt, Homo sapiens
uagaagagccuuuacuauc

SEQ ID NO: 1501346 - RNA, 19 nt, Homo sapiens
uaaagaugcagcagaagaa

SEQ ID NO: 1501347 - RNA, 19 nt, Homo sapiens
agaauacaauagcagauga

SEQ ID NO: 1501348 - RNA, 19 nt, Homo sapiens
gcuacuaucucacuaaagc

SEQ ID NO: 1501349 - RNA, 19 nt, Homo sapiens
ccugugauguggaaagaaa

SEQ ID NO: 1501350 - RNA, 19 nt, Homo sapiens
aagaugaguuggcauuaga

SEQ ID NO: 1501351 - RNA, 19 nt, Homo sapiens
acacguuucuuaaguagga

SEQ ID NO: 1501352 - RNA, 19 nt, Homo sapiens
ugaaaugaauugucucaac

SEQ ID NO: 1501353 - RNA, 19 nt, Homo sapiens
gcaggagacuaaagaugca

SEQ ID NO: 1501354 - RNA, 19 nt, Homo sapiens
gguccaucaucucuaaauu

SEQ ID NO: 1501355 - RNA, 19 nt, Homo sapiens
ggaugaaugcauacuuaaa

SEQ ID NO: 1501356 - RNA, 19 nt, Homo sapiens
gaaaagauacuuaggaaca

SEQ ID NO: 1501357 - RNA, 19 nt, Homo sapiens
gcagaaacucaauaaagau

SEQ ID NO: 1501358 - RNA, 19 nt, Homo sapiens
gaaagcaguaauacagaga

SEQ ID NO: 1501359 - RNA, 19 nt, Homo sapiens
guguugacauuccauaaga

SEQ ID NO: 1501360 - RNA, 19 nt, Homo sapiens
ggaguuugagugaauuauu

SEQ ID NO: 1501361 - RNA, 19 nt, Homo sapiens
aagcagagaauaugaaaug

SEQ ID NO: 1501362 - RNA, 19 nt, Homo sapiens
gugaugacacguuucuuaa

SEQ ID NO: 1501363 - RNA, 19 nt, Homo sapiens
guuaaagugucuucuggau

SEQ ID NO: 1501364 - RNA, 19 nt, Homo sapiens
gggcuauugugcugccuuu

SEQ ID NO: 1501365 - RNA, 19 nt, Homo sapiens
uaagaugaguuggcauuag

SEQ ID NO: 1501366 - RNA, 19 nt, Homo sapiens
uaaguaggaguuugaguga

SEQ ID NO: 1501367 - RNA, 19 nt, Homo sapiens
cugggaccauuguuuauaa

SEQ ID NO: 1501368 - RNA, 19 nt, Homo sapiens
ucacugaagcagagaauau

SEQ ID NO: 1501369 - RNA, 19 nt, Homo sapiens
gaugaaaagcugaaaauga

SEQ ID NO: 1501370 - RNA, 19 nt, Homo sapiens
cauaaucggcugagagaga

SEQ ID NO: 1501371 - RNA, 19 nt, Homo sapiens
gaaggacuuggaugagaaa

SEQ ID NO: 1501372 - RNA, 19 nt, Homo sapiens
gaagaaauuaagucugcaa

SEQ ID NO: 1501373 - RNA, 19 nt, Homo sapiens
gggaaggauuucaauggau

SEQ ID NO: 1501374 - RNA, 19 nt, Homo sapiens
caaggacguuauuauuagu

SEQ ID NO: 1501375 - RNA, 19 nt, Homo sapiens
gaggugcucucaacagaac

SEQ ID NO: 1501376 - RNA, 19 nt, Homo sapiens
caacagaaccaggauccuu

SEQ ID NO: 1501377 - RNA, 19 nt, Homo sapiens
gugcugugauuguccugua

SEQ ID NO: 1501378 - RNA, 19 nt, Homo sapiens
gaacccuaaucaaggacuu

SEQ ID NO: 1501379 - RNA, 19 nt, Homo sapiens
ggaaaccuagauggaauuu

SEQ ID NO: 1501380 - RNA, 19 nt, Homo sapiens
acacagagauccacaggaa

SEQ ID NO: 1501381 - RNA, 19 nt, Homo sapiens
gagaggaggugcaguuggu

SEQ ID NO: 1501382 - RNA, 19 nt, Homo sapiens
ucagcaacgucaacaacua

SEQ ID NO: 1501383 - RNA, 19 nt, Homo sapiens
cagcgcagauguuaacuca

SEQ ID NO: 1501384 - RNA, 19 nt, Homo sapiens
ggaaggacaggaaccagaa

SEQ ID NO: 1501385 - RNA, 19 nt, Homo sapiens
gcacaagcgccucuacugu

SEQ ID NO: 1501386 - RNA, 19 nt, Homo sapiens
ccgcagugaucaacaaaga

SEQ ID NO: 1501387 - RNA, 19 nt, Homo sapiens
caagggacauccucuacag

SEQ ID NO: 1501388 - RNA, 19 nt, Homo sapiens
ccaccgcagugaucaacaa

SEQ ID NO: 1501389 - RNA, 19 nt, Homo sapiens
caccgguacugccgucuuu

SEQ ID NO: 1501390 - RNA, 19 nt, Homo sapiens
acaagcgccucuacuguuc

SEQ ID NO: 1501391 - RNA, 19 nt, Homo sapiens
gacgagaagcccaaagaga

SEQ ID NO: 1501392 - RNA, 19 nt, Homo sapiens
aggcgcaccugcucuacua

SEQ ID NO: 1501393 - RNA, 19 nt, Homo sapiens
ccaucgaccugagcaagaa

SEQ ID NO: 1501394 - RNA, 19 nt, Homo sapiens
ccacaagggacauccucua

SEQ ID NO: 1501395 - RNA, 19 nt, Homo sapiens
cacaagcgccucuacuguu

SEQ ID NO: 1501396 - RNA, 19 nt, Homo sapiens
gcuccaagggugagaucua

SEQ ID NO: 1501397 - RNA, 19 nt, Homo sapiens
gcaacgucaacaacuacua

SEQ ID NO: 1501398 - RNA, 19 nt, Homo sapiens
gcagacgccgcaagcucua

SEQ ID NO: 1501399 - RNA, 19 nt, Homo sapiens
cagacgagaagcccaaaga

SEQ ID NO: 1501400 - RNA, 19 nt, Homo sapiens
ucagcagccuguccaccuu

SEQ ID NO: 1501401 - RNA, 19 nt, Homo sapiens
ggagauccuggccaagaug

SEQ ID NO: 1501402 - RNA, 19 nt, Homo sapiens
ggagcuggaaggacaggaa

SEQ ID NO: 1501403 - RNA, 19 nt, Homo sapiens
caacgucaacaacuacuac

SEQ ID NO: 1501404 - RNA, 19 nt, Homo sapiens
gugcgaggccugcaacauc

SEQ ID NO: 1501405 - RNA, 19 nt, Homo sapiens
cggagauccuggccaagau

SEQ ID NO: 1501406 - RNA, 19 nt, Homo sapiens
ggcuucaucuccaccacaa

SEQ ID NO: 1501407 - RNA, 19 nt, Homo sapiens
ucgcccacaagaaguauua

SEQ ID NO: 1501408 - RNA, 19 nt, Homo sapiens
ccucccagcgcagauguua

SEQ ID NO: 1501409 - RNA, 19 nt, Homo sapiens
ccaccuucaucgcccacaa

SEQ ID NO: 1501410 - RNA, 19 nt, Homo sapiens
ucaucgcccacaagaagua

SEQ ID NO: 1501411 - RNA, 19 nt, Homo sapiens
aggccuaccuggcgcacaa

SEQ ID NO: 1501412 - RNA, 19 nt, Homo sapiens
caacuacuacgugcacaag

SEQ ID NO: 1501413 - RNA, 19 nt, Homo sapiens
ccaagggcgcuacgugcuu

SEQ ID NO: 1501414 - RNA, 19 nt, Homo sapiens
ccggagaggaggugcaguu

SEQ ID NO: 1501415 - RNA, 19 nt, Homo sapiens
ggagaggaauugaaagcaa

SEQ ID NO: 1501416 - RNA, 19 nt, Homo sapiens
gggcuugaauaaagaagua

SEQ ID NO: 1501417 - RNA, 19 nt, Homo sapiens
ggaggagccugcugugguu

SEQ ID NO: 1501418 - RNA, 19 nt, Homo sapiens
ggauuuggguccugacuca

SEQ ID NO: 1501419 - RNA, 19 nt, Homo sapiens
caggaaaaguguucaaaua

SEQ ID NO: 1501420 - RNA, 19 nt, Homo sapiens
ugaaggagaucuacaagcu

SEQ ID NO: 1501421 - RNA, 19 nt, Homo sapiens
gcacguuugggcuugaaua

SEQ ID NO: 1501422 - RNA, 19 nt, Homo sapiens
gcuuugaccuccuguugga

SEQ ID NO: 1501423 - RNA, 19 nt, Homo sapiens
gcaagacggaggccaaaca

SEQ ID NO: 1501424 - RNA, 19 nt, Homo sapiens
agaacauccugacccauga

SEQ ID NO: 1501425 - RNA, 19 nt, Homo sapiens
cguuugggcuugaauaaag

SEQ ID NO: 1501426 - RNA, 19 nt, Homo sapiens
uguccuugcucacggagua

SEQ ID NO: 1501427 - RNA, 19 nt, Homo sapiens
gcgagagcagcgcgagaua

SEQ ID NO: 1501428 - RNA, 19 nt, Homo sapiens
uggaggagaggaauugaaa

SEQ ID NO: 1501429 - RNA, 19 nt, Homo sapiens
ggccauggcuucggcuucu

SEQ ID NO: 1501430 - RNA, 19 nt, Homo sapiens
ggagaggggaccuggauuu

SEQ ID NO: 1501431 - RNA, 19 nt, Homo sapiens
guuugggcuugaauaaaga

SEQ ID NO: 1501432 - RNA, 19 nt, Homo sapiens
ggugagcgcggaacuggau

SEQ ID NO: 1501433 - RNA, 19 nt, Homo sapiens
gagccuuccuccugagaac

SEQ ID NO: 1501434 - RNA, 19 nt, Homo sapiens
cguuucugcucaucuguga

SEQ ID NO: 1501435 - RNA, 19 nt, Homo sapiens
gcagguggaagugcucaga

SEQ ID NO: 1501436 - RNA, 19 nt, Homo sapiens
gaggagaggaauugaaagc

SEQ ID NO: 1501437 - RNA, 19 nt, Homo sapiens
gugggcaaauucagaaacu

SEQ ID NO: 1501438 - RNA, 19 nt, Homo sapiens
gaggaccagccaccaggaa

SEQ ID NO: 1501439 - RNA, 19 nt, Homo sapiens
cuacagcaccagccucauc

SEQ ID NO: 1501440 - RNA, 19 nt, Homo sapiens
cacguuugggcuugaauaa

SEQ ID NO: 1501441 - RNA, 19 nt, Homo sapiens
gaacauccugacccaugag

SEQ ID NO: 1501442 - RNA, 19 nt, Homo sapiens
cugcucaucugugaaaugg

SEQ ID NO: 1501443 - RNA, 19 nt, Homo sapiens
gccuagcgccucagaucuu

SEQ ID NO: 1501444 - RNA, 19 nt, Homo sapiens
gaaguucucugaaauauuc

SEQ ID NO: 1501445 - RNA, 19 nt, Homo sapiens
caaaugcuguguauuauga

SEQ ID NO: 1501446 - RNA, 19 nt, Homo sapiens
gcacucacauguggaauaa

SEQ ID NO: 1501447 - RNA, 19 nt, Homo sapiens
ugagaacucugcaaccuuu

SEQ ID NO: 1501448 - RNA, 19 nt, Homo sapiens
guccaaaugcuguguauua

SEQ ID NO: 1501449 - RNA, 19 nt, Homo sapiens
gaucugacagcccaaauaa

SEQ ID NO: 1501450 - RNA, 19 nt, Homo sapiens
ggcaacagacaauauaaua

SEQ ID NO: 1501451 - RNA, 19 nt, Homo sapiens
gaauuagacacuugaacua

SEQ ID NO: 1501452 - RNA, 19 nt, Homo sapiens
gaacaaggagauggucuaa

SEQ ID NO: 1501453 - RNA, 19 nt, Homo sapiens
gguagggccuucaccacua

SEQ ID NO: 1501454 - RNA, 19 nt, Homo sapiens
cccaggagcuucccauaaa

SEQ ID NO: 1501455 - RNA, 19 nt, Homo sapiens
caaaauagcccucccauug

SEQ ID NO: 1501456 - RNA, 19 nt, Homo sapiens
ggccugaaguucucugaaa

SEQ ID NO: 1501457 - RNA, 19 nt, Homo sapiens
ggucuaaacuagcucaaca

SEQ ID NO: 1501458 - RNA, 19 nt, Homo sapiens
ggaauaaccacccucacaa

SEQ ID NO: 1501459 - RNA, 19 nt, Homo sapiens
acaaggagauggucuaaac

SEQ ID NO: 1501460 - RNA, 19 nt, Homo sapiens
guagggccuucaccacuaa

SEQ ID NO: 1501461 - RNA, 19 nt, Homo sapiens
cagccaaugucuccuguug

SEQ ID NO: 1501462 - RNA, 19 nt, Homo sapiens
ggaucugacagcccaaaua

SEQ ID NO: 1501463 - RNA, 19 nt, Homo sapiens
aggcaauccucacuucuuu

SEQ ID NO: 1501464 - RNA, 19 nt, Homo sapiens
gagauggucuaaacuagcu

SEQ ID NO: 1501465 - RNA, 19 nt, Homo sapiens
gaugauggccugaaguucu

SEQ ID NO: 1501466 - RNA, 19 nt, Homo sapiens
ccucugacguauuuauaau

SEQ ID NO: 1501467 - RNA, 19 nt, Homo sapiens
uuagacacuugaacuaugu

SEQ ID NO: 1501468 - RNA, 19 nt, Homo sapiens
ucugacagcccaaauaaug

SEQ ID NO: 1501469 - RNA, 19 nt, Homo sapiens
gagauuuccaucauucaga

SEQ ID NO: 1501470 - RNA, 19 nt, Homo sapiens
gagcuucccauaaagaaca

SEQ ID NO: 1501471 - RNA, 19 nt, Homo sapiens
gagcagaagagccgcugaa

SEQ ID NO: 1501472 - RNA, 19 nt, Homo sapiens
ccugaaguucucugaaaua

SEQ ID NO: 1501473 - RNA, 19 nt, Homo sapiens
gggaugauggccugaaguu

SEQ ID NO: 1501474 - RNA, 19 nt, Homo sapiens
uggaggagcccagggaaua

SEQ ID NO: 1501475 - RNA, 19 nt, Homo sapiens
cugaggagcccgcuagaaa

SEQ ID NO: 1501476 - RNA, 19 nt, Homo sapiens
gggcgucuccugcaguauu

SEQ ID NO: 1501477 - RNA, 19 nt, Homo sapiens
agaaagagcccaggcaauc

SEQ ID NO: 1501478 - RNA, 19 nt, Homo sapiens
aaauagcccucccauuguc

SEQ ID NO: 1501479 - RNA, 19 nt, Homo sapiens
gugcaaagagcgcaaaaua

SEQ ID NO: 1501480 - RNA, 19 nt, Homo sapiens
cugaaguucucugaaauau

SEQ ID NO: 1501481 - RNA, 19 nt, Homo sapiens
gucuuccucugacguauuu

SEQ ID NO: 1501482 - RNA, 19 nt, Homo sapiens
aagaagugguuuaguaguc

SEQ ID NO: 1501483 - RNA, 19 nt, Homo sapiens
gaaggaugccaagccugua

SEQ ID NO: 1501484 - RNA, 19 nt, Homo sapiens
gugggcaacagacaauaua

SEQ ID NO: 1501485 - RNA, 19 nt, Homo sapiens
ccauaaagaacaaugagau

SEQ ID NO: 1501486 - RNA, 19 nt, Homo sapiens
ugacagcccaaauaaugaa

SEQ ID NO: 1501487 - RNA, 19 nt, Homo sapiens
agauuuccaucauucagaa

SEQ ID NO: 1501488 - RNA, 19 nt, Homo sapiens
gggcaacagacaauauaau

SEQ ID NO: 1501489 - RNA, 19 nt, Homo sapiens
uccaaaugcuguguauuau

SEQ ID NO: 1501490 - RNA, 19 nt, Homo sapiens
gccugaaguucucugaaau

SEQ ID NO: 1501491 - RNA, 19 nt, Homo sapiens
ccaaaugcuguguauuaug

SEQ ID NO: 1501492 - RNA, 19 nt, Homo sapiens
cgaauuagacacuugaacu

SEQ ID NO: 1501493 - RNA, 19 nt, Homo sapiens
gaauaaccacccucacaac

SEQ ID NO: 1501494 - RNA, 19 nt, Homo sapiens
ggcacucacauguggaaua

SEQ ID NO: 1501495 - RNA, 19 nt, Homo sapiens
gccaaugucuccuguugcu

SEQ ID NO: 1501496 - RNA, 19 nt, Homo sapiens
acccuaaccuuaaaugaag

SEQ ID NO: 1501497 - RNA, 19 nt, Homo sapiens
aaggagauggucuaaacua

SEQ ID NO: 1501498 - RNA, 19 nt, Homo sapiens
ccaggagcuucccauaaag

SEQ ID NO: 1501499 - RNA, 19 nt, Homo sapiens
acacuuggcacucacaugu

SEQ ID NO: 1501500 - RNA, 19 nt, Homo sapiens
aagggcgucuccugcagua

SEQ ID NO: 1501501 - RNA, 19 nt, Homo sapiens
cagguacacuuggcacuca

SEQ ID NO: 1501502 - RNA, 19 nt, Homo sapiens
gcucgaauuagacacuuga

SEQ ID NO: 1501503 - RNA, 19 nt, Homo sapiens
ccacugaaacucgcugguu

SEQ ID NO: 1501504 - RNA, 19 nt, Homo sapiens
gaucgacuucagcgagaaa

SEQ ID NO: 1501505 - RNA, 19 nt, Homo sapiens
uaacccuaaccuuaaauga

SEQ ID NO: 1501506 - RNA, 19 nt, Homo sapiens
ugccaagccuguagaagca

SEQ ID NO: 1501507 - RNA, 19 nt, Homo sapiens
ggccggagaucgacuucag

SEQ ID NO: 1501508 - RNA, 19 nt, Homo sapiens
gaacucugcaaccuuuuaa

SEQ ID NO: 1501509 - RNA, 19 nt, Homo sapiens
gcaaagagcgcaaaauagc

SEQ ID NO: 1501510 - RNA, 19 nt, Homo sapiens
auuagacacuugaacuaug

SEQ ID NO: 1501511 - RNA, 19 nt, Homo sapiens
ucgcguccuucaacaguga

SEQ ID NO: 1501512 - RNA, 19 nt, Homo sapiens
gaggagcccgcuagaaagg

SEQ ID NO: 1501513 - RNA, 19 nt, Homo sapiens
gaauggcgaccccaauauu

SEQ ID NO: 1501514 - RNA, 19 nt, Homo sapiens
cagcccaaauaaugaaugg

SEQ ID NO: 1501515 - RNA, 19 nt, Homo sapiens
caggagcuucccauaaaga

SEQ ID NO: 1501516 - RNA, 19 nt, Homo sapiens
ggaggagcccagggaauag

SEQ ID NO: 1501517 - RNA, 19 nt, Homo sapiens
aacccuaaccuuaaaugaa

SEQ ID NO: 1501518 - RNA, 19 nt, Homo sapiens
ggcgucuccugcaguauuc

SEQ ID NO: 1501519 - RNA, 19 nt, Homo sapiens
agaacaaggagauggucua

SEQ ID NO: 1501520 - RNA, 19 nt, Homo sapiens
ccagagaccaagccaagag

SEQ ID NO: 1501521 - RNA, 19 nt, Homo sapiens
uggaauaaccacccucaca

SEQ ID NO: 1501522 - RNA, 19 nt, Homo sapiens
caggcaauccucacuucuu

SEQ ID NO: 1501523 - RNA, 19 nt, Homo sapiens
cccaggcaauccucacuuc

SEQ ID NO: 1501524 - RNA, 19 nt, Homo sapiens
gaaagagcccaggcaaucc

SEQ ID NO: 1501525 - RNA, 19 nt, Homo sapiens
cagaaagagcccaggcaau

SEQ ID NO: 1501526 - RNA, 19 nt, Homo sapiens
caaaacggccucaggaaca

SEQ ID NO: 1501527 - RNA, 19 nt, Homo sapiens
aggagauggucuaaacuag

SEQ ID NO: 1501528 - RNA, 19 nt, Homo sapiens
guaguccaaaugcugugua

SEQ ID NO: 1501529 - RNA, 19 nt, Homo sapiens
ccucacuucuuuucuacua

SEQ ID NO: 1501530 - RNA, 19 nt, Homo sapiens
ugaaauauuccggaaggau

SEQ ID NO: 1501531 - RNA, 19 nt, Homo sapiens
uaguccaaaugcuguguau

SEQ ID NO: 1501532 - RNA, 19 nt, Homo sapiens
ggaugccaagccuguagaa

SEQ ID NO: 1501533 - RNA, 19 nt, Homo sapiens
ucccagaucccaggaaguu

SEQ ID NO: 1501534 - RNA, 19 nt, Homo sapiens
aaagaacaaugagauuucc

SEQ ID NO: 1501535 - RNA, 19 nt, Homo sapiens
gaacauccauagcccaaua

SEQ ID NO: 1501536 - RNA, 19 nt, Homo sapiens
gaggucaacucuuagauua

SEQ ID NO: 1501537 - RNA, 19 nt, Homo sapiens
gggaauggaugaauaaauu

SEQ ID NO: 1501538 - RNA, 19 nt, Homo sapiens
guaagggaauggaugaaua

SEQ ID NO: 1501539 - RNA, 19 nt, Homo sapiens
cagaauauauccaguugua

SEQ ID NO: 1501540 - RNA, 19 nt, Homo sapiens
ccaauaagcuuuugucuaa

SEQ ID NO: 1501541 - RNA, 19 nt, Homo sapiens
gagcacauauggagaagaa

SEQ ID NO: 1501542 - RNA, 19 nt, Homo sapiens
gaagucaaaccuuaucaua

SEQ ID NO: 1501543 - RNA, 19 nt, Homo sapiens
gaagcacuauuuacacaaa

SEQ ID NO: 1501544 - RNA, 19 nt, Homo sapiens
gagaauacauacuggagaa

SEQ ID NO: 1501545 - RNA, 19 nt, Homo sapiens
gagggaacaugggaauuua

SEQ ID NO: 1501546 - RNA, 19 nt, Homo sapiens
acacagacuuuguuucuuu

SEQ ID NO: 1501547 - RNA, 19 nt, Homo sapiens
gacagcagcauaagaaaua

SEQ ID NO: 1501548 - RNA, 19 nt, Homo sapiens
gagaaacccuaugaaugua

SEQ ID NO: 1501549 - RNA, 19 nt, Homo sapiens
gaacucacagcucaucaua

SEQ ID NO: 1501550 - RNA, 19 nt, Homo sapiens
gaaaagcacuuaaucugaa

SEQ ID NO: 1501551 - RNA, 19 nt, Homo sapiens
gaacaaauuuauccagaac

SEQ ID NO: 1501552 - RNA, 19 nt, Homo sapiens
ucaguggucucuccagaua

SEQ ID NO: 1501553 - RNA, 19 nt, Homo sapiens
guaggaugcuucuguaguu

SEQ ID NO: 1501554 - RNA, 19 nt, Homo sapiens
gaucugcacaugugaauuu

SEQ ID NO: 1501555 - RNA, 19 nt, Homo sapiens
gcauggaaccuacgucuuu

SEQ ID NO: 1501556 - RNA, 19 nt, Homo sapiens
gaaaagcccucagccauaa

SEQ ID NO: 1501557 - RNA, 19 nt, Homo sapiens
gacaugagcuguacuacuc

SEQ ID NO: 1501558 - RNA, 19 nt, Homo sapiens
cagacuugcuuaauaguaa

SEQ ID NO: 1501559 - RNA, 19 nt, Homo sapiens
gaugcaaucucucaacuca

SEQ ID NO: 1501560 - RNA, 19 nt, Homo sapiens
gagagaaacccuaugaaug

SEQ ID NO: 1501561 - RNA, 19 nt, Homo sapiens
caucaaacaucagagaauu

SEQ ID NO: 1501562 - RNA, 19 nt, Homo sapiens
gaggcgaucucuuuggaaa

SEQ ID NO: 1501563 - RNA, 19 nt, Homo sapiens
cauaaucacugggaauuug

SEQ ID NO: 1501564 - RNA, 19 nt, Homo sapiens
ggaugugacuguggacuuu

SEQ ID NO: 1501565 - RNA, 19 nt, Homo sapiens
ggagaauuauagcaacuug

SEQ ID NO: 1501566 - RNA, 19 nt, Homo sapiens
aauaagaguuugccgugua

SEQ ID NO: 1501567 - RNA, 19 nt, Homo sapiens
ggagagaaacccuaugaau

SEQ ID NO: 1501568 - RNA, 19 nt, Homo sapiens
guucaaccuuucauuugua

SEQ ID NO: 1501569 - RNA, 19 nt, Homo sapiens
caaacaguauccuaugaau

SEQ ID NO: 1501570 - RNA, 19 nt, Homo sapiens
caagugguaugcuuuagau

SEQ ID NO: 1501571 - RNA, 19 nt, Homo sapiens
aaacacaagugguaugcuu

SEQ ID NO: 1501572 - RNA, 19 nt, Homo sapiens
gaaaauccuuuauccagaa

SEQ ID NO: 1501573 - RNA, 19 nt, Homo sapiens
ccauaugaaugcaauguau

SEQ ID NO: 1501574 - RNA, 19 nt, Homo sapiens
gaagacaguguugaaguuu

SEQ ID NO: 1501575 - RNA, 19 nt, Homo sapiens
gggaacaugggaauuuaua

SEQ ID NO: 1501576 - RNA, 19 nt, Homo sapiens
caggaaagcagacugauga

SEQ ID NO: 1501577 - RNA, 19 nt, Homo sapiens
agaagacaguguugaaguu

SEQ ID NO: 1501578 - RNA, 19 nt, Homo sapiens
uaaaguagcauggaaccua

SEQ ID NO: 1501579 - RNA, 19 nt, Homo sapiens
ggagagaaaccauaugagu

SEQ ID NO: 1501580 - RNA, 19 nt, Homo sapiens
ggucaacucuuagauuaca

SEQ ID NO: 1501581 - RNA, 19 nt, Homo sapiens
gaaggcugaugaccagaug

SEQ ID NO: 1501582 - RNA, 19 nt, Homo sapiens
gaaauaaccgaucuauaac

SEQ ID NO: 1501583 - RNA, 19 nt, Homo sapiens
agagaaacccuaugaaugu

SEQ ID NO: 1501584 - RNA, 19 nt, Homo sapiens
agucaaaccuuaucauaca

SEQ ID NO: 1501585 - RNA, 19 nt, Homo sapiens
caucuuacuuacucacaaa

SEQ ID NO: 1501586 - RNA, 19 nt, Homo sapiens
ucacaaaucauguauugga

SEQ ID NO: 1501587 - RNA, 19 nt, Homo sapiens
gcagacaugagcuguacua

SEQ ID NO: 1501588 - RNA, 19 nt, Homo sapiens
ugcaaucucucaacucaaa

SEQ ID NO: 1501589 - RNA, 19 nt, Homo sapiens
cacagacuuuguuucuuua

SEQ ID NO: 1501590 - RNA, 19 nt, Homo sapiens
uaagggaauggaugaauaa

SEQ ID NO: 1501591 - RNA, 19 nt, Homo sapiens
cgccagcacuuaagauuau

SEQ ID NO: 1501592 - RNA, 19 nt, Homo sapiens
gugacuuucugaacaaauu

SEQ ID NO: 1501593 - RNA, 19 nt, Homo sapiens
uggcauauaucaguuggua

SEQ ID NO: 1501594 - RNA, 19 nt, Homo sapiens
cuccagauauuaacaagaa

SEQ ID NO: 1501595 - RNA, 19 nt, Homo sapiens
uuaagucacuccucauuag

SEQ ID NO: 1501596 - RNA, 19 nt, Homo sapiens
ggagagagaccacagaaac

SEQ ID NO: 1501597 - RNA, 19 nt, Homo sapiens
uacaaaugcaugucuguua

SEQ ID NO: 1501598 - RNA, 19 nt, Homo sapiens
uacaaacaguauccuauga

SEQ ID NO: 1501599 - RNA, 19 nt, Homo sapiens
gagaagaagcccuaugagu

SEQ ID NO: 1501600 - RNA, 19 nt, Homo sapiens
ggaaucuccugggaaucua

SEQ ID NO: 1501601 - RNA, 19 nt, Homo sapiens
uagaagcacuauuuacaca

SEQ ID NO: 1501602 - RNA, 19 nt, Homo sapiens
gagcgacccuaugagugua

SEQ ID NO: 1501603 - RNA, 19 nt, Homo sapiens
ggaaaagcccucagccaua

SEQ ID NO: 1501604 - RNA, 19 nt, Homo sapiens
gcgccagcacuuaagauua

SEQ ID NO: 1501605 - RNA, 19 nt, Homo sapiens
ugagugacuuucugaacaa

SEQ ID NO: 1501606 - RNA, 19 nt, Homo sapiens
caagaauuguuguguaacu

SEQ ID NO: 1501607 - RNA, 19 nt, Homo sapiens
ggaauggaugaauaaauug

SEQ ID NO: 1501608 - RNA, 19 nt, Homo sapiens
guucuugagcugccucuua

SEQ ID NO: 1501609 - RNA, 19 nt, Homo sapiens
acacaagugguaugcuuua

SEQ ID NO: 1501610 - RNA, 19 nt, Homo sapiens
cuagacagcagcauaagaa

SEQ ID NO: 1501611 - RNA, 19 nt, Homo sapiens
gaacaugggaauuuauacu

SEQ ID NO: 1501612 - RNA, 19 nt, Homo sapiens
acucacagcucaucauaca

SEQ ID NO: 1501613 - RNA, 19 nt, Homo sapiens
caggagagcgacccuauga

SEQ ID NO: 1501614 - RNA, 19 nt, Homo sapiens
cauaagagaauacauacug

SEQ ID NO: 1501615 - RNA, 19 nt, Homo sapiens
gcccaaaacugcagaaaau

SEQ ID NO: 1501616 - RNA, 19 nt, Homo sapiens
guucagccuuucccuauca

SEQ ID NO: 1501617 - RNA, 19 nt, Homo sapiens
ggaacaugaguuauaaguu

SEQ ID NO: 1501618 - RNA, 19 nt, Homo sapiens
ucaacuguuucauugcuuu

SEQ ID NO: 1501619 - RNA, 19 nt, Homo sapiens
uaaauagccauacccaguu

SEQ ID NO: 1501620 - RNA, 19 nt, Homo sapiens
gaauuuauacugagaugca

SEQ ID NO: 1501621 - RNA, 19 nt, Homo sapiens
ggaaggccuuuagcaggaa

SEQ ID NO: 1501622 - RNA, 19 nt, Homo sapiens
gagaaaagccauaugaaug

SEQ ID NO: 1501623 - RNA, 19 nt, Homo sapiens
ggaugaauaaauuguggua

SEQ ID NO: 1501624 - RNA, 19 nt, Homo sapiens
gcugucacacuauauauug

SEQ ID NO: 1501625 - RNA, 19 nt, Homo sapiens
gaauuguuguguaacucaa

SEQ ID NO: 1501626 - RNA, 19 nt, Homo sapiens
gauacccagcuaaagaaua

SEQ ID NO: 1501627 - RNA, 19 nt, Homo sapiens
gggaauuuauacugagaug

SEQ ID NO: 1501628 - RNA, 19 nt, Homo sapiens
ggagagcgacccuaugagu

SEQ ID NO: 1501629 - RNA, 19 nt, Homo sapiens
agucaaaccucauuguaca

SEQ ID NO: 1501630 - RNA, 19 nt, Homo sapiens
ucacuccucauuagucaua

SEQ ID NO: 1501631 - RNA, 19 nt, Homo sapiens
gaaaagcacuucucuaccu

SEQ ID NO: 1501632 - RNA, 19 nt, Homo sapiens
caccacagaauaagaguuu

SEQ ID NO: 1501633 - RNA, 19 nt, Homo sapiens
gagaaaccauaugaguguu

SEQ ID NO: 1501634 - RNA, 19 nt, Homo sapiens
caggagagaaaccauauga

SEQ ID NO: 1501635 - RNA, 19 nt, Homo sapiens
ugaaagcacuggacaauua

SEQ ID NO: 1501636 - RNA, 19 nt, Homo sapiens
cagcacagcuacagaauuu

SEQ ID NO: 1501637 - RNA, 19 nt, Homo sapiens
ucacgaagcugucuuguau

SEQ ID NO: 1501638 - RNA, 19 nt, Homo sapiens
ggagaugcuuuauucauuu

SEQ ID NO: 1501639 - RNA, 19 nt, Homo sapiens
gaaagacuaugacgacaga

SEQ ID NO: 1501640 - RNA, 19 nt, Homo sapiens
ggagaaaucaucauggaua

SEQ ID NO: 1501641 - RNA, 19 nt, Homo sapiens
gccaacagcuuuagacauu

SEQ ID NO: 1501642 - RNA, 19 nt, Homo sapiens
gagaaaucaucauggauaa

SEQ ID NO: 1501643 - RNA, 19 nt, Homo sapiens
gcaaagccaaugugauuua

SEQ ID NO: 1501644 - RNA, 19 nt, Homo sapiens
gcaaugaagccauguuuga

SEQ ID NO: 1501645 - RNA, 19 nt, Homo sapiens
uaacccagccuccuuauaa

SEQ ID NO: 1501646 - RNA, 19 nt, Homo sapiens
gaagaucaaguaccaauug

SEQ ID NO: 1501647 - RNA, 19 nt, Homo sapiens
ccaggaggcuacucuuuaa

SEQ ID NO: 1501648 - RNA, 19 nt, Homo sapiens
gcaaauggaugcagaucuc

SEQ ID NO: 1501649 - RNA, 19 nt, Homo sapiens
gagauucgcuugcuuugca

SEQ ID NO: 1501650 - RNA, 19 nt, Homo sapiens
gaaugggaauggauccaaa

SEQ ID NO: 1501651 - RNA, 19 nt, Homo sapiens
ggaaacauacucauaguca

SEQ ID NO: 1501652 - RNA, 19 nt, Homo sapiens
gcagaucaauauaccucua

SEQ ID NO: 1501653 - RNA, 19 nt, Homo sapiens
gcaugugccucuccuucua

SEQ ID NO: 1501654 - RNA, 19 nt, Homo sapiens
gaucaaguaccaauuguug

SEQ ID NO: 1501655 - RNA, 19 nt, Homo sapiens
gaaagcaaagccaauguga

SEQ ID NO: 1501656 - RNA, 19 nt, Homo sapiens
ggaagaccucggugaauuu

SEQ ID NO: 1501657 - RNA, 19 nt, Homo sapiens
caaugucugucucauggua

SEQ ID NO: 1501658 - RNA, 19 nt, Homo sapiens
gaguauguccgaagacuuu

SEQ ID NO: 1501659 - RNA, 19 nt, Homo sapiens
uaaccucccucuucagaug

SEQ ID NO: 1501660 - RNA, 19 nt, Homo sapiens
ucucacaccaguucuauua

SEQ ID NO: 1501661 - RNA, 19 nt, Homo sapiens
gaacugaucggcugagucu

SEQ ID NO: 1501662 - RNA, 19 nt, Homo sapiens
gggaagaguuuacuaugag

SEQ ID NO: 1501663 - RNA, 19 nt, Homo sapiens
caacacagagaaagagaaa

SEQ ID NO: 1501664 - RNA, 19 nt, Homo sapiens
caacagcacagcuacagaa

SEQ ID NO: 1501665 - RNA, 19 nt, Homo sapiens
caaugaagaucaaguacca

SEQ ID NO: 1501666 - RNA, 19 nt, Homo sapiens
gaaaucaucauggauaauc

SEQ ID NO: 1501667 - RNA, 19 nt, Homo sapiens
cauuaaagaucgacaugga

SEQ ID NO: 1501668 - RNA, 19 nt, Homo sapiens
gaaggagauucgcuugcuu

SEQ ID NO: 1501669 - RNA, 19 nt, Homo sapiens
ccaguucuauuacacaaga

SEQ ID NO: 1501670 - RNA, 19 nt, Homo sapiens
gaucaaaucaaaguucuug

SEQ ID NO: 1501671 - RNA, 19 nt, Homo sapiens
uggagaugcuuuauucauu

SEQ ID NO: 1501672 - RNA, 19 nt, Homo sapiens
aagcaaagccaaugugauu

SEQ ID NO: 1501673 - RNA, 19 nt, Homo sapiens
guacacaccagaagaacuu

SEQ ID NO: 1501674 - RNA, 19 nt, Homo sapiens
gaaaaugacgcaacaaaug

SEQ ID NO: 1501675 - RNA, 19 nt, Homo sapiens
ggacaauuaccaacaacuu

SEQ ID NO: 1501676 - RNA, 19 nt, Homo sapiens
acucugagaugcacaauca

SEQ ID NO: 1501677 - RNA, 19 nt, Homo sapiens
aaaguggaauggaguaugu

SEQ ID NO: 1501678 - RNA, 19 nt, Homo sapiens
guuugaacuugguauagua

SEQ ID NO: 1501679 - RNA, 19 nt, Homo sapiens
cacaggagguguuggaaau

SEQ ID NO: 1501680 - RNA, 19 nt, Homo sapiens
gaagauccgugaaaacaau

SEQ ID NO: 1501681 - RNA, 19 nt, Homo sapiens
ugggaagaguuuacuauga

SEQ ID NO: 1501682 - RNA, 19 nt, Homo sapiens
caaagccaaugugauuuau

SEQ ID NO: 1501683 - RNA, 19 nt, Homo sapiens
aggcaaagcauaccaauau

SEQ ID NO: 1501684 - RNA, 19 nt, Homo sapiens
gaaagagaaacagcugaaa

SEQ ID NO: 1501685 - RNA, 19 nt, Homo sapiens
uuacaucucugucagucaa

SEQ ID NO: 1501686 - RNA, 19 nt, Homo sapiens
gaacuuccgccucuacaca

SEQ ID NO: 1501687 - RNA, 19 nt, Homo sapiens
acuaugagcccauuaaaga

SEQ ID NO: 1501688 - RNA, 19 nt, Homo sapiens
ggagaaagcaaagccaaug

SEQ ID NO: 1501689 - RNA, 19 nt, Homo sapiens
gagccacucuuccuucgau

SEQ ID NO: 1501690 - RNA, 19 nt, Homo sapiens
ucucuuuccuggauuauau

SEQ ID NO: 1501691 - RNA, 19 nt, Homo sapiens
agaucgacauggaaacaua

SEQ ID NO: 1501692 - RNA, 19 nt, Homo sapiens
ggaaggagauucgcuugcu

SEQ ID NO: 1501693 - RNA, 19 nt, Homo sapiens
guaguaaccagguauaaag

SEQ ID NO: 1501694 - RNA, 19 nt, Homo sapiens
caacagcuuuagacauucu

SEQ ID NO: 1501695 - RNA, 19 nt, Homo sapiens
aggaagaccucggugaauu

SEQ ID NO: 1501696 - RNA, 19 nt, Homo sapiens
ggacucuacauagccauua

SEQ ID NO: 1501697 - RNA, 19 nt, Homo sapiens
cagcgucucuuuccuggau

SEQ ID NO: 1501698 - RNA, 19 nt, Homo sapiens
gaggcaaagcauaccaaua

SEQ ID NO: 1501699 - RNA, 19 nt, Homo sapiens
ucacaccaguucuauuaca

SEQ ID NO: 1501700 - RNA, 19 nt, Homo sapiens
uagcuuguuucaccuagaa

SEQ ID NO: 1501701 - RNA, 19 nt, Homo sapiens
ggaugcagaucucaaagcu

SEQ ID NO: 1501702 - RNA, 19 nt, Homo sapiens
uggauaaucugcagacucu

SEQ ID NO: 1501703 - RNA, 19 nt, Homo sapiens
cgucaaugcagcuguagua

SEQ ID NO: 1501704 - RNA, 19 nt, Homo sapiens
uagcgucaaugcagcugua

SEQ ID NO: 1501705 - RNA, 19 nt, Homo sapiens
gggcaaugaagccauguuu

SEQ ID NO: 1501706 - RNA, 19 nt, Homo sapiens
gcacagcuacagaauuuac

SEQ ID NO: 1501707 - RNA, 19 nt, Homo sapiens
uaagguggcugaggcaaag

SEQ ID NO: 1501708 - RNA, 19 nt, Homo sapiens
gacaauuaccaacaacuug

SEQ ID NO: 1501709 - RNA, 19 nt, Homo sapiens
gauguuugaacuugguaua

SEQ ID NO: 1501710 - RNA, 19 nt, Homo sapiens
guagcucuguggaucaaau

SEQ ID NO: 1501711 - RNA, 19 nt, Homo sapiens
caagagcucaguccugugu

SEQ ID NO: 1501712 - RNA, 19 nt, Homo sapiens
caaugggccaacaguauuu

SEQ ID NO: 1501713 - RNA, 19 nt, Homo sapiens
gcgucucuuuccuggauua

SEQ ID NO: 1501714 - RNA, 19 nt, Homo sapiens
uuaaagaucgacauggaaa

SEQ ID NO: 1501715 - RNA, 19 nt, Homo sapiens
cgaacagcauaaacuggaa

SEQ ID NO: 1501716 - RNA, 19 nt, Homo sapiens
caaugcagcuguaguaacc

SEQ ID NO: 1501717 - RNA, 19 nt, Homo sapiens
gccgagcaaugcaccuaaa

SEQ ID NO: 1501718 - RNA, 19 nt, Homo sapiens
ccacacucaggguuucuua

SEQ ID NO: 1501719 - RNA, 19 nt, Homo sapiens
ggacagaauaauccuuaca

SEQ ID NO: 1501720 - RNA, 19 nt, Homo sapiens
gaaugaaagcacuggacaa

SEQ ID NO: 1501721 - RNA, 19 nt, Homo sapiens
acgaagcugucuuguaugu

SEQ ID NO: 1501722 - RNA, 19 nt, Homo sapiens
ccaugcaauuguucuucua

SEQ ID NO: 1501723 - RNA, 19 nt, Homo sapiens
cugaaucuauggaaagugu

SEQ ID NO: 1501724 - RNA, 19 nt, Homo sapiens
gauuauaucuggguuaccu

SEQ ID NO: 1501725 - RNA, 19 nt, Homo sapiens
acacacaacuugggaagag

SEQ ID NO: 1501726 - RNA, 19 nt, Homo sapiens
guucaagucucggcuuaca

SEQ ID NO: 1501727 - RNA, 19 nt, Homo sapiens
ggacaacacagagaaagag

SEQ ID NO: 1501728 - RNA, 19 nt, Homo sapiens
gagggugagugaacugucu

SEQ ID NO: 1501729 - RNA, 19 nt, Homo sapiens
gaagaccucggugaauuuc

SEQ ID NO: 1501730 - RNA, 19 nt, Homo sapiens
cgacauggaaacauacuca

SEQ ID NO: 1501731 - RNA, 19 nt, Homo sapiens
gcauaccaauauccucauc

SEQ ID NO: 1501732 - RNA, 19 nt, Homo sapiens
cauuacaguugccgggaaa

SEQ ID NO: 1501733 - RNA, 19 nt, Homo sapiens
agucucggcuuacaauaug

SEQ ID NO: 1501734 - RNA, 19 nt, Homo sapiens
gaauuuccagggcaaugaa

SEQ ID NO: 1501735 - RNA, 19 nt, Homo sapiens
gaaccaaggucaucuauca

SEQ ID NO: 1501736 - RNA, 19 nt, Homo sapiens
ggacagagguggcagugaa

SEQ ID NO: 1501737 - RNA, 19 nt, Homo sapiens
caagauaucugcauuuaag

SEQ ID NO: 1501738 - RNA, 19 nt, Homo sapiens
caaccacugucucccauua

SEQ ID NO: 1501739 - RNA, 19 nt, Homo sapiens
ucaaguaguucaacaagaa

SEQ ID NO: 1501740 - RNA, 19 nt, Homo sapiens
gaagagacccaaaugagaa

SEQ ID NO: 1501741 - RNA, 19 nt, Homo sapiens
gaaggcagcauuucucaaa

SEQ ID NO: 1501742 - RNA, 19 nt, Homo sapiens
agagagagguugucaagaa

SEQ ID NO: 1501743 - RNA, 19 nt, Homo sapiens
gaaaauguauggagugauu

SEQ ID NO: 1501744 - RNA, 19 nt, Homo sapiens
gagagagguugucaagaaa

SEQ ID NO: 1501745 - RNA, 19 nt, Homo sapiens
gagaugauauuccaguaga

SEQ ID NO: 1501746 - RNA, 19 nt, Homo sapiens
aagaaggccugauguguaa

SEQ ID NO: 1501747 - RNA, 19 nt, Homo sapiens
caagaaggccugaugugua

SEQ ID NO: 1501748 - RNA, 19 nt, Homo sapiens
gaucaucagugaauucauc

SEQ ID NO: 1501749 - RNA, 19 nt, Homo sapiens
ccaagaaaggcaucauuua

SEQ ID NO: 1501750 - RNA, 19 nt, Homo sapiens
gggagcagaucaaguaguu

SEQ ID NO: 1501751 - RNA, 19 nt, Homo sapiens
gagagguugucaagaaauu

SEQ ID NO: 1501752 - RNA, 19 nt, Homo sapiens
guuccgagaugaagacuuu

SEQ ID NO: 1501753 - RNA, 19 nt, Homo sapiens
ggacagaagcagacagaaa

SEQ ID NO: 1501754 - RNA, 19 nt, Homo sapiens
gaacucagaaggccauuug

SEQ ID NO: 1501755 - RNA, 19 nt, Homo sapiens
aaacaucagucaagcagaa

SEQ ID NO: 1501756 - RNA, 19 nt, Homo sapiens
ccaguagacuugucaaugu

SEQ ID NO: 1501757 - RNA, 19 nt, Homo sapiens
gagagaugauauuccagua

SEQ ID NO: 1501758 - RNA, 19 nt, Homo sapiens
ggaggaugcucuaacugaa

SEQ ID NO: 1501759 - RNA, 19 nt, Homo sapiens
acagaucucuuacuaaauc

SEQ ID NO: 1501760 - RNA, 19 nt, Homo sapiens
aaaggaaaccaguaagaua

SEQ ID NO: 1501761 - RNA, 19 nt, Homo sapiens
caucaagaaugaacucaga

SEQ ID NO: 1501762 - RNA, 19 nt, Homo sapiens
ucagugaauucauccuaua

SEQ ID NO: 1501763 - RNA, 19 nt, Homo sapiens
agaaagcgaugacacugaa

SEQ ID NO: 1501764 - RNA, 19 nt, Homo sapiens
ccaaacagaguucuaguga

SEQ ID NO: 1501765 - RNA, 19 nt, Homo sapiens
guugggagauggaaaugaa

SEQ ID NO: 1501766 - RNA, 19 nt, Homo sapiens
gcagaagauacuacuuuaa

SEQ ID NO: 1501767 - RNA, 19 nt, Homo sapiens
gagaauaagcaaugcaaug

SEQ ID NO: 1501768 - RNA, 19 nt, Homo sapiens
caagaaaggcaucauuuag

SEQ ID NO: 1501769 - RNA, 19 nt, Homo sapiens
uaagaaagaggaagccaaa

SEQ ID NO: 1501770 - RNA, 19 nt, Homo sapiens
uaccaugacuguaaggaaa

SEQ ID NO: 1501771 - RNA, 19 nt, Homo sapiens
ccaaagcguucacaguuag

SEQ ID NO: 1501772 - RNA, 19 nt, Homo sapiens
gaacagaggaaaaugaaaa

SEQ ID NO: 1501773 - RNA, 19 nt, Homo sapiens
gagcagagguuugcagaac

SEQ ID NO: 1501774 - RNA, 19 nt, Homo sapiens
gugaagaccugugagaugu

SEQ ID NO: 1501775 - RNA, 19 nt, Homo sapiens
gcacacgaauuugcuguca

SEQ ID NO: 1501776 - RNA, 19 nt, Homo sapiens
ccauaauuauuucccagua

SEQ ID NO: 1501777 - RNA, 19 nt, Homo sapiens
gaaggauacuggaaagacu

SEQ ID NO: 1501778 - RNA, 19 nt, Homo sapiens
aaaacgagcugaugaauuc

SEQ ID NO: 1501779 - RNA, 19 nt, Homo sapiens
ucauuuagguuccgagaug

SEQ ID NO: 1501780 - RNA, 19 nt, Homo sapiens
gaagaccugugagaugugu

SEQ ID NO: 1501781 - RNA, 19 nt, Homo sapiens
ccaaaccugaggagauuua

SEQ ID NO: 1501782 - RNA, 19 nt, Homo sapiens
cucaagaaauugcaagaaa

SEQ ID NO: 1501783 - RNA, 19 nt, Homo sapiens
ucuccaagaucaucaguga

SEQ ID NO: 1501784 - RNA, 19 nt, Homo sapiens
accaaagcguucacaguua

SEQ ID NO: 1501785 - RNA, 19 nt, Homo sapiens
gucaagaaauuacccacaa

SEQ ID NO: 1501786 - RNA, 19 nt, Homo sapiens
agcagaagauacuacuuua

SEQ ID NO: 1501787 - RNA, 19 nt, Homo sapiens
gauacuggaaagacuauuu

SEQ ID NO: 1501788 - RNA, 19 nt, Homo sapiens
cgaugacacugaagaggaa

SEQ ID NO: 1501789 - RNA, 19 nt, Homo sapiens
gccaagaaaggcaucauuu

SEQ ID NO: 1501790 - RNA, 19 nt, Homo sapiens
cuucagcgauguucaguau

SEQ ID NO: 1501791 - RNA, 19 nt, Homo sapiens
ucaagaaauugcaagaaag

SEQ ID NO: 1501792 - RNA, 19 nt, Homo sapiens
aaggaaaccaguaagauaa

SEQ ID NO: 1501793 - RNA, 19 nt, Homo sapiens
gaaggccauuugcaugugu

SEQ ID NO: 1501794 - RNA, 19 nt, Homo sapiens
ggcaaagguugucccaaga

SEQ ID NO: 1501795 - RNA, 19 nt, Homo sapiens
ggaaacccagucugaagaa

SEQ ID NO: 1501796 - RNA, 19 nt, Homo sapiens
gagaaagcgaugacacuga

SEQ ID NO: 1501797 - RNA, 19 nt, Homo sapiens
cugaggagauuuacaguca

SEQ ID NO: 1501798 - RNA, 19 nt, Homo sapiens
ccaaggucaucuaucaaga

SEQ ID NO: 1501799 - RNA, 19 nt, Homo sapiens
cgacaggaauauagaagag

SEQ ID NO: 1501800 - RNA, 19 nt, Homo sapiens
ggaaaccaguaagauaaag

SEQ ID NO: 1501801 - RNA, 19 nt, Homo sapiens
guaaauagugcacacgaau

SEQ ID NO: 1501802 - RNA, 19 nt, Homo sapiens
gaagaagugagcccaguca

SEQ ID NO: 1501803 - RNA, 19 nt, Homo sapiens
gaaaggcaucauuuagguu

SEQ ID NO: 1501804 - RNA, 19 nt, Homo sapiens
agaaaggcaucauuuaggu

SEQ ID NO: 1501805 - RNA, 19 nt, Homo sapiens
gagcagaucaaguaguuca

SEQ ID NO: 1501806 - RNA, 19 nt, Homo sapiens
uaucugcauuuaaguguga

SEQ ID NO: 1501807 - RNA, 19 nt, Homo sapiens
ggaaagagagagguuguca

SEQ ID NO: 1501808 - RNA, 19 nt, Homo sapiens
ggacucgagccauguauuc

SEQ ID NO: 1501809 - RNA, 19 nt, Homo sapiens
gcagagguuugcagaacuc

SEQ ID NO: 1501810 - RNA, 19 nt, Homo sapiens
cagcuccucuccaucaaga

SEQ ID NO: 1501811 - RNA, 19 nt, Homo sapiens
gggcuccacuauauacaga

SEQ ID NO: 1501812 - RNA, 19 nt, Homo sapiens
aagcagaagauacuacuuu

SEQ ID NO: 1501813 - RNA, 19 nt, Homo sapiens
cuauaacccuccugcauca

SEQ ID NO: 1501814 - RNA, 19 nt, Homo sapiens
guauuucuguggaacauag

SEQ ID NO: 1501815 - RNA, 19 nt, Homo sapiens
caauggagccagcaacaga

SEQ ID NO: 1501816 - RNA, 19 nt, Homo sapiens
gcaguuuguucaucaagag

SEQ ID NO: 1501817 - RNA, 19 nt, Homo sapiens
ggaaagacuauuuaaacag

SEQ ID NO: 1501818 - RNA, 19 nt, Homo sapiens
gcagaggucauucuucaag

SEQ ID NO: 1501819 - RNA, 19 nt, Homo sapiens
gaaacccagucugaagaau

SEQ ID NO: 1501820 - RNA, 19 nt, Homo sapiens
gaggccaaaucaagagaga

SEQ ID NO: 1501821 - RNA, 19 nt, Homo sapiens
ugaagaggccaaaucaaga

SEQ ID NO: 1501822 - RNA, 19 nt, Homo sapiens
acaaccagguggaaagaga

SEQ ID NO: 1501823 - RNA, 19 nt, Homo sapiens
caagaaauugcaagaaagu

SEQ ID NO: 1501824 - RNA, 19 nt, Homo sapiens
uaaauagugcacacgaauu

SEQ ID NO: 1501825 - RNA, 19 nt, Homo sapiens
guauggagugauuguauuu

SEQ ID NO: 1501826 - RNA, 19 nt, Homo sapiens
gccuggugcugcucccuua

SEQ ID NO: 1501827 - RNA, 19 nt, Homo sapiens
uacugaaacugaaaccaaa

SEQ ID NO: 1501828 - RNA, 19 nt, Homo sapiens
gaaaaggaaaccaguaaga

SEQ ID NO: 1501829 - RNA, 19 nt, Homo sapiens
acagggcaauuuguccuua

SEQ ID NO: 1501830 - RNA, 19 nt, Homo sapiens
caagggacaggcagaaguu

SEQ ID NO: 1501831 - RNA, 19 nt, Homo sapiens
ccaagaucaucagugaauu

SEQ ID NO: 1501832 - RNA, 19 nt, Homo sapiens
agcauaagguggacucuga

SEQ ID NO: 1501833 - RNA, 19 nt, Homo sapiens
acaagagguuggugucaau

SEQ ID NO: 1501834 - RNA, 19 nt, Homo sapiens
uugcagaggucauucuuca

SEQ ID NO: 1501835 - RNA, 19 nt, Homo sapiens
gaacaggacuggcuuguga

SEQ ID NO: 1501836 - RNA, 19 nt, Homo sapiens
ggaaaugccuggcuucaga

SEQ ID NO: 1501837 - RNA, 19 nt, Homo sapiens
gcacuucccuuguaaugga

SEQ ID NO: 1501838 - RNA, 19 nt, Homo sapiens
ucaaagcacuguccauugu

SEQ ID NO: 1501839 - RNA, 19 nt, Homo sapiens
ccaacaggaucaucucauu

SEQ ID NO: 1501840 - RNA, 19 nt, Homo sapiens
gcugagaaauccagagugu

SEQ ID NO: 1501841 - RNA, 19 nt, Homo sapiens
gagcauugccuuucccauu

SEQ ID NO: 1501842 - RNA, 19 nt, Homo sapiens
gaacgaauggacugaacaa

SEQ ID NO: 1501843 - RNA, 19 nt, Homo sapiens
gaugacagccuuuaugagu

SEQ ID NO: 1501844 - RNA, 19 nt, Homo sapiens
gcagaugacagccuuuaug

SEQ ID NO: 1501845 - RNA, 19 nt, Homo sapiens
ugacagccuuuaugaguuc

SEQ ID NO: 1501846 - RNA, 19 nt, Homo sapiens
gaagagaggaugggucugu

SEQ ID NO: 1501847 - RNA, 19 nt, Homo sapiens
ggucaaagcacuguccauu

SEQ ID NO: 1501848 - RNA, 19 nt, Homo sapiens
ggucagcacccuggccuua

SEQ ID NO: 1501849 - RNA, 19 nt, Homo sapiens
gccaaaagcuaccggaaaa

SEQ ID NO: 1501850 - RNA, 19 nt, Homo sapiens
cagaugacagccuuuauga

SEQ ID NO: 1501851 - RNA, 19 nt, Homo sapiens
cgggugcacuucccuugua

SEQ ID NO: 1501852 - RNA, 19 nt, Homo sapiens
caacaggaucaucucauug

SEQ ID NO: 1501853 - RNA, 19 nt, Homo sapiens
ugaaagggcugagaaaucc

SEQ ID NO: 1501854 - RNA, 19 nt, Homo sapiens
gaauccagccaauuuguca

SEQ ID NO: 1501855 - RNA, 19 nt, Homo sapiens
gaaaugccuggcuucagaa

SEQ ID NO: 1501856 - RNA, 19 nt, Homo sapiens
ucaguacuguccagaacuu

SEQ ID NO: 1501857 - RNA, 19 nt, Homo sapiens
cgaagcugcuguccaugga

SEQ ID NO: 1501858 - RNA, 19 nt, Homo sapiens
cuucauccguucaaagcua

SEQ ID NO: 1501859 - RNA, 19 nt, Homo sapiens
uggagcagguggcagauga

SEQ ID NO: 1501860 - RNA, 19 nt, Homo sapiens
gcgagcuggucauggguuu

SEQ ID NO: 1501861 - RNA, 19 nt, Homo sapiens
cuacauugcuuaggaaacu

SEQ ID NO: 1501862 - RNA, 19 nt, Homo sapiens
gcugaaggcccaacaggau

SEQ ID NO: 1501863 - RNA, 19 nt, Homo sapiens
gguaggagccaucgucagu

SEQ ID NO: 1501864 - RNA, 19 nt, Homo sapiens
ggaugccacugaccgauac

SEQ ID NO: 1501865 - RNA, 19 nt, Homo sapiens
ccgggaauccagccaauuu

SEQ ID NO: 1501866 - RNA, 19 nt, Homo sapiens
gaucuugagugccauuagc

SEQ ID NO: 1501867 - RNA, 19 nt, Homo sapiens
gggugcacuucccuuguaa

SEQ ID NO: 1501868 - RNA, 19 nt, Homo sapiens
uuuaugaguuccuggauuc

SEQ ID NO: 1501869 - RNA, 19 nt, Homo sapiens
ggacugcagagguggaaau

SEQ ID NO: 1501870 - RNA, 19 nt, Homo sapiens
acucgaagcugcuguccau

SEQ ID NO: 1501871 - RNA, 19 nt, Homo sapiens
gaucugcacgucuacuuag

SEQ ID NO: 1501872 - RNA, 19 nt, Homo sapiens
cuucugggcucccgucugu

SEQ ID NO: 1501873 - RNA, 19 nt, Homo sapiens
ggaugggucugugcugaag

SEQ ID NO: 1501874 - RNA, 19 nt, Homo sapiens
ggagguugcugggcauguc

SEQ ID NO: 1501875 - RNA, 19 nt, Homo sapiens
ggugaaagugaccgagaaa

SEQ ID NO: 1501876 - RNA, 19 nt, Homo sapiens
guuccuggauucuguggau

SEQ ID NO: 1501877 - RNA, 19 nt, Homo sapiens
uuucuguucuggcacauga

SEQ ID NO: 1501878 - RNA, 19 nt, Homo sapiens
cuggacugcuuccugauga

SEQ ID NO: 1501879 - RNA, 19 nt, Homo sapiens
gggaauccagccaauuugu

SEQ ID NO: 1501880 - RNA, 19 nt, Homo sapiens
cgaauggacugaacaaaac

SEQ ID NO: 1501881 - RNA, 19 nt, Homo sapiens
guaggagccaucgucagua

SEQ ID NO: 1501882 - RNA, 19 nt, Homo sapiens
gcaggcguguguggcauca

SEQ ID NO: 1501883 - RNA, 19 nt, Homo sapiens
ugaucugcacgucuacuua

SEQ ID NO: 1501884 - RNA, 19 nt, Homo sapiens
gccauuagcaacagagcuu

SEQ ID NO: 1501885 - RNA, 19 nt, Homo sapiens
gucaaagcacuguccauug

SEQ ID NO: 1501886 - RNA, 19 nt, Homo sapiens
ggaauccagccaauuuguc

SEQ ID NO: 1501887 - RNA, 19 nt, Homo sapiens
ggucccaccgguagacaaa

SEQ ID NO: 1501888 - RNA, 19 nt, Homo sapiens
ggaacgaauggacugaaca

SEQ ID NO: 1501889 - RNA, 19 nt, Homo sapiens
agacugaaagggcugagaa

SEQ ID NO: 1501890 - RNA, 19 nt, Homo sapiens
ccacugaccgauacagaag

SEQ ID NO: 1501891 - RNA, 19 nt, Homo sapiens
uaggagccaucgucaguac

SEQ ID NO: 1501892 - RNA, 19 nt, Homo sapiens
agcauugccuuucccauuc

SEQ ID NO: 1501893 - RNA, 19 nt, Homo sapiens
gugcacuucccuuguaaug

SEQ ID NO: 1501894 - RNA, 19 nt, Homo sapiens
aaggagagcgcuucugauc

SEQ ID NO: 1501895 - RNA, 19 nt, Homo sapiens
cgucaguacuguccagaac

SEQ ID NO: 1501896 - RNA, 19 nt, Homo sapiens
ggacuuuuauccucuccuu

SEQ ID NO: 1501897 - RNA, 19 nt, Homo sapiens
ugaaagugaccgagaaacu

SEQ ID NO: 1501898 - RNA, 19 nt, Homo sapiens
cugaaagggcugagaaauc

SEQ ID NO: 1501899 - RNA, 19 nt, Homo sapiens
ggagccaucgucaguacug

SEQ ID NO: 1501900 - RNA, 19 nt, Homo sapiens
uggcagaugacagccuuua

SEQ ID NO: 1501901 - RNA, 19 nt, Homo sapiens
uggugaaagugaccgagaa

SEQ ID NO: 1501902 - RNA, 19 nt, Homo sapiens
gacugaaagggcugagaaa

SEQ ID NO: 1501903 - RNA, 19 nt, Homo sapiens
gccacugaccgauacagaa

SEQ ID NO: 1501904 - RNA, 19 nt, Homo sapiens
cuuuaugaguuccuggauu

SEQ ID NO: 1501905 - RNA, 19 nt, Homo sapiens
caaggaacgaauggacuga

SEQ ID NO: 1501906 - RNA, 19 nt, Homo sapiens
gggcugagaaauccagagu

SEQ ID NO: 1501907 - RNA, 19 nt, Homo sapiens
aaaaggagagcgcuucuga

SEQ ID NO: 1501908 - RNA, 19 nt, Homo sapiens
caaagcacuguccauugug

SEQ ID NO: 1501909 - RNA, 19 nt, Homo sapiens
augacagccuuuaugaguu

SEQ ID NO: 1501910 - RNA, 19 nt, Homo sapiens
gggaaccaagcaccuaauc

SEQ ID NO: 1501911 - RNA, 19 nt, Homo sapiens
gcuggacugcuuccugaug

SEQ ID NO: 1501912 - RNA, 19 nt, Homo sapiens
uggaugccacugaccgaua

SEQ ID NO: 1501913 - RNA, 19 nt, Homo sapiens
gaacaaaggcuacaauuau

SEQ ID NO: 1501914 - RNA, 19 nt, Homo sapiens
gaaguguguuucugcauuu

SEQ ID NO: 1501915 - RNA, 19 nt, Homo sapiens
gggagaacauuucaggaua

SEQ ID NO: 1501916 - RNA, 19 nt, Homo sapiens
ggauugauguggauacaaa

SEQ ID NO: 1501917 - RNA, 19 nt, Homo sapiens
caaucaagguggagaaauu

SEQ ID NO: 1501918 - RNA, 19 nt, Homo sapiens
ugaaggaggauauguauuu

SEQ ID NO: 1501919 - RNA, 19 nt, Homo sapiens
gauacaaacuuuccugagu

SEQ ID NO: 1501920 - RNA, 19 nt, Homo sapiens
ggauaugucugugcaauca

SEQ ID NO: 1501921 - RNA, 19 nt, Homo sapiens
ccacacauguugaauuugu

SEQ ID NO: 1501922 - RNA, 19 nt, Homo sapiens
gaaagagggauaugguauu

SEQ ID NO: 1501923 - RNA, 19 nt, Homo sapiens
guccacacauguugaauuu

SEQ ID NO: 1501924 - RNA, 19 nt, Homo sapiens
uagauaagaugcagaagga

SEQ ID NO: 1501925 - RNA, 19 nt, Homo sapiens
gaacauuucaggauaggaa

SEQ ID NO: 1501926 - RNA, 19 nt, Homo sapiens
gaagcuaccuguccaucau

SEQ ID NO: 1501927 - RNA, 19 nt, Homo sapiens
ggagaacauuucaggauag

SEQ ID NO: 1501928 - RNA, 19 nt, Homo sapiens
ggaaagagggauaugguau

SEQ ID NO: 1501929 - RNA, 19 nt, Homo sapiens
aaauagaccuuacgagcuu

SEQ ID NO: 1501930 - RNA, 19 nt, Homo sapiens
ggagcaauauccacaaugg

SEQ ID NO: 1501931 - RNA, 19 nt, Homo sapiens
cgaaguguguuucugcauu

SEQ ID NO: 1501932 - RNA, 19 nt, Homo sapiens
ggacucagacuccaacgaa

SEQ ID NO: 1501933 - RNA, 19 nt, Homo sapiens
gauaagaugcagaaggaaa

SEQ ID NO: 1501934 - RNA, 19 nt, Homo sapiens
ggacaaccgugugagacaa

SEQ ID NO: 1501935 - RNA, 19 nt, Homo sapiens
ucagaagccauuuagauaa

SEQ ID NO: 1501936 - RNA, 19 nt, Homo sapiens
agaacaaaggcuacaauua

SEQ ID NO: 1501937 - RNA, 19 nt, Homo sapiens
ucaggaagcucuggcauuc

SEQ ID NO: 1501938 - RNA, 19 nt, Homo sapiens
gagaacaaaggcuacaauu

SEQ ID NO: 1501939 - RNA, 19 nt, Homo sapiens
ccaccgaugucauggauuc

SEQ ID NO: 1501940 - RNA, 19 nt, Homo sapiens
ugucauggauucucaggaa

SEQ ID NO: 1501941 - RNA, 19 nt, Homo sapiens
ugauguggauacaaacuuu

SEQ ID NO: 1501942 - RNA, 19 nt, Homo sapiens
acacagaggccugagauaa

SEQ ID NO: 1501943 - RNA, 19 nt, Homo sapiens
uaugugcucugcugaauuc

SEQ ID NO: 1501944 - RNA, 19 nt, Homo sapiens
gaaggacaaccgugugaga

SEQ ID NO: 1501945 - RNA, 19 nt, Homo sapiens
auugauggcuguauuaaga

SEQ ID NO: 1501946 - RNA, 19 nt, Homo sapiens
gagaauggacugcuuggau

SEQ ID NO: 1501947 - RNA, 19 nt, Homo sapiens
gacaauugcccacaagaga

SEQ ID NO: 1501948 - RNA, 19 nt, Homo sapiens
gcugcugcuuuauuugaua

SEQ ID NO: 1501949 - RNA, 19 nt, Homo sapiens
gcucuggcauuccucaaau

SEQ ID NO: 1501950 - RNA, 19 nt, Homo sapiens
cagaagccauuuagauaag

SEQ ID NO: 1501951 - RNA, 19 nt, Homo sapiens
aacaaaggcuacaauuaug

SEQ ID NO: 1501952 - RNA, 19 nt, Homo sapiens
ggagaaacagaaugaaauc

SEQ ID NO: 1501953 - RNA, 19 nt, Homo sapiens
aaagagggauaugguauuc

SEQ ID NO: 1501954 - RNA, 19 nt, Homo sapiens
gggagaaacagaaugaaau

SEQ ID NO: 1501955 - RNA, 19 nt, Homo sapiens
gaaggaggauauguauuuu

SEQ ID NO: 1501956 - RNA, 19 nt, Homo sapiens
gaagccauuuagauaagau

SEQ ID NO: 1501957 - RNA, 19 nt, Homo sapiens
aggcugagauugagaacaa

SEQ ID NO: 1501958 - RNA, 19 nt, Homo sapiens
gcacacagaggccugagau

SEQ ID NO: 1501959 - RNA, 19 nt, Homo sapiens
gaacccagcgggagaacau

SEQ ID NO: 1501960 - RNA, 19 nt, Homo sapiens
ucaggguaguguacaauau

SEQ ID NO: 1501961 - RNA, 19 nt, Homo sapiens
cagacuccaacgaauauua

SEQ ID NO: 1501962 - RNA, 19 nt, Homo sapiens
caaaggcuacaauuaugaa

SEQ ID NO: 1501963 - RNA, 19 nt, Homo sapiens
gaauggacugcuuggauga

SEQ ID NO: 1501964 - RNA, 19 nt, Homo sapiens
cacagaggccugagauaaa

SEQ ID NO: 1501965 - RNA, 19 nt, Homo sapiens
caagugauuggaugugaaa

SEQ ID NO: 1501966 - RNA, 19 nt, Homo sapiens
gccaagugcugagaagaug

SEQ ID NO: 1501967 - RNA, 19 nt, Homo sapiens
ucaagugauuggaugugaa

SEQ ID NO: 1501968 - RNA, 19 nt, Homo sapiens
acaagagaauggacugcuu

SEQ ID NO: 1501969 - RNA, 19 nt, Homo sapiens
cuugagggcuucuauugau

SEQ ID NO: 1501970 - RNA, 19 nt, Homo sapiens
uucagaagccauuuagaua

SEQ ID NO: 1501971 - RNA, 19 nt, Homo sapiens
acaaaggcuacaauuauga

SEQ ID NO: 1501972 - RNA, 19 nt, Homo sapiens
gaggaaagagggauauggu

SEQ ID NO: 1501973 - RNA, 19 nt, Homo sapiens
gugagacaauugcccacaa

SEQ ID NO: 1501974 - RNA, 19 nt, Homo sapiens
agacuccaacgaauauuaa

SEQ ID NO: 1501975 - RNA, 19 nt, Homo sapiens
agaugagucuuaggauuga

SEQ ID NO: 1501976 - RNA, 19 nt, Homo sapiens
aaacuuuccugaguguguu

SEQ ID NO: 1501977 - RNA, 19 nt, Homo sapiens
acucagacuccaacgaaua

SEQ ID NO: 1501978 - RNA, 19 nt, Homo sapiens
caaacuuuccugagugugu

SEQ ID NO: 1501979 - RNA, 19 nt, Homo sapiens
ucuauugauggcuguauua

SEQ ID NO: 1501980 - RNA, 19 nt, Homo sapiens
gucaagugauuggauguga

SEQ ID NO: 1501981 - RNA, 19 nt, Homo sapiens
gauaggaauaggccaagug

SEQ ID NO: 1501982 - RNA, 19 nt, Homo sapiens
uccuugaagugcaugauaa

SEQ ID NO: 1501983 - RNA, 19 nt, Homo sapiens
gagcuugagggcuucuauu

SEQ ID NO: 1501984 - RNA, 19 nt, Homo sapiens
cacacauguugaauuugua

SEQ ID NO: 1501985 - RNA, 19 nt, Homo sapiens
ggaugugccuccaauuuuc

SEQ ID NO: 1501986 - RNA, 19 nt, Homo sapiens
gcuugagggcuucuauuga

SEQ ID NO: 1501987 - RNA, 19 nt, Homo sapiens
uaccuuaugcuccaauuug

SEQ ID NO: 1501988 - RNA, 19 nt, Homo sapiens
gagaacauuucaggauagg

SEQ ID NO: 1501989 - RNA, 19 nt, Homo sapiens
ggagaacccagcgggagaa

SEQ ID NO: 1501990 - RNA, 19 nt, Homo sapiens
uacaaacuuuccugagugu

SEQ ID NO: 1501991 - RNA, 19 nt, Homo sapiens
guggauaugucugugcaau

SEQ ID NO: 1501992 - RNA, 19 nt, Homo sapiens
ggccugagauaaaauaugu

SEQ ID NO: 1501993 - RNA, 19 nt, Homo sapiens
gagaaacagaaugaaauca

SEQ ID NO: 1501994 - RNA, 19 nt, Homo sapiens
ggauaugguauuccuugga

SEQ ID NO: 1501995 - RNA, 19 nt, Homo sapiens
ugagacaauugcccacaag

SEQ ID NO: 1501996 - RNA, 19 nt, Homo sapiens
gcuaccuuaugcuccaauu

SEQ ID NO: 1501997 - RNA, 19 nt, Homo sapiens
acaauugcccacaagagaa

SEQ ID NO: 1501998 - RNA, 19 nt, Homo sapiens
gcaaucaagguggagaaau

SEQ ID NO: 1501999 - RNA, 19 nt, Homo sapiens
cgggagaaacagaaugaaa

SEQ ID NO: 1502000 - RNA, 19 nt, Homo sapiens
caaauacugaaggaggaua

SEQ ID NO: 1502001 - RNA, 19 nt, Homo sapiens
cggcuucaguaucuggaaa

SEQ ID NO: 1502002 - RNA, 19 nt, Homo sapiens
cagagaggaaagagggaua

SEQ ID NO: 1502003 - RNA, 19 nt, Homo sapiens
caauugcccacaagagaau

SEQ ID NO: 1502004 - RNA, 19 nt, Homo sapiens
gugaaggacaaccguguga

SEQ ID NO: 1502005 - RNA, 19 nt, Homo sapiens
ugaaaucauggaacacaga

SEQ ID NO: 1502006 - RNA, 19 nt, Homo sapiens
gcagaaggaaaaccacuuu

SEQ ID NO: 1502007 - RNA, 19 nt, Homo sapiens
ugaacgucauggaguagga

SEQ ID NO: 1502008 - RNA, 19 nt, Homo sapiens
aggguaguguacaauauga

SEQ ID NO: 1502009 - RNA, 19 nt, Homo sapiens
ggauaggaauaggccaagu

SEQ ID NO: 1502010 - RNA, 19 nt, Homo sapiens
uggaagcugacccagguua

SEQ ID NO: 1502011 - RNA, 19 nt, Homo sapiens
ggacugcuuggaugaugga

SEQ ID NO: 1502012 - RNA, 19 nt, Homo sapiens
gagacaauugcccacaaga

SEQ ID NO: 1502013 - RNA, 19 nt, Homo sapiens
ucacugagcucuuuagcaa

SEQ ID NO: 1502014 - RNA, 19 nt, Homo sapiens
gucauaagguccugaguaa

SEQ ID NO: 1502015 - RNA, 19 nt, Homo sapiens
gauggcagcuucuccaaca

SEQ ID NO: 1502016 - RNA, 19 nt, Homo sapiens
gaacgccgagcgaaugcua

SEQ ID NO: 1502017 - RNA, 19 nt, Homo sapiens
gguuuggccuggcugauau

SEQ ID NO: 1502018 - RNA, 19 nt, Homo sapiens
caagaacgccgagcgaaug

SEQ ID NO: 1502019 - RNA, 19 nt, Homo sapiens
ccgggacccuguucaagaa

SEQ ID NO: 1502020 - RNA, 19 nt, Homo sapiens
gcugcaaggugcugguaga

SEQ ID NO: 1502021 - RNA, 19 nt, Homo sapiens
gcugauggcugugguucug

SEQ ID NO: 1502022 - RNA, 19 nt, Homo sapiens
acgaggaggugcucaagug

SEQ ID NO: 1502023 - RNA, 19 nt, Homo sapiens
ccgagugggugagcacaaa

SEQ ID NO: 1502024 - RNA, 19 nt, Homo sapiens
caacaagcaguggaucuuc

SEQ ID NO: 1502025 - RNA, 19 nt, Homo sapiens
acugagcucuuuagcaaca

SEQ ID NO: 1502026 - RNA, 19 nt, Homo sapiens
agucauaagguccugagua

SEQ ID NO: 1502027 - RNA, 19 nt, Homo sapiens
ggcgggaccuucagacacu

SEQ ID NO: 1502028 - RNA, 19 nt, Homo sapiens
ccccguaccuggacaaauu

SEQ ID NO: 1502029 - RNA, 19 nt, Homo sapiens
gggacugccagacuccuuu

SEQ ID NO: 1502030 - RNA, 19 nt, Homo sapiens
ucaagaacgccgagcgaau

SEQ ID NO: 1502031 - RNA, 19 nt, Homo sapiens
cauaagguccugaguaacg

SEQ ID NO: 1502032 - RNA, 19 nt, Homo sapiens
ccaacaagcaguggaucuu

SEQ ID NO: 1502033 - RNA, 19 nt, Homo sapiens
caaaagaacggcagcagau

SEQ ID NO: 1502034 - RNA, 19 nt, Homo sapiens
uagacgcgcuucgacacaa

SEQ ID NO: 1502035 - RNA, 19 nt, Homo sapiens
gagcugcaaggugcuggua

SEQ ID NO: 1502036 - RNA, 19 nt, Homo sapiens
guggaucuucuucugguuu

SEQ ID NO: 1502037 - RNA, 19 nt, Homo sapiens
uggaucuucuucugguuug

SEQ ID NO: 1502038 - RNA, 19 nt, Homo sapiens
gccagacuccuuucacaag

SEQ ID NO: 1502039 - RNA, 19 nt, Homo sapiens
ggacugccagacuccuuuc

SEQ ID NO: 1502040 - RNA, 19 nt, Homo sapiens
guacuucaaacacagugau

SEQ ID NO: 1502041 - RNA, 19 nt, Homo sapiens
caucaaucccugguacuuc

SEQ ID NO: 1502042 - RNA, 19 nt, Homo sapiens
ggacgaggaggugcucaag

SEQ ID NO: 1502043 - RNA, 19 nt, Homo sapiens
caaaagagcucaauaagua

SEQ ID NO: 1502044 - RNA, 19 nt, Homo sapiens
gaaagaggcugccggaaag

SEQ ID NO: 1502045 - RNA, 19 nt, Homo sapiens
gcaggaggauguugagaaa

SEQ ID NO: 1502046 - RNA, 19 nt, Homo sapiens
gaaaguggccauccugaaa

SEQ ID NO: 1502047 - RNA, 19 nt, Homo sapiens
gagagaggcuuguucuaga

SEQ ID NO: 1502048 - RNA, 19 nt, Homo sapiens
aaacacauguccucacuga

SEQ ID NO: 1502049 - RNA, 19 nt, Homo sapiens
caauaaguaucaugcacua

SEQ ID NO: 1502050 - RNA, 19 nt, Homo sapiens
gcaauuccacuucuagaaa

SEQ ID NO: 1502051 - RNA, 19 nt, Homo sapiens
gaaaacauguggguucuuu

SEQ ID NO: 1502052 - RNA, 19 nt, Homo sapiens
agaaugagcccaagcguaa

SEQ ID NO: 1502053 - RNA, 19 nt, Homo sapiens
uuacgaagcuccugcuaug

SEQ ID NO: 1502054 - RNA, 19 nt, Homo sapiens
ggaaggagugcagcaguua

SEQ ID NO: 1502055 - RNA, 19 nt, Homo sapiens
guacgcgugucccuuguuu

SEQ ID NO: 1502056 - RNA, 19 nt, Homo sapiens
gaauaaauaggaucuguag

SEQ ID NO: 1502057 - RNA, 19 nt, Homo sapiens
caaauguggucucauccuu

SEQ ID NO: 1502058 - RNA, 19 nt, Homo sapiens
ggacguugccuuccuuuca

SEQ ID NO: 1502059 - RNA, 19 nt, Homo sapiens
ggagguaugcgaaucuuga

SEQ ID NO: 1502060 - RNA, 19 nt, Homo sapiens
caacaggggugccucuuuu

SEQ ID NO: 1502061 - RNA, 19 nt, Homo sapiens
caugagaaguugguaaguu

SEQ ID NO: 1502062 - RNA, 19 nt, Homo sapiens
caccagagcucccuaugca

SEQ ID NO: 1502063 - RNA, 19 nt, Homo sapiens
caauuccacuucuagaaau

SEQ ID NO: 1502064 - RNA, 19 nt, Homo sapiens
gcacuggguauccauuaaa

SEQ ID NO: 1502065 - RNA, 19 nt, Homo sapiens
ggagagaggcuuguucuag

SEQ ID NO: 1502066 - RNA, 19 nt, Homo sapiens
ccacaacacaugauaaaca

SEQ ID NO: 1502067 - RNA, 19 nt, Homo sapiens
acagugaggugauucugaa

SEQ ID NO: 1502068 - RNA, 19 nt, Homo sapiens
gcacgugaccuggcaauuc

SEQ ID NO: 1502069 - RNA, 19 nt, Homo sapiens
ggaaaccucuguggcucuu

SEQ ID NO: 1502070 - RNA, 19 nt, Homo sapiens
agaaagaggcugccggaaa

SEQ ID NO: 1502071 - RNA, 19 nt, Homo sapiens
ggaaaguggccauccugaa

SEQ ID NO: 1502072 - RNA, 19 nt, Homo sapiens
gagaaguccugcagcugau

SEQ ID NO: 1502073 - RNA, 19 nt, Homo sapiens
ccaaagcucucaggaggau

SEQ ID NO: 1502074 - RNA, 19 nt, Homo sapiens
gaaagaaaaugcugaccau

SEQ ID NO: 1502075 - RNA, 19 nt, Homo sapiens
ccagagagggucagaguau

SEQ ID NO: 1502076 - RNA, 19 nt, Homo sapiens
gugaggaucuucgucauca

SEQ ID NO: 1502077 - RNA, 19 nt, Homo sapiens
ugggagaccuggaggagaa

SEQ ID NO: 1502078 - RNA, 19 nt, Homo sapiens
gcaaucccaccacugauga

SEQ ID NO: 1502079 - RNA, 19 nt, Homo sapiens
cgccacagaucuuuacgaa

SEQ ID NO: 1502080 - RNA, 19 nt, Homo sapiens
cagaagugcucauacaaaa

SEQ ID NO: 1502081 - RNA, 19 nt, Homo sapiens
ggcacuggguauccauuaa

SEQ ID NO: 1502082 - RNA, 19 nt, Homo sapiens
cauguggguucuuugugua

SEQ ID NO: 1502083 - RNA, 19 nt, Homo sapiens
ccaaacagccuggaaaugg

SEQ ID NO: 1502084 - RNA, 19 nt, Homo sapiens
aggaggauguugagaaaug

SEQ ID NO: 1502085 - RNA, 19 nt, Homo sapiens
gaggcuuguucuagaugua

SEQ ID NO: 1502086 - RNA, 19 nt, Homo sapiens
acagccagcucugagauuu

SEQ ID NO: 1502087 - RNA, 19 nt, Homo sapiens
ucagaagugcucauacaaa

SEQ ID NO: 1502088 - RNA, 19 nt, Homo sapiens
gauagcaggaggauguuga

SEQ ID NO: 1502089 - RNA, 19 nt, Homo sapiens
cagaguggcccuagggaaa

SEQ ID NO: 1502090 - RNA, 19 nt, Homo sapiens
guguagauguggcuaguuc

SEQ ID NO: 1502091 - RNA, 19 nt, Homo sapiens
uuagugcucucccaauaau

SEQ ID NO: 1502092 - RNA, 19 nt, Homo sapiens
acacauguccucacugaau

SEQ ID NO: 1502093 - RNA, 19 nt, Homo sapiens
ggucagggguggcagaaaa

SEQ ID NO: 1502094 - RNA, 19 nt, Homo sapiens
cacugaauguuacugauug

SEQ ID NO: 1502095 - RNA, 19 nt, Homo sapiens
ggguuaggcuggagugaca

SEQ ID NO: 1502096 - RNA, 19 nt, Homo sapiens
ucucuuguccugaggguua

SEQ ID NO: 1502097 - RNA, 19 nt, Homo sapiens
aaagauugcagccaaaugu

SEQ ID NO: 1502098 - RNA, 19 nt, Homo sapiens
acuccuaccugaauagaga

SEQ ID NO: 1502099 - RNA, 19 nt, Homo sapiens
gagccagcuuccacuccua

SEQ ID NO: 1502100 - RNA, 19 nt, Homo sapiens
gccaggaugucccaagcuu

SEQ ID NO: 1502101 - RNA, 19 nt, Homo sapiens
ccuccugccuggaaucuug

SEQ ID NO: 1502102 - RNA, 19 nt, Homo sapiens
ggaacugcccuccaucauc

SEQ ID NO: 1502103 - RNA, 19 nt, Homo sapiens
cgaagcuccugcuauguag

SEQ ID NO: 1502104 - RNA, 19 nt, Homo sapiens
aagcguaaguggaaguuuc

SEQ ID NO: 1502105 - RNA, 19 nt, Homo sapiens
guugguaaguuggcuguga

SEQ ID NO: 1502106 - RNA, 19 nt, Homo sapiens
ucacugaauguuacugauu

SEQ ID NO: 1502107 - RNA, 19 nt, Homo sapiens
uaucagggcacuucuauac

SEQ ID NO: 1502108 - RNA, 19 nt, Homo sapiens
gaagugcucauacaaaaga

SEQ ID NO: 1502109 - RNA, 19 nt, Homo sapiens
gcgcccaccuugcuguuca

SEQ ID NO: 1502110 - RNA, 19 nt, Homo sapiens
guggcuaguuccaauuaga

SEQ ID NO: 1502111 - RNA, 19 nt, Homo sapiens
augagaaguugguaaguug

SEQ ID NO: 1502112 - RNA, 19 nt, Homo sapiens
gacguugccuuccuuucau

SEQ ID NO: 1502113 - RNA, 19 nt, Homo sapiens
uggaaggagugcagcaguu

SEQ ID NO: 1502114 - RNA, 19 nt, Homo sapiens
ugucuuaccaugagaaguu

SEQ ID NO: 1502115 - RNA, 19 nt, Homo sapiens
caacacaugauaaacacau

SEQ ID NO: 1502116 - RNA, 19 nt, Homo sapiens
ggacagccagcucugagau

SEQ ID NO: 1502117 - RNA, 19 nt, Homo sapiens
ucuguucauucuuggauuu

SEQ ID NO: 1502118 - RNA, 19 nt, Homo sapiens
ggucauccuguccgucuuu

SEQ ID NO: 1502119 - RNA, 19 nt, Homo sapiens
gaucuucgucaucaucuuc

SEQ ID NO: 1502120 - RNA, 19 nt, Homo sapiens
acgaagcuccugcuaugua

SEQ ID NO: 1502121 - RNA, 19 nt, Homo sapiens
gcagccaaauguggucuca

SEQ ID NO: 1502122 - RNA, 19 nt, Homo sapiens
cacauguccucacugaaug

SEQ ID NO: 1502123 - RNA, 19 nt, Homo sapiens
ccacccacaacacaugaua

SEQ ID NO: 1502124 - RNA, 19 nt, Homo sapiens
ggaggauguugagaaaugg

SEQ ID NO: 1502125 - RNA, 19 nt, Homo sapiens
cgugauagcaggaggaugu

SEQ ID NO: 1502126 - RNA, 19 nt, Homo sapiens
acauguggguucuuugugu

SEQ ID NO: 1502127 - RNA, 19 nt, Homo sapiens
aaacauguggguucuuugu

SEQ ID NO: 1502128 - RNA, 19 nt, Homo sapiens
uguauuggcugucuguuuu

SEQ ID NO: 1502129 - RNA, 19 nt, Homo sapiens
agagaggcuuguucuagau

SEQ ID NO: 1502130 - RNA, 19 nt, Homo sapiens
ggaggugcccaacaguaga

SEQ ID NO: 1502131 - RNA, 19 nt, Homo sapiens
gaaugucccugcccauccu

SEQ ID NO: 1502132 - RNA, 19 nt, Homo sapiens
auaaauaggaucuguagca

SEQ ID NO: 1502133 - RNA, 19 nt, Homo sapiens
ggcaauuccacuucuagaa

SEQ ID NO: 1502134 - RNA, 19 nt, Homo sapiens
cauguaaucacgccacaga

SEQ ID NO: 1502135 - RNA, 19 nt, Homo sapiens
gguagaacuggcccuggua

SEQ ID NO: 1502136 - RNA, 19 nt, Homo sapiens
cuagaaaugagccuucaga

SEQ ID NO: 1502137 - RNA, 19 nt, Homo sapiens
ggucagaguaucccuuucu

SEQ ID NO: 1502138 - RNA, 19 nt, Homo sapiens
gaggugcccaacaguagaa

SEQ ID NO: 1502139 - RNA, 19 nt, Homo sapiens
guaaucacgccacagaucu

SEQ ID NO: 1502140 - RNA, 19 nt, Homo sapiens
ccaaaagauugcagccaaa

SEQ ID NO: 1502141 - RNA, 19 nt, Homo sapiens
ucacugcacccacccacaa

SEQ ID NO: 1502142 - RNA, 19 nt, Homo sapiens
agauguggcuaguuccaau

SEQ ID NO: 1502143 - RNA, 19 nt, Homo sapiens
ggaaaguccuguuugauca

SEQ ID NO: 1502144 - RNA, 19 nt, Homo sapiens
gaauugggcuugucuacgu

SEQ ID NO: 1502145 - RNA, 19 nt, Homo sapiens
uugaagaacucccugguuu

SEQ ID NO: 1502146 - RNA, 19 nt, Homo sapiens
ugacauacaucuucaugca

SEQ ID NO: 1502147 - RNA, 19 nt, Homo sapiens
gggaacacaggcuacauua

SEQ ID NO: 1502148 - RNA, 19 nt, Homo sapiens
gucacuaggucaauuugua

SEQ ID NO: 1502149 - RNA, 19 nt, Homo sapiens
gcauggagccacccgaauu

SEQ ID NO: 1502150 - RNA, 19 nt, Homo sapiens
ugaagaacucccugguuua

SEQ ID NO: 1502151 - RNA, 19 nt, Homo sapiens
gaacuggucaggcaugaag

SEQ ID NO: 1502152 - RNA, 19 nt, Homo sapiens
gaacaccugggacucaaug

SEQ ID NO: 1502153 - RNA, 19 nt, Homo sapiens
cuucaugcaugcagggaua

SEQ ID NO: 1502154 - RNA, 19 nt, Homo sapiens
gaagaacucccugguuuac

SEQ ID NO: 1502155 - RNA, 19 nt, Homo sapiens
gcagaucggcuaccaggau

SEQ ID NO: 1502156 - RNA, 19 nt, Homo sapiens
gcaacaagcguuccaacag

SEQ ID NO: 1502157 - RNA, 19 nt, Homo sapiens
ccacuguaauguuuguguu

SEQ ID NO: 1502158 - RNA, 19 nt, Homo sapiens
ggauggcuguggcccuuau

SEQ ID NO: 1502159 - RNA, 19 nt, Homo sapiens
cagaucggcuaccaggauu

SEQ ID NO: 1502160 - RNA, 19 nt, Homo sapiens
ccacuggaaaguccuguuu

SEQ ID NO: 1502161 - RNA, 19 nt, Homo sapiens
caauuuguacugcagguaa

SEQ ID NO: 1502162 - RNA, 19 nt, Homo sapiens
gaccgcaagugguacuaug

SEQ ID NO: 1502163 - RNA, 19 nt, Homo sapiens
aaauugaccgcaaguggua

SEQ ID NO: 1502164 - RNA, 19 nt, Homo sapiens
ccacguuacuugaagaacu

SEQ ID NO: 1502165 - RNA, 19 nt, Homo sapiens
gcuguggcccuuaucugua

SEQ ID NO: 1502166 - RNA, 19 nt, Homo sapiens
gguguaugcucucgucucu

SEQ ID NO: 1502167 - RNA, 19 nt, Homo sapiens
acacccugcuggacuuaaa

SEQ ID NO: 1502168 - RNA, 19 nt, Homo sapiens
acuggaaaguccuguuuga

SEQ ID NO: 1502169 - RNA, 19 nt, Homo sapiens
gcaggguccuuggcagugu

SEQ ID NO: 1502170 - RNA, 19 nt, Homo sapiens
ccugcgagguuucuucuca

SEQ ID NO: 1502171 - RNA, 19 nt, Homo sapiens
uggccaacauugucaugaa

SEQ ID NO: 1502172 - RNA, 19 nt, Homo sapiens
cugggccacuguaauguuu

SEQ ID NO: 1502173 - RNA, 19 nt, Homo sapiens
guaugagcauggaguuugg

SEQ ID NO: 1502174 - RNA, 19 nt, Homo sapiens
ggcgcuaccugacauacau

SEQ ID NO: 1502175 - RNA, 19 nt, Homo sapiens
guuuagauuuggacacaca

SEQ ID NO: 1502176 - RNA, 19 nt, Homo sapiens
uagaacaccugggacucaa

SEQ ID NO: 1502177 - RNA, 19 nt, Homo sapiens
gacaaggacagaagacucu

SEQ ID NO: 1502178 - RNA, 19 nt, Homo sapiens
ggaacacaggcuacauuag

SEQ ID NO: 1502179 - RNA, 19 nt, Homo sapiens
ccaacauugucaugaacug

SEQ ID NO: 1502180 - RNA, 19 nt, Homo sapiens
cuacguggccgguguugug

SEQ ID NO: 1502181 - RNA, 19 nt, Homo sapiens
cauccacguuacuugaaga

SEQ ID NO: 1502182 - RNA, 19 nt, Homo sapiens
ggugucacuaggucaauuu

SEQ ID NO: 1502183 - RNA, 19 nt, Homo sapiens
gggccacuguaauguuugu

SEQ ID NO: 1502184 - RNA, 19 nt, Homo sapiens
cagcugcgagcacagguuu

SEQ ID NO: 1502185 - RNA, 19 nt, Homo sapiens
ccacccugguucaugauca

SEQ ID NO: 1502186 - RNA, 19 nt, Homo sapiens
cagggcaaccgcaggcuaa

SEQ ID NO: 1502187 - RNA, 19 nt, Homo sapiens
cauggagccacccgaauug

SEQ ID NO: 1502188 - RNA, 19 nt, Homo sapiens
gggugucacuaggucaauu

SEQ ID NO: 1502189 - RNA, 19 nt, Homo sapiens
gggcagacaaggacagaag

SEQ ID NO: 1502190 - RNA, 19 nt, Homo sapiens
uggaaaguccuguuugauc

SEQ ID NO: 1502191 - RNA, 19 nt, Homo sapiens
uaccugacauacaucuuca

SEQ ID NO: 1502192 - RNA, 19 nt, Homo sapiens
ccuacacccugcuggacuu

SEQ ID NO: 1502193 - RNA, 19 nt, Homo sapiens
guacugcagguaacucauc

SEQ ID NO: 1502194 - RNA, 19 nt, Homo sapiens
aguccuguuugaucaguuu

SEQ ID NO: 1502195 - RNA, 19 nt, Homo sapiens
ggccaacauugucaugaac

SEQ ID NO: 1502196 - RNA, 19 nt, Homo sapiens
gcccaucuggccaacauug

SEQ ID NO: 1502197 - RNA, 19 nt, Homo sapiens
ggcaaguuccggagucuuc

SEQ ID NO: 1502198 - RNA, 19 nt, Homo sapiens
uggaacaucuuugccuaca

SEQ ID NO: 1502199 - RNA, 19 nt, Homo sapiens
caagcuuuguggcgcacuu

SEQ ID NO: 1502200 - RNA, 19 nt, Homo sapiens
cuguggcccuuaucuguau

SEQ ID NO: 1502201 - RNA, 19 nt, Homo sapiens
caagcuggacccgcacaaa

SEQ ID NO: 1502202 - RNA, 19 nt, Homo sapiens
gaaaguccuguuugaucag

SEQ ID NO: 1502203 - RNA, 19 nt, Homo sapiens
gcugucuucuggaacaucu

SEQ ID NO: 1502204 - RNA, 19 nt, Homo sapiens
uguaugagcauggaguuug

SEQ ID NO: 1502205 - RNA, 19 nt, Homo sapiens
ucucgucucugcccaucug

SEQ ID NO: 1502206 - RNA, 19 nt, Homo sapiens
cuaccugacauacaucuuc

SEQ ID NO: 1502207 - RNA, 19 nt, Homo sapiens
gcgcaucgaggagcuggaa

SEQ ID NO: 1502208 - RNA, 19 nt, Homo sapiens
ugggaacacaggcuacauu

SEQ ID NO: 1502209 - RNA, 19 nt, Homo sapiens
gcaaacagcugguguaaac

SEQ ID NO: 1502210 - RNA, 19 nt, Homo sapiens
gggaagaccugccugauga

SEQ ID NO: 1502211 - RNA, 19 nt, Homo sapiens
ggaaaucacugucuacaac

SEQ ID NO: 1502212 - RNA, 19 nt, Homo sapiens
ggaagaaguuugccaagca

SEQ ID NO: 1502213 - RNA, 19 nt, Homo sapiens
ggaaugcgcucuggaaaca

SEQ ID NO: 1502214 - RNA, 19 nt, Homo sapiens
gauacugucugucuucuug

SEQ ID NO: 1502215 - RNA, 19 nt, Homo sapiens
gggcgaacaugcucuacua

SEQ ID NO: 1502216 - RNA, 19 nt, Homo sapiens
gugcacagcuggccaagga

SEQ ID NO: 1502217 - RNA, 19 nt, Homo sapiens
cagcagaacuccaaguauc

SEQ ID NO: 1502218 - RNA, 19 nt, Homo sapiens
gaggugaaguggacugaau

SEQ ID NO: 1502219 - RNA, 19 nt, Homo sapiens
gcaaaguggccgaggauga

SEQ ID NO: 1502220 - RNA, 19 nt, Homo sapiens
aaaccacucucaaugcauu

SEQ ID NO: 1502221 - RNA, 19 nt, Homo sapiens
acgaacagauuucaacaaa

SEQ ID NO: 1502222 - RNA, 19 nt, Homo sapiens
guucugaaguucuuguuug

SEQ ID NO: 1502223 - RNA, 19 nt, Homo sapiens
aggcggagauccugaagua

SEQ ID NO: 1502224 - RNA, 19 nt, Homo sapiens
gugcaucucugguaacugu

SEQ ID NO: 1502225 - RNA, 19 nt, Homo sapiens
ugacuggguugccugaauu

SEQ ID NO: 1502226 - RNA, 19 nt, Homo sapiens
gcgaacaugcucuacuaua

SEQ ID NO: 1502227 - RNA, 19 nt, Homo sapiens
gagaaaauguuaccagaau

SEQ ID NO: 1502228 - RNA, 19 nt, Homo sapiens
cgaacaugcucuacuauac

SEQ ID NO: 1502229 - RNA, 19 nt, Homo sapiens
acacagaggaggccuauga

SEQ ID NO: 1502230 - RNA, 19 nt, Homo sapiens
cauaugaaguggaagaagu

SEQ ID NO: 1502231 - RNA, 19 nt, Homo sapiens
ggagauagaaggguuugaa

SEQ ID NO: 1502232 - RNA, 19 nt, Homo sapiens
gagguaagcuggauauccu

SEQ ID NO: 1502233 - RNA, 19 nt, Homo sapiens
ggacggagguaagcuggau

SEQ ID NO: 1502234 - RNA, 19 nt, Homo sapiens
agagauggauggcgggaaa

SEQ ID NO: 1502235 - RNA, 19 nt, Homo sapiens
uugaagaagucgaggaauu

SEQ ID NO: 1502236 - RNA, 19 nt, Homo sapiens
acgcacgucuccuuccuua

SEQ ID NO: 1502237 - RNA, 19 nt, Homo sapiens
gaggaugauuuccgacugu

SEQ ID NO: 1502238 - RNA, 19 nt, Homo sapiens
ggagaccacucgcaacaac

SEQ ID NO: 1502239 - RNA, 19 nt, Homo sapiens
gaaccucaccagccaugaa

SEQ ID NO: 1502240 - RNA, 19 nt, Homo sapiens
ggcagugcaucucugguaa

SEQ ID NO: 1502241 - RNA, 19 nt, Homo sapiens
ggaccaucuuggaguuuga

SEQ ID NO: 1502242 - RNA, 19 nt, Homo sapiens
ccaaguaucccauucucuu

SEQ ID NO: 1502243 - RNA, 19 nt, Homo sapiens
gcucaucaccuaugucauc

SEQ ID NO: 1502244 - RNA, 19 nt, Homo sapiens
cugaaguucuuguuuguau

SEQ ID NO: 1502245 - RNA, 19 nt, Homo sapiens
ccaagcacauguucuuucu

SEQ ID NO: 1502246 - RNA, 19 nt, Homo sapiens
ggacaacucagugcuggaa

SEQ ID NO: 1502247 - RNA, 19 nt, Homo sapiens
ccaggaccaucuuggaguu

SEQ ID NO: 1502248 - RNA, 19 nt, Homo sapiens
caaguaucccauucucuuu

SEQ ID NO: 1502249 - RNA, 19 nt, Homo sapiens
gaacuccaaguaucccauu

SEQ ID NO: 1502250 - RNA, 19 nt, Homo sapiens
aagcacauguucuuucugu

SEQ ID NO: 1502251 - RNA, 19 nt, Homo sapiens
gucgugagaucaaggagaa

SEQ ID NO: 1502252 - RNA, 19 nt, Homo sapiens
ggugaagccucugguuuua

SEQ ID NO: 1502253 - RNA, 19 nt, Homo sapiens
ugaaguggacugaauggaa

SEQ ID NO: 1502254 - RNA, 19 nt, Homo sapiens
ugcaugauguucugaaguu

SEQ ID NO: 1502255 - RNA, 19 nt, Homo sapiens
ugaugaaggccuuguuaaa

SEQ ID NO: 1502256 - RNA, 19 nt, Homo sapiens
gaaaggggcagcagucuug

SEQ ID NO: 1502257 - RNA, 19 nt, Homo sapiens
gaggggcaguugucaauuu

SEQ ID NO: 1502258 - RNA, 19 nt, Homo sapiens
gcacgucuccuuccuuaac

SEQ ID NO: 1502259 - RNA, 19 nt, Homo sapiens
gcagaaugacuuugugaag

SEQ ID NO: 1502260 - RNA, 19 nt, Homo sapiens
caucuuggaguuugagaaa

SEQ ID NO: 1502261 - RNA, 19 nt, Homo sapiens
acacgcugcugcauaugaa

SEQ ID NO: 1502262 - RNA, 19 nt, Homo sapiens
gaaaucacugucuacaaca

SEQ ID NO: 1502263 - RNA, 19 nt, Homo sapiens
uggaggaguugguagaguu

SEQ ID NO: 1502264 - RNA, 19 nt, Homo sapiens
cgacuguguuugcggauca

SEQ ID NO: 1502265 - RNA, 19 nt, Homo sapiens
ugggagagcugugcaaagu

SEQ ID NO: 1502266 - RNA, 19 nt, Homo sapiens
gcaaggcggagauccugaa

SEQ ID NO: 1502267 - RNA, 19 nt, Homo sapiens
gaugaaggccuuguuaaac

SEQ ID NO: 1502268 - RNA, 19 nt, Homo sapiens
aaagacauuucaguugaga

SEQ ID NO: 1502269 - RNA, 19 nt, Homo sapiens
gaugauuuccgacuguguu

SEQ ID NO: 1502270 - RNA, 19 nt, Homo sapiens
caaaguggccgaggaugau

SEQ ID NO: 1502271 - RNA, 19 nt, Homo sapiens
gcggagauccugaaguaca

SEQ ID NO: 1502272 - RNA, 19 nt, Homo sapiens
ucaagacgcagaaugacuu

SEQ ID NO: 1502273 - RNA, 19 nt, Homo sapiens
ccaaccagcccgagauugu

SEQ ID NO: 1502274 - RNA, 19 nt, Homo sapiens
caaugcauuugaagaaguc

SEQ ID NO: 1502275 - RNA, 19 nt, Homo sapiens
cgagaagugucccaaagac

SEQ ID NO: 1502276 - RNA, 19 nt, Homo sapiens
gaacaugcucuacuauacg

SEQ ID NO: 1502277 - RNA, 19 nt, Homo sapiens
ccucggaucugcaguccau

SEQ ID NO: 1502278 - RNA, 19 nt, Homo sapiens
gaaguuugccaagcacaug

SEQ ID NO: 1502279 - RNA, 19 nt, Homo sapiens
gggcaguugucaauuuguc

SEQ ID NO: 1502280 - RNA, 19 nt, Homo sapiens
ugaagaagucgaggaauuc

SEQ ID NO: 1502281 - RNA, 19 nt, Homo sapiens
gaucgagaagugucccaaa

SEQ ID NO: 1502282 - RNA, 19 nt, Homo sapiens
gcaccaaccagcccgagau

SEQ ID NO: 1502283 - RNA, 19 nt, Homo sapiens
ccugaugaaggccuuguua

SEQ ID NO: 1502284 - RNA, 19 nt, Homo sapiens
gagaccauccuuggaguga

SEQ ID NO: 1502285 - RNA, 19 nt, Homo sapiens
gugacuggguugccugaau

SEQ ID NO: 1502286 - RNA, 19 nt, Homo sapiens
cggcucugcuggccuagaa

SEQ ID NO: 1502287 - RNA, 19 nt, Homo sapiens
gaccucuccuccugucuuc

SEQ ID NO: 1502288 - RNA, 19 nt, Homo sapiens
ccggaaaccucgguguaga

SEQ ID NO: 1502289 - RNA, 19 nt, Homo sapiens
caagacgcagaaugacuuu

SEQ ID NO: 1502290 - RNA, 19 nt, Homo sapiens
ccaugugcaucucugugaa

SEQ ID NO: 1502291 - RNA, 19 nt, Homo sapiens
acaacucagugcuggaaau

SEQ ID NO: 1502292 - RNA, 19 nt, Homo sapiens
ggaagaccugccugaugaa

SEQ ID NO: 1502293 - RNA, 19 nt, Homo sapiens
caaaaccacucucaaugca

SEQ ID NO: 1502294 - RNA, 19 nt, Homo sapiens
guaagacgaacagauuuca

SEQ ID NO: 1502295 - RNA, 19 nt, Homo sapiens
cgacaaccggcaugagaug

SEQ ID NO: 1502296 - RNA, 19 nt, Homo sapiens
cggcagugcaucucuggua

SEQ ID NO: 1502297 - RNA, 19 nt, Homo sapiens
ggaggaguugguagaguug

SEQ ID NO: 1502298 - RNA, 19 nt, Homo sapiens
gaauuaacacaggguuuua

SEQ ID NO: 1502299 - RNA, 19 nt, Homo sapiens
gaccauccuuggagugaac

SEQ ID NO: 1502300 - RNA, 19 nt, Homo sapiens
gcgagacuguggagaacgu

SEQ ID NO: 1502301 - RNA, 19 nt, Homo sapiens
gcaugauguucugaaguuc

SEQ ID NO: 1502302 - RNA, 19 nt, Homo sapiens
gugcucaucugggccaugu

SEQ ID NO: 1502303 - RNA, 19 nt, Homo sapiens
guacacagaggaggccuau

SEQ ID NO: 1502304 - RNA, 19 nt, Homo sapiens
caucaacgccgaguacaca

SEQ ID NO: 1502305 - RNA, 19 nt, Homo sapiens
gacgaacagauuucaacaa

SEQ ID NO: 1502306 - RNA, 19 nt, Homo sapiens
gaugggagagcugugcaaa

SEQ ID NO: 1502307 - RNA, 19 nt, Homo sapiens
gagccaggaccaucuugga

SEQ ID NO: 1502308 - RNA, 19 nt, Homo sapiens
gcagggagaggagucuuuc

SEQ ID NO: 1502309 - RNA, 19 nt, Homo sapiens
ggacaccacuuguugauua

SEQ ID NO: 1502310 - RNA, 19 nt, Homo sapiens
ccacagggcuggugaugau

SEQ ID NO: 1502311 - RNA, 19 nt, Homo sapiens
gcggguacuucguuccuua

SEQ ID NO: 1502312 - RNA, 19 nt, Homo sapiens
gagagagcccguccaaguu

SEQ ID NO: 1502313 - RNA, 19 nt, Homo sapiens
caccacuuguugauuauuu

SEQ ID NO: 1502314 - RNA, 19 nt, Homo sapiens
cgagagagcccguccaagu

SEQ ID NO: 1502315 - RNA, 19 nt, Homo sapiens
gcgaucugcugcaucucua

SEQ ID NO: 1502316 - RNA, 19 nt, Homo sapiens
uaggcacccucucgcguua

SEQ ID NO: 1502317 - RNA, 19 nt, Homo sapiens
gacaccacuuguugauuau

SEQ ID NO: 1502318 - RNA, 19 nt, Homo sapiens
ggaggcuucucucacagau

SEQ ID NO: 1502319 - RNA, 19 nt, Homo sapiens
ccgcagccuucgcgauaaa

SEQ ID NO: 1502320 - RNA, 19 nt, Homo sapiens
ccuccugucugguucuuug

SEQ ID NO: 1502321 - RNA, 19 nt, Homo sapiens
cguggaggcuucucucaca

SEQ ID NO: 1502322 - RNA, 19 nt, Homo sapiens
ggaugagacaggagacuuc

SEQ ID NO: 1502323 - RNA, 19 nt, Homo sapiens
aggcuucucucacagaugu

SEQ ID NO: 1502324 - RNA, 19 nt, Homo sapiens
gagacuucaccgccucuuu

SEQ ID NO: 1502325 - RNA, 19 nt, Homo sapiens
cgauaaacgggcuguccua

SEQ ID NO: 1502326 - RNA, 19 nt, Homo sapiens
agagagcccguccaaguug

SEQ ID NO: 1502327 - RNA, 19 nt, Homo sapiens
gccgcagccuucgcgauaa

SEQ ID NO: 1502328 - RNA, 19 nt, Homo sapiens
cggcagcuucaucuacaua

SEQ ID NO: 1502329 - RNA, 19 nt, Homo sapiens
agacuucaccgccucuuuc

SEQ ID NO: 1502330 - RNA, 19 nt, Homo sapiens
gcagcuucaucuacauagg

SEQ ID NO: 1502331 - RNA, 19 nt, Homo sapiens
ugaccuugccgagcacuuu

SEQ ID NO: 1502332 - RNA, 19 nt, Homo sapiens
gaugagacaggagacuuca

SEQ ID NO: 1502333 - RNA, 19 nt, Homo sapiens
ccuccucgcuggcuuuggu

SEQ ID NO: 1502334 - RNA, 19 nt, Homo sapiens
gagcaaggcugccaaauuc

SEQ ID NO: 1502335 - RNA, 19 nt, Homo sapiens
ggaaccagaugauguauuc

SEQ ID NO: 1502336 - RNA, 19 nt, Homo sapiens
gagcugcaccuccucauua

SEQ ID NO: 1502337 - RNA, 19 nt, Homo sapiens
gcaaacgccuggauuaucu

SEQ ID NO: 1502338 - RNA, 19 nt, Homo sapiens
gaaguugagucagcuguuu

SEQ ID NO: 1502339 - RNA, 19 nt, Homo sapiens
acagaaagcugaucgaauc

SEQ ID NO: 1502340 - RNA, 19 nt, Homo sapiens
gauaugagacgaaugaaga

SEQ ID NO: 1502341 - RNA, 19 nt, Homo sapiens
guaaugagcacucuacaga

SEQ ID NO: 1502342 - RNA, 19 nt, Homo sapiens
gacccagacuguucaauga

SEQ ID NO: 1502343 - RNA, 19 nt, Homo sapiens
guacaugcaucugaaguug

SEQ ID NO: 1502344 - RNA, 19 nt, Homo sapiens
ggagcaaggcugccaaauu

SEQ ID NO: 1502345 - RNA, 19 nt, Homo sapiens
cgaagaaagugaacugauc

SEQ ID NO: 1502346 - RNA, 19 nt, Homo sapiens
uggauuaucucaaccuaaa

SEQ ID NO: 1502347 - RNA, 19 nt, Homo sapiens
uuaagaaguuuggucguua

SEQ ID NO: 1502348 - RNA, 19 nt, Homo sapiens
ugagucagcuguuugguau

SEQ ID NO: 1502349 - RNA, 19 nt, Homo sapiens
gagcagaaagcaagugauu

SEQ ID NO: 1502350 - RNA, 19 nt, Homo sapiens
gcucuugucugcagaaagu

SEQ ID NO: 1502351 - RNA, 19 nt, Homo sapiens
gacaagacccugcaggaaa

SEQ ID NO: 1502352 - RNA, 19 nt, Homo sapiens
cugagaagcugcuauuuca

SEQ ID NO: 1502353 - RNA, 19 nt, Homo sapiens
ucaaugagacccacucuga

SEQ ID NO: 1502354 - RNA, 19 nt, Homo sapiens
gagcaacaaccgucugaaa

SEQ ID NO: 1502355 - RNA, 19 nt, Homo sapiens
gaaguuuggucguuaucug

SEQ ID NO: 1502356 - RNA, 19 nt, Homo sapiens
ggcacacucugcagaaauu

SEQ ID NO: 1502357 - RNA, 19 nt, Homo sapiens
caacaucgaggacuauuuc

SEQ ID NO: 1502358 - RNA, 19 nt, Homo sapiens
ucucagagcucaacaucga

SEQ ID NO: 1502359 - RNA, 19 nt, Homo sapiens
caacaacaaccaugaguca

SEQ ID NO: 1502360 - RNA, 19 nt, Homo sapiens
caacaaccgucugaaaucu

SEQ ID NO: 1502361 - RNA, 19 nt, Homo sapiens
gcgcuauguuuaccaacua

SEQ ID NO: 1502362 - RNA, 19 nt, Homo sapiens
aaacagauaugagacgaau

SEQ ID NO: 1502363 - RNA, 19 nt, Homo sapiens
gcaacaaccgucugaaauc

SEQ ID NO: 1502364 - RNA, 19 nt, Homo sapiens
ccgacgagcugcuugagaa

SEQ ID NO: 1502365 - RNA, 19 nt, Homo sapiens
uaagaaguuuggucguuau

SEQ ID NO: 1502366 - RNA, 19 nt, Homo sapiens
ggacaagacccugcaggaa

SEQ ID NO: 1502367 - RNA, 19 nt, Homo sapiens
aaggugaacuucuucuuug

SEQ ID NO: 1502368 - RNA, 19 nt, Homo sapiens
cuugagaacuugugugaga

SEQ ID NO: 1502369 - RNA, 19 nt, Homo sapiens
guuaagaaguuuggucguu

SEQ ID NO: 1502370 - RNA, 19 nt, Homo sapiens
ucagcuguuugguauguua

SEQ ID NO: 1502371 - RNA, 19 nt, Homo sapiens
gaaaguggaaccagaugau

SEQ ID NO: 1502372 - RNA, 19 nt, Homo sapiens
gcgagaauuuauacaaaca

SEQ ID NO: 1502373 - RNA, 19 nt, Homo sapiens
ucaaaugccacguucauga

SEQ ID NO: 1502374 - RNA, 19 nt, Homo sapiens
acaagacccugcaggaaau

SEQ ID NO: 1502375 - RNA, 19 nt, Homo sapiens
uugaacggaucaugaagua

SEQ ID NO: 1502376 - RNA, 19 nt, Homo sapiens
gaaccucaacuacaacugu

SEQ ID NO: 1502377 - RNA, 19 nt, Homo sapiens
gccaucaccuugcugucua

SEQ ID NO: 1502378 - RNA, 19 nt, Homo sapiens
ggagcacuuugaacuugaa

SEQ ID NO: 1502379 - RNA, 19 nt, Homo sapiens
aaugagcacucuacagaug

SEQ ID NO: 1502380 - RNA, 19 nt, Homo sapiens
caacaucaaaugccacguu

SEQ ID NO: 1502381 - RNA, 19 nt, Homo sapiens
uaaagaagaugggcaaacg

SEQ ID NO: 1502382 - RNA, 19 nt, Homo sapiens
gggagcacuuugaacuuga

SEQ ID NO: 1502383 - RNA, 19 nt, Homo sapiens
acagauaugagacgaauga

SEQ ID NO: 1502384 - RNA, 19 nt, Homo sapiens
aaucugggcuuuccuugau
